United States Patent 10,968,269 (MHC MULTIMERS IN BORRELIA DIAGNOSTICS AND DISEASE) - sequence listing, part 6

SEQ ID NO: 166454 - protein, 16 aa, Borrelia burgdorferi B31
SNAVLLAVKEVEALLS

SEQ ID NO: 166455 - protein, 16 aa, Borrelia burgdorferi B31
NAVLLAVKEVEALLSS

SEQ ID NO: 166456 - protein, 16 aa, Borrelia burgdorferi B31
AVLLAVKEVEALLSSI

SEQ ID NO: 166457 - protein, 16 aa, Borrelia burgdorferi B31
VLLAVKEVEALLSSID

SEQ ID NO: 166458 - protein, 16 aa, Borrelia burgdorferi B31
LLAVKEVEALLSSIDE

SEQ ID NO: 166459 - protein, 16 aa, Borrelia burgdorferi B31
LAVKEVEALLSSIDEI

SEQ ID NO: 166460 - protein, 16 aa, Borrelia burgdorferi B31
AVKEVEALLSSIDEIA

SEQ ID NO: 166461 - protein, 16 aa, Borrelia burgdorferi B31
VKEVEALLSSIDEIAA

SEQ ID NO: 166462 - protein, 16 aa, Borrelia burgdorferi B31
KEVEALLSSIDEIAAK

SEQ ID NO: 166463 - protein, 16 aa, Borrelia burgdorferi B31
EVEALLSSIDEIAAKA

SEQ ID NO: 166464 - protein, 16 aa, Borrelia burgdorferi B31
VEALLSSIDEIAAKAI

SEQ ID NO: 166465 - protein, 16 aa, Borrelia burgdorferi B31
EALLSSIDEIAAKAIG

SEQ ID NO: 166466 - protein, 16 aa, Borrelia burgdorferi B31
ALLSSIDEIAAKAIGK

SEQ ID NO: 166467 - protein, 16 aa, Borrelia burgdorferi B31
LLSSIDEIAAKAIGKK

SEQ ID NO: 166468 - protein, 16 aa, Borrelia burgdorferi B31
LSSIDEIAAKAIGKKI

SEQ ID NO: 166469 - protein, 16 aa, Borrelia burgdorferi B31
SSIDEIAAKAIGKKIH

SEQ ID NO: 166470 - protein, 16 aa, Borrelia burgdorferi B31
SIDEIAAKAIGKKIHQ

SEQ ID NO: 166471 - protein, 16 aa, Borrelia burgdorferi B31
IDEIAAKAIGKKIHQN

SEQ ID NO: 166472 - protein, 16 aa, Borrelia burgdorferi B31
DEIAAKAIGKKIHQNN

SEQ ID NO: 166473 - protein, 16 aa, Borrelia burgdorferi B31
EIAAKAIGKKIHQNNG

SEQ ID NO: 166474 - protein, 16 aa, Borrelia burgdorferi B31
IAAKAIGKKIHQNNGL

SEQ ID NO: 166475 - protein, 16 aa, Borrelia burgdorferi B31
AAKAIGKKIHQNNGLD

SEQ ID NO: 166476 - protein, 16 aa, Borrelia burgdorferi B31
AKAIGKKIHQNNGLDT

SEQ ID NO: 166477 - protein, 16 aa, Borrelia burgdorferi B31
KAIGKKIHQNNGLDTE

SEQ ID NO: 166478 - protein, 16 aa, Borrelia burgdorferi B31
AIGKKIHQNNGLDTEN

SEQ ID NO: 166479 - protein, 16 aa, Borrelia burgdorferi B31
IGKKIHQNNGLDTENN

SEQ ID NO: 166480 - protein, 16 aa, Borrelia burgdorferi B31
GKKIHQNNGLDTENNH

SEQ ID NO: 166481 - protein, 16 aa, Borrelia burgdorferi B31
KKIHQNNGLDTENNHN

SEQ ID NO: 166482 - protein, 16 aa, Borrelia burgdorferi B31
KIHQNNGLDTENNHNG

SEQ ID NO: 166483 - protein, 16 aa, Borrelia burgdorferi B31
IHQNNGLDTENNHNGS

SEQ ID NO: 166484 - protein, 16 aa, Borrelia burgdorferi B31
HQNNGLDTENNHNGSL

SEQ ID NO: 166485 - protein, 16 aa, Borrelia burgdorferi B31
QNNGLDTENNHNGSLL

SEQ ID NO: 166486 - protein, 16 aa, Borrelia burgdorferi B31
NNGLDTENNHNGSLLA

SEQ ID NO: 166487 - protein, 16 aa, Borrelia burgdorferi B31
NGLDTENNHNGSLLAG

SEQ ID NO: 166488 - protein, 16 aa, Borrelia burgdorferi B31
GLDTENNHNGSLLAGA

SEQ ID NO: 166489 - protein, 16 aa, Borrelia burgdorferi B31
LDTENNHNGSLLAGAY

SEQ ID NO: 166490 - protein, 16 aa, Borrelia burgdorferi B31
DTENNHNGSLLAGAYA

SEQ ID NO: 166491 - protein, 16 aa, Borrelia burgdorferi B31
TENNHNGSLLAGAYAI

SEQ ID NO: 166492 - protein, 16 aa, Borrelia burgdorferi B31
ENNHNGSLLAGAYAIS

SEQ ID NO: 166493 - protein, 16 aa, Borrelia burgdorferi B31
NNHNGSLLAGAYAIST

SEQ ID NO: 166494 - protein, 16 aa, Borrelia burgdorferi B31
NHNGSLLAGAYAISTL

SEQ ID NO: 166495 - protein, 16 aa, Borrelia burgdorferi B31
HNGSLLAGAYAISTLI

SEQ ID NO: 166496 - protein, 16 aa, Borrelia burgdorferi B31
NGSLLAGAYAISTLIK

SEQ ID NO: 166497 - protein, 16 aa, Borrelia burgdorferi B31
GSLLAGAYAISTLIKQ

SEQ ID NO: 166498 - protein, 16 aa, Borrelia burgdorferi B31
SLLAGAYAISTLIKQK

SEQ ID NO: 166499 - protein, 16 aa, Borrelia burgdorferi B31
LLAGAYAISTLIKQKL

SEQ ID NO: 166500 - protein, 16 aa, Borrelia burgdorferi B31
LAGAYAISTLIKQKLD

SEQ ID NO: 166501 - protein, 16 aa, Borrelia burgdorferi B31
AGAYAISTLIKQKLDG

SEQ ID NO: 166502 - protein, 16 aa, Borrelia burgdorferi B31
GAYAISTLIKQKLDGL

SEQ ID NO: 166503 - protein, 16 aa, Borrelia burgdorferi B31
AYAISTLIKQKLDGLK

SEQ ID NO: 166504 - protein, 16 aa, Borrelia burgdorferi B31
YAISTLIKQKLDGLKN

SEQ ID NO: 166505 - protein, 16 aa, Borrelia burgdorferi B31
AISTLIKQKLDGLKNE

SEQ ID NO: 166506 - protein, 16 aa, Borrelia burgdorferi B31
ISTLIKQKLDGLKNEG

SEQ ID NO: 166507 - protein, 16 aa, Borrelia burgdorferi B31
STLIKQKLDGLKNEGL

SEQ ID NO: 166508 - protein, 16 aa, Borrelia burgdorferi B31
TLIKQKLDGLKNEGLK

SEQ ID NO: 166509 - protein, 16 aa, Borrelia burgdorferi B31
LIKQKLDGLKNEGLKE

SEQ ID NO: 166510 - protein, 16 aa, Borrelia burgdorferi B31
IKQKLDGLKNEGLKEK

SEQ ID NO: 166511 - protein, 16 aa, Borrelia burgdorferi B31
KQKLDGLKNEGLKEKI

SEQ ID NO: 166512 - protein, 16 aa, Borrelia burgdorferi B31
QKLDGLKNEGLKEKID

SEQ ID NO: 166513 - protein, 16 aa, Borrelia burgdorferi B31
KLDGLKNEGLKEKIDA

SEQ ID NO: 166514 - protein, 16 aa, Borrelia burgdorferi B31
LDGLKNEGLKEKIDAA

SEQ ID NO: 166515 - protein, 16 aa, Borrelia burgdorferi B31
DGLKNEGLKEKIDAAK

SEQ ID NO: 166516 - protein, 16 aa, Borrelia burgdorferi B31
GLKNEGLKEKIDAAKK

SEQ ID NO: 166517 - protein, 16 aa, Borrelia burgdorferi B31
LKNEGLKEKIDAAKKC

SEQ ID NO: 166518 - protein, 16 aa, Borrelia burgdorferi B31
KNEGLKEKIDAAKKCS

SEQ ID NO: 166519 - protein, 16 aa, Borrelia burgdorferi B31
NEGLKEKIDAAKKCSE

SEQ ID NO: 166520 - protein, 16 aa, Borrelia burgdorferi B31
EGLKEKIDAAKKCSET

SEQ ID NO: 166521 - protein, 16 aa, Borrelia burgdorferi B31
GLKEKIDAAKKCSETF

SEQ ID NO: 166522 - protein, 16 aa, Borrelia burgdorferi B31
LKEKIDAAKKCSETFT

SEQ ID NO: 166523 - protein, 16 aa, Borrelia burgdorferi B31
KEKIDAAKKCSETFTN

SEQ ID NO: 166524 - protein, 16 aa, Borrelia burgdorferi B31
EKIDAAKKCSETFTNK

SEQ ID NO: 166525 - protein, 16 aa, Borrelia burgdorferi B31
KIDAAKKCSETFTNKL

SEQ ID NO: 166526 - protein, 16 aa, Borrelia burgdorferi B31
IDAAKKCSETFTNKLK

SEQ ID NO: 166527 - protein, 16 aa, Borrelia burgdorferi B31
DAAKKCSETFTNKLKE

SEQ ID NO: 166528 - protein, 16 aa, Borrelia burgdorferi B31
AAKKCSETFTNKLKEK

SEQ ID NO: 166529 - protein, 16 aa, Borrelia burgdorferi B31
AKKCSETFTNKLKEKH

SEQ ID NO: 166530 - protein, 16 aa, Borrelia burgdorferi B31
KKCSETFTNKLKEKHT

SEQ ID NO: 166531 - protein, 16 aa, Borrelia burgdorferi B31
KCSETFTNKLKEKHTD

SEQ ID NO: 166532 - protein, 16 aa, Borrelia burgdorferi B31
CSETFTNKLKEKHTDL

SEQ ID NO: 166533 - protein, 16 aa, Borrelia burgdorferi B31
SETFTNKLKEKHTDLG

SEQ ID NO: 166534 - protein, 16 aa, Borrelia burgdorferi B31
ETFTNKLKEKHTDLGK

SEQ ID NO: 166535 - protein, 16 aa, Borrelia burgdorferi B31
TFTNKLKEKHTDLGKE

SEQ ID NO: 166536 - protein, 16 aa, Borrelia burgdorferi B31
FTNKLKEKHTDLGKEG

SEQ ID NO: 166537 - protein, 16 aa, Borrelia burgdorferi B31
TNKLKEKHTDLGKEGV

SEQ ID NO: 166538 - protein, 16 aa, Borrelia burgdorferi B31
NKLKEKHTDLGKEGVT

SEQ ID NO: 166539 - protein, 16 aa, Borrelia burgdorferi B31
KLKEKHTDLGKEGVTD

SEQ ID NO: 166540 - protein, 16 aa, Borrelia burgdorferi B31
LKEKHTDLGKEGVTDA

SEQ ID NO: 166541 - protein, 16 aa, Borrelia burgdorferi B31
KEKHTDLGKEGVTDAD

SEQ ID NO: 166542 - protein, 16 aa, Borrelia burgdorferi B31
EKHTDLGKEGVTDADA

SEQ ID NO: 166543 - protein, 16 aa, Borrelia burgdorferi B31
KHTDLGKEGVTDADAK

SEQ ID NO: 166544 - protein, 16 aa, Borrelia burgdorferi B31
HTDLGKEGVTDADAKE

SEQ ID NO: 166545 - protein, 16 aa, Borrelia burgdorferi B31
TDLGKEGVTDADAKEA

SEQ ID NO: 166546 - protein, 16 aa, Borrelia burgdorferi B31
DLGKEGVTDADAKEAI

SEQ ID NO: 166547 - protein, 16 aa, Borrelia burgdorferi B31
LGKEGVTDADAKEAIL

SEQ ID NO: 166548 - protein, 16 aa, Borrelia burgdorferi B31
GKEGVTDADAKEAILK

SEQ ID NO: 166549 - protein, 16 aa, Borrelia burgdorferi B31
KEGVTDADAKEAILKT

SEQ ID NO: 166550 - protein, 16 aa, Borrelia burgdorferi B31
EGVTDADAKEAILKTN

SEQ ID NO: 166551 - protein, 16 aa, Borrelia burgdorferi B31
GVTDADAKEAILKTNG

SEQ ID NO: 166552 - protein, 16 aa, Borrelia burgdorferi B31
VTDADAKEAILKTNGT

SEQ ID NO: 166553 - protein, 16 aa, Borrelia burgdorferi B31
TDADAKEAILKTNGTK

SEQ ID NO: 166554 - protein, 16 aa, Borrelia burgdorferi B31
DADAKEAILKTNGTKT

SEQ ID NO: 166555 - protein, 16 aa, Borrelia burgdorferi B31
ADAKEAILKTNGTKTK

SEQ ID NO: 166556 - protein, 16 aa, Borrelia burgdorferi B31
DAKEAILKTNGTKTKG

SEQ ID NO: 166557 - protein, 16 aa, Borrelia burgdorferi B31
AKEAILKTNGTKTKGA

SEQ ID NO: 166558 - protein, 16 aa, Borrelia burgdorferi B31
KEAILKTNGTKTKGAE

SEQ ID NO: 166559 - protein, 16 aa, Borrelia burgdorferi B31
EAILKTNGTKTKGAEE

SEQ ID NO: 166560 - protein, 16 aa, Borrelia burgdorferi B31
AILKTNGTKTKGAEEL

SEQ ID NO: 166561 - protein, 16 aa, Borrelia burgdorferi B31
ILKTNGTKTKGAEELG

SEQ ID NO: 166562 - protein, 16 aa, Borrelia burgdorferi B31
LKTNGTKTKGAEELGK

SEQ ID NO: 166563 - protein, 16 aa, Borrelia burgdorferi B31
KTNGTKTKGAEELGKL

SEQ ID NO: 166564 - protein, 16 aa, Borrelia burgdorferi B31
TNGTKTKGAEELGKLF

SEQ ID NO: 166565 - protein, 16 aa, Borrelia burgdorferi B31
NGTKTKGAEELGKLFE

SEQ ID NO: 166566 - protein, 16 aa, Borrelia burgdorferi B31
GTKTKGAEELGKLFES

SEQ ID NO: 166567 - protein, 16 aa, Borrelia burgdorferi B31
TKTKGAEELGKLFESV

SEQ ID NO: 166568 - protein, 16 aa, Borrelia burgdorferi B31
KTKGAEELGKLFESVE

SEQ ID NO: 166569 - protein, 16 aa, Borrelia burgdorferi B31
TKGAEELGKLFESVEV

SEQ ID NO: 166570 - protein, 16 aa, Borrelia burgdorferi B31
KGAEELGKLFESVEVL

SEQ ID NO: 166571 - protein, 16 aa, Borrelia burgdorferi B31
GAEELGKLFESVEVLS

SEQ ID NO: 166572 - protein, 16 aa, Borrelia burgdorferi B31
AEELGKLFESVEVLSK

SEQ ID NO: 166573 - protein, 16 aa, Borrelia burgdorferi B31
EELGKLFESVEVLSKA

SEQ ID NO: 166574 - protein, 16 aa, Borrelia burgdorferi B31
ELGKLFESVEVLSKAA

SEQ ID NO: 166575 - protein, 16 aa, Borrelia burgdorferi B31
LGKLFESVEVLSKAAK

SEQ ID NO: 166576 - protein, 16 aa, Borrelia burgdorferi B31
GKLFESVEVLSKAAKE

SEQ ID NO: 166577 - protein, 16 aa, Borrelia burgdorferi B31
KLFESVEVLSKAAKEM

SEQ ID NO: 166578 - protein, 16 aa, Borrelia burgdorferi B31
LFESVEVLSKAAKEML

SEQ ID NO: 166579 - protein, 16 aa, Borrelia burgdorferi B31
FESVEVLSKAAKEMLA

SEQ ID NO: 166580 - protein, 16 aa, Borrelia burgdorferi B31
ESVEVLSKAAKEMLAN

SEQ ID NO: 166581 - protein, 16 aa, Borrelia burgdorferi B31
SVEVLSKAAKEMLANS

SEQ ID NO: 166582 - protein, 16 aa, Borrelia burgdorferi B31
VEVLSKAAKEMLANSV

SEQ ID NO: 166583 - protein, 16 aa, Borrelia burgdorferi B31
EVLSKAAKEMLANSVK

SEQ ID NO: 166584 - protein, 16 aa, Borrelia burgdorferi B31
VLSKAAKEMLANSVKE

SEQ ID NO: 166585 - protein, 16 aa, Borrelia burgdorferi B31
LSKAAKEMLANSVKEL

SEQ ID NO: 166586 - protein, 16 aa, Borrelia burgdorferi B31
SKAAKEMLANSVKELT

SEQ ID NO: 166587 - protein, 16 aa, Borrelia burgdorferi B31
KAAKEMLANSVKELTS

SEQ ID NO: 166588 - protein, 16 aa, Borrelia burgdorferi B31
AAKEMLANSVKELTSP

SEQ ID NO: 166589 - protein, 16 aa, Borrelia burgdorferi B31
AKEMLANSVKELTSPV

SEQ ID NO: 166590 - protein, 16 aa, Borrelia burgdorferi B31
KEMLANSVKELTSPVV

SEQ ID NO: 166591 - protein, 16 aa, Borrelia burgdorferi B31
EMLANSVKELTSPVVA

SEQ ID NO: 166592 - protein, 16 aa, Borrelia burgdorferi B31
MLANSVKELTSPVVAE

SEQ ID NO: 166593 - protein, 16 aa, Borrelia burgdorferi B31
LANSVKELTSPVVAES

SEQ ID NO: 166594 - protein, 16 aa, Borrelia burgdorferi B31
ANSVKELTSPVVAESP

SEQ ID NO: 166595 - protein, 16 aa, Borrelia burgdorferi B31
NSVKELTSPVVAESPK

SEQ ID NO: 166596 - protein, 16 aa, Borrelia burgdorferi B31
SVKELTSPVVAESPKK

SEQ ID NO: 166597 - protein, 16 aa, Borrelia burgdorferi B31
VKELTSPVVAESPKKP

SEQ ID NO: 166598 - protein, 8 aa, Borrelia garinii
MKKISSAI

SEQ ID NO: 166599 - protein, 8 aa, Borrelia garinii
KKISSAIF

SEQ ID NO: 166600 - protein, 8 aa, Borrelia garinii
KISSAIFI

SEQ ID NO: 166601 - protein, 8 aa, Borrelia garinii
ISSAIFIV

SEQ ID NO: 166602 - protein, 8 aa, Borrelia garinii
SSAIFIVA

SEQ ID NO: 166603 - protein, 8 aa, Borrelia garinii
SAIFIVAF

SEQ ID NO: 166604 - protein, 8 aa, Borrelia garinii
AIFIVAFL

SEQ ID NO: 166605 - protein, 8 aa, Borrelia garinii
IFIVAFLA

SEQ ID NO: 166606 - protein, 8 aa, Borrelia garinii
FIVAFLAL

SEQ ID NO: 166607 - protein, 8 aa, Borrelia garinii
IVAFLALI

SEQ ID NO: 166608 - protein, 8 aa, Borrelia garinii
VAFLALIG

SEQ ID NO: 166609 - protein, 8 aa, Borrelia garinii
AFLALIGC

SEQ ID NO: 166610 - protein, 8 aa, Borrelia garinii
FLALIGCK

SEQ ID NO: 166611 - protein, 8 aa, Borrelia garinii
LALIGCKN

SEQ ID NO: 166612 - protein, 8 aa, Borrelia garinii
ALIGCKNN

SEQ ID NO: 166613 - protein, 8 aa, Borrelia garinii
LIGCKNNV

SEQ ID NO: 166614 - protein, 8 aa, Borrelia garinii
IGCKNNVG

SEQ ID NO: 166615 - protein, 8 aa, Borrelia garinii
GCKNNVGG

SEQ ID NO: 166616 - protein, 8 aa, Borrelia garinii
CKNNVGGD

SEQ ID NO: 166617 - protein, 8 aa, Borrelia garinii
KNNVGGDD

SEQ ID NO: 166618 - protein, 8 aa, Borrelia garinii
NNVGGDDK

SEQ ID NO: 166619 - protein, 8 aa, Borrelia garinii
NVGGDDKK

SEQ ID NO: 166620 - protein, 8 aa, Borrelia garinii
VGGDDKKD

SEQ ID NO: 166621 - protein, 8 aa, Borrelia garinii
GGDDKKDT

SEQ ID NO: 166622 - protein, 8 aa, Borrelia garinii
GDDKKDTA

SEQ ID NO: 166623 - protein, 8 aa, Borrelia garinii
DDKKDTAA

SEQ ID NO: 166624 - protein, 8 aa, Borrelia garinii
DKKDTAAS

SEQ ID NO: 166625 - protein, 8 aa, Borrelia garinii
KKDTAASI

SEQ ID NO: 166626 - protein, 8 aa, Borrelia garinii
KDTAASIF

SEQ ID NO: 166627 - protein, 8 aa, Borrelia garinii
DTAASIFY

SEQ ID NO: 166628 - protein, 8 aa, Borrelia garinii
TAASIFYQ

SEQ ID NO: 166629 - protein, 8 aa, Borrelia garinii
AASIFYQS

SEQ ID NO: 166630 - protein, 8 aa, Borrelia garinii
ASIFYQSI

SEQ ID NO: 166631 - protein, 8 aa, Borrelia garinii
SIFYQSII

SEQ ID NO: 166632 - protein, 8 aa, Borrelia garinii
IFYQSIIN

SEQ ID NO: 166633 - protein, 8 aa, Borrelia garinii
FYQSIINL

SEQ ID NO: 166634 - protein, 8 aa, Borrelia garinii
YQSIINLG

SEQ ID NO: 166635 - protein, 8 aa, Borrelia garinii
QSIINLGN

SEQ ID NO: 166636 - protein, 8 aa, Borrelia garinii
SIINLGNG

SEQ ID NO: 166637 - protein, 8 aa, Borrelia garinii
IINLGNGF

SEQ ID NO: 166638 - protein, 8 aa, Borrelia garinii
INLGNGFI

SEQ ID NO: 166639 - protein, 8 aa, Borrelia garinii
NLGNGFIE

SEQ ID NO: 166640 - protein, 8 aa, Borrelia garinii
LGNGFIEV

SEQ ID NO: 166641 - protein, 8 aa, Borrelia garinii
GNGFIEVF

SEQ ID NO: 166642 - protein, 8 aa, Borrelia garinii
NGFIEVFN

SEQ ID NO: 166643 - protein, 8 aa, Borrelia garinii
GFIEVFNA

SEQ ID NO: 166644 - protein, 8 aa, Borrelia garinii
FIEVFNAF

SEQ ID NO: 166645 - protein, 8 aa, Borrelia garinii
IEVFNAFS

SEQ ID NO: 166646 - protein, 8 aa, Borrelia garinii
EVFNAFSG

SEQ ID NO: 166647 - protein, 8 aa, Borrelia garinii
VFNAFSGL

SEQ ID NO: 166648 - protein, 8 aa, Borrelia garinii
FNAFSGLV

SEQ ID NO: 166649 - protein, 8 aa, Borrelia garinii
NAFSGLVA

SEQ ID NO: 166650 - protein, 8 aa, Borrelia garinii
AFSGLVAD

SEQ ID NO: 166651 - protein, 8 aa, Borrelia garinii
FSGLVADA

SEQ ID NO: 166652 - protein, 8 aa, Borrelia garinii
SGLVADAF

SEQ ID NO: 166653 - protein, 8 aa, Borrelia garinii
GLVADAFS

SEQ ID NO: 166654 - protein, 8 aa, Borrelia garinii
LVADAFSK

SEQ ID NO: 166655 - protein, 8 aa, Borrelia garinii
VADAFSKA

SEQ ID NO: 166656 - protein, 8 aa, Borrelia garinii
ADAFSKAD

SEQ ID NO: 166657 - protein, 8 aa, Borrelia garinii
DAFSKADP

SEQ ID NO: 166658 - protein, 8 aa, Borrelia garinii
AFSKADPK

SEQ ID NO: 166659 - protein, 8 aa, Borrelia garinii
FSKADPKK

SEQ ID NO: 166660 - protein, 8 aa, Borrelia garinii
SKADPKKS

SEQ ID NO: 166661 - protein, 8 aa, Borrelia garinii
KADPKKSD

SEQ ID NO: 166662 - protein, 8 aa, Borrelia garinii
ADPKKSDV

SEQ ID NO: 166663 - protein, 8 aa, Borrelia garinii
DPKKSDVK

SEQ ID NO: 166664 - protein, 8 aa, Borrelia garinii
PKKSDVKT

SEQ ID NO: 166665 - protein, 8 aa, Borrelia garinii
KKSDVKTY

SEQ ID NO: 166666 - protein, 8 aa, Borrelia garinii
KSDVKTYF

SEQ ID NO: 166667 - protein, 8 aa, Borrelia garinii
SDVKTYFD

SEQ ID NO: 166668 - protein, 8 aa, Borrelia garinii
DVKTYFDS

SEQ ID NO: 166669 - protein, 8 aa, Borrelia garinii
VKTYFDSI

SEQ ID NO: 166670 - protein, 8 aa, Borrelia garinii
KTYFDSIT

SEQ ID NO: 166671 - protein, 8 aa, Borrelia garinii
TYFDSITK

SEQ ID NO: 166672 - protein, 8 aa, Borrelia garinii
YFDSITKT

SEQ ID NO: 166673 - protein, 8 aa, Borrelia garinii
FDSITKTL

SEQ ID NO: 166674 - protein, 8 aa, Borrelia garinii
DSITKTLK

SEQ ID NO: 166675 - protein, 8 aa, Borrelia garinii
SITKTLKD

SEQ ID NO: 166676 - protein, 8 aa, Borrelia garinii
ITKTLKDT

SEQ ID NO: 166677 - protein, 8 aa, Borrelia garinii
TKTLKDTK

SEQ ID NO: 166678 - protein, 8 aa, Borrelia garinii
KTLKDTKT

SEQ ID NO: 166679 - protein, 8 aa, Borrelia garinii
TLKDTKTK

SEQ ID NO: 166680 - protein, 8 aa, Borrelia garinii
LKDTKTKL

SEQ ID NO: 166681 - protein, 8 aa, Borrelia garinii
KDTKTKLE

SEQ ID NO: 166682 - protein, 8 aa, Borrelia garinii
DTKTKLED

SEQ ID NO: 166683 - protein, 8 aa, Borrelia garinii
TKTKLEDI

SEQ ID NO: 166684 - protein, 8 aa, Borrelia garinii
KTKLEDIS

SEQ ID NO: 166685 - protein, 8 aa, Borrelia garinii
TKLEDISK

SEQ ID NO: 166686 - protein, 8 aa, Borrelia garinii
KLEDISKE

SEQ ID NO: 166687 - protein, 8 aa, Borrelia garinii
LEDISKEK

SEQ ID NO: 166688 - protein, 8 aa, Borrelia garinii
EDISKEKT

SEQ ID NO: 166689 - protein, 8 aa, Borrelia garinii
DISKEKTG

SEQ ID NO: 166690 - protein, 8 aa, Borrelia garinii
ISKEKTGG

SEQ ID NO: 166691 - protein, 8 aa, Borrelia garinii
SKEKTGGE

SEQ ID NO: 166692 - protein, 8 aa, Borrelia garinii
KEKTGGEK

SEQ ID NO: 166693 - protein, 8 aa, Borrelia garinii
EKTGGEKT

SEQ ID NO: 166694 - protein, 8 aa, Borrelia garinii
KTGGEKTP

SEQ ID NO: 166695 - protein, 8 aa, Borrelia garinii
TGGEKTPA

SEQ ID NO: 166696 - protein, 8 aa, Borrelia garinii
GGEKTPAV

SEQ ID NO: 166697 - protein, 8 aa, Borrelia garinii
GEKTPAVE

SEQ ID NO: 166698 - protein, 8 aa, Borrelia garinii
EKTPAVEG

SEQ ID NO: 166699 - protein, 8 aa, Borrelia garinii
KTPAVEGI

SEQ ID NO: 166700 - protein, 8 aa, Borrelia garinii
TPAVEGIA

SEQ ID NO: 166701 - protein, 8 aa, Borrelia garinii
PAVEGIAE

SEQ ID NO: 166702 - protein, 8 aa, Borrelia garinii
AVEGIAEV

SEQ ID NO: 166703 - protein, 8 aa, Borrelia garinii
VEGIAEVV

SEQ ID NO: 166704 - protein, 8 aa, Borrelia garinii
EGIAEVVK

SEQ ID NO: 166705 - protein, 8 aa, Borrelia garinii
GIAEVVKT

SEQ ID NO: 166706 - protein, 8 aa, Borrelia garinii
IAEVVKTV

SEQ ID NO: 166707 - protein, 8 aa, Borrelia garinii
AEVVKTVG

SEQ ID NO: 166708 - protein, 8 aa, Borrelia garinii
EVVKTVGE

SEQ ID NO: 166709 - protein, 8 aa, Borrelia garinii
VVKTVGEW

SEQ ID NO: 166710 - protein, 8 aa, Borrelia garinii
VKTVGEWL

SEQ ID NO: 166711 - protein, 8 aa, Borrelia garinii
KTVGEWLD

SEQ ID NO: 166712 - protein, 8 aa, Borrelia garinii
TVGEWLDG

SEQ ID NO: 166713 - protein, 8 aa, Borrelia garinii
VGEWLDGL

SEQ ID NO: 166714 - protein, 8 aa, Borrelia garinii
GEWLDGLI

SEQ ID NO: 166715 - protein, 8 aa, Borrelia garinii
EWLDGLIK

SEQ ID NO: 166716 - protein, 8 aa, Borrelia garinii
WLDGLIKA

SEQ ID NO: 166717 - protein, 8 aa, Borrelia garinii
LDGLIKAA

SEQ ID NO: 166718 - protein, 8 aa, Borrelia garinii
DGLIKAAE

SEQ ID NO: 166719 - protein, 8 aa, Borrelia garinii
GLIKAAEG

SEQ ID NO: 166720 - protein, 8 aa, Borrelia garinii
LIKAAEGG

SEQ ID NO: 166721 - protein, 8 aa, Borrelia garinii
IKAAEGGG

SEQ ID NO: 166722 - protein, 8 aa, Borrelia garinii
KAAEGGGK

SEQ ID NO: 166723 - protein, 8 aa, Borrelia garinii
AAEGGGKA

SEQ ID NO: 166724 - protein, 8 aa, Borrelia garinii
AEGGGKAA

SEQ ID NO: 166725 - protein, 8 aa, Borrelia garinii
EGGGKAAD

SEQ ID NO: 166726 - protein, 8 aa, Borrelia garinii
GGGKAADG

SEQ ID NO: 166727 - protein, 8 aa, Borrelia garinii
GGKAADGG

SEQ ID NO: 166728 - protein, 8 aa, Borrelia garinii
GKAADGGG

SEQ ID NO: 166729 - protein, 8 aa, Borrelia garinii
KAADGGGS

SEQ ID NO: 166730 - protein, 8 aa, Borrelia garinii
AADGGGSD

SEQ ID NO: 166731 - protein, 8 aa, Borrelia garinii
ADGGGSDK

SEQ ID NO: 166732 - protein, 8 aa, Borrelia garinii
DGGGSDKI

SEQ ID NO: 166733 - protein, 8 aa, Borrelia garinii
GGGSDKIG

SEQ ID NO: 166734 - protein, 8 aa, Borrelia garinii
GGSDKIGN

SEQ ID NO: 166735 - protein, 8 aa, Borrelia garinii
GSDKIGNV

SEQ ID NO: 166736 - protein, 8 aa, Borrelia garinii
SDKIGNVA

SEQ ID NO: 166737 - protein, 8 aa, Borrelia garinii
DKIGNVAA

SEQ ID NO: 166738 - protein, 8 aa, Borrelia garinii
KIGNVAAG

SEQ ID NO: 166739 - protein, 8 aa, Borrelia garinii
IGNVAAGG

SEQ ID NO: 166740 - protein, 8 aa, Borrelia garinii
GNVAAGGG

SEQ ID NO: 166741 - protein, 8 aa, Borrelia garinii
NVAAGGGA

SEQ ID NO: 166742 - protein, 8 aa, Borrelia garinii
VAAGGGAG

SEQ ID NO: 166743 - protein, 8 aa, Borrelia garinii
AAGGGAGA

SEQ ID NO: 166744 - protein, 8 aa, Borrelia garinii
AGGGAGAD

SEQ ID NO: 166745 - protein, 8 aa, Borrelia garinii
GGGAGADK

SEQ ID NO: 166746 - protein, 8 aa, Borrelia garinii
GGAGADKE

SEQ ID NO: 166747 - protein, 8 aa, Borrelia garinii
GAGADKES

SEQ ID NO: 166748 - protein, 8 aa, Borrelia garinii
AGADKESV

SEQ ID NO: 166749 - protein, 8 aa, Borrelia garinii
GADKESVN

SEQ ID NO: 166750 - protein, 8 aa, Borrelia garinii
ADKESVNG

SEQ ID NO: 166751 - protein, 8 aa, Borrelia garinii
DKESVNGI

SEQ ID NO: 166752 - protein, 8 aa, Borrelia garinii
KESVNGIA

SEQ ID NO: 166753 - protein, 8 aa, Borrelia garinii
ESVNGIAG

SEQ ID NO: 166754 - protein, 8 aa, Borrelia garinii
SVNGIAGA

SEQ ID NO: 166755 - protein, 8 aa, Borrelia garinii
VNGIAGAI

SEQ ID NO: 166756 - protein, 8 aa, Borrelia garinii
NGIAGAIK

SEQ ID NO: 166757 - protein, 8 aa, Borrelia garinii
GIAGAIKG

SEQ ID NO: 166758 - protein, 8 aa, Borrelia garinii
IAGAIKGI

SEQ ID NO: 166759 - protein, 8 aa, Borrelia garinii
AGAIKGIV

SEQ ID NO: 166760 - protein, 8 aa, Borrelia garinii
GAIKGIVE

SEQ ID NO: 166761 - protein, 8 aa, Borrelia garinii
AIKGIVEA

SEQ ID NO: 166762 - protein, 8 aa, Borrelia garinii
IKGIVEAA

SEQ ID NO: 166763 - protein, 8 aa, Borrelia garinii
KGIVEAAK

SEQ ID NO: 166764 - protein, 8 aa, Borrelia garinii
GIVEAAKK

SEQ ID NO: 166765 - protein, 8 aa, Borrelia garinii
IVEAAKKV

SEQ ID NO: 166766 - protein, 8 aa, Borrelia garinii
VEAAKKVE

SEQ ID NO: 166767 - protein, 8 aa, Borrelia garinii
EAAKKVEG

SEQ ID NO: 166768 - protein, 8 aa, Borrelia garinii
AAKKVEGV

SEQ ID NO: 166769 - protein, 8 aa, Borrelia garinii
AKKVEGVK

SEQ ID NO: 166770 - protein, 8 aa, Borrelia garinii
KKVEGVKF

SEQ ID NO: 166771 - protein, 8 aa, Borrelia garinii
KVEGVKFA

SEQ ID NO: 166772 - protein, 8 aa, Borrelia garinii
VEGVKFAP

SEQ ID NO: 166773 - protein, 8 aa, Borrelia garinii
EGVKFAPK

SEQ ID NO: 166774 - protein, 8 aa, Borrelia garinii
GVKFAPKA

SEQ ID NO: 166775 - protein, 8 aa, Borrelia garinii
VKFAPKAA

SEQ ID NO: 166776 - protein, 8 aa, Borrelia garinii
KFAPKAAA

SEQ ID NO: 166777 - protein, 8 aa, Borrelia garinii
FAPKAAAD

SEQ ID NO: 166778 - protein, 8 aa, Borrelia garinii
APKAAADA

SEQ ID NO: 166779 - protein, 8 aa, Borrelia garinii
PKAAADAA

SEQ ID NO: 166780 - protein, 8 aa, Borrelia garinii
KAAADAAA

SEQ ID NO: 166781 - protein, 8 aa, Borrelia garinii
AAADAAAA

SEQ ID NO: 166782 - protein, 8 aa, Borrelia garinii
AADAAAAD

SEQ ID NO: 166783 - protein, 8 aa, Borrelia garinii
ADAAAADG

SEQ ID NO: 166784 - protein, 8 aa, Borrelia garinii
DAAAADGN

SEQ ID NO: 166785 - protein, 8 aa, Borrelia garinii
AAAADGNK

SEQ ID NO: 166786 - protein, 8 aa, Borrelia garinii
AAADGNKK

SEQ ID NO: 166787 - protein, 8 aa, Borrelia garinii
AADGNKKA

SEQ ID NO: 166788 - protein, 8 aa, Borrelia garinii
ADGNKKAG

SEQ ID NO: 166789 - protein, 8 aa, Borrelia garinii
DGNKKAGK

SEQ ID NO: 166790 - protein, 8 aa, Borrelia garinii
GNKKAGKL

SEQ ID NO: 166791 - protein, 8 aa, Borrelia garinii
NKKAGKLF

SEQ ID NO: 166792 - protein, 8 aa, Borrelia garinii
KKAGKLFG

SEQ ID NO: 166793 - protein, 8 aa, Borrelia garinii
KAGKLFGT

SEQ ID NO: 166794 - protein, 8 aa, Borrelia garinii
AGKLFGTA

SEQ ID NO: 166795 - protein, 8 aa, Borrelia garinii
GKLFGTAA

SEQ ID NO: 166796 - protein, 8 aa, Borrelia garinii
KLFGTAAG

SEQ ID NO: 166797 - protein, 8 aa, Borrelia garinii
LFGTAAGA

SEQ ID NO: 166798 - protein, 8 aa, Borrelia garinii
FGTAAGAD

SEQ ID NO: 166799 - protein, 8 aa, Borrelia garinii
GTAAGADA

SEQ ID NO: 166800 - protein, 8 aa, Borrelia garinii
TAAGADAG

SEQ ID NO: 166801 - protein, 8 aa, Borrelia garinii
AAGADAGD

SEQ ID NO: 166802 - protein, 8 aa, Borrelia garinii
AGADAGDV

SEQ ID NO: 166803 - protein, 8 aa, Borrelia garinii
GADAGDVK

SEQ ID NO: 166804 - protein, 8 aa, Borrelia garinii
ADAGDVKD

SEQ ID NO: 166805 - protein, 8 aa, Borrelia garinii
DAGDVKDA

SEQ ID NO: 166806 - protein, 8 aa, Borrelia garinii
AGDVKDAA

SEQ ID NO: 166807 - protein, 8 aa, Borrelia garinii
GDVKDAAA

SEQ ID NO: 166808 - protein, 8 aa, Borrelia garinii
DVKDAAAA

SEQ ID NO: 166809 - protein, 8 aa, Borrelia garinii
VKDAAAAV

SEQ ID NO: 166810 - protein, 8 aa, Borrelia garinii
KDAAAAVG

SEQ ID NO: 166811 - protein, 8 aa, Borrelia garinii
DAAAAVGA

SEQ ID NO: 166812 - protein, 8 aa, Borrelia garinii
AAAAVGAV

SEQ ID NO: 166813 - protein, 8 aa, Borrelia garinii
AAAVGAVS

SEQ ID NO: 166814 - protein, 8 aa, Borrelia garinii
AAVGAVSG

SEQ ID NO: 166815 - protein, 8 aa, Borrelia garinii
AVGAVSGE

SEQ ID NO: 166816 - protein, 8 aa, Borrelia garinii
VGAVSGEQ

SEQ ID NO: 166817 - protein, 8 aa, Borrelia garinii
GAVSGEQI

SEQ ID NO: 166818 - protein, 8 aa, Borrelia garinii
AVSGEQIL

SEQ ID NO: 166819 - protein, 8 aa, Borrelia garinii
VSGEQILN

SEQ ID NO: 166820 - protein, 8 aa, Borrelia garinii
SGEQILNA

SEQ ID NO: 166821 - protein, 8 aa, Borrelia garinii
GEQILNAI

SEQ ID NO: 166822 - protein, 8 aa, Borrelia garinii
EQILNAIV

SEQ ID NO: 166823 - protein, 8 aa, Borrelia garinii
QILNAIVT

SEQ ID NO: 166824 - protein, 8 aa, Borrelia garinii
ILNAIVTA

SEQ ID NO: 166825 - protein, 8 aa, Borrelia garinii
LNAIVTAA

SEQ ID NO: 166826 - protein, 8 aa, Borrelia garinii
NAIVTAAG

SEQ ID NO: 166827 - protein, 8 aa, Borrelia garinii
AIVTAAGQ

SEQ ID NO: 166828 - protein, 8 aa, Borrelia garinii
IVTAAGQA

SEQ ID NO: 166829 - protein, 8 aa, Borrelia garinii
VTAAGQAG

SEQ ID NO: 166830 - protein, 8 aa, Borrelia garinii
TAAGQAGQ

SEQ ID NO: 166831 - protein, 8 aa, Borrelia garinii
AAGQAGQA

SEQ ID NO: 166832 - protein, 8 aa, Borrelia garinii
AGQAGQAG

SEQ ID NO: 166833 - protein, 8 aa, Borrelia garinii
GQAGQAGK

SEQ ID NO: 166834 - protein, 8 aa, Borrelia garinii
QAGQAGKK

SEQ ID NO: 166835 - protein, 8 aa, Borrelia garinii
AGQAGKKA

SEQ ID NO: 166836 - protein, 8 aa, Borrelia garinii
GQAGKKAD

SEQ ID NO: 166837 - protein, 8 aa, Borrelia garinii
QAGKKADE

SEQ ID NO: 166838 - protein, 8 aa, Borrelia garinii
AGKKADEA

SEQ ID NO: 166839 - protein, 8 aa, Borrelia garinii
GKKADEAK

SEQ ID NO: 166840 - protein, 8 aa, Borrelia garinii
KKADEAKN

SEQ ID NO: 166841 - protein, 8 aa, Borrelia garinii
KADEAKNA

SEQ ID NO: 166842 - protein, 8 aa, Borrelia garinii
ADEAKNAI

SEQ ID NO: 166843 - protein, 8 aa, Borrelia garinii
DEAKNAIE

SEQ ID NO: 166844 - protein, 8 aa, Borrelia garinii
EAKNAIEA

SEQ ID NO: 166845 - protein, 8 aa, Borrelia garinii
AKNAIEAA

SEQ ID NO: 166846 - protein, 8 aa, Borrelia garinii
KNAIEAAI

SEQ ID NO: 166847 - protein, 8 aa, Borrelia garinii
NAIEAAIG

SEQ ID NO: 166848 - protein, 8 aa, Borrelia garinii
AIEAAIGA

SEQ ID NO: 166849 - protein, 8 aa, Borrelia garinii
IEAAIGAA

SEQ ID NO: 166850 - protein, 8 aa, Borrelia garinii
EAAIGAAG

SEQ ID NO: 166851 - protein, 8 aa, Borrelia garinii
AAIGAAGD

SEQ ID NO: 166852 - protein, 8 aa, Borrelia garinii
AIGAAGDA

SEQ ID NO: 166853 - protein, 8 aa, Borrelia garinii
IGAAGDAD

SEQ ID NO: 166854 - protein, 8 aa, Borrelia garinii
GAAGDADF

SEQ ID NO: 166855 - protein, 8 aa, Borrelia garinii
AAGDADFG

SEQ ID NO: 166856 - protein, 8 aa, Borrelia garinii
AGDADFGD

SEQ ID NO: 166857 - protein, 8 aa, Borrelia garinii
GDADFGDD

SEQ ID NO: 166858 - protein, 8 aa, Borrelia garinii
DADFGDDI

SEQ ID NO: 166859 - protein, 8 aa, Borrelia garinii
ADFGDDIK

SEQ ID NO: 166860 - protein, 8 aa, Borrelia garinii
DFGDDIKK

SEQ ID NO: 166861 - protein, 8 aa, Borrelia garinii
FGDDIKKK

SEQ ID NO: 166862 - protein, 8 aa, Borrelia garinii
GDDIKKKN

SEQ ID NO: 166863 - protein, 8 aa, Borrelia garinii
DDIKKKND

SEQ ID NO: 166864 - protein, 8 aa, Borrelia garinii
DIKKKNDQ

SEQ ID NO: 166865 - protein, 8 aa, Borrelia garinii
IKKKNDQI

SEQ ID NO: 166866 - protein, 8 aa, Borrelia garinii
KKKNDQIA

SEQ ID NO: 166867 - protein, 8 aa, Borrelia garinii
KKNDQIAA

SEQ ID NO: 166868 - protein, 8 aa, Borrelia garinii
KNDQIAAA

SEQ ID NO: 166869 - protein, 8 aa, Borrelia garinii
NDQIAAAL

SEQ ID NO: 166870 - protein, 8 aa, Borrelia garinii
DQIAAALV

SEQ ID NO: 166871 - protein, 8 aa, Borrelia garinii
QIAAALVL

SEQ ID NO: 166872 - protein, 8 aa, Borrelia garinii
IAAALVLR

SEQ ID NO: 166873 - protein, 8 aa, Borrelia garinii
AAALVLRG

SEQ ID NO: 166874 - protein, 8 aa, Borrelia garinii
AALVLRGV

SEQ ID NO: 166875 - protein, 8 aa, Borrelia garinii
ALVLRGVA

SEQ ID NO: 166876 - protein, 8 aa, Borrelia garinii
LVLRGVAK

SEQ ID NO: 166877 - protein, 8 aa, Borrelia garinii
VLRGVAKD

SEQ ID NO: 166878 - protein, 8 aa, Borrelia garinii
LRGVAKDG

SEQ ID NO: 166879 - protein, 8 aa, Borrelia garinii
RGVAKDGK

SEQ ID NO: 166880 - protein, 8 aa, Borrelia garinii
GVAKDGKF

SEQ ID NO: 166881 - protein, 8 aa, Borrelia garinii
VAKDGKFA

SEQ ID NO: 166882 - protein, 8 aa, Borrelia garinii
AKDGKFAG

SEQ ID NO: 166883 - protein, 8 aa, Borrelia garinii
KDGKFAGA

SEQ ID NO: 166884 - protein, 9 aa, Borrelia garinii
MKKISSAIF

SEQ ID NO: 166885 - protein, 9 aa, Borrelia garinii
KKISSAIFI

SEQ ID NO: 166886 - protein, 9 aa, Borrelia garinii
KISSAIFIV

SEQ ID NO: 166887 - protein, 9 aa, Borrelia garinii
ISSAIFIVA

SEQ ID NO: 166888 - protein, 9 aa, Borrelia garinii
SSAIFIVAF

SEQ ID NO: 166889 - protein, 9 aa, Borrelia garinii
SAIFIVAFL

SEQ ID NO: 166890 - protein, 9 aa, Borrelia garinii
AIFIVAFLA

SEQ ID NO: 166891 - protein, 9 aa, Borrelia garinii
IFIVAFLAL

SEQ ID NO: 166892 - protein, 9 aa, Borrelia garinii
FIVAFLALI

SEQ ID NO: 166893 - protein, 9 aa, Borrelia garinii
IVAFLALIG

SEQ ID NO: 166894 - protein, 9 aa, Borrelia garinii
VAFLALIGC

SEQ ID NO: 166895 - protein, 9 aa, Borrelia garinii
AFLALIGCK

SEQ ID NO: 166896 - protein, 9 aa, Borrelia garinii
FLALIGCKN

SEQ ID NO: 166897 - protein, 9 aa, Borrelia garinii
LALIGCKNN

SEQ ID NO: 166898 - protein, 9 aa, Borrelia garinii
ALIGCKNNV

SEQ ID NO: 166899 - protein, 9 aa, Borrelia garinii
LIGCKNNVG

SEQ ID NO: 166900 - protein, 9 aa, Borrelia garinii
IGCKNNVGG

SEQ ID NO: 166901 - protein, 9 aa, Borrelia garinii
GCKNNVGGD

SEQ ID NO: 166902 - protein, 9 aa, Borrelia garinii
CKNNVGGDD

SEQ ID NO: 166903 - protein, 9 aa, Borrelia garinii
KNNVGGDDK

SEQ ID NO: 166904 - protein, 9 aa, Borrelia garinii
NNVGGDDKK

SEQ ID NO: 166905 - protein, 9 aa, Borrelia garinii
NVGGDDKKD

SEQ ID NO: 166906 - protein, 9 aa, Borrelia garinii
VGGDDKKDT

SEQ ID NO: 166907 - protein, 9 aa, Borrelia garinii
GGDDKKDTA

SEQ ID NO: 166908 - protein, 9 aa, Borrelia garinii
GDDKKDTAA

SEQ ID NO: 166909 - protein, 9 aa, Borrelia garinii
DDKKDTAAS

SEQ ID NO: 166910 - protein, 9 aa, Borrelia garinii
DKKDTAASI

SEQ ID NO: 166911 - protein, 9 aa, Borrelia garinii
KKDTAASIF

SEQ ID NO: 166912 - protein, 9 aa, Borrelia garinii
KDTAASIFY

SEQ ID NO: 166913 - protein, 9 aa, Borrelia garinii
DTAASIFYQ

SEQ ID NO: 166914 - protein, 9 aa, Borrelia garinii
TAASIFYQS

SEQ ID NO: 166915 - protein, 9 aa, Borrelia garinii
AASIFYQSI

SEQ ID NO: 166916 - protein, 9 aa, Borrelia garinii
ASIFYQSII

SEQ ID NO: 166917 - protein, 9 aa, Borrelia garinii
SIFYQSIIN

SEQ ID NO: 166918 - protein, 9 aa, Borrelia garinii
IFYQSIINL

SEQ ID NO: 166919 - protein, 9 aa, Borrelia garinii
FYQSIINLG

SEQ ID NO: 166920 - protein, 9 aa, Borrelia garinii
YQSIINLGN

SEQ ID NO: 166921 - protein, 9 aa, Borrelia garinii
QSIINLGNG

SEQ ID NO: 166922 - protein, 9 aa, Borrelia garinii
SIINLGNGF

SEQ ID NO: 166923 - protein, 9 aa, Borrelia garinii
IINLGNGFI

SEQ ID NO: 166924 - protein, 9 aa, Borrelia garinii
INLGNGFIE

SEQ ID NO: 166925 - protein, 9 aa, Borrelia garinii
NLGNGFIEV

SEQ ID NO: 166926 - protein, 9 aa, Borrelia garinii
LGNGFIEVF

SEQ ID NO: 166927 - protein, 9 aa, Borrelia garinii
GNGFIEVFN

SEQ ID NO: 166928 - protein, 9 aa, Borrelia garinii
NGFIEVFNA

SEQ ID NO: 166929 - protein, 9 aa, Borrelia garinii
GFIEVFNAF

SEQ ID NO: 166930 - protein, 9 aa, Borrelia garinii
FIEVFNAFS

SEQ ID NO: 166931 - protein, 9 aa, Borrelia garinii
IEVFNAFSG

SEQ ID NO: 166932 - protein, 9 aa, Borrelia garinii
EVFNAFSGL

SEQ ID NO: 166933 - protein, 9 aa, Borrelia garinii
VFNAFSGLV

SEQ ID NO: 166934 - protein, 9 aa, Borrelia garinii
FNAFSGLVA

SEQ ID NO: 166935 - protein, 9 aa, Borrelia garinii
NAFSGLVAD

SEQ ID NO: 166936 - protein, 9 aa, Borrelia garinii
AFSGLVADA

SEQ ID NO: 166937 - protein, 9 aa, Borrelia garinii
FSGLVADAF

SEQ ID NO: 166938 - protein, 9 aa, Borrelia garinii
SGLVADAFS

SEQ ID NO: 166939 - protein, 9 aa, Borrelia garinii
GLVADAFSK

SEQ ID NO: 166940 - protein, 9 aa, Borrelia garinii
LVADAFSKA

SEQ ID NO: 166941 - protein, 9 aa, Borrelia garinii
VADAFSKAD

SEQ ID NO: 166942 - protein, 9 aa, Borrelia garinii
ADAFSKADP

SEQ ID NO: 166943 - protein, 9 aa, Borrelia garinii
DAFSKADPK

SEQ ID NO: 166944 - protein, 9 aa, Borrelia garinii
AFSKADPKK

SEQ ID NO: 166945 - protein, 9 aa, Borrelia garinii
FSKADPKKS

SEQ ID NO: 166946 - protein, 9 aa, Borrelia garinii
SKADPKKSD

SEQ ID NO: 166947 - protein, 9 aa, Borrelia garinii
KADPKKSDV

SEQ ID NO: 166948 - protein, 9 aa, Borrelia garinii
ADPKKSDVK

SEQ ID NO: 166949 - protein, 9 aa, Borrelia garinii
DPKKSDVKT

SEQ ID NO: 166950 - protein, 9 aa, Borrelia garinii
PKKSDVKTY

SEQ ID NO: 166951 - protein, 9 aa, Borrelia garinii
KKSDVKTYF

SEQ ID NO: 166952 - protein, 9 aa, Borrelia garinii
KSDVKTYFD

SEQ ID NO: 166953 - protein, 9 aa, Borrelia garinii
SDVKTYFDS

SEQ ID NO: 166954 - protein, 9 aa, Borrelia garinii
DVKTYFDSI

SEQ ID NO: 166955 - protein, 9 aa, Borrelia garinii
VKTYFDSIT

SEQ ID NO: 166956 - protein, 9 aa, Borrelia garinii
KTYFDSITK

SEQ ID NO: 166957 - protein, 9 aa, Borrelia garinii
TYFDSITKT

SEQ ID NO: 166958 - protein, 9 aa, Borrelia garinii
YFDSITKTL

SEQ ID NO: 166959 - protein, 9 aa, Borrelia garinii
FDSITKTLK

SEQ ID NO: 166960 - protein, 9 aa, Borrelia garinii
DSITKTLKD

SEQ ID NO: 166961 - protein, 9 aa, Borrelia garinii
SITKTLKDT

SEQ ID NO: 166962 - protein, 9 aa, Borrelia garinii
ITKTLKDTK

SEQ ID NO: 166963 - protein, 9 aa, Borrelia garinii
TKTLKDTKT

SEQ ID NO: 166964 - protein, 9 aa, Borrelia garinii
KTLKDTKTK

SEQ ID NO: 166965 - protein, 9 aa, Borrelia garinii
TLKDTKTKL

SEQ ID NO: 166966 - protein, 9 aa, Borrelia garinii
LKDTKTKLE

SEQ ID NO: 166967 - protein, 9 aa, Borrelia garinii
KDTKTKLED

SEQ ID NO: 166968 - protein, 9 aa, Borrelia garinii
DTKTKLEDI

SEQ ID NO: 166969 - protein, 9 aa, Borrelia garinii
TKTKLEDIS

SEQ ID NO: 166970 - protein, 9 aa, Borrelia garinii
KTKLEDISK

SEQ ID NO: 166971 - protein, 9 aa, Borrelia garinii
TKLEDISKE

SEQ ID NO: 166972 - protein, 9 aa, Borrelia garinii
KLEDISKEK

SEQ ID NO: 166973 - protein, 9 aa, Borrelia garinii
LEDISKEKT

SEQ ID NO: 166974 - protein, 9 aa, Borrelia garinii
EDISKEKTG

SEQ ID NO: 166975 - protein, 9 aa, Borrelia garinii
DISKEKTGG

SEQ ID NO: 166976 - protein, 9 aa, Borrelia garinii
ISKEKTGGE

SEQ ID NO: 166977 - protein, 9 aa, Borrelia garinii
SKEKTGGEK

SEQ ID NO: 166978 - protein, 9 aa, Borrelia garinii
KEKTGGEKT

SEQ ID NO: 166979 - protein, 9 aa, Borrelia garinii
EKTGGEKTP

SEQ ID NO: 166980 - protein, 9 aa, Borrelia garinii
KTGGEKTPA

SEQ ID NO: 166981 - protein, 9 aa, Borrelia garinii
TGGEKTPAV

SEQ ID NO: 166982 - protein, 9 aa, Borrelia garinii
GGEKTPAVE

SEQ ID NO: 166983 - protein, 9 aa, Borrelia garinii
GEKTPAVEG

SEQ ID NO: 166984 - protein, 9 aa, Borrelia garinii
EKTPAVEGI

SEQ ID NO: 166985 - protein, 9 aa, Borrelia garinii
KTPAVEGIA

SEQ ID NO: 166986 - protein, 9 aa, Borrelia garinii
TPAVEGIAE

SEQ ID NO: 166987 - protein, 9 aa, Borrelia garinii
PAVEGIAEV

SEQ ID NO: 166988 - protein, 9 aa, Borrelia garinii
AVEGIAEVV

SEQ ID NO: 166989 - protein, 9 aa, Borrelia garinii
VEGIAEVVK

SEQ ID NO: 166990 - protein, 9 aa, Borrelia garinii
EGIAEVVKT

SEQ ID NO: 166991 - protein, 9 aa, Borrelia garinii
GIAEVVKTV

SEQ ID NO: 166992 - protein, 9 aa, Borrelia garinii
IAEVVKTVG

SEQ ID NO: 166993 - protein, 9 aa, Borrelia garinii
AEVVKTVGE

SEQ ID NO: 166994 - protein, 9 aa, Borrelia garinii
EVVKTVGEW

SEQ ID NO: 166995 - protein, 9 aa, Borrelia garinii
VVKTVGEWL

SEQ ID NO: 166996 - protein, 9 aa, Borrelia garinii
VKTVGEWLD

SEQ ID NO: 166997 - protein, 9 aa, Borrelia garinii
KTVGEWLDG

SEQ ID NO: 166998 - protein, 9 aa, Borrelia garinii
TVGEWLDGL

SEQ ID NO: 166999 - protein, 9 aa, Borrelia garinii
VGEWLDGLI

SEQ ID NO: 167000 - protein, 9 aa, Borrelia garinii
GEWLDGLIK

SEQ ID NO: 167001 - protein, 9 aa, Borrelia garinii
EWLDGLIKA

SEQ ID NO: 167002 - protein, 9 aa, Borrelia garinii
WLDGLIKAA

SEQ ID NO: 167003 - protein, 9 aa, Borrelia garinii
LDGLIKAAE

SEQ ID NO: 167004 - protein, 9 aa, Borrelia garinii
DGLIKAAEG

SEQ ID NO: 167005 - protein, 9 aa, Borrelia garinii
GLIKAAEGG

SEQ ID NO: 167006 - protein, 9 aa, Borrelia garinii
LIKAAEGGG

SEQ ID NO: 167007 - protein, 9 aa, Borrelia garinii
IKAAEGGGK

SEQ ID NO: 167008 - protein, 9 aa, Borrelia garinii
KAAEGGGKA

SEQ ID NO: 167009 - protein, 9 aa, Borrelia garinii
AAEGGGKAA

SEQ ID NO: 167010 - protein, 9 aa, Borrelia garinii
AEGGGKAAD

SEQ ID NO: 167011 - protein, 9 aa, Borrelia garinii
EGGGKAADG

SEQ ID NO: 167012 - protein, 9 aa, Borrelia garinii
GGGKAADGG

SEQ ID NO: 167013 - protein, 9 aa, Borrelia garinii
GGKAADGGG

SEQ ID NO: 167014 - protein, 9 aa, Borrelia garinii
GKAADGGGS

SEQ ID NO: 167015 - protein, 9 aa, Borrelia garinii
KAADGGGSD

SEQ ID NO: 167016 - protein, 9 aa, Borrelia garinii
AADGGGSDK

SEQ ID NO: 167017 - protein, 9 aa, Borrelia garinii
ADGGGSDKI

SEQ ID NO: 167018 - protein, 9 aa, Borrelia garinii
DGGGSDKIG

SEQ ID NO: 167019 - protein, 9 aa, Borrelia garinii
GGGSDKIGN

SEQ ID NO: 167020 - protein, 9 aa, Borrelia garinii
GGSDKIGNV

SEQ ID NO: 167021 - protein, 9 aa, Borrelia garinii
GSDKIGNVA

SEQ ID NO: 167022 - protein, 9 aa, Borrelia garinii
SDKIGNVAA

SEQ ID NO: 167023 - protein, 9 aa, Borrelia garinii
DKIGNVAAG

SEQ ID NO: 167024 - protein, 9 aa, Borrelia garinii
KIGNVAAGG

SEQ ID NO: 167025 - protein, 9 aa, Borrelia garinii
IGNVAAGGG

SEQ ID NO: 167026 - protein, 9 aa, Borrelia garinii
GNVAAGGGA

SEQ ID NO: 167027 - protein, 9 aa, Borrelia garinii
NVAAGGGAG

SEQ ID NO: 167028 - protein, 9 aa, Borrelia garinii
VAAGGGAGA

SEQ ID NO: 167029 - protein, 9 aa, Borrelia garinii
AAGGGAGAD

SEQ ID NO: 167030 - protein, 9 aa, Borrelia garinii
AGGGAGADK

SEQ ID NO: 167031 - protein, 9 aa, Borrelia garinii
GGGAGADKE

SEQ ID NO: 167032 - protein, 9 aa, Borrelia garinii
GGAGADKES

SEQ ID NO: 167033 - protein, 9 aa, Borrelia garinii
GAGADKESV

SEQ ID NO: 167034 - protein, 9 aa, Borrelia garinii
AGADKESVN

SEQ ID NO: 167035 - protein, 9 aa, Borrelia garinii
GADKESVNG

SEQ ID NO: 167036 - protein, 9 aa, Borrelia garinii
ADKESVNGI

SEQ ID NO: 167037 - protein, 9 aa, Borrelia garinii
DKESVNGIA

SEQ ID NO: 167038 - protein, 9 aa, Borrelia garinii
KESVNGIAG

SEQ ID NO: 167039 - protein, 9 aa, Borrelia garinii
ESVNGIAGA

SEQ ID NO: 167040 - protein, 9 aa, Borrelia garinii
SVNGIAGAI

SEQ ID NO: 167041 - protein, 9 aa, Borrelia garinii
VNGIAGAIK

SEQ ID NO: 167042 - protein, 9 aa, Borrelia garinii
NGIAGAIKG

SEQ ID NO: 167043 - protein, 9 aa, Borrelia garinii
GIAGAIKGI

SEQ ID NO: 167044 - protein, 9 aa, Borrelia garinii
IAGAIKGIV

SEQ ID NO: 167045 - protein, 9 aa, Borrelia garinii
AGAIKGIVE

SEQ ID NO: 167046 - protein, 9 aa, Borrelia garinii
GAIKGIVEA

SEQ ID NO: 167047 - protein, 9 aa, Borrelia garinii
AIKGIVEAA

SEQ ID NO: 167048 - protein, 9 aa, Borrelia garinii
IKGIVEAAK

SEQ ID NO: 167049 - protein, 9 aa, Borrelia garinii
KGIVEAAKK

SEQ ID NO: 167050 - protein, 9 aa, Borrelia garinii
GIVEAAKKV

SEQ ID NO: 167051 - protein, 9 aa, Borrelia garinii
IVEAAKKVE

SEQ ID NO: 167052 - protein, 9 aa, Borrelia garinii
VEAAKKVEG

SEQ ID NO: 167053 - protein, 9 aa, Borrelia garinii
EAAKKVEGV

SEQ ID NO: 167054 - protein, 9 aa, Borrelia garinii
AAKKVEGVK

SEQ ID NO: 167055 - protein, 9 aa, Borrelia garinii
AKKVEGVKF

SEQ ID NO: 167056 - protein, 9 aa, Borrelia garinii
KKVEGVKFA

SEQ ID NO: 167057 - protein, 9 aa, Borrelia garinii
KVEGVKFAP

SEQ ID NO: 167058 - protein, 9 aa, Borrelia garinii
VEGVKFAPK

SEQ ID NO: 167059 - protein, 9 aa, Borrelia garinii
EGVKFAPKA

SEQ ID NO: 167060 - protein, 9 aa, Borrelia garinii
GVKFAPKAA

SEQ ID NO: 167061 - protein, 9 aa, Borrelia garinii
VKFAPKAAA

SEQ ID NO: 167062 - protein, 9 aa, Borrelia garinii
KFAPKAAAD

SEQ ID NO: 167063 - protein, 9 aa, Borrelia garinii
FAPKAAADA

SEQ ID NO: 167064 - protein, 9 aa, Borrelia garinii
APKAAADAA

SEQ ID NO: 167065 - protein, 9 aa, Borrelia garinii
PKAAADAAA

SEQ ID NO: 167066 - protein, 9 aa, Borrelia garinii
KAAADAAAA

SEQ ID NO: 167067 - protein, 9 aa, Borrelia garinii
AAADAAAAD

SEQ ID NO: 167068 - protein, 9 aa, Borrelia garinii
AADAAAADG

SEQ ID NO: 167069 - protein, 9 aa, Borrelia garinii
ADAAAADGN

SEQ ID NO: 167070 - protein, 9 aa, Borrelia garinii
DAAAADGNK

SEQ ID NO: 167071 - protein, 9 aa, Borrelia garinii
AAAADGNKK

SEQ ID NO: 167072 - protein, 9 aa, Borrelia garinii
AAADGNKKA

SEQ ID NO: 167073 - protein, 9 aa, Borrelia garinii
AADGNKKAG

SEQ ID NO: 167074 - protein, 9 aa, Borrelia garinii
ADGNKKAGK

SEQ ID NO: 167075 - protein, 9 aa, Borrelia garinii
DGNKKAGKL

SEQ ID NO: 167076 - protein, 9 aa, Borrelia garinii
GNKKAGKLF

SEQ ID NO: 167077 - protein, 9 aa, Borrelia garinii
NKKAGKLFG

SEQ ID NO: 167078 - protein, 9 aa, Borrelia garinii
KKAGKLFGT

SEQ ID NO: 167079 - protein, 9 aa, Borrelia garinii
KAGKLFGTA

SEQ ID NO: 167080 - protein, 9 aa, Borrelia garinii
AGKLFGTAA

SEQ ID NO: 167081 - protein, 9 aa, Borrelia garinii
GKLFGTAAG

SEQ ID NO: 167082 - protein, 9 aa, Borrelia garinii
KLFGTAAGA

SEQ ID NO: 167083 - protein, 9 aa, Borrelia garinii
LFGTAAGAD

SEQ ID NO: 167084 - protein, 9 aa, Borrelia garinii
FGTAAGADA

SEQ ID NO: 167085 - protein, 9 aa, Borrelia garinii
GTAAGADAG

SEQ ID NO: 167086 - protein, 9 aa, Borrelia garinii
TAAGADAGD

SEQ ID NO: 167087 - protein, 9 aa, Borrelia garinii
AAGADAGDV

SEQ ID NO: 167088 - protein, 9 aa, Borrelia garinii
AGADAGDVK

SEQ ID NO: 167089 - protein, 9 aa, Borrelia garinii
GADAGDVKD

SEQ ID NO: 167090 - protein, 9 aa, Borrelia garinii
ADAGDVKDA

SEQ ID NO: 167091 - protein, 9 aa, Borrelia garinii
DAGDVKDAA

SEQ ID NO: 167092 - protein, 9 aa, Borrelia garinii
AGDVKDAAA

SEQ ID NO: 167093 - protein, 9 aa, Borrelia garinii
GDVKDAAAA

SEQ ID NO: 167094 - protein, 9 aa, Borrelia garinii
DVKDAAAAV

SEQ ID NO: 167095 - protein, 9 aa, Borrelia garinii
VKDAAAAVG

SEQ ID NO: 167096 - protein, 9 aa, Borrelia garinii
KDAAAAVGA

SEQ ID NO: 167097 - protein, 9 aa, Borrelia garinii
DAAAAVGAV

SEQ ID NO: 167098 - protein, 9 aa, Borrelia garinii
AAAAVGAVS

SEQ ID NO: 167099 - protein, 9 aa, Borrelia garinii
AAAVGAVSG

SEQ ID NO: 167100 - protein, 9 aa, Borrelia garinii
AAVGAVSGE

SEQ ID NO: 167101 - protein, 9 aa, Borrelia garinii
AVGAVSGEQ

SEQ ID NO: 167102 - protein, 9 aa, Borrelia garinii
VGAVSGEQI

SEQ ID NO: 167103 - protein, 9 aa, Borrelia garinii
GAVSGEQIL

SEQ ID NO: 167104 - protein, 9 aa, Borrelia garinii
AVSGEQILN

SEQ ID NO: 167105 - protein, 9 aa, Borrelia garinii
VSGEQILNA

SEQ ID NO: 167106 - protein, 9 aa, Borrelia garinii
SGEQILNAI

SEQ ID NO: 167107 - protein, 9 aa, Borrelia garinii
GEQILNAIV

SEQ ID NO: 167108 - protein, 9 aa, Borrelia garinii
EQILNAIVT

SEQ ID NO: 167109 - protein, 9 aa, Borrelia garinii
QILNAIVTA

SEQ ID NO: 167110 - protein, 9 aa, Borrelia garinii
ILNAIVTAA

SEQ ID NO: 167111 - protein, 9 aa, Borrelia garinii
LNAIVTAAG

SEQ ID NO: 167112 - protein, 9 aa, Borrelia garinii
NAIVTAAGQ

SEQ ID NO: 167113 - protein, 9 aa, Borrelia garinii
AIVTAAGQA

SEQ ID NO: 167114 - protein, 9 aa, Borrelia garinii
IVTAAGQAG

SEQ ID NO: 167115 - protein, 9 aa, Borrelia garinii
VTAAGQAGQ

SEQ ID NO: 167116 - protein, 9 aa, Borrelia garinii
TAAGQAGQA

SEQ ID NO: 167117 - protein, 9 aa, Borrelia garinii
AAGQAGQAG

SEQ ID NO: 167118 - protein, 9 aa, Borrelia garinii
AGQAGQAGK

SEQ ID NO: 167119 - protein, 9 aa, Borrelia garinii
GQAGQAGKK

SEQ ID NO: 167120 - protein, 9 aa, Borrelia garinii
QAGQAGKKA

SEQ ID NO: 167121 - protein, 9 aa, Borrelia garinii
AGQAGKKAD

SEQ ID NO: 167122 - protein, 9 aa, Borrelia garinii
GQAGKKADE

SEQ ID NO: 167123 - protein, 9 aa, Borrelia garinii
QAGKKADEA

SEQ ID NO: 167124 - protein, 9 aa, Borrelia garinii
AGKKADEAK

SEQ ID NO: 167125 - protein, 9 aa, Borrelia garinii
GKKADEAKN

SEQ ID NO: 167126 - protein, 9 aa, Borrelia garinii
KKADEAKNA

SEQ ID NO: 167127 - protein, 9 aa, Borrelia garinii
KADEAKNAI

SEQ ID NO: 167128 - protein, 9 aa, Borrelia garinii
ADEAKNAIE

SEQ ID NO: 167129 - protein, 9 aa, Borrelia garinii
DEAKNAIEA

SEQ ID NO: 167130 - protein, 9 aa, Borrelia garinii
EAKNAIEAA

SEQ ID NO: 167131 - protein, 9 aa, Borrelia garinii
AKNAIEAAI

SEQ ID NO: 167132 - protein, 9 aa, Borrelia garinii
KNAIEAAIG

SEQ ID NO: 167133 - protein, 9 aa, Borrelia garinii
NAIEAAIGA

SEQ ID NO: 167134 - protein, 9 aa, Borrelia garinii
AIEAAIGAA

SEQ ID NO: 167135 - protein, 9 aa, Borrelia garinii
IEAAIGAAG

SEQ ID NO: 167136 - protein, 9 aa, Borrelia garinii
EAAIGAAGD

SEQ ID NO: 167137 - protein, 9 aa, Borrelia garinii
AAIGAAGDA

SEQ ID NO: 167138 - protein, 9 aa, Borrelia garinii
AIGAAGDAD

SEQ ID NO: 167139 - protein, 9 aa, Borrelia garinii
IGAAGDADF

SEQ ID NO: 167140 - protein, 9 aa, Borrelia garinii
GAAGDADFG

SEQ ID NO: 167141 - protein, 9 aa, Borrelia garinii
AAGDADFGD

SEQ ID NO: 167142 - protein, 9 aa, Borrelia garinii
AGDADFGDD

SEQ ID NO: 167143 - protein, 9 aa, Borrelia garinii
GDADFGDDI

SEQ ID NO: 167144 - protein, 9 aa, Borrelia garinii
DADFGDDIK

SEQ ID NO: 167145 - protein, 9 aa, Borrelia garinii
ADFGDDIKK

SEQ ID NO: 167146 - protein, 9 aa, Borrelia garinii
DFGDDIKKK

SEQ ID NO: 167147 - protein, 9 aa, Borrelia garinii
FGDDIKKKN

SEQ ID NO: 167148 - protein, 9 aa, Borrelia garinii
GDDIKKKND

SEQ ID NO: 167149 - protein, 9 aa, Borrelia garinii
DDIKKKNDQ

SEQ ID NO: 167150 - protein, 9 aa, Borrelia garinii
DIKKKNDQI

SEQ ID NO: 167151 - protein, 9 aa, Borrelia garinii
IKKKNDQIA

SEQ ID NO: 167152 - protein, 9 aa, Borrelia garinii
KKKNDQIAA

SEQ ID NO: 167153 - protein, 9 aa, Borrelia garinii
KKNDQIAAA

SEQ ID NO: 167154 - protein, 9 aa, Borrelia garinii
KNDQIAAAL

SEQ ID NO: 167155 - protein, 9 aa, Borrelia garinii
NDQIAAALV

SEQ ID NO: 167156 - protein, 9 aa, Borrelia garinii
DQIAAALVL

SEQ ID NO: 167157 - protein, 9 aa, Borrelia garinii
QIAAALVLR

SEQ ID NO: 167158 - protein, 9 aa, Borrelia garinii
IAAALVLRG

SEQ ID NO: 167159 - protein, 9 aa, Borrelia garinii
AAALVLRGV

SEQ ID NO: 167160 - protein, 9 aa, Borrelia garinii
AALVLRGVA

SEQ ID NO: 167161 - protein, 9 aa, Borrelia garinii
ALVLRGVAK

SEQ ID NO: 167162 - protein, 9 aa, Borrelia garinii
LVLRGVAKD

SEQ ID NO: 167163 - protein, 9 aa, Borrelia garinii
VLRGVAKDG

SEQ ID NO: 167164 - protein, 9 aa, Borrelia garinii
LRGVAKDGK

SEQ ID NO: 167165 - protein, 9 aa, Borrelia garinii
RGVAKDGKF

SEQ ID NO: 167166 - protein, 9 aa, Borrelia garinii
GVAKDGKFA

SEQ ID NO: 167167 - protein, 9 aa, Borrelia garinii
VAKDGKFAG

SEQ ID NO: 167168 - protein, 9 aa, Borrelia garinii
AKDGKFAGA

SEQ ID NO: 167169 - protein, 10 aa, Borrelia garinii
MKKISSAIFI

SEQ ID NO: 167170 - protein, 10 aa, Borrelia garinii
KKISSAIFIV

SEQ ID NO: 167171 - protein, 10 aa, Borrelia garinii
KISSAIFIVA

SEQ ID NO: 167172 - protein, 10 aa, Borrelia garinii
ISSAIFIVAF

SEQ ID NO: 167173 - protein, 10 aa, Borrelia garinii
SSAIFIVAFL

SEQ ID NO: 167174 - protein, 10 aa, Borrelia garinii
SAIFIVAFLA

SEQ ID NO: 167175 - protein, 10 aa, Borrelia garinii
AIFIVAFLAL

SEQ ID NO: 167176 - protein, 10 aa, Borrelia garinii
IFIVAFLALI

SEQ ID NO: 167177 - protein, 10 aa, Borrelia garinii
FIVAFLALIG

SEQ ID NO: 167178 - protein, 10 aa, Borrelia garinii
IVAFLALIGC

SEQ ID NO: 167179 - protein, 10 aa, Borrelia garinii
VAFLALIGCK

SEQ ID NO: 167180 - protein, 10 aa, Borrelia garinii
AFLALIGCKN

SEQ ID NO: 167181 - protein, 10 aa, Borrelia garinii
FLALIGCKNN

SEQ ID NO: 167182 - protein, 10 aa, Borrelia garinii
LALIGCKNNV

SEQ ID NO: 167183 - protein, 10 aa, Borrelia garinii
ALIGCKNNVG

SEQ ID NO: 167184 - protein, 10 aa, Borrelia garinii
LIGCKNNVGG

SEQ ID NO: 167185 - protein, 10 aa, Borrelia garinii
IGCKNNVGGD

SEQ ID NO: 167186 - protein, 10 aa, Borrelia garinii
GCKNNVGGDD

SEQ ID NO: 167187 - protein, 10 aa, Borrelia garinii
CKNNVGGDDK

SEQ ID NO: 167188 - protein, 10 aa, Borrelia garinii
KNNVGGDDKK

SEQ ID NO: 167189 - protein, 10 aa, Borrelia garinii
NNVGGDDKKD

SEQ ID NO: 167190 - protein, 10 aa, Borrelia garinii
NVGGDDKKDT

SEQ ID NO: 167191 - protein, 10 aa, Borrelia garinii
VGGDDKKDTA

SEQ ID NO: 167192 - protein, 10 aa, Borrelia garinii
GGDDKKDTAA

SEQ ID NO: 167193 - protein, 10 aa, Borrelia garinii
GDDKKDTAAS

SEQ ID NO: 167194 - protein, 10 aa, Borrelia garinii
DDKKDTAASI

SEQ ID NO: 167195 - protein, 10 aa, Borrelia garinii
DKKDTAASIF

SEQ ID NO: 167196 - protein, 10 aa, Borrelia garinii
KKDTAASIFY

SEQ ID NO: 167197 - protein, 10 aa, Borrelia garinii
KDTAASIFYQ

SEQ ID NO: 167198 - protein, 10 aa, Borrelia garinii
DTAASIFYQS

SEQ ID NO: 167199 - protein, 10 aa, Borrelia garinii
TAASIFYQSI

SEQ ID NO: 167200 - protein, 10 aa, Borrelia garinii
AASIFYQSII

SEQ ID NO: 167201 - protein, 10 aa, Borrelia garinii
ASIFYQSIIN

SEQ ID NO: 167202 - protein, 10 aa, Borrelia garinii
SIFYQSIINL

SEQ ID NO: 167203 - protein, 10 aa, Borrelia garinii
IFYQSIINLG

SEQ ID NO: 167204 - protein, 10 aa, Borrelia garinii
FYQSIINLGN

SEQ ID NO: 167205 - protein, 10 aa, Borrelia garinii
YQSIINLGNG

SEQ ID NO: 167206 - protein, 10 aa, Borrelia garinii
QSIINLGNGF

SEQ ID NO: 167207 - protein, 10 aa, Borrelia garinii
SIINLGNGFI

SEQ ID NO: 167208 - protein, 10 aa, Borrelia garinii
IINLGNGFIE

SEQ ID NO: 167209 - protein, 10 aa, Borrelia garinii
INLGNGFIEV

SEQ ID NO: 167210 - protein, 10 aa, Borrelia garinii
NLGNGFIEVF

SEQ ID NO: 167211 - protein, 10 aa, Borrelia garinii
LGNGFIEVFN

SEQ ID NO: 167212 - protein, 10 aa, Borrelia garinii
GNGFIEVFNA

SEQ ID NO: 167213 - protein, 10 aa, Borrelia garinii
NGFIEVFNAF

SEQ ID NO: 167214 - protein, 10 aa, Borrelia garinii
GFIEVFNAFS

SEQ ID NO: 167215 - protein, 10 aa, Borrelia garinii
FIEVFNAFSG

SEQ ID NO: 167216 - protein, 10 aa, Borrelia garinii
IEVFNAFSGL

SEQ ID NO: 167217 - protein, 10 aa, Borrelia garinii
EVFNAFSGLV

SEQ ID NO: 167218 - protein, 10 aa, Borrelia garinii
VFNAFSGLVA

SEQ ID NO: 167219 - protein, 10 aa, Borrelia garinii
FNAFSGLVAD

SEQ ID NO: 167220 - protein, 10 aa, Borrelia garinii
NAFSGLVADA

SEQ ID NO: 167221 - protein, 10 aa, Borrelia garinii
AFSGLVADAF

SEQ ID NO: 167222 - protein, 10 aa, Borrelia garinii
FSGLVADAFS

SEQ ID NO: 167223 - protein, 10 aa, Borrelia garinii
SGLVADAFSK

SEQ ID NO: 167224 - protein, 10 aa, Borrelia garinii
GLVADAFSKA

SEQ ID NO: 167225 - protein, 10 aa, Borrelia garinii
LVADAFSKAD

SEQ ID NO: 167226 - protein, 10 aa, Borrelia garinii
VADAFSKADP

SEQ ID NO: 167227 - protein, 10 aa, Borrelia garinii
ADAFSKADPK

SEQ ID NO: 167228 - protein, 10 aa, Borrelia garinii
DAFSKADPKK

SEQ ID NO: 167229 - protein, 10 aa, Borrelia garinii
AFSKADPKKS

SEQ ID NO: 167230 - protein, 10 aa, Borrelia garinii
FSKADPKKSD

SEQ ID NO: 167231 - protein, 10 aa, Borrelia garinii
SKADPKKSDV

SEQ ID NO: 167232 - protein, 10 aa, Borrelia garinii
KADPKKSDVK

SEQ ID NO: 167233 - protein, 10 aa, Borrelia garinii
ADPKKSDVKT

SEQ ID NO: 167234 - protein, 10 aa, Borrelia garinii
DPKKSDVKTY

SEQ ID NO: 167235 - protein, 10 aa, Borrelia garinii
PKKSDVKTYF

SEQ ID NO: 167236 - protein, 10 aa, Borrelia garinii
KKSDVKTYFD

SEQ ID NO: 167237 - protein, 10 aa, Borrelia garinii
KSDVKTYFDS

SEQ ID NO: 167238 - protein, 10 aa, Borrelia garinii
SDVKTYFDSI

SEQ ID NO: 167239 - protein, 10 aa, Borrelia garinii
DVKTYFDSIT

SEQ ID NO: 167240 - protein, 10 aa, Borrelia garinii
VKTYFDSITK

SEQ ID NO: 167241 - protein, 10 aa, Borrelia garinii
KTYFDSITKT

SEQ ID NO: 167242 - protein, 10 aa, Borrelia garinii
TYFDSITKTL

SEQ ID NO: 167243 - protein, 10 aa, Borrelia garinii
YFDSITKTLK

SEQ ID NO: 167244 - protein, 10 aa, Borrelia garinii
FDSITKTLKD

SEQ ID NO: 167245 - protein, 10 aa, Borrelia garinii
DSITKTLKDT

SEQ ID NO: 167246 - protein, 10 aa, Borrelia garinii
SITKTLKDTK

SEQ ID NO: 167247 - protein, 10 aa, Borrelia garinii
ITKTLKDTKT

SEQ ID NO: 167248 - protein, 10 aa, Borrelia garinii
TKTLKDTKTK

SEQ ID NO: 167249 - protein, 10 aa, Borrelia garinii
KTLKDTKTKL

SEQ ID NO: 167250 - protein, 10 aa, Borrelia garinii
TLKDTKTKLE

SEQ ID NO: 167251 - protein, 10 aa, Borrelia garinii
LKDTKTKLED

SEQ ID NO: 167252 - protein, 10 aa, Borrelia garinii
KDTKTKLEDI

SEQ ID NO: 167253 - protein, 10 aa, Borrelia garinii
DTKTKLEDIS

SEQ ID NO: 167254 - protein, 10 aa, Borrelia garinii
TKTKLEDISK

SEQ ID NO: 167255 - protein, 10 aa, Borrelia garinii
KTKLEDISKE

SEQ ID NO: 167256 - protein, 10 aa, Borrelia garinii
TKLEDISKEK

SEQ ID NO: 167257 - protein, 10 aa, Borrelia garinii
KLEDISKEKT

SEQ ID NO: 167258 - protein, 10 aa, Borrelia garinii
LEDISKEKTG

SEQ ID NO: 167259 - protein, 10 aa, Borrelia garinii
EDISKEKTGG

SEQ ID NO: 167260 - protein, 10 aa, Borrelia garinii
DISKEKTGGE

SEQ ID NO: 167261 - protein, 10 aa, Borrelia garinii
ISKEKTGGEK

SEQ ID NO: 167262 - protein, 10 aa, Borrelia garinii
SKEKTGGEKT

SEQ ID NO: 167263 - protein, 10 aa, Borrelia garinii
KEKTGGEKTP

SEQ ID NO: 167264 - protein, 10 aa, Borrelia garinii
EKTGGEKTPA

SEQ ID NO: 167265 - protein, 10 aa, Borrelia garinii
KTGGEKTPAV

SEQ ID NO: 167266 - protein, 10 aa, Borrelia garinii
TGGEKTPAVE

SEQ ID NO: 167267 - protein, 10 aa, Borrelia garinii
GGEKTPAVEG

SEQ ID NO: 167268 - protein, 10 aa, Borrelia garinii
GEKTPAVEGI

SEQ ID NO: 167269 - protein, 10 aa, Borrelia garinii
EKTPAVEGIA

SEQ ID NO: 167270 - protein, 10 aa, Borrelia garinii
KTPAVEGIAE

SEQ ID NO: 167271 - protein, 10 aa, Borrelia garinii
TPAVEGIAEV

SEQ ID NO: 167272 - protein, 10 aa, Borrelia garinii
PAVEGIAEVV

SEQ ID NO: 167273 - protein, 10 aa, Borrelia garinii
AVEGIAEVVK

SEQ ID NO: 167274 - protein, 10 aa, Borrelia garinii
VEGIAEVVKT

SEQ ID NO: 167275 - protein, 10 aa, Borrelia garinii
EGIAEVVKTV

SEQ ID NO: 167276 - protein, 10 aa, Borrelia garinii
GIAEVVKTVG

SEQ ID NO: 167277 - protein, 10 aa, Borrelia garinii
IAEVVKTVGE

SEQ ID NO: 167278 - protein, 10 aa, Borrelia garinii
AEVVKTVGEW

SEQ ID NO: 167279 - protein, 10 aa, Borrelia garinii
EVVKTVGEWL

SEQ ID NO: 167280 - protein, 10 aa, Borrelia garinii
VVKTVGEWLD

SEQ ID NO: 167281 - protein, 10 aa, Borrelia garinii
VKTVGEWLDG

SEQ ID NO: 167282 - protein, 10 aa, Borrelia garinii
KTVGEWLDGL

SEQ ID NO: 167283 - protein, 10 aa, Borrelia garinii
TVGEWLDGLI

SEQ ID NO: 167284 - protein, 10 aa, Borrelia garinii
VGEWLDGLIK

SEQ ID NO: 167285 - protein, 10 aa, Borrelia garinii
GEWLDGLIKA

SEQ ID NO: 167286 - protein, 10 aa, Borrelia garinii
EWLDGLIKAA

SEQ ID NO: 167287 - protein, 10 aa, Borrelia garinii
WLDGLIKAAE

SEQ ID NO: 167288 - protein, 10 aa, Borrelia garinii
LDGLIKAAEG

SEQ ID NO: 167289 - protein, 10 aa, Borrelia garinii
DGLIKAAEGG

SEQ ID NO: 167290 - protein, 10 aa, Borrelia garinii
GLIKAAEGGG

SEQ ID NO: 167291 - protein, 10 aa, Borrelia garinii
LIKAAEGGGK

SEQ ID NO: 167292 - protein, 10 aa, Borrelia garinii
IKAAEGGGKA

SEQ ID NO: 167293 - protein, 10 aa, Borrelia garinii
KAAEGGGKAA

SEQ ID NO: 167294 - protein, 10 aa, Borrelia garinii
AAEGGGKAAD

SEQ ID NO: 167295 - protein, 10 aa, Borrelia garinii
AEGGGKAADG

SEQ ID NO: 167296 - protein, 10 aa, Borrelia garinii
EGGGKAADGG

SEQ ID NO: 167297 - protein, 10 aa, Borrelia garinii
GGGKAADGGG

SEQ ID NO: 167298 - protein, 10 aa, Borrelia garinii
GGKAADGGGS

SEQ ID NO: 167299 - protein, 10 aa, Borrelia garinii
GKAADGGGSD

SEQ ID NO: 167300 - protein, 10 aa, Borrelia garinii
KAADGGGSDK

SEQ ID NO: 167301 - protein, 10 aa, Borrelia garinii
AADGGGSDKI

SEQ ID NO: 167302 - protein, 10 aa, Borrelia garinii
ADGGGSDKIG

SEQ ID NO: 167303 - protein, 10 aa, Borrelia garinii
DGGGSDKIGN

SEQ ID NO: 167304 - protein, 10 aa, Borrelia garinii
GGGSDKIGNV

SEQ ID NO: 167305 - protein, 10 aa, Borrelia garinii
GGSDKIGNVA

SEQ ID NO: 167306 - protein, 10 aa, Borrelia garinii
GSDKIGNVAA

SEQ ID NO: 167307 - protein, 10 aa, Borrelia garinii
SDKIGNVAAG

SEQ ID NO: 167308 - protein, 10 aa, Borrelia garinii
DKIGNVAAGG

SEQ ID NO: 167309 - protein, 10 aa, Borrelia garinii
KIGNVAAGGG

SEQ ID NO: 167310 - protein, 10 aa, Borrelia garinii
IGNVAAGGGA

SEQ ID NO: 167311 - protein, 10 aa, Borrelia garinii
GNVAAGGGAG

SEQ ID NO: 167312 - protein, 10 aa, Borrelia garinii
NVAAGGGAGA

SEQ ID NO: 167313 - protein, 10 aa, Borrelia garinii
VAAGGGAGAD

SEQ ID NO: 167314 - protein, 10 aa, Borrelia garinii
AAGGGAGADK

SEQ ID NO: 167315 - protein, 10 aa, Borrelia garinii
AGGGAGADKE

SEQ ID NO: 167316 - protein, 10 aa, Borrelia garinii
GGGAGADKES

SEQ ID NO: 167317 - protein, 10 aa, Borrelia garinii
GGAGADKESV

SEQ ID NO: 167318 - protein, 10 aa, Borrelia garinii
GAGADKESVN

SEQ ID NO: 167319 - protein, 10 aa, Borrelia garinii
AGADKESVNG

SEQ ID NO: 167320 - protein, 10 aa, Borrelia garinii
GADKESVNGI

SEQ ID NO: 167321 - protein, 10 aa, Borrelia garinii
ADKESVNGIA

SEQ ID NO: 167322 - protein, 10 aa, Borrelia garinii
DKESVNGIAG

SEQ ID NO: 167323 - protein, 10 aa, Borrelia garinii
KESVNGIAGA

SEQ ID NO: 167324 - protein, 10 aa, Borrelia garinii
ESVNGIAGAI

SEQ ID NO: 167325 - protein, 10 aa, Borrelia garinii
SVNGIAGAIK

SEQ ID NO: 167326 - protein, 10 aa, Borrelia garinii
VNGIAGAIKG

SEQ ID NO: 167327 - protein, 10 aa, Borrelia garinii
NGIAGAIKGI

SEQ ID NO: 167328 - protein, 10 aa, Borrelia garinii
GIAGAIKGIV

SEQ ID NO: 167329 - protein, 10 aa, Borrelia garinii
IAGAIKGIVE

SEQ ID NO: 167330 - protein, 10 aa, Borrelia garinii
AGAIKGIVEA

SEQ ID NO: 167331 - protein, 10 aa, Borrelia garinii
GAIKGIVEAA

SEQ ID NO: 167332 - protein, 10 aa, Borrelia garinii
AIKGIVEAAK

SEQ ID NO: 167333 - protein, 10 aa, Borrelia garinii
IKGIVEAAKK

SEQ ID NO: 167334 - protein, 10 aa, Borrelia garinii
KGIVEAAKKV

SEQ ID NO: 167335 - protein, 10 aa, Borrelia garinii
GIVEAAKKVE

SEQ ID NO: 167336 - protein, 10 aa, Borrelia garinii
IVEAAKKVEG

SEQ ID NO: 167337 - protein, 10 aa, Borrelia garinii
VEAAKKVEGV

SEQ ID NO: 167338 - protein, 10 aa, Borrelia garinii
EAAKKVEGVK

SEQ ID NO: 167339 - protein, 10 aa, Borrelia garinii
AAKKVEGVKF

SEQ ID NO: 167340 - protein, 10 aa, Borrelia garinii
AKKVEGVKFA

SEQ ID NO: 167341 - protein, 10 aa, Borrelia garinii
KKVEGVKFAP

SEQ ID NO: 167342 - protein, 10 aa, Borrelia garinii
KVEGVKFAPK

SEQ ID NO: 167343 - protein, 10 aa, Borrelia garinii
VEGVKFAPKA

SEQ ID NO: 167344 - protein, 10 aa, Borrelia garinii
EGVKFAPKAA

SEQ ID NO: 167345 - protein, 10 aa, Borrelia garinii
GVKFAPKAAA

SEQ ID NO: 167346 - protein, 10 aa, Borrelia garinii
VKFAPKAAAD

SEQ ID NO: 167347 - protein, 10 aa, Borrelia garinii
KFAPKAAADA

SEQ ID NO: 167348 - protein, 10 aa, Borrelia garinii
FAPKAAADAA

SEQ ID NO: 167349 - protein, 10 aa, Borrelia garinii
APKAAADAAA

SEQ ID NO: 167350 - protein, 10 aa, Borrelia garinii
PKAAADAAAA

SEQ ID NO: 167351 - protein, 10 aa, Borrelia garinii
KAAADAAAAD

SEQ ID NO: 167352 - protein, 10 aa, Borrelia garinii
AAADAAAADG

SEQ ID NO: 167353 - protein, 10 aa, Borrelia garinii
AADAAAADGN

SEQ ID NO: 167354 - protein, 10 aa, Borrelia garinii
ADAAAADGNK

SEQ ID NO: 167355 - protein, 10 aa, Borrelia garinii
DAAAADGNKK

SEQ ID NO: 167356 - protein, 10 aa, Borrelia garinii
AAAADGNKKA

SEQ ID NO: 167357 - protein, 10 aa, Borrelia garinii
AAADGNKKAG

SEQ ID NO: 167358 - protein, 10 aa, Borrelia garinii
AADGNKKAGK

SEQ ID NO: 167359 - protein, 10 aa, Borrelia garinii
ADGNKKAGKL

SEQ ID NO: 167360 - protein, 10 aa, Borrelia garinii
DGNKKAGKLF

SEQ ID NO: 167361 - protein, 10 aa, Borrelia garinii
GNKKAGKLFG

SEQ ID NO: 167362 - protein, 10 aa, Borrelia garinii
NKKAGKLFGT

SEQ ID NO: 167363 - protein, 10 aa, Borrelia garinii
KKAGKLFGTA

SEQ ID NO: 167364 - protein, 10 aa, Borrelia garinii
KAGKLFGTAA

SEQ ID NO: 167365 - protein, 10 aa, Borrelia garinii
AGKLFGTAAG

SEQ ID NO: 167366 - protein, 10 aa, Borrelia garinii
GKLFGTAAGA

SEQ ID NO: 167367 - protein, 10 aa, Borrelia garinii
KLFGTAAGAD

SEQ ID NO: 167368 - protein, 10 aa, Borrelia garinii
LFGTAAGADA

SEQ ID NO: 167369 - protein, 10 aa, Borrelia garinii
FGTAAGADAG

SEQ ID NO: 167370 - protein, 10 aa, Borrelia garinii
GTAAGADAGD

SEQ ID NO: 167371 - protein, 10 aa, Borrelia garinii
TAAGADAGDV

SEQ ID NO: 167372 - protein, 10 aa, Borrelia garinii
AAGADAGDVK

SEQ ID NO: 167373 - protein, 10 aa, Borrelia garinii
AGADAGDVKD

SEQ ID NO: 167374 - protein, 10 aa, Borrelia garinii
GADAGDVKDA

SEQ ID NO: 167375 - protein, 10 aa, Borrelia garinii
ADAGDVKDAA

SEQ ID NO: 167376 - protein, 10 aa, Borrelia garinii
DAGDVKDAAA

SEQ ID NO: 167377 - protein, 10 aa, Borrelia garinii
AGDVKDAAAA

SEQ ID NO: 167378 - protein, 10 aa, Borrelia garinii
GDVKDAAAAV

SEQ ID NO: 167379 - protein, 10 aa, Borrelia garinii
DVKDAAAAVG

SEQ ID NO: 167380 - protein, 10 aa, Borrelia garinii
VKDAAAAVGA

SEQ ID NO: 167381 - protein, 10 aa, Borrelia garinii
KDAAAAVGAV

SEQ ID NO: 167382 - protein, 10 aa, Borrelia garinii
DAAAAVGAVS

SEQ ID NO: 167383 - protein, 10 aa, Borrelia garinii
AAAAVGAVSG

SEQ ID NO: 167384 - protein, 10 aa, Borrelia garinii
AAAVGAVSGE

SEQ ID NO: 167385 - protein, 10 aa, Borrelia garinii
AAVGAVSGEQ

SEQ ID NO: 167386 - protein, 10 aa, Borrelia garinii
AVGAVSGEQI

SEQ ID NO: 167387 - protein, 10 aa, Borrelia garinii
VGAVSGEQIL

SEQ ID NO: 167388 - protein, 10 aa, Borrelia garinii
GAVSGEQILN

SEQ ID NO: 167389 - protein, 10 aa, Borrelia garinii
AVSGEQILNA

SEQ ID NO: 167390 - protein, 10 aa, Borrelia garinii
VSGEQILNAI

SEQ ID NO: 167391 - protein, 10 aa, Borrelia garinii
SGEQILNAIV

SEQ ID NO: 167392 - protein, 10 aa, Borrelia garinii
GEQILNAIVT

SEQ ID NO: 167393 - protein, 10 aa, Borrelia garinii
EQILNAIVTA

SEQ ID NO: 167394 - protein, 10 aa, Borrelia garinii
QILNAIVTAA

SEQ ID NO: 167395 - protein, 10 aa, Borrelia garinii
ILNAIVTAAG

SEQ ID NO: 167396 - protein, 10 aa, Borrelia garinii
LNAIVTAAGQ

SEQ ID NO: 167397 - protein, 10 aa, Borrelia garinii
NAIVTAAGQA

SEQ ID NO: 167398 - protein, 10 aa, Borrelia garinii
AIVTAAGQAG

SEQ ID NO: 167399 - protein, 10 aa, Borrelia garinii
IVTAAGQAGQ

SEQ ID NO: 167400 - protein, 10 aa, Borrelia garinii
VTAAGQAGQA

SEQ ID NO: 167401 - protein, 10 aa, Borrelia garinii
TAAGQAGQAG

SEQ ID NO: 167402 - protein, 10 aa, Borrelia garinii
AAGQAGQAGK

SEQ ID NO: 167403 - protein, 10 aa, Borrelia garinii
AGQAGQAGKK

SEQ ID NO: 167404 - protein, 10 aa, Borrelia garinii
GQAGQAGKKA

SEQ ID NO: 167405 - protein, 10 aa, Borrelia garinii
QAGQAGKKAD

SEQ ID NO: 167406 - protein, 10 aa, Borrelia garinii
AGQAGKKADE

SEQ ID NO: 167407 - protein, 10 aa, Borrelia garinii
GQAGKKADEA

SEQ ID NO: 167408 - protein, 10 aa, Borrelia garinii
QAGKKADEAK

SEQ ID NO: 167409 - protein, 10 aa, Borrelia garinii
AGKKADEAKN

SEQ ID NO: 167410 - protein, 10 aa, Borrelia garinii
GKKADEAKNA

SEQ ID NO: 167411 - protein, 10 aa, Borrelia garinii
KKADEAKNAI

SEQ ID NO: 167412 - protein, 10 aa, Borrelia garinii
KADEAKNAIE

SEQ ID NO: 167413 - protein, 10 aa, Borrelia garinii
ADEAKNAIEA

SEQ ID NO: 167414 - protein, 10 aa, Borrelia garinii
DEAKNAIEAA

SEQ ID NO: 167415 - protein, 10 aa, Borrelia garinii
EAKNAIEAAI

SEQ ID NO: 167416 - protein, 10 aa, Borrelia garinii
AKNAIEAAIG

SEQ ID NO: 167417 - protein, 10 aa, Borrelia garinii
KNAIEAAIGA

SEQ ID NO: 167418 - protein, 10 aa, Borrelia garinii
NAIEAAIGAA

SEQ ID NO: 167419 - protein, 10 aa, Borrelia garinii
AIEAAIGAAG

SEQ ID NO: 167420 - protein, 10 aa, Borrelia garinii
IEAAIGAAGD

SEQ ID NO: 167421 - protein, 10 aa, Borrelia garinii
EAAIGAAGDA

SEQ ID NO: 167422 - protein, 10 aa, Borrelia garinii
AAIGAAGDAD

SEQ ID NO: 167423 - protein, 10 aa, Borrelia garinii
AIGAAGDADF

SEQ ID NO: 167424 - protein, 10 aa, Borrelia garinii
IGAAGDADFG

SEQ ID NO: 167425 - protein, 10 aa, Borrelia garinii
GAAGDADFGD

SEQ ID NO: 167426 - protein, 10 aa, Borrelia garinii
AAGDADFGDD

SEQ ID NO: 167427 - protein, 10 aa, Borrelia garinii
AGDADFGDDI

SEQ ID NO: 167428 - protein, 10 aa, Borrelia garinii
GDADFGDDIK

SEQ ID NO: 167429 - protein, 10 aa, Borrelia garinii
DADFGDDIKK

SEQ ID NO: 167430 - protein, 10 aa, Borrelia garinii
ADFGDDIKKK

SEQ ID NO: 167431 - protein, 10 aa, Borrelia garinii
DFGDDIKKKN

SEQ ID NO: 167432 - protein, 10 aa, Borrelia garinii
FGDDIKKKND

SEQ ID NO: 167433 - protein, 10 aa, Borrelia garinii
GDDIKKKNDQ

SEQ ID NO: 167434 - protein, 10 aa, Borrelia garinii
DDIKKKNDQI

SEQ ID NO: 167435 - protein, 10 aa, Borrelia garinii
DIKKKNDQIA

SEQ ID NO: 167436 - protein, 10 aa, Borrelia garinii
IKKKNDQIAA

SEQ ID NO: 167437 - protein, 10 aa, Borrelia garinii
KKKNDQIAAA

SEQ ID NO: 167438 - protein, 10 aa, Borrelia garinii
KKNDQIAAAL

SEQ ID NO: 167439 - protein, 10 aa, Borrelia garinii
KNDQIAAALV

SEQ ID NO: 167440 - protein, 10 aa, Borrelia garinii
NDQIAAALVL

SEQ ID NO: 167441 - protein, 10 aa, Borrelia garinii
DQIAAALVLR

SEQ ID NO: 167442 - protein, 10 aa, Borrelia garinii
QIAAALVLRG

SEQ ID NO: 167443 - protein, 10 aa, Borrelia garinii
IAAALVLRGV

SEQ ID NO: 167444 - protein, 10 aa, Borrelia garinii
AAALVLRGVA

SEQ ID NO: 167445 - protein, 10 aa, Borrelia garinii
AALVLRGVAK

SEQ ID NO: 167446 - protein, 10 aa, Borrelia garinii
ALVLRGVAKD

SEQ ID NO: 167447 - protein, 10 aa, Borrelia garinii
LVLRGVAKDG

SEQ ID NO: 167448 - protein, 10 aa, Borrelia garinii
VLRGVAKDGK

SEQ ID NO: 167449 - protein, 10 aa, Borrelia garinii
LRGVAKDGKF

SEQ ID NO: 167450 - protein, 10 aa, Borrelia garinii
RGVAKDGKFA

SEQ ID NO: 167451 - protein, 10 aa, Borrelia garinii
GVAKDGKFAG

SEQ ID NO: 167452 - protein, 10 aa, Borrelia garinii
VAKDGKFAGA

SEQ ID NO: 167453 - protein, 11 aa, Borrelia garinii
MKKISSAIFIV

SEQ ID NO: 167454 - protein, 11 aa, Borrelia garinii
KKISSAIFIVA

SEQ ID NO: 167455 - protein, 11 aa, Borrelia garinii
KISSAIFIVAF

SEQ ID NO: 167456 - protein, 11 aa, Borrelia garinii
ISSAIFIVAFL

SEQ ID NO: 167457 - protein, 11 aa, Borrelia garinii
SSAIFIVAFLA

SEQ ID NO: 167458 - protein, 11 aa, Borrelia garinii
SAIFIVAFLAL

SEQ ID NO: 167459 - protein, 11 aa, Borrelia garinii
AIFIVAFLALI

SEQ ID NO: 167460 - protein, 11 aa, Borrelia garinii
IFIVAFLALIG

SEQ ID NO: 167461 - protein, 11 aa, Borrelia garinii
FIVAFLALIGC

SEQ ID NO: 167462 - protein, 11 aa, Borrelia garinii
IVAFLALIGCK

SEQ ID NO: 167463 - protein, 11 aa, Borrelia garinii
VAFLALIGCKN

SEQ ID NO: 167464 - protein, 11 aa, Borrelia garinii
AFLALIGCKNN

SEQ ID NO: 167465 - protein, 11 aa, Borrelia garinii
FLALIGCKNNV

SEQ ID NO: 167466 - protein, 11 aa, Borrelia garinii
LALIGCKNNVG

SEQ ID NO: 167467 - protein, 11 aa, Borrelia garinii
ALIGCKNNVGG

SEQ ID NO: 167468 - protein, 11 aa, Borrelia garinii
LIGCKNNVGGD

SEQ ID NO: 167469 - protein, 11 aa, Borrelia garinii
IGCKNNVGGDD

SEQ ID NO: 167470 - protein, 11 aa, Borrelia garinii
GCKNNVGGDDK

SEQ ID NO: 167471 - protein, 11 aa, Borrelia garinii
CKNNVGGDDKK

SEQ ID NO: 167472 - protein, 11 aa, Borrelia garinii
KNNVGGDDKKD

SEQ ID NO: 167473 - protein, 11 aa, Borrelia garinii
NNVGGDDKKDT

SEQ ID NO: 167474 - protein, 11 aa, Borrelia garinii
NVGGDDKKDTA

SEQ ID NO: 167475 - protein, 11 aa, Borrelia garinii
VGGDDKKDTAA

SEQ ID NO: 167476 - protein, 11 aa, Borrelia garinii
GGDDKKDTAAS

SEQ ID NO: 167477 - protein, 11 aa, Borrelia garinii
GDDKKDTAASI

SEQ ID NO: 167478 - protein, 11 aa, Borrelia garinii
DDKKDTAASIF

SEQ ID NO: 167479 - protein, 11 aa, Borrelia garinii
DKKDTAASIFY

SEQ ID NO: 167480 - protein, 11 aa, Borrelia garinii
KKDTAASIFYQ

SEQ ID NO: 167481 - protein, 11 aa, Borrelia garinii
KDTAASIFYQS

SEQ ID NO: 167482 - protein, 11 aa, Borrelia garinii
DTAASIFYQSI

SEQ ID NO: 167483 - protein, 11 aa, Borrelia garinii
TAASIFYQSII

SEQ ID NO: 167484 - protein, 11 aa, Borrelia garinii
AASIFYQSIIN

SEQ ID NO: 167485 - protein, 11 aa, Borrelia garinii
ASIFYQSIINL

SEQ ID NO: 167486 - protein, 11 aa, Borrelia garinii
SIFYQSIINLG

SEQ ID NO: 167487 - protein, 11 aa, Borrelia garinii
IFYQSIINLGN

SEQ ID NO: 167488 - protein, 11 aa, Borrelia garinii
FYQSIINLGNG

SEQ ID NO: 167489 - protein, 11 aa, Borrelia garinii
YQSIINLGNGF

SEQ ID NO: 167490 - protein, 11 aa, Borrelia garinii
QSIINLGNGFI

SEQ ID NO: 167491 - protein, 11 aa, Borrelia garinii
SIINLGNGFIE

SEQ ID NO: 167492 - protein, 11 aa, Borrelia garinii
IINLGNGFIEV

SEQ ID NO: 167493 - protein, 11 aa, Borrelia garinii
INLGNGFIEVF

SEQ ID NO: 167494 - protein, 11 aa, Borrelia garinii
NLGNGFIEVFN

SEQ ID NO: 167495 - protein, 11 aa, Borrelia garinii
LGNGFIEVFNA

SEQ ID NO: 167496 - protein, 11 aa, Borrelia garinii
GNGFIEVFNAF

SEQ ID NO: 167497 - protein, 11 aa, Borrelia garinii
NGFIEVFNAFS

SEQ ID NO: 167498 - protein, 11 aa, Borrelia garinii
GFIEVFNAFSG

SEQ ID NO: 167499 - protein, 11 aa, Borrelia garinii
FIEVFNAFSGL

SEQ ID NO: 167500 - protein, 11 aa, Borrelia garinii
IEVFNAFSGLV

SEQ ID NO: 167501 - protein, 11 aa, Borrelia garinii
EVFNAFSGLVA

SEQ ID NO: 167502 - protein, 11 aa, Borrelia garinii
VFNAFSGLVAD

SEQ ID NO: 167503 - protein, 11 aa, Borrelia garinii
FNAFSGLVADA

SEQ ID NO: 167504 - protein, 11 aa, Borrelia garinii
NAFSGLVADAF

SEQ ID NO: 167505 - protein, 11 aa, Borrelia garinii
AFSGLVADAFS

SEQ ID NO: 167506 - protein, 11 aa, Borrelia garinii
FSGLVADAFSK

SEQ ID NO: 167507 - protein, 11 aa, Borrelia garinii
SGLVADAFSKA

SEQ ID NO: 167508 - protein, 11 aa, Borrelia garinii
GLVADAFSKAD

SEQ ID NO: 167509 - protein, 11 aa, Borrelia garinii
LVADAFSKADP

SEQ ID NO: 167510 - protein, 11 aa, Borrelia garinii
VADAFSKADPK

SEQ ID NO: 167511 - protein, 11 aa, Borrelia garinii
ADAFSKADPKK

SEQ ID NO: 167512 - protein, 11 aa, Borrelia garinii
DAFSKADPKKS

SEQ ID NO: 167513 - protein, 11 aa, Borrelia garinii
AFSKADPKKSD

SEQ ID NO: 167514 - protein, 11 aa, Borrelia garinii
FSKADPKKSDV

SEQ ID NO: 167515 - protein, 11 aa, Borrelia garinii
SKADPKKSDVK

SEQ ID NO: 167516 - protein, 11 aa, Borrelia garinii
KADPKKSDVKT

SEQ ID NO: 167517 - protein, 11 aa, Borrelia garinii
ADPKKSDVKTY

SEQ ID NO: 167518 - protein, 11 aa, Borrelia garinii
DPKKSDVKTYF

SEQ ID NO: 167519 - protein, 11 aa, Borrelia garinii
PKKSDVKTYFD

SEQ ID NO: 167520 - protein, 11 aa, Borrelia garinii
KKSDVKTYFDS

SEQ ID NO: 167521 - protein, 11 aa, Borrelia garinii
KSDVKTYFDSI

SEQ ID NO: 167522 - protein, 11 aa, Borrelia garinii
SDVKTYFDSIT

SEQ ID NO: 167523 - protein, 11 aa, Borrelia garinii
DVKTYFDSITK

SEQ ID NO: 167524 - protein, 11 aa, Borrelia garinii
VKTYFDSITKT

SEQ ID NO: 167525 - protein, 11 aa, Borrelia garinii
KTYFDSITKTL

SEQ ID NO: 167526 - protein, 11 aa, Borrelia garinii
TYFDSITKTLK

SEQ ID NO: 167527 - protein, 11 aa, Borrelia garinii
YFDSITKTLKD

SEQ ID NO: 167528 - protein, 11 aa, Borrelia garinii
FDSITKTLKDT

SEQ ID NO: 167529 - protein, 11 aa, Borrelia garinii
DSITKTLKDTK

SEQ ID NO: 167530 - protein, 11 aa, Borrelia garinii
SITKTLKDTKT

SEQ ID NO: 167531 - protein, 11 aa, Borrelia garinii
ITKTLKDTKTK

SEQ ID NO: 167532 - protein, 11 aa, Borrelia garinii
TKTLKDTKTKL

SEQ ID NO: 167533 - protein, 11 aa, Borrelia garinii
KTLKDTKTKLE

SEQ ID NO: 167534 - protein, 11 aa, Borrelia garinii
TLKDTKTKLED

SEQ ID NO: 167535 - protein, 11 aa, Borrelia garinii
LKDTKTKLEDI

SEQ ID NO: 167536 - protein, 11 aa, Borrelia garinii
KDTKTKLEDIS

SEQ ID NO: 167537 - protein, 11 aa, Borrelia garinii
DTKTKLEDISK

SEQ ID NO: 167538 - protein, 11 aa, Borrelia garinii
TKTKLEDISKE

SEQ ID NO: 167539 - protein, 11 aa, Borrelia garinii
KTKLEDISKEK

SEQ ID NO: 167540 - protein, 11 aa, Borrelia garinii
TKLEDISKEKT

SEQ ID NO: 167541 - protein, 11 aa, Borrelia garinii
KLEDISKEKTG

SEQ ID NO: 167542 - protein, 11 aa, Borrelia garinii
LEDISKEKTGG

SEQ ID NO: 167543 - protein, 11 aa, Borrelia garinii
EDISKEKTGGE

SEQ ID NO: 167544 - protein, 11 aa, Borrelia garinii
DISKEKTGGEK

SEQ ID NO: 167545 - protein, 11 aa, Borrelia garinii
ISKEKTGGEKT

SEQ ID NO: 167546 - protein, 11 aa, Borrelia garinii
SKEKTGGEKTP

SEQ ID NO: 167547 - protein, 11 aa, Borrelia garinii
KEKTGGEKTPA

SEQ ID NO: 167548 - protein, 11 aa, Borrelia garinii
EKTGGEKTPAV

SEQ ID NO: 167549 - protein, 11 aa, Borrelia garinii
KTGGEKTPAVE

SEQ ID NO: 167550 - protein, 11 aa, Borrelia garinii
TGGEKTPAVEG

SEQ ID NO: 167551 - protein, 11 aa, Borrelia garinii
GGEKTPAVEGI

SEQ ID NO: 167552 - protein, 11 aa, Borrelia garinii
GEKTPAVEGIA

SEQ ID NO: 167553 - protein, 11 aa, Borrelia garinii
EKTPAVEGIAE

SEQ ID NO: 167554 - protein, 11 aa, Borrelia garinii
KTPAVEGIAEV

SEQ ID NO: 167555 - protein, 11 aa, Borrelia garinii
TPAVEGIAEVV

SEQ ID NO: 167556 - protein, 11 aa, Borrelia garinii
PAVEGIAEVVK

SEQ ID NO: 167557 - protein, 11 aa, Borrelia garinii
AVEGIAEVVKT

SEQ ID NO: 167558 - protein, 11 aa, Borrelia garinii
VEGIAEVVKTV

SEQ ID NO: 167559 - protein, 11 aa, Borrelia garinii
EGIAEVVKTVG

SEQ ID NO: 167560 - protein, 11 aa, Borrelia garinii
GIAEVVKTVGE

SEQ ID NO: 167561 - protein, 11 aa, Borrelia garinii
IAEVVKTVGEW

SEQ ID NO: 167562 - protein, 11 aa, Borrelia garinii
AEVVKTVGEWL

SEQ ID NO: 167563 - protein, 11 aa, Borrelia garinii
EVVKTVGEWLD

SEQ ID NO: 167564 - protein, 11 aa, Borrelia garinii
VVKTVGEWLDG

SEQ ID NO: 167565 - protein, 11 aa, Borrelia garinii
VKTVGEWLDGL

SEQ ID NO: 167566 - protein, 11 aa, Borrelia garinii
KTVGEWLDGLI

SEQ ID NO: 167567 - protein, 11 aa, Borrelia garinii
TVGEWLDGLIK

SEQ ID NO: 167568 - protein, 11 aa, Borrelia garinii
VGEWLDGLIKA

SEQ ID NO: 167569 - protein, 11 aa, Borrelia garinii
GEWLDGLIKAA

SEQ ID NO: 167570 - protein, 11 aa, Borrelia garinii
EWLDGLIKAAE

SEQ ID NO: 167571 - protein, 11 aa, Borrelia garinii
WLDGLIKAAEG

SEQ ID NO: 167572 - protein, 11 aa, Borrelia garinii
LDGLIKAAEGG

SEQ ID NO: 167573 - protein, 11 aa, Borrelia garinii
DGLIKAAEGGG

SEQ ID NO: 167574 - protein, 11 aa, Borrelia garinii
GLIKAAEGGGK

SEQ ID NO: 167575 - protein, 11 aa, Borrelia garinii
LIKAAEGGGKA

SEQ ID NO: 167576 - protein, 11 aa, Borrelia garinii
IKAAEGGGKAA

SEQ ID NO: 167577 - protein, 11 aa, Borrelia garinii
KAAEGGGKAAD

SEQ ID NO: 167578 - protein, 11 aa, Borrelia garinii
AAEGGGKAADG

SEQ ID NO: 167579 - protein, 11 aa, Borrelia garinii
AEGGGKAADGG

SEQ ID NO: 167580 - protein, 11 aa, Borrelia garinii
EGGGKAADGGG

SEQ ID NO: 167581 - protein, 11 aa, Borrelia garinii
GGGKAADGGGS

SEQ ID NO: 167582 - protein, 11 aa, Borrelia garinii
GGKAADGGGSD

SEQ ID NO: 167583 - protein, 11 aa, Borrelia garinii
GKAADGGGSDK

SEQ ID NO: 167584 - protein, 11 aa, Borrelia garinii
KAADGGGSDKI

SEQ ID NO: 167585 - protein, 11 aa, Borrelia garinii
AADGGGSDKIG

SEQ ID NO: 167586 - protein, 11 aa, Borrelia garinii
ADGGGSDKIGN

SEQ ID NO: 167587 - protein, 11 aa, Borrelia garinii
DGGGSDKIGNV

SEQ ID NO: 167588 - protein, 11 aa, Borrelia garinii
GGGSDKIGNVA

SEQ ID NO: 167589 - protein, 11 aa, Borrelia garinii
GGSDKIGNVAA

SEQ ID NO: 167590 - protein, 11 aa, Borrelia garinii
GSDKIGNVAAG

SEQ ID NO: 167591 - protein, 11 aa, Borrelia garinii
SDKIGNVAAGG

SEQ ID NO: 167592 - protein, 11 aa, Borrelia garinii
DKIGNVAAGGG

SEQ ID NO: 167593 - protein, 11 aa, Borrelia garinii
KIGNVAAGGGA

SEQ ID NO: 167594 - protein, 11 aa, Borrelia garinii
IGNVAAGGGAG

SEQ ID NO: 167595 - protein, 11 aa, Borrelia garinii
GNVAAGGGAGA

SEQ ID NO: 167596 - protein, 11 aa, Borrelia garinii
NVAAGGGAGAD

SEQ ID NO: 167597 - protein, 11 aa, Borrelia garinii
VAAGGGAGADK

SEQ ID NO: 167598 - protein, 11 aa, Borrelia garinii
AAGGGAGADKE

SEQ ID NO: 167599 - protein, 11 aa, Borrelia garinii
AGGGAGADKES

SEQ ID NO: 167600 - protein, 11 aa, Borrelia garinii
GGGAGADKESV

SEQ ID NO: 167601 - protein, 11 aa, Borrelia garinii
GGAGADKESVN

SEQ ID NO: 167602 - protein, 11 aa, Borrelia garinii
GAGADKESVNG

SEQ ID NO: 167603 - protein, 11 aa, Borrelia garinii
AGADKESVNGI

SEQ ID NO: 167604 - protein, 11 aa, Borrelia garinii
GADKESVNGIA

SEQ ID NO: 167605 - protein, 11 aa, Borrelia garinii
ADKESVNGIAG

SEQ ID NO: 167606 - protein, 11 aa, Borrelia garinii
DKESVNGIAGA

SEQ ID NO: 167607 - protein, 11 aa, Borrelia garinii
KESVNGIAGAI

SEQ ID NO: 167608 - protein, 11 aa, Borrelia garinii
ESVNGIAGAIK

SEQ ID NO: 167609 - protein, 11 aa, Borrelia garinii
SVNGIAGAIKG

SEQ ID NO: 167610 - protein, 11 aa, Borrelia garinii
VNGIAGAIKGI

SEQ ID NO: 167611 - protein, 11 aa, Borrelia garinii
NGIAGAIKGIV

SEQ ID NO: 167612 - protein, 11 aa, Borrelia garinii
GIAGAIKGIVE

SEQ ID NO: 167613 - protein, 11 aa, Borrelia garinii
IAGAIKGIVEA

SEQ ID NO: 167614 - protein, 11 aa, Borrelia garinii
AGAIKGIVEAA

SEQ ID NO: 167615 - protein, 11 aa, Borrelia garinii
GAIKGIVEAAK

SEQ ID NO: 167616 - protein, 11 aa, Borrelia garinii
AIKGIVEAAKK

SEQ ID NO: 167617 - protein, 11 aa, Borrelia garinii
IKGIVEAAKKV

SEQ ID NO: 167618 - protein, 11 aa, Borrelia garinii
KGIVEAAKKVE

SEQ ID NO: 167619 - protein, 11 aa, Borrelia garinii
GIVEAAKKVEG

SEQ ID NO: 167620 - protein, 11 aa, Borrelia garinii
IVEAAKKVEGV

SEQ ID NO: 167621 - protein, 11 aa, Borrelia garinii
VEAAKKVEGVK

SEQ ID NO: 167622 - protein, 11 aa, Borrelia garinii
EAAKKVEGVKF

SEQ ID NO: 167623 - protein, 11 aa, Borrelia garinii
AAKKVEGVKFA

SEQ ID NO: 167624 - protein, 11 aa, Borrelia garinii
AKKVEGVKFAP

SEQ ID NO: 167625 - protein, 11 aa, Borrelia garinii
KKVEGVKFAPK

SEQ ID NO: 167626 - protein, 11 aa, Borrelia garinii
KVEGVKFAPKA

SEQ ID NO: 167627 - protein, 11 aa, Borrelia garinii
VEGVKFAPKAA

SEQ ID NO: 167628 - protein, 11 aa, Borrelia garinii
EGVKFAPKAAA

SEQ ID NO: 167629 - protein, 11 aa, Borrelia garinii
GVKFAPKAAAD

SEQ ID NO: 167630 - protein, 11 aa, Borrelia garinii
VKFAPKAAADA

SEQ ID NO: 167631 - protein, 11 aa, Borrelia garinii
KFAPKAAADAA

SEQ ID NO: 167632 - protein, 11 aa, Borrelia garinii
FAPKAAADAAA

SEQ ID NO: 167633 - protein, 11 aa, Borrelia garinii
APKAAADAAAA

SEQ ID NO: 167634 - protein, 11 aa, Borrelia garinii
PKAAADAAAAD

SEQ ID NO: 167635 - protein, 11 aa, Borrelia garinii
KAAADAAAADG

SEQ ID NO: 167636 - protein, 11 aa, Borrelia garinii
AAADAAAADGN

SEQ ID NO: 167637 - protein, 11 aa, Borrelia garinii
AADAAAADGNK

SEQ ID NO: 167638 - protein, 11 aa, Borrelia garinii
ADAAAADGNKK

SEQ ID NO: 167639 - protein, 11 aa, Borrelia garinii
DAAAADGNKKA

SEQ ID NO: 167640 - protein, 11 aa, Borrelia garinii
AAAADGNKKAG

SEQ ID NO: 167641 - protein, 11 aa, Borrelia garinii
AAADGNKKAGK

SEQ ID NO: 167642 - protein, 11 aa, Borrelia garinii
AADGNKKAGKL

SEQ ID NO: 167643 - protein, 11 aa, Borrelia garinii
ADGNKKAGKLF

SEQ ID NO: 167644 - protein, 11 aa, Borrelia garinii
DGNKKAGKLFG

SEQ ID NO: 167645 - protein, 11 aa, Borrelia garinii
GNKKAGKLFGT

SEQ ID NO: 167646 - protein, 11 aa, Borrelia garinii
NKKAGKLFGTA

SEQ ID NO: 167647 - protein, 11 aa, Borrelia garinii
KKAGKLFGTAA

SEQ ID NO: 167648 - protein, 11 aa, Borrelia garinii
KAGKLFGTAAG

SEQ ID NO: 167649 - protein, 11 aa, Borrelia garinii
AGKLFGTAAGA

SEQ ID NO: 167650 - protein, 11 aa, Borrelia garinii
GKLFGTAAGAD

SEQ ID NO: 167651 - protein, 11 aa, Borrelia garinii
KLFGTAAGADA

SEQ ID NO: 167652 - protein, 11 aa, Borrelia garinii
LFGTAAGADAG

SEQ ID NO: 167653 - protein, 11 aa, Borrelia garinii
FGTAAGADAGD

SEQ ID NO: 167654 - protein, 11 aa, Borrelia garinii
GTAAGADAGDV

SEQ ID NO: 167655 - protein, 11 aa, Borrelia garinii
TAAGADAGDVK

SEQ ID NO: 167656 - protein, 11 aa, Borrelia garinii
AAGADAGDVKD

SEQ ID NO: 167657 - protein, 11 aa, Borrelia garinii
AGADAGDVKDA

SEQ ID NO: 167658 - protein, 11 aa, Borrelia garinii
GADAGDVKDAA

SEQ ID NO: 167659 - protein, 11 aa, Borrelia garinii
ADAGDVKDAAA

SEQ ID NO: 167660 - protein, 11 aa, Borrelia garinii
DAGDVKDAAAA

SEQ ID NO: 167661 - protein, 11 aa, Borrelia garinii
AGDVKDAAAAV

SEQ ID NO: 167662 - protein, 11 aa, Borrelia garinii
GDVKDAAAAVG

SEQ ID NO: 167663 - protein, 11 aa, Borrelia garinii
DVKDAAAAVGA

SEQ ID NO: 167664 - protein, 11 aa, Borrelia garinii
VKDAAAAVGAV

SEQ ID NO: 167665 - protein, 11 aa, Borrelia garinii
KDAAAAVGAVS

SEQ ID NO: 167666 - protein, 11 aa, Borrelia garinii
DAAAAVGAVSG

SEQ ID NO: 167667 - protein, 11 aa, Borrelia garinii
AAAAVGAVSGE

SEQ ID NO: 167668 - protein, 11 aa, Borrelia garinii
AAAVGAVSGEQ

SEQ ID NO: 167669 - protein, 11 aa, Borrelia garinii
AAVGAVSGEQI

SEQ ID NO: 167670 - protein, 11 aa, Borrelia garinii
AVGAVSGEQIL

SEQ ID NO: 167671 - protein, 11 aa, Borrelia garinii
VGAVSGEQILN

SEQ ID NO: 167672 - protein, 11 aa, Borrelia garinii
GAVSGEQILNA

SEQ ID NO: 167673 - protein, 11 aa, Borrelia garinii
AVSGEQILNAI

SEQ ID NO: 167674 - protein, 11 aa, Borrelia garinii
VSGEQILNAIV

SEQ ID NO: 167675 - protein, 11 aa, Borrelia garinii
SGEQILNAIVT

SEQ ID NO: 167676 - protein, 11 aa, Borrelia garinii
GEQILNAIVTA

SEQ ID NO: 167677 - protein, 11 aa, Borrelia garinii
EQILNAIVTAA

SEQ ID NO: 167678 - protein, 11 aa, Borrelia garinii
QILNAIVTAAG

SEQ ID NO: 167679 - protein, 11 aa, Borrelia garinii
ILNAIVTAAGQ

SEQ ID NO: 167680 - protein, 11 aa, Borrelia garinii
LNAIVTAAGQA

SEQ ID NO: 167681 - protein, 11 aa, Borrelia garinii
NAIVTAAGQAG

SEQ ID NO: 167682 - protein, 11 aa, Borrelia garinii
AIVTAAGQAGQ

SEQ ID NO: 167683 - protein, 11 aa, Borrelia garinii
IVTAAGQAGQA

SEQ ID NO: 167684 - protein, 11 aa, Borrelia garinii
VTAAGQAGQAG

SEQ ID NO: 167685 - protein, 11 aa, Borrelia garinii
TAAGQAGQAGK

SEQ ID NO: 167686 - protein, 11 aa, Borrelia garinii
AAGQAGQAGKK

SEQ ID NO: 167687 - protein, 11 aa, Borrelia garinii
AGQAGQAGKKA

SEQ ID NO: 167688 - protein, 11 aa, Borrelia garinii
GQAGQAGKKAD

SEQ ID NO: 167689 - protein, 11 aa, Borrelia garinii
QAGQAGKKADE

SEQ ID NO: 167690 - protein, 11 aa, Borrelia garinii
AGQAGKKADEA

SEQ ID NO: 167691 - protein, 11 aa, Borrelia garinii
GQAGKKADEAK

SEQ ID NO: 167692 - protein, 11 aa, Borrelia garinii
QAGKKADEAKN

SEQ ID NO: 167693 - protein, 11 aa, Borrelia garinii
AGKKADEAKNA

SEQ ID NO: 167694 - protein, 11 aa, Borrelia garinii
GKKADEAKNAI

SEQ ID NO: 167695 - protein, 11 aa, Borrelia garinii
KKADEAKNAIE

SEQ ID NO: 167696 - protein, 11 aa, Borrelia garinii
KADEAKNAIEA

SEQ ID NO: 167697 - protein, 11 aa, Borrelia garinii
ADEAKNAIEAA

SEQ ID NO: 167698 - protein, 11 aa, Borrelia garinii
DEAKNAIEAAI

SEQ ID NO: 167699 - protein, 11 aa, Borrelia garinii
EAKNAIEAAIG

SEQ ID NO: 167700 - protein, 11 aa, Borrelia garinii
AKNAIEAAIGA

SEQ ID NO: 167701 - protein, 11 aa, Borrelia garinii
KNAIEAAIGAA

SEQ ID NO: 167702 - protein, 11 aa, Borrelia garinii
NAIEAAIGAAG

SEQ ID NO: 167703 - protein, 11 aa, Borrelia garinii
AIEAAIGAAGD

SEQ ID NO: 167704 - protein, 11 aa, Borrelia garinii
IEAAIGAAGDA

SEQ ID NO: 167705 - protein, 11 aa, Borrelia garinii
EAAIGAAGDAD

SEQ ID NO: 167706 - protein, 11 aa, Borrelia garinii
AAIGAAGDADF

SEQ ID NO: 167707 - protein, 11 aa, Borrelia garinii
AIGAAGDADFG

SEQ ID NO: 167708 - protein, 11 aa, Borrelia garinii
IGAAGDADFGD

SEQ ID NO: 167709 - protein, 11 aa, Borrelia garinii
GAAGDADFGDD

SEQ ID NO: 167710 - protein, 11 aa, Borrelia garinii
AAGDADFGDDI

SEQ ID NO: 167711 - protein, 11 aa, Borrelia garinii
AGDADFGDDIK

SEQ ID NO: 167712 - protein, 11 aa, Borrelia garinii
GDADFGDDIKK

SEQ ID NO: 167713 - protein, 11 aa, Borrelia garinii
DADFGDDIKKK

SEQ ID NO: 167714 - protein, 11 aa, Borrelia garinii
ADFGDDIKKKN

SEQ ID NO: 167715 - protein, 11 aa, Borrelia garinii
DFGDDIKKKND

SEQ ID NO: 167716 - protein, 11 aa, Borrelia garinii
FGDDIKKKNDQ

SEQ ID NO: 167717 - protein, 11 aa, Borrelia garinii
GDDIKKKNDQI

SEQ ID NO: 167718 - protein, 11 aa, Borrelia garinii
DDIKKKNDQIA

SEQ ID NO: 167719 - protein, 11 aa, Borrelia garinii
DIKKKNDQIAA

SEQ ID NO: 167720 - protein, 11 aa, Borrelia garinii
IKKKNDQIAAA

SEQ ID NO: 167721 - protein, 11 aa, Borrelia garinii
KKKNDQIAAAL

SEQ ID NO: 167722 - protein, 11 aa, Borrelia garinii
KKNDQIAAALV

SEQ ID NO: 167723 - protein, 11 aa, Borrelia garinii
KNDQIAAALVL

SEQ ID NO: 167724 - protein, 11 aa, Borrelia garinii
NDQIAAALVLR

SEQ ID NO: 167725 - protein, 11 aa, Borrelia garinii
DQIAAALVLRG

SEQ ID NO: 167726 - protein, 11 aa, Borrelia garinii
QIAAALVLRGV

SEQ ID NO: 167727 - protein, 11 aa, Borrelia garinii
IAAALVLRGVA

SEQ ID NO: 167728 - protein, 11 aa, Borrelia garinii
AAALVLRGVAK

SEQ ID NO: 167729 - protein, 11 aa, Borrelia garinii
AALVLRGVAKD

SEQ ID NO: 167730 - protein, 11 aa, Borrelia garinii
ALVLRGVAKDG

SEQ ID NO: 167731 - protein, 11 aa, Borrelia garinii
LVLRGVAKDGK

SEQ ID NO: 167732 - protein, 11 aa, Borrelia garinii
VLRGVAKDGKF

SEQ ID NO: 167733 - protein, 11 aa, Borrelia garinii
LRGVAKDGKFA

SEQ ID NO: 167734 - protein, 11 aa, Borrelia garinii
RGVAKDGKFAG

SEQ ID NO: 167735 - protein, 11 aa, Borrelia garinii
GVAKDGKFAGA

SEQ ID NO: 167736 - protein, 13 aa, Borrelia garinii
MKKISSAIFIVAF

SEQ ID NO: 167737 - protein, 13 aa, Borrelia garinii
KKISSAIFIVAFL

SEQ ID NO: 167738 - protein, 13 aa, Borrelia garinii
KISSAIFIVAFLA

SEQ ID NO: 167739 - protein, 13 aa, Borrelia garinii
ISSAIFIVAFLAL

SEQ ID NO: 167740 - protein, 13 aa, Borrelia garinii
SSAIFIVAFLALI

SEQ ID NO: 167741 - protein, 13 aa, Borrelia garinii
SAIFIVAFLALIG

SEQ ID NO: 167742 - protein, 13 aa, Borrelia garinii
AIFIVAFLALIGC

SEQ ID NO: 167743 - protein, 13 aa, Borrelia garinii
IFIVAFLALIGCK

SEQ ID NO: 167744 - protein, 13 aa, Borrelia garinii
FIVAFLALIGCKN

SEQ ID NO: 167745 - protein, 13 aa, Borrelia garinii
IVAFLALIGCKNN

SEQ ID NO: 167746 - protein, 13 aa, Borrelia garinii
VAFLALIGCKNNV

SEQ ID NO: 167747 - protein, 13 aa, Borrelia garinii
AFLALIGCKNNVG

SEQ ID NO: 167748 - protein, 13 aa, Borrelia garinii
FLALIGCKNNVGG

SEQ ID NO: 167749 - protein, 13 aa, Borrelia garinii
LALIGCKNNVGGD

SEQ ID NO: 167750 - protein, 13 aa, Borrelia garinii
ALIGCKNNVGGDD

SEQ ID NO: 167751 - protein, 13 aa, Borrelia garinii
LIGCKNNVGGDDK

SEQ ID NO: 167752 - protein, 13 aa, Borrelia garinii
IGCKNNVGGDDKK

SEQ ID NO: 167753 - protein, 13 aa, Borrelia garinii
GCKNNVGGDDKKD

SEQ ID NO: 167754 - protein, 13 aa, Borrelia garinii
CKNNVGGDDKKDT

SEQ ID NO: 167755 - protein, 13 aa, Borrelia garinii
KNNVGGDDKKDTA

SEQ ID NO: 167756 - protein, 13 aa, Borrelia garinii
NNVGGDDKKDTAA

SEQ ID NO: 167757 - protein, 13 aa, Borrelia garinii
NVGGDDKKDTAAS

SEQ ID NO: 167758 - protein, 13 aa, Borrelia garinii
VGGDDKKDTAASI

SEQ ID NO: 167759 - protein, 13 aa, Borrelia garinii
GGDDKKDTAASIF

SEQ ID NO: 167760 - protein, 13 aa, Borrelia garinii
GDDKKDTAASIFY

SEQ ID NO: 167761 - protein, 13 aa, Borrelia garinii
DDKKDTAASIFYQ

SEQ ID NO: 167762 - protein, 13 aa, Borrelia garinii
DKKDTAASIFYQS

SEQ ID NO: 167763 - protein, 13 aa, Borrelia garinii
KKDTAASIFYQSI

SEQ ID NO: 167764 - protein, 13 aa, Borrelia garinii
KDTAASIFYQSII

SEQ ID NO: 167765 - protein, 13 aa, Borrelia garinii
DTAASIFYQSIIN

SEQ ID NO: 167766 - protein, 13 aa, Borrelia garinii
TAASIFYQSIINL

SEQ ID NO: 167767 - protein, 13 aa, Borrelia garinii
AASIFYQSIINLG

SEQ ID NO: 167768 - protein, 13 aa, Borrelia garinii
ASIFYQSIINLGN

SEQ ID NO: 167769 - protein, 13 aa, Borrelia garinii
SIFYQSIINLGNG

SEQ ID NO: 167770 - protein, 13 aa, Borrelia garinii
IFYQSIINLGNGF

SEQ ID NO: 167771 - protein, 13 aa, Borrelia garinii
FYQSIINLGNGFI

SEQ ID NO: 167772 - protein, 13 aa, Borrelia garinii
YQSIINLGNGFIE

SEQ ID NO: 167773 - protein, 13 aa, Borrelia garinii
QSIINLGNGFIEV

SEQ ID NO: 167774 - protein, 13 aa, Borrelia garinii
SIINLGNGFIEVF

SEQ ID NO: 167775 - protein, 13 aa, Borrelia garinii
IINLGNGFIEVFN

SEQ ID NO: 167776 - protein, 13 aa, Borrelia garinii
INLGNGFIEVFNA

SEQ ID NO: 167777 - protein, 13 aa, Borrelia garinii
NLGNGFIEVFNAF

SEQ ID NO: 167778 - protein, 13 aa, Borrelia garinii
LGNGFIEVFNAFS

SEQ ID NO: 167779 - protein, 13 aa, Borrelia garinii
GNGFIEVFNAFSG

SEQ ID NO: 167780 - protein, 13 aa, Borrelia garinii
NGFIEVFNAFSGL

SEQ ID NO: 167781 - protein, 13 aa, Borrelia garinii
GFIEVFNAFSGLV

SEQ ID NO: 167782 - protein, 13 aa, Borrelia garinii
FIEVFNAFSGLVA

SEQ ID NO: 167783 - protein, 13 aa, Borrelia garinii
IEVFNAFSGLVAD

SEQ ID NO: 167784 - protein, 13 aa, Borrelia garinii
EVFNAFSGLVADA

SEQ ID NO: 167785 - protein, 13 aa, Borrelia garinii
VFNAFSGLVADAF

SEQ ID NO: 167786 - protein, 13 aa, Borrelia garinii
FNAFSGLVADAFS

SEQ ID NO: 167787 - protein, 13 aa, Borrelia garinii
NAFSGLVADAFSK

SEQ ID NO: 167788 - protein, 13 aa, Borrelia garinii
AFSGLVADAFSKA

SEQ ID NO: 167789 - protein, 13 aa, Borrelia garinii
FSGLVADAFSKAD

SEQ ID NO: 167790 - protein, 13 aa, Borrelia garinii
SGLVADAFSKADP

SEQ ID NO: 167791 - protein, 13 aa, Borrelia garinii
GLVADAFSKADPK

SEQ ID NO: 167792 - protein, 13 aa, Borrelia garinii
LVADAFSKADPKK

SEQ ID NO: 167793 - protein, 13 aa, Borrelia garinii
VADAFSKADPKKS

SEQ ID NO: 167794 - protein, 13 aa, Borrelia garinii
ADAFSKADPKKSD

SEQ ID NO: 167795 - protein, 13 aa, Borrelia garinii
DAFSKADPKKSDV

SEQ ID NO: 167796 - protein, 13 aa, Borrelia garinii
AFSKADPKKSDVK

SEQ ID NO: 167797 - protein, 13 aa, Borrelia garinii
FSKADPKKSDVKT

SEQ ID NO: 167798 - protein, 13 aa, Borrelia garinii
SKADPKKSDVKTY

SEQ ID NO: 167799 - protein, 13 aa, Borrelia garinii
KADPKKSDVKTYF

SEQ ID NO: 167800 - protein, 13 aa, Borrelia garinii
ADPKKSDVKTYFD

SEQ ID NO: 167801 - protein, 13 aa, Borrelia garinii
DPKKSDVKTYFDS

SEQ ID NO: 167802 - protein, 13 aa, Borrelia garinii
PKKSDVKTYFDSI

SEQ ID NO: 167803 - protein, 13 aa, Borrelia garinii
KKSDVKTYFDSIT

SEQ ID NO: 167804 - protein, 13 aa, Borrelia garinii
KSDVKTYFDSITK

SEQ ID NO: 167805 - protein, 13 aa, Borrelia garinii
SDVKTYFDSITKT

SEQ ID NO: 167806 - protein, 13 aa, Borrelia garinii
DVKTYFDSITKTL

SEQ ID NO: 167807 - protein, 13 aa, Borrelia garinii
VKTYFDSITKTLK

SEQ ID NO: 167808 - protein, 13 aa, Borrelia garinii
KTYFDSITKTLKD

SEQ ID NO: 167809 - protein, 13 aa, Borrelia garinii
TYFDSITKTLKDT

SEQ ID NO: 167810 - protein, 13 aa, Borrelia garinii
YFDSITKTLKDTK

SEQ ID NO: 167811 - protein, 13 aa, Borrelia garinii
FDSITKTLKDTKT

SEQ ID NO: 167812 - protein, 13 aa, Borrelia garinii
DSITKTLKDTKTK

SEQ ID NO: 167813 - protein, 13 aa, Borrelia garinii
SITKTLKDTKTKL

SEQ ID NO: 167814 - protein, 13 aa, Borrelia garinii
ITKTLKDTKTKLE

SEQ ID NO: 167815 - protein, 13 aa, Borrelia garinii
TKTLKDTKTKLED

SEQ ID NO: 167816 - protein, 13 aa, Borrelia garinii
KTLKDTKTKLEDI

SEQ ID NO: 167817 - protein, 13 aa, Borrelia garinii
TLKDTKTKLEDIS

SEQ ID NO: 167818 - protein, 13 aa, Borrelia garinii
LKDTKTKLEDISK

SEQ ID NO: 167819 - protein, 13 aa, Borrelia garinii
KDTKTKLEDISKE

SEQ ID NO: 167820 - protein, 13 aa, Borrelia garinii
DTKTKLEDISKEK

SEQ ID NO: 167821 - protein, 13 aa, Borrelia garinii
TKTKLEDISKEKT

SEQ ID NO: 167822 - protein, 13 aa, Borrelia garinii
KTKLEDISKEKTG

SEQ ID NO: 167823 - protein, 13 aa, Borrelia garinii
TKLEDISKEKTGG

SEQ ID NO: 167824 - protein, 13 aa, Borrelia garinii
KLEDISKEKTGGE

SEQ ID NO: 167825 - protein, 13 aa, Borrelia garinii
LEDISKEKTGGEK

SEQ ID NO: 167826 - protein, 13 aa, Borrelia garinii
EDISKEKTGGEKT

SEQ ID NO: 167827 - protein, 13 aa, Borrelia garinii
DISKEKTGGEKTP

SEQ ID NO: 167828 - protein, 13 aa, Borrelia garinii
ISKEKTGGEKTPA

SEQ ID NO: 167829 - protein, 13 aa, Borrelia garinii
SKEKTGGEKTPAV

SEQ ID NO: 167830 - protein, 13 aa, Borrelia garinii
KEKTGGEKTPAVE

SEQ ID NO: 167831 - protein, 13 aa, Borrelia garinii
EKTGGEKTPAVEG

SEQ ID NO: 167832 - protein, 13 aa, Borrelia garinii
KTGGEKTPAVEGI

SEQ ID NO: 167833 - protein, 13 aa, Borrelia garinii
TGGEKTPAVEGIA

SEQ ID NO: 167834 - protein, 13 aa, Borrelia garinii
GGEKTPAVEGIAE

SEQ ID NO: 167835 - protein, 13 aa, Borrelia garinii
GEKTPAVEGIAEV

SEQ ID NO: 167836 - protein, 13 aa, Borrelia garinii
EKTPAVEGIAEVV

SEQ ID NO: 167837 - protein, 13 aa, Borrelia garinii
KTPAVEGIAEVVK

SEQ ID NO: 167838 - protein, 13 aa, Borrelia garinii
TPAVEGIAEVVKT

SEQ ID NO: 167839 - protein, 13 aa, Borrelia garinii
PAVEGIAEVVKTV

SEQ ID NO: 167840 - protein, 13 aa, Borrelia garinii
AVEGIAEVVKTVG

SEQ ID NO: 167841 - protein, 13 aa, Borrelia garinii
VEGIAEVVKTVGE

SEQ ID NO: 167842 - protein, 13 aa, Borrelia garinii
EGIAEVVKTVGEW

SEQ ID NO: 167843 - protein, 13 aa, Borrelia garinii
GIAEVVKTVGEWL

SEQ ID NO: 167844 - protein, 13 aa, Borrelia garinii
IAEVVKTVGEWLD

SEQ ID NO: 167845 - protein, 13 aa, Borrelia garinii
AEVVKTVGEWLDG

SEQ ID NO: 167846 - protein, 13 aa, Borrelia garinii
EVVKTVGEWLDGL

SEQ ID NO: 167847 - protein, 13 aa, Borrelia garinii
VVKTVGEWLDGLI

SEQ ID NO: 167848 - protein, 13 aa, Borrelia garinii
VKTVGEWLDGLIK

SEQ ID NO: 167849 - protein, 13 aa, Borrelia garinii
KTVGEWLDGLIKA

SEQ ID NO: 167850 - protein, 13 aa, Borrelia garinii
TVGEWLDGLIKAA

SEQ ID NO: 167851 - protein, 13 aa, Borrelia garinii
VGEWLDGLIKAAE

SEQ ID NO: 167852 - protein, 13 aa, Borrelia garinii
GEWLDGLIKAAEG

SEQ ID NO: 167853 - protein, 13 aa, Borrelia garinii
EWLDGLIKAAEGG

SEQ ID NO: 167854 - protein, 13 aa, Borrelia garinii
WLDGLIKAAEGGG

SEQ ID NO: 167855 - protein, 13 aa, Borrelia garinii
LDGLIKAAEGGGK

SEQ ID NO: 167856 - protein, 13 aa, Borrelia garinii
DGLIKAAEGGGKA

SEQ ID NO: 167857 - protein, 13 aa, Borrelia garinii
GLIKAAEGGGKAA

SEQ ID NO: 167858 - protein, 13 aa, Borrelia garinii
LIKAAEGGGKAAD

SEQ ID NO: 167859 - protein, 13 aa, Borrelia garinii
IKAAEGGGKAADG

SEQ ID NO: 167860 - protein, 13 aa, Borrelia garinii
KAAEGGGKAADGG

SEQ ID NO: 167861 - protein, 13 aa, Borrelia garinii
AAEGGGKAADGGG

SEQ ID NO: 167862 - protein, 13 aa, Borrelia garinii
AEGGGKAADGGGS

SEQ ID NO: 167863 - protein, 13 aa, Borrelia garinii
EGGGKAADGGGSD

SEQ ID NO: 167864 - protein, 13 aa, Borrelia garinii
GGGKAADGGGSDK

SEQ ID NO: 167865 - protein, 13 aa, Borrelia garinii
GGKAADGGGSDKI

SEQ ID NO: 167866 - protein, 13 aa, Borrelia garinii
GKAADGGGSDKIG

SEQ ID NO: 167867 - protein, 13 aa, Borrelia garinii
KAADGGGSDKIGN

SEQ ID NO: 167868 - protein, 13 aa, Borrelia garinii
AADGGGSDKIGNV

SEQ ID NO: 167869 - protein, 13 aa, Borrelia garinii
ADGGGSDKIGNVA

SEQ ID NO: 167870 - protein, 13 aa, Borrelia garinii
DGGGSDKIGNVAA

SEQ ID NO: 167871 - protein, 13 aa, Borrelia garinii
GGGSDKIGNVAAG

SEQ ID NO: 167872 - protein, 13 aa, Borrelia garinii
GGSDKIGNVAAGG

SEQ ID NO: 167873 - protein, 13 aa, Borrelia garinii
GSDKIGNVAAGGG

SEQ ID NO: 167874 - protein, 13 aa, Borrelia garinii
SDKIGNVAAGGGA

SEQ ID NO: 167875 - protein, 13 aa, Borrelia garinii
DKIGNVAAGGGAG

SEQ ID NO: 167876 - protein, 13 aa, Borrelia garinii
KIGNVAAGGGAGA

SEQ ID NO: 167877 - protein, 13 aa, Borrelia garinii
IGNVAAGGGAGAD

SEQ ID NO: 167878 - protein, 13 aa, Borrelia garinii
GNVAAGGGAGADK

SEQ ID NO: 167879 - protein, 13 aa, Borrelia garinii
NVAAGGGAGADKE

SEQ ID NO: 167880 - protein, 13 aa, Borrelia garinii
VAAGGGAGADKES

SEQ ID NO: 167881 - protein, 13 aa, Borrelia garinii
AAGGGAGADKESV

SEQ ID NO: 167882 - protein, 13 aa, Borrelia garinii
AGGGAGADKESVN

SEQ ID NO: 167883 - protein, 13 aa, Borrelia garinii
GGGAGADKESVNG

SEQ ID NO: 167884 - protein, 13 aa, Borrelia garinii
GGAGADKESVNGI

SEQ ID NO: 167885 - protein, 13 aa, Borrelia garinii
GAGADKESVNGIA

SEQ ID NO: 167886 - protein, 13 aa, Borrelia garinii
AGADKESVNGIAG

SEQ ID NO: 167887 - protein, 13 aa, Borrelia garinii
GADKESVNGIAGA

SEQ ID NO: 167888 - protein, 13 aa, Borrelia garinii
ADKESVNGIAGAI

SEQ ID NO: 167889 - protein, 13 aa, Borrelia garinii
DKESVNGIAGAIK

SEQ ID NO: 167890 - protein, 13 aa, Borrelia garinii
KESVNGIAGAIKG

SEQ ID NO: 167891 - protein, 13 aa, Borrelia garinii
ESVNGIAGAIKGI

SEQ ID NO: 167892 - protein, 13 aa, Borrelia garinii
SVNGIAGAIKGIV

SEQ ID NO: 167893 - protein, 13 aa, Borrelia garinii
VNGIAGAIKGIVE

SEQ ID NO: 167894 - protein, 13 aa, Borrelia garinii
NGIAGAIKGIVEA

SEQ ID NO: 167895 - protein, 13 aa, Borrelia garinii
GIAGAIKGIVEAA

SEQ ID NO: 167896 - protein, 13 aa, Borrelia garinii
IAGAIKGIVEAAK

SEQ ID NO: 167897 - protein, 13 aa, Borrelia garinii
AGAIKGIVEAAKK

SEQ ID NO: 167898 - protein, 13 aa, Borrelia garinii
GAIKGIVEAAKKV

SEQ ID NO: 167899 - protein, 13 aa, Borrelia garinii
AIKGIVEAAKKVE

SEQ ID NO: 167900 - protein, 13 aa, Borrelia garinii
IKGIVEAAKKVEG

SEQ ID NO: 167901 - protein, 13 aa, Borrelia garinii
KGIVEAAKKVEGV

SEQ ID NO: 167902 - protein, 13 aa, Borrelia garinii
GIVEAAKKVEGVK

SEQ ID NO: 167903 - protein, 13 aa, Borrelia garinii
IVEAAKKVEGVKF

SEQ ID NO: 167904 - protein, 13 aa, Borrelia garinii
VEAAKKVEGVKFA

SEQ ID NO: 167905 - protein, 13 aa, Borrelia garinii
EAAKKVEGVKFAP

SEQ ID NO: 167906 - protein, 13 aa, Borrelia garinii
AAKKVEGVKFAPK

SEQ ID NO: 167907 - protein, 13 aa, Borrelia garinii
AKKVEGVKFAPKA

SEQ ID NO: 167908 - protein, 13 aa, Borrelia garinii
KKVEGVKFAPKAA

SEQ ID NO: 167909 - protein, 13 aa, Borrelia garinii
KVEGVKFAPKAAA

SEQ ID NO: 167910 - protein, 13 aa, Borrelia garinii
VEGVKFAPKAAAD

SEQ ID NO: 167911 - protein, 13 aa, Borrelia garinii
EGVKFAPKAAADA

SEQ ID NO: 167912 - protein, 13 aa, Borrelia garinii
GVKFAPKAAADAA

SEQ ID NO: 167913 - protein, 13 aa, Borrelia garinii
VKFAPKAAADAAA

SEQ ID NO: 167914 - protein, 13 aa, Borrelia garinii
KFAPKAAADAAAA

SEQ ID NO: 167915 - protein, 13 aa, Borrelia garinii
FAPKAAADAAAAD

SEQ ID NO: 167916 - protein, 13 aa, Borrelia garinii
APKAAADAAAADG

SEQ ID NO: 167917 - protein, 13 aa, Borrelia garinii
PKAAADAAAADGN

SEQ ID NO: 167918 - protein, 13 aa, Borrelia garinii
KAAADAAAADGNK

SEQ ID NO: 167919 - protein, 13 aa, Borrelia garinii
AAADAAAADGNKK

SEQ ID NO: 167920 - protein, 13 aa, Borrelia garinii
AADAAAADGNKKA

SEQ ID NO: 167921 - protein, 13 aa, Borrelia garinii
ADAAAADGNKKAG

SEQ ID NO: 167922 - protein, 13 aa, Borrelia garinii
DAAAADGNKKAGK

SEQ ID NO: 167923 - protein, 13 aa, Borrelia garinii
AAAADGNKKAGKL

SEQ ID NO: 167924 - protein, 13 aa, Borrelia garinii
AAADGNKKAGKLF

SEQ ID NO: 167925 - protein, 13 aa, Borrelia garinii
AADGNKKAGKLFG

SEQ ID NO: 167926 - protein, 13 aa, Borrelia garinii
ADGNKKAGKLFGT

SEQ ID NO: 167927 - protein, 13 aa, Borrelia garinii
DGNKKAGKLFGTA

SEQ ID NO: 167928 - protein, 13 aa, Borrelia garinii
GNKKAGKLFGTAA

SEQ ID NO: 167929 - protein, 13 aa, Borrelia garinii
NKKAGKLFGTAAG

SEQ ID NO: 167930 - protein, 13 aa, Borrelia garinii
KKAGKLFGTAAGA

SEQ ID NO: 167931 - protein, 13 aa, Borrelia garinii
KAGKLFGTAAGAD

SEQ ID NO: 167932 - protein, 13 aa, Borrelia garinii
AGKLFGTAAGADA

SEQ ID NO: 167933 - protein, 13 aa, Borrelia garinii
GKLFGTAAGADAG

SEQ ID NO: 167934 - protein, 13 aa, Borrelia garinii
KLFGTAAGADAGD

SEQ ID NO: 167935 - protein, 13 aa, Borrelia garinii
LFGTAAGADAGDV

SEQ ID NO: 167936 - protein, 13 aa, Borrelia garinii
FGTAAGADAGDVK

SEQ ID NO: 167937 - protein, 13 aa, Borrelia garinii
GTAAGADAGDVKD

SEQ ID NO: 167938 - protein, 13 aa, Borrelia garinii
TAAGADAGDVKDA

SEQ ID NO: 167939 - protein, 13 aa, Borrelia garinii
AAGADAGDVKDAA

SEQ ID NO: 167940 - protein, 13 aa, Borrelia garinii
AGADAGDVKDAAA

SEQ ID NO: 167941 - protein, 13 aa, Borrelia garinii
GADAGDVKDAAAA

SEQ ID NO: 167942 - protein, 13 aa, Borrelia garinii
ADAGDVKDAAAAV

SEQ ID NO: 167943 - protein, 13 aa, Borrelia garinii
DAGDVKDAAAAVG

SEQ ID NO: 167944 - protein, 13 aa, Borrelia garinii
AGDVKDAAAAVGA

SEQ ID NO: 167945 - protein, 13 aa, Borrelia garinii
GDVKDAAAAVGAV

SEQ ID NO: 167946 - protein, 13 aa, Borrelia garinii
DVKDAAAAVGAVS

SEQ ID NO: 167947 - protein, 13 aa, Borrelia garinii
VKDAAAAVGAVSG

SEQ ID NO: 167948 - protein, 13 aa, Borrelia garinii
KDAAAAVGAVSGE

SEQ ID NO: 167949 - protein, 13 aa, Borrelia garinii
DAAAAVGAVSGEQ

SEQ ID NO: 167950 - protein, 13 aa, Borrelia garinii
AAAAVGAVSGEQI

SEQ ID NO: 167951 - protein, 13 aa, Borrelia garinii
AAAVGAVSGEQIL

SEQ ID NO: 167952 - protein, 13 aa, Borrelia garinii
AAVGAVSGEQILN

SEQ ID NO: 167953 - protein, 13 aa, Borrelia garinii
AVGAVSGEQILNA

SEQ ID NO: 167954 - protein, 13 aa, Borrelia garinii
VGAVSGEQILNAI

SEQ ID NO: 167955 - protein, 13 aa, Borrelia garinii
GAVSGEQILNAIV

SEQ ID NO: 167956 - protein, 13 aa, Borrelia garinii
AVSGEQILNAIVT

SEQ ID NO: 167957 - protein, 13 aa, Borrelia garinii
VSGEQILNAIVTA

SEQ ID NO: 167958 - protein, 13 aa, Borrelia garinii
SGEQILNAIVTAA

SEQ ID NO: 167959 - protein, 13 aa, Borrelia garinii
GEQILNAIVTAAG

SEQ ID NO: 167960 - protein, 13 aa, Borrelia garinii
EQILNAIVTAAGQ

SEQ ID NO: 167961 - protein, 13 aa, Borrelia garinii
QILNAIVTAAGQA

SEQ ID NO: 167962 - protein, 13 aa, Borrelia garinii
ILNAIVTAAGQAG

SEQ ID NO: 167963 - protein, 13 aa, Borrelia garinii
LNAIVTAAGQAGQ

SEQ ID NO: 167964 - protein, 13 aa, Borrelia garinii
NAIVTAAGQAGQA

SEQ ID NO: 167965 - protein, 13 aa, Borrelia garinii
AIVTAAGQAGQAG

SEQ ID NO: 167966 - protein, 13 aa, Borrelia garinii
IVTAAGQAGQAGK

SEQ ID NO: 167967 - protein, 13 aa, Borrelia garinii
VTAAGQAGQAGKK

SEQ ID NO: 167968 - protein, 13 aa, Borrelia garinii
TAAGQAGQAGKKA

SEQ ID NO: 167969 - protein, 13 aa, Borrelia garinii
AAGQAGQAGKKAD

SEQ ID NO: 167970 - protein, 13 aa, Borrelia garinii
AGQAGQAGKKADE

SEQ ID NO: 167971 - protein, 13 aa, Borrelia garinii
GQAGQAGKKADEA

SEQ ID NO: 167972 - protein, 13 aa, Borrelia garinii
QAGQAGKKADEAK

SEQ ID NO: 167973 - protein, 13 aa, Borrelia garinii
AGQAGKKADEAKN

SEQ ID NO: 167974 - protein, 13 aa, Borrelia garinii
GQAGKKADEAKNA

SEQ ID NO: 167975 - protein, 13 aa, Borrelia garinii
QAGKKADEAKNAI

SEQ ID NO: 167976 - protein, 13 aa, Borrelia garinii
AGKKADEAKNAIE

SEQ ID NO: 167977 - protein, 13 aa, Borrelia garinii
GKKADEAKNAIEA

SEQ ID NO: 167978 - protein, 13 aa, Borrelia garinii
KKADEAKNAIEAA

SEQ ID NO: 167979 - protein, 13 aa, Borrelia garinii
KADEAKNAIEAAI

SEQ ID NO: 167980 - protein, 13 aa, Borrelia garinii
ADEAKNAIEAAIG

SEQ ID NO: 167981 - protein, 13 aa, Borrelia garinii
DEAKNAIEAAIGA

SEQ ID NO: 167982 - protein, 13 aa, Borrelia garinii
EAKNAIEAAIGAA

SEQ ID NO: 167983 - protein, 13 aa, Borrelia garinii
AKNAIEAAIGAAG

SEQ ID NO: 167984 - protein, 13 aa, Borrelia garinii
KNAIEAAIGAAGD

SEQ ID NO: 167985 - protein, 13 aa, Borrelia garinii
NAIEAAIGAAGDA

SEQ ID NO: 167986 - protein, 13 aa, Borrelia garinii
AIEAAIGAAGDAD

SEQ ID NO: 167987 - protein, 13 aa, Borrelia garinii
IEAAIGAAGDADF

SEQ ID NO: 167988 - protein, 13 aa, Borrelia garinii
EAAIGAAGDADFG

SEQ ID NO: 167989 - protein, 13 aa, Borrelia garinii
AAIGAAGDADFGD

SEQ ID NO: 167990 - protein, 13 aa, Borrelia garinii
AIGAAGDADFGDD

SEQ ID NO: 167991 - protein, 13 aa, Borrelia garinii
IGAAGDADFGDDI

SEQ ID NO: 167992 - protein, 13 aa, Borrelia garinii
GAAGDADFGDDIK

SEQ ID NO: 167993 - protein, 13 aa, Borrelia garinii
AAGDADFGDDIKK

SEQ ID NO: 167994 - protein, 13 aa, Borrelia garinii
AGDADFGDDIKKK

SEQ ID NO: 167995 - protein, 13 aa, Borrelia garinii
GDADFGDDIKKKN

SEQ ID NO: 167996 - protein, 13 aa, Borrelia garinii
DADFGDDIKKKND

SEQ ID NO: 167997 - protein, 13 aa, Borrelia garinii
ADFGDDIKKKNDQ

SEQ ID NO: 167998 - protein, 13 aa, Borrelia garinii
DFGDDIKKKNDQI

SEQ ID NO: 167999 - protein, 13 aa, Borrelia garinii
FGDDIKKKNDQIA

SEQ ID NO: 168000 - protein, 13 aa, Borrelia garinii
GDDIKKKNDQIAA

SEQ ID NO: 168001 - protein, 13 aa, Borrelia garinii
DDIKKKNDQIAAA

SEQ ID NO: 168002 - protein, 13 aa, Borrelia garinii
DIKKKNDQIAAAL

SEQ ID NO: 168003 - protein, 13 aa, Borrelia garinii
IKKKNDQIAAALV

SEQ ID NO: 168004 - protein, 13 aa, Borrelia garinii
KKKNDQIAAALVL

SEQ ID NO: 168005 - protein, 13 aa, Borrelia garinii
KKNDQIAAALVLR

SEQ ID NO: 168006 - protein, 13 aa, Borrelia garinii
KNDQIAAALVLRG

SEQ ID NO: 168007 - protein, 13 aa, Borrelia garinii
NDQIAAALVLRGV

SEQ ID NO: 168008 - protein, 13 aa, Borrelia garinii
DQIAAALVLRGVA

SEQ ID NO: 168009 - protein, 13 aa, Borrelia garinii
QIAAALVLRGVAK

SEQ ID NO: 168010 - protein, 13 aa, Borrelia garinii
IAAALVLRGVAKD

SEQ ID NO: 168011 - protein, 13 aa, Borrelia garinii
AAALVLRGVAKDG

SEQ ID NO: 168012 - protein, 13 aa, Borrelia garinii
AALVLRGVAKDGK

SEQ ID NO: 168013 - protein, 13 aa, Borrelia garinii
ALVLRGVAKDGKF

SEQ ID NO: 168014 - protein, 13 aa, Borrelia garinii
LVLRGVAKDGKFA

SEQ ID NO: 168015 - protein, 13 aa, Borrelia garinii
VLRGVAKDGKFAG

SEQ ID NO: 168016 - protein, 13 aa, Borrelia garinii
LRGVAKDGKFAGA

SEQ ID NO: 168017 - protein, 14 aa, Borrelia garinii
MKKISSAIFIVAFL

SEQ ID NO: 168018 - protein, 14 aa, Borrelia garinii
KKISSAIFIVAFLA

SEQ ID NO: 168019 - protein, 14 aa, Borrelia garinii
KISSAIFIVAFLAL

SEQ ID NO: 168020 - protein, 14 aa, Borrelia garinii
ISSAIFIVAFLALI

SEQ ID NO: 168021 - protein, 14 aa, Borrelia garinii
SSAIFIVAFLALIG

SEQ ID NO: 168022 - protein, 14 aa, Borrelia garinii
SAIFIVAFLALIGC

SEQ ID NO: 168023 - protein, 14 aa, Borrelia garinii
AIFIVAFLALIGCK

SEQ ID NO: 168024 - protein, 14 aa, Borrelia garinii
IFIVAFLALIGCKN

SEQ ID NO: 168025 - protein, 14 aa, Borrelia garinii
FIVAFLALIGCKNN

SEQ ID NO: 168026 - protein, 14 aa, Borrelia garinii
IVAFLALIGCKNNV

SEQ ID NO: 168027 - protein, 14 aa, Borrelia garinii
VAFLALIGCKNNVG

SEQ ID NO: 168028 - protein, 14 aa, Borrelia garinii
AFLALIGCKNNVGG

SEQ ID NO: 168029 - protein, 14 aa, Borrelia garinii
FLALIGCKNNVGGD

SEQ ID NO: 168030 - protein, 14 aa, Borrelia garinii
LALIGCKNNVGGDD

SEQ ID NO: 168031 - protein, 14 aa, Borrelia garinii
ALIGCKNNVGGDDK

SEQ ID NO: 168032 - protein, 14 aa, Borrelia garinii
LIGCKNNVGGDDKK

SEQ ID NO: 168033 - protein, 14 aa, Borrelia garinii
IGCKNNVGGDDKKD

SEQ ID NO: 168034 - protein, 14 aa, Borrelia garinii
GCKNNVGGDDKKDT

SEQ ID NO: 168035 - protein, 14 aa, Borrelia garinii
CKNNVGGDDKKDTA

SEQ ID NO: 168036 - protein, 14 aa, Borrelia garinii
KNNVGGDDKKDTAA

SEQ ID NO: 168037 - protein, 14 aa, Borrelia garinii
NNVGGDDKKDTAAS

SEQ ID NO: 168038 - protein, 14 aa, Borrelia garinii
NVGGDDKKDTAASI

SEQ ID NO: 168039 - protein, 14 aa, Borrelia garinii
VGGDDKKDTAASIF

SEQ ID NO: 168040 - protein, 14 aa, Borrelia garinii
GGDDKKDTAASIFY

SEQ ID NO: 168041 - protein, 14 aa, Borrelia garinii
GDDKKDTAASIFYQ

SEQ ID NO: 168042 - protein, 14 aa, Borrelia garinii
DDKKDTAASIFYQS

SEQ ID NO: 168043 - protein, 14 aa, Borrelia garinii
DKKDTAASIFYQSI

SEQ ID NO: 168044 - protein, 14 aa, Borrelia garinii
KKDTAASIFYQSII

SEQ ID NO: 168045 - protein, 14 aa, Borrelia garinii
KDTAASIFYQSIIN

SEQ ID NO: 168046 - protein, 14 aa, Borrelia garinii
DTAASIFYQSIINL

SEQ ID NO: 168047 - protein, 14 aa, Borrelia garinii
TAASIFYQSIINLG

SEQ ID NO: 168048 - protein, 14 aa, Borrelia garinii
AASIFYQSIINLGN

SEQ ID NO: 168049 - protein, 14 aa, Borrelia garinii
ASIFYQSIINLGNG

SEQ ID NO: 168050 - protein, 14 aa, Borrelia garinii
SIFYQSIINLGNGF

SEQ ID NO: 168051 - protein, 14 aa, Borrelia garinii
IFYQSIINLGNGFI

SEQ ID NO: 168052 - protein, 14 aa, Borrelia garinii
FYQSIINLGNGFIE

SEQ ID NO: 168053 - protein, 14 aa, Borrelia garinii
YQSIINLGNGFIEV

SEQ ID NO: 168054 - protein, 14 aa, Borrelia garinii
QSIINLGNGFIEVF

SEQ ID NO: 168055 - protein, 14 aa, Borrelia garinii
SIINLGNGFIEVFN

SEQ ID NO: 168056 - protein, 14 aa, Borrelia garinii
IINLGNGFIEVFNA

SEQ ID NO: 168057 - protein, 14 aa, Borrelia garinii
INLGNGFIEVFNAF

SEQ ID NO: 168058 - protein, 14 aa, Borrelia garinii
NLGNGFIEVFNAFS

SEQ ID NO: 168059 - protein, 14 aa, Borrelia garinii
LGNGFIEVFNAFSG

SEQ ID NO: 168060 - protein, 14 aa, Borrelia garinii
GNGFIEVFNAFSGL

SEQ ID NO: 168061 - protein, 14 aa, Borrelia garinii
NGFIEVFNAFSGLV

SEQ ID NO: 168062 - protein, 14 aa, Borrelia garinii
GFIEVFNAFSGLVA

SEQ ID NO: 168063 - protein, 14 aa, Borrelia garinii
FIEVFNAFSGLVAD

SEQ ID NO: 168064 - protein, 14 aa, Borrelia garinii
IEVFNAFSGLVADA

SEQ ID NO: 168065 - protein, 14 aa, Borrelia garinii
EVFNAFSGLVADAF

SEQ ID NO: 168066 - protein, 14 aa, Borrelia garinii
VFNAFSGLVADAFS

SEQ ID NO: 168067 - protein, 14 aa, Borrelia garinii
FNAFSGLVADAFSK

SEQ ID NO: 168068 - protein, 14 aa, Borrelia garinii
NAFSGLVADAFSKA

SEQ ID NO: 168069 - protein, 14 aa, Borrelia garinii
AFSGLVADAFSKAD

SEQ ID NO: 168070 - protein, 14 aa, Borrelia garinii
FSGLVADAFSKADP

SEQ ID NO: 168071 - protein, 14 aa, Borrelia garinii
SGLVADAFSKADPK

SEQ ID NO: 168072 - protein, 14 aa, Borrelia garinii
GLVADAFSKADPKK

SEQ ID NO: 168073 - protein, 14 aa, Borrelia garinii
LVADAFSKADPKKS

SEQ ID NO: 168074 - protein, 14 aa, Borrelia garinii
VADAFSKADPKKSD

SEQ ID NO: 168075 - protein, 14 aa, Borrelia garinii
ADAFSKADPKKSDV

SEQ ID NO: 168076 - protein, 14 aa, Borrelia garinii
DAFSKADPKKSDVK

SEQ ID NO: 168077 - protein, 14 aa, Borrelia garinii
AFSKADPKKSDVKT

SEQ ID NO: 168078 - protein, 14 aa, Borrelia garinii
FSKADPKKSDVKTY

SEQ ID NO: 168079 - protein, 14 aa, Borrelia garinii
SKADPKKSDVKTYF

SEQ ID NO: 168080 - protein, 14 aa, Borrelia garinii
KADPKKSDVKTYFD

SEQ ID NO: 168081 - protein, 14 aa, Borrelia garinii
ADPKKSDVKTYFDS

SEQ ID NO: 168082 - protein, 14 aa, Borrelia garinii
DPKKSDVKTYFDSI

SEQ ID NO: 168083 - protein, 14 aa, Borrelia garinii
PKKSDVKTYFDSIT

SEQ ID NO: 168084 - protein, 14 aa, Borrelia garinii
KKSDVKTYFDSITK

SEQ ID NO: 168085 - protein, 14 aa, Borrelia garinii
KSDVKTYFDSITKT

SEQ ID NO: 168086 - protein, 14 aa, Borrelia garinii
SDVKTYFDSITKTL

SEQ ID NO: 168087 - protein, 14 aa, Borrelia garinii
DVKTYFDSITKTLK

SEQ ID NO: 168088 - protein, 14 aa, Borrelia garinii
VKTYFDSITKTLKD

SEQ ID NO: 168089 - protein, 14 aa, Borrelia garinii
KTYFDSITKTLKDT

SEQ ID NO: 168090 - protein, 14 aa, Borrelia garinii
TYFDSITKTLKDTK

SEQ ID NO: 168091 - protein, 14 aa, Borrelia garinii
YFDSITKTLKDTKT

SEQ ID NO: 168092 - protein, 14 aa, Borrelia garinii
FDSITKTLKDTKTK

SEQ ID NO: 168093 - protein, 14 aa, Borrelia garinii
DSITKTLKDTKTKL

SEQ ID NO: 168094 - protein, 14 aa, Borrelia garinii
SITKTLKDTKTKLE

SEQ ID NO: 168095 - protein, 14 aa, Borrelia garinii
ITKTLKDTKTKLED

SEQ ID NO: 168096 - protein, 14 aa, Borrelia garinii
TKTLKDTKTKLEDI

SEQ ID NO: 168097 - protein, 14 aa, Borrelia garinii
KTLKDTKTKLEDIS

SEQ ID NO: 168098 - protein, 14 aa, Borrelia garinii
TLKDTKTKLEDISK

SEQ ID NO: 168099 - protein, 14 aa, Borrelia garinii
LKDTKTKLEDISKE

SEQ ID NO: 168100 - protein, 14 aa, Borrelia garinii
KDTKTKLEDISKEK

SEQ ID NO: 168101 - protein, 14 aa, Borrelia garinii
DTKTKLEDISKEKT

SEQ ID NO: 168102 - protein, 14 aa, Borrelia garinii
TKTKLEDISKEKTG

SEQ ID NO: 168103 - protein, 14 aa, Borrelia garinii
KTKLEDISKEKTGG

SEQ ID NO: 168104 - protein, 14 aa, Borrelia garinii
TKLEDISKEKTGGE

SEQ ID NO: 168105 - protein, 14 aa, Borrelia garinii
KLEDISKEKTGGEK

SEQ ID NO: 168106 - protein, 14 aa, Borrelia garinii
LEDISKEKTGGEKT

SEQ ID NO: 168107 - protein, 14 aa, Borrelia garinii
EDISKEKTGGEKTP

SEQ ID NO: 168108 - protein, 14 aa, Borrelia garinii
DISKEKTGGEKTPA

SEQ ID NO: 168109 - protein, 14 aa, Borrelia garinii
ISKEKTGGEKTPAV

SEQ ID NO: 168110 - protein, 14 aa, Borrelia garinii
SKEKTGGEKTPAVE

SEQ ID NO: 168111 - protein, 14 aa, Borrelia garinii
KEKTGGEKTPAVEG

SEQ ID NO: 168112 - protein, 14 aa, Borrelia garinii
EKTGGEKTPAVEGI

SEQ ID NO: 168113 - protein, 14 aa, Borrelia garinii
KTGGEKTPAVEGIA

SEQ ID NO: 168114 - protein, 14 aa, Borrelia garinii
TGGEKTPAVEGIAE

SEQ ID NO: 168115 - protein, 14 aa, Borrelia garinii
GGEKTPAVEGIAEV

SEQ ID NO: 168116 - protein, 14 aa, Borrelia garinii
GEKTPAVEGIAEVV

SEQ ID NO: 168117 - protein, 14 aa, Borrelia garinii
EKTPAVEGIAEVVK

SEQ ID NO: 168118 - protein, 14 aa, Borrelia garinii
KTPAVEGIAEVVKT

SEQ ID NO: 168119 - protein, 14 aa, Borrelia garinii
TPAVEGIAEVVKTV

SEQ ID NO: 168120 - protein, 14 aa, Borrelia garinii
PAVEGIAEVVKTVG

SEQ ID NO: 168121 - protein, 14 aa, Borrelia garinii
AVEGIAEVVKTVGE

SEQ ID NO: 168122 - protein, 14 aa, Borrelia garinii
VEGIAEVVKTVGEW

SEQ ID NO: 168123 - protein, 14 aa, Borrelia garinii
EGIAEVVKTVGEWL

SEQ ID NO: 168124 - protein, 14 aa, Borrelia garinii
GIAEVVKTVGEWLD

SEQ ID NO: 168125 - protein, 14 aa, Borrelia garinii
IAEVVKTVGEWLDG

SEQ ID NO: 168126 - protein, 14 aa, Borrelia garinii
AEVVKTVGEWLDGL

SEQ ID NO: 168127 - protein, 14 aa, Borrelia garinii
EVVKTVGEWLDGLI

SEQ ID NO: 168128 - protein, 14 aa, Borrelia garinii
VVKTVGEWLDGLIK

SEQ ID NO: 168129 - protein, 14 aa, Borrelia garinii
VKTVGEWLDGLIKA

SEQ ID NO: 168130 - protein, 14 aa, Borrelia garinii
KTVGEWLDGLIKAA

SEQ ID NO: 168131 - protein, 14 aa, Borrelia garinii
TVGEWLDGLIKAAE

SEQ ID NO: 168132 - protein, 14 aa, Borrelia garinii
VGEWLDGLIKAAEG

SEQ ID NO: 168133 - protein, 14 aa, Borrelia garinii
GEWLDGLIKAAEGG

SEQ ID NO: 168134 - protein, 14 aa, Borrelia garinii
EWLDGLIKAAEGGG

SEQ ID NO: 168135 - protein, 14 aa, Borrelia garinii
WLDGLIKAAEGGGK

SEQ ID NO: 168136 - protein, 14 aa, Borrelia garinii
LDGLIKAAEGGGKA

SEQ ID NO: 168137 - protein, 14 aa, Borrelia garinii
DGLIKAAEGGGKAA

SEQ ID NO: 168138 - protein, 14 aa, Borrelia garinii
GLIKAAEGGGKAAD

SEQ ID NO: 168139 - protein, 14 aa, Borrelia garinii
LIKAAEGGGKAADG

SEQ ID NO: 168140 - protein, 14 aa, Borrelia garinii
IKAAEGGGKAADGG

SEQ ID NO: 168141 - protein, 14 aa, Borrelia garinii
KAAEGGGKAADGGG

SEQ ID NO: 168142 - protein, 14 aa, Borrelia garinii
AAEGGGKAADGGGS

SEQ ID NO: 168143 - protein, 14 aa, Borrelia garinii
AEGGGKAADGGGSD

SEQ ID NO: 168144 - protein, 14 aa, Borrelia garinii
EGGGKAADGGGSDK

SEQ ID NO: 168145 - protein, 14 aa, Borrelia garinii
GGGKAADGGGSDKI

SEQ ID NO: 168146 - protein, 14 aa, Borrelia garinii
GGKAADGGGSDKIG

SEQ ID NO: 168147 - protein, 14 aa, Borrelia garinii
GKAADGGGSDKIGN

SEQ ID NO: 168148 - protein, 14 aa, Borrelia garinii
KAADGGGSDKIGNV

SEQ ID NO: 168149 - protein, 14 aa, Borrelia garinii
AADGGGSDKIGNVA

SEQ ID NO: 168150 - protein, 14 aa, Borrelia garinii
ADGGGSDKIGNVAA

SEQ ID NO: 168151 - protein, 14 aa, Borrelia garinii
DGGGSDKIGNVAAG

SEQ ID NO: 168152 - protein, 14 aa, Borrelia garinii
GGGSDKIGNVAAGG

SEQ ID NO: 168153 - protein, 14 aa, Borrelia garinii
GGSDKIGNVAAGGG

SEQ ID NO: 168154 - protein, 14 aa, Borrelia garinii
GSDKIGNVAAGGGA

SEQ ID NO: 168155 - protein, 14 aa, Borrelia garinii
SDKIGNVAAGGGAG

SEQ ID NO: 168156 - protein, 14 aa, Borrelia garinii
DKIGNVAAGGGAGA

SEQ ID NO: 168157 - protein, 14 aa, Borrelia garinii
KIGNVAAGGGAGAD

SEQ ID NO: 168158 - protein, 14 aa, Borrelia garinii
IGNVAAGGGAGADK

SEQ ID NO: 168159 - protein, 14 aa, Borrelia garinii
GNVAAGGGAGADKE

SEQ ID NO: 168160 - protein, 14 aa, Borrelia garinii
NVAAGGGAGADKES

SEQ ID NO: 168161 - protein, 14 aa, Borrelia garinii
VAAGGGAGADKESV

SEQ ID NO: 168162 - protein, 14 aa, Borrelia garinii
AAGGGAGADKESVN

SEQ ID NO: 168163 - protein, 14 aa, Borrelia garinii
AGGGAGADKESVNG

SEQ ID NO: 168164 - protein, 14 aa, Borrelia garinii
GGGAGADKESVNGI

SEQ ID NO: 168165 - protein, 14 aa, Borrelia garinii
GGAGADKESVNGIA

SEQ ID NO: 168166 - protein, 14 aa, Borrelia garinii
GAGADKESVNGIAG

SEQ ID NO: 168167 - protein, 14 aa, Borrelia garinii
AGADKESVNGIAGA

SEQ ID NO: 168168 - protein, 14 aa, Borrelia garinii
GADKESVNGIAGAI

SEQ ID NO: 168169 - protein, 14 aa, Borrelia garinii
ADKESVNGIAGAIK

SEQ ID NO: 168170 - protein, 14 aa, Borrelia garinii
DKESVNGIAGAIKG

SEQ ID NO: 168171 - protein, 14 aa, Borrelia garinii
KESVNGIAGAIKGI

SEQ ID NO: 168172 - protein, 14 aa, Borrelia garinii
ESVNGIAGAIKGIV

SEQ ID NO: 168173 - protein, 14 aa, Borrelia garinii
SVNGIAGAIKGIVE

SEQ ID NO: 168174 - protein, 14 aa, Borrelia garinii
VNGIAGAIKGIVEA

SEQ ID NO: 168175 - protein, 14 aa, Borrelia garinii
NGIAGAIKGIVEAA

SEQ ID NO: 168176 - protein, 14 aa, Borrelia garinii
GIAGAIKGIVEAAK

SEQ ID NO: 168177 - protein, 14 aa, Borrelia garinii
IAGAIKGIVEAAKK

SEQ ID NO: 168178 - protein, 14 aa, Borrelia garinii
AGAIKGIVEAAKKV

SEQ ID NO: 168179 - protein, 14 aa, Borrelia garinii
GAIKGIVEAAKKVE

SEQ ID NO: 168180 - protein, 14 aa, Borrelia garinii
AIKGIVEAAKKVEG

SEQ ID NO: 168181 - protein, 14 aa, Borrelia garinii
IKGIVEAAKKVEGV

SEQ ID NO: 168182 - protein, 14 aa, Borrelia garinii
KGIVEAAKKVEGVK

SEQ ID NO: 168183 - protein, 14 aa, Borrelia garinii
GIVEAAKKVEGVKF

SEQ ID NO: 168184 - protein, 14 aa, Borrelia garinii
IVEAAKKVEGVKFA

SEQ ID NO: 168185 - protein, 14 aa, Borrelia garinii
VEAAKKVEGVKFAP

SEQ ID NO: 168186 - protein, 14 aa, Borrelia garinii
EAAKKVEGVKFAPK

SEQ ID NO: 168187 - protein, 14 aa, Borrelia garinii
AAKKVEGVKFAPKA

SEQ ID NO: 168188 - protein, 14 aa, Borrelia garinii
AKKVEGVKFAPKAA

SEQ ID NO: 168189 - protein, 14 aa, Borrelia garinii
KKVEGVKFAPKAAA

SEQ ID NO: 168190 - protein, 14 aa, Borrelia garinii
KVEGVKFAPKAAAD

SEQ ID NO: 168191 - protein, 14 aa, Borrelia garinii
VEGVKFAPKAAADA

SEQ ID NO: 168192 - protein, 14 aa, Borrelia garinii
EGVKFAPKAAADAA

SEQ ID NO: 168193 - protein, 14 aa, Borrelia garinii
GVKFAPKAAADAAA

SEQ ID NO: 168194 - protein, 14 aa, Borrelia garinii
VKFAPKAAADAAAA

SEQ ID NO: 168195 - protein, 14 aa, Borrelia garinii
KFAPKAAADAAAAD

SEQ ID NO: 168196 - protein, 14 aa, Borrelia garinii
FAPKAAADAAAADG

SEQ ID NO: 168197 - protein, 14 aa, Borrelia garinii
APKAAADAAAADGN

SEQ ID NO: 168198 - protein, 14 aa, Borrelia garinii
PKAAADAAAADGNK

SEQ ID NO: 168199 - protein, 14 aa, Borrelia garinii
KAAADAAAADGNKK

SEQ ID NO: 168200 - protein, 14 aa, Borrelia garinii
AAADAAAADGNKKA

SEQ ID NO: 168201 - protein, 14 aa, Borrelia garinii
AADAAAADGNKKAG

SEQ ID NO: 168202 - protein, 14 aa, Borrelia garinii
ADAAAADGNKKAGK

SEQ ID NO: 168203 - protein, 14 aa, Borrelia garinii
DAAAADGNKKAGKL

SEQ ID NO: 168204 - protein, 14 aa, Borrelia garinii
AAAADGNKKAGKLF

SEQ ID NO: 168205 - protein, 14 aa, Borrelia garinii
AAADGNKKAGKLFG

SEQ ID NO: 168206 - protein, 14 aa, Borrelia garinii
AADGNKKAGKLFGT

SEQ ID NO: 168207 - protein, 14 aa, Borrelia garinii
ADGNKKAGKLFGTA

SEQ ID NO: 168208 - protein, 14 aa, Borrelia garinii
DGNKKAGKLFGTAA

SEQ ID NO: 168209 - protein, 14 aa, Borrelia garinii
GNKKAGKLFGTAAG

SEQ ID NO: 168210 - protein, 14 aa, Borrelia garinii
NKKAGKLFGTAAGA

SEQ ID NO: 168211 - protein, 14 aa, Borrelia garinii
KKAGKLFGTAAGAD

SEQ ID NO: 168212 - protein, 14 aa, Borrelia garinii
KAGKLFGTAAGADA

SEQ ID NO: 168213 - protein, 14 aa, Borrelia garinii
AGKLFGTAAGADAG

SEQ ID NO: 168214 - protein, 14 aa, Borrelia garinii
GKLFGTAAGADAGD

SEQ ID NO: 168215 - protein, 14 aa, Borrelia garinii
KLFGTAAGADAGDV

SEQ ID NO: 168216 - protein, 14 aa, Borrelia garinii
LFGTAAGADAGDVK

SEQ ID NO: 168217 - protein, 14 aa, Borrelia garinii
FGTAAGADAGDVKD

SEQ ID NO: 168218 - protein, 14 aa, Borrelia garinii
GTAAGADAGDVKDA

SEQ ID NO: 168219 - protein, 14 aa, Borrelia garinii
TAAGADAGDVKDAA

SEQ ID NO: 168220 - protein, 14 aa, Borrelia garinii
AAGADAGDVKDAAA

SEQ ID NO: 168221 - protein, 14 aa, Borrelia garinii
AGADAGDVKDAAAA

SEQ ID NO: 168222 - protein, 14 aa, Borrelia garinii
GADAGDVKDAAAAV

SEQ ID NO: 168223 - protein, 14 aa, Borrelia garinii
ADAGDVKDAAAAVG

SEQ ID NO: 168224 - protein, 14 aa, Borrelia garinii
DAGDVKDAAAAVGA

SEQ ID NO: 168225 - protein, 14 aa, Borrelia garinii
AGDVKDAAAAVGAV

SEQ ID NO: 168226 - protein, 14 aa, Borrelia garinii
GDVKDAAAAVGAVS

SEQ ID NO: 168227 - protein, 14 aa, Borrelia garinii
DVKDAAAAVGAVSG

SEQ ID NO: 168228 - protein, 14 aa, Borrelia garinii
VKDAAAAVGAVSGE

SEQ ID NO: 168229 - protein, 14 aa, Borrelia garinii
KDAAAAVGAVSGEQ

SEQ ID NO: 168230 - protein, 14 aa, Borrelia garinii
DAAAAVGAVSGEQI

SEQ ID NO: 168231 - protein, 14 aa, Borrelia garinii
AAAAVGAVSGEQIL

SEQ ID NO: 168232 - protein, 14 aa, Borrelia garinii
AAAVGAVSGEQILN

SEQ ID NO: 168233 - protein, 14 aa, Borrelia garinii
AAVGAVSGEQILNA

SEQ ID NO: 168234 - protein, 14 aa, Borrelia garinii
AVGAVSGEQILNAI

SEQ ID NO: 168235 - protein, 14 aa, Borrelia garinii
VGAVSGEQILNAIV

SEQ ID NO: 168236 - protein, 14 aa, Borrelia garinii
GAVSGEQILNAIVT

SEQ ID NO: 168237 - protein, 14 aa, Borrelia garinii
AVSGEQILNAIVTA

SEQ ID NO: 168238 - protein, 14 aa, Borrelia garinii
VSGEQILNAIVTAA

SEQ ID NO: 168239 - protein, 14 aa, Borrelia garinii
SGEQILNAIVTAAG

SEQ ID NO: 168240 - protein, 14 aa, Borrelia garinii
GEQILNAIVTAAGQ

SEQ ID NO: 168241 - protein, 14 aa, Borrelia garinii
EQILNAIVTAAGQA

SEQ ID NO: 168242 - protein, 14 aa, Borrelia garinii
QILNAIVTAAGQAG

SEQ ID NO: 168243 - protein, 14 aa, Borrelia garinii
ILNAIVTAAGQAGQ

SEQ ID NO: 168244 - protein, 14 aa, Borrelia garinii
LNAIVTAAGQAGQA

SEQ ID NO: 168245 - protein, 14 aa, Borrelia garinii
NAIVTAAGQAGQAG

SEQ ID NO: 168246 - protein, 14 aa, Borrelia garinii
AIVTAAGQAGQAGK

SEQ ID NO: 168247 - protein, 14 aa, Borrelia garinii
IVTAAGQAGQAGKK

SEQ ID NO: 168248 - protein, 14 aa, Borrelia garinii
VTAAGQAGQAGKKA

SEQ ID NO: 168249 - protein, 14 aa, Borrelia garinii
TAAGQAGQAGKKAD

SEQ ID NO: 168250 - protein, 14 aa, Borrelia garinii
AAGQAGQAGKKADE

SEQ ID NO: 168251 - protein, 14 aa, Borrelia garinii
AGQAGQAGKKADEA

SEQ ID NO: 168252 - protein, 14 aa, Borrelia garinii
GQAGQAGKKADEAK

SEQ ID NO: 168253 - protein, 14 aa, Borrelia garinii
QAGQAGKKADEAKN

SEQ ID NO: 168254 - protein, 14 aa, Borrelia garinii
AGQAGKKADEAKNA

SEQ ID NO: 168255 - protein, 14 aa, Borrelia garinii
GQAGKKADEAKNAI

SEQ ID NO: 168256 - protein, 14 aa, Borrelia garinii
QAGKKADEAKNAIE

SEQ ID NO: 168257 - protein, 14 aa, Borrelia garinii
AGKKADEAKNAIEA

SEQ ID NO: 168258 - protein, 14 aa, Borrelia garinii
GKKADEAKNAIEAA

SEQ ID NO: 168259 - protein, 14 aa, Borrelia garinii
KKADEAKNAIEAAI

SEQ ID NO: 168260 - protein, 14 aa, Borrelia garinii
KADEAKNAIEAAIG

SEQ ID NO: 168261 - protein, 14 aa, Borrelia garinii
ADEAKNAIEAAIGA

SEQ ID NO: 168262 - protein, 14 aa, Borrelia garinii
DEAKNAIEAAIGAA

SEQ ID NO: 168263 - protein, 14 aa, Borrelia garinii
EAKNAIEAAIGAAG

SEQ ID NO: 168264 - protein, 14 aa, Borrelia garinii
AKNAIEAAIGAAGD

SEQ ID NO: 168265 - protein, 14 aa, Borrelia garinii
KNAIEAAIGAAGDA

SEQ ID NO: 168266 - protein, 14 aa, Borrelia garinii
NAIEAAIGAAGDAD

SEQ ID NO: 168267 - protein, 14 aa, Borrelia garinii
AIEAAIGAAGDADF

SEQ ID NO: 168268 - protein, 14 aa, Borrelia garinii
IEAAIGAAGDADFG

SEQ ID NO: 168269 - protein, 14 aa, Borrelia garinii
EAAIGAAGDADFGD

SEQ ID NO: 168270 - protein, 14 aa, Borrelia garinii
AAIGAAGDADFGDD

SEQ ID NO: 168271 - protein, 14 aa, Borrelia garinii
AIGAAGDADFGDDI

SEQ ID NO: 168272 - protein, 14 aa, Borrelia garinii
IGAAGDADFGDDIK

SEQ ID NO: 168273 - protein, 14 aa, Borrelia garinii
GAAGDADFGDDIKK

SEQ ID NO: 168274 - protein, 14 aa, Borrelia garinii
AAGDADFGDDIKKK

SEQ ID NO: 168275 - protein, 14 aa, Borrelia garinii
AGDADFGDDIKKKN

SEQ ID NO: 168276 - protein, 14 aa, Borrelia garinii
GDADFGDDIKKKND

SEQ ID NO: 168277 - protein, 14 aa, Borrelia garinii
DADFGDDIKKKNDQ

SEQ ID NO: 168278 - protein, 14 aa, Borrelia garinii
ADFGDDIKKKNDQI

SEQ ID NO: 168279 - protein, 14 aa, Borrelia garinii
DFGDDIKKKNDQIA

SEQ ID NO: 168280 - protein, 14 aa, Borrelia garinii
FGDDIKKKNDQIAA

SEQ ID NO: 168281 - protein, 14 aa, Borrelia garinii
GDDIKKKNDQIAAA

SEQ ID NO: 168282 - protein, 14 aa, Borrelia garinii
DDIKKKNDQIAAAL

SEQ ID NO: 168283 - protein, 14 aa, Borrelia garinii
DIKKKNDQIAAALV

SEQ ID NO: 168284 - protein, 14 aa, Borrelia garinii
IKKKNDQIAAALVL

SEQ ID NO: 168285 - protein, 14 aa, Borrelia garinii
KKKNDQIAAALVLR

SEQ ID NO: 168286 - protein, 14 aa, Borrelia garinii
KKNDQIAAALVLRG

SEQ ID NO: 168287 - protein, 14 aa, Borrelia garinii
KNDQIAAALVLRGV

SEQ ID NO: 168288 - protein, 14 aa, Borrelia garinii
NDQIAAALVLRGVA

SEQ ID NO: 168289 - protein, 14 aa, Borrelia garinii
DQIAAALVLRGVAK

SEQ ID NO: 168290 - protein, 14 aa, Borrelia garinii
QIAAALVLRGVAKD

SEQ ID NO: 168291 - protein, 14 aa, Borrelia garinii
IAAALVLRGVAKDG

SEQ ID NO: 168292 - protein, 14 aa, Borrelia garinii
AAALVLRGVAKDGK

SEQ ID NO: 168293 - protein, 14 aa, Borrelia garinii
AALVLRGVAKDGKF

SEQ ID NO: 168294 - protein, 14 aa, Borrelia garinii
ALVLRGVAKDGKFA

SEQ ID NO: 168295 - protein, 14 aa, Borrelia garinii
LVLRGVAKDGKFAG

SEQ ID NO: 168296 - protein, 14 aa, Borrelia garinii
VLRGVAKDGKFAGA

SEQ ID NO: 168297 - protein, 15 aa, Borrelia garinii
MKKISSAIFIVAFLA

SEQ ID NO: 168298 - protein, 15 aa, Borrelia garinii
KKISSAIFIVAFLAL

SEQ ID NO: 168299 - protein, 15 aa, Borrelia garinii
KISSAIFIVAFLALI

SEQ ID NO: 168300 - protein, 15 aa, Borrelia garinii
ISSAIFIVAFLALIG

SEQ ID NO: 168301 - protein, 15 aa, Borrelia garinii
SSAIFIVAFLALIGC

SEQ ID NO: 168302 - protein, 15 aa, Borrelia garinii
SAIFIVAFLALIGCK

SEQ ID NO: 168303 - protein, 15 aa, Borrelia garinii
AIFIVAFLALIGCKN

SEQ ID NO: 168304 - protein, 15 aa, Borrelia garinii
IFIVAFLALIGCKNN

SEQ ID NO: 168305 - protein, 15 aa, Borrelia garinii
FIVAFLALIGCKNNV

SEQ ID NO: 168306 - protein, 15 aa, Borrelia garinii
IVAFLALIGCKNNVG

SEQ ID NO: 168307 - protein, 15 aa, Borrelia garinii
VAFLALIGCKNNVGG

SEQ ID NO: 168308 - protein, 15 aa, Borrelia garinii
AFLALIGCKNNVGGD

SEQ ID NO: 168309 - protein, 15 aa, Borrelia garinii
FLALIGCKNNVGGDD

SEQ ID NO: 168310 - protein, 15 aa, Borrelia garinii
LALIGCKNNVGGDDK

SEQ ID NO: 168311 - protein, 15 aa, Borrelia garinii
ALIGCKNNVGGDDKK

SEQ ID NO: 168312 - protein, 15 aa, Borrelia garinii
LIGCKNNVGGDDKKD

SEQ ID NO: 168313 - protein, 15 aa, Borrelia garinii
IGCKNNVGGDDKKDT

SEQ ID NO: 168314 - protein, 15 aa, Borrelia garinii
GCKNNVGGDDKKDTA

SEQ ID NO: 168315 - protein, 15 aa, Borrelia garinii
CKNNVGGDDKKDTAA

SEQ ID NO: 168316 - protein, 15 aa, Borrelia garinii
KNNVGGDDKKDTAAS

SEQ ID NO: 168317 - protein, 15 aa, Borrelia garinii
NNVGGDDKKDTAASI

SEQ ID NO: 168318 - protein, 15 aa, Borrelia garinii
NVGGDDKKDTAASIF

SEQ ID NO: 168319 - protein, 15 aa, Borrelia garinii
VGGDDKKDTAASIFY

SEQ ID NO: 168320 - protein, 15 aa, Borrelia garinii
GGDDKKDTAASIFYQ

SEQ ID NO: 168321 - protein, 15 aa, Borrelia garinii
GDDKKDTAASIFYQS

SEQ ID NO: 168322 - protein, 15 aa, Borrelia garinii
DDKKDTAASIFYQSI

SEQ ID NO: 168323 - protein, 15 aa, Borrelia garinii
DKKDTAASIFYQSII

SEQ ID NO: 168324 - protein, 15 aa, Borrelia garinii
KKDTAASIFYQSIIN

SEQ ID NO: 168325 - protein, 15 aa, Borrelia garinii
KDTAASIFYQSIINL

SEQ ID NO: 168326 - protein, 15 aa, Borrelia garinii
DTAASIFYQSIINLG

SEQ ID NO: 168327 - protein, 15 aa, Borrelia garinii
TAASIFYQSIINLGN

SEQ ID NO: 168328 - protein, 15 aa, Borrelia garinii
AASIFYQSIINLGNG

SEQ ID NO: 168329 - protein, 15 aa, Borrelia garinii
ASIFYQSIINLGNGF

SEQ ID NO: 168330 - protein, 15 aa, Borrelia garinii
SIFYQSIINLGNGFI

SEQ ID NO: 168331 - protein, 15 aa, Borrelia garinii
IFYQSIINLGNGFIE

SEQ ID NO: 168332 - protein, 15 aa, Borrelia garinii
FYQSIINLGNGFIEV

SEQ ID NO: 168333 - protein, 15 aa, Borrelia garinii
YQSIINLGNGFIEVF

SEQ ID NO: 168334 - protein, 15 aa, Borrelia garinii
QSIINLGNGFIEVFN

SEQ ID NO: 168335 - protein, 15 aa, Borrelia garinii
SIINLGNGFIEVFNA

SEQ ID NO: 168336 - protein, 15 aa, Borrelia garinii
IINLGNGFIEVFNAF

SEQ ID NO: 168337 - protein, 15 aa, Borrelia garinii
INLGNGFIEVFNAFS

SEQ ID NO: 168338 - protein, 15 aa, Borrelia garinii
NLGNGFIEVFNAFSG

SEQ ID NO: 168339 - protein, 15 aa, Borrelia garinii
LGNGFIEVFNAFSGL

SEQ ID NO: 168340 - protein, 15 aa, Borrelia garinii
GNGFIEVFNAFSGLV

SEQ ID NO: 168341 - protein, 15 aa, Borrelia garinii
NGFIEVFNAFSGLVA

SEQ ID NO: 168342 - protein, 15 aa, Borrelia garinii
GFIEVFNAFSGLVAD

SEQ ID NO: 168343 - protein, 15 aa, Borrelia garinii
FIEVFNAFSGLVADA

SEQ ID NO: 168344 - protein, 15 aa, Borrelia garinii
IEVFNAFSGLVADAF

SEQ ID NO: 168345 - protein, 15 aa, Borrelia garinii
EVFNAFSGLVADAFS

SEQ ID NO: 168346 - protein, 15 aa, Borrelia garinii
VFNAFSGLVADAFSK

SEQ ID NO: 168347 - protein, 15 aa, Borrelia garinii
FNAFSGLVADAFSKA

SEQ ID NO: 168348 - protein, 15 aa, Borrelia garinii
NAFSGLVADAFSKAD

SEQ ID NO: 168349 - protein, 15 aa, Borrelia garinii
AFSGLVADAFSKADP

SEQ ID NO: 168350 - protein, 15 aa, Borrelia garinii
FSGLVADAFSKADPK

SEQ ID NO: 168351 - protein, 15 aa, Borrelia garinii
SGLVADAFSKADPKK

SEQ ID NO: 168352 - protein, 15 aa, Borrelia garinii
GLVADAFSKADPKKS

SEQ ID NO: 168353 - protein, 15 aa, Borrelia garinii
LVADAFSKADPKKSD

SEQ ID NO: 168354 - protein, 15 aa, Borrelia garinii
VADAFSKADPKKSDV

SEQ ID NO: 168355 - protein, 15 aa, Borrelia garinii
ADAFSKADPKKSDVK

SEQ ID NO: 168356 - protein, 15 aa, Borrelia garinii
DAFSKADPKKSDVKT

SEQ ID NO: 168357 - protein, 15 aa, Borrelia garinii
AFSKADPKKSDVKTY

SEQ ID NO: 168358 - protein, 15 aa, Borrelia garinii
FSKADPKKSDVKTYF

SEQ ID NO: 168359 - protein, 15 aa, Borrelia garinii
SKADPKKSDVKTYFD

SEQ ID NO: 168360 - protein, 15 aa, Borrelia garinii
KADPKKSDVKTYFDS

SEQ ID NO: 168361 - protein, 15 aa, Borrelia garinii
ADPKKSDVKTYFDSI

SEQ ID NO: 168362 - protein, 15 aa, Borrelia garinii
DPKKSDVKTYFDSIT

SEQ ID NO: 168363 - protein, 15 aa, Borrelia garinii
PKKSDVKTYFDSITK

SEQ ID NO: 168364 - protein, 15 aa, Borrelia garinii
KKSDVKTYFDSITKT

SEQ ID NO: 168365 - protein, 15 aa, Borrelia garinii
KSDVKTYFDSITKTL

SEQ ID NO: 168366 - protein, 15 aa, Borrelia garinii
SDVKTYFDSITKTLK

SEQ ID NO: 168367 - protein, 15 aa, Borrelia garinii
DVKTYFDSITKTLKD

SEQ ID NO: 168368 - protein, 15 aa, Borrelia garinii
VKTYFDSITKTLKDT

SEQ ID NO: 168369 - protein, 15 aa, Borrelia garinii
KTYFDSITKTLKDTK

SEQ ID NO: 168370 - protein, 15 aa, Borrelia garinii
TYFDSITKTLKDTKT

SEQ ID NO: 168371 - protein, 15 aa, Borrelia garinii
YFDSITKTLKDTKTK

SEQ ID NO: 168372 - protein, 15 aa, Borrelia garinii
FDSITKTLKDTKTKL

SEQ ID NO: 168373 - protein, 15 aa, Borrelia garinii
DSITKTLKDTKTKLE

SEQ ID NO: 168374 - protein, 15 aa, Borrelia garinii
SITKTLKDTKTKLED

SEQ ID NO: 168375 - protein, 15 aa, Borrelia garinii
ITKTLKDTKTKLEDI

SEQ ID NO: 168376 - protein, 15 aa, Borrelia garinii
TKTLKDTKTKLEDIS

SEQ ID NO: 168377 - protein, 15 aa, Borrelia garinii
KTLKDTKTKLEDISK

SEQ ID NO: 168378 - protein, 15 aa, Borrelia garinii
TLKDTKTKLEDISKE

SEQ ID NO: 168379 - protein, 15 aa, Borrelia garinii
LKDTKTKLEDISKEK

SEQ ID NO: 168380 - protein, 15 aa, Borrelia garinii
KDTKTKLEDISKEKT

SEQ ID NO: 168381 - protein, 15 aa, Borrelia garinii
DTKTKLEDISKEKTG

SEQ ID NO: 168382 - protein, 15 aa, Borrelia garinii
TKTKLEDISKEKTGG

SEQ ID NO: 168383 - protein, 15 aa, Borrelia garinii
KTKLEDISKEKTGGE

SEQ ID NO: 168384 - protein, 15 aa, Borrelia garinii
TKLEDISKEKTGGEK

SEQ ID NO: 168385 - protein, 15 aa, Borrelia garinii
KLEDISKEKTGGEKT

SEQ ID NO: 168386 - protein, 15 aa, Borrelia garinii
LEDISKEKTGGEKTP

SEQ ID NO: 168387 - protein, 15 aa, Borrelia garinii
EDISKEKTGGEKTPA

SEQ ID NO: 168388 - protein, 15 aa, Borrelia garinii
DISKEKTGGEKTPAV

SEQ ID NO: 168389 - protein, 15 aa, Borrelia garinii
ISKEKTGGEKTPAVE

SEQ ID NO: 168390 - protein, 15 aa, Borrelia garinii
SKEKTGGEKTPAVEG

SEQ ID NO: 168391 - protein, 15 aa, Borrelia garinii
KEKTGGEKTPAVEGI

SEQ ID NO: 168392 - protein, 15 aa, Borrelia garinii
EKTGGEKTPAVEGIA

SEQ ID NO: 168393 - protein, 15 aa, Borrelia garinii
KTGGEKTPAVEGIAE

SEQ ID NO: 168394 - protein, 15 aa, Borrelia garinii
TGGEKTPAVEGIAEV

SEQ ID NO: 168395 - protein, 15 aa, Borrelia garinii
GGEKTPAVEGIAEVV

SEQ ID NO: 168396 - protein, 15 aa, Borrelia garinii
GEKTPAVEGIAEVVK

SEQ ID NO: 168397 - protein, 15 aa, Borrelia garinii
EKTPAVEGIAEVVKT

SEQ ID NO: 168398 - protein, 15 aa, Borrelia garinii
KTPAVEGIAEVVKTV

SEQ ID NO: 168399 - protein, 15 aa, Borrelia garinii
TPAVEGIAEVVKTVG

SEQ ID NO: 168400 - protein, 15 aa, Borrelia garinii
PAVEGIAEVVKTVGE

SEQ ID NO: 168401 - protein, 15 aa, Borrelia garinii
AVEGIAEVVKTVGEW

SEQ ID NO: 168402 - protein, 15 aa, Borrelia garinii
VEGIAEVVKTVGEWL

SEQ ID NO: 168403 - protein, 15 aa, Borrelia garinii
EGIAEVVKTVGEWLD

SEQ ID NO: 168404 - protein, 15 aa, Borrelia garinii
GIAEVVKTVGEWLDG

SEQ ID NO: 168405 - protein, 15 aa, Borrelia garinii
IAEVVKTVGEWLDGL

SEQ ID NO: 168406 - protein, 15 aa, Borrelia garinii
AEVVKTVGEWLDGLI

SEQ ID NO: 168407 - protein, 15 aa, Borrelia garinii
EVVKTVGEWLDGLIK

SEQ ID NO: 168408 - protein, 15 aa, Borrelia garinii
VVKTVGEWLDGLIKA

SEQ ID NO: 168409 - protein, 15 aa, Borrelia garinii
VKTVGEWLDGLIKAA

SEQ ID NO: 168410 - protein, 15 aa, Borrelia garinii
KTVGEWLDGLIKAAE

SEQ ID NO: 168411 - protein, 15 aa, Borrelia garinii
TVGEWLDGLIKAAEG

SEQ ID NO: 168412 - protein, 15 aa, Borrelia garinii
VGEWLDGLIKAAEGG

SEQ ID NO: 168413 - protein, 15 aa, Borrelia garinii
GEWLDGLIKAAEGGG

SEQ ID NO: 168414 - protein, 15 aa, Borrelia garinii
EWLDGLIKAAEGGGK

SEQ ID NO: 168415 - protein, 15 aa, Borrelia garinii
WLDGLIKAAEGGGKA

SEQ ID NO: 168416 - protein, 15 aa, Borrelia garinii
LDGLIKAAEGGGKAA

SEQ ID NO: 168417 - protein, 15 aa, Borrelia garinii
DGLIKAAEGGGKAAD

SEQ ID NO: 168418 - protein, 15 aa, Borrelia garinii
GLIKAAEGGGKAADG

SEQ ID NO: 168419 - protein, 15 aa, Borrelia garinii
LIKAAEGGGKAADGG

SEQ ID NO: 168420 - protein, 15 aa, Borrelia garinii
IKAAEGGGKAADGGG

SEQ ID NO: 168421 - protein, 15 aa, Borrelia garinii
KAAEGGGKAADGGGS

SEQ ID NO: 168422 - protein, 15 aa, Borrelia garinii
AAEGGGKAADGGGSD

SEQ ID NO: 168423 - protein, 15 aa, Borrelia garinii
AEGGGKAADGGGSDK

SEQ ID NO: 168424 - protein, 15 aa, Borrelia garinii
EGGGKAADGGGSDKI

SEQ ID NO: 168425 - protein, 15 aa, Borrelia garinii
GGGKAADGGGSDKIG

SEQ ID NO: 168426 - protein, 15 aa, Borrelia garinii
GGKAADGGGSDKIGN

SEQ ID NO: 168427 - protein, 15 aa, Borrelia garinii
GKAADGGGSDKIGNV

SEQ ID NO: 168428 - protein, 15 aa, Borrelia garinii
KAADGGGSDKIGNVA

SEQ ID NO: 168429 - protein, 15 aa, Borrelia garinii
AADGGGSDKIGNVAA

SEQ ID NO: 168430 - protein, 15 aa, Borrelia garinii
ADGGGSDKIGNVAAG

SEQ ID NO: 168431 - protein, 15 aa, Borrelia garinii
DGGGSDKIGNVAAGG

SEQ ID NO: 168432 - protein, 15 aa, Borrelia garinii
GGGSDKIGNVAAGGG

SEQ ID NO: 168433 - protein, 15 aa, Borrelia garinii
GGSDKIGNVAAGGGA

SEQ ID NO: 168434 - protein, 15 aa, Borrelia garinii
GSDKIGNVAAGGGAG

SEQ ID NO: 168435 - protein, 15 aa, Borrelia garinii
SDKIGNVAAGGGAGA

SEQ ID NO: 168436 - protein, 15 aa, Borrelia garinii
DKIGNVAAGGGAGAD

SEQ ID NO: 168437 - protein, 15 aa, Borrelia garinii
KIGNVAAGGGAGADK

SEQ ID NO: 168438 - protein, 15 aa, Borrelia garinii
IGNVAAGGGAGADKE

SEQ ID NO: 168439 - protein, 15 aa, Borrelia garinii
GNVAAGGGAGADKES

SEQ ID NO: 168440 - protein, 15 aa, Borrelia garinii
NVAAGGGAGADKESV

SEQ ID NO: 168441 - protein, 15 aa, Borrelia garinii
VAAGGGAGADKESVN

SEQ ID NO: 168442 - protein, 15 aa, Borrelia garinii
AAGGGAGADKESVNG

SEQ ID NO: 168443 - protein, 15 aa, Borrelia garinii
AGGGAGADKESVNGI

SEQ ID NO: 168444 - protein, 15 aa, Borrelia garinii
GGGAGADKESVNGIA

SEQ ID NO: 168445 - protein, 15 aa, Borrelia garinii
GGAGADKESVNGIAG

SEQ ID NO: 168446 - protein, 15 aa, Borrelia garinii
GAGADKESVNGIAGA

SEQ ID NO: 168447 - protein, 15 aa, Borrelia garinii
AGADKESVNGIAGAI

SEQ ID NO: 168448 - protein, 15 aa, Borrelia garinii
GADKESVNGIAGAIK

SEQ ID NO: 168449 - protein, 15 aa, Borrelia garinii
ADKESVNGIAGAIKG

SEQ ID NO: 168450 - protein, 15 aa, Borrelia garinii
DKESVNGIAGAIKGI

SEQ ID NO: 168451 - protein, 15 aa, Borrelia garinii
KESVNGIAGAIKGIV

SEQ ID NO: 168452 - protein, 15 aa, Borrelia garinii
ESVNGIAGAIKGIVE

SEQ ID NO: 168453 - protein, 15 aa, Borrelia garinii
SVNGIAGAIKGIVEA

SEQ ID NO: 168454 - protein, 15 aa, Borrelia garinii
VNGIAGAIKGIVEAA

SEQ ID NO: 168455 - protein, 15 aa, Borrelia garinii
NGIAGAIKGIVEAAK

SEQ ID NO: 168456 - protein, 15 aa, Borrelia garinii
GIAGAIKGIVEAAKK

SEQ ID NO: 168457 - protein, 15 aa, Borrelia garinii
IAGAIKGIVEAAKKV

SEQ ID NO: 168458 - protein, 15 aa, Borrelia garinii
AGAIKGIVEAAKKVE

SEQ ID NO: 168459 - protein, 15 aa, Borrelia garinii
GAIKGIVEAAKKVEG

SEQ ID NO: 168460 - protein, 15 aa, Borrelia garinii
AIKGIVEAAKKVEGV

SEQ ID NO: 168461 - protein, 15 aa, Borrelia garinii
IKGIVEAAKKVEGVK

SEQ ID NO: 168462 - protein, 15 aa, Borrelia garinii
KGIVEAAKKVEGVKF

SEQ ID NO: 168463 - protein, 15 aa, Borrelia garinii
GIVEAAKKVEGVKFA

SEQ ID NO: 168464 - protein, 15 aa, Borrelia garinii
IVEAAKKVEGVKFAP

SEQ ID NO: 168465 - protein, 15 aa, Borrelia garinii
VEAAKKVEGVKFAPK

SEQ ID NO: 168466 - protein, 15 aa, Borrelia garinii
EAAKKVEGVKFAPKA

SEQ ID NO: 168467 - protein, 15 aa, Borrelia garinii
AAKKVEGVKFAPKAA

SEQ ID NO: 168468 - protein, 15 aa, Borrelia garinii
AKKVEGVKFAPKAAA

SEQ ID NO: 168469 - protein, 15 aa, Borrelia garinii
KKVEGVKFAPKAAAD

SEQ ID NO: 168470 - protein, 15 aa, Borrelia garinii
KVEGVKFAPKAAADA

SEQ ID NO: 168471 - protein, 15 aa, Borrelia garinii
VEGVKFAPKAAADAA

SEQ ID NO: 168472 - protein, 15 aa, Borrelia garinii
EGVKFAPKAAADAAA

SEQ ID NO: 168473 - protein, 15 aa, Borrelia garinii
GVKFAPKAAADAAAA

SEQ ID NO: 168474 - protein, 15 aa, Borrelia garinii
VKFAPKAAADAAAAD

SEQ ID NO: 168475 - protein, 15 aa, Borrelia garinii
KFAPKAAADAAAADG

SEQ ID NO: 168476 - protein, 15 aa, Borrelia garinii
FAPKAAADAAAADGN

SEQ ID NO: 168477 - protein, 15 aa, Borrelia garinii
APKAAADAAAADGNK

SEQ ID NO: 168478 - protein, 15 aa, Borrelia garinii
PKAAADAAAADGNKK

SEQ ID NO: 168479 - protein, 15 aa, Borrelia garinii
KAAADAAAADGNKKA

SEQ ID NO: 168480 - protein, 15 aa, Borrelia garinii
AAADAAAADGNKKAG

SEQ ID NO: 168481 - protein, 15 aa, Borrelia garinii
AADAAAADGNKKAGK

SEQ ID NO: 168482 - protein, 15 aa, Borrelia garinii
ADAAAADGNKKAGKL

SEQ ID NO: 168483 - protein, 15 aa, Borrelia garinii
DAAAADGNKKAGKLF

SEQ ID NO: 168484 - protein, 15 aa, Borrelia garinii
AAAADGNKKAGKLFG

SEQ ID NO: 168485 - protein, 15 aa, Borrelia garinii
AAADGNKKAGKLFGT

SEQ ID NO: 168486 - protein, 15 aa, Borrelia garinii
AADGNKKAGKLFGTA

SEQ ID NO: 168487 - protein, 15 aa, Borrelia garinii
ADGNKKAGKLFGTAA

SEQ ID NO: 168488 - protein, 15 aa, Borrelia garinii
DGNKKAGKLFGTAAG

SEQ ID NO: 168489 - protein, 15 aa, Borrelia garinii
GNKKAGKLFGTAAGA

SEQ ID NO: 168490 - protein, 15 aa, Borrelia garinii
NKKAGKLFGTAAGAD

SEQ ID NO: 168491 - protein, 15 aa, Borrelia garinii
KKAGKLFGTAAGADA

SEQ ID NO: 168492 - protein, 15 aa, Borrelia garinii
KAGKLFGTAAGADAG

SEQ ID NO: 168493 - protein, 15 aa, Borrelia garinii
AGKLFGTAAGADAGD

SEQ ID NO: 168494 - protein, 15 aa, Borrelia garinii
GKLFGTAAGADAGDV

SEQ ID NO: 168495 - protein, 15 aa, Borrelia garinii
KLFGTAAGADAGDVK

SEQ ID NO: 168496 - protein, 15 aa, Borrelia garinii
LFGTAAGADAGDVKD

SEQ ID NO: 168497 - protein, 15 aa, Borrelia garinii
FGTAAGADAGDVKDA

SEQ ID NO: 168498 - protein, 15 aa, Borrelia garinii
GTAAGADAGDVKDAA

SEQ ID NO: 168499 - protein, 15 aa, Borrelia garinii
TAAGADAGDVKDAAA

SEQ ID NO: 168500 - protein, 15 aa, Borrelia garinii
AAGADAGDVKDAAAA

SEQ ID NO: 168501 - protein, 15 aa, Borrelia garinii
AGADAGDVKDAAAAV

SEQ ID NO: 168502 - protein, 15 aa, Borrelia garinii
GADAGDVKDAAAAVG

SEQ ID NO: 168503 - protein, 15 aa, Borrelia garinii
ADAGDVKDAAAAVGA

SEQ ID NO: 168504 - protein, 15 aa, Borrelia garinii
DAGDVKDAAAAVGAV

SEQ ID NO: 168505 - protein, 15 aa, Borrelia garinii
AGDVKDAAAAVGAVS

SEQ ID NO: 168506 - protein, 15 aa, Borrelia garinii
GDVKDAAAAVGAVSG

SEQ ID NO: 168507 - protein, 15 aa, Borrelia garinii
DVKDAAAAVGAVSGE

SEQ ID NO: 168508 - protein, 15 aa, Borrelia garinii
VKDAAAAVGAVSGEQ

SEQ ID NO: 168509 - protein, 15 aa, Borrelia garinii
KDAAAAVGAVSGEQI

SEQ ID NO: 168510 - protein, 15 aa, Borrelia garinii
DAAAAVGAVSGEQIL

SEQ ID NO: 168511 - protein, 15 aa, Borrelia garinii
AAAAVGAVSGEQILN

SEQ ID NO: 168512 - protein, 15 aa, Borrelia garinii
AAAVGAVSGEQILNA

SEQ ID NO: 168513 - protein, 15 aa, Borrelia garinii
AAVGAVSGEQILNAI

SEQ ID NO: 168514 - protein, 15 aa, Borrelia garinii
AVGAVSGEQILNAIV

SEQ ID NO: 168515 - protein, 15 aa, Borrelia garinii
VGAVSGEQILNAIVT

SEQ ID NO: 168516 - protein, 15 aa, Borrelia garinii
GAVSGEQILNAIVTA

SEQ ID NO: 168517 - protein, 15 aa, Borrelia garinii
AVSGEQILNAIVTAA

SEQ ID NO: 168518 - protein, 15 aa, Borrelia garinii
VSGEQILNAIVTAAG

SEQ ID NO: 168519 - protein, 15 aa, Borrelia garinii
SGEQILNAIVTAAGQ

SEQ ID NO: 168520 - protein, 15 aa, Borrelia garinii
GEQILNAIVTAAGQA

SEQ ID NO: 168521 - protein, 15 aa, Borrelia garinii
EQILNAIVTAAGQAG

SEQ ID NO: 168522 - protein, 15 aa, Borrelia garinii
QILNAIVTAAGQAGQ

SEQ ID NO: 168523 - protein, 15 aa, Borrelia garinii
ILNAIVTAAGQAGQA

SEQ ID NO: 168524 - protein, 15 aa, Borrelia garinii
LNAIVTAAGQAGQAG

SEQ ID NO: 168525 - protein, 15 aa, Borrelia garinii
NAIVTAAGQAGQAGK

SEQ ID NO: 168526 - protein, 15 aa, Borrelia garinii
AIVTAAGQAGQAGKK

SEQ ID NO: 168527 - protein, 15 aa, Borrelia garinii
IVTAAGQAGQAGKKA

SEQ ID NO: 168528 - protein, 15 aa, Borrelia garinii
VTAAGQAGQAGKKAD

SEQ ID NO: 168529 - protein, 15 aa, Borrelia garinii
TAAGQAGQAGKKADE

SEQ ID NO: 168530 - protein, 15 aa, Borrelia garinii
AAGQAGQAGKKADEA

SEQ ID NO: 168531 - protein, 15 aa, Borrelia garinii
AGQAGQAGKKADEAK

SEQ ID NO: 168532 - protein, 15 aa, Borrelia garinii
GQAGQAGKKADEAKN

SEQ ID NO: 168533 - protein, 15 aa, Borrelia garinii
QAGQAGKKADEAKNA

SEQ ID NO: 168534 - protein, 15 aa, Borrelia garinii
AGQAGKKADEAKNAI

SEQ ID NO: 168535 - protein, 15 aa, Borrelia garinii
GQAGKKADEAKNAIE

SEQ ID NO: 168536 - protein, 15 aa, Borrelia garinii
QAGKKADEAKNAIEA

SEQ ID NO: 168537 - protein, 15 aa, Borrelia garinii
AGKKADEAKNAIEAA

SEQ ID NO: 168538 - protein, 15 aa, Borrelia garinii
GKKADEAKNAIEAAI

SEQ ID NO: 168539 - protein, 15 aa, Borrelia garinii
KKADEAKNAIEAAIG

SEQ ID NO: 168540 - protein, 15 aa, Borrelia garinii
KADEAKNAIEAAIGA

SEQ ID NO: 168541 - protein, 15 aa, Borrelia garinii
ADEAKNAIEAAIGAA

SEQ ID NO: 168542 - protein, 15 aa, Borrelia garinii
DEAKNAIEAAIGAAG

SEQ ID NO: 168543 - protein, 15 aa, Borrelia garinii
EAKNAIEAAIGAAGD

SEQ ID NO: 168544 - protein, 15 aa, Borrelia garinii
AKNAIEAAIGAAGDA

SEQ ID NO: 168545 - protein, 15 aa, Borrelia garinii
KNAIEAAIGAAGDAD

SEQ ID NO: 168546 - protein, 15 aa, Borrelia garinii
NAIEAAIGAAGDADF

SEQ ID NO: 168547 - protein, 15 aa, Borrelia garinii
AIEAAIGAAGDADFG

SEQ ID NO: 168548 - protein, 15 aa, Borrelia garinii
IEAAIGAAGDADFGD

SEQ ID NO: 168549 - protein, 15 aa, Borrelia garinii
EAAIGAAGDADFGDD

SEQ ID NO: 168550 - protein, 15 aa, Borrelia garinii
AAIGAAGDADFGDDI

SEQ ID NO: 168551 - protein, 15 aa, Borrelia garinii
AIGAAGDADFGDDIK

SEQ ID NO: 168552 - protein, 15 aa, Borrelia garinii
IGAAGDADFGDDIKK

SEQ ID NO: 168553 - protein, 15 aa, Borrelia garinii
GAAGDADFGDDIKKK

SEQ ID NO: 168554 - protein, 15 aa, Borrelia garinii
AAGDADFGDDIKKKN

SEQ ID NO: 168555 - protein, 15 aa, Borrelia garinii
AGDADFGDDIKKKND

SEQ ID NO: 168556 - protein, 15 aa, Borrelia garinii
GDADFGDDIKKKNDQ

SEQ ID NO: 168557 - protein, 15 aa, Borrelia garinii
DADFGDDIKKKNDQI

SEQ ID NO: 168558 - protein, 15 aa, Borrelia garinii
ADFGDDIKKKNDQIA

SEQ ID NO: 168559 - protein, 15 aa, Borrelia garinii
DFGDDIKKKNDQIAA

SEQ ID NO: 168560 - protein, 15 aa, Borrelia garinii
FGDDIKKKNDQIAAA

SEQ ID NO: 168561 - protein, 15 aa, Borrelia garinii
GDDIKKKNDQIAAAL

SEQ ID NO: 168562 - protein, 15 aa, Borrelia garinii
DDIKKKNDQIAAALV

SEQ ID NO: 168563 - protein, 15 aa, Borrelia garinii
DIKKKNDQIAAALVL

SEQ ID NO: 168564 - protein, 15 aa, Borrelia garinii
IKKKNDQIAAALVLR

SEQ ID NO: 168565 - protein, 15 aa, Borrelia garinii
KKKNDQIAAALVLRG

SEQ ID NO: 168566 - protein, 15 aa, Borrelia garinii
KKNDQIAAALVLRGV

SEQ ID NO: 168567 - protein, 15 aa, Borrelia garinii
KNDQIAAALVLRGVA

SEQ ID NO: 168568 - protein, 15 aa, Borrelia garinii
NDQIAAALVLRGVAK

SEQ ID NO: 168569 - protein, 15 aa, Borrelia garinii
DQIAAALVLRGVAKD

SEQ ID NO: 168570 - protein, 15 aa, Borrelia garinii
QIAAALVLRGVAKDG

SEQ ID NO: 168571 - protein, 15 aa, Borrelia garinii
IAAALVLRGVAKDGK

SEQ ID NO: 168572 - protein, 15 aa, Borrelia garinii
AAALVLRGVAKDGKF

SEQ ID NO: 168573 - protein, 15 aa, Borrelia garinii
AALVLRGVAKDGKFA

SEQ ID NO: 168574 - protein, 15 aa, Borrelia garinii
ALVLRGVAKDGKFAG

SEQ ID NO: 168575 - protein, 15 aa, Borrelia garinii
LVLRGVAKDGKFAGA

SEQ ID NO: 168576 - protein, 16 aa, Borrelia garinii
MKKISSAIFIVAFLAL

SEQ ID NO: 168577 - protein, 16 aa, Borrelia garinii
KKISSAIFIVAFLALI

SEQ ID NO: 168578 - protein, 16 aa, Borrelia garinii
KISSAIFIVAFLALIG

SEQ ID NO: 168579 - protein, 16 aa, Borrelia garinii
ISSAIFIVAFLALIGC

SEQ ID NO: 168580 - protein, 16 aa, Borrelia garinii
SSAIFIVAFLALIGCK

SEQ ID NO: 168581 - protein, 16 aa, Borrelia garinii
SAIFIVAFLALIGCKN

SEQ ID NO: 168582 - protein, 16 aa, Borrelia garinii
AIFIVAFLALIGCKNN

SEQ ID NO: 168583 - protein, 16 aa, Borrelia garinii
IFIVAFLALIGCKNNV

SEQ ID NO: 168584 - protein, 16 aa, Borrelia garinii
FIVAFLALIGCKNNVG

SEQ ID NO: 168585 - protein, 16 aa, Borrelia garinii
IVAFLALIGCKNNVGG

SEQ ID NO: 168586 - protein, 16 aa, Borrelia garinii
VAFLALIGCKNNVGGD

SEQ ID NO: 168587 - protein, 16 aa, Borrelia garinii
AFLALIGCKNNVGGDD

SEQ ID NO: 168588 - protein, 16 aa, Borrelia garinii
FLALIGCKNNVGGDDK

SEQ ID NO: 168589 - protein, 16 aa, Borrelia garinii
LALIGCKNNVGGDDKK

SEQ ID NO: 168590 - protein, 16 aa, Borrelia garinii
ALIGCKNNVGGDDKKD

SEQ ID NO: 168591 - protein, 16 aa, Borrelia garinii
LIGCKNNVGGDDKKDT

SEQ ID NO: 168592 - protein, 16 aa, Borrelia garinii
IGCKNNVGGDDKKDTA

SEQ ID NO: 168593 - protein, 16 aa, Borrelia garinii
GCKNNVGGDDKKDTAA

SEQ ID NO: 168594 - protein, 16 aa, Borrelia garinii
CKNNVGGDDKKDTAAS

SEQ ID NO: 168595 - protein, 16 aa, Borrelia garinii
KNNVGGDDKKDTAASI

SEQ ID NO: 168596 - protein, 16 aa, Borrelia garinii
NNVGGDDKKDTAASIF

SEQ ID NO: 168597 - protein, 16 aa, Borrelia garinii
NVGGDDKKDTAASIFY

SEQ ID NO: 168598 - protein, 16 aa, Borrelia garinii
VGGDDKKDTAASIFYQ

SEQ ID NO: 168599 - protein, 16 aa, Borrelia garinii
GGDDKKDTAASIFYQS

SEQ ID NO: 168600 - protein, 16 aa, Borrelia garinii
GDDKKDTAASIFYQSI

SEQ ID NO: 168601 - protein, 16 aa, Borrelia garinii
DDKKDTAASIFYQSII

SEQ ID NO: 168602 - protein, 16 aa, Borrelia garinii
DKKDTAASIFYQSIIN

SEQ ID NO: 168603 - protein, 16 aa, Borrelia garinii
KKDTAASIFYQSIINL

SEQ ID NO: 168604 - protein, 16 aa, Borrelia garinii
KDTAASIFYQSIINLG

SEQ ID NO: 168605 - protein, 16 aa, Borrelia garinii
DTAASIFYQSIINLGN

SEQ ID NO: 168606 - protein, 16 aa, Borrelia garinii
TAASIFYQSIINLGNG

SEQ ID NO: 168607 - protein, 16 aa, Borrelia garinii
AASIFYQSIINLGNGF

SEQ ID NO: 168608 - protein, 16 aa, Borrelia garinii
ASIFYQSIINLGNGFI

SEQ ID NO: 168609 - protein, 16 aa, Borrelia garinii
SIFYQSIINLGNGFIE

SEQ ID NO: 168610 - protein, 16 aa, Borrelia garinii
IFYQSIINLGNGFIEV

SEQ ID NO: 168611 - protein, 16 aa, Borrelia garinii
FYQSIINLGNGFIEVF

SEQ ID NO: 168612 - protein, 16 aa, Borrelia garinii
YQSIINLGNGFIEVFN

SEQ ID NO: 168613 - protein, 16 aa, Borrelia garinii
QSIINLGNGFIEVFNA

SEQ ID NO: 168614 - protein, 16 aa, Borrelia garinii
SIINLGNGFIEVFNAF

SEQ ID NO: 168615 - protein, 16 aa, Borrelia garinii
IINLGNGFIEVFNAFS

SEQ ID NO: 168616 - protein, 16 aa, Borrelia garinii
INLGNGFIEVFNAFSG

SEQ ID NO: 168617 - protein, 16 aa, Borrelia garinii
NLGNGFIEVFNAFSGL

SEQ ID NO: 168618 - protein, 16 aa, Borrelia garinii
LGNGFIEVFNAFSGLV

SEQ ID NO: 168619 - protein, 16 aa, Borrelia garinii
GNGFIEVFNAFSGLVA

SEQ ID NO: 168620 - protein, 16 aa, Borrelia garinii
NGFIEVFNAFSGLVAD

SEQ ID NO: 168621 - protein, 16 aa, Borrelia garinii
GFIEVFNAFSGLVADA

SEQ ID NO: 168622 - protein, 16 aa, Borrelia garinii
FIEVFNAFSGLVADAF

SEQ ID NO: 168623 - protein, 16 aa, Borrelia garinii
IEVFNAFSGLVADAFS

SEQ ID NO: 168624 - protein, 16 aa, Borrelia garinii
EVFNAFSGLVADAFSK

SEQ ID NO: 168625 - protein, 16 aa, Borrelia garinii
VFNAFSGLVADAFSKA

SEQ ID NO: 168626 - protein, 16 aa, Borrelia garinii
FNAFSGLVADAFSKAD

SEQ ID NO: 168627 - protein, 16 aa, Borrelia garinii
NAFSGLVADAFSKADP

SEQ ID NO: 168628 - protein, 16 aa, Borrelia garinii
AFSGLVADAFSKADPK

SEQ ID NO: 168629 - protein, 16 aa, Borrelia garinii
FSGLVADAFSKADPKK

SEQ ID NO: 168630 - protein, 16 aa, Borrelia garinii
SGLVADAFSKADPKKS

SEQ ID NO: 168631 - protein, 16 aa, Borrelia garinii
GLVADAFSKADPKKSD

SEQ ID NO: 168632 - protein, 16 aa, Borrelia garinii
LVADAFSKADPKKSDV

SEQ ID NO: 168633 - protein, 16 aa, Borrelia garinii
VADAFSKADPKKSDVK

SEQ ID NO: 168634 - protein, 16 aa, Borrelia garinii
ADAFSKADPKKSDVKT

SEQ ID NO: 168635 - protein, 16 aa, Borrelia garinii
DAFSKADPKKSDVKTY

SEQ ID NO: 168636 - protein, 16 aa, Borrelia garinii
AFSKADPKKSDVKTYF

SEQ ID NO: 168637 - protein, 16 aa, Borrelia garinii
FSKADPKKSDVKTYFD

SEQ ID NO: 168638 - protein, 16 aa, Borrelia garinii
SKADPKKSDVKTYFDS

SEQ ID NO: 168639 - protein, 16 aa, Borrelia garinii
KADPKKSDVKTYFDSI

SEQ ID NO: 168640 - protein, 16 aa, Borrelia garinii
ADPKKSDVKTYFDSIT

SEQ ID NO: 168641 - protein, 16 aa, Borrelia garinii
DPKKSDVKTYFDSITK

SEQ ID NO: 168642 - protein, 16 aa, Borrelia garinii
PKKSDVKTYFDSITKT

SEQ ID NO: 168643 - protein, 16 aa, Borrelia garinii
KKSDVKTYFDSITKTL

SEQ ID NO: 168644 - protein, 16 aa, Borrelia garinii
KSDVKTYFDSITKTLK

SEQ ID NO: 168645 - protein, 16 aa, Borrelia garinii
SDVKTYFDSITKTLKD

SEQ ID NO: 168646 - protein, 16 aa, Borrelia garinii
DVKTYFDSITKTLKDT

SEQ ID NO: 168647 - protein, 16 aa, Borrelia garinii
VKTYFDSITKTLKDTK

SEQ ID NO: 168648 - protein, 16 aa, Borrelia garinii
KTYFDSITKTLKDTKT

SEQ ID NO: 168649 - protein, 16 aa, Borrelia garinii
TYFDSITKTLKDTKTK

SEQ ID NO: 168650 - protein, 16 aa, Borrelia garinii
YFDSITKTLKDTKTKL

SEQ ID NO: 168651 - protein, 16 aa, Borrelia garinii
FDSITKTLKDTKTKLE

SEQ ID NO: 168652 - protein, 16 aa, Borrelia garinii
DSITKTLKDTKTKLED

SEQ ID NO: 168653 - protein, 16 aa, Borrelia garinii
SITKTLKDTKTKLEDI

SEQ ID NO: 168654 - protein, 16 aa, Borrelia garinii
ITKTLKDTKTKLEDIS

SEQ ID NO: 168655 - protein, 16 aa, Borrelia garinii
TKTLKDTKTKLEDISK

SEQ ID NO: 168656 - protein, 16 aa, Borrelia garinii
KTLKDTKTKLEDISKE

SEQ ID NO: 168657 - protein, 16 aa, Borrelia garinii
TLKDTKTKLEDISKEK

SEQ ID NO: 168658 - protein, 16 aa, Borrelia garinii
LKDTKTKLEDISKEKT

SEQ ID NO: 168659 - protein, 16 aa, Borrelia garinii
KDTKTKLEDISKEKTG

SEQ ID NO: 168660 - protein, 16 aa, Borrelia garinii
DTKTKLEDISKEKTGG

SEQ ID NO: 168661 - protein, 16 aa, Borrelia garinii
TKTKLEDISKEKTGGE

SEQ ID NO: 168662 - protein, 16 aa, Borrelia garinii
KTKLEDISKEKTGGEK

SEQ ID NO: 168663 - protein, 16 aa, Borrelia garinii
TKLEDISKEKTGGEKT

SEQ ID NO: 168664 - protein, 16 aa, Borrelia garinii
KLEDISKEKTGGEKTP

SEQ ID NO: 168665 - protein, 16 aa, Borrelia garinii
LEDISKEKTGGEKTPA

SEQ ID NO: 168666 - protein, 16 aa, Borrelia garinii
EDISKEKTGGEKTPAV

SEQ ID NO: 168667 - protein, 16 aa, Borrelia garinii
DISKEKTGGEKTPAVE

SEQ ID NO: 168668 - protein, 16 aa, Borrelia garinii
ISKEKTGGEKTPAVEG

SEQ ID NO: 168669 - protein, 16 aa, Borrelia garinii
SKEKTGGEKTPAVEGI

SEQ ID NO: 168670 - protein, 16 aa, Borrelia garinii
KEKTGGEKTPAVEGIA

SEQ ID NO: 168671 - protein, 16 aa, Borrelia garinii
EKTGGEKTPAVEGIAE

SEQ ID NO: 168672 - protein, 16 aa, Borrelia garinii
KTGGEKTPAVEGIAEV

SEQ ID NO: 168673 - protein, 16 aa, Borrelia garinii
TGGEKTPAVEGIAEVV

SEQ ID NO: 168674 - protein, 16 aa, Borrelia garinii
GGEKTPAVEGIAEVVK

SEQ ID NO: 168675 - protein, 16 aa, Borrelia garinii
GEKTPAVEGIAEVVKT

SEQ ID NO: 168676 - protein, 16 aa, Borrelia garinii
EKTPAVEGIAEVVKTV

SEQ ID NO: 168677 - protein, 16 aa, Borrelia garinii
KTPAVEGIAEVVKTVG

SEQ ID NO: 168678 - protein, 16 aa, Borrelia garinii
TPAVEGIAEVVKTVGE

SEQ ID NO: 168679 - protein, 16 aa, Borrelia garinii
PAVEGIAEVVKTVGEW

SEQ ID NO: 168680 - protein, 16 aa, Borrelia garinii
AVEGIAEVVKTVGEWL

SEQ ID NO: 168681 - protein, 16 aa, Borrelia garinii
VEGIAEVVKTVGEWLD

SEQ ID NO: 168682 - protein, 16 aa, Borrelia garinii
EGIAEVVKTVGEWLDG

SEQ ID NO: 168683 - protein, 16 aa, Borrelia garinii
GIAEVVKTVGEWLDGL

SEQ ID NO: 168684 - protein, 16 aa, Borrelia garinii
IAEVVKTVGEWLDGLI

SEQ ID NO: 168685 - protein, 16 aa, Borrelia garinii
AEVVKTVGEWLDGLIK

SEQ ID NO: 168686 - protein, 16 aa, Borrelia garinii
EVVKTVGEWLDGLIKA

SEQ ID NO: 168687 - protein, 16 aa, Borrelia garinii
VVKTVGEWLDGLIKAA

SEQ ID NO: 168688 - protein, 16 aa, Borrelia garinii
VKTVGEWLDGLIKAAE

SEQ ID NO: 168689 - protein, 16 aa, Borrelia garinii
KTVGEWLDGLIKAAEG

SEQ ID NO: 168690 - protein, 16 aa, Borrelia garinii
TVGEWLDGLIKAAEGG

SEQ ID NO: 168691 - protein, 16 aa, Borrelia garinii
VGEWLDGLIKAAEGGG

SEQ ID NO: 168692 - protein, 16 aa, Borrelia garinii
GEWLDGLIKAAEGGGK

SEQ ID NO: 168693 - protein, 16 aa, Borrelia garinii
EWLDGLIKAAEGGGKA

SEQ ID NO: 168694 - protein, 16 aa, Borrelia garinii
WLDGLIKAAEGGGKAA

SEQ ID NO: 168695 - protein, 16 aa, Borrelia garinii
LDGLIKAAEGGGKAAD

SEQ ID NO: 168696 - protein, 16 aa, Borrelia garinii
DGLIKAAEGGGKAADG

SEQ ID NO: 168697 - protein, 16 aa, Borrelia garinii
GLIKAAEGGGKAADGG

SEQ ID NO: 168698 - protein, 16 aa, Borrelia garinii
LIKAAEGGGKAADGGG

SEQ ID NO: 168699 - protein, 16 aa, Borrelia garinii
IKAAEGGGKAADGGGS

SEQ ID NO: 168700 - protein, 16 aa, Borrelia garinii
KAAEGGGKAADGGGSD

SEQ ID NO: 168701 - protein, 16 aa, Borrelia garinii
AAEGGGKAADGGGSDK

SEQ ID NO: 168702 - protein, 16 aa, Borrelia garinii
AEGGGKAADGGGSDKI

SEQ ID NO: 168703 - protein, 16 aa, Borrelia garinii
EGGGKAADGGGSDKIG

SEQ ID NO: 168704 - protein, 16 aa, Borrelia garinii
GGGKAADGGGSDKIGN

SEQ ID NO: 168705 - protein, 16 aa, Borrelia garinii
GGKAADGGGSDKIGNV

SEQ ID NO: 168706 - protein, 16 aa, Borrelia garinii
GKAADGGGSDKIGNVA

SEQ ID NO: 168707 - protein, 16 aa, Borrelia garinii
KAADGGGSDKIGNVAA

SEQ ID NO: 168708 - protein, 16 aa, Borrelia garinii
AADGGGSDKIGNVAAG

SEQ ID NO: 168709 - protein, 16 aa, Borrelia garinii
ADGGGSDKIGNVAAGG

SEQ ID NO: 168710 - protein, 16 aa, Borrelia garinii
DGGGSDKIGNVAAGGG

SEQ ID NO: 168711 - protein, 16 aa, Borrelia garinii
GGGSDKIGNVAAGGGA

SEQ ID NO: 168712 - protein, 16 aa, Borrelia garinii
GGSDKIGNVAAGGGAG

SEQ ID NO: 168713 - protein, 16 aa, Borrelia garinii
GSDKIGNVAAGGGAGA

SEQ ID NO: 168714 - protein, 16 aa, Borrelia garinii
SDKIGNVAAGGGAGAD

SEQ ID NO: 168715 - protein, 16 aa, Borrelia garinii
DKIGNVAAGGGAGADK

SEQ ID NO: 168716 - protein, 16 aa, Borrelia garinii
KIGNVAAGGGAGADKE

SEQ ID NO: 168717 - protein, 16 aa, Borrelia garinii
IGNVAAGGGAGADKES

SEQ ID NO: 168718 - protein, 16 aa, Borrelia garinii
GNVAAGGGAGADKESV

SEQ ID NO: 168719 - protein, 16 aa, Borrelia garinii
NVAAGGGAGADKESVN

SEQ ID NO: 168720 - protein, 16 aa, Borrelia garinii
VAAGGGAGADKESVNG

SEQ ID NO: 168721 - protein, 16 aa, Borrelia garinii
AAGGGAGADKESVNGI

SEQ ID NO: 168722 - protein, 16 aa, Borrelia garinii
AGGGAGADKESVNGIA

SEQ ID NO: 168723 - protein, 16 aa, Borrelia garinii
GGGAGADKESVNGIAG

SEQ ID NO: 168724 - protein, 16 aa, Borrelia garinii
GGAGADKESVNGIAGA

SEQ ID NO: 168725 - protein, 16 aa, Borrelia garinii
GAGADKESVNGIAGAI

SEQ ID NO: 168726 - protein, 16 aa, Borrelia garinii
AGADKESVNGIAGAIK

SEQ ID NO: 168727 - protein, 16 aa, Borrelia garinii
GADKESVNGIAGAIKG

SEQ ID NO: 168728 - protein, 16 aa, Borrelia garinii
ADKESVNGIAGAIKGI

SEQ ID NO: 168729 - protein, 16 aa, Borrelia garinii
DKESVNGIAGAIKGIV

SEQ ID NO: 168730 - protein, 16 aa, Borrelia garinii
KESVNGIAGAIKGIVE

SEQ ID NO: 168731 - protein, 16 aa, Borrelia garinii
ESVNGIAGAIKGIVEA

SEQ ID NO: 168732 - protein, 16 aa, Borrelia garinii
SVNGIAGAIKGIVEAA

SEQ ID NO: 168733 - protein, 16 aa, Borrelia garinii
VNGIAGAIKGIVEAAK

SEQ ID NO: 168734 - protein, 16 aa, Borrelia garinii
NGIAGAIKGIVEAAKK

SEQ ID NO: 168735 - protein, 16 aa, Borrelia garinii
GIAGAIKGIVEAAKKV

SEQ ID NO: 168736 - protein, 16 aa, Borrelia garinii
IAGAIKGIVEAAKKVE

SEQ ID NO: 168737 - protein, 16 aa, Borrelia garinii
AGAIKGIVEAAKKVEG

SEQ ID NO: 168738 - protein, 16 aa, Borrelia garinii
GAIKGIVEAAKKVEGV

SEQ ID NO: 168739 - protein, 16 aa, Borrelia garinii
AIKGIVEAAKKVEGVK

SEQ ID NO: 168740 - protein, 16 aa, Borrelia garinii
IKGIVEAAKKVEGVKF

SEQ ID NO: 168741 - protein, 16 aa, Borrelia garinii
KGIVEAAKKVEGVKFA

SEQ ID NO: 168742 - protein, 16 aa, Borrelia garinii
GIVEAAKKVEGVKFAP

SEQ ID NO: 168743 - protein, 16 aa, Borrelia garinii
IVEAAKKVEGVKFAPK

SEQ ID NO: 168744 - protein, 16 aa, Borrelia garinii
VEAAKKVEGVKFAPKA

SEQ ID NO: 168745 - protein, 16 aa, Borrelia garinii
EAAKKVEGVKFAPKAA

SEQ ID NO: 168746 - protein, 16 aa, Borrelia garinii
AAKKVEGVKFAPKAAA

SEQ ID NO: 168747 - protein, 16 aa, Borrelia garinii
AKKVEGVKFAPKAAAD

SEQ ID NO: 168748 - protein, 16 aa, Borrelia garinii
KKVEGVKFAPKAAADA

SEQ ID NO: 168749 - protein, 16 aa, Borrelia garinii
KVEGVKFAPKAAADAA

SEQ ID NO: 168750 - protein, 16 aa, Borrelia garinii
VEGVKFAPKAAADAAA

SEQ ID NO: 168751 - protein, 16 aa, Borrelia garinii
EGVKFAPKAAADAAAA

SEQ ID NO: 168752 - protein, 16 aa, Borrelia garinii
GVKFAPKAAADAAAAD

SEQ ID NO: 168753 - protein, 16 aa, Borrelia garinii
VKFAPKAAADAAAADG

SEQ ID NO: 168754 - protein, 16 aa, Borrelia garinii
KFAPKAAADAAAADGN

SEQ ID NO: 168755 - protein, 16 aa, Borrelia garinii
FAPKAAADAAAADGNK

SEQ ID NO: 168756 - protein, 16 aa, Borrelia garinii
APKAAADAAAADGNKK

SEQ ID NO: 168757 - protein, 16 aa, Borrelia garinii
PKAAADAAAADGNKKA

SEQ ID NO: 168758 - protein, 16 aa, Borrelia garinii
KAAADAAAADGNKKAG

SEQ ID NO: 168759 - protein, 16 aa, Borrelia garinii
AAADAAAADGNKKAGK

SEQ ID NO: 168760 - protein, 16 aa, Borrelia garinii
AADAAAADGNKKAGKL

SEQ ID NO: 168761 - protein, 16 aa, Borrelia garinii
ADAAAADGNKKAGKLF

SEQ ID NO: 168762 - protein, 16 aa, Borrelia garinii
DAAAADGNKKAGKLFG

SEQ ID NO: 168763 - protein, 16 aa, Borrelia garinii
AAAADGNKKAGKLFGT

SEQ ID NO: 168764 - protein, 16 aa, Borrelia garinii
AAADGNKKAGKLFGTA

SEQ ID NO: 168765 - protein, 16 aa, Borrelia garinii
AADGNKKAGKLFGTAA

SEQ ID NO: 168766 - protein, 16 aa, Borrelia garinii
ADGNKKAGKLFGTAAG

SEQ ID NO: 168767 - protein, 16 aa, Borrelia garinii
DGNKKAGKLFGTAAGA

SEQ ID NO: 168768 - protein, 16 aa, Borrelia garinii
GNKKAGKLFGTAAGAD

SEQ ID NO: 168769 - protein, 16 aa, Borrelia garinii
NKKAGKLFGTAAGADA

SEQ ID NO: 168770 - protein, 16 aa, Borrelia garinii
KKAGKLFGTAAGADAG

SEQ ID NO: 168771 - protein, 16 aa, Borrelia garinii
KAGKLFGTAAGADAGD

SEQ ID NO: 168772 - protein, 16 aa, Borrelia garinii
AGKLFGTAAGADAGDV

SEQ ID NO: 168773 - protein, 16 aa, Borrelia garinii
GKLFGTAAGADAGDVK

SEQ ID NO: 168774 - protein, 16 aa, Borrelia garinii
KLFGTAAGADAGDVKD

SEQ ID NO: 168775 - protein, 16 aa, Borrelia garinii
LFGTAAGADAGDVKDA

SEQ ID NO: 168776 - protein, 16 aa, Borrelia garinii
FGTAAGADAGDVKDAA

SEQ ID NO: 168777 - protein, 16 aa, Borrelia garinii
GTAAGADAGDVKDAAA

SEQ ID NO: 168778 - protein, 16 aa, Borrelia garinii
TAAGADAGDVKDAAAA

SEQ ID NO: 168779 - protein, 16 aa, Borrelia garinii
AAGADAGDVKDAAAAV

SEQ ID NO: 168780 - protein, 16 aa, Borrelia garinii
AGADAGDVKDAAAAVG

SEQ ID NO: 168781 - protein, 16 aa, Borrelia garinii
GADAGDVKDAAAAVGA

SEQ ID NO: 168782 - protein, 16 aa, Borrelia garinii
ADAGDVKDAAAAVGAV

SEQ ID NO: 168783 - protein, 16 aa, Borrelia garinii
DAGDVKDAAAAVGAVS

SEQ ID NO: 168784 - protein, 16 aa, Borrelia garinii
AGDVKDAAAAVGAVSG

SEQ ID NO: 168785 - protein, 16 aa, Borrelia garinii
GDVKDAAAAVGAVSGE

SEQ ID NO: 168786 - protein, 16 aa, Borrelia garinii
DVKDAAAAVGAVSGEQ

SEQ ID NO: 168787 - protein, 16 aa, Borrelia garinii
VKDAAAAVGAVSGEQI

SEQ ID NO: 168788 - protein, 16 aa, Borrelia garinii
KDAAAAVGAVSGEQIL

SEQ ID NO: 168789 - protein, 16 aa, Borrelia garinii
DAAAAVGAVSGEQILN

SEQ ID NO: 168790 - protein, 16 aa, Borrelia garinii
AAAAVGAVSGEQILNA

SEQ ID NO: 168791 - protein, 16 aa, Borrelia garinii
AAAVGAVSGEQILNAI

SEQ ID NO: 168792 - protein, 16 aa, Borrelia garinii
AAVGAVSGEQILNAIV

SEQ ID NO: 168793 - protein, 16 aa, Borrelia garinii
AVGAVSGEQILNAIVT

SEQ ID NO: 168794 - protein, 16 aa, Borrelia garinii
VGAVSGEQILNAIVTA

SEQ ID NO: 168795 - protein, 16 aa, Borrelia garinii
GAVSGEQILNAIVTAA

SEQ ID NO: 168796 - protein, 16 aa, Borrelia garinii
AVSGEQILNAIVTAAG

SEQ ID NO: 168797 - protein, 16 aa, Borrelia garinii
VSGEQILNAIVTAAGQ

SEQ ID NO: 168798 - protein, 16 aa, Borrelia garinii
SGEQILNAIVTAAGQA

SEQ ID NO: 168799 - protein, 16 aa, Borrelia garinii
GEQILNAIVTAAGQAG

SEQ ID NO: 168800 - protein, 16 aa, Borrelia garinii
EQILNAIVTAAGQAGQ

SEQ ID NO: 168801 - protein, 16 aa, Borrelia garinii
QILNAIVTAAGQAGQA

SEQ ID NO: 168802 - protein, 16 aa, Borrelia garinii
ILNAIVTAAGQAGQAG

SEQ ID NO: 168803 - protein, 16 aa, Borrelia garinii
LNAIVTAAGQAGQAGK

SEQ ID NO: 168804 - protein, 16 aa, Borrelia garinii
NAIVTAAGQAGQAGKK

SEQ ID NO: 168805 - protein, 16 aa, Borrelia garinii
AIVTAAGQAGQAGKKA

SEQ ID NO: 168806 - protein, 16 aa, Borrelia garinii
IVTAAGQAGQAGKKAD

SEQ ID NO: 168807 - protein, 16 aa, Borrelia garinii
VTAAGQAGQAGKKADE

SEQ ID NO: 168808 - protein, 16 aa, Borrelia garinii
TAAGQAGQAGKKADEA

SEQ ID NO: 168809 - protein, 16 aa, Borrelia garinii
AAGQAGQAGKKADEAK

SEQ ID NO: 168810 - protein, 16 aa, Borrelia garinii
AGQAGQAGKKADEAKN

SEQ ID NO: 168811 - protein, 16 aa, Borrelia garinii
GQAGQAGKKADEAKNA

SEQ ID NO: 168812 - protein, 16 aa, Borrelia garinii
QAGQAGKKADEAKNAI

SEQ ID NO: 168813 - protein, 16 aa, Borrelia garinii
AGQAGKKADEAKNAIE

SEQ ID NO: 168814 - protein, 16 aa, Borrelia garinii
GQAGKKADEAKNAIEA

SEQ ID NO: 168815 - protein, 16 aa, Borrelia garinii
QAGKKADEAKNAIEAA

SEQ ID NO: 168816 - protein, 16 aa, Borrelia garinii
AGKKADEAKNAIEAAI

SEQ ID NO: 168817 - protein, 16 aa, Borrelia garinii
GKKADEAKNAIEAAIG

SEQ ID NO: 168818 - protein, 16 aa, Borrelia garinii
KKADEAKNAIEAAIGA

SEQ ID NO: 168819 - protein, 16 aa, Borrelia garinii
KADEAKNAIEAAIGAA

SEQ ID NO: 168820 - protein, 16 aa, Borrelia garinii
ADEAKNAIEAAIGAAG

SEQ ID NO: 168821 - protein, 16 aa, Borrelia garinii
DEAKNAIEAAIGAAGD

SEQ ID NO: 168822 - protein, 16 aa, Borrelia garinii
EAKNAIEAAIGAAGDA

SEQ ID NO: 168823 - protein, 16 aa, Borrelia garinii
AKNAIEAAIGAAGDAD

SEQ ID NO: 168824 - protein, 16 aa, Borrelia garinii
KNAIEAAIGAAGDADF

SEQ ID NO: 168825 - protein, 16 aa, Borrelia garinii
NAIEAAIGAAGDADFG

SEQ ID NO: 168826 - protein, 16 aa, Borrelia garinii
AIEAAIGAAGDADFGD

SEQ ID NO: 168827 - protein, 16 aa, Borrelia garinii
IEAAIGAAGDADFGDD

SEQ ID NO: 168828 - protein, 16 aa, Borrelia garinii
EAAIGAAGDADFGDDI

SEQ ID NO: 168829 - protein, 16 aa, Borrelia garinii
AAIGAAGDADFGDDIK

SEQ ID NO: 168830 - protein, 16 aa, Borrelia garinii
AIGAAGDADFGDDIKK

SEQ ID NO: 168831 - protein, 16 aa, Borrelia garinii
IGAAGDADFGDDIKKK

SEQ ID NO: 168832 - protein, 16 aa, Borrelia garinii
GAAGDADFGDDIKKKN

SEQ ID NO: 168833 - protein, 16 aa, Borrelia garinii
AAGDADFGDDIKKKND

SEQ ID NO: 168834 - protein, 16 aa, Borrelia garinii
AGDADFGDDIKKKNDQ

SEQ ID NO: 168835 - protein, 16 aa, Borrelia garinii
GDADFGDDIKKKNDQI

SEQ ID NO: 168836 - protein, 16 aa, Borrelia garinii
DADFGDDIKKKNDQIA

SEQ ID NO: 168837 - protein, 16 aa, Borrelia garinii
ADFGDDIKKKNDQIAA

SEQ ID NO: 168838 - protein, 16 aa, Borrelia garinii
DFGDDIKKKNDQIAAA

SEQ ID NO: 168839 - protein, 16 aa, Borrelia garinii
FGDDIKKKNDQIAAAL

SEQ ID NO: 168840 - protein, 16 aa, Borrelia garinii
GDDIKKKNDQIAAALV

SEQ ID NO: 168841 - protein, 16 aa, Borrelia garinii
DDIKKKNDQIAAALVL

SEQ ID NO: 168842 - protein, 16 aa, Borrelia garinii
DIKKKNDQIAAALVLR

SEQ ID NO: 168843 - protein, 16 aa, Borrelia garinii
IKKKNDQIAAALVLRG

SEQ ID NO: 168844 - protein, 16 aa, Borrelia garinii
KKKNDQIAAALVLRGV

SEQ ID NO: 168845 - protein, 16 aa, Borrelia garinii
KKNDQIAAALVLRGVA

SEQ ID NO: 168846 - protein, 16 aa, Borrelia garinii
KNDQIAAALVLRGVAK

SEQ ID NO: 168847 - protein, 16 aa, Borrelia garinii
NDQIAAALVLRGVAKD

SEQ ID NO: 168848 - protein, 16 aa, Borrelia garinii
DQIAAALVLRGVAKDG

SEQ ID NO: 168849 - protein, 16 aa, Borrelia garinii
QIAAALVLRGVAKDGK

SEQ ID NO: 168850 - protein, 16 aa, Borrelia garinii
IAAALVLRGVAKDGKF

SEQ ID NO: 168851 - protein, 16 aa, Borrelia garinii
AAALVLRGVAKDGKFA

SEQ ID NO: 168852 - protein, 16 aa, Borrelia garinii
AALVLRGVAKDGKFAG

SEQ ID NO: 168853 - protein, 16 aa, Borrelia garinii
ALVLRGVAKDGKFAGA

SEQ ID NO: 168854 - protein, 8 aa, Borrelia afzelii PKo
MKKISSAI

SEQ ID NO: 168855 - protein, 8 aa, Borrelia afzelii PKo
KKISSAIF

SEQ ID NO: 168856 - protein, 8 aa, Borrelia afzelii PKo
KISSAIFL

SEQ ID NO: 168857 - protein, 8 aa, Borrelia afzelii PKo
ISSAIFLT

SEQ ID NO: 168858 - protein, 8 aa, Borrelia afzelii PKo
SSAIFLTA

SEQ ID NO: 168859 - protein, 8 aa, Borrelia afzelii PKo
SAIFLTAL

SEQ ID NO: 168860 - protein, 8 aa, Borrelia afzelii PKo
AIFLTALL

SEQ ID NO: 168861 - protein, 8 aa, Borrelia afzelii PKo
IFLTALLV

SEQ ID NO: 168862 - protein, 8 aa, Borrelia afzelii PKo
FLTALLVF

SEQ ID NO: 168863 - protein, 8 aa, Borrelia afzelii PKo
LTALLVFI

SEQ ID NO: 168864 - protein, 8 aa, Borrelia afzelii PKo
TALLVFIN

SEQ ID NO: 168865 - protein, 8 aa, Borrelia afzelii PKo
ALLVFINC

SEQ ID NO: 168866 - protein, 8 aa, Borrelia afzelii PKo
LLVFINCK

SEQ ID NO: 168867 - protein, 8 aa, Borrelia afzelii PKo
LVFINCKN

SEQ ID NO: 168868 - protein, 8 aa, Borrelia afzelii PKo
VFINCKNN

SEQ ID NO: 168869 - protein, 8 aa, Borrelia afzelii PKo
FINCKNNA

SEQ ID NO: 168870 - protein, 8 aa, Borrelia afzelii PKo
INCKNNAV

SEQ ID NO: 168871 - protein, 8 aa, Borrelia afzelii PKo
NCKNNAVG

SEQ ID NO: 168872 - protein, 8 aa, Borrelia afzelii PKo
CKNNAVGK

SEQ ID NO: 168873 - protein, 8 aa, Borrelia afzelii PKo
KNNAVGKG

SEQ ID NO: 168874 - protein, 8 aa, Borrelia afzelii PKo
NNAVGKGN

SEQ ID NO: 168875 - protein, 8 aa, Borrelia afzelii PKo
NAVGKGND

SEQ ID NO: 168876 - protein, 8 aa, Borrelia afzelii PKo
AVGKGNDD

SEQ ID NO: 168877 - protein, 8 aa, Borrelia afzelii PKo
VGKGNDDK

SEQ ID NO: 168878 - protein, 8 aa, Borrelia afzelii PKo
GKGNDDKD

SEQ ID NO: 168879 - protein, 8 aa, Borrelia afzelii PKo
KGNDDKDS

SEQ ID NO: 168880 - protein, 8 aa, Borrelia afzelii PKo
GNDDKDSV

SEQ ID NO: 168881 - protein, 8 aa, Borrelia afzelii PKo
NDDKDSVK

SEQ ID NO: 168882 - protein, 8 aa, Borrelia afzelii PKo
DDKDSVKT

SEQ ID NO: 168883 - protein, 8 aa, Borrelia afzelii PKo
DKDSVKTF

SEQ ID NO: 168884 - protein, 8 aa, Borrelia afzelii PKo
KDSVKTFY

SEQ ID NO: 168885 - protein, 8 aa, Borrelia afzelii PKo
DSVKTFYE

SEQ ID NO: 168886 - protein, 8 aa, Borrelia afzelii PKo
SVKTFYES

SEQ ID NO: 168887 - protein, 8 aa, Borrelia afzelii PKo
VKTFYESI

SEQ ID NO: 168888 - protein, 8 aa, Borrelia afzelii PKo
KTFYESII

SEQ ID NO: 168889 - protein, 8 aa, Borrelia afzelii PKo
TFYESIIN

SEQ ID NO: 168890 - protein, 8 aa, Borrelia afzelii PKo
FYESIINL

SEQ ID NO: 168891 - protein, 8 aa, Borrelia afzelii PKo
YESIINLG

SEQ ID NO: 168892 - protein, 8 aa, Borrelia afzelii PKo
ESIINLGN

SEQ ID NO: 168893 - protein, 8 aa, Borrelia afzelii PKo
SIINLGNG

SEQ ID NO: 168894 - protein, 8 aa, Borrelia afzelii PKo
IINLGNGF

SEQ ID NO: 168895 - protein, 8 aa, Borrelia afzelii PKo
INLGNGFI

SEQ ID NO: 168896 - protein, 8 aa, Borrelia afzelii PKo
NLGNGFID

SEQ ID NO: 168897 - protein, 8 aa, Borrelia afzelii PKo
LGNGFIDV

SEQ ID NO: 168898 - protein, 8 aa, Borrelia afzelii PKo
GNGFIDVF

SEQ ID NO: 168899 - protein, 8 aa, Borrelia afzelii PKo
NGFIDVFN

SEQ ID NO: 168900 - protein, 8 aa, Borrelia afzelii PKo
GFIDVFNA

SEQ ID NO: 168901 - protein, 8 aa, Borrelia afzelii PKo
FIDVFNAF

SEQ ID NO: 168902 - protein, 8 aa, Borrelia afzelii PKo
IDVFNAFS

SEQ ID NO: 168903 - protein, 8 aa, Borrelia afzelii PKo
DVFNAFSG

SEQ ID NO: 168904 - protein, 8 aa, Borrelia afzelii PKo
VFNAFSGL

SEQ ID NO: 168905 - protein, 8 aa, Borrelia afzelii PKo
FNAFSGLV

SEQ ID NO: 168906 - protein, 8 aa, Borrelia afzelii PKo
NAFSGLVA

SEQ ID NO: 168907 - protein, 8 aa, Borrelia afzelii PKo
AFSGLVAD

SEQ ID NO: 168908 - protein, 8 aa, Borrelia afzelii PKo
FSGLVADT

SEQ ID NO: 168909 - protein, 8 aa, Borrelia afzelii PKo
SGLVADTF

SEQ ID NO: 168910 - protein, 8 aa, Borrelia afzelii PKo
GLVADTFF

SEQ ID NO: 168911 - protein, 8 aa, Borrelia afzelii PKo
LVADTFFK

SEQ ID NO: 168912 - protein, 8 aa, Borrelia afzelii PKo
VADTFFKS

SEQ ID NO: 168913 - protein, 8 aa, Borrelia afzelii PKo
ADTFFKSD

SEQ ID NO: 168914 - protein, 8 aa, Borrelia afzelii PKo
DTFFKSDP

SEQ ID NO: 168915 - protein, 8 aa, Borrelia afzelii PKo
TFFKSDPK

SEQ ID NO: 168916 - protein, 8 aa, Borrelia afzelii PKo
FFKSDPKK

SEQ ID NO: 168917 - protein, 8 aa, Borrelia afzelii PKo
FKSDPKKS

SEQ ID NO: 168918 - protein, 8 aa, Borrelia afzelii PKo
KSDPKKSD

SEQ ID NO: 168919 - protein, 8 aa, Borrelia afzelii PKo
SDPKKSDV

SEQ ID NO: 168920 - protein, 8 aa, Borrelia afzelii PKo
DPKKSDVK

SEQ ID NO: 168921 - protein, 8 aa, Borrelia afzelii PKo
PKKSDVKT

SEQ ID NO: 168922 - protein, 8 aa, Borrelia afzelii PKo
KKSDVKTY

SEQ ID NO: 168923 - protein, 8 aa, Borrelia afzelii PKo
KSDVKTYF

SEQ ID NO: 168924 - protein, 8 aa, Borrelia afzelii PKo
SDVKTYFE

SEQ ID NO: 168925 - protein, 8 aa, Borrelia afzelii PKo
DVKTYFES

SEQ ID NO: 168926 - protein, 8 aa, Borrelia afzelii PKo
VKTYFESI

SEQ ID NO: 168927 - protein, 8 aa, Borrelia afzelii PKo
KTYFESIS

SEQ ID NO: 168928 - protein, 8 aa, Borrelia afzelii PKo
TYFESISS

SEQ ID NO: 168929 - protein, 8 aa, Borrelia afzelii PKo
YFESISST

SEQ ID NO: 168930 - protein, 8 aa, Borrelia afzelii PKo
FESISSTL

SEQ ID NO: 168931 - protein, 8 aa, Borrelia afzelii PKo
ESISSTLK

SEQ ID NO: 168932 - protein, 8 aa, Borrelia afzelii PKo
SISSTLKA

SEQ ID NO: 168933 - protein, 8 aa, Borrelia afzelii PKo
ISSTLKAT

SEQ ID NO: 168934 - protein, 8 aa, Borrelia afzelii PKo
SSTLKATK

SEQ ID NO: 168935 - protein, 8 aa, Borrelia afzelii PKo
STLKATKG

SEQ ID NO: 168936 - protein, 8 aa, Borrelia afzelii PKo
TLKATKGK

SEQ ID NO: 168937 - protein, 8 aa, Borrelia afzelii PKo
LKATKGKL

SEQ ID NO: 168938 - protein, 8 aa, Borrelia afzelii PKo
KATKGKLD

SEQ ID NO: 168939 - protein, 8 aa, Borrelia afzelii PKo
ATKGKLDE

SEQ ID NO: 168940 - protein, 8 aa, Borrelia afzelii PKo
TKGKLDEL

SEQ ID NO: 168941 - protein, 8 aa, Borrelia afzelii PKo
KGKLDELV

SEQ ID NO: 168942 - protein, 8 aa, Borrelia afzelii PKo
GKLDELVS

SEQ ID NO: 168943 - protein, 8 aa, Borrelia afzelii PKo
KLDELVSA

SEQ ID NO: 168944 - protein, 8 aa, Borrelia afzelii PKo
LDELVSAK

SEQ ID NO: 168945 - protein, 8 aa, Borrelia afzelii PKo
DELVSAKK

SEQ ID NO: 168946 - protein, 8 aa, Borrelia afzelii PKo
ELVSAKKG

SEQ ID NO: 168947 - protein, 8 aa, Borrelia afzelii PKo
LVSAKKGE

SEQ ID NO: 168948 - protein, 8 aa, Borrelia afzelii PKo
VSAKKGEG

SEQ ID NO: 168949 - protein, 8 aa, Borrelia afzelii PKo
SAKKGEGG

SEQ ID NO: 168950 - protein, 8 aa, Borrelia afzelii PKo
AKKGEGGS

SEQ ID NO: 168951 - protein, 8 aa, Borrelia afzelii PKo
KKGEGGSV

SEQ ID NO: 168952 - protein, 8 aa, Borrelia afzelii PKo
KGEGGSVK

SEQ ID NO: 168953 - protein, 8 aa, Borrelia afzelii PKo
GEGGSVKA

SEQ ID NO: 168954 - protein, 8 aa, Borrelia afzelii PKo
EGGSVKAS

SEQ ID NO: 168955 - protein, 8 aa, Borrelia afzelii PKo
GGSVKASV

SEQ ID NO: 168956 - protein, 8 aa, Borrelia afzelii PKo
GSVKASVE

SEQ ID NO: 168957 - protein, 8 aa, Borrelia afzelii PKo
SVKASVES

SEQ ID NO: 168958 - protein, 8 aa, Borrelia afzelii PKo
VKASVESA

SEQ ID NO: 168959 - protein, 8 aa, Borrelia afzelii PKo
KASVESAV

SEQ ID NO: 168960 - protein, 8 aa, Borrelia afzelii PKo
ASVESAVD

SEQ ID NO: 168961 - protein, 8 aa, Borrelia afzelii PKo
SVESAVDE

SEQ ID NO: 168962 - protein, 8 aa, Borrelia afzelii PKo
VESAVDEV

SEQ ID NO: 168963 - protein, 8 aa, Borrelia afzelii PKo
ESAVDEVS

SEQ ID NO: 168964 - protein, 8 aa, Borrelia afzelii PKo
SAVDEVSK

SEQ ID NO: 168965 - protein, 8 aa, Borrelia afzelii PKo
AVDEVSKW

SEQ ID NO: 168966 - protein, 8 aa, Borrelia afzelii PKo
VDEVSKWL

SEQ ID NO: 168967 - protein, 8 aa, Borrelia afzelii PKo
DEVSKWLE

SEQ ID NO: 168968 - protein, 8 aa, Borrelia afzelii PKo
EVSKWLEE

SEQ ID NO: 168969 - protein, 8 aa, Borrelia afzelii PKo
VSKWLEEM

SEQ ID NO: 168970 - protein, 8 aa, Borrelia afzelii PKo
SKWLEEMI

SEQ ID NO: 168971 - protein, 8 aa, Borrelia afzelii PKo
KWLEEMIK

SEQ ID NO: 168972 - protein, 8 aa, Borrelia afzelii PKo
WLEEMIKA

SEQ ID NO: 168973 - protein, 8 aa, Borrelia afzelii PKo
LEEMIKAA

SEQ ID NO: 168974 - protein, 8 aa, Borrelia afzelii PKo
EEMIKAAE

SEQ ID NO: 168975 - protein, 8 aa, Borrelia afzelii PKo
EMIKAAEE

SEQ ID NO: 168976 - protein, 8 aa, Borrelia afzelii PKo
MIKAAEEA

SEQ ID NO: 168977 - protein, 8 aa, Borrelia afzelii PKo
IKAAEEAA

SEQ ID NO: 168978 - protein, 8 aa, Borrelia afzelii PKo
KAAEEAAK

SEQ ID NO: 168979 - protein, 8 aa, Borrelia afzelii PKo
AAEEAAKV

SEQ ID NO: 168980 - protein, 8 aa, Borrelia afzelii PKo
AEEAAKVG

SEQ ID NO: 168981 - protein, 8 aa, Borrelia afzelii PKo
EEAAKVGG

SEQ ID NO: 168982 - protein, 8 aa, Borrelia afzelii PKo
EAAKVGGT

SEQ ID NO: 168983 - protein, 8 aa, Borrelia afzelii PKo
AAKVGGTG

SEQ ID NO: 168984 - protein, 8 aa, Borrelia afzelii PKo
AKVGGTGG

SEQ ID NO: 168985 - protein, 8 aa, Borrelia afzelii PKo
KVGGTGGD

SEQ ID NO: 168986 - protein, 8 aa, Borrelia afzelii PKo
VGGTGGDG

SEQ ID NO: 168987 - protein, 8 aa, Borrelia afzelii PKo
GGTGGDGK

SEQ ID NO: 168988 - protein, 8 aa, Borrelia afzelii PKo
GTGGDGKI

SEQ ID NO: 168989 - protein, 8 aa, Borrelia afzelii PKo
TGGDGKIG

SEQ ID NO: 168990 - protein, 8 aa, Borrelia afzelii PKo
GGDGKIGD

SEQ ID NO: 168991 - protein, 8 aa, Borrelia afzelii PKo
GDGKIGDS

SEQ ID NO: 168992 - protein, 8 aa, Borrelia afzelii PKo
DGKIGDSA

SEQ ID NO: 168993 - protein, 8 aa, Borrelia afzelii PKo
GKIGDSAA

SEQ ID NO: 168994 - protein, 8 aa, Borrelia afzelii PKo
KIGDSAAN

SEQ ID NO: 168995 - protein, 8 aa, Borrelia afzelii PKo
IGDSAANH

SEQ ID NO: 168996 - protein, 8 aa, Borrelia afzelii PKo
GDSAANHG

SEQ ID NO: 168997 - protein, 8 aa, Borrelia afzelii PKo
DSAANHGA

SEQ ID NO: 168998 - protein, 8 aa, Borrelia afzelii PKo
SAANHGAK

SEQ ID NO: 168999 - protein, 8 aa, Borrelia afzelii PKo
AANHGAKA

SEQ ID NO: 169000 - protein, 8 aa, Borrelia afzelii PKo
ANHGAKAD

SEQ ID NO: 169001 - protein, 8 aa, Borrelia afzelii PKo
NHGAKADK

SEQ ID NO: 169002 - protein, 8 aa, Borrelia afzelii PKo
HGAKADKD

SEQ ID NO: 169003 - protein, 8 aa, Borrelia afzelii PKo
GAKADKDS

SEQ ID NO: 169004 - protein, 8 aa, Borrelia afzelii PKo
AKADKDSV

SEQ ID NO: 169005 - protein, 8 aa, Borrelia afzelii PKo
KADKDSVK

SEQ ID NO: 169006 - protein, 8 aa, Borrelia afzelii PKo
ADKDSVKG

SEQ ID NO: 169007 - protein, 8 aa, Borrelia afzelii PKo
DKDSVKGI

SEQ ID NO: 169008 - protein, 8 aa, Borrelia afzelii PKo
KDSVKGIA

SEQ ID NO: 169009 - protein, 8 aa, Borrelia afzelii PKo
DSVKGIAK

SEQ ID NO: 169010 - protein, 8 aa, Borrelia afzelii PKo
SVKGIAKG

SEQ ID NO: 169011 - protein, 8 aa, Borrelia afzelii PKo
VKGIAKGI

SEQ ID NO: 169012 - protein, 8 aa, Borrelia afzelii PKo
KGIAKGIK

SEQ ID NO: 169013 - protein, 8 aa, Borrelia afzelii PKo
GIAKGIKG

SEQ ID NO: 169014 - protein, 8 aa, Borrelia afzelii PKo
IAKGIKGI

SEQ ID NO: 169015 - protein, 8 aa, Borrelia afzelii PKo
AKGIKGIV

SEQ ID NO: 169016 - protein, 8 aa, Borrelia afzelii PKo
KGIKGIVD

SEQ ID NO: 169017 - protein, 8 aa, Borrelia afzelii PKo
GIKGIVDA

SEQ ID NO: 169018 - protein, 8 aa, Borrelia afzelii PKo
IKGIVDAA

SEQ ID NO: 169019 - protein, 8 aa, Borrelia afzelii PKo
KGIVDAAG

SEQ ID NO: 169020 - protein, 8 aa, Borrelia afzelii PKo
GIVDAAGK

SEQ ID NO: 169021 - protein, 8 aa, Borrelia afzelii PKo
IVDAAGKA

SEQ ID NO: 169022 - protein, 8 aa, Borrelia afzelii PKo
VDAAGKAL

SEQ ID NO: 169023 - protein, 8 aa, Borrelia afzelii PKo
DAAGKALG

SEQ ID NO: 169024 - protein, 8 aa, Borrelia afzelii PKo
AAGKALGE

SEQ ID NO: 169025 - protein, 8 aa, Borrelia afzelii PKo
AGKALGEK

SEQ ID NO: 169026 - protein, 8 aa, Borrelia afzelii PKo
GKALGEKG

SEQ ID NO: 169027 - protein, 8 aa, Borrelia afzelii PKo
KALGEKGA

SEQ ID NO: 169028 - protein, 8 aa, Borrelia afzelii PKo
ALGEKGAL

SEQ ID NO: 169029 - protein, 8 aa, Borrelia afzelii PKo
LGEKGALK

SEQ ID NO: 169030 - protein, 8 aa, Borrelia afzelii PKo
GEKGALKD

SEQ ID NO: 169031 - protein, 8 aa, Borrelia afzelii PKo
EKGALKDV

SEQ ID NO: 169032 - protein, 8 aa, Borrelia afzelii PKo
KGALKDVK

SEQ ID NO: 169033 - protein, 8 aa, Borrelia afzelii PKo
GALKDVKA

SEQ ID NO: 169034 - protein, 8 aa, Borrelia afzelii PKo
ALKDVKAA

SEQ ID NO: 169035 - protein, 8 aa, Borrelia afzelii PKo
LKDVKAAA

SEQ ID NO: 169036 - protein, 8 aa, Borrelia afzelii PKo
KDVKAAAD

SEQ ID NO: 169037 - protein, 8 aa, Borrelia afzelii PKo
DVKAAADD

SEQ ID NO: 169038 - protein, 8 aa, Borrelia afzelii PKo
VKAAADDE

SEQ ID NO: 169039 - protein, 8 aa, Borrelia afzelii PKo
KAAADDEA

SEQ ID NO: 169040 - protein, 8 aa, Borrelia afzelii PKo
AAADDEAN

SEQ ID NO: 169041 - protein, 8 aa, Borrelia afzelii PKo
AADDEANA

SEQ ID NO: 169042 - protein, 8 aa, Borrelia afzelii PKo
ADDEANAD

SEQ ID NO: 169043 - protein, 8 aa, Borrelia afzelii PKo
DDEANADA

SEQ ID NO: 169044 - protein, 8 aa, Borrelia afzelii PKo
DEANADAG

SEQ ID NO: 169045 - protein, 8 aa, Borrelia afzelii PKo
EANADAGK

SEQ ID NO: 169046 - protein, 8 aa, Borrelia afzelii PKo
ANADAGKL

SEQ ID NO: 169047 - protein, 8 aa, Borrelia afzelii PKo
NADAGKLF

SEQ ID NO: 169048 - protein, 8 aa, Borrelia afzelii PKo
ADAGKLFA

SEQ ID NO: 169049 - protein, 8 aa, Borrelia afzelii PKo
DAGKLFAG

SEQ ID NO: 169050 - protein, 8 aa, Borrelia afzelii PKo
AGKLFAGN

SEQ ID NO: 169051 - protein, 8 aa, Borrelia afzelii PKo
GKLFAGNA

SEQ ID NO: 169052 - protein, 8 aa, Borrelia afzelii PKo
KLFAGNAN

SEQ ID NO: 169053 - protein, 8 aa, Borrelia afzelii PKo
LFAGNANA

SEQ ID NO: 169054 - protein, 8 aa, Borrelia afzelii PKo
FAGNANAA

SEQ ID NO: 169055 - protein, 8 aa, Borrelia afzelii PKo
AGNANAAV

SEQ ID NO: 169056 - protein, 8 aa, Borrelia afzelii PKo
GNANAAVG

SEQ ID NO: 169057 - protein, 8 aa, Borrelia afzelii PKo
NANAAVGA

SEQ ID NO: 169058 - protein, 8 aa, Borrelia afzelii PKo
ANAAVGAA

SEQ ID NO: 169059 - protein, 8 aa, Borrelia afzelii PKo
NAAVGAAA

SEQ ID NO: 169060 - protein, 8 aa, Borrelia afzelii PKo
AAVGAAAD

SEQ ID NO: 169061 - protein, 8 aa, Borrelia afzelii PKo
AVGAAADI

SEQ ID NO: 169062 - protein, 8 aa, Borrelia afzelii PKo
VGAAADIA

SEQ ID NO: 169063 - protein, 8 aa, Borrelia afzelii PKo
GAAADIAK

SEQ ID NO: 169064 - protein, 8 aa, Borrelia afzelii PKo
AAADIAKA

SEQ ID NO: 169065 - protein, 8 aa, Borrelia afzelii PKo
AADIAKAA

SEQ ID NO: 169066 - protein, 8 aa, Borrelia afzelii PKo
ADIAKAAG

SEQ ID NO: 169067 - protein, 8 aa, Borrelia afzelii PKo
DIAKAAGA

SEQ ID NO: 169068 - protein, 8 aa, Borrelia afzelii PKo
IAKAAGAV

SEQ ID NO: 169069 - protein, 8 aa, Borrelia afzelii PKo
AKAAGAVT

SEQ ID NO: 169070 - protein, 8 aa, Borrelia afzelii PKo
KAAGAVTA

SEQ ID NO: 169071 - protein, 8 aa, Borrelia afzelii PKo
AAGAVTAV

SEQ ID NO: 169072 - protein, 8 aa, Borrelia afzelii PKo
AGAVTAVS

SEQ ID NO: 169073 - protein, 8 aa, Borrelia afzelii PKo
GAVTAVSG

SEQ ID NO: 169074 - protein, 8 aa, Borrelia afzelii PKo
AVTAVSGE

SEQ ID NO: 169075 - protein, 8 aa, Borrelia afzelii PKo
VTAVSGEQ

SEQ ID NO: 169076 - protein, 8 aa, Borrelia afzelii PKo
TAVSGEQI

SEQ ID NO: 169077 - protein, 8 aa, Borrelia afzelii PKo
AVSGEQIL

SEQ ID NO: 169078 - protein, 8 aa, Borrelia afzelii PKo
VSGEQILK

SEQ ID NO: 169079 - protein, 8 aa, Borrelia afzelii PKo
SGEQILKA

SEQ ID NO: 169080 - protein, 8 aa, Borrelia afzelii PKo
GEQILKAI

SEQ ID NO: 169081 - protein, 8 aa, Borrelia afzelii PKo
EQILKAIV

SEQ ID NO: 169082 - protein, 8 aa, Borrelia afzelii PKo
QILKAIVE

SEQ ID NO: 169083 - protein, 8 aa, Borrelia afzelii PKo
ILKAIVEA

SEQ ID NO: 169084 - protein, 8 aa, Borrelia afzelii PKo
LKAIVEAA

SEQ ID NO: 169085 - protein, 8 aa, Borrelia afzelii PKo
KAIVEAAG

SEQ ID NO: 169086 - protein, 8 aa, Borrelia afzelii PKo
AIVEAAGD

SEQ ID NO: 169087 - protein, 8 aa, Borrelia afzelii PKo
IVEAAGDP

SEQ ID NO: 169088 - protein, 8 aa, Borrelia afzelii PKo
VEAAGDPA

SEQ ID NO: 169089 - protein, 8 aa, Borrelia afzelii PKo
EAAGDPAN

SEQ ID NO: 169090 - protein, 8 aa, Borrelia afzelii PKo
AAGDPANQ

SEQ ID NO: 169091 - protein, 8 aa, Borrelia afzelii PKo
AGDPANQA

SEQ ID NO: 169092 - protein, 8 aa, Borrelia afzelii PKo
GDPANQAG

SEQ ID NO: 169093 - protein, 8 aa, Borrelia afzelii PKo
DPANQAGK

SEQ ID NO: 169094 - protein, 8 aa, Borrelia afzelii PKo
PANQAGKK

SEQ ID NO: 169095 - protein, 8 aa, Borrelia afzelii PKo
ANQAGKKA

SEQ ID NO: 169096 - protein, 8 aa, Borrelia afzelii PKo
NQAGKKAE

SEQ ID NO: 169097 - protein, 8 aa, Borrelia afzelii PKo
QAGKKAEE

SEQ ID NO: 169098 - protein, 8 aa, Borrelia afzelii PKo
AGKKAEEA

SEQ ID NO: 169099 - protein, 8 aa, Borrelia afzelii PKo
GKKAEEAK

SEQ ID NO: 169100 - protein, 8 aa, Borrelia afzelii PKo
KKAEEAKN

SEQ ID NO: 169101 - protein, 8 aa, Borrelia afzelii PKo
KAEEAKNP

SEQ ID NO: 169102 - protein, 8 aa, Borrelia afzelii PKo
AEEAKNPI

SEQ ID NO: 169103 - protein, 8 aa, Borrelia afzelii PKo
EEAKNPIA

SEQ ID NO: 169104 - protein, 8 aa, Borrelia afzelii PKo
EAKNPIAA

SEQ ID NO: 169105 - protein, 8 aa, Borrelia afzelii PKo
AKNPIAAA

SEQ ID NO: 169106 - protein, 8 aa, Borrelia afzelii PKo
KNPIAAAI

SEQ ID NO: 169107 - protein, 8 aa, Borrelia afzelii PKo
NPIAAAIG

SEQ ID NO: 169108 - protein, 8 aa, Borrelia afzelii PKo
PIAAAIGT

SEQ ID NO: 169109 - protein, 8 aa, Borrelia afzelii PKo
IAAAIGTD

SEQ ID NO: 169110 - protein, 8 aa, Borrelia afzelii PKo
AAAIGTDD

SEQ ID NO: 169111 - protein, 8 aa, Borrelia afzelii PKo
AAIGTDDD

SEQ ID NO: 169112 - protein, 8 aa, Borrelia afzelii PKo
AIGTDDDN

SEQ ID NO: 169113 - protein, 8 aa, Borrelia afzelii PKo
IGTDDDNG

SEQ ID NO: 169114 - protein, 8 aa, Borrelia afzelii PKo
GTDDDNGA

SEQ ID NO: 169115 - protein, 8 aa, Borrelia afzelii PKo
TDDDNGAA

SEQ ID NO: 169116 - protein, 8 aa, Borrelia afzelii PKo
DDDNGAAF

SEQ ID NO: 169117 - protein, 8 aa, Borrelia afzelii PKo
DDNGAAFK

SEQ ID NO: 169118 - protein, 8 aa, Borrelia afzelii PKo
DNGAAFKD

SEQ ID NO: 169119 - protein, 8 aa, Borrelia afzelii PKo
NGAAFKDE

SEQ ID NO: 169120 - protein, 8 aa, Borrelia afzelii PKo
GAAFKDEM

SEQ ID NO: 169121 - protein, 8 aa, Borrelia afzelii PKo
AAFKDEMK

SEQ ID NO: 169122 - protein, 8 aa, Borrelia afzelii PKo
AFKDEMKK

SEQ ID NO: 169123 - protein, 8 aa, Borrelia afzelii PKo
FKDEMKKS

SEQ ID NO: 169124 - protein, 8 aa, Borrelia afzelii PKo
KDEMKKSD

SEQ ID NO: 169125 - protein, 8 aa, Borrelia afzelii PKo
DEMKKSDK

SEQ ID NO: 169126 - protein, 8 aa, Borrelia afzelii PKo
EMKKSDKI

SEQ ID NO: 169127 - protein, 8 aa, Borrelia afzelii PKo
MKKSDKIA

SEQ ID NO: 169128 - protein, 8 aa, Borrelia afzelii PKo
KKSDKIAA

SEQ ID NO: 169129 - protein, 8 aa, Borrelia afzelii PKo
KSDKIAAA

SEQ ID NO: 169130 - protein, 8 aa, Borrelia afzelii PKo
SDKIAAAI

SEQ ID NO: 169131 - protein, 8 aa, Borrelia afzelii PKo
DKIAAAIV

SEQ ID NO: 169132 - protein, 8 aa, Borrelia afzelii PKo
KIAAAIVL

SEQ ID NO: 169133 - protein, 8 aa, Borrelia afzelii PKo
IAAAIVLR

SEQ ID NO: 169134 - protein, 8 aa, Borrelia afzelii PKo
AAAIVLRG

SEQ ID NO: 169135 - protein, 8 aa, Borrelia afzelii PKo
AAIVLRGV

SEQ ID NO: 169136 - protein, 8 aa, Borrelia afzelii PKo
AIVLRGVA

SEQ ID NO: 169137 - protein, 8 aa, Borrelia afzelii PKo
IVLRGVAK

SEQ ID NO: 169138 - protein, 8 aa, Borrelia afzelii PKo
VLRGVAKD

SEQ ID NO: 169139 - protein, 8 aa, Borrelia afzelii PKo
LRGVAKDG

SEQ ID NO: 169140 - protein, 8 aa, Borrelia afzelii PKo
RGVAKDGK

SEQ ID NO: 169141 - protein, 8 aa, Borrelia afzelii PKo
GVAKDGKF

SEQ ID NO: 169142 - protein, 8 aa, Borrelia afzelii PKo
VAKDGKFA

SEQ ID NO: 169143 - protein, 8 aa, Borrelia afzelii PKo
AKDGKFAV

SEQ ID NO: 169144 - protein, 8 aa, Borrelia afzelii PKo
KDGKFAVK

SEQ ID NO: 169145 - protein, 9 aa, Borrelia afzelii PKo
MKKISSAIF

SEQ ID NO: 169146 - protein, 9 aa, Borrelia afzelii PKo
KKISSAIFL

SEQ ID NO: 169147 - protein, 9 aa, Borrelia afzelii PKo
KISSAIFLT

SEQ ID NO: 169148 - protein, 9 aa, Borrelia afzelii PKo
ISSAIFLTA

SEQ ID NO: 169149 - protein, 9 aa, Borrelia afzelii PKo
SSAIFLTAL

SEQ ID NO: 169150 - protein, 9 aa, Borrelia afzelii PKo
SAIFLTALL

SEQ ID NO: 169151 - protein, 9 aa, Borrelia afzelii PKo
AIFLTALLV

SEQ ID NO: 169152 - protein, 9 aa, Borrelia afzelii PKo
IFLTALLVF

SEQ ID NO: 169153 - protein, 9 aa, Borrelia afzelii PKo
FLTALLVFI

SEQ ID NO: 169154 - protein, 9 aa, Borrelia afzelii PKo
LTALLVFIN

SEQ ID NO: 169155 - protein, 9 aa, Borrelia afzelii PKo
TALLVFINC

SEQ ID NO: 169156 - protein, 9 aa, Borrelia afzelii PKo
ALLVFINCK

SEQ ID NO: 169157 - protein, 9 aa, Borrelia afzelii PKo
LLVFINCKN

SEQ ID NO: 169158 - protein, 9 aa, Borrelia afzelii PKo
LVFINCKNN

SEQ ID NO: 169159 - protein, 9 aa, Borrelia afzelii PKo
VFINCKNNA

SEQ ID NO: 169160 - protein, 9 aa, Borrelia afzelii PKo
FINCKNNAV

SEQ ID NO: 169161 - protein, 9 aa, Borrelia afzelii PKo
INCKNNAVG

SEQ ID NO: 169162 - protein, 9 aa, Borrelia afzelii PKo
NCKNNAVGK

SEQ ID NO: 169163 - protein, 9 aa, Borrelia afzelii PKo
CKNNAVGKG

SEQ ID NO: 169164 - protein, 9 aa, Borrelia afzelii PKo
KNNAVGKGN

SEQ ID NO: 169165 - protein, 9 aa, Borrelia afzelii PKo
NNAVGKGND

SEQ ID NO: 169166 - protein, 9 aa, Borrelia afzelii PKo
NAVGKGNDD

SEQ ID NO: 169167 - protein, 9 aa, Borrelia afzelii PKo
AVGKGNDDK

SEQ ID NO: 169168 - protein, 9 aa, Borrelia afzelii PKo
VGKGNDDKD

SEQ ID NO: 169169 - protein, 9 aa, Borrelia afzelii PKo
GKGNDDKDS

SEQ ID NO: 169170 - protein, 9 aa, Borrelia afzelii PKo
KGNDDKDSV

SEQ ID NO: 169171 - protein, 9 aa, Borrelia afzelii PKo
GNDDKDSVK

SEQ ID NO: 169172 - protein, 9 aa, Borrelia afzelii PKo
NDDKDSVKT

SEQ ID NO: 169173 - protein, 9 aa, Borrelia afzelii PKo
DDKDSVKTF

SEQ ID NO: 169174 - protein, 9 aa, Borrelia afzelii PKo
DKDSVKTFY

SEQ ID NO: 169175 - protein, 9 aa, Borrelia afzelii PKo
KDSVKTFYE

SEQ ID NO: 169176 - protein, 9 aa, Borrelia afzelii PKo
DSVKTFYES

SEQ ID NO: 169177 - protein, 9 aa, Borrelia afzelii PKo
SVKTFYESI

SEQ ID NO: 169178 - protein, 9 aa, Borrelia afzelii PKo
VKTFYESII

SEQ ID NO: 169179 - protein, 9 aa, Borrelia afzelii PKo
KTFYESIIN

SEQ ID NO: 169180 - protein, 9 aa, Borrelia afzelii PKo
TFYESIINL

SEQ ID NO: 169181 - protein, 9 aa, Borrelia afzelii PKo
FYESIINLG

SEQ ID NO: 169182 - protein, 9 aa, Borrelia afzelii PKo
YESIINLGN

SEQ ID NO: 169183 - protein, 9 aa, Borrelia afzelii PKo
ESIINLGNG

SEQ ID NO: 169184 - protein, 9 aa, Borrelia afzelii PKo
SIINLGNGF

SEQ ID NO: 169185 - protein, 9 aa, Borrelia afzelii PKo
IINLGNGFI

SEQ ID NO: 169186 - protein, 9 aa, Borrelia afzelii PKo
INLGNGFID

SEQ ID NO: 169187 - protein, 9 aa, Borrelia afzelii PKo
NLGNGFIDV

SEQ ID NO: 169188 - protein, 9 aa, Borrelia afzelii PKo
LGNGFIDVF

SEQ ID NO: 169189 - protein, 9 aa, Borrelia afzelii PKo
GNGFIDVFN

SEQ ID NO: 169190 - protein, 9 aa, Borrelia afzelii PKo
NGFIDVFNA

SEQ ID NO: 169191 - protein, 9 aa, Borrelia afzelii PKo
GFIDVFNAF

SEQ ID NO: 169192 - protein, 9 aa, Borrelia afzelii PKo
FIDVFNAFS

SEQ ID NO: 169193 - protein, 9 aa, Borrelia afzelii PKo
IDVFNAFSG

SEQ ID NO: 169194 - protein, 9 aa, Borrelia afzelii PKo
DVFNAFSGL

SEQ ID NO: 169195 - protein, 9 aa, Borrelia afzelii PKo
VFNAFSGLV

SEQ ID NO: 169196 - protein, 9 aa, Borrelia afzelii PKo
FNAFSGLVA

SEQ ID NO: 169197 - protein, 9 aa, Borrelia afzelii PKo
NAFSGLVAD

SEQ ID NO: 169198 - protein, 9 aa, Borrelia afzelii PKo
AFSGLVADT

SEQ ID NO: 169199 - protein, 9 aa, Borrelia afzelii PKo
FSGLVADTF

SEQ ID NO: 169200 - protein, 9 aa, Borrelia afzelii PKo
SGLVADTFF

SEQ ID NO: 169201 - protein, 9 aa, Borrelia afzelii PKo
GLVADTFFK

SEQ ID NO: 169202 - protein, 9 aa, Borrelia afzelii PKo
LVADTFFKS

SEQ ID NO: 169203 - protein, 9 aa, Borrelia afzelii PKo
VADTFFKSD

SEQ ID NO: 169204 - protein, 9 aa, Borrelia afzelii PKo
ADTFFKSDP

SEQ ID NO: 169205 - protein, 9 aa, Borrelia afzelii PKo
DTFFKSDPK

SEQ ID NO: 169206 - protein, 9 aa, Borrelia afzelii PKo
TFFKSDPKK

SEQ ID NO: 169207 - protein, 9 aa, Borrelia afzelii PKo
FFKSDPKKS

SEQ ID NO: 169208 - protein, 9 aa, Borrelia afzelii PKo
FKSDPKKSD

SEQ ID NO: 169209 - protein, 9 aa, Borrelia afzelii PKo
KSDPKKSDV

SEQ ID NO: 169210 - protein, 9 aa, Borrelia afzelii PKo
SDPKKSDVK

SEQ ID NO: 169211 - protein, 9 aa, Borrelia afzelii PKo
DPKKSDVKT

SEQ ID NO: 169212 - protein, 9 aa, Borrelia afzelii PKo
PKKSDVKTY

SEQ ID NO: 169213 - protein, 9 aa, Borrelia afzelii PKo
KKSDVKTYF

SEQ ID NO: 169214 - protein, 9 aa, Borrelia afzelii PKo
KSDVKTYFE

SEQ ID NO: 169215 - protein, 9 aa, Borrelia afzelii PKo
SDVKTYFES

SEQ ID NO: 169216 - protein, 9 aa, Borrelia afzelii PKo
DVKTYFESI

SEQ ID NO: 169217 - protein, 9 aa, Borrelia afzelii PKo
VKTYFESIS

SEQ ID NO: 169218 - protein, 9 aa, Borrelia afzelii PKo
KTYFESISS

SEQ ID NO: 169219 - protein, 9 aa, Borrelia afzelii PKo
TYFESISST

SEQ ID NO: 169220 - protein, 9 aa, Borrelia afzelii PKo
YFESISSTL

SEQ ID NO: 169221 - protein, 9 aa, Borrelia afzelii PKo
FESISSTLK

SEQ ID NO: 169222 - protein, 9 aa, Borrelia afzelii PKo
ESISSTLKA

SEQ ID NO: 169223 - protein, 9 aa, Borrelia afzelii PKo
SISSTLKAT

SEQ ID NO: 169224 - protein, 9 aa, Borrelia afzelii PKo
ISSTLKATK

SEQ ID NO: 169225 - protein, 9 aa, Borrelia afzelii PKo
SSTLKATKG

SEQ ID NO: 169226 - protein, 9 aa, Borrelia afzelii PKo
STLKATKGK

SEQ ID NO: 169227 - protein, 9 aa, Borrelia afzelii PKo
TLKATKGKL

SEQ ID NO: 169228 - protein, 9 aa, Borrelia afzelii PKo
LKATKGKLD

SEQ ID NO: 169229 - protein, 9 aa, Borrelia afzelii PKo
KATKGKLDE

SEQ ID NO: 169230 - protein, 9 aa, Borrelia afzelii PKo
ATKGKLDEL

SEQ ID NO: 169231 - protein, 9 aa, Borrelia afzelii PKo
TKGKLDELV

SEQ ID NO: 169232 - protein, 9 aa, Borrelia afzelii PKo
KGKLDELVS

SEQ ID NO: 169233 - protein, 9 aa, Borrelia afzelii PKo
GKLDELVSA

SEQ ID NO: 169234 - protein, 9 aa, Borrelia afzelii PKo
KLDELVSAK

SEQ ID NO: 169235 - protein, 9 aa, Borrelia afzelii PKo
LDELVSAKK

SEQ ID NO: 169236 - protein, 9 aa, Borrelia afzelii PKo
DELVSAKKG

SEQ ID NO: 169237 - protein, 9 aa, Borrelia afzelii PKo
ELVSAKKGE

SEQ ID NO: 169238 - protein, 9 aa, Borrelia afzelii PKo
LVSAKKGEG

SEQ ID NO: 169239 - protein, 9 aa, Borrelia afzelii PKo
VSAKKGEGG

SEQ ID NO: 169240 - protein, 9 aa, Borrelia afzelii PKo
SAKKGEGGS

SEQ ID NO: 169241 - protein, 9 aa, Borrelia afzelii PKo
AKKGEGGSV

SEQ ID NO: 169242 - protein, 9 aa, Borrelia afzelii PKo
KKGEGGSVK

SEQ ID NO: 169243 - protein, 9 aa, Borrelia afzelii PKo
KGEGGSVKA

SEQ ID NO: 169244 - protein, 9 aa, Borrelia afzelii PKo
GEGGSVKAS

SEQ ID NO: 169245 - protein, 9 aa, Borrelia afzelii PKo
EGGSVKASV

SEQ ID NO: 169246 - protein, 9 aa, Borrelia afzelii PKo
GGSVKASVE

SEQ ID NO: 169247 - protein, 9 aa, Borrelia afzelii PKo
GSVKASVES

SEQ ID NO: 169248 - protein, 9 aa, Borrelia afzelii PKo
SVKASVESA

SEQ ID NO: 169249 - protein, 9 aa, Borrelia afzelii PKo
VKASVESAV

SEQ ID NO: 169250 - protein, 9 aa, Borrelia afzelii PKo
KASVESAVD

SEQ ID NO: 169251 - protein, 9 aa, Borrelia afzelii PKo
ASVESAVDE

SEQ ID NO: 169252 - protein, 9 aa, Borrelia afzelii PKo
SVESAVDEV

SEQ ID NO: 169253 - protein, 9 aa, Borrelia afzelii PKo
VESAVDEVS

SEQ ID NO: 169254 - protein, 9 aa, Borrelia afzelii PKo
ESAVDEVSK

SEQ ID NO: 169255 - protein, 9 aa, Borrelia afzelii PKo
SAVDEVSKW

SEQ ID NO: 169256 - protein, 9 aa, Borrelia afzelii PKo
AVDEVSKWL

SEQ ID NO: 169257 - protein, 9 aa, Borrelia afzelii PKo
VDEVSKWLE

SEQ ID NO: 169258 - protein, 9 aa, Borrelia afzelii PKo
DEVSKWLEE

SEQ ID NO: 169259 - protein, 9 aa, Borrelia afzelii PKo
EVSKWLEEM

SEQ ID NO: 169260 - protein, 9 aa, Borrelia afzelii PKo
VSKWLEEMI

SEQ ID NO: 169261 - protein, 9 aa, Borrelia afzelii PKo
SKWLEEMIK

SEQ ID NO: 169262 - protein, 9 aa, Borrelia afzelii PKo
KWLEEMIKA

SEQ ID NO: 169263 - protein, 9 aa, Borrelia afzelii PKo
WLEEMIKAA

SEQ ID NO: 169264 - protein, 9 aa, Borrelia afzelii PKo
LEEMIKAAE

SEQ ID NO: 169265 - protein, 9 aa, Borrelia afzelii PKo
EEMIKAAEE

SEQ ID NO: 169266 - protein, 9 aa, Borrelia afzelii PKo
EMIKAAEEA

SEQ ID NO: 169267 - protein, 9 aa, Borrelia afzelii PKo
MIKAAEEAA

SEQ ID NO: 169268 - protein, 9 aa, Borrelia afzelii PKo
IKAAEEAAK

SEQ ID NO: 169269 - protein, 9 aa, Borrelia afzelii PKo
KAAEEAAKV

SEQ ID NO: 169270 - protein, 9 aa, Borrelia afzelii PKo
AAEEAAKVG

SEQ ID NO: 169271 - protein, 9 aa, Borrelia afzelii PKo
AEEAAKVGG

SEQ ID NO: 169272 - protein, 9 aa, Borrelia afzelii PKo
EEAAKVGGT

SEQ ID NO: 169273 - protein, 9 aa, Borrelia afzelii PKo
EAAKVGGTG

SEQ ID NO: 169274 - protein, 9 aa, Borrelia afzelii PKo
AAKVGGTGG

SEQ ID NO: 169275 - protein, 9 aa, Borrelia afzelii PKo
AKVGGTGGD

SEQ ID NO: 169276 - protein, 9 aa, Borrelia afzelii PKo
KVGGTGGDG

SEQ ID NO: 169277 - protein, 9 aa, Borrelia afzelii PKo
VGGTGGDGK

SEQ ID NO: 169278 - protein, 9 aa, Borrelia afzelii PKo
GGTGGDGKI

SEQ ID NO: 169279 - protein, 9 aa, Borrelia afzelii PKo
GTGGDGKIG

SEQ ID NO: 169280 - protein, 9 aa, Borrelia afzelii PKo
TGGDGKIGD

SEQ ID NO: 169281 - protein, 9 aa, Borrelia afzelii PKo
GGDGKIGDS

SEQ ID NO: 169282 - protein, 9 aa, Borrelia afzelii PKo
GDGKIGDSA

SEQ ID NO: 169283 - protein, 9 aa, Borrelia afzelii PKo
DGKIGDSAA

SEQ ID NO: 169284 - protein, 9 aa, Borrelia afzelii PKo
GKIGDSAAN

SEQ ID NO: 169285 - protein, 9 aa, Borrelia afzelii PKo
KIGDSAANH

SEQ ID NO: 169286 - protein, 9 aa, Borrelia afzelii PKo
IGDSAANHG

SEQ ID NO: 169287 - protein, 9 aa, Borrelia afzelii PKo
GDSAANHGA

SEQ ID NO: 169288 - protein, 9 aa, Borrelia afzelii PKo
DSAANHGAK

SEQ ID NO: 169289 - protein, 9 aa, Borrelia afzelii PKo
SAANHGAKA

SEQ ID NO: 169290 - protein, 9 aa, Borrelia afzelii PKo
AANHGAKAD

SEQ ID NO: 169291 - protein, 9 aa, Borrelia afzelii PKo
ANHGAKADK

SEQ ID NO: 169292 - protein, 9 aa, Borrelia afzelii PKo
NHGAKADKD

SEQ ID NO: 169293 - protein, 9 aa, Borrelia afzelii PKo
HGAKADKDS

SEQ ID NO: 169294 - protein, 9 aa, Borrelia afzelii PKo
GAKADKDSV

SEQ ID NO: 169295 - protein, 9 aa, Borrelia afzelii PKo
AKADKDSVK

SEQ ID NO: 169296 - protein, 9 aa, Borrelia afzelii PKo
KADKDSVKG

SEQ ID NO: 169297 - protein, 9 aa, Borrelia afzelii PKo
ADKDSVKGI

SEQ ID NO: 169298 - protein, 9 aa, Borrelia afzelii PKo
DKDSVKGIA

SEQ ID NO: 169299 - protein, 9 aa, Borrelia afzelii PKo
KDSVKGIAK

SEQ ID NO: 169300 - protein, 9 aa, Borrelia afzelii PKo
DSVKGIAKG

SEQ ID NO: 169301 - protein, 9 aa, Borrelia afzelii PKo
SVKGIAKGI

SEQ ID NO: 169302 - protein, 9 aa, Borrelia afzelii PKo
VKGIAKGIK

SEQ ID NO: 169303 - protein, 9 aa, Borrelia afzelii PKo
KGIAKGIKG

SEQ ID NO: 169304 - protein, 9 aa, Borrelia afzelii PKo
GIAKGIKGI

SEQ ID NO: 169305 - protein, 9 aa, Borrelia afzelii PKo
IAKGIKGIV

SEQ ID NO: 169306 - protein, 9 aa, Borrelia afzelii PKo
AKGIKGIVD

SEQ ID NO: 169307 - protein, 9 aa, Borrelia afzelii PKo
KGIKGIVDA

SEQ ID NO: 169308 - protein, 9 aa, Borrelia afzelii PKo
GIKGIVDAA

SEQ ID NO: 169309 - protein, 9 aa, Borrelia afzelii PKo
IKGIVDAAG

SEQ ID NO: 169310 - protein, 9 aa, Borrelia afzelii PKo
KGIVDAAGK

SEQ ID NO: 169311 - protein, 9 aa, Borrelia afzelii PKo
GIVDAAGKA

SEQ ID NO: 169312 - protein, 9 aa, Borrelia afzelii PKo
IVDAAGKAL

SEQ ID NO: 169313 - protein, 9 aa, Borrelia afzelii PKo
VDAAGKALG

SEQ ID NO: 169314 - protein, 9 aa, Borrelia afzelii PKo
DAAGKALGE

SEQ ID NO: 169315 - protein, 9 aa, Borrelia afzelii PKo
AAGKALGEK

SEQ ID NO: 169316 - protein, 9 aa, Borrelia afzelii PKo
AGKALGEKG

SEQ ID NO: 169317 - protein, 9 aa, Borrelia afzelii PKo
GKALGEKGA

SEQ ID NO: 169318 - protein, 9 aa, Borrelia afzelii PKo
KALGEKGAL

SEQ ID NO: 169319 - protein, 9 aa, Borrelia afzelii PKo
ALGEKGALK

SEQ ID NO: 169320 - protein, 9 aa, Borrelia afzelii PKo
LGEKGALKD

SEQ ID NO: 169321 - protein, 9 aa, Borrelia afzelii PKo
GEKGALKDV

SEQ ID NO: 169322 - protein, 9 aa, Borrelia afzelii PKo
EKGALKDVK

SEQ ID NO: 169323 - protein, 9 aa, Borrelia afzelii PKo
KGALKDVKA

SEQ ID NO: 169324 - protein, 9 aa, Borrelia afzelii PKo
GALKDVKAA

SEQ ID NO: 169325 - protein, 9 aa, Borrelia afzelii PKo
ALKDVKAAA

SEQ ID NO: 169326 - protein, 9 aa, Borrelia afzelii PKo
LKDVKAAAD

SEQ ID NO: 169327 - protein, 9 aa, Borrelia afzelii PKo
KDVKAAADD

SEQ ID NO: 169328 - protein, 9 aa, Borrelia afzelii PKo
DVKAAADDE

SEQ ID NO: 169329 - protein, 9 aa, Borrelia afzelii PKo
VKAAADDEA

SEQ ID NO: 169330 - protein, 9 aa, Borrelia afzelii PKo
KAAADDEAN

SEQ ID NO: 169331 - protein, 9 aa, Borrelia afzelii PKo
AAADDEANA

SEQ ID NO: 169332 - protein, 9 aa, Borrelia afzelii PKo
AADDEANAD

SEQ ID NO: 169333 - protein, 9 aa, Borrelia afzelii PKo
ADDEANADA

SEQ ID NO: 169334 - protein, 9 aa, Borrelia afzelii PKo
DDEANADAG

SEQ ID NO: 169335 - protein, 9 aa, Borrelia afzelii PKo
DEANADAGK

SEQ ID NO: 169336 - protein, 9 aa, Borrelia afzelii PKo
EANADAGKL

SEQ ID NO: 169337 - protein, 9 aa, Borrelia afzelii PKo
ANADAGKLF

SEQ ID NO: 169338 - protein, 9 aa, Borrelia afzelii PKo
NADAGKLFA

SEQ ID NO: 169339 - protein, 9 aa, Borrelia afzelii PKo
ADAGKLFAG

SEQ ID NO: 169340 - protein, 9 aa, Borrelia afzelii PKo
DAGKLFAGN

SEQ ID NO: 169341 - protein, 9 aa, Borrelia afzelii PKo
AGKLFAGNA

SEQ ID NO: 169342 - protein, 9 aa, Borrelia afzelii PKo
GKLFAGNAN

SEQ ID NO: 169343 - protein, 9 aa, Borrelia afzelii PKo
KLFAGNANA

SEQ ID NO: 169344 - protein, 9 aa, Borrelia afzelii PKo
LFAGNANAA

SEQ ID NO: 169345 - protein, 9 aa, Borrelia afzelii PKo
FAGNANAAV

SEQ ID NO: 169346 - protein, 9 aa, Borrelia afzelii PKo
AGNANAAVG

SEQ ID NO: 169347 - protein, 9 aa, Borrelia afzelii PKo
GNANAAVGA

SEQ ID NO: 169348 - protein, 9 aa, Borrelia afzelii PKo
NANAAVGAA

SEQ ID NO: 169349 - protein, 9 aa, Borrelia afzelii PKo
ANAAVGAAA

SEQ ID NO: 169350 - protein, 9 aa, Borrelia afzelii PKo
NAAVGAAAD

SEQ ID NO: 169351 - protein, 9 aa, Borrelia afzelii PKo
AAVGAAADI

SEQ ID NO: 169352 - protein, 9 aa, Borrelia afzelii PKo
AVGAAADIA

SEQ ID NO: 169353 - protein, 9 aa, Borrelia afzelii PKo
VGAAADIAK

SEQ ID NO: 169354 - protein, 9 aa, Borrelia afzelii PKo
GAAADIAKA

SEQ ID NO: 169355 - protein, 9 aa, Borrelia afzelii PKo
AAADIAKAA

SEQ ID NO: 169356 - protein, 9 aa, Borrelia afzelii PKo
AADIAKAAG

SEQ ID NO: 169357 - protein, 9 aa, Borrelia afzelii PKo
ADIAKAAGA

SEQ ID NO: 169358 - protein, 9 aa, Borrelia afzelii PKo
DIAKAAGAV

SEQ ID NO: 169359 - protein, 9 aa, Borrelia afzelii PKo
IAKAAGAVT

SEQ ID NO: 169360 - protein, 9 aa, Borrelia afzelii PKo
AKAAGAVTA

SEQ ID NO: 169361 - protein, 9 aa, Borrelia afzelii PKo
KAAGAVTAV

SEQ ID NO: 169362 - protein, 9 aa, Borrelia afzelii PKo
AAGAVTAVS

SEQ ID NO: 169363 - protein, 9 aa, Borrelia afzelii PKo
AGAVTAVSG

SEQ ID NO: 169364 - protein, 9 aa, Borrelia afzelii PKo
GAVTAVSGE

SEQ ID NO: 169365 - protein, 9 aa, Borrelia afzelii PKo
AVTAVSGEQ

SEQ ID NO: 169366 - protein, 9 aa, Borrelia afzelii PKo
VTAVSGEQI

SEQ ID NO: 169367 - protein, 9 aa, Borrelia afzelii PKo
TAVSGEQIL

SEQ ID NO: 169368 - protein, 9 aa, Borrelia afzelii PKo
AVSGEQILK

SEQ ID NO: 169369 - protein, 9 aa, Borrelia afzelii PKo
VSGEQILKA

SEQ ID NO: 169370 - protein, 9 aa, Borrelia afzelii PKo
SGEQILKAI

SEQ ID NO: 169371 - protein, 9 aa, Borrelia afzelii PKo
GEQILKAIV

SEQ ID NO: 169372 - protein, 9 aa, Borrelia afzelii PKo
EQILKAIVE

SEQ ID NO: 169373 - protein, 9 aa, Borrelia afzelii PKo
QILKAIVEA

SEQ ID NO: 169374 - protein, 9 aa, Borrelia afzelii PKo
ILKAIVEAA

SEQ ID NO: 169375 - protein, 9 aa, Borrelia afzelii PKo
LKAIVEAAG

SEQ ID NO: 169376 - protein, 9 aa, Borrelia afzelii PKo
KAIVEAAGD

SEQ ID NO: 169377 - protein, 9 aa, Borrelia afzelii PKo
AIVEAAGDP

SEQ ID NO: 169378 - protein, 9 aa, Borrelia afzelii PKo
IVEAAGDPA

SEQ ID NO: 169379 - protein, 9 aa, Borrelia afzelii PKo
VEAAGDPAN

SEQ ID NO: 169380 - protein, 9 aa, Borrelia afzelii PKo
EAAGDPANQ

SEQ ID NO: 169381 - protein, 9 aa, Borrelia afzelii PKo
AAGDPANQA

SEQ ID NO: 169382 - protein, 9 aa, Borrelia afzelii PKo
AGDPANQAG

SEQ ID NO: 169383 - protein, 9 aa, Borrelia afzelii PKo
GDPANQAGK

SEQ ID NO: 169384 - protein, 9 aa, Borrelia afzelii PKo
DPANQAGKK

SEQ ID NO: 169385 - protein, 9 aa, Borrelia afzelii PKo
PANQAGKKA

SEQ ID NO: 169386 - protein, 9 aa, Borrelia afzelii PKo
ANQAGKKAE

SEQ ID NO: 169387 - protein, 9 aa, Borrelia afzelii PKo
NQAGKKAEE

SEQ ID NO: 169388 - protein, 9 aa, Borrelia afzelii PKo
QAGKKAEEA

SEQ ID NO: 169389 - protein, 9 aa, Borrelia afzelii PKo
AGKKAEEAK

SEQ ID NO: 169390 - protein, 9 aa, Borrelia afzelii PKo
GKKAEEAKN

SEQ ID NO: 169391 - protein, 9 aa, Borrelia afzelii PKo
KKAEEAKNP

SEQ ID NO: 169392 - protein, 9 aa, Borrelia afzelii PKo
KAEEAKNPI

SEQ ID NO: 169393 - protein, 9 aa, Borrelia afzelii PKo
AEEAKNPIA

SEQ ID NO: 169394 - protein, 9 aa, Borrelia afzelii PKo
EEAKNPIAA

SEQ ID NO: 169395 - protein, 9 aa, Borrelia afzelii PKo
EAKNPIAAA

SEQ ID NO: 169396 - protein, 9 aa, Borrelia afzelii PKo
AKNPIAAAI

SEQ ID NO: 169397 - protein, 9 aa, Borrelia afzelii PKo
KNPIAAAIG

SEQ ID NO: 169398 - protein, 9 aa, Borrelia afzelii PKo
NPIAAAIGT

SEQ ID NO: 169399 - protein, 9 aa, Borrelia afzelii PKo
PIAAAIGTD

SEQ ID NO: 169400 - protein, 9 aa, Borrelia afzelii PKo
IAAAIGTDD

SEQ ID NO: 169401 - protein, 9 aa, Borrelia afzelii PKo
AAAIGTDDD

SEQ ID NO: 169402 - protein, 9 aa, Borrelia afzelii PKo
AAIGTDDDN

SEQ ID NO: 169403 - protein, 9 aa, Borrelia afzelii PKo
AIGTDDDNG

SEQ ID NO: 169404 - protein, 9 aa, Borrelia afzelii PKo
IGTDDDNGA

SEQ ID NO: 169405 - protein, 9 aa, Borrelia afzelii PKo
GTDDDNGAA

SEQ ID NO: 169406 - protein, 9 aa, Borrelia afzelii PKo
TDDDNGAAF

SEQ ID NO: 169407 - protein, 9 aa, Borrelia afzelii PKo
DDDNGAAFK

SEQ ID NO: 169408 - protein, 9 aa, Borrelia afzelii PKo
DDNGAAFKD

SEQ ID NO: 169409 - protein, 9 aa, Borrelia afzelii PKo
DNGAAFKDE

SEQ ID NO: 169410 - protein, 9 aa, Borrelia afzelii PKo
NGAAFKDEM

SEQ ID NO: 169411 - protein, 9 aa, Borrelia afzelii PKo
GAAFKDEMK

SEQ ID NO: 169412 - protein, 9 aa, Borrelia afzelii PKo
AAFKDEMKK

SEQ ID NO: 169413 - protein, 9 aa, Borrelia afzelii PKo
AFKDEMKKS

SEQ ID NO: 169414 - protein, 9 aa, Borrelia afzelii PKo
FKDEMKKSD

SEQ ID NO: 169415 - protein, 9 aa, Borrelia afzelii PKo
KDEMKKSDK

SEQ ID NO: 169416 - protein, 9 aa, Borrelia afzelii PKo
DEMKKSDKI

SEQ ID NO: 169417 - protein, 9 aa, Borrelia afzelii PKo
EMKKSDKIA

SEQ ID NO: 169418 - protein, 9 aa, Borrelia afzelii PKo
MKKSDKIAA

SEQ ID NO: 169419 - protein, 9 aa, Borrelia afzelii PKo
KKSDKIAAA

SEQ ID NO: 169420 - protein, 9 aa, Borrelia afzelii PKo
KSDKIAAAI

SEQ ID NO: 169421 - protein, 9 aa, Borrelia afzelii PKo
SDKIAAAIV

SEQ ID NO: 169422 - protein, 9 aa, Borrelia afzelii PKo
DKIAAAIVL

SEQ ID NO: 169423 - protein, 9 aa, Borrelia afzelii PKo
KIAAAIVLR

SEQ ID NO: 169424 - protein, 9 aa, Borrelia afzelii PKo
IAAAIVLRG

SEQ ID NO: 169425 - protein, 9 aa, Borrelia afzelii PKo
AAAIVLRGV

SEQ ID NO: 169426 - protein, 9 aa, Borrelia afzelii PKo
AAIVLRGVA

SEQ ID NO: 169427 - protein, 9 aa, Borrelia afzelii PKo
AIVLRGVAK

SEQ ID NO: 169428 - protein, 9 aa, Borrelia afzelii PKo
IVLRGVAKD

SEQ ID NO: 169429 - protein, 9 aa, Borrelia afzelii PKo
VLRGVAKDG

SEQ ID NO: 169430 - protein, 9 aa, Borrelia afzelii PKo
LRGVAKDGK

SEQ ID NO: 169431 - protein, 9 aa, Borrelia afzelii PKo
RGVAKDGKF

SEQ ID NO: 169432 - protein, 9 aa, Borrelia afzelii PKo
GVAKDGKFA

SEQ ID NO: 169433 - protein, 9 aa, Borrelia afzelii PKo
VAKDGKFAV

SEQ ID NO: 169434 - protein, 9 aa, Borrelia afzelii PKo
AKDGKFAVK

SEQ ID NO: 169435 - protein, 10 aa, Borrelia afzelii PKo
MKKISSAIFL

SEQ ID NO: 169436 - protein, 10 aa, Borrelia afzelii PKo
KKISSAIFLT

SEQ ID NO: 169437 - protein, 10 aa, Borrelia afzelii PKo
KISSAIFLTA

SEQ ID NO: 169438 - protein, 10 aa, Borrelia afzelii PKo
ISSAIFLTAL

SEQ ID NO: 169439 - protein, 10 aa, Borrelia afzelii PKo
SSAIFLTALL

SEQ ID NO: 169440 - protein, 10 aa, Borrelia afzelii PKo
SAIFLTALLV

SEQ ID NO: 169441 - protein, 10 aa, Borrelia afzelii PKo
AIFLTALLVF

SEQ ID NO: 169442 - protein, 10 aa, Borrelia afzelii PKo
IFLTALLVFI

SEQ ID NO: 169443 - protein, 10 aa, Borrelia afzelii PKo
FLTALLVFIN

SEQ ID NO: 169444 - protein, 10 aa, Borrelia afzelii PKo
LTALLVFINC

SEQ ID NO: 169445 - protein, 10 aa, Borrelia afzelii PKo
TALLVFINCK

SEQ ID NO: 169446 - protein, 10 aa, Borrelia afzelii PKo
ALLVFINCKN

SEQ ID NO: 169447 - protein, 10 aa, Borrelia afzelii PKo
LLVFINCKNN

SEQ ID NO: 169448 - protein, 10 aa, Borrelia afzelii PKo
LVFINCKNNA

SEQ ID NO: 169449 - protein, 10 aa, Borrelia afzelii PKo
VFINCKNNAV

SEQ ID NO: 169450 - protein, 10 aa, Borrelia afzelii PKo
FINCKNNAVG

SEQ ID NO: 169451 - protein, 10 aa, Borrelia afzelii PKo
INCKNNAVGK

SEQ ID NO: 169452 - protein, 10 aa, Borrelia afzelii PKo
NCKNNAVGKG

SEQ ID NO: 169453 - protein, 10 aa, Borrelia afzelii PKo
CKNNAVGKGN

SEQ ID NO: 169454 - protein, 10 aa, Borrelia afzelii PKo
KNNAVGKGND

SEQ ID NO: 169455 - protein, 10 aa, Borrelia afzelii PKo
NNAVGKGNDD

SEQ ID NO: 169456 - protein, 10 aa, Borrelia afzelii PKo
NAVGKGNDDK

SEQ ID NO: 169457 - protein, 10 aa, Borrelia afzelii PKo
AVGKGNDDKD

SEQ ID NO: 169458 - protein, 10 aa, Borrelia afzelii PKo
VGKGNDDKDS

SEQ ID NO: 169459 - protein, 10 aa, Borrelia afzelii PKo
GKGNDDKDSV

SEQ ID NO: 169460 - protein, 10 aa, Borrelia afzelii PKo
KGNDDKDSVK

SEQ ID NO: 169461 - protein, 10 aa, Borrelia afzelii PKo
GNDDKDSVKT

SEQ ID NO: 169462 - protein, 10 aa, Borrelia afzelii PKo
NDDKDSVKTF

SEQ ID NO: 169463 - protein, 10 aa, Borrelia afzelii PKo
DDKDSVKTFY

SEQ ID NO: 169464 - protein, 10 aa, Borrelia afzelii PKo
DKDSVKTFYE

SEQ ID NO: 169465 - protein, 10 aa, Borrelia afzelii PKo
KDSVKTFYES

SEQ ID NO: 169466 - protein, 10 aa, Borrelia afzelii PKo
DSVKTFYESI

SEQ ID NO: 169467 - protein, 10 aa, Borrelia afzelii PKo
SVKTFYESII

SEQ ID NO: 169468 - protein, 10 aa, Borrelia afzelii PKo
VKTFYESIIN

SEQ ID NO: 169469 - protein, 10 aa, Borrelia afzelii PKo
KTFYESIINL

SEQ ID NO: 169470 - protein, 10 aa, Borrelia afzelii PKo
TFYESIINLG

SEQ ID NO: 169471 - protein, 10 aa, Borrelia afzelii PKo
FYESIINLGN

SEQ ID NO: 169472 - protein, 10 aa, Borrelia afzelii PKo
YESIINLGNG

SEQ ID NO: 169473 - protein, 10 aa, Borrelia afzelii PKo
ESIINLGNGF

SEQ ID NO: 169474 - protein, 10 aa, Borrelia afzelii PKo
SIINLGNGFI

SEQ ID NO: 169475 - protein, 10 aa, Borrelia afzelii PKo
IINLGNGFID

SEQ ID NO: 169476 - protein, 10 aa, Borrelia afzelii PKo
INLGNGFIDV

SEQ ID NO: 169477 - protein, 10 aa, Borrelia afzelii PKo
NLGNGFIDVF

SEQ ID NO: 169478 - protein, 10 aa, Borrelia afzelii PKo
LGNGFIDVFN

SEQ ID NO: 169479 - protein, 10 aa, Borrelia afzelii PKo
GNGFIDVFNA

SEQ ID NO: 169480 - protein, 10 aa, Borrelia afzelii PKo
NGFIDVFNAF

SEQ ID NO: 169481 - protein, 10 aa, Borrelia afzelii PKo
GFIDVFNAFS

SEQ ID NO: 169482 - protein, 10 aa, Borrelia afzelii PKo
FIDVFNAFSG

SEQ ID NO: 169483 - protein, 10 aa, Borrelia afzelii PKo
IDVFNAFSGL

SEQ ID NO: 169484 - protein, 10 aa, Borrelia afzelii PKo
DVFNAFSGLV

SEQ ID NO: 169485 - protein, 10 aa, Borrelia afzelii PKo
VFNAFSGLVA

SEQ ID NO: 169486 - protein, 10 aa, Borrelia afzelii PKo
FNAFSGLVAD

SEQ ID NO: 169487 - protein, 10 aa, Borrelia afzelii PKo
NAFSGLVADT

SEQ ID NO: 169488 - protein, 10 aa, Borrelia afzelii PKo
AFSGLVADTF

SEQ ID NO: 169489 - protein, 10 aa, Borrelia afzelii PKo
FSGLVADTFF

SEQ ID NO: 169490 - protein, 10 aa, Borrelia afzelii PKo
SGLVADTFFK

SEQ ID NO: 169491 - protein, 10 aa, Borrelia afzelii PKo
GLVADTFFKS

SEQ ID NO: 169492 - protein, 10 aa, Borrelia afzelii PKo
LVADTFFKSD

SEQ ID NO: 169493 - protein, 10 aa, Borrelia afzelii PKo
VADTFFKSDP

SEQ ID NO: 169494 - protein, 10 aa, Borrelia afzelii PKo
ADTFFKSDPK

SEQ ID NO: 169495 - protein, 10 aa, Borrelia afzelii PKo
DTFFKSDPKK

SEQ ID NO: 169496 - protein, 10 aa, Borrelia afzelii PKo
TFFKSDPKKS

SEQ ID NO: 169497 - protein, 10 aa, Borrelia afzelii PKo
FFKSDPKKSD

SEQ ID NO: 169498 - protein, 10 aa, Borrelia afzelii PKo
FKSDPKKSDV

SEQ ID NO: 169499 - protein, 10 aa, Borrelia afzelii PKo
KSDPKKSDVK

SEQ ID NO: 169500 - protein, 10 aa, Borrelia afzelii PKo
SDPKKSDVKT

SEQ ID NO: 169501 - protein, 10 aa, Borrelia afzelii PKo
DPKKSDVKTY

SEQ ID NO: 169502 - protein, 10 aa, Borrelia afzelii PKo
PKKSDVKTYF

SEQ ID NO: 169503 - protein, 10 aa, Borrelia afzelii PKo
KKSDVKTYFE

SEQ ID NO: 169504 - protein, 10 aa, Borrelia afzelii PKo
KSDVKTYFES

SEQ ID NO: 169505 - protein, 10 aa, Borrelia afzelii PKo
SDVKTYFESI

SEQ ID NO: 169506 - protein, 10 aa, Borrelia afzelii PKo
DVKTYFESIS

SEQ ID NO: 169507 - protein, 10 aa, Borrelia afzelii PKo
VKTYFESISS

SEQ ID NO: 169508 - protein, 10 aa, Borrelia afzelii PKo
KTYFESISST

SEQ ID NO: 169509 - protein, 10 aa, Borrelia afzelii PKo
TYFESISSTL

SEQ ID NO: 169510 - protein, 10 aa, Borrelia afzelii PKo
YFESISSTLK

SEQ ID NO: 169511 - protein, 10 aa, Borrelia afzelii PKo
FESISSTLKA

SEQ ID NO: 169512 - protein, 10 aa, Borrelia afzelii PKo
ESISSTLKAT

SEQ ID NO: 169513 - protein, 10 aa, Borrelia afzelii PKo
SISSTLKATK

SEQ ID NO: 169514 - protein, 10 aa, Borrelia afzelii PKo
ISSTLKATKG

SEQ ID NO: 169515 - protein, 10 aa, Borrelia afzelii PKo
SSTLKATKGK

SEQ ID NO: 169516 - protein, 10 aa, Borrelia afzelii PKo
STLKATKGKL

SEQ ID NO: 169517 - protein, 10 aa, Borrelia afzelii PKo
TLKATKGKLD

SEQ ID NO: 169518 - protein, 10 aa, Borrelia afzelii PKo
LKATKGKLDE

SEQ ID NO: 169519 - protein, 10 aa, Borrelia afzelii PKo
KATKGKLDEL

SEQ ID NO: 169520 - protein, 10 aa, Borrelia afzelii PKo
ATKGKLDELV

SEQ ID NO: 169521 - protein, 10 aa, Borrelia afzelii PKo
TKGKLDELVS

SEQ ID NO: 169522 - protein, 10 aa, Borrelia afzelii PKo
KGKLDELVSA

SEQ ID NO: 169523 - protein, 10 aa, Borrelia afzelii PKo
GKLDELVSAK

SEQ ID NO: 169524 - protein, 10 aa, Borrelia afzelii PKo
KLDELVSAKK

SEQ ID NO: 169525 - protein, 10 aa, Borrelia afzelii PKo
LDELVSAKKG

SEQ ID NO: 169526 - protein, 10 aa, Borrelia afzelii PKo
DELVSAKKGE

SEQ ID NO: 169527 - protein, 10 aa, Borrelia afzelii PKo
ELVSAKKGEG

SEQ ID NO: 169528 - protein, 10 aa, Borrelia afzelii PKo
LVSAKKGEGG

SEQ ID NO: 169529 - protein, 10 aa, Borrelia afzelii PKo
VSAKKGEGGS

SEQ ID NO: 169530 - protein, 10 aa, Borrelia afzelii PKo
SAKKGEGGSV

SEQ ID NO: 169531 - protein, 10 aa, Borrelia afzelii PKo
AKKGEGGSVK

SEQ ID NO: 169532 - protein, 10 aa, Borrelia afzelii PKo
KKGEGGSVKA

SEQ ID NO: 169533 - protein, 10 aa, Borrelia afzelii PKo
KGEGGSVKAS

SEQ ID NO: 169534 - protein, 10 aa, Borrelia afzelii PKo
GEGGSVKASV

SEQ ID NO: 169535 - protein, 10 aa, Borrelia afzelii PKo
EGGSVKASVE

SEQ ID NO: 169536 - protein, 10 aa, Borrelia afzelii PKo
GGSVKASVES

SEQ ID NO: 169537 - protein, 10 aa, Borrelia afzelii PKo
GSVKASVESA

SEQ ID NO: 169538 - protein, 10 aa, Borrelia afzelii PKo
SVKASVESAV

SEQ ID NO: 169539 - protein, 10 aa, Borrelia afzelii PKo
VKASVESAVD

SEQ ID NO: 169540 - protein, 10 aa, Borrelia afzelii PKo
KASVESAVDE

SEQ ID NO: 169541 - protein, 10 aa, Borrelia afzelii PKo
ASVESAVDEV

SEQ ID NO: 169542 - protein, 10 aa, Borrelia afzelii PKo
SVESAVDEVS

SEQ ID NO: 169543 - protein, 10 aa, Borrelia afzelii PKo
VESAVDEVSK

SEQ ID NO: 169544 - protein, 10 aa, Borrelia afzelii PKo
ESAVDEVSKW

SEQ ID NO: 169545 - protein, 10 aa, Borrelia afzelii PKo
SAVDEVSKWL

SEQ ID NO: 169546 - protein, 10 aa, Borrelia afzelii PKo
AVDEVSKWLE

SEQ ID NO: 169547 - protein, 10 aa, Borrelia afzelii PKo
VDEVSKWLEE

SEQ ID NO: 169548 - protein, 10 aa, Borrelia afzelii PKo
DEVSKWLEEM

SEQ ID NO: 169549 - protein, 10 aa, Borrelia afzelii PKo
EVSKWLEEMI

SEQ ID NO: 169550 - protein, 10 aa, Borrelia afzelii PKo
VSKWLEEMIK

SEQ ID NO: 169551 - protein, 10 aa, Borrelia afzelii PKo
SKWLEEMIKA

SEQ ID NO: 169552 - protein, 10 aa, Borrelia afzelii PKo
KWLEEMIKAA

SEQ ID NO: 169553 - protein, 10 aa, Borrelia afzelii PKo
WLEEMIKAAE

SEQ ID NO: 169554 - protein, 10 aa, Borrelia afzelii PKo
LEEMIKAAEE

SEQ ID NO: 169555 - protein, 10 aa, Borrelia afzelii PKo
EEMIKAAEEA

SEQ ID NO: 169556 - protein, 10 aa, Borrelia afzelii PKo
EMIKAAEEAA

SEQ ID NO: 169557 - protein, 10 aa, Borrelia afzelii PKo
MIKAAEEAAK

SEQ ID NO: 169558 - protein, 10 aa, Borrelia afzelii PKo
IKAAEEAAKV

SEQ ID NO: 169559 - protein, 10 aa, Borrelia afzelii PKo
KAAEEAAKVG

SEQ ID NO: 169560 - protein, 10 aa, Borrelia afzelii PKo
AAEEAAKVGG

SEQ ID NO: 169561 - protein, 10 aa, Borrelia afzelii PKo
AEEAAKVGGT

SEQ ID NO: 169562 - protein, 10 aa, Borrelia afzelii PKo
EEAAKVGGTG

SEQ ID NO: 169563 - protein, 10 aa, Borrelia afzelii PKo
EAAKVGGTGG

SEQ ID NO: 169564 - protein, 10 aa, Borrelia afzelii PKo
AAKVGGTGGD

SEQ ID NO: 169565 - protein, 10 aa, Borrelia afzelii PKo
AKVGGTGGDG

SEQ ID NO: 169566 - protein, 10 aa, Borrelia afzelii PKo
KVGGTGGDGK

SEQ ID NO: 169567 - protein, 10 aa, Borrelia afzelii PKo
VGGTGGDGKI

SEQ ID NO: 169568 - protein, 10 aa, Borrelia afzelii PKo
GGTGGDGKIG

SEQ ID NO: 169569 - protein, 10 aa, Borrelia afzelii PKo
GTGGDGKIGD

SEQ ID NO: 169570 - protein, 10 aa, Borrelia afzelii PKo
TGGDGKIGDS

SEQ ID NO: 169571 - protein, 10 aa, Borrelia afzelii PKo
GGDGKIGDSA

SEQ ID NO: 169572 - protein, 10 aa, Borrelia afzelii PKo
GDGKIGDSAA

SEQ ID NO: 169573 - protein, 10 aa, Borrelia afzelii PKo
DGKIGDSAAN

SEQ ID NO: 169574 - protein, 10 aa, Borrelia afzelii PKo
GKIGDSAANH

SEQ ID NO: 169575 - protein, 10 aa, Borrelia afzelii PKo
KIGDSAANHG

SEQ ID NO: 169576 - protein, 10 aa, Borrelia afzelii PKo
IGDSAANHGA

SEQ ID NO: 169577 - protein, 10 aa, Borrelia afzelii PKo
GDSAANHGAK

SEQ ID NO: 169578 - protein, 10 aa, Borrelia afzelii PKo
DSAANHGAKA

SEQ ID NO: 169579 - protein, 10 aa, Borrelia afzelii PKo
SAANHGAKAD

SEQ ID NO: 169580 - protein, 10 aa, Borrelia afzelii PKo
AANHGAKADK

SEQ ID NO: 169581 - protein, 10 aa, Borrelia afzelii PKo
ANHGAKADKD

SEQ ID NO: 169582 - protein, 10 aa, Borrelia afzelii PKo
NHGAKADKDS

SEQ ID NO: 169583 - protein, 10 aa, Borrelia afzelii PKo
HGAKADKDSV

SEQ ID NO: 169584 - protein, 10 aa, Borrelia afzelii PKo
GAKADKDSVK

SEQ ID NO: 169585 - protein, 10 aa, Borrelia afzelii PKo
AKADKDSVKG

SEQ ID NO: 169586 - protein, 10 aa, Borrelia afzelii PKo
KADKDSVKGI

SEQ ID NO: 169587 - protein, 10 aa, Borrelia afzelii PKo
ADKDSVKGIA

SEQ ID NO: 169588 - protein, 10 aa, Borrelia afzelii PKo
DKDSVKGIAK

SEQ ID NO: 169589 - protein, 10 aa, Borrelia afzelii PKo
KDSVKGIAKG

SEQ ID NO: 169590 - protein, 10 aa, Borrelia afzelii PKo
DSVKGIAKGI

SEQ ID NO: 169591 - protein, 10 aa, Borrelia afzelii PKo
SVKGIAKGIK

SEQ ID NO: 169592 - protein, 10 aa, Borrelia afzelii PKo
VKGIAKGIKG

SEQ ID NO: 169593 - protein, 10 aa, Borrelia afzelii PKo
KGIAKGIKGI

SEQ ID NO: 169594 - protein, 10 aa, Borrelia afzelii PKo
GIAKGIKGIV

SEQ ID NO: 169595 - protein, 10 aa, Borrelia afzelii PKo
IAKGIKGIVD

SEQ ID NO: 169596 - protein, 10 aa, Borrelia afzelii PKo
AKGIKGIVDA

SEQ ID NO: 169597 - protein, 10 aa, Borrelia afzelii PKo
KGIKGIVDAA

SEQ ID NO: 169598 - protein, 10 aa, Borrelia afzelii PKo
GIKGIVDAAG

SEQ ID NO: 169599 - protein, 10 aa, Borrelia afzelii PKo
IKGIVDAAGK

SEQ ID NO: 169600 - protein, 10 aa, Borrelia afzelii PKo
KGIVDAAGKA

SEQ ID NO: 169601 - protein, 10 aa, Borrelia afzelii PKo
GIVDAAGKAL

SEQ ID NO: 169602 - protein, 10 aa, Borrelia afzelii PKo
IVDAAGKALG

SEQ ID NO: 169603 - protein, 10 aa, Borrelia afzelii PKo
VDAAGKALGE

SEQ ID NO: 169604 - protein, 10 aa, Borrelia afzelii PKo
DAAGKALGEK

SEQ ID NO: 169605 - protein, 10 aa, Borrelia afzelii PKo
AAGKALGEKG

SEQ ID NO: 169606 - protein, 10 aa, Borrelia afzelii PKo
AGKALGEKGA

SEQ ID NO: 169607 - protein, 10 aa, Borrelia afzelii PKo
GKALGEKGAL

SEQ ID NO: 169608 - protein, 10 aa, Borrelia afzelii PKo
KALGEKGALK

SEQ ID NO: 169609 - protein, 10 aa, Borrelia afzelii PKo
ALGEKGALKD

SEQ ID NO: 169610 - protein, 10 aa, Borrelia afzelii PKo
LGEKGALKDV

SEQ ID NO: 169611 - protein, 10 aa, Borrelia afzelii PKo
GEKGALKDVK

SEQ ID NO: 169612 - protein, 10 aa, Borrelia afzelii PKo
EKGALKDVKA

SEQ ID NO: 169613 - protein, 10 aa, Borrelia afzelii PKo
KGALKDVKAA

SEQ ID NO: 169614 - protein, 10 aa, Borrelia afzelii PKo
GALKDVKAAA

SEQ ID NO: 169615 - protein, 10 aa, Borrelia afzelii PKo
ALKDVKAAAD

SEQ ID NO: 169616 - protein, 10 aa, Borrelia afzelii PKo
LKDVKAAADD

SEQ ID NO: 169617 - protein, 10 aa, Borrelia afzelii PKo
KDVKAAADDE

SEQ ID NO: 169618 - protein, 10 aa, Borrelia afzelii PKo
DVKAAADDEA

SEQ ID NO: 169619 - protein, 10 aa, Borrelia afzelii PKo
VKAAADDEAN

SEQ ID NO: 169620 - protein, 10 aa, Borrelia afzelii PKo
KAAADDEANA

SEQ ID NO: 169621 - protein, 10 aa, Borrelia afzelii PKo
AAADDEANAD

SEQ ID NO: 169622 - protein, 10 aa, Borrelia afzelii PKo
AADDEANADA

SEQ ID NO: 169623 - protein, 10 aa, Borrelia afzelii PKo
ADDEANADAG

SEQ ID NO: 169624 - protein, 10 aa, Borrelia afzelii PKo
DDEANADAGK

SEQ ID NO: 169625 - protein, 10 aa, Borrelia afzelii PKo
DEANADAGKL

SEQ ID NO: 169626 - protein, 10 aa, Borrelia afzelii PKo
EANADAGKLF

SEQ ID NO: 169627 - protein, 10 aa, Borrelia afzelii PKo
ANADAGKLFA

SEQ ID NO: 169628 - protein, 10 aa, Borrelia afzelii PKo
NADAGKLFAG

SEQ ID NO: 169629 - protein, 10 aa, Borrelia afzelii PKo
ADAGKLFAGN

SEQ ID NO: 169630 - protein, 10 aa, Borrelia afzelii PKo
DAGKLFAGNA

SEQ ID NO: 169631 - protein, 10 aa, Borrelia afzelii PKo
AGKLFAGNAN

SEQ ID NO: 169632 - protein, 10 aa, Borrelia afzelii PKo
GKLFAGNANA

SEQ ID NO: 169633 - protein, 10 aa, Borrelia afzelii PKo
KLFAGNANAA

SEQ ID NO: 169634 - protein, 10 aa, Borrelia afzelii PKo
LFAGNANAAV

SEQ ID NO: 169635 - protein, 10 aa, Borrelia afzelii PKo
FAGNANAAVG

SEQ ID NO: 169636 - protein, 10 aa, Borrelia afzelii PKo
AGNANAAVGA

SEQ ID NO: 169637 - protein, 10 aa, Borrelia afzelii PKo
GNANAAVGAA

SEQ ID NO: 169638 - protein, 10 aa, Borrelia afzelii PKo
NANAAVGAAA

SEQ ID NO: 169639 - protein, 10 aa, Borrelia afzelii PKo
ANAAVGAAAD

SEQ ID NO: 169640 - protein, 10 aa, Borrelia afzelii PKo
NAAVGAAADI

SEQ ID NO: 169641 - protein, 10 aa, Borrelia afzelii PKo
AAVGAAADIA

SEQ ID NO: 169642 - protein, 10 aa, Borrelia afzelii PKo
AVGAAADIAK

SEQ ID NO: 169643 - protein, 10 aa, Borrelia afzelii PKo
VGAAADIAKA

SEQ ID NO: 169644 - protein, 10 aa, Borrelia afzelii PKo
GAAADIAKAA

SEQ ID NO: 169645 - protein, 10 aa, Borrelia afzelii PKo
AAADIAKAAG

SEQ ID NO: 169646 - protein, 10 aa, Borrelia afzelii PKo
AADIAKAAGA

SEQ ID NO: 169647 - protein, 10 aa, Borrelia afzelii PKo
ADIAKAAGAV

SEQ ID NO: 169648 - protein, 10 aa, Borrelia afzelii PKo
DIAKAAGAVT

SEQ ID NO: 169649 - protein, 10 aa, Borrelia afzelii PKo
IAKAAGAVTA

SEQ ID NO: 169650 - protein, 10 aa, Borrelia afzelii PKo
AKAAGAVTAV

SEQ ID NO: 169651 - protein, 10 aa, Borrelia afzelii PKo
KAAGAVTAVS

SEQ ID NO: 169652 - protein, 10 aa, Borrelia afzelii PKo
AAGAVTAVSG

SEQ ID NO: 169653 - protein, 10 aa, Borrelia afzelii PKo
AGAVTAVSGE

SEQ ID NO: 169654 - protein, 10 aa, Borrelia afzelii PKo
GAVTAVSGEQ

SEQ ID NO: 169655 - protein, 10 aa, Borrelia afzelii PKo
AVTAVSGEQI

SEQ ID NO: 169656 - protein, 10 aa, Borrelia afzelii PKo
VTAVSGEQIL

SEQ ID NO: 169657 - protein, 10 aa, Borrelia afzelii PKo
TAVSGEQILK

SEQ ID NO: 169658 - protein, 10 aa, Borrelia afzelii PKo
AVSGEQILKA

SEQ ID NO: 169659 - protein, 10 aa, Borrelia afzelii PKo
VSGEQILKAI

SEQ ID NO: 169660 - protein, 10 aa, Borrelia afzelii PKo
SGEQILKAIV

SEQ ID NO: 169661 - protein, 10 aa, Borrelia afzelii PKo
GEQILKAIVE

SEQ ID NO: 169662 - protein, 10 aa, Borrelia afzelii PKo
EQILKAIVEA

SEQ ID NO: 169663 - protein, 10 aa, Borrelia afzelii PKo
QILKAIVEAA

SEQ ID NO: 169664 - protein, 10 aa, Borrelia afzelii PKo
ILKAIVEAAG

SEQ ID NO: 169665 - protein, 10 aa, Borrelia afzelii PKo
LKAIVEAAGD

SEQ ID NO: 169666 - protein, 10 aa, Borrelia afzelii PKo
KAIVEAAGDP

SEQ ID NO: 169667 - protein, 10 aa, Borrelia afzelii PKo
AIVEAAGDPA

SEQ ID NO: 169668 - protein, 10 aa, Borrelia afzelii PKo
IVEAAGDPAN

SEQ ID NO: 169669 - protein, 10 aa, Borrelia afzelii PKo
VEAAGDPANQ

SEQ ID NO: 169670 - protein, 10 aa, Borrelia afzelii PKo
EAAGDPANQA

SEQ ID NO: 169671 - protein, 10 aa, Borrelia afzelii PKo
AAGDPANQAG

SEQ ID NO: 169672 - protein, 10 aa, Borrelia afzelii PKo
AGDPANQAGK

SEQ ID NO: 169673 - protein, 10 aa, Borrelia afzelii PKo
GDPANQAGKK

SEQ ID NO: 169674 - protein, 10 aa, Borrelia afzelii PKo
DPANQAGKKA

SEQ ID NO: 169675 - protein, 10 aa, Borrelia afzelii PKo
PANQAGKKAE

SEQ ID NO: 169676 - protein, 10 aa, Borrelia afzelii PKo
ANQAGKKAEE

SEQ ID NO: 169677 - protein, 10 aa, Borrelia afzelii PKo
NQAGKKAEEA

SEQ ID NO: 169678 - protein, 10 aa, Borrelia afzelii PKo
QAGKKAEEAK

SEQ ID NO: 169679 - protein, 10 aa, Borrelia afzelii PKo
AGKKAEEAKN

SEQ ID NO: 169680 - protein, 10 aa, Borrelia afzelii PKo
GKKAEEAKNP

SEQ ID NO: 169681 - protein, 10 aa, Borrelia afzelii PKo
KKAEEAKNPI

SEQ ID NO: 169682 - protein, 10 aa, Borrelia afzelii PKo
KAEEAKNPIA

SEQ ID NO: 169683 - protein, 10 aa, Borrelia afzelii PKo
AEEAKNPIAA

SEQ ID NO: 169684 - protein, 10 aa, Borrelia afzelii PKo
EEAKNPIAAA

SEQ ID NO: 169685 - protein, 10 aa, Borrelia afzelii PKo
EAKNPIAAAI

SEQ ID NO: 169686 - protein, 10 aa, Borrelia afzelii PKo
AKNPIAAAIG

SEQ ID NO: 169687 - protein, 10 aa, Borrelia afzelii PKo
KNPIAAAIGT

SEQ ID NO: 169688 - protein, 10 aa, Borrelia afzelii PKo
NPIAAAIGTD

SEQ ID NO: 169689 - protein, 10 aa, Borrelia afzelii PKo
PIAAAIGTDD

SEQ ID NO: 169690 - protein, 10 aa, Borrelia afzelii PKo
IAAAIGTDDD

SEQ ID NO: 169691 - protein, 10 aa, Borrelia afzelii PKo
AAAIGTDDDN

SEQ ID NO: 169692 - protein, 10 aa, Borrelia afzelii PKo
AAIGTDDDNG

SEQ ID NO: 169693 - protein, 10 aa, Borrelia afzelii PKo
AIGTDDDNGA

SEQ ID NO: 169694 - protein, 10 aa, Borrelia afzelii PKo
IGTDDDNGAA

SEQ ID NO: 169695 - protein, 10 aa, Borrelia afzelii PKo
GTDDDNGAAF

SEQ ID NO: 169696 - protein, 10 aa, Borrelia afzelii PKo
TDDDNGAAFK

SEQ ID NO: 169697 - protein, 10 aa, Borrelia afzelii PKo
DDDNGAAFKD

SEQ ID NO: 169698 - protein, 10 aa, Borrelia afzelii PKo
DDNGAAFKDE

SEQ ID NO: 169699 - protein, 10 aa, Borrelia afzelii PKo
DNGAAFKDEM

SEQ ID NO: 169700 - protein, 10 aa, Borrelia afzelii PKo
NGAAFKDEMK

SEQ ID NO: 169701 - protein, 10 aa, Borrelia afzelii PKo
GAAFKDEMKK

SEQ ID NO: 169702 - protein, 10 aa, Borrelia afzelii PKo
AAFKDEMKKS

SEQ ID NO: 169703 - protein, 10 aa, Borrelia afzelii PKo
AFKDEMKKSD

SEQ ID NO: 169704 - protein, 10 aa, Borrelia afzelii PKo
FKDEMKKSDK

SEQ ID NO: 169705 - protein, 10 aa, Borrelia afzelii PKo
KDEMKKSDKI

SEQ ID NO: 169706 - protein, 10 aa, Borrelia afzelii PKo
DEMKKSDKIA

SEQ ID NO: 169707 - protein, 10 aa, Borrelia afzelii PKo
EMKKSDKIAA

SEQ ID NO: 169708 - protein, 10 aa, Borrelia afzelii PKo
MKKSDKIAAA

SEQ ID NO: 169709 - protein, 10 aa, Borrelia afzelii PKo
KKSDKIAAAI

SEQ ID NO: 169710 - protein, 10 aa, Borrelia afzelii PKo
KSDKIAAAIV

SEQ ID NO: 169711 - protein, 10 aa, Borrelia afzelii PKo
SDKIAAAIVL

SEQ ID NO: 169712 - protein, 10 aa, Borrelia afzelii PKo
DKIAAAIVLR

SEQ ID NO: 169713 - protein, 10 aa, Borrelia afzelii PKo
KIAAAIVLRG

SEQ ID NO: 169714 - protein, 10 aa, Borrelia afzelii PKo
IAAAIVLRGV

SEQ ID NO: 169715 - protein, 10 aa, Borrelia afzelii PKo
AAAIVLRGVA

SEQ ID NO: 169716 - protein, 10 aa, Borrelia afzelii PKo
AAIVLRGVAK

SEQ ID NO: 169717 - protein, 10 aa, Borrelia afzelii PKo
AIVLRGVAKD

SEQ ID NO: 169718 - protein, 10 aa, Borrelia afzelii PKo
IVLRGVAKDG

SEQ ID NO: 169719 - protein, 10 aa, Borrelia afzelii PKo
VLRGVAKDGK

SEQ ID NO: 169720 - protein, 10 aa, Borrelia afzelii PKo
LRGVAKDGKF

SEQ ID NO: 169721 - protein, 10 aa, Borrelia afzelii PKo
RGVAKDGKFA

SEQ ID NO: 169722 - protein, 10 aa, Borrelia afzelii PKo
GVAKDGKFAV

SEQ ID NO: 169723 - protein, 10 aa, Borrelia afzelii PKo
VAKDGKFAVK

SEQ ID NO: 169724 - protein, 11 aa, Borrelia afzelii PKo
MKKISSAIFLT

SEQ ID NO: 169725 - protein, 11 aa, Borrelia afzelii PKo
KKISSAIFLTA

SEQ ID NO: 169726 - protein, 11 aa, Borrelia afzelii PKo
KISSAIFLTAL

SEQ ID NO: 169727 - protein, 11 aa, Borrelia afzelii PKo
ISSAIFLTALL

SEQ ID NO: 169728 - protein, 11 aa, Borrelia afzelii PKo
SSAIFLTALLV

SEQ ID NO: 169729 - protein, 11 aa, Borrelia afzelii PKo
SAIFLTALLVF

SEQ ID NO: 169730 - protein, 11 aa, Borrelia afzelii PKo
AIFLTALLVFI

SEQ ID NO: 169731 - protein, 11 aa, Borrelia afzelii PKo
IFLTALLVFIN

SEQ ID NO: 169732 - protein, 11 aa, Borrelia afzelii PKo
FLTALLVFINC

SEQ ID NO: 169733 - protein, 11 aa, Borrelia afzelii PKo
LTALLVFINCK

SEQ ID NO: 169734 - protein, 11 aa, Borrelia afzelii PKo
TALLVFINCKN

SEQ ID NO: 169735 - protein, 11 aa, Borrelia afzelii PKo
ALLVFINCKNN

SEQ ID NO: 169736 - protein, 11 aa, Borrelia afzelii PKo
LLVFINCKNNA

SEQ ID NO: 169737 - protein, 11 aa, Borrelia afzelii PKo
LVFINCKNNAV

SEQ ID NO: 169738 - protein, 11 aa, Borrelia afzelii PKo
VFINCKNNAVG

SEQ ID NO: 169739 - protein, 11 aa, Borrelia afzelii PKo
FINCKNNAVGK

SEQ ID NO: 169740 - protein, 11 aa, Borrelia afzelii PKo
INCKNNAVGKG

SEQ ID NO: 169741 - protein, 11 aa, Borrelia afzelii PKo
NCKNNAVGKGN

SEQ ID NO: 169742 - protein, 11 aa, Borrelia afzelii PKo
CKNNAVGKGND

SEQ ID NO: 169743 - protein, 11 aa, Borrelia afzelii PKo
KNNAVGKGNDD

SEQ ID NO: 169744 - protein, 11 aa, Borrelia afzelii PKo
NNAVGKGNDDK

SEQ ID NO: 169745 - protein, 11 aa, Borrelia afzelii PKo
NAVGKGNDDKD

SEQ ID NO: 169746 - protein, 11 aa, Borrelia afzelii PKo
AVGKGNDDKDS

SEQ ID NO: 169747 - protein, 11 aa, Borrelia afzelii PKo
VGKGNDDKDSV

SEQ ID NO: 169748 - protein, 11 aa, Borrelia afzelii PKo
GKGNDDKDSVK

SEQ ID NO: 169749 - protein, 11 aa, Borrelia afzelii PKo
KGNDDKDSVKT

SEQ ID NO: 169750 - protein, 11 aa, Borrelia afzelii PKo
GNDDKDSVKTF

SEQ ID NO: 169751 - protein, 11 aa, Borrelia afzelii PKo
NDDKDSVKTFY

SEQ ID NO: 169752 - protein, 11 aa, Borrelia afzelii PKo
DDKDSVKTFYE

SEQ ID NO: 169753 - protein, 11 aa, Borrelia afzelii PKo
DKDSVKTFYES

SEQ ID NO: 169754 - protein, 11 aa, Borrelia afzelii PKo
KDSVKTFYESI

SEQ ID NO: 169755 - protein, 11 aa, Borrelia afzelii PKo
DSVKTFYESII

SEQ ID NO: 169756 - protein, 11 aa, Borrelia afzelii PKo
SVKTFYESIIN

SEQ ID NO: 169757 - protein, 11 aa, Borrelia afzelii PKo
VKTFYESIINL

SEQ ID NO: 169758 - protein, 11 aa, Borrelia afzelii PKo
KTFYESIINLG

SEQ ID NO: 169759 - protein, 11 aa, Borrelia afzelii PKo
TFYESIINLGN

SEQ ID NO: 169760 - protein, 11 aa, Borrelia afzelii PKo
FYESIINLGNG

SEQ ID NO: 169761 - protein, 11 aa, Borrelia afzelii PKo
YESIINLGNGF

SEQ ID NO: 169762 - protein, 11 aa, Borrelia afzelii PKo
ESIINLGNGFI

SEQ ID NO: 169763 - protein, 11 aa, Borrelia afzelii PKo
SIINLGNGFID

SEQ ID NO: 169764 - protein, 11 aa, Borrelia afzelii PKo
IINLGNGFIDV

SEQ ID NO: 169765 - protein, 11 aa, Borrelia afzelii PKo
INLGNGFIDVF

SEQ ID NO: 169766 - protein, 11 aa, Borrelia afzelii PKo
NLGNGFIDVFN

SEQ ID NO: 169767 - protein, 11 aa, Borrelia afzelii PKo
LGNGFIDVFNA

SEQ ID NO: 169768 - protein, 11 aa, Borrelia afzelii PKo
GNGFIDVFNAF

SEQ ID NO: 169769 - protein, 11 aa, Borrelia afzelii PKo
NGFIDVFNAFS

SEQ ID NO: 169770 - protein, 11 aa, Borrelia afzelii PKo
GFIDVFNAFSG

SEQ ID NO: 169771 - protein, 11 aa, Borrelia afzelii PKo
FIDVFNAFSGL

SEQ ID NO: 169772 - protein, 11 aa, Borrelia afzelii PKo
IDVFNAFSGLV

SEQ ID NO: 169773 - protein, 11 aa, Borrelia afzelii PKo
DVFNAFSGLVA

SEQ ID NO: 169774 - protein, 11 aa, Borrelia afzelii PKo
VFNAFSGLVAD

SEQ ID NO: 169775 - protein, 11 aa, Borrelia afzelii PKo
FNAFSGLVADT

SEQ ID NO: 169776 - protein, 11 aa, Borrelia afzelii PKo
NAFSGLVADTF

SEQ ID NO: 169777 - protein, 11 aa, Borrelia afzelii PKo
AFSGLVADTFF

SEQ ID NO: 169778 - protein, 11 aa, Borrelia afzelii PKo
FSGLVADTFFK

SEQ ID NO: 169779 - protein, 11 aa, Borrelia afzelii PKo
SGLVADTFFKS

SEQ ID NO: 169780 - protein, 11 aa, Borrelia afzelii PKo
GLVADTFFKSD

SEQ ID NO: 169781 - protein, 11 aa, Borrelia afzelii PKo
LVADTFFKSDP

SEQ ID NO: 169782 - protein, 11 aa, Borrelia afzelii PKo
VADTFFKSDPK

SEQ ID NO: 169783 - protein, 11 aa, Borrelia afzelii PKo
ADTFFKSDPKK

SEQ ID NO: 169784 - protein, 11 aa, Borrelia afzelii PKo
DTFFKSDPKKS

SEQ ID NO: 169785 - protein, 11 aa, Borrelia afzelii PKo
TFFKSDPKKSD

SEQ ID NO: 169786 - protein, 11 aa, Borrelia afzelii PKo
FFKSDPKKSDV

SEQ ID NO: 169787 - protein, 11 aa, Borrelia afzelii PKo
FKSDPKKSDVK

SEQ ID NO: 169788 - protein, 11 aa, Borrelia afzelii PKo
KSDPKKSDVKT

SEQ ID NO: 169789 - protein, 11 aa, Borrelia afzelii PKo
SDPKKSDVKTY

SEQ ID NO: 169790 - protein, 11 aa, Borrelia afzelii PKo
DPKKSDVKTYF

SEQ ID NO: 169791 - protein, 11 aa, Borrelia afzelii PKo
PKKSDVKTYFE

SEQ ID NO: 169792 - protein, 11 aa, Borrelia afzelii PKo
KKSDVKTYFES

SEQ ID NO: 169793 - protein, 11 aa, Borrelia afzelii PKo
KSDVKTYFESI

SEQ ID NO: 169794 - protein, 11 aa, Borrelia afzelii PKo
SDVKTYFESIS

SEQ ID NO: 169795 - protein, 11 aa, Borrelia afzelii PKo
DVKTYFESISS

SEQ ID NO: 169796 - protein, 11 aa, Borrelia afzelii PKo
VKTYFESISST

SEQ ID NO: 169797 - protein, 11 aa, Borrelia afzelii PKo
KTYFESISSTL

SEQ ID NO: 169798 - protein, 11 aa, Borrelia afzelii PKo
TYFESISSTLK

SEQ ID NO: 169799 - protein, 11 aa, Borrelia afzelii PKo
YFESISSTLKA

SEQ ID NO: 169800 - protein, 11 aa, Borrelia afzelii PKo
FESISSTLKAT

SEQ ID NO: 169801 - protein, 11 aa, Borrelia afzelii PKo
ESISSTLKATK

SEQ ID NO: 169802 - protein, 11 aa, Borrelia afzelii PKo
SISSTLKATKG

SEQ ID NO: 169803 - protein, 11 aa, Borrelia afzelii PKo
ISSTLKATKGK

SEQ ID NO: 169804 - protein, 11 aa, Borrelia afzelii PKo
SSTLKATKGKL

SEQ ID NO: 169805 - protein, 11 aa, Borrelia afzelii PKo
STLKATKGKLD

SEQ ID NO: 169806 - protein, 11 aa, Borrelia afzelii PKo
TLKATKGKLDE

SEQ ID NO: 169807 - protein, 11 aa, Borrelia afzelii PKo
LKATKGKLDEL

SEQ ID NO: 169808 - protein, 11 aa, Borrelia afzelii PKo
KATKGKLDELV

SEQ ID NO: 169809 - protein, 11 aa, Borrelia afzelii PKo
ATKGKLDELVS

SEQ ID NO: 169810 - protein, 11 aa, Borrelia afzelii PKo
TKGKLDELVSA

SEQ ID NO: 169811 - protein, 11 aa, Borrelia afzelii PKo
KGKLDELVSAK

SEQ ID NO: 169812 - protein, 11 aa, Borrelia afzelii PKo
GKLDELVSAKK

SEQ ID NO: 169813 - protein, 11 aa, Borrelia afzelii PKo
KLDELVSAKKG

SEQ ID NO: 169814 - protein, 11 aa, Borrelia afzelii PKo
LDELVSAKKGE

SEQ ID NO: 169815 - protein, 11 aa, Borrelia afzelii PKo
DELVSAKKGEG

SEQ ID NO: 169816 - protein, 11 aa, Borrelia afzelii PKo
ELVSAKKGEGG

SEQ ID NO: 169817 - protein, 11 aa, Borrelia afzelii PKo
LVSAKKGEGGS

SEQ ID NO: 169818 - protein, 11 aa, Borrelia afzelii PKo
VSAKKGEGGSV

SEQ ID NO: 169819 - protein, 11 aa, Borrelia afzelii PKo
SAKKGEGGSVK

SEQ ID NO: 169820 - protein, 11 aa, Borrelia afzelii PKo
AKKGEGGSVKA

SEQ ID NO: 169821 - protein, 11 aa, Borrelia afzelii PKo
KKGEGGSVKAS

SEQ ID NO: 169822 - protein, 11 aa, Borrelia afzelii PKo
KGEGGSVKASV

SEQ ID NO: 169823 - protein, 11 aa, Borrelia afzelii PKo
GEGGSVKASVE

SEQ ID NO: 169824 - protein, 11 aa, Borrelia afzelii PKo
EGGSVKASVES

SEQ ID NO: 169825 - protein, 11 aa, Borrelia afzelii PKo
GGSVKASVESA

SEQ ID NO: 169826 - protein, 11 aa, Borrelia afzelii PKo
GSVKASVESAV

SEQ ID NO: 169827 - protein, 11 aa, Borrelia afzelii PKo
SVKASVESAVD

SEQ ID NO: 169828 - protein, 11 aa, Borrelia afzelii PKo
VKASVESAVDE

SEQ ID NO: 169829 - protein, 11 aa, Borrelia afzelii PKo
KASVESAVDEV

SEQ ID NO: 169830 - protein, 11 aa, Borrelia afzelii PKo
ASVESAVDEVS

SEQ ID NO: 169831 - protein, 11 aa, Borrelia afzelii PKo
SVESAVDEVSK

SEQ ID NO: 169832 - protein, 11 aa, Borrelia afzelii PKo
VESAVDEVSKW

SEQ ID NO: 169833 - protein, 11 aa, Borrelia afzelii PKo
ESAVDEVSKWL

SEQ ID NO: 169834 - protein, 11 aa, Borrelia afzelii PKo
SAVDEVSKWLE

SEQ ID NO: 169835 - protein, 11 aa, Borrelia afzelii PKo
AVDEVSKWLEE

SEQ ID NO: 169836 - protein, 11 aa, Borrelia afzelii PKo
VDEVSKWLEEM

SEQ ID NO: 169837 - protein, 11 aa, Borrelia afzelii PKo
DEVSKWLEEMI

SEQ ID NO: 169838 - protein, 11 aa, Borrelia afzelii PKo
EVSKWLEEMIK

SEQ ID NO: 169839 - protein, 11 aa, Borrelia afzelii PKo
VSKWLEEMIKA

SEQ ID NO: 169840 - protein, 11 aa, Borrelia afzelii PKo
SKWLEEMIKAA

SEQ ID NO: 169841 - protein, 11 aa, Borrelia afzelii PKo
KWLEEMIKAAE

SEQ ID NO: 169842 - protein, 11 aa, Borrelia afzelii PKo
WLEEMIKAAEE

SEQ ID NO: 169843 - protein, 11 aa, Borrelia afzelii PKo
LEEMIKAAEEA

SEQ ID NO: 169844 - protein, 11 aa, Borrelia afzelii PKo
EEMIKAAEEAA

SEQ ID NO: 169845 - protein, 11 aa, Borrelia afzelii PKo
EMIKAAEEAAK

SEQ ID NO: 169846 - protein, 11 aa, Borrelia afzelii PKo
MIKAAEEAAKV

SEQ ID NO: 169847 - protein, 11 aa, Borrelia afzelii PKo
IKAAEEAAKVG

SEQ ID NO: 169848 - protein, 11 aa, Borrelia afzelii PKo
KAAEEAAKVGG

SEQ ID NO: 169849 - protein, 11 aa, Borrelia afzelii PKo
AAEEAAKVGGT

SEQ ID NO: 169850 - protein, 11 aa, Borrelia afzelii PKo
AEEAAKVGGTG

SEQ ID NO: 169851 - protein, 11 aa, Borrelia afzelii PKo
EEAAKVGGTGG

SEQ ID NO: 169852 - protein, 11 aa, Borrelia afzelii PKo
EAAKVGGTGGD

SEQ ID NO: 169853 - protein, 11 aa, Borrelia afzelii PKo
AAKVGGTGGDG

SEQ ID NO: 169854 - protein, 11 aa, Borrelia afzelii PKo
AKVGGTGGDGK

SEQ ID NO: 169855 - protein, 11 aa, Borrelia afzelii PKo
KVGGTGGDGKI

SEQ ID NO: 169856 - protein, 11 aa, Borrelia afzelii PKo
VGGTGGDGKIG

SEQ ID NO: 169857 - protein, 11 aa, Borrelia afzelii PKo
GGTGGDGKIGD

SEQ ID NO: 169858 - protein, 11 aa, Borrelia afzelii PKo
GTGGDGKIGDS

SEQ ID NO: 169859 - protein, 11 aa, Borrelia afzelii PKo
TGGDGKIGDSA

SEQ ID NO: 169860 - protein, 11 aa, Borrelia afzelii PKo
GGDGKIGDSAA

SEQ ID NO: 169861 - protein, 11 aa, Borrelia afzelii PKo
GDGKIGDSAAN

SEQ ID NO: 169862 - protein, 11 aa, Borrelia afzelii PKo
DGKIGDSAANH

SEQ ID NO: 169863 - protein, 11 aa, Borrelia afzelii PKo
GKIGDSAANHG

SEQ ID NO: 169864 - protein, 11 aa, Borrelia afzelii PKo
KIGDSAANHGA

SEQ ID NO: 169865 - protein, 11 aa, Borrelia afzelii PKo
IGDSAANHGAK

SEQ ID NO: 169866 - protein, 11 aa, Borrelia afzelii PKo
GDSAANHGAKA

SEQ ID NO: 169867 - protein, 11 aa, Borrelia afzelii PKo
DSAANHGAKAD

SEQ ID NO: 169868 - protein, 11 aa, Borrelia afzelii PKo
SAANHGAKADK

SEQ ID NO: 169869 - protein, 11 aa, Borrelia afzelii PKo
AANHGAKADKD

SEQ ID NO: 169870 - protein, 11 aa, Borrelia afzelii PKo
ANHGAKADKDS

SEQ ID NO: 169871 - protein, 11 aa, Borrelia afzelii PKo
NHGAKADKDSV

SEQ ID NO: 169872 - protein, 11 aa, Borrelia afzelii PKo
HGAKADKDSVK

SEQ ID NO: 169873 - protein, 11 aa, Borrelia afzelii PKo
GAKADKDSVKG

SEQ ID NO: 169874 - protein, 11 aa, Borrelia afzelii PKo
AKADKDSVKGI

SEQ ID NO: 169875 - protein, 11 aa, Borrelia afzelii PKo
KADKDSVKGIA

SEQ ID NO: 169876 - protein, 11 aa, Borrelia afzelii PKo
ADKDSVKGIAK

SEQ ID NO: 169877 - protein, 11 aa, Borrelia afzelii PKo
DKDSVKGIAKG

SEQ ID NO: 169878 - protein, 11 aa, Borrelia afzelii PKo
KDSVKGIAKGI

SEQ ID NO: 169879 - protein, 11 aa, Borrelia afzelii PKo
DSVKGIAKGIK

SEQ ID NO: 169880 - protein, 11 aa, Borrelia afzelii PKo
SVKGIAKGIKG

SEQ ID NO: 169881 - protein, 11 aa, Borrelia afzelii PKo
VKGIAKGIKGI

SEQ ID NO: 169882 - protein, 11 aa, Borrelia afzelii PKo
KGIAKGIKGIV

SEQ ID NO: 169883 - protein, 11 aa, Borrelia afzelii PKo
GIAKGIKGIVD

SEQ ID NO: 169884 - protein, 11 aa, Borrelia afzelii PKo
IAKGIKGIVDA

SEQ ID NO: 169885 - protein, 11 aa, Borrelia afzelii PKo
AKGIKGIVDAA

SEQ ID NO: 169886 - protein, 11 aa, Borrelia afzelii PKo
KGIKGIVDAAG

SEQ ID NO: 169887 - protein, 11 aa, Borrelia afzelii PKo
GIKGIVDAAGK

SEQ ID NO: 169888 - protein, 11 aa, Borrelia afzelii PKo
IKGIVDAAGKA

SEQ ID NO: 169889 - protein, 11 aa, Borrelia afzelii PKo
KGIVDAAGKAL

SEQ ID NO: 169890 - protein, 11 aa, Borrelia afzelii PKo
GIVDAAGKALG

SEQ ID NO: 169891 - protein, 11 aa, Borrelia afzelii PKo
IVDAAGKALGE

SEQ ID NO: 169892 - protein, 11 aa, Borrelia afzelii PKo
VDAAGKALGEK

SEQ ID NO: 169893 - protein, 11 aa, Borrelia afzelii PKo
DAAGKALGEKG

SEQ ID NO: 169894 - protein, 11 aa, Borrelia afzelii PKo
AAGKALGEKGA

SEQ ID NO: 169895 - protein, 11 aa, Borrelia afzelii PKo
AGKALGEKGAL

SEQ ID NO: 169896 - protein, 11 aa, Borrelia afzelii PKo
GKALGEKGALK

SEQ ID NO: 169897 - protein, 11 aa, Borrelia afzelii PKo
KALGEKGALKD

SEQ ID NO: 169898 - protein, 11 aa, Borrelia afzelii PKo
ALGEKGALKDV

SEQ ID NO: 169899 - protein, 11 aa, Borrelia afzelii PKo
LGEKGALKDVK

SEQ ID NO: 169900 - protein, 11 aa, Borrelia afzelii PKo
GEKGALKDVKA

SEQ ID NO: 169901 - protein, 11 aa, Borrelia afzelii PKo
EKGALKDVKAA

SEQ ID NO: 169902 - protein, 11 aa, Borrelia afzelii PKo
KGALKDVKAAA

SEQ ID NO: 169903 - protein, 11 aa, Borrelia afzelii PKo
GALKDVKAAAD

SEQ ID NO: 169904 - protein, 11 aa, Borrelia afzelii PKo
ALKDVKAAADD

SEQ ID NO: 169905 - protein, 11 aa, Borrelia afzelii PKo
LKDVKAAADDE

SEQ ID NO: 169906 - protein, 11 aa, Borrelia afzelii PKo
KDVKAAADDEA

SEQ ID NO: 169907 - protein, 11 aa, Borrelia afzelii PKo
DVKAAADDEAN

SEQ ID NO: 169908 - protein, 11 aa, Borrelia afzelii PKo
VKAAADDEANA

SEQ ID NO: 169909 - protein, 11 aa, Borrelia afzelii PKo
KAAADDEANAD

SEQ ID NO: 169910 - protein, 11 aa, Borrelia afzelii PKo
AAADDEANADA

SEQ ID NO: 169911 - protein, 11 aa, Borrelia afzelii PKo
AADDEANADAG

SEQ ID NO: 169912 - protein, 11 aa, Borrelia afzelii PKo
ADDEANADAGK

SEQ ID NO: 169913 - protein, 11 aa, Borrelia afzelii PKo
DDEANADAGKL

SEQ ID NO: 169914 - protein, 11 aa, Borrelia afzelii PKo
DEANADAGKLF

SEQ ID NO: 169915 - protein, 11 aa, Borrelia afzelii PKo
EANADAGKLFA

SEQ ID NO: 169916 - protein, 11 aa, Borrelia afzelii PKo
ANADAGKLFAG

SEQ ID NO: 169917 - protein, 11 aa, Borrelia afzelii PKo
NADAGKLFAGN

SEQ ID NO: 169918 - protein, 11 aa, Borrelia afzelii PKo
ADAGKLFAGNA

SEQ ID NO: 169919 - protein, 11 aa, Borrelia afzelii PKo
DAGKLFAGNAN

SEQ ID NO: 169920 - protein, 11 aa, Borrelia afzelii PKo
AGKLFAGNANA

SEQ ID NO: 169921 - protein, 11 aa, Borrelia afzelii PKo
GKLFAGNANAA

SEQ ID NO: 169922 - protein, 11 aa, Borrelia afzelii PKo
KLFAGNANAAV

SEQ ID NO: 169923 - protein, 11 aa, Borrelia afzelii PKo
LFAGNANAAVG

SEQ ID NO: 169924 - protein, 11 aa, Borrelia afzelii PKo
FAGNANAAVGA

SEQ ID NO: 169925 - protein, 11 aa, Borrelia afzelii PKo
AGNANAAVGAA

SEQ ID NO: 169926 - protein, 11 aa, Borrelia afzelii PKo
GNANAAVGAAA

SEQ ID NO: 169927 - protein, 11 aa, Borrelia afzelii PKo
NANAAVGAAAD

SEQ ID NO: 169928 - protein, 11 aa, Borrelia afzelii PKo
ANAAVGAAADI

SEQ ID NO: 169929 - protein, 11 aa, Borrelia afzelii PKo
NAAVGAAADIA

SEQ ID NO: 169930 - protein, 11 aa, Borrelia afzelii PKo
AAVGAAADIAK

SEQ ID NO: 169931 - protein, 11 aa, Borrelia afzelii PKo
AVGAAADIAKA

SEQ ID NO: 169932 - protein, 11 aa, Borrelia afzelii PKo
VGAAADIAKAA

SEQ ID NO: 169933 - protein, 11 aa, Borrelia afzelii PKo
GAAADIAKAAG

SEQ ID NO: 169934 - protein, 11 aa, Borrelia afzelii PKo
AAADIAKAAGA

SEQ ID NO: 169935 - protein, 11 aa, Borrelia afzelii PKo
AADIAKAAGAV

SEQ ID NO: 169936 - protein, 11 aa, Borrelia afzelii PKo
ADIAKAAGAVT

SEQ ID NO: 169937 - protein, 11 aa, Borrelia afzelii PKo
DIAKAAGAVTA

SEQ ID NO: 169938 - protein, 11 aa, Borrelia afzelii PKo
IAKAAGAVTAV

SEQ ID NO: 169939 - protein, 11 aa, Borrelia afzelii PKo
AKAAGAVTAVS

SEQ ID NO: 169940 - protein, 11 aa, Borrelia afzelii PKo
KAAGAVTAVSG

SEQ ID NO: 169941 - protein, 11 aa, Borrelia afzelii PKo
AAGAVTAVSGE

SEQ ID NO: 169942 - protein, 11 aa, Borrelia afzelii PKo
AGAVTAVSGEQ

SEQ ID NO: 169943 - protein, 11 aa, Borrelia afzelii PKo
GAVTAVSGEQI

SEQ ID NO: 169944 - protein, 11 aa, Borrelia afzelii PKo
AVTAVSGEQIL

SEQ ID NO: 169945 - protein, 11 aa, Borrelia afzelii PKo
VTAVSGEQILK

SEQ ID NO: 169946 - protein, 11 aa, Borrelia afzelii PKo
TAVSGEQILKA

SEQ ID NO: 169947 - protein, 11 aa, Borrelia afzelii PKo
AVSGEQILKAI

SEQ ID NO: 169948 - protein, 11 aa, Borrelia afzelii PKo
VSGEQILKAIV

SEQ ID NO: 169949 - protein, 11 aa, Borrelia afzelii PKo
SGEQILKAIVE

SEQ ID NO: 169950 - protein, 11 aa, Borrelia afzelii PKo
GEQILKAIVEA

SEQ ID NO: 169951 - protein, 11 aa, Borrelia afzelii PKo
EQILKAIVEAA

SEQ ID NO: 169952 - protein, 11 aa, Borrelia afzelii PKo
QILKAIVEAAG

SEQ ID NO: 169953 - protein, 11 aa, Borrelia afzelii PKo
ILKAIVEAAGD

SEQ ID NO: 169954 - protein, 11 aa, Borrelia afzelii PKo
LKAIVEAAGDP

SEQ ID NO: 169955 - protein, 11 aa, Borrelia afzelii PKo
KAIVEAAGDPA

SEQ ID NO: 169956 - protein, 11 aa, Borrelia afzelii PKo
AIVEAAGDPAN

SEQ ID NO: 169957 - protein, 11 aa, Borrelia afzelii PKo
IVEAAGDPANQ

SEQ ID NO: 169958 - protein, 11 aa, Borrelia afzelii PKo
VEAAGDPANQA

SEQ ID NO: 169959 - protein, 11 aa, Borrelia afzelii PKo
EAAGDPANQAG

SEQ ID NO: 169960 - protein, 11 aa, Borrelia afzelii PKo
AAGDPANQAGK

SEQ ID NO: 169961 - protein, 11 aa, Borrelia afzelii PKo
AGDPANQAGKK

SEQ ID NO: 169962 - protein, 11 aa, Borrelia afzelii PKo
GDPANQAGKKA

SEQ ID NO: 169963 - protein, 11 aa, Borrelia afzelii PKo
DPANQAGKKAE

SEQ ID NO: 169964 - protein, 11 aa, Borrelia afzelii PKo
PANQAGKKAEE

SEQ ID NO: 169965 - protein, 11 aa, Borrelia afzelii PKo
ANQAGKKAEEA

SEQ ID NO: 169966 - protein, 11 aa, Borrelia afzelii PKo
NQAGKKAEEAK

SEQ ID NO: 169967 - protein, 11 aa, Borrelia afzelii PKo
QAGKKAEEAKN

SEQ ID NO: 169968 - protein, 11 aa, Borrelia afzelii PKo
AGKKAEEAKNP

SEQ ID NO: 169969 - protein, 11 aa, Borrelia afzelii PKo
GKKAEEAKNPI

SEQ ID NO: 169970 - protein, 11 aa, Borrelia afzelii PKo
KKAEEAKNPIA

SEQ ID NO: 169971 - protein, 11 aa, Borrelia afzelii PKo
KAEEAKNPIAA

SEQ ID NO: 169972 - protein, 11 aa, Borrelia afzelii PKo
AEEAKNPIAAA

SEQ ID NO: 169973 - protein, 11 aa, Borrelia afzelii PKo
EEAKNPIAAAI

SEQ ID NO: 169974 - protein, 11 aa, Borrelia afzelii PKo
EAKNPIAAAIG

SEQ ID NO: 169975 - protein, 11 aa, Borrelia afzelii PKo
AKNPIAAAIGT

SEQ ID NO: 169976 - protein, 11 aa, Borrelia afzelii PKo
KNPIAAAIGTD

SEQ ID NO: 169977 - protein, 11 aa, Borrelia afzelii PKo
NPIAAAIGTDD

SEQ ID NO: 169978 - protein, 11 aa, Borrelia afzelii PKo
PIAAAIGTDDD

SEQ ID NO: 169979 - protein, 11 aa, Borrelia afzelii PKo
IAAAIGTDDDN

SEQ ID NO: 169980 - protein, 11 aa, Borrelia afzelii PKo
AAAIGTDDDNG

SEQ ID NO: 169981 - protein, 11 aa, Borrelia afzelii PKo
AAIGTDDDNGA

SEQ ID NO: 169982 - protein, 11 aa, Borrelia afzelii PKo
AIGTDDDNGAA

SEQ ID NO: 169983 - protein, 11 aa, Borrelia afzelii PKo
IGTDDDNGAAF

SEQ ID NO: 169984 - protein, 11 aa, Borrelia afzelii PKo
GTDDDNGAAFK

SEQ ID NO: 169985 - protein, 11 aa, Borrelia afzelii PKo
TDDDNGAAFKD

SEQ ID NO: 169986 - protein, 11 aa, Borrelia afzelii PKo
DDDNGAAFKDE

SEQ ID NO: 169987 - protein, 11 aa, Borrelia afzelii PKo
DDNGAAFKDEM

SEQ ID NO: 169988 - protein, 11 aa, Borrelia afzelii PKo
DNGAAFKDEMK

SEQ ID NO: 169989 - protein, 11 aa, Borrelia afzelii PKo
NGAAFKDEMKK

SEQ ID NO: 169990 - protein, 11 aa, Borrelia afzelii PKo
GAAFKDEMKKS

SEQ ID NO: 169991 - protein, 11 aa, Borrelia afzelii PKo
AAFKDEMKKSD

SEQ ID NO: 169992 - protein, 11 aa, Borrelia afzelii PKo
AFKDEMKKSDK

SEQ ID NO: 169993 - protein, 11 aa, Borrelia afzelii PKo
FKDEMKKSDKI

SEQ ID NO: 169994 - protein, 11 aa, Borrelia afzelii PKo
KDEMKKSDKIA

SEQ ID NO: 169995 - protein, 11 aa, Borrelia afzelii PKo
DEMKKSDKIAA

SEQ ID NO: 169996 - protein, 11 aa, Borrelia afzelii PKo
EMKKSDKIAAA

SEQ ID NO: 169997 - protein, 11 aa, Borrelia afzelii PKo
MKKSDKIAAAI

SEQ ID NO: 169998 - protein, 11 aa, Borrelia afzelii PKo
KKSDKIAAAIV

SEQ ID NO: 169999 - protein, 11 aa, Borrelia afzelii PKo
KSDKIAAAIVL

SEQ ID NO: 170000 - protein, 11 aa, Borrelia afzelii PKo
SDKIAAAIVLR

SEQ ID NO: 170001 - protein, 11 aa, Borrelia afzelii PKo
DKIAAAIVLRG

SEQ ID NO: 170002 - protein, 11 aa, Borrelia afzelii PKo
KIAAAIVLRGV

SEQ ID NO: 170003 - protein, 11 aa, Borrelia afzelii PKo
IAAAIVLRGVA

SEQ ID NO: 170004 - protein, 11 aa, Borrelia afzelii PKo
AAAIVLRGVAK

SEQ ID NO: 170005 - protein, 11 aa, Borrelia afzelii PKo
AAIVLRGVAKD

SEQ ID NO: 170006 - protein, 11 aa, Borrelia afzelii PKo
AIVLRGVAKDG

SEQ ID NO: 170007 - protein, 11 aa, Borrelia afzelii PKo
IVLRGVAKDGK

SEQ ID NO: 170008 - protein, 11 aa, Borrelia afzelii PKo
VLRGVAKDGKF

SEQ ID NO: 170009 - protein, 11 aa, Borrelia afzelii PKo
LRGVAKDGKFA

SEQ ID NO: 170010 - protein, 11 aa, Borrelia afzelii PKo
RGVAKDGKFAV

SEQ ID NO: 170011 - protein, 11 aa, Borrelia afzelii PKo
GVAKDGKFAVK

SEQ ID NO: 170012 - protein, 13 aa, Borrelia afzelii PKo
MKKISSAIFLTAL

SEQ ID NO: 170013 - protein, 13 aa, Borrelia afzelii PKo
KKISSAIFLTALL

SEQ ID NO: 170014 - protein, 13 aa, Borrelia afzelii PKo
KISSAIFLTALLV

SEQ ID NO: 170015 - protein, 13 aa, Borrelia afzelii PKo
ISSAIFLTALLVF

SEQ ID NO: 170016 - protein, 13 aa, Borrelia afzelii PKo
SSAIFLTALLVFI

SEQ ID NO: 170017 - protein, 13 aa, Borrelia afzelii PKo
SAIFLTALLVFIN

SEQ ID NO: 170018 - protein, 13 aa, Borrelia afzelii PKo
AIFLTALLVFINC

SEQ ID NO: 170019 - protein, 13 aa, Borrelia afzelii PKo
IFLTALLVFINCK

SEQ ID NO: 170020 - protein, 13 aa, Borrelia afzelii PKo
FLTALLVFINCKN

SEQ ID NO: 170021 - protein, 13 aa, Borrelia afzelii PKo
LTALLVFINCKNN

SEQ ID NO: 170022 - protein, 13 aa, Borrelia afzelii PKo
TALLVFINCKNNA

SEQ ID NO: 170023 - protein, 13 aa, Borrelia afzelii PKo
ALLVFINCKNNAV

SEQ ID NO: 170024 - protein, 13 aa, Borrelia afzelii PKo
LLVFINCKNNAVG

SEQ ID NO: 170025 - protein, 13 aa, Borrelia afzelii PKo
LVFINCKNNAVGK

SEQ ID NO: 170026 - protein, 13 aa, Borrelia afzelii PKo
VFINCKNNAVGKG

SEQ ID NO: 170027 - protein, 13 aa, Borrelia afzelii PKo
FINCKNNAVGKGN

SEQ ID NO: 170028 - protein, 13 aa, Borrelia afzelii PKo
INCKNNAVGKGND

SEQ ID NO: 170029 - protein, 13 aa, Borrelia afzelii PKo
NCKNNAVGKGNDD

SEQ ID NO: 170030 - protein, 13 aa, Borrelia afzelii PKo
CKNNAVGKGNDDK

SEQ ID NO: 170031 - protein, 13 aa, Borrelia afzelii PKo
KNNAVGKGNDDKD

SEQ ID NO: 170032 - protein, 13 aa, Borrelia afzelii PKo
NNAVGKGNDDKDS

SEQ ID NO: 170033 - protein, 13 aa, Borrelia afzelii PKo
NAVGKGNDDKDSV

SEQ ID NO: 170034 - protein, 13 aa, Borrelia afzelii PKo
AVGKGNDDKDSVK

SEQ ID NO: 170035 - protein, 13 aa, Borrelia afzelii PKo
VGKGNDDKDSVKT

SEQ ID NO: 170036 - protein, 13 aa, Borrelia afzelii PKo
GKGNDDKDSVKTF

SEQ ID NO: 170037 - protein, 13 aa, Borrelia afzelii PKo
KGNDDKDSVKTFY

SEQ ID NO: 170038 - protein, 13 aa, Borrelia afzelii PKo
GNDDKDSVKTFYE

SEQ ID NO: 170039 - protein, 13 aa, Borrelia afzelii PKo
NDDKDSVKTFYES

SEQ ID NO: 170040 - protein, 13 aa, Borrelia afzelii PKo
DDKDSVKTFYESI

SEQ ID NO: 170041 - protein, 13 aa, Borrelia afzelii PKo
DKDSVKTFYESII

SEQ ID NO: 170042 - protein, 13 aa, Borrelia afzelii PKo
KDSVKTFYESIIN

SEQ ID NO: 170043 - protein, 13 aa, Borrelia afzelii PKo
DSVKTFYESIINL

SEQ ID NO: 170044 - protein, 13 aa, Borrelia afzelii PKo
SVKTFYESIINLG

SEQ ID NO: 170045 - protein, 13 aa, Borrelia afzelii PKo
VKTFYESIINLGN

SEQ ID NO: 170046 - protein, 13 aa, Borrelia afzelii PKo
KTFYESIINLGNG

SEQ ID NO: 170047 - protein, 13 aa, Borrelia afzelii PKo
TFYESIINLGNGF

SEQ ID NO: 170048 - protein, 13 aa, Borrelia afzelii PKo
FYESIINLGNGFI

SEQ ID NO: 170049 - protein, 13 aa, Borrelia afzelii PKo
YESIINLGNGFID

SEQ ID NO: 170050 - protein, 13 aa, Borrelia afzelii PKo
ESIINLGNGFIDV

SEQ ID NO: 170051 - protein, 13 aa, Borrelia afzelii PKo
SIINLGNGFIDVF

SEQ ID NO: 170052 - protein, 13 aa, Borrelia afzelii PKo
IINLGNGFIDVFN

SEQ ID NO: 170053 - protein, 13 aa, Borrelia afzelii PKo
INLGNGFIDVFNA

SEQ ID NO: 170054 - protein, 13 aa, Borrelia afzelii PKo
NLGNGFIDVFNAF

SEQ ID NO: 170055 - protein, 13 aa, Borrelia afzelii PKo
LGNGFIDVFNAFS

SEQ ID NO: 170056 - protein, 13 aa, Borrelia afzelii PKo
GNGFIDVFNAFSG

SEQ ID NO: 170057 - protein, 13 aa, Borrelia afzelii PKo
NGFIDVFNAFSGL

SEQ ID NO: 170058 - protein, 13 aa, Borrelia afzelii PKo
GFIDVFNAFSGLV

SEQ ID NO: 170059 - protein, 13 aa, Borrelia afzelii PKo
FIDVFNAFSGLVA

SEQ ID NO: 170060 - protein, 13 aa, Borrelia afzelii PKo
IDVFNAFSGLVAD

SEQ ID NO: 170061 - protein, 13 aa, Borrelia afzelii PKo
DVFNAFSGLVADT

SEQ ID NO: 170062 - protein, 13 aa, Borrelia afzelii PKo
VFNAFSGLVADTF

SEQ ID NO: 170063 - protein, 13 aa, Borrelia afzelii PKo
FNAFSGLVADTFF

SEQ ID NO: 170064 - protein, 13 aa, Borrelia afzelii PKo
NAFSGLVADTFFK

SEQ ID NO: 170065 - protein, 13 aa, Borrelia afzelii PKo
AFSGLVADTFFKS

SEQ ID NO: 170066 - protein, 13 aa, Borrelia afzelii PKo
FSGLVADTFFKSD

SEQ ID NO: 170067 - protein, 13 aa, Borrelia afzelii PKo
SGLVADTFFKSDP

SEQ ID NO: 170068 - protein, 13 aa, Borrelia afzelii PKo
GLVADTFFKSDPK

SEQ ID NO: 170069 - protein, 13 aa, Borrelia afzelii PKo
LVADTFFKSDPKK

SEQ ID NO: 170070 - protein, 13 aa, Borrelia afzelii PKo
VADTFFKSDPKKS

SEQ ID NO: 170071 - protein, 13 aa, Borrelia afzelii PKo
ADTFFKSDPKKSD

SEQ ID NO: 170072 - protein, 13 aa, Borrelia afzelii PKo
DTFFKSDPKKSDV

SEQ ID NO: 170073 - protein, 13 aa, Borrelia afzelii PKo
TFFKSDPKKSDVK

SEQ ID NO: 170074 - protein, 13 aa, Borrelia afzelii PKo
FFKSDPKKSDVKT

SEQ ID NO: 170075 - protein, 13 aa, Borrelia afzelii PKo
FKSDPKKSDVKTY

SEQ ID NO: 170076 - protein, 13 aa, Borrelia afzelii PKo
KSDPKKSDVKTYF

SEQ ID NO: 170077 - protein, 13 aa, Borrelia afzelii PKo
SDPKKSDVKTYFE

SEQ ID NO: 170078 - protein, 13 aa, Borrelia afzelii PKo
DPKKSDVKTYFES

SEQ ID NO: 170079 - protein, 13 aa, Borrelia afzelii PKo
PKKSDVKTYFESI

SEQ ID NO: 170080 - protein, 13 aa, Borrelia afzelii PKo
KKSDVKTYFESIS

SEQ ID NO: 170081 - protein, 13 aa, Borrelia afzelii PKo
KSDVKTYFESISS

SEQ ID NO: 170082 - protein, 13 aa, Borrelia afzelii PKo
SDVKTYFESISST

SEQ ID NO: 170083 - protein, 13 aa, Borrelia afzelii PKo
DVKTYFESISSTL

SEQ ID NO: 170084 - protein, 13 aa, Borrelia afzelii PKo
VKTYFESISSTLK

SEQ ID NO: 170085 - protein, 13 aa, Borrelia afzelii PKo
KTYFESISSTLKA

SEQ ID NO: 170086 - protein, 13 aa, Borrelia afzelii PKo
TYFESISSTLKAT

SEQ ID NO: 170087 - protein, 13 aa, Borrelia afzelii PKo
YFESISSTLKATK

SEQ ID NO: 170088 - protein, 13 aa, Borrelia afzelii PKo
FESISSTLKATKG

SEQ ID NO: 170089 - protein, 13 aa, Borrelia afzelii PKo
ESISSTLKATKGK

SEQ ID NO: 170090 - protein, 13 aa, Borrelia afzelii PKo
SISSTLKATKGKL

SEQ ID NO: 170091 - protein, 13 aa, Borrelia afzelii PKo
ISSTLKATKGKLD

SEQ ID NO: 170092 - protein, 13 aa, Borrelia afzelii PKo
SSTLKATKGKLDE

SEQ ID NO: 170093 - protein, 13 aa, Borrelia afzelii PKo
STLKATKGKLDEL

SEQ ID NO: 170094 - protein, 13 aa, Borrelia afzelii PKo
TLKATKGKLDELV

SEQ ID NO: 170095 - protein, 13 aa, Borrelia afzelii PKo
LKATKGKLDELVS

SEQ ID NO: 170096 - protein, 13 aa, Borrelia afzelii PKo
KATKGKLDELVSA

SEQ ID NO: 170097 - protein, 13 aa, Borrelia afzelii PKo
ATKGKLDELVSAK

SEQ ID NO: 170098 - protein, 13 aa, Borrelia afzelii PKo
TKGKLDELVSAKK

SEQ ID NO: 170099 - protein, 13 aa, Borrelia afzelii PKo
KGKLDELVSAKKG

SEQ ID NO: 170100 - protein, 13 aa, Borrelia afzelii PKo
GKLDELVSAKKGE

SEQ ID NO: 170101 - protein, 13 aa, Borrelia afzelii PKo
KLDELVSAKKGEG

SEQ ID NO: 170102 - protein, 13 aa, Borrelia afzelii PKo
LDELVSAKKGEGG

SEQ ID NO: 170103 - protein, 13 aa, Borrelia afzelii PKo
DELVSAKKGEGGS

SEQ ID NO: 170104 - protein, 13 aa, Borrelia afzelii PKo
ELVSAKKGEGGSV

SEQ ID NO: 170105 - protein, 13 aa, Borrelia afzelii PKo
LVSAKKGEGGSVK

SEQ ID NO: 170106 - protein, 13 aa, Borrelia afzelii PKo
VSAKKGEGGSVKA

SEQ ID NO: 170107 - protein, 13 aa, Borrelia afzelii PKo
SAKKGEGGSVKAS

SEQ ID NO: 170108 - protein, 13 aa, Borrelia afzelii PKo
AKKGEGGSVKASV

SEQ ID NO: 170109 - protein, 13 aa, Borrelia afzelii PKo
KKGEGGSVKASVE

SEQ ID NO: 170110 - protein, 13 aa, Borrelia afzelii PKo
KGEGGSVKASVES

SEQ ID NO: 170111 - protein, 13 aa, Borrelia afzelii PKo
GEGGSVKASVESA

SEQ ID NO: 170112 - protein, 13 aa, Borrelia afzelii PKo
EGGSVKASVESAV

SEQ ID NO: 170113 - protein, 13 aa, Borrelia afzelii PKo
GGSVKASVESAVD

SEQ ID NO: 170114 - protein, 13 aa, Borrelia afzelii PKo
GSVKASVESAVDE

SEQ ID NO: 170115 - protein, 13 aa, Borrelia afzelii PKo
SVKASVESAVDEV

SEQ ID NO: 170116 - protein, 13 aa, Borrelia afzelii PKo
VKASVESAVDEVS

SEQ ID NO: 170117 - protein, 13 aa, Borrelia afzelii PKo
KASVESAVDEVSK

SEQ ID NO: 170118 - protein, 13 aa, Borrelia afzelii PKo
ASVESAVDEVSKW

SEQ ID NO: 170119 - protein, 13 aa, Borrelia afzelii PKo
SVESAVDEVSKWL

SEQ ID NO: 170120 - protein, 13 aa, Borrelia afzelii PKo
VESAVDEVSKWLE

SEQ ID NO: 170121 - protein, 13 aa, Borrelia afzelii PKo
ESAVDEVSKWLEE

SEQ ID NO: 170122 - protein, 13 aa, Borrelia afzelii PKo
SAVDEVSKWLEEM

SEQ ID NO: 170123 - protein, 13 aa, Borrelia afzelii PKo
AVDEVSKWLEEMI

SEQ ID NO: 170124 - protein, 13 aa, Borrelia afzelii PKo
VDEVSKWLEEMIK

SEQ ID NO: 170125 - protein, 13 aa, Borrelia afzelii PKo
DEVSKWLEEMIKA

SEQ ID NO: 170126 - protein, 13 aa, Borrelia afzelii PKo
EVSKWLEEMIKAA

SEQ ID NO: 170127 - protein, 13 aa, Borrelia afzelii PKo
VSKWLEEMIKAAE

SEQ ID NO: 170128 - protein, 13 aa, Borrelia afzelii PKo
SKWLEEMIKAAEE

SEQ ID NO: 170129 - protein, 13 aa, Borrelia afzelii PKo
KWLEEMIKAAEEA

SEQ ID NO: 170130 - protein, 13 aa, Borrelia afzelii PKo
WLEEMIKAAEEAA

SEQ ID NO: 170131 - protein, 13 aa, Borrelia afzelii PKo
LEEMIKAAEEAAK

SEQ ID NO: 170132 - protein, 13 aa, Borrelia afzelii PKo
EEMIKAAEEAAKV

SEQ ID NO: 170133 - protein, 13 aa, Borrelia afzelii PKo
EMIKAAEEAAKVG

SEQ ID NO: 170134 - protein, 13 aa, Borrelia afzelii PKo
MIKAAEEAAKVGG

SEQ ID NO: 170135 - protein, 13 aa, Borrelia afzelii PKo
IKAAEEAAKVGGT

SEQ ID NO: 170136 - protein, 13 aa, Borrelia afzelii PKo
KAAEEAAKVGGTG

SEQ ID NO: 170137 - protein, 13 aa, Borrelia afzelii PKo
AAEEAAKVGGTGG

SEQ ID NO: 170138 - protein, 13 aa, Borrelia afzelii PKo
AEEAAKVGGTGGD

SEQ ID NO: 170139 - protein, 13 aa, Borrelia afzelii PKo
EEAAKVGGTGGDG

SEQ ID NO: 170140 - protein, 13 aa, Borrelia afzelii PKo
EAAKVGGTGGDGK

SEQ ID NO: 170141 - protein, 13 aa, Borrelia afzelii PKo
AAKVGGTGGDGKI

SEQ ID NO: 170142 - protein, 13 aa, Borrelia afzelii PKo
AKVGGTGGDGKIG

SEQ ID NO: 170143 - protein, 13 aa, Borrelia afzelii PKo
KVGGTGGDGKIGD

SEQ ID NO: 170144 - protein, 13 aa, Borrelia afzelii PKo
VGGTGGDGKIGDS

SEQ ID NO: 170145 - protein, 13 aa, Borrelia afzelii PKo
GGTGGDGKIGDSA

SEQ ID NO: 170146 - protein, 13 aa, Borrelia afzelii PKo
GTGGDGKIGDSAA

SEQ ID NO: 170147 - protein, 13 aa, Borrelia afzelii PKo
TGGDGKIGDSAAN

SEQ ID NO: 170148 - protein, 13 aa, Borrelia afzelii PKo
GGDGKIGDSAANH

SEQ ID NO: 170149 - protein, 13 aa, Borrelia afzelii PKo
GDGKIGDSAANHG

SEQ ID NO: 170150 - protein, 13 aa, Borrelia afzelii PKo
DGKIGDSAANHGA

SEQ ID NO: 170151 - protein, 13 aa, Borrelia afzelii PKo
GKIGDSAANHGAK

SEQ ID NO: 170152 - protein, 13 aa, Borrelia afzelii PKo
KIGDSAANHGAKA

SEQ ID NO: 170153 - protein, 13 aa, Borrelia afzelii PKo
IGDSAANHGAKAD

SEQ ID NO: 170154 - protein, 13 aa, Borrelia afzelii PKo
GDSAANHGAKADK

SEQ ID NO: 170155 - protein, 13 aa, Borrelia afzelii PKo
DSAANHGAKADKD

SEQ ID NO: 170156 - protein, 13 aa, Borrelia afzelii PKo
SAANHGAKADKDS

SEQ ID NO: 170157 - protein, 13 aa, Borrelia afzelii PKo
AANHGAKADKDSV

SEQ ID NO: 170158 - protein, 13 aa, Borrelia afzelii PKo
ANHGAKADKDSVK

SEQ ID NO: 170159 - protein, 13 aa, Borrelia afzelii PKo
NHGAKADKDSVKG

SEQ ID NO: 170160 - protein, 13 aa, Borrelia afzelii PKo
HGAKADKDSVKGI

SEQ ID NO: 170161 - protein, 13 aa, Borrelia afzelii PKo
GAKADKDSVKGIA

SEQ ID NO: 170162 - protein, 13 aa, Borrelia afzelii PKo
AKADKDSVKGIAK

SEQ ID NO: 170163 - protein, 13 aa, Borrelia afzelii PKo
KADKDSVKGIAKG

SEQ ID NO: 170164 - protein, 13 aa, Borrelia afzelii PKo
ADKDSVKGIAKGI

SEQ ID NO: 170165 - protein, 13 aa, Borrelia afzelii PKo
DKDSVKGIAKGIK

SEQ ID NO: 170166 - protein, 13 aa, Borrelia afzelii PKo
KDSVKGIAKGIKG

SEQ ID NO: 170167 - protein, 13 aa, Borrelia afzelii PKo
DSVKGIAKGIKGI

SEQ ID NO: 170168 - protein, 13 aa, Borrelia afzelii PKo
SVKGIAKGIKGIV

SEQ ID NO: 170169 - protein, 13 aa, Borrelia afzelii PKo
VKGIAKGIKGIVD

SEQ ID NO: 170170 - protein, 13 aa, Borrelia afzelii PKo
KGIAKGIKGIVDA

SEQ ID NO: 170171 - protein, 13 aa, Borrelia afzelii PKo
GIAKGIKGIVDAA

SEQ ID NO: 170172 - protein, 13 aa, Borrelia afzelii PKo
IAKGIKGIVDAAG

SEQ ID NO: 170173 - protein, 13 aa, Borrelia afzelii PKo
AKGIKGIVDAAGK

SEQ ID NO: 170174 - protein, 13 aa, Borrelia afzelii PKo
KGIKGIVDAAGKA

SEQ ID NO: 170175 - protein, 13 aa, Borrelia afzelii PKo
GIKGIVDAAGKAL

SEQ ID NO: 170176 - protein, 13 aa, Borrelia afzelii PKo
IKGIVDAAGKALG

SEQ ID NO: 170177 - protein, 13 aa, Borrelia afzelii PKo
KGIVDAAGKALGE

SEQ ID NO: 170178 - protein, 13 aa, Borrelia afzelii PKo
GIVDAAGKALGEK

SEQ ID NO: 170179 - protein, 13 aa, Borrelia afzelii PKo
IVDAAGKALGEKG

SEQ ID NO: 170180 - protein, 13 aa, Borrelia afzelii PKo
VDAAGKALGEKGA

SEQ ID NO: 170181 - protein, 13 aa, Borrelia afzelii PKo
DAAGKALGEKGAL

SEQ ID NO: 170182 - protein, 13 aa, Borrelia afzelii PKo
AAGKALGEKGALK

SEQ ID NO: 170183 - protein, 13 aa, Borrelia afzelii PKo
AGKALGEKGALKD

SEQ ID NO: 170184 - protein, 13 aa, Borrelia afzelii PKo
GKALGEKGALKDV

SEQ ID NO: 170185 - protein, 13 aa, Borrelia afzelii PKo
KALGEKGALKDVK

SEQ ID NO: 170186 - protein, 13 aa, Borrelia afzelii PKo
ALGEKGALKDVKA

SEQ ID NO: 170187 - protein, 13 aa, Borrelia afzelii PKo
LGEKGALKDVKAA

SEQ ID NO: 170188 - protein, 13 aa, Borrelia afzelii PKo
GEKGALKDVKAAA

SEQ ID NO: 170189 - protein, 13 aa, Borrelia afzelii PKo
EKGALKDVKAAAD

SEQ ID NO: 170190 - protein, 13 aa, Borrelia afzelii PKo
KGALKDVKAAADD

SEQ ID NO: 170191 - protein, 13 aa, Borrelia afzelii PKo
GALKDVKAAADDE

SEQ ID NO: 170192 - protein, 13 aa, Borrelia afzelii PKo
ALKDVKAAADDEA

SEQ ID NO: 170193 - protein, 13 aa, Borrelia afzelii PKo
LKDVKAAADDEAN

SEQ ID NO: 170194 - protein, 13 aa, Borrelia afzelii PKo
KDVKAAADDEANA

SEQ ID NO: 170195 - protein, 13 aa, Borrelia afzelii PKo
DVKAAADDEANAD

SEQ ID NO: 170196 - protein, 13 aa, Borrelia afzelii PKo
VKAAADDEANADA

SEQ ID NO: 170197 - protein, 13 aa, Borrelia afzelii PKo
KAAADDEANADAG

SEQ ID NO: 170198 - protein, 13 aa, Borrelia afzelii PKo
AAADDEANADAGK

SEQ ID NO: 170199 - protein, 13 aa, Borrelia afzelii PKo
AADDEANADAGKL

SEQ ID NO: 170200 - protein, 13 aa, Borrelia afzelii PKo
ADDEANADAGKLF

SEQ ID NO: 170201 - protein, 13 aa, Borrelia afzelii PKo
DDEANADAGKLFA

SEQ ID NO: 170202 - protein, 13 aa, Borrelia afzelii PKo
DEANADAGKLFAG

SEQ ID NO: 170203 - protein, 13 aa, Borrelia afzelii PKo
EANADAGKLFAGN

SEQ ID NO: 170204 - protein, 13 aa, Borrelia afzelii PKo
ANADAGKLFAGNA

SEQ ID NO: 170205 - protein, 13 aa, Borrelia afzelii PKo
NADAGKLFAGNAN

SEQ ID NO: 170206 - protein, 13 aa, Borrelia afzelii PKo
ADAGKLFAGNANA

SEQ ID NO: 170207 - protein, 13 aa, Borrelia afzelii PKo
DAGKLFAGNANAA

SEQ ID NO: 170208 - protein, 13 aa, Borrelia afzelii PKo
AGKLFAGNANAAV

SEQ ID NO: 170209 - protein, 13 aa, Borrelia afzelii PKo
GKLFAGNANAAVG

SEQ ID NO: 170210 - protein, 13 aa, Borrelia afzelii PKo
KLFAGNANAAVGA

SEQ ID NO: 170211 - protein, 13 aa, Borrelia afzelii PKo
LFAGNANAAVGAA

SEQ ID NO: 170212 - protein, 13 aa, Borrelia afzelii PKo
FAGNANAAVGAAA

SEQ ID NO: 170213 - protein, 13 aa, Borrelia afzelii PKo
AGNANAAVGAAAD

SEQ ID NO: 170214 - protein, 13 aa, Borrelia afzelii PKo
GNANAAVGAAADI

SEQ ID NO: 170215 - protein, 13 aa, Borrelia afzelii PKo
NANAAVGAAADIA

SEQ ID NO: 170216 - protein, 13 aa, Borrelia afzelii PKo
ANAAVGAAADIAK

SEQ ID NO: 170217 - protein, 13 aa, Borrelia afzelii PKo
NAAVGAAADIAKA

SEQ ID NO: 170218 - protein, 13 aa, Borrelia afzelii PKo
AAVGAAADIAKAA

SEQ ID NO: 170219 - protein, 13 aa, Borrelia afzelii PKo
AVGAAADIAKAAG

SEQ ID NO: 170220 - protein, 13 aa, Borrelia afzelii PKo
VGAAADIAKAAGA

SEQ ID NO: 170221 - protein, 13 aa, Borrelia afzelii PKo
GAAADIAKAAGAV

SEQ ID NO: 170222 - protein, 13 aa, Borrelia afzelii PKo
AAADIAKAAGAVT

SEQ ID NO: 170223 - protein, 13 aa, Borrelia afzelii PKo
AADIAKAAGAVTA

SEQ ID NO: 170224 - protein, 13 aa, Borrelia afzelii PKo
ADIAKAAGAVTAV

SEQ ID NO: 170225 - protein, 13 aa, Borrelia afzelii PKo
DIAKAAGAVTAVS

SEQ ID NO: 170226 - protein, 13 aa, Borrelia afzelii PKo
IAKAAGAVTAVSG

SEQ ID NO: 170227 - protein, 13 aa, Borrelia afzelii PKo
AKAAGAVTAVSGE

SEQ ID NO: 170228 - protein, 13 aa, Borrelia afzelii PKo
KAAGAVTAVSGEQ

SEQ ID NO: 170229 - protein, 13 aa, Borrelia afzelii PKo
AAGAVTAVSGEQI

SEQ ID NO: 170230 - protein, 13 aa, Borrelia afzelii PKo
AGAVTAVSGEQIL

SEQ ID NO: 170231 - protein, 13 aa, Borrelia afzelii PKo
GAVTAVSGEQILK

SEQ ID NO: 170232 - protein, 13 aa, Borrelia afzelii PKo
AVTAVSGEQILKA

SEQ ID NO: 170233 - protein, 13 aa, Borrelia afzelii PKo
VTAVSGEQILKAI

SEQ ID NO: 170234 - protein, 13 aa, Borrelia afzelii PKo
TAVSGEQILKAIV

SEQ ID NO: 170235 - protein, 13 aa, Borrelia afzelii PKo
AVSGEQILKAIVE

SEQ ID NO: 170236 - protein, 13 aa, Borrelia afzelii PKo
VSGEQILKAIVEA

SEQ ID NO: 170237 - protein, 13 aa, Borrelia afzelii PKo
SGEQILKAIVEAA

SEQ ID NO: 170238 - protein, 13 aa, Borrelia afzelii PKo
GEQILKAIVEAAG

SEQ ID NO: 170239 - protein, 13 aa, Borrelia afzelii PKo
EQILKAIVEAAGD

SEQ ID NO: 170240 - protein, 13 aa, Borrelia afzelii PKo
QILKAIVEAAGDP

SEQ ID NO: 170241 - protein, 13 aa, Borrelia afzelii PKo
ILKAIVEAAGDPA

SEQ ID NO: 170242 - protein, 13 aa, Borrelia afzelii PKo
LKAIVEAAGDPAN

SEQ ID NO: 170243 - protein, 13 aa, Borrelia afzelii PKo
KAIVEAAGDPANQ

SEQ ID NO: 170244 - protein, 13 aa, Borrelia afzelii PKo
AIVEAAGDPANQA

SEQ ID NO: 170245 - protein, 13 aa, Borrelia afzelii PKo
IVEAAGDPANQAG

SEQ ID NO: 170246 - protein, 13 aa, Borrelia afzelii PKo
VEAAGDPANQAGK

SEQ ID NO: 170247 - protein, 13 aa, Borrelia afzelii PKo
EAAGDPANQAGKK

SEQ ID NO: 170248 - protein, 13 aa, Borrelia afzelii PKo
AAGDPANQAGKKA

SEQ ID NO: 170249 - protein, 13 aa, Borrelia afzelii PKo
AGDPANQAGKKAE

SEQ ID NO: 170250 - protein, 13 aa, Borrelia afzelii PKo
GDPANQAGKKAEE

SEQ ID NO: 170251 - protein, 13 aa, Borrelia afzelii PKo
DPANQAGKKAEEA

SEQ ID NO: 170252 - protein, 13 aa, Borrelia afzelii PKo
PANQAGKKAEEAK

SEQ ID NO: 170253 - protein, 13 aa, Borrelia afzelii PKo
ANQAGKKAEEAKN

SEQ ID NO: 170254 - protein, 13 aa, Borrelia afzelii PKo
NQAGKKAEEAKNP

SEQ ID NO: 170255 - protein, 13 aa, Borrelia afzelii PKo
QAGKKAEEAKNPI

SEQ ID NO: 170256 - protein, 13 aa, Borrelia afzelii PKo
AGKKAEEAKNPIA

SEQ ID NO: 170257 - protein, 13 aa, Borrelia afzelii PKo
GKKAEEAKNPIAA

SEQ ID NO: 170258 - protein, 13 aa, Borrelia afzelii PKo
KKAEEAKNPIAAA

SEQ ID NO: 170259 - protein, 13 aa, Borrelia afzelii PKo
KAEEAKNPIAAAI

SEQ ID NO: 170260 - protein, 13 aa, Borrelia afzelii PKo
AEEAKNPIAAAIG

SEQ ID NO: 170261 - protein, 13 aa, Borrelia afzelii PKo
EEAKNPIAAAIGT

SEQ ID NO: 170262 - protein, 13 aa, Borrelia afzelii PKo
EAKNPIAAAIGTD

SEQ ID NO: 170263 - protein, 13 aa, Borrelia afzelii PKo
AKNPIAAAIGTDD

SEQ ID NO: 170264 - protein, 13 aa, Borrelia afzelii PKo
KNPIAAAIGTDDD

SEQ ID NO: 170265 - protein, 13 aa, Borrelia afzelii PKo
NPIAAAIGTDDDN

SEQ ID NO: 170266 - protein, 13 aa, Borrelia afzelii PKo
PIAAAIGTDDDNG

SEQ ID NO: 170267 - protein, 13 aa, Borrelia afzelii PKo
IAAAIGTDDDNGA

SEQ ID NO: 170268 - protein, 13 aa, Borrelia afzelii PKo
AAAIGTDDDNGAA

SEQ ID NO: 170269 - protein, 13 aa, Borrelia afzelii PKo
AAIGTDDDNGAAF

SEQ ID NO: 170270 - protein, 13 aa, Borrelia afzelii PKo
AIGTDDDNGAAFK

SEQ ID NO: 170271 - protein, 13 aa, Borrelia afzelii PKo
IGTDDDNGAAFKD

SEQ ID NO: 170272 - protein, 13 aa, Borrelia afzelii PKo
GTDDDNGAAFKDE

SEQ ID NO: 170273 - protein, 13 aa, Borrelia afzelii PKo
TDDDNGAAFKDEM

SEQ ID NO: 170274 - protein, 13 aa, Borrelia afzelii PKo
DDDNGAAFKDEMK

SEQ ID NO: 170275 - protein, 13 aa, Borrelia afzelii PKo
DDNGAAFKDEMKK

SEQ ID NO: 170276 - protein, 13 aa, Borrelia afzelii PKo
DNGAAFKDEMKKS

SEQ ID NO: 170277 - protein, 13 aa, Borrelia afzelii PKo
NGAAFKDEMKKSD

SEQ ID NO: 170278 - protein, 13 aa, Borrelia afzelii PKo
GAAFKDEMKKSDK

SEQ ID NO: 170279 - protein, 13 aa, Borrelia afzelii PKo
AAFKDEMKKSDKI

SEQ ID NO: 170280 - protein, 13 aa, Borrelia afzelii PKo
AFKDEMKKSDKIA

SEQ ID NO: 170281 - protein, 13 aa, Borrelia afzelii PKo
FKDEMKKSDKIAA

SEQ ID NO: 170282 - protein, 13 aa, Borrelia afzelii PKo
KDEMKKSDKIAAA

SEQ ID NO: 170283 - protein, 13 aa, Borrelia afzelii PKo
DEMKKSDKIAAAI

SEQ ID NO: 170284 - protein, 13 aa, Borrelia afzelii PKo
EMKKSDKIAAAIV

SEQ ID NO: 170285 - protein, 13 aa, Borrelia afzelii PKo
MKKSDKIAAAIVL

SEQ ID NO: 170286 - protein, 13 aa, Borrelia afzelii PKo
KKSDKIAAAIVLR

SEQ ID NO: 170287 - protein, 13 aa, Borrelia afzelii PKo
KSDKIAAAIVLRG

SEQ ID NO: 170288 - protein, 13 aa, Borrelia afzelii PKo
SDKIAAAIVLRGV

SEQ ID NO: 170289 - protein, 13 aa, Borrelia afzelii PKo
DKIAAAIVLRGVA

SEQ ID NO: 170290 - protein, 13 aa, Borrelia afzelii PKo
KIAAAIVLRGVAK

SEQ ID NO: 170291 - protein, 13 aa, Borrelia afzelii PKo
IAAAIVLRGVAKD

SEQ ID NO: 170292 - protein, 13 aa, Borrelia afzelii PKo
AAAIVLRGVAKDG

SEQ ID NO: 170293 - protein, 13 aa, Borrelia afzelii PKo
AAIVLRGVAKDGK

SEQ ID NO: 170294 - protein, 13 aa, Borrelia afzelii PKo
AIVLRGVAKDGKF

SEQ ID NO: 170295 - protein, 13 aa, Borrelia afzelii PKo
IVLRGVAKDGKFA

SEQ ID NO: 170296 - protein, 13 aa, Borrelia afzelii PKo
VLRGVAKDGKFAV

SEQ ID NO: 170297 - protein, 13 aa, Borrelia afzelii PKo
LRGVAKDGKFAVK

SEQ ID NO: 170298 - protein, 14 aa, Borrelia afzelii PKo
MKKISSAIFLTALL

SEQ ID NO: 170299 - protein, 14 aa, Borrelia afzelii PKo
KKISSAIFLTALLV

SEQ ID NO: 170300 - protein, 14 aa, Borrelia afzelii PKo
KISSAIFLTALLVF

SEQ ID NO: 170301 - protein, 14 aa, Borrelia afzelii PKo
ISSAIFLTALLVFI

SEQ ID NO: 170302 - protein, 14 aa, Borrelia afzelii PKo
SSAIFLTALLVFIN

SEQ ID NO: 170303 - protein, 14 aa, Borrelia afzelii PKo
SAIFLTALLVFINC

SEQ ID NO: 170304 - protein, 14 aa, Borrelia afzelii PKo
AIFLTALLVFINCK

SEQ ID NO: 170305 - protein, 14 aa, Borrelia afzelii PKo
IFLTALLVFINCKN

SEQ ID NO: 170306 - protein, 14 aa, Borrelia afzelii PKo
FLTALLVFINCKNN

SEQ ID NO: 170307 - protein, 14 aa, Borrelia afzelii PKo
LTALLVFINCKNNA

SEQ ID NO: 170308 - protein, 14 aa, Borrelia afzelii PKo
TALLVFINCKNNAV

SEQ ID NO: 170309 - protein, 14 aa, Borrelia afzelii PKo
ALLVFINCKNNAVG

SEQ ID NO: 170310 - protein, 14 aa, Borrelia afzelii PKo
LLVFINCKNNAVGK

SEQ ID NO: 170311 - protein, 14 aa, Borrelia afzelii PKo
LVFINCKNNAVGKG

SEQ ID NO: 170312 - protein, 14 aa, Borrelia afzelii PKo
VFINCKNNAVGKGN

SEQ ID NO: 170313 - protein, 14 aa, Borrelia afzelii PKo
FINCKNNAVGKGND

SEQ ID NO: 170314 - protein, 14 aa, Borrelia afzelii PKo
INCKNNAVGKGNDD

SEQ ID NO: 170315 - protein, 14 aa, Borrelia afzelii PKo
NCKNNAVGKGNDDK

SEQ ID NO: 170316 - protein, 14 aa, Borrelia afzelii PKo
CKNNAVGKGNDDKD

SEQ ID NO: 170317 - protein, 14 aa, Borrelia afzelii PKo
KNNAVGKGNDDKDS

SEQ ID NO: 170318 - protein, 14 aa, Borrelia afzelii PKo
NNAVGKGNDDKDSV

SEQ ID NO: 170319 - protein, 14 aa, Borrelia afzelii PKo
NAVGKGNDDKDSVK

SEQ ID NO: 170320 - protein, 14 aa, Borrelia afzelii PKo
AVGKGNDDKDSVKT

SEQ ID NO: 170321 - protein, 14 aa, Borrelia afzelii PKo
VGKGNDDKDSVKTF

SEQ ID NO: 170322 - protein, 14 aa, Borrelia afzelii PKo
GKGNDDKDSVKTFY

SEQ ID NO: 170323 - protein, 14 aa, Borrelia afzelii PKo
KGNDDKDSVKTFYE

SEQ ID NO: 170324 - protein, 14 aa, Borrelia afzelii PKo
GNDDKDSVKTFYES

SEQ ID NO: 170325 - protein, 14 aa, Borrelia afzelii PKo
NDDKDSVKTFYESI

SEQ ID NO: 170326 - protein, 14 aa, Borrelia afzelii PKo
DDKDSVKTFYESII

SEQ ID NO: 170327 - protein, 14 aa, Borrelia afzelii PKo
DKDSVKTFYESIIN

SEQ ID NO: 170328 - protein, 14 aa, Borrelia afzelii PKo
KDSVKTFYESIINL

SEQ ID NO: 170329 - protein, 14 aa, Borrelia afzelii PKo
DSVKTFYESIINLG

SEQ ID NO: 170330 - protein, 14 aa, Borrelia afzelii PKo
SVKTFYESIINLGN

SEQ ID NO: 170331 - protein, 14 aa, Borrelia afzelii PKo
VKTFYESIINLGNG

SEQ ID NO: 170332 - protein, 14 aa, Borrelia afzelii PKo
KTFYESIINLGNGF

SEQ ID NO: 170333 - protein, 14 aa, Borrelia afzelii PKo
TFYESIINLGNGFI

SEQ ID NO: 170334 - protein, 14 aa, Borrelia afzelii PKo
FYESIINLGNGFID

SEQ ID NO: 170335 - protein, 14 aa, Borrelia afzelii PKo
YESIINLGNGFIDV

SEQ ID NO: 170336 - protein, 14 aa, Borrelia afzelii PKo
ESIINLGNGFIDVF

SEQ ID NO: 170337 - protein, 14 aa, Borrelia afzelii PKo
SIINLGNGFIDVFN

SEQ ID NO: 170338 - protein, 14 aa, Borrelia afzelii PKo
IINLGNGFIDVFNA

SEQ ID NO: 170339 - protein, 14 aa, Borrelia afzelii PKo
INLGNGFIDVFNAF

SEQ ID NO: 170340 - protein, 14 aa, Borrelia afzelii PKo
NLGNGFIDVFNAFS

SEQ ID NO: 170341 - protein, 14 aa, Borrelia afzelii PKo
LGNGFIDVFNAFSG

SEQ ID NO: 170342 - protein, 14 aa, Borrelia afzelii PKo
GNGFIDVFNAFSGL

SEQ ID NO: 170343 - protein, 14 aa, Borrelia afzelii PKo
NGFIDVFNAFSGLV

SEQ ID NO: 170344 - protein, 14 aa, Borrelia afzelii PKo
GFIDVFNAFSGLVA

SEQ ID NO: 170345 - protein, 14 aa, Borrelia afzelii PKo
FIDVFNAFSGLVAD

SEQ ID NO: 170346 - protein, 14 aa, Borrelia afzelii PKo
IDVFNAFSGLVADT

SEQ ID NO: 170347 - protein, 14 aa, Borrelia afzelii PKo
DVFNAFSGLVADTF

SEQ ID NO: 170348 - protein, 14 aa, Borrelia afzelii PKo
VFNAFSGLVADTFF

SEQ ID NO: 170349 - protein, 14 aa, Borrelia afzelii PKo
FNAFSGLVADTFFK

SEQ ID NO: 170350 - protein, 14 aa, Borrelia afzelii PKo
NAFSGLVADTFFKS

SEQ ID NO: 170351 - protein, 14 aa, Borrelia afzelii PKo
AFSGLVADTFFKSD

SEQ ID NO: 170352 - protein, 14 aa, Borrelia afzelii PKo
FSGLVADTFFKSDP

SEQ ID NO: 170353 - protein, 14 aa, Borrelia afzelii PKo
SGLVADTFFKSDPK

SEQ ID NO: 170354 - protein, 14 aa, Borrelia afzelii PKo
GLVADTFFKSDPKK

SEQ ID NO: 170355 - protein, 14 aa, Borrelia afzelii PKo
LVADTFFKSDPKKS

SEQ ID NO: 170356 - protein, 14 aa, Borrelia afzelii PKo
VADTFFKSDPKKSD

SEQ ID NO: 170357 - protein, 14 aa, Borrelia afzelii PKo
ADTFFKSDPKKSDV

SEQ ID NO: 170358 - protein, 14 aa, Borrelia afzelii PKo
DTFFKSDPKKSDVK

SEQ ID NO: 170359 - protein, 14 aa, Borrelia afzelii PKo
TFFKSDPKKSDVKT

SEQ ID NO: 170360 - protein, 14 aa, Borrelia afzelii PKo
FFKSDPKKSDVKTY

SEQ ID NO: 170361 - protein, 14 aa, Borrelia afzelii PKo
FKSDPKKSDVKTYF

SEQ ID NO: 170362 - protein, 14 aa, Borrelia afzelii PKo
KSDPKKSDVKTYFE

SEQ ID NO: 170363 - protein, 14 aa, Borrelia afzelii PKo
SDPKKSDVKTYFES

SEQ ID NO: 170364 - protein, 14 aa, Borrelia afzelii PKo
DPKKSDVKTYFESI

SEQ ID NO: 170365 - protein, 14 aa, Borrelia afzelii PKo
PKKSDVKTYFESIS

SEQ ID NO: 170366 - protein, 14 aa, Borrelia afzelii PKo
KKSDVKTYFESISS

SEQ ID NO: 170367 - protein, 14 aa, Borrelia afzelii PKo
KSDVKTYFESISST

SEQ ID NO: 170368 - protein, 14 aa, Borrelia afzelii PKo
SDVKTYFESISSTL

SEQ ID NO: 170369 - protein, 14 aa, Borrelia afzelii PKo
DVKTYFESISSTLK

SEQ ID NO: 170370 - protein, 14 aa, Borrelia afzelii PKo
VKTYFESISSTLKA

SEQ ID NO: 170371 - protein, 14 aa, Borrelia afzelii PKo
KTYFESISSTLKAT

SEQ ID NO: 170372 - protein, 14 aa, Borrelia afzelii PKo
TYFESISSTLKATK

SEQ ID NO: 170373 - protein, 14 aa, Borrelia afzelii PKo
YFESISSTLKATKG

SEQ ID NO: 170374 - protein, 14 aa, Borrelia afzelii PKo
FESISSTLKATKGK

SEQ ID NO: 170375 - protein, 14 aa, Borrelia afzelii PKo
ESISSTLKATKGKL

SEQ ID NO: 170376 - protein, 14 aa, Borrelia afzelii PKo
SISSTLKATKGKLD

SEQ ID NO: 170377 - protein, 14 aa, Borrelia afzelii PKo
ISSTLKATKGKLDE

SEQ ID NO: 170378 - protein, 14 aa, Borrelia afzelii PKo
SSTLKATKGKLDEL

SEQ ID NO: 170379 - protein, 14 aa, Borrelia afzelii PKo
STLKATKGKLDELV

SEQ ID NO: 170380 - protein, 14 aa, Borrelia afzelii PKo
TLKATKGKLDELVS

SEQ ID NO: 170381 - protein, 14 aa, Borrelia afzelii PKo
LKATKGKLDELVSA

SEQ ID NO: 170382 - protein, 14 aa, Borrelia afzelii PKo
KATKGKLDELVSAK

SEQ ID NO: 170383 - protein, 14 aa, Borrelia afzelii PKo
ATKGKLDELVSAKK

SEQ ID NO: 170384 - protein, 14 aa, Borrelia afzelii PKo
TKGKLDELVSAKKG

SEQ ID NO: 170385 - protein, 14 aa, Borrelia afzelii PKo
KGKLDELVSAKKGE

SEQ ID NO: 170386 - protein, 14 aa, Borrelia afzelii PKo
GKLDELVSAKKGEG

SEQ ID NO: 170387 - protein, 14 aa, Borrelia afzelii PKo
KLDELVSAKKGEGG

SEQ ID NO: 170388 - protein, 14 aa, Borrelia afzelii PKo
LDELVSAKKGEGGS

SEQ ID NO: 170389 - protein, 14 aa, Borrelia afzelii PKo
DELVSAKKGEGGSV

SEQ ID NO: 170390 - protein, 14 aa, Borrelia afzelii PKo
ELVSAKKGEGGSVK

SEQ ID NO: 170391 - protein, 14 aa, Borrelia afzelii PKo
LVSAKKGEGGSVKA

SEQ ID NO: 170392 - protein, 14 aa, Borrelia afzelii PKo
VSAKKGEGGSVKAS

SEQ ID NO: 170393 - protein, 14 aa, Borrelia afzelii PKo
SAKKGEGGSVKASV

SEQ ID NO: 170394 - protein, 14 aa, Borrelia afzelii PKo
AKKGEGGSVKASVE

SEQ ID NO: 170395 - protein, 14 aa, Borrelia afzelii PKo
KKGEGGSVKASVES

SEQ ID NO: 170396 - protein, 14 aa, Borrelia afzelii PKo
KGEGGSVKASVESA

SEQ ID NO: 170397 - protein, 14 aa, Borrelia afzelii PKo
GEGGSVKASVESAV

SEQ ID NO: 170398 - protein, 14 aa, Borrelia afzelii PKo
EGGSVKASVESAVD

SEQ ID NO: 170399 - protein, 14 aa, Borrelia afzelii PKo
GGSVKASVESAVDE

SEQ ID NO: 170400 - protein, 14 aa, Borrelia afzelii PKo
GSVKASVESAVDEV

SEQ ID NO: 170401 - protein, 14 aa, Borrelia afzelii PKo
SVKASVESAVDEVS

SEQ ID NO: 170402 - protein, 14 aa, Borrelia afzelii PKo
VKASVESAVDEVSK

SEQ ID NO: 170403 - protein, 14 aa, Borrelia afzelii PKo
KASVESAVDEVSKW

SEQ ID NO: 170404 - protein, 14 aa, Borrelia afzelii PKo
ASVESAVDEVSKWL

SEQ ID NO: 170405 - protein, 14 aa, Borrelia afzelii PKo
SVESAVDEVSKWLE

SEQ ID NO: 170406 - protein, 14 aa, Borrelia afzelii PKo
VESAVDEVSKWLEE

SEQ ID NO: 170407 - protein, 14 aa, Borrelia afzelii PKo
ESAVDEVSKWLEEM

SEQ ID NO: 170408 - protein, 14 aa, Borrelia afzelii PKo
SAVDEVSKWLEEMI

SEQ ID NO: 170409 - protein, 14 aa, Borrelia afzelii PKo
AVDEVSKWLEEMIK

SEQ ID NO: 170410 - protein, 14 aa, Borrelia afzelii PKo
VDEVSKWLEEMIKA

SEQ ID NO: 170411 - protein, 14 aa, Borrelia afzelii PKo
DEVSKWLEEMIKAA

SEQ ID NO: 170412 - protein, 14 aa, Borrelia afzelii PKo
EVSKWLEEMIKAAE

SEQ ID NO: 170413 - protein, 14 aa, Borrelia afzelii PKo
VSKWLEEMIKAAEE

SEQ ID NO: 170414 - protein, 14 aa, Borrelia afzelii PKo
SKWLEEMIKAAEEA

SEQ ID NO: 170415 - protein, 14 aa, Borrelia afzelii PKo
KWLEEMIKAAEEAA

SEQ ID NO: 170416 - protein, 14 aa, Borrelia afzelii PKo
WLEEMIKAAEEAAK

SEQ ID NO: 170417 - protein, 14 aa, Borrelia afzelii PKo
LEEMIKAAEEAAKV

SEQ ID NO: 170418 - protein, 14 aa, Borrelia afzelii PKo
EEMIKAAEEAAKVG

SEQ ID NO: 170419 - protein, 14 aa, Borrelia afzelii PKo
EMIKAAEEAAKVGG

SEQ ID NO: 170420 - protein, 14 aa, Borrelia afzelii PKo
MIKAAEEAAKVGGT

SEQ ID NO: 170421 - protein, 14 aa, Borrelia afzelii PKo
IKAAEEAAKVGGTG

SEQ ID NO: 170422 - protein, 14 aa, Borrelia afzelii PKo
KAAEEAAKVGGTGG

SEQ ID NO: 170423 - protein, 14 aa, Borrelia afzelii PKo
AAEEAAKVGGTGGD

SEQ ID NO: 170424 - protein, 14 aa, Borrelia afzelii PKo
AEEAAKVGGTGGDG

SEQ ID NO: 170425 - protein, 14 aa, Borrelia afzelii PKo
EEAAKVGGTGGDGK

SEQ ID NO: 170426 - protein, 14 aa, Borrelia afzelii PKo
EAAKVGGTGGDGKI

SEQ ID NO: 170427 - protein, 14 aa, Borrelia afzelii PKo
AAKVGGTGGDGKIG

SEQ ID NO: 170428 - protein, 14 aa, Borrelia afzelii PKo
AKVGGTGGDGKIGD

SEQ ID NO: 170429 - protein, 14 aa, Borrelia afzelii PKo
KVGGTGGDGKIGDS

SEQ ID NO: 170430 - protein, 14 aa, Borrelia afzelii PKo
VGGTGGDGKIGDSA

SEQ ID NO: 170431 - protein, 14 aa, Borrelia afzelii PKo
GGTGGDGKIGDSAA

SEQ ID NO: 170432 - protein, 14 aa, Borrelia afzelii PKo
GTGGDGKIGDSAAN

SEQ ID NO: 170433 - protein, 14 aa, Borrelia afzelii PKo
TGGDGKIGDSAANH

SEQ ID NO: 170434 - protein, 14 aa, Borrelia afzelii PKo
GGDGKIGDSAANHG

SEQ ID NO: 170435 - protein, 14 aa, Borrelia afzelii PKo
GDGKIGDSAANHGA

SEQ ID NO: 170436 - protein, 14 aa, Borrelia afzelii PKo
DGKIGDSAANHGAK

SEQ ID NO: 170437 - protein, 14 aa, Borrelia afzelii PKo
GKIGDSAANHGAKA

SEQ ID NO: 170438 - protein, 14 aa, Borrelia afzelii PKo
KIGDSAANHGAKAD

SEQ ID NO: 170439 - protein, 14 aa, Borrelia afzelii PKo
IGDSAANHGAKADK

SEQ ID NO: 170440 - protein, 14 aa, Borrelia afzelii PKo
GDSAANHGAKADKD

SEQ ID NO: 170441 - protein, 14 aa, Borrelia afzelii PKo
DSAANHGAKADKDS

SEQ ID NO: 170442 - protein, 14 aa, Borrelia afzelii PKo
SAANHGAKADKDSV

SEQ ID NO: 170443 - protein, 14 aa, Borrelia afzelii PKo
AANHGAKADKDSVK

SEQ ID NO: 170444 - protein, 14 aa, Borrelia afzelii PKo
ANHGAKADKDSVKG

SEQ ID NO: 170445 - protein, 14 aa, Borrelia afzelii PKo
NHGAKADKDSVKGI

SEQ ID NO: 170446 - protein, 14 aa, Borrelia afzelii PKo
HGAKADKDSVKGIA

SEQ ID NO: 170447 - protein, 14 aa, Borrelia afzelii PKo
GAKADKDSVKGIAK

SEQ ID NO: 170448 - protein, 14 aa, Borrelia afzelii PKo
AKADKDSVKGIAKG

SEQ ID NO: 170449 - protein, 14 aa, Borrelia afzelii PKo
KADKDSVKGIAKGI

SEQ ID NO: 170450 - protein, 14 aa, Borrelia afzelii PKo
ADKDSVKGIAKGIK

SEQ ID NO: 170451 - protein, 14 aa, Borrelia afzelii PKo
DKDSVKGIAKGIKG

SEQ ID NO: 170452 - protein, 14 aa, Borrelia afzelii PKo
KDSVKGIAKGIKGI

SEQ ID NO: 170453 - protein, 14 aa, Borrelia afzelii PKo
DSVKGIAKGIKGIV

SEQ ID NO: 170454 - protein, 14 aa, Borrelia afzelii PKo
SVKGIAKGIKGIVD

SEQ ID NO: 170455 - protein, 14 aa, Borrelia afzelii PKo
VKGIAKGIKGIVDA

SEQ ID NO: 170456 - protein, 14 aa, Borrelia afzelii PKo
KGIAKGIKGIVDAA

SEQ ID NO: 170457 - protein, 14 aa, Borrelia afzelii PKo
GIAKGIKGIVDAAG

SEQ ID NO: 170458 - protein, 14 aa, Borrelia afzelii PKo
IAKGIKGIVDAAGK

SEQ ID NO: 170459 - protein, 14 aa, Borrelia afzelii PKo
AKGIKGIVDAAGKA

SEQ ID NO: 170460 - protein, 14 aa, Borrelia afzelii PKo
KGIKGIVDAAGKAL

SEQ ID NO: 170461 - protein, 14 aa, Borrelia afzelii PKo
GIKGIVDAAGKALG

SEQ ID NO: 170462 - protein, 14 aa, Borrelia afzelii PKo
IKGIVDAAGKALGE

SEQ ID NO: 170463 - protein, 14 aa, Borrelia afzelii PKo
KGIVDAAGKALGEK

SEQ ID NO: 170464 - protein, 14 aa, Borrelia afzelii PKo
GIVDAAGKALGEKG

SEQ ID NO: 170465 - protein, 14 aa, Borrelia afzelii PKo
IVDAAGKALGEKGA

SEQ ID NO: 170466 - protein, 14 aa, Borrelia afzelii PKo
VDAAGKALGEKGAL

SEQ ID NO: 170467 - protein, 14 aa, Borrelia afzelii PKo
DAAGKALGEKGALK

SEQ ID NO: 170468 - protein, 14 aa, Borrelia afzelii PKo
AAGKALGEKGALKD

SEQ ID NO: 170469 - protein, 14 aa, Borrelia afzelii PKo
AGKALGEKGALKDV

SEQ ID NO: 170470 - protein, 14 aa, Borrelia afzelii PKo
GKALGEKGALKDVK

SEQ ID NO: 170471 - protein, 14 aa, Borrelia afzelii PKo
KALGEKGALKDVKA

SEQ ID NO: 170472 - protein, 14 aa, Borrelia afzelii PKo
ALGEKGALKDVKAA

SEQ ID NO: 170473 - protein, 14 aa, Borrelia afzelii PKo
LGEKGALKDVKAAA

SEQ ID NO: 170474 - protein, 14 aa, Borrelia afzelii PKo
GEKGALKDVKAAAD

SEQ ID NO: 170475 - protein, 14 aa, Borrelia afzelii PKo
EKGALKDVKAAADD

SEQ ID NO: 170476 - protein, 14 aa, Borrelia afzelii PKo
KGALKDVKAAADDE

SEQ ID NO: 170477 - protein, 14 aa, Borrelia afzelii PKo
GALKDVKAAADDEA

SEQ ID NO: 170478 - protein, 14 aa, Borrelia afzelii PKo
ALKDVKAAADDEAN

SEQ ID NO: 170479 - protein, 14 aa, Borrelia afzelii PKo
LKDVKAAADDEANA

SEQ ID NO: 170480 - protein, 14 aa, Borrelia afzelii PKo
KDVKAAADDEANAD

SEQ ID NO: 170481 - protein, 14 aa, Borrelia afzelii PKo
DVKAAADDEANADA

SEQ ID NO: 170482 - protein, 14 aa, Borrelia afzelii PKo
VKAAADDEANADAG

SEQ ID NO: 170483 - protein, 14 aa, Borrelia afzelii PKo
KAAADDEANADAGK

SEQ ID NO: 170484 - protein, 14 aa, Borrelia afzelii PKo
AAADDEANADAGKL

SEQ ID NO: 170485 - protein, 14 aa, Borrelia afzelii PKo
AADDEANADAGKLF

SEQ ID NO: 170486 - protein, 14 aa, Borrelia afzelii PKo
ADDEANADAGKLFA

SEQ ID NO: 170487 - protein, 14 aa, Borrelia afzelii PKo
DDEANADAGKLFAG

SEQ ID NO: 170488 - protein, 14 aa, Borrelia afzelii PKo
DEANADAGKLFAGN

SEQ ID NO: 170489 - protein, 14 aa, Borrelia afzelii PKo
EANADAGKLFAGNA

SEQ ID NO: 170490 - protein, 14 aa, Borrelia afzelii PKo
ANADAGKLFAGNAN

SEQ ID NO: 170491 - protein, 14 aa, Borrelia afzelii PKo
NADAGKLFAGNANA

SEQ ID NO: 170492 - protein, 14 aa, Borrelia afzelii PKo
ADAGKLFAGNANAA

SEQ ID NO: 170493 - protein, 14 aa, Borrelia afzelii PKo
DAGKLFAGNANAAV

SEQ ID NO: 170494 - protein, 14 aa, Borrelia afzelii PKo
AGKLFAGNANAAVG

SEQ ID NO: 170495 - protein, 14 aa, Borrelia afzelii PKo
GKLFAGNANAAVGA

SEQ ID NO: 170496 - protein, 14 aa, Borrelia afzelii PKo
KLFAGNANAAVGAA

SEQ ID NO: 170497 - protein, 14 aa, Borrelia afzelii PKo
LFAGNANAAVGAAA

SEQ ID NO: 170498 - protein, 14 aa, Borrelia afzelii PKo
FAGNANAAVGAAAD

SEQ ID NO: 170499 - protein, 14 aa, Borrelia afzelii PKo
AGNANAAVGAAADI

SEQ ID NO: 170500 - protein, 14 aa, Borrelia afzelii PKo
GNANAAVGAAADIA

SEQ ID NO: 170501 - protein, 14 aa, Borrelia afzelii PKo
NANAAVGAAADIAK

SEQ ID NO: 170502 - protein, 14 aa, Borrelia afzelii PKo
ANAAVGAAADIAKA

SEQ ID NO: 170503 - protein, 14 aa, Borrelia afzelii PKo
NAAVGAAADIAKAA

SEQ ID NO: 170504 - protein, 14 aa, Borrelia afzelii PKo
AAVGAAADIAKAAG

SEQ ID NO: 170505 - protein, 14 aa, Borrelia afzelii PKo
AVGAAADIAKAAGA

SEQ ID NO: 170506 - protein, 14 aa, Borrelia afzelii PKo
VGAAADIAKAAGAV

SEQ ID NO: 170507 - protein, 14 aa, Borrelia afzelii PKo
GAAADIAKAAGAVT

SEQ ID NO: 170508 - protein, 14 aa, Borrelia afzelii PKo
AAADIAKAAGAVTA

SEQ ID NO: 170509 - protein, 14 aa, Borrelia afzelii PKo
AADIAKAAGAVTAV

SEQ ID NO: 170510 - protein, 14 aa, Borrelia afzelii PKo
ADIAKAAGAVTAVS

SEQ ID NO: 170511 - protein, 14 aa, Borrelia afzelii PKo
DIAKAAGAVTAVSG

SEQ ID NO: 170512 - protein, 14 aa, Borrelia afzelii PKo
IAKAAGAVTAVSGE

SEQ ID NO: 170513 - protein, 14 aa, Borrelia afzelii PKo
AKAAGAVTAVSGEQ

SEQ ID NO: 170514 - protein, 14 aa, Borrelia afzelii PKo
KAAGAVTAVSGEQI

SEQ ID NO: 170515 - protein, 14 aa, Borrelia afzelii PKo
AAGAVTAVSGEQIL

SEQ ID NO: 170516 - protein, 14 aa, Borrelia afzelii PKo
AGAVTAVSGEQILK

SEQ ID NO: 170517 - protein, 14 aa, Borrelia afzelii PKo
GAVTAVSGEQILKA

SEQ ID NO: 170518 - protein, 14 aa, Borrelia afzelii PKo
AVTAVSGEQILKAI

SEQ ID NO: 170519 - protein, 14 aa, Borrelia afzelii PKo
VTAVSGEQILKAIV

SEQ ID NO: 170520 - protein, 14 aa, Borrelia afzelii PKo
TAVSGEQILKAIVE

SEQ ID NO: 170521 - protein, 14 aa, Borrelia afzelii PKo
AVSGEQILKAIVEA

SEQ ID NO: 170522 - protein, 14 aa, Borrelia afzelii PKo
VSGEQILKAIVEAA

SEQ ID NO: 170523 - protein, 14 aa, Borrelia afzelii PKo
SGEQILKAIVEAAG

SEQ ID NO: 170524 - protein, 14 aa, Borrelia afzelii PKo
GEQILKAIVEAAGD

SEQ ID NO: 170525 - protein, 14 aa, Borrelia afzelii PKo
EQILKAIVEAAGDP

SEQ ID NO: 170526 - protein, 14 aa, Borrelia afzelii PKo
QILKAIVEAAGDPA

SEQ ID NO: 170527 - protein, 14 aa, Borrelia afzelii PKo
ILKAIVEAAGDPAN

SEQ ID NO: 170528 - protein, 14 aa, Borrelia afzelii PKo
LKAIVEAAGDPANQ

SEQ ID NO: 170529 - protein, 14 aa, Borrelia afzelii PKo
KAIVEAAGDPANQA

SEQ ID NO: 170530 - protein, 14 aa, Borrelia afzelii PKo
AIVEAAGDPANQAG

SEQ ID NO: 170531 - protein, 14 aa, Borrelia afzelii PKo
IVEAAGDPANQAGK

SEQ ID NO: 170532 - protein, 14 aa, Borrelia afzelii PKo
VEAAGDPANQAGKK

SEQ ID NO: 170533 - protein, 14 aa, Borrelia afzelii PKo
EAAGDPANQAGKKA

SEQ ID NO: 170534 - protein, 14 aa, Borrelia afzelii PKo
AAGDPANQAGKKAE

SEQ ID NO: 170535 - protein, 14 aa, Borrelia afzelii PKo
AGDPANQAGKKAEE

SEQ ID NO: 170536 - protein, 14 aa, Borrelia afzelii PKo
GDPANQAGKKAEEA

SEQ ID NO: 170537 - protein, 14 aa, Borrelia afzelii PKo
DPANQAGKKAEEAK

SEQ ID NO: 170538 - protein, 14 aa, Borrelia afzelii PKo
PANQAGKKAEEAKN

SEQ ID NO: 170539 - protein, 14 aa, Borrelia afzelii PKo
ANQAGKKAEEAKNP

SEQ ID NO: 170540 - protein, 14 aa, Borrelia afzelii PKo
NQAGKKAEEAKNPI

SEQ ID NO: 170541 - protein, 14 aa, Borrelia afzelii PKo
QAGKKAEEAKNPIA

SEQ ID NO: 170542 - protein, 14 aa, Borrelia afzelii PKo
AGKKAEEAKNPIAA

SEQ ID NO: 170543 - protein, 14 aa, Borrelia afzelii PKo
GKKAEEAKNPIAAA

SEQ ID NO: 170544 - protein, 14 aa, Borrelia afzelii PKo
KKAEEAKNPIAAAI

SEQ ID NO: 170545 - protein, 14 aa, Borrelia afzelii PKo
KAEEAKNPIAAAIG

SEQ ID NO: 170546 - protein, 14 aa, Borrelia afzelii PKo
AEEAKNPIAAAIGT

SEQ ID NO: 170547 - protein, 14 aa, Borrelia afzelii PKo
EEAKNPIAAAIGTD

SEQ ID NO: 170548 - protein, 14 aa, Borrelia afzelii PKo
EAKNPIAAAIGTDD

SEQ ID NO: 170549 - protein, 14 aa, Borrelia afzelii PKo
AKNPIAAAIGTDDD

SEQ ID NO: 170550 - protein, 14 aa, Borrelia afzelii PKo
KNPIAAAIGTDDDN

SEQ ID NO: 170551 - protein, 14 aa, Borrelia afzelii PKo
NPIAAAIGTDDDNG

SEQ ID NO: 170552 - protein, 14 aa, Borrelia afzelii PKo
PIAAAIGTDDDNGA

SEQ ID NO: 170553 - protein, 14 aa, Borrelia afzelii PKo
IAAAIGTDDDNGAA

SEQ ID NO: 170554 - protein, 14 aa, Borrelia afzelii PKo
AAAIGTDDDNGAAF

SEQ ID NO: 170555 - protein, 14 aa, Borrelia afzelii PKo
AAIGTDDDNGAAFK

SEQ ID NO: 170556 - protein, 14 aa, Borrelia afzelii PKo
AIGTDDDNGAAFKD

SEQ ID NO: 170557 - protein, 14 aa, Borrelia afzelii PKo
IGTDDDNGAAFKDE

SEQ ID NO: 170558 - protein, 14 aa, Borrelia afzelii PKo
GTDDDNGAAFKDEM

SEQ ID NO: 170559 - protein, 14 aa, Borrelia afzelii PKo
TDDDNGAAFKDEMK

SEQ ID NO: 170560 - protein, 14 aa, Borrelia afzelii PKo
DDDNGAAFKDEMKK

SEQ ID NO: 170561 - protein, 14 aa, Borrelia afzelii PKo
DDNGAAFKDEMKKS

SEQ ID NO: 170562 - protein, 14 aa, Borrelia afzelii PKo
DNGAAFKDEMKKSD

SEQ ID NO: 170563 - protein, 14 aa, Borrelia afzelii PKo
NGAAFKDEMKKSDK

SEQ ID NO: 170564 - protein, 14 aa, Borrelia afzelii PKo
GAAFKDEMKKSDKI

SEQ ID NO: 170565 - protein, 14 aa, Borrelia afzelii PKo
AAFKDEMKKSDKIA

SEQ ID NO: 170566 - protein, 14 aa, Borrelia afzelii PKo
AFKDEMKKSDKIAA

SEQ ID NO: 170567 - protein, 14 aa, Borrelia afzelii PKo
FKDEMKKSDKIAAA

SEQ ID NO: 170568 - protein, 14 aa, Borrelia afzelii PKo
KDEMKKSDKIAAAI

SEQ ID NO: 170569 - protein, 14 aa, Borrelia afzelii PKo
DEMKKSDKIAAAIV

SEQ ID NO: 170570 - protein, 14 aa, Borrelia afzelii PKo
EMKKSDKIAAAIVL

SEQ ID NO: 170571 - protein, 14 aa, Borrelia afzelii PKo
MKKSDKIAAAIVLR

SEQ ID NO: 170572 - protein, 14 aa, Borrelia afzelii PKo
KKSDKIAAAIVLRG

SEQ ID NO: 170573 - protein, 14 aa, Borrelia afzelii PKo
KSDKIAAAIVLRGV

SEQ ID NO: 170574 - protein, 14 aa, Borrelia afzelii PKo
SDKIAAAIVLRGVA

SEQ ID NO: 170575 - protein, 14 aa, Borrelia afzelii PKo
DKIAAAIVLRGVAK

SEQ ID NO: 170576 - protein, 14 aa, Borrelia afzelii PKo
KIAAAIVLRGVAKD

SEQ ID NO: 170577 - protein, 14 aa, Borrelia afzelii PKo
IAAAIVLRGVAKDG

SEQ ID NO: 170578 - protein, 14 aa, Borrelia afzelii PKo
AAAIVLRGVAKDGK

SEQ ID NO: 170579 - protein, 14 aa, Borrelia afzelii PKo
AAIVLRGVAKDGKF

SEQ ID NO: 170580 - protein, 14 aa, Borrelia afzelii PKo
AIVLRGVAKDGKFA

SEQ ID NO: 170581 - protein, 14 aa, Borrelia afzelii PKo
IVLRGVAKDGKFAV

SEQ ID NO: 170582 - protein, 14 aa, Borrelia afzelii PKo
VLRGVAKDGKFAVK

SEQ ID NO: 170583 - protein, 15 aa, Borrelia afzelii PKo
MKKISSAIFLTALLV

SEQ ID NO: 170584 - protein, 15 aa, Borrelia afzelii PKo
KKISSAIFLTALLVF

SEQ ID NO: 170585 - protein, 15 aa, Borrelia afzelii PKo
KISSAIFLTALLVFI

SEQ ID NO: 170586 - protein, 15 aa, Borrelia afzelii PKo
ISSAIFLTALLVFIN

SEQ ID NO: 170587 - protein, 15 aa, Borrelia afzelii PKo
SSAIFLTALLVFINC

SEQ ID NO: 170588 - protein, 15 aa, Borrelia afzelii PKo
SAIFLTALLVFINCK

SEQ ID NO: 170589 - protein, 15 aa, Borrelia afzelii PKo
AIFLTALLVFINCKN

SEQ ID NO: 170590 - protein, 15 aa, Borrelia afzelii PKo
IFLTALLVFINCKNN

SEQ ID NO: 170591 - protein, 15 aa, Borrelia afzelii PKo
FLTALLVFINCKNNA

SEQ ID NO: 170592 - protein, 15 aa, Borrelia afzelii PKo
LTALLVFINCKNNAV

SEQ ID NO: 170593 - protein, 15 aa, Borrelia afzelii PKo
TALLVFINCKNNAVG

SEQ ID NO: 170594 - protein, 15 aa, Borrelia afzelii PKo
ALLVFINCKNNAVGK

SEQ ID NO: 170595 - protein, 15 aa, Borrelia afzelii PKo
LLVFINCKNNAVGKG

SEQ ID NO: 170596 - protein, 15 aa, Borrelia afzelii PKo
LVFINCKNNAVGKGN

SEQ ID NO: 170597 - protein, 15 aa, Borrelia afzelii PKo
VFINCKNNAVGKGND

SEQ ID NO: 170598 - protein, 15 aa, Borrelia afzelii PKo
FINCKNNAVGKGNDD

SEQ ID NO: 170599 - protein, 15 aa, Borrelia afzelii PKo
INCKNNAVGKGNDDK

SEQ ID NO: 170600 - protein, 15 aa, Borrelia afzelii PKo
NCKNNAVGKGNDDKD

SEQ ID NO: 170601 - protein, 15 aa, Borrelia afzelii PKo
CKNNAVGKGNDDKDS

SEQ ID NO: 170602 - protein, 15 aa, Borrelia afzelii PKo
KNNAVGKGNDDKDSV

SEQ ID NO: 170603 - protein, 15 aa, Borrelia afzelii PKo
NNAVGKGNDDKDSVK

SEQ ID NO: 170604 - protein, 15 aa, Borrelia afzelii PKo
NAVGKGNDDKDSVKT

SEQ ID NO: 170605 - protein, 15 aa, Borrelia afzelii PKo
AVGKGNDDKDSVKTF

SEQ ID NO: 170606 - protein, 15 aa, Borrelia afzelii PKo
VGKGNDDKDSVKTFY

SEQ ID NO: 170607 - protein, 15 aa, Borrelia afzelii PKo
GKGNDDKDSVKTFYE

SEQ ID NO: 170608 - protein, 15 aa, Borrelia afzelii PKo
KGNDDKDSVKTFYES

SEQ ID NO: 170609 - protein, 15 aa, Borrelia afzelii PKo
GNDDKDSVKTFYESI

SEQ ID NO: 170610 - protein, 15 aa, Borrelia afzelii PKo
NDDKDSVKTFYESII

SEQ ID NO: 170611 - protein, 15 aa, Borrelia afzelii PKo
DDKDSVKTFYESIIN

SEQ ID NO: 170612 - protein, 15 aa, Borrelia afzelii PKo
DKDSVKTFYESIINL

SEQ ID NO: 170613 - protein, 15 aa, Borrelia afzelii PKo
KDSVKTFYESIINLG

SEQ ID NO: 170614 - protein, 15 aa, Borrelia afzelii PKo
DSVKTFYESIINLGN

SEQ ID NO: 170615 - protein, 15 aa, Borrelia afzelii PKo
SVKTFYESIINLGNG

SEQ ID NO: 170616 - protein, 15 aa, Borrelia afzelii PKo
VKTFYESIINLGNGF

SEQ ID NO: 170617 - protein, 15 aa, Borrelia afzelii PKo
KTFYESIINLGNGFI

SEQ ID NO: 170618 - protein, 15 aa, Borrelia afzelii PKo
TFYESIINLGNGFID

SEQ ID NO: 170619 - protein, 15 aa, Borrelia afzelii PKo
FYESIINLGNGFIDV

SEQ ID NO: 170620 - protein, 15 aa, Borrelia afzelii PKo
YESIINLGNGFIDVF

SEQ ID NO: 170621 - protein, 15 aa, Borrelia afzelii PKo
ESIINLGNGFIDVFN

SEQ ID NO: 170622 - protein, 15 aa, Borrelia afzelii PKo
SIINLGNGFIDVFNA

SEQ ID NO: 170623 - protein, 15 aa, Borrelia afzelii PKo
IINLGNGFIDVFNAF

SEQ ID NO: 170624 - protein, 15 aa, Borrelia afzelii PKo
INLGNGFIDVFNAFS

SEQ ID NO: 170625 - protein, 15 aa, Borrelia afzelii PKo
NLGNGFIDVFNAFSG

SEQ ID NO: 170626 - protein, 15 aa, Borrelia afzelii PKo
LGNGFIDVFNAFSGL

SEQ ID NO: 170627 - protein, 15 aa, Borrelia afzelii PKo
GNGFIDVFNAFSGLV

SEQ ID NO: 170628 - protein, 15 aa, Borrelia afzelii PKo
NGFIDVFNAFSGLVA

SEQ ID NO: 170629 - protein, 15 aa, Borrelia afzelii PKo
GFIDVFNAFSGLVAD

SEQ ID NO: 170630 - protein, 15 aa, Borrelia afzelii PKo
FIDVFNAFSGLVADT

SEQ ID NO: 170631 - protein, 15 aa, Borrelia afzelii PKo
IDVFNAFSGLVADTF

SEQ ID NO: 170632 - protein, 15 aa, Borrelia afzelii PKo
DVFNAFSGLVADTFF

SEQ ID NO: 170633 - protein, 15 aa, Borrelia afzelii PKo
VFNAFSGLVADTFFK

SEQ ID NO: 170634 - protein, 15 aa, Borrelia afzelii PKo
FNAFSGLVADTFFKS

SEQ ID NO: 170635 - protein, 15 aa, Borrelia afzelii PKo
NAFSGLVADTFFKSD

SEQ ID NO: 170636 - protein, 15 aa, Borrelia afzelii PKo
AFSGLVADTFFKSDP

SEQ ID NO: 170637 - protein, 15 aa, Borrelia afzelii PKo
FSGLVADTFFKSDPK

SEQ ID NO: 170638 - protein, 15 aa, Borrelia afzelii PKo
SGLVADTFFKSDPKK

SEQ ID NO: 170639 - protein, 15 aa, Borrelia afzelii PKo
GLVADTFFKSDPKKS

SEQ ID NO: 170640 - protein, 15 aa, Borrelia afzelii PKo
LVADTFFKSDPKKSD

SEQ ID NO: 170641 - protein, 15 aa, Borrelia afzelii PKo
VADTFFKSDPKKSDV

SEQ ID NO: 170642 - protein, 15 aa, Borrelia afzelii PKo
ADTFFKSDPKKSDVK

SEQ ID NO: 170643 - protein, 15 aa, Borrelia afzelii PKo
DTFFKSDPKKSDVKT

SEQ ID NO: 170644 - protein, 15 aa, Borrelia afzelii PKo
TFFKSDPKKSDVKTY

SEQ ID NO: 170645 - protein, 15 aa, Borrelia afzelii PKo
FFKSDPKKSDVKTYF

SEQ ID NO: 170646 - protein, 15 aa, Borrelia afzelii PKo
FKSDPKKSDVKTYFE

SEQ ID NO: 170647 - protein, 15 aa, Borrelia afzelii PKo
KSDPKKSDVKTYFES

SEQ ID NO: 170648 - protein, 15 aa, Borrelia afzelii PKo
SDPKKSDVKTYFESI

SEQ ID NO: 170649 - protein, 15 aa, Borrelia afzelii PKo
DPKKSDVKTYFESIS

SEQ ID NO: 170650 - protein, 15 aa, Borrelia afzelii PKo
PKKSDVKTYFESISS

SEQ ID NO: 170651 - protein, 15 aa, Borrelia afzelii PKo
KKSDVKTYFESISST

SEQ ID NO: 170652 - protein, 15 aa, Borrelia afzelii PKo
KSDVKTYFESISSTL

SEQ ID NO: 170653 - protein, 15 aa, Borrelia afzelii PKo
SDVKTYFESISSTLK

SEQ ID NO: 170654 - protein, 15 aa, Borrelia afzelii PKo
DVKTYFESISSTLKA

SEQ ID NO: 170655 - protein, 15 aa, Borrelia afzelii PKo
VKTYFESISSTLKAT

SEQ ID NO: 170656 - protein, 15 aa, Borrelia afzelii PKo
KTYFESISSTLKATK

SEQ ID NO: 170657 - protein, 15 aa, Borrelia afzelii PKo
TYFESISSTLKATKG

SEQ ID NO: 170658 - protein, 15 aa, Borrelia afzelii PKo
YFESISSTLKATKGK

SEQ ID NO: 170659 - protein, 15 aa, Borrelia afzelii PKo
FESISSTLKATKGKL

SEQ ID NO: 170660 - protein, 15 aa, Borrelia afzelii PKo
ESISSTLKATKGKLD

SEQ ID NO: 170661 - protein, 15 aa, Borrelia afzelii PKo
SISSTLKATKGKLDE

SEQ ID NO: 170662 - protein, 15 aa, Borrelia afzelii PKo
ISSTLKATKGKLDEL

SEQ ID NO: 170663 - protein, 15 aa, Borrelia afzelii PKo
SSTLKATKGKLDELV

SEQ ID NO: 170664 - protein, 15 aa, Borrelia afzelii PKo
STLKATKGKLDELVS

SEQ ID NO: 170665 - protein, 15 aa, Borrelia afzelii PKo
TLKATKGKLDELVSA

SEQ ID NO: 170666 - protein, 15 aa, Borrelia afzelii PKo
LKATKGKLDELVSAK

SEQ ID NO: 170667 - protein, 15 aa, Borrelia afzelii PKo
KATKGKLDELVSAKK

SEQ ID NO: 170668 - protein, 15 aa, Borrelia afzelii PKo
ATKGKLDELVSAKKG

SEQ ID NO: 170669 - protein, 15 aa, Borrelia afzelii PKo
TKGKLDELVSAKKGE

SEQ ID NO: 170670 - protein, 15 aa, Borrelia afzelii PKo
KGKLDELVSAKKGEG

SEQ ID NO: 170671 - protein, 15 aa, Borrelia afzelii PKo
GKLDELVSAKKGEGG

SEQ ID NO: 170672 - protein, 15 aa, Borrelia afzelii PKo
KLDELVSAKKGEGGS

SEQ ID NO: 170673 - protein, 15 aa, Borrelia afzelii PKo
LDELVSAKKGEGGSV

SEQ ID NO: 170674 - protein, 15 aa, Borrelia afzelii PKo
DELVSAKKGEGGSVK

SEQ ID NO: 170675 - protein, 15 aa, Borrelia afzelii PKo
ELVSAKKGEGGSVKA

SEQ ID NO: 170676 - protein, 15 aa, Borrelia afzelii PKo
LVSAKKGEGGSVKAS

SEQ ID NO: 170677 - protein, 15 aa, Borrelia afzelii PKo
VSAKKGEGGSVKASV

SEQ ID NO: 170678 - protein, 15 aa, Borrelia afzelii PKo
SAKKGEGGSVKASVE

SEQ ID NO: 170679 - protein, 15 aa, Borrelia afzelii PKo
AKKGEGGSVKASVES

SEQ ID NO: 170680 - protein, 15 aa, Borrelia afzelii PKo
KKGEGGSVKASVESA

SEQ ID NO: 170681 - protein, 15 aa, Borrelia afzelii PKo
KGEGGSVKASVESAV

SEQ ID NO: 170682 - protein, 15 aa, Borrelia afzelii PKo
GEGGSVKASVESAVD

SEQ ID NO: 170683 - protein, 15 aa, Borrelia afzelii PKo
EGGSVKASVESAVDE

SEQ ID NO: 170684 - protein, 15 aa, Borrelia afzelii PKo
GGSVKASVESAVDEV

SEQ ID NO: 170685 - protein, 15 aa, Borrelia afzelii PKo
GSVKASVESAVDEVS

SEQ ID NO: 170686 - protein, 15 aa, Borrelia afzelii PKo
SVKASVESAVDEVSK

SEQ ID NO: 170687 - protein, 15 aa, Borrelia afzelii PKo
VKASVESAVDEVSKW

SEQ ID NO: 170688 - protein, 15 aa, Borrelia afzelii PKo
KASVESAVDEVSKWL

SEQ ID NO: 170689 - protein, 15 aa, Borrelia afzelii PKo
ASVESAVDEVSKWLE

SEQ ID NO: 170690 - protein, 15 aa, Borrelia afzelii PKo
SVESAVDEVSKWLEE

SEQ ID NO: 170691 - protein, 15 aa, Borrelia afzelii PKo
VESAVDEVSKWLEEM

SEQ ID NO: 170692 - protein, 15 aa, Borrelia afzelii PKo
ESAVDEVSKWLEEMI

SEQ ID NO: 170693 - protein, 15 aa, Borrelia afzelii PKo
SAVDEVSKWLEEMIK

SEQ ID NO: 170694 - protein, 15 aa, Borrelia afzelii PKo
AVDEVSKWLEEMIKA

SEQ ID NO: 170695 - protein, 15 aa, Borrelia afzelii PKo
VDEVSKWLEEMIKAA

SEQ ID NO: 170696 - protein, 15 aa, Borrelia afzelii PKo
DEVSKWLEEMIKAAE

SEQ ID NO: 170697 - protein, 15 aa, Borrelia afzelii PKo
EVSKWLEEMIKAAEE

SEQ ID NO: 170698 - protein, 15 aa, Borrelia afzelii PKo
VSKWLEEMIKAAEEA

SEQ ID NO: 170699 - protein, 15 aa, Borrelia afzelii PKo
SKWLEEMIKAAEEAA

SEQ ID NO: 170700 - protein, 15 aa, Borrelia afzelii PKo
KWLEEMIKAAEEAAK

SEQ ID NO: 170701 - protein, 15 aa, Borrelia afzelii PKo
WLEEMIKAAEEAAKV

SEQ ID NO: 170702 - protein, 15 aa, Borrelia afzelii PKo
LEEMIKAAEEAAKVG

SEQ ID NO: 170703 - protein, 15 aa, Borrelia afzelii PKo
EEMIKAAEEAAKVGG

SEQ ID NO: 170704 - protein, 15 aa, Borrelia afzelii PKo
EMIKAAEEAAKVGGT

SEQ ID NO: 170705 - protein, 15 aa, Borrelia afzelii PKo
MIKAAEEAAKVGGTG

SEQ ID NO: 170706 - protein, 15 aa, Borrelia afzelii PKo
IKAAEEAAKVGGTGG

SEQ ID NO: 170707 - protein, 15 aa, Borrelia afzelii PKo
KAAEEAAKVGGTGGD

SEQ ID NO: 170708 - protein, 15 aa, Borrelia afzelii PKo
AAEEAAKVGGTGGDG

SEQ ID NO: 170709 - protein, 15 aa, Borrelia afzelii PKo
AEEAAKVGGTGGDGK

SEQ ID NO: 170710 - protein, 15 aa, Borrelia afzelii PKo
EEAAKVGGTGGDGKI

SEQ ID NO: 170711 - protein, 15 aa, Borrelia afzelii PKo
EAAKVGGTGGDGKIG

SEQ ID NO: 170712 - protein, 15 aa, Borrelia afzelii PKo
AAKVGGTGGDGKIGD

SEQ ID NO: 170713 - protein, 15 aa, Borrelia afzelii PKo
AKVGGTGGDGKIGDS

SEQ ID NO: 170714 - protein, 15 aa, Borrelia afzelii PKo
KVGGTGGDGKIGDSA

SEQ ID NO: 170715 - protein, 15 aa, Borrelia afzelii PKo
VGGTGGDGKIGDSAA

SEQ ID NO: 170716 - protein, 15 aa, Borrelia afzelii PKo
GGTGGDGKIGDSAAN

SEQ ID NO: 170717 - protein, 15 aa, Borrelia afzelii PKo
GTGGDGKIGDSAANH

SEQ ID NO: 170718 - protein, 15 aa, Borrelia afzelii PKo
TGGDGKIGDSAANHG

SEQ ID NO: 170719 - protein, 15 aa, Borrelia afzelii PKo
GGDGKIGDSAANHGA

SEQ ID NO: 170720 - protein, 15 aa, Borrelia afzelii PKo
GDGKIGDSAANHGAK

SEQ ID NO: 170721 - protein, 15 aa, Borrelia afzelii PKo
DGKIGDSAANHGAKA

SEQ ID NO: 170722 - protein, 15 aa, Borrelia afzelii PKo
GKIGDSAANHGAKAD

SEQ ID NO: 170723 - protein, 15 aa, Borrelia afzelii PKo
KIGDSAANHGAKADK

SEQ ID NO: 170724 - protein, 15 aa, Borrelia afzelii PKo
IGDSAANHGAKADKD

SEQ ID NO: 170725 - protein, 15 aa, Borrelia afzelii PKo
GDSAANHGAKADKDS

SEQ ID NO: 170726 - protein, 15 aa, Borrelia afzelii PKo
DSAANHGAKADKDSV

SEQ ID NO: 170727 - protein, 15 aa, Borrelia afzelii PKo
SAANHGAKADKDSVK

SEQ ID NO: 170728 - protein, 15 aa, Borrelia afzelii PKo
AANHGAKADKDSVKG

SEQ ID NO: 170729 - protein, 15 aa, Borrelia afzelii PKo
ANHGAKADKDSVKGI

SEQ ID NO: 170730 - protein, 15 aa, Borrelia afzelii PKo
NHGAKADKDSVKGIA

SEQ ID NO: 170731 - protein, 15 aa, Borrelia afzelii PKo
HGAKADKDSVKGIAK

SEQ ID NO: 170732 - protein, 15 aa, Borrelia afzelii PKo
GAKADKDSVKGIAKG

SEQ ID NO: 170733 - protein, 15 aa, Borrelia afzelii PKo
AKADKDSVKGIAKGI

SEQ ID NO: 170734 - protein, 15 aa, Borrelia afzelii PKo
KADKDSVKGIAKGIK

SEQ ID NO: 170735 - protein, 15 aa, Borrelia afzelii PKo
ADKDSVKGIAKGIKG

SEQ ID NO: 170736 - protein, 15 aa, Borrelia afzelii PKo
DKDSVKGIAKGIKGI

SEQ ID NO: 170737 - protein, 15 aa, Borrelia afzelii PKo
KDSVKGIAKGIKGIV

SEQ ID NO: 170738 - protein, 15 aa, Borrelia afzelii PKo
DSVKGIAKGIKGIVD

SEQ ID NO: 170739 - protein, 15 aa, Borrelia afzelii PKo
SVKGIAKGIKGIVDA

SEQ ID NO: 170740 - protein, 15 aa, Borrelia afzelii PKo
VKGIAKGIKGIVDAA

SEQ ID NO: 170741 - protein, 15 aa, Borrelia afzelii PKo
KGIAKGIKGIVDAAG

SEQ ID NO: 170742 - protein, 15 aa, Borrelia afzelii PKo
GIAKGIKGIVDAAGK

SEQ ID NO: 170743 - protein, 15 aa, Borrelia afzelii PKo
IAKGIKGIVDAAGKA

SEQ ID NO: 170744 - protein, 15 aa, Borrelia afzelii PKo
AKGIKGIVDAAGKAL

SEQ ID NO: 170745 - protein, 15 aa, Borrelia afzelii PKo
KGIKGIVDAAGKALG

SEQ ID NO: 170746 - protein, 15 aa, Borrelia afzelii PKo
GIKGIVDAAGKALGE

SEQ ID NO: 170747 - protein, 15 aa, Borrelia afzelii PKo
IKGIVDAAGKALGEK

SEQ ID NO: 170748 - protein, 15 aa, Borrelia afzelii PKo
KGIVDAAGKALGEKG

SEQ ID NO: 170749 - protein, 15 aa, Borrelia afzelii PKo
GIVDAAGKALGEKGA

SEQ ID NO: 170750 - protein, 15 aa, Borrelia afzelii PKo
IVDAAGKALGEKGAL

SEQ ID NO: 170751 - protein, 15 aa, Borrelia afzelii PKo
VDAAGKALGEKGALK

SEQ ID NO: 170752 - protein, 15 aa, Borrelia afzelii PKo
DAAGKALGEKGALKD

SEQ ID NO: 170753 - protein, 15 aa, Borrelia afzelii PKo
AAGKALGEKGALKDV

SEQ ID NO: 170754 - protein, 15 aa, Borrelia afzelii PKo
AGKALGEKGALKDVK

SEQ ID NO: 170755 - protein, 15 aa, Borrelia afzelii PKo
GKALGEKGALKDVKA

SEQ ID NO: 170756 - protein, 15 aa, Borrelia afzelii PKo
KALGEKGALKDVKAA

SEQ ID NO: 170757 - protein, 15 aa, Borrelia afzelii PKo
ALGEKGALKDVKAAA

SEQ ID NO: 170758 - protein, 15 aa, Borrelia afzelii PKo
LGEKGALKDVKAAAD

SEQ ID NO: 170759 - protein, 15 aa, Borrelia afzelii PKo
GEKGALKDVKAAADD

SEQ ID NO: 170760 - protein, 15 aa, Borrelia afzelii PKo
EKGALKDVKAAADDE

SEQ ID NO: 170761 - protein, 15 aa, Borrelia afzelii PKo
KGALKDVKAAADDEA

SEQ ID NO: 170762 - protein, 15 aa, Borrelia afzelii PKo
GALKDVKAAADDEAN

SEQ ID NO: 170763 - protein, 15 aa, Borrelia afzelii PKo
ALKDVKAAADDEANA

SEQ ID NO: 170764 - protein, 15 aa, Borrelia afzelii PKo
LKDVKAAADDEANAD

SEQ ID NO: 170765 - protein, 15 aa, Borrelia afzelii PKo
KDVKAAADDEANADA

SEQ ID NO: 170766 - protein, 15 aa, Borrelia afzelii PKo
DVKAAADDEANADAG

SEQ ID NO: 170767 - protein, 15 aa, Borrelia afzelii PKo
VKAAADDEANADAGK

SEQ ID NO: 170768 - protein, 15 aa, Borrelia afzelii PKo
KAAADDEANADAGKL

SEQ ID NO: 170769 - protein, 15 aa, Borrelia afzelii PKo
AAADDEANADAGKLF

SEQ ID NO: 170770 - protein, 15 aa, Borrelia afzelii PKo
AADDEANADAGKLFA

SEQ ID NO: 170771 - protein, 15 aa, Borrelia afzelii PKo
ADDEANADAGKLFAG

SEQ ID NO: 170772 - protein, 15 aa, Borrelia afzelii PKo
DDEANADAGKLFAGN

SEQ ID NO: 170773 - protein, 15 aa, Borrelia afzelii PKo
DEANADAGKLFAGNA

SEQ ID NO: 170774 - protein, 15 aa, Borrelia afzelii PKo
EANADAGKLFAGNAN

SEQ ID NO: 170775 - protein, 15 aa, Borrelia afzelii PKo
ANADAGKLFAGNANA

SEQ ID NO: 170776 - protein, 15 aa, Borrelia afzelii PKo
NADAGKLFAGNANAA

SEQ ID NO: 170777 - protein, 15 aa, Borrelia afzelii PKo
ADAGKLFAGNANAAV

SEQ ID NO: 170778 - protein, 15 aa, Borrelia afzelii PKo
DAGKLFAGNANAAVG

SEQ ID NO: 170779 - protein, 15 aa, Borrelia afzelii PKo
AGKLFAGNANAAVGA

SEQ ID NO: 170780 - protein, 15 aa, Borrelia afzelii PKo
GKLFAGNANAAVGAA

SEQ ID NO: 170781 - protein, 15 aa, Borrelia afzelii PKo
KLFAGNANAAVGAAA

SEQ ID NO: 170782 - protein, 15 aa, Borrelia afzelii PKo
LFAGNANAAVGAAAD

SEQ ID NO: 170783 - protein, 15 aa, Borrelia afzelii PKo
FAGNANAAVGAAADI

SEQ ID NO: 170784 - protein, 15 aa, Borrelia afzelii PKo
AGNANAAVGAAADIA

SEQ ID NO: 170785 - protein, 15 aa, Borrelia afzelii PKo
GNANAAVGAAADIAK

SEQ ID NO: 170786 - protein, 15 aa, Borrelia afzelii PKo
NANAAVGAAADIAKA

SEQ ID NO: 170787 - protein, 15 aa, Borrelia afzelii PKo
ANAAVGAAADIAKAA

SEQ ID NO: 170788 - protein, 15 aa, Borrelia afzelii PKo
NAAVGAAADIAKAAG

SEQ ID NO: 170789 - protein, 15 aa, Borrelia afzelii PKo
AAVGAAADIAKAAGA

SEQ ID NO: 170790 - protein, 15 aa, Borrelia afzelii PKo
AVGAAADIAKAAGAV

SEQ ID NO: 170791 - protein, 15 aa, Borrelia afzelii PKo
VGAAADIAKAAGAVT

SEQ ID NO: 170792 - protein, 15 aa, Borrelia afzelii PKo
GAAADIAKAAGAVTA

SEQ ID NO: 170793 - protein, 15 aa, Borrelia afzelii PKo
AAADIAKAAGAVTAV

SEQ ID NO: 170794 - protein, 15 aa, Borrelia afzelii PKo
AADIAKAAGAVTAVS

SEQ ID NO: 170795 - protein, 15 aa, Borrelia afzelii PKo
ADIAKAAGAVTAVSG

SEQ ID NO: 170796 - protein, 15 aa, Borrelia afzelii PKo
DIAKAAGAVTAVSGE

SEQ ID NO: 170797 - protein, 15 aa, Borrelia afzelii PKo
IAKAAGAVTAVSGEQ

SEQ ID NO: 170798 - protein, 15 aa, Borrelia afzelii PKo
AKAAGAVTAVSGEQI

SEQ ID NO: 170799 - protein, 15 aa, Borrelia afzelii PKo
KAAGAVTAVSGEQIL

SEQ ID NO: 170800 - protein, 15 aa, Borrelia afzelii PKo
AAGAVTAVSGEQILK

SEQ ID NO: 170801 - protein, 15 aa, Borrelia afzelii PKo
AGAVTAVSGEQILKA

SEQ ID NO: 170802 - protein, 15 aa, Borrelia afzelii PKo
GAVTAVSGEQILKAI

SEQ ID NO: 170803 - protein, 15 aa, Borrelia afzelii PKo
AVTAVSGEQILKAIV

SEQ ID NO: 170804 - protein, 15 aa, Borrelia afzelii PKo
VTAVSGEQILKAIVE

SEQ ID NO: 170805 - protein, 15 aa, Borrelia afzelii PKo
TAVSGEQILKAIVEA

SEQ ID NO: 170806 - protein, 15 aa, Borrelia afzelii PKo
AVSGEQILKAIVEAA

SEQ ID NO: 170807 - protein, 15 aa, Borrelia afzelii PKo
VSGEQILKAIVEAAG

SEQ ID NO: 170808 - protein, 15 aa, Borrelia afzelii PKo
SGEQILKAIVEAAGD

SEQ ID NO: 170809 - protein, 15 aa, Borrelia afzelii PKo
GEQILKAIVEAAGDP

SEQ ID NO: 170810 - protein, 15 aa, Borrelia afzelii PKo
EQILKAIVEAAGDPA

SEQ ID NO: 170811 - protein, 15 aa, Borrelia afzelii PKo
QILKAIVEAAGDPAN

SEQ ID NO: 170812 - protein, 15 aa, Borrelia afzelii PKo
ILKAIVEAAGDPANQ

SEQ ID NO: 170813 - protein, 15 aa, Borrelia afzelii PKo
LKAIVEAAGDPANQA

SEQ ID NO: 170814 - protein, 15 aa, Borrelia afzelii PKo
KAIVEAAGDPANQAG

SEQ ID NO: 170815 - protein, 15 aa, Borrelia afzelii PKo
AIVEAAGDPANQAGK

SEQ ID NO: 170816 - protein, 15 aa, Borrelia afzelii PKo
IVEAAGDPANQAGKK

SEQ ID NO: 170817 - protein, 15 aa, Borrelia afzelii PKo
VEAAGDPANQAGKKA

SEQ ID NO: 170818 - protein, 15 aa, Borrelia afzelii PKo
EAAGDPANQAGKKAE

SEQ ID NO: 170819 - protein, 15 aa, Borrelia afzelii PKo
AAGDPANQAGKKAEE

SEQ ID NO: 170820 - protein, 15 aa, Borrelia afzelii PKo
AGDPANQAGKKAEEA

SEQ ID NO: 170821 - protein, 15 aa, Borrelia afzelii PKo
GDPANQAGKKAEEAK

SEQ ID NO: 170822 - protein, 15 aa, Borrelia afzelii PKo
DPANQAGKKAEEAKN

SEQ ID NO: 170823 - protein, 15 aa, Borrelia afzelii PKo
PANQAGKKAEEAKNP

SEQ ID NO: 170824 - protein, 15 aa, Borrelia afzelii PKo
ANQAGKKAEEAKNPI

SEQ ID NO: 170825 - protein, 15 aa, Borrelia afzelii PKo
NQAGKKAEEAKNPIA

SEQ ID NO: 170826 - protein, 15 aa, Borrelia afzelii PKo
QAGKKAEEAKNPIAA

SEQ ID NO: 170827 - protein, 15 aa, Borrelia afzelii PKo
AGKKAEEAKNPIAAA

SEQ ID NO: 170828 - protein, 15 aa, Borrelia afzelii PKo
GKKAEEAKNPIAAAI

SEQ ID NO: 170829 - protein, 15 aa, Borrelia afzelii PKo
KKAEEAKNPIAAAIG

SEQ ID NO: 170830 - protein, 15 aa, Borrelia afzelii PKo
KAEEAKNPIAAAIGT

SEQ ID NO: 170831 - protein, 15 aa, Borrelia afzelii PKo
AEEAKNPIAAAIGTD

SEQ ID NO: 170832 - protein, 15 aa, Borrelia afzelii PKo
EEAKNPIAAAIGTDD

SEQ ID NO: 170833 - protein, 15 aa, Borrelia afzelii PKo
EAKNPIAAAIGTDDD

SEQ ID NO: 170834 - protein, 15 aa, Borrelia afzelii PKo
AKNPIAAAIGTDDDN

SEQ ID NO: 170835 - protein, 15 aa, Borrelia afzelii PKo
KNPIAAAIGTDDDNG

SEQ ID NO: 170836 - protein, 15 aa, Borrelia afzelii PKo
NPIAAAIGTDDDNGA

SEQ ID NO: 170837 - protein, 15 aa, Borrelia afzelii PKo
PIAAAIGTDDDNGAA

SEQ ID NO: 170838 - protein, 15 aa, Borrelia afzelii PKo
IAAAIGTDDDNGAAF

SEQ ID NO: 170839 - protein, 15 aa, Borrelia afzelii PKo
AAAIGTDDDNGAAFK

SEQ ID NO: 170840 - protein, 15 aa, Borrelia afzelii PKo
AAIGTDDDNGAAFKD

SEQ ID NO: 170841 - protein, 15 aa, Borrelia afzelii PKo
AIGTDDDNGAAFKDE

SEQ ID NO: 170842 - protein, 15 aa, Borrelia afzelii PKo
IGTDDDNGAAFKDEM

SEQ ID NO: 170843 - protein, 15 aa, Borrelia afzelii PKo
GTDDDNGAAFKDEMK

SEQ ID NO: 170844 - protein, 15 aa, Borrelia afzelii PKo
TDDDNGAAFKDEMKK

SEQ ID NO: 170845 - protein, 15 aa, Borrelia afzelii PKo
DDDNGAAFKDEMKKS

SEQ ID NO: 170846 - protein, 15 aa, Borrelia afzelii PKo
DDNGAAFKDEMKKSD

SEQ ID NO: 170847 - protein, 15 aa, Borrelia afzelii PKo
DNGAAFKDEMKKSDK

SEQ ID NO: 170848 - protein, 15 aa, Borrelia afzelii PKo
NGAAFKDEMKKSDKI

SEQ ID NO: 170849 - protein, 15 aa, Borrelia afzelii PKo
GAAFKDEMKKSDKIA

SEQ ID NO: 170850 - protein, 15 aa, Borrelia afzelii PKo
AAFKDEMKKSDKIAA

SEQ ID NO: 170851 - protein, 15 aa, Borrelia afzelii PKo
AFKDEMKKSDKIAAA

SEQ ID NO: 170852 - protein, 15 aa, Borrelia afzelii PKo
FKDEMKKSDKIAAAI

SEQ ID NO: 170853 - protein, 15 aa, Borrelia afzelii PKo
KDEMKKSDKIAAAIV

SEQ ID NO: 170854 - protein, 15 aa, Borrelia afzelii PKo
DEMKKSDKIAAAIVL

SEQ ID NO: 170855 - protein, 15 aa, Borrelia afzelii PKo
EMKKSDKIAAAIVLR

SEQ ID NO: 170856 - protein, 15 aa, Borrelia afzelii PKo
MKKSDKIAAAIVLRG

SEQ ID NO: 170857 - protein, 15 aa, Borrelia afzelii PKo
KKSDKIAAAIVLRGV

SEQ ID NO: 170858 - protein, 15 aa, Borrelia afzelii PKo
KSDKIAAAIVLRGVA

SEQ ID NO: 170859 - protein, 15 aa, Borrelia afzelii PKo
SDKIAAAIVLRGVAK

SEQ ID NO: 170860 - protein, 15 aa, Borrelia afzelii PKo
DKIAAAIVLRGVAKD

SEQ ID NO: 170861 - protein, 15 aa, Borrelia afzelii PKo
KIAAAIVLRGVAKDG

SEQ ID NO: 170862 - protein, 15 aa, Borrelia afzelii PKo
IAAAIVLRGVAKDGK

SEQ ID NO: 170863 - protein, 15 aa, Borrelia afzelii PKo
AAAIVLRGVAKDGKF

SEQ ID NO: 170864 - protein, 15 aa, Borrelia afzelii PKo
AAIVLRGVAKDGKFA

SEQ ID NO: 170865 - protein, 15 aa, Borrelia afzelii PKo
AIVLRGVAKDGKFAV

SEQ ID NO: 170866 - protein, 15 aa, Borrelia afzelii PKo
IVLRGVAKDGKFAVK

SEQ ID NO: 170867 - protein, 16 aa, Borrelia afzelii PKo
MKKISSAIFLTALLVF

SEQ ID NO: 170868 - protein, 16 aa, Borrelia afzelii PKo
KKISSAIFLTALLVFI

SEQ ID NO: 170869 - protein, 16 aa, Borrelia afzelii PKo
KISSAIFLTALLVFIN

SEQ ID NO: 170870 - protein, 16 aa, Borrelia afzelii PKo
ISSAIFLTALLVFINC

SEQ ID NO: 170871 - protein, 16 aa, Borrelia afzelii PKo
SSAIFLTALLVFINCK

SEQ ID NO: 170872 - protein, 16 aa, Borrelia afzelii PKo
SAIFLTALLVFINCKN

SEQ ID NO: 170873 - protein, 16 aa, Borrelia afzelii PKo
AIFLTALLVFINCKNN

SEQ ID NO: 170874 - protein, 16 aa, Borrelia afzelii PKo
IFLTALLVFINCKNNA

SEQ ID NO: 170875 - protein, 16 aa, Borrelia afzelii PKo
FLTALLVFINCKNNAV

SEQ ID NO: 170876 - protein, 16 aa, Borrelia afzelii PKo
LTALLVFINCKNNAVG

SEQ ID NO: 170877 - protein, 16 aa, Borrelia afzelii PKo
TALLVFINCKNNAVGK

SEQ ID NO: 170878 - protein, 16 aa, Borrelia afzelii PKo
ALLVFINCKNNAVGKG

SEQ ID NO: 170879 - protein, 16 aa, Borrelia afzelii PKo
LLVFINCKNNAVGKGN

SEQ ID NO: 170880 - protein, 16 aa, Borrelia afzelii PKo
LVFINCKNNAVGKGND

SEQ ID NO: 170881 - protein, 16 aa, Borrelia afzelii PKo
VFINCKNNAVGKGNDD

SEQ ID NO: 170882 - protein, 16 aa, Borrelia afzelii PKo
FINCKNNAVGKGNDDK

SEQ ID NO: 170883 - protein, 16 aa, Borrelia afzelii PKo
INCKNNAVGKGNDDKD

SEQ ID NO: 170884 - protein, 16 aa, Borrelia afzelii PKo
NCKNNAVGKGNDDKDS

SEQ ID NO: 170885 - protein, 16 aa, Borrelia afzelii PKo
CKNNAVGKGNDDKDSV

SEQ ID NO: 170886 - protein, 16 aa, Borrelia afzelii PKo
KNNAVGKGNDDKDSVK

SEQ ID NO: 170887 - protein, 16 aa, Borrelia afzelii PKo
NNAVGKGNDDKDSVKT

SEQ ID NO: 170888 - protein, 16 aa, Borrelia afzelii PKo
NAVGKGNDDKDSVKTF

SEQ ID NO: 170889 - protein, 16 aa, Borrelia afzelii PKo
AVGKGNDDKDSVKTFY

SEQ ID NO: 170890 - protein, 16 aa, Borrelia afzelii PKo
VGKGNDDKDSVKTFYE

SEQ ID NO: 170891 - protein, 16 aa, Borrelia afzelii PKo
GKGNDDKDSVKTFYES

SEQ ID NO: 170892 - protein, 16 aa, Borrelia afzelii PKo
KGNDDKDSVKTFYESI

SEQ ID NO: 170893 - protein, 16 aa, Borrelia afzelii PKo
GNDDKDSVKTFYESII

SEQ ID NO: 170894 - protein, 16 aa, Borrelia afzelii PKo
NDDKDSVKTFYESIIN

SEQ ID NO: 170895 - protein, 16 aa, Borrelia afzelii PKo
DDKDSVKTFYESIINL

SEQ ID NO: 170896 - protein, 16 aa, Borrelia afzelii PKo
DKDSVKTFYESIINLG

SEQ ID NO: 170897 - protein, 16 aa, Borrelia afzelii PKo
KDSVKTFYESIINLGN

SEQ ID NO: 170898 - protein, 16 aa, Borrelia afzelii PKo
DSVKTFYESIINLGNG

SEQ ID NO: 170899 - protein, 16 aa, Borrelia afzelii PKo
SVKTFYESIINLGNGF

SEQ ID NO: 170900 - protein, 16 aa, Borrelia afzelii PKo
VKTFYESIINLGNGFI

SEQ ID NO: 170901 - protein, 16 aa, Borrelia afzelii PKo
KTFYESIINLGNGFID

SEQ ID NO: 170902 - protein, 16 aa, Borrelia afzelii PKo
TFYESIINLGNGFIDV

SEQ ID NO: 170903 - protein, 16 aa, Borrelia afzelii PKo
FYESIINLGNGFIDVF

SEQ ID NO: 170904 - protein, 16 aa, Borrelia afzelii PKo
YESIINLGNGFIDVFN

SEQ ID NO: 170905 - protein, 16 aa, Borrelia afzelii PKo
ESIINLGNGFIDVFNA

SEQ ID NO: 170906 - protein, 16 aa, Borrelia afzelii PKo
SIINLGNGFIDVFNAF

SEQ ID NO: 170907 - protein, 16 aa, Borrelia afzelii PKo
IINLGNGFIDVFNAFS

SEQ ID NO: 170908 - protein, 16 aa, Borrelia afzelii PKo
INLGNGFIDVFNAFSG

SEQ ID NO: 170909 - protein, 16 aa, Borrelia afzelii PKo
NLGNGFIDVFNAFSGL

SEQ ID NO: 170910 - protein, 16 aa, Borrelia afzelii PKo
LGNGFIDVFNAFSGLV

SEQ ID NO: 170911 - protein, 16 aa, Borrelia afzelii PKo
GNGFIDVFNAFSGLVA

SEQ ID NO: 170912 - protein, 16 aa, Borrelia afzelii PKo
NGFIDVFNAFSGLVAD

SEQ ID NO: 170913 - protein, 16 aa, Borrelia afzelii PKo
GFIDVFNAFSGLVADT

SEQ ID NO: 170914 - protein, 16 aa, Borrelia afzelii PKo
FIDVFNAFSGLVADTF

SEQ ID NO: 170915 - protein, 16 aa, Borrelia afzelii PKo
IDVFNAFSGLVADTFF

SEQ ID NO: 170916 - protein, 16 aa, Borrelia afzelii PKo
DVFNAFSGLVADTFFK

SEQ ID NO: 170917 - protein, 16 aa, Borrelia afzelii PKo
VFNAFSGLVADTFFKS

SEQ ID NO: 170918 - protein, 16 aa, Borrelia afzelii PKo
FNAFSGLVADTFFKSD

SEQ ID NO: 170919 - protein, 16 aa, Borrelia afzelii PKo
NAFSGLVADTFFKSDP

SEQ ID NO: 170920 - protein, 16 aa, Borrelia afzelii PKo
AFSGLVADTFFKSDPK

SEQ ID NO: 170921 - protein, 16 aa, Borrelia afzelii PKo
FSGLVADTFFKSDPKK

SEQ ID NO: 170922 - protein, 16 aa, Borrelia afzelii PKo
SGLVADTFFKSDPKKS

SEQ ID NO: 170923 - protein, 16 aa, Borrelia afzelii PKo
GLVADTFFKSDPKKSD

SEQ ID NO: 170924 - protein, 16 aa, Borrelia afzelii PKo
LVADTFFKSDPKKSDV

SEQ ID NO: 170925 - protein, 16 aa, Borrelia afzelii PKo
VADTFFKSDPKKSDVK

SEQ ID NO: 170926 - protein, 16 aa, Borrelia afzelii PKo
ADTFFKSDPKKSDVKT

SEQ ID NO: 170927 - protein, 16 aa, Borrelia afzelii PKo
DTFFKSDPKKSDVKTY

SEQ ID NO: 170928 - protein, 16 aa, Borrelia afzelii PKo
TFFKSDPKKSDVKTYF

SEQ ID NO: 170929 - protein, 16 aa, Borrelia afzelii PKo
FFKSDPKKSDVKTYFE

SEQ ID NO: 170930 - protein, 16 aa, Borrelia afzelii PKo
FKSDPKKSDVKTYFES

SEQ ID NO: 170931 - protein, 16 aa, Borrelia afzelii PKo
KSDPKKSDVKTYFESI

SEQ ID NO: 170932 - protein, 16 aa, Borrelia afzelii PKo
SDPKKSDVKTYFESIS

SEQ ID NO: 170933 - protein, 16 aa, Borrelia afzelii PKo
DPKKSDVKTYFESISS

SEQ ID NO: 170934 - protein, 16 aa, Borrelia afzelii PKo
PKKSDVKTYFESISST

SEQ ID NO: 170935 - protein, 16 aa, Borrelia afzelii PKo
KKSDVKTYFESISSTL

SEQ ID NO: 170936 - protein, 16 aa, Borrelia afzelii PKo
KSDVKTYFESISSTLK

SEQ ID NO: 170937 - protein, 16 aa, Borrelia afzelii PKo
SDVKTYFESISSTLKA

SEQ ID NO: 170938 - protein, 16 aa, Borrelia afzelii PKo
DVKTYFESISSTLKAT

SEQ ID NO: 170939 - protein, 16 aa, Borrelia afzelii PKo
VKTYFESISSTLKATK

SEQ ID NO: 170940 - protein, 16 aa, Borrelia afzelii PKo
KTYFESISSTLKATKG

SEQ ID NO: 170941 - protein, 16 aa, Borrelia afzelii PKo
TYFESISSTLKATKGK

SEQ ID NO: 170942 - protein, 16 aa, Borrelia afzelii PKo
YFESISSTLKATKGKL

SEQ ID NO: 170943 - protein, 16 aa, Borrelia afzelii PKo
FESISSTLKATKGKLD

SEQ ID NO: 170944 - protein, 16 aa, Borrelia afzelii PKo
ESISSTLKATKGKLDE

SEQ ID NO: 170945 - protein, 16 aa, Borrelia afzelii PKo
SISSTLKATKGKLDEL

SEQ ID NO: 170946 - protein, 16 aa, Borrelia afzelii PKo
ISSTLKATKGKLDELV

SEQ ID NO: 170947 - protein, 16 aa, Borrelia afzelii PKo
SSTLKATKGKLDELVS

SEQ ID NO: 170948 - protein, 16 aa, Borrelia afzelii PKo
STLKATKGKLDELVSA

SEQ ID NO: 170949 - protein, 16 aa, Borrelia afzelii PKo
TLKATKGKLDELVSAK

SEQ ID NO: 170950 - protein, 16 aa, Borrelia afzelii PKo
LKATKGKLDELVSAKK

SEQ ID NO: 170951 - protein, 16 aa, Borrelia afzelii PKo
KATKGKLDELVSAKKG

SEQ ID NO: 170952 - protein, 16 aa, Borrelia afzelii PKo
ATKGKLDELVSAKKGE

SEQ ID NO: 170953 - protein, 16 aa, Borrelia afzelii PKo
TKGKLDELVSAKKGEG

SEQ ID NO: 170954 - protein, 16 aa, Borrelia afzelii PKo
KGKLDELVSAKKGEGG

SEQ ID NO: 170955 - protein, 16 aa, Borrelia afzelii PKo
GKLDELVSAKKGEGGS

SEQ ID NO: 170956 - protein, 16 aa, Borrelia afzelii PKo
KLDELVSAKKGEGGSV

SEQ ID NO: 170957 - protein, 16 aa, Borrelia afzelii PKo
LDELVSAKKGEGGSVK

SEQ ID NO: 170958 - protein, 16 aa, Borrelia afzelii PKo
DELVSAKKGEGGSVKA

SEQ ID NO: 170959 - protein, 16 aa, Borrelia afzelii PKo
ELVSAKKGEGGSVKAS

SEQ ID NO: 170960 - protein, 16 aa, Borrelia afzelii PKo
LVSAKKGEGGSVKASV

SEQ ID NO: 170961 - protein, 16 aa, Borrelia afzelii PKo
VSAKKGEGGSVKASVE

SEQ ID NO: 170962 - protein, 16 aa, Borrelia afzelii PKo
SAKKGEGGSVKASVES

SEQ ID NO: 170963 - protein, 16 aa, Borrelia afzelii PKo
AKKGEGGSVKASVESA

SEQ ID NO: 170964 - protein, 16 aa, Borrelia afzelii PKo
KKGEGGSVKASVESAV

SEQ ID NO: 170965 - protein, 16 aa, Borrelia afzelii PKo
KGEGGSVKASVESAVD

SEQ ID NO: 170966 - protein, 16 aa, Borrelia afzelii PKo
GEGGSVKASVESAVDE

SEQ ID NO: 170967 - protein, 16 aa, Borrelia afzelii PKo
EGGSVKASVESAVDEV

SEQ ID NO: 170968 - protein, 16 aa, Borrelia afzelii PKo
GGSVKASVESAVDEVS

SEQ ID NO: 170969 - protein, 16 aa, Borrelia afzelii PKo
GSVKASVESAVDEVSK

SEQ ID NO: 170970 - protein, 16 aa, Borrelia afzelii PKo
SVKASVESAVDEVSKW

SEQ ID NO: 170971 - protein, 16 aa, Borrelia afzelii PKo
VKASVESAVDEVSKWL

SEQ ID NO: 170972 - protein, 16 aa, Borrelia afzelii PKo
KASVESAVDEVSKWLE

SEQ ID NO: 170973 - protein, 16 aa, Borrelia afzelii PKo
ASVESAVDEVSKWLEE

SEQ ID NO: 170974 - protein, 16 aa, Borrelia afzelii PKo
SVESAVDEVSKWLEEM

SEQ ID NO: 170975 - protein, 16 aa, Borrelia afzelii PKo
VESAVDEVSKWLEEMI

SEQ ID NO: 170976 - protein, 16 aa, Borrelia afzelii PKo
ESAVDEVSKWLEEMIK

SEQ ID NO: 170977 - protein, 16 aa, Borrelia afzelii PKo
SAVDEVSKWLEEMIKA

SEQ ID NO: 170978 - protein, 16 aa, Borrelia afzelii PKo
AVDEVSKWLEEMIKAA

SEQ ID NO: 170979 - protein, 16 aa, Borrelia afzelii PKo
VDEVSKWLEEMIKAAE

SEQ ID NO: 170980 - protein, 16 aa, Borrelia afzelii PKo
DEVSKWLEEMIKAAEE

SEQ ID NO: 170981 - protein, 16 aa, Borrelia afzelii PKo
EVSKWLEEMIKAAEEA

SEQ ID NO: 170982 - protein, 16 aa, Borrelia afzelii PKo
VSKWLEEMIKAAEEAA

SEQ ID NO: 170983 - protein, 16 aa, Borrelia afzelii PKo
SKWLEEMIKAAEEAAK

SEQ ID NO: 170984 - protein, 16 aa, Borrelia afzelii PKo
KWLEEMIKAAEEAAKV

SEQ ID NO: 170985 - protein, 16 aa, Borrelia afzelii PKo
WLEEMIKAAEEAAKVG

SEQ ID NO: 170986 - protein, 16 aa, Borrelia afzelii PKo
LEEMIKAAEEAAKVGG

SEQ ID NO: 170987 - protein, 16 aa, Borrelia afzelii PKo
EEMIKAAEEAAKVGGT

SEQ ID NO: 170988 - protein, 16 aa, Borrelia afzelii PKo
EMIKAAEEAAKVGGTG

SEQ ID NO: 170989 - protein, 16 aa, Borrelia afzelii PKo
MIKAAEEAAKVGGTGG

SEQ ID NO: 170990 - protein, 16 aa, Borrelia afzelii PKo
IKAAEEAAKVGGTGGD

SEQ ID NO: 170991 - protein, 16 aa, Borrelia afzelii PKo
KAAEEAAKVGGTGGDG

SEQ ID NO: 170992 - protein, 16 aa, Borrelia afzelii PKo
AAEEAAKVGGTGGDGK

SEQ ID NO: 170993 - protein, 16 aa, Borrelia afzelii PKo
AEEAAKVGGTGGDGKI

SEQ ID NO: 170994 - protein, 16 aa, Borrelia afzelii PKo
EEAAKVGGTGGDGKIG

SEQ ID NO: 170995 - protein, 16 aa, Borrelia afzelii PKo
EAAKVGGTGGDGKIGD

SEQ ID NO: 170996 - protein, 16 aa, Borrelia afzelii PKo
AAKVGGTGGDGKIGDS

SEQ ID NO: 170997 - protein, 16 aa, Borrelia afzelii PKo
AKVGGTGGDGKIGDSA

SEQ ID NO: 170998 - protein, 16 aa, Borrelia afzelii PKo
KVGGTGGDGKIGDSAA

SEQ ID NO: 170999 - protein, 16 aa, Borrelia afzelii PKo
VGGTGGDGKIGDSAAN

SEQ ID NO: 171000 - protein, 16 aa, Borrelia afzelii PKo
GGTGGDGKIGDSAANH

SEQ ID NO: 171001 - protein, 16 aa, Borrelia afzelii PKo
GTGGDGKIGDSAANHG

SEQ ID NO: 171002 - protein, 16 aa, Borrelia afzelii PKo
TGGDGKIGDSAANHGA

SEQ ID NO: 171003 - protein, 16 aa, Borrelia afzelii PKo
GGDGKIGDSAANHGAK

SEQ ID NO: 171004 - protein, 16 aa, Borrelia afzelii PKo
GDGKIGDSAANHGAKA

SEQ ID NO: 171005 - protein, 16 aa, Borrelia afzelii PKo
DGKIGDSAANHGAKAD

SEQ ID NO: 171006 - protein, 16 aa, Borrelia afzelii PKo
GKIGDSAANHGAKADK

SEQ ID NO: 171007 - protein, 16 aa, Borrelia afzelii PKo
KIGDSAANHGAKADKD

SEQ ID NO: 171008 - protein, 16 aa, Borrelia afzelii PKo
IGDSAANHGAKADKDS

SEQ ID NO: 171009 - protein, 16 aa, Borrelia afzelii PKo
GDSAANHGAKADKDSV

SEQ ID NO: 171010 - protein, 16 aa, Borrelia afzelii PKo
DSAANHGAKADKDSVK

SEQ ID NO: 171011 - protein, 16 aa, Borrelia afzelii PKo
SAANHGAKADKDSVKG

SEQ ID NO: 171012 - protein, 16 aa, Borrelia afzelii PKo
AANHGAKADKDSVKGI

SEQ ID NO: 171013 - protein, 16 aa, Borrelia afzelii PKo
ANHGAKADKDSVKGIA

SEQ ID NO: 171014 - protein, 16 aa, Borrelia afzelii PKo
NHGAKADKDSVKGIAK

SEQ ID NO: 171015 - protein, 16 aa, Borrelia afzelii PKo
HGAKADKDSVKGIAKG

SEQ ID NO: 171016 - protein, 16 aa, Borrelia afzelii PKo
GAKADKDSVKGIAKGI

SEQ ID NO: 171017 - protein, 16 aa, Borrelia afzelii PKo
AKADKDSVKGIAKGIK

SEQ ID NO: 171018 - protein, 16 aa, Borrelia afzelii PKo
KADKDSVKGIAKGIKG

SEQ ID NO: 171019 - protein, 16 aa, Borrelia afzelii PKo
ADKDSVKGIAKGIKGI

SEQ ID NO: 171020 - protein, 16 aa, Borrelia afzelii PKo
DKDSVKGIAKGIKGIV

SEQ ID NO: 171021 - protein, 16 aa, Borrelia afzelii PKo
KDSVKGIAKGIKGIVD

SEQ ID NO: 171022 - protein, 16 aa, Borrelia afzelii PKo
DSVKGIAKGIKGIVDA

SEQ ID NO: 171023 - protein, 16 aa, Borrelia afzelii PKo
SVKGIAKGIKGIVDAA

SEQ ID NO: 171024 - protein, 16 aa, Borrelia afzelii PKo
VKGIAKGIKGIVDAAG

SEQ ID NO: 171025 - protein, 16 aa, Borrelia afzelii PKo
KGIAKGIKGIVDAAGK

SEQ ID NO: 171026 - protein, 16 aa, Borrelia afzelii PKo
GIAKGIKGIVDAAGKA

SEQ ID NO: 171027 - protein, 16 aa, Borrelia afzelii PKo
IAKGIKGIVDAAGKAL

SEQ ID NO: 171028 - protein, 16 aa, Borrelia afzelii PKo
AKGIKGIVDAAGKALG

SEQ ID NO: 171029 - protein, 16 aa, Borrelia afzelii PKo
KGIKGIVDAAGKALGE

SEQ ID NO: 171030 - protein, 16 aa, Borrelia afzelii PKo
GIKGIVDAAGKALGEK

SEQ ID NO: 171031 - protein, 16 aa, Borrelia afzelii PKo
IKGIVDAAGKALGEKG

SEQ ID NO: 171032 - protein, 16 aa, Borrelia afzelii PKo
KGIVDAAGKALGEKGA

SEQ ID NO: 171033 - protein, 16 aa, Borrelia afzelii PKo
GIVDAAGKALGEKGAL

SEQ ID NO: 171034 - protein, 16 aa, Borrelia afzelii PKo
IVDAAGKALGEKGALK

SEQ ID NO: 171035 - protein, 16 aa, Borrelia afzelii PKo
VDAAGKALGEKGALKD

SEQ ID NO: 171036 - protein, 16 aa, Borrelia afzelii PKo
DAAGKALGEKGALKDV

SEQ ID NO: 171037 - protein, 16 aa, Borrelia afzelii PKo
AAGKALGEKGALKDVK

SEQ ID NO: 171038 - protein, 16 aa, Borrelia afzelii PKo
AGKALGEKGALKDVKA

SEQ ID NO: 171039 - protein, 16 aa, Borrelia afzelii PKo
GKALGEKGALKDVKAA

SEQ ID NO: 171040 - protein, 16 aa, Borrelia afzelii PKo
KALGEKGALKDVKAAA

SEQ ID NO: 171041 - protein, 16 aa, Borrelia afzelii PKo
ALGEKGALKDVKAAAD

SEQ ID NO: 171042 - protein, 16 aa, Borrelia afzelii PKo
LGEKGALKDVKAAADD

SEQ ID NO: 171043 - protein, 16 aa, Borrelia afzelii PKo
GEKGALKDVKAAADDE

SEQ ID NO: 171044 - protein, 16 aa, Borrelia afzelii PKo
EKGALKDVKAAADDEA

SEQ ID NO: 171045 - protein, 16 aa, Borrelia afzelii PKo
KGALKDVKAAADDEAN

SEQ ID NO: 171046 - protein, 16 aa, Borrelia afzelii PKo
GALKDVKAAADDEANA

SEQ ID NO: 171047 - protein, 16 aa, Borrelia afzelii PKo
ALKDVKAAADDEANAD

SEQ ID NO: 171048 - protein, 16 aa, Borrelia afzelii PKo
LKDVKAAADDEANADA

SEQ ID NO: 171049 - protein, 16 aa, Borrelia afzelii PKo
KDVKAAADDEANADAG

SEQ ID NO: 171050 - protein, 16 aa, Borrelia afzelii PKo
DVKAAADDEANADAGK

SEQ ID NO: 171051 - protein, 16 aa, Borrelia afzelii PKo
VKAAADDEANADAGKL

SEQ ID NO: 171052 - protein, 16 aa, Borrelia afzelii PKo
KAAADDEANADAGKLF

SEQ ID NO: 171053 - protein, 16 aa, Borrelia afzelii PKo
AAADDEANADAGKLFA

SEQ ID NO: 171054 - protein, 16 aa, Borrelia afzelii PKo
AADDEANADAGKLFAG

SEQ ID NO: 171055 - protein, 16 aa, Borrelia afzelii PKo
ADDEANADAGKLFAGN

SEQ ID NO: 171056 - protein, 16 aa, Borrelia afzelii PKo
DDEANADAGKLFAGNA

SEQ ID NO: 171057 - protein, 16 aa, Borrelia afzelii PKo
DEANADAGKLFAGNAN

SEQ ID NO: 171058 - protein, 16 aa, Borrelia afzelii PKo
EANADAGKLFAGNANA

SEQ ID NO: 171059 - protein, 16 aa, Borrelia afzelii PKo
ANADAGKLFAGNANAA

SEQ ID NO: 171060 - protein, 16 aa, Borrelia afzelii PKo
NADAGKLFAGNANAAV

SEQ ID NO: 171061 - protein, 16 aa, Borrelia afzelii PKo
ADAGKLFAGNANAAVG

SEQ ID NO: 171062 - protein, 16 aa, Borrelia afzelii PKo
DAGKLFAGNANAAVGA

SEQ ID NO: 171063 - protein, 16 aa, Borrelia afzelii PKo
AGKLFAGNANAAVGAA

SEQ ID NO: 171064 - protein, 16 aa, Borrelia afzelii PKo
GKLFAGNANAAVGAAA

SEQ ID NO: 171065 - protein, 16 aa, Borrelia afzelii PKo
KLFAGNANAAVGAAAD

SEQ ID NO: 171066 - protein, 16 aa, Borrelia afzelii PKo
LFAGNANAAVGAAADI

SEQ ID NO: 171067 - protein, 16 aa, Borrelia afzelii PKo
FAGNANAAVGAAADIA

SEQ ID NO: 171068 - protein, 16 aa, Borrelia afzelii PKo
AGNANAAVGAAADIAK

SEQ ID NO: 171069 - protein, 16 aa, Borrelia afzelii PKo
GNANAAVGAAADIAKA

SEQ ID NO: 171070 - protein, 16 aa, Borrelia afzelii PKo
NANAAVGAAADIAKAA

SEQ ID NO: 171071 - protein, 16 aa, Borrelia afzelii PKo
ANAAVGAAADIAKAAG

SEQ ID NO: 171072 - protein, 16 aa, Borrelia afzelii PKo
NAAVGAAADIAKAAGA

SEQ ID NO: 171073 - protein, 16 aa, Borrelia afzelii PKo
AAVGAAADIAKAAGAV

SEQ ID NO: 171074 - protein, 16 aa, Borrelia afzelii PKo
AVGAAADIAKAAGAVT

SEQ ID NO: 171075 - protein, 16 aa, Borrelia afzelii PKo
VGAAADIAKAAGAVTA

SEQ ID NO: 171076 - protein, 16 aa, Borrelia afzelii PKo
GAAADIAKAAGAVTAV

SEQ ID NO: 171077 - protein, 16 aa, Borrelia afzelii PKo
AAADIAKAAGAVTAVS

SEQ ID NO: 171078 - protein, 16 aa, Borrelia afzelii PKo
AADIAKAAGAVTAVSG

SEQ ID NO: 171079 - protein, 16 aa, Borrelia afzelii PKo
ADIAKAAGAVTAVSGE

SEQ ID NO: 171080 - protein, 16 aa, Borrelia afzelii PKo
DIAKAAGAVTAVSGEQ

SEQ ID NO: 171081 - protein, 16 aa, Borrelia afzelii PKo
IAKAAGAVTAVSGEQI

SEQ ID NO: 171082 - protein, 16 aa, Borrelia afzelii PKo
AKAAGAVTAVSGEQIL

SEQ ID NO: 171083 - protein, 16 aa, Borrelia afzelii PKo
KAAGAVTAVSGEQILK

SEQ ID NO: 171084 - protein, 16 aa, Borrelia afzelii PKo
AAGAVTAVSGEQILKA

SEQ ID NO: 171085 - protein, 16 aa, Borrelia afzelii PKo
AGAVTAVSGEQILKAI

SEQ ID NO: 171086 - protein, 16 aa, Borrelia afzelii PKo
GAVTAVSGEQILKAIV

SEQ ID NO: 171087 - protein, 16 aa, Borrelia afzelii PKo
AVTAVSGEQILKAIVE

SEQ ID NO: 171088 - protein, 16 aa, Borrelia afzelii PKo
VTAVSGEQILKAIVEA

SEQ ID NO: 171089 - protein, 16 aa, Borrelia afzelii PKo
TAVSGEQILKAIVEAA

SEQ ID NO: 171090 - protein, 16 aa, Borrelia afzelii PKo
AVSGEQILKAIVEAAG

SEQ ID NO: 171091 - protein, 16 aa, Borrelia afzelii PKo
VSGEQILKAIVEAAGD

SEQ ID NO: 171092 - protein, 16 aa, Borrelia afzelii PKo
SGEQILKAIVEAAGDP

SEQ ID NO: 171093 - protein, 16 aa, Borrelia afzelii PKo
GEQILKAIVEAAGDPA

SEQ ID NO: 171094 - protein, 16 aa, Borrelia afzelii PKo
EQILKAIVEAAGDPAN

SEQ ID NO: 171095 - protein, 16 aa, Borrelia afzelii PKo
QILKAIVEAAGDPANQ

SEQ ID NO: 171096 - protein, 16 aa, Borrelia afzelii PKo
ILKAIVEAAGDPANQA

SEQ ID NO: 171097 - protein, 16 aa, Borrelia afzelii PKo
LKAIVEAAGDPANQAG

SEQ ID NO: 171098 - protein, 16 aa, Borrelia afzelii PKo
KAIVEAAGDPANQAGK

SEQ ID NO: 171099 - protein, 16 aa, Borrelia afzelii PKo
AIVEAAGDPANQAGKK

SEQ ID NO: 171100 - protein, 16 aa, Borrelia afzelii PKo
IVEAAGDPANQAGKKA

SEQ ID NO: 171101 - protein, 16 aa, Borrelia afzelii PKo
VEAAGDPANQAGKKAE

SEQ ID NO: 171102 - protein, 16 aa, Borrelia afzelii PKo
EAAGDPANQAGKKAEE

SEQ ID NO: 171103 - protein, 16 aa, Borrelia afzelii PKo
AAGDPANQAGKKAEEA

SEQ ID NO: 171104 - protein, 16 aa, Borrelia afzelii PKo
AGDPANQAGKKAEEAK

SEQ ID NO: 171105 - protein, 16 aa, Borrelia afzelii PKo
GDPANQAGKKAEEAKN

SEQ ID NO: 171106 - protein, 16 aa, Borrelia afzelii PKo
DPANQAGKKAEEAKNP

SEQ ID NO: 171107 - protein, 16 aa, Borrelia afzelii PKo
PANQAGKKAEEAKNPI

SEQ ID NO: 171108 - protein, 16 aa, Borrelia afzelii PKo
ANQAGKKAEEAKNPIA

SEQ ID NO: 171109 - protein, 16 aa, Borrelia afzelii PKo
NQAGKKAEEAKNPIAA

SEQ ID NO: 171110 - protein, 16 aa, Borrelia afzelii PKo
QAGKKAEEAKNPIAAA

SEQ ID NO: 171111 - protein, 16 aa, Borrelia afzelii PKo
AGKKAEEAKNPIAAAI

SEQ ID NO: 171112 - protein, 16 aa, Borrelia afzelii PKo
GKKAEEAKNPIAAAIG

SEQ ID NO: 171113 - protein, 16 aa, Borrelia afzelii PKo
KKAEEAKNPIAAAIGT

SEQ ID NO: 171114 - protein, 16 aa, Borrelia afzelii PKo
KAEEAKNPIAAAIGTD

SEQ ID NO: 171115 - protein, 16 aa, Borrelia afzelii PKo
AEEAKNPIAAAIGTDD

SEQ ID NO: 171116 - protein, 16 aa, Borrelia afzelii PKo
EEAKNPIAAAIGTDDD

SEQ ID NO: 171117 - protein, 16 aa, Borrelia afzelii PKo
EAKNPIAAAIGTDDDN

SEQ ID NO: 171118 - protein, 16 aa, Borrelia afzelii PKo
AKNPIAAAIGTDDDNG

SEQ ID NO: 171119 - protein, 16 aa, Borrelia afzelii PKo
KNPIAAAIGTDDDNGA

SEQ ID NO: 171120 - protein, 16 aa, Borrelia afzelii PKo
NPIAAAIGTDDDNGAA

SEQ ID NO: 171121 - protein, 16 aa, Borrelia afzelii PKo
PIAAAIGTDDDNGAAF

SEQ ID NO: 171122 - protein, 16 aa, Borrelia afzelii PKo
IAAAIGTDDDNGAAFK

SEQ ID NO: 171123 - protein, 16 aa, Borrelia afzelii PKo
AAAIGTDDDNGAAFKD

SEQ ID NO: 171124 - protein, 16 aa, Borrelia afzelii PKo
AAIGTDDDNGAAFKDE

SEQ ID NO: 171125 - protein, 16 aa, Borrelia afzelii PKo
AIGTDDDNGAAFKDEM

SEQ ID NO: 171126 - protein, 16 aa, Borrelia afzelii PKo
IGTDDDNGAAFKDEMK

SEQ ID NO: 171127 - protein, 16 aa, Borrelia afzelii PKo
GTDDDNGAAFKDEMKK

SEQ ID NO: 171128 - protein, 16 aa, Borrelia afzelii PKo
TDDDNGAAFKDEMKKS

SEQ ID NO: 171129 - protein, 16 aa, Borrelia afzelii PKo
DDDNGAAFKDEMKKSD

SEQ ID NO: 171130 - protein, 16 aa, Borrelia afzelii PKo
DDNGAAFKDEMKKSDK

SEQ ID NO: 171131 - protein, 16 aa, Borrelia afzelii PKo
DNGAAFKDEMKKSDKI

SEQ ID NO: 171132 - protein, 16 aa, Borrelia afzelii PKo
NGAAFKDEMKKSDKIA

SEQ ID NO: 171133 - protein, 16 aa, Borrelia afzelii PKo
GAAFKDEMKKSDKIAA

SEQ ID NO: 171134 - protein, 16 aa, Borrelia afzelii PKo
AAFKDEMKKSDKIAAA

SEQ ID NO: 171135 - protein, 16 aa, Borrelia afzelii PKo
AFKDEMKKSDKIAAAI

SEQ ID NO: 171136 - protein, 16 aa, Borrelia afzelii PKo
FKDEMKKSDKIAAAIV

SEQ ID NO: 171137 - protein, 16 aa, Borrelia afzelii PKo
KDEMKKSDKIAAAIVL

SEQ ID NO: 171138 - protein, 16 aa, Borrelia afzelii PKo
DEMKKSDKIAAAIVLR

SEQ ID NO: 171139 - protein, 16 aa, Borrelia afzelii PKo
EMKKSDKIAAAIVLRG

SEQ ID NO: 171140 - protein, 16 aa, Borrelia afzelii PKo
MKKSDKIAAAIVLRGV

SEQ ID NO: 171141 - protein, 16 aa, Borrelia afzelii PKo
KKSDKIAAAIVLRGVA

SEQ ID NO: 171142 - protein, 16 aa, Borrelia afzelii PKo
KSDKIAAAIVLRGVAK

SEQ ID NO: 171143 - protein, 16 aa, Borrelia afzelii PKo
SDKIAAAIVLRGVAKD

SEQ ID NO: 171144 - protein, 16 aa, Borrelia afzelii PKo
DKIAAAIVLRGVAKDG

SEQ ID NO: 171145 - protein, 16 aa, Borrelia afzelii PKo
KIAAAIVLRGVAKDGK

SEQ ID NO: 171146 - protein, 16 aa, Borrelia afzelii PKo
IAAAIVLRGVAKDGKF

SEQ ID NO: 171147 - protein, 16 aa, Borrelia afzelii PKo
AAAIVLRGVAKDGKFA

SEQ ID NO: 171148 - protein, 16 aa, Borrelia afzelii PKo
AAIVLRGVAKDGKFAV

SEQ ID NO: 171149 - protein, 16 aa, Borrelia afzelii PKo
AIVLRGVAKDGKFAVK

SEQ ID NO: 171150 - protein, 8 aa, Borrelia burgdorferi
MKKSFLSI

SEQ ID NO: 171151 - protein, 8 aa, Borrelia burgdorferi
KSFLSIYM

SEQ ID NO: 171152 - protein, 8 aa, Borrelia burgdorferi
SFLSIYML

SEQ ID NO: 171153 - protein, 8 aa, Borrelia burgdorferi
FLSIYMLI

SEQ ID NO: 171154 - protein, 8 aa, Borrelia burgdorferi
SIYMLISI

SEQ ID NO: 171155 - protein, 8 aa, Borrelia burgdorferi
YMLISISL

SEQ ID NO: 171156 - protein, 8 aa, Borrelia burgdorferi
MLISISLL

SEQ ID NO: 171157 - protein, 8 aa, Borrelia burgdorferi
LLSCDVSR

SEQ ID NO: 171158 - protein, 8 aa, Borrelia burgdorferi
DVSRLNQR

SEQ ID NO: 171159 - protein, 8 aa, Borrelia burgdorferi
NIDELKIF

SEQ ID NO: 171160 - protein, 8 aa, Borrelia burgdorferi
ELKIFVEK

SEQ ID NO: 171161 - protein, 8 aa, Borrelia burgdorferi
KIFVEKAK

SEQ ID NO: 171162 - protein, 8 aa, Borrelia burgdorferi
IFVEKAKY

SEQ ID NO: 171163 - protein, 8 aa, Borrelia burgdorferi
FVEKAKYY

SEQ ID NO: 171164 - protein, 8 aa, Borrelia burgdorferi
EKAKYYSI

SEQ ID NO: 171165 - protein, 8 aa, Borrelia burgdorferi
KAKYYSIK

SEQ ID NO: 171166 - protein, 8 aa, Borrelia burgdorferi
YSIKLDAI

SEQ ID NO: 171167 - protein, 8 aa, Borrelia burgdorferi
SIKLDAIY

SEQ ID NO: 171168 - protein, 8 aa, Borrelia burgdorferi
KLDAIYSE

SEQ ID NO: 171169 - protein, 8 aa, Borrelia burgdorferi
YSEYTGAY

SEQ ID NO: 171170 - protein, 8 aa, Borrelia burgdorferi
AYNDIMTY

SEQ ID NO: 171171 - protein, 8 aa, Borrelia burgdorferi
IMTYIMTY

SEQ ID NO: 171172 - protein, 8 aa, Borrelia burgdorferi
MTYIMTYS

SEQ ID NO: 171173 - protein, 8 aa, Borrelia burgdorferi
GTSSDKSK

SEQ ID NO: 171174 - protein, 8 aa, Borrelia burgdorferi
TSSDKSKV

SEQ ID NO: 171175 - protein, 8 aa, Borrelia burgdorferi
KSKVNQAI

SEQ ID NO: 171176 - protein, 8 aa, Borrelia burgdorferi
KVNQAISI

SEQ ID NO: 171177 - protein, 8 aa, Borrelia burgdorferi
NQAISILK

SEQ ID NO: 171178 - protein, 8 aa, Borrelia burgdorferi
QAISILKK

SEQ ID NO: 171179 - protein, 8 aa, Borrelia burgdorferi
SILKKDNK

SEQ ID NO: 171180 - protein, 8 aa, Borrelia burgdorferi
EEYKPMFL

SEQ ID NO: 171181 - protein, 8 aa, Borrelia burgdorferi
KPMFLSKL

SEQ ID NO: 171182 - protein, 8 aa, Borrelia burgdorferi
PMFLSKLI

SEQ ID NO: 171183 - protein, 8 aa, Borrelia burgdorferi
KLIDDFAI

SEQ ID NO: 171184 - protein, 8 aa, Borrelia burgdorferi
FAIELDQA

SEQ ID NO: 171185 - protein, 8 aa, Borrelia burgdorferi
AIELDQAV

SEQ ID NO: 171186 - protein, 8 aa, Borrelia burgdorferi
DVSNARHV

SEQ ID NO: 171187 - protein, 8 aa, Borrelia burgdorferi
HVADSYEK

SEQ ID NO: 171188 - protein, 8 aa, Borrelia burgdorferi
DSYEKLRK

SEQ ID NO: 171189 - protein, 8 aa, Borrelia burgdorferi
KLRKSVAL

SEQ ID NO: 171190 - protein, 8 aa, Borrelia burgdorferi
KSVALAYI

SEQ ID NO: 171191 - protein, 8 aa, Borrelia burgdorferi
ALAYIESF

SEQ ID NO: 171192 - protein, 8 aa, Borrelia burgdorferi
AYIESFDV

SEQ ID NO: 171193 - protein, 8 aa, Borrelia burgdorferi
YIESFDVI

SEQ ID NO: 171194 - protein, 8 aa, Borrelia burgdorferi
ESFDVISS

SEQ ID NO: 171195 - protein, 8 aa, Borrelia burgdorferi
DVISSKFV

SEQ ID NO: 171196 - protein, 8 aa, Borrelia burgdorferi
SSKFVDSK

SEQ ID NO: 171197 - protein, 8 aa, Borrelia burgdorferi
KFVDSKFV

SEQ ID NO: 171198 - protein, 8 aa, Borrelia burgdorferi
KFVEASKK

SEQ ID NO: 171199 - protein, 8 aa, Borrelia burgdorferi
ASKKFVNK

SEQ ID NO: 171200 - protein, 8 aa, Borrelia burgdorferi
KKFVNKAK

SEQ ID NO: 171201 - protein, 8 aa, Borrelia burgdorferi
FVNKAKEF

SEQ ID NO: 171202 - protein, 8 aa, Borrelia burgdorferi
FVEENDLI

SEQ ID NO: 171203 - protein, 8 aa, Borrelia burgdorferi
EENDLIAL

SEQ ID NO: 171204 - protein, 8 aa, Borrelia burgdorferi
DLIALKCI

SEQ ID NO: 171205 - protein, 8 aa, Borrelia burgdorferi
LIALKCIV

SEQ ID NO: 171206 - protein, 8 aa, Borrelia burgdorferi
IALKCIVK

SEQ ID NO: 171207 - protein, 8 aa, Borrelia burgdorferi
ALKCIVKT

SEQ ID NO: 171208 - protein, 8 aa, Borrelia burgdorferi
REINSRSR

SEQ ID NO: 171209 - protein, 8 aa, Borrelia burgdorferi
EINSRSRY

SEQ ID NO: 171210 - protein, 8 aa, Borrelia burgdorferi
RSRYNNFY

SEQ ID NO: 171211 - protein, 8 aa, Borrelia burgdorferi
SRYNNFYK

SEQ ID NO: 171212 - protein, 8 aa, Borrelia burgdorferi
RYNNFYKK

SEQ ID NO: 171213 - protein, 8 aa, Borrelia burgdorferi
FYKKEADF

SEQ ID NO: 171214 - protein, 8 aa, Borrelia burgdorferi
KEADFLGA

SEQ ID NO: 171215 - protein, 8 aa, Borrelia burgdorferi
EADFLGAA

SEQ ID NO: 171216 - protein, 8 aa, Borrelia burgdorferi
FLGAAVEL

SEQ ID NO: 171217 - protein, 8 aa, Borrelia burgdorferi
AAVELEGA

SEQ ID NO: 171218 - protein, 8 aa, Borrelia burgdorferi
AVELEGAY

SEQ ID NO: 171219 - protein, 8 aa, Borrelia burgdorferi
ELEGAYKA

SEQ ID NO: 171220 - protein, 8 aa, Borrelia burgdorferi
EGAYKAIK

SEQ ID NO: 171221 - protein, 8 aa, Borrelia burgdorferi
YKAIKQTL

SEQ ID NO: 171222 - protein, 8 aa, Borrelia burgdorferi
KAIKQTLL

SEQ ID NO: 171223 - protein, 9 aa, Borrelia burgdorferi
KSFLSIYML

SEQ ID NO: 171224 - protein, 9 aa, Borrelia burgdorferi
SFLSIYMLI

SEQ ID NO: 171225 - protein, 9 aa, Borrelia burgdorferi
FLSIYMLIS

SEQ ID NO: 171226 - protein, 9 aa, Borrelia burgdorferi
LSIYMLISI

SEQ ID NO: 171227 - protein, 9 aa, Borrelia burgdorferi
IYMLISISL

SEQ ID NO: 171228 - protein, 9 aa, Borrelia burgdorferi
YMLISISLL

SEQ ID NO: 171229 - protein, 9 aa, Borrelia burgdorferi
MLISISLLS

SEQ ID NO: 171230 - protein, 9 aa, Borrelia burgdorferi
SISLLSCDV

SEQ ID NO: 171231 - protein, 9 aa, Borrelia burgdorferi
SLLSCDVSR

SEQ ID NO: 171232 - protein, 9 aa, Borrelia burgdorferi
LLSCDVSRL

SEQ ID NO: 171233 - protein, 9 aa, Borrelia burgdorferi
NIDELKIFV

SEQ ID NO: 171234 - protein, 9 aa, Borrelia burgdorferi
KIFVEKAKY

SEQ ID NO: 171235 - protein, 9 aa, Borrelia burgdorferi
EKAKYYSIK

SEQ ID NO: 171236 - protein, 9 aa, Borrelia burgdorferi
YYSIKLDAI

SEQ ID NO: 171237 - protein, 9 aa, Borrelia burgdorferi
YSIKLDAIY

SEQ ID NO: 171238 - protein, 9 aa, Borrelia burgdorferi
KLDAIYSEY

SEQ ID NO: 171239 - protein, 9 aa, Borrelia burgdorferi
AIYSEYTGA

SEQ ID NO: 171240 - protein, 9 aa, Borrelia burgdorferi
IYSEYTGAY

SEQ ID NO: 171241 - protein, 9 aa, Borrelia burgdorferi
EYTGAYNDI

SEQ ID NO: 171242 - protein, 9 aa, Borrelia burgdorferi
YTGAYNDIM

SEQ ID NO: 171243 - protein, 9 aa, Borrelia burgdorferi
GAYNDIMTY

SEQ ID NO: 171244 - protein, 9 aa, Borrelia burgdorferi
AYNDIMTYI

SEQ ID NO: 171245 - protein, 9 aa, Borrelia burgdorferi
YNDIMTYIM

SEQ ID NO: 171246 - protein, 9 aa, Borrelia burgdorferi
DIMTYIMTY

SEQ ID NO: 171247 - protein, 9 aa, Borrelia burgdorferi
IMTYIMTYS

SEQ ID NO: 171248 - protein, 9 aa, Borrelia burgdorferi
MTYIMTYSE

SEQ ID NO: 171249 - protein, 9 aa, Borrelia burgdorferi
YIMTYSEGT

SEQ ID NO: 171250 - protein, 9 aa, Borrelia burgdorferi
YSEGTSSDK

SEQ ID NO: 171251 - protein, 9 aa, Borrelia burgdorferi
KVNQAISIL

SEQ ID NO: 171252 - protein, 9 aa, Borrelia burgdorferi
VNQAISILK

SEQ ID NO: 171253 - protein, 9 aa, Borrelia burgdorferi
NQAISILKK

SEQ ID NO: 171254 - protein, 9 aa, Borrelia burgdorferi
ISILKKDNK

SEQ ID NO: 171255 - protein, 9 aa, Borrelia burgdorferi
ILKKDNKIV

SEQ ID NO: 171256 - protein, 9 aa, Borrelia burgdorferi
KIVNKFKEL

SEQ ID NO: 171257 - protein, 9 aa, Borrelia burgdorferi
ELEKIIEEY

SEQ ID NO: 171258 - protein, 9 aa, Borrelia burgdorferi
KIIEEYKPM

SEQ ID NO: 171259 - protein, 9 aa, Borrelia burgdorferi
IEEYKPMFL

SEQ ID NO: 171260 - protein, 9 aa, Borrelia burgdorferi
EYKPMFLSK

SEQ ID NO: 171261 - protein, 9 aa, Borrelia burgdorferi
KPMFLSKLI

SEQ ID NO: 171262 - protein, 9 aa, Borrelia burgdorferi
FLSKLIDDF

SEQ ID NO: 171263 - protein, 9 aa, Borrelia burgdorferi
KLIDDFAIE

SEQ ID NO: 171264 - protein, 9 aa, Borrelia burgdorferi
LIDDFAIEL

SEQ ID NO: 171265 - protein, 9 aa, Borrelia burgdorferi
FAIELDQAV

SEQ ID NO: 171266 - protein, 9 aa, Borrelia burgdorferi
DVSNARHVA

SEQ ID NO: 171267 - protein, 9 aa, Borrelia burgdorferi
NARHVADSY

SEQ ID NO: 171268 - protein, 9 aa, Borrelia burgdorferi
HVADSYEKL

SEQ ID NO: 171269 - protein, 9 aa, Borrelia burgdorferi
YEKLRKSVA

SEQ ID NO: 171270 - protein, 9 aa, Borrelia burgdorferi
KLRKSVALA

SEQ ID NO: 171271 - protein, 9 aa, Borrelia burgdorferi
VALAYIESF

SEQ ID NO: 171272 - protein, 9 aa, Borrelia burgdorferi
LAYIESFDV

SEQ ID NO: 171273 - protein, 9 aa, Borrelia burgdorferi
AYIESFDVI

SEQ ID NO: 171274 - protein, 9 aa, Borrelia burgdorferi
ESFDVISSK

SEQ ID NO: 171275 - protein, 9 aa, Borrelia burgdorferi
SFDVISSKF

SEQ ID NO: 171276 - protein, 9 aa, Borrelia burgdorferi
ISSKFVDSK

SEQ ID NO: 171277 - protein, 9 aa, Borrelia burgdorferi
FVDSKFVEA

SEQ ID NO: 171278 - protein, 9 aa, Borrelia burgdorferi
DSKFVEASK

SEQ ID NO: 171279 - protein, 9 aa, Borrelia burgdorferi
KFVEASKKF

SEQ ID NO: 171280 - protein, 9 aa, Borrelia burgdorferi
FVEASKKFV

SEQ ID NO: 171281 - protein, 9 aa, Borrelia burgdorferi
EASKKFVNK

SEQ ID NO: 171282 - protein, 9 aa, Borrelia burgdorferi
KFVNKAKEF

SEQ ID NO: 171283 - protein, 9 aa, Borrelia burgdorferi
FVNKAKEFV

SEQ ID NO: 171284 - protein, 9 aa, Borrelia burgdorferi
KEFVEENDL

SEQ ID NO: 171285 - protein, 9 aa, Borrelia burgdorferi
VEENDLIAL

SEQ ID NO: 171286 - protein, 9 aa, Borrelia burgdorferi
EENDLIALK

SEQ ID NO: 171287 - protein, 9 aa, Borrelia burgdorferi
DLIALKCIV

SEQ ID NO: 171288 - protein, 9 aa, Borrelia burgdorferi
LIALKCIVK

SEQ ID NO: 171289 - protein, 9 aa, Borrelia burgdorferi
ALKCIVKTI

SEQ ID NO: 171290 - protein, 9 aa, Borrelia burgdorferi
IVKTIGDMV

SEQ ID NO: 171291 - protein, 9 aa, Borrelia burgdorferi
TIGDMVNDR

SEQ ID NO: 171292 - protein, 9 aa, Borrelia burgdorferi
REINSRSRY

SEQ ID NO: 171293 - protein, 9 aa, Borrelia burgdorferi
RSRYNNFYK

SEQ ID NO: 171294 - protein, 9 aa, Borrelia burgdorferi
SRYNNFYKK

SEQ ID NO: 171295 - protein, 9 aa, Borrelia burgdorferi
NFYKKEADF

SEQ ID NO: 171296 - protein, 9 aa, Borrelia burgdorferi
FYKKEADFL

SEQ ID NO: 171297 - protein, 9 aa, Borrelia burgdorferi
KEADFLGAA

SEQ ID NO: 171298 - protein, 9 aa, Borrelia burgdorferi
EADFLGAAV

SEQ ID NO: 171299 - protein, 9 aa, Borrelia burgdorferi
DFLGAAVEL

SEQ ID NO: 171300 - protein, 9 aa, Borrelia burgdorferi
FLGAAVELE

SEQ ID NO: 171301 - protein, 9 aa, Borrelia burgdorferi
AAVELEGAY

SEQ ID NO: 171302 - protein, 9 aa, Borrelia burgdorferi
AVELEGAYK

SEQ ID NO: 171303 - protein, 9 aa, Borrelia burgdorferi
VELEGAYKA

SEQ ID NO: 171304 - protein, 9 aa, Borrelia burgdorferi
ELEGAYKAI

SEQ ID NO: 171305 - protein, 9 aa, Borrelia burgdorferi
AYKAIKQTL

SEQ ID NO: 171306 - protein, 9 aa, Borrelia burgdorferi
YKAIKQTLL

SEQ ID NO: 171307 - protein, 10 aa, Borrelia burgdorferi
KSFLSIYMLI

SEQ ID NO: 171308 - protein, 10 aa, Borrelia burgdorferi
FLSIYMLISI

SEQ ID NO: 171309 - protein, 10 aa, Borrelia burgdorferi
SIYMLISISL

SEQ ID NO: 171310 - protein, 10 aa, Borrelia burgdorferi
IYMLISISLL

SEQ ID NO: 171311 - protein, 10 aa, Borrelia burgdorferi
YMLISISLLS

SEQ ID NO: 171312 - protein, 10 aa, Borrelia burgdorferi
MLISISLLSC

SEQ ID NO: 171313 - protein, 10 aa, Borrelia burgdorferi
ISLLSCDVSR

SEQ ID NO: 171314 - protein, 10 aa, Borrelia burgdorferi
SLLSCDVSRL

SEQ ID NO: 171315 - protein, 10 aa, Borrelia burgdorferi
RLNQRNIDEL

SEQ ID NO: 171316 - protein, 10 aa, Borrelia burgdorferi
ELKIFVEKAK

SEQ ID NO: 171317 - protein, 10 aa, Borrelia burgdorferi
KIFVEKAKYY

SEQ ID NO: 171318 - protein, 10 aa, Borrelia burgdorferi
FVEKAKYYSI

SEQ ID NO: 171319 - protein, 10 aa, Borrelia burgdorferi
KYYSIKLDAI

SEQ ID NO: 171320 - protein, 10 aa, Borrelia burgdorferi
YYSIKLDAIY

SEQ ID NO: 171321 - protein, 10 aa, Borrelia burgdorferi
KLDAIYSEYT

SEQ ID NO: 171322 - protein, 10 aa, Borrelia burgdorferi
AIYSEYTGAY

SEQ ID NO: 171323 - protein, 10 aa, Borrelia burgdorferi
SEYTGAYNDI

SEQ ID NO: 171324 - protein, 10 aa, Borrelia burgdorferi
TGAYNDIMTY

SEQ ID NO: 171325 - protein, 10 aa, Borrelia burgdorferi
GAYNDIMTYI

SEQ ID NO: 171326 - protein, 10 aa, Borrelia burgdorferi
AYNDIMTYIM

SEQ ID NO: 171327 - protein, 10 aa, Borrelia burgdorferi
DIMTYIMTYS

SEQ ID NO: 171328 - protein, 10 aa, Borrelia burgdorferi
TYSEGTSSDK

SEQ ID NO: 171329 - protein, 10 aa, Borrelia burgdorferi
KVNQAISILK

SEQ ID NO: 171330 - protein, 10 aa, Borrelia burgdorferi
VNQAISILKK

SEQ ID NO: 171331 - protein, 10 aa, Borrelia burgdorferi
AISILKKDNK

SEQ ID NO: 171332 - protein, 10 aa, Borrelia burgdorferi
SILKKDNKIV

SEQ ID NO: 171333 - protein, 10 aa, Borrelia burgdorferi
KDNKIVNKFK

SEQ ID NO: 171334 - protein, 10 aa, Borrelia burgdorferi
IVNKFKELEK

SEQ ID NO: 171335 - protein, 10 aa, Borrelia burgdorferi
KELEKIIEEY

SEQ ID NO: 171336 - protein, 10 aa, Borrelia burgdorferi
ELEKIIEEYK

SEQ ID NO: 171337 - protein, 10 aa, Borrelia burgdorferi
KIIEEYKPMF

SEQ ID NO: 171338 - protein, 10 aa, Borrelia burgdorferi
IIEEYKPMFL

SEQ ID NO: 171339 - protein, 10 aa, Borrelia burgdorferi
EEYKPMFLSK

SEQ ID NO: 171340 - protein, 10 aa, Borrelia burgdorferi
EYKPMFLSKL

SEQ ID NO: 171341 - protein, 10 aa, Borrelia burgdorferi
MFLSKLIDDF

SEQ ID NO: 171342 - protein, 10 aa, Borrelia burgdorferi
FLSKLIDDFA

SEQ ID NO: 171343 - protein, 10 aa, Borrelia burgdorferi
KLIDDFAIEL

SEQ ID NO: 171344 - protein, 10 aa, Borrelia burgdorferi
ELDQAVDNDV

SEQ ID NO: 171345 - protein, 10 aa, Borrelia burgdorferi
AVDNDVSNAR

SEQ ID NO: 171346 - protein, 10 aa, Borrelia burgdorferi
ARHVADSYEK

SEQ ID NO: 171347 - protein, 10 aa, Borrelia burgdorferi
HVADSYEKLR

SEQ ID NO: 171348 - protein, 10 aa, Borrelia burgdorferi
VADSYEKLRK

SEQ ID NO: 171349 - protein, 10 aa, Borrelia burgdorferi
YEKLRKSVAL

SEQ ID NO: 171350 - protein, 10 aa, Borrelia burgdorferi
KLRKSVALAY

SEQ ID NO: 171351 - protein, 10 aa, Borrelia burgdorferi
SVALAYIESF

SEQ ID NO: 171352 - protein, 10 aa, Borrelia burgdorferi
ALAYIESFDV

SEQ ID NO: 171353 - protein, 10 aa, Borrelia burgdorferi
LAYIESFDVI

SEQ ID NO: 171354 - protein, 10 aa, Borrelia burgdorferi
ESFDVISSKF

SEQ ID NO: 171355 - protein, 10 aa, Borrelia burgdorferi
SFDVISSKFV

SEQ ID NO: 171356 - protein, 10 aa, Borrelia burgdorferi
VISSKFVDSK

SEQ ID NO: 171357 - protein, 10 aa, Borrelia burgdorferi
ISSKFVDSKF

SEQ ID NO: 171358 - protein, 10 aa, Borrelia burgdorferi
DSKFVEASKK

SEQ ID NO: 171359 - protein, 10 aa, Borrelia burgdorferi
EASKKFVNKA

SEQ ID NO: 171360 - protein, 10 aa, Borrelia burgdorferi
ASKKFVNKAK

SEQ ID NO: 171361 - protein, 10 aa, Borrelia burgdorferi
KEFVEENDLI

SEQ ID NO: 171362 - protein, 10 aa, Borrelia burgdorferi
FVEENDLIAL

SEQ ID NO: 171363 - protein, 10 aa, Borrelia burgdorferi
EENDLIALKC

SEQ ID NO: 171364 - protein, 10 aa, Borrelia burgdorferi
DLIALKCIVK

SEQ ID NO: 171365 - protein, 10 aa, Borrelia burgdorferi
CIVKTIGDMV

SEQ ID NO: 171366 - protein, 10 aa, Borrelia burgdorferi
KTIGDMVNDR

SEQ ID NO: 171367 - protein, 10 aa, Borrelia burgdorferi
MVNDREINSR

SEQ ID NO: 171368 - protein, 10 aa, Borrelia burgdorferi
NSRSRYNNFY

SEQ ID NO: 171369 - protein, 10 aa, Borrelia burgdorferi
RSRYNNFYKK

SEQ ID NO: 171370 - protein, 10 aa, Borrelia burgdorferi
KEADFLGAAV

SEQ ID NO: 171371 - protein, 10 aa, Borrelia burgdorferi
FLGAAVELEG

SEQ ID NO: 171372 - protein, 10 aa, Borrelia burgdorferi
GAAVELEGAY

SEQ ID NO: 171373 - protein, 10 aa, Borrelia burgdorferi
AAVELEGAYK

SEQ ID NO: 171374 - protein, 10 aa, Borrelia burgdorferi
VELEGAYKAI

SEQ ID NO: 171375 - protein, 10 aa, Borrelia burgdorferi
ELEGAYKAIK

SEQ ID NO: 171376 - protein, 10 aa, Borrelia burgdorferi
GAYKAIKQTL

SEQ ID NO: 171377 - protein, 10 aa, Borrelia burgdorferi
AYKAIKQTLL

SEQ ID NO: 171378 - protein, 11 aa, Borrelia burgdorferi
SFLSIYMLISI

SEQ ID NO: 171379 - protein, 11 aa, Borrelia burgdorferi
FLSIYMLISIS

SEQ ID NO: 171380 - protein, 11 aa, Borrelia burgdorferi
LSIYMLISISL

SEQ ID NO: 171381 - protein, 11 aa, Borrelia burgdorferi
SIYMLISISLL

SEQ ID NO: 171382 - protein, 11 aa, Borrelia burgdorferi
IYMLISISLLS

SEQ ID NO: 171383 - protein, 11 aa, Borrelia burgdorferi
YMLISISLLSC

SEQ ID NO: 171384 - protein, 11 aa, Borrelia burgdorferi
LISISLLSCDV

SEQ ID NO: 171385 - protein, 11 aa, Borrelia burgdorferi
SISLLSCDVSR

SEQ ID NO: 171386 - protein, 11 aa, Borrelia burgdorferi
LSCDVSRLNQR

SEQ ID NO: 171387 - protein, 11 aa, Borrelia burgdorferi
RLNQRNIDELK

SEQ ID NO: 171388 - protein, 11 aa, Borrelia burgdorferi
NQRNIDELKIF

SEQ ID NO: 171389 - protein, 11 aa, Borrelia burgdorferi
NIDELKIFVEK

SEQ ID NO: 171390 - protein, 11 aa, Borrelia burgdorferi
ELKIFVEKAKY

SEQ ID NO: 171391 - protein, 11 aa, Borrelia burgdorferi
FVEKAKYYSIK

SEQ ID NO: 171392 - protein, 11 aa, Borrelia burgdorferi
VEKAKYYSIKL

SEQ ID NO: 171393 - protein, 11 aa, Borrelia burgdorferi
KYYSIKLDAIY

SEQ ID NO: 171394 - protein, 11 aa, Borrelia burgdorferi
SIKLDAIYSEY

SEQ ID NO: 171395 - protein, 11 aa, Borrelia burgdorferi
KLDAIYSEYTG

SEQ ID NO: 171396 - protein, 11 aa, Borrelia burgdorferi
DAIYSEYTGAY

SEQ ID NO: 171397 - protein, 11 aa, Borrelia burgdorferi
SEYTGAYNDIM

SEQ ID NO: 171398 - protein, 11 aa, Borrelia burgdorferi
YTGAYNDIMTY

SEQ ID NO: 171399 - protein, 11 aa, Borrelia burgdorferi
TGAYNDIMTYI

SEQ ID NO: 171400 - protein, 11 aa, Borrelia burgdorferi
GAYNDIMTYIM

SEQ ID NO: 171401 - protein, 11 aa, Borrelia burgdorferi
YNDIMTYIMTY

SEQ ID NO: 171402 - protein, 11 aa, Borrelia burgdorferi
MTYIMTYSEGT

SEQ ID NO: 171403 - protein, 11 aa, Borrelia burgdorferi
YIMTYSEGTSS

SEQ ID NO: 171404 - protein, 11 aa, Borrelia burgdorferi
MTYSEGTSSDK

SEQ ID NO: 171405 - protein, 11 aa, Borrelia burgdorferi
KVNQAISILKK

SEQ ID NO: 171406 - protein, 11 aa, Borrelia burgdorferi
QAISILKKDNK

SEQ ID NO: 171407 - protein, 11 aa, Borrelia burgdorferi
ILKKDNKIVNK

SEQ ID NO: 171408 - protein, 11 aa, Borrelia burgdorferi
KIVNKFKELEK

SEQ ID NO: 171409 - protein, 11 aa, Borrelia burgdorferi
KIIEEYKPMFL

SEQ ID NO: 171410 - protein, 11 aa, Borrelia burgdorferi
EEYKPMFLSKL

SEQ ID NO: 171411 - protein, 11 aa, Borrelia burgdorferi
EYKPMFLSKLI

SEQ ID NO: 171412 - protein, 11 aa, Borrelia burgdorferi
PMFLSKLIDDF

SEQ ID NO: 171413 - protein, 11 aa, Borrelia burgdorferi
FLSKLIDDFAI

SEQ ID NO: 171414 - protein, 11 aa, Borrelia burgdorferi
LIDDFAIELDQ

SEQ ID NO: 171415 - protein, 11 aa, Borrelia burgdorferi
QAVDNDVSNAR

SEQ ID NO: 171416 - protein, 11 aa, Borrelia burgdorferi
VSNARHVADSY

SEQ ID NO: 171417 - protein, 11 aa, Borrelia burgdorferi
NARHVADSYEK

SEQ ID NO: 171418 - protein, 11 aa, Borrelia burgdorferi
HVADSYEKLRK

SEQ ID NO: 171419 - protein, 11 aa, Borrelia burgdorferi
SYEKLRKSVAL

SEQ ID NO: 171420 - protein, 11 aa, Borrelia burgdorferi
KLRKSVALAYI

SEQ ID NO: 171421 - protein, 11 aa, Borrelia burgdorferi
KSVALAYIESF

SEQ ID NO: 171422 - protein, 11 aa, Borrelia burgdorferi
VALAYIESFDV

SEQ ID NO: 171423 - protein, 11 aa, Borrelia burgdorferi
ALAYIESFDVI

SEQ ID NO: 171424 - protein, 11 aa, Borrelia burgdorferi
YIESFDVISSK

SEQ ID NO: 171425 - protein, 11 aa, Borrelia burgdorferi
IESFDVISSKF

SEQ ID NO: 171426 - protein, 11 aa, Borrelia burgdorferi
ESFDVISSKFV

SEQ ID NO: 171427 - protein, 11 aa, Borrelia burgdorferi
DVISSKFVDSK

SEQ ID NO: 171428 - protein, 11 aa, Borrelia burgdorferi
FVDSKFVEASK

SEQ ID NO: 171429 - protein, 11 aa, Borrelia burgdorferi
FVEASKKFVNK

SEQ ID NO: 171430 - protein, 11 aa, Borrelia burgdorferi
EASKKFVNKAK

SEQ ID NO: 171431 - protein, 11 aa, Borrelia burgdorferi
KEFVEENDLIA

SEQ ID NO: 171432 - protein, 11 aa, Borrelia burgdorferi
EFVEENDLIAL

SEQ ID NO: 171433 - protein, 11 aa, Borrelia burgdorferi
FVEENDLIALK

SEQ ID NO: 171434 - protein, 11 aa, Borrelia burgdorferi
EENDLIALKCI

SEQ ID NO: 171435 - protein, 11 aa, Borrelia burgdorferi
LIALKCIVKTI

SEQ ID NO: 171436 - protein, 11 aa, Borrelia burgdorferi
TIGDMVNDREI

SEQ ID NO: 171437 - protein, 11 aa, Borrelia burgdorferi
DMVNDREINSR

SEQ ID NO: 171438 - protein, 11 aa, Borrelia burgdorferi
EINSRSRYNNF

SEQ ID NO: 171439 - protein, 11 aa, Borrelia burgdorferi
NSRSRYNNFYK

SEQ ID NO: 171440 - protein, 11 aa, Borrelia burgdorferi
EADFLGAAVEL

SEQ ID NO: 171441 - protein, 11 aa, Borrelia burgdorferi
FLGAAVELEGA

SEQ ID NO: 171442 - protein, 11 aa, Borrelia burgdorferi
LGAAVELEGAY

SEQ ID NO: 171443 - protein, 11 aa, Borrelia burgdorferi
GAAVELEGAYK

SEQ ID NO: 171444 - protein, 11 aa, Borrelia burgdorferi
EGAYKAIKQTL

SEQ ID NO: 171445 - protein, 11 aa, Borrelia burgdorferi
GAYKAIKQTLL

SEQ ID NO: 171446 - protein, 15 aa, Borrelia burgdorferi
ADFLGAAVELEGAYK

SEQ ID NO: 171447 - protein, 9 aa, Borrelia burgdorferi
FLGAAVELE

SEQ ID NO: 171448 - protein, 15 aa, Borrelia burgdorferi
ADSYEKLRKSVALAY

SEQ ID NO: 171449 - protein, 9 aa, Borrelia burgdorferi
EKLRKSVAL

SEQ ID NO: 171450 - protein, 15 aa, Borrelia burgdorferi
ADSYEKLRKSVALAY

SEQ ID NO: 171451 - protein, 9 aa, Borrelia burgdorferi
YEKLRKSVA

SEQ ID NO: 171452 - protein, 15 aa, Borrelia burgdorferi
AISILKKDNKIVNKF

SEQ ID NO: 171453 - protein, 9 aa, Borrelia burgdorferi
LKKDNKIVN

SEQ ID NO: 171454 - protein, 15 aa, Borrelia burgdorferi
AYIESFDVISSKFVD

SEQ ID NO: 171455 - protein, 9 aa, Borrelia burgdorferi
FDVISSKFV

SEQ ID NO: 171456 - protein, 15 aa, Borrelia burgdorferi
AYNDIMTYIMTYSEG

SEQ ID NO: 171457 - protein, 9 aa, Borrelia burgdorferi
YNDIMTYIM

SEQ ID NO: 171458 - protein, 15 aa, Borrelia burgdorferi
DAIYSEYTGAYNDIM

SEQ ID NO: 171459 - protein, 9 aa, Borrelia burgdorferi
IYSEYTGAY

SEQ ID NO: 171460 - protein, 15 aa, Borrelia burgdorferi
DDFAIELDQAVDNDV

SEQ ID NO: 171461 - protein, 9 aa, Borrelia burgdorferi
FAIELDQAV

SEQ ID NO: 171462 - protein, 15 aa, Borrelia burgdorferi
DFLGAAVELEGAYKA

SEQ ID NO: 171463 - protein, 9 aa, Borrelia burgdorferi
FLGAAVELE

SEQ ID NO: 171464 - protein, 15 aa, Borrelia burgdorferi
DIMTYIMTYSEGTSS

SEQ ID NO: 171465 - protein, 9 aa, Borrelia burgdorferi
IMTYSEGTS

SEQ ID NO: 171466 - protein, 15 aa, Borrelia burgdorferi
DIMTYIMTYSEGTSS

SEQ ID NO: 171467 - protein, 9 aa, Borrelia burgdorferi
YIMTYSEGT

SEQ ID NO: 171468 - protein, 15 aa, Borrelia burgdorferi
DKSKVNQAISILKKD

SEQ ID NO: 171469 - protein, 9 aa, Borrelia burgdorferi
VNQAISILK

SEQ ID NO: 171470 - protein, 15 aa, Borrelia burgdorferi
DLIALKCIVKTIGDM

SEQ ID NO: 171471 - protein, 9 aa, Borrelia burgdorferi
IALKCIVKT

SEQ ID NO: 171472 - protein, 15 aa, Borrelia burgdorferi
DQAVDNDVSNARHVA

SEQ ID NO: 171473 - protein, 9 aa, Borrelia burgdorferi
VDNDVSNAR

SEQ ID NO: 171474 - protein, 15 aa, Borrelia burgdorferi
DSKFVEASKKFVNKA

SEQ ID NO: 171475 - protein, 9 aa, Borrelia burgdorferi
FVEASKKFV

SEQ ID NO: 171476 - protein, 15 aa, Borrelia burgdorferi
DSYEKLRKSVALAYI

SEQ ID NO: 171477 - protein, 9 aa, Borrelia burgdorferi
LRKSVALAY

SEQ ID NO: 171478 - protein, 15 aa, Borrelia burgdorferi
DSYEKLRKSVALAYI

SEQ ID NO: 171479 - protein, 9 aa, Borrelia burgdorferi
YEKLRKSVA

SEQ ID NO: 171480 - protein, 15 aa, Borrelia burgdorferi
EADFLGAAVELEGAY

SEQ ID NO: 171481 - protein, 9 aa, Borrelia burgdorferi
FLGAAVELE

SEQ ID NO: 171482 - protein, 15 aa, Borrelia burgdorferi
EENDLIALKCIVKTI

SEQ ID NO: 171483 - protein, 9 aa, Borrelia burgdorferi
IALKCIVKT

SEQ ID NO: 171484 - protein, 15 aa, Borrelia burgdorferi
EEYKPMFLSKLIDDF

SEQ ID NO: 171485 - protein, 9 aa, Borrelia burgdorferi
YKPMFLSKL

SEQ ID NO: 171486 - protein, 15 aa, Borrelia burgdorferi
EKIIEEYKPMFLSKL

SEQ ID NO: 171487 - protein, 9 aa, Borrelia burgdorferi
IEEYKPMFL

SEQ ID NO: 171488 - protein, 15 aa, Borrelia burgdorferi
EKLRKSVALAYIESF

SEQ ID NO: 171489 - protein, 9 aa, Borrelia burgdorferi
LRKSVALAY

SEQ ID NO: 171490 - protein, 15 aa, Borrelia burgdorferi
ELDQAVDNDVSNARH

SEQ ID NO: 171491 - protein, 9 aa, Borrelia burgdorferi
VDNDVSNAR

SEQ ID NO: 171492 - protein, 15 aa, Borrelia burgdorferi
ELEKIIEEYKPMFLS

SEQ ID NO: 171493 - protein, 9 aa, Borrelia burgdorferi
IEEYKPMFL

SEQ ID NO: 171494 - protein, 15 aa, Borrelia burgdorferi
ENDLIALKCIVKTIG

SEQ ID NO: 171495 - protein, 9 aa, Borrelia burgdorferi
IALKCIVKT

SEQ ID NO: 171496 - protein, 15 aa, Borrelia burgdorferi
ESFDVISSKFVDSKF

SEQ ID NO: 171497 - protein, 9 aa, Borrelia burgdorferi
FDVISSKFV

SEQ ID NO: 171498 - protein, 15 aa, Borrelia burgdorferi
EYKPMFLSKLIDDFA

SEQ ID NO: 171499 - protein, 9 aa, Borrelia burgdorferi
YKPMFLSKL

SEQ ID NO: 171500 - protein, 15 aa, Borrelia burgdorferi
EYTGAYNDIMTYIMT

SEQ ID NO: 171501 - protein, 9 aa, Borrelia burgdorferi
YNDIMTYIM

SEQ ID NO: 171502 - protein, 15 aa, Borrelia burgdorferi
FDVISSKFVDSKFVE

SEQ ID NO: 171503 - protein, 9 aa, Borrelia burgdorferi
FDVISSKFV

SEQ ID NO: 171504 - protein, 15 aa, Borrelia burgdorferi
FLGAAVELEGAYKAI

SEQ ID NO: 171505 - protein, 9 aa, Borrelia burgdorferi
VELEGAYKA

SEQ ID NO: 171506 - protein, 15 aa, Borrelia burgdorferi
FLSIYMLISISLLSC

SEQ ID NO: 171507 - protein, 9 aa, Borrelia burgdorferi
FLSIYMLIS

SEQ ID NO: 171508 - protein, 15 aa, Borrelia burgdorferi
FLSIYMLISISLLSC

SEQ ID NO: 171509 - protein, 9 aa, Borrelia burgdorferi
IYMLISISL

SEQ ID NO: 171510 - protein, 15 aa, Borrelia burgdorferi
FLSIYMLISISLLSC

SEQ ID NO: 171511 - protein, 9 aa, Borrelia burgdorferi
MLISISLLS

SEQ ID NO: 171512 - protein, 15 aa, Borrelia burgdorferi
FVDSKFVEASKKFVN

SEQ ID NO: 171513 - protein, 9 aa, Borrelia burgdorferi
FVEASKKFV

SEQ ID NO: 171514 - protein, 15 aa, Borrelia burgdorferi
GAYNDIMTYIMTYSE

SEQ ID NO: 171515 - protein, 9 aa, Borrelia burgdorferi
YNDIMTYIM

SEQ ID NO: 171516 - protein, 15 aa, Borrelia burgdorferi
IALKCIVKTIGDMVN

SEQ ID NO: 171517 - protein, 9 aa, Borrelia burgdorferi
IALKCIVKT

SEQ ID NO: 171518 - protein, 15 aa, Borrelia burgdorferi
IALKCIVKTIGDMVN

SEQ ID NO: 171519 - protein, 9 aa, Borrelia burgdorferi
LKCIVKTIG

SEQ ID NO: 171520 - protein, 15 aa, Borrelia burgdorferi
IDDFAIELDQAVDND

SEQ ID NO: 171521 - protein, 9 aa, Borrelia burgdorferi
FAIELDQAV

SEQ ID NO: 171522 - protein, 15 aa, Borrelia burgdorferi
IEEYKPMFLSKLIDD

SEQ ID NO: 171523 - protein, 9 aa, Borrelia burgdorferi
YKPMFLSKL

SEQ ID NO: 171524 - protein, 15 aa, Borrelia burgdorferi
IELDQAVDNDVSNAR

SEQ ID NO: 171525 - protein, 9 aa, Borrelia burgdorferi
IELDQAVDN

SEQ ID NO: 171526 - protein, 15 aa, Borrelia burgdorferi
IESFDVISSKFVDSK

SEQ ID NO: 171527 - protein, 9 aa, Borrelia burgdorferi
FDVISSKFV

SEQ ID NO: 171528 - protein, 15 aa, Borrelia burgdorferi
IIEEYKPMFLSKLID

SEQ ID NO: 171529 - protein, 9 aa, Borrelia burgdorferi
YKPMFLSKL

SEQ ID NO: 171530 - protein, 15 aa, Borrelia burgdorferi
IKLDAIYSEYTGAYN

SEQ ID NO: 171531 - protein, 9 aa, Borrelia burgdorferi
IYSEYTGAY

SEQ ID NO: 171532 - protein, 15 aa, Borrelia burgdorferi
IKLDAIYSEYTGAYN

SEQ ID NO: 171533 - protein, 9 aa, Borrelia burgdorferi
LDAIYSEYT

SEQ ID NO: 171534 - protein, 15 aa, Borrelia burgdorferi
IMTYIMTYSEGTSSD

SEQ ID NO: 171535 - protein, 9 aa, Borrelia burgdorferi
IMTYSEGTS

SEQ ID NO: 171536 - protein, 15 aa, Borrelia burgdorferi
IMTYIMTYSEGTSSD

SEQ ID NO: 171537 - protein, 9 aa, Borrelia burgdorferi
YIMTYSEGT

SEQ ID NO: 171538 - protein, 15 aa, Borrelia burgdorferi
ISILKKDNKIVNKFK

SEQ ID NO: 171539 - protein, 9 aa, Borrelia burgdorferi
LKKDNKIVN

SEQ ID NO: 171540 - protein, 15 aa, Borrelia burgdorferi
IYMLISISLLSCDVS

SEQ ID NO: 171541 - protein, 9 aa, Borrelia burgdorferi
IYMLISISL

SEQ ID NO: 171542 - protein, 15 aa, Borrelia burgdorferi
IYMLISISLLSCDVS

SEQ ID NO: 171543 - protein, 9 aa, Borrelia burgdorferi
LISISLLSC

SEQ ID NO: 171544 - protein, 15 aa, Borrelia burgdorferi
IYMLISISLLSCDVS

SEQ ID NO: 171545 - protein, 9 aa, Borrelia burgdorferi
MLISISLLS

SEQ ID NO: 171546 - protein, 15 aa, Borrelia burgdorferi
KEADFLGAAVELEGA

SEQ ID NO: 171547 - protein, 9 aa, Borrelia burgdorferi
FLGAAVELE

SEQ ID NO: 171548 - protein, 15 aa, Borrelia burgdorferi
KELEKIIEEYKPMFL

SEQ ID NO: 171549 - protein, 9 aa, Borrelia burgdorferi
IIEEYKPMF

SEQ ID NO: 171550 - protein, 15 aa, Borrelia burgdorferi
KFVDSKFVEASKKFV

SEQ ID NO: 171551 - protein, 9 aa, Borrelia burgdorferi
FVDSKFVEA

SEQ ID NO: 171552 - protein, 15 aa, Borrelia burgdorferi
KIIEEYKPMFLSKLI

SEQ ID NO: 171553 - protein, 9 aa, Borrelia burgdorferi
IEEYKPMFL

SEQ ID NO: 171554 - protein, 15 aa, Borrelia burgdorferi
KIIEEYKPMFLSKLI

SEQ ID NO: 171555 - protein, 9 aa, Borrelia burgdorferi
YKPMFLSKL

SEQ ID NO: 171556 - protein, 15 aa, Borrelia burgdorferi
KKEADFLGAAVELEG

SEQ ID NO: 171557 - protein, 9 aa, Borrelia burgdorferi
FLGAAVELE

SEQ ID NO: 171558 - protein, 15 aa, Borrelia burgdorferi
KKSFLSIYMLISISL

SEQ ID NO: 171559 - protein, 9 aa, Borrelia burgdorferi
FLSIYMLIS

SEQ ID NO: 171560 - protein, 15 aa, Borrelia burgdorferi
KKSFLSIYMLISISL

SEQ ID NO: 171561 - protein, 9 aa, Borrelia burgdorferi
LSIYMLISI

SEQ ID NO: 171562 - protein, 15 aa, Borrelia burgdorferi
KLDAIYSEYTGAYND

SEQ ID NO: 171563 - protein, 9 aa, Borrelia burgdorferi
IYSEYTGAY

SEQ ID NO: 171564 - protein, 15 aa, Borrelia burgdorferi
KLDAIYSEYTGAYND

SEQ ID NO: 171565 - protein, 9 aa, Borrelia burgdorferi
LDAIYSEYT

SEQ ID NO: 171566 - protein, 15 aa, Borrelia burgdorferi
KLIDDFAIELDQAVD

SEQ ID NO: 171567 - protein, 9 aa, Borrelia burgdorferi
FAIELDQAV

SEQ ID NO: 171568 - protein, 15 aa, Borrelia burgdorferi
KLRKSVALAYIESFD

SEQ ID NO: 171569 - protein, 9 aa, Borrelia burgdorferi
LRKSVALAY

SEQ ID NO: 171570 - protein, 15 aa, Borrelia burgdorferi
KSFLSIYMLISISLL

SEQ ID NO: 171571 - protein, 9 aa, Borrelia burgdorferi
FLSIYMLIS

SEQ ID NO: 171572 - protein, 15 aa, Borrelia burgdorferi
KSFLSIYMLISISLL

SEQ ID NO: 171573 - protein, 9 aa, Borrelia burgdorferi
IYMLISISL

SEQ ID NO: 171574 - protein, 15 aa, Borrelia burgdorferi
KSKVNQAISILKKDN

SEQ ID NO: 171575 - protein, 9 aa, Borrelia burgdorferi
VNQAISILK

SEQ ID NO: 171576 - protein, 15 aa, Borrelia burgdorferi
KVNQAISILKKDNKI

SEQ ID NO: 171577 - protein, 9 aa, Borrelia burgdorferi
VNQAISILK

SEQ ID NO: 171578 - protein, 15 aa, Borrelia burgdorferi
KYYSIKLDAIYSEYT

SEQ ID NO: 171579 - protein, 9 aa, Borrelia burgdorferi
YSIKLDAIY

SEQ ID NO: 171580 - protein, 15 aa, Borrelia burgdorferi
LAYIESFDVISSKFV

SEQ ID NO: 171581 - protein, 9 aa, Borrelia burgdorferi
SFDVISSKF

SEQ ID NO: 171582 - protein, 15 aa, Borrelia burgdorferi
LAYIESFDVISSKFV

SEQ ID NO: 171583 - protein, 9 aa, Borrelia burgdorferi
YIESFDVIS

SEQ ID NO: 171584 - protein, 15 aa, Borrelia burgdorferi
LDAIYSEYTGAYNDI

SEQ ID NO: 171585 - protein, 9 aa, Borrelia burgdorferi
IYSEYTGAY

SEQ ID NO: 171586 - protein, 15 aa, Borrelia burgdorferi
LDAIYSEYTGAYNDI

SEQ ID NO: 171587 - protein, 9 aa, Borrelia burgdorferi
LDAIYSEYT

SEQ ID NO: 171588 - protein, 15 aa, Borrelia burgdorferi
LDQAVDNDVSNARHV

SEQ ID NO: 171589 - protein, 9 aa, Borrelia burgdorferi
VDNDVSNAR

SEQ ID NO: 171590 - protein, 15 aa, Borrelia burgdorferi
LEKIIEEYKPMFLSK

SEQ ID NO: 171591 - protein, 9 aa, Borrelia burgdorferi
IEEYKPMFL

SEQ ID NO: 171592 - protein, 15 aa, Borrelia burgdorferi
LIALKCIVKTIGDMV

SEQ ID NO: 171593 - protein, 9 aa, Borrelia burgdorferi
LKCIVKTIG

SEQ ID NO: 171594 - protein, 15 aa, Borrelia burgdorferi
LIDDFAIELDQAVDN

SEQ ID NO: 171595 - protein, 9 aa, Borrelia burgdorferi
FAIELDQAV

SEQ ID NO: 171596 - protein, 15 aa, Borrelia burgdorferi
LRKSVALAYIESFDV

SEQ ID NO: 171597 - protein, 9 aa, Borrelia burgdorferi
LRKSVALAY

SEQ ID NO: 171598 - protein, 15 aa, Borrelia burgdorferi
LSIYMLISISLLSCD

SEQ ID NO: 171599 - protein, 9 aa, Borrelia burgdorferi
IYMLISISL

SEQ ID NO: 171600 - protein, 15 aa, Borrelia burgdorferi
LSIYMLISISLLSCD

SEQ ID NO: 171601 - protein, 9 aa, Borrelia burgdorferi
MLISISLLS

SEQ ID NO: 171602 - protein, 15 aa, Borrelia burgdorferi
MKKSFLSIYMLISIS

SEQ ID NO: 171603 - protein, 9 aa, Borrelia burgdorferi
FLSIYMLIS

SEQ ID NO: 171604 - protein, 15 aa, Borrelia burgdorferi
MLISISLLSCDVSRL

SEQ ID NO: 171605 - protein, 9 aa, Borrelia burgdorferi
ISLLSCDVS

SEQ ID NO: 171606 - protein, 15 aa, Borrelia burgdorferi
MLISISLLSCDVSRL

SEQ ID NO: 171607 - protein, 9 aa, Borrelia burgdorferi
MLISISLLS

SEQ ID NO: 171608 - protein, 15 aa, Borrelia burgdorferi
MTYIMTYSEGTSSDK

SEQ ID NO: 171609 - protein, 9 aa, Borrelia burgdorferi
YIMTYSEGT

SEQ ID NO: 171610 - protein, 15 aa, Borrelia burgdorferi
MVNDREINSRSRYNN

SEQ ID NO: 171611 - protein, 9 aa, Borrelia burgdorferi
REINSRSRY

SEQ ID NO: 171612 - protein, 15 aa, Borrelia burgdorferi
NDIMTYIMTYSEGTS

SEQ ID NO: 171613 - protein, 9 aa, Borrelia burgdorferi
IMTYIMTYS

SEQ ID NO: 171614 - protein, 15 aa, Borrelia burgdorferi
NDIMTYIMTYSEGTS

SEQ ID NO: 171615 - protein, 9 aa, Borrelia burgdorferi
YIMTYSEGT

SEQ ID NO: 171616 - protein, 15 aa, Borrelia burgdorferi
NDLIALKCIVKTIGD

SEQ ID NO: 171617 - protein, 9 aa, Borrelia burgdorferi
IALKCIVKT

SEQ ID NO: 171618 - protein, 15 aa, Borrelia burgdorferi
NDREINSRSRYNNFY

SEQ ID NO: 171619 - protein, 9 aa, Borrelia burgdorferi
REINSRSRY

SEQ ID NO: 171620 - protein, 15 aa, Borrelia burgdorferi
NQAISILKKDNKIVN

SEQ ID NO: 171621 - protein, 9 aa, Borrelia burgdorferi
ISILKKDNK

SEQ ID NO: 171622 - protein, 15 aa, Borrelia burgdorferi
QAISILKKDNKIVNK

SEQ ID NO: 171623 - protein, 9 aa, Borrelia burgdorferi
ISILKKDNK

SEQ ID NO: 171624 - protein, 15 aa, Borrelia burgdorferi
QAVDNDVSNARHVAD

SEQ ID NO: 171625 - protein, 9 aa, Borrelia burgdorferi
VDNDVSNAR

SEQ ID NO: 171626 - protein, 15 aa, Borrelia burgdorferi
SDKSKVNQAISILKK

SEQ ID NO: 171627 - protein, 9 aa, Borrelia burgdorferi
VNQAISILK

SEQ ID NO: 171628 - protein, 15 aa, Borrelia burgdorferi
SEYTGAYNDIMTYIM

SEQ ID NO: 171629 - protein, 9 aa, Borrelia burgdorferi
AYNDIMTYI

SEQ ID NO: 171630 - protein, 15 aa, Borrelia burgdorferi
SEYTGAYNDIMTYIM

SEQ ID NO: 171631 - protein, 9 aa, Borrelia burgdorferi
YTGAYNDIM

SEQ ID NO: 171632 - protein, 15 aa, Borrelia burgdorferi
SFDVISSKFVDSKFV

SEQ ID NO: 171633 - protein, 9 aa, Borrelia burgdorferi
FDVISSKFV

SEQ ID NO: 171634 - protein, 15 aa, Borrelia burgdorferi
SFLSIYMLISISLLS

SEQ ID NO: 171635 - protein, 9 aa, Borrelia burgdorferi
IYMLISISL

SEQ ID NO: 171636 - protein, 15 aa, Borrelia burgdorferi
SFLSIYMLISISLLS

SEQ ID NO: 171637 - protein, 9 aa, Borrelia burgdorferi
YMLISISLL

SEQ ID NO: 171638 - protein, 15 aa, Borrelia burgdorferi
SIKLDAIYSEYTGAY

SEQ ID NO: 171639 - protein, 9 aa, Borrelia burgdorferi
LDAIYSEYT

SEQ ID NO: 171640 - protein, 15 aa, Borrelia burgdorferi
SIYMLISISLLSCDV

SEQ ID NO: 171641 - protein, 9 aa, Borrelia burgdorferi
IYMLISISL

SEQ ID NO: 171642 - protein, 15 aa, Borrelia burgdorferi
SIYMLISISLLSCDV

SEQ ID NO: 171643 - protein, 9 aa, Borrelia burgdorferi
MLISISLLS

SEQ ID NO: 171644 - protein, 15 aa, Borrelia burgdorferi
SIYMLISISLLSCDV

SEQ ID NO: 171645 - protein, 9 aa, Borrelia burgdorferi
YMLISISLL

SEQ ID NO: 171646 - protein, 15 aa, Borrelia burgdorferi
SKFVEASKKFVNKAK

SEQ ID NO: 171647 - protein, 9 aa, Borrelia burgdorferi
FVEASKKFV

SEQ ID NO: 171648 - protein, 15 aa, Borrelia burgdorferi
SKLIDDFAIELDQAV

SEQ ID NO: 171649 - protein, 9 aa, Borrelia burgdorferi
LIDDFAIEL

SEQ ID NO: 171650 - protein, 15 aa, Borrelia burgdorferi
SKVNQAISILKKDNK

SEQ ID NO: 171651 - protein, 9 aa, Borrelia burgdorferi
VNQAISILK

SEQ ID NO: 171652 - protein, 15 aa, Borrelia burgdorferi
SSDKSKVNQAISILK

SEQ ID NO: 171653 - protein, 9 aa, Borrelia burgdorferi
KVNQAISIL

SEQ ID NO: 171654 - protein, 15 aa, Borrelia burgdorferi
SYEKLRKSVALAYIE

SEQ ID NO: 171655 - protein, 9 aa, Borrelia burgdorferi
LRKSVALAY

SEQ ID NO: 171656 - protein, 15 aa, Borrelia burgdorferi
TGAYNDIMTYIMTYS

SEQ ID NO: 171657 - protein, 9 aa, Borrelia burgdorferi
YNDIMTYIM

SEQ ID NO: 171658 - protein, 15 aa, Borrelia burgdorferi
TYIMTYSEGTSSDKS

SEQ ID NO: 171659 - protein, 9 aa, Borrelia burgdorferi
YIMTYSEGT

SEQ ID NO: 171660 - protein, 15 aa, Borrelia burgdorferi
VDSKFVEASKKFVNK

SEQ ID NO: 171661 - protein, 9 aa, Borrelia burgdorferi
FVEASKKFV

SEQ ID NO: 171662 - protein, 15 aa, Borrelia burgdorferi
VEENDLIALKCIVKT

SEQ ID NO: 171663 - protein, 9 aa, Borrelia burgdorferi
ENDLIALKC

SEQ ID NO: 171664 - protein, 15 aa, Borrelia burgdorferi
VELEGAYKAIKQTLL

SEQ ID NO: 171665 - protein, 9 aa, Borrelia burgdorferi
VELEGAYKA

SEQ ID NO: 171666 - protein, 15 aa, Borrelia burgdorferi
VNDREINSRSRYNNF

SEQ ID NO: 171667 - protein, 9 aa, Borrelia burgdorferi
REINSRSRY

SEQ ID NO: 171668 - protein, 15 aa, Borrelia burgdorferi
VNQAISILKKDNKIV

SEQ ID NO: 171669 - protein, 9 aa, Borrelia burgdorferi
ISILKKDNK

SEQ ID NO: 171670 - protein, 15 aa, Borrelia burgdorferi
YEKLRKSVALAYIES

SEQ ID NO: 171671 - protein, 9 aa, Borrelia burgdorferi
LRKSVALAY

SEQ ID NO: 171672 - protein, 15 aa, Borrelia burgdorferi
YIESFDVISSKFVDS

SEQ ID NO: 171673 - protein, 9 aa, Borrelia burgdorferi
FDVISSKFV

SEQ ID NO: 171674 - protein, 15 aa, Borrelia burgdorferi
YIMTYSEGTSSDKSK

SEQ ID NO: 171675 - protein, 9 aa, Borrelia burgdorferi
YIMTYSEGT

SEQ ID NO: 171676 - protein, 15 aa, Borrelia burgdorferi
YKKEADFLGAAVELE

SEQ ID NO: 171677 - protein, 9 aa, Borrelia burgdorferi
YKKEADFLG

SEQ ID NO: 171678 - protein, 15 aa, Borrelia burgdorferi
YKPMFLSKLIDDFAI

SEQ ID NO: 171679 - protein, 9 aa, Borrelia burgdorferi
YKPMFLSKL

SEQ ID NO: 171680 - protein, 15 aa, Borrelia burgdorferi
YMLISISLLSCDVSR

SEQ ID NO: 171681 - protein, 9 aa, Borrelia burgdorferi
ISLLSCDVS

SEQ ID NO: 171682 - protein, 15 aa, Borrelia burgdorferi
YMLISISLLSCDVSR

SEQ ID NO: 171683 - protein, 9 aa, Borrelia burgdorferi
MLISISLLS

SEQ ID NO: 171684 - protein, 15 aa, Borrelia burgdorferi
YNDIMTYIMTYSEGT

SEQ ID NO: 171685 - protein, 9 aa, Borrelia burgdorferi
DIMTYIMTY

SEQ ID NO: 171686 - protein, 15 aa, Borrelia burgdorferi
YNDIMTYIMTYSEGT

SEQ ID NO: 171687 - protein, 9 aa, Borrelia burgdorferi
IMTYIMTYS

SEQ ID NO: 171688 - protein, 15 aa, Borrelia burgdorferi
YNDIMTYIMTYSEGT

SEQ ID NO: 171689 - protein, 9 aa, Borrelia burgdorferi
YNDIMTYIM

SEQ ID NO: 171690 - protein, 15 aa, Borrelia burgdorferi
YSIKLDAIYSEYTGA

SEQ ID NO: 171691 - protein, 9 aa, Borrelia burgdorferi
LDAIYSEYT

SEQ ID NO: 171692 - protein, 15 aa, Borrelia burgdorferi
YTGAYNDIMTYIMTY

SEQ ID NO: 171693 - protein, 9 aa, Borrelia burgdorferi
YNDIMTYIM

SEQ ID NO: 171694 - protein, 15 aa, Borrelia burgdorferi
YYSIKLDAIYSEYTG

SEQ ID NO: 171695 - protein, 9 aa, Borrelia burgdorferi
LDAIYSEYT

SEQ ID NO: 171696 - protein, 8 aa, Borrelia burgdorferi B31
RLLIGFAL

SEQ ID NO: 171697 - protein, 8 aa, Borrelia burgdorferi B31
LLIGFALA

SEQ ID NO: 171698 - protein, 8 aa, Borrelia burgdorferi B31
LIGFALAL

SEQ ID NO: 171699 - protein, 8 aa, Borrelia burgdorferi B31
FALALALI

SEQ ID NO: 171700 - protein, 8 aa, Borrelia burgdorferi B31
ALALIGCA

SEQ ID NO: 171701 - protein, 8 aa, Borrelia burgdorferi B31
ALIGCAQK

SEQ ID NO: 171702 - protein, 8 aa, Borrelia burgdorferi B31
AQKGAESI

SEQ ID NO: 171703 - protein, 8 aa, Borrelia burgdorferi B31
LPAVTEDS

SEQ ID NO: 171704 - protein, 8 aa, Borrelia burgdorferi B31
VSLFNGNK

SEQ ID NO: 171705 - protein, 8 aa, Borrelia burgdorferi B31
SLFNGNKI

SEQ ID NO: 171706 - protein, 8 aa, Borrelia burgdorferi B31
LFNGNKIF

SEQ ID NO: 171707 - protein, 8 aa, Borrelia burgdorferi B31
KIFVSKEK

SEQ ID NO: 171708 - protein, 8 aa, Borrelia burgdorferi B31
KEKNSSGK

SEQ ID NO: 171709 - protein, 8 aa, Borrelia burgdorferi B31
SSGKYDLR

SEQ ID NO: 171710 - protein, 8 aa, Borrelia burgdorferi B31
KYDLRATI

SEQ ID NO: 171711 - protein, 8 aa, Borrelia burgdorferi B31
ATIDQVEL

SEQ ID NO: 171712 - protein, 8 aa, Borrelia burgdorferi B31
TIDQVELK

SEQ ID NO: 171713 - protein, 8 aa, Borrelia burgdorferi B31
ELKGTSDK

SEQ ID NO: 171714 - protein, 8 aa, Borrelia burgdorferi B31
GSKPDKSK

SEQ ID NO: 171715 - protein, 8 aa, Borrelia burgdorferi B31
KVKLTVSA

SEQ ID NO: 171716 - protein, 8 aa, Borrelia burgdorferi B31
KLTVSADL

SEQ ID NO: 171717 - protein, 8 aa, Borrelia burgdorferi B31
VSADLNTV

SEQ ID NO: 171718 - protein, 8 aa, Borrelia burgdorferi B31
NTVTLEAF

SEQ ID NO: 171719 - protein, 8 aa, Borrelia burgdorferi B31
EAFDASNQ

SEQ ID NO: 171720 - protein, 8 aa, Borrelia burgdorferi B31
NQKISSKV

SEQ ID NO: 171721 - protein, 8 aa, Borrelia burgdorferi B31
KISSKVTK

SEQ ID NO: 171722 - protein, 8 aa, Borrelia burgdorferi B31
ISSKVTKK

SEQ ID NO: 171723 - protein, 8 aa, Borrelia burgdorferi B31
  Xaa can be any naturally occurring amino acid
  VARIANT 4: Xaa = Any Amino Acid
SITXETLK

SEQ ID NO: 171724 - protein, 8 aa, Borrelia burgdorferi B31
ETLKANKL

SEQ ID NO: 171725 - protein, 8 aa, Borrelia burgdorferi B31
KANKLDSK

SEQ ID NO: 171726 - protein, 8 aa, Borrelia burgdorferi B31
KLDSKKLT

SEQ ID NO: 171727 - protein, 8 aa, Borrelia burgdorferi B31
TRSNGTTL

SEQ ID NO: 171728 - protein, 8 aa, Borrelia burgdorferi B31
TTLEYSQI

SEQ ID NO: 171729 - protein, 8 aa, Borrelia burgdorferi B31
ATKAVETL

SEQ ID NO: 171730 - protein, 8 aa, Borrelia burgdorferi B31
ETLKNSIK

SEQ ID NO: 171731 - protein, 8 aa, Borrelia burgdorferi B31
TLKNSIKL

SEQ ID NO: 171732 - protein, 8 aa, Borrelia burgdorferi B31
SIKLEGSL

SEQ ID NO: 171733 - protein, 8 aa, Borrelia burgdorferi B31
IKLEGSLV

SEQ ID NO: 171734 - protein, 8 aa, Borrelia burgdorferi B31
SLVGGKTT

SEQ ID NO: 171735 - protein, 8 aa, Borrelia burgdorferi B31
LVGGKTTV

SEQ ID NO: 171736 - protein, 8 aa, Borrelia burgdorferi B31
IKEGTVTL

SEQ ID NO: 171737 - protein, 8 aa, Borrelia burgdorferi B31
EGTVTLKR

SEQ ID NO: 171738 - protein, 8 aa, Borrelia burgdorferi B31
TLKREIEK

SEQ ID NO: 171739 - protein, 8 aa, Borrelia burgdorferi B31
FLNDTAGS

SEQ ID NO: 171740 - protein, 8 aa, Borrelia burgdorferi B31
DTAGSNKK

SEQ ID NO: 171741 - protein, 8 aa, Borrelia burgdorferi B31
GSNKKTGK

SEQ ID NO: 171742 - protein, 8 aa, Borrelia burgdorferi B31
WEDSTSTL

SEQ ID NO: 171743 - protein, 8 aa, Borrelia burgdorferi B31
TSTLTISA

SEQ ID NO: 171744 - protein, 8 aa, Borrelia burgdorferi B31
LTISADSK

SEQ ID NO: 171745 - protein, 8 aa, Borrelia burgdorferi B31
TISADSKK

SEQ ID NO: 171746 - protein, 8 aa, Borrelia burgdorferi B31
SADSKKTK

SEQ ID NO: 171747 - protein, 8 aa, Borrelia burgdorferi B31
KTKDLVFL

SEQ ID NO: 171748 - protein, 8 aa, Borrelia burgdorferi B31
VFLTDGTI

SEQ ID NO: 171749 - protein, 8 aa, Borrelia burgdorferi B31
FLTDGTIT

SEQ ID NO: 171750 - protein, 8 aa, Borrelia burgdorferi B31
LTDGTITV

SEQ ID NO: 171751 - protein, 8 aa, Borrelia burgdorferi B31
GTITVQQY

SEQ ID NO: 171752 - protein, 8 aa, Borrelia burgdorferi B31
QQYNTAGT

SEQ ID NO: 171753 - protein, 8 aa, Borrelia burgdorferi B31
NTAGTSLE

SEQ ID NO: 171754 - protein, 8 aa, Borrelia burgdorferi B31
EIKNLSEL

SEQ ID NO: 171755 - protein, 8 aa, Borrelia burgdorferi B31
NLSELKNA

SEQ ID NO: 171756 - protein, 9 aa, Borrelia burgdorferi B31
MRLLIGFAL

SEQ ID NO: 171757 - protein, 9 aa, Borrelia burgdorferi B31
RLLIGFALA

SEQ ID NO: 171758 - protein, 9 aa, Borrelia burgdorferi B31
LLIGFALAL

SEQ ID NO: 171759 - protein, 9 aa, Borrelia burgdorferi B31
LIGFALALA

SEQ ID NO: 171760 - protein, 9 aa, Borrelia burgdorferi B31
ALALALIGC

SEQ ID NO: 171761 - protein, 9 aa, Borrelia burgdorferi B31
LALALIGCA

SEQ ID NO: 171762 - protein, 9 aa, Borrelia burgdorferi B31
LALIGCAQK

SEQ ID NO: 171763 - protein, 9 aa, Borrelia burgdorferi B31
GAESIGSQK

SEQ ID NO: 171764 - protein, 9 aa, Borrelia burgdorferi B31
SQKENDLNL

SEQ ID NO: 171765 - protein, 9 aa, Borrelia burgdorferi B31
SKKSHQNAK

SEQ ID NO: 171766 - protein, 9 aa, Borrelia burgdorferi B31
LPAVTEDSV

SEQ ID NO: 171767 - protein, 9 aa, Borrelia burgdorferi B31
AVTEDSVSL

SEQ ID NO: 171768 - protein, 9 aa, Borrelia burgdorferi B31
VTEDSVSLF

SEQ ID NO: 171769 - protein, 9 aa, Borrelia burgdorferi B31
SVSLFNGNK

SEQ ID NO: 171770 - protein, 9 aa, Borrelia burgdorferi B31
SLFNGNKIF

SEQ ID NO: 171771 - protein, 9 aa, Borrelia burgdorferi B31
LFNGNKIFV

SEQ ID NO: 171772 - protein, 9 aa, Borrelia burgdorferi B31
NSSGKYDLR

SEQ ID NO: 171773 - protein, 9 aa, Borrelia burgdorferi B31
DLRATIDQV

SEQ ID NO: 171774 - protein, 9 aa, Borrelia burgdorferi B31
ATIDQVELK

SEQ ID NO: 171775 - protein, 9 aa, Borrelia burgdorferi B31
GSGTLEGSK

SEQ ID NO: 171776 - protein, 9 aa, Borrelia burgdorferi B31
KPDKSKVKL

SEQ ID NO: 171777 - protein, 9 aa, Borrelia burgdorferi B31
TVSADLNTV

SEQ ID NO: 171778 - protein, 9 aa, Borrelia burgdorferi B31
SADLNTVTL

SEQ ID NO: 171779 - protein, 9 aa, Borrelia burgdorferi B31
DLNTVTLEA

SEQ ID NO: 171780 - protein, 9 aa, Borrelia burgdorferi B31
VTLEAFDAS

SEQ ID NO: 171781 - protein, 9 aa, Borrelia burgdorferi B31
EAFDASNQK

SEQ ID NO: 171782 - protein, 9 aa, Borrelia burgdorferi B31
ASNQKISSK

SEQ ID NO: 171783 - protein, 9 aa, Borrelia burgdorferi B31
KISSKVTKK

SEQ ID NO: 171784 - protein, 9 aa, Borrelia burgdorferi B31
  Xaa can be any naturally occurring amino acid
  VARIANT 7: Xaa = Any Amino Acid
KQGSITXET

SEQ ID NO: 171785 - protein, 9 aa, Borrelia burgdorferi B31
  Xaa can be any naturally occurring amino acid
  VARIANT 5: Xaa = Any Amino Acid
GSITXETLK

SEQ ID NO: 171786 - protein, 9 aa, Borrelia burgdorferi B31
  Xaa can be any naturally occurring amino acid
  VARIANT 4: Xaa = Any Amino Acid
SITXETLKA

SEQ ID NO: 171787 - protein, 9 aa, Borrelia burgdorferi B31
KANKLDSKK

SEQ ID NO: 171788 - protein, 9 aa, Borrelia burgdorferi B31
KLDSKKLTR

SEQ ID NO: 171789 - protein, 9 aa, Borrelia burgdorferi B31
LTRSNGTTL

SEQ ID NO: 171790 - protein, 9 aa, Borrelia burgdorferi B31
RSNGTTLEY

SEQ ID NO: 171791 - protein, 9 aa, Borrelia burgdorferi B31
TTLEYSQIT

SEQ ID NO: 171792 - protein, 9 aa, Borrelia burgdorferi B31
SQITDADNA

SEQ ID NO: 171793 - protein, 9 aa, Borrelia burgdorferi B31
ITDADNATK

SEQ ID NO: 171794 - protein, 9 aa, Borrelia burgdorferi B31
DADNATKAV

SEQ ID NO: 171795 - protein, 9 aa, Borrelia burgdorferi B31
ATKAVETLK

SEQ ID NO: 171796 - protein, 9 aa, Borrelia burgdorferi B31
ETLKNSIKL

SEQ ID NO: 171797 - protein, 9 aa, Borrelia burgdorferi B31
SIKLEGSLV

SEQ ID NO: 171798 - protein, 9 aa, Borrelia burgdorferi B31
SLVGGKTTV

SEQ ID NO: 171799 - protein, 9 aa, Borrelia burgdorferi B31
TTVEIKEGT

SEQ ID NO: 171800 - protein, 9 aa, Borrelia burgdorferi B31
EIKEGTVTL

SEQ ID NO: 171801 - protein, 9 aa, Borrelia burgdorferi B31
VTLKREIEK

SEQ ID NO: 171802 - protein, 9 aa, Borrelia burgdorferi B31
GSNKKTGKW

SEQ ID NO: 171803 - protein, 9 aa, Borrelia burgdorferi B31
STSTLTISA

SEQ ID NO: 171804 - protein, 9 aa, Borrelia burgdorferi B31
TLTISADSK

SEQ ID NO: 171805 - protein, 9 aa, Borrelia burgdorferi B31
LTISADSKK

SEQ ID NO: 171806 - protein, 9 aa, Borrelia burgdorferi B31
ISADSKKTK

SEQ ID NO: 171807 - protein, 9 aa, Borrelia burgdorferi B31
KTKDLVFLT

SEQ ID NO: 171808 - protein, 9 aa, Borrelia burgdorferi B31
FLTDGTITV

SEQ ID NO: 171809 - protein, 9 aa, Borrelia burgdorferi B31
VQQYNTAGT

SEQ ID NO: 171810 - protein, 9 aa, Borrelia burgdorferi B31
QYNTAGTSL

SEQ ID NO: 171811 - protein, 9 aa, Borrelia burgdorferi B31
SLEGSASEI

SEQ ID NO: 171812 - protein, 9 aa, Borrelia burgdorferi B31
SEIKNLSEL

SEQ ID NO: 171813 - protein, 9 aa, Borrelia burgdorferi B31
EIKNLSELK

SEQ ID NO: 171814 - protein, 9 aa, Borrelia burgdorferi B31
NLSELKNAL

SEQ ID NO: 171815 - protein, 9 aa, Borrelia burgdorferi B31
LSELKNALK

SEQ ID NO: 171816 - protein, 10 aa, Borrelia burgdorferi B31
RLLIGFALAL

SEQ ID NO: 171817 - protein, 10 aa, Borrelia burgdorferi B31
LLIGFALALA

SEQ ID NO: 171818 - protein, 10 aa, Borrelia burgdorferi B31
LIGFALALAL

SEQ ID NO: 171819 - protein, 10 aa, Borrelia burgdorferi B31
IGFALALALI

SEQ ID NO: 171820 - protein, 10 aa, Borrelia burgdorferi B31
FALALALIGC

SEQ ID NO: 171821 - protein, 10 aa, Borrelia burgdorferi B31
ALALALIGCA

SEQ ID NO: 171822 - protein, 10 aa, Borrelia burgdorferi B31
ALALIGCAQK

SEQ ID NO: 171823 - protein, 10 aa, Borrelia burgdorferi B31
ALIGCAQKGA

SEQ ID NO: 171824 - protein, 10 aa, Borrelia burgdorferi B31
DLNLEDSSKK

SEQ ID NO: 171825 - protein, 10 aa, Borrelia burgdorferi B31
SSKKSHQNAK

SEQ ID NO: 171826 - protein, 10 aa, Borrelia burgdorferi B31
DLPAVTEDSV

SEQ ID NO: 171827 - protein, 10 aa, Borrelia burgdorferi B31
LPAVTEDSVS

SEQ ID NO: 171828 - protein, 10 aa, Borrelia burgdorferi B31
AVTEDSVSLF

SEQ ID NO: 171829 - protein, 10 aa, Borrelia burgdorferi B31
DSVSLFNGNK

SEQ ID NO: 171830 - protein, 10 aa, Borrelia burgdorferi B31
SVSLFNGNKI

SEQ ID NO: 171831 - protein, 10 aa, Borrelia burgdorferi B31
VSLFNGNKIF

SEQ ID NO: 171832 - protein, 10 aa, Borrelia burgdorferi B31
SLFNGNKIFV

SEQ ID NO: 171833 - protein, 10 aa, Borrelia burgdorferi B31
VSKEKNSSGK

SEQ ID NO: 171834 - protein, 10 aa, Borrelia burgdorferi B31
RATIDQVELK

SEQ ID NO: 171835 - protein, 10 aa, Borrelia burgdorferi B31
GTLEGSKPDK

SEQ ID NO: 171836 - protein, 10 aa, Borrelia burgdorferi B31
GSKPDKSKVK

SEQ ID NO: 171837 - protein, 10 aa, Borrelia burgdorferi B31
LTVSADLNTV

SEQ ID NO: 171838 - protein, 10 aa, Borrelia burgdorferi B31
DLNTVTLEAF

SEQ ID NO: 171839 - protein, 10 aa, Borrelia burgdorferi B31
EAFDASNQKI

SEQ ID NO: 171840 - protein, 10 aa, Borrelia burgdorferi B31
DASNQKISSK

SEQ ID NO: 171841 - protein, 10 aa, Borrelia burgdorferi B31
  Xaa can be any naturally occurring amino acid
  VARIANT 7: Xaa = Any Amino Acid
KQGSITXETL

SEQ ID NO: 171842 - protein, 10 aa, Borrelia burgdorferi B31
  Xaa can be any naturally occurring amino acid
  VARIANT 3: Xaa = Any Amino Acid
ITXETLKANK

SEQ ID NO: 171843 - protein, 10 aa, Borrelia burgdorferi B31
TLKANKLDSK

SEQ ID NO: 171844 - protein, 10 aa, Borrelia burgdorferi B31
KLDSKKLTRS

SEQ ID NO: 171845 - protein, 10 aa, Borrelia burgdorferi B31
KLTRSNGTTL

SEQ ID NO: 171846 - protein, 10 aa, Borrelia burgdorferi B31
SQITDADNAT

SEQ ID NO: 171847 - protein, 10 aa, Borrelia burgdorferi B31
QITDADNATK

SEQ ID NO: 171848 - protein, 10 aa, Borrelia burgdorferi B31
NATKAVETLK

SEQ ID NO: 171849 - protein, 10 aa, Borrelia burgdorferi B31
KAVETLKNSI

SEQ ID NO: 171850 - protein, 10 aa, Borrelia burgdorferi B31
AVETLKNSIK

SEQ ID NO: 171851 - protein, 10 aa, Borrelia burgdorferi B31
VETLKNSIKL

SEQ ID NO: 171852 - protein, 10 aa, Borrelia burgdorferi B31
NSIKLEGSLV

SEQ ID NO: 171853 - protein, 10 aa, Borrelia burgdorferi B31
KLEGSLVGGK

SEQ ID NO: 171854 - protein, 10 aa, Borrelia burgdorferi B31
SLVGGKTTVE

SEQ ID NO: 171855 - protein, 10 aa, Borrelia burgdorferi B31
LVGGKTTVEI

SEQ ID NO: 171856 - protein, 10 aa, Borrelia burgdorferi B31
TTVEIKEGTV

SEQ ID NO: 171857 - protein, 10 aa, Borrelia burgdorferi B31
VEIKEGTVTL

SEQ ID NO: 171858 - protein, 10 aa, Borrelia burgdorferi B31
EIKEGTVTLK

SEQ ID NO: 171859 - protein, 10 aa, Borrelia burgdorferi B31
TVTLKREIEK

SEQ ID NO: 171860 - protein, 10 aa, Borrelia burgdorferi B31
EIEKDGKVKV

SEQ ID NO: 171861 - protein, 10 aa, Borrelia burgdorferi B31
IEKDGKVKVF

SEQ ID NO: 171862 - protein, 10 aa, Borrelia burgdorferi B31
FLNDTAGSNK

SEQ ID NO: 171863 - protein, 10 aa, Borrelia burgdorferi B31
TAGSNKKTGK

SEQ ID NO: 171864 - protein, 10 aa, Borrelia burgdorferi B31
WEDSTSTLTI

SEQ ID NO: 171865 - protein, 10 aa, Borrelia burgdorferi B31
STLTISADSK

SEQ ID NO: 171866 - protein, 10 aa, Borrelia burgdorferi B31
TLTISADSKK

SEQ ID NO: 171867 - protein, 10 aa, Borrelia burgdorferi B31
TISADSKKTK

SEQ ID NO: 171868 - protein, 10 aa, Borrelia burgdorferi B31
VFLTDGTITV

SEQ ID NO: 171869 - protein, 10 aa, Borrelia burgdorferi B31
FLTDGTITVQ

SEQ ID NO: 171870 - protein, 10 aa, Borrelia burgdorferi B31
QQYNTAGTSL

SEQ ID NO: 171871 - protein, 10 aa, Borrelia burgdorferi B31
NTAGTSLEGS

SEQ ID NO: 171872 - protein, 10 aa, Borrelia burgdorferi B31
SLEGSASEIK

SEQ ID NO: 171873 - protein, 10 aa, Borrelia burgdorferi B31
NLSELKNALK

SEQ ID NO: 171874 - protein, 11 aa, Borrelia burgdorferi B31
MRLLIGFALAL

SEQ ID NO: 171875 - protein, 11 aa, Borrelia burgdorferi B31
RLLIGFALALA

SEQ ID NO: 171876 - protein, 11 aa, Borrelia burgdorferi B31
LLIGFALALAL

SEQ ID NO: 171877 - protein, 11 aa, Borrelia burgdorferi B31
LIGFALALALI

SEQ ID NO: 171878 - protein, 11 aa, Borrelia burgdorferi B31
FALALALIGCA

SEQ ID NO: 171879 - protein, 11 aa, Borrelia burgdorferi B31
ALALALIGCAQ

SEQ ID NO: 171880 - protein, 11 aa, Borrelia burgdorferi B31
LALALIGCAQK

SEQ ID NO: 171881 - protein, 11 aa, Borrelia burgdorferi B31
DSSKKSHQNAK

SEQ ID NO: 171882 - protein, 11 aa, Borrelia burgdorferi B31
HQNAKQDLPAV

SEQ ID NO: 171883 - protein, 11 aa, Borrelia burgdorferi B31
LPAVTEDSVSL

SEQ ID NO: 171884 - protein, 11 aa, Borrelia burgdorferi B31
DSVSLFNGNKI

SEQ ID NO: 171885 - protein, 11 aa, Borrelia burgdorferi B31
SVSLFNGNKIF

SEQ ID NO: 171886 - protein, 11 aa, Borrelia burgdorferi B31
SLFNGNKIFVS

SEQ ID NO: 171887 - protein, 11 aa, Borrelia burgdorferi B31
LFNGNKIFVSK

SEQ ID NO: 171888 - protein, 11 aa, Borrelia burgdorferi B31
FVSKEKNSSGK

SEQ ID NO: 171889 - protein, 11 aa, Borrelia burgdorferi B31
VSKEKNSSGKY

SEQ ID NO: 171890 - protein, 11 aa, Borrelia burgdorferi B31
KEKNSSGKYDL

SEQ ID NO: 171891 - protein, 11 aa, Borrelia burgdorferi B31
DLRATIDQVEL

SEQ ID NO: 171892 - protein, 11 aa, Borrelia burgdorferi B31
KPDKSKVKLTV

SEQ ID NO: 171893 - protein, 11 aa, Borrelia burgdorferi B31
KLTVSADLNTV

SEQ ID NO: 171894 - protein, 11 aa, Borrelia burgdorferi B31
TVSADLNTVTL

SEQ ID NO: 171895 - protein, 11 aa, Borrelia burgdorferi B31
TLEAFDASNQK

SEQ ID NO: 171896 - protein, 11 aa, Borrelia burgdorferi B31
DASNQKISSKV

SEQ ID NO: 171897 - protein, 11 aa, Borrelia burgdorferi B31
  Xaa can be any naturally occurring amino acid
  VARIANT 7: Xaa = Any Amino Acid
KQGSITXETLK

SEQ ID NO: 171898 - protein, 11 aa, Borrelia burgdorferi B31
  Xaa can be any naturally occurring amino acid
  VARIANT 4: Xaa = Any Amino Acid
SITXETLKANK

SEQ ID NO: 171899 - protein, 11 aa, Borrelia burgdorferi B31
ETLKANKLDSK

SEQ ID NO: 171900 - protein, 11 aa, Borrelia burgdorferi B31
TLKANKLDSKK

SEQ ID NO: 171901 - protein, 11 aa, Borrelia burgdorferi B31
LTRSNGTTLEY

SEQ ID NO: 171902 - protein, 11 aa, Borrelia burgdorferi B31
TTLEYSQITDA

SEQ ID NO: 171903 - protein, 11 aa, Borrelia burgdorferi B31
SQITDADNATK

SEQ ID NO: 171904 - protein, 11 aa, Borrelia burgdorferi B31
ITDADNATKAV

SEQ ID NO: 171905 - protein, 11 aa, Borrelia burgdorferi B31
DNATKAVETLK

SEQ ID NO: 171906 - protein, 11 aa, Borrelia burgdorferi B31
KAVETLKNSIK

SEQ ID NO: 171907 - protein, 11 aa, Borrelia burgdorferi B31
EGSLVGGKTTV

SEQ ID NO: 171908 - protein, 11 aa, Borrelia burgdorferi B31
SLVGGKTTVEI

SEQ ID NO: 171909 - protein, 11 aa, Borrelia burgdorferi B31
LVGGKTTVEIK

SEQ ID NO: 171910 - protein, 11 aa, Borrelia burgdorferi B31
EIKEGTVTLKR

SEQ ID NO: 171911 - protein, 11 aa, Borrelia burgdorferi B31
GTVTLKREIEK

SEQ ID NO: 171912 - protein, 11 aa, Borrelia burgdorferi B31
EIEKDGKVKVF

SEQ ID NO: 171913 - protein, 11 aa, Borrelia burgdorferi B31
IEKDGKVKVFL

SEQ ID NO: 171914 - protein, 11 aa, Borrelia burgdorferi B31
VFLNDTAGSNK

SEQ ID NO: 171915 - protein, 11 aa, Borrelia burgdorferi B31
FLNDTAGSNKK

SEQ ID NO: 171916 - protein, 11 aa, Borrelia burgdorferi B31
DTAGSNKKTGK

SEQ ID NO: 171917 - protein, 11 aa, Borrelia burgdorferi B31
KWEDSTSTLTI

SEQ ID NO: 171918 - protein, 11 aa, Borrelia burgdorferi B31
TSTLTISADSK

SEQ ID NO: 171919 - protein, 11 aa, Borrelia burgdorferi B31
STLTISADSKK

SEQ ID NO: 171920 - protein, 11 aa, Borrelia burgdorferi B31
LTISADSKKTK

SEQ ID NO: 171921 - protein, 11 aa, Borrelia burgdorferi B31
SADSKKTKDLV

SEQ ID NO: 171922 - protein, 11 aa, Borrelia burgdorferi B31
LVFLTDGTITV

SEQ ID NO: 171923 - protein, 11 aa, Borrelia burgdorferi B31
FLTDGTITVQQ

SEQ ID NO: 171924 - protein, 11 aa, Borrelia burgdorferi B31
LTDGTITVQQY

SEQ ID NO: 171925 - protein, 11 aa, Borrelia burgdorferi B31
VQQYNTAGTSL

SEQ ID NO: 171926 - protein, 11 aa, Borrelia burgdorferi B31
NTAGTSLEGSA

SEQ ID NO: 171927 - protein, 11 aa, Borrelia burgdorferi B31
TSLEGSASEIK

SEQ ID NO: 171928 - protein, 11 aa, Borrelia burgdorferi B31
LEGSASEIKNL

SEQ ID NO: 171929 - protein, 11 aa, Borrelia burgdorferi B31
SASEIKNLSEL

SEQ ID NO: 171930 - protein, 11 aa, Borrelia burgdorferi B31
ASEIKNLSELK

SEQ ID NO: 171931 - protein, 15 aa, Borrelia burgdorferi B31
ALIGCAQKGAESIGS

SEQ ID NO: 171932 - protein, 9 aa, Borrelia burgdorferi B31
LIGCAQKGA

SEQ ID NO: 171933 - protein, 15 aa, Borrelia burgdorferi B31
ANKLDSKKLTRSNGT

SEQ ID NO: 171934 - protein, 9 aa, Borrelia burgdorferi B31
LDSKKLTRS

SEQ ID NO: 171935 - protein, 15 aa, Borrelia burgdorferi B31
ASEIKNLSELKNALK

SEQ ID NO: 171936 - protein, 9 aa, Borrelia burgdorferi B31
IKNLSELKN

SEQ ID NO: 171937 - protein, 15 aa, Borrelia burgdorferi B31
ASNQKISSKVTKKQG

SEQ ID NO: 171938 - protein, 9 aa, Borrelia burgdorferi B31
ISSKVTKKQ

SEQ ID NO: 171939 - protein, 15 aa, Borrelia burgdorferi B31
AVETLKNSIKLEGSL

SEQ ID NO: 171940 - protein, 9 aa, Borrelia burgdorferi B31
LKNSIKLEG

SEQ ID NO: 171941 - protein, 15 aa, Borrelia burgdorferi B31
DASNQKISSKVTKKQ

SEQ ID NO: 171942 - protein, 9 aa, Borrelia burgdorferi B31
NQKISSKVT

SEQ ID NO: 171943 - protein, 15 aa, Borrelia burgdorferi B31
DGKVKVFLNDTAGSN

SEQ ID NO: 171944 - protein, 9 aa, Borrelia burgdorferi B31
VKVFLNDTA

SEQ ID NO: 171945 - protein, 15 aa, Borrelia burgdorferi B31
DGTITVQQYNTAGTS

SEQ ID NO: 171946 - protein, 9 aa, Borrelia burgdorferi B31
VQQYNTAGT

SEQ ID NO: 171947 - protein, 15 aa, Borrelia burgdorferi B31
DKSKVKLTVSADLNT

SEQ ID NO: 171948 - protein, 9 aa, Borrelia burgdorferi B31
VKLTVSADL

SEQ ID NO: 171949 - protein, 15 aa, Borrelia burgdorferi B31
DLVFLTDGTITVQQY

SEQ ID NO: 171950 - protein, 9 aa, Borrelia burgdorferi B31
FLTDGTITV

SEQ ID NO: 171951 - protein, 15 aa, Borrelia burgdorferi B31
DSVSLFNGNKIFVSK

SEQ ID NO: 171952 - protein, 9 aa, Borrelia burgdorferi B31
VSLFNGNKI

SEQ ID NO: 171953 - protein, 15 aa, Borrelia burgdorferi B31
EDSVSLFNGNKIFVS

SEQ ID NO: 171954 - protein, 9 aa, Borrelia burgdorferi B31
VSLFNGNKI

SEQ ID NO: 171955 - protein, 15 aa, Borrelia burgdorferi B31
EGSASEIKNLSELKN

SEQ ID NO: 171956 - protein, 9 aa, Borrelia burgdorferi B31
SASEIKNLS

SEQ ID NO: 171957 - protein, 15 aa, Borrelia burgdorferi B31
EGSLVGGKTTVEIKE

SEQ ID NO: 171958 - protein, 9 aa, Borrelia burgdorferi B31
VGGKTTVEI

SEQ ID NO: 171959 - protein, 15 aa, Borrelia burgdorferi B31
ETLKNSIKLEGSLVG

SEQ ID NO: 171960 - protein, 9 aa, Borrelia burgdorferi B31
KNSIKLEGS

SEQ ID NO: 171961 - protein, 15 aa, Borrelia burgdorferi B31
ETLKNSIKLEGSLVG

SEQ ID NO: 171962 - protein, 9 aa, Borrelia burgdorferi B31
LKNSIKLEG

SEQ ID NO: 171963 - protein, 15 aa, Borrelia burgdorferi B31
FALALALIGCAQKGA

SEQ ID NO: 171964 - protein, 9 aa, Borrelia burgdorferi B31
FALALALIG

SEQ ID NO: 171965 - protein, 15 aa, Borrelia burgdorferi B31
FLTDGTITVQQYNTA

SEQ ID NO: 171966 - protein, 9 aa, Borrelia burgdorferi B31
FLTDGTITV

SEQ ID NO: 171967 - protein, 15 aa, Borrelia burgdorferi B31
FNGNKIFVSKEKNSS

SEQ ID NO: 171968 - protein, 9 aa, Borrelia burgdorferi B31
FNGNKIFVS

SEQ ID NO: 171969 - protein, 15 aa, Borrelia burgdorferi B31
GFALALALIGCAQKG

SEQ ID NO: 171970 - protein, 9 aa, Borrelia burgdorferi B31
FALALALIG

SEQ ID NO: 171971 - protein, 15 aa, Borrelia burgdorferi B31
GKVKVFLNDTAGSNK

SEQ ID NO: 171972 - protein, 9 aa, Borrelia burgdorferi B31
VKVFLNDTA

SEQ ID NO: 171973 - protein, 15 aa, Borrelia burgdorferi B31
GKWEDSTSTLTISAD

SEQ ID NO: 171974 - protein, 9 aa, Borrelia burgdorferi B31
WEDSTSTLT

SEQ ID NO: 171975 - protein, 15 aa, Borrelia burgdorferi B31
GNKIFVSKEKNSSGK

SEQ ID NO: 171976 - protein, 9 aa, Borrelia burgdorferi B31
FVSKEKNSS

SEQ ID NO: 171977 - protein, 15 aa, Borrelia burgdorferi B31
GSASEIKNLSELKNA

SEQ ID NO: 171978 - protein, 9 aa, Borrelia burgdorferi B31
IKNLSELKN

SEQ ID NO: 171979 - protein, 15 aa, Borrelia burgdorferi B31
  Xaa can be any naturally occurring amino acid
  VARIANT 5: Xaa = Any Amino Acid
GSITXETLKANKLDS

SEQ ID NO: 171980 - protein, 9 aa, Borrelia burgdorferi B31
  Xaa can be any naturally occurring amino acid
  VARIANT 1: Xaa = Any Amino Acid
XETLKANKL

SEQ ID NO: 171981 - protein, 15 aa, Borrelia burgdorferi B31
GSLVGGKTTVEIKEG

SEQ ID NO: 171982 - protein, 9 aa, Borrelia burgdorferi B31
VGGKTTVEI

SEQ ID NO: 171983 - protein, 15 aa, Borrelia burgdorferi B31
GTITVQQYNTAGTSL

SEQ ID NO: 171984 - protein, 9 aa, Borrelia burgdorferi B31
VQQYNTAGT

SEQ ID NO: 171985 - protein, 15 aa, Borrelia burgdorferi B31
IGFALALALIGCAQK

SEQ ID NO: 171986 - protein, 9 aa, Borrelia burgdorferi B31
FALALALIG

SEQ ID NO: 171987 - protein, 15 aa, Borrelia burgdorferi B31
IKLEGSLVGGKTTVE

SEQ ID NO: 171988 - protein, 9 aa, Borrelia burgdorferi B31
IKLEGSLVG

SEQ ID NO: 171989 - protein, 15 aa, Borrelia burgdorferi B31
ITVQQYNTAGTSLEG

SEQ ID NO: 171990 - protein, 9 aa, Borrelia burgdorferi B31
VQQYNTAGT

SEQ ID NO: 171991 - protein, 15 aa, Borrelia burgdorferi B31
ITVQQYNTAGTSLEG

SEQ ID NO: 171992 - protein, 9 aa, Borrelia burgdorferi B31
YNTAGTSLE

SEQ ID NO: 171993 - protein, 15 aa, Borrelia burgdorferi B31
KANKLDSKKLTRSNG

SEQ ID NO: 171994 - protein, 9 aa, Borrelia burgdorferi B31
LDSKKLTRS

SEQ ID NO: 171995 - protein, 15 aa, Borrelia burgdorferi B31
KAVETLKNSIKLEGS

SEQ ID NO: 171996 - protein, 9 aa, Borrelia burgdorferi B31
LKNSIKLEG

SEQ ID NO: 171997 - protein, 15 aa, Borrelia burgdorferi B31
KDGKVKVFLNDTAGS

SEQ ID NO: 171998 - protein, 9 aa, Borrelia burgdorferi B31
VKVFLNDTA

SEQ ID NO: 171999 - protein, 15 aa, Borrelia burgdorferi B31
KDLVFLTDGTITVQQ

SEQ ID NO: 172000 - protein, 9 aa, Borrelia burgdorferi B31
FLTDGTITV

SEQ ID NO: 172001 - protein, 15 aa, Borrelia burgdorferi B31
KIFVSKEKNSSGKYD

SEQ ID NO: 172002 - protein, 9 aa, Borrelia burgdorferi B31
FVSKEKNSS

SEQ ID NO: 172003 - protein, 15 aa, Borrelia burgdorferi B31
KKTGKWEDSTSTLTI

SEQ ID NO: 172004 - protein, 9 aa, Borrelia burgdorferi B31
WEDSTSTLT

SEQ ID NO: 172005 - protein, 15 aa, Borrelia burgdorferi B31
KLEGSLVGGKTTVEI

SEQ ID NO: 172006 - protein, 9 aa, Borrelia burgdorferi B31
LVGGKTTVE

SEQ ID NO: 172007 - protein, 15 aa, Borrelia burgdorferi B31
KLTVSADLNTVTLEA

SEQ ID NO: 172008 - protein, 9 aa, Borrelia burgdorferi B31
VSADLNTVT

SEQ ID NO: 172009 - protein, 15 aa, Borrelia burgdorferi B31
KNSIKLEGSLVGGKT

SEQ ID NO: 172010 - protein, 9 aa, Borrelia burgdorferi B31
IKLEGSLVG

SEQ ID NO: 172011 - protein, 15 aa, Borrelia burgdorferi B31
KPDKSKVKLTVSADL

SEQ ID NO: 172012 - protein, 9 aa, Borrelia burgdorferi B31
SKVKLTVSA

SEQ ID NO: 172013 - protein, 15 aa, Borrelia burgdorferi B31
  Xaa can be any naturally occurring amino acid
  VARIANT 7: Xaa = Any Amino Acid
KQGSITXETLKANKL

SEQ ID NO: 172014 - protein, 9 aa, Borrelia burgdorferi B31
  Xaa can be any naturally occurring amino acid
  VARIANT 3: Xaa = Any Amino Acid
ITXETLKAN

SEQ ID NO: 172015 - protein, 15 aa, Borrelia burgdorferi B31
KSKVKLTVSADLNTV

SEQ ID NO: 172016 - protein, 9 aa, Borrelia burgdorferi B31
VKLTVSADL

SEQ ID NO: 172017 - protein, 15 aa, Borrelia burgdorferi B31
KTGKWEDSTSTLTIS

SEQ ID NO: 172018 - protein, 9 aa, Borrelia burgdorferi B31
WEDSTSTLT

SEQ ID NO: 172019 - protein, 15 aa, Borrelia burgdorferi B31
KTKDLVFLTDGTITV

SEQ ID NO: 172020 - protein, 9 aa, Borrelia burgdorferi B31
VFLTDGTIT

SEQ ID NO: 172021 - protein, 15 aa, Borrelia burgdorferi B31
KVKLTVSADLNTVTL

SEQ ID NO: 172022 - protein, 9 aa, Borrelia burgdorferi B31
LTVSADLNT

SEQ ID NO: 172023 - protein, 15 aa, Borrelia burgdorferi B31
KVKVFLNDTAGSNKK

SEQ ID NO: 172024 - protein, 9 aa, Borrelia burgdorferi B31
FLNDTAGSN

SEQ ID NO: 172025 - protein, 15 aa, Borrelia burgdorferi B31
KWEDSTSTLTISADS

SEQ ID NO: 172026 - protein, 9 aa, Borrelia burgdorferi B31
WEDSTSTLT

SEQ ID NO: 172027 - protein, 15 aa, Borrelia burgdorferi B31
LDSKKLTRSNGTTLE

SEQ ID NO: 172028 - protein, 9 aa, Borrelia burgdorferi B31
LTRSNGTTL

SEQ ID NO: 172029 - protein, 15 aa, Borrelia burgdorferi B31
LEGSLVGGKTTVEIK

SEQ ID NO: 172030 - protein, 9 aa, Borrelia burgdorferi B31
VGGKTTVEI

SEQ ID NO: 172031 - protein, 15 aa, Borrelia burgdorferi B31
LIGFALALALIGCAQ

SEQ ID NO: 172032 - protein, 9 aa, Borrelia burgdorferi B31
FALALALIG

SEQ ID NO: 172033 - protein, 15 aa, Borrelia burgdorferi B31
LKANKLDSKKLTRSN

SEQ ID NO: 172034 - protein, 9 aa, Borrelia burgdorferi B31
LDSKKLTRS

SEQ ID NO: 172035 - protein, 15 aa, Borrelia burgdorferi B31
LKNSIKLEGSLVGGK

SEQ ID NO: 172036 - protein, 9 aa, Borrelia burgdorferi B31
IKLEGSLVG

SEQ ID NO: 172037 - protein, 15 aa, Borrelia burgdorferi B31
LKNSIKLEGSLVGGK

SEQ ID NO: 172038 - protein, 9 aa, Borrelia burgdorferi B31
LKNSIKLEG

SEQ ID NO: 172039 - protein, 15 aa, Borrelia burgdorferi B31
LLIGFALALALIGCA

SEQ ID NO: 172040 - protein, 9 aa, Borrelia burgdorferi B31
FALALALIG

SEQ ID NO: 172041 - protein, 15 aa, Borrelia burgdorferi B31
LLIGFALALALIGCA

SEQ ID NO: 172042 - protein, 9 aa, Borrelia burgdorferi B31
IGFALALAL

SEQ ID NO: 172043 - protein, 15 aa, Borrelia burgdorferi B31
LTVSADLNTVTLEAF

SEQ ID NO: 172044 - protein, 9 aa, Borrelia burgdorferi B31
VSADLNTVT

SEQ ID NO: 172045 - protein, 15 aa, Borrelia burgdorferi B31
LVFLTDGTITVQQYN

SEQ ID NO: 172046 - protein, 9 aa, Borrelia burgdorferi B31
FLTDGTITV

SEQ ID NO: 172047 - protein, 15 aa, Borrelia burgdorferi B31
LVGGKTTVEIKEGTV

SEQ ID NO: 172048 - protein, 9 aa, Borrelia burgdorferi B31
VGGKTTVEI

SEQ ID NO: 172049 - protein, 15 aa, Borrelia burgdorferi B31
MRLLIGFALALALIG

SEQ ID NO: 172050 - protein, 9 aa, Borrelia burgdorferi B31
IGFALALAL

SEQ ID NO: 172051 - protein, 15 aa, Borrelia burgdorferi B31
MRLLIGFALALALIG

SEQ ID NO: 172052 - protein, 9 aa, Borrelia burgdorferi B31
LIGFALALA

SEQ ID NO: 172053 - protein, 15 aa, Borrelia burgdorferi B31
NGNKIFVSKEKNSSG

SEQ ID NO: 172054 - protein, 9 aa, Borrelia burgdorferi B31
FVSKEKNSS

SEQ ID NO: 172055 - protein, 15 aa, Borrelia burgdorferi B31
NKIFVSKEKNSSGKY

SEQ ID NO: 172056 - protein, 9 aa, Borrelia burgdorferi B31
FVSKEKNSS

SEQ ID NO: 172057 - protein, 15 aa, Borrelia burgdorferi B31
NKKTGKWEDSTSTLT

SEQ ID NO: 172058 - protein, 9 aa, Borrelia burgdorferi B31
GKWEDSTST

SEQ ID NO: 172059 - protein, 15 aa, Borrelia burgdorferi B31
NKLDSKKLTRSNGTT

SEQ ID NO: 172060 - protein, 9 aa, Borrelia burgdorferi B31
LDSKKLTRS

SEQ ID NO: 172061 - protein, 15 aa, Borrelia burgdorferi B31
NSIKLEGSLVGGKTT

SEQ ID NO: 172062 - protein, 9 aa, Borrelia burgdorferi B31
IKLEGSLVG

SEQ ID NO: 172063 - protein, 15 aa, Borrelia burgdorferi B31
NTAGTSLEGSASEIK

SEQ ID NO: 172064 - protein, 9 aa, Borrelia burgdorferi B31
GTSLEGSAS

SEQ ID NO: 172065 - protein, 15 aa, Borrelia burgdorferi B31
PDKSKVKLTVSADLN

SEQ ID NO: 172066 - protein, 9 aa, Borrelia burgdorferi B31
VKLTVSADL

SEQ ID NO: 172067 - protein, 15 aa, Borrelia burgdorferi B31
  Xaa can be any naturally occurring amino acid
  VARIANT 6: Xaa = Any Amino Acid
QGSITXETLKANKLD

SEQ ID NO: 172068 - protein, 9 aa, Borrelia burgdorferi B31
  Xaa can be any naturally occurring amino acid
  VARIANT 1: Xaa = Any Amino Acid
XETLKANKL

SEQ ID NO: 172069 - protein, 15 aa, Borrelia burgdorferi B31
QQYNTAGTSLEGSAS

SEQ ID NO: 172070 - protein, 9 aa, Borrelia burgdorferi B31
YNTAGTSLE

SEQ ID NO: 172071 - protein, 15 aa, Borrelia burgdorferi B31
QYNTAGTSLEGSASE

SEQ ID NO: 172072 - protein, 9 aa, Borrelia burgdorferi B31
YNTAGTSLE

SEQ ID NO: 172073 - protein, 15 aa, Borrelia burgdorferi B31
RLLIGFALALALIGC

SEQ ID NO: 172074 - protein, 9 aa, Borrelia burgdorferi B31
FALALALIG

SEQ ID NO: 172075 - protein, 15 aa, Borrelia burgdorferi B31
RLLIGFALALALIGC

SEQ ID NO: 172076 - protein, 9 aa, Borrelia burgdorferi B31
IGFALALAL

SEQ ID NO: 172077 - protein, 15 aa, Borrelia burgdorferi B31
RLLIGFALALALIGC

SEQ ID NO: 172078 - protein, 9 aa, Borrelia burgdorferi B31
LIGFALALA

SEQ ID NO: 172079 - protein, 15 aa, Borrelia burgdorferi B31
SASEIKNLSELKNAL

SEQ ID NO: 172080 - protein, 9 aa, Borrelia burgdorferi B31
IKNLSELKN

SEQ ID NO: 172081 - protein, 15 aa, Borrelia burgdorferi B31
SIKLEGSLVGGKTTV

SEQ ID NO: 172082 - protein, 9 aa, Borrelia burgdorferi B31
IKLEGSLVG

SEQ ID NO: 172083 - protein, 15 aa, Borrelia burgdorferi B31
SKVKLTVSADLNTVT

SEQ ID NO: 172084 - protein, 9 aa, Borrelia burgdorferi B31
VKLTVSADL

SEQ ID NO: 172085 - protein, 15 aa, Borrelia burgdorferi B31
  Xaa can be any naturally occurring amino acid
  VARIANT 12: Xaa = Any Amino Acid
SKVTKKQGSITXETL

SEQ ID NO: 172086 - protein, 9 aa, Borrelia burgdorferi B31
VTKKQGSIT

SEQ ID NO: 172087 - protein, 15 aa, Borrelia burgdorferi B31
SLVGGKTTVEIKEGT

SEQ ID NO: 172088 - protein, 9 aa, Borrelia burgdorferi B31
VGGKTTVEI

SEQ ID NO: 172089 - protein, 15 aa, Borrelia burgdorferi B31
  Xaa can be any naturally occurring amino acid
  VARIANT 13: Xaa = Any Amino Acid
SSKVTKKQGSITXET

SEQ ID NO: 172090 - protein, 9 aa, Borrelia burgdorferi B31
VTKKQGSIT

SEQ ID NO: 172091 - protein, 15 aa, Borrelia burgdorferi B31
SVSLFNGNKIFVSKE

SEQ ID NO: 172092 - protein, 9 aa, Borrelia burgdorferi B31
VSLFNGNKI

SEQ ID NO: 172093 - protein, 15 aa, Borrelia burgdorferi B31
TAGTSLEGSASEIKN

SEQ ID NO: 172094 - protein, 9 aa, Borrelia burgdorferi B31
LEGSASEIK

SEQ ID NO: 172095 - protein, 15 aa, Borrelia burgdorferi B31
TDGTITVQQYNTAGT

SEQ ID NO: 172096 - protein, 9 aa, Borrelia burgdorferi B31
ITVQQYNTA

SEQ ID NO: 172097 - protein, 15 aa, Borrelia burgdorferi B31
TEDSVSLFNGNKIFV

SEQ ID NO: 172098 - protein, 9 aa, Borrelia burgdorferi B31
VSLFNGNKI

SEQ ID NO: 172099 - protein, 15 aa, Borrelia burgdorferi B31
TGKWEDSTSTLTISA

SEQ ID NO: 172100 - protein, 9 aa, Borrelia burgdorferi B31
WEDSTSTLT

SEQ ID NO: 172101 - protein, 15 aa, Borrelia burgdorferi B31
TITVQQYNTAGTSLE

SEQ ID NO: 172102 - protein, 9 aa, Borrelia burgdorferi B31
VQQYNTAGT

SEQ ID NO: 172103 - protein, 15 aa, Borrelia burgdorferi B31
TKAVETLKNSIKLEG

SEQ ID NO: 172104 - protein, 9 aa, Borrelia burgdorferi B31
VETLKNSIK

SEQ ID NO: 172105 - protein, 15 aa, Borrelia burgdorferi B31
TKDLVFLTDGTITVQ

SEQ ID NO: 172106 - protein, 9 aa, Borrelia burgdorferi B31
FLTDGTITV

SEQ ID NO: 172107 - protein, 15 aa, Borrelia burgdorferi B31
TLKANKLDSKKLTRS

SEQ ID NO: 172108 - protein, 9 aa, Borrelia burgdorferi B31
ANKLDSKKL

SEQ ID NO: 172109 - protein, 15 aa, Borrelia burgdorferi B31
TLKNSIKLEGSLVGG

SEQ ID NO: 172110 - protein, 9 aa, Borrelia burgdorferi B31
IKLEGSLVG

SEQ ID NO: 172111 - protein, 15 aa, Borrelia burgdorferi B31
TLKNSIKLEGSLVGG

SEQ ID NO: 172112 - protein, 9 aa, Borrelia burgdorferi B31
LKNSIKLEG

SEQ ID NO: 172113 - protein, 15 aa, Borrelia burgdorferi B31
TVQQYNTAGTSLEGS

SEQ ID NO: 172114 - protein, 9 aa, Borrelia burgdorferi B31
YNTAGTSLE

SEQ ID NO: 172115 - protein, 15 aa, Borrelia burgdorferi B31
VETLKNSIKLEGSLV

SEQ ID NO: 172116 - protein, 9 aa, Borrelia burgdorferi B31
LKNSIKLEG

SEQ ID NO: 172117 - protein, 15 aa, Borrelia burgdorferi B31
VFLTDGTITVQQYNT

SEQ ID NO: 172118 - protein, 9 aa, Borrelia burgdorferi B31
FLTDGTITV

SEQ ID NO: 172119 - protein, 15 aa, Borrelia burgdorferi B31
VGGKTTVEIKEGTVT

SEQ ID NO: 172120 - protein, 9 aa, Borrelia burgdorferi B31
VGGKTTVEI

SEQ ID NO: 172121 - protein, 15 aa, Borrelia burgdorferi B31
VKLTVSADLNTVTLE

SEQ ID NO: 172122 - protein, 9 aa, Borrelia burgdorferi B31
LTVSADLNT

SEQ ID NO: 172123 - protein, 15 aa, Borrelia burgdorferi B31
VKVFLNDTAGSNKKT

SEQ ID NO: 172124 - protein, 9 aa, Borrelia burgdorferi B31
FLNDTAGSN

SEQ ID NO: 172125 - protein, 15 aa, Borrelia burgdorferi B31
VQQYNTAGTSLEGSA

SEQ ID NO: 172126 - protein, 9 aa, Borrelia burgdorferi B31
YNTAGTSLE

SEQ ID NO: 172127 - protein, 15 aa, Borrelia burgdorferi B31
VSLFNGNKIFVSKEK

SEQ ID NO: 172128 - protein, 9 aa, Borrelia burgdorferi B31
VSLFNGNKI

SEQ ID NO: 172129 - protein, 15 aa, Borrelia burgdorferi B31
VTEDSVSLFNGNKIF

SEQ ID NO: 172130 - protein, 9 aa, Borrelia burgdorferi B31
VSLFNGNKI

SEQ ID NO: 172131 - protein, 15 aa, Borrelia burgdorferi B31
WEDSTSTLTISADSK

SEQ ID NO: 172132 - protein, 9 aa, Borrelia burgdorferi B31
WEDSTSTLT

SEQ ID NO: 172133 - protein, 15 aa, Borrelia burgdorferi B31
YNTAGTSLEGSASEI

SEQ ID NO: 172134 - protein, 9 aa, Borrelia burgdorferi B31
YNTAGTSLE

SEQ ID NO: 172135 - protein, 8 aa, Borrelia burgdorferi B31
NTLSAILM

SEQ ID NO: 172136 - protein, 8 aa, Borrelia burgdorferi B31
TLSAILMT

SEQ ID NO: 172137 - protein, 8 aa, Borrelia burgdorferi B31
LSAILMTL

SEQ ID NO: 172138 - protein, 8 aa, Borrelia burgdorferi B31
SAILMTLF

SEQ ID NO: 172139 - protein, 8 aa, Borrelia burgdorferi B31
AILMTLFL

SEQ ID NO: 172140 - protein, 8 aa, Borrelia burgdorferi B31
ILMTLFLF

SEQ ID NO: 172141 - protein, 8 aa, Borrelia burgdorferi B31
LMTLFLFI

SEQ ID NO: 172142 - protein, 8 aa, Borrelia burgdorferi B31
TLFLFISC

SEQ ID NO: 172143 - protein, 8 aa, Borrelia burgdorferi B31
ISCNNSGK

SEQ ID NO: 172144 - protein, 8 aa, Borrelia burgdorferi B31
NSADESVK

SEQ ID NO: 172145 - protein, 8 aa, Borrelia burgdorferi B31
NLTEISKK

SEQ ID NO: 172146 - protein, 8 aa, Borrelia burgdorferi B31
KITDSNAV

SEQ ID NO: 172147 - protein, 8 aa, Borrelia burgdorferi B31
NAVLLAVK

SEQ ID NO: 172148 - protein, 8 aa, Borrelia burgdorferi B31
VLLAVKEV

SEQ ID NO: 172149 - protein, 8 aa, Borrelia burgdorferi B31
AVKEVEAL

SEQ ID NO: 172150 - protein, 8 aa, Borrelia burgdorferi B31
KEVEALLS

SEQ ID NO: 172151 - protein, 8 aa, Borrelia burgdorferi B31
LLSSIDEI

SEQ ID NO: 172152 - protein, 8 aa, Borrelia burgdorferi B31
SIDEIAAK

SEQ ID NO: 172153 - protein, 8 aa, Borrelia burgdorferi B31
IAAKAIGK

SEQ ID NO: 172154 - protein, 8 aa, Borrelia burgdorferi B31
AAKAIGKK

SEQ ID NO: 172155 - protein, 8 aa, Borrelia burgdorferi B31
KIHQNNGL

SEQ ID NO: 172156 - protein, 8 aa, Borrelia burgdorferi B31
GSLLAGAY

SEQ ID NO: 172157 - protein, 8 aa, Borrelia burgdorferi B31
SLLAGAYA

SEQ ID NO: 172158 - protein, 8 aa, Borrelia burgdorferi B31
LLAGAYAI

SEQ ID NO: 172159 - protein, 8 aa, Borrelia burgdorferi B31
GAYAISTL

SEQ ID NO: 172160 - protein, 8 aa, Borrelia burgdorferi B31
AYAISTLI

SEQ ID NO: 172161 - protein, 8 aa, Borrelia burgdorferi B31
YAISTLIK

SEQ ID NO: 172162 - protein, 8 aa, Borrelia burgdorferi B31
ISTLIKQK

SEQ ID NO: 172163 - protein, 8 aa, Borrelia burgdorferi B31
KQKLDGLK

SEQ ID NO: 172164 - protein, 8 aa, Borrelia burgdorferi B31
KLDGLKNE

SEQ ID NO: 172165 - protein, 8 aa, Borrelia burgdorferi B31
GLKNEGLK

SEQ ID NO: 172166 - protein, 8 aa, Borrelia burgdorferi B31
GLKEKIDA

SEQ ID NO: 172167 - protein, 8 aa, Borrelia burgdorferi B31
EKIDAAKK

SEQ ID NO: 172168 - protein, 8 aa, Borrelia burgdorferi B31
CSETFTNK

SEQ ID NO: 172169 - protein, 8 aa, Borrelia burgdorferi B31
SETFTNKL

SEQ ID NO: 172170 - protein, 8 aa, Borrelia burgdorferi B31
ETFTNKLK

SEQ ID NO: 172171 - protein, 8 aa, Borrelia burgdorferi B31
FTNKLKEK

SEQ ID NO: 172172 - protein, 8 aa, Borrelia burgdorferi B31
GVTDADAK

SEQ ID NO: 172173 - protein, 8 aa, Borrelia burgdorferi B31
DAKEAILK

SEQ ID NO: 172174 - protein, 8 aa, Borrelia burgdorferi B31
ILKTNGTK

SEQ ID NO: 172175 - protein, 8 aa, Borrelia burgdorferi B31
KTNGTKTK

SEQ ID NO: 172176 - protein, 8 aa, Borrelia burgdorferi B31
AEELGKLF

SEQ ID NO: 172177 - protein, 8 aa, Borrelia burgdorferi B31
KLFESVEV

SEQ ID NO: 172178 - protein, 8 aa, Borrelia burgdorferi B31
ESVEVLSK

SEQ ID NO: 172179 - protein, 8 aa, Borrelia burgdorferi B31
EVLSKAAK

SEQ ID NO: 172180 - protein, 8 aa, Borrelia burgdorferi B31
KEMLANSV

SEQ ID NO: 172181 - protein, 8 aa, Borrelia burgdorferi B31
EMLANSVK

SEQ ID NO: 172182 - protein, 8 aa, Borrelia burgdorferi B31
KELTSPVV

SEQ ID NO: 172183 - protein, 8 aa, Borrelia burgdorferi B31
ELTSPVVA

SEQ ID NO: 172184 - protein, 8 aa, Borrelia burgdorferi B31
PVVAESPK

SEQ ID NO: 172185 - protein, 8 aa, Borrelia burgdorferi B31
VVAESPKK

SEQ ID NO: 172186 - protein, 9 aa, Borrelia burgdorferi B31
MKKNTLSAI

SEQ ID NO: 172187 - protein, 9 aa, Borrelia burgdorferi B31
NTLSAILMT

SEQ ID NO: 172188 - protein, 9 aa, Borrelia burgdorferi B31
TLSAILMTL

SEQ ID NO: 172189 - protein, 9 aa, Borrelia burgdorferi B31
LSAILMTLF

SEQ ID NO: 172190 - protein, 9 aa, Borrelia burgdorferi B31
SAILMTLFL

SEQ ID NO: 172191 - protein, 9 aa, Borrelia burgdorferi B31
AILMTLFLF

SEQ ID NO: 172192 - protein, 9 aa, Borrelia burgdorferi B31
ILMTLFLFI

SEQ ID NO: 172193 - protein, 9 aa, Borrelia burgdorferi B31
FLFISCNNS

SEQ ID NO: 172194 - protein, 9 aa, Borrelia burgdorferi B31
FISCNNSGK

SEQ ID NO: 172195 - protein, 9 aa, Borrelia burgdorferi B31
SANSADESV

SEQ ID NO: 172196 - protein, 9 aa, Borrelia burgdorferi B31
DESVKGPNL

SEQ ID NO: 172197 - protein, 9 aa, Borrelia burgdorferi B31
NLTEISKKI

SEQ ID NO: 172198 - protein, 9 aa, Borrelia burgdorferi B31
KKITDSNAV

SEQ ID NO: 172199 - protein, 9 aa, Borrelia burgdorferi B31
KITDSNAVL

SEQ ID NO: 172200 - protein, 9 aa, Borrelia burgdorferi B31
ITDSNAVLL

SEQ ID NO: 172201 - protein, 9 aa, Borrelia burgdorferi B31
DSNAVLLAV

SEQ ID NO: 172202 - protein, 9 aa, Borrelia burgdorferi B31
AVLLAVKEV

SEQ ID NO: 172203 - protein, 9 aa, Borrelia burgdorferi B31
LLAVKEVEA

SEQ ID NO: 172204 - protein, 9 aa, Borrelia burgdorferi B31
LAVKEVEAL

SEQ ID NO: 172205 - protein, 9 aa, Borrelia burgdorferi B31
AVKEVEALL

SEQ ID NO: 172206 - protein, 9 aa, Borrelia burgdorferi B31
EVEALLSSI

SEQ ID NO: 172207 - protein, 9 aa, Borrelia burgdorferi B31
ALLSSIDEI

SEQ ID NO: 172208 - protein, 9 aa, Borrelia burgdorferi B31
LLSSIDEIA

SEQ ID NO: 172209 - protein, 9 aa, Borrelia burgdorferi B31
SSIDEIAAK

SEQ ID NO: 172210 - protein, 9 aa, Borrelia burgdorferi B31
SIDEIAAKA

SEQ ID NO: 172211 - protein, 9 aa, Borrelia burgdorferi B31
EIAAKAIGK

SEQ ID NO: 172212 - protein, 9 aa, Borrelia burgdorferi B31
IAAKAIGKK

SEQ ID NO: 172213 - protein, 9 aa, Borrelia burgdorferi B31
HQNNGLDTE

SEQ ID NO: 172214 - protein, 9 aa, Borrelia burgdorferi B31
TENNHNGSL

SEQ ID NO: 172215 - protein, 9 aa, Borrelia burgdorferi B31
NGSLLAGAY

SEQ ID NO: 172216 - protein, 9 aa, Borrelia burgdorferi B31
SLLAGAYAI

SEQ ID NO: 172217 - protein, 9 aa, Borrelia burgdorferi B31
LLAGAYAIS

SEQ ID NO: 172218 - protein, 9 aa, Borrelia burgdorferi B31
GAYAISTLI

SEQ ID NO: 172219 - protein, 9 aa, Borrelia burgdorferi B31
AYAISTLIK

SEQ ID NO: 172220 - protein, 9 aa, Borrelia burgdorferi B31
AISTLIKQK

SEQ ID NO: 172221 - protein, 9 aa, Borrelia burgdorferi B31
LIKQKLDGL

SEQ ID NO: 172222 - protein, 9 aa, Borrelia burgdorferi B31
KLDGLKNEG

SEQ ID NO: 172223 - protein, 9 aa, Borrelia burgdorferi B31
GLKEKIDAA

SEQ ID NO: 172224 - protein, 9 aa, Borrelia burgdorferi B31
ETFTNKLKE

SEQ ID NO: 172225 - protein, 9 aa, Borrelia burgdorferi B31
KLKEKHTDL

SEQ ID NO: 172226 - protein, 9 aa, Borrelia burgdorferi B31
KEKHTDLGK

SEQ ID NO: 172227 - protein, 9 aa, Borrelia burgdorferi B31
HTDLGKEGV

SEQ ID NO: 172228 - protein, 9 aa, Borrelia burgdorferi B31
AILKTNGTK

SEQ ID NO: 172229 - protein, 9 aa, Borrelia burgdorferi B31
ELGKLFESV

SEQ ID NO: 172230 - protein, 9 aa, Borrelia burgdorferi B31
KLFESVEVL

SEQ ID NO: 172231 - protein, 9 aa, Borrelia burgdorferi B31
ESVEVLSKA

SEQ ID NO: 172232 - protein, 9 aa, Borrelia burgdorferi B31
VLSKAAKEM

SEQ ID NO: 172233 - protein, 9 aa, Borrelia burgdorferi B31
MLANSVKEL

SEQ ID NO: 172234 - protein, 9 aa, Borrelia burgdorferi B31
SVKELTSPV

SEQ ID NO: 172235 - protein, 9 aa, Borrelia burgdorferi B31
LTSPVVAES

SEQ ID NO: 172236 - protein, 9 aa, Borrelia burgdorferi B31
PVVAESPKK

SEQ ID NO: 172237 - protein, 10 aa, Borrelia burgdorferi B31
NTLSAILMTL

SEQ ID NO: 172238 - protein, 10 aa, Borrelia burgdorferi B31
TLSAILMTLF

SEQ ID NO: 172239 - protein, 10 aa, Borrelia burgdorferi B31
LSAILMTLFL

SEQ ID NO: 172240 - protein, 10 aa, Borrelia burgdorferi B31
SAILMTLFLF

SEQ ID NO: 172241 - protein, 10 aa, Borrelia burgdorferi B31
AILMTLFLFI

SEQ ID NO: 172242 - protein, 10 aa, Borrelia burgdorferi B31
ILMTLFLFIS

SEQ ID NO: 172243 - protein, 10 aa, Borrelia burgdorferi B31
LMTLFLFISC

SEQ ID NO: 172244 - protein, 10 aa, Borrelia burgdorferi B31
FLFISCNNSG

SEQ ID NO: 172245 - protein, 10 aa, Borrelia burgdorferi B31
LFISCNNSGK

SEQ ID NO: 172246 - protein, 10 aa, Borrelia burgdorferi B31
TSANSADESV

SEQ ID NO: 172247 - protein, 10 aa, Borrelia burgdorferi B31
SANSADESVK

SEQ ID NO: 172248 - protein, 10 aa, Borrelia burgdorferi B31
SVKGPNLTEI

SEQ ID NO: 172249 - protein, 10 aa, Borrelia burgdorferi B31
KGPNLTEISK

SEQ ID NO: 172250 - protein, 10 aa, Borrelia burgdorferi B31
KITDSNAVLL

SEQ ID NO: 172251 - protein, 10 aa, Borrelia burgdorferi B31
DSNAVLLAVK

SEQ ID NO: 172252 - protein, 10 aa, Borrelia burgdorferi B31
NAVLLAVKEV

SEQ ID NO: 172253 - protein, 10 aa, Borrelia burgdorferi B31
VLLAVKEVEA

SEQ ID NO: 172254 - protein, 10 aa, Borrelia burgdorferi B31
LLAVKEVEAL

SEQ ID NO: 172255 - protein, 10 aa, Borrelia burgdorferi B31
KEVEALLSSI

SEQ ID NO: 172256 - protein, 10 aa, Borrelia burgdorferi B31
EALLSSIDEI

SEQ ID NO: 172257 - protein, 10 aa, Borrelia burgdorferi B31
ALLSSIDEIA

SEQ ID NO: 172258 - protein, 10 aa, Borrelia burgdorferi B31
LLSSIDEIAA

SEQ ID NO: 172259 - protein, 10 aa, Borrelia burgdorferi B31
LSSIDEIAAK

SEQ ID NO: 172260 - protein, 10 aa, Borrelia burgdorferi B31
SSIDEIAAKA

SEQ ID NO: 172261 - protein, 10 aa, Borrelia burgdorferi B31
SIDEIAAKAI

SEQ ID NO: 172262 - protein, 10 aa, Borrelia burgdorferi B31
EIAAKAIGKK

SEQ ID NO: 172263 - protein, 10 aa, Borrelia burgdorferi B31
DTENNHNGSL

SEQ ID NO: 172264 - protein, 10 aa, Borrelia burgdorferi B31
TENNHNGSLL

SEQ ID NO: 172265 - protein, 10 aa, Borrelia burgdorferi B31
SLLAGAYAIS

SEQ ID NO: 172266 - protein, 10 aa, Borrelia burgdorferi B31
LLAGAYAIST

SEQ ID NO: 172267 - protein, 10 aa, Borrelia burgdorferi B31
LAGAYAISTL

SEQ ID NO: 172268 - protein, 10 aa, Borrelia burgdorferi B31
AGAYAISTLI

SEQ ID NO: 172269 - protein, 10 aa, Borrelia burgdorferi B31
GAYAISTLIK

SEQ ID NO: 172270 - protein, 10 aa, Borrelia burgdorferi B31
YAISTLIKQK

SEQ ID NO: 172271 - protein, 10 aa, Borrelia burgdorferi B31
AISTLIKQKL

SEQ ID NO: 172272 - protein, 10 aa, Borrelia burgdorferi B31
TLIKQKLDGL

SEQ ID NO: 172273 - protein, 10 aa, Borrelia burgdorferi B31
KLDGLKNEGL

SEQ ID NO: 172274 - protein, 10 aa, Borrelia burgdorferi B31
GLKNEGLKEK

SEQ ID NO: 172275 - protein, 10 aa, Borrelia burgdorferi B31
CSETFTNKLK

SEQ ID NO: 172276 - protein, 10 aa, Borrelia burgdorferi B31
ETFTNKLKEK

SEQ ID NO: 172277 - protein, 10 aa, Borrelia burgdorferi B31
EAILKTNGTK

SEQ ID NO: 172278 - protein, 10 aa, Borrelia burgdorferi B31
ILKTNGTKTK

SEQ ID NO: 172279 - protein, 10 aa, Borrelia burgdorferi B31
KTKGAEELGK

SEQ ID NO: 172280 - protein, 10 aa, Borrelia burgdorferi B31
KLFESVEVLS

SEQ ID NO: 172281 - protein, 10 aa, Borrelia burgdorferi B31
ESVEVLSKAA

SEQ ID NO: 172282 - protein, 10 aa, Borrelia burgdorferi B31
SVEVLSKAAK

SEQ ID NO: 172283 - protein, 10 aa, Borrelia burgdorferi B31
EVLSKAAKEM

SEQ ID NO: 172284 - protein, 10 aa, Borrelia burgdorferi B31
VLSKAAKEML

SEQ ID NO: 172285 - protein, 10 aa, Borrelia burgdorferi B31
AAKEMLANSV

SEQ ID NO: 172286 - protein, 10 aa, Borrelia burgdorferi B31
EMLANSVKEL

SEQ ID NO: 172287 - protein, 10 aa, Borrelia burgdorferi B31
MLANSVKELT

SEQ ID NO: 172288 - protein, 10 aa, Borrelia burgdorferi B31
NSVKELTSPV

SEQ ID NO: 172289 - protein, 10 aa, Borrelia burgdorferi B31
SVKELTSPVV

SEQ ID NO: 172290 - protein, 10 aa, Borrelia burgdorferi B31
TSPVVAESPK

SEQ ID NO: 172291 - protein, 11 aa, Borrelia burgdorferi B31
NTLSAILMTLF

SEQ ID NO: 172292 - protein, 11 aa, Borrelia burgdorferi B31
TLSAILMTLFL

SEQ ID NO: 172293 - protein, 11 aa, Borrelia burgdorferi B31
LSAILMTLFLF

SEQ ID NO: 172294 - protein, 11 aa, Borrelia burgdorferi B31
SAILMTLFLFI

SEQ ID NO: 172295 - protein, 11 aa, Borrelia burgdorferi B31
ILMTLFLFISC

SEQ ID NO: 172296 - protein, 11 aa, Borrelia burgdorferi B31
FLFISCNNSGK

SEQ ID NO: 172297 - protein, 11 aa, Borrelia burgdorferi B31
NTSANSADESV

SEQ ID NO: 172298 - protein, 11 aa, Borrelia burgdorferi B31
TSANSADESVK

SEQ ID NO: 172299 - protein, 11 aa, Borrelia burgdorferi B31
ESVKGPNLTEI

SEQ ID NO: 172300 - protein, 11 aa, Borrelia burgdorferi B31
KITDSNAVLLA

SEQ ID NO: 172301 - protein, 11 aa, Borrelia burgdorferi B31
ITDSNAVLLAV

SEQ ID NO: 172302 - protein, 11 aa, Borrelia burgdorferi B31
VLLAVKEVEAL

SEQ ID NO: 172303 - protein, 11 aa, Borrelia burgdorferi B31
LLAVKEVEALL

SEQ ID NO: 172304 - protein, 11 aa, Borrelia burgdorferi B31
ALLSSIDEIAA

SEQ ID NO: 172305 - protein, 11 aa, Borrelia burgdorferi B31
LLSSIDEIAAK

SEQ ID NO: 172306 - protein, 11 aa, Borrelia burgdorferi B31
EIAAKAIGKKI

SEQ ID NO: 172307 - protein, 11 aa, Borrelia burgdorferi B31
DTENNHNGSLL

SEQ ID NO: 172308 - protein, 11 aa, Borrelia burgdorferi B31
NHNGSLLAGAY

SEQ ID NO: 172309 - protein, 11 aa, Borrelia burgdorferi B31
NGSLLAGAYAI

SEQ ID NO: 172310 - protein, 11 aa, Borrelia burgdorferi B31
SLLAGAYAIST

SEQ ID NO: 172311 - protein, 11 aa, Borrelia burgdorferi B31
LLAGAYAISTL

SEQ ID NO: 172312 - protein, 11 aa, Borrelia burgdorferi B31
LAGAYAISTLI

SEQ ID NO: 172313 - protein, 11 aa, Borrelia burgdorferi B31
AYAISTLIKQK

SEQ ID NO: 172314 - protein, 11 aa, Borrelia burgdorferi B31
YAISTLIKQKL

SEQ ID NO: 172315 - protein, 11 aa, Borrelia burgdorferi B31
TLIKQKLDGLK

SEQ ID NO: 172316 - protein, 11 aa, Borrelia burgdorferi B31
KLDGLKNEGLK

SEQ ID NO: 172317 - protein, 11 aa, Borrelia burgdorferi B31
GLKEKIDAAKK

SEQ ID NO: 172318 - protein, 11 aa, Borrelia burgdorferi B31
KCSETFTNKLK

SEQ ID NO: 172319 - protein, 11 aa, Borrelia burgdorferi B31
ETFTNKLKEKH

SEQ ID NO: 172320 - protein, 11 aa, Borrelia burgdorferi B31
KLKEKHTDLGK

SEQ ID NO: 172321 - protein, 11 aa, Borrelia burgdorferi B31
GVTDADAKEAI

SEQ ID NO: 172322 - protein, 11 aa, Borrelia burgdorferi B31
AILKTNGTKTK

SEQ ID NO: 172323 - protein, 11 aa, Borrelia burgdorferi B31
AEELGKLFESV

SEQ ID NO: 172324 - protein, 11 aa, Borrelia burgdorferi B31
ELGKLFESVEV

SEQ ID NO: 172325 - protein, 11 aa, Borrelia burgdorferi B31
KLFESVEVLSK

SEQ ID NO: 172326 - protein, 11 aa, Borrelia burgdorferi B31
ESVEVLSKAAK

SEQ ID NO: 172327 - protein, 11 aa, Borrelia burgdorferi B31
VEVLSKAAKEM

SEQ ID NO: 172328 - protein, 11 aa, Borrelia burgdorferi B31
EVLSKAAKEML

SEQ ID NO: 172329 - protein, 11 aa, Borrelia burgdorferi B31
VLSKAAKEMLA

SEQ ID NO: 172330 - protein, 11 aa, Borrelia burgdorferi B31
KAAKEMLANSV

SEQ ID NO: 172331 - protein, 11 aa, Borrelia burgdorferi B31
AAKEMLANSVK

SEQ ID NO: 172332 - protein, 11 aa, Borrelia burgdorferi B31
KEMLANSVKEL

SEQ ID NO: 172333 - protein, 11 aa, Borrelia burgdorferi B31
MLANSVKELTS

SEQ ID NO: 172334 - protein, 11 aa, Borrelia burgdorferi B31
SVKELTSPVVA

SEQ ID NO: 172335 - protein, 11 aa, Borrelia burgdorferi B31
LTSPVVAESPK

SEQ ID NO: 172336 - protein, 11 aa, Borrelia burgdorferi B31
TSPVVAESPKK

SEQ ID NO: 172337 - protein, 15 aa, Borrelia burgdorferi B31
ADAKEAILKTNGTKT

SEQ ID NO: 172338 - protein, 9 aa, Borrelia burgdorferi B31
EAILKTNGT

SEQ ID NO: 172339 - protein, 15 aa, Borrelia burgdorferi B31
ADESVKGPNLTEISK

SEQ ID NO: 172340 - protein, 9 aa, Borrelia burgdorferi B31
VKGPNLTEI

SEQ ID NO: 172341 - protein, 15 aa, Borrelia burgdorferi B31
AGAYAISTLIKQKLD

SEQ ID NO: 172342 - protein, 9 aa, Borrelia burgdorferi B31
ISTLIKQKL

SEQ ID NO: 172343 - protein, 15 aa, Borrelia burgdorferi B31
AGAYAISTLIKQKLD

SEQ ID NO: 172344 - protein, 9 aa, Borrelia burgdorferi B31
YAISTLIKQ

SEQ ID NO: 172345 - protein, 15 aa, Borrelia burgdorferi B31
AILKTNGTKTKGAEE

SEQ ID NO: 172346 - protein, 9 aa, Borrelia burgdorferi B31
LKTNGTKTK

SEQ ID NO: 172347 - protein, 15 aa, Borrelia burgdorferi B31
AILMTLFLFISCNNS

SEQ ID NO: 172348 - protein, 9 aa, Borrelia burgdorferi B31
LMTLFLFIS

SEQ ID NO: 172349 - protein, 15 aa, Borrelia burgdorferi B31
AKEAILKTNGTKTKG

SEQ ID NO: 172350 - protein, 9 aa, Borrelia burgdorferi B31
ILKTNGTKT

SEQ ID NO: 172351 - protein, 15 aa, Borrelia burgdorferi B31
AKEAILKTNGTKTKG

SEQ ID NO: 172352 - protein, 9 aa, Borrelia burgdorferi B31
LKTNGTKTK

SEQ ID NO: 172353 - protein, 15 aa, Borrelia burgdorferi B31
AKEMLANSVKELTSP

SEQ ID NO: 172354 - protein, 9 aa, Borrelia burgdorferi B31
LANSVKELT

SEQ ID NO: 172355 - protein, 15 aa, Borrelia burgdorferi B31
AKEMLANSVKELTSP

SEQ ID NO: 172356 - protein, 9 aa, Borrelia burgdorferi B31
MLANSVKEL

SEQ ID NO: 172357 - protein, 15 aa, Borrelia burgdorferi B31
ANSVKELTSPVVAES

SEQ ID NO: 172358 - protein, 9 aa, Borrelia burgdorferi B31
VKELTSPVV

SEQ ID NO: 172359 - protein, 15 aa, Borrelia burgdorferi B31
AVKEVEALLSSIDEI

SEQ ID NO: 172360 - protein, 9 aa, Borrelia burgdorferi B31
VKEVEALLS

SEQ ID NO: 172361 - protein, 15 aa, Borrelia burgdorferi B31
AVLLAVKEVEALLSS

SEQ ID NO: 172362 - protein, 9 aa, Borrelia burgdorferi B31
VKEVEALLS

SEQ ID NO: 172363 - protein, 15 aa, Borrelia burgdorferi B31
AYAISTLIKQKLDGL

SEQ ID NO: 172364 - protein, 9 aa, Borrelia burgdorferi B31
ISTLIKQKL

SEQ ID NO: 172365 - protein, 15 aa, Borrelia burgdorferi B31
CSETFTNKLKEKHTD

SEQ ID NO: 172366 - protein, 9 aa, Borrelia burgdorferi B31
FTNKLKEKH

SEQ ID NO: 172367 - protein, 15 aa, Borrelia burgdorferi B31
DAKEAILKTNGTKTK

SEQ ID NO: 172368 - protein, 9 aa, Borrelia burgdorferi B31
EAILKTNGT

SEQ ID NO: 172369 - protein, 15 aa, Borrelia burgdorferi B31
DESVKGPNLTEISKK

SEQ ID NO: 172370 - protein, 9 aa, Borrelia burgdorferi B31
VKGPNLTEI

SEQ ID NO: 172371 - protein, 15 aa, Borrelia burgdorferi B31
DGLKNEGLKEKIDAA

SEQ ID NO: 172372 - protein, 9 aa, Borrelia burgdorferi B31
LKNEGLKEK

SEQ ID NO: 172373 - protein, 15 aa, Borrelia burgdorferi B31
DLGKEGVTDADAKEA

SEQ ID NO: 172374 - protein, 9 aa, Borrelia burgdorferi B31
LGKEGVTDA

SEQ ID NO: 172375 - protein, 15 aa, Borrelia burgdorferi B31
EAILKTNGTKTKGAE

SEQ ID NO: 172376 - protein, 9 aa, Borrelia burgdorferi B31
ILKTNGTKT

SEQ ID NO: 172377 - protein, 15 aa, Borrelia burgdorferi B31
EAILKTNGTKTKGAE

SEQ ID NO: 172378 - protein, 9 aa, Borrelia burgdorferi B31
LKTNGTKTK

SEQ ID NO: 172379 - protein, 15 aa, Borrelia burgdorferi B31
EGVTDADAKEAILKT

SEQ ID NO: 172380 - protein, 9 aa, Borrelia burgdorferi B31
VTDADAKEA

SEQ ID NO: 172381 - protein, 15 aa, Borrelia burgdorferi B31
EISKKITDSNAVLLA

SEQ ID NO: 172382 - protein, 9 aa, Borrelia burgdorferi B31
ITDSNAVLL

SEQ ID NO: 172383 - protein, 15 aa, Borrelia burgdorferi B31
EMLANSVKELTSPVV

SEQ ID NO: 172384 - protein, 9 aa, Borrelia burgdorferi B31
LANSVKELT

SEQ ID NO: 172385 - protein, 15 aa, Borrelia burgdorferi B31
EMLANSVKELTSPVV

SEQ ID NO: 172386 - protein, 9 aa, Borrelia burgdorferi B31
MLANSVKEL

SEQ ID NO: 172387 - protein, 15 aa, Borrelia burgdorferi B31
EMLANSVKELTSPVV

SEQ ID NO: 172388 - protein, 9 aa, Borrelia burgdorferi B31
NSVKELTSP

SEQ ID NO: 172389 - protein, 15 aa, Borrelia burgdorferi B31
EMLANSVKELTSPVV

SEQ ID NO: 172390 - protein, 9 aa, Borrelia burgdorferi B31
SVKELTSPV

SEQ ID NO: 172391 - protein, 15 aa, Borrelia burgdorferi B31
ESVEVLSKAAKEMLA

SEQ ID NO: 172392 - protein, 9 aa, Borrelia burgdorferi B31
LSKAAKEML

SEQ ID NO: 172393 - protein, 15 aa, Borrelia burgdorferi B31
ESVEVLSKAAKEMLA

SEQ ID NO: 172394 - protein, 9 aa, Borrelia burgdorferi B31
VLSKAAKEM

SEQ ID NO: 172395 - protein, 15 aa, Borrelia burgdorferi B31
ESVKGPNLTEISKKI

SEQ ID NO: 172396 - protein, 9 aa, Borrelia burgdorferi B31
VKGPNLTEI

SEQ ID NO: 172397 - protein, 15 aa, Borrelia burgdorferi B31
ETFTNKLKEKHTDLG

SEQ ID NO: 172398 - protein, 9 aa, Borrelia burgdorferi B31
FTNKLKEKH

SEQ ID NO: 172399 - protein, 15 aa, Borrelia burgdorferi B31
EVLSKAAKEMLANSV

SEQ ID NO: 172400 - protein, 9 aa, Borrelia burgdorferi B31
VLSKAAKEM

SEQ ID NO: 172401 - protein, 15 aa, Borrelia burgdorferi B31
FESVEVLSKAAKEML

SEQ ID NO: 172402 - protein, 9 aa, Borrelia burgdorferi B31
EVLSKAAKE

SEQ ID NO: 172403 - protein, 15 aa, Borrelia burgdorferi B31
FESVEVLSKAAKEML

SEQ ID NO: 172404 - protein, 9 aa, Borrelia burgdorferi B31
VLSKAAKEM

SEQ ID NO: 172405 - protein, 15 aa, Borrelia burgdorferi B31
GAYAISTLIKQKLDG

SEQ ID NO: 172406 - protein, 9 aa, Borrelia burgdorferi B31
ISTLIKQKL

SEQ ID NO: 172407 - protein, 15 aa, Borrelia burgdorferi B31
GKEGVTDADAKEAIL

SEQ ID NO: 172408 - protein, 9 aa, Borrelia burgdorferi B31
VTDADAKEA

SEQ ID NO: 172409 - protein, 15 aa, Borrelia burgdorferi B31
GSLLAGAYAISTLIK

SEQ ID NO: 172410 - protein, 9 aa, Borrelia burgdorferi B31
LAGAYAIST

SEQ ID NO: 172411 - protein, 15 aa, Borrelia burgdorferi B31
HNGSLLAGAYAISTL

SEQ ID NO: 172412 - protein, 9 aa, Borrelia burgdorferi B31
LAGAYAIST

SEQ ID NO: 172413 - protein, 15 aa, Borrelia burgdorferi B31
ILKTNGTKTKGAEEL

SEQ ID NO: 172414 - protein, 9 aa, Borrelia burgdorferi B31
LKTNGTKTK

SEQ ID NO: 172415 - protein, 15 aa, Borrelia burgdorferi B31
ILMTLFLFISCNNSG

SEQ ID NO: 172416 - protein, 9 aa, Borrelia burgdorferi B31
FLFISCNNS

SEQ ID NO: 172417 - protein, 15 aa, Borrelia burgdorferi B31
ISKKITDSNAVLLAV

SEQ ID NO: 172418 - protein, 9 aa, Borrelia burgdorferi B31
ITDSNAVLL

SEQ ID NO: 172419 - protein, 15 aa, Borrelia burgdorferi B31
ITDSNAVLLAVKEVE

SEQ ID NO: 172420 - protein, 9 aa, Borrelia burgdorferi B31
ITDSNAVLL

SEQ ID NO: 172421 - protein, 15 aa, Borrelia burgdorferi B31
KCSETFTNKLKEKHT

SEQ ID NO: 172422 - protein, 9 aa, Borrelia burgdorferi B31
FTNKLKEKH

SEQ ID NO: 172423 - protein, 15 aa, Borrelia burgdorferi B31
KEAILKTNGTKTKGA

SEQ ID NO: 172424 - protein, 9 aa, Borrelia burgdorferi B31
ILKTNGTKT

SEQ ID NO: 172425 - protein, 15 aa, Borrelia burgdorferi B31
KEAILKTNGTKTKGA

SEQ ID NO: 172426 - protein, 9 aa, Borrelia burgdorferi B31
LKTNGTKTK

SEQ ID NO: 172427 - protein, 15 aa, Borrelia burgdorferi B31
KEGVTDADAKEAILK

SEQ ID NO: 172428 - protein, 9 aa, Borrelia burgdorferi B31
VTDADAKEA

SEQ ID NO: 172429 - protein, 15 aa, Borrelia burgdorferi B31
KELTSPVVAESPKKP

SEQ ID NO: 172430 - protein, 9 aa, Borrelia burgdorferi B31
LTSPVVAES

SEQ ID NO: 172431 - protein, 15 aa, Borrelia burgdorferi B31
KEMLANSVKELTSPV

SEQ ID NO: 172432 - protein, 9 aa, Borrelia burgdorferi B31
LANSVKELT

SEQ ID NO: 172433 - protein, 15 aa, Borrelia burgdorferi B31
KEMLANSVKELTSPV

SEQ ID NO: 172434 - protein, 9 aa, Borrelia burgdorferi B31
MLANSVKEL

SEQ ID NO: 172435 - protein, 15 aa, Borrelia burgdorferi B31
KITDSNAVLLAVKEV

SEQ ID NO: 172436 - protein, 9 aa, Borrelia burgdorferi B31
ITDSNAVLL

SEQ ID NO: 172437 - protein, 15 aa, Borrelia burgdorferi B31
KKCSETFTNKLKEKH

SEQ ID NO: 172438 - protein, 9 aa, Borrelia burgdorferi B31
KKCSETFTN

SEQ ID NO: 172439 - protein, 15 aa, Borrelia burgdorferi B31
KKITDSNAVLLAVKE

SEQ ID NO: 172440 - protein, 9 aa, Borrelia burgdorferi B31
ITDSNAVLL

SEQ ID NO: 172441 - protein, 15 aa, Borrelia burgdorferi B31
KKNTLSAILMTLFLF

SEQ ID NO: 172442 - protein, 9 aa, Borrelia burgdorferi B31
LSAILMTLF

SEQ ID NO: 172443 - protein, 15 aa, Borrelia burgdorferi B31
KLDGLKNEGLKEKID

SEQ ID NO: 172444 - protein, 9 aa, Borrelia burgdorferi B31
LKNEGLKEK

SEQ ID NO: 172445 - protein, 15 aa, Borrelia burgdorferi B31
KNTLSAILMTLFLFI

SEQ ID NO: 172446 - protein, 9 aa, Borrelia burgdorferi B31
LSAILMTLF

SEQ ID NO: 172447 - protein, 15 aa, Borrelia burgdorferi B31
KQKLDGLKNEGLKEK

SEQ ID NO: 172448 - protein, 9 aa, Borrelia burgdorferi B31
KQKLDGLKN

SEQ ID NO: 172449 - protein, 15 aa, Borrelia burgdorferi B31
KAAKEMLANSVKELT

SEQ ID NO: 172450 - protein, 9 aa, Borrelia burgdorferi B31
AKEMLANSV

SEQ ID NO: 172451 - protein, 15 aa, Borrelia burgdorferi B31
KAAKEMLANSVKELT

SEQ ID NO: 172452 - protein, 9 aa, Borrelia burgdorferi B31
MLANSVKEL

SEQ ID NO: 172453 - protein, 15 aa, Borrelia burgdorferi B31
LAGAYAISTLIKQKL

SEQ ID NO: 172454 - protein, 9 aa, Borrelia burgdorferi B31
LAGAYAIST

SEQ ID NO: 172455 - protein, 15 aa, Borrelia burgdorferi B31
LAGAYAISTLIKQKL

SEQ ID NO: 172456 - protein, 9 aa, Borrelia burgdorferi B31
YAISTLIKQ

SEQ ID NO: 172457 - protein, 15 aa, Borrelia burgdorferi B31
LANSVKELTSPVVAE

SEQ ID NO: 172458 - protein, 9 aa, Borrelia burgdorferi B31
LANSVKELT

SEQ ID NO: 172459 - protein, 15 aa, Borrelia burgdorferi B31
LANSVKELTSPVVAE

SEQ ID NO: 172460 - protein, 9 aa, Borrelia burgdorferi B31
VKELTSPVV

SEQ ID NO: 172461 - protein, 15 aa, Borrelia burgdorferi B31
LAVKEVEALLSSIDE

SEQ ID NO: 172462 - protein, 9 aa, Borrelia burgdorferi B31
VKEVEALLS

SEQ ID NO: 172463 - protein, 15 aa, Borrelia burgdorferi B31
LDGLKNEGLKEKIDA

SEQ ID NO: 172464 - protein, 9 aa, Borrelia burgdorferi B31
LKNEGLKEK

SEQ ID NO: 172465 - protein, 15 aa, Borrelia burgdorferi B31
LFESVEVLSKAAKEM

SEQ ID NO: 172466 - protein, 9 aa, Borrelia burgdorferi B31
SVEVLSKAA

SEQ ID NO: 172467 - protein, 15 aa, Borrelia burgdorferi B31
LFLFISCNNSGKDGN

SEQ ID NO: 172468 - protein, 9 aa, Borrelia burgdorferi B31
LFISCNNSG

SEQ ID NO: 172469 - protein, 15 aa, Borrelia burgdorferi B31
LGKEGVTDADAKEAI

SEQ ID NO: 172470 - protein, 9 aa, Borrelia burgdorferi B31
VTDADAKEA

SEQ ID NO: 172471 - protein, 15 aa, Borrelia burgdorferi B31
LKTNGTKTKGAEELG

SEQ ID NO: 172472 - protein, 9 aa, Borrelia burgdorferi B31
LKTNGTKTK

SEQ ID NO: 172473 - protein, 15 aa, Borrelia burgdorferi B31
LLAGAYAISTLIKQK

SEQ ID NO: 172474 - protein, 9 aa, Borrelia burgdorferi B31
LAGAYAIST

SEQ ID NO: 172475 - protein, 15 aa, Borrelia burgdorferi B31
LLAVKEVEALLSSID

SEQ ID NO: 172476 - protein, 9 aa, Borrelia burgdorferi B31
VKEVEALLS

SEQ ID NO: 172477 - protein, 15 aa, Borrelia burgdorferi B31
LMTLFLFISCNNSGK

SEQ ID NO: 172478 - protein, 9 aa, Borrelia burgdorferi B31
LFISCNNSG

SEQ ID NO: 172479 - protein, 15 aa, Borrelia burgdorferi B31
LSAILMTLFLFISCN

SEQ ID NO: 172480 - protein, 9 aa, Borrelia burgdorferi B31
LMTLFLFIS

SEQ ID NO: 172481 - protein, 15 aa, Borrelia burgdorferi B31
LSKAAKEMLANSVKE

SEQ ID NO: 172482 - protein, 9 aa, Borrelia burgdorferi B31
AKEMLANSV

SEQ ID NO: 172483 - protein, 15 aa, Borrelia burgdorferi B31
LSSIDEIAAKAIGKK

SEQ ID NO: 172484 - protein, 9 aa, Borrelia burgdorferi B31
IDEIAAKAI

SEQ ID NO: 172485 - protein, 15 aa, Borrelia burgdorferi B31
MKKNTLSAILMTLFL

SEQ ID NO: 172486 - protein, 9 aa, Borrelia burgdorferi B31
KNTLSAILM

SEQ ID NO: 172487 - protein, 15 aa, Borrelia burgdorferi B31
MKKNTLSAILMTLFL

SEQ ID NO: 172488 - protein, 9 aa, Borrelia burgdorferi B31
MKKNTLSAI

SEQ ID NO: 172489 - protein, 15 aa, Borrelia burgdorferi B31
MLANSVKELTSPVVA

SEQ ID NO: 172490 - protein, 9 aa, Borrelia burgdorferi B31
LANSVKELT

SEQ ID NO: 172491 - protein, 15 aa, Borrelia burgdorferi B31
MLANSVKELTSPVVA

SEQ ID NO: 172492 - protein, 9 aa, Borrelia burgdorferi B31
VKELTSPVV

SEQ ID NO: 172493 - protein, 15 aa, Borrelia burgdorferi B31
MTLFLFISCNNSGKD

SEQ ID NO: 172494 - protein, 9 aa, Borrelia burgdorferi B31
LFISCNNSG

SEQ ID NO: 172495 - protein, 15 aa, Borrelia burgdorferi B31
NAVLLAVKEVEALLS

SEQ ID NO: 172496 - protein, 9 aa, Borrelia burgdorferi B31
LAVKEVEAL

SEQ ID NO: 172497 - protein, 15 aa, Borrelia burgdorferi B31
NGSLLAGAYAISTLI

SEQ ID NO: 172498 - protein, 9 aa, Borrelia burgdorferi B31
LAGAYAIST

SEQ ID NO: 172499 - protein, 15 aa, Borrelia burgdorferi B31
NHNGSLLAGAYAIST

SEQ ID NO: 172500 - protein, 9 aa, Borrelia burgdorferi B31
LLAGAYAIS

SEQ ID NO: 172501 - protein, 15 aa, Borrelia burgdorferi B31
NNHNGSLLAGAYAIS

SEQ ID NO: 172502 - protein, 9 aa, Borrelia burgdorferi B31
SLLAGAYAI

SEQ ID NO: 172503 - protein, 15 aa, Borrelia burgdorferi B31
NSADESVKGPNLTEI

SEQ ID NO: 172504 - protein, 9 aa, Borrelia burgdorferi B31
ESVKGPNLT

SEQ ID NO: 172505 - protein, 15 aa, Borrelia burgdorferi B31
NSVKELTSPVVAESP

SEQ ID NO: 172506 - protein, 9 aa, Borrelia burgdorferi B31
VKELTSPVV

SEQ ID NO: 172507 - protein, 15 aa, Borrelia burgdorferi B31
NTLSAILMTLFLFIS

SEQ ID NO: 172508 - protein, 9 aa, Borrelia burgdorferi B31
LSAILMTLF

SEQ ID NO: 172509 - protein, 15 aa, Borrelia burgdorferi B31
QKLDGLKNEGLKEKI

SEQ ID NO: 172510 - protein, 9 aa, Borrelia burgdorferi B31
LKNEGLKEK

SEQ ID NO: 172511 - protein, 15 aa, Borrelia burgdorferi B31
SADESVKGPNLTEIS

SEQ ID NO: 172512 - protein, 9 aa, Borrelia burgdorferi B31
VKGPNLTEI

SEQ ID NO: 172513 - protein, 15 aa, Borrelia burgdorferi B31
SAILMTLFLFISCNN

SEQ ID NO: 172514 - protein, 9 aa, Borrelia burgdorferi B31
LMTLFLFIS

SEQ ID NO: 172515 - protein, 15 aa, Borrelia burgdorferi B31
SETFTNKLKEKHTDL

SEQ ID NO: 172516 - protein, 9 aa, Borrelia burgdorferi B31
FTNKLKEKH

SEQ ID NO: 172517 - protein, 15 aa, Borrelia burgdorferi B31
SKKITDSNAVLLAVK

SEQ ID NO: 172518 - protein, 9 aa, Borrelia burgdorferi B31
ITDSNAVLL

SEQ ID NO: 172519 - protein, 15 aa, Borrelia burgdorferi B31
SKAAKEMLANSVKEL

SEQ ID NO: 172520 - protein, 9 aa, Borrelia burgdorferi B31
AKEMLANSV

SEQ ID NO: 172521 - protein, 15 aa, Borrelia burgdorferi B31
SLLAGAYAISTLIKQ

SEQ ID NO: 172522 - protein, 9 aa, Borrelia burgdorferi B31
LAGAYAIST

SEQ ID NO: 172523 - protein, 15 aa, Borrelia burgdorferi B31
SSIDEIAAKAIGKKI

SEQ ID NO: 172524 - protein, 9 aa, Borrelia burgdorferi B31
IDEIAAKAI

SEQ ID NO: 172525 - protein, 15 aa, Borrelia burgdorferi B31
SVEVLSKAAKEMLAN

SEQ ID NO: 172526 - protein, 9 aa, Borrelia burgdorferi B31
LSKAAKEML

SEQ ID NO: 172527 - protein, 15 aa, Borrelia burgdorferi B31
SVEVLSKAAKEMLAN

SEQ ID NO: 172528 - protein, 9 aa, Borrelia burgdorferi B31
VLSKAAKEM

SEQ ID NO: 172529 - protein, 15 aa, Borrelia burgdorferi B31
SVKELTSPVVAESPK

SEQ ID NO: 172530 - protein, 9 aa, Borrelia burgdorferi B31
VKELTSPVV

SEQ ID NO: 172531 - protein, 15 aa, Borrelia burgdorferi B31
TEISKKITDSNAVLL

SEQ ID NO: 172532 - protein, 9 aa, Borrelia burgdorferi B31
KKITDSNAV

SEQ ID NO: 172533 - protein, 15 aa, Borrelia burgdorferi B31
TLFLFISCNNSGKDG

SEQ ID NO: 172534 - protein, 9 aa, Borrelia burgdorferi B31
LFISCNNSG

SEQ ID NO: 172535 - protein, 15 aa, Borrelia burgdorferi B31
TLSAILMTLFLFISC

SEQ ID NO: 172536 - protein, 9 aa, Borrelia burgdorferi B31
LMTLFLFIS

SEQ ID NO: 172537 - protein, 15 aa, Borrelia burgdorferi B31
VEVLSKAAKEMLANS

SEQ ID NO: 172538 - protein, 9 aa, Borrelia burgdorferi B31
VLSKAAKEM

SEQ ID NO: 172539 - protein, 15 aa, Borrelia burgdorferi B31
VKELTSPVVAESPKK

SEQ ID NO: 172540 - protein, 9 aa, Borrelia burgdorferi B31
VKELTSPVV

SEQ ID NO: 172541 - protein, 15 aa, Borrelia burgdorferi B31
VKEVEALLSSIDEIA

SEQ ID NO: 172542 - protein, 9 aa, Borrelia burgdorferi B31
VKEVEALLS

SEQ ID NO: 172543 - protein, 15 aa, Borrelia burgdorferi B31
VLLAVKEVEALLSSI

SEQ ID NO: 172544 - protein, 9 aa, Borrelia burgdorferi B31
VKEVEALLS

SEQ ID NO: 172545 - protein, 15 aa, Borrelia burgdorferi B31
VLSKAAKEMLANSVK

SEQ ID NO: 172546 - protein, 9 aa, Borrelia burgdorferi B31
VLSKAAKEM

SEQ ID NO: 172547 - protein, 15 aa, Borrelia burgdorferi B31
YAISTLIKQKLDGLK

SEQ ID NO: 172548 - protein, 9 aa, Borrelia burgdorferi B31
ISTLIKQKL

SEQ ID NO: 172549 - protein, 15 aa, Borrelia burgdorferi B31
AAKEMLANSVKELTS

SEQ ID NO: 172550 - protein, 9 aa, Borrelia burgdorferi B31
LANSVKELT

SEQ ID NO: 172551 - protein, 15 aa, Borrelia burgdorferi B31
AAKEMLANSVKELTS

SEQ ID NO: 172552 - protein, 9 aa, Borrelia burgdorferi B31
MLANSVKEL

SEQ ID NO: 172553 - protein, 8 aa, Borrelia afzelii
KYLLGIGL

SEQ ID NO: 172554 - protein, 8 aa, Borrelia afzelii
YLLGIGLI

SEQ ID NO: 172555 - protein, 8 aa, Borrelia afzelii
LLGIGLIL

SEQ ID NO: 172556 - protein, 8 aa, Borrelia afzelii
GIGLILAL

SEQ ID NO: 172557 - protein, 8 aa, Borrelia afzelii
GLILALIA

SEQ ID NO: 172558 - protein, 8 aa, Borrelia afzelii
ILALIACK

SEQ ID NO: 172559 - protein, 8 aa, Borrelia afzelii
LIACKQNV

SEQ ID NO: 172560 - protein, 8 aa, Borrelia afzelii
NVSSLDEK

SEQ ID NO: 172561 - protein, 8 aa, Borrelia afzelii
SLDEKNSA

SEQ ID NO: 172562 - protein, 8 aa, Borrelia afzelii
SVDLPGEM

SEQ ID NO: 172563 - protein, 8 aa, Borrelia afzelii
DLPGEMKV

SEQ ID NO: 172564 - protein, 8 aa, Borrelia afzelii
LPGEMKVL

SEQ ID NO: 172565 - protein, 8 aa, Borrelia afzelii
EMKVLVSK

SEQ ID NO: 172566 - protein, 8 aa, Borrelia afzelii
KVLVSKEK

SEQ ID NO: 172567 - protein, 8 aa, Borrelia afzelii
SLKATVDK

SEQ ID NO: 172568 - protein, 8 aa, Borrelia afzelii
ATVDKIEL

SEQ ID NO: 172569 - protein, 8 aa, Borrelia afzelii
TVDKIELK

SEQ ID NO: 172570 - protein, 8 aa, Borrelia afzelii
ELKGTSDK

SEQ ID NO: 172571 - protein, 8 aa, Borrelia afzelii
GTKDDKSK

SEQ ID NO: 172572 - protein, 8 aa, Borrelia afzelii
KLTIADDL

SEQ ID NO: 172573 - protein, 8 aa, Borrelia afzelii
TIADDLSK

SEQ ID NO: 172574 - protein, 8 aa, Borrelia afzelii
KTTFELFK

SEQ ID NO: 172575 - protein, 8 aa, Borrelia afzelii
TTFELFKE

SEQ ID NO: 172576 - protein, 8 aa, Borrelia afzelii
ELFKEDGK

SEQ ID NO: 172577 - protein, 8 aa, Borrelia afzelii
FKEDGKTL

SEQ ID NO: 172578 - protein, 8 aa, Borrelia afzelii
KEDGKTLV

SEQ ID NO: 172579 - protein, 8 aa, Borrelia afzelii
VSRKVSSK

SEQ ID NO: 172580 - protein, 8 aa, Borrelia afzelii
KTSTDEMF

SEQ ID NO: 172581 - protein, 8 aa, Borrelia afzelii
GELSAKTM

SEQ ID NO: 172582 - protein, 8 aa, Borrelia afzelii
LSAKTMTR

SEQ ID NO: 172583 - protein, 8 aa, Borrelia afzelii
MTRENGTK

SEQ ID NO: 172584 - protein, 8 aa, Borrelia afzelii
TRENGTKL

SEQ ID NO: 172585 - protein, 8 aa, Borrelia afzelii
KLEYTEMK

SEQ ID NO: 172586 - protein, 8 aa, Borrelia afzelii
GTGKAKEV

SEQ ID NO: 172587 - protein, 8 aa, Borrelia afzelii
EVLKNFTL

SEQ ID NO: 172588 - protein, 8 aa, Borrelia afzelii
FTLEGKVA

SEQ ID NO: 172589 - protein, 8 aa, Borrelia afzelii
VANDKVTL

SEQ ID NO: 172590 - protein, 8 aa, Borrelia afzelii
VKEGTVTL

SEQ ID NO: 172591 - protein, 8 aa, Borrelia afzelii
TLSKEIAK

SEQ ID NO: 172592 - protein, 8 aa, Borrelia afzelii
EIAKSGEV

SEQ ID NO: 172593 - protein, 8 aa, Borrelia afzelii
ALNDTNTT

SEQ ID NO: 172594 - protein, 8 aa, Borrelia afzelii
NTTQATKK

SEQ ID NO: 172595 - protein, 8 aa, Borrelia afzelii
ATKKTGAW

SEQ ID NO: 172596 - protein, 8 aa, Borrelia afzelii
KTGAWDSK

SEQ ID NO: 172597 - protein, 8 aa, Borrelia afzelii
TSTLTISV

SEQ ID NO: 172598 - protein, 8 aa, Borrelia afzelii
LTISVNSK

SEQ ID NO: 172599 - protein, 8 aa, Borrelia afzelii
TISVNSKK

SEQ ID NO: 172600 - protein, 8 aa, Borrelia afzelii
TTQLVFTK

SEQ ID NO: 172601 - protein, 8 aa, Borrelia afzelii
TKQDTITV

SEQ ID NO: 172602 - protein, 8 aa, Borrelia afzelii
DTITVQKY

SEQ ID NO: 172603 - protein, 8 aa, Borrelia afzelii
EGTAVEIK

SEQ ID NO: 172604 - protein, 8 aa, Borrelia afzelii
TAVEIKTL

SEQ ID NO: 172605 - protein, 8 aa, Borrelia afzelii
EIKTLDEL

SEQ ID NO: 172606 - protein, 8 aa, Borrelia afzelii
TLDELKNA

SEQ ID NO: 172607 - protein, 9 aa, Borrelia afzelii
KYLLGIGLI

SEQ ID NO: 172608 - protein, 9 aa, Borrelia afzelii
YLLGIGLIL

SEQ ID NO: 172609 - protein, 9 aa, Borrelia afzelii
LLGIGLILA

SEQ ID NO: 172610 - protein, 9 aa, Borrelia afzelii
GIGLILALI

SEQ ID NO: 172611 - protein, 9 aa, Borrelia afzelii
LILALIACK

SEQ ID NO: 172612 - protein, 9 aa, Borrelia afzelii
ALIACKQNV

SEQ ID NO: 172613 - protein, 9 aa, Borrelia afzelii
SLDEKNSAS

SEQ ID NO: 172614 - protein, 9 aa, Borrelia afzelii
SVDLPGEMK

SEQ ID NO: 172615 - protein, 9 aa, Borrelia afzelii
VDLPGEMKV

SEQ ID NO: 172616 - protein, 9 aa, Borrelia afzelii
DLPGEMKVL

SEQ ID NO: 172617 - protein, 9 aa, Borrelia afzelii
LPGEMKVLV

SEQ ID NO: 172618 - protein, 9 aa, Borrelia afzelii
GKYSLKATV

SEQ ID NO: 172619 - protein, 9 aa, Borrelia afzelii
YSLKATVDK

SEQ ID NO: 172620 - protein, 9 aa, Borrelia afzelii
SLKATVDKI

SEQ ID NO: 172621 - protein, 9 aa, Borrelia afzelii
ATVDKIELK

SEQ ID NO: 172622 - protein, 9 aa, Borrelia afzelii
GSGVLEGTK

SEQ ID NO: 172623 - protein, 9 aa, Borrelia afzelii
LTIADDLSK

SEQ ID NO: 172624 - protein, 9 aa, Borrelia afzelii
TIADDLSKT

SEQ ID NO: 172625 - protein, 9 aa, Borrelia afzelii
DLSKTTFEL

SEQ ID NO: 172626 - protein, 9 aa, Borrelia afzelii
SKTTFELFK

SEQ ID NO: 172627 - protein, 9 aa, Borrelia afzelii
FKEDGKTLV

SEQ ID NO: 172628 - protein, 9 aa, Borrelia afzelii
LVSRKVSSK

SEQ ID NO: 172629 - protein, 9 aa, Borrelia afzelii
SRKVSSKDK

SEQ ID NO: 172630 - protein, 9 aa, Borrelia afzelii
STDEMFNEK

SEQ ID NO: 172631 - protein, 9 aa, Borrelia afzelii
EMFNEKGEL

SEQ ID NO: 172632 - protein, 9 aa, Borrelia afzelii
ELSAKTMTR

SEQ ID NO: 172633 - protein, 9 aa, Borrelia afzelii
TMTRENGTK

SEQ ID NO: 172634 - protein, 9 aa, Borrelia afzelii
MTRENGTKL

SEQ ID NO: 172635 - protein, 9 aa, Borrelia afzelii
RENGTKLEY

SEQ ID NO: 172636 - protein, 9 aa, Borrelia afzelii
KSDGTGKAK

SEQ ID NO: 172637 - protein, 9 aa, Borrelia afzelii
TGKAKEVLK

SEQ ID NO: 172638 - protein, 9 aa, Borrelia afzelii
KEVLKNFTL

SEQ ID NO: 172639 - protein, 9 aa, Borrelia afzelii
KVANDKVTL

SEQ ID NO: 172640 - protein, 9 aa, Borrelia afzelii
ANDKVTLEV

SEQ ID NO: 172641 - protein, 9 aa, Borrelia afzelii
TLEVKEGTV

SEQ ID NO: 172642 - protein, 9 aa, Borrelia afzelii
EVKEGTVTL

SEQ ID NO: 172643 - protein, 9 aa, Borrelia afzelii
VTLSKEIAK

SEQ ID NO: 172644 - protein, 9 aa, Borrelia afzelii
KEIAKSGEV

SEQ ID NO: 172645 - protein, 9 aa, Borrelia afzelii
IAKSGEVTV

SEQ ID NO: 172646 - protein, 9 aa, Borrelia afzelii
KSGEVTVAL

SEQ ID NO: 172647 - protein, 9 aa, Borrelia afzelii
TVALNDTNT

SEQ ID NO: 172648 - protein, 9 aa, Borrelia afzelii
ALNDTNTTQ

SEQ ID NO: 172649 - protein, 9 aa, Borrelia afzelii
DTNTTQATK

SEQ ID NO: 172650 - protein, 9 aa, Borrelia afzelii
KKTGAWDSK

SEQ ID NO: 172651 - protein, 9 aa, Borrelia afzelii
KTSTLTISV

SEQ ID NO: 172652 - protein, 9 aa, Borrelia afzelii
TLTISVNSK

SEQ ID NO: 172653 - protein, 9 aa, Borrelia afzelii
LTISVNSKK

SEQ ID NO: 172654 - protein, 9 aa, Borrelia afzelii
KTTQLVFTK

SEQ ID NO: 172655 - protein, 9 aa, Borrelia afzelii
FTKQDTITV

SEQ ID NO: 172656 - protein, 9 aa, Borrelia afzelii
KQDTITVQK

SEQ ID NO: 172657 - protein, 9 aa, Borrelia afzelii
KYDSAGTNL

SEQ ID NO: 172658 - protein, 9 aa, Borrelia afzelii
GTNLEGTAV

SEQ ID NO: 172659 - protein, 9 aa, Borrelia afzelii
NLEGTAVEI

SEQ ID NO: 172660 - protein, 9 aa, Borrelia afzelii
VEIKTLDEL

SEQ ID NO: 172661 - protein, 9 aa, Borrelia afzelii
EIKTLDELK

SEQ ID NO: 172662 - protein, 9 aa, Borrelia afzelii
TLDELKNAL

SEQ ID NO: 172663 - protein, 10 aa, Borrelia afzelii
KYLLGIGLIL

SEQ ID NO: 172664 - protein, 10 aa, Borrelia afzelii
YLLGIGLILA

SEQ ID NO: 172665 - protein, 10 aa, Borrelia afzelii
LLGIGLILAL

SEQ ID NO: 172666 - protein, 10 aa, Borrelia afzelii
LGIGLILALI

SEQ ID NO: 172667 - protein, 10 aa, Borrelia afzelii
GLILALIACK

SEQ ID NO: 172668 - protein, 10 aa, Borrelia afzelii
KQNVSSLDEK

SEQ ID NO: 172669 - protein, 10 aa, Borrelia afzelii
SLDEKNSASV

SEQ ID NO: 172670 - protein, 10 aa, Borrelia afzelii
SASVDLPGEM

SEQ ID NO: 172671 - protein, 10 aa, Borrelia afzelii
ASVDLPGEMK

SEQ ID NO: 172672 - protein, 10 aa, Borrelia afzelii
SVDLPGEMKV

SEQ ID NO: 172673 - protein, 10 aa, Borrelia afzelii
DLPGEMKVLV

SEQ ID NO: 172674 - protein, 10 aa, Borrelia afzelii
LPGEMKVLVS

SEQ ID NO: 172675 - protein, 10 aa, Borrelia afzelii
EMKVLVSKEK

SEQ ID NO: 172676 - protein, 10 aa, Borrelia afzelii
KVLVSKEKDK

SEQ ID NO: 172677 - protein, 10 aa, Borrelia afzelii
KDKDGKYSLK

SEQ ID NO: 172678 - protein, 10 aa, Borrelia afzelii
KYSLKATVDK

SEQ ID NO: 172679 - protein, 10 aa, Borrelia afzelii
KATVDKIELK

SEQ ID NO: 172680 - protein, 10 aa, Borrelia afzelii
KIELKGTSDK

SEQ ID NO: 172681 - protein, 10 aa, Borrelia afzelii
GVLEGTKDDK

SEQ ID NO: 172682 - protein, 10 aa, Borrelia afzelii
GTKDDKSKAK

SEQ ID NO: 172683 - protein, 10 aa, Borrelia afzelii
KLTIADDLSK

SEQ ID NO: 172684 - protein, 10 aa, Borrelia afzelii
TIADDLSKTT

SEQ ID NO: 172685 - protein, 10 aa, Borrelia afzelii
IADDLSKTTF

SEQ ID NO: 172686 - protein, 10 aa, Borrelia afzelii
DLSKTTFELF

SEQ ID NO: 172687 - protein, 10 aa, Borrelia afzelii
LSKTTFELFK

SEQ ID NO: 172688 - protein, 10 aa, Borrelia afzelii
ELFKEDGKTL

SEQ ID NO: 172689 - protein, 10 aa, Borrelia afzelii
TLVSRKVSSK

SEQ ID NO: 172690 - protein, 10 aa, Borrelia afzelii
VSRKVSSKDK

SEQ ID NO: 172691 - protein, 10 aa, Borrelia afzelii
TSTDEMFNEK

SEQ ID NO: 172692 - protein, 10 aa, Borrelia afzelii
DEMFNEKGEL

SEQ ID NO: 172693 - protein, 10 aa, Borrelia afzelii
KTMTRENGTK

SEQ ID NO: 172694 - protein, 10 aa, Borrelia afzelii
TMTRENGTKL

SEQ ID NO: 172695 - protein, 10 aa, Borrelia afzelii
GTKLEYTEMK

SEQ ID NO: 172696 - protein, 10 aa, Borrelia afzelii
GTGKAKEVLK

SEQ ID NO: 172697 - protein, 10 aa, Borrelia afzelii
VLKNFTLEGK

SEQ ID NO: 172698 - protein, 10 aa, Borrelia afzelii
VANDKVTLEV

SEQ ID NO: 172699 - protein, 10 aa, Borrelia afzelii
VTLEVKEGTV

SEQ ID NO: 172700 - protein, 10 aa, Borrelia afzelii
LEVKEGTVTL

SEQ ID NO: 172701 - protein, 10 aa, Borrelia afzelii
TVTLSKEIAK

SEQ ID NO: 172702 - protein, 10 aa, Borrelia afzelii
EIAKSGEVTV

SEQ ID NO: 172703 - protein, 10 aa, Borrelia afzelii
AKSGEVTVAL

SEQ ID NO: 172704 - protein, 10 aa, Borrelia afzelii
TVALNDTNTT

SEQ ID NO: 172705 - protein, 10 aa, Borrelia afzelii
ALNDTNTTQA

SEQ ID NO: 172706 - protein, 10 aa, Borrelia afzelii
DTNTTQATKK

SEQ ID NO: 172707 - protein, 10 aa, Borrelia afzelii
GAWDSKTSTL

SEQ ID NO: 172708 - protein, 10 aa, Borrelia afzelii
SKTSTLTISV

SEQ ID NO: 172709 - protein, 10 aa, Borrelia afzelii
STLTISVNSK

SEQ ID NO: 172710 - protein, 10 aa, Borrelia afzelii
TLTISVNSKK

SEQ ID NO: 172711 - protein, 10 aa, Borrelia afzelii
SVNSKKTTQL

SEQ ID NO: 172712 - protein, 10 aa, Borrelia afzelii
KKTTQLVFTK

SEQ ID NO: 172713 - protein, 10 aa, Borrelia afzelii
QLVFTKQDTI

SEQ ID NO: 172714 - protein, 10 aa, Borrelia afzelii
KTLDELKNAL

SEQ ID NO: 172715 - protein, 10 aa, Borrelia afzelii
TLDELKNALK

SEQ ID NO: 172716 - protein, 11 aa, Borrelia afzelii
YLLGIGLILAL

SEQ ID NO: 172717 - protein, 11 aa, Borrelia afzelii
LLGIGLILALI

SEQ ID NO: 172718 - protein, 11 aa, Borrelia afzelii
ILALIACKQNV

SEQ ID NO: 172719 - protein, 11 aa, Borrelia afzelii
LIACKQNVSSL

SEQ ID NO: 172720 - protein, 11 aa, Borrelia afzelii
NVSSLDEKNSA

SEQ ID NO: 172721 - protein, 11 aa, Borrelia afzelii
SSLDEKNSASV

SEQ ID NO: 172722 - protein, 11 aa, Borrelia afzelii
SASVDLPGEMK

SEQ ID NO: 172723 - protein, 11 aa, Borrelia afzelii
SVDLPGEMKVL

SEQ ID NO: 172724 - protein, 11 aa, Borrelia afzelii
VDLPGEMKVLV

SEQ ID NO: 172725 - protein, 11 aa, Borrelia afzelii
LPGEMKVLVSK

SEQ ID NO: 172726 - protein, 11 aa, Borrelia afzelii
LVSKEKDKDGK

SEQ ID NO: 172727 - protein, 11 aa, Borrelia afzelii
KYSLKATVDKI

SEQ ID NO: 172728 - protein, 11 aa, Borrelia afzelii
SLKATVDKIEL

SEQ ID NO: 172729 - protein, 11 aa, Borrelia afzelii
GTSDKDNGSGV

SEQ ID NO: 172730 - protein, 11 aa, Borrelia afzelii
TIADDLSKTTF

SEQ ID NO: 172731 - protein, 11 aa, Borrelia afzelii
DLSKTTFELFK

SEQ ID NO: 172732 - protein, 11 aa, Borrelia afzelii
TTFELFKEDGK

SEQ ID NO: 172733 - protein, 11 aa, Borrelia afzelii
FELFKEDGKTL

SEQ ID NO: 172734 - protein, 11 aa, Borrelia afzelii
ELFKEDGKTLV

SEQ ID NO: 172735 - protein, 11 aa, Borrelia afzelii
KTLVSRKVSSK

SEQ ID NO: 172736 - protein, 11 aa, Borrelia afzelii
LVSRKVSSKDK

SEQ ID NO: 172737 - protein, 11 aa, Borrelia afzelii
KTSTDEMFNEK

SEQ ID NO: 172738 - protein, 11 aa, Borrelia afzelii
EMFNEKGELSA

SEQ ID NO: 172739 - protein, 11 aa, Borrelia afzelii
MFNEKGELSAK

SEQ ID NO: 172740 - protein, 11 aa, Borrelia afzelii
KTMTRENGTKL

SEQ ID NO: 172741 - protein, 11 aa, Borrelia afzelii
MTRENGTKLEY

SEQ ID NO: 172742 - protein, 11 aa, Borrelia afzelii
YTEMKSDGTGK

SEQ ID NO: 172743 - protein, 11 aa, Borrelia afzelii
EVLKNFTLEGK

SEQ ID NO: 172744 - protein, 11 aa, Borrelia afzelii
VLKNFTLEGKV

SEQ ID NO: 172745 - protein, 11 aa, Borrelia afzelii
FTLEGKVANDK

SEQ ID NO: 172746 - protein, 11 aa, Borrelia afzelii
TLEGKVANDKV

SEQ ID NO: 172747 - protein, 11 aa, Borrelia afzelii
KVANDKVTLEV

SEQ ID NO: 172748 - protein, 11 aa, Borrelia afzelii
VANDKVTLEVK

SEQ ID NO: 172749 - protein, 11 aa, Borrelia afzelii
KVTLEVKEGTV

SEQ ID NO: 172750 - protein, 11 aa, Borrelia afzelii
TLEVKEGTVTL

SEQ ID NO: 172751 - protein, 11 aa, Borrelia afzelii
EVKEGTVTLSK

SEQ ID NO: 172752 - protein, 11 aa, Borrelia afzelii
GTVTLSKEIAK

SEQ ID NO: 172753 - protein, 11 aa, Borrelia afzelii
KEIAKSGEVTV

SEQ ID NO: 172754 - protein, 11 aa, Borrelia afzelii
EIAKSGEVTVA

SEQ ID NO: 172755 - protein, 11 aa, Borrelia afzelii
IAKSGEVTVAL

SEQ ID NO: 172756 - protein, 11 aa, Borrelia afzelii
ALNDTNTTQAT

SEQ ID NO: 172757 - protein, 11 aa, Borrelia afzelii
TTQATKKTGAW

SEQ ID NO: 172758 - protein, 11 aa, Borrelia afzelii
ATKKTGAWDSK

SEQ ID NO: 172759 - protein, 11 aa, Borrelia afzelii
AWDSKTSTLTI

SEQ ID NO: 172760 - protein, 11 aa, Borrelia afzelii
TSTLTISVNSK

SEQ ID NO: 172761 - protein, 11 aa, Borrelia afzelii
STLTISVNSKK

SEQ ID NO: 172762 - protein, 11 aa, Borrelia afzelii
SVNSKKTTQLV

SEQ ID NO: 172763 - protein, 11 aa, Borrelia afzelii
SKKTTQLVFTK

SEQ ID NO: 172764 - protein, 11 aa, Borrelia afzelii
TQLVFTKQDTI

SEQ ID NO: 172765 - protein, 11 aa, Borrelia afzelii
LVFTKQDTITV

SEQ ID NO: 172766 - protein, 11 aa, Borrelia afzelii
FTKQDTITVQK

SEQ ID NO: 172767 - protein, 11 aa, Borrelia afzelii
DTITVQKYDSA

SEQ ID NO: 172768 - protein, 11 aa, Borrelia afzelii
VQKYDSAGTNL

SEQ ID NO: 172769 - protein, 11 aa, Borrelia afzelii
SAGTNLEGTAV

SEQ ID NO: 172770 - protein, 11 aa, Borrelia afzelii
NLEGTAVEIKT

SEQ ID NO: 172771 - protein, 11 aa, Borrelia afzelii
LEGTAVEIKTL

SEQ ID NO: 172772 - protein, 11 aa, Borrelia afzelii
TAVEIKTLDEL

SEQ ID NO: 172773 - protein, 11 aa, Borrelia afzelii
AVEIKTLDELK

SEQ ID NO: 172774 - protein, 11 aa, Borrelia afzelii
KTLDELKNALK

SEQ ID NO: 172775 - protein, 15 aa, Borrelia afzelii
AKEVLKNFTLEGKVA

SEQ ID NO: 172776 - protein, 9 aa, Borrelia afzelii
LKNFTLEGK

SEQ ID NO: 172777 - protein, 15 aa, Borrelia afzelii
AKEVLKNFTLEGKVA

SEQ ID NO: 172778 - protein, 9 aa, Borrelia afzelii
VLKNFTLEG

SEQ ID NO: 172779 - protein, 15 aa, Borrelia afzelii
ALNDTNTTQATKKTG

SEQ ID NO: 172780 - protein, 9 aa, Borrelia afzelii
NTTQATKKT

SEQ ID NO: 172781 - protein, 15 aa, Borrelia afzelii
AWDSKTSTLTISVNS

SEQ ID NO: 172782 - protein, 9 aa, Borrelia afzelii
WDSKTSTLT

SEQ ID NO: 172783 - protein, 15 aa, Borrelia afzelii
DEMFNEKGELSAKTM

SEQ ID NO: 172784 - protein, 9 aa, Borrelia afzelii
MFNEKGELS

SEQ ID NO: 172785 - protein, 15 aa, Borrelia afzelii
DGKTLVSRKVSSKDK

SEQ ID NO: 172786 - protein, 9 aa, Borrelia afzelii
GKTLVSRKV

SEQ ID NO: 172787 - protein, 15 aa, Borrelia afzelii
DKVTLEVKEGTVTLS

SEQ ID NO: 172788 - protein, 9 aa, Borrelia afzelii
LEVKEGTVT

SEQ ID NO: 172789 - protein, 15 aa, Borrelia afzelii
DLPGEMKVLVSKEKD

SEQ ID NO: 172790 - protein, 9 aa, Borrelia afzelii
MKVLVSKEK

SEQ ID NO: 172791 - protein, 15 aa, Borrelia afzelii
DTITVQKYDSAGTNL

SEQ ID NO: 172792 - protein, 9 aa, Borrelia afzelii
VQKYDSAGT

SEQ ID NO: 172793 - protein, 15 aa, Borrelia afzelii
EDGKTLVSRKVSSKD

SEQ ID NO: 172794 - protein, 9 aa, Borrelia afzelii
GKTLVSRKV

SEQ ID NO: 172795 - protein, 15 aa, Borrelia afzelii
ELFKEDGKTLVSRKV

SEQ ID NO: 172796 - protein, 9 aa, Borrelia afzelii
FKEDGKTLV

SEQ ID NO: 172797 - protein, 15 aa, Borrelia afzelii
EMFNEKGELSAKTMT

SEQ ID NO: 172798 - protein, 9 aa, Borrelia afzelii
EKGELSAKT

SEQ ID NO: 172799 - protein, 15 aa, Borrelia afzelii
EVKEGTVTLSKEIAK

SEQ ID NO: 172800 - protein, 9 aa, Borrelia afzelii
VKEGTVTLS

SEQ ID NO: 172801 - protein, 15 aa, Borrelia afzelii
EVLKNFTLEGKVAND

SEQ ID NO: 172802 - protein, 9 aa, Borrelia afzelii
LKNFTLEGK

SEQ ID NO: 172803 - protein, 15 aa, Borrelia afzelii
EVTVALNDTNTTQAT

SEQ ID NO: 172804 - protein, 9 aa, Borrelia afzelii
LNDTNTTQA

SEQ ID NO: 172805 - protein, 15 aa, Borrelia afzelii
EVTVALNDTNTTQAT

SEQ ID NO: 172806 - protein, 9 aa, Borrelia afzelii
VALNDTNTT

SEQ ID NO: 172807 - protein, 15 aa, Borrelia afzelii
EYTEMKSDGTGKAKE

SEQ ID NO: 172808 - protein, 9 aa, Borrelia afzelii
MKSDGTGKA

SEQ ID NO: 172809 - protein, 15 aa, Borrelia afzelii
EYTEMKSDGTGKAKE

SEQ ID NO: 172810 - protein, 9 aa, Borrelia afzelii
YTEMKSDGT

SEQ ID NO: 172811 - protein, 15 aa, Borrelia afzelii
FKEDGKTLVSRKVSS

SEQ ID NO: 172812 - protein, 9 aa, Borrelia afzelii
GKTLVSRKV

SEQ ID NO: 172813 - protein, 15 aa, Borrelia afzelii
FNEKGELSAKTMTRE

SEQ ID NO: 172814 - protein, 9 aa, Borrelia afzelii
EKGELSAKT

SEQ ID NO: 172815 - protein, 15 aa, Borrelia afzelii
FTKQDTITVQKYDSA

SEQ ID NO: 172816 - protein, 9 aa, Borrelia afzelii
FTKQDTITV

SEQ ID NO: 172817 - protein, 15 aa, Borrelia afzelii
GAWDSKTSTLTISVN

SEQ ID NO: 172818 - protein, 9 aa, Borrelia afzelii
WDSKTSTLT

SEQ ID NO: 172819 - protein, 15 aa, Borrelia afzelii
GEMKVLVSKEKDKDG

SEQ ID NO: 172820 - protein, 9 aa, Borrelia afzelii
MKVLVSKEK

SEQ ID NO: 172821 - protein, 15 aa, Borrelia afzelii
GEVTVALNDTNTTQA

SEQ ID NO: 172822 - protein, 9 aa, Borrelia afzelii
VALNDTNTT

SEQ ID NO: 172823 - protein, 15 aa, Borrelia afzelii
GIGLILALIACKQNV

SEQ ID NO: 172824 - protein, 9 aa, Borrelia afzelii
ILALIACKQ

SEQ ID NO: 172825 - protein, 15 aa, Borrelia afzelii
GKAKEVLKNFTLEGK

SEQ ID NO: 172826 - protein, 9 aa, Borrelia afzelii
VLKNFTLEG

SEQ ID NO: 172827 - protein, 15 aa, Borrelia afzelii
GKTLVSRKVSSKDKT

SEQ ID NO: 172828 - protein, 9 aa, Borrelia afzelii
GKTLVSRKV

SEQ ID NO: 172829 - protein, 15 aa, Borrelia afzelii
GLILALIACKQNVSS

SEQ ID NO: 172830 - protein, 9 aa, Borrelia afzelii
ILALIACKQ

SEQ ID NO: 172831 - protein, 15 aa, Borrelia afzelii
GTKLEYTEMKSDGTG

SEQ ID NO: 172832 - protein, 9 aa, Borrelia afzelii
YTEMKSDGT

SEQ ID NO: 172833 - protein, 15 aa, Borrelia afzelii
IGLILALIACKQNVS

SEQ ID NO: 172834 - protein, 9 aa, Borrelia afzelii
ILALIACKQ

SEQ ID NO: 172835 - protein, 15 aa, Borrelia afzelii
ISVNSKKTTQLVFTK

SEQ ID NO: 172836 - protein, 9 aa, Borrelia afzelii
ISVNSKKTT

SEQ ID NO: 172837 - protein, 15 aa, Borrelia afzelii
ISVNSKKTTQLVFTK

SEQ ID NO: 172838 - protein, 9 aa, Borrelia afzelii
VNSKKTTQL

SEQ ID NO: 172839 - protein, 15 aa, Borrelia afzelii
ITVQKYDSAGTNLEG

SEQ ID NO: 172840 - protein, 9 aa, Borrelia afzelii
VQKYDSAGT

SEQ ID NO: 172841 - protein, 15 aa, Borrelia afzelii
ITVQKYDSAGTNLEG

SEQ ID NO: 172842 - protein, 9 aa, Borrelia afzelii
YDSAGTNLE

SEQ ID NO: 172843 - protein, 15 aa, Borrelia afzelii
KAKEVLKNFTLEGKV

SEQ ID NO: 172844 - protein, 9 aa, Borrelia afzelii
LKNFTLEGK

SEQ ID NO: 172845 - protein, 15 aa, Borrelia afzelii
KAKEVLKNFTLEGKV

SEQ ID NO: 172846 - protein, 9 aa, Borrelia afzelii
VLKNFTLEG

SEQ ID NO: 172847 - protein, 15 aa, Borrelia afzelii
KEDGKTLVSRKVSSK

SEQ ID NO: 172848 - protein, 9 aa, Borrelia afzelii
GKTLVSRKV

SEQ ID NO: 172849 - protein, 15 aa, Borrelia afzelii
KEVLKNFTLEGKVAN

SEQ ID NO: 172850 - protein, 9 aa, Borrelia afzelii
LKNFTLEGK

SEQ ID NO: 172851 - protein, 15 aa, Borrelia afzelii
KEVLKNFTLEGKVAN

SEQ ID NO: 172852 - protein, 9 aa, Borrelia afzelii
VLKNFTLEG

SEQ ID NO: 172853 - protein, 15 aa, Borrelia afzelii
KKTGAWDSKTSTLTI

SEQ ID NO: 172854 - protein, 9 aa, Borrelia afzelii
WDSKTSTLT

SEQ ID NO: 172855 - protein, 15 aa, Borrelia afzelii
KKYLLGIGLILALIA

SEQ ID NO: 172856 - protein, 9 aa, Borrelia afzelii
LLGIGLILA

SEQ ID NO: 172857 - protein, 15 aa, Borrelia afzelii
KLEYTEMKSDGTGKA

SEQ ID NO: 172858 - protein, 9 aa, Borrelia afzelii
YTEMKSDGT

SEQ ID NO: 172859 - protein, 15 aa, Borrelia afzelii
KQDTITVQKYDSAGT

SEQ ID NO: 172860 - protein, 9 aa, Borrelia afzelii
ITVQKYDSA

SEQ ID NO: 172861 - protein, 15 aa, Borrelia afzelii
KSGEVTVALNDTNTT

SEQ ID NO: 172862 - protein, 9 aa, Borrelia afzelii
EVTVALNDT

SEQ ID NO: 172863 - protein, 15 aa, Borrelia afzelii
KTGAWDSKTSTLTIS

SEQ ID NO: 172864 - protein, 9 aa, Borrelia afzelii
WDSKTSTLT

SEQ ID NO: 172865 - protein, 15 aa, Borrelia afzelii
KTSTLTISVNSKKTT

SEQ ID NO: 172866 - protein, 9 aa, Borrelia afzelii
LTISVNSKK

SEQ ID NO: 172867 - protein, 15 aa, Borrelia afzelii
KTTQLVFTKQDTITV

SEQ ID NO: 172868 - protein, 9 aa, Borrelia afzelii
KTTQLVFTK

SEQ ID NO: 172869 - protein, 15 aa, Borrelia afzelii
KTTQLVFTKQDTITV

SEQ ID NO: 172870 - protein, 9 aa, Borrelia afzelii
VFTKQDTIT

SEQ ID NO: 172871 - protein, 15 aa, Borrelia afzelii
KVTLEVKEGTVTLSK

SEQ ID NO: 172872 - protein, 9 aa, Borrelia afzelii
VKEGTVTLS

SEQ ID NO: 172873 - protein, 15 aa, Borrelia afzelii
KYLLGIGLILALIAC

SEQ ID NO: 172874 - protein, 9 aa, Borrelia afzelii
LLGIGLILA

SEQ ID NO: 172875 - protein, 15 aa, Borrelia afzelii
LEVKEGTVTLSKEIA

SEQ ID NO: 172876 - protein, 9 aa, Borrelia afzelii
VKEGTVTLS

SEQ ID NO: 172877 - protein, 15 aa, Borrelia afzelii
LEYTEMKSDGTGKAK

SEQ ID NO: 172878 - protein, 9 aa, Borrelia afzelii
MKSDGTGKA

SEQ ID NO: 172879 - protein, 15 aa, Borrelia afzelii
LEYTEMKSDGTGKAK

SEQ ID NO: 172880 - protein, 9 aa, Borrelia afzelii
YTEMKSDGT

SEQ ID NO: 172881 - protein, 15 aa, Borrelia afzelii
LFKEDGKTLVSRKVS

SEQ ID NO: 172882 - protein, 9 aa, Borrelia afzelii
GKTLVSRKV

SEQ ID NO: 172883 - protein, 15 aa, Borrelia afzelii
LGIGLILALIACKQN

SEQ ID NO: 172884 - protein, 9 aa, Borrelia afzelii
IGLILALIA

SEQ ID NO: 172885 - protein, 15 aa, Borrelia afzelii
LKNFTLEGKVANDKV

SEQ ID NO: 172886 - protein, 9 aa, Borrelia afzelii
LKNFTLEGK

SEQ ID NO: 172887 - protein, 15 aa, Borrelia afzelii
LLGIGLILALIACKQ

SEQ ID NO: 172888 - protein, 9 aa, Borrelia afzelii
IGLILALIA

SEQ ID NO: 172889 - protein, 15 aa, Borrelia afzelii
LNDTNTTQATKKTGA

SEQ ID NO: 172890 - protein, 9 aa, Borrelia afzelii
NTTQATKKT

SEQ ID NO: 172891 - protein, 15 aa, Borrelia afzelii
LPGEMKVLVSKEKDK

SEQ ID NO: 172892 - protein, 9 aa, Borrelia afzelii
MKVLVSKEK

SEQ ID NO: 172893 - protein, 15 aa, Borrelia afzelii
LTISVNSKKTTQLVF

SEQ ID NO: 172894 - protein, 9 aa, Borrelia afzelii
ISVNSKKTT

SEQ ID NO: 172895 - protein, 15 aa, Borrelia afzelii
LTISVNSKKTTQLVF

SEQ ID NO: 172896 - protein, 9 aa, Borrelia afzelii
VNSKKTTQL

SEQ ID NO: 172897 - protein, 15 aa, Borrelia afzelii
LVFTKQDTITVQKYD

SEQ ID NO: 172898 - protein, 9 aa, Borrelia afzelii
FTKQDTITV

SEQ ID NO: 172899 - protein, 15 aa, Borrelia afzelii
MKKYLLGIGLILALI

SEQ ID NO: 172900 - protein, 9 aa, Borrelia afzelii
LLGIGLILA

SEQ ID NO: 172901 - protein, 15 aa, Borrelia afzelii
NGTKLEYTEMKSDGT

SEQ ID NO: 172902 - protein, 9 aa, Borrelia afzelii
TKLEYTEMK

SEQ ID NO: 172903 - protein, 15 aa, Borrelia afzelii
NVSSLDEKNSASVDL

SEQ ID NO: 172904 - protein, 9 aa, Borrelia afzelii
LDEKNSASV

SEQ ID NO: 172905 - protein, 15 aa, Borrelia afzelii
PGEMKVLVSKEKDKD

SEQ ID NO: 172906 - protein, 9 aa, Borrelia afzelii
MKVLVSKEK

SEQ ID NO: 172907 - protein, 15 aa, Borrelia afzelii
QDTITVQKYDSAGTN

SEQ ID NO: 172908 - protein, 9 aa, Borrelia afzelii
VQKYDSAGT

SEQ ID NO: 172909 - protein, 15 aa, Borrelia afzelii
QKYDSAGTNLEGTAV

SEQ ID NO: 172910 - protein, 9 aa, Borrelia afzelii
YDSAGTNLE

SEQ ID NO: 172911 - protein, 15 aa, Borrelia afzelii
QLVFTKQDTITVQKY

SEQ ID NO: 172912 - protein, 9 aa, Borrelia afzelii
FTKQDTITV

SEQ ID NO: 172913 - protein, 15 aa, Borrelia afzelii
SGEVTVALNDTNTTQ

SEQ ID NO: 172914 - protein, 9 aa, Borrelia afzelii
VALNDTNTT

SEQ ID NO: 172915 - protein, 15 aa, Borrelia afzelii
SSLDEKNSASVDLPG

SEQ ID NO: 172916 - protein, 9 aa, Borrelia afzelii
EKNSASVDL

SEQ ID NO: 172917 - protein, 15 aa, Borrelia afzelii
STLTISVNSKKTTQL

SEQ ID NO: 172918 - protein, 9 aa, Borrelia afzelii
ISVNSKKTT

SEQ ID NO: 172919 - protein, 15 aa, Borrelia afzelii
STLTISVNSKKTTQL

SEQ ID NO: 172920 - protein, 9 aa, Borrelia afzelii
TISVNSKKT

SEQ ID NO: 172921 - protein, 15 aa, Borrelia afzelii
SVNSKKTTQLVFTKQ

SEQ ID NO: 172922 - protein, 9 aa, Borrelia afzelii
VNSKKTTQL

SEQ ID NO: 172923 - protein, 15 aa, Borrelia afzelii
TDEMFNEKGELSAKT

SEQ ID NO: 172924 - protein, 9 aa, Borrelia afzelii
MFNEKGELS

SEQ ID NO: 172925 - protein, 15 aa, Borrelia afzelii
TEMKSDGTGKAKEVL

SEQ ID NO: 172926 - protein, 9 aa, Borrelia afzelii
MKSDGTGKA

SEQ ID NO: 172927 - protein, 15 aa, Borrelia afzelii
TGAWDSKTSTLTISV

SEQ ID NO: 172928 - protein, 9 aa, Borrelia afzelii
WDSKTSTLT

SEQ ID NO: 172929 - protein, 15 aa, Borrelia afzelii
TGKAKEVLKNFTLEG

SEQ ID NO: 172930 - protein, 9 aa, Borrelia afzelii
AKEVLKNFT

SEQ ID NO: 172931 - protein, 15 aa, Borrelia afzelii
TISVNSKKTTQLVFT

SEQ ID NO: 172932 - protein, 9 aa, Borrelia afzelii
ISVNSKKTT

SEQ ID NO: 172933 - protein, 15 aa, Borrelia afzelii
TISVNSKKTTQLVFT

SEQ ID NO: 172934 - protein, 9 aa, Borrelia afzelii
VNSKKTTQL

SEQ ID NO: 172935 - protein, 15 aa, Borrelia afzelii
TITVQKYDSAGTNLE

SEQ ID NO: 172936 - protein, 9 aa, Borrelia afzelii
VQKYDSAGT

SEQ ID NO: 172937 - protein, 15 aa, Borrelia afzelii
TKKTGAWDSKTSTLT

SEQ ID NO: 172938 - protein, 9 aa, Borrelia afzelii
KTGAWDSKT

SEQ ID NO: 172939 - protein, 15 aa, Borrelia afzelii
TKLEYTEMKSDGTGK

SEQ ID NO: 172940 - protein, 9 aa, Borrelia afzelii
YTEMKSDGT

SEQ ID NO: 172941 - protein, 15 aa, Borrelia afzelii
TLEVKEGTVTLSKEI

SEQ ID NO: 172942 - protein, 9 aa, Borrelia afzelii
VKEGTVTLS

SEQ ID NO: 172943 - protein, 15 aa, Borrelia afzelii
TLTISVNSKKTTQLV

SEQ ID NO: 172944 - protein, 9 aa, Borrelia afzelii
ISVNSKKTT

SEQ ID NO: 172945 - protein, 15 aa, Borrelia afzelii
TLTISVNSKKTTQLV

SEQ ID NO: 172946 - protein, 9 aa, Borrelia afzelii
VNSKKTTQL

SEQ ID NO: 172947 - protein, 15 aa, Borrelia afzelii
TQLVFTKQDTITVQK

SEQ ID NO: 172948 - protein, 9 aa, Borrelia afzelii
FTKQDTITV

SEQ ID NO: 172949 - protein, 15 aa, Borrelia afzelii
TSTLTISVNSKKTTQ

SEQ ID NO: 172950 - protein, 9 aa, Borrelia afzelii
ISVNSKKTT

SEQ ID NO: 172951 - protein, 15 aa, Borrelia afzelii
TTQLVFTKQDTITVQ

SEQ ID NO: 172952 - protein, 9 aa, Borrelia afzelii
FTKQDTITV

SEQ ID NO: 172953 - protein, 15 aa, Borrelia afzelii
TVALNDTNTTQATKK

SEQ ID NO: 172954 - protein, 9 aa, Borrelia afzelii
LNDTNTTQA

SEQ ID NO: 172955 - protein, 15 aa, Borrelia afzelii
TVALNDTNTTQATKK

SEQ ID NO: 172956 - protein, 9 aa, Borrelia afzelii
VALNDTNTT

SEQ ID NO: 172957 - protein, 15 aa, Borrelia afzelii
TVQKYDSAGTNLEGT

SEQ ID NO: 172958 - protein, 9 aa, Borrelia afzelii
VQKYDSAGT

SEQ ID NO: 172959 - protein, 15 aa, Borrelia afzelii
TVQKYDSAGTNLEGT

SEQ ID NO: 172960 - protein, 9 aa, Borrelia afzelii
YDSAGTNLE

SEQ ID NO: 172961 - protein, 15 aa, Borrelia afzelii
VALNDTNTTQATKKT

SEQ ID NO: 172962 - protein, 9 aa, Borrelia afzelii
LNDTNTTQA

SEQ ID NO: 172963 - protein, 15 aa, Borrelia afzelii
VALNDTNTTQATKKT

SEQ ID NO: 172964 - protein, 9 aa, Borrelia afzelii
VALNDTNTT

SEQ ID NO: 172965 - protein, 15 aa, Borrelia afzelii
VDLPGEMKVLVSKEK

SEQ ID NO: 172966 - protein, 9 aa, Borrelia afzelii
LPGEMKVLV

SEQ ID NO: 172967 - protein, 15 aa, Borrelia afzelii
VDLPGEMKVLVSKEK

SEQ ID NO: 172968 - protein, 9 aa, Borrelia afzelii
VDLPGEMKV

SEQ ID NO: 172969 - protein, 15 aa, Borrelia afzelii
VFTKQDTITVQKYDS

SEQ ID NO: 172970 - protein, 9 aa, Borrelia afzelii
FTKQDTITV

SEQ ID NO: 172971 - protein, 15 aa, Borrelia afzelii
VKEGTVTLSKEIAKS

SEQ ID NO: 172972 - protein, 9 aa, Borrelia afzelii
VKEGTVTLS

SEQ ID NO: 172973 - protein, 15 aa, Borrelia afzelii
VLKNFTLEGKVANDK

SEQ ID NO: 172974 - protein, 9 aa, Borrelia afzelii
LKNFTLEGK

SEQ ID NO: 172975 - protein, 15 aa, Borrelia afzelii
VNSKKTTQLVFTKQD

SEQ ID NO: 172976 - protein, 9 aa, Borrelia afzelii
VNSKKTTQL

SEQ ID NO: 172977 - protein, 15 aa, Borrelia afzelii
VQKYDSAGTNLEGTA

SEQ ID NO: 172978 - protein, 9 aa, Borrelia afzelii
VQKYDSAGT

SEQ ID NO: 172979 - protein, 15 aa, Borrelia afzelii
VQKYDSAGTNLEGTA

SEQ ID NO: 172980 - protein, 9 aa, Borrelia afzelii
YDSAGTNLE

SEQ ID NO: 172981 - protein, 15 aa, Borrelia afzelii
VSSLDEKNSASVDLP

SEQ ID NO: 172982 - protein, 9 aa, Borrelia afzelii
EKNSASVDL

SEQ ID NO: 172983 - protein, 15 aa, Borrelia afzelii
VTLEVKEGTVTLSKE

SEQ ID NO: 172984 - protein, 9 aa, Borrelia afzelii
VKEGTVTLS

SEQ ID NO: 172985 - protein, 15 aa, Borrelia afzelii
VTVALNDTNTTQATK

SEQ ID NO: 172986 - protein, 9 aa, Borrelia afzelii
LNDTNTTQA

SEQ ID NO: 172987 - protein, 15 aa, Borrelia afzelii
VTVALNDTNTTQATK

SEQ ID NO: 172988 - protein, 9 aa, Borrelia afzelii
VALNDTNTT

SEQ ID NO: 172989 - protein, 15 aa, Borrelia afzelii
WDSKTSTLTISVNSK

SEQ ID NO: 172990 - protein, 9 aa, Borrelia afzelii
WDSKTSTLT

SEQ ID NO: 172991 - protein, 15 aa, Borrelia afzelii
YLLGIGLILALIACK

SEQ ID NO: 172992 - protein, 9 aa, Borrelia afzelii
IGLILALIA

SEQ ID NO: 172993 - protein, 15 aa, Borrelia afzelii
YTEMKSDGTGKAKEV

SEQ ID NO: 172994 - protein, 9 aa, Borrelia afzelii
MKSDGTGKA

SEQ ID NO: 172995 - protein, 15 aa, Borrelia afzelii
YTEMKSDGTGKAKEV

SEQ ID NO: 172996 - protein, 9 aa, Borrelia afzelii
YTEMKSDGT

SEQ ID NO: 172997 - protein, 8 aa, Borrelia afzelii PKo
KQYLLVFA

SEQ ID NO: 172998 - protein, 8 aa, Borrelia afzelii PKo
QYLLVFAL

SEQ ID NO: 172999 - protein, 8 aa, Borrelia afzelii PKo
YLLVFALV

SEQ ID NO: 173000 - protein, 8 aa, Borrelia afzelii PKo
LLVFALVL

SEQ ID NO: 173001 - protein, 8 aa, Borrelia afzelii PKo
LVFALVLA

SEQ ID NO: 173002 - protein, 8 aa, Borrelia afzelii PKo
VFALVLAL

SEQ ID NO: 173003 - protein, 8 aa, Borrelia afzelii PKo
FALVLALI

SEQ ID NO: 173004 - protein, 8 aa, Borrelia afzelii PKo
ALVLALIA

SEQ ID NO: 173005 - protein, 8 aa, Borrelia afzelii PKo
ALIACSQK

SEQ ID NO: 173006 - protein, 8 aa, Borrelia afzelii PKo
SQKGTEPK

SEQ ID NO: 173007 - protein, 8 aa, Borrelia afzelii PKo
NTPKDSKK

SEQ ID NO: 173008 - protein, 8 aa, Borrelia afzelii PKo
VLAEENSV

SEQ ID NO: 173009 - protein, 8 aa, Borrelia afzelii PKo
AEENSVPL

SEQ ID NO: 173010 - protein, 8 aa, Borrelia afzelii PKo
EENSVPLF

SEQ ID NO: 173011 - protein, 8 aa, Borrelia afzelii PKo
PLFNGNKI

SEQ ID NO: 173012 - protein, 8 aa, Borrelia afzelii PKo
LFNGNKIF

SEQ ID NO: 173013 - protein, 8 aa, Borrelia afzelii PKo
KIFVSKEK

SEQ ID NO: 173014 - protein, 8 aa, Borrelia afzelii PKo
KEKNSAGK

SEQ ID NO: 173015 - protein, 8 aa, Borrelia afzelii PKo
NSAGKYEL

SEQ ID NO: 173016 - protein, 8 aa, Borrelia afzelii PKo
SAGKYELR

SEQ ID NO: 173017 - protein, 8 aa, Borrelia afzelii PKo
ATVDTVEL

SEQ ID NO: 173018 - protein, 8 aa, Borrelia afzelii PKo
TVDTVELK

SEQ ID NO: 173019 - protein, 8 aa, Borrelia afzelii PKo
DTVELKGV

SEQ ID NO: 173020 - protein, 8 aa, Borrelia afzelii PKo
ELKGVSDK

SEQ ID NO: 173021 - protein, 8 aa, Borrelia afzelii PKo
SGKLEGTK

SEQ ID NO: 173022 - protein, 8 aa, Borrelia afzelii PKo
GTKADKTK

SEQ ID NO: 173023 - protein, 8 aa, Borrelia afzelii PKo
KTKVAMTI

SEQ ID NO: 173024 - protein, 8 aa, Borrelia afzelii PKo
AMTIADDL

SEQ ID NO: 173025 - protein, 8 aa, Borrelia afzelii PKo
IADDLNTI

SEQ ID NO: 173026 - protein, 8 aa, Borrelia afzelii PKo
NTITVETY

SEQ ID NO: 173027 - protein, 8 aa, Borrelia afzelii PKo
ETYDASNK

SEQ ID NO: 173028 - protein, 8 aa, Borrelia afzelii PKo
TYDASNKK

SEQ ID NO: 173029 - protein, 8 aa, Borrelia afzelii PKo
KTGSEVVK

SEQ ID NO: 173030 - protein, 8 aa, Borrelia afzelii PKo
VVKKQGSV

SEQ ID NO: 173031 - protein, 8 aa, Borrelia afzelii PKo
KKQGSVIK

SEQ ID NO: 173032 - protein, 8 aa, Borrelia afzelii PKo
SVIKESYK

SEQ ID NO: 173033 - protein, 8 aa, Borrelia afzelii PKo
KANKLDSK

SEQ ID NO: 173034 - protein, 8 aa, Borrelia afzelii PKo
KLDSKKIT

SEQ ID NO: 173035 - protein, 8 aa, Borrelia afzelii PKo
TRENETTL

SEQ ID NO: 173036 - protein, 8 aa, Borrelia afzelii PKo
TTLEYSEM

SEQ ID NO: 173037 - protein, 8 aa, Borrelia afzelii PKo
EMTDSSNA

SEQ ID NO: 173038 - protein, 8 aa, Borrelia afzelii PKo
ATKAVETL

SEQ ID NO: 173039 - protein, 8 aa, Borrelia afzelii PKo
ETLKNGIK

SEQ ID NO: 173040 - protein, 8 aa, Borrelia afzelii PKo
TLKNGIKL

SEQ ID NO: 173041 - protein, 8 aa, Borrelia afzelii PKo
IKLEGSLV

SEQ ID NO: 173042 - protein, 8 aa, Borrelia afzelii PKo
SLVGGKTT

SEQ ID NO: 173043 - protein, 8 aa, Borrelia afzelii PKo
LVGGKTTV

SEQ ID NO: 173044 - protein, 8 aa, Borrelia afzelii PKo
KLTEGTIT

SEQ ID NO: 173045 - protein, 8 aa, Borrelia afzelii PKo
EGTITLTR

SEQ ID NO: 173046 - protein, 8 aa, Borrelia afzelii PKo
TLTREIEQ

SEQ ID NO: 173047 - protein, 8 aa, Borrelia afzelii PKo
YLNDTTSG

SEQ ID NO: 173048 - protein, 8 aa, Borrelia afzelii PKo
DTTSGSTK

SEQ ID NO: 173049 - protein, 8 aa, Borrelia afzelii PKo
TTSGSTKK

SEQ ID NO: 173050 - protein, 8 aa, Borrelia afzelii PKo
STKKTATW

SEQ ID NO: 173051 - protein, 8 aa, Borrelia afzelii PKo
ETTNTLTI

SEQ ID NO: 173052 - protein, 8 aa, Borrelia afzelii PKo
LTISADSK

SEQ ID NO: 173053 - protein, 8 aa, Borrelia afzelii PKo
TISADSKK

SEQ ID NO: 173054 - protein, 8 aa, Borrelia afzelii PKo
SADSKKTK

SEQ ID NO: 173055 - protein, 8 aa, Borrelia afzelii PKo
KTKDFVFL

SEQ ID NO: 173056 - protein, 8 aa, Borrelia afzelii PKo
FVFLTDGT

SEQ ID NO: 173057 - protein, 8 aa, Borrelia afzelii PKo
VFLTDGTI

SEQ ID NO: 173058 - protein, 8 aa, Borrelia afzelii PKo
FLTDGTIT

SEQ ID NO: 173059 - protein, 8 aa, Borrelia afzelii PKo
LTDGTITV

SEQ ID NO: 173060 - protein, 8 aa, Borrelia afzelii PKo
GTITVQAY

SEQ ID NO: 173061 - protein, 8 aa, Borrelia afzelii PKo
AYDTAGTK

SEQ ID NO: 173062 - protein, 8 aa, Borrelia afzelii PKo
SEIKDLAA

SEQ ID NO: 173063 - protein, 8 aa, Borrelia afzelii PKo
EIKDLAAL

SEQ ID NO: 173064 - protein, 8 aa, Borrelia afzelii PKo
DLAALKAA

SEQ ID NO: 173065 - protein, 8 aa, Borrelia afzelii PKo
LAALKAAL

SEQ ID NO: 173066 - protein, 8 aa, Borrelia afzelii PKo
AALKAALK

SEQ ID NO: 173067 - protein, 9 aa, Borrelia afzelii PKo
KQYLLVFAL

SEQ ID NO: 173068 - protein, 9 aa, Borrelia afzelii PKo
QYLLVFALV

SEQ ID NO: 173069 - protein, 9 aa, Borrelia afzelii PKo
YLLVFALVL

SEQ ID NO: 173070 - protein, 9 aa, Borrelia afzelii PKo
LLVFALVLA

SEQ ID NO: 173071 - protein, 9 aa, Borrelia afzelii PKo
LVFALVLAL

SEQ ID NO: 173072 - protein, 9 aa, Borrelia afzelii PKo
VFALVLALI

SEQ ID NO: 173073 - protein, 9 aa, Borrelia afzelii PKo
FALVLALIA

SEQ ID NO: 173074 - protein, 9 aa, Borrelia afzelii PKo
VLALIACSQ

SEQ ID NO: 173075 - protein, 9 aa, Borrelia afzelii PKo
LALIACSQK

SEQ ID NO: 173076 - protein, 9 aa, Borrelia afzelii PKo
CSQKGTEPK

SEQ ID NO: 173077 - protein, 9 aa, Borrelia afzelii PKo
SQDHNDQEI

SEQ ID NO: 173078 - protein, 9 aa, Borrelia afzelii PKo
IINSDNTPK

SEQ ID NO: 173079 - protein, 9 aa, Borrelia afzelii PKo
TPKDSKKDL

SEQ ID NO: 173080 - protein, 9 aa, Borrelia afzelii PKo
TVLAEENSV

SEQ ID NO: 173081 - protein, 9 aa, Borrelia afzelii PKo
LAEENSVPL

SEQ ID NO: 173082 - protein, 9 aa, Borrelia afzelii PKo
AEENSVPLF

SEQ ID NO: 173083 - protein, 9 aa, Borrelia afzelii PKo
EENSVPLFN

SEQ ID NO: 173084 - protein, 9 aa, Borrelia afzelii PKo
SVPLFNGNK

SEQ ID NO: 173085 - protein, 9 aa, Borrelia afzelii PKo
VPLFNGNKI

SEQ ID NO: 173086 - protein, 9 aa, Borrelia afzelii PKo
LFNGNKIFV

SEQ ID NO: 173087 - protein, 9 aa, Borrelia afzelii PKo
FVSKEKNSA

SEQ ID NO: 173088 - protein, 9 aa, Borrelia afzelii PKo
NSAGKYELR

SEQ ID NO: 173089 - protein, 9 aa, Borrelia afzelii PKo
GKYELRATV

SEQ ID NO: 173090 - protein, 9 aa, Borrelia afzelii PKo
ELRATVDTV

SEQ ID NO: 173091 - protein, 9 aa, Borrelia afzelii PKo
RATVDTVEL

SEQ ID NO: 173092 - protein, 9 aa, Borrelia afzelii PKo
ATVDTVELK

SEQ ID NO: 173093 - protein, 9 aa, Borrelia afzelii PKo
KADKTKVAM

SEQ ID NO: 173094 - protein, 9 aa, Borrelia afzelii PKo
KTKVAMTIA

SEQ ID NO: 173095 - protein, 9 aa, Borrelia afzelii PKo
TIADDLNTI

SEQ ID NO: 173096 - protein, 9 aa, Borrelia afzelii PKo
ETYDASNKK

SEQ ID NO: 173097 - protein, 9 aa, Borrelia afzelii PKo
KTGSEVVKK

SEQ ID NO: 173098 - protein, 9 aa, Borrelia afzelii PKo
EVVKKQGSV

SEQ ID NO: 173099 - protein, 9 aa, Borrelia afzelii PKo
GSVIKESYK

SEQ ID NO: 173100 - protein, 9 aa, Borrelia afzelii PKo
SVIKESYKA

SEQ ID NO: 173101 - protein, 9 aa, Borrelia afzelii PKo
KANKLDSKK

SEQ ID NO: 173102 - protein, 9 aa, Borrelia afzelii PKo
KLDSKKITR

SEQ ID NO: 173103 - protein, 9 aa, Borrelia afzelii PKo
ITRENETTL

SEQ ID NO: 173104 - protein, 9 aa, Borrelia afzelii PKo
RENETTLEY

SEQ ID NO: 173105 - protein, 9 aa, Borrelia afzelii PKo
ETTLEYSEM

SEQ ID NO: 173106 - protein, 9 aa, Borrelia afzelii PKo
TTLEYSEMT

SEQ ID NO: 173107 - protein, 9 aa, Borrelia afzelii PKo
EMTDSSNAT

SEQ ID NO: 173108 - protein, 9 aa, Borrelia afzelii PKo
MTDSSNATK

SEQ ID NO: 173109 - protein, 9 aa, Borrelia afzelii PKo
ATKAVETLK

SEQ ID NO: 173110 - protein, 9 aa, Borrelia afzelii PKo
ETLKNGIKL

SEQ ID NO: 173111 - protein, 9 aa, Borrelia afzelii PKo
GIKLEGSLV

SEQ ID NO: 173112 - protein, 9 aa, Borrelia afzelii PKo
SLVGGKTTV

SEQ ID NO: 173113 - protein, 9 aa, Borrelia afzelii PKo
LVGGKTTVK

SEQ ID NO: 173114 - protein, 9 aa, Borrelia afzelii PKo
TTVKLTEGT

SEQ ID NO: 173115 - protein, 9 aa, Borrelia afzelii PKo
KLTEGTITL

SEQ ID NO: 173116 - protein, 9 aa, Borrelia afzelii PKo
REIEQDGKV

SEQ ID NO: 173117 - protein, 9 aa, Borrelia afzelii PKo
IEQDGKVKI

SEQ ID NO: 173118 - protein, 9 aa, Borrelia afzelii PKo
YLNDTTSGS

SEQ ID NO: 173119 - protein, 9 aa, Borrelia afzelii PKo
DTTSGSTKK

SEQ ID NO: 173120 - protein, 9 aa, Borrelia afzelii PKo
GSTKKTATW

SEQ ID NO: 173121 - protein, 9 aa, Borrelia afzelii PKo
TWNETTNTL

SEQ ID NO: 173122 - protein, 9 aa, Borrelia afzelii PKo
NETTNTLTI

SEQ ID NO: 173123 - protein, 9 aa, Borrelia afzelii PKo
TTNTLTISA

SEQ ID NO: 173124 - protein, 9 aa, Borrelia afzelii PKo
TLTISADSK

SEQ ID NO: 173125 - protein, 9 aa, Borrelia afzelii PKo
LTISADSKK

SEQ ID NO: 173126 - protein, 9 aa, Borrelia afzelii PKo
ISADSKKTK

SEQ ID NO: 173127 - protein, 9 aa, Borrelia afzelii PKo
KTKDFVFLT

SEQ ID NO: 173128 - protein, 9 aa, Borrelia afzelii PKo
FVFLTDGTI

SEQ ID NO: 173129 - protein, 9 aa, Borrelia afzelii PKo
FLTDGTITV

SEQ ID NO: 173130 - protein, 9 aa, Borrelia afzelii PKo
ITVQAYDTA

SEQ ID NO: 173131 - protein, 9 aa, Borrelia afzelii PKo
VQAYDTAGT

SEQ ID NO: 173132 - protein, 9 aa, Borrelia afzelii PKo
QAYDTAGTK

SEQ ID NO: 173133 - protein, 9 aa, Borrelia afzelii PKo
AYDTAGTKL

SEQ ID NO: 173134 - protein, 9 aa, Borrelia afzelii PKo
KLEGNSSEI

SEQ ID NO: 173135 - protein, 9 aa, Borrelia afzelii PKo
NSSEIKDLA

SEQ ID NO: 173136 - protein, 9 aa, Borrelia afzelii PKo
SEIKDLAAL

SEQ ID NO: 173137 - protein, 9 aa, Borrelia afzelii PKo
EIKDLAALK

SEQ ID NO: 173138 - protein, 9 aa, Borrelia afzelii PKo
DLAALKAAL

SEQ ID NO: 173139 - protein, 9 aa, Borrelia afzelii PKo
LAALKAALK

SEQ ID NO: 173140 - protein, 10 aa, Borrelia afzelii PKo
KQYLLVFALV

SEQ ID NO: 173141 - protein, 10 aa, Borrelia afzelii PKo
QYLLVFALVL

SEQ ID NO: 173142 - protein, 10 aa, Borrelia afzelii PKo
YLLVFALVLA

SEQ ID NO: 173143 - protein, 10 aa, Borrelia afzelii PKo
LLVFALVLAL

SEQ ID NO: 173144 - protein, 10 aa, Borrelia afzelii PKo
LVFALVLALI

SEQ ID NO: 173145 - protein, 10 aa, Borrelia afzelii PKo
VLALIACSQK

SEQ ID NO: 173146 - protein, 10 aa, Borrelia afzelii PKo
ACSQKGTEPK

SEQ ID NO: 173147 - protein, 10 aa, Borrelia afzelii PKo
SQDHNDQEII

SEQ ID NO: 173148 - protein, 10 aa, Borrelia afzelii PKo
EIINSDNTPK

SEQ ID NO: 173149 - protein, 10 aa, Borrelia afzelii PKo
LTVLAEENSV

SEQ ID NO: 173150 - protein, 10 aa, Borrelia afzelii PKo
VLAEENSVPL

SEQ ID NO: 173151 - protein, 10 aa, Borrelia afzelii PKo
LAEENSVPLF

SEQ ID NO: 173152 - protein, 10 aa, Borrelia afzelii PKo
NSVPLFNGNK

SEQ ID NO: 173153 - protein, 10 aa, Borrelia afzelii PKo
SVPLFNGNKI

SEQ ID NO: 173154 - protein, 10 aa, Borrelia afzelii PKo
VPLFNGNKIF

SEQ ID NO: 173155 - protein, 10 aa, Borrelia afzelii PKo
PLFNGNKIFV

SEQ ID NO: 173156 - protein, 10 aa, Borrelia afzelii PKo
VSKEKNSAGK

SEQ ID NO: 173157 - protein, 10 aa, Borrelia afzelii PKo
KNSAGKYELR

SEQ ID NO: 173158 - protein, 10 aa, Borrelia afzelii PKo
YELRATVDTV

SEQ ID NO: 173159 - protein, 10 aa, Borrelia afzelii PKo
RATVDTVELK

SEQ ID NO: 173160 - protein, 10 aa, Borrelia afzelii PKo
TVDTVELKGV

SEQ ID NO: 173161 - protein, 10 aa, Borrelia afzelii PKo
TVELKGVSDK

SEQ ID NO: 173162 - protein, 10 aa, Borrelia afzelii PKo
VSDKNNGSGK

SEQ ID NO: 173163 - protein, 10 aa, Borrelia afzelii PKo
MTIADDLNTI

SEQ ID NO: 173164 - protein, 10 aa, Borrelia afzelii PKo
IADDLNTITV

SEQ ID NO: 173165 - protein, 10 aa, Borrelia afzelii PKo
DLNTITVETY

SEQ ID NO: 173166 - protein, 10 aa, Borrelia afzelii PKo
NTITVETYDA

SEQ ID NO: 173167 - protein, 10 aa, Borrelia afzelii PKo
TVETYDASNK

SEQ ID NO: 173168 - protein, 10 aa, Borrelia afzelii PKo
ETYDASNKKT

SEQ ID NO: 173169 - protein, 10 aa, Borrelia afzelii PKo
EVVKKQGSVI

SEQ ID NO: 173170 - protein, 10 aa, Borrelia afzelii PKo
VVKKQGSVIK

SEQ ID NO: 173171 - protein, 10 aa, Borrelia afzelii PKo
KQGSVIKESY

SEQ ID NO: 173172 - protein, 10 aa, Borrelia afzelii PKo
VIKESYKANK

SEQ ID NO: 173173 - protein, 10 aa, Borrelia afzelii PKo
SYKANKLDSK

SEQ ID NO: 173174 - protein, 10 aa, Borrelia afzelii PKo
KITRENETTL

SEQ ID NO: 173175 - protein, 10 aa, Borrelia afzelii PKo
ETTLEYSEMT

SEQ ID NO: 173176 - protein, 10 aa, Borrelia afzelii PKo
EMTDSSNATK

SEQ ID NO: 173177 - protein, 10 aa, Borrelia afzelii PKo
MTDSSNATKA

SEQ ID NO: 173178 - protein, 10 aa, Borrelia afzelii PKo
NATKAVETLK

SEQ ID NO: 173179 - protein, 10 aa, Borrelia afzelii PKo
KAVETLKNGI

SEQ ID NO: 173180 - protein, 10 aa, Borrelia afzelii PKo
AVETLKNGIK

SEQ ID NO: 173181 - protein, 10 aa, Borrelia afzelii PKo
VETLKNGIKL

SEQ ID NO: 173182 - protein, 10 aa, Borrelia afzelii PKo
KLEGSLVGGK

SEQ ID NO: 173183 - protein, 10 aa, Borrelia afzelii PKo
SLVGGKTTVK

SEQ ID NO: 173184 - protein, 10 aa, Borrelia afzelii PKo
LVGGKTTVKL

SEQ ID NO: 173185 - protein, 10 aa, Borrelia afzelii PKo
TTVKLTEGTI

SEQ ID NO: 173186 - protein, 10 aa, Borrelia afzelii PKo
VKLTEGTITL

SEQ ID NO: 173187 - protein, 10 aa, Borrelia afzelii PKo
KLTEGTITLT

SEQ ID NO: 173188 - protein, 10 aa, Borrelia afzelii PKo
LTEGTITLTR

SEQ ID NO: 173189 - protein, 10 aa, Borrelia afzelii PKo
LTREIEQDGK

SEQ ID NO: 173190 - protein, 10 aa, Borrelia afzelii PKo
IEQDGKVKIY

SEQ ID NO: 173191 - protein, 10 aa, Borrelia afzelii PKo
YLNDTTSGST

SEQ ID NO: 173192 - protein, 10 aa, Borrelia afzelii PKo
SGSTKKTATW

SEQ ID NO: 173193 - protein, 10 aa, Borrelia afzelii PKo
ATWNETTNTL

SEQ ID NO: 173194 - protein, 10 aa, Borrelia afzelii PKo
ETTNTLTISA

SEQ ID NO: 173195 - protein, 10 aa, Borrelia afzelii PKo
NTLTISADSK

SEQ ID NO: 173196 - protein, 10 aa, Borrelia afzelii PKo
TLTISADSKK

SEQ ID NO: 173197 - protein, 10 aa, Borrelia afzelii PKo
TISADSKKTK

SEQ ID NO: 173198 - protein, 10 aa, Borrelia afzelii PKo
VFLTDGTITV

SEQ ID NO: 173199 - protein, 10 aa, Borrelia afzelii PKo
FLTDGTITVQ

SEQ ID NO: 173200 - protein, 10 aa, Borrelia afzelii PKo
LTDGTITVQA

SEQ ID NO: 173201 - protein, 10 aa, Borrelia afzelii PKo
VQAYDTAGTK

SEQ ID NO: 173202 - protein, 10 aa, Borrelia afzelii PKo
QAYDTAGTKL

SEQ ID NO: 173203 - protein, 10 aa, Borrelia afzelii PKo
KLEGNSSEIK

SEQ ID NO: 173204 - protein, 10 aa, Borrelia afzelii PKo
DLAALKAALK

SEQ ID NO: 173205 - protein, 11 aa, Borrelia afzelii PKo
MKQYLLVFALV

SEQ ID NO: 173206 - protein, 11 aa, Borrelia afzelii PKo
KQYLLVFALVL

SEQ ID NO: 173207 - protein, 11 aa, Borrelia afzelii PKo
YLLVFALVLAL

SEQ ID NO: 173208 - protein, 11 aa, Borrelia afzelii PKo
LLVFALVLALI

SEQ ID NO: 173209 - protein, 11 aa, Borrelia afzelii PKo
ALVLALIACSQ

SEQ ID NO: 173210 - protein, 11 aa, Borrelia afzelii PKo
LVLALIACSQK

SEQ ID NO: 173211 - protein, 11 aa, Borrelia afzelii PKo
IACSQKGTEPK

SEQ ID NO: 173212 - protein, 11 aa, Borrelia afzelii PKo
STSQDHNDQEI

SEQ ID NO: 173213 - protein, 11 aa, Borrelia afzelii PKo
DLTVLAEENSV

SEQ ID NO: 173214 - protein, 11 aa, Borrelia afzelii PKo
TVLAEENSVPL

SEQ ID NO: 173215 - protein, 11 aa, Borrelia afzelii PKo
VLAEENSVPLF

SEQ ID NO: 173216 - protein, 11 aa, Borrelia afzelii PKo
NSVPLFNGNKI

SEQ ID NO: 173217 - protein, 11 aa, Borrelia afzelii PKo
SVPLFNGNKIF

SEQ ID NO: 173218 - protein, 11 aa, Borrelia afzelii PKo
VPLFNGNKIFV

SEQ ID NO: 173219 - protein, 11 aa, Borrelia afzelii PKo
LFNGNKIFVSK

SEQ ID NO: 173220 - protein, 11 aa, Borrelia afzelii PKo
FVSKEKNSAGK

SEQ ID NO: 173221 - protein, 11 aa, Borrelia afzelii PKo
VSKEKNSAGKY

SEQ ID NO: 173222 - protein, 11 aa, Borrelia afzelii PKo
KEKNSAGKYEL

SEQ ID NO: 173223 - protein, 11 aa, Borrelia afzelii PKo
EKNSAGKYELR

SEQ ID NO: 173224 - protein, 11 aa, Borrelia afzelii PKo
SAGKYELRATV

SEQ ID NO: 173225 - protein, 11 aa, Borrelia afzelii PKo
ELRATVDTVEL

SEQ ID NO: 173226 - protein, 11 aa, Borrelia afzelii PKo
ATVDTVELKGV

SEQ ID NO: 173227 - protein, 11 aa, Borrelia afzelii PKo
DTVELKGVSDK

SEQ ID NO: 173228 - protein, 11 aa, Borrelia afzelii PKo
GVSDKNNGSGK

SEQ ID NO: 173229 - protein, 11 aa, Borrelia afzelii PKo
KLEGTKADKTK

SEQ ID NO: 173230 - protein, 11 aa, Borrelia afzelii PKo
KADKTKVAMTI

SEQ ID NO: 173231 - protein, 11 aa, Borrelia afzelii PKo
AMTIADDLNTI

SEQ ID NO: 173232 - protein, 11 aa, Borrelia afzelii PKo
MTIADDLNTIT

SEQ ID NO: 173233 - protein, 11 aa, Borrelia afzelii PKo
TIADDLNTITV

SEQ ID NO: 173234 - protein, 11 aa, Borrelia afzelii PKo
ITVETYDASNK

SEQ ID NO: 173235 - protein, 11 aa, Borrelia afzelii PKo
TVETYDASNKK

SEQ ID NO: 173236 - protein, 11 aa, Borrelia afzelii PKo
EVVKKQGSVIK

SEQ ID NO: 173237 - protein, 11 aa, Borrelia afzelii PKo
KQGSVIKESYK

SEQ ID NO: 173238 - protein, 11 aa, Borrelia afzelii PKo
SVIKESYKANK

SEQ ID NO: 173239 - protein, 11 aa, Borrelia afzelii PKo
VIKESYKANKL

SEQ ID NO: 173240 - protein, 11 aa, Borrelia afzelii PKo
ESYKANKLDSK

SEQ ID NO: 173241 - protein, 11 aa, Borrelia afzelii PKo
SYKANKLDSKK

SEQ ID NO: 173242 - protein, 11 aa, Borrelia afzelii PKo
ITRENETTLEY

SEQ ID NO: 173243 - protein, 11 aa, Borrelia afzelii PKo
EMTDSSNATKA

SEQ ID NO: 173244 - protein, 11 aa, Borrelia afzelii PKo
MTDSSNATKAV

SEQ ID NO: 173245 - protein, 11 aa, Borrelia afzelii PKo
KAVETLKNGIK

SEQ ID NO: 173246 - protein, 11 aa, Borrelia afzelii PKo
TLKNGIKLEGS

SEQ ID NO: 173247 - protein, 11 aa, Borrelia afzelii PKo
EGSLVGGKTTV

SEQ ID NO: 173248 - protein, 11 aa, Borrelia afzelii PKo
GSLVGGKTTVK

SEQ ID NO: 173249 - protein, 11 aa, Borrelia afzelii PKo
SLVGGKTTVKL

SEQ ID NO: 173250 - protein, 11 aa, Borrelia afzelii PKo
KLTEGTITLTR

SEQ ID NO: 173251 - protein, 11 aa, Borrelia afzelii PKo
TLTREIEQDGK

SEQ ID NO: 173252 - protein, 11 aa, Borrelia afzelii PKo
REIEQDGKVKI

SEQ ID NO: 173253 - protein, 11 aa, Borrelia afzelii PKo
EIEQDGKVKIY

SEQ ID NO: 173254 - protein, 11 aa, Borrelia afzelii PKo
IEQDGKVKIYL

SEQ ID NO: 173255 - protein, 11 aa, Borrelia afzelii PKo
YLNDTTSGSTK

SEQ ID NO: 173256 - protein, 11 aa, Borrelia afzelii PKo
TSGSTKKTATW

SEQ ID NO: 173257 - protein, 11 aa, Borrelia afzelii PKo
TATWNETTNTL

SEQ ID NO: 173258 - protein, 11 aa, Borrelia afzelii PKo
TWNETTNTLTI

SEQ ID NO: 173259 - protein, 11 aa, Borrelia afzelii PKo
TNTLTISADSK

SEQ ID NO: 173260 - protein, 11 aa, Borrelia afzelii PKo
NTLTISADSKK

SEQ ID NO: 173261 - protein, 11 aa, Borrelia afzelii PKo
LTISADSKKTK

SEQ ID NO: 173262 - protein, 11 aa, Borrelia afzelii PKo
SADSKKTKDFV

SEQ ID NO: 173263 - protein, 11 aa, Borrelia afzelii PKo
FVFLTDGTITV

SEQ ID NO: 173264 - protein, 11 aa, Borrelia afzelii PKo
FLTDGTITVQA

SEQ ID NO: 173265 - protein, 11 aa, Borrelia afzelii PKo
LTDGTITVQAY

SEQ ID NO: 173266 - protein, 11 aa, Borrelia afzelii PKo
TVQAYDTAGTK

SEQ ID NO: 173267 - protein, 11 aa, Borrelia afzelii PKo
VQAYDTAGTKL

SEQ ID NO: 173268 - protein, 11 aa, Borrelia afzelii PKo
LEGNSSEIKDL

SEQ ID NO: 173269 - protein, 11 aa, Borrelia afzelii PKo
NSSEIKDLAAL

SEQ ID NO: 173270 - protein, 11 aa, Borrelia afzelii PKo
SSEIKDLAALK

SEQ ID NO: 173271 - protein, 15 aa, Borrelia afzelii PKo
AEENSVPLFNGNKIF

SEQ ID NO: 173272 - protein, 9 aa, Borrelia afzelii PKo
VPLFNGNKI

SEQ ID NO: 173273 - protein, 15 aa, Borrelia afzelii PKo
AGKYELRATVDTVEL

SEQ ID NO: 173274 - protein, 9 aa, Borrelia afzelii PKo
YELRATVDT

SEQ ID NO: 173275 - protein, 15 aa, Borrelia afzelii PKo
ALVLALIACSQKGTE

SEQ ID NO: 173276 - protein, 9 aa, Borrelia afzelii PKo
VLALIACSQ

SEQ ID NO: 173277 - protein, 15 aa, Borrelia afzelii PKo
ATWNETTNTLTISAD

SEQ ID NO: 173278 - protein, 9 aa, Borrelia afzelii PKo
WNETTNTLT

SEQ ID NO: 173279 - protein, 15 aa, Borrelia afzelii PKo
AVETLKNGIKLEGSL

SEQ ID NO: 173280 - protein, 9 aa, Borrelia afzelii PKo
LKNGIKLEG

SEQ ID NO: 173281 - protein, 15 aa, Borrelia afzelii PKo
DASNKKTGSEVVKKQ

SEQ ID NO: 173282 - protein, 9 aa, Borrelia afzelii PKo
NKKTGSEVV

SEQ ID NO: 173283 - protein, 15 aa, Borrelia afzelii PKo
DFVFLTDGTITVQAY

SEQ ID NO: 173284 - protein, 9 aa, Borrelia afzelii PKo
FLTDGTITV

SEQ ID NO: 173285 - protein, 15 aa, Borrelia afzelii PKo
DGKVKIYLNDTTSGS

SEQ ID NO: 173286 - protein, 9 aa, Borrelia afzelii PKo
IYLNDTTSG

SEQ ID NO: 173287 - protein, 15 aa, Borrelia afzelii PKo
DGKVKIYLNDTTSGS

SEQ ID NO: 173288 - protein, 9 aa, Borrelia afzelii PKo
VKIYLNDTT

SEQ ID NO: 173289 - protein, 15 aa, Borrelia afzelii PKo
DGTITVQAYDTAGTK

SEQ ID NO: 173290 - protein, 9 aa, Borrelia afzelii PKo
VQAYDTAGT

SEQ ID NO: 173291 - protein, 15 aa, Borrelia afzelii PKo
DKTKVAMTIADDLNT

SEQ ID NO: 173292 - protein, 9 aa, Borrelia afzelii PKo
VAMTIADDL

SEQ ID NO: 173293 - protein, 15 aa, Borrelia afzelii PKo
DNTPKDSKKDLTVLA

SEQ ID NO: 173294 - protein, 9 aa, Borrelia afzelii PKo
DNTPKDSKK

SEQ ID NO: 173295 - protein, 15 aa, Borrelia afzelii PKo
DQEIINSDNTPKDSK

SEQ ID NO: 173296 - protein, 9 aa, Borrelia afzelii PKo
INSDNTPKD

SEQ ID NO: 173297 - protein, 15 aa, Borrelia afzelii PKo
DSKKDLTVLAEENSV

SEQ ID NO: 173298 - protein, 9 aa, Borrelia afzelii PKo
SKKDLTVLA

SEQ ID NO: 173299 - protein, 15 aa, Borrelia afzelii PKo
EENSVPLFNGNKIFV

SEQ ID NO: 173300 - protein, 9 aa, Borrelia afzelii PKo
VPLFNGNKI

SEQ ID NO: 173301 - protein, 15 aa, Borrelia afzelii PKo
EGNSSEIKDLAALKA

SEQ ID NO: 173302 - protein, 9 aa, Borrelia afzelii PKo
EGNSSEIKD

SEQ ID NO: 173303 - protein, 15 aa, Borrelia afzelii PKo
EGSLVGGKTTVKLTE

SEQ ID NO: 173304 - protein, 9 aa, Borrelia afzelii PKo
VGGKTTVKL

SEQ ID NO: 173305 - protein, 15 aa, Borrelia afzelii PKo
EIINSDNTPKDSKKD

SEQ ID NO: 173306 - protein, 9 aa, Borrelia afzelii PKo
INSDNTPKD

SEQ ID NO: 173307 - protein, 15 aa, Borrelia afzelii PKo
ENSVPLFNGNKIFVS

SEQ ID NO: 173308 - protein, 9 aa, Borrelia afzelii PKo
VPLFNGNKI

SEQ ID NO: 173309 - protein, 15 aa, Borrelia afzelii PKo
ETLKNGIKLEGSLVG

SEQ ID NO: 173310 - protein, 9 aa, Borrelia afzelii PKo
LKNGIKLEG

SEQ ID NO: 173311 - protein, 15 aa, Borrelia afzelii PKo
ETYDASNKKTGSEVV

SEQ ID NO: 173312 - protein, 9 aa, Borrelia afzelii PKo
SNKKTGSEV

SEQ ID NO: 173313 - protein, 15 aa, Borrelia afzelii PKo
EVVKKQGSVIKESYK

SEQ ID NO: 173314 - protein, 9 aa, Borrelia afzelii PKo
VKKQGSVIK

SEQ ID NO: 173315 - protein, 15 aa, Borrelia afzelii PKo
FALVLALIACSQKGT

SEQ ID NO: 173316 - protein, 9 aa, Borrelia afzelii PKo
LVLALIACS

SEQ ID NO: 173317 - protein, 15 aa, Borrelia afzelii PKo
FLTDGTITVQAYDTA

SEQ ID NO: 173318 - protein, 9 aa, Borrelia afzelii PKo
FLTDGTITV

SEQ ID NO: 173319 - protein, 15 aa, Borrelia afzelii PKo
FNGNKIFVSKEKNSA

SEQ ID NO: 173320 - protein, 9 aa, Borrelia afzelii PKo
FNGNKIFVS

SEQ ID NO: 173321 - protein, 15 aa, Borrelia afzelii PKo
FVFLTDGTITVQAYD

SEQ ID NO: 173322 - protein, 9 aa, Borrelia afzelii PKo
FLTDGTITV

SEQ ID NO: 173323 - protein, 15 aa, Borrelia afzelii PKo
GGKTTVKLTEGTITL

SEQ ID NO: 173324 - protein, 9 aa, Borrelia afzelii PKo
VKLTEGTIT

SEQ ID NO: 173325 - protein, 15 aa, Borrelia afzelii PKo
GIKLEGSLVGGKTTV

SEQ ID NO: 173326 - protein, 9 aa, Borrelia afzelii PKo
IKLEGSLVG

SEQ ID NO: 173327 - protein, 15 aa, Borrelia afzelii PKo
GKTTVKLTEGTITLT

SEQ ID NO: 173328 - protein, 9 aa, Borrelia afzelii PKo
VKLTEGTIT

SEQ ID NO: 173329 - protein, 15 aa, Borrelia afzelii PKo
GKVKIYLNDTTSGST

SEQ ID NO: 173330 - protein, 9 aa, Borrelia afzelii PKo
IYLNDTTSG

SEQ ID NO: 173331 - protein, 15 aa, Borrelia afzelii PKo
GKVKIYLNDTTSGST

SEQ ID NO: 173332 - protein, 9 aa, Borrelia afzelii PKo
YLNDTTSGS

SEQ ID NO: 173333 - protein, 15 aa, Borrelia afzelii PKo
GKYELRATVDTVELK

SEQ ID NO: 173334 - protein, 9 aa, Borrelia afzelii PKo
YELRATVDT

SEQ ID NO: 173335 - protein, 15 aa, Borrelia afzelii PKo
GNKIFVSKEKNSAGK

SEQ ID NO: 173336 - protein, 9 aa, Borrelia afzelii PKo
FVSKEKNSA

SEQ ID NO: 173337 - protein, 15 aa, Borrelia afzelii PKo
GNSSEIKDLAALKAA

SEQ ID NO: 173338 - protein, 9 aa, Borrelia afzelii PKo
IKDLAALKA

SEQ ID NO: 173339 - protein, 15 aa, Borrelia afzelii PKo
GSEVVKKQGSVIKES

SEQ ID NO: 173340 - protein, 9 aa, Borrelia afzelii PKo
VKKQGSVIK

SEQ ID NO: 173341 - protein, 15 aa, Borrelia afzelii PKo
GSLVGGKTTVKLTEG

SEQ ID NO: 173342 - protein, 9 aa, Borrelia afzelii PKo
VGGKTTVKL

SEQ ID NO: 173343 - protein, 15 aa, Borrelia afzelii PKo
GTITVQAYDTAGTKL

SEQ ID NO: 173344 - protein, 9 aa, Borrelia afzelii PKo
VQAYDTAGT

SEQ ID NO: 173345 - protein, 15 aa, Borrelia afzelii PKo
HNDQEIINSDNTPKD

SEQ ID NO: 173346 - protein, 9 aa, Borrelia afzelii PKo
IINSDNTPK

SEQ ID NO: 173347 - protein, 15 aa, Borrelia afzelii PKo
IINSDNTPKDSKKDL

SEQ ID NO: 173348 - protein, 9 aa, Borrelia afzelii PKo
INSDNTPKD

SEQ ID NO: 173349 - protein, 15 aa, Borrelia afzelii PKo
IKLEGSLVGGKTTVK

SEQ ID NO: 173350 - protein, 9 aa, Borrelia afzelii PKo
IKLEGSLVG

SEQ ID NO: 173351 - protein, 15 aa, Borrelia afzelii PKo
INSDNTPKDSKKDLT

SEQ ID NO: 173352 - protein, 9 aa, Borrelia afzelii PKo
INSDNTPKD

SEQ ID NO: 173353 - protein, 15 aa, Borrelia afzelii PKo
ITVQAYDTAGTKLEG

SEQ ID NO: 173354 - protein, 9 aa, Borrelia afzelii PKo
VQAYDTAGT

SEQ ID NO: 173355 - protein, 15 aa, Borrelia afzelii PKo
IYLNDTTSGSTKKTA

SEQ ID NO: 173356 - protein, 9 aa, Borrelia afzelii PKo
TTSGSTKKT

SEQ ID NO: 173357 - protein, 15 aa, Borrelia afzelii PKo
KAVETLKNGIKLEGS

SEQ ID NO: 173358 - protein, 9 aa, Borrelia afzelii PKo
LKNGIKLEG

SEQ ID NO: 173359 - protein, 15 aa, Borrelia afzelii PKo
KDFVFLTDGTITVQA

SEQ ID NO: 173360 - protein, 9 aa, Borrelia afzelii PKo
FLTDGTITV

SEQ ID NO: 173361 - protein, 15 aa, Borrelia afzelii PKo
KDSKKDLTVLAEENS

SEQ ID NO: 173362 - protein, 9 aa, Borrelia afzelii PKo
SKKDLTVLA

SEQ ID NO: 173363 - protein, 15 aa, Borrelia afzelii PKo
KIFVSKEKNSAGKYE

SEQ ID NO: 173364 - protein, 9 aa, Borrelia afzelii PKo
FVSKEKNSA

SEQ ID NO: 173365 - protein, 15 aa, Borrelia afzelii PKo
KIYLNDTTSGSTKKT

SEQ ID NO: 173366 - protein, 9 aa, Borrelia afzelii PKo
YLNDTTSGS

SEQ ID NO: 173367 - protein, 15 aa, Borrelia afzelii PKo
KKTATWNETTNTLTI

SEQ ID NO: 173368 - protein, 9 aa, Borrelia afzelii PKo
WNETTNTLT

SEQ ID NO: 173369 - protein, 15 aa, Borrelia afzelii PKo
KLEGSLVGGKTTVKL

SEQ ID NO: 173370 - protein, 9 aa, Borrelia afzelii PKo
LVGGKTTVK

SEQ ID NO: 173371 - protein, 15 aa, Borrelia afzelii PKo
KNGIKLEGSLVGGKT

SEQ ID NO: 173372 - protein, 9 aa, Borrelia afzelii PKo
IKLEGSLVG

SEQ ID NO: 173373 - protein, 15 aa, Borrelia afzelii PKo
KNSAGKYELRATVDT

SEQ ID NO: 173374 - protein, 9 aa, Borrelia afzelii PKo
AGKYELRAT

SEQ ID NO: 173375 - protein, 15 aa, Borrelia afzelii PKo
KQYLLVFALVLALIA

SEQ ID NO: 173376 - protein, 9 aa, Borrelia afzelii PKo
LLVFALVLA

SEQ ID NO: 173377 - protein, 15 aa, Borrelia afzelii PKo
KQYLLVFALVLALIA

SEQ ID NO: 173378 - protein, 9 aa, Borrelia afzelii PKo
LVFALVLAL

SEQ ID NO: 173379 - protein, 15 aa, Borrelia afzelii PKo
KQYLLVFALVLALIA

SEQ ID NO: 173380 - protein, 9 aa, Borrelia afzelii PKo
VFALVLALI

SEQ ID NO: 173381 - protein, 15 aa, Borrelia afzelii PKo
KTATWNETTNTLTIS

SEQ ID NO: 173382 - protein, 9 aa, Borrelia afzelii PKo
WNETTNTLT

SEQ ID NO: 173383 - protein, 15 aa, Borrelia afzelii PKo
KTGSEVVKKQGSVIK

SEQ ID NO: 173384 - protein, 9 aa, Borrelia afzelii PKo
VVKKQGSVI

SEQ ID NO: 173385 - protein, 15 aa, Borrelia afzelii PKo
KTKDFVFLTDGTITV

SEQ ID NO: 173386 - protein, 9 aa, Borrelia afzelii PKo
FVFLTDGTI

SEQ ID NO: 173387 - protein, 15 aa, Borrelia afzelii PKo
KTTVKLTEGTITLTR

SEQ ID NO: 173388 - protein, 9 aa, Borrelia afzelii PKo
LTEGTITLT

SEQ ID NO: 173389 - protein, 15 aa, Borrelia afzelii PKo
KVKIYLNDTTSGSTK

SEQ ID NO: 173390 - protein, 9 aa, Borrelia afzelii PKo
IYLNDTTSG

SEQ ID NO: 173391 - protein, 15 aa, Borrelia afzelii PKo
KVKIYLNDTTSGSTK

SEQ ID NO: 173392 - protein, 9 aa, Borrelia afzelii PKo
YLNDTTSGS

SEQ ID NO: 173393 - protein, 15 aa, Borrelia afzelii PKo
KYELRATVDTVELKG

SEQ ID NO: 173394 - protein, 9 aa, Borrelia afzelii PKo
YELRATVDT

SEQ ID NO: 173395 - protein, 15 aa, Borrelia afzelii PKo
LAEENSVPLFNGNKI

SEQ ID NO: 173396 - protein, 9 aa, Borrelia afzelii PKo
ENSVPLFNG

SEQ ID NO: 173397 - protein, 15 aa, Borrelia afzelii PKo
LEGSLVGGKTTVKLT

SEQ ID NO: 173398 - protein, 9 aa, Borrelia afzelii PKo
VGGKTTVKL

SEQ ID NO: 173399 - protein, 15 aa, Borrelia afzelii PKo
LKNGIKLEGSLVGGK

SEQ ID NO: 173400 - protein, 9 aa, Borrelia afzelii PKo
IKLEGSLVG

SEQ ID NO: 173401 - protein, 15 aa, Borrelia afzelii PKo
LKNGIKLEGSLVGGK

SEQ ID NO: 173402 - protein, 9 aa, Borrelia afzelii PKo
LKNGIKLEG

SEQ ID NO: 173403 - protein, 15 aa, Borrelia afzelii PKo
LLVFALVLALIACSQ

SEQ ID NO: 173404 - protein, 9 aa, Borrelia afzelii PKo
FALVLALIA

SEQ ID NO: 173405 - protein, 15 aa, Borrelia afzelii PKo
LLVFALVLALIACSQ

SEQ ID NO: 173406 - protein, 9 aa, Borrelia afzelii PKo
LLVFALVLA

SEQ ID NO: 173407 - protein, 15 aa, Borrelia afzelii PKo
LNDTTSGSTKKTATW

SEQ ID NO: 173408 - protein, 9 aa, Borrelia afzelii PKo
TTSGSTKKT

SEQ ID NO: 173409 - protein, 15 aa, Borrelia afzelii PKo
LVFALVLALIACSQK

SEQ ID NO: 173410 - protein, 9 aa, Borrelia afzelii PKo
FALVLALIA

SEQ ID NO: 173411 - protein, 15 aa, Borrelia afzelii PKo
LVGGKTTVKLTEGTI

SEQ ID NO: 173412 - protein, 9 aa, Borrelia afzelii PKo
VGGKTTVKL

SEQ ID NO: 173413 - protein, 15 aa, Borrelia afzelii PKo
LVLALIACSQKGTEP

SEQ ID NO: 173414 - protein, 9 aa, Borrelia afzelii PKo
LVLALIACS

SEQ ID NO: 173415 - protein, 15 aa, Borrelia afzelii PKo
MKQYLLVFALVLALI

SEQ ID NO: 173416 - protein, 9 aa, Borrelia afzelii PKo
LLVFALVLA

SEQ ID NO: 173417 - protein, 15 aa, Borrelia afzelii PKo
MKQYLLVFALVLALI

SEQ ID NO: 173418 - protein, 9 aa, Borrelia afzelii PKo
LVFALVLAL

SEQ ID NO: 173419 - protein, 15 aa, Borrelia afzelii PKo
NDQEIINSDNTPKDS

SEQ ID NO: 173420 - protein, 9 aa, Borrelia afzelii PKo
INSDNTPKD

SEQ ID NO: 173421 - protein, 15 aa, Borrelia afzelii PKo
NGIKLEGSLVGGKTT

SEQ ID NO: 173422 - protein, 9 aa, Borrelia afzelii PKo
IKLEGSLVG

SEQ ID NO: 173423 - protein, 15 aa, Borrelia afzelii PKo
NGNKIFVSKEKNSAG

SEQ ID NO: 173424 - protein, 9 aa, Borrelia afzelii PKo
FVSKEKNSA

SEQ ID NO: 173425 - protein, 15 aa, Borrelia afzelii PKo
NKIFVSKEKNSAGKY

SEQ ID NO: 173426 - protein, 9 aa, Borrelia afzelii PKo
FVSKEKNSA

SEQ ID NO: 173427 - protein, 15 aa, Borrelia afzelii PKo
NSAGKYELRATVDTV

SEQ ID NO: 173428 - protein, 9 aa, Borrelia afzelii PKo
YELRATVDT

SEQ ID NO: 173429 - protein, 15 aa, Borrelia afzelii PKo
NSSEIKDLAALKAAL

SEQ ID NO: 173430 - protein, 9 aa, Borrelia afzelii PKo
IKDLAALKA

SEQ ID NO: 173431 - protein, 15 aa, Borrelia afzelii PKo
NSVPLFNGNKIFVSK

SEQ ID NO: 173432 - protein, 9 aa, Borrelia afzelii PKo
VPLFNGNKI

SEQ ID NO: 173433 - protein, 15 aa, Borrelia afzelii PKo
NTPKDSKKDLTVLAE

SEQ ID NO: 173434 - protein, 9 aa, Borrelia afzelii PKo
SKKDLTVLA

SEQ ID NO: 173435 - protein, 15 aa, Borrelia afzelii PKo
PKDSKKDLTVLAEEN

SEQ ID NO: 173436 - protein, 9 aa, Borrelia afzelii PKo
SKKDLTVLA

SEQ ID NO: 173437 - protein, 15 aa, Borrelia afzelii PKo
QAYDTAGTKLEGNSS

SEQ ID NO: 173438 - protein, 9 aa, Borrelia afzelii PKo
YDTAGTKLE

SEQ ID NO: 173439 - protein, 15 aa, Borrelia afzelii PKo
QDGKVKIYLNDTTSG

SEQ ID NO: 173440 - protein, 9 aa, Borrelia afzelii PKo
KVKIYLNDT

SEQ ID NO: 173441 - protein, 15 aa, Borrelia afzelii PKo
QDGKVKIYLNDTTSG

SEQ ID NO: 173442 - protein, 9 aa, Borrelia afzelii PKo
VKIYLNDTT

SEQ ID NO: 173443 - protein, 15 aa, Borrelia afzelii PKo
QEIINSDNTPKDSKK

SEQ ID NO: 173444 - protein, 9 aa, Borrelia afzelii PKo
INSDNTPKD

SEQ ID NO: 173445 - protein, 15 aa, Borrelia afzelii PKo
QYLLVFALVLALIAC

SEQ ID NO: 173446 - protein, 9 aa, Borrelia afzelii PKo
FALVLALIA

SEQ ID NO: 173447 - protein, 15 aa, Borrelia afzelii PKo
QYLLVFALVLALIAC

SEQ ID NO: 173448 - protein, 9 aa, Borrelia afzelii PKo
LLVFALVLA

SEQ ID NO: 173449 - protein, 15 aa, Borrelia afzelii PKo
QYLLVFALVLALIAC

SEQ ID NO: 173450 - protein, 9 aa, Borrelia afzelii PKo
LVFALVLAL

SEQ ID NO: 173451 - protein, 15 aa, Borrelia afzelii PKo
SAGKYELRATVDTVE

SEQ ID NO: 173452 - protein, 9 aa, Borrelia afzelii PKo
YELRATVDT

SEQ ID NO: 173453 - protein, 15 aa, Borrelia afzelii PKo
SEVVKKQGSVIKESY

SEQ ID NO: 173454 - protein, 9 aa, Borrelia afzelii PKo
VKKQGSVIK

SEQ ID NO: 173455 - protein, 15 aa, Borrelia afzelii PKo
SKKDLTVLAEENSVP

SEQ ID NO: 173456 - protein, 9 aa, Borrelia afzelii PKo
SKKDLTVLA

SEQ ID NO: 173457 - protein, 15 aa, Borrelia afzelii PKo
SLVGGKTTVKLTEGT

SEQ ID NO: 173458 - protein, 9 aa, Borrelia afzelii PKo
VGGKTTVKL

SEQ ID NO: 173459 - protein, 15 aa, Borrelia afzelii PKo
SSEIKDLAALKAALK

SEQ ID NO: 173460 - protein, 9 aa, Borrelia afzelii PKo
IKDLAALKA

SEQ ID NO: 173461 - protein, 15 aa, Borrelia afzelii PKo
SVPLFNGNKIFVSKE

SEQ ID NO: 173462 - protein, 9 aa, Borrelia afzelii PKo
VPLFNGNKI

SEQ ID NO: 173463 - protein, 15 aa, Borrelia afzelii PKo
TATWNETTNTLTISA

SEQ ID NO: 173464 - protein, 9 aa, Borrelia afzelii PKo
WNETTNTLT

SEQ ID NO: 173465 - protein, 15 aa, Borrelia afzelii PKo
TDGTITVQAYDTAGT

SEQ ID NO: 173466 - protein, 9 aa, Borrelia afzelii PKo
TITVQAYDT

SEQ ID NO: 173467 - protein, 15 aa, Borrelia afzelii PKo
TGSEVVKKQGSVIKE

SEQ ID NO: 173468 - protein, 9 aa, Borrelia afzelii PKo
VKKQGSVIK

SEQ ID NO: 173469 - protein, 15 aa, Borrelia afzelii PKo
TITVQAYDTAGTKLE

SEQ ID NO: 173470 - protein, 9 aa, Borrelia afzelii PKo
VQAYDTAGT

SEQ ID NO: 173471 - protein, 15 aa, Borrelia afzelii PKo
TKAVETLKNGIKLEG

SEQ ID NO: 173472 - protein, 9 aa, Borrelia afzelii PKo
VETLKNGIK

SEQ ID NO: 173473 - protein, 15 aa, Borrelia afzelii PKo
TKDFVFLTDGTITVQ

SEQ ID NO: 173474 - protein, 9 aa, Borrelia afzelii PKo
FLTDGTITV

SEQ ID NO: 173475 - protein, 15 aa, Borrelia afzelii PKo
TKKTATWNETTNTLT

SEQ ID NO: 173476 - protein, 9 aa, Borrelia afzelii PKo
ATWNETTNT

SEQ ID NO: 173477 - protein, 15 aa, Borrelia afzelii PKo
TKKTATWNETTNTLT

SEQ ID NO: 173478 - protein, 9 aa, Borrelia afzelii PKo
TKKTATWNE

SEQ ID NO: 173479 - protein, 15 aa, Borrelia afzelii PKo
TLKNGIKLEGSLVGG

SEQ ID NO: 173480 - protein, 9 aa, Borrelia afzelii PKo
IKLEGSLVG

SEQ ID NO: 173481 - protein, 15 aa, Borrelia afzelii PKo
TLKNGIKLEGSLVGG

SEQ ID NO: 173482 - protein, 9 aa, Borrelia afzelii PKo
LKNGIKLEG

SEQ ID NO: 173483 - protein, 15 aa, Borrelia afzelii PKo
TPKDSKKDLTVLAEE

SEQ ID NO: 173484 - protein, 9 aa, Borrelia afzelii PKo
SKKDLTVLA

SEQ ID NO: 173485 - protein, 15 aa, Borrelia afzelii PKo
TTVKLTEGTITLTRE

SEQ ID NO: 173486 - protein, 9 aa, Borrelia afzelii PKo
LTEGTITLT

SEQ ID NO: 173487 - protein, 15 aa, Borrelia afzelii PKo
TVKLTEGTITLTREI

SEQ ID NO: 173488 - protein, 9 aa, Borrelia afzelii PKo
LTEGTITLT

SEQ ID NO: 173489 - protein, 15 aa, Borrelia afzelii PKo
TVQAYDTAGTKLEGN

SEQ ID NO: 173490 - protein, 9 aa, Borrelia afzelii PKo
VQAYDTAGT

SEQ ID NO: 173491 - protein, 15 aa, Borrelia afzelii PKo
TYDASNKKTGSEVVK

SEQ ID NO: 173492 - protein, 9 aa, Borrelia afzelii PKo
NKKTGSEVV

SEQ ID NO: 173493 - protein, 15 aa, Borrelia afzelii PKo
VETLKNGIKLEGSLV

SEQ ID NO: 173494 - protein, 9 aa, Borrelia afzelii PKo
LKNGIKLEG

SEQ ID NO: 173495 - protein, 15 aa, Borrelia afzelii PKo
VFALVLALIACSQKG

SEQ ID NO: 173496 - protein, 9 aa, Borrelia afzelii PKo
LVLALIACS

SEQ ID NO: 173497 - protein, 15 aa, Borrelia afzelii PKo
VFLTDGTITVQAYDT

SEQ ID NO: 173498 - protein, 9 aa, Borrelia afzelii PKo
FLTDGTITV

SEQ ID NO: 173499 - protein, 15 aa, Borrelia afzelii PKo
VGGKTTVKLTEGTIT

SEQ ID NO: 173500 - protein, 9 aa, Borrelia afzelii PKo
VGGKTTVKL

SEQ ID NO: 173501 - protein, 15 aa, Borrelia afzelii PKo
VKIYLNDTTSGSTKK

SEQ ID NO: 173502 - protein, 9 aa, Borrelia afzelii PKo
YLNDTTSGS

SEQ ID NO: 173503 - protein, 15 aa, Borrelia afzelii PKo
VKLTEGTITLTREIE

SEQ ID NO: 173504 - protein, 9 aa, Borrelia afzelii PKo
LTEGTITLT

SEQ ID NO: 173505 - protein, 15 aa, Borrelia afzelii PKo
VLALIACSQKGTEPK

SEQ ID NO: 173506 - protein, 9 aa, Borrelia afzelii PKo
VLALIACSQ

SEQ ID NO: 173507 - protein, 15 aa, Borrelia afzelii PKo
VPLFNGNKIFVSKEK

SEQ ID NO: 173508 - protein, 9 aa, Borrelia afzelii PKo
VPLFNGNKI

SEQ ID NO: 173509 - protein, 15 aa, Borrelia afzelii PKo
VQAYDTAGTKLEGNS

SEQ ID NO: 173510 - protein, 9 aa, Borrelia afzelii PKo
VQAYDTAGT

SEQ ID NO: 173511 - protein, 15 aa, Borrelia afzelii PKo
YDASNKKTGSEVVKK

SEQ ID NO: 173512 - protein, 9 aa, Borrelia afzelii PKo
NKKTGSEVV

SEQ ID NO: 173513 - protein, 15 aa, Borrelia afzelii PKo
YELRATVDTVELKGV

SEQ ID NO: 173514 - protein, 9 aa, Borrelia afzelii PKo
YELRATVDT

SEQ ID NO: 173515 - protein, 15 aa, Borrelia afzelii PKo
YLLVFALVLALIACS

SEQ ID NO: 173516 - protein, 9 aa, Borrelia afzelii PKo
FALVLALIA

SEQ ID NO: 173517 - protein, 15 aa, Borrelia afzelii PKo
YLLVFALVLALIACS

SEQ ID NO: 173518 - protein, 9 aa, Borrelia afzelii PKo
LLVFALVLA

SEQ ID NO: 173519 - protein, 15 aa, Borrelia afzelii PKo
YLLVFALVLALIACS

SEQ ID NO: 173520 - protein, 9 aa, Borrelia afzelii PKo
LVFALVLAL

SEQ ID NO: 173521 - protein, 15 aa, Borrelia afzelii PKo
YLNDTTSGSTKKTAT

SEQ ID NO: 173522 - protein, 9 aa, Borrelia afzelii PKo
TTSGSTKKT

SEQ ID NO: 173523 - protein, 8 aa, Borrelia afzelii PKo
KISSAIFL

SEQ ID NO: 173524 - protein, 8 aa, Borrelia afzelii PKo
SAIFLTAL

SEQ ID NO: 173525 - protein, 8 aa, Borrelia afzelii PKo
AIFLTALL

SEQ ID NO: 173526 - protein, 8 aa, Borrelia afzelii PKo
IFLTALLV

SEQ ID NO: 173527 - protein, 8 aa, Borrelia afzelii PKo
FLTALLVF

SEQ ID NO: 173528 - protein, 8 aa, Borrelia afzelii PKo
LTALLVFI

SEQ ID NO: 173529 - protein, 8 aa, Borrelia afzelii PKo
ALLVFINC

SEQ ID NO: 173530 - protein, 8 aa, Borrelia afzelii PKo
LLVFINCK

SEQ ID NO: 173531 - protein, 8 aa, Borrelia afzelii PKo
FINCKNNA

SEQ ID NO: 173532 - protein, 8 aa, Borrelia afzelii PKo
FYESIINL

SEQ ID NO: 173533 - protein, 8 aa, Borrelia afzelii PKo
IINLGNGF

SEQ ID NO: 173534 - protein, 8 aa, Borrelia afzelii PKo
FIDVFNAF

SEQ ID NO: 173535 - protein, 8 aa, Borrelia afzelii PKo
FNAFSGLV

SEQ ID NO: 173536 - protein, 8 aa, Borrelia afzelii PKo
GLVADTFF

SEQ ID NO: 173537 - protein, 8 aa, Borrelia afzelii PKo
LVADTFFK

SEQ ID NO: 173538 - protein, 8 aa, Borrelia afzelii PKo
TFFKSDPK

SEQ ID NO: 173539 - protein, 8 aa, Borrelia afzelii PKo
KSDVKTYF

SEQ ID NO: 173540 - protein, 8 aa, Borrelia afzelii PKo
FESISSTL

SEQ ID NO: 173541 - protein, 8 aa, Borrelia afzelii PKo
ESISSTLK

SEQ ID NO: 173542 - protein, 8 aa, Borrelia afzelii PKo
SISSTLKA

SEQ ID NO: 173543 - protein, 8 aa, Borrelia afzelii PKo
SSTLKATK

SEQ ID NO: 173544 - protein, 8 aa, Borrelia afzelii PKo
TLKATKGK

SEQ ID NO: 173545 - protein, 8 aa, Borrelia afzelii PKo
KLDELVSA

SEQ ID NO: 173546 - protein, 8 aa, Borrelia afzelii PKo
KASVESAV

SEQ ID NO: 173547 - protein, 8 aa, Borrelia afzelii PKo
SAVDEVSK

SEQ ID NO: 173548 - protein, 8 aa, Borrelia afzelii PKo
KWLEEMIK

SEQ ID NO: 173549 - protein, 8 aa, Borrelia afzelii PKo
WLEEMIKA

SEQ ID NO: 173550 - protein, 8 aa, Borrelia afzelii PKo
MIKAAEEA

SEQ ID NO: 173551 - protein, 8 aa, Borrelia afzelii PKo
KAAEEAAK

SEQ ID NO: 173552 - protein, 8 aa, Borrelia afzelii PKo
DSAANHGA

SEQ ID NO: 173553 - protein, 8 aa, Borrelia afzelii PKo
SAANHGAK

SEQ ID NO: 173554 - protein, 8 aa, Borrelia afzelii PKo
DSVKGIAK

SEQ ID NO: 173555 - protein, 8 aa, Borrelia afzelii PKo
KGIAKGIK

SEQ ID NO: 173556 - protein, 8 aa, Borrelia afzelii PKo
GIKGIVDA

SEQ ID NO: 173557 - protein, 8 aa, Borrelia afzelii PKo
GIVDAAGK

SEQ ID NO: 173558 - protein, 8 aa, Borrelia afzelii PKo
AGKALGEK

SEQ ID NO: 173559 - protein, 8 aa, Borrelia afzelii PKo
ALGEKGAL

SEQ ID NO: 173560 - protein, 8 aa, Borrelia afzelii PKo
ALKDVKAA

SEQ ID NO: 173561 - protein, 8 aa, Borrelia afzelii PKo
EANADAGK

SEQ ID NO: 173562 - protein, 8 aa, Borrelia afzelii PKo
FAGNANAA

SEQ ID NO: 173563 - protein, 8 aa, Borrelia afzelii PKo
NAAVGAAA

SEQ ID NO: 173564 - protein, 8 aa, Borrelia afzelii PKo
GAAADIAK

SEQ ID NO: 173565 - protein, 8 aa, Borrelia afzelii PKo
IAKAAGAV

SEQ ID NO: 173566 - protein, 8 aa, Borrelia afzelii PKo
KAAGAVTA

SEQ ID NO: 173567 - protein, 8 aa, Borrelia afzelii PKo
AAGAVTAV

SEQ ID NO: 173568 - protein, 8 aa, Borrelia afzelii PKo
AVSGEQIL

SEQ ID NO: 173569 - protein, 8 aa, Borrelia afzelii PKo
VSGEQILK

SEQ ID NO: 173570 - protein, 8 aa, Borrelia afzelii PKo
ILKAIVEA

SEQ ID NO: 173571 - protein, 8 aa, Borrelia afzelii PKo
DPANQAGK

SEQ ID NO: 173572 - protein, 8 aa, Borrelia afzelii PKo
AEEAKNPI

SEQ ID NO: 173573 - protein, 8 aa, Borrelia afzelii PKo
DDNGAAFK

SEQ ID NO: 173574 - protein, 8 aa, Borrelia afzelii PKo
AAFKDEMK

SEQ ID NO: 173575 - protein, 8 aa, Borrelia afzelii PKo
AFKDEMKK

SEQ ID NO: 173576 - protein, 8 aa, Borrelia afzelii PKo
KIAAAIVL

SEQ ID NO: 173577 - protein, 8 aa, Borrelia afzelii PKo
IAAAIVLR

SEQ ID NO: 173578 - protein, 8 aa, Borrelia afzelii PKo
AAIVLRGV

SEQ ID NO: 173579 - protein, 8 aa, Borrelia afzelii PKo
IVLRGVAK

SEQ ID NO: 173580 - protein, 8 aa, Borrelia afzelii PKo
AKDGKFAV

SEQ ID NO: 173581 - protein, 9 aa, Borrelia afzelii PKo
KISSAIFLT

SEQ ID NO: 173582 - protein, 9 aa, Borrelia afzelii PKo
ISSAIFLTA

SEQ ID NO: 173583 - protein, 9 aa, Borrelia afzelii PKo
SSAIFLTAL

SEQ ID NO: 173584 - protein, 9 aa, Borrelia afzelii PKo
SAIFLTALL

SEQ ID NO: 173585 - protein, 9 aa, Borrelia afzelii PKo
AIFLTALLV

SEQ ID NO: 173586 - protein, 9 aa, Borrelia afzelii PKo
IFLTALLVF

SEQ ID NO: 173587 - protein, 9 aa, Borrelia afzelii PKo
FLTALLVFI

SEQ ID NO: 173588 - protein, 9 aa, Borrelia afzelii PKo
ALLVFINCK

SEQ ID NO: 173589 - protein, 9 aa, Borrelia afzelii PKo
FINCKNNAV

SEQ ID NO: 173590 - protein, 9 aa, Borrelia afzelii PKo
AVGKGNDDK

SEQ ID NO: 173591 - protein, 9 aa, Borrelia afzelii PKo
SVKTFYESI

SEQ ID NO: 173592 - protein, 9 aa, Borrelia afzelii PKo
TFYESIINL

SEQ ID NO: 173593 - protein, 9 aa, Borrelia afzelii PKo
SIINLGNGF

SEQ ID NO: 173594 - protein, 9 aa, Borrelia afzelii PKo
IINLGNGFI

SEQ ID NO: 173595 - protein, 9 aa, Borrelia afzelii PKo
NLGNGFIDV

SEQ ID NO: 173596 - protein, 9 aa, Borrelia afzelii PKo
GFIDVFNAF

SEQ ID NO: 173597 - protein, 9 aa, Borrelia afzelii PKo
DVFNAFSGL

SEQ ID NO: 173598 - protein, 9 aa, Borrelia afzelii PKo
FSGLVADTF

SEQ ID NO: 173599 - protein, 9 aa, Borrelia afzelii PKo
GLVADTFFK

SEQ ID NO: 173600 - protein, 9 aa, Borrelia afzelii PKo
LVADTFFKS

SEQ ID NO: 173601 - protein, 9 aa, Borrelia afzelii PKo
DTFFKSDPK

SEQ ID NO: 173602 - protein, 9 aa, Borrelia afzelii PKo
TFFKSDPKK

SEQ ID NO: 173603 - protein, 9 aa, Borrelia afzelii PKo
DVKTYFESI

SEQ ID NO: 173604 - protein, 9 aa, Borrelia afzelii PKo
YFESISSTL

SEQ ID NO: 173605 - protein, 9 aa, Borrelia afzelii PKo
ISSTLKATK

SEQ ID NO: 173606 - protein, 9 aa, Borrelia afzelii PKo
STLKATKGK

SEQ ID NO: 173607 - protein, 9 aa, Borrelia afzelii PKo
TLKATKGKL

SEQ ID NO: 173608 - protein, 9 aa, Borrelia afzelii PKo
ATKGKLDEL

SEQ ID NO: 173609 - protein, 9 aa, Borrelia afzelii PKo
KLDELVSAK

SEQ ID NO: 173610 - protein, 9 aa, Borrelia afzelii PKo
EGGSVKASV

SEQ ID NO: 173611 - protein, 9 aa, Borrelia afzelii PKo
SVKASVESA

SEQ ID NO: 173612 - protein, 9 aa, Borrelia afzelii PKo
SVESAVDEV

SEQ ID NO: 173613 - protein, 9 aa, Borrelia afzelii PKo
ESAVDEVSK

SEQ ID NO: 173614 - protein, 9 aa, Borrelia afzelii PKo
SAVDEVSKW

SEQ ID NO: 173615 - protein, 9 aa, Borrelia afzelii PKo
AVDEVSKWL

SEQ ID NO: 173616 - protein, 9 aa, Borrelia afzelii PKo
EVSKWLEEM

SEQ ID NO: 173617 - protein, 9 aa, Borrelia afzelii PKo
WLEEMIKAA

SEQ ID NO: 173618 - protein, 9 aa, Borrelia afzelii PKo
EMIKAAEEA

SEQ ID NO: 173619 - protein, 9 aa, Borrelia afzelii PKo
MIKAAEEAA

SEQ ID NO: 173620 - protein, 9 aa, Borrelia afzelii PKo
KAAEEAAKV

SEQ ID NO: 173621 - protein, 9 aa, Borrelia afzelii PKo
DSAANHGAK

SEQ ID NO: 173622 - protein, 9 aa, Borrelia afzelii PKo
ANHGAKADK

SEQ ID NO: 173623 - protein, 9 aa, Borrelia afzelii PKo
SVKGIAKGI

SEQ ID NO: 173624 - protein, 9 aa, Borrelia afzelii PKo
GIAKGIKGI

SEQ ID NO: 173625 - protein, 9 aa, Borrelia afzelii PKo
GIKGIVDAA

SEQ ID NO: 173626 - protein, 9 aa, Borrelia afzelii PKo
IVDAAGKAL

SEQ ID NO: 173627 - protein, 9 aa, Borrelia afzelii PKo
AAGKALGEK

SEQ ID NO: 173628 - protein, 9 aa, Borrelia afzelii PKo
ALGEKGALK

SEQ ID NO: 173629 - protein, 9 aa, Borrelia afzelii PKo
ALKDVKAAA

SEQ ID NO: 173630 - protein, 9 aa, Borrelia afzelii PKo
NADAGKLFA

SEQ ID NO: 173631 - protein, 9 aa, Borrelia afzelii PKo
KLFAGNANA

SEQ ID NO: 173632 - protein, 9 aa, Borrelia afzelii PKo
FAGNANAAV

SEQ ID NO: 173633 - protein, 9 aa, Borrelia afzelii PKo
NANAAVGAA

SEQ ID NO: 173634 - protein, 9 aa, Borrelia afzelii PKo
DIAKAAGAV

SEQ ID NO: 173635 - protein, 9 aa, Borrelia afzelii PKo
KAAGAVTAV

SEQ ID NO: 173636 - protein, 9 aa, Borrelia afzelii PKo
TAVSGEQIL

SEQ ID NO: 173637 - protein, 9 aa, Borrelia afzelii PKo
AVSGEQILK

SEQ ID NO: 173638 - protein, 9 aa, Borrelia afzelii PKo
QILKAIVEA

SEQ ID NO: 173639 - protein, 9 aa, Borrelia afzelii PKo
ILKAIVEAA

SEQ ID NO: 173640 - protein, 9 aa, Borrelia afzelii PKo
AGKKAEEAK

SEQ ID NO: 173641 - protein, 9 aa, Borrelia afzelii PKo
AEEAKNPIA

SEQ ID NO: 173642 - protein, 9 aa, Borrelia afzelii PKo
EEAKNPIAA

SEQ ID NO: 173643 - protein, 9 aa, Borrelia afzelii PKo
NPIAAAIGT

SEQ ID NO: 173644 - protein, 9 aa, Borrelia afzelii PKo
TDDDNGAAF

SEQ ID NO: 173645 - protein, 9 aa, Borrelia afzelii PKo
GAAFKDEMK

SEQ ID NO: 173646 - protein, 9 aa, Borrelia afzelii PKo
AAFKDEMKK

SEQ ID NO: 173647 - protein, 9 aa, Borrelia afzelii PKo
KIAAAIVLR

SEQ ID NO: 173648 - protein, 9 aa, Borrelia afzelii PKo
AAAIVLRGV

SEQ ID NO: 173649 - protein, 9 aa, Borrelia afzelii PKo
AIVLRGVAK

SEQ ID NO: 173650 - protein, 9 aa, Borrelia afzelii PKo
VAKDGKFAV

SEQ ID NO: 173651 - protein, 10 aa, Borrelia afzelii PKo
KISSAIFLTA

SEQ ID NO: 173652 - protein, 10 aa, Borrelia afzelii PKo
ISSAIFLTAL

SEQ ID NO: 173653 - protein, 10 aa, Borrelia afzelii PKo
SSAIFLTALL

SEQ ID NO: 173654 - protein, 10 aa, Borrelia afzelii PKo
SAIFLTALLV

SEQ ID NO: 173655 - protein, 10 aa, Borrelia afzelii PKo
AIFLTALLVF

SEQ ID NO: 173656 - protein, 10 aa, Borrelia afzelii PKo
IFLTALLVFI

SEQ ID NO: 173657 - protein, 10 aa, Borrelia afzelii PKo
FLTALLVFIN

SEQ ID NO: 173658 - protein, 10 aa, Borrelia afzelii PKo
TALLVFINCK

SEQ ID NO: 173659 - protein, 10 aa, Borrelia afzelii PKo
DSVKTFYESI

SEQ ID NO: 173660 - protein, 10 aa, Borrelia afzelii PKo
SVKTFYESII

SEQ ID NO: 173661 - protein, 10 aa, Borrelia afzelii PKo
KTFYESIINL

SEQ ID NO: 173662 - protein, 10 aa, Borrelia afzelii PKo
ESIINLGNGF

SEQ ID NO: 173663 - protein, 10 aa, Borrelia afzelii PKo
SIINLGNGFI

SEQ ID NO: 173664 - protein, 10 aa, Borrelia afzelii PKo
NGFIDVFNAF

SEQ ID NO: 173665 - protein, 10 aa, Borrelia afzelii PKo
DVFNAFSGLV

SEQ ID NO: 173666 - protein, 10 aa, Borrelia afzelii PKo
AFSGLVADTF

SEQ ID NO: 173667 - protein, 10 aa, Borrelia afzelii PKo
FSGLVADTFF

SEQ ID NO: 173668 - protein, 10 aa, Borrelia afzelii PKo
SGLVADTFFK

SEQ ID NO: 173669 - protein, 10 aa, Borrelia afzelii PKo
GLVADTFFKS

SEQ ID NO: 173670 - protein, 10 aa, Borrelia afzelii PKo
ADTFFKSDPK

SEQ ID NO: 173671 - protein, 10 aa, Borrelia afzelii PKo
DTFFKSDPKK

SEQ ID NO: 173672 - protein, 10 aa, Borrelia afzelii PKo
DPKKSDVKTY

SEQ ID NO: 173673 - protein, 10 aa, Borrelia afzelii PKo
KTYFESISST

SEQ ID NO: 173674 - protein, 10 aa, Borrelia afzelii PKo
TYFESISSTL

SEQ ID NO: 173675 - protein, 10 aa, Borrelia afzelii PKo
YFESISSTLK

SEQ ID NO: 173676 - protein, 10 aa, Borrelia afzelii PKo
SISSTLKATK

SEQ ID NO: 173677 - protein, 10 aa, Borrelia afzelii PKo
SSTLKATKGK

SEQ ID NO: 173678 - protein, 10 aa, Borrelia afzelii PKo
ATKGKLDELV

SEQ ID NO: 173679 - protein, 10 aa, Borrelia afzelii PKo
KLDELVSAKK

SEQ ID NO: 173680 - protein, 10 aa, Borrelia afzelii PKo
SAKKGEGGSV

SEQ ID NO: 173681 - protein, 10 aa, Borrelia afzelii PKo
SVKASVESAV

SEQ ID NO: 173682 - protein, 10 aa, Borrelia afzelii PKo
ASVESAVDEV

SEQ ID NO: 173683 - protein, 10 aa, Borrelia afzelii PKo
ESAVDEVSKW

SEQ ID NO: 173684 - protein, 10 aa, Borrelia afzelii PKo
SAVDEVSKWL

SEQ ID NO: 173685 - protein, 10 aa, Borrelia afzelii PKo
EVSKWLEEMI

SEQ ID NO: 173686 - protein, 10 aa, Borrelia afzelii PKo
VSKWLEEMIK

SEQ ID NO: 173687 - protein, 10 aa, Borrelia afzelii PKo
EEMIKAAEEA

SEQ ID NO: 173688 - protein, 10 aa, Borrelia afzelii PKo
MIKAAEEAAK

SEQ ID NO: 173689 - protein, 10 aa, Borrelia afzelii PKo
AEEAAKVGGT

SEQ ID NO: 173690 - protein, 10 aa, Borrelia afzelii PKo
KVGGTGGDGK

SEQ ID NO: 173691 - protein, 10 aa, Borrelia afzelii PKo
AANHGAKADK

SEQ ID NO: 173692 - protein, 10 aa, Borrelia afzelii PKo
HGAKADKDSV

SEQ ID NO: 173693 - protein, 10 aa, Borrelia afzelii PKo
SVKGIAKGIK

SEQ ID NO: 173694 - protein, 10 aa, Borrelia afzelii PKo
GIAKGIKGIV

SEQ ID NO: 173695 - protein, 10 aa, Borrelia afzelii PKo
GIVDAAGKAL

SEQ ID NO: 173696 - protein, 10 aa, Borrelia afzelii PKo
DAAGKALGEK

SEQ ID NO: 173697 - protein, 10 aa, Borrelia afzelii PKo
KALGEKGALK

SEQ ID NO: 173698 - protein, 10 aa, Borrelia afzelii PKo
EANADAGKLF

SEQ ID NO: 173699 - protein, 10 aa, Borrelia afzelii PKo
KLFAGNANAA

SEQ ID NO: 173700 - protein, 10 aa, Borrelia afzelii PKo
LFAGNANAAV

SEQ ID NO: 173701 - protein, 10 aa, Borrelia afzelii PKo
NANAAVGAAA

SEQ ID NO: 173702 - protein, 10 aa, Borrelia afzelii PKo
AVGAAADIAK

SEQ ID NO: 173703 - protein, 10 aa, Borrelia afzelii PKo
AKAAGAVTAV

SEQ ID NO: 173704 - protein, 10 aa, Borrelia afzelii PKo
TAVSGEQILK

SEQ ID NO: 173705 - protein, 10 aa, Borrelia afzelii PKo
AVSGEQILKA

SEQ ID NO: 173706 - protein, 10 aa, Borrelia afzelii PKo
QILKAIVEAA

SEQ ID NO: 173707 - protein, 10 aa, Borrelia afzelii PKo
AIVEAAGDPA

SEQ ID NO: 173708 - protein, 10 aa, Borrelia afzelii PKo
EAAGDPANQA

SEQ ID NO: 173709 - protein, 10 aa, Borrelia afzelii PKo
AEEAKNPIAA

SEQ ID NO: 173710 - protein, 10 aa, Borrelia afzelii PKo
EEAKNPIAAA

SEQ ID NO: 173711 - protein, 10 aa, Borrelia afzelii PKo
EAKNPIAAAI

SEQ ID NO: 173712 - protein, 10 aa, Borrelia afzelii PKo
GTDDDNGAAF

SEQ ID NO: 173713 - protein, 10 aa, Borrelia afzelii PKo
NGAAFKDEMK

SEQ ID NO: 173714 - protein, 10 aa, Borrelia afzelii PKo
GAAFKDEMKK

SEQ ID NO: 173715 - protein, 10 aa, Borrelia afzelii PKo
DKIAAAIVLR

SEQ ID NO: 173716 - protein, 10 aa, Borrelia afzelii PKo
IAAAIVLRGV

SEQ ID NO: 173717 - protein, 10 aa, Borrelia afzelii PKo
AAIVLRGVAK

SEQ ID NO: 173718 - protein, 10 aa, Borrelia afzelii PKo
VLRGVAKDGK

SEQ ID NO: 173719 - protein, 10 aa, Borrelia afzelii PKo
GVAKDGKFAV

SEQ ID NO: 173720 - protein, 10 aa, Borrelia afzelii PKo
VAKDGKFAVK

SEQ ID NO: 173721 - protein, 11 aa, Borrelia afzelii PKo
KKISSAIFLTA

SEQ ID NO: 173722 - protein, 11 aa, Borrelia afzelii PKo
KISSAIFLTAL

SEQ ID NO: 173723 - protein, 11 aa, Borrelia afzelii PKo
ISSAIFLTALL

SEQ ID NO: 173724 - protein, 11 aa, Borrelia afzelii PKo
SSAIFLTALLV

SEQ ID NO: 173725 - protein, 11 aa, Borrelia afzelii PKo
SAIFLTALLVF

SEQ ID NO: 173726 - protein, 11 aa, Borrelia afzelii PKo
AIFLTALLVFI

SEQ ID NO: 173727 - protein, 11 aa, Borrelia afzelii PKo
FLTALLVFINC

SEQ ID NO: 173728 - protein, 11 aa, Borrelia afzelii PKo
LTALLVFINCK

SEQ ID NO: 173729 - protein, 11 aa, Borrelia afzelii PKo
LLVFINCKNNA

SEQ ID NO: 173730 - protein, 11 aa, Borrelia afzelii PKo
LVFINCKNNAV

SEQ ID NO: 173731 - protein, 11 aa, Borrelia afzelii PKo
FINCKNNAVGK

SEQ ID NO: 173732 - protein, 11 aa, Borrelia afzelii PKo
YESIINLGNGF

SEQ ID NO: 173733 - protein, 11 aa, Borrelia afzelii PKo
ESIINLGNGFI

SEQ ID NO: 173734 - protein, 11 aa, Borrelia afzelii PKo
IINLGNGFIDV

SEQ ID NO: 173735 - protein, 11 aa, Borrelia afzelii PKo
FIDVFNAFSGL

SEQ ID NO: 173736 - protein, 11 aa, Borrelia afzelii PKo
DVFNAFSGLVA

SEQ ID NO: 173737 - protein, 11 aa, Borrelia afzelii PKo
NAFSGLVADTF

SEQ ID NO: 173738 - protein, 11 aa, Borrelia afzelii PKo
AFSGLVADTFF

SEQ ID NO: 173739 - protein, 11 aa, Borrelia afzelii PKo
FSGLVADTFFK

SEQ ID NO: 173740 - protein, 11 aa, Borrelia afzelii PKo
VADTFFKSDPK

SEQ ID NO: 173741 - protein, 11 aa, Borrelia afzelii PKo
DPKKSDVKTYF

SEQ ID NO: 173742 - protein, 11 aa, Borrelia afzelii PKo
KTYFESISSTL

SEQ ID NO: 173743 - protein, 11 aa, Borrelia afzelii PKo
TYFESISSTLK

SEQ ID NO: 173744 - protein, 11 aa, Borrelia afzelii PKo
ESISSTLKATK

SEQ ID NO: 173745 - protein, 11 aa, Borrelia afzelii PKo
ISSTLKATKGK

SEQ ID NO: 173746 - protein, 11 aa, Borrelia afzelii PKo
KATKGKLDELV

SEQ ID NO: 173747 - protein, 11 aa, Borrelia afzelii PKo
KGKLDELVSAK

SEQ ID NO: 173748 - protein, 11 aa, Borrelia afzelii PKo
SAKKGEGGSVK

SEQ ID NO: 173749 - protein, 11 aa, Borrelia afzelii PKo
KASVESAVDEV

SEQ ID NO: 173750 - protein, 11 aa, Borrelia afzelii PKo
SVESAVDEVSK

SEQ ID NO: 173751 - protein, 11 aa, Borrelia afzelii PKo
ESAVDEVSKWL

SEQ ID NO: 173752 - protein, 11 aa, Borrelia afzelii PKo
EVSKWLEEMIK

SEQ ID NO: 173753 - protein, 11 aa, Borrelia afzelii PKo
EEMIKAAEEAA

SEQ ID NO: 173754 - protein, 11 aa, Borrelia afzelii PKo
EMIKAAEEAAK

SEQ ID NO: 173755 - protein, 11 aa, Borrelia afzelii PKo
MIKAAEEAAKV

SEQ ID NO: 173756 - protein, 11 aa, Borrelia afzelii PKo
KIGDSAANHGA

SEQ ID NO: 173757 - protein, 11 aa, Borrelia afzelii PKo
SAANHGAKADK

SEQ ID NO: 173758 - protein, 11 aa, Borrelia afzelii PKo
DSVKGIAKGIK

SEQ ID NO: 173759 - protein, 11 aa, Borrelia afzelii PKo
GIKGIVDAAGK

SEQ ID NO: 173760 - protein, 11 aa, Borrelia afzelii PKo
ALGEKGALKDV

SEQ ID NO: 173761 - protein, 11 aa, Borrelia afzelii PKo
DEANADAGKLF

SEQ ID NO: 173762 - protein, 11 aa, Borrelia afzelii PKo
KLFAGNANAAV

SEQ ID NO: 173763 - protein, 11 aa, Borrelia afzelii PKo
FAGNANAAVGA

SEQ ID NO: 173764 - protein, 11 aa, Borrelia afzelii PKo
AAVGAAADIAK

SEQ ID NO: 173765 - protein, 11 aa, Borrelia afzelii PKo
AAADIAKAAGA

SEQ ID NO: 173766 - protein, 11 aa, Borrelia afzelii PKo
IAKAAGAVTAV

SEQ ID NO: 173767 - protein, 11 aa, Borrelia afzelii PKo
AVTAVSGEQIL

SEQ ID NO: 173768 - protein, 11 aa, Borrelia afzelii PKo
VTAVSGEQILK

SEQ ID NO: 173769 - protein, 11 aa, Borrelia afzelii PKo
AVSGEQILKAI

SEQ ID NO: 173770 - protein, 11 aa, Borrelia afzelii PKo
AAGDPANQAGK

SEQ ID NO: 173771 - protein, 11 aa, Borrelia afzelii PKo
AEEAKNPIAAA

SEQ ID NO: 173772 - protein, 11 aa, Borrelia afzelii PKo
EEAKNPIAAAI

SEQ ID NO: 173773 - protein, 11 aa, Borrelia afzelii PKo
IGTDDDNGAAF

SEQ ID NO: 173774 - protein, 11 aa, Borrelia afzelii PKo
GTDDDNGAAFK

SEQ ID NO: 173775 - protein, 11 aa, Borrelia afzelii PKo
NGAAFKDEMKK

SEQ ID NO: 173776 - protein, 11 aa, Borrelia afzelii PKo
AFKDEMKKSDK

SEQ ID NO: 173777 - protein, 11 aa, Borrelia afzelii PKo
KSDKIAAAIVL

SEQ ID NO: 173778 - protein, 11 aa, Borrelia afzelii PKo
KIAAAIVLRGV

SEQ ID NO: 173779 - protein, 11 aa, Borrelia afzelii PKo
IAAAIVLRGVA

SEQ ID NO: 173780 - protein, 11 aa, Borrelia afzelii PKo
AAAIVLRGVAK

SEQ ID NO: 173781 - protein, 11 aa, Borrelia afzelii PKo
IVLRGVAKDGK

SEQ ID NO: 173782 - protein, 11 aa, Borrelia afzelii PKo
VLRGVAKDGKF

SEQ ID NO: 173783 - protein, 11 aa, Borrelia afzelii PKo
GVAKDGKFAVK

SEQ ID NO: 173784 - protein, 15 aa, Borrelia afzelii PKo
ADAGKLFAGNANAAV

SEQ ID NO: 173785 - protein, 9 aa, Borrelia afzelii PKo
LFAGNANAA

SEQ ID NO: 173786 - protein, 15 aa, Borrelia afzelii PKo
ADIAKAAGAVTAVSG

SEQ ID NO: 173787 - protein, 9 aa, Borrelia afzelii PKo
IAKAAGAVT

SEQ ID NO: 173788 - protein, 15 aa, Borrelia afzelii PKo
ADTFFKSDPKKSDVK

SEQ ID NO: 173789 - protein, 9 aa, Borrelia afzelii PKo
FFKSDPKKS

SEQ ID NO: 173790 - protein, 15 aa, Borrelia afzelii PKo
ADTFFKSDPKKSDVK

SEQ ID NO: 173791 - protein, 9 aa, Borrelia afzelii PKo
FKSDPKKSD

SEQ ID NO: 173792 - protein, 15 aa, Borrelia afzelii PKo
AEEAKNPIAAAIGTD

SEQ ID NO: 173793 - protein, 9 aa, Borrelia afzelii PKo
AKNPIAAAI

SEQ ID NO: 173794 - protein, 15 aa, Borrelia afzelii PKo
AGAVTAVSGEQILKA

SEQ ID NO: 173795 - protein, 9 aa, Borrelia afzelii PKo
VTAVSGEQI

SEQ ID NO: 173796 - protein, 15 aa, Borrelia afzelii PKo
AGKLFAGNANAAVGA

SEQ ID NO: 173797 - protein, 9 aa, Borrelia afzelii PKo
FAGNANAAV

SEQ ID NO: 173798 - protein, 15 aa, Borrelia afzelii PKo
AGNANAAVGAAADIA

SEQ ID NO: 173799 - protein, 9 aa, Borrelia afzelii PKo
ANAAVGAAA

SEQ ID NO: 173800 - protein, 15 aa, Borrelia afzelii PKo
AIFLTALLVFINCKN

SEQ ID NO: 173801 - protein, 9 aa, Borrelia afzelii PKo
FLTALLVFI

SEQ ID NO: 173802 - protein, 15 aa, Borrelia afzelii PKo
AIVLRGVAKDGKFAV

SEQ ID NO: 173803 - protein, 9 aa, Borrelia afzelii PKo
LRGVAKDGK

SEQ ID NO: 173804 - protein, 15 aa, Borrelia afzelii PKo
AKGIKGIVDAAGKAL

SEQ ID NO: 173805 - protein, 9 aa, Borrelia afzelii PKo
IKGIVDAAG

SEQ ID NO: 173806 - protein, 15 aa, Borrelia afzelii PKo
AKAAGAVTAVSGEQI

SEQ ID NO: 173807 - protein, 9 aa, Borrelia afzelii PKo
AKAAGAVTA

SEQ ID NO: 173808 - protein, 15 aa, Borrelia afzelii PKo
ALLVFINCKNNAVGK

SEQ ID NO: 173809 - protein, 9 aa, Borrelia afzelii PKo
FINCKNNAV

SEQ ID NO: 173810 - protein, 15 aa, Borrelia afzelii PKo
ALLVFINCKNNAVGK

SEQ ID NO: 173811 - protein, 9 aa, Borrelia afzelii PKo
VFINCKNNA

SEQ ID NO: 173812 - protein, 15 aa, Borrelia afzelii PKo
ANAAVGAAADIAKAA

SEQ ID NO: 173813 - protein, 9 aa, Borrelia afzelii PKo
AVGAAADIA

SEQ ID NO: 173814 - protein, 15 aa, Borrelia afzelii PKo
DAGKLFAGNANAAVG

SEQ ID NO: 173815 - protein, 9 aa, Borrelia afzelii PKo
FAGNANAAV

SEQ ID NO: 173816 - protein, 15 aa, Borrelia afzelii PKo
DGKIGDSAANHGAKA

SEQ ID NO: 173817 - protein, 9 aa, Borrelia afzelii PKo
IGDSAANHG

SEQ ID NO: 173818 - protein, 15 aa, Borrelia afzelii PKo
DIAKAAGAVTAVSGE

SEQ ID NO: 173819 - protein, 9 aa, Borrelia afzelii PKo
AKAAGAVTA

SEQ ID NO: 173820 - protein, 15 aa, Borrelia afzelii PKo
DKIAAAIVLRGVAKD

SEQ ID NO: 173821 - protein, 9 aa, Borrelia afzelii PKo
IAAAIVLRG

SEQ ID NO: 173822 - protein, 15 aa, Borrelia afzelii PKo
DSVKTFYESIINLGN

SEQ ID NO: 173823 - protein, 9 aa, Borrelia afzelii PKo
FYESIINLG

SEQ ID NO: 173824 - protein, 15 aa, Borrelia afzelii PKo
DSVKTFYESIINLGN

SEQ ID NO: 173825 - protein, 9 aa, Borrelia afzelii PKo
VKTFYESII

SEQ ID NO: 173826 - protein, 15 aa, Borrelia afzelii PKo
DTFFKSDPKKSDVKT

SEQ ID NO: 173827 - protein, 9 aa, Borrelia afzelii PKo
FFKSDPKKS

SEQ ID NO: 173828 - protein, 15 aa, Borrelia afzelii PKo
DTFFKSDPKKSDVKT

SEQ ID NO: 173829 - protein, 9 aa, Borrelia afzelii PKo
FKSDPKKSD

SEQ ID NO: 173830 - protein, 15 aa, Borrelia afzelii PKo
DVFNAFSGLVADTFF

SEQ ID NO: 173831 - protein, 9 aa, Borrelia afzelii PKo
FNAFSGLVA

SEQ ID NO: 173832 - protein, 15 aa, Borrelia afzelii PKo
DVFNAFSGLVADTFF

SEQ ID NO: 173833 - protein, 9 aa, Borrelia afzelii PKo
VFNAFSGLV

SEQ ID NO: 173834 - protein, 15 aa, Borrelia afzelii PKo
DVKTYFESISSTLKA

SEQ ID NO: 173835 - protein, 9 aa, Borrelia afzelii PKo
FESISSTLK

SEQ ID NO: 173836 - protein, 15 aa, Borrelia afzelii PKo
DVKTYFESISSTLKA

SEQ ID NO: 173837 - protein, 9 aa, Borrelia afzelii PKo
YFESISSTL

SEQ ID NO: 173838 - protein, 15 aa, Borrelia afzelii PKo
EAKNPIAAAIGTDDD

SEQ ID NO: 173839 - protein, 9 aa, Borrelia afzelii PKo
IAAAIGTDD

SEQ ID NO: 173840 - protein, 15 aa, Borrelia afzelii PKo
EEAKNPIAAAIGTDD

SEQ ID NO: 173841 - protein, 9 aa, Borrelia afzelii PKo
AKNPIAAAI

SEQ ID NO: 173842 - protein, 15 aa, Borrelia afzelii PKo
EQILKAIVEAAGDPA

SEQ ID NO: 173843 - protein, 9 aa, Borrelia afzelii PKo
LKAIVEAAG

SEQ ID NO: 173844 - protein, 15 aa, Borrelia afzelii PKo
ESIINLGNGFIDVFN

SEQ ID NO: 173845 - protein, 9 aa, Borrelia afzelii PKo
IINLGNGFI

SEQ ID NO: 173846 - protein, 15 aa, Borrelia afzelii PKo
FAGNANAAVGAAADI

SEQ ID NO: 173847 - protein, 9 aa, Borrelia afzelii PKo
FAGNANAAV

SEQ ID NO: 173848 - protein, 15 aa, Borrelia afzelii PKo
FESISSTLKATKGKL

SEQ ID NO: 173849 - protein, 9 aa, Borrelia afzelii PKo
FESISSTLK

SEQ ID NO: 173850 - protein, 15 aa, Borrelia afzelii PKo
FIDVFNAFSGLVADT

SEQ ID NO: 173851 - protein, 9 aa, Borrelia afzelii PKo
FNAFSGLVA

SEQ ID NO: 173852 - protein, 15 aa, Borrelia afzelii PKo
FIDVFNAFSGLVADT

SEQ ID NO: 173853 - protein, 9 aa, Borrelia afzelii PKo
VFNAFSGLV

SEQ ID NO: 173854 - protein, 15 aa, Borrelia afzelii PKo
FKSDPKKSDVKTYFE

SEQ ID NO: 173855 - protein, 9 aa, Borrelia afzelii PKo
FKSDPKKSD

SEQ ID NO: 173856 - protein, 15 aa, Borrelia afzelii PKo
FLTALLVFINCKNNA

SEQ ID NO: 173857 - protein, 9 aa, Borrelia afzelii PKo
FLTALLVFI

SEQ ID NO: 173858 - protein, 15 aa, Borrelia afzelii PKo
FNAFSGLVADTFFKS

SEQ ID NO: 173859 - protein, 9 aa, Borrelia afzelii PKo
FNAFSGLVA

SEQ ID NO: 173860 - protein, 15 aa, Borrelia afzelii PKo
FYESIINLGNGFIDV

SEQ ID NO: 173861 - protein, 9 aa, Borrelia afzelii PKo
FYESIINLG

SEQ ID NO: 173862 - protein, 15 aa, Borrelia afzelii PKo
FYESIINLGNGFIDV

SEQ ID NO: 173863 - protein, 9 aa, Borrelia afzelii PKo
IINLGNGFI

SEQ ID NO: 173864 - protein, 15 aa, Borrelia afzelii PKo
GAVTAVSGEQILKAI

SEQ ID NO: 173865 - protein, 9 aa, Borrelia afzelii PKo
VTAVSGEQI

SEQ ID NO: 173866 - protein, 15 aa, Borrelia afzelii PKo
GDGKIGDSAANHGAK

SEQ ID NO: 173867 - protein, 9 aa, Borrelia afzelii PKo
IGDSAANHG

SEQ ID NO: 173868 - protein, 15 aa, Borrelia afzelii PKo
GEQILKAIVEAAGDP

SEQ ID NO: 173869 - protein, 9 aa, Borrelia afzelii PKo
LKAIVEAAG

SEQ ID NO: 173870 - protein, 15 aa, Borrelia afzelii PKo
GFIDVFNAFSGLVAD

SEQ ID NO: 173871 - protein, 9 aa, Borrelia afzelii PKo
FNAFSGLVA

SEQ ID NO: 173872 - protein, 15 aa, Borrelia afzelii PKo
GFIDVFNAFSGLVAD

SEQ ID NO: 173873 - protein, 9 aa, Borrelia afzelii PKo
VFNAFSGLV

SEQ ID NO: 173874 - protein, 15 aa, Borrelia afzelii PKo
GGDGKIGDSAANHGA

SEQ ID NO: 173875 - protein, 9 aa, Borrelia afzelii PKo
IGDSAANHG

SEQ ID NO: 173876 - protein, 15 aa, Borrelia afzelii PKo
GIAKGIKGIVDAAGK

SEQ ID NO: 173877 - protein, 9 aa, Borrelia afzelii PKo
IKGIVDAAG

SEQ ID NO: 173878 - protein, 15 aa, Borrelia afzelii PKo
GIKGIVDAAGKALGE

SEQ ID NO: 173879 - protein, 9 aa, Borrelia afzelii PKo
IVDAAGKAL

SEQ ID NO: 173880 - protein, 15 aa, Borrelia afzelii PKo
GIVDAAGKALGEKGA

SEQ ID NO: 173881 - protein, 9 aa, Borrelia afzelii PKo
IVDAAGKAL

SEQ ID NO: 173882 - protein, 15 aa, Borrelia afzelii PKo
GKIGDSAANHGAKAD

SEQ ID NO: 173883 - protein, 9 aa, Borrelia afzelii PKo
IGDSAANHG

SEQ ID NO: 173884 - protein, 15 aa, Borrelia afzelii PKo
GKLFAGNANAAVGAA

SEQ ID NO: 173885 - protein, 9 aa, Borrelia afzelii PKo
FAGNANAAV

SEQ ID NO: 173886 - protein, 15 aa, Borrelia afzelii PKo
GLVADTFFKSDPKKS

SEQ ID NO: 173887 - protein, 9 aa, Borrelia afzelii PKo
DTFFKSDPK

SEQ ID NO: 173888 - protein, 15 aa, Borrelia afzelii PKo
GNANAAVGAAADIAK

SEQ ID NO: 173889 - protein, 9 aa, Borrelia afzelii PKo
AVGAAADIA

SEQ ID NO: 173890 - protein, 15 aa, Borrelia afzelii PKo
GNGFIDVFNAFSGLV

SEQ ID NO: 173891 - protein, 9 aa, Borrelia afzelii PKo
FIDVFNAFS

SEQ ID NO: 173892 - protein, 15 aa, Borrelia afzelii PKo
GAAADIAKAAGAVTA

SEQ ID NO: 173893 - protein, 9 aa, Borrelia afzelii PKo
IAKAAGAVT

SEQ ID NO: 173894 - protein, 15 aa, Borrelia afzelii PKo
IAKGIKGIVDAAGKA

SEQ ID NO: 173895 - protein, 9 aa, Borrelia afzelii PKo
IKGIVDAAG

SEQ ID NO: 173896 - protein, 15 aa, Borrelia afzelii PKo
IAKAAGAVTAVSGEQ

SEQ ID NO: 173897 - protein, 9 aa, Borrelia afzelii PKo
IAKAAGAVT

SEQ ID NO: 173898 - protein, 15 aa, Borrelia afzelii PKo
IDVFNAFSGLVADTF

SEQ ID NO: 173899 - protein, 9 aa, Borrelia afzelii PKo
FNAFSGLVA

SEQ ID NO: 173900 - protein, 15 aa, Borrelia afzelii PKo
IDVFNAFSGLVADTF

SEQ ID NO: 173901 - protein, 9 aa, Borrelia afzelii PKo
VFNAFSGLV

SEQ ID NO: 173902 - protein, 15 aa, Borrelia afzelii PKo
IFLTALLVFINCKNN

SEQ ID NO: 173903 - protein, 9 aa, Borrelia afzelii PKo
FLTALLVFI

SEQ ID NO: 173904 - protein, 15 aa, Borrelia afzelii PKo
IKGIVDAAGKALGEK

SEQ ID NO: 173905 - protein, 9 aa, Borrelia afzelii PKo
IVDAAGKAL

SEQ ID NO: 173906 - protein, 15 aa, Borrelia afzelii PKo
ISSAIFLTALLVFIN

SEQ ID NO: 173907 - protein, 9 aa, Borrelia afzelii PKo
FLTALLVFI

SEQ ID NO: 173908 - protein, 15 aa, Borrelia afzelii PKo
IVDAAGKALGEKGAL

SEQ ID NO: 173909 - protein, 9 aa, Borrelia afzelii PKo
IVDAAGKAL

SEQ ID NO: 173910 - protein, 15 aa, Borrelia afzelii PKo
IAAAIVLRGVAKDGK

SEQ ID NO: 173911 - protein, 9 aa, Borrelia afzelii PKo
AIVLRGVAK

SEQ ID NO: 173912 - protein, 15 aa, Borrelia afzelii PKo
IAAAIVLRGVAKDGK

SEQ ID NO: 173913 - protein, 9 aa, Borrelia afzelii PKo
IAAAIVLRG

SEQ ID NO: 173914 - protein, 15 aa, Borrelia afzelii PKo
KAEEAKNPIAAAIGT

SEQ ID NO: 173915 - protein, 9 aa, Borrelia afzelii PKo
AKNPIAAAI

SEQ ID NO: 173916 - protein, 15 aa, Borrelia afzelii PKo
KAIVEAAGDPANQAG

SEQ ID NO: 173917 - protein, 9 aa, Borrelia afzelii PKo
AAGDPANQA

SEQ ID NO: 173918 - protein, 15 aa, Borrelia afzelii PKo
KDSVKTFYESIINLG

SEQ ID NO: 173919 - protein, 9 aa, Borrelia afzelii PKo
KTFYESIIN

SEQ ID NO: 173920 - protein, 15 aa, Borrelia afzelii PKo
KGIAKGIKGIVDAAG

SEQ ID NO: 173921 - protein, 9 aa, Borrelia afzelii PKo
IAKGIKGIV

SEQ ID NO: 173922 - protein, 15 aa, Borrelia afzelii PKo
KGIKGIVDAAGKALG

SEQ ID NO: 173923 - protein, 9 aa, Borrelia afzelii PKo
IVDAAGKAL

SEQ ID NO: 173924 - protein, 15 aa, Borrelia afzelii PKo
KGIVDAAGKALGEKG

SEQ ID NO: 173925 - protein, 9 aa, Borrelia afzelii PKo
IVDAAGKAL

SEQ ID NO: 173926 - protein, 15 aa, Borrelia afzelii PKo
KISSAIFLTALLVFI

SEQ ID NO: 173927 - protein, 9 aa, Borrelia afzelii PKo
AIFLTALLV

SEQ ID NO: 173928 - protein, 15 aa, Borrelia afzelii PKo
KIAAAIVLRGVAKDG

SEQ ID NO: 173929 - protein, 9 aa, Borrelia afzelii PKo
IAAAIVLRG

SEQ ID NO: 173930 - protein, 15 aa, Borrelia afzelii PKo
KKISSAIFLTALLVF

SEQ ID NO: 173931 - protein, 9 aa, Borrelia afzelii PKo
ISSAIFLTA

SEQ ID NO: 173932 - protein, 15 aa, Borrelia afzelii PKo
KKSDKIAAAIVLRGV

SEQ ID NO: 173933 - protein, 9 aa, Borrelia afzelii PKo
IAAAIVLRG

SEQ ID NO: 173934 - protein, 15 aa, Borrelia afzelii PKo
KLFAGNANAAVGAAA

SEQ ID NO: 173935 - protein, 9 aa, Borrelia afzelii PKo
FAGNANAAV

SEQ ID NO: 173936 - protein, 15 aa, Borrelia afzelii PKo
KSDKIAAAIVLRGVA

SEQ ID NO: 173937 - protein, 9 aa, Borrelia afzelii PKo
IAAAIVLRG

SEQ ID NO: 173938 - protein, 15 aa, Borrelia afzelii PKo
KSDVKTYFESISSTL

SEQ ID NO: 173939 - protein, 9 aa, Borrelia afzelii PKo
KSDVKTYFE

SEQ ID NO: 173940 - protein, 15 aa, Borrelia afzelii PKo
KTFYESIINLGNGFI

SEQ ID NO: 173941 - protein, 9 aa, Borrelia afzelii PKo
FYESIINLG

SEQ ID NO: 173942 - protein, 15 aa, Borrelia afzelii PKo
KTFYESIINLGNGFI

SEQ ID NO: 173943 - protein, 9 aa, Borrelia afzelii PKo
YESIINLGN

SEQ ID NO: 173944 - protein, 15 aa, Borrelia afzelii PKo
KTYFESISSTLKATK

SEQ ID NO: 173945 - protein, 9 aa, Borrelia afzelii PKo
FESISSTLK

SEQ ID NO: 173946 - protein, 15 aa, Borrelia afzelii PKo
KTYFESISSTLKATK

SEQ ID NO: 173947 - protein, 9 aa, Borrelia afzelii PKo
YFESISSTL

SEQ ID NO: 173948 - protein, 15 aa, Borrelia afzelii PKo
KAAGAVTAVSGEQIL

SEQ ID NO: 173949 - protein, 9 aa, Borrelia afzelii PKo
VTAVSGEQI

SEQ ID NO: 173950 - protein, 15 aa, Borrelia afzelii PKo
LFAGNANAAVGAAAD

SEQ ID NO: 173951 - protein, 9 aa, Borrelia afzelii PKo
FAGNANAAV

SEQ ID NO: 173952 - protein, 15 aa, Borrelia afzelii PKo
LKAIVEAAGDPANQA

SEQ ID NO: 173953 - protein, 9 aa, Borrelia afzelii PKo
LKAIVEAAG

SEQ ID NO: 173954 - protein, 15 aa, Borrelia afzelii PKo
LLVFINCKNNAVGKG

SEQ ID NO: 173955 - protein, 9 aa, Borrelia afzelii PKo
FINCKNNAV

SEQ ID NO: 173956 - protein, 15 aa, Borrelia afzelii PKo
LLVFINCKNNAVGKG

SEQ ID NO: 173957 - protein, 9 aa, Borrelia afzelii PKo
VFINCKNNA

SEQ ID NO: 173958 - protein, 15 aa, Borrelia afzelii PKo
LTALLVFINCKNNAV

SEQ ID NO: 173959 - protein, 9 aa, Borrelia afzelii PKo
VFINCKNNA

SEQ ID NO: 173960 - protein, 15 aa, Borrelia afzelii PKo
LVADTFFKSDPKKSD

SEQ ID NO: 173961 - protein, 9 aa, Borrelia afzelii PKo
DTFFKSDPK

SEQ ID NO: 173962 - protein, 15 aa, Borrelia afzelii PKo
LVADTFFKSDPKKSD

SEQ ID NO: 173963 - protein, 9 aa, Borrelia afzelii PKo
FFKSDPKKS

SEQ ID NO: 173964 - protein, 15 aa, Borrelia afzelii PKo
LVFINCKNNAVGKGN

SEQ ID NO: 173965 - protein, 9 aa, Borrelia afzelii PKo
CKNNAVGKG

SEQ ID NO: 173966 - protein, 15 aa, Borrelia afzelii PKo
LVFINCKNNAVGKGN

SEQ ID NO: 173967 - protein, 9 aa, Borrelia afzelii PKo
FINCKNNAV

SEQ ID NO: 173968 - protein, 15 aa, Borrelia afzelii PKo
MKKISSAIFLTALLV

SEQ ID NO: 173969 - protein, 9 aa, Borrelia afzelii PKo
MKKISSAIF

SEQ ID NO: 173970 - protein, 15 aa, Borrelia afzelii PKo
MKKSDKIAAAIVLRG

SEQ ID NO: 173971 - protein, 9 aa, Borrelia afzelii PKo
DKIAAAIVL

SEQ ID NO: 173972 - protein, 15 aa, Borrelia afzelii PKo
NADAGKLFAGNANAA

SEQ ID NO: 173973 - protein, 9 aa, Borrelia afzelii PKo
AGKLFAGNA

SEQ ID NO: 173974 - protein, 15 aa, Borrelia afzelii PKo
NANAAVGAAADIAKA

SEQ ID NO: 173975 - protein, 9 aa, Borrelia afzelii PKo
AVGAAADIA

SEQ ID NO: 173976 - protein, 15 aa, Borrelia afzelii PKo
NGFIDVFNAFSGLVA

SEQ ID NO: 173977 - protein, 9 aa, Borrelia afzelii PKo
FIDVFNAFS

SEQ ID NO: 173978 - protein, 15 aa, Borrelia afzelii PKo
NGFIDVFNAFSGLVA

SEQ ID NO: 173979 - protein, 9 aa, Borrelia afzelii PKo
VFNAFSGLV

SEQ ID NO: 173980 - protein, 15 aa, Borrelia afzelii PKo
NAAVGAAADIAKAAG

SEQ ID NO: 173981 - protein, 9 aa, Borrelia afzelii PKo
AVGAAADIA

SEQ ID NO: 173982 - protein, 15 aa, Borrelia afzelii PKo
SAIFLTALLVFINCK

SEQ ID NO: 173983 - protein, 9 aa, Borrelia afzelii PKo
FLTALLVFI

SEQ ID NO: 173984 - protein, 15 aa, Borrelia afzelii PKo
SDKIAAAIVLRGVAK

SEQ ID NO: 173985 - protein, 9 aa, Borrelia afzelii PKo
IAAAIVLRG

SEQ ID NO: 173986 - protein, 15 aa, Borrelia afzelii PKo
SDVKTYFESISSTLK

SEQ ID NO: 173987 - protein, 9 aa, Borrelia afzelii PKo
YFESISSTL

SEQ ID NO: 173988 - protein, 15 aa, Borrelia afzelii PKo
SGEQILKAIVEAAGD

SEQ ID NO: 173989 - protein, 9 aa, Borrelia afzelii PKo
LKAIVEAAG

SEQ ID NO: 173990 - protein, 15 aa, Borrelia afzelii PKo
SIINLGNGFIDVFNA

SEQ ID NO: 173991 - protein, 9 aa, Borrelia afzelii PKo
IINLGNGFI

SEQ ID NO: 173992 - protein, 15 aa, Borrelia afzelii PKo
SSAIFLTALLVFINC

SEQ ID NO: 173993 - protein, 9 aa, Borrelia afzelii PKo
FLTALLVFI

SEQ ID NO: 173994 - protein, 15 aa, Borrelia afzelii PKo
SVKTFYESIINLGNG

SEQ ID NO: 173995 - protein, 9 aa, Borrelia afzelii PKo
FYESIINLG

SEQ ID NO: 173996 - protein, 15 aa, Borrelia afzelii PKo
SVKTFYESIINLGNG

SEQ ID NO: 173997 - protein, 9 aa, Borrelia afzelii PKo
YESIINLGN

SEQ ID NO: 173998 - protein, 15 aa, Borrelia afzelii PKo
TALLVFINCKNNAVG

SEQ ID NO: 173999 - protein, 9 aa, Borrelia afzelii PKo
FINCKNNAV

SEQ ID NO: 174000 - protein, 15 aa, Borrelia afzelii PKo
TALLVFINCKNNAVG

SEQ ID NO: 174001 - protein, 9 aa, Borrelia afzelii PKo
VFINCKNNA

SEQ ID NO: 174002 - protein, 15 aa, Borrelia afzelii PKo
TFFKSDPKKSDVKTY

SEQ ID NO: 174003 - protein, 9 aa, Borrelia afzelii PKo
FKSDPKKSD

SEQ ID NO: 174004 - protein, 15 aa, Borrelia afzelii PKo
TFYESIINLGNGFID

SEQ ID NO: 174005 - protein, 9 aa, Borrelia afzelii PKo
FYESIINLG

SEQ ID NO: 174006 - protein, 15 aa, Borrelia afzelii PKo
TFYESIINLGNGFID

SEQ ID NO: 174007 - protein, 9 aa, Borrelia afzelii PKo
IINLGNGFI

SEQ ID NO: 174008 - protein, 15 aa, Borrelia afzelii PKo
TFYESIINLGNGFID

SEQ ID NO: 174009 - protein, 9 aa, Borrelia afzelii PKo
YESIINLGN

SEQ ID NO: 174010 - protein, 15 aa, Borrelia afzelii PKo
TGGDGKIGDSAANHG

SEQ ID NO: 174011 - protein, 9 aa, Borrelia afzelii PKo
GKIGDSAAN

SEQ ID NO: 174012 - protein, 15 aa, Borrelia afzelii PKo
TYFESISSTLKATKG

SEQ ID NO: 174013 - protein, 9 aa, Borrelia afzelii PKo
FESISSTLK

SEQ ID NO: 174014 - protein, 15 aa, Borrelia afzelii PKo
TYFESISSTLKATKG

SEQ ID NO: 174015 - protein, 9 aa, Borrelia afzelii PKo
YFESISSTL

SEQ ID NO: 174016 - protein, 15 aa, Borrelia afzelii PKo
VADTFFKSDPKKSDV

SEQ ID NO: 174017 - protein, 9 aa, Borrelia afzelii PKo
FFKSDPKKS

SEQ ID NO: 174018 - protein, 15 aa, Borrelia afzelii PKo
VADTFFKSDPKKSDV

SEQ ID NO: 174019 - protein, 9 aa, Borrelia afzelii PKo
FKSDPKKSD

SEQ ID NO: 174020 - protein, 15 aa, Borrelia afzelii PKo
VFINCKNNAVGKGND

SEQ ID NO: 174021 - protein, 9 aa, Borrelia afzelii PKo
CKNNAVGKG

SEQ ID NO: 174022 - protein, 15 aa, Borrelia afzelii PKo
VFNAFSGLVADTFFK

SEQ ID NO: 174023 - protein, 9 aa, Borrelia afzelii PKo
VFNAFSGLV

SEQ ID NO: 174024 - protein, 15 aa, Borrelia afzelii PKo
VGAAADIAKAAGAVT

SEQ ID NO: 174025 - protein, 9 aa, Borrelia afzelii PKo
DIAKAAGAV

SEQ ID NO: 174026 - protein, 15 aa, Borrelia afzelii PKo
VKTFYESIINLGNGF

SEQ ID NO: 174027 - protein, 9 aa, Borrelia afzelii PKo
FYESIINLG

SEQ ID NO: 174028 - protein, 15 aa, Borrelia afzelii PKo
VKTFYESIINLGNGF

SEQ ID NO: 174029 - protein, 9 aa, Borrelia afzelii PKo
YESIINLGN

SEQ ID NO: 174030 - protein, 15 aa, Borrelia afzelii PKo
VKTYFESISSTLKAT

SEQ ID NO: 174031 - protein, 9 aa, Borrelia afzelii PKo
FESISSTLK

SEQ ID NO: 174032 - protein, 15 aa, Borrelia afzelii PKo
VKTYFESISSTLKAT

SEQ ID NO: 174033 - protein, 9 aa, Borrelia afzelii PKo
YFESISSTL

SEQ ID NO: 174034 - protein, 15 aa, Borrelia afzelii PKo
VSGEQILKAIVEAAG

SEQ ID NO: 174035 - protein, 9 aa, Borrelia afzelii PKo
ILKAIVEAA

SEQ ID NO: 174036 - protein, 15 aa, Borrelia afzelii PKo
YESIINLGNGFIDVF

SEQ ID NO: 174037 - protein, 9 aa, Borrelia afzelii PKo
IINLGNGFI

SEQ ID NO: 174038 - protein, 15 aa, Borrelia afzelii PKo
YFESISSTLKATKGK

SEQ ID NO: 174039 - protein, 9 aa, Borrelia afzelii PKo
FESISSTLK

SEQ ID NO: 174040 - protein, 15 aa, Borrelia afzelii PKo
AAADIAKAAGAVTAV

SEQ ID NO: 174041 - protein, 9 aa, Borrelia afzelii PKo
IAKAAGAVT

SEQ ID NO: 174042 - protein, 15 aa, Borrelia afzelii PKo
AAAIVLRGVAKDGKF

SEQ ID NO: 174043 - protein, 9 aa, Borrelia afzelii PKo
LRGVAKDGK

SEQ ID NO: 174044 - protein, 15 aa, Borrelia afzelii PKo
AAAIVLRGVAKDGKF

SEQ ID NO: 174045 - protein, 9 aa, Borrelia afzelii PKo
VLRGVAKDG

SEQ ID NO: 174046 - protein, 15 aa, Borrelia afzelii PKo
AADIAKAAGAVTAVS

SEQ ID NO: 174047 - protein, 9 aa, Borrelia afzelii PKo
IAKAAGAVT

SEQ ID NO: 174048 - protein, 15 aa, Borrelia afzelii PKo
AAGAVTAVSGEQILK

SEQ ID NO: 174049 - protein, 9 aa, Borrelia afzelii PKo
VTAVSGEQI

SEQ ID NO: 174050 - protein, 15 aa, Borrelia afzelii PKo
AAIVLRGVAKDGKFA

SEQ ID NO: 174051 - protein, 9 aa, Borrelia afzelii PKo
LRGVAKDGK

SEQ ID NO: 174052 - protein, 15 aa, Borrelia afzelii PKo
AAIVLRGVAKDGKFA

SEQ ID NO: 174053 - protein, 9 aa, Borrelia afzelii PKo
VLRGVAKDG

SEQ ID NO: 174054 - protein, 8 aa, Borrelia garinii
KTKLNIIK

SEQ ID NO: 174055 - protein, 8 aa, Borrelia garinii
NIIKLNIL

SEQ ID NO: 174056 - protein, 8 aa, Borrelia garinii
KLNILTTI

SEQ ID NO: 174057 - protein, 8 aa, Borrelia garinii
ILTTILTL

SEQ ID NO: 174058 - protein, 8 aa, Borrelia garinii
LTTILTLI

SEQ ID NO: 174059 - protein, 8 aa, Borrelia garinii
TILTLICI

SEQ ID NO: 174060 - protein, 8 aa, Borrelia garinii
TLICISCA

SEQ ID NO: 174061 - protein, 8 aa, Borrelia garinii
LICISCAV

SEQ ID NO: 174062 - protein, 8 aa, Borrelia garinii
CISCAVDK

SEQ ID NO: 174063 - protein, 8 aa, Borrelia garinii
NTKDFENK

SEQ ID NO: 174064 - protein, 8 aa, Borrelia garinii
FENKSQDL

SEQ ID NO: 174065 - protein, 8 aa, Borrelia garinii
EPSNTKNK

SEQ ID NO: 174066 - protein, 8 aa, Borrelia garinii
KETIISKL

SEQ ID NO: 174067 - protein, 8 aa, Borrelia garinii
TIISKLEK

SEQ ID NO: 174068 - protein, 8 aa, Borrelia garinii
LEKMIKDL

SEQ ID NO: 174069 - protein, 8 aa, Borrelia garinii
EIAKITNT

SEQ ID NO: 174070 - protein, 8 aa, Borrelia garinii
ITNTQIDF

SEQ ID NO: 174071 - protein, 8 aa, Borrelia garinii
QIDFLENF

SEQ ID NO: 174072 - protein, 8 aa, Borrelia garinii
TISEDIEM

SEQ ID NO: 174073 - protein, 8 aa, Borrelia garinii
ISEDIEMK

SEQ ID NO: 174074 - protein, 8 aa, Borrelia garinii
DIEMKIKR

SEQ ID NO: 174075 - protein, 8 aa, Borrelia garinii
KIKRIIYS

SEQ ID NO: 174076 - protein, 8 aa, Borrelia garinii
KRIIYSSL

SEQ ID NO: 174077 - protein, 8 aa, Borrelia garinii
IIYSSLNY

SEQ ID NO: 174078 - protein, 8 aa, Borrelia garinii
YSSLNYEI

SEQ ID NO: 174079 - protein, 8 aa, Borrelia garinii
SLNYEIEK

SEQ ID NO: 174080 - protein, 8 aa, Borrelia garinii
EIEKINTL

SEQ ID NO: 174081 - protein, 8 aa, Borrelia garinii
KINTLKEI

SEQ ID NO: 174082 - protein, 8 aa, Borrelia garinii
TLKEILDK

SEQ ID NO: 174083 - protein, 8 aa, Borrelia garinii
KEILDKLY

SEQ ID NO: 174084 - protein, 8 aa, Borrelia garinii
EILDKLYK

SEQ ID NO: 174085 - protein, 8 aa, Borrelia garinii
KLYKNHKY

SEQ ID NO: 174086 - protein, 8 aa, Borrelia garinii
LYKNHKYK

SEQ ID NO: 174087 - protein, 8 aa, Borrelia garinii
HKYKTTAR

SEQ ID NO: 174088 - protein, 8 aa, Borrelia garinii
TTARNFIL

SEQ ID NO: 174089 - protein, 8 aa, Borrelia garinii
NFILNISI

SEQ ID NO: 174090 - protein, 8 aa, Borrelia garinii
FILNISIK

SEQ ID NO: 174091 - protein, 8 aa, Borrelia garinii
ILNISIKI

SEQ ID NO: 174092 - protein, 8 aa, Borrelia garinii
SIKIQFQI

SEQ ID NO: 174093 - protein, 8 aa, Borrelia garinii
IQFQIENA

SEQ ID NO: 174094 - protein, 8 aa, Borrelia garinii
QFQIENAL

SEQ ID NO: 174095 - protein, 8 aa, Borrelia garinii
FQIENALE

SEQ ID NO: 174096 - protein, 8 aa, Borrelia garinii
QIENALEL

SEQ ID NO: 174097 - protein, 8 aa, Borrelia garinii
ENALELMK

SEQ ID NO: 174098 - protein, 8 aa, Borrelia garinii
IEDASEIL

SEQ ID NO: 174099 - protein, 8 aa, Borrelia garinii
EILNQERY

SEQ ID NO: 174100 - protein, 8 aa, Borrelia garinii
NQERYEIL

SEQ ID NO: 174101 - protein, 8 aa, Borrelia garinii
QERYEILL

SEQ ID NO: 174102 - protein, 8 aa, Borrelia garinii
ERYEILLK

SEQ ID NO: 174103 - protein, 8 aa, Borrelia garinii
YEILLKHV

SEQ ID NO: 174104 - protein, 8 aa, Borrelia garinii
NLKQKFEK

SEQ ID NO: 174105 - protein, 8 aa, Borrelia garinii
KILNETIK

SEQ ID NO: 174106 - protein, 8 aa, Borrelia garinii
ILNETIKA

SEQ ID NO: 174107 - protein, 8 aa, Borrelia garinii
ETIKAYNQ

SEQ ID NO: 174108 - protein, 8 aa, Borrelia garinii
LAHMDENY

SEQ ID NO: 174109 - protein, 8 aa, Borrelia garinii
HMDENYKE

SEQ ID NO: 174110 - protein, 8 aa, Borrelia garinii
NYKEFDPL

SEQ ID NO: 174111 - protein, 8 aa, Borrelia garinii
KEFDPLNL

SEQ ID NO: 174112 - protein, 9 aa, Borrelia garinii
KLNIIKLNI

SEQ ID NO: 174113 - protein, 9 aa, Borrelia garinii
IKLNILTTI

SEQ ID NO: 174114 - protein, 9 aa, Borrelia garinii
KLNILTTIL

SEQ ID NO: 174115 - protein, 9 aa, Borrelia garinii
NILTTILTL

SEQ ID NO: 174116 - protein, 9 aa, Borrelia garinii
ILTTILTLI

SEQ ID NO: 174117 - protein, 9 aa, Borrelia garinii
TTILTLICI

SEQ ID NO: 174118 - protein, 9 aa, Borrelia garinii
ILTLICISC

SEQ ID NO: 174119 - protein, 9 aa, Borrelia garinii
TLICISCAV

SEQ ID NO: 174120 - protein, 9 aa, Borrelia garinii
CISCAVDKI

SEQ ID NO: 174121 - protein, 9 aa, Borrelia garinii
ESKSKTNTK

SEQ ID NO: 174122 - protein, 9 aa, Borrelia garinii
NSKETIISK

SEQ ID NO: 174123 - protein, 9 aa, Borrelia garinii
ETIISKLEK

SEQ ID NO: 174124 - protein, 9 aa, Borrelia garinii
TIISKLEKM

SEQ ID NO: 174125 - protein, 9 aa, Borrelia garinii
ISKLEKMIK

SEQ ID NO: 174126 - protein, 9 aa, Borrelia garinii
MIKDLEDQK

SEQ ID NO: 174127 - protein, 9 aa, Borrelia garinii
EIAKITNTQ

SEQ ID NO: 174128 - protein, 9 aa, Borrelia garinii
KITNTQIDF

SEQ ID NO: 174129 - protein, 9 aa, Borrelia garinii
ITNTQIDFL

SEQ ID NO: 174130 - protein, 9 aa, Borrelia garinii
TQIDFLENF

SEQ ID NO: 174131 - protein, 9 aa, Borrelia garinii
QIDFLENFK

SEQ ID NO: 174132 - protein, 9 aa, Borrelia garinii
DTISEDIEM

SEQ ID NO: 174133 - protein, 9 aa, Borrelia garinii
TISEDIEMK

SEQ ID NO: 174134 - protein, 9 aa, Borrelia garinii
EDIEMKIKR

SEQ ID NO: 174135 - protein, 9 aa, Borrelia garinii
EMKIKRIIY

SEQ ID NO: 174136 - protein, 9 aa, Borrelia garinii
KIKRIIYSS

SEQ ID NO: 174137 - protein, 9 aa, Borrelia garinii
RIIYSSLNY

SEQ ID NO: 174138 - protein, 9 aa, Borrelia garinii
IYSSLNYEI

SEQ ID NO: 174139 - protein, 9 aa, Borrelia garinii
SSLNYEIEK

SEQ ID NO: 174140 - protein, 9 aa, Borrelia garinii
SLNYEIEKI

SEQ ID NO: 174141 - protein, 9 aa, Borrelia garinii
YEIEKINTL

SEQ ID NO: 174142 - protein, 9 aa, Borrelia garinii
EIEKINTLK

SEQ ID NO: 174143 - protein, 9 aa, Borrelia garinii
NTLKEILDK

SEQ ID NO: 174144 - protein, 9 aa, Borrelia garinii
TLKEILDKL

SEQ ID NO: 174145 - protein, 9 aa, Borrelia garinii
LDKLYKNHK

SEQ ID NO: 174146 - protein, 9 aa, Borrelia garinii
KLYKNHKYK

SEQ ID NO: 174147 - protein, 9 aa, Borrelia garinii
NHKYKTTAR

SEQ ID NO: 174148 - protein, 9 aa, Borrelia garinii
KYKTTARNF

SEQ ID NO: 174149 - protein, 9 aa, Borrelia garinii
KTTARNFIL

SEQ ID NO: 174150 - protein, 9 aa, Borrelia garinii
NFILNISIK

SEQ ID NO: 174151 - protein, 9 aa, Borrelia garinii
FILNISIKI

SEQ ID NO: 174152 - protein, 9 aa, Borrelia garinii
ISIKIQFQI

SEQ ID NO: 174153 - protein, 9 aa, Borrelia garinii
KIQFQIENA

SEQ ID NO: 174154 - protein, 9 aa, Borrelia garinii
IQFQIENAL

SEQ ID NO: 174155 - protein, 9 aa, Borrelia garinii
FQIENALEL

SEQ ID NO: 174156 - protein, 9 aa, Borrelia garinii
QIENALELM

SEQ ID NO: 174157 - protein, 9 aa, Borrelia garinii
ALELMKEEI

SEQ ID NO: 174158 - protein, 9 aa, Borrelia garinii
LMKEEIEDA

SEQ ID NO: 174159 - protein, 9 aa, Borrelia garinii
EEIEDASEI

SEQ ID NO: 174160 - protein, 9 aa, Borrelia garinii
EIEDASEIL

SEQ ID NO: 174161 - protein, 9 aa, Borrelia garinii
ASEILNQER

SEQ ID NO: 174162 - protein, 9 aa, Borrelia garinii
SEILNQERY

SEQ ID NO: 174163 - protein, 9 aa, Borrelia garinii
ILNQERYEI

SEQ ID NO: 174164 - protein, 9 aa, Borrelia garinii
LLKHVEPSL

SEQ ID NO: 174165 - protein, 9 aa, Borrelia garinii
KHVEPSLNL

SEQ ID NO: 174166 - protein, 9 aa, Borrelia garinii
HVEPSLNLK

SEQ ID NO: 174167 - protein, 9 aa, Borrelia garinii
EPSLNLKQK

SEQ ID NO: 174168 - protein, 9 aa, Borrelia garinii
NLKQKFEKI

SEQ ID NO: 174169 - protein, 9 aa, Borrelia garinii
KILNETIKA

SEQ ID NO: 174170 - protein, 9 aa, Borrelia garinii
ILNETIKAY

SEQ ID NO: 174171 - protein, 9 aa, Borrelia garinii
AYNQDLDNI

SEQ ID NO: 174172 - protein, 9 aa, Borrelia garinii
QLAHMDENY

SEQ ID NO: 174173 - protein, 9 aa, Borrelia garinii
LAHMDENYK

SEQ ID NO: 174174 - protein, 9 aa, Borrelia garinii
HMDENYKEF

SEQ ID NO: 174175 - protein, 9 aa, Borrelia garinii
YKEFDPLNL

SEQ ID NO: 174176 - protein, 9 aa, Borrelia garinii
EFDPLNLDY

SEQ ID NO: 174177 - protein, 10 aa, Borrelia garinii
KLNIIKLNIL

SEQ ID NO: 174178 - protein, 10 aa, Borrelia garinii
IIKLNILTTI

SEQ ID NO: 174179 - protein, 10 aa, Borrelia garinii
KLNILTTILT

SEQ ID NO: 174180 - protein, 10 aa, Borrelia garinii
NILTTILTLI

SEQ ID NO: 174181 - protein, 10 aa, Borrelia garinii
ILTTILTLIC

SEQ ID NO: 174182 - protein, 10 aa, Borrelia garinii
ILTLICISCA

SEQ ID NO: 174183 - protein, 10 aa, Borrelia garinii
LTLICISCAV

SEQ ID NO: 174184 - protein, 10 aa, Borrelia garinii
LICISCAVDK

SEQ ID NO: 174185 - protein, 10 aa, Borrelia garinii
AVDKIDPESK

SEQ ID NO: 174186 - protein, 10 aa, Borrelia garinii
KTNTKDFENK

SEQ ID NO: 174187 - protein, 10 aa, Borrelia garinii
SQDLEPSNTK

SEQ ID NO: 174188 - protein, 10 aa, Borrelia garinii
KNKDLEPLEK

SEQ ID NO: 174189 - protein, 10 aa, Borrelia garinii
PLEKNSKETI

SEQ ID NO: 174190 - protein, 10 aa, Borrelia garinii
ETIISKLEKM

SEQ ID NO: 174191 - protein, 10 aa, Borrelia garinii
TIISKLEKMI

SEQ ID NO: 174192 - protein, 10 aa, Borrelia garinii
IISKLEKMIK

SEQ ID NO: 174193 - protein, 10 aa, Borrelia garinii
KMIKDLEDQK

SEQ ID NO: 174194 - protein, 10 aa, Borrelia garinii
EIAKITNTQI

SEQ ID NO: 174195 - protein, 10 aa, Borrelia garinii
KITNTQIDFL

SEQ ID NO: 174196 - protein, 10 aa, Borrelia garinii
NTQIDFLENF

SEQ ID NO: 174197 - protein, 10 aa, Borrelia garinii
TQIDFLENFK

SEQ ID NO: 174198 - protein, 10 aa, Borrelia garinii
DTISEDIEMK

SEQ ID NO: 174199 - protein, 10 aa, Borrelia garinii
TISEDIEMKI

SEQ ID NO: 174200 - protein, 10 aa, Borrelia garinii
IEMKIKRIIY

SEQ ID NO: 174201 - protein, 10 aa, Borrelia garinii
KIKRIIYSSL

SEQ ID NO: 174202 - protein, 10 aa, Borrelia garinii
KRIIYSSLNY

SEQ ID NO: 174203 - protein, 10 aa, Borrelia garinii
IIYSSLNYEI

SEQ ID NO: 174204 - protein, 10 aa, Borrelia garinii
YSSLNYEIEK

SEQ ID NO: 174205 - protein, 10 aa, Borrelia garinii
NYEIEKINTL

SEQ ID NO: 174206 - protein, 10 aa, Borrelia garinii
ILDKLYKNHK

SEQ ID NO: 174207 - protein, 10 aa, Borrelia garinii
KLYKNHKYKT

SEQ ID NO: 174208 - protein, 10 aa, Borrelia garinii
KNHKYKTTAR

SEQ ID NO: 174209 - protein, 10 aa, Borrelia garinii
KYKTTARNFI

SEQ ID NO: 174210 - protein, 10 aa, Borrelia garinii
YKTTARNFIL

SEQ ID NO: 174211 - protein, 10 aa, Borrelia garinii
TTARNFILNI

SEQ ID NO: 174212 - protein, 10 aa, Borrelia garinii
NFILNISIKI

SEQ ID NO: 174213 - protein, 10 aa, Borrelia garinii
NISIKIQFQI

SEQ ID NO: 174214 - protein, 10 aa, Borrelia garinii
QFQIENALEL

SEQ ID NO: 174215 - protein, 10 aa, Borrelia garinii
FQIENALELM

SEQ ID NO: 174216 - protein, 10 aa, Borrelia garinii
QIENALELMK

SEQ ID NO: 174217 - protein, 10 aa, Borrelia garinii
NALELMKEEI

SEQ ID NO: 174218 - protein, 10 aa, Borrelia garinii
EEIEDASEIL

SEQ ID NO: 174219 - protein, 10 aa, Borrelia garinii
DASEILNQER

SEQ ID NO: 174220 - protein, 10 aa, Borrelia garinii
ASEILNQERY

SEQ ID NO: 174221 - protein, 10 aa, Borrelia garinii
EILNQERYEI

SEQ ID NO: 174222 - protein, 10 aa, Borrelia garinii
ILNQERYEIL

SEQ ID NO: 174223 - protein, 10 aa, Borrelia garinii
NQERYEILLK

SEQ ID NO: 174224 - protein, 10 aa, Borrelia garinii
ILLKHVEPSL

SEQ ID NO: 174225 - protein, 10 aa, Borrelia garinii
EPSLNLKQKF

SEQ ID NO: 174226 - protein, 10 aa, Borrelia garinii
SLNLKQKFEK

SEQ ID NO: 174227 - protein, 10 aa, Borrelia garinii
NLKQKFEKIL

SEQ ID NO: 174228 - protein, 10 aa, Borrelia garinii
KILNETIKAY

SEQ ID NO: 174229 - protein, 10 aa, Borrelia garinii
ETIKAYNQDL

SEQ ID NO: 174230 - protein, 10 aa, Borrelia garinii
KAYNQDLDNI

SEQ ID NO: 174231 - protein, 10 aa, Borrelia garinii
AYNQDLDNIK

SEQ ID NO: 174232 - protein, 10 aa, Borrelia garinii
KSNEDQLAHM

SEQ ID NO: 174233 - protein, 10 aa, Borrelia garinii
QLAHMDENYK

SEQ ID NO: 174234 - protein, 10 aa, Borrelia garinii
AHMDENYKEF

SEQ ID NO: 174235 - protein, 10 aa, Borrelia garinii
NYKEFDPLNL

SEQ ID NO: 174236 - protein, 10 aa, Borrelia garinii
KEFDPLNLDY

SEQ ID NO: 174237 - protein, 11 aa, Borrelia garinii
KLNIIKLNILT

SEQ ID NO: 174238 - protein, 11 aa, Borrelia garinii
NIIKLNILTTI

SEQ ID NO: 174239 - protein, 11 aa, Borrelia garinii
IIKLNILTTIL

SEQ ID NO: 174240 - protein, 11 aa, Borrelia garinii
KLNILTTILTL

SEQ ID NO: 174241 - protein, 11 aa, Borrelia garinii
ILTTILTLICI

SEQ ID NO: 174242 - protein, 11 aa, Borrelia garinii
ILTLICISCAV

SEQ ID NO: 174243 - protein, 11 aa, Borrelia garinii
TLICISCAVDK

SEQ ID NO: 174244 - protein, 11 aa, Borrelia garinii
CAVDKIDPESK

SEQ ID NO: 174245 - protein, 11 aa, Borrelia garinii
KSQDLEPSNTK

SEQ ID NO: 174246 - protein, 11 aa, Borrelia garinii
EPLEKNSKETI

SEQ ID NO: 174247 - protein, 11 aa, Borrelia garinii
ETIISKLEKMI

SEQ ID NO: 174248 - protein, 11 aa, Borrelia garinii
TIISKLEKMIK

SEQ ID NO: 174249 - protein, 11 aa, Borrelia garinii
NTQIDFLENFK

SEQ ID NO: 174250 - protein, 11 aa, Borrelia garinii
TQIDFLENFKS

SEQ ID NO: 174251 - protein, 11 aa, Borrelia garinii
DTISEDIEMKI

SEQ ID NO: 174252 - protein, 11 aa, Borrelia garinii
TISEDIEMKIK

SEQ ID NO: 174253 - protein, 11 aa, Borrelia garinii
ISEDIEMKIKR

SEQ ID NO: 174254 - protein, 11 aa, Borrelia garinii
DIEMKIKRIIY

SEQ ID NO: 174255 - protein, 11 aa, Borrelia garinii
MKIKRIIYSSL

SEQ ID NO: 174256 - protein, 11 aa, Borrelia garinii
RIIYSSLNYEI

SEQ ID NO: 174257 - protein, 11 aa, Borrelia garinii
IYSSLNYEIEK

SEQ ID NO: 174258 - protein, 11 aa, Borrelia garinii
NYEIEKINTLK

SEQ ID NO: 174259 - protein, 11 aa, Borrelia garinii
IEKINTLKEIL

SEQ ID NO: 174260 - protein, 11 aa, Borrelia garinii
KINTLKEILDK

SEQ ID NO: 174261 - protein, 11 aa, Borrelia garinii
NTLKEILDKLY

SEQ ID NO: 174262 - protein, 11 aa, Borrelia garinii
TLKEILDKLYK

SEQ ID NO: 174263 - protein, 11 aa, Borrelia garinii
EILDKLYKNHK

SEQ ID NO: 174264 - protein, 11 aa, Borrelia garinii
ILDKLYKNHKY

SEQ ID NO: 174265 - protein, 11 aa, Borrelia garinii
KLYKNHKYKTT

SEQ ID NO: 174266 - protein, 11 aa, Borrelia garinii
KYKTTARNFIL

SEQ ID NO: 174267 - protein, 11 aa, Borrelia garinii
TTARNFILNIS

SEQ ID NO: 174268 - protein, 11 aa, Borrelia garinii
FILNISIKIQF

SEQ ID NO: 174269 - protein, 11 aa, Borrelia garinii
ILNISIKIQFQ

SEQ ID NO: 174270 - protein, 11 aa, Borrelia garinii
SIKIQFQIENA

SEQ ID NO: 174271 - protein, 11 aa, Borrelia garinii
IQFQIENALEL

SEQ ID NO: 174272 - protein, 11 aa, Borrelia garinii
FQIENALELMK

SEQ ID NO: 174273 - protein, 11 aa, Borrelia garinii
KEEIEDASEIL

SEQ ID NO: 174274 - protein, 11 aa, Borrelia garinii
EEIEDASEILN

SEQ ID NO: 174275 - protein, 11 aa, Borrelia garinii
EDASEILNQER

SEQ ID NO: 174276 - protein, 11 aa, Borrelia garinii
DASEILNQERY

SEQ ID NO: 174277 - protein, 11 aa, Borrelia garinii
SEILNQERYEI

SEQ ID NO: 174278 - protein, 11 aa, Borrelia garinii
EILNQERYEIL

SEQ ID NO: 174279 - protein, 11 aa, Borrelia garinii
ILNQERYEILL

SEQ ID NO: 174280 - protein, 11 aa, Borrelia garinii
EILLKHVEPSL

SEQ ID NO: 174281 - protein, 11 aa, Borrelia garinii
LLKHVEPSLNL

SEQ ID NO: 174282 - protein, 11 aa, Borrelia garinii
HVEPSLNLKQK

SEQ ID NO: 174283 - protein, 11 aa, Borrelia garinii
VEPSLNLKQKF

SEQ ID NO: 174284 - protein, 11 aa, Borrelia garinii
PSLNLKQKFEK

SEQ ID NO: 174285 - protein, 11 aa, Borrelia garinii
SLNLKQKFEKI

SEQ ID NO: 174286 - protein, 11 aa, Borrelia garinii
KFEKILNETIK

SEQ ID NO: 174287 - protein, 11 aa, Borrelia garinii
EKILNETIKAY

SEQ ID NO: 174288 - protein, 11 aa, Borrelia garinii
ILNETIKAYNQ

SEQ ID NO: 174289 - protein, 11 aa, Borrelia garinii
NETIKAYNQDL

SEQ ID NO: 174290 - protein, 11 aa, Borrelia garinii
KAYNQDLDNIK

SEQ ID NO: 174291 - protein, 11 aa, Borrelia garinii
LAHMDENYKEF

SEQ ID NO: 174292 - protein, 15 aa, Borrelia garinii
ARNFILNISIKIQFQ

SEQ ID NO: 174293 - protein, 9 aa, Borrelia garinii
FILNISIKI

SEQ ID NO: 174294 - protein, 15 aa, Borrelia garinii
AYNQDLDNIKSNEDQ

SEQ ID NO: 174295 - protein, 9 aa, Borrelia garinii
LDNIKSNED

SEQ ID NO: 174296 - protein, 15 aa, Borrelia garinii
DFLENFKSEPHDTIS

SEQ ID NO: 174297 - protein, 9 aa, Borrelia garinii
LENFKSEPH

SEQ ID NO: 174298 - protein, 15 aa, Borrelia garinii
DIEMKIKRIIYSSLN

SEQ ID NO: 174299 - protein, 9 aa, Borrelia garinii
MKIKRIIYS

SEQ ID NO: 174300 - protein, 15 aa, Borrelia garinii
DKLYKNHKYKTTARN

SEQ ID NO: 174301 - protein, 9 aa, Borrelia garinii
YKNHKYKTT

SEQ ID NO: 174302 - protein, 15 aa, Borrelia garinii
DLDNIKSNEDQLAHM

SEQ ID NO: 174303 - protein, 9 aa, Borrelia garinii
IKSNEDQLA

SEQ ID NO: 174304 - protein, 15 aa, Borrelia garinii
EDIEMKIKRIIYSSL

SEQ ID NO: 174305 - protein, 9 aa, Borrelia garinii
MKIKRIIYS

SEQ ID NO: 174306 - protein, 15 aa, Borrelia garinii
EIEKINTLKEILDKL

SEQ ID NO: 174307 - protein, 9 aa, Borrelia garinii
INTLKEILD

SEQ ID NO: 174308 - protein, 15 aa, Borrelia garinii
EILDKLYKNHKYKTT

SEQ ID NO: 174309 - protein, 9 aa, Borrelia garinii
LDKLYKNHK

SEQ ID NO: 174310 - protein, 15 aa, Borrelia garinii
EILDKLYKNHKYKTT

SEQ ID NO: 174311 - protein, 9 aa, Borrelia garinii
LYKNHKYKT

SEQ ID NO: 174312 - protein, 15 aa, Borrelia garinii
EILLKHVEPSLNLKQ

SEQ ID NO: 174313 - protein, 9 aa, Borrelia garinii
LKHVEPSLN

SEQ ID NO: 174314 - protein, 15 aa, Borrelia garinii
EMKIKRIIYSSLNYE

SEQ ID NO: 174315 - protein, 9 aa, Borrelia garinii
MKIKRIIYS

SEQ ID NO: 174316 - protein, 15 aa, Borrelia garinii
ENKSQDLEPSNTKNK

SEQ ID NO: 174317 - protein, 9 aa, Borrelia garinii
QDLEPSNTK

SEQ ID NO: 174318 - protein, 15 aa, Borrelia garinii
ERYEILLKHVEPSLN

SEQ ID NO: 174319 - protein, 9 aa, Borrelia garinii
YEILLKHVE

SEQ ID NO: 174320 - protein, 15 aa, Borrelia garinii
ETIKAYNQDLDNIKS

SEQ ID NO: 174321 - protein, 9 aa, Borrelia garinii
IKAYNQDLD

SEQ ID NO: 174322 - protein, 15 aa, Borrelia garinii
FILNISIKIQFQIEN

SEQ ID NO: 174323 - protein, 9 aa, Borrelia garinii
LNISIKIQF

SEQ ID NO: 174324 - protein, 15 aa, Borrelia garinii
HKYKTTARNFILNIS

SEQ ID NO: 174325 - protein, 9 aa, Borrelia garinii
YKTTARNFI

SEQ ID NO: 174326 - protein, 15 aa, Borrelia garinii
HMDENYKEFDPLNLD

SEQ ID NO: 174327 - protein, 9 aa, Borrelia garinii
YKEFDPLNL

SEQ ID NO: 174328 - protein, 15 aa, Borrelia garinii
IDFLENFKSEPHDTI

SEQ ID NO: 174329 - protein, 9 aa, Borrelia garinii
LENFKSEPH

SEQ ID NO: 174330 - protein, 15 aa, Borrelia garinii
IEKINTLKEILDKLY

SEQ ID NO: 174331 - protein, 9 aa, Borrelia garinii
INTLKEILD

SEQ ID NO: 174332 - protein, 15 aa, Borrelia garinii
IEMKIKRIIYSSLNY

SEQ ID NO: 174333 - protein, 9 aa, Borrelia garinii
MKIKRIIYS

SEQ ID NO: 174334 - protein, 15 aa, Borrelia garinii
IIKLNILTTILTLIC

SEQ ID NO: 174335 - protein, 9 aa, Borrelia garinii
ILTTILTLI

SEQ ID NO: 174336 - protein, 15 aa, Borrelia garinii
IIKLNILTTILTLIC

SEQ ID NO: 174337 - protein, 9 aa, Borrelia garinii
LNILTTILT

SEQ ID NO: 174338 - protein, 15 aa, Borrelia garinii
IKIQFQIENALELMK

SEQ ID NO: 174339 - protein, 9 aa, Borrelia garinii
FQIENALEL

SEQ ID NO: 174340 - protein, 15 aa, Borrelia garinii
IKLNILTTILTLICI

SEQ ID NO: 174341 - protein, 9 aa, Borrelia garinii
LNILTTILT

SEQ ID NO: 174342 - protein, 15 aa, Borrelia garinii
ILDKLYKNHKYKTTA

SEQ ID NO: 174343 - protein, 9 aa, Borrelia garinii
YKNHKYKTT

SEQ ID NO: 174344 - protein, 15 aa, Borrelia garinii
ILLKHVEPSLNLKQK

SEQ ID NO: 174345 - protein, 9 aa, Borrelia garinii
LKHVEPSLN

SEQ ID NO: 174346 - protein, 15 aa, Borrelia garinii
ILNISIKIQFQIENA

SEQ ID NO: 174347 - protein, 9 aa, Borrelia garinii
LNISIKIQF

SEQ ID NO: 174348 - protein, 15 aa, Borrelia garinii
ILTTILTLICISCAV

SEQ ID NO: 174349 - protein, 9 aa, Borrelia garinii
ILTTILTLI

SEQ ID NO: 174350 - protein, 15 aa, Borrelia garinii
ILTTILTLICISCAV

SEQ ID NO: 174351 - protein, 9 aa, Borrelia garinii
LTLICISCA

SEQ ID NO: 174352 - protein, 15 aa, Borrelia garinii
IQFQIENALELMKEE

SEQ ID NO: 174353 - protein, 9 aa, Borrelia garinii
FQIENALEL

SEQ ID NO: 174354 - protein, 15 aa, Borrelia garinii
ISEDIEMKIKRIIYS

SEQ ID NO: 174355 - protein, 9 aa, Borrelia garinii
IEMKIKRII

SEQ ID NO: 174356 - protein, 15 aa, Borrelia garinii
ISIKIQFQIENALEL

SEQ ID NO: 174357 - protein, 9 aa, Borrelia garinii
IKIQFQIEN

SEQ ID NO: 174358 - protein, 15 aa, Borrelia garinii
ISIKIQFQIENALEL

SEQ ID NO: 174359 - protein, 9 aa, Borrelia garinii
IQFQIENAL

SEQ ID NO: 174360 - protein, 15 aa, Borrelia garinii
KAYNQDLDNIKSNED

SEQ ID NO: 174361 - protein, 9 aa, Borrelia garinii
YNQDLDNIK

SEQ ID NO: 174362 - protein, 15 aa, Borrelia garinii
KEILDKLYKNHKYKT

SEQ ID NO: 174363 - protein, 9 aa, Borrelia garinii
LDKLYKNHK

SEQ ID NO: 174364 - protein, 15 aa, Borrelia garinii
KIQFQIENALELMKE

SEQ ID NO: 174365 - protein, 9 aa, Borrelia garinii
FQIENALEL

SEQ ID NO: 174366 - protein, 15 aa, Borrelia garinii
KKTKLNIIKLNILTT

SEQ ID NO: 174367 - protein, 9 aa, Borrelia garinii
LNIIKLNIL

SEQ ID NO: 174368 - protein, 15 aa, Borrelia garinii
KLNIIKLNILTTILT

SEQ ID NO: 174369 - protein, 9 aa, Borrelia garinii
IIKLNILTT

SEQ ID NO: 174370 - protein, 15 aa, Borrelia garinii
KLNIIKLNILTTILT

SEQ ID NO: 174371 - protein, 9 aa, Borrelia garinii
IKLNILTTI

SEQ ID NO: 174372 - protein, 15 aa, Borrelia garinii
KLNIIKLNILTTILT

SEQ ID NO: 174373 - protein, 9 aa, Borrelia garinii
KLNILTTIL

SEQ ID NO: 174374 - protein, 15 aa, Borrelia garinii
KLNILTTILTLICIS

SEQ ID NO: 174375 - protein, 9 aa, Borrelia garinii
LNILTTILT

SEQ ID NO: 174376 - protein, 15 aa, Borrelia garinii
KLYKNHKYKTTARNF

SEQ ID NO: 174377 - protein, 9 aa, Borrelia garinii
YKNHKYKTT

SEQ ID NO: 174378 - protein, 15 aa, Borrelia garinii
KNHKYKTTARNFILN

SEQ ID NO: 174379 - protein, 9 aa, Borrelia garinii
YKTTARNFI

SEQ ID NO: 174380 - protein, 15 aa, Borrelia garinii
KSQDLEPSNTKNKDL

SEQ ID NO: 174381 - protein, 9 aa, Borrelia garinii
LEPSNTKNK

SEQ ID NO: 174382 - protein, 15 aa, Borrelia garinii
KTKLNIIKLNILTTI

SEQ ID NO: 174383 - protein, 9 aa, Borrelia garinii
IIKLNILTT

SEQ ID NO: 174384 - protein, 15 aa, Borrelia garinii
KTKLNIIKLNILTTI

SEQ ID NO: 174385 - protein, 9 aa, Borrelia garinii
LNIIKLNIL

SEQ ID NO: 174386 - protein, 15 aa, Borrelia garinii
KTTARNFILNISIKI

SEQ ID NO: 174387 - protein, 9 aa, Borrelia garinii
ARNFILNIS

SEQ ID NO: 174388 - protein, 15 aa, Borrelia garinii
KYKTTARNFILNISI

SEQ ID NO: 174389 - protein, 9 aa, Borrelia garinii
ARNFILNIS

SEQ ID NO: 174390 - protein, 15 aa, Borrelia garinii
KYKTTARNFILNISI

SEQ ID NO: 174391 - protein, 9 aa, Borrelia garinii
YKTTARNFI

SEQ ID NO: 174392 - protein, 15 aa, Borrelia garinii
LDKLYKNHKYKTTAR

SEQ ID NO: 174393 - protein, 9 aa, Borrelia garinii
YKNHKYKTT

SEQ ID NO: 174394 - protein, 15 aa, Borrelia garinii
LDNIKSNEDQLAHMD

SEQ ID NO: 174395 - protein, 9 aa, Borrelia garinii
IKSNEDQLA

SEQ ID NO: 174396 - protein, 15 aa, Borrelia garinii
LNIIKLNILTTILTL

SEQ ID NO: 174397 - protein, 9 aa, Borrelia garinii
LNILTTILT

SEQ ID NO: 174398 - protein, 15 aa, Borrelia garinii
LNILTTILTLICISC

SEQ ID NO: 174399 - protein, 9 aa, Borrelia garinii
LNILTTILT

SEQ ID NO: 174400 - protein, 15 aa, Borrelia garinii
LNISIKIQFQIENAL

SEQ ID NO: 174401 - protein, 9 aa, Borrelia garinii
LNISIKIQF

SEQ ID NO: 174402 - protein, 15 aa, Borrelia garinii
LNYEIEKINTLKEIL

SEQ ID NO: 174403 - protein, 9 aa, Borrelia garinii
IEKINTLKE

SEQ ID NO: 174404 - protein, 15 aa, Borrelia garinii
LNYEIEKINTLKEIL

SEQ ID NO: 174405 - protein, 9 aa, Borrelia garinii
YEIEKINTL

SEQ ID NO: 174406 - protein, 15 aa, Borrelia garinii
LTTILTLICISCAVD

SEQ ID NO: 174407 - protein, 9 aa, Borrelia garinii
LTLICISCA

SEQ ID NO: 174408 - protein, 15 aa, Borrelia garinii
LYKNHKYKTTARNFI

SEQ ID NO: 174409 - protein, 9 aa, Borrelia garinii
KYKTTARNF

SEQ ID NO: 174410 - protein, 15 aa, Borrelia garinii
LYKNHKYKTTARNFI

SEQ ID NO: 174411 - protein, 9 aa, Borrelia garinii
NHKYKTTAR

SEQ ID NO: 174412 - protein, 15 aa, Borrelia garinii
LYKNHKYKTTARNFI

SEQ ID NO: 174413 - protein, 9 aa, Borrelia garinii
YKNHKYKTT

SEQ ID NO: 174414 - protein, 15 aa, Borrelia garinii
MDENYKEFDPLNLDY

SEQ ID NO: 174415 - protein, 9 aa, Borrelia garinii
KEFDPLNLD

SEQ ID NO: 174416 - protein, 15 aa, Borrelia garinii
MKIKRIIYSSLNYEI

SEQ ID NO: 174417 - protein, 9 aa, Borrelia garinii
KRIIYSSLN

SEQ ID NO: 174418 - protein, 15 aa, Borrelia garinii
MKIKRIIYSSLNYEI

SEQ ID NO: 174419 - protein, 9 aa, Borrelia garinii
MKIKRIIYS

SEQ ID NO: 174420 - protein, 15 aa, Borrelia garinii
MKKTKLNIIKLNILT

SEQ ID NO: 174421 - protein, 9 aa, Borrelia garinii
LNIIKLNIL

SEQ ID NO: 174422 - protein, 15 aa, Borrelia garinii
NFILNISIKIQFQIE

SEQ ID NO: 174423 - protein, 9 aa, Borrelia garinii
LNISIKIQF

SEQ ID NO: 174424 - protein, 15 aa, Borrelia garinii
NHKYKTTARNFILNI

SEQ ID NO: 174425 - protein, 9 aa, Borrelia garinii
YKTTARNFI

SEQ ID NO: 174426 - protein, 15 aa, Borrelia garinii
NIIKLNILTTILTLI

SEQ ID NO: 174427 - protein, 9 aa, Borrelia garinii
LNILTTILT

SEQ ID NO: 174428 - protein, 15 aa, Borrelia garinii
NILTTILTLICISCA

SEQ ID NO: 174429 - protein, 9 aa, Borrelia garinii
ILTTILTLI

SEQ ID NO: 174430 - protein, 15 aa, Borrelia garinii
NILTTILTLICISCA

SEQ ID NO: 174431 - protein, 9 aa, Borrelia garinii
LTTILTLIC

SEQ ID NO: 174432 - protein, 15 aa, Borrelia garinii
NKSQDLEPSNTKNKD

SEQ ID NO: 174433 - protein, 9 aa, Borrelia garinii
LEPSNTKNK

SEQ ID NO: 174434 - protein, 15 aa, Borrelia garinii
NQDLDNIKSNEDQLA

SEQ ID NO: 174435 - protein, 9 aa, Borrelia garinii
LDNIKSNED

SEQ ID NO: 174436 - protein, 15 aa, Borrelia garinii
NTQIDFLENFKSEPH

SEQ ID NO: 174437 - protein, 9 aa, Borrelia garinii
FLENFKSEP

SEQ ID NO: 174438 - protein, 15 aa, Borrelia garinii
NTQIDFLENFKSEPH

SEQ ID NO: 174439 - protein, 9 aa, Borrelia garinii
IDFLENFKS

SEQ ID NO: 174440 - protein, 15 aa, Borrelia garinii
NYEIEKINTLKEILD

SEQ ID NO: 174441 - protein, 9 aa, Borrelia garinii
EKINTLKEI

SEQ ID NO: 174442 - protein, 15 aa, Borrelia garinii
NYEIEKINTLKEILD

SEQ ID NO: 174443 - protein, 9 aa, Borrelia garinii
IEKINTLKE

SEQ ID NO: 174444 - protein, 15 aa, Borrelia garinii
QDLDNIKSNEDQLAH

SEQ ID NO: 174445 - protein, 9 aa, Borrelia garinii
IKSNEDQLA

SEQ ID NO: 174446 - protein, 15 aa, Borrelia garinii
QDLEPSNTKNKDLEP

SEQ ID NO: 174447 - protein, 9 aa, Borrelia garinii
LEPSNTKNK

SEQ ID NO: 174448 - protein, 15 aa, Borrelia garinii
QIDFLENFKSEPHDT

SEQ ID NO: 174449 - protein, 9 aa, Borrelia garinii
LENFKSEPH

SEQ ID NO: 174450 - protein, 15 aa, Borrelia garinii
RNFILNISIKIQFQI

SEQ ID NO: 174451 - protein, 9 aa, Borrelia garinii
FILNISIKI

SEQ ID NO: 174452 - protein, 15 aa, Borrelia garinii
RYEILLKHVEPSLNL

SEQ ID NO: 174453 - protein, 9 aa, Borrelia garinii
LKHVEPSLN

SEQ ID NO: 174454 - protein, 15 aa, Borrelia garinii
SEDIEMKIKRIIYSS

SEQ ID NO: 174455 - protein, 9 aa, Borrelia garinii
MKIKRIIYS

SEQ ID NO: 174456 - protein, 15 aa, Borrelia garinii
SIKIQFQIENALELM

SEQ ID NO: 174457 - protein, 9 aa, Borrelia garinii
FQIENALEL

SEQ ID NO: 174458 - protein, 15 aa, Borrelia garinii
SLNYEIEKINTLKEI

SEQ ID NO: 174459 - protein, 9 aa, Borrelia garinii
IEKINTLKE

SEQ ID NO: 174460 - protein, 15 aa, Borrelia garinii
SLNYEIEKINTLKEI

SEQ ID NO: 174461 - protein, 9 aa, Borrelia garinii
YEIEKINTL

SEQ ID NO: 174462 - protein, 15 aa, Borrelia garinii
SQDLEPSNTKNKDLE

SEQ ID NO: 174463 - protein, 9 aa, Borrelia garinii
LEPSNTKNK

SEQ ID NO: 174464 - protein, 15 aa, Borrelia garinii
SSLNYEIEKINTLKE

SEQ ID NO: 174465 - protein, 9 aa, Borrelia garinii
YEIEKINTL

SEQ ID NO: 174466 - protein, 15 aa, Borrelia garinii
TARNFILNISIKIQF

SEQ ID NO: 174467 - protein, 9 aa, Borrelia garinii
FILNISIKI

SEQ ID NO: 174468 - protein, 15 aa, Borrelia garinii
TKLNIIKLNILTTIL

SEQ ID NO: 174469 - protein, 9 aa, Borrelia garinii
IIKLNILTT

SEQ ID NO: 174470 - protein, 15 aa, Borrelia garinii
TKLNIIKLNILTTIL

SEQ ID NO: 174471 - protein, 9 aa, Borrelia garinii
IKLNILTTI

SEQ ID NO: 174472 - protein, 15 aa, Borrelia garinii
TQIDFLENFKSEPHD

SEQ ID NO: 174473 - protein, 9 aa, Borrelia garinii
LENFKSEPH

SEQ ID NO: 174474 - protein, 15 aa, Borrelia garinii
TTARNFILNISIKIQ

SEQ ID NO: 174475 - protein, 9 aa, Borrelia garinii
FILNISIKI

SEQ ID NO: 174476 - protein, 15 aa, Borrelia garinii
TTILTLICISCAVDK

SEQ ID NO: 174477 - protein, 9 aa, Borrelia garinii
LTLICISCA

SEQ ID NO: 174478 - protein, 15 aa, Borrelia garinii
YEIEKINTLKEILDK

SEQ ID NO: 174479 - protein, 9 aa, Borrelia garinii
IEKINTLKE

SEQ ID NO: 174480 - protein, 15 aa, Borrelia garinii
YEIEKINTLKEILDK

SEQ ID NO: 174481 - protein, 9 aa, Borrelia garinii
INTLKEILD

SEQ ID NO: 174482 - protein, 15 aa, Borrelia garinii
YEILLKHVEPSLNLK

SEQ ID NO: 174483 - protein, 9 aa, Borrelia garinii
LKHVEPSLN

SEQ ID NO: 174484 - protein, 15 aa, Borrelia garinii
YKNHKYKTTARNFIL

SEQ ID NO: 174485 - protein, 9 aa, Borrelia garinii
YKNHKYKTT

SEQ ID NO: 174486 - protein, 15 aa, Borrelia garinii
YKNHKYKTTARNFIL

SEQ ID NO: 174487 - protein, 9 aa, Borrelia garinii
YKTTARNFI

SEQ ID NO: 174488 - protein, 15 aa, Borrelia garinii
YKTTARNFILNISIK

SEQ ID NO: 174489 - protein, 9 aa, Borrelia garinii
ARNFILNIS

SEQ ID NO: 174490 - protein, 15 aa, Borrelia garinii
YNQDLDNIKSNEDQL

SEQ ID NO: 174491 - protein, 9 aa, Borrelia garinii
LDNIKSNED

SEQ ID NO: 174492 - protein, 8 aa, Borrelia garinii PBi
KIRINLNL

SEQ ID NO: 174493 - protein, 8 aa, Borrelia garinii PBi
RINLNLKR

SEQ ID NO: 174494 - protein, 8 aa, Borrelia garinii PBi
NLKRKSGI

SEQ ID NO: 174495 - protein, 8 aa, Borrelia garinii PBi
ILLNISSL

SEQ ID NO: 174496 - protein, 8 aa, Borrelia garinii PBi
NISSLPSK

SEQ ID NO: 174497 - protein, 8 aa, Borrelia garinii PBi
SLPSKYGI

SEQ ID NO: 174498 - protein, 8 aa, Borrelia garinii PBi
GAYKFIDF

SEQ ID NO: 174499 - protein, 8 aa, Borrelia garinii PBi
AYKFIDFL

SEQ ID NO: 174500 - protein, 8 aa, Borrelia garinii PBi
KFIDFLFA

SEQ ID NO: 174501 - protein, 8 aa, Borrelia garinii PBi
FIDFLFAS

SEQ ID NO: 174502 - protein, 8 aa, Borrelia garinii PBi
FLFASSQS

SEQ ID NO: 174503 - protein, 8 aa, Borrelia garinii PBi
LFASSQSY

SEQ ID NO: 174504 - protein, 8 aa, Borrelia garinii PBi
FASSQSYW

SEQ ID NO: 174505 - protein, 8 aa, Borrelia garinii PBi
SQSYWQMF

SEQ ID NO: 174506 - protein, 8 aa, Borrelia garinii PBi
QSYWQMFA

SEQ ID NO: 174507 - protein, 8 aa, Borrelia garinii PBi
SYWQMFAY

SEQ ID NO: 174508 - protein, 8 aa, Borrelia garinii PBi
WQMFAYSP

SEQ ID NO: 174509 - protein, 8 aa, Borrelia garinii PBi
QMFAYSPI

SEQ ID NO: 174510 - protein, 8 aa, Borrelia garinii PBi
FAYSPIDF

SEQ ID NO: 174511 - protein, 8 aa, Borrelia garinii PBi
YSPIDFTR

SEQ ID NO: 174512 - protein, 8 aa, Borrelia garinii PBi
TRSPPYSI

SEQ ID NO: 174513 - protein, 8 aa, Borrelia garinii PBi
RSPPYSIF

SEQ ID NO: 174514 - protein, 8 aa, Borrelia garinii PBi
PPYSIFSA

SEQ ID NO: 174515 - protein, 8 aa, Borrelia garinii PBi
PYSIFSAF

SEQ ID NO: 174516 - protein, 8 aa, Borrelia garinii PBi
YSIFSAFA

SEQ ID NO: 174517 - protein, 8 aa, Borrelia garinii PBi
FSAFAGNV

SEQ ID NO: 174518 - protein, 8 aa, Borrelia garinii PBi
SAFAGNVY

SEQ ID NO: 174519 - protein, 8 aa, Borrelia garinii PBi
AFAGNVYY

SEQ ID NO: 174520 - protein, 8 aa, Borrelia garinii PBi
FAGNVYYI

SEQ ID NO: 174521 - protein, 8 aa, Borrelia garinii PBi
NVYYIDLE

SEQ ID NO: 174522 - protein, 8 aa, Borrelia garinii PBi
YYIDLEAL

SEQ ID NO: 174523 - protein, 8 aa, Borrelia garinii PBi
FIDSDLNL

SEQ ID NO: 174524 - protein, 8 aa, Borrelia garinii PBi
LLKENETR

SEQ ID NO: 174525 - protein, 8 aa, Borrelia garinii PBi
NETRYSDL

SEQ ID NO: 174526 - protein, 8 aa, Borrelia garinii PBi
ETRYSDLK

SEQ ID NO: 174527 - protein, 8 aa, Borrelia garinii PBi
RYSDLKKL

SEQ ID NO: 174528 - protein, 8 aa, Borrelia garinii PBi
DLKKLSFK

SEQ ID NO: 174529 - protein, 8 aa, Borrelia garinii PBi
SFKDKFLK

SEQ ID NO: 174530 - protein, 8 aa, Borrelia garinii PBi
KFLKEAAL

SEQ ID NO: 174531 - protein, 8 aa, Borrelia garinii PBi
KEAALNFI

SEQ ID NO: 174532 - protein, 8 aa, Borrelia garinii PBi
AALNFINR

SEQ ID NO: 174533 - protein, 8 aa, Borrelia garinii PBi
ALNFINRA

SEQ ID NO: 174534 - protein, 8 aa, Borrelia garinii PBi
NRASVDEV

SEQ ID NO: 174535 - protein, 8 aa, Borrelia garinii PBi
RASVDEVR

SEQ ID NO: 174536 - protein, 8 aa, Borrelia garinii PBi
SVDEVRSF

SEQ ID NO: 174537 - protein, 8 aa, Borrelia garinii PBi
EVRSFEKF

SEQ ID NO: 174538 - protein, 8 aa, Borrelia garinii PBi
RSFEKFKK

SEQ ID NO: 174539 - protein, 8 aa, Borrelia garinii PBi
KKSSYWLL

SEQ ID NO: 174540 - protein, 8 aa, Borrelia garinii PBi
SSYWLLDF

SEQ ID NO: 174541 - protein, 8 aa, Borrelia garinii PBi
WLLDFASF

SEQ ID NO: 174542 - protein, 8 aa, Borrelia garinii PBi
LLDFASFV

SEQ ID NO: 174543 - protein, 8 aa, Borrelia garinii PBi
DFASFVAF

SEQ ID NO: 174544 - protein, 8 aa, Borrelia garinii PBi
FASFVAFK

SEQ ID NO: 174545 - protein, 8 aa, Borrelia garinii PBi
FVAFKEYF

SEQ ID NO: 174546 - protein, 8 aa, Borrelia garinii PBi
VAFKEYFL

SEQ ID NO: 174547 - protein, 8 aa, Borrelia garinii PBi
AFKEYFLK

SEQ ID NO: 174548 - protein, 8 aa, Borrelia garinii PBi
EYFLKDSR

SEQ ID NO: 174549 - protein, 8 aa, Borrelia garinii PBi
FLKDSRDA

SEQ ID NO: 174550 - protein, 8 aa, Borrelia garinii PBi
DSRDAFNV

SEQ ID NO: 174551 - protein, 8 aa, Borrelia garinii PBi
SRDAFNVL

SEQ ID NO: 174552 - protein, 8 aa, Borrelia garinii PBi
AFNVLFDR

SEQ ID NO: 174553 - protein, 8 aa, Borrelia garinii PBi
VLFDRGIL

SEQ ID NO: 174554 - protein, 8 aa, Borrelia garinii PBi
GILIRNEK

SEQ ID NO: 174555 - protein, 8 aa, Borrelia garinii PBi
NEKDLFKL

SEQ ID NO: 174556 - protein, 8 aa, Borrelia garinii PBi
DLFKLRNI

SEQ ID NO: 174557 - protein, 8 aa, Borrelia garinii PBi
KLRNILSK

SEQ ID NO: 174558 - protein, 8 aa, Borrelia garinii PBi
ILSKEIKV

SEQ ID NO: 174559 - protein, 8 aa, Borrelia garinii PBi
KEIKVQEV

SEQ ID NO: 174560 - protein, 8 aa, Borrelia garinii PBi
EIKVQEVL

SEQ ID NO: 174561 - protein, 8 aa, Borrelia garinii PBi
KVQEVLQY

SEQ ID NO: 174562 - protein, 8 aa, Borrelia garinii PBi
VQEVLQYF

SEQ ID NO: 174563 - protein, 8 aa, Borrelia garinii PBi
QEVLQYFF

SEQ ID NO: 174564 - protein, 8 aa, Borrelia garinii PBi
EVLQYFFF

SEQ ID NO: 174565 - protein, 8 aa, Borrelia garinii PBi
LQYFFFSQ

SEQ ID NO: 174566 - protein, 8 aa, Borrelia garinii PBi
QYFFFSQF

SEQ ID NO: 174567 - protein, 8 aa, Borrelia garinii PBi
FFSQFQAL

SEQ ID NO: 174568 - protein, 8 aa, Borrelia garinii PBi
FSQFQALK

SEQ ID NO: 174569 - protein, 8 aa, Borrelia garinii PBi
SQFQALKR

SEQ ID NO: 174570 - protein, 8 aa, Borrelia garinii PBi
FQALKRYA

SEQ ID NO: 174571 - protein, 8 aa, Borrelia garinii PBi
RYANDKGI

SEQ ID NO: 174572 - protein, 8 aa, Borrelia garinii PBi
ELVMNLPL

SEQ ID NO: 174573 - protein, 8 aa, Borrelia garinii PBi
LVMNLPLF

SEQ ID NO: 174574 - protein, 8 aa, Borrelia garinii PBi
VMNLPLFI

SEQ ID NO: 174575 - protein, 8 aa, Borrelia garinii PBi
NLPLFIAY

SEQ ID NO: 174576 - protein, 8 aa, Borrelia garinii PBi
LPLFIAYD

SEQ ID NO: 174577 - protein, 8 aa, Borrelia garinii PBi
IAYDSADV

SEQ ID NO: 174578 - protein, 8 aa, Borrelia garinii PBi
AYDSADVW

SEQ ID NO: 174579 - protein, 8 aa, Borrelia garinii PBi
DVWAHQKY

SEQ ID NO: 174580 - protein, 8 aa, Borrelia garinii PBi
VWAHQKYF

SEQ ID NO: 174581 - protein, 8 aa, Borrelia garinii PBi
WAHQKYFK

SEQ ID NO: 174582 - protein, 8 aa, Borrelia garinii PBi
HQKYFKLR

SEQ ID NO: 174583 - protein, 8 aa, Borrelia garinii PBi
KLRFDASK

SEQ ID NO: 174584 - protein, 8 aa, Borrelia garinii PBi
GISPDYFL

SEQ ID NO: 174585 - protein, 8 aa, Borrelia garinii PBi
QAWDSPAY

SEQ ID NO: 174586 - protein, 8 aa, Borrelia garinii PBi
SPAYSWNV

SEQ ID NO: 174587 - protein, 8 aa, Borrelia garinii PBi
AYSWNVLK

SEQ ID NO: 174588 - protein, 8 aa, Borrelia garinii PBi
NVLKNVKY

SEQ ID NO: 174589 - protein, 8 aa, Borrelia garinii PBi
KYEWWAKR

SEQ ID NO: 174590 - protein, 8 aa, Borrelia garinii PBi
YEWWAKRI

SEQ ID NO: 174591 - protein, 8 aa, Borrelia garinii PBi
WWAKRIGI

SEQ ID NO: 174592 - protein, 8 aa, Borrelia garinii PBi
WAKRIGIL

SEQ ID NO: 174593 - protein, 8 aa, Borrelia garinii PBi
KRIGILRK

SEQ ID NO: 174594 - protein, 8 aa, Borrelia garinii PBi
ILRKYIDV

SEQ ID NO: 174595 - protein, 8 aa, Borrelia garinii PBi
KYIDVIKI

SEQ ID NO: 174596 - protein, 8 aa, Borrelia garinii PBi
DVIKIDHF

SEQ ID NO: 174597 - protein, 8 aa, Borrelia garinii PBi
VIKIDHFR

SEQ ID NO: 174598 - protein, 8 aa, Borrelia garinii PBi
GFVSTWEV

SEQ ID NO: 174599 - protein, 8 aa, Borrelia garinii PBi
WEVGVGEA

SEQ ID NO: 174600 - protein, 8 aa, Borrelia garinii PBi
EVGVGEAY

SEQ ID NO: 174601 - protein, 8 aa, Borrelia garinii PBi
EAYAFNGL

SEQ ID NO: 174602 - protein, 8 aa, Borrelia garinii PBi
AYAFNGLW

SEQ ID NO: 174603 - protein, 8 aa, Borrelia garinii PBi
YAFNGLWV

SEQ ID NO: 174604 - protein, 8 aa, Borrelia garinii PBi
AFNGLWVK

SEQ ID NO: 174605 - protein, 8 aa, Borrelia garinii PBi
RDFFNFIL

SEQ ID NO: 174606 - protein, 8 aa, Borrelia garinii PBi
NFILNEIK

SEQ ID NO: 174607 - protein, 8 aa, Borrelia garinii PBi
ILNEIKDL

SEQ ID NO: 174608 - protein, 8 aa, Borrelia garinii PBi
EIKDLKIW

SEQ ID NO: 174609 - protein, 8 aa, Borrelia garinii PBi
IKDLKIWV

SEQ ID NO: 174610 - protein, 8 aa, Borrelia garinii PBi
VEDFENDL

SEQ ID NO: 174611 - protein, 8 aa, Borrelia garinii PBi
FENDLEDV

SEQ ID NO: 174612 - protein, 8 aa, Borrelia garinii PBi
DLEDVSRL

SEQ ID NO: 174613 - protein, 8 aa, Borrelia garinii PBi
DVSRLRDF

SEQ ID NO: 174614 - protein, 8 aa, Borrelia garinii PBi
RLRDFFNF

SEQ ID NO: 174615 - protein, 8 aa, Borrelia garinii PBi
FFNFPGMR

SEQ ID NO: 174616 - protein, 8 aa, Borrelia garinii PBi
GMRIMKLA

SEQ ID NO: 174617 - protein, 8 aa, Borrelia garinii PBi
MRIMKLAF

SEQ ID NO: 174618 - protein, 8 aa, Borrelia garinii PBi
IMKLAFDF

SEQ ID NO: 174619 - protein, 8 aa, Borrelia garinii PBi
FDSDNQNL

SEQ ID NO: 174620 - protein, 8 aa, Borrelia garinii PBi
NQNLPHNY

SEQ ID NO: 174621 - protein, 8 aa, Borrelia garinii PBi
YIKNCIVY

SEQ ID NO: 174622 - protein, 8 aa, Borrelia garinii PBi
NCIVYTGI

SEQ ID NO: 174623 - protein, 8 aa, Borrelia garinii PBi
GIGDNSTI

SEQ ID NO: 174624 - protein, 8 aa, Borrelia garinii PBi
NSTIREFV

SEQ ID NO: 174625 - protein, 8 aa, Borrelia garinii PBi
IREFVNSL

SEQ ID NO: 174626 - protein, 8 aa, Borrelia garinii PBi
FVNSLDDL

SEQ ID NO: 174627 - protein, 8 aa, Borrelia garinii PBi
NSLDDLHK

SEQ ID NO: 174628 - protein, 8 aa, Borrelia garinii PBi
SLDDLHKK

SEQ ID NO: 174629 - protein, 8 aa, Borrelia garinii PBi
YIFDYLNT

SEQ ID NO: 174630 - protein, 8 aa, Borrelia garinii PBi
YLNTNEDF

SEQ ID NO: 174631 - protein, 8 aa, Borrelia garinii PBi
NTNEDFVV

SEQ ID NO: 174632 - protein, 8 aa, Borrelia garinii PBi
FVVWDMIR

SEQ ID NO: 174633 - protein, 8 aa, Borrelia garinii PBi
MSSVSDSV

SEQ ID NO: 174634 - protein, 8 aa, Borrelia garinii PBi
SVSDSVII

SEQ ID NO: 174635 - protein, 8 aa, Borrelia garinii PBi
VIIPMQDY

SEQ ID NO: 174636 - protein, 8 aa, Borrelia garinii PBi
PMQDYINL

SEQ ID NO: 174637 - protein, 8 aa, Borrelia garinii PBi
YINLGNEF

SEQ ID NO: 174638 - protein, 8 aa, Borrelia garinii PBi
NLGNEFRA

SEQ ID NO: 174639 - protein, 8 aa, Borrelia garinii PBi
EFRANIPK

SEQ ID NO: 174640 - protein, 8 aa, Borrelia garinii PBi
NTLNNWIF

SEQ ID NO: 174641 - protein, 8 aa, Borrelia garinii PBi
TLNNWIFR

SEQ ID NO: 174642 - protein, 8 aa, Borrelia garinii PBi
TLSKNISF

SEQ ID NO: 174643 - protein, 8 aa, Borrelia garinii PBi
KNISFITR

SEQ ID NO: 174644 - protein, 8 aa, Borrelia garinii PBi
NISFITRL

SEQ ID NO: 174645 - protein, 8 aa, Borrelia garinii PBi
ISFITRLY

SEQ ID NO: 174646 - protein, 8 aa, Borrelia garinii PBi
FITRLYGR

SEQ ID NO: 174647 - protein, 9 aa, Borrelia garinii PBi
KYKKIRINL

SEQ ID NO: 174648 - protein, 9 aa, Borrelia garinii PBi
KIRINLNLK

SEQ ID NO: 174649 - protein, 9 aa, Borrelia garinii PBi
IRINLNLKR

SEQ ID NO: 174650 - protein, 9 aa, Borrelia garinii PBi
RINLNLKRK

SEQ ID NO: 174651 - protein, 9 aa, Borrelia garinii PBi
NLKRKSGIL

SEQ ID NO: 174652 - protein, 9 aa, Borrelia garinii PBi
GILLNISSL

SEQ ID NO: 174653 - protein, 9 aa, Borrelia garinii PBi
NISSLPSKY

SEQ ID NO: 174654 - protein, 9 aa, Borrelia garinii PBi
KYGIGDLGK

SEQ ID NO: 174655 - protein, 9 aa, Borrelia garinii PBi
DLGKGAYKF

SEQ ID NO: 174656 - protein, 9 aa, Borrelia garinii PBi
GAYKFIDFL

SEQ ID NO: 174657 - protein, 9 aa, Borrelia garinii PBi
AYKFIDFLF

SEQ ID NO: 174658 - protein, 9 aa, Borrelia garinii PBi
YKFIDFLFA

SEQ ID NO: 174659 - protein, 9 aa, Borrelia garinii PBi
FIDFLFASS

SEQ ID NO: 174660 - protein, 9 aa, Borrelia garinii PBi
FLFASSQSY

SEQ ID NO: 174661 - protein, 9 aa, Borrelia garinii PBi
LFASSQSYW

SEQ ID NO: 174662 - protein, 9 aa, Borrelia garinii PBi
FASSQSYWQ

SEQ ID NO: 174663 - protein, 9 aa, Borrelia garinii PBi
ASSQSYWQM

SEQ ID NO: 174664 - protein, 9 aa, Borrelia garinii PBi
SQSYWQMFA

SEQ ID NO: 174665 - protein, 9 aa, Borrelia garinii PBi
QSYWQMFAY

SEQ ID NO: 174666 - protein, 9 aa, Borrelia garinii PBi
SYWQMFAYS

SEQ ID NO: 174667 - protein, 9 aa, Borrelia garinii PBi
WQMFAYSPI

SEQ ID NO: 174668 - protein, 9 aa, Borrelia garinii PBi
MFAYSPIDF

SEQ ID NO: 174669 - protein, 9 aa, Borrelia garinii PBi
FAYSPIDFT

SEQ ID NO: 174670 - protein, 9 aa, Borrelia garinii PBi
AYSPIDFTR

SEQ ID NO: 174671 - protein, 9 aa, Borrelia garinii PBi
FTRSPPYSI

SEQ ID NO: 174672 - protein, 9 aa, Borrelia garinii PBi
SPPYSIFSA

SEQ ID NO: 174673 - protein, 9 aa, Borrelia garinii PBi
PPYSIFSAF

SEQ ID NO: 174674 - protein, 9 aa, Borrelia garinii PBi
FSAFAGNVY

SEQ ID NO: 174675 - protein, 9 aa, Borrelia garinii PBi
SAFAGNVYY

SEQ ID NO: 174676 - protein, 9 aa, Borrelia garinii PBi
AFAGNVYYI

SEQ ID NO: 174677 - protein, 9 aa, Borrelia garinii PBi
NVYYIDLEA

SEQ ID NO: 174678 - protein, 9 aa, Borrelia garinii PBi
VYYIDLEAL

SEQ ID NO: 174679 - protein, 9 aa, Borrelia garinii PBi
KFIDSDLNL

SEQ ID NO: 174680 - protein, 9 aa, Borrelia garinii PBi
FIDSDLNLL

SEQ ID NO: 174681 - protein, 9 aa, Borrelia garinii PBi
LLKENETRY

SEQ ID NO: 174682 - protein, 9 aa, Borrelia garinii PBi
ETRYSDLKK

SEQ ID NO: 174683 - protein, 9 aa, Borrelia garinii PBi
YSDLKKLSF

SEQ ID NO: 174684 - protein, 9 aa, Borrelia garinii PBi
KLSFKDKFL

SEQ ID NO: 174685 - protein, 9 aa, Borrelia garinii PBi
LSFKDKFLK

SEQ ID NO: 174686 - protein, 9 aa, Borrelia garinii PBi
FLKEAALNF

SEQ ID NO: 174687 - protein, 9 aa, Borrelia garinii PBi
EAALNFINR

SEQ ID NO: 174688 - protein, 9 aa, Borrelia garinii PBi
AALNFINRA

SEQ ID NO: 174689 - protein, 9 aa, Borrelia garinii PBi
ASVDEVRSF

SEQ ID NO: 174690 - protein, 9 aa, Borrelia garinii PBi
DEVRSFEKF

SEQ ID NO: 174691 - protein, 9 aa, Borrelia garinii PBi
EVRSFEKFK

SEQ ID NO: 174692 - protein, 9 aa, Borrelia garinii PBi
RSFEKFKKK

SEQ ID NO: 174693 - protein, 9 aa, Borrelia garinii PBi
KFKKKSSYW

SEQ ID NO: 174694 - protein, 9 aa, Borrelia garinii PBi
KSSYWLLDF

SEQ ID NO: 174695 - protein, 9 aa, Borrelia garinii PBi
SSYWLLDFA

SEQ ID NO: 174696 - protein, 9 aa, Borrelia garinii PBi
YWLLDFASF

SEQ ID NO: 174697 - protein, 9 aa, Borrelia garinii PBi
WLLDFASFV

SEQ ID NO: 174698 - protein, 9 aa, Borrelia garinii PBi
LLDFASFVA

SEQ ID NO: 174699 - protein, 9 aa, Borrelia garinii PBi
LDFASFVAF

SEQ ID NO: 174700 - protein, 9 aa, Borrelia garinii PBi
DFASFVAFK

SEQ ID NO: 174701 - protein, 9 aa, Borrelia garinii PBi
FASFVAFKE

SEQ ID NO: 174702 - protein, 9 aa, Borrelia garinii PBi
ASFVAFKEY

SEQ ID NO: 174703 - protein, 9 aa, Borrelia garinii PBi
SFVAFKEYF

SEQ ID NO: 174704 - protein, 9 aa, Borrelia garinii PBi
FVAFKEYFL

SEQ ID NO: 174705 - protein, 9 aa, Borrelia garinii PBi
VAFKEYFLK

SEQ ID NO: 174706 - protein, 9 aa, Borrelia garinii PBi
KEYFLKDSR

SEQ ID NO: 174707 - protein, 9 aa, Borrelia garinii PBi
FLKDSRDAF

SEQ ID NO: 174708 - protein, 9 aa, Borrelia garinii PBi
DAFNVLFDR

SEQ ID NO: 174709 - protein, 9 aa, Borrelia garinii PBi
VLFDRGILI

SEQ ID NO: 174710 - protein, 9 aa, Borrelia garinii PBi
RGILIRNEK

SEQ ID NO: 174711 - protein, 9 aa, Borrelia garinii PBi
ILIRNEKDL

SEQ ID NO: 174712 - protein, 9 aa, Borrelia garinii PBi
DLFKLRNIL

SEQ ID NO: 174713 - protein, 9 aa, Borrelia garinii PBi
RNILSKEIK

SEQ ID NO: 174714 - protein, 9 aa, Borrelia garinii PBi
NILSKEIKV

SEQ ID NO: 174715 - protein, 9 aa, Borrelia garinii PBi
KEIKVQEVL

SEQ ID NO: 174716 - protein, 9 aa, Borrelia garinii PBi
IKVQEVLQY

SEQ ID NO: 174717 - protein, 9 aa, Borrelia garinii PBi
KVQEVLQYF

SEQ ID NO: 174718 - protein, 9 aa, Borrelia garinii PBi
VQEVLQYFF

SEQ ID NO: 174719 - protein, 9 aa, Borrelia garinii PBi
QEVLQYFFF

SEQ ID NO: 174720 - protein, 9 aa, Borrelia garinii PBi
EVLQYFFFS

SEQ ID NO: 174721 - protein, 9 aa, Borrelia garinii PBi
VLQYFFFSQ

SEQ ID NO: 174722 - protein, 9 aa, Borrelia garinii PBi
LQYFFFSQF

SEQ ID NO: 174723 - protein, 9 aa, Borrelia garinii PBi
FFFSQFQAL

SEQ ID NO: 174724 - protein, 9 aa, Borrelia garinii PBi
FFSQFQALK

SEQ ID NO: 174725 - protein, 9 aa, Borrelia garinii PBi
FSQFQALKR

SEQ ID NO: 174726 - protein, 9 aa, Borrelia garinii PBi
SQFQALKRY

SEQ ID NO: 174727 - protein, 9 aa, Borrelia garinii PBi
ALKRYANDK

SEQ ID NO: 174728 - protein, 9 aa, Borrelia garinii PBi
YANDKGIEL

SEQ ID NO: 174729 - protein, 9 aa, Borrelia garinii PBi
ANDKGIELV

SEQ ID NO: 174730 - protein, 9 aa, Borrelia garinii PBi
IELVMNLPL

SEQ ID NO: 174731 - protein, 9 aa, Borrelia garinii PBi
ELVMNLPLF

SEQ ID NO: 174732 - protein, 9 aa, Borrelia garinii PBi
LVMNLPLFI

SEQ ID NO: 174733 - protein, 9 aa, Borrelia garinii PBi
VMNLPLFIA

SEQ ID NO: 174734 - protein, 9 aa, Borrelia garinii PBi
MNLPLFIAY

SEQ ID NO: 174735 - protein, 9 aa, Borrelia garinii PBi
LPLFIAYDS

SEQ ID NO: 174736 - protein, 9 aa, Borrelia garinii PBi
PLFIAYDSA

SEQ ID NO: 174737 - protein, 9 aa, Borrelia garinii PBi
FIAYDSADV

SEQ ID NO: 174738 - protein, 9 aa, Borrelia garinii PBi
IAYDSADVW

SEQ ID NO: 174739 - protein, 9 aa, Borrelia garinii PBi
SADVWAHQK

SEQ ID NO: 174740 - protein, 9 aa, Borrelia garinii PBi
DVWAHQKYF

SEQ ID NO: 174741 - protein, 9 aa, Borrelia garinii PBi
VWAHQKYFK

SEQ ID NO: 174742 - protein, 9 aa, Borrelia garinii PBi
HQKYFKLRF

SEQ ID NO: 174743 - protein, 9 aa, Borrelia garinii PBi
ASKDKVAGI

SEQ ID NO: 174744 - protein, 9 aa, Borrelia garinii PBi
KVAGISPDY

SEQ ID NO: 174745 - protein, 9 aa, Borrelia garinii PBi
VAGISPDYF

SEQ ID NO: 174746 - protein, 9 aa, Borrelia garinii PBi
YFLEQEQAW

SEQ ID NO: 174747 - protein, 9 aa, Borrelia garinii PBi
EQAWDSPAY

SEQ ID NO: 174748 - protein, 9 aa, Borrelia garinii PBi
QAWDSPAYS

SEQ ID NO: 174749 - protein, 9 aa, Borrelia garinii PBi
AWDSPAYSW

SEQ ID NO: 174750 - protein, 9 aa, Borrelia garinii PBi
DSPAYSWNV

SEQ ID NO: 174751 - protein, 9 aa, Borrelia garinii PBi
SPAYSWNVL

SEQ ID NO: 174752 - protein, 9 aa, Borrelia garinii PBi
PAYSWNVLK

SEQ ID NO: 174753 - protein, 9 aa, Borrelia garinii PBi
YSWNVLKNV

SEQ ID NO: 174754 - protein, 9 aa, Borrelia garinii PBi
SWNVLKNVK

SEQ ID NO: 174755 - protein, 9 aa, Borrelia garinii PBi
NVKYEWWAK

SEQ ID NO: 174756 - protein, 9 aa, Borrelia garinii PBi
KYEWWAKRI

SEQ ID NO: 174757 - protein, 9 aa, Borrelia garinii PBi
WWAKRIGIL

SEQ ID NO: 174758 - protein, 9 aa, Borrelia garinii PBi
WAKRIGILR

SEQ ID NO: 174759 - protein, 9 aa, Borrelia garinii PBi
AKRIGILRK

SEQ ID NO: 174760 - protein, 9 aa, Borrelia garinii PBi
KRIGILRKY

SEQ ID NO: 174761 - protein, 9 aa, Borrelia garinii PBi
GILRKYIDV

SEQ ID NO: 174762 - protein, 9 aa, Borrelia garinii PBi
ILRKYIDVI

SEQ ID NO: 174763 - protein, 9 aa, Borrelia garinii PBi
DVIKIDHFR

SEQ ID NO: 174764 - protein, 9 aa, Borrelia garinii PBi
KIDHFRGFV

SEQ ID NO: 174765 - protein, 9 aa, Borrelia garinii PBi
RGFVSTWEV

SEQ ID NO: 174766 - protein, 9 aa, Borrelia garinii PBi
FVSTWEVGV

SEQ ID NO: 174767 - protein, 9 aa, Borrelia garinii PBi
WEVGVGEAY

SEQ ID NO: 174768 - protein, 9 aa, Borrelia garinii PBi
EVGVGEAYA

SEQ ID NO: 174769 - protein, 9 aa, Borrelia garinii PBi
VGVGEAYAF

SEQ ID NO: 174770 - protein, 9 aa, Borrelia garinii PBi
GEAYAFNGL

SEQ ID NO: 174771 - protein, 9 aa, Borrelia garinii PBi
EAYAFNGLW

SEQ ID NO: 174772 - protein, 9 aa, Borrelia garinii PBi
AYAFNGLWV

SEQ ID NO: 174773 - protein, 9 aa, Borrelia garinii PBi
YAFNGLWVK

SEQ ID NO: 174774 - protein, 9 aa, Borrelia garinii PBi
GLWVKSPGR

SEQ ID NO: 174775 - protein, 9 aa, Borrelia garinii PBi
WVKSPGRDF

SEQ ID NO: 174776 - protein, 9 aa, Borrelia garinii PBi
SPGRDFFNF

SEQ ID NO: 174777 - protein, 9 aa, Borrelia garinii PBi
GRDFFNFIL

SEQ ID NO: 174778 - protein, 9 aa, Borrelia garinii PBi
FFNFILNEI

SEQ ID NO: 174779 - protein, 9 aa, Borrelia garinii PBi
FNFILNEIK

SEQ ID NO: 174780 - protein, 9 aa, Borrelia garinii PBi
FILNEIKDL

SEQ ID NO: 174781 - protein, 9 aa, Borrelia garinii PBi
ILNEIKDLK

SEQ ID NO: 174782 - protein, 9 aa, Borrelia garinii PBi
EIKDLKIWV

SEQ ID NO: 174783 - protein, 9 aa, Borrelia garinii PBi
WVEDFENDL

SEQ ID NO: 174784 - protein, 9 aa, Borrelia garinii PBi
DLEDVSRLR

SEQ ID NO: 174785 - protein, 9 aa, Borrelia garinii PBi
DVSRLRDFF

SEQ ID NO: 174786 - protein, 9 aa, Borrelia garinii PBi
SRLRDFFNF

SEQ ID NO: 174787 - protein, 9 aa, Borrelia garinii PBi
RLRDFFNFP

SEQ ID NO: 174788 - protein, 9 aa, Borrelia garinii PBi
DFFNFPGMR

SEQ ID NO: 174789 - protein, 9 aa, Borrelia garinii PBi
NFPGMRIMK

SEQ ID NO: 174790 - protein, 9 aa, Borrelia garinii PBi
FPGMRIMKL

SEQ ID NO: 174791 - protein, 9 aa, Borrelia garinii PBi
GMRIMKLAF

SEQ ID NO: 174792 - protein, 9 aa, Borrelia garinii PBi
RIMKLAFDF

SEQ ID NO: 174793 - protein, 9 aa, Borrelia garinii PBi
NYIKNCIVY

SEQ ID NO: 174794 - protein, 9 aa, Borrelia garinii PBi
YIKNCIVYT

SEQ ID NO: 174795 - protein, 9 aa, Borrelia garinii PBi
TGIGDNSTI

SEQ ID NO: 174796 - protein, 9 aa, Borrelia garinii PBi
DNSTIREFV

SEQ ID NO: 174797 - protein, 9 aa, Borrelia garinii PBi
TIREFVNSL

SEQ ID NO: 174798 - protein, 9 aa, Borrelia garinii PBi
EFVNSLDDL

SEQ ID NO: 174799 - protein, 9 aa, Borrelia garinii PBi
NSLDDLHKK

SEQ ID NO: 174800 - protein, 9 aa, Borrelia garinii PBi
SLDDLHKKY

SEQ ID NO: 174801 - protein, 9 aa, Borrelia garinii PBi
HKKYIFDYL

SEQ ID NO: 174802 - protein, 9 aa, Borrelia garinii PBi
YIFDYLNTN

SEQ ID NO: 174803 - protein, 9 aa, Borrelia garinii PBi
DYLNTNEDF

SEQ ID NO: 174804 - protein, 9 aa, Borrelia garinii PBi
YLNTNEDFV

SEQ ID NO: 174805 - protein, 9 aa, Borrelia garinii PBi
NTNEDFVVW

SEQ ID NO: 174806 - protein, 9 aa, Borrelia garinii PBi
EDFVVWDMI

SEQ ID NO: 174807 - protein, 9 aa, Borrelia garinii PBi
DFVVWDMIR

SEQ ID NO: 174808 - protein, 9 aa, Borrelia garinii PBi
FVVWDMIRS

SEQ ID NO: 174809 - protein, 9 aa, Borrelia garinii PBi
VVWDMIRSA

SEQ ID NO: 174810 - protein, 9 aa, Borrelia garinii PBi
MIRSAMSSV

SEQ ID NO: 174811 - protein, 9 aa, Borrelia garinii PBi
AMSSVSDSV

SEQ ID NO: 174812 - protein, 9 aa, Borrelia garinii PBi
MSSVSDSVI

SEQ ID NO: 174813 - protein, 9 aa, Borrelia garinii PBi
SVIIPMQDY

SEQ ID NO: 174814 - protein, 9 aa, Borrelia garinii PBi
VIIPMQDYI

SEQ ID NO: 174815 - protein, 9 aa, Borrelia garinii PBi
IPMQDYINL

SEQ ID NO: 174816 - protein, 9 aa, Borrelia garinii PBi
DYINLGNEF

SEQ ID NO: 174817 - protein, 9 aa, Borrelia garinii PBi
YINLGNEFR

SEQ ID NO: 174818 - protein, 9 aa, Borrelia garinii PBi
RANIPKNTL

SEQ ID NO: 174819 - protein, 9 aa, Borrelia garinii PBi
IPKNTLNNW

SEQ ID NO: 174820 - protein, 9 aa, Borrelia garinii PBi
NTLNNWIFR

SEQ ID NO: 174821 - protein, 9 aa, Borrelia garinii PBi
TLNNWIFRL

SEQ ID NO: 174822 - protein, 9 aa, Borrelia garinii PBi
RLLESDLDA

SEQ ID NO: 174823 - protein, 9 aa, Borrelia garinii PBi
LLESDLDAT

SEQ ID NO: 174824 - protein, 9 aa, Borrelia garinii PBi
LESDLDATL

SEQ ID NO: 174825 - protein, 9 aa, Borrelia garinii PBi
SDLDATLSK

SEQ ID NO: 174826 - protein, 9 aa, Borrelia garinii PBi
ATLSKNISF

SEQ ID NO: 174827 - protein, 9 aa, Borrelia garinii PBi
TLSKNISFI

SEQ ID NO: 174828 - protein, 9 aa, Borrelia garinii PBi
NISFITRLY

SEQ ID NO: 174829 - protein, 9 aa, Borrelia garinii PBi
SFITRLYGR

SEQ ID NO: 174830 - protein, 10 aa, Borrelia garinii PBi
KYKKIRINLN

SEQ ID NO: 174831 - protein, 10 aa, Borrelia garinii PBi
KIRINLNLKR

SEQ ID NO: 174832 - protein, 10 aa, Borrelia garinii PBi
NLNLKRKSGI

SEQ ID NO: 174833 - protein, 10 aa, Borrelia garinii PBi
NLKRKSGILL

SEQ ID NO: 174834 - protein, 10 aa, Borrelia garinii PBi
SGILLNISSL

SEQ ID NO: 174835 - protein, 10 aa, Borrelia garinii PBi
ILLNISSLPS

SEQ ID NO: 174836 - protein, 10 aa, Borrelia garinii PBi
LLNISSLPSK

SEQ ID NO: 174837 - protein, 10 aa, Borrelia garinii PBi
LPSKYGIGDL

SEQ ID NO: 174838 - protein, 10 aa, Borrelia garinii PBi
DLGKGAYKFI

SEQ ID NO: 174839 - protein, 10 aa, Borrelia garinii PBi
GAYKFIDFLF

SEQ ID NO: 174840 - protein, 10 aa, Borrelia garinii PBi
FIDFLFASSQ

SEQ ID NO: 174841 - protein, 10 aa, Borrelia garinii PBi
DFLFASSQSY

SEQ ID NO: 174842 - protein, 10 aa, Borrelia garinii PBi
FLFASSQSYW

SEQ ID NO: 174843 - protein, 10 aa, Borrelia garinii PBi
FASSQSYWQM

SEQ ID NO: 174844 - protein, 10 aa, Borrelia garinii PBi
ASSQSYWQMF

SEQ ID NO: 174845 - protein, 10 aa, Borrelia garinii PBi
SQSYWQMFAY

SEQ ID NO: 174846 - protein, 10 aa, Borrelia garinii PBi
YWQMFAYSPI

SEQ ID NO: 174847 - protein, 10 aa, Borrelia garinii PBi
QMFAYSPIDF

SEQ ID NO: 174848 - protein, 10 aa, Borrelia garinii PBi
FAYSPIDFTR

SEQ ID NO: 174849 - protein, 10 aa, Borrelia garinii PBi
PIDFTRSPPY

SEQ ID NO: 174850 - protein, 10 aa, Borrelia garinii PBi
FTRSPPYSIF

SEQ ID NO: 174851 - protein, 10 aa, Borrelia garinii PBi
RSPPYSIFSA

SEQ ID NO: 174852 - protein, 10 aa, Borrelia garinii PBi
SPPYSIFSAF

SEQ ID NO: 174853 - protein, 10 aa, Borrelia garinii PBi
PPYSIFSAFA

SEQ ID NO: 174854 - protein, 10 aa, Borrelia garinii PBi
SIFSAFAGNV

SEQ ID NO: 174855 - protein, 10 aa, Borrelia garinii PBi
IFSAFAGNVY

SEQ ID NO: 174856 - protein, 10 aa, Borrelia garinii PBi
FSAFAGNVYY

SEQ ID NO: 174857 - protein, 10 aa, Borrelia garinii PBi
SAFAGNVYYI

SEQ ID NO: 174858 - protein, 10 aa, Borrelia garinii PBi
FAGNVYYIDL

SEQ ID NO: 174859 - protein, 10 aa, Borrelia garinii PBi
NVYYIDLEAL

SEQ ID NO: 174860 - protein, 10 aa, Borrelia garinii PBi
YYIDLEALDK

SEQ ID NO: 174861 - protein, 10 aa, Borrelia garinii PBi
YIDLEALDKF

SEQ ID NO: 174862 - protein, 10 aa, Borrelia garinii PBi
ALDKFIDSDL

SEQ ID NO: 174863 - protein, 10 aa, Borrelia garinii PBi
KFIDSDLNLL

SEQ ID NO: 174864 - protein, 10 aa, Borrelia garinii PBi
FIDSDLNLLK

SEQ ID NO: 174865 - protein, 10 aa, Borrelia garinii PBi
KENETRYSDL

SEQ ID NO: 174866 - protein, 10 aa, Borrelia garinii PBi
ETRYSDLKKL

SEQ ID NO: 174867 - protein, 10 aa, Borrelia garinii PBi
RYSDLKKLSF

SEQ ID NO: 174868 - protein, 10 aa, Borrelia garinii PBi
YSDLKKLSFK

SEQ ID NO: 174869 - protein, 10 aa, Borrelia garinii PBi
KLSFKDKFLK

SEQ ID NO: 174870 - protein, 10 aa, Borrelia garinii PBi
KFLKEAALNF

SEQ ID NO: 174871 - protein, 10 aa, Borrelia garinii PBi
FLKEAALNFI

SEQ ID NO: 174872 - protein, 10 aa, Borrelia garinii PBi
EAALNFINRA

SEQ ID NO: 174873 - protein, 10 aa, Borrelia garinii PBi
ALNFINRASV

SEQ ID NO: 174874 - protein, 10 aa, Borrelia garinii PBi
FINRASVDEV

SEQ ID NO: 174875 - protein, 10 aa, Borrelia garinii PBi
RASVDEVRSF

SEQ ID NO: 174876 - protein, 10 aa, Borrelia garinii PBi
SVDEVRSFEK

SEQ ID NO: 174877 - protein, 10 aa, Borrelia garinii PBi
EVRSFEKFKK

SEQ ID NO: 174878 - protein, 10 aa, Borrelia garinii PBi
KFKKKSSYWL

SEQ ID NO: 174879 - protein, 10 aa, Borrelia garinii PBi
KSSYWLLDFA

SEQ ID NO: 174880 - protein, 10 aa, Borrelia garinii PBi
SYWLLDFASF

SEQ ID NO: 174881 - protein, 10 aa, Borrelia garinii PBi
YWLLDFASFV

SEQ ID NO: 174882 - protein, 10 aa, Borrelia garinii PBi
WLLDFASFVA

SEQ ID NO: 174883 - protein, 10 aa, Borrelia garinii PBi
LLDFASFVAF

SEQ ID NO: 174884 - protein, 10 aa, Borrelia garinii PBi
LDFASFVAFK

SEQ ID NO: 174885 - protein, 10 aa, Borrelia garinii PBi
DFASFVAFKE

SEQ ID NO: 174886 - protein, 10 aa, Borrelia garinii PBi
FASFVAFKEY

SEQ ID NO: 174887 - protein, 10 aa, Borrelia garinii PBi
ASFVAFKEYF

SEQ ID NO: 174888 - protein, 10 aa, Borrelia garinii PBi
SFVAFKEYFL

SEQ ID NO: 174889 - protein, 10 aa, Borrelia garinii PBi
FVAFKEYFLK

SEQ ID NO: 174890 - protein, 10 aa, Borrelia garinii PBi
YFLKDSRDAF

SEQ ID NO: 174891 - protein, 10 aa, Borrelia garinii PBi
RDAFNVLFDR

SEQ ID NO: 174892 - protein, 10 aa, Borrelia garinii PBi
NVLFDRGILI

SEQ ID NO: 174893 - protein, 10 aa, Borrelia garinii PBi
VLFDRGILIR

SEQ ID NO: 174894 - protein, 10 aa, Borrelia garinii PBi
ILIRNEKDLF

SEQ ID NO: 174895 - protein, 10 aa, Borrelia garinii PBi
LIRNEKDLFK

SEQ ID NO: 174896 - protein, 10 aa, Borrelia garinii PBi
LFKLRNILSK

SEQ ID NO: 174897 - protein, 10 aa, Borrelia garinii PBi
KLRNILSKEI

SEQ ID NO: 174898 - protein, 10 aa, Borrelia garinii PBi
EIKVQEVLQY

SEQ ID NO: 174899 - protein, 10 aa, Borrelia garinii PBi
IKVQEVLQYF

SEQ ID NO: 174900 - protein, 10 aa, Borrelia garinii PBi
KVQEVLQYFF

SEQ ID NO: 174901 - protein, 10 aa, Borrelia garinii PBi
VQEVLQYFFF

SEQ ID NO: 174902 - protein, 10 aa, Borrelia garinii PBi
QEVLQYFFFS

SEQ ID NO: 174903 - protein, 10 aa, Borrelia garinii PBi
EVLQYFFFSQ

SEQ ID NO: 174904 - protein, 10 aa, Borrelia garinii PBi
VLQYFFFSQF

SEQ ID NO: 174905 - protein, 10 aa, Borrelia garinii PBi
YFFFSQFQAL

SEQ ID NO: 174906 - protein, 10 aa, Borrelia garinii PBi
FFFSQFQALK

SEQ ID NO: 174907 - protein, 10 aa, Borrelia garinii PBi
FFSQFQALKR

SEQ ID NO: 174908 - protein, 10 aa, Borrelia garinii PBi
SQFQALKRYA

SEQ ID NO: 174909 - protein, 10 aa, Borrelia garinii PBi
RYANDKGIEL

SEQ ID NO: 174910 - protein, 10 aa, Borrelia garinii PBi
YANDKGIELV

SEQ ID NO: 174911 - protein, 10 aa, Borrelia garinii PBi
IELVMNLPLF

SEQ ID NO: 174912 - protein, 10 aa, Borrelia garinii PBi
ELVMNLPLFI

SEQ ID NO: 174913 - protein, 10 aa, Borrelia garinii PBi
LVMNLPLFIA

SEQ ID NO: 174914 - protein, 10 aa, Borrelia garinii PBi
VMNLPLFIAY

SEQ ID NO: 174915 - protein, 10 aa, Borrelia garinii PBi
LPLFIAYDSA

SEQ ID NO: 174916 - protein, 10 aa, Borrelia garinii PBi
FIAYDSADVW

SEQ ID NO: 174917 - protein, 10 aa, Borrelia garinii PBi
DSADVWAHQK

SEQ ID NO: 174918 - protein, 10 aa, Borrelia garinii PBi
SADVWAHQKY

SEQ ID NO: 174919 - protein, 10 aa, Borrelia garinii PBi
DVWAHQKYFK

SEQ ID NO: 174920 - protein, 10 aa, Borrelia garinii PBi
VWAHQKYFKL

SEQ ID NO: 174921 - protein, 10 aa, Borrelia garinii PBi
WAHQKYFKLR

SEQ ID NO: 174922 - protein, 10 aa, Borrelia garinii PBi
AHQKYFKLRF

SEQ ID NO: 174923 - protein, 10 aa, Borrelia garinii PBi
YFKLRFDASK

SEQ ID NO: 174924 - protein, 10 aa, Borrelia garinii PBi
KLRFDASKDK

SEQ ID NO: 174925 - protein, 10 aa, Borrelia garinii PBi
KVAGISPDYF

SEQ ID NO: 174926 - protein, 10 aa, Borrelia garinii PBi
GISPDYFLEQ

SEQ ID NO: 174927 - protein, 10 aa, Borrelia garinii PBi
DYFLEQEQAW

SEQ ID NO: 174928 - protein, 10 aa, Borrelia garinii PBi
QEQAWDSPAY

SEQ ID NO: 174929 - protein, 10 aa, Borrelia garinii PBi
QAWDSPAYSW

SEQ ID NO: 174930 - protein, 10 aa, Borrelia garinii PBi
WDSPAYSWNV

SEQ ID NO: 174931 - protein, 10 aa, Borrelia garinii PBi
SPAYSWNVLK

SEQ ID NO: 174932 - protein, 10 aa, Borrelia garinii PBi
AYSWNVLKNV

SEQ ID NO: 174933 - protein, 10 aa, Borrelia garinii PBi
YSWNVLKNVK

SEQ ID NO: 174934 - protein, 10 aa, Borrelia garinii PBi
SWNVLKNVKY

SEQ ID NO: 174935 - protein, 10 aa, Borrelia garinii PBi
KNVKYEWWAK

SEQ ID NO: 174936 - protein, 10 aa, Borrelia garinii PBi
NVKYEWWAKR

SEQ ID NO: 174937 - protein, 10 aa, Borrelia garinii PBi
YEWWAKRIGI

SEQ ID NO: 174938 - protein, 10 aa, Borrelia garinii PBi
WWAKRIGILR

SEQ ID NO: 174939 - protein, 10 aa, Borrelia garinii PBi
WAKRIGILRK

SEQ ID NO: 174940 - protein, 10 aa, Borrelia garinii PBi
KRIGILRKYI

SEQ ID NO: 174941 - protein, 10 aa, Borrelia garinii PBi
ILRKYIDVIK

SEQ ID NO: 174942 - protein, 10 aa, Borrelia garinii PBi
YIDVIKIDHF

SEQ ID NO: 174943 - protein, 10 aa, Borrelia garinii PBi
VIKIDHFRGF

SEQ ID NO: 174944 - protein, 10 aa, Borrelia garinii PBi
FRGFVSTWEV

SEQ ID NO: 174945 - protein, 10 aa, Borrelia garinii PBi
STWEVGVGEA

SEQ ID NO: 174946 - protein, 10 aa, Borrelia garinii PBi
WEVGVGEAYA

SEQ ID NO: 174947 - protein, 10 aa, Borrelia garinii PBi
EVGVGEAYAF

SEQ ID NO: 174948 - protein, 10 aa, Borrelia garinii PBi
GEAYAFNGLW

SEQ ID NO: 174949 - protein, 10 aa, Borrelia garinii PBi
EAYAFNGLWV

SEQ ID NO: 174950 - protein, 10 aa, Borrelia garinii PBi
AYAFNGLWVK

SEQ ID NO: 174951 - protein, 10 aa, Borrelia garinii PBi
LWVKSPGRDF

SEQ ID NO: 174952 - protein, 10 aa, Borrelia garinii PBi
WVKSPGRDFF

SEQ ID NO: 174953 - protein, 10 aa, Borrelia garinii PBi
KSPGRDFFNF

SEQ ID NO: 174954 - protein, 10 aa, Borrelia garinii PBi
SPGRDFFNFI

SEQ ID NO: 174955 - protein, 10 aa, Borrelia garinii PBi
DFFNFILNEI

SEQ ID NO: 174956 - protein, 10 aa, Borrelia garinii PBi
FFNFILNEIK

SEQ ID NO: 174957 - protein, 10 aa, Borrelia garinii PBi
NFILNEIKDL

SEQ ID NO: 174958 - protein, 10 aa, Borrelia garinii PBi
FILNEIKDLK

SEQ ID NO: 174959 - protein, 10 aa, Borrelia garinii PBi
ILNEIKDLKI

SEQ ID NO: 174960 - protein, 10 aa, Borrelia garinii PBi
NEIKDLKIWV

SEQ ID NO: 174961 - protein, 10 aa, Borrelia garinii PBi
IWVEDFENDL

SEQ ID NO: 174962 - protein, 10 aa, Borrelia garinii PBi
VSRLRDFFNF

SEQ ID NO: 174963 - protein, 10 aa, Borrelia garinii PBi
RLRDFFNFPG

SEQ ID NO: 174964 - protein, 10 aa, Borrelia garinii PBi
FNFPGMRIMK

SEQ ID NO: 174965 - protein, 10 aa, Borrelia garinii PBi
FPGMRIMKLA

SEQ ID NO: 174966 - protein, 10 aa, Borrelia garinii PBi
NQNLPHNYIK

SEQ ID NO: 174967 - protein, 10 aa, Borrelia garinii PBi
LPHNYIKNCI

SEQ ID NO: 174968 - protein, 10 aa, Borrelia garinii PBi
HNYIKNCIVY

SEQ ID NO: 174969 - protein, 10 aa, Borrelia garinii PBi
YTGIGDNSTI

SEQ ID NO: 174970 - protein, 10 aa, Borrelia garinii PBi
TGIGDNSTIR

SEQ ID NO: 174971 - protein, 10 aa, Borrelia garinii PBi
STIREFVNSL

SEQ ID NO: 174972 - protein, 10 aa, Borrelia garinii PBi
REFVNSLDDL

SEQ ID NO: 174973 - protein, 10 aa, Borrelia garinii PBi
FVNSLDDLHK

SEQ ID NO: 174974 - protein, 10 aa, Borrelia garinii PBi
SLDDLHKKYI

SEQ ID NO: 174975 - protein, 10 aa, Borrelia garinii PBi
DLHKKYIFDY

SEQ ID NO: 174976 - protein, 10 aa, Borrelia garinii PBi
YIFDYLNTNE

SEQ ID NO: 174977 - protein, 10 aa, Borrelia garinii PBi
YLNTNEDFVV

SEQ ID NO: 174978 - protein, 10 aa, Borrelia garinii PBi
EDFVVWDMIR

SEQ ID NO: 174979 - protein, 10 aa, Borrelia garinii PBi
FVVWDMIRSA

SEQ ID NO: 174980 - protein, 10 aa, Borrelia garinii PBi
VVWDMIRSAM

SEQ ID NO: 174981 - protein, 10 aa, Borrelia garinii PBi
DMIRSAMSSV

SEQ ID NO: 174982 - protein, 10 aa, Borrelia garinii PBi
SAMSSVSDSV

SEQ ID NO: 174983 - protein, 10 aa, Borrelia garinii PBi
AMSSVSDSVI

SEQ ID NO: 174984 - protein, 10 aa, Borrelia garinii PBi
SVSDSVIIPM

SEQ ID NO: 174985 - protein, 10 aa, Borrelia garinii PBi
DSVIIPMQDY

SEQ ID NO: 174986 - protein, 10 aa, Borrelia garinii PBi
SVIIPMQDYI

SEQ ID NO: 174987 - protein, 10 aa, Borrelia garinii PBi
IIPMQDYINL

SEQ ID NO: 174988 - protein, 10 aa, Borrelia garinii PBi
DYINLGNEFR

SEQ ID NO: 174989 - protein, 10 aa, Borrelia garinii PBi
YINLGNEFRA

SEQ ID NO: 174990 - protein, 10 aa, Borrelia garinii PBi
NLGNEFRANI

SEQ ID NO: 174991 - protein, 10 aa, Borrelia garinii PBi
FRANIPKNTL

SEQ ID NO: 174992 - protein, 10 aa, Borrelia garinii PBi
IPKNTLNNWI

SEQ ID NO: 174993 - protein, 10 aa, Borrelia garinii PBi
KNTLNNWIFR

SEQ ID NO: 174994 - protein, 10 aa, Borrelia garinii PBi
NTLNNWIFRL

SEQ ID NO: 174995 - protein, 10 aa, Borrelia garinii PBi
TLNNWIFRLL

SEQ ID NO: 174996 - protein, 10 aa, Borrelia garinii PBi
WIFRLLESDL

SEQ ID NO: 174997 - protein, 10 aa, Borrelia garinii PBi
RLLESDLDAT

SEQ ID NO: 174998 - protein, 10 aa, Borrelia garinii PBi
LLESDLDATL

SEQ ID NO: 174999 - protein, 10 aa, Borrelia garinii PBi
ESDLDATLSK

SEQ ID NO: 175000 - protein, 10 aa, Borrelia garinii PBi
DLDATLSKNI

SEQ ID NO: 175001 - protein, 10 aa, Borrelia garinii PBi
ATLSKNISFI

SEQ ID NO: 175002 - protein, 10 aa, Borrelia garinii PBi
TLSKNISFIT

SEQ ID NO: 175003 - protein, 10 aa, Borrelia garinii PBi
LSKNISFITR

SEQ ID NO: 175004 - protein, 10 aa, Borrelia garinii PBi
ISFITRLYGR

SEQ ID NO: 175005 - protein, 11 aa, Borrelia garinii PBi
KYKKIRINLNL

SEQ ID NO: 175006 - protein, 11 aa, Borrelia garinii PBi
KIRINLNLKRK

SEQ ID NO: 175007 - protein, 11 aa, Borrelia garinii PBi
NLNLKRKSGIL

SEQ ID NO: 175008 - protein, 11 aa, Borrelia garinii PBi
ILLNISSLPSK

SEQ ID NO: 175009 - protein, 11 aa, Borrelia garinii PBi
LLNISSLPSKY

SEQ ID NO: 175010 - protein, 11 aa, Borrelia garinii PBi
NISSLPSKYGI

SEQ ID NO: 175011 - protein, 11 aa, Borrelia garinii PBi
SLPSKYGIGDL

SEQ ID NO: 175012 - protein, 11 aa, Borrelia garinii PBi
YGIGDLGKGAY

SEQ ID NO: 175013 - protein, 11 aa, Borrelia garinii PBi
GIGDLGKGAYK

SEQ ID NO: 175014 - protein, 11 aa, Borrelia garinii PBi
KGAYKFIDFLF

SEQ ID NO: 175015 - protein, 11 aa, Borrelia garinii PBi
IDFLFASSQSY

SEQ ID NO: 175016 - protein, 11 aa, Borrelia garinii PBi
DFLFASSQSYW

SEQ ID NO: 175017 - protein, 11 aa, Borrelia garinii PBi
FLFASSQSYWQ

SEQ ID NO: 175018 - protein, 11 aa, Borrelia garinii PBi
FASSQSYWQMF

SEQ ID NO: 175019 - protein, 11 aa, Borrelia garinii PBi
SSQSYWQMFAY

SEQ ID NO: 175020 - protein, 11 aa, Borrelia garinii PBi
SQSYWQMFAYS

SEQ ID NO: 175021 - protein, 11 aa, Borrelia garinii PBi
SYWQMFAYSPI

SEQ ID NO: 175022 - protein, 11 aa, Borrelia garinii PBi
WQMFAYSPIDF

SEQ ID NO: 175023 - protein, 11 aa, Borrelia garinii PBi
QMFAYSPIDFT

SEQ ID NO: 175024 - protein, 11 aa, Borrelia garinii PBi
MFAYSPIDFTR

SEQ ID NO: 175025 - protein, 11 aa, Borrelia garinii PBi
SPIDFTRSPPY

SEQ ID NO: 175026 - protein, 11 aa, Borrelia garinii PBi
DFTRSPPYSIF

SEQ ID NO: 175027 - protein, 11 aa, Borrelia garinii PBi
TRSPPYSIFSA

SEQ ID NO: 175028 - protein, 11 aa, Borrelia garinii PBi
RSPPYSIFSAF

SEQ ID NO: 175029 - protein, 11 aa, Borrelia garinii PBi
YSIFSAFAGNV

SEQ ID NO: 175030 - protein, 11 aa, Borrelia garinii PBi
SIFSAFAGNVY

SEQ ID NO: 175031 - protein, 11 aa, Borrelia garinii PBi
IFSAFAGNVYY

SEQ ID NO: 175032 - protein, 11 aa, Borrelia garinii PBi
FSAFAGNVYYI

SEQ ID NO: 175033 - protein, 11 aa, Borrelia garinii PBi
AFAGNVYYIDL

SEQ ID NO: 175034 - protein, 11 aa, Borrelia garinii PBi
VYYIDLEALDK

SEQ ID NO: 175035 - protein, 11 aa, Borrelia garinii PBi
YYIDLEALDKF

SEQ ID NO: 175036 - protein, 11 aa, Borrelia garinii PBi
YIDLEALDKFI

SEQ ID NO: 175037 - protein, 11 aa, Borrelia garinii PBi
KFIDSDLNLLK

SEQ ID NO: 175038 - protein, 11 aa, Borrelia garinii PBi
DLNLLKENETR

SEQ ID NO: 175039 - protein, 11 aa, Borrelia garinii PBi
KENETRYSDLK

SEQ ID NO: 175040 - protein, 11 aa, Borrelia garinii PBi
NETRYSDLKKL

SEQ ID NO: 175041 - protein, 11 aa, Borrelia garinii PBi
TRYSDLKKLSF

SEQ ID NO: 175042 - protein, 11 aa, Borrelia garinii PBi
RYSDLKKLSFK

SEQ ID NO: 175043 - protein, 11 aa, Borrelia garinii PBi
KKLSFKDKFLK

SEQ ID NO: 175044 - protein, 11 aa, Borrelia garinii PBi
FKDKFLKEAAL

SEQ ID NO: 175045 - protein, 11 aa, Borrelia garinii PBi
KFLKEAALNFI

SEQ ID NO: 175046 - protein, 11 aa, Borrelia garinii PBi
EAALNFINRAS

SEQ ID NO: 175047 - protein, 11 aa, Borrelia garinii PBi
AALNFINRASV

SEQ ID NO: 175048 - protein, 11 aa, Borrelia garinii PBi
FINRASVDEVR

SEQ ID NO: 175049 - protein, 11 aa, Borrelia garinii PBi
ASVDEVRSFEK

SEQ ID NO: 175050 - protein, 11 aa, Borrelia garinii PBi
SVDEVRSFEKF

SEQ ID NO: 175051 - protein, 11 aa, Borrelia garinii PBi
EVRSFEKFKKK

SEQ ID NO: 175052 - protein, 11 aa, Borrelia garinii PBi
KFKKKSSYWLL

SEQ ID NO: 175053 - protein, 11 aa, Borrelia garinii PBi
SSYWLLDFASF

SEQ ID NO: 175054 - protein, 11 aa, Borrelia garinii PBi
SYWLLDFASFV

SEQ ID NO: 175055 - protein, 11 aa, Borrelia garinii PBi
WLLDFASFVAF

SEQ ID NO: 175056 - protein, 11 aa, Borrelia garinii PBi
LLDFASFVAFK

SEQ ID NO: 175057 - protein, 11 aa, Borrelia garinii PBi
DFASFVAFKEY

SEQ ID NO: 175058 - protein, 11 aa, Borrelia garinii PBi
FASFVAFKEYF

SEQ ID NO: 175059 - protein, 11 aa, Borrelia garinii PBi
SFVAFKEYFLK

SEQ ID NO: 175060 - protein, 11 aa, Borrelia garinii PBi
AFKEYFLKDSR

SEQ ID NO: 175061 - protein, 11 aa, Borrelia garinii PBi
EYFLKDSRDAF

SEQ ID NO: 175062 - protein, 11 aa, Borrelia garinii PBi
FLKDSRDAFNV

SEQ ID NO: 175063 - protein, 11 aa, Borrelia garinii PBi
DAFNVLFDRGI

SEQ ID NO: 175064 - protein, 11 aa, Borrelia garinii PBi
NVLFDRGILIR

SEQ ID NO: 175065 - protein, 11 aa, Borrelia garinii PBi
VLFDRGILIRN

SEQ ID NO: 175066 - protein, 11 aa, Borrelia garinii PBi
ILIRNEKDLFK

SEQ ID NO: 175067 - protein, 11 aa, Borrelia garinii PBi
EKDLFKLRNIL

SEQ ID NO: 175068 - protein, 11 aa, Borrelia garinii PBi
DLFKLRNILSK

SEQ ID NO: 175069 - protein, 11 aa, Borrelia garinii PBi
KLRNILSKEIK

SEQ ID NO: 175070 - protein, 11 aa, Borrelia garinii PBi
ILSKEIKVQEV

SEQ ID NO: 175071 - protein, 11 aa, Borrelia garinii PBi
KEIKVQEVLQY

SEQ ID NO: 175072 - protein, 11 aa, Borrelia garinii PBi
EIKVQEVLQYF

SEQ ID NO: 175073 - protein, 11 aa, Borrelia garinii PBi
KVQEVLQYFFF

SEQ ID NO: 175074 - protein, 11 aa, Borrelia garinii PBi
EVLQYFFFSQF

SEQ ID NO: 175075 - protein, 11 aa, Borrelia garinii PBi
VLQYFFFSQFQ

SEQ ID NO: 175076 - protein, 11 aa, Borrelia garinii PBi
LQYFFFSQFQA

SEQ ID NO: 175077 - protein, 11 aa, Borrelia garinii PBi
QYFFFSQFQAL

SEQ ID NO: 175078 - protein, 11 aa, Borrelia garinii PBi
YFFFSQFQALK

SEQ ID NO: 175079 - protein, 11 aa, Borrelia garinii PBi
FFFSQFQALKR

SEQ ID NO: 175080 - protein, 11 aa, Borrelia garinii PBi
FFSQFQALKRY

SEQ ID NO: 175081 - protein, 11 aa, Borrelia garinii PBi
ALKRYANDKGI

SEQ ID NO: 175082 - protein, 11 aa, Borrelia garinii PBi
KRYANDKGIEL

SEQ ID NO: 175083 - protein, 11 aa, Borrelia garinii PBi
RYANDKGIELV

SEQ ID NO: 175084 - protein, 11 aa, Borrelia garinii PBi
YANDKGIELVM

SEQ ID NO: 175085 - protein, 11 aa, Borrelia garinii PBi
IELVMNLPLFI

SEQ ID NO: 175086 - protein, 11 aa, Borrelia garinii PBi
ELVMNLPLFIA

SEQ ID NO: 175087 - protein, 11 aa, Borrelia garinii PBi
LVMNLPLFIAY

SEQ ID NO: 175088 - protein, 11 aa, Borrelia garinii PBi
NLPLFIAYDSA

SEQ ID NO: 175089 - protein, 11 aa, Borrelia garinii PBi
LPLFIAYDSAD

SEQ ID NO: 175090 - protein, 11 aa, Borrelia garinii PBi
PLFIAYDSADV

SEQ ID NO: 175091 - protein, 11 aa, Borrelia garinii PBi
LFIAYDSADVW

SEQ ID NO: 175092 - protein, 11 aa, Borrelia garinii PBi
FIAYDSADVWA

SEQ ID NO: 175093 - protein, 11 aa, Borrelia garinii PBi
IAYDSADVWAH

SEQ ID NO: 175094 - protein, 11 aa, Borrelia garinii PBi
DSADVWAHQKY

SEQ ID NO: 175095 - protein, 11 aa, Borrelia garinii PBi
DVWAHQKYFKL

SEQ ID NO: 175096 - protein, 11 aa, Borrelia garinii PBi
VWAHQKYFKLR

SEQ ID NO: 175097 - protein, 11 aa, Borrelia garinii PBi
WAHQKYFKLRF

SEQ ID NO: 175098 - protein, 11 aa, Borrelia garinii PBi
KYFKLRFDASK

SEQ ID NO: 175099 - protein, 11 aa, Borrelia garinii PBi
KLRFDASKDKV

SEQ ID NO: 175100 - protein, 11 aa, Borrelia garinii PBi
KVAGISPDYFL

SEQ ID NO: 175101 - protein, 11 aa, Borrelia garinii PBi
EQEQAWDSPAY

SEQ ID NO: 175102 - protein, 11 aa, Borrelia garinii PBi
AWDSPAYSWNV

SEQ ID NO: 175103 - protein, 11 aa, Borrelia garinii PBi
DSPAYSWNVLK

SEQ ID NO: 175104 - protein, 11 aa, Borrelia garinii PBi
PAYSWNVLKNV

SEQ ID NO: 175105 - protein, 11 aa, Borrelia garinii PBi
AYSWNVLKNVK

SEQ ID NO: 175106 - protein, 11 aa, Borrelia garinii PBi
YSWNVLKNVKY

SEQ ID NO: 175107 - protein, 11 aa, Borrelia garinii PBi
VLKNVKYEWWA

SEQ ID NO: 175108 - protein, 11 aa, Borrelia garinii PBi
KNVKYEWWAKR

SEQ ID NO: 175109 - protein, 11 aa, Borrelia garinii PBi
KYEWWAKRIGI

SEQ ID NO: 175110 - protein, 11 aa, Borrelia garinii PBi
YEWWAKRIGIL

SEQ ID NO: 175111 - protein, 11 aa, Borrelia garinii PBi
EWWAKRIGILR

SEQ ID NO: 175112 - protein, 11 aa, Borrelia garinii PBi
WWAKRIGILRK

SEQ ID NO: 175113 - protein, 11 aa, Borrelia garinii PBi
RIGILRKYIDV

SEQ ID NO: 175114 - protein, 11 aa, Borrelia garinii PBi
GILRKYIDVIK

SEQ ID NO: 175115 - protein, 11 aa, Borrelia garinii PBi
ILRKYIDVIKI

SEQ ID NO: 175116 - protein, 11 aa, Borrelia garinii PBi
KYIDVIKIDHF

SEQ ID NO: 175117 - protein, 11 aa, Borrelia garinii PBi
YIDVIKIDHFR

SEQ ID NO: 175118 - protein, 11 aa, Borrelia garinii PBi
DVIKIDHFRGF

SEQ ID NO: 175119 - protein, 11 aa, Borrelia garinii PBi
VIKIDHFRGFV

SEQ ID NO: 175120 - protein, 11 aa, Borrelia garinii PBi
KIDHFRGFVST

SEQ ID NO: 175121 - protein, 11 aa, Borrelia garinii PBi
HFRGFVSTWEV

SEQ ID NO: 175122 - protein, 11 aa, Borrelia garinii PBi
STWEVGVGEAY

SEQ ID NO: 175123 - protein, 11 aa, Borrelia garinii PBi
WEVGVGEAYAF

SEQ ID NO: 175124 - protein, 11 aa, Borrelia garinii PBi
GVGEAYAFNGL

SEQ ID NO: 175125 - protein, 11 aa, Borrelia garinii PBi
GEAYAFNGLWV

SEQ ID NO: 175126 - protein, 11 aa, Borrelia garinii PBi
EAYAFNGLWVK

SEQ ID NO: 175127 - protein, 11 aa, Borrelia garinii PBi
LWVKSPGRDFF

SEQ ID NO: 175128 - protein, 11 aa, Borrelia garinii PBi
SPGRDFFNFIL

SEQ ID NO: 175129 - protein, 11 aa, Borrelia garinii PBi
DFFNFILNEIK

SEQ ID NO: 175130 - protein, 11 aa, Borrelia garinii PBi
NFILNEIKDLK

SEQ ID NO: 175131 - protein, 11 aa, Borrelia garinii PBi
FILNEIKDLKI

SEQ ID NO: 175132 - protein, 11 aa, Borrelia garinii PBi
ILNEIKDLKIW

SEQ ID NO: 175133 - protein, 11 aa, Borrelia garinii PBi
KIWVEDFENDL

SEQ ID NO: 175134 - protein, 11 aa, Borrelia garinii PBi
DFENDLEDVSR

SEQ ID NO: 175135 - protein, 11 aa, Borrelia garinii PBi
FENDLEDVSRL

SEQ ID NO: 175136 - protein, 11 aa, Borrelia garinii PBi
DVSRLRDFFNF

SEQ ID NO: 175137 - protein, 11 aa, Borrelia garinii PBi
RLRDFFNFPGM

SEQ ID NO: 175138 - protein, 11 aa, Borrelia garinii PBi
DFFNFPGMRIM

SEQ ID NO: 175139 - protein, 11 aa, Borrelia garinii PBi
FFNFPGMRIMK

SEQ ID NO: 175140 - protein, 11 aa, Borrelia garinii PBi
FPGMRIMKLAF

SEQ ID NO: 175141 - protein, 11 aa, Borrelia garinii PBi
GMRIMKLAFDF

SEQ ID NO: 175142 - protein, 11 aa, Borrelia garinii PBi
KLAFDFDSDNQ

SEQ ID NO: 175143 - protein, 11 aa, Borrelia garinii PBi
DSDNQNLPHNY

SEQ ID NO: 175144 - protein, 11 aa, Borrelia garinii PBi
NLPHNYIKNCI

SEQ ID NO: 175145 - protein, 11 aa, Borrelia garinii PBi
LPHNYIKNCIV

SEQ ID NO: 175146 - protein, 11 aa, Borrelia garinii PBi
YIKNCIVYTGI

SEQ ID NO: 175147 - protein, 11 aa, Borrelia garinii PBi
VYTGIGDNSTI

SEQ ID NO: 175148 - protein, 11 aa, Borrelia garinii PBi
YTGIGDNSTIR

SEQ ID NO: 175149 - protein, 11 aa, Borrelia garinii PBi
IGDNSTIREFV

SEQ ID NO: 175150 - protein, 11 aa, Borrelia garinii PBi
EFVNSLDDLHK

SEQ ID NO: 175151 - protein, 11 aa, Borrelia garinii PBi
FVNSLDDLHKK

SEQ ID NO: 175152 - protein, 11 aa, Borrelia garinii PBi
SLDDLHKKYIF

SEQ ID NO: 175153 - protein, 11 aa, Borrelia garinii PBi
DLHKKYIFDYL

SEQ ID NO: 175154 - protein, 11 aa, Borrelia garinii PBi
YIFDYLNTNED

SEQ ID NO: 175155 - protein, 11 aa, Borrelia garinii PBi
IFDYLNTNEDF

SEQ ID NO: 175156 - protein, 11 aa, Borrelia garinii PBi
FDYLNTNEDFV

SEQ ID NO: 175157 - protein, 11 aa, Borrelia garinii PBi
DYLNTNEDFVV

SEQ ID NO: 175158 - protein, 11 aa, Borrelia garinii PBi
YLNTNEDFVVW

SEQ ID NO: 175159 - protein, 11 aa, Borrelia garinii PBi
NTNEDFVVWDM

SEQ ID NO: 175160 - protein, 11 aa, Borrelia garinii PBi
FVVWDMIRSAM

SEQ ID NO: 175161 - protein, 11 aa, Borrelia garinii PBi
WDMIRSAMSSV

SEQ ID NO: 175162 - protein, 11 aa, Borrelia garinii PBi
RSAMSSVSDSV

SEQ ID NO: 175163 - protein, 11 aa, Borrelia garinii PBi
SAMSSVSDSVI

SEQ ID NO: 175164 - protein, 11 aa, Borrelia garinii PBi
AMSSVSDSVII

SEQ ID NO: 175165 - protein, 11 aa, Borrelia garinii PBi
SSVSDSVIIPM

SEQ ID NO: 175166 - protein, 11 aa, Borrelia garinii PBi
SVSDSVIIPMQ

SEQ ID NO: 175167 - protein, 11 aa, Borrelia garinii PBi
DSVIIPMQDYI

SEQ ID NO: 175168 - protein, 11 aa, Borrelia garinii PBi
VIIPMQDYINL

SEQ ID NO: 175169 - protein, 11 aa, Borrelia garinii PBi
MQDYINLGNEF

SEQ ID NO: 175170 - protein, 11 aa, Borrelia garinii PBi
QDYINLGNEFR

SEQ ID NO: 175171 - protein, 11 aa, Borrelia garinii PBi
LGNEFRANIPK

SEQ ID NO: 175172 - protein, 11 aa, Borrelia garinii PBi
NIPKNTLNNWI

SEQ ID NO: 175173 - protein, 11 aa, Borrelia garinii PBi
IPKNTLNNWIF

SEQ ID NO: 175174 - protein, 11 aa, Borrelia garinii PBi
NTLNNWIFRLL

SEQ ID NO: 175175 - protein, 11 aa, Borrelia garinii PBi
TLNNWIFRLLE

SEQ ID NO: 175176 - protein, 11 aa, Borrelia garinii PBi
NWIFRLLESDL

SEQ ID NO: 175177 - protein, 11 aa, Borrelia garinii PBi
RLLESDLDATL

SEQ ID NO: 175178 - protein, 11 aa, Borrelia garinii PBi
DATLSKNISFI

SEQ ID NO: 175179 - protein, 11 aa, Borrelia garinii PBi
TLSKNISFITR

SEQ ID NO: 175180 - protein, 11 aa, Borrelia garinii PBi
NISFITRLYGR

SEQ ID NO: 175181 - protein, 15 aa, Borrelia garinii PBi
AFDFDSDNQNLPHNY

SEQ ID NO: 175182 - protein, 9 aa, Borrelia garinii PBi
FDSDNQNLP

SEQ ID NO: 175183 - protein, 15 aa, Borrelia garinii PBi
AFKEYFLKDSRDAFN

SEQ ID NO: 175184 - protein, 9 aa, Borrelia garinii PBi
FLKDSRDAF

SEQ ID NO: 175185 - protein, 15 aa, Borrelia garinii PBi
AFKEYFLKDSRDAFN

SEQ ID NO: 175186 - protein, 9 aa, Borrelia garinii PBi
YFLKDSRDA

SEQ ID NO: 175187 - protein, 15 aa, Borrelia garinii PBi
AFNGLWVKSPGRDFF

SEQ ID NO: 175188 - protein, 9 aa, Borrelia garinii PBi
FNGLWVKSP

SEQ ID NO: 175189 - protein, 15 aa, Borrelia garinii PBi
AFNVLFDRGILIRNE

SEQ ID NO: 175190 - protein, 9 aa, Borrelia garinii PBi
FDRGILIRN

SEQ ID NO: 175191 - protein, 15 aa, Borrelia garinii PBi
AFNVLFDRGILIRNE

SEQ ID NO: 175192 - protein, 9 aa, Borrelia garinii PBi
VLFDRGILI

SEQ ID NO: 175193 - protein, 15 aa, Borrelia garinii PBi
AGNVYYIDLEALDKF

SEQ ID NO: 175194 - protein, 9 aa, Borrelia garinii PBi
YYIDLEALD

SEQ ID NO: 175195 - protein, 15 aa, Borrelia garinii PBi
AHQKYFKLRFDASKD

SEQ ID NO: 175196 - protein, 9 aa, Borrelia garinii PBi
FKLRFDASK

SEQ ID NO: 175197 - protein, 15 aa, Borrelia garinii PBi
AKRIGILRKYIDVIK

SEQ ID NO: 175198 - protein, 9 aa, Borrelia garinii PBi
AKRIGILRK

SEQ ID NO: 175199 - protein, 15 aa, Borrelia garinii PBi
AKRIGILRKYIDVIK

SEQ ID NO: 175200 - protein, 9 aa, Borrelia garinii PBi
IGILRKYID

SEQ ID NO: 175201 - protein, 15 aa, Borrelia garinii PBi
AKRIGILRKYIDVIK

SEQ ID NO: 175202 - protein, 9 aa, Borrelia garinii PBi
ILRKYIDVI

SEQ ID NO: 175203 - protein, 15 aa, Borrelia garinii PBi
ALDKFIDSDLNLLKE

SEQ ID NO: 175204 - protein, 9 aa, Borrelia garinii PBi
FIDSDLNLL

SEQ ID NO: 175205 - protein, 15 aa, Borrelia garinii PBi
ALNFINRASVDEVRS

SEQ ID NO: 175206 - protein, 9 aa, Borrelia garinii PBi
FINRASVDE

SEQ ID NO: 175207 - protein, 15 aa, Borrelia garinii PBi
ANIPKNTLNNWIFRL

SEQ ID NO: 175208 - protein, 9 aa, Borrelia garinii PBi
PKNTLNNWI

SEQ ID NO: 175209 - protein, 15 aa, Borrelia garinii PBi
ASSQSYWQMFAYSPI

SEQ ID NO: 175210 - protein, 9 aa, Borrelia garinii PBi
YWQMFAYSP

SEQ ID NO: 175211 - protein, 15 aa, Borrelia garinii PBi
ATLSKNISFITRLYG

SEQ ID NO: 175212 - protein, 9 aa, Borrelia garinii PBi
LSKNISFIT

SEQ ID NO: 175213 - protein, 15 aa, Borrelia garinii PBi
AWDSPAYSWNVLKNV

SEQ ID NO: 175214 - protein, 9 aa, Borrelia garinii PBi
DSPAYSWNV

SEQ ID NO: 175215 - protein, 15 aa, Borrelia garinii PBi
AYAFNGLWVKSPGRD

SEQ ID NO: 175216 - protein, 9 aa, Borrelia garinii PBi
FNGLWVKSP

SEQ ID NO: 175217 - protein, 15 aa, Borrelia garinii PBi
AYAFNGLWVKSPGRD

SEQ ID NO: 175218 - protein, 9 aa, Borrelia garinii PBi
GLWVKSPGR

SEQ ID NO: 175219 - protein, 15 aa, Borrelia garinii PBi
AYKFIDFLFASSQSY

SEQ ID NO: 175220 - protein, 9 aa, Borrelia garinii PBi
FIDFLFASS

SEQ ID NO: 175221 - protein, 15 aa, Borrelia garinii PBi
AYKFIDFLFASSQSY

SEQ ID NO: 175222 - protein, 9 aa, Borrelia garinii PBi
IDFLFASSQ

SEQ ID NO: 175223 - protein, 15 aa, Borrelia garinii PBi
AYSPIDFTRSPPYSI

SEQ ID NO: 175224 - protein, 9 aa, Borrelia garinii PBi
IDFTRSPPY

SEQ ID NO: 175225 - protein, 15 aa, Borrelia garinii PBi
AYSPIDFTRSPPYSI

SEQ ID NO: 175226 - protein, 9 aa, Borrelia garinii PBi
YSPIDFTRS

SEQ ID NO: 175227 - protein, 15 aa, Borrelia garinii PBi
AYSWNVLKNVKYEWW

SEQ ID NO: 175228 - protein, 9 aa, Borrelia garinii PBi
WNVLKNVKY

SEQ ID NO: 175229 - protein, 15 aa, Borrelia garinii PBi
CIVYTGIGDNSTIRE

SEQ ID NO: 175230 - protein, 9 aa, Borrelia garinii PBi
VYTGIGDNS

SEQ ID NO: 175231 - protein, 15 aa, Borrelia garinii PBi
CIVYTGIGDNSTIRE

SEQ ID NO: 175232 - protein, 9 aa, Borrelia garinii PBi
YTGIGDNST

SEQ ID NO: 175233 - protein, 15 aa, Borrelia garinii PBi
DAFNVLFDRGILIRN

SEQ ID NO: 175234 - protein, 9 aa, Borrelia garinii PBi
FNVLFDRGI

SEQ ID NO: 175235 - protein, 15 aa, Borrelia garinii PBi
DATLSKNISFITRLY

SEQ ID NO: 175236 - protein, 9 aa, Borrelia garinii PBi
LSKNISFIT

SEQ ID NO: 175237 - protein, 15 aa, Borrelia garinii PBi
DDLHKKYIFDYLNTN

SEQ ID NO: 175238 - protein, 9 aa, Borrelia garinii PBi
DDLHKKYIF

SEQ ID NO: 175239 - protein, 15 aa, Borrelia garinii PBi
DFDSDNQNLPHNYIK

SEQ ID NO: 175240 - protein, 9 aa, Borrelia garinii PBi
FDSDNQNLP

SEQ ID NO: 175241 - protein, 15 aa, Borrelia garinii PBi
DFFNFILNEIKDLKI

SEQ ID NO: 175242 - protein, 9 aa, Borrelia garinii PBi
ILNEIKDLK

SEQ ID NO: 175243 - protein, 15 aa, Borrelia garinii PBi
DFFNFPGMRIMKLAF

SEQ ID NO: 175244 - protein, 9 aa, Borrelia garinii PBi
FPGMRIMKL

SEQ ID NO: 175245 - protein, 15 aa, Borrelia garinii PBi
DFLFASSQSYWQMFA

SEQ ID NO: 175246 - protein, 9 aa, Borrelia garinii PBi
FASSQSYWQ

SEQ ID NO: 175247 - protein, 15 aa, Borrelia garinii PBi
DFLFASSQSYWQMFA

SEQ ID NO: 175248 - protein, 9 aa, Borrelia garinii PBi
LFASSQSYW

SEQ ID NO: 175249 - protein, 15 aa, Borrelia garinii PBi
DFTRSPPYSIFSAFA

SEQ ID NO: 175250 - protein, 9 aa, Borrelia garinii PBi
FTRSPPYSI

SEQ ID NO: 175251 - protein, 15 aa, Borrelia garinii PBi
DFVVWDMIRSAMSSV

SEQ ID NO: 175252 - protein, 9 aa, Borrelia garinii PBi
FVVWDMIRS

SEQ ID NO: 175253 - protein, 15 aa, Borrelia garinii PBi
DFVVWDMIRSAMSSV

SEQ ID NO: 175254 - protein, 9 aa, Borrelia garinii PBi
WDMIRSAMS

SEQ ID NO: 175255 - protein, 15 aa, Borrelia garinii PBi
DHFRGFVSTWEVGVG

SEQ ID NO: 175256 - protein, 9 aa, Borrelia garinii PBi
FRGFVSTWE

SEQ ID NO: 175257 - protein, 15 aa, Borrelia garinii PBi
DKFLKEAALNFINRA

SEQ ID NO: 175258 - protein, 9 aa, Borrelia garinii PBi
LKEAALNFI

SEQ ID NO: 175259 - protein, 15 aa, Borrelia garinii PBi
DKGIELVMNLPLFIA

SEQ ID NO: 175260 - protein, 9 aa, Borrelia garinii PBi
LVMNLPLFI

SEQ ID NO: 175261 - protein, 15 aa, Borrelia garinii PBi
DLDATLSKNISFITR

SEQ ID NO: 175262 - protein, 9 aa, Borrelia garinii PBi
LSKNISFIT

SEQ ID NO: 175263 - protein, 15 aa, Borrelia garinii PBi
DLEALDKFIDSDLNL

SEQ ID NO: 175264 - protein, 9 aa, Borrelia garinii PBi
LEALDKFID

SEQ ID NO: 175265 - protein, 15 aa, Borrelia garinii PBi
DLFKLRNILSKEIKV

SEQ ID NO: 175266 - protein, 9 aa, Borrelia garinii PBi
FKLRNILSK

SEQ ID NO: 175267 - protein, 15 aa, Borrelia garinii PBi
DLFKLRNILSKEIKV

SEQ ID NO: 175268 - protein, 9 aa, Borrelia garinii PBi
LFKLRNILS

SEQ ID NO: 175269 - protein, 15 aa, Borrelia garinii PBi
DLFKLRNILSKEIKV

SEQ ID NO: 175270 - protein, 9 aa, Borrelia garinii PBi
LRNILSKEI

SEQ ID NO: 175271 - protein, 15 aa, Borrelia garinii PBi
DLHKKYIFDYLNTNE

SEQ ID NO: 175272 - protein, 9 aa, Borrelia garinii PBi
YIFDYLNTN

SEQ ID NO: 175273 - protein, 15 aa, Borrelia garinii PBi
DLNLLKENETRYSDL

SEQ ID NO: 175274 - protein, 9 aa, Borrelia garinii PBi
LKENETRYS

SEQ ID NO: 175275 - protein, 15 aa, Borrelia garinii PBi
DMIRSAMSSVSDSVI

SEQ ID NO: 175276 - protein, 9 aa, Borrelia garinii PBi
IRSAMSSVS

SEQ ID NO: 175277 - protein, 15 aa, Borrelia garinii PBi
DNSTIREFVNSLDDL

SEQ ID NO: 175278 - protein, 9 aa, Borrelia garinii PBi
IREFVNSLD

SEQ ID NO: 175279 - protein, 15 aa, Borrelia garinii PBi
DRGILIRNEKDLFKL

SEQ ID NO: 175280 - protein, 9 aa, Borrelia garinii PBi
LIRNEKDLF

SEQ ID NO: 175281 - protein, 15 aa, Borrelia garinii PBi
DSDLNLLKENETRYS

SEQ ID NO: 175282 - protein, 9 aa, Borrelia garinii PBi
LNLLKENET

SEQ ID NO: 175283 - protein, 15 aa, Borrelia garinii PBi
DSPAYSWNVLKNVKY

SEQ ID NO: 175284 - protein, 9 aa, Borrelia garinii PBi
AYSWNVLKN

SEQ ID NO: 175285 - protein, 15 aa, Borrelia garinii PBi
DSPAYSWNVLKNVKY

SEQ ID NO: 175286 - protein, 9 aa, Borrelia garinii PBi
SWNVLKNVK

SEQ ID NO: 175287 - protein, 15 aa, Borrelia garinii PBi
DSPAYSWNVLKNVKY

SEQ ID NO: 175288 - protein, 9 aa, Borrelia garinii PBi
YSWNVLKNV

SEQ ID NO: 175289 - protein, 15 aa, Borrelia garinii PBi
DVWAHQKYFKLRFDA

SEQ ID NO: 175290 - protein, 9 aa, Borrelia garinii PBi
WAHQKYFKL

SEQ ID NO: 175291 - protein, 15 aa, Borrelia garinii PBi
DYFLEQEQAWDSPAY

SEQ ID NO: 175292 - protein, 9 aa, Borrelia garinii PBi
YFLEQEQAW

SEQ ID NO: 175293 - protein, 15 aa, Borrelia garinii PBi
EAYAFNGLWVKSPGR

SEQ ID NO: 175294 - protein, 9 aa, Borrelia garinii PBi
FNGLWVKSP

SEQ ID NO: 175295 - protein, 15 aa, Borrelia garinii PBi
EAYAFNGLWVKSPGR

SEQ ID NO: 175296 - protein, 9 aa, Borrelia garinii PBi
YAFNGLWVK

SEQ ID NO: 175297 - protein, 15 aa, Borrelia garinii PBi
EDFENDLEDVSRLRD

SEQ ID NO: 175298 - protein, 9 aa, Borrelia garinii PBi
FENDLEDVS

SEQ ID NO: 175299 - protein, 15 aa, Borrelia garinii PBi
EDFVVWDMIRSAMSS

SEQ ID NO: 175300 - protein, 9 aa, Borrelia garinii PBi
FVVWDMIRS

SEQ ID NO: 175301 - protein, 15 aa, Borrelia garinii PBi
EDFVVWDMIRSAMSS

SEQ ID NO: 175302 - protein, 9 aa, Borrelia garinii PBi
WDMIRSAMS

SEQ ID NO: 175303 - protein, 15 aa, Borrelia garinii PBi
EFRANIPKNTLNNWI

SEQ ID NO: 175304 - protein, 9 aa, Borrelia garinii PBi
FRANIPKNT

SEQ ID NO: 175305 - protein, 15 aa, Borrelia garinii PBi
EKDLFKLRNILSKEI

SEQ ID NO: 175306 - protein, 9 aa, Borrelia garinii PBi
LFKLRNILS

SEQ ID NO: 175307 - protein, 15 aa, Borrelia garinii PBi
EKFKKKSSYWLLDFA

SEQ ID NO: 175308 - protein, 9 aa, Borrelia garinii PBi
FKKKSSYWL

SEQ ID NO: 175309 - protein, 15 aa, Borrelia garinii PBi
ELVMNLPLFIAYDSA

SEQ ID NO: 175310 - protein, 9 aa, Borrelia garinii PBi
VMNLPLFIA

SEQ ID NO: 175311 - protein, 15 aa, Borrelia garinii PBi
ENETRYSDLKKLSFK

SEQ ID NO: 175312 - protein, 9 aa, Borrelia garinii PBi
RYSDLKKLS

SEQ ID NO: 175313 - protein, 15 aa, Borrelia garinii PBi
ETRYSDLKKLSFKDK

SEQ ID NO: 175314 - protein, 9 aa, Borrelia garinii PBi
RYSDLKKLS

SEQ ID NO: 175315 - protein, 15 aa, Borrelia garinii PBi
EVLQYFFFSQFQALK

SEQ ID NO: 175316 - protein, 9 aa, Borrelia garinii PBi
YFFFSQFQA

SEQ ID NO: 175317 - protein, 15 aa, Borrelia garinii PBi
EVRSFEKFKKKSSYW

SEQ ID NO: 175318 - protein, 9 aa, Borrelia garinii PBi
FEKFKKKSS

SEQ ID NO: 175319 - protein, 15 aa, Borrelia garinii PBi
EWWAKRIGILRKYID

SEQ ID NO: 175320 - protein, 9 aa, Borrelia garinii PBi
WAKRIGILR

SEQ ID NO: 175321 - protein, 15 aa, Borrelia garinii PBi
EYFLKDSRDAFNVLF

SEQ ID NO: 175322 - protein, 9 aa, Borrelia garinii PBi
FLKDSRDAF

SEQ ID NO: 175323 - protein, 15 aa, Borrelia garinii PBi
EAALNFINRASVDEV

SEQ ID NO: 175324 - protein, 9 aa, Borrelia garinii PBi
ALNFINRAS

SEQ ID NO: 175325 - protein, 15 aa, Borrelia garinii PBi
EAALNFINRASVDEV

SEQ ID NO: 175326 - protein, 9 aa, Borrelia garinii PBi
FINRASVDE

SEQ ID NO: 175327 - protein, 15 aa, Borrelia garinii PBi
FASSQSYWQMFAYSP

SEQ ID NO: 175328 - protein, 9 aa, Borrelia garinii PBi
FASSQSYWQ

SEQ ID NO: 175329 - protein, 15 aa, Borrelia garinii PBi
FAYSPIDFTRSPPYS

SEQ ID NO: 175330 - protein, 9 aa, Borrelia garinii PBi
YSPIDFTRS

SEQ ID NO: 175331 - protein, 15 aa, Borrelia garinii PBi
FDASKDKVAGISPDY

SEQ ID NO: 175332 - protein, 9 aa, Borrelia garinii PBi
FDASKDKVA

SEQ ID NO: 175333 - protein, 15 aa, Borrelia garinii PBi
FDFDSDNQNLPHNYI

SEQ ID NO: 175334 - protein, 9 aa, Borrelia garinii PBi
FDSDNQNLP

SEQ ID NO: 175335 - protein, 15 aa, Borrelia garinii PBi
FDRGILIRNEKDLFK

SEQ ID NO: 175336 - protein, 9 aa, Borrelia garinii PBi
RGILIRNEK

SEQ ID NO: 175337 - protein, 15 aa, Borrelia garinii PBi
FDYLNTNEDFVVWDM

SEQ ID NO: 175338 - protein, 9 aa, Borrelia garinii PBi
FDYLNTNED

SEQ ID NO: 175339 - protein, 15 aa, Borrelia garinii PBi
FDYLNTNEDFVVWDM

SEQ ID NO: 175340 - protein, 9 aa, Borrelia garinii PBi
YLNTNEDFV

SEQ ID NO: 175341 - protein, 15 aa, Borrelia garinii PBi
FEKFKKKSSYWLLDF

SEQ ID NO: 175342 - protein, 9 aa, Borrelia garinii PBi
FKKKSSYWL

SEQ ID NO: 175343 - protein, 15 aa, Borrelia garinii PBi
FENDLEDVSRLRDFF

SEQ ID NO: 175344 - protein, 9 aa, Borrelia garinii PBi
DLEDVSRLR

SEQ ID NO: 175345 - protein, 15 aa, Borrelia garinii PBi
FENDLEDVSRLRDFF

SEQ ID NO: 175346 - protein, 9 aa, Borrelia garinii PBi
FENDLEDVS

SEQ ID NO: 175347 - protein, 15 aa, Borrelia garinii PBi
FFFSQFQALKRYAND

SEQ ID NO: 175348 - protein, 9 aa, Borrelia garinii PBi
FQALKRYAN

SEQ ID NO: 175349 - protein, 15 aa, Borrelia garinii PBi
FFFSQFQALKRYAND

SEQ ID NO: 175350 - protein, 9 aa, Borrelia garinii PBi
FSQFQALKR

SEQ ID NO: 175351 - protein, 15 aa, Borrelia garinii PBi
FFNFILNEIKDLKIW

SEQ ID NO: 175352 - protein, 9 aa, Borrelia garinii PBi
ILNEIKDLK

SEQ ID NO: 175353 - protein, 15 aa, Borrelia garinii PBi
FFNFPGMRIMKLAFD

SEQ ID NO: 175354 - protein, 9 aa, Borrelia garinii PBi
FPGMRIMKL

SEQ ID NO: 175355 - protein, 15 aa, Borrelia garinii PBi
FFNFPGMRIMKLAFD

SEQ ID NO: 175356 - protein, 9 aa, Borrelia garinii PBi
GMRIMKLAF

SEQ ID NO: 175357 - protein, 15 aa, Borrelia garinii PBi
FFSQFQALKRYANDK

SEQ ID NO: 175358 - protein, 9 aa, Borrelia garinii PBi
FQALKRYAN

SEQ ID NO: 175359 - protein, 15 aa, Borrelia garinii PBi
FIAYDSADVWAHQKY

SEQ ID NO: 175360 - protein, 9 aa, Borrelia garinii PBi
FIAYDSADV

SEQ ID NO: 175361 - protein, 15 aa, Borrelia garinii PBi
FIDFLFASSQSYWQM

SEQ ID NO: 175362 - protein, 9 aa, Borrelia garinii PBi
FASSQSYWQ

SEQ ID NO: 175363 - protein, 15 aa, Borrelia garinii PBi
FIDFLFASSQSYWQM

SEQ ID NO: 175364 - protein, 9 aa, Borrelia garinii PBi
FLFASSQSY

SEQ ID NO: 175365 - protein, 15 aa, Borrelia garinii PBi
FIDSDLNLLKENETR

SEQ ID NO: 175366 - protein, 9 aa, Borrelia garinii PBi
IDSDLNLLK

SEQ ID NO: 175367 - protein, 15 aa, Borrelia garinii PBi
FIDSDLNLLKENETR

SEQ ID NO: 175368 - protein, 9 aa, Borrelia garinii PBi
LNLLKENET

SEQ ID NO: 175369 - protein, 15 aa, Borrelia garinii PBi
FKDKFLKEAALNFIN

SEQ ID NO: 175370 - protein, 9 aa, Borrelia garinii PBi
FLKEAALNF

SEQ ID NO: 175371 - protein, 15 aa, Borrelia garinii PBi
FKDKFLKEAALNFIN

SEQ ID NO: 175372 - protein, 9 aa, Borrelia garinii PBi
LKEAALNFI

SEQ ID NO: 175373 - protein, 15 aa, Borrelia garinii PBi
FKEYFLKDSRDAFNV

SEQ ID NO: 175374 - protein, 9 aa, Borrelia garinii PBi
FLKDSRDAF

SEQ ID NO: 175375 - protein, 15 aa, Borrelia garinii PBi
FKEYFLKDSRDAFNV

SEQ ID NO: 175376 - protein, 9 aa, Borrelia garinii PBi
YFLKDSRDA

SEQ ID NO: 175377 - protein, 15 aa, Borrelia garinii PBi
FKKKSSYWLLDFASF

SEQ ID NO: 175378 - protein, 9 aa, Borrelia garinii PBi
FKKKSSYWL

SEQ ID NO: 175379 - protein, 15 aa, Borrelia garinii PBi
FKLRFDASKDKVAGI

SEQ ID NO: 175380 - protein, 9 aa, Borrelia garinii PBi
LRFDASKDK

SEQ ID NO: 175381 - protein, 15 aa, Borrelia garinii PBi
FKLRNILSKEIKVQE

SEQ ID NO: 175382 - protein, 9 aa, Borrelia garinii PBi
FKLRNILSK

SEQ ID NO: 175383 - protein, 15 aa, Borrelia garinii PBi
FKLRNILSKEIKVQE

SEQ ID NO: 175384 - protein, 9 aa, Borrelia garinii PBi
LRNILSKEI

SEQ ID NO: 175385 - protein, 15 aa, Borrelia garinii PBi
FLEQEQAWDSPAYSW

SEQ ID NO: 175386 - protein, 9 aa, Borrelia garinii PBi
QAWDSPAYS

SEQ ID NO: 175387 - protein, 15 aa, Borrelia garinii PBi
FLFASSQSYWQMFAY

SEQ ID NO: 175388 - protein, 9 aa, Borrelia garinii PBi
FASSQSYWQ

SEQ ID NO: 175389 - protein, 15 aa, Borrelia garinii PBi
FLFASSQSYWQMFAY

SEQ ID NO: 175390 - protein, 9 aa, Borrelia garinii PBi
FLFASSQSY

SEQ ID NO: 175391 - protein, 15 aa, Borrelia garinii PBi
FLKEAALNFINRASV

SEQ ID NO: 175392 - protein, 9 aa, Borrelia garinii PBi
ALNFINRAS

SEQ ID NO: 175393 - protein, 15 aa, Borrelia garinii PBi
FLKEAALNFINRASV

SEQ ID NO: 175394 - protein, 9 aa, Borrelia garinii PBi
LKEAALNFI

SEQ ID NO: 175395 - protein, 15 aa, Borrelia garinii PBi
FNFILNEIKDLKIWV

SEQ ID NO: 175396 - protein, 9 aa, Borrelia garinii PBi
ILNEIKDLK

SEQ ID NO: 175397 - protein, 15 aa, Borrelia garinii PBi
FNFPGMRIMKLAFDF

SEQ ID NO: 175398 - protein, 9 aa, Borrelia garinii PBi
FPGMRIMKL

SEQ ID NO: 175399 - protein, 15 aa, Borrelia garinii PBi
FNGLWVKSPGRDFFN

SEQ ID NO: 175400 - protein, 9 aa, Borrelia garinii PBi
FNGLWVKSP

SEQ ID NO: 175401 - protein, 15 aa, Borrelia garinii PBi
FNVLFDRGILIRNEK

SEQ ID NO: 175402 - protein, 9 aa, Borrelia garinii PBi
FDRGILIRN

SEQ ID NO: 175403 - protein, 15 aa, Borrelia garinii PBi
FNVLFDRGILIRNEK

SEQ ID NO: 175404 - protein, 9 aa, Borrelia garinii PBi
VLFDRGILI

SEQ ID NO: 175405 - protein, 15 aa, Borrelia garinii PBi
FPGMRIMKLAFDFDS

SEQ ID NO: 175406 - protein, 9 aa, Borrelia garinii PBi
FPGMRIMKL

SEQ ID NO: 175407 - protein, 15 aa, Borrelia garinii PBi
FRANIPKNTLNNWIF

SEQ ID NO: 175408 - protein, 9 aa, Borrelia garinii PBi
FRANIPKNT

SEQ ID NO: 175409 - protein, 15 aa, Borrelia garinii PBi
FRGFVSTWEVGVGEA

SEQ ID NO: 175410 - protein, 9 aa, Borrelia garinii PBi
FRGFVSTWE

SEQ ID NO: 175411 - protein, 15 aa, Borrelia garinii PBi
FRLLESDLDATLSKN

SEQ ID NO: 175412 - protein, 9 aa, Borrelia garinii PBi
FRLLESDLD

SEQ ID NO: 175413 - protein, 15 aa, Borrelia garinii PBi
FSQFQALKRYANDKG

SEQ ID NO: 175414 - protein, 9 aa, Borrelia garinii PBi
FQALKRYAN

SEQ ID NO: 175415 - protein, 15 aa, Borrelia garinii PBi
FTRSPPYSIFSAFAG

SEQ ID NO: 175416 - protein, 9 aa, Borrelia garinii PBi
FTRSPPYSI

SEQ ID NO: 175417 - protein, 15 aa, Borrelia garinii PBi
FVAFKEYFLKDSRDA

SEQ ID NO: 175418 - protein, 9 aa, Borrelia garinii PBi
FKEYFLKDS

SEQ ID NO: 175419 - protein, 15 aa, Borrelia garinii PBi
FVVWDMIRSAMSSVS

SEQ ID NO: 175420 - protein, 9 aa, Borrelia garinii PBi
MIRSAMSSV

SEQ ID NO: 175421 - protein, 15 aa, Borrelia garinii PBi
FVVWDMIRSAMSSVS

SEQ ID NO: 175422 - protein, 9 aa, Borrelia garinii PBi
VWDMIRSAM

SEQ ID NO: 175423 - protein, 15 aa, Borrelia garinii PBi
FVVWDMIRSAMSSVS

SEQ ID NO: 175424 - protein, 9 aa, Borrelia garinii PBi
WDMIRSAMS

SEQ ID NO: 175425 - protein, 15 aa, Borrelia garinii PBi
GDLGKGAYKFIDFLF

SEQ ID NO: 175426 - protein, 9 aa, Borrelia garinii PBi
LGKGAYKFI

SEQ ID NO: 175427 - protein, 15 aa, Borrelia garinii PBi
GDNSTIREFVNSLDD

SEQ ID NO: 175428 - protein, 9 aa, Borrelia garinii PBi
IREFVNSLD

SEQ ID NO: 175429 - protein, 15 aa, Borrelia garinii PBi
GEAYAFNGLWVKSPG

SEQ ID NO: 175430 - protein, 9 aa, Borrelia garinii PBi
AYAFNGLWV

SEQ ID NO: 175431 - protein, 15 aa, Borrelia garinii PBi
GEAYAFNGLWVKSPG

SEQ ID NO: 175432 - protein, 9 aa, Borrelia garinii PBi
FNGLWVKSP

SEQ ID NO: 175433 - protein, 15 aa, Borrelia garinii PBi
GIELVMNLPLFIAYD

SEQ ID NO: 175434 - protein, 9 aa, Borrelia garinii PBi
LVMNLPLFI

SEQ ID NO: 175435 - protein, 15 aa, Borrelia garinii PBi
GIELVMNLPLFIAYD

SEQ ID NO: 175436 - protein, 9 aa, Borrelia garinii PBi
VMNLPLFIA

SEQ ID NO: 175437 - protein, 15 aa, Borrelia garinii PBi
GILLNISSLPSKYGI

SEQ ID NO: 175438 - protein, 9 aa, Borrelia garinii PBi
ILLNISSLP

SEQ ID NO: 175439 - protein, 15 aa, Borrelia garinii PBi
GILLNISSLPSKYGI

SEQ ID NO: 175440 - protein, 9 aa, Borrelia garinii PBi
ISSLPSKYG

SEQ ID NO: 175441 - protein, 15 aa, Borrelia garinii PBi
GILLNISSLPSKYGI

SEQ ID NO: 175442 - protein, 9 aa, Borrelia garinii PBi
LLNISSLPS

SEQ ID NO: 175443 - protein, 15 aa, Borrelia garinii PBi
GNEFRANIPKNTLNN

SEQ ID NO: 175444 - protein, 9 aa, Borrelia garinii PBi
FRANIPKNT

SEQ ID NO: 175445 - protein, 15 aa, Borrelia garinii PBi
GRDFFNFILNEIKDL

SEQ ID NO: 175446 - protein, 9 aa, Borrelia garinii PBi
FFNFILNEI

SEQ ID NO: 175447 - protein, 15 aa, Borrelia garinii PBi
HFRGFVSTWEVGVGE

SEQ ID NO: 175448 - protein, 9 aa, Borrelia garinii PBi
FRGFVSTWE

SEQ ID NO: 175449 - protein, 15 aa, Borrelia garinii PBi
HKKYIFDYLNTNEDF

SEQ ID NO: 175450 - protein, 9 aa, Borrelia garinii PBi
FDYLNTNED

SEQ ID NO: 175451 - protein, 15 aa, Borrelia garinii PBi
HKKYIFDYLNTNEDF

SEQ ID NO: 175452 - protein, 9 aa, Borrelia garinii PBi
YIFDYLNTN

SEQ ID NO: 175453 - protein, 15 aa, Borrelia garinii PBi
HNYIKNCIVYTGIGD

SEQ ID NO: 175454 - protein, 9 aa, Borrelia garinii PBi
IKNCIVYTG

SEQ ID NO: 175455 - protein, 15 aa, Borrelia garinii PBi
HNYIKNCIVYTGIGD

SEQ ID NO: 175456 - protein, 9 aa, Borrelia garinii PBi
YIKNCIVYT

SEQ ID NO: 175457 - protein, 15 aa, Borrelia garinii PBi
IAYDSADVWAHQKYF

SEQ ID NO: 175458 - protein, 9 aa, Borrelia garinii PBi
YDSADVWAH

SEQ ID NO: 175459 - protein, 15 aa, Borrelia garinii PBi
IDFLFASSQSYWQMF

SEQ ID NO: 175460 - protein, 9 aa, Borrelia garinii PBi
FASSQSYWQ

SEQ ID NO: 175461 - protein, 15 aa, Borrelia garinii PBi
IDFLFASSQSYWQMF

SEQ ID NO: 175462 - protein, 9 aa, Borrelia garinii PBi
FLFASSQSY

SEQ ID NO: 175463 - protein, 15 aa, Borrelia garinii PBi
IDFTRSPPYSIFSAF

SEQ ID NO: 175464 - protein, 9 aa, Borrelia garinii PBi
FTRSPPYSI

SEQ ID NO: 175465 - protein, 15 aa, Borrelia garinii PBi
IDHFRGFVSTWEVGV

SEQ ID NO: 175466 - protein, 9 aa, Borrelia garinii PBi
FRGFVSTWE

SEQ ID NO: 175467 - protein, 15 aa, Borrelia garinii PBi
IDLEALDKFIDSDLN

SEQ ID NO: 175468 - protein, 9 aa, Borrelia garinii PBi
EALDKFIDS

SEQ ID NO: 175469 - protein, 15 aa, Borrelia garinii PBi
IDSDLNLLKENETRY

SEQ ID NO: 175470 - protein, 9 aa, Borrelia garinii PBi
LNLLKENET

SEQ ID NO: 175471 - protein, 15 aa, Borrelia garinii PBi
IELVMNLPLFIAYDS

SEQ ID NO: 175472 - protein, 9 aa, Borrelia garinii PBi
LVMNLPLFI

SEQ ID NO: 175473 - protein, 15 aa, Borrelia garinii PBi
IELVMNLPLFIAYDS

SEQ ID NO: 175474 - protein, 9 aa, Borrelia garinii PBi
VMNLPLFIA

SEQ ID NO: 175475 - protein, 15 aa, Borrelia garinii PBi
IFDYLNTNEDFVVWD

SEQ ID NO: 175476 - protein, 9 aa, Borrelia garinii PBi
FDYLNTNED

SEQ ID NO: 175477 - protein, 15 aa, Borrelia garinii PBi
IFDYLNTNEDFVVWD

SEQ ID NO: 175478 - protein, 9 aa, Borrelia garinii PBi
YLNTNEDFV

SEQ ID NO: 175479 - protein, 15 aa, Borrelia garinii PBi
IFRLLESDLDATLSK

SEQ ID NO: 175480 - protein, 9 aa, Borrelia garinii PBi
FRLLESDLD

SEQ ID NO: 175481 - protein, 15 aa, Borrelia garinii PBi
IFSAFAGNVYYIDLE

SEQ ID NO: 175482 - protein, 9 aa, Borrelia garinii PBi
FSAFAGNVY

SEQ ID NO: 175483 - protein, 15 aa, Borrelia garinii PBi
IGDNSTIREFVNSLD

SEQ ID NO: 175484 - protein, 9 aa, Borrelia garinii PBi
NSTIREFVN

SEQ ID NO: 175485 - protein, 15 aa, Borrelia garinii PBi
IGILRKYIDVIKIDH

SEQ ID NO: 175486 - protein, 9 aa, Borrelia garinii PBi
IGILRKYID

SEQ ID NO: 175487 - protein, 15 aa, Borrelia garinii PBi
IGILRKYIDVIKIDH

SEQ ID NO: 175488 - protein, 9 aa, Borrelia garinii PBi
ILRKYIDVI

SEQ ID NO: 175489 - protein, 15 aa, Borrelia garinii PBi
IIPMQDYINLGNEFR

SEQ ID NO: 175490 - protein, 9 aa, Borrelia garinii PBi
PMQDYINLG

SEQ ID NO: 175491 - protein, 15 aa, Borrelia garinii PBi
IKIDHFRGFVSTWEV

SEQ ID NO: 175492 - protein, 9 aa, Borrelia garinii PBi
FRGFVSTWE

SEQ ID NO: 175493 - protein, 15 aa, Borrelia garinii PBi
IKNCIVYTGIGDNST

SEQ ID NO: 175494 - protein, 9 aa, Borrelia garinii PBi
IKNCIVYTG

SEQ ID NO: 175495 - protein, 15 aa, Borrelia garinii PBi
ILLNISSLPSKYGIG

SEQ ID NO: 175496 - protein, 9 aa, Borrelia garinii PBi
ILLNISSLP

SEQ ID NO: 175497 - protein, 15 aa, Borrelia garinii PBi
ILLNISSLPSKYGIG

SEQ ID NO: 175498 - protein, 9 aa, Borrelia garinii PBi
ISSLPSKYG

SEQ ID NO: 175499 - protein, 15 aa, Borrelia garinii PBi
ILLNISSLPSKYGIG

SEQ ID NO: 175500 - protein, 9 aa, Borrelia garinii PBi
LLNISSLPS

SEQ ID NO: 175501 - protein, 15 aa, Borrelia garinii PBi
ILNEIKDLKIWVEDF

SEQ ID NO: 175502 - protein, 9 aa, Borrelia garinii PBi
EIKDLKIWV

SEQ ID NO: 175503 - protein, 15 aa, Borrelia garinii PBi
ILNEIKDLKIWVEDF

SEQ ID NO: 175504 - protein, 9 aa, Borrelia garinii PBi
ILNEIKDLK

SEQ ID NO: 175505 - protein, 15 aa, Borrelia garinii PBi
INLGNEFRANIPKNT

SEQ ID NO: 175506 - protein, 9 aa, Borrelia garinii PBi
LGNEFRANI

SEQ ID NO: 175507 - protein, 15 aa, Borrelia garinii PBi
INLNLKRKSGILLNI

SEQ ID NO: 175508 - protein, 9 aa, Borrelia garinii PBi
LKRKSGILL

SEQ ID NO: 175509 - protein, 15 aa, Borrelia garinii PBi
IPKNTLNNWIFRLLE

SEQ ID NO: 175510 - protein, 9 aa, Borrelia garinii PBi
LNNWIFRLL

SEQ ID NO: 175511 - protein, 15 aa, Borrelia garinii PBi
IPKNTLNNWIFRLLE

SEQ ID NO: 175512 - protein, 9 aa, Borrelia garinii PBi
PKNTLNNWI

SEQ ID NO: 175513 - protein, 15 aa, Borrelia garinii PBi
IPMQDYINLGNEFRA

SEQ ID NO: 175514 - protein, 9 aa, Borrelia garinii PBi
YINLGNEFR

SEQ ID NO: 175515 - protein, 15 aa, Borrelia garinii PBi
IREFVNSLDDLHKKY

SEQ ID NO: 175516 - protein, 9 aa, Borrelia garinii PBi
FVNSLDDLH

SEQ ID NO: 175517 - protein, 15 aa, Borrelia garinii PBi
IREFVNSLDDLHKKY

SEQ ID NO: 175518 - protein, 9 aa, Borrelia garinii PBi
IREFVNSLD

SEQ ID NO: 175519 - protein, 15 aa, Borrelia garinii PBi
IRINLNLKRKSGILL

SEQ ID NO: 175520 - protein, 9 aa, Borrelia garinii PBi
INLNLKRKS

SEQ ID NO: 175521 - protein, 15 aa, Borrelia garinii PBi
IRINLNLKRKSGILL

SEQ ID NO: 175522 - protein, 9 aa, Borrelia garinii PBi
IRINLNLKR

SEQ ID NO: 175523 - protein, 15 aa, Borrelia garinii PBi
IRSAMSSVSDSVIIP

SEQ ID NO: 175524 - protein, 9 aa, Borrelia garinii PBi
IRSAMSSVS

SEQ ID NO: 175525 - protein, 15 aa, Borrelia garinii PBi
ISSLPSKYGIGDLGK

SEQ ID NO: 175526 - protein, 9 aa, Borrelia garinii PBi
ISSLPSKYG

SEQ ID NO: 175527 - protein, 15 aa, Borrelia garinii PBi
IVYTGIGDNSTIREF

SEQ ID NO: 175528 - protein, 9 aa, Borrelia garinii PBi
IGDNSTIRE

SEQ ID NO: 175529 - protein, 15 aa, Borrelia garinii PBi
IVYTGIGDNSTIREF

SEQ ID NO: 175530 - protein, 9 aa, Borrelia garinii PBi
IVYTGIGDN

SEQ ID NO: 175531 - protein, 15 aa, Borrelia garinii PBi
IVYTGIGDNSTIREF

SEQ ID NO: 175532 - protein, 9 aa, Borrelia garinii PBi
YTGIGDNST

SEQ ID NO: 175533 - protein, 15 aa, Borrelia garinii PBi
KDKFLKEAALNFINR

SEQ ID NO: 175534 - protein, 9 aa, Borrelia garinii PBi
LKEAALNFI

SEQ ID NO: 175535 - protein, 15 aa, Borrelia garinii PBi
KDKVAGISPDYFLEQ

SEQ ID NO: 175536 - protein, 9 aa, Borrelia garinii PBi
VAGISPDYF

SEQ ID NO: 175537 - protein, 15 aa, Borrelia garinii PBi
KDLFKLRNILSKEIK

SEQ ID NO: 175538 - protein, 9 aa, Borrelia garinii PBi
LFKLRNILS

SEQ ID NO: 175539 - protein, 15 aa, Borrelia garinii PBi
KDLFKLRNILSKEIK

SEQ ID NO: 175540 - protein, 9 aa, Borrelia garinii PBi
LRNILSKEI

SEQ ID NO: 175541 - protein, 15 aa, Borrelia garinii PBi
KEYFLKDSRDAFNVL

SEQ ID NO: 175542 - protein, 9 aa, Borrelia garinii PBi
FLKDSRDAF

SEQ ID NO: 175543 - protein, 15 aa, Borrelia garinii PBi
KEYFLKDSRDAFNVL

SEQ ID NO: 175544 - protein, 9 aa, Borrelia garinii PBi
YFLKDSRDA

SEQ ID NO: 175545 - protein, 15 aa, Borrelia garinii PBi
KEAALNFINRASVDE

SEQ ID NO: 175546 - protein, 9 aa, Borrelia garinii PBi
ALNFINRAS

SEQ ID NO: 175547 - protein, 15 aa, Borrelia garinii PBi
KEAALNFINRASVDE

SEQ ID NO: 175548 - protein, 9 aa, Borrelia garinii PBi
AALNFINRA

SEQ ID NO: 175549 - protein, 15 aa, Borrelia garinii PBi
KFIDFLFASSQSYWQ

SEQ ID NO: 175550 - protein, 9 aa, Borrelia garinii PBi
FLFASSQSY

SEQ ID NO: 175551 - protein, 15 aa, Borrelia garinii PBi
KFIDSDLNLLKENET

SEQ ID NO: 175552 - protein, 9 aa, Borrelia garinii PBi
FIDSDLNLL

SEQ ID NO: 175553 - protein, 15 aa, Borrelia garinii PBi
KFKKKSSYWLLDFAS

SEQ ID NO: 175554 - protein, 9 aa, Borrelia garinii PBi
FKKKSSYWL

SEQ ID NO: 175555 - protein, 15 aa, Borrelia garinii PBi
KFLKEAALNFINRAS

SEQ ID NO: 175556 - protein, 9 aa, Borrelia garinii PBi
FLKEAALNF

SEQ ID NO: 175557 - protein, 15 aa, Borrelia garinii PBi
KFLKEAALNFINRAS

SEQ ID NO: 175558 - protein, 9 aa, Borrelia garinii PBi
LKEAALNFI

SEQ ID NO: 175559 - protein, 15 aa, Borrelia garinii PBi
KGIELVMNLPLFIAY

SEQ ID NO: 175560 - protein, 9 aa, Borrelia garinii PBi
VMNLPLFIA

SEQ ID NO: 175561 - protein, 15 aa, Borrelia garinii PBi
KIDHFRGFVSTWEVG

SEQ ID NO: 175562 - protein, 9 aa, Borrelia garinii PBi
FRGFVSTWE

SEQ ID NO: 175563 - protein, 15 aa, Borrelia garinii PBi
KIRINLNLKRKSGIL

SEQ ID NO: 175564 - protein, 9 aa, Borrelia garinii PBi
INLNLKRKS

SEQ ID NO: 175565 - protein, 15 aa, Borrelia garinii PBi
KIRINLNLKRKSGIL

SEQ ID NO: 175566 - protein, 9 aa, Borrelia garinii PBi
IRINLNLKR

SEQ ID NO: 175567 - protein, 15 aa, Borrelia garinii PBi
KKIRINLNLKRKSGI

SEQ ID NO: 175568 - protein, 9 aa, Borrelia garinii PBi
INLNLKRKS

SEQ ID NO: 175569 - protein, 15 aa, Borrelia garinii PBi
KKIRINLNLKRKSGI

SEQ ID NO: 175570 - protein, 9 aa, Borrelia garinii PBi
IRINLNLKR

SEQ ID NO: 175571 - protein, 15 aa, Borrelia garinii PBi
KKSSYWLLDFASFVA

SEQ ID NO: 175572 - protein, 9 aa, Borrelia garinii PBi
WLLDFASFV

SEQ ID NO: 175573 - protein, 15 aa, Borrelia garinii PBi
KKSSYWLLDFASFVA

SEQ ID NO: 175574 - protein, 9 aa, Borrelia garinii PBi
YWLLDFASF

SEQ ID NO: 175575 - protein, 15 aa, Borrelia garinii PBi
KKYIFDYLNTNEDFV

SEQ ID NO: 175576 - protein, 9 aa, Borrelia garinii PBi
FDYLNTNED

SEQ ID NO: 175577 - protein, 15 aa, Borrelia garinii PBi
KKYIFDYLNTNEDFV

SEQ ID NO: 175578 - protein, 9 aa, Borrelia garinii PBi
YIFDYLNTN

SEQ ID NO: 175579 - protein, 15 aa, Borrelia garinii PBi
KLRNILSKEIKVQEV

SEQ ID NO: 175580 - protein, 9 aa, Borrelia garinii PBi
LRNILSKEI

SEQ ID NO: 175581 - protein, 15 aa, Borrelia garinii PBi
KNCIVYTGIGDNSTI

SEQ ID NO: 175582 - protein, 9 aa, Borrelia garinii PBi
YTGIGDNST

SEQ ID NO: 175583 - protein, 15 aa, Borrelia garinii PBi
KNTLNNWIFRLLESD

SEQ ID NO: 175584 - protein, 9 aa, Borrelia garinii PBi
LNNWIFRLL

SEQ ID NO: 175585 - protein, 15 aa, Borrelia garinii PBi
KNVKYEWWAKRIGIL

SEQ ID NO: 175586 - protein, 9 aa, Borrelia garinii PBi
VKYEWWAKR

SEQ ID NO: 175587 - protein, 15 aa, Borrelia garinii PBi
KNVKYEWWAKRIGIL

SEQ ID NO: 175588 - protein, 9 aa, Borrelia garinii PBi
YEWWAKRIG

SEQ ID NO: 175589 - protein, 15 aa, Borrelia garinii PBi
KRIGILRKYIDVIKI

SEQ ID NO: 175590 - protein, 9 aa, Borrelia garinii PBi
IGILRKYID

SEQ ID NO: 175591 - protein, 15 aa, Borrelia garinii PBi
KRIGILRKYIDVIKI

SEQ ID NO: 175592 - protein, 9 aa, Borrelia garinii PBi
ILRKYIDVI

SEQ ID NO: 175593 - protein, 15 aa, Borrelia garinii PBi
KRKSGILLNISSLPS

SEQ ID NO: 175594 - protein, 9 aa, Borrelia garinii PBi
GILLNISSL

SEQ ID NO: 175595 - protein, 15 aa, Borrelia garinii PBi
KRKSGILLNISSLPS

SEQ ID NO: 175596 - protein, 9 aa, Borrelia garinii PBi
ILLNISSLP

SEQ ID NO: 175597 - protein, 15 aa, Borrelia garinii PBi
KSGILLNISSLPSKY

SEQ ID NO: 175598 - protein, 9 aa, Borrelia garinii PBi
ILLNISSLP

SEQ ID NO: 175599 - protein, 15 aa, Borrelia garinii PBi
KSGILLNISSLPSKY

SEQ ID NO: 175600 - protein, 9 aa, Borrelia garinii PBi
LLNISSLPS

SEQ ID NO: 175601 - protein, 15 aa, Borrelia garinii PBi
KSSYWLLDFASFVAF

SEQ ID NO: 175602 - protein, 9 aa, Borrelia garinii PBi
LLDFASFVA

SEQ ID NO: 175603 - protein, 15 aa, Borrelia garinii PBi
KSSYWLLDFASFVAF

SEQ ID NO: 175604 - protein, 9 aa, Borrelia garinii PBi
WLLDFASFV

SEQ ID NO: 175605 - protein, 15 aa, Borrelia garinii PBi
KYEWWAKRIGILRKY

SEQ ID NO: 175606 - protein, 9 aa, Borrelia garinii PBi
WAKRIGILR

SEQ ID NO: 175607 - protein, 15 aa, Borrelia garinii PBi
KYEWWAKRIGILRKY

SEQ ID NO: 175608 - protein, 9 aa, Borrelia garinii PBi
YEWWAKRIG

SEQ ID NO: 175609 - protein, 15 aa, Borrelia garinii PBi
KYGIGDLGKGAYKFI

SEQ ID NO: 175610 - protein, 9 aa, Borrelia garinii PBi
IGDLGKGAY

SEQ ID NO: 175611 - protein, 15 aa, Borrelia garinii PBi
KYIFDYLNTNEDFVV

SEQ ID NO: 175612 - protein, 9 aa, Borrelia garinii PBi
FDYLNTNED

SEQ ID NO: 175613 - protein, 15 aa, Borrelia garinii PBi
KYIFDYLNTNEDFVV

SEQ ID NO: 175614 - protein, 9 aa, Borrelia garinii PBi
YIFDYLNTN

SEQ ID NO: 175615 - protein, 15 aa, Borrelia garinii PBi
KYIFDYLNTNEDFVV

SEQ ID NO: 175616 - protein, 9 aa, Borrelia garinii PBi
YLNTNEDFV

SEQ ID NO: 175617 - protein, 15 aa, Borrelia garinii PBi
KYKKIRINLNLKRKS

SEQ ID NO: 175618 - protein, 9 aa, Borrelia garinii PBi
IRINLNLKR

SEQ ID NO: 175619 - protein, 15 aa, Borrelia garinii PBi
KYKKIRINLNLKRKS

SEQ ID NO: 175620 - protein, 9 aa, Borrelia garinii PBi
YKKIRINLN

SEQ ID NO: 175621 - protein, 15 aa, Borrelia garinii PBi
LDATLSKNISFITRL

SEQ ID NO: 175622 - protein, 9 aa, Borrelia garinii PBi
LSKNISFIT

SEQ ID NO: 175623 - protein, 15 aa, Borrelia garinii PBi
LDDLHKKYIFDYLNT

SEQ ID NO: 175624 - protein, 9 aa, Borrelia garinii PBi
HKKYIFDYL

SEQ ID NO: 175625 - protein, 15 aa, Borrelia garinii PBi
LEDVSRLRDFFNFPG

SEQ ID NO: 175626 - protein, 9 aa, Borrelia garinii PBi
LEDVSRLRD

SEQ ID NO: 175627 - protein, 15 aa, Borrelia garinii PBi
LEDVSRLRDFFNFPG

SEQ ID NO: 175628 - protein, 9 aa, Borrelia garinii PBi
RLRDFFNFP

SEQ ID NO: 175629 - protein, 15 aa, Borrelia garinii PBi
LEQEQAWDSPAYSWN

SEQ ID NO: 175630 - protein, 9 aa, Borrelia garinii PBi
EQAWDSPAY

SEQ ID NO: 175631 - protein, 15 aa, Borrelia garinii PBi
LESDLDATLSKNISF

SEQ ID NO: 175632 - protein, 9 aa, Borrelia garinii PBi
LESDLDATL

SEQ ID NO: 175633 - protein, 15 aa, Borrelia garinii PBi
LFDRGILIRNEKDLF

SEQ ID NO: 175634 - protein, 9 aa, Borrelia garinii PBi
ILIRNEKDL

SEQ ID NO: 175635 - protein, 15 aa, Borrelia garinii PBi
LFDRGILIRNEKDLF

SEQ ID NO: 175636 - protein, 9 aa, Borrelia garinii PBi
RGILIRNEK

SEQ ID NO: 175637 - protein, 15 aa, Borrelia garinii PBi
LFIAYDSADVWAHQK

SEQ ID NO: 175638 - protein, 9 aa, Borrelia garinii PBi
FIAYDSADV

SEQ ID NO: 175639 - protein, 15 aa, Borrelia garinii PBi
LFKLRNILSKEIKVQ

SEQ ID NO: 175640 - protein, 9 aa, Borrelia garinii PBi
FKLRNILSK

SEQ ID NO: 175641 - protein, 15 aa, Borrelia garinii PBi
LFKLRNILSKEIKVQ

SEQ ID NO: 175642 - protein, 9 aa, Borrelia garinii PBi
LRNILSKEI

SEQ ID NO: 175643 - protein, 15 aa, Borrelia garinii PBi
LGNEFRANIPKNTLN

SEQ ID NO: 175644 - protein, 9 aa, Borrelia garinii PBi
FRANIPKNT

SEQ ID NO: 175645 - protein, 15 aa, Borrelia garinii PBi
LHKKYIFDYLNTNED

SEQ ID NO: 175646 - protein, 9 aa, Borrelia garinii PBi
YIFDYLNTN

SEQ ID NO: 175647 - protein, 15 aa, Borrelia garinii PBi
LKDSRDAFNVLFDRG

SEQ ID NO: 175648 - protein, 9 aa, Borrelia garinii PBi
DSRDAFNVL

SEQ ID NO: 175649 - protein, 15 aa, Borrelia garinii PBi
LKEAALNFINRASVD

SEQ ID NO: 175650 - protein, 9 aa, Borrelia garinii PBi
ALNFINRAS

SEQ ID NO: 175651 - protein, 15 aa, Borrelia garinii PBi
LKNVKYEWWAKRIGI

SEQ ID NO: 175652 - protein, 9 aa, Borrelia garinii PBi
VKYEWWAKR

SEQ ID NO: 175653 - protein, 15 aa, Borrelia garinii PBi
LKNVKYEWWAKRIGI

SEQ ID NO: 175654 - protein, 9 aa, Borrelia garinii PBi
YEWWAKRIG

SEQ ID NO: 175655 - protein, 15 aa, Borrelia garinii PBi
LKRKSGILLNISSLP

SEQ ID NO: 175656 - protein, 9 aa, Borrelia garinii PBi
GILLNISSL

SEQ ID NO: 175657 - protein, 15 aa, Borrelia garinii PBi
LKRKSGILLNISSLP

SEQ ID NO: 175658 - protein, 9 aa, Borrelia garinii PBi
LKRKSGILL

SEQ ID NO: 175659 - protein, 15 aa, Borrelia garinii PBi
LLDFASFVAFKEYFL

SEQ ID NO: 175660 - protein, 9 aa, Borrelia garinii PBi
LLDFASFVA

SEQ ID NO: 175661 - protein, 15 aa, Borrelia garinii PBi
LLESDLDATLSKNIS

SEQ ID NO: 175662 - protein, 9 aa, Borrelia garinii PBi
LDATLSKNI

SEQ ID NO: 175663 - protein, 15 aa, Borrelia garinii PBi
LLNISSLPSKYGIGD

SEQ ID NO: 175664 - protein, 9 aa, Borrelia garinii PBi
ISSLPSKYG

SEQ ID NO: 175665 - protein, 15 aa, Borrelia garinii PBi
LLNISSLPSKYGIGD

SEQ ID NO: 175666 - protein, 9 aa, Borrelia garinii PBi
LLNISSLPS

SEQ ID NO: 175667 - protein, 15 aa, Borrelia garinii PBi
LNFINRASVDEVRSF

SEQ ID NO: 175668 - protein, 9 aa, Borrelia garinii PBi
FINRASVDE

SEQ ID NO: 175669 - protein, 15 aa, Borrelia garinii PBi
LNISSLPSKYGIGDL

SEQ ID NO: 175670 - protein, 9 aa, Borrelia garinii PBi
ISSLPSKYG

SEQ ID NO: 175671 - protein, 15 aa, Borrelia garinii PBi
LNLKRKSGILLNISS

SEQ ID NO: 175672 - protein, 9 aa, Borrelia garinii PBi
LKRKSGILL

SEQ ID NO: 175673 - protein, 15 aa, Borrelia garinii PBi
LNLLKENETRYSDLK

SEQ ID NO: 175674 - protein, 9 aa, Borrelia garinii PBi
LKENETRYS

SEQ ID NO: 175675 - protein, 15 aa, Borrelia garinii PBi
LNNWIFRLLESDLDA

SEQ ID NO: 175676 - protein, 9 aa, Borrelia garinii PBi
FRLLESDLD

SEQ ID NO: 175677 - protein, 15 aa, Borrelia garinii PBi
LNTNEDFVVWDMIRS

SEQ ID NO: 175678 - protein, 9 aa, Borrelia garinii PBi
TNEDFVVWD

SEQ ID NO: 175679 - protein, 15 aa, Borrelia garinii PBi
LPHNYIKNCIVYTGI

SEQ ID NO: 175680 - protein, 9 aa, Borrelia garinii PBi
IKNCIVYTG

SEQ ID NO: 175681 - protein, 15 aa, Borrelia garinii PBi
LPHNYIKNCIVYTGI

SEQ ID NO: 175682 - protein, 9 aa, Borrelia garinii PBi
LPHNYIKNC

SEQ ID NO: 175683 - protein, 15 aa, Borrelia garinii PBi
LPHNYIKNCIVYTGI

SEQ ID NO: 175684 - protein, 9 aa, Borrelia garinii PBi
YIKNCIVYT

SEQ ID NO: 175685 - protein, 15 aa, Borrelia garinii PBi
LPLFIAYDSADVWAH

SEQ ID NO: 175686 - protein, 9 aa, Borrelia garinii PBi
FIAYDSADV

SEQ ID NO: 175687 - protein, 15 aa, Borrelia garinii PBi
LQYFFFSQFQALKRY

SEQ ID NO: 175688 - protein, 9 aa, Borrelia garinii PBi
FFSQFQALK

SEQ ID NO: 175689 - protein, 15 aa, Borrelia garinii PBi
LQYFFFSQFQALKRY

SEQ ID NO: 175690 - protein, 9 aa, Borrelia garinii PBi
FSQFQALKR

SEQ ID NO: 175691 - protein, 15 aa, Borrelia garinii PBi
LRDFFNFPGMRIMKL

SEQ ID NO: 175692 - protein, 9 aa, Borrelia garinii PBi
FFNFPGMRI

SEQ ID NO: 175693 - protein, 15 aa, Borrelia garinii PBi
LRNILSKEIKVQEVL

SEQ ID NO: 175694 - protein, 9 aa, Borrelia garinii PBi
LRNILSKEI

SEQ ID NO: 175695 - protein, 15 aa, Borrelia garinii PBi
LRNILSKEIKVQEVL

SEQ ID NO: 175696 - protein, 9 aa, Borrelia garinii PBi
LSKEIKVQE

SEQ ID NO: 175697 - protein, 15 aa, Borrelia garinii PBi
LSFKDKFLKEAALNF

SEQ ID NO: 175698 - protein, 9 aa, Borrelia garinii PBi
FKDKFLKEA

SEQ ID NO: 175699 - protein, 15 aa, Borrelia garinii PBi
LSKEIKVQEVLQYFF

SEQ ID NO: 175700 - protein, 9 aa, Borrelia garinii PBi
IKVQEVLQY

SEQ ID NO: 175701 - protein, 15 aa, Borrelia garinii PBi
LSKNISFITRLYGRT

SEQ ID NO: 175702 - protein, 9 aa, Borrelia garinii PBi
LSKNISFIT

SEQ ID NO: 175703 - protein, 15 aa, Borrelia garinii PBi
LSKNISFITRLYGRT

SEQ ID NO: 175704 - protein, 9 aa, Borrelia garinii PBi
SFITRLYGR

SEQ ID NO: 175705 - protein, 15 aa, Borrelia garinii PBi
LVMNLPLFIAYDSAD

SEQ ID NO: 175706 - protein, 9 aa, Borrelia garinii PBi
LVMNLPLFI

SEQ ID NO: 175707 - protein, 15 aa, Borrelia garinii PBi
LVMNLPLFIAYDSAD

SEQ ID NO: 175708 - protein, 9 aa, Borrelia garinii PBi
VMNLPLFIA

SEQ ID NO: 175709 - protein, 15 aa, Borrelia garinii PBi
LWVKSPGRDFFNFIL

SEQ ID NO: 175710 - protein, 9 aa, Borrelia garinii PBi
LWVKSPGRD

SEQ ID NO: 175711 - protein, 15 aa, Borrelia garinii PBi
LWVKSPGRDFFNFIL

SEQ ID NO: 175712 - protein, 9 aa, Borrelia garinii PBi
PGRDFFNFI

SEQ ID NO: 175713 - protein, 15 aa, Borrelia garinii PBi
MFAYSPIDFTRSPPY

SEQ ID NO: 175714 - protein, 9 aa, Borrelia garinii PBi
YSPIDFTRS

SEQ ID NO: 175715 - protein, 15 aa, Borrelia garinii PBi
MIRSAMSSVSDSVII

SEQ ID NO: 175716 - protein, 9 aa, Borrelia garinii PBi
IRSAMSSVS

SEQ ID NO: 175717 - protein, 15 aa, Borrelia garinii PBi
MKYKKIRINLNLKRK

SEQ ID NO: 175718 - protein, 9 aa, Borrelia garinii PBi
IRINLNLKR

SEQ ID NO: 175719 - protein, 15 aa, Borrelia garinii PBi
MKYKKIRINLNLKRK

SEQ ID NO: 175720 - protein, 9 aa, Borrelia garinii PBi
YKKIRINLN

SEQ ID NO: 175721 - protein, 15 aa, Borrelia garinii PBi
MNLPLFIAYDSADVW

SEQ ID NO: 175722 - protein, 9 aa, Borrelia garinii PBi
FIAYDSADV

SEQ ID NO: 175723 - protein, 15 aa, Borrelia garinii PBi
MQDYINLGNEFRANI

SEQ ID NO: 175724 - protein, 9 aa, Borrelia garinii PBi
YINLGNEFR

SEQ ID NO: 175725 - protein, 15 aa, Borrelia garinii PBi
NCIVYTGIGDNSTIR

SEQ ID NO: 175726 - protein, 9 aa, Borrelia garinii PBi
YTGIGDNST

SEQ ID NO: 175727 - protein, 15 aa, Borrelia garinii PBi
NDKGIELVMNLPLFI

SEQ ID NO: 175728 - protein, 9 aa, Borrelia garinii PBi
DKGIELVMN

SEQ ID NO: 175729 - protein, 15 aa, Borrelia garinii PBi
NDKGIELVMNLPLFI

SEQ ID NO: 175730 - protein, 9 aa, Borrelia garinii PBi
ELVMNLPLF

SEQ ID NO: 175731 - protein, 15 aa, Borrelia garinii PBi
NDKGIELVMNLPLFI

SEQ ID NO: 175732 - protein, 9 aa, Borrelia garinii PBi
IELVMNLPL

SEQ ID NO: 175733 - protein, 15 aa, Borrelia garinii PBi
NDLEDVSRLRDFFNF

SEQ ID NO: 175734 - protein, 9 aa, Borrelia garinii PBi
VSRLRDFFN

SEQ ID NO: 175735 - protein, 15 aa, Borrelia garinii PBi
NEDFVVWDMIRSAMS

SEQ ID NO: 175736 - protein, 9 aa, Borrelia garinii PBi
FVVWDMIRS

SEQ ID NO: 175737 - protein, 15 aa, Borrelia garinii PBi
NEDFVVWDMIRSAMS

SEQ ID NO: 175738 - protein, 9 aa, Borrelia garinii PBi
VVWDMIRSA

SEQ ID NO: 175739 - protein, 15 aa, Borrelia garinii PBi
NEFRANIPKNTLNNW

SEQ ID NO: 175740 - protein, 9 aa, Borrelia garinii PBi
FRANIPKNT

SEQ ID NO: 175741 - protein, 15 aa, Borrelia garinii PBi
NEKDLFKLRNILSKE

SEQ ID NO: 175742 - protein, 9 aa, Borrelia garinii PBi
LFKLRNILS

SEQ ID NO: 175743 - protein, 15 aa, Borrelia garinii PBi
NETRYSDLKKLSFKD

SEQ ID NO: 175744 - protein, 9 aa, Borrelia garinii PBi
RYSDLKKLS

SEQ ID NO: 175745 - protein, 15 aa, Borrelia garinii PBi
NFILNEIKDLKIWVE

SEQ ID NO: 175746 - protein, 9 aa, Borrelia garinii PBi
FILNEIKDL

SEQ ID NO: 175747 - protein, 15 aa, Borrelia garinii PBi
NFILNEIKDLKIWVE

SEQ ID NO: 175748 - protein, 9 aa, Borrelia garinii PBi
ILNEIKDLK

SEQ ID NO: 175749 - protein, 15 aa, Borrelia garinii PBi
NFPGMRIMKLAFDFD

SEQ ID NO: 175750 - protein, 9 aa, Borrelia garinii PBi
FPGMRIMKL

SEQ ID NO: 175751 - protein, 15 aa, Borrelia garinii PBi
NILSKEIKVQEVLQY

SEQ ID NO: 175752 - protein, 9 aa, Borrelia garinii PBi
EIKVQEVLQ

SEQ ID NO: 175753 - protein, 15 aa, Borrelia garinii PBi
NIPKNTLNNWIFRLL

SEQ ID NO: 175754 - protein, 9 aa, Borrelia garinii PBi
IPKNTLNNW

SEQ ID NO: 175755 - protein, 15 aa, Borrelia garinii PBi
NISSLPSKYGIGDLG

SEQ ID NO: 175756 - protein, 9 aa, Borrelia garinii PBi
ISSLPSKYG

SEQ ID NO: 175757 - protein, 15 aa, Borrelia garinii PBi
NLGNEFRANIPKNTL

SEQ ID NO: 175758 - protein, 9 aa, Borrelia garinii PBi
FRANIPKNT

SEQ ID NO: 175759 - protein, 15 aa, Borrelia garinii PBi
NLKRKSGILLNISSL

SEQ ID NO: 175760 - protein, 9 aa, Borrelia garinii PBi
LKRKSGILL

SEQ ID NO: 175761 - protein, 15 aa, Borrelia garinii PBi
NLLKENETRYSDLKK

SEQ ID NO: 175762 - protein, 9 aa, Borrelia garinii PBi
LKENETRYS

SEQ ID NO: 175763 - protein, 15 aa, Borrelia garinii PBi
NLNLKRKSGILLNIS

SEQ ID NO: 175764 - protein, 9 aa, Borrelia garinii PBi
LKRKSGILL

SEQ ID NO: 175765 - protein, 15 aa, Borrelia garinii PBi
NLPHNYIKNCIVYTG

SEQ ID NO: 175766 - protein, 9 aa, Borrelia garinii PBi
YIKNCIVYT

SEQ ID NO: 175767 - protein, 15 aa, Borrelia garinii PBi
NLPLFIAYDSADVWA

SEQ ID NO: 175768 - protein, 9 aa, Borrelia garinii PBi
FIAYDSADV

SEQ ID NO: 175769 - protein, 15 aa, Borrelia garinii PBi
NNWIFRLLESDLDAT

SEQ ID NO: 175770 - protein, 9 aa, Borrelia garinii PBi
FRLLESDLD

SEQ ID NO: 175771 - protein, 15 aa, Borrelia garinii PBi
NQNLPHNYIKNCIVY

SEQ ID NO: 175772 - protein, 9 aa, Borrelia garinii PBi
LPHNYIKNC

SEQ ID NO: 175773 - protein, 15 aa, Borrelia garinii PBi
NSLDDLHKKYIFDYL

SEQ ID NO: 175774 - protein, 9 aa, Borrelia garinii PBi
LDDLHKKYI

SEQ ID NO: 175775 - protein, 15 aa, Borrelia garinii PBi
NSTIREFVNSLDDLH

SEQ ID NO: 175776 - protein, 9 aa, Borrelia garinii PBi
IREFVNSLD

SEQ ID NO: 175777 - protein, 15 aa, Borrelia garinii PBi
NTLNNWIFRLLESDL

SEQ ID NO: 175778 - protein, 9 aa, Borrelia garinii PBi
LNNWIFRLL

SEQ ID NO: 175779 - protein, 15 aa, Borrelia garinii PBi
NTNEDFVVWDMIRSA

SEQ ID NO: 175780 - protein, 9 aa, Borrelia garinii PBi
FVVWDMIRS

SEQ ID NO: 175781 - protein, 15 aa, Borrelia garinii PBi
NVKYEWWAKRIGILR

SEQ ID NO: 175782 - protein, 9 aa, Borrelia garinii PBi
VKYEWWAKR

SEQ ID NO: 175783 - protein, 15 aa, Borrelia garinii PBi
NVKYEWWAKRIGILR

SEQ ID NO: 175784 - protein, 9 aa, Borrelia garinii PBi
WWAKRIGIL

SEQ ID NO: 175785 - protein, 15 aa, Borrelia garinii PBi
NVKYEWWAKRIGILR

SEQ ID NO: 175786 - protein, 9 aa, Borrelia garinii PBi
YEWWAKRIG

SEQ ID NO: 175787 - protein, 15 aa, Borrelia garinii PBi
NVLFDRGILIRNEKD

SEQ ID NO: 175788 - protein, 9 aa, Borrelia garinii PBi
RGILIRNEK

SEQ ID NO: 175789 - protein, 15 aa, Borrelia garinii PBi
NVLKNVKYEWWAKRI

SEQ ID NO: 175790 - protein, 9 aa, Borrelia garinii PBi
VKYEWWAKR

SEQ ID NO: 175791 - protein, 15 aa, Borrelia garinii PBi
NVYYIDLEALDKFID

SEQ ID NO: 175792 - protein, 9 aa, Borrelia garinii PBi
YIDLEALDK

SEQ ID NO: 175793 - protein, 15 aa, Borrelia garinii PBi
NWIFRLLESDLDATL

SEQ ID NO: 175794 - protein, 9 aa, Borrelia garinii PBi
FRLLESDLD

SEQ ID NO: 175795 - protein, 15 aa, Borrelia garinii PBi
NYIKNCIVYTGIGDN

SEQ ID NO: 175796 - protein, 9 aa, Borrelia garinii PBi
IKNCIVYTG

SEQ ID NO: 175797 - protein, 15 aa, Borrelia garinii PBi
PAYSWNVLKNVKYEW

SEQ ID NO: 175798 - protein, 9 aa, Borrelia garinii PBi
WNVLKNVKY

SEQ ID NO: 175799 - protein, 15 aa, Borrelia garinii PBi
PAYSWNVLKNVKYEW

SEQ ID NO: 175800 - protein, 9 aa, Borrelia garinii PBi
YSWNVLKNV

SEQ ID NO: 175801 - protein, 15 aa, Borrelia garinii PBi
PHNYIKNCIVYTGIG

SEQ ID NO: 175802 - protein, 9 aa, Borrelia garinii PBi
IKNCIVYTG

SEQ ID NO: 175803 - protein, 15 aa, Borrelia garinii PBi
PHNYIKNCIVYTGIG

SEQ ID NO: 175804 - protein, 9 aa, Borrelia garinii PBi
YIKNCIVYT

SEQ ID NO: 175805 - protein, 15 aa, Borrelia garinii PBi
PIDFTRSPPYSIFSA

SEQ ID NO: 175806 - protein, 9 aa, Borrelia garinii PBi
FTRSPPYSI

SEQ ID NO: 175807 - protein, 15 aa, Borrelia garinii PBi
PKNTLNNWIFRLLES

SEQ ID NO: 175808 - protein, 9 aa, Borrelia garinii PBi
LNNWIFRLL

SEQ ID NO: 175809 - protein, 15 aa, Borrelia garinii PBi
PLFIAYDSADVWAHQ

SEQ ID NO: 175810 - protein, 9 aa, Borrelia garinii PBi
FIAYDSADV

SEQ ID NO: 175811 - protein, 15 aa, Borrelia garinii PBi
PMQDYINLGNEFRAN

SEQ ID NO: 175812 - protein, 9 aa, Borrelia garinii PBi
YINLGNEFR

SEQ ID NO: 175813 - protein, 15 aa, Borrelia garinii PBi
PPYSIFSAFAGNVYY

SEQ ID NO: 175814 - protein, 9 aa, Borrelia garinii PBi
IFSAFAGNV

SEQ ID NO: 175815 - protein, 15 aa, Borrelia garinii PBi
PYSIFSAFAGNVYYI

SEQ ID NO: 175816 - protein, 9 aa, Borrelia garinii PBi
IFSAFAGNV

SEQ ID NO: 175817 - protein, 15 aa, Borrelia garinii PBi
QALKRYANDKGIELV

SEQ ID NO: 175818 - protein, 9 aa, Borrelia garinii PBi
LKRYANDKG

SEQ ID NO: 175819 - protein, 15 aa, Borrelia garinii PBi
QAWDSPAYSWNVLKN

SEQ ID NO: 175820 - protein, 9 aa, Borrelia garinii PBi
QAWDSPAYS

SEQ ID NO: 175821 - protein, 15 aa, Borrelia garinii PBi
QDYINLGNEFRANIP

SEQ ID NO: 175822 - protein, 9 aa, Borrelia garinii PBi
LGNEFRANI

SEQ ID NO: 175823 - protein, 15 aa, Borrelia garinii PBi
QDYINLGNEFRANIP

SEQ ID NO: 175824 - protein, 9 aa, Borrelia garinii PBi
YINLGNEFR

SEQ ID NO: 175825 - protein, 15 aa, Borrelia garinii PBi
QMFAYSPIDFTRSPP

SEQ ID NO: 175826 - protein, 9 aa, Borrelia garinii PBi
YSPIDFTRS

SEQ ID NO: 175827 - protein, 15 aa, Borrelia garinii PBi
QNLPHNYIKNCIVYT

SEQ ID NO: 175828 - protein, 9 aa, Borrelia garinii PBi
LPHNYIKNC

SEQ ID NO: 175829 - protein, 15 aa, Borrelia garinii PBi
QNLPHNYIKNCIVYT

SEQ ID NO: 175830 - protein, 9 aa, Borrelia garinii PBi
PHNYIKNCI

SEQ ID NO: 175831 - protein, 15 aa, Borrelia garinii PBi
QSYWQMFAYSPIDFT

SEQ ID NO: 175832 - protein, 9 aa, Borrelia garinii PBi
MFAYSPIDF

SEQ ID NO: 175833 - protein, 15 aa, Borrelia garinii PBi
QSYWQMFAYSPIDFT

SEQ ID NO: 175834 - protein, 9 aa, Borrelia garinii PBi
WQMFAYSPI

SEQ ID NO: 175835 - protein, 15 aa, Borrelia garinii PBi
QSYWQMFAYSPIDFT

SEQ ID NO: 175836 - protein, 9 aa, Borrelia garinii PBi
YWQMFAYSP

SEQ ID NO: 175837 - protein, 15 aa, Borrelia garinii PBi
QYFFFSQFQALKRYA

SEQ ID NO: 175838 - protein, 9 aa, Borrelia garinii PBi
FFSQFQALK

SEQ ID NO: 175839 - protein, 15 aa, Borrelia garinii PBi
RDFFNFILNEIKDLK

SEQ ID NO: 175840 - protein, 9 aa, Borrelia garinii PBi
FFNFILNEI

SEQ ID NO: 175841 - protein, 15 aa, Borrelia garinii PBi
RDFFNFPGMRIMKLA

SEQ ID NO: 175842 - protein, 9 aa, Borrelia garinii PBi
FPGMRIMKL

SEQ ID NO: 175843 - protein, 15 aa, Borrelia garinii PBi
RGILIRNEKDLFKLR

SEQ ID NO: 175844 - protein, 9 aa, Borrelia garinii PBi
LIRNEKDLF

SEQ ID NO: 175845 - protein, 15 aa, Borrelia garinii PBi
RIGILRKYIDVIKID

SEQ ID NO: 175846 - protein, 9 aa, Borrelia garinii PBi
IGILRKYID

SEQ ID NO: 175847 - protein, 15 aa, Borrelia garinii PBi
RIGILRKYIDVIKID

SEQ ID NO: 175848 - protein, 9 aa, Borrelia garinii PBi
ILRKYIDVI

SEQ ID NO: 175849 - protein, 15 aa, Borrelia garinii PBi
RIGILRKYIDVIKID

SEQ ID NO: 175850 - protein, 9 aa, Borrelia garinii PBi
LRKYIDVIK

SEQ ID NO: 175851 - protein, 15 aa, Borrelia garinii PBi
RINLNLKRKSGILLN

SEQ ID NO: 175852 - protein, 9 aa, Borrelia garinii PBi
LKRKSGILL

SEQ ID NO: 175853 - protein, 15 aa, Borrelia garinii PBi
RKSGILLNISSLPSK

SEQ ID NO: 175854 - protein, 9 aa, Borrelia garinii PBi
ILLNISSLP

SEQ ID NO: 175855 - protein, 15 aa, Borrelia garinii PBi
RKSGILLNISSLPSK

SEQ ID NO: 175856 - protein, 9 aa, Borrelia garinii PBi
LLNISSLPS

SEQ ID NO: 175857 - protein, 15 aa, Borrelia garinii PBi
RLRDFFNFPGMRIMK

SEQ ID NO: 175858 - protein, 9 aa, Borrelia garinii PBi
FFNFPGMRI

SEQ ID NO: 175859 - protein, 15 aa, Borrelia garinii PBi
RNEKDLFKLRNILSK

SEQ ID NO: 175860 - protein, 9 aa, Borrelia garinii PBi
LFKLRNILS

SEQ ID NO: 175861 - protein, 15 aa, Borrelia garinii PBi
RNILSKEIKVQEVLQ

SEQ ID NO: 175862 - protein, 9 aa, Borrelia garinii PBi
LSKEIKVQE

SEQ ID NO: 175863 - protein, 15 aa, Borrelia garinii PBi
RSFEKFKKKSSYWLL

SEQ ID NO: 175864 - protein, 9 aa, Borrelia garinii PBi
FKKKSSYWL

SEQ ID NO: 175865 - protein, 15 aa, Borrelia garinii PBi
RSPPYSIFSAFAGNV

SEQ ID NO: 175866 - protein, 9 aa, Borrelia garinii PBi
YSIFSAFAG

SEQ ID NO: 175867 - protein, 15 aa, Borrelia garinii PBi
SDLDATLSKNISFIT

SEQ ID NO: 175868 - protein, 9 aa, Borrelia garinii PBi
DATLSKNIS

SEQ ID NO: 175869 - protein, 15 aa, Borrelia garinii PBi
SDLNLLKENETRYSD

SEQ ID NO: 175870 - protein, 9 aa, Borrelia garinii PBi
LKENETRYS

SEQ ID NO: 175871 - protein, 15 aa, Borrelia garinii PBi
SDLNLLKENETRYSD

SEQ ID NO: 175872 - protein, 9 aa, Borrelia garinii PBi
LNLLKENET

SEQ ID NO: 175873 - protein, 15 aa, Borrelia garinii PBi
SFEKFKKKSSYWLLD

SEQ ID NO: 175874 - protein, 9 aa, Borrelia garinii PBi
FKKKSSYWL

SEQ ID NO: 175875 - protein, 15 aa, Borrelia garinii PBi
SFKDKFLKEAALNFI

SEQ ID NO: 175876 - protein, 9 aa, Borrelia garinii PBi
FLKEAALNF

SEQ ID NO: 175877 - protein, 15 aa, Borrelia garinii PBi
SGILLNISSLPSKYG

SEQ ID NO: 175878 - protein, 9 aa, Borrelia garinii PBi
ILLNISSLP

SEQ ID NO: 175879 - protein, 15 aa, Borrelia garinii PBi
SGILLNISSLPSKYG

SEQ ID NO: 175880 - protein, 9 aa, Borrelia garinii PBi
LLNISSLPS

SEQ ID NO: 175881 - protein, 15 aa, Borrelia garinii PBi
SLPSKYGIGDLGKGA

SEQ ID NO: 175882 - protein, 9 aa, Borrelia garinii PBi
PSKYGIGDL

SEQ ID NO: 175883 - protein, 15 aa, Borrelia garinii PBi
SPAYSWNVLKNVKYE

SEQ ID NO: 175884 - protein, 9 aa, Borrelia garinii PBi
AYSWNVLKN

SEQ ID NO: 175885 - protein, 15 aa, Borrelia garinii PBi
SPAYSWNVLKNVKYE

SEQ ID NO: 175886 - protein, 9 aa, Borrelia garinii PBi
WNVLKNVKY

SEQ ID NO: 175887 - protein, 15 aa, Borrelia garinii PBi
SPAYSWNVLKNVKYE

SEQ ID NO: 175888 - protein, 9 aa, Borrelia garinii PBi
YSWNVLKNV

SEQ ID NO: 175889 - protein, 15 aa, Borrelia garinii PBi
SPIDFTRSPPYSIFS

SEQ ID NO: 175890 - protein, 9 aa, Borrelia garinii PBi
FTRSPPYSI

SEQ ID NO: 175891 - protein, 15 aa, Borrelia garinii PBi
SPPYSIFSAFAGNVY

SEQ ID NO: 175892 - protein, 9 aa, Borrelia garinii PBi
IFSAFAGNV

SEQ ID NO: 175893 - protein, 15 aa, Borrelia garinii PBi
SQFQALKRYANDKGI

SEQ ID NO: 175894 - protein, 9 aa, Borrelia garinii PBi
FQALKRYAN

SEQ ID NO: 175895 - protein, 15 aa, Borrelia garinii PBi
SQSYWQMFAYSPIDF

SEQ ID NO: 175896 - protein, 9 aa, Borrelia garinii PBi
WQMFAYSPI

SEQ ID NO: 175897 - protein, 15 aa, Borrelia garinii PBi
SQSYWQMFAYSPIDF

SEQ ID NO: 175898 - protein, 9 aa, Borrelia garinii PBi
YWQMFAYSP

SEQ ID NO: 175899 - protein, 15 aa, Borrelia garinii PBi
SRDAFNVLFDRGILI

SEQ ID NO: 175900 - protein, 9 aa, Borrelia garinii PBi
FNVLFDRGI

SEQ ID NO: 175901 - protein, 15 aa, Borrelia garinii PBi
SRLRDFFNFPGMRIM

SEQ ID NO: 175902 - protein, 9 aa, Borrelia garinii PBi
FFNFPGMRI

SEQ ID NO: 175903 - protein, 15 aa, Borrelia garinii PBi
SSQSYWQMFAYSPID

SEQ ID NO: 175904 - protein, 9 aa, Borrelia garinii PBi
WQMFAYSPI

SEQ ID NO: 175905 - protein, 15 aa, Borrelia garinii PBi
SSQSYWQMFAYSPID

SEQ ID NO: 175906 - protein, 9 aa, Borrelia garinii PBi
YWQMFAYSP

SEQ ID NO: 175907 - protein, 15 aa, Borrelia garinii PBi
SSYWLLDFASFVAFK

SEQ ID NO: 175908 - protein, 9 aa, Borrelia garinii PBi
LLDFASFVA

SEQ ID NO: 175909 - protein, 15 aa, Borrelia garinii PBi
SSYWLLDFASFVAFK

SEQ ID NO: 175910 - protein, 9 aa, Borrelia garinii PBi
WLLDFASFV

SEQ ID NO: 175911 - protein, 15 aa, Borrelia garinii PBi
STIREFVNSLDDLHK

SEQ ID NO: 175912 - protein, 9 aa, Borrelia garinii PBi
IREFVNSLD

SEQ ID NO: 175913 - protein, 15 aa, Borrelia garinii PBi
STWEVGVGEAYAFNG

SEQ ID NO: 175914 - protein, 9 aa, Borrelia garinii PBi
VGVGEAYAF

SEQ ID NO: 175915 - protein, 15 aa, Borrelia garinii PBi
SWNVLKNVKYEWWAK

SEQ ID NO: 175916 - protein, 9 aa, Borrelia garinii PBi
WNVLKNVKY

SEQ ID NO: 175917 - protein, 15 aa, Borrelia garinii PBi
SYWLLDFASFVAFKE

SEQ ID NO: 175918 - protein, 9 aa, Borrelia garinii PBi
WLLDFASFV

SEQ ID NO: 175919 - protein, 15 aa, Borrelia garinii PBi
SYWQMFAYSPIDFTR

SEQ ID NO: 175920 - protein, 9 aa, Borrelia garinii PBi
MFAYSPIDF

SEQ ID NO: 175921 - protein, 15 aa, Borrelia garinii PBi
SYWQMFAYSPIDFTR

SEQ ID NO: 175922 - protein, 9 aa, Borrelia garinii PBi
WQMFAYSPI

SEQ ID NO: 175923 - protein, 15 aa, Borrelia garinii PBi
SYWQMFAYSPIDFTR

SEQ ID NO: 175924 - protein, 9 aa, Borrelia garinii PBi
YWQMFAYSP

SEQ ID NO: 175925 - protein, 15 aa, Borrelia garinii PBi
TGIGDNSTIREFVNS

SEQ ID NO: 175926 - protein, 9 aa, Borrelia garinii PBi
IGDNSTIRE

SEQ ID NO: 175927 - protein, 15 aa, Borrelia garinii PBi
TIREFVNSLDDLHKK

SEQ ID NO: 175928 - protein, 9 aa, Borrelia garinii PBi
IREFVNSLD

SEQ ID NO: 175929 - protein, 15 aa, Borrelia garinii PBi
TLNNWIFRLLESDLD

SEQ ID NO: 175930 - protein, 9 aa, Borrelia garinii PBi
IFRLLESDL

SEQ ID NO: 175931 - protein, 15 aa, Borrelia garinii PBi
TLNNWIFRLLESDLD

SEQ ID NO: 175932 - protein, 9 aa, Borrelia garinii PBi
NNWIFRLLE

SEQ ID NO: 175933 - protein, 15 aa, Borrelia garinii PBi
TLSKNISFITRLYGR

SEQ ID NO: 175934 - protein, 9 aa, Borrelia garinii PBi
LSKNISFIT

SEQ ID NO: 175935 - protein, 15 aa, Borrelia garinii PBi
TLSKNISFITRLYGR

SEQ ID NO: 175936 - protein, 9 aa, Borrelia garinii PBi
SKNISFITR

SEQ ID NO: 175937 - protein, 15 aa, Borrelia garinii PBi
TNEDFVVWDMIRSAM

SEQ ID NO: 175938 - protein, 9 aa, Borrelia garinii PBi
FVVWDMIRS

SEQ ID NO: 175939 - protein, 15 aa, Borrelia garinii PBi
TNEDFVVWDMIRSAM

SEQ ID NO: 175940 - protein, 9 aa, Borrelia garinii PBi
VVWDMIRSA

SEQ ID NO: 175941 - protein, 15 aa, Borrelia garinii PBi
TWEVGVGEAYAFNGL

SEQ ID NO: 175942 - protein, 9 aa, Borrelia garinii PBi
VGVGEAYAF

SEQ ID NO: 175943 - protein, 15 aa, Borrelia garinii PBi
VAFKEYFLKDSRDAF

SEQ ID NO: 175944 - protein, 9 aa, Borrelia garinii PBi
FKEYFLKDS

SEQ ID NO: 175945 - protein, 15 aa, Borrelia garinii PBi
VAFKEYFLKDSRDAF

SEQ ID NO: 175946 - protein, 9 aa, Borrelia garinii PBi
YFLKDSRDA

SEQ ID NO: 175947 - protein, 15 aa, Borrelia garinii PBi
VGEAYAFNGLWVKSP

SEQ ID NO: 175948 - protein, 9 aa, Borrelia garinii PBi
AFNGLWVKS

SEQ ID NO: 175949 - protein, 15 aa, Borrelia garinii PBi
VGEAYAFNGLWVKSP

SEQ ID NO: 175950 - protein, 9 aa, Borrelia garinii PBi
AYAFNGLWV

SEQ ID NO: 175951 - protein, 15 aa, Borrelia garinii PBi
VGVGEAYAFNGLWVK

SEQ ID NO: 175952 - protein, 9 aa, Borrelia garinii PBi
GEAYAFNGL

SEQ ID NO: 175953 - protein, 15 aa, Borrelia garinii PBi
VIKIDHFRGFVSTWE

SEQ ID NO: 175954 - protein, 9 aa, Borrelia garinii PBi
IDHFRGFVS

SEQ ID NO: 175955 - protein, 15 aa, Borrelia garinii PBi
VKSPGRDFFNFILNE

SEQ ID NO: 175956 - protein, 9 aa, Borrelia garinii PBi
PGRDFFNFI

SEQ ID NO: 175957 - protein, 15 aa, Borrelia garinii PBi
VKYEWWAKRIGILRK

SEQ ID NO: 175958 - protein, 9 aa, Borrelia garinii PBi
VKYEWWAKR

SEQ ID NO: 175959 - protein, 15 aa, Borrelia garinii PBi
VKYEWWAKRIGILRK

SEQ ID NO: 175960 - protein, 9 aa, Borrelia garinii PBi
WAKRIGILR

SEQ ID NO: 175961 - protein, 15 aa, Borrelia garinii PBi
VKYEWWAKRIGILRK

SEQ ID NO: 175962 - protein, 9 aa, Borrelia garinii PBi
YEWWAKRIG

SEQ ID NO: 175963 - protein, 15 aa, Borrelia garinii PBi
VLFDRGILIRNEKDL

SEQ ID NO: 175964 - protein, 9 aa, Borrelia garinii PBi
RGILIRNEK

SEQ ID NO: 175965 - protein, 15 aa, Borrelia garinii PBi
VLKNVKYEWWAKRIG

SEQ ID NO: 175966 - protein, 9 aa, Borrelia garinii PBi
VKYEWWAKR

SEQ ID NO: 175967 - protein, 15 aa, Borrelia garinii PBi
VLQYFFFSQFQALKR

SEQ ID NO: 175968 - protein, 9 aa, Borrelia garinii PBi
FFSQFQALK

SEQ ID NO: 175969 - protein, 15 aa, Borrelia garinii PBi
VMNLPLFIAYDSADV

SEQ ID NO: 175970 - protein, 9 aa, Borrelia garinii PBi
VMNLPLFIA

SEQ ID NO: 175971 - protein, 15 aa, Borrelia garinii PBi
VRSFEKFKKKSSYWL

SEQ ID NO: 175972 - protein, 9 aa, Borrelia garinii PBi
FEKFKKKSS

SEQ ID NO: 175973 - protein, 15 aa, Borrelia garinii PBi
VRSFEKFKKKSSYWL

SEQ ID NO: 175974 - protein, 9 aa, Borrelia garinii PBi
KFKKKSSYW

SEQ ID NO: 175975 - protein, 15 aa, Borrelia garinii PBi
VRSFEKFKKKSSYWL

SEQ ID NO: 175976 - protein, 9 aa, Borrelia garinii PBi
VRSFEKFKK

SEQ ID NO: 175977 - protein, 15 aa, Borrelia garinii PBi
VSRLRDFFNFPGMRI

SEQ ID NO: 175978 - protein, 9 aa, Borrelia garinii PBi
LRDFFNFPG

SEQ ID NO: 175979 - protein, 15 aa, Borrelia garinii PBi
VSRLRDFFNFPGMRI

SEQ ID NO: 175980 - protein, 9 aa, Borrelia garinii PBi
RLRDFFNFP

SEQ ID NO: 175981 - protein, 15 aa, Borrelia garinii PBi
VSRLRDFFNFPGMRI

SEQ ID NO: 175982 - protein, 9 aa, Borrelia garinii PBi
VSRLRDFFN

SEQ ID NO: 175983 - protein, 15 aa, Borrelia garinii PBi
VVWDMIRSAMSSVSD

SEQ ID NO: 175984 - protein, 9 aa, Borrelia garinii PBi
IRSAMSSVS

SEQ ID NO: 175985 - protein, 15 aa, Borrelia garinii PBi
VVWDMIRSAMSSVSD

SEQ ID NO: 175986 - protein, 9 aa, Borrelia garinii PBi
MIRSAMSSV

SEQ ID NO: 175987 - protein, 15 aa, Borrelia garinii PBi
VVWDMIRSAMSSVSD

SEQ ID NO: 175988 - protein, 9 aa, Borrelia garinii PBi
WDMIRSAMS

SEQ ID NO: 175989 - protein, 15 aa, Borrelia garinii PBi
VWAHQKYFKLRFDAS

SEQ ID NO: 175990 - protein, 9 aa, Borrelia garinii PBi
QKYFKLRFD

SEQ ID NO: 175991 - protein, 15 aa, Borrelia garinii PBi
VWAHQKYFKLRFDAS

SEQ ID NO: 175992 - protein, 9 aa, Borrelia garinii PBi
WAHQKYFKL

SEQ ID NO: 175993 - protein, 15 aa, Borrelia garinii PBi
VWDMIRSAMSSVSDS

SEQ ID NO: 175994 - protein, 9 aa, Borrelia garinii PBi
IRSAMSSVS

SEQ ID NO: 175995 - protein, 15 aa, Borrelia garinii PBi
VWDMIRSAMSSVSDS

SEQ ID NO: 175996 - protein, 9 aa, Borrelia garinii PBi
MIRSAMSSV

SEQ ID NO: 175997 - protein, 15 aa, Borrelia garinii PBi
VWDMIRSAMSSVSDS

SEQ ID NO: 175998 - protein, 9 aa, Borrelia garinii PBi
WDMIRSAMS

SEQ ID NO: 175999 - protein, 15 aa, Borrelia garinii PBi
VYTGIGDNSTIREFV

SEQ ID NO: 176000 - protein, 9 aa, Borrelia garinii PBi
IGDNSTIRE

SEQ ID NO: 176001 - protein, 15 aa, Borrelia garinii PBi
VYTGIGDNSTIREFV

SEQ ID NO: 176002 - protein, 9 aa, Borrelia garinii PBi
YTGIGDNST

SEQ ID NO: 176003 - protein, 15 aa, Borrelia garinii PBi
VYYIDLEALDKFIDS

SEQ ID NO: 176004 - protein, 9 aa, Borrelia garinii PBi
YIDLEALDK

SEQ ID NO: 176005 - protein, 15 aa, Borrelia garinii PBi
WAKRIGILRKYIDVI

SEQ ID NO: 176006 - protein, 9 aa, Borrelia garinii PBi
IGILRKYID

SEQ ID NO: 176007 - protein, 15 aa, Borrelia garinii PBi
WAKRIGILRKYIDVI

SEQ ID NO: 176008 - protein, 9 aa, Borrelia garinii PBi
WAKRIGILR

SEQ ID NO: 176009 - protein, 15 aa, Borrelia garinii PBi
WDMIRSAMSSVSDSV

SEQ ID NO: 176010 - protein, 9 aa, Borrelia garinii PBi
IRSAMSSVS

SEQ ID NO: 176011 - protein, 15 aa, Borrelia garinii PBi
WDMIRSAMSSVSDSV

SEQ ID NO: 176012 - protein, 9 aa, Borrelia garinii PBi
WDMIRSAMS

SEQ ID NO: 176013 - protein, 15 aa, Borrelia garinii PBi
WEVGVGEAYAFNGLW

SEQ ID NO: 176014 - protein, 9 aa, Borrelia garinii PBi
VGVGEAYAF

SEQ ID NO: 176015 - protein, 15 aa, Borrelia garinii PBi
WIFRLLESDLDATLS

SEQ ID NO: 176016 - protein, 9 aa, Borrelia garinii PBi
FRLLESDLD

SEQ ID NO: 176017 - protein, 15 aa, Borrelia garinii PBi
WNVLKNVKYEWWAKR

SEQ ID NO: 176018 - protein, 9 aa, Borrelia garinii PBi
NVKYEWWAK

SEQ ID NO: 176019 - protein, 15 aa, Borrelia garinii PBi
WNVLKNVKYEWWAKR

SEQ ID NO: 176020 - protein, 9 aa, Borrelia garinii PBi
WNVLKNVKY

SEQ ID NO: 176021 - protein, 15 aa, Borrelia garinii PBi
WQMFAYSPIDFTRSP

SEQ ID NO: 176022 - protein, 9 aa, Borrelia garinii PBi
MFAYSPIDF

SEQ ID NO: 176023 - protein, 15 aa, Borrelia garinii PBi
WQMFAYSPIDFTRSP

SEQ ID NO: 176024 - protein, 9 aa, Borrelia garinii PBi
YSPIDFTRS

SEQ ID NO: 176025 - protein, 15 aa, Borrelia garinii PBi
WWAKRIGILRKYIDV

SEQ ID NO: 176026 - protein, 9 aa, Borrelia garinii PBi
IGILRKYID

SEQ ID NO: 176027 - protein, 15 aa, Borrelia garinii PBi
YAFNGLWVKSPGRDF

SEQ ID NO: 176028 - protein, 9 aa, Borrelia garinii PBi
FNGLWVKSP

SEQ ID NO: 176029 - protein, 15 aa, Borrelia garinii PBi
YDSADVWAHQKYFKL

SEQ ID NO: 176030 - protein, 9 aa, Borrelia garinii PBi
VWAHQKYFK

SEQ ID NO: 176031 - protein, 15 aa, Borrelia garinii PBi
YEWWAKRIGILRKYI

SEQ ID NO: 176032 - protein, 9 aa, Borrelia garinii PBi
WAKRIGILR

SEQ ID NO: 176033 - protein, 15 aa, Borrelia garinii PBi
YEWWAKRIGILRKYI

SEQ ID NO: 176034 - protein, 9 aa, Borrelia garinii PBi
YEWWAKRIG

SEQ ID NO: 176035 - protein, 15 aa, Borrelia garinii PBi
YFFFSQFQALKRYAN

SEQ ID NO: 176036 - protein, 9 aa, Borrelia garinii PBi
FFSQFQALK

SEQ ID NO: 176037 - protein, 15 aa, Borrelia garinii PBi
YFFFSQFQALKRYAN

SEQ ID NO: 176038 - protein, 9 aa, Borrelia garinii PBi
FSQFQALKR

SEQ ID NO: 176039 - protein, 15 aa, Borrelia garinii PBi
YFLEQEQAWDSPAYS

SEQ ID NO: 176040 - protein, 9 aa, Borrelia garinii PBi
EQAWDSPAY

SEQ ID NO: 176041 - protein, 15 aa, Borrelia garinii PBi
YGIGDLGKGAYKFID

SEQ ID NO: 176042 - protein, 9 aa, Borrelia garinii PBi
LGKGAYKFI

SEQ ID NO: 176043 - protein, 15 aa, Borrelia garinii PBi
YIFDYLNTNEDFVVW

SEQ ID NO: 176044 - protein, 9 aa, Borrelia garinii PBi
FDYLNTNED

SEQ ID NO: 176045 - protein, 15 aa, Borrelia garinii PBi
YIFDYLNTNEDFVVW

SEQ ID NO: 176046 - protein, 9 aa, Borrelia garinii PBi
YIFDYLNTN

SEQ ID NO: 176047 - protein, 15 aa, Borrelia garinii PBi
YIFDYLNTNEDFVVW

SEQ ID NO: 176048 - protein, 9 aa, Borrelia garinii PBi
YLNTNEDFV

SEQ ID NO: 176049 - protein, 15 aa, Borrelia garinii PBi
YIKNCIVYTGIGDNS

SEQ ID NO: 176050 - protein, 9 aa, Borrelia garinii PBi
IKNCIVYTG

SEQ ID NO: 176051 - protein, 15 aa, Borrelia garinii PBi
YINLGNEFRANIPKN

SEQ ID NO: 176052 - protein, 9 aa, Borrelia garinii PBi
YINLGNEFR

SEQ ID NO: 176053 - protein, 15 aa, Borrelia garinii PBi
YKFIDFLFASSQSYW

SEQ ID NO: 176054 - protein, 9 aa, Borrelia garinii PBi
FIDFLFASS

SEQ ID NO: 176055 - protein, 15 aa, Borrelia garinii PBi
YKFIDFLFASSQSYW

SEQ ID NO: 176056 - protein, 9 aa, Borrelia garinii PBi
FLFASSQSY

SEQ ID NO: 176057 - protein, 15 aa, Borrelia garinii PBi
YKKIRINLNLKRKSG

SEQ ID NO: 176058 - protein, 9 aa, Borrelia garinii PBi
INLNLKRKS

SEQ ID NO: 176059 - protein, 15 aa, Borrelia garinii PBi
YKKIRINLNLKRKSG

SEQ ID NO: 176060 - protein, 9 aa, Borrelia garinii PBi
IRINLNLKR

SEQ ID NO: 176061 - protein, 15 aa, Borrelia garinii PBi
YKKIRINLNLKRKSG

SEQ ID NO: 176062 - protein, 9 aa, Borrelia garinii PBi
YKKIRINLN

SEQ ID NO: 176063 - protein, 15 aa, Borrelia garinii PBi
YSIFSAFAGNVYYID

SEQ ID NO: 176064 - protein, 9 aa, Borrelia garinii PBi
IFSAFAGNV

SEQ ID NO: 176065 - protein, 15 aa, Borrelia garinii PBi
YSPIDFTRSPPYSIF

SEQ ID NO: 176066 - protein, 9 aa, Borrelia garinii PBi
FTRSPPYSI

SEQ ID NO: 176067 - protein, 15 aa, Borrelia garinii PBi
YSWNVLKNVKYEWWA

SEQ ID NO: 176068 - protein, 9 aa, Borrelia garinii PBi
WNVLKNVKY

SEQ ID NO: 176069 - protein, 15 aa, Borrelia garinii PBi
YTGIGDNSTIREFVN

SEQ ID NO: 176070 - protein, 9 aa, Borrelia garinii PBi
IGDNSTIRE

SEQ ID NO: 176071 - protein, 15 aa, Borrelia garinii PBi
YTGIGDNSTIREFVN

SEQ ID NO: 176072 - protein, 9 aa, Borrelia garinii PBi
YTGIGDNST

SEQ ID NO: 176073 - protein, 15 aa, Borrelia garinii PBi
YWQMFAYSPIDFTRS

SEQ ID NO: 176074 - protein, 9 aa, Borrelia garinii PBi
MFAYSPIDF

SEQ ID NO: 176075 - protein, 15 aa, Borrelia garinii PBi
YWQMFAYSPIDFTRS

SEQ ID NO: 176076 - protein, 9 aa, Borrelia garinii PBi
WQMFAYSPI

SEQ ID NO: 176077 - protein, 15 aa, Borrelia garinii PBi
YWQMFAYSPIDFTRS

SEQ ID NO: 176078 - protein, 9 aa, Borrelia garinii PBi
YWQMFAYSP

SEQ ID NO: 176079 - protein, 15 aa, Borrelia garinii PBi
AALNFINRASVDEVR

SEQ ID NO: 176080 - protein, 9 aa, Borrelia garinii PBi
FINRASVDE

SEQ ID NO: 176081 - protein, 15 aa, Borrelia garinii PBi
AALNFINRASVDEVR

SEQ ID NO: 176082 - protein, 9 aa, Borrelia garinii PBi
INRASVDEV

SEQ ID NO: 176083 - protein, 8 aa, Borrelia garinii
KYLLGIGL

SEQ ID NO: 176084 - protein, 8 aa, Borrelia garinii
YLLGIGLI

SEQ ID NO: 176085 - protein, 8 aa, Borrelia garinii
LLGIGLIL

SEQ ID NO: 176086 - protein, 8 aa, Borrelia garinii
GIGLILAL

SEQ ID NO: 176087 - protein, 8 aa, Borrelia garinii
GLILALIA

SEQ ID NO: 176088 - protein, 8 aa, Borrelia garinii
ILALIACK

SEQ ID NO: 176089 - protein, 8 aa, Borrelia garinii
LIACKQNV

SEQ ID NO: 176090 - protein, 8 aa, Borrelia garinii
NVSSLDEK

SEQ ID NO: 176091 - protein, 8 aa, Borrelia garinii
SLDEKNSV

SEQ ID NO: 176092 - protein, 8 aa, Borrelia garinii
SVDLPGGM

SEQ ID NO: 176093 - protein, 8 aa, Borrelia garinii
DLPGGMKV

SEQ ID NO: 176094 - protein, 8 aa, Borrelia garinii
LPGGMKVL

SEQ ID NO: 176095 - protein, 8 aa, Borrelia garinii
GMKVLVSK

SEQ ID NO: 176096 - protein, 8 aa, Borrelia garinii
KVLVSKEK

SEQ ID NO: 176097 - protein, 8 aa, Borrelia garinii
KYSLMATV

SEQ ID NO: 176098 - protein, 8 aa, Borrelia garinii
SLMATVEK

SEQ ID NO: 176099 - protein, 8 aa, Borrelia garinii
LMATVEKL

SEQ ID NO: 176100 - protein, 8 aa, Borrelia garinii
ATVEKLEL

SEQ ID NO: 176101 - protein, 8 aa, Borrelia garinii
TVEKLELK

SEQ ID NO: 176102 - protein, 8 aa, Borrelia garinii
ELKGTSDK

SEQ ID NO: 176103 - protein, 8 aa, Borrelia garinii
KTDKSKVK

SEQ ID NO: 176104 - protein, 8 aa, Borrelia garinii
KLTIAEDL

SEQ ID NO: 176105 - protein, 8 aa, Borrelia garinii
TIAEDLSK

SEQ ID NO: 176106 - protein, 8 aa, Borrelia garinii
AEDLSKTT

SEQ ID NO: 176107 - protein, 8 aa, Borrelia garinii
KTTFEIFK

SEQ ID NO: 176108 - protein, 8 aa, Borrelia garinii
TTFEIFKE

SEQ ID NO: 176109 - protein, 8 aa, Borrelia garinii
EIFKEDGK

SEQ ID NO: 176110 - protein, 8 aa, Borrelia garinii
FKEDGKTL

SEQ ID NO: 176111 - protein, 8 aa, Borrelia garinii
KEDGKTLV

SEQ ID NO: 176112 - protein, 8 aa, Borrelia garinii
LVSKKVTL

SEQ ID NO: 176113 - protein, 8 aa, Borrelia garinii
VSKKVTLK

SEQ ID NO: 176114 - protein, 8 aa, Borrelia garinii
TLKDKSST

SEQ ID NO: 176115 - protein, 8 aa, Borrelia garinii
KSSTEEKF

SEQ ID NO: 176116 - protein, 8 aa, Borrelia garinii
GEISEKTI

SEQ ID NO: 176117 - protein, 8 aa, Borrelia garinii
EISEKTIV

SEQ ID NO: 176118 - protein, 8 aa, Borrelia garinii
ISEKTIVR

SEQ ID NO: 176119 - protein, 8 aa, Borrelia garinii
IVRANGTR

SEQ ID NO: 176120 - protein, 8 aa, Borrelia garinii
RLEYTDIK

SEQ ID NO: 176121 - protein, 8 aa, Borrelia garinii
EVLKDFTL

SEQ ID NO: 176122 - protein, 8 aa, Borrelia garinii
FTLEGTLA

SEQ ID NO: 176123 - protein, 8 aa, Borrelia garinii
TLEGTLAA

SEQ ID NO: 176124 - protein, 8 aa, Borrelia garinii
GTLAADGK

SEQ ID NO: 176125 - protein, 8 aa, Borrelia garinii
AADGKTTL

SEQ ID NO: 176126 - protein, 8 aa, Borrelia garinii
KVTEGTVV

SEQ ID NO: 176127 - protein, 8 aa, Borrelia garinii
EGTVVLSK

SEQ ID NO: 176128 - protein, 8 aa, Borrelia garinii
TVVLSKNI

SEQ ID NO: 176129 - protein, 8 aa, Borrelia garinii
VLSKNILK

SEQ ID NO: 176130 - protein, 8 aa, Borrelia garinii
ALDDSDTT

SEQ ID NO: 176131 - protein, 8 aa, Borrelia garinii
DTTQATKK

SEQ ID NO: 176132 - protein, 8 aa, Borrelia garinii
KTGKWDSK

SEQ ID NO: 176133 - protein, 8 aa, Borrelia garinii
TSTLTISV

SEQ ID NO: 176134 - protein, 8 aa, Borrelia garinii
TISVNSQK

SEQ ID NO: 176135 - protein, 8 aa, Borrelia garinii
SVNSQKTK

SEQ ID NO: 176136 - protein, 8 aa, Borrelia garinii
SQKTKNLV

SEQ ID NO: 176137 - protein, 8 aa, Borrelia garinii
TKNLVFTK

SEQ ID NO: 176138 - protein, 8 aa, Borrelia garinii
EDTITVQK

SEQ ID NO: 176139 - protein, 8 aa, Borrelia garinii
DTITVQKY

SEQ ID NO: 176140 - protein, 8 aa, Borrelia garinii
KAVEITTL

SEQ ID NO: 176141 - protein, 8 aa, Borrelia garinii
EITTLEKL

SEQ ID NO: 176142 - protein, 8 aa, Borrelia garinii
ITTLEKLK

SEQ ID NO: 176143 - protein, 9 aa, Borrelia garinii
KYLLGIGLI

SEQ ID NO: 176144 - protein, 9 aa, Borrelia garinii
YLLGIGLIL

SEQ ID NO: 176145 - protein, 9 aa, Borrelia garinii
LLGIGLILA

SEQ ID NO: 176146 - protein, 9 aa, Borrelia garinii
GIGLILALI

SEQ ID NO: 176147 - protein, 9 aa, Borrelia garinii
LILALIACK

SEQ ID NO: 176148 - protein, 9 aa, Borrelia garinii
ALIACKQNV

SEQ ID NO: 176149 - protein, 9 aa, Borrelia garinii
SSLDEKNSV

SEQ ID NO: 176150 - protein, 9 aa, Borrelia garinii
SLDEKNSVS

SEQ ID NO: 176151 - protein, 9 aa, Borrelia garinii
SVDLPGGMK

SEQ ID NO: 176152 - protein, 9 aa, Borrelia garinii
VDLPGGMKV

SEQ ID NO: 176153 - protein, 9 aa, Borrelia garinii
DLPGGMKVL

SEQ ID NO: 176154 - protein, 9 aa, Borrelia garinii
LPGGMKVLV

SEQ ID NO: 176155 - protein, 9 aa, Borrelia garinii
GGMKVLVSK

SEQ ID NO: 176156 - protein, 9 aa, Borrelia garinii
GKYSLMATV

SEQ ID NO: 176157 - protein, 9 aa, Borrelia garinii
YSLMATVEK

SEQ ID NO: 176158 - protein, 9 aa, Borrelia garinii
SLMATVEKL

SEQ ID NO: 176159 - protein, 9 aa, Borrelia garinii
ATVEKLELK

SEQ ID NO: 176160 - protein, 9 aa, Borrelia garinii
GSGTLEGEK

SEQ ID NO: 176161 - protein, 9 aa, Borrelia garinii
LTIAEDLSK

SEQ ID NO: 176162 - protein, 9 aa, Borrelia garinii
AEDLSKTTF

SEQ ID NO: 176163 - protein, 9 aa, Borrelia garinii
DLSKTTFEI

SEQ ID NO: 176164 - protein, 9 aa, Borrelia garinii
FKEDGKTLV

SEQ ID NO: 176165 - protein, 9 aa, Borrelia garinii
TLVSKKVTL

SEQ ID NO: 176166 - protein, 9 aa, Borrelia garinii
LVSKKVTLK

SEQ ID NO: 176167 - protein, 9 aa, Borrelia garinii
KDKSSTEEK

SEQ ID NO: 176168 - protein, 9 aa, Borrelia garinii
STEEKFNEK

SEQ ID NO: 176169 - protein, 9 aa, Borrelia garinii
GEISEKTIV

SEQ ID NO: 176170 - protein, 9 aa, Borrelia garinii
EISEKTIVR

SEQ ID NO: 176171 - protein, 9 aa, Borrelia garinii
TIVRANGTR

SEQ ID NO: 176172 - protein, 9 aa, Borrelia garinii
IVRANGTRL

SEQ ID NO: 176173 - protein, 9 aa, Borrelia garinii
RANGTRLEY

SEQ ID NO: 176174 - protein, 9 aa, Borrelia garinii
KSDGSGKAK

SEQ ID NO: 176175 - protein, 9 aa, Borrelia garinii
SGKAKEVLK

SEQ ID NO: 176176 - protein, 9 aa, Borrelia garinii
KEVLKDFTL

SEQ ID NO: 176177 - protein, 9 aa, Borrelia garinii
VLKDFTLEG

SEQ ID NO: 176178 - protein, 9 aa, Borrelia garinii
FTLEGTLAA

SEQ ID NO: 176179 - protein, 9 aa, Borrelia garinii
LAADGKTTL

SEQ ID NO: 176180 - protein, 9 aa, Borrelia garinii
AADGKTTLK

SEQ ID NO: 176181 - protein, 9 aa, Borrelia garinii
TTLKVTEGT

SEQ ID NO: 176182 - protein, 9 aa, Borrelia garinii
TLKVTEGTV

SEQ ID NO: 176183 - protein, 9 aa, Borrelia garinii
KVTEGTVVL

SEQ ID NO: 176184 - protein, 9 aa, Borrelia garinii
VVLSKNILK

SEQ ID NO: 176185 - protein, 9 aa, Borrelia garinii
VLSKNILKS

SEQ ID NO: 176186 - protein, 9 aa, Borrelia garinii
ILKSGEITV

SEQ ID NO: 176187 - protein, 9 aa, Borrelia garinii
KSGEITVAL

SEQ ID NO: 176188 - protein, 9 aa, Borrelia garinii
ALDDSDTTQ

SEQ ID NO: 176189 - protein, 9 aa, Borrelia garinii
TQATKKTGK

SEQ ID NO: 176190 - protein, 9 aa, Borrelia garinii
KTSTLTISV

SEQ ID NO: 176191 - protein, 9 aa, Borrelia garinii
LTISVNSQK

SEQ ID NO: 176192 - protein, 9 aa, Borrelia garinii
ISVNSQKTK

SEQ ID NO: 176193 - protein, 9 aa, Borrelia garinii
SQKTKNLVF

SEQ ID NO: 176194 - protein, 9 aa, Borrelia garinii
KTKNLVFTK

SEQ ID NO: 176195 - protein, 9 aa, Borrelia garinii
FTKEDTITV

SEQ ID NO: 176196 - protein, 9 aa, Borrelia garinii
KYDSAGTNL

SEQ ID NO: 176197 - protein, 9 aa, Borrelia garinii
SAGTNLEGK

SEQ ID NO: 176198 - protein, 9 aa, Borrelia garinii
NLEGKAVEI

SEQ ID NO: 176199 - protein, 9 aa, Borrelia garinii
AVEITTLEK

SEQ ID NO: 176200 - protein, 9 aa, Borrelia garinii
VEITTLEKL

SEQ ID NO: 176201 - protein, 9 aa, Borrelia garinii
EITTLEKLK

SEQ ID NO: 176202 - protein, 9 aa, Borrelia garinii
TLEKLKDAL

SEQ ID NO: 176203 - protein, 10 aa, Borrelia garinii
KYLLGIGLIL

SEQ ID NO: 176204 - protein, 10 aa, Borrelia garinii
YLLGIGLILA

SEQ ID NO: 176205 - protein, 10 aa, Borrelia garinii
LLGIGLILAL

SEQ ID NO: 176206 - protein, 10 aa, Borrelia garinii
LGIGLILALI

SEQ ID NO: 176207 - protein, 10 aa, Borrelia garinii
GLILALIACK

SEQ ID NO: 176208 - protein, 10 aa, Borrelia garinii
KQNVSSLDEK

SEQ ID NO: 176209 - protein, 10 aa, Borrelia garinii
SLDEKNSVSV

SEQ ID NO: 176210 - protein, 10 aa, Borrelia garinii
SVSVDLPGGM

SEQ ID NO: 176211 - protein, 10 aa, Borrelia garinii
VSVDLPGGMK

SEQ ID NO: 176212 - protein, 10 aa, Borrelia garinii
SVDLPGGMKV

SEQ ID NO: 176213 - protein, 10 aa, Borrelia garinii
VDLPGGMKVL

SEQ ID NO: 176214 - protein, 10 aa, Borrelia garinii
DLPGGMKVLV

SEQ ID NO: 176215 - protein, 10 aa, Borrelia garinii
LPGGMKVLVS

SEQ ID NO: 176216 - protein, 10 aa, Borrelia garinii
GMKVLVSKEK

SEQ ID NO: 176217 - protein, 10 aa, Borrelia garinii
KVLVSKEKDK

SEQ ID NO: 176218 - protein, 10 aa, Borrelia garinii
KYSLMATVEK

SEQ ID NO: 176219 - protein, 10 aa, Borrelia garinii
YSLMATVEKL

SEQ ID NO: 176220 - protein, 10 aa, Borrelia garinii
LMATVEKLEL

SEQ ID NO: 176221 - protein, 10 aa, Borrelia garinii
MATVEKLELK

SEQ ID NO: 176222 - protein, 10 aa, Borrelia garinii
KLELKGTSDK

SEQ ID NO: 176223 - protein, 10 aa, Borrelia garinii
GTLEGEKTDK

SEQ ID NO: 176224 - protein, 10 aa, Borrelia garinii
KLTIAEDLSK

SEQ ID NO: 176225 - protein, 10 aa, Borrelia garinii
IAEDLSKTTF

SEQ ID NO: 176226 - protein, 10 aa, Borrelia garinii
DLSKTTFEIF

SEQ ID NO: 176227 - protein, 10 aa, Borrelia garinii
LSKTTFEIFK

SEQ ID NO: 176228 - protein, 10 aa, Borrelia garinii
EIFKEDGKTL

SEQ ID NO: 176229 - protein, 10 aa, Borrelia garinii
TLVSKKVTLK

SEQ ID NO: 176230 - protein, 10 aa, Borrelia garinii
VSKKVTLKDK

SEQ ID NO: 176231 - protein, 10 aa, Borrelia garinii
SSTEEKFNEK

SEQ ID NO: 176232 - protein, 10 aa, Borrelia garinii
EEKFNEKGEI

SEQ ID NO: 176233 - protein, 10 aa, Borrelia garinii
EISEKTIVRA

SEQ ID NO: 176234 - protein, 10 aa, Borrelia garinii
KTIVRANGTR

SEQ ID NO: 176235 - protein, 10 aa, Borrelia garinii
TIVRANGTRL

SEQ ID NO: 176236 - protein, 10 aa, Borrelia garinii
GTRLEYTDIK

SEQ ID NO: 176237 - protein, 10 aa, Borrelia garinii
GSGKAKEVLK

SEQ ID NO: 176238 - protein, 10 aa, Borrelia garinii
VLKDFTLEGT

SEQ ID NO: 176239 - protein, 10 aa, Borrelia garinii
FTLEGTLAAD

SEQ ID NO: 176240 - protein, 10 aa, Borrelia garinii
TLAADGKTTL

SEQ ID NO: 176241 - protein, 10 aa, Borrelia garinii
LAADGKTTLK

SEQ ID NO: 176242 - protein, 10 aa, Borrelia garinii
AADGKTTLKV

SEQ ID NO: 176243 - protein, 10 aa, Borrelia garinii
TTLKVTEGTV

SEQ ID NO: 176244 - protein, 10 aa, Borrelia garinii
TLKVTEGTVV

SEQ ID NO: 176245 - protein, 10 aa, Borrelia garinii
VTEGTVVLSK

SEQ ID NO: 176246 - protein, 10 aa, Borrelia garinii
TVVLSKNILK

SEQ ID NO: 176247 - protein, 10 aa, Borrelia garinii
NILKSGEITV

SEQ ID NO: 176248 - protein, 10 aa, Borrelia garinii
ILKSGEITVA

SEQ ID NO: 176249 - protein, 10 aa, Borrelia garinii
ALDDSDTTQA

SEQ ID NO: 176250 - protein, 10 aa, Borrelia garinii
TTQATKKTGK

SEQ ID NO: 176251 - protein, 10 aa, Borrelia garinii
SKTSTLTISV

SEQ ID NO: 176252 - protein, 10 aa, Borrelia garinii
TLTISVNSQK

SEQ ID NO: 176253 - protein, 10 aa, Borrelia garinii
TISVNSQKTK

SEQ ID NO: 176254 - protein, 10 aa, Borrelia garinii
NSQKTKNLVF

SEQ ID NO: 176255 - protein, 10 aa, Borrelia garinii
NLVFTKEDTI

SEQ ID NO: 176256 - protein, 10 aa, Borrelia garinii
VFTKEDTITV

SEQ ID NO: 176257 - protein, 10 aa, Borrelia garinii
DSAGTNLEGK

SEQ ID NO: 176258 - protein, 10 aa, Borrelia garinii
KAVEITTLEK

SEQ ID NO: 176259 - protein, 10 aa, Borrelia garinii
TTLEKLKDAL

SEQ ID NO: 176260 - protein, 10 aa, Borrelia garinii
TLEKLKDALK

SEQ ID NO: 176261 - protein, 11 aa, Borrelia garinii
YLLGIGLILAL

SEQ ID NO: 176262 - protein, 11 aa, Borrelia garinii
LLGIGLILALI

SEQ ID NO: 176263 - protein, 11 aa, Borrelia garinii
ILALIACKQNV

SEQ ID NO: 176264 - protein, 11 aa, Borrelia garinii
LIACKQNVSSL

SEQ ID NO: 176265 - protein, 11 aa, Borrelia garinii
NVSSLDEKNSV

SEQ ID NO: 176266 - protein, 11 aa, Borrelia garinii
SSLDEKNSVSV

SEQ ID NO: 176267 - protein, 11 aa, Borrelia garinii
SVSVDLPGGMK

SEQ ID NO: 176268 - protein, 11 aa, Borrelia garinii
SVDLPGGMKVL

SEQ ID NO: 176269 - protein, 11 aa, Borrelia garinii
VDLPGGMKVLV

SEQ ID NO: 176270 - protein, 11 aa, Borrelia garinii
LPGGMKVLVSK

SEQ ID NO: 176271 - protein, 11 aa, Borrelia garinii
LVSKEKDKDGK

SEQ ID NO: 176272 - protein, 11 aa, Borrelia garinii
KYSLMATVEKL

SEQ ID NO: 176273 - protein, 11 aa, Borrelia garinii
SLMATVEKLEL

SEQ ID NO: 176274 - protein, 11 aa, Borrelia garinii
LMATVEKLELK

SEQ ID NO: 176275 - protein, 11 aa, Borrelia garinii
GEKTDKSKVKL

SEQ ID NO: 176276 - protein, 11 aa, Borrelia garinii
KTDKSKVKLTI

SEQ ID NO: 176277 - protein, 11 aa, Borrelia garinii
TIAEDLSKTTF

SEQ ID NO: 176278 - protein, 11 aa, Borrelia garinii
AEDLSKTTFEI

SEQ ID NO: 176279 - protein, 11 aa, Borrelia garinii
DLSKTTFEIFK

SEQ ID NO: 176280 - protein, 11 aa, Borrelia garinii
TTFEIFKEDGK

SEQ ID NO: 176281 - protein, 11 aa, Borrelia garinii
FEIFKEDGKTL

SEQ ID NO: 176282 - protein, 11 aa, Borrelia garinii
EIFKEDGKTLV

SEQ ID NO: 176283 - protein, 11 aa, Borrelia garinii
KTLVSKKVTLK

SEQ ID NO: 176284 - protein, 11 aa, Borrelia garinii
LVSKKVTLKDK

SEQ ID NO: 176285 - protein, 11 aa, Borrelia garinii
TLKDKSSTEEK

SEQ ID NO: 176286 - protein, 11 aa, Borrelia garinii
KSSTEEKFNEK

SEQ ID NO: 176287 - protein, 11 aa, Borrelia garinii
KFNEKGEISEK

SEQ ID NO: 176288 - protein, 11 aa, Borrelia garinii
EKTIVRANGTR

SEQ ID NO: 176289 - protein, 11 aa, Borrelia garinii
KTIVRANGTRL

SEQ ID NO: 176290 - protein, 11 aa, Borrelia garinii
IVRANGTRLEY

SEQ ID NO: 176291 - protein, 11 aa, Borrelia garinii
YTDIKSDGSGK

SEQ ID NO: 176292 - protein, 11 aa, Borrelia garinii
VLKDFTLEGTL

SEQ ID NO: 176293 - protein, 11 aa, Borrelia garinii
TLEGTLAADGK

SEQ ID NO: 176294 - protein, 11 aa, Borrelia garinii
TLAADGKTTLK

SEQ ID NO: 176295 - protein, 11 aa, Borrelia garinii
LAADGKTTLKV

SEQ ID NO: 176296 - protein, 11 aa, Borrelia garinii
KTTLKVTEGTV

SEQ ID NO: 176297 - protein, 11 aa, Borrelia garinii
TTLKVTEGTVV

SEQ ID NO: 176298 - protein, 11 aa, Borrelia garinii
TLKVTEGTVVL

SEQ ID NO: 176299 - protein, 11 aa, Borrelia garinii
KVTEGTVVLSK

SEQ ID NO: 176300 - protein, 11 aa, Borrelia garinii
GTVVLSKNILK

SEQ ID NO: 176301 - protein, 11 aa, Borrelia garinii
ILKSGEITVAL

SEQ ID NO: 176302 - protein, 11 aa, Borrelia garinii
ALDDSDTTQAT

SEQ ID NO: 176303 - protein, 11 aa, Borrelia garinii
DTTQATKKTGK

SEQ ID NO: 176304 - protein, 11 aa, Borrelia garinii
ATKKTGKWDSK

SEQ ID NO: 176305 - protein, 11 aa, Borrelia garinii
KWDSKTSTLTI

SEQ ID NO: 176306 - protein, 11 aa, Borrelia garinii
STLTISVNSQK

SEQ ID NO: 176307 - protein, 11 aa, Borrelia garinii
LTISVNSQKTK

SEQ ID NO: 176308 - protein, 11 aa, Borrelia garinii
SVNSQKTKNLV

SEQ ID NO: 176309 - protein, 11 aa, Borrelia garinii
SQKTKNLVFTK

SEQ ID NO: 176310 - protein, 11 aa, Borrelia garinii
LVFTKEDTITV

SEQ ID NO: 176311 - protein, 11 aa, Borrelia garinii
FTKEDTITVQK

SEQ ID NO: 176312 - protein, 11 aa, Borrelia garinii
DTITVQKYDSA

SEQ ID NO: 176313 - protein, 11 aa, Borrelia garinii
VQKYDSAGTNL

SEQ ID NO: 176314 - protein, 11 aa, Borrelia garinii
NLEGKAVEITT

SEQ ID NO: 176315 - protein, 11 aa, Borrelia garinii
LEGKAVEITTL

SEQ ID NO: 176316 - protein, 11 aa, Borrelia garinii
KAVEITTLEKL

SEQ ID NO: 176317 - protein, 11 aa, Borrelia garinii
AVEITTLEKLK

SEQ ID NO: 176318 - protein, 11 aa, Borrelia garinii
TTLEKLKDALK

SEQ ID NO: 176319 - protein, 15 aa, Borrelia garinii
ADGKTTLKVTEGTVV

SEQ ID NO: 176320 - protein, 9 aa, Borrelia garinii
ADGKTTLKV

SEQ ID NO: 176321 - protein, 15 aa, Borrelia garinii
ADGKTTLKVTEGTVV

SEQ ID NO: 176322 - protein, 9 aa, Borrelia garinii
TLKVTEGTV

SEQ ID NO: 176323 - protein, 15 aa, Borrelia garinii
AGTNLEGKAVEITTL

SEQ ID NO: 176324 - protein, 9 aa, Borrelia garinii
LEGKAVEIT

SEQ ID NO: 176325 - protein, 15 aa, Borrelia garinii
AKEVLKDFTLEGTLA

SEQ ID NO: 176326 - protein, 9 aa, Borrelia garinii
VLKDFTLEG

SEQ ID NO: 176327 - protein, 15 aa, Borrelia garinii
DFTLEGTLAADGKTT

SEQ ID NO: 176328 - protein, 9 aa, Borrelia garinii
FTLEGTLAA

SEQ ID NO: 176329 - protein, 15 aa, Borrelia garinii
DGKTLVSKKVTLKDK

SEQ ID NO: 176330 - protein, 9 aa, Borrelia garinii
LVSKKVTLK

SEQ ID NO: 176331 - protein, 15 aa, Borrelia garinii
DGKTTLKVTEGTVVL

SEQ ID NO: 176332 - protein, 9 aa, Borrelia garinii
LKVTEGTVV

SEQ ID NO: 176333 - protein, 15 aa, Borrelia garinii
DGKYSLMATVEKLEL

SEQ ID NO: 176334 - protein, 9 aa, Borrelia garinii
YSLMATVEK

SEQ ID NO: 176335 - protein, 15 aa, Borrelia garinii
DKDGKYSLMATVEKL

SEQ ID NO: 176336 - protein, 9 aa, Borrelia garinii
YSLMATVEK

SEQ ID NO: 176337 - protein, 15 aa, Borrelia garinii
DLPGGMKVLVSKEKD

SEQ ID NO: 176338 - protein, 9 aa, Borrelia garinii
MKVLVSKEK

SEQ ID NO: 176339 - protein, 15 aa, Borrelia garinii
DSAGTNLEGKAVEIT

SEQ ID NO: 176340 - protein, 9 aa, Borrelia garinii
GTNLEGKAV

SEQ ID NO: 176341 - protein, 15 aa, Borrelia garinii
DTITVQKYDSAGTNL

SEQ ID NO: 176342 - protein, 9 aa, Borrelia garinii
VQKYDSAGT

SEQ ID NO: 176343 - protein, 15 aa, Borrelia garinii
EDGKTLVSKKVTLKD

SEQ ID NO: 176344 - protein, 9 aa, Borrelia garinii
GKTLVSKKV

SEQ ID NO: 176345 - protein, 15 aa, Borrelia garinii
EDGKTLVSKKVTLKD

SEQ ID NO: 176346 - protein, 9 aa, Borrelia garinii
LVSKKVTLK

SEQ ID NO: 176347 - protein, 15 aa, Borrelia garinii
EDTITVQKYDSAGTN

SEQ ID NO: 176348 - protein, 9 aa, Borrelia garinii
VQKYDSAGT

SEQ ID NO: 176349 - protein, 15 aa, Borrelia garinii
EGTVVLSKNILKSGE

SEQ ID NO: 176350 - protein, 9 aa, Borrelia garinii
TVVLSKNIL

SEQ ID NO: 176351 - protein, 15 aa, Borrelia garinii
EGTVVLSKNILKSGE

SEQ ID NO: 176352 - protein, 9 aa, Borrelia garinii
VLSKNILKS

SEQ ID NO: 176353 - protein, 15 aa, Borrelia garinii
EIFKEDGKTLVSKKV

SEQ ID NO: 176354 - protein, 9 aa, Borrelia garinii
FKEDGKTLV

SEQ ID NO: 176355 - protein, 15 aa, Borrelia garinii
EISEKTIVRANGTRL

SEQ ID NO: 176356 - protein, 9 aa, Borrelia garinii
KTIVRANGT

SEQ ID NO: 176357 - protein, 15 aa, Borrelia garinii
EKTIVRANGTRLEYT

SEQ ID NO: 176358 - protein, 9 aa, Borrelia garinii
IVRANGTRL

SEQ ID NO: 176359 - protein, 15 aa, Borrelia garinii
EVLKDFTLEGTLAAD

SEQ ID NO: 176360 - protein, 9 aa, Borrelia garinii
FTLEGTLAA

SEQ ID NO: 176361 - protein, 15 aa, Borrelia garinii
EYTDIKSDGSGKAKE

SEQ ID NO: 176362 - protein, 9 aa, Borrelia garinii
IKSDGSGKA

SEQ ID NO: 176363 - protein, 15 aa, Borrelia garinii
FKEDGKTLVSKKVTL

SEQ ID NO: 176364 - protein, 9 aa, Borrelia garinii
GKTLVSKKV

SEQ ID NO: 176365 - protein, 15 aa, Borrelia garinii
FTLEGTLAADGKTTL

SEQ ID NO: 176366 - protein, 9 aa, Borrelia garinii
FTLEGTLAA

SEQ ID NO: 176367 - protein, 15 aa, Borrelia garinii
GGMKVLVSKEKDKDG

SEQ ID NO: 176368 - protein, 9 aa, Borrelia garinii
MKVLVSKEK

SEQ ID NO: 176369 - protein, 15 aa, Borrelia garinii
GIGLILALIACKQNV

SEQ ID NO: 176370 - protein, 9 aa, Borrelia garinii
ILALIACKQ

SEQ ID NO: 176371 - protein, 15 aa, Borrelia garinii
GKAKEVLKDFTLEGT

SEQ ID NO: 176372 - protein, 9 aa, Borrelia garinii
VLKDFTLEG

SEQ ID NO: 176373 - protein, 15 aa, Borrelia garinii
GKTLVSKKVTLKDKS

SEQ ID NO: 176374 - protein, 9 aa, Borrelia garinii
LVSKKVTLK

SEQ ID NO: 176375 - protein, 15 aa, Borrelia garinii
GKTTLKVTEGTVVLS

SEQ ID NO: 176376 - protein, 9 aa, Borrelia garinii
LKVTEGTVV

SEQ ID NO: 176377 - protein, 15 aa, Borrelia garinii
GKWDSKTSTLTISVN

SEQ ID NO: 176378 - protein, 9 aa, Borrelia garinii
WDSKTSTLT

SEQ ID NO: 176379 - protein, 15 aa, Borrelia garinii
GKYSLMATVEKLELK

SEQ ID NO: 176380 - protein, 9 aa, Borrelia garinii
YSLMATVEK

SEQ ID NO: 176381 - protein, 15 aa, Borrelia garinii
GLILALIACKQNVSS

SEQ ID NO: 176382 - protein, 9 aa, Borrelia garinii
ILALIACKQ

SEQ ID NO: 176383 - protein, 15 aa, Borrelia garinii
GTNLEGKAVEITTLE

SEQ ID NO: 176384 - protein, 9 aa, Borrelia garinii
LEGKAVEIT

SEQ ID NO: 176385 - protein, 15 aa, Borrelia garinii
GTVVLSKNILKSGEI

SEQ ID NO: 176386 - protein, 9 aa, Borrelia garinii
VVLSKNILK

SEQ ID NO: 176387 - protein, 15 aa, Borrelia garinii
IFKEDGKTLVSKKVT

SEQ ID NO: 176388 - protein, 9 aa, Borrelia garinii
GKTLVSKKV

SEQ ID NO: 176389 - protein, 15 aa, Borrelia garinii
IGLILALIACKQNVS

SEQ ID NO: 176390 - protein, 9 aa, Borrelia garinii
ILALIACKQ

SEQ ID NO: 176391 - protein, 15 aa, Borrelia garinii
ILKSGEITVALDDSD

SEQ ID NO: 176392 - protein, 9 aa, Borrelia garinii
LKSGEITVA

SEQ ID NO: 176393 - protein, 15 aa, Borrelia garinii
ISEKTIVRANGTRLE

SEQ ID NO: 176394 - protein, 9 aa, Borrelia garinii
IVRANGTRL

SEQ ID NO: 176395 - protein, 15 aa, Borrelia garinii
ISVNSQKTKNLVFTK

SEQ ID NO: 176396 - protein, 9 aa, Borrelia garinii
VNSQKTKNL

SEQ ID NO: 176397 - protein, 15 aa, Borrelia garinii
ITVQKYDSAGTNLEG

SEQ ID NO: 176398 - protein, 9 aa, Borrelia garinii
VQKYDSAGT

SEQ ID NO: 176399 - protein, 15 aa, Borrelia garinii
ITVQKYDSAGTNLEG

SEQ ID NO: 176400 - protein, 9 aa, Borrelia garinii
YDSAGTNLE

SEQ ID NO: 176401 - protein, 15 aa, Borrelia garinii
IVRANGTRLEYTDIK

SEQ ID NO: 176402 - protein, 9 aa, Borrelia garinii
IVRANGTRL

SEQ ID NO: 176403 - protein, 15 aa, Borrelia garinii
KAKEVLKDFTLEGTL

SEQ ID NO: 176404 - protein, 9 aa, Borrelia garinii
VLKDFTLEG

SEQ ID NO: 176405 - protein, 15 aa, Borrelia garinii
KDFTLEGTLAADGKT

SEQ ID NO: 176406 - protein, 9 aa, Borrelia garinii
FTLEGTLAA

SEQ ID NO: 176407 - protein, 15 aa, Borrelia garinii
KDGKYSLMATVEKLE

SEQ ID NO: 176408 - protein, 9 aa, Borrelia garinii
YSLMATVEK

SEQ ID NO: 176409 - protein, 15 aa, Borrelia garinii
KDKDGKYSLMATVEK

SEQ ID NO: 176410 - protein, 9 aa, Borrelia garinii
KDGKYSLMA

SEQ ID NO: 176411 - protein, 15 aa, Borrelia garinii
KEDGKTLVSKKVTLK

SEQ ID NO: 176412 - protein, 9 aa, Borrelia garinii
GKTLVSKKV

SEQ ID NO: 176413 - protein, 15 aa, Borrelia garinii
KEDTITVQKYDSAGT

SEQ ID NO: 176414 - protein, 9 aa, Borrelia garinii
ITVQKYDSA

SEQ ID NO: 176415 - protein, 15 aa, Borrelia garinii
KEVLKDFTLEGTLAA

SEQ ID NO: 176416 - protein, 9 aa, Borrelia garinii
LKDFTLEGT

SEQ ID NO: 176417 - protein, 15 aa, Borrelia garinii
KEVLKDFTLEGTLAA

SEQ ID NO: 176418 - protein, 9 aa, Borrelia garinii
VLKDFTLEG

SEQ ID NO: 176419 - protein, 15 aa, Borrelia garinii
KKTGKWDSKTSTLTI

SEQ ID NO: 176420 - protein, 9 aa, Borrelia garinii
WDSKTSTLT

SEQ ID NO: 176421 - protein, 15 aa, Borrelia garinii
KKYLLGIGLILALIA

SEQ ID NO: 176422 - protein, 9 aa, Borrelia garinii
LLGIGLILA

SEQ ID NO: 176423 - protein, 15 aa, Borrelia garinii
KNILKSGEITVALDD

SEQ ID NO: 176424 - protein, 9 aa, Borrelia garinii
LKSGEITVA

SEQ ID NO: 176425 - protein, 15 aa, Borrelia garinii
KNLVFTKEDTITVQK

SEQ ID NO: 176426 - protein, 9 aa, Borrelia garinii
FTKEDTITV

SEQ ID NO: 176427 - protein, 15 aa, Borrelia garinii
KTGKWDSKTSTLTIS

SEQ ID NO: 176428 - protein, 9 aa, Borrelia garinii
WDSKTSTLT

SEQ ID NO: 176429 - protein, 15 aa, Borrelia garinii
KTIVRANGTRLEYTD

SEQ ID NO: 176430 - protein, 9 aa, Borrelia garinii
IVRANGTRL

SEQ ID NO: 176431 - protein, 15 aa, Borrelia garinii
KTKNLVFTKEDTITV

SEQ ID NO: 176432 - protein, 9 aa, Borrelia garinii
KTKNLVFTK

SEQ ID NO: 176433 - protein, 15 aa, Borrelia garinii
KTKNLVFTKEDTITV

SEQ ID NO: 176434 - protein, 9 aa, Borrelia garinii
VFTKEDTIT

SEQ ID NO: 176435 - protein, 15 aa, Borrelia garinii
KTTLKVTEGTVVLSK

SEQ ID NO: 176436 - protein, 9 aa, Borrelia garinii
LKVTEGTVV

SEQ ID NO: 176437 - protein, 15 aa, Borrelia garinii
KTTLKVTEGTVVLSK

SEQ ID NO: 176438 - protein, 9 aa, Borrelia garinii
VTEGTVVLS

SEQ ID NO: 176439 - protein, 15 aa, Borrelia garinii
KVTEGTVVLSKNILK

SEQ ID NO: 176440 - protein, 9 aa, Borrelia garinii
TVVLSKNIL

SEQ ID NO: 176441 - protein, 15 aa, Borrelia garinii
KVTEGTVVLSKNILK

SEQ ID NO: 176442 - protein, 9 aa, Borrelia garinii
VTEGTVVLS

SEQ ID NO: 176443 - protein, 15 aa, Borrelia garinii
KWDSKTSTLTISVNS

SEQ ID NO: 176444 - protein, 9 aa, Borrelia garinii
WDSKTSTLT

SEQ ID NO: 176445 - protein, 15 aa, Borrelia garinii
KYLLGIGLILALIAC

SEQ ID NO: 176446 - protein, 9 aa, Borrelia garinii
LLGIGLILA

SEQ ID NO: 176447 - protein, 15 aa, Borrelia garinii
LEGTLAADGKTTLKV

SEQ ID NO: 176448 - protein, 9 aa, Borrelia garinii
LEGTLAADG

SEQ ID NO: 176449 - protein, 15 aa, Borrelia garinii
LEYTDIKSDGSGKAK

SEQ ID NO: 176450 - protein, 9 aa, Borrelia garinii
IKSDGSGKA

SEQ ID NO: 176451 - protein, 15 aa, Borrelia garinii
LGIGLILALIACKQN

SEQ ID NO: 176452 - protein, 9 aa, Borrelia garinii
IGLILALIA

SEQ ID NO: 176453 - protein, 15 aa, Borrelia garinii
LKDFTLEGTLAADGK

SEQ ID NO: 176454 - protein, 9 aa, Borrelia garinii
FTLEGTLAA

SEQ ID NO: 176455 - protein, 15 aa, Borrelia garinii
LKSGEITVALDDSDT

SEQ ID NO: 176456 - protein, 9 aa, Borrelia garinii
LKSGEITVA

SEQ ID NO: 176457 - protein, 15 aa, Borrelia garinii
LKVTEGTVVLSKNIL

SEQ ID NO: 176458 - protein, 9 aa, Borrelia garinii
LKVTEGTVV

SEQ ID NO: 176459 - protein, 15 aa, Borrelia garinii
LKVTEGTVVLSKNIL

SEQ ID NO: 176460 - protein, 9 aa, Borrelia garinii
VTEGTVVLS

SEQ ID NO: 176461 - protein, 15 aa, Borrelia garinii
LLGIGLILALIACKQ

SEQ ID NO: 176462 - protein, 9 aa, Borrelia garinii
IGLILALIA

SEQ ID NO: 176463 - protein, 15 aa, Borrelia garinii
LPGGMKVLVSKEKDK

SEQ ID NO: 176464 - protein, 9 aa, Borrelia garinii
MKVLVSKEK

SEQ ID NO: 176465 - protein, 15 aa, Borrelia garinii
LSKNILKSGEITVAL

SEQ ID NO: 176466 - protein, 9 aa, Borrelia garinii
LKSGEITVA

SEQ ID NO: 176467 - protein, 15 aa, Borrelia garinii
LTISVNSQKTKNLVF

SEQ ID NO: 176468 - protein, 9 aa, Borrelia garinii
VNSQKTKNL

SEQ ID NO: 176469 - protein, 15 aa, Borrelia garinii
LVFTKEDTITVQKYD

SEQ ID NO: 176470 - protein, 9 aa, Borrelia garinii
FTKEDTITV

SEQ ID NO: 176471 - protein, 15 aa, Borrelia garinii
MKKYLLGIGLILALI

SEQ ID NO: 176472 - protein, 9 aa, Borrelia garinii
LLGIGLILA

SEQ ID NO: 176473 - protein, 15 aa, Borrelia garinii
NILKSGEITVALDDS

SEQ ID NO: 176474 - protein, 9 aa, Borrelia garinii
LKSGEITVA

SEQ ID NO: 176475 - protein, 15 aa, Borrelia garinii
NLVFTKEDTITVQKY

SEQ ID NO: 176476 - protein, 9 aa, Borrelia garinii
FTKEDTITV

SEQ ID NO: 176477 - protein, 15 aa, Borrelia garinii
NSVSVDLPGGMKVLV

SEQ ID NO: 176478 - protein, 9 aa, Borrelia garinii
VDLPGGMKV

SEQ ID NO: 176479 - protein, 15 aa, Borrelia garinii
PGGMKVLVSKEKDKD

SEQ ID NO: 176480 - protein, 9 aa, Borrelia garinii
MKVLVSKEK

SEQ ID NO: 176481 - protein, 15 aa, Borrelia garinii
QKYDSAGTNLEGKAV

SEQ ID NO: 176482 - protein, 9 aa, Borrelia garinii
YDSAGTNLE

SEQ ID NO: 176483 - protein, 15 aa, Borrelia garinii
RLEYTDIKSDGSGKA

SEQ ID NO: 176484 - protein, 9 aa, Borrelia garinii
YTDIKSDGS

SEQ ID NO: 176485 - protein, 15 aa, Borrelia garinii
SAGTNLEGKAVEITT

SEQ ID NO: 176486 - protein, 9 aa, Borrelia garinii
LEGKAVEIT

SEQ ID NO: 176487 - protein, 15 aa, Borrelia garinii
SEKTIVRANGTRLEY

SEQ ID NO: 176488 - protein, 9 aa, Borrelia garinii
IVRANGTRL

SEQ ID NO: 176489 - protein, 15 aa, Borrelia garinii
SGKAKEVLKDFTLEG

SEQ ID NO: 176490 - protein, 9 aa, Borrelia garinii
AKEVLKDFT

SEQ ID NO: 176491 - protein, 15 aa, Borrelia garinii
SKNILKSGEITVALD

SEQ ID NO: 176492 - protein, 9 aa, Borrelia garinii
LKSGEITVA

SEQ ID NO: 176493 - protein, 15 aa, Borrelia garinii
SKVKLTIAEDLSKTT

SEQ ID NO: 176494 - protein, 9 aa, Borrelia garinii
VKLTIAEDL

SEQ ID NO: 176495 - protein, 15 aa, Borrelia garinii
STLTISVNSQKTKNL

SEQ ID NO: 176496 - protein, 9 aa, Borrelia garinii
ISVNSQKTK

SEQ ID NO: 176497 - protein, 15 aa, Borrelia garinii
STLTISVNSQKTKNL

SEQ ID NO: 176498 - protein, 9 aa, Borrelia garinii
TISVNSQKT

SEQ ID NO: 176499 - protein, 15 aa, Borrelia garinii
SVDLPGGMKVLVSKE

SEQ ID NO: 176500 - protein, 9 aa, Borrelia garinii
LPGGMKVLV

SEQ ID NO: 176501 - protein, 15 aa, Borrelia garinii
SVSVDLPGGMKVLVS

SEQ ID NO: 176502 - protein, 9 aa, Borrelia garinii
LPGGMKVLV

SEQ ID NO: 176503 - protein, 15 aa, Borrelia garinii
TEGTVVLSKNILKSG

SEQ ID NO: 176504 - protein, 9 aa, Borrelia garinii
TVVLSKNIL

SEQ ID NO: 176505 - protein, 15 aa, Borrelia garinii
TEGTVVLSKNILKSG

SEQ ID NO: 176506 - protein, 9 aa, Borrelia garinii
VLSKNILKS

SEQ ID NO: 176507 - protein, 15 aa, Borrelia garinii
TGKWDSKTSTLTISV

SEQ ID NO: 176508 - protein, 9 aa, Borrelia garinii
WDSKTSTLT

SEQ ID NO: 176509 - protein, 15 aa, Borrelia garinii
TISVNSQKTKNLVFT

SEQ ID NO: 176510 - protein, 9 aa, Borrelia garinii
VNSQKTKNL

SEQ ID NO: 176511 - protein, 15 aa, Borrelia garinii
TITVQKYDSAGTNLE

SEQ ID NO: 176512 - protein, 9 aa, Borrelia garinii
VQKYDSAGT

SEQ ID NO: 176513 - protein, 15 aa, Borrelia garinii
TIVRANGTRLEYTDI

SEQ ID NO: 176514 - protein, 9 aa, Borrelia garinii
VRANGTRLE

SEQ ID NO: 176515 - protein, 15 aa, Borrelia garinii
TKKTGKWDSKTSTLT

SEQ ID NO: 176516 - protein, 9 aa, Borrelia garinii
TGKWDSKTS

SEQ ID NO: 176517 - protein, 15 aa, Borrelia garinii
TKNLVFTKEDTITVQ

SEQ ID NO: 176518 - protein, 9 aa, Borrelia garinii
FTKEDTITV

SEQ ID NO: 176519 - protein, 15 aa, Borrelia garinii
TLEGTLAADGKTTLK

SEQ ID NO: 176520 - protein, 9 aa, Borrelia garinii
LEGTLAADG

SEQ ID NO: 176521 - protein, 15 aa, Borrelia garinii
TLKVTEGTVVLSKNI

SEQ ID NO: 176522 - protein, 9 aa, Borrelia garinii
VTEGTVVLS

SEQ ID NO: 176523 - protein, 15 aa, Borrelia garinii
TLTISVNSQKTKNLV

SEQ ID NO: 176524 - protein, 9 aa, Borrelia garinii
VNSQKTKNL

SEQ ID NO: 176525 - protein, 15 aa, Borrelia garinii
TNLEGKAVEITTLEK

SEQ ID NO: 176526 - protein, 9 aa, Borrelia garinii
LEGKAVEIT

SEQ ID NO: 176527 - protein, 15 aa, Borrelia garinii
TTLKVTEGTVVLSKN

SEQ ID NO: 176528 - protein, 9 aa, Borrelia garinii
LKVTEGTVV

SEQ ID NO: 176529 - protein, 15 aa, Borrelia garinii
TTLKVTEGTVVLSKN

SEQ ID NO: 176530 - protein, 9 aa, Borrelia garinii
VTEGTVVLS

SEQ ID NO: 176531 - protein, 15 aa, Borrelia garinii
TVQKYDSAGTNLEGK

SEQ ID NO: 176532 - protein, 9 aa, Borrelia garinii
VQKYDSAGT

SEQ ID NO: 176533 - protein, 15 aa, Borrelia garinii
TVQKYDSAGTNLEGK

SEQ ID NO: 176534 - protein, 9 aa, Borrelia garinii
YDSAGTNLE

SEQ ID NO: 176535 - protein, 15 aa, Borrelia garinii
TVVLSKNILKSGEIT

SEQ ID NO: 176536 - protein, 9 aa, Borrelia garinii
TVVLSKNIL

SEQ ID NO: 176537 - protein, 15 aa, Borrelia garinii
VALDDSDTTQATKKT

SEQ ID NO: 176538 - protein, 9 aa, Borrelia garinii
LDDSDTTQA

SEQ ID NO: 176539 - protein, 15 aa, Borrelia garinii
VDLPGGMKVLVSKEK

SEQ ID NO: 176540 - protein, 9 aa, Borrelia garinii
LPGGMKVLV

SEQ ID NO: 176541 - protein, 15 aa, Borrelia garinii
VDLPGGMKVLVSKEK

SEQ ID NO: 176542 - protein, 9 aa, Borrelia garinii
VDLPGGMKV

SEQ ID NO: 176543 - protein, 15 aa, Borrelia garinii
VLKDFTLEGTLAADG

SEQ ID NO: 176544 - protein, 9 aa, Borrelia garinii
FTLEGTLAA

SEQ ID NO: 176545 - protein, 15 aa, Borrelia garinii
VLSKNILKSGEITVA

SEQ ID NO: 176546 - protein, 9 aa, Borrelia garinii
KNILKSGEI

SEQ ID NO: 176547 - protein, 15 aa, Borrelia garinii
VQKYDSAGTNLEGKA

SEQ ID NO: 176548 - protein, 9 aa, Borrelia garinii
VQKYDSAGT

SEQ ID NO: 176549 - protein, 15 aa, Borrelia garinii
VQKYDSAGTNLEGKA

SEQ ID NO: 176550 - protein, 9 aa, Borrelia garinii
YDSAGTNLE

SEQ ID NO: 176551 - protein, 15 aa, Borrelia garinii
VRANGTRLEYTDIKS

SEQ ID NO: 176552 - protein, 9 aa, Borrelia garinii
VRANGTRLE

SEQ ID NO: 176553 - protein, 15 aa, Borrelia garinii
VSVDLPGGMKVLVSK

SEQ ID NO: 176554 - protein, 9 aa, Borrelia garinii
LPGGMKVLV

SEQ ID NO: 176555 - protein, 15 aa, Borrelia garinii
VTEGTVVLSKNILKS

SEQ ID NO: 176556 - protein, 9 aa, Borrelia garinii
TVVLSKNIL

SEQ ID NO: 176557 - protein, 15 aa, Borrelia garinii
VTEGTVVLSKNILKS

SEQ ID NO: 176558 - protein, 9 aa, Borrelia garinii
VTEGTVVLS

SEQ ID NO: 176559 - protein, 15 aa, Borrelia garinii
VVLSKNILKSGEITV

SEQ ID NO: 176560 - protein, 9 aa, Borrelia garinii
VVLSKNILK

SEQ ID NO: 176561 - protein, 15 aa, Borrelia garinii
WDSKTSTLTISVNSQ

SEQ ID NO: 176562 - protein, 9 aa, Borrelia garinii
WDSKTSTLT

SEQ ID NO: 176563 - protein, 15 aa, Borrelia garinii
YLLGIGLILALIACK

SEQ ID NO: 176564 - protein, 9 aa, Borrelia garinii
IGLILALIA

SEQ ID NO: 176565 - protein, 15 aa, Borrelia garinii
YSLMATVEKLELKGT

SEQ ID NO: 176566 - protein, 9 aa, Borrelia garinii
YSLMATVEK

SEQ ID NO: 176567 - protein, 15 aa, Borrelia garinii
YTDIKSDGSGKAKEV

SEQ ID NO: 176568 - protein, 9 aa, Borrelia garinii
IKSDGSGKA

SEQ ID NO: 176569 - protein, 8 aa, Borrelia garinii
ILMTLFLF

SEQ ID NO: 176570 - protein, 8 aa, Borrelia garinii
LMTLFLFI

SEQ ID NO: 176571 - protein, 8 aa, Borrelia garinii
TLFLFISC

SEQ ID NO: 176572 - protein, 8 aa, Borrelia garinii
STNPDESA

SEQ ID NO: 176573 - protein, 8 aa, Borrelia garinii
ESAKGPNL

SEQ ID NO: 176574 - protein, 8 aa, Borrelia garinii
AKGPNLTV

SEQ ID NO: 176575 - protein, 8 aa, Borrelia garinii
NLTVISKK

SEQ ID NO: 176576 - protein, 8 aa, Borrelia garinii
KITDSNAF

SEQ ID NO: 176577 - protein, 8 aa, Borrelia garinii
ITDSNAFV

SEQ ID NO: 176578 - protein, 8 aa, Borrelia garinii
SNAFVLAV

SEQ ID NO: 176579 - protein, 8 aa, Borrelia garinii
NAFVLAVK

SEQ ID NO: 176580 - protein, 8 aa, Borrelia garinii
FVLAVKEV

SEQ ID NO: 176581 - protein, 8 aa, Borrelia garinii
AVKEVEAL

SEQ ID NO: 176582 - protein, 8 aa, Borrelia garinii
KEVEALIS

SEQ ID NO: 176583 - protein, 8 aa, Borrelia garinii
LISSIDEL

SEQ ID NO: 176584 - protein, 8 aa, Borrelia garinii
SIDELANK

SEQ ID NO: 176585 - protein, 8 aa, Borrelia garinii
DELANKAI

SEQ ID NO: 176586 - protein, 8 aa, Borrelia garinii
LANKAIGK

SEQ ID NO: 176587 - protein, 8 aa, Borrelia garinii
VIHQNNGL

SEQ ID NO: 176588 - protein, 8 aa, Borrelia garinii
HQNNGLNA

SEQ ID NO: 176589 - protein, 8 aa, Borrelia garinii
GQNGSLLA

SEQ ID NO: 176590 - protein, 8 aa, Borrelia garinii
GSLLAGAY

SEQ ID NO: 176591 - protein, 8 aa, Borrelia garinii
SLLAGAYA

SEQ ID NO: 176592 - protein, 8 aa, Borrelia garinii
LLAGAYAI

SEQ ID NO: 176593 - protein, 8 aa, Borrelia garinii
GAYAISTL

SEQ ID NO: 176594 - protein, 8 aa, Borrelia garinii
AYAISTLI

SEQ ID NO: 176595 - protein, 8 aa, Borrelia garinii
ISTLITEK

SEQ ID NO: 176596 - protein, 8 aa, Borrelia garinii
LITEKLSK

SEQ ID NO: 176597 - protein, 8 aa, Borrelia garinii
TEKLSKLK

SEQ ID NO: 176598 - protein, 8 aa, Borrelia garinii
KLKNSEEL

SEQ ID NO: 176599 - protein, 8 aa, Borrelia garinii
HSEAFTNR

SEQ ID NO: 176600 - protein, 8 aa, Borrelia garinii
SEAFTNRL

SEQ ID NO: 176601 - protein, 8 aa, Borrelia garinii
EAFTNRLK

SEQ ID NO: 176602 - protein, 8 aa, Borrelia garinii
RLKGSHAQ

SEQ ID NO: 176603 - protein, 8 aa, Borrelia garinii
AQLGVAAA

SEQ ID NO: 176604 - protein, 8 aa, Borrelia garinii
AATDDHAK

SEQ ID NO: 176605 - protein, 8 aa, Borrelia garinii
DHAKEAIL

SEQ ID NO: 176606 - protein, 8 aa, Borrelia garinii
HAKEAILK

SEQ ID NO: 176607 - protein, 8 aa, Borrelia garinii
ILKSNPTK

SEQ ID NO: 176608 - protein, 8 aa, Borrelia garinii
KSNPTKDK

SEQ ID NO: 176609 - protein, 8 aa, Borrelia garinii
PTKDKGAK

SEQ ID NO: 176610 - protein, 8 aa, Borrelia garinii
ESVESLAK

SEQ ID NO: 176611 - protein, 8 aa, Borrelia garinii
EALANSVK

SEQ ID NO: 176612 - protein, 8 aa, Borrelia garinii
KELTNPVV

SEQ ID NO: 176613 - protein, 8 aa, Borrelia garinii
ELTNPVVA

SEQ ID NO: 176614 - protein, 8 aa, Borrelia garinii
PVVAESPK

SEQ ID NO: 176615 - protein, 9 aa, Borrelia garinii
ILMTLFLFI

SEQ ID NO: 176616 - protein, 9 aa, Borrelia garinii
FLFISCNNS

SEQ ID NO: 176617 - protein, 9 aa, Borrelia garinii
STNPDESAK

SEQ ID NO: 176618 - protein, 9 aa, Borrelia garinii
SAKGPNLTV

SEQ ID NO: 176619 - protein, 9 aa, Borrelia garinii
NLTVISKKI

SEQ ID NO: 176620 - protein, 9 aa, Borrelia garinii
KITDSNAFV

SEQ ID NO: 176621 - protein, 9 aa, Borrelia garinii
ITDSNAFVL

SEQ ID NO: 176622 - protein, 9 aa, Borrelia garinii
DSNAFVLAV

SEQ ID NO: 176623 - protein, 9 aa, Borrelia garinii
SNAFVLAVK

SEQ ID NO: 176624 - protein, 9 aa, Borrelia garinii
VLAVKEVEA

SEQ ID NO: 176625 - protein, 9 aa, Borrelia garinii
LAVKEVEAL

SEQ ID NO: 176626 - protein, 9 aa, Borrelia garinii
AVKEVEALI

SEQ ID NO: 176627 - protein, 9 aa, Borrelia garinii
EVEALISSI

SEQ ID NO: 176628 - protein, 9 aa, Borrelia garinii
ALISSIDEL

SEQ ID NO: 176629 - protein, 9 aa, Borrelia garinii
LISSIDELA

SEQ ID NO: 176630 - protein, 9 aa, Borrelia garinii
SSIDELANK

SEQ ID NO: 176631 - protein, 9 aa, Borrelia garinii
SIDELANKA

SEQ ID NO: 176632 - protein, 9 aa, Borrelia garinii
ELANKAIGK

SEQ ID NO: 176633 - protein, 9 aa, Borrelia garinii
LANKAIGKV

SEQ ID NO: 176634 - protein, 9 aa, Borrelia garinii
KVIHQNNGL

SEQ ID NO: 176635 - protein, 9 aa, Borrelia garinii
NGSLLAGAY

SEQ ID NO: 176636 - protein, 9 aa, Borrelia garinii
SLLAGAYAI

SEQ ID NO: 176637 - protein, 9 aa, Borrelia garinii
LLAGAYAIS

SEQ ID NO: 176638 - protein, 9 aa, Borrelia garinii
GAYAISTLI

SEQ ID NO: 176639 - protein, 9 aa, Borrelia garinii
AISTLITEK

SEQ ID NO: 176640 - protein, 9 aa, Borrelia garinii
ISTLITEKL

SEQ ID NO: 176641 - protein, 9 aa, Borrelia garinii
TLITEKLSK

SEQ ID NO: 176642 - protein, 9 aa, Borrelia garinii
LITEKLSKL

SEQ ID NO: 176643 - protein, 9 aa, Borrelia garinii
ITEKLSKLK

SEQ ID NO: 176644 - protein, 9 aa, Borrelia garinii
ELNKKIEEA

SEQ ID NO: 176645 - protein, 9 aa, Borrelia garinii
EEAKNHSEA

SEQ ID NO: 176646 - protein, 9 aa, Borrelia garinii
EAKNHSEAF

SEQ ID NO: 176647 - protein, 9 aa, Borrelia garinii
HSEAFTNRL

SEQ ID NO: 176648 - protein, 9 aa, Borrelia garinii
RLKGSHAQL

SEQ ID NO: 176649 - protein, 9 aa, Borrelia garinii
AQLGVAAAT

SEQ ID NO: 176650 - protein, 9 aa, Borrelia garinii
AAATDDHAK

SEQ ID NO: 176651 - protein, 9 aa, Borrelia garinii
ATDDHAKEA

SEQ ID NO: 176652 - protein, 9 aa, Borrelia garinii
AILKSNPTK

SEQ ID NO: 176653 - protein, 9 aa, Borrelia garinii
KDKGAKELK

SEQ ID NO: 176654 - protein, 9 aa, Borrelia garinii
ELKDLSESV

SEQ ID NO: 176655 - protein, 9 aa, Borrelia garinii
DLSESVESL

SEQ ID NO: 176656 - protein, 9 aa, Borrelia garinii
ESVESLAKA

SEQ ID NO: 176657 - protein, 9 aa, Borrelia garinii
SLAKAAQEA

SEQ ID NO: 176658 - protein, 9 aa, Borrelia garinii
AQEALANSV

SEQ ID NO: 176659 - protein, 9 aa, Borrelia garinii
ALANSVKEL

SEQ ID NO: 176660 - protein, 9 aa, Borrelia garinii
SVKELTNPV

SEQ ID NO: 176661 - protein, 10 aa, Borrelia garinii
ILMTLFLFIS

SEQ ID NO: 176662 - protein, 10 aa, Borrelia garinii
LMTLFLFISC

SEQ ID NO: 176663 - protein, 10 aa, Borrelia garinii
FLFISCNNSG

SEQ ID NO: 176664 - protein, 10 aa, Borrelia garinii
TASTNPDESA

SEQ ID NO: 176665 - protein, 10 aa, Borrelia garinii
ASTNPDESAK

SEQ ID NO: 176666 - protein, 10 aa, Borrelia garinii
ESAKGPNLTV

SEQ ID NO: 176667 - protein, 10 aa, Borrelia garinii
KGPNLTVISK

SEQ ID NO: 176668 - protein, 10 aa, Borrelia garinii
KKITDSNAFV

SEQ ID NO: 176669 - protein, 10 aa, Borrelia garinii
KITDSNAFVL

SEQ ID NO: 176670 - protein, 10 aa, Borrelia garinii
DSNAFVLAVK

SEQ ID NO: 176671 - protein, 10 aa, Borrelia garinii
NAFVLAVKEV

SEQ ID NO: 176672 - protein, 10 aa, Borrelia garinii
FVLAVKEVEA

SEQ ID NO: 176673 - protein, 10 aa, Borrelia garinii
VLAVKEVEAL

SEQ ID NO: 176674 - protein, 10 aa, Borrelia garinii
LAVKEVEALI

SEQ ID NO: 176675 - protein, 10 aa, Borrelia garinii
KEVEALISSI

SEQ ID NO: 176676 - protein, 10 aa, Borrelia garinii
EALISSIDEL

SEQ ID NO: 176677 - protein, 10 aa, Borrelia garinii
ALISSIDELA

SEQ ID NO: 176678 - protein, 10 aa, Borrelia garinii
ISSIDELANK

SEQ ID NO: 176679 - protein, 10 aa, Borrelia garinii
SIDELANKAI

SEQ ID NO: 176680 - protein, 10 aa, Borrelia garinii
ELANKAIGKV

SEQ ID NO: 176681 - protein, 10 aa, Borrelia garinii
HQNNGLNANA

SEQ ID NO: 176682 - protein, 10 aa, Borrelia garinii
NANAGQNGSL

SEQ ID NO: 176683 - protein, 10 aa, Borrelia garinii
GQNGSLLAGA

SEQ ID NO: 176684 - protein, 10 aa, Borrelia garinii
SLLAGAYAIS

SEQ ID NO: 176685 - protein, 10 aa, Borrelia garinii
LLAGAYAIST

SEQ ID NO: 176686 - protein, 10 aa, Borrelia garinii
LAGAYAISTL

SEQ ID NO: 176687 - protein, 10 aa, Borrelia garinii
AGAYAISTLI

SEQ ID NO: 176688 - protein, 10 aa, Borrelia garinii
YAISTLITEK

SEQ ID NO: 176689 - protein, 10 aa, Borrelia garinii
AISTLITEKL

SEQ ID NO: 176690 - protein, 10 aa, Borrelia garinii
STLITEKLSK

SEQ ID NO: 176691 - protein, 10 aa, Borrelia garinii
TLITEKLSKL

SEQ ID NO: 176692 - protein, 10 aa, Borrelia garinii
LITEKLSKLK

SEQ ID NO: 176693 - protein, 10 aa, Borrelia garinii
KLKNSEELNK

SEQ ID NO: 176694 - protein, 10 aa, Borrelia garinii
ELNKKIEEAK

SEQ ID NO: 176695 - protein, 10 aa, Borrelia garinii
EEAKNHSEAF

SEQ ID NO: 176696 - protein, 10 aa, Borrelia garinii
NHSEAFTNRL

SEQ ID NO: 176697 - protein, 10 aa, Borrelia garinii
HSEAFTNRLK

SEQ ID NO: 176698 - protein, 10 aa, Borrelia garinii
VAAATDDHAK

SEQ ID NO: 176699 - protein, 10 aa, Borrelia garinii
ATDDHAKEAI

SEQ ID NO: 176700 - protein, 10 aa, Borrelia garinii
EAILKSNPTK

SEQ ID NO: 176701 - protein, 10 aa, Borrelia garinii
ILKSNPTKDK

SEQ ID NO: 176702 - protein, 10 aa, Borrelia garinii
KELKDLSESV

SEQ ID NO: 176703 - protein, 10 aa, Borrelia garinii
DLSESVESLA

SEQ ID NO: 176704 - protein, 10 aa, Borrelia garinii
LSESVESLAK

SEQ ID NO: 176705 - protein, 10 aa, Borrelia garinii
SLAKAAQEAL

SEQ ID NO: 176706 - protein, 10 aa, Borrelia garinii
AAQEALANSV

SEQ ID NO: 176707 - protein, 10 aa, Borrelia garinii
AQEALANSVK

SEQ ID NO: 176708 - protein, 10 aa, Borrelia garinii
EALANSVKEL

SEQ ID NO: 176709 - protein, 10 aa, Borrelia garinii
ALANSVKELT

SEQ ID NO: 176710 - protein, 10 aa, Borrelia garinii
NSVKELTNPV

SEQ ID NO: 176711 - protein, 10 aa, Borrelia garinii
SVKELTNPVV

SEQ ID NO: 176712 - protein, 11 aa, Borrelia garinii
ILMTLFLFISC

SEQ ID NO: 176713 - protein, 11 aa, Borrelia garinii
FLFISCNNSGG

SEQ ID NO: 176714 - protein, 11 aa, Borrelia garinii
DTASTNPDESA

SEQ ID NO: 176715 - protein, 11 aa, Borrelia garinii
TASTNPDESAK

SEQ ID NO: 176716 - protein, 11 aa, Borrelia garinii
ESAKGPNLTVI

SEQ ID NO: 176717 - protein, 11 aa, Borrelia garinii
ISKKITDSNAF

SEQ ID NO: 176718 - protein, 11 aa, Borrelia garinii
KITDSNAFVLA

SEQ ID NO: 176719 - protein, 11 aa, Borrelia garinii
ITDSNAFVLAV

SEQ ID NO: 176720 - protein, 11 aa, Borrelia garinii
SNAFVLAVKEV

SEQ ID NO: 176721 - protein, 11 aa, Borrelia garinii
FVLAVKEVEAL

SEQ ID NO: 176722 - protein, 11 aa, Borrelia garinii
VLAVKEVEALI

SEQ ID NO: 176723 - protein, 11 aa, Borrelia garinii
VEALISSIDEL

SEQ ID NO: 176724 - protein, 11 aa, Borrelia garinii
EALISSIDELA

SEQ ID NO: 176725 - protein, 11 aa, Borrelia garinii
LISSIDELANK

SEQ ID NO: 176726 - protein, 11 aa, Borrelia garinii
ELANKAIGKVI

SEQ ID NO: 176727 - protein, 11 aa, Borrelia garinii
GQNGSLLAGAY

SEQ ID NO: 176728 - protein, 11 aa, Borrelia garinii
NGSLLAGAYAI

SEQ ID NO: 176729 - protein, 11 aa, Borrelia garinii
SLLAGAYAIST

SEQ ID NO: 176730 - protein, 11 aa, Borrelia garinii
LLAGAYAISTL

SEQ ID NO: 176731 - protein, 11 aa, Borrelia garinii
LAGAYAISTLI

SEQ ID NO: 176732 - protein, 11 aa, Borrelia garinii
AYAISTLITEK

SEQ ID NO: 176733 - protein, 11 aa, Borrelia garinii
YAISTLITEKL

SEQ ID NO: 176734 - protein, 11 aa, Borrelia garinii
ISTLITEKLSK

SEQ ID NO: 176735 - protein, 11 aa, Borrelia garinii
TLITEKLSKLK

SEQ ID NO: 176736 - protein, 11 aa, Borrelia garinii
KLSKLKNSEEL

SEQ ID NO: 176737 - protein, 11 aa, Borrelia garinii
KLKNSEELNKK

SEQ ID NO: 176738 - protein, 11 aa, Borrelia garinii
EEAKNHSEAFT

SEQ ID NO: 176739 - protein, 11 aa, Borrelia garinii
RLKGSHAQLGV

SEQ ID NO: 176740 - protein, 11 aa, Borrelia garinii
GVAAATDDHAK

SEQ ID NO: 176741 - protein, 11 aa, Borrelia garinii
ATDDHAKEAIL

SEQ ID NO: 176742 - protein, 11 aa, Borrelia garinii
AILKSNPTKDK

SEQ ID NO: 176743 - protein, 11 aa, Borrelia garinii
KSNPTKDKGAK

SEQ ID NO: 176744 - protein, 11 aa, Borrelia garinii
NPTKDKGAKEL

SEQ ID NO: 176745 - protein, 11 aa, Borrelia garinii
PTKDKGAKELK

SEQ ID NO: 176746 - protein, 11 aa, Borrelia garinii
SLAKAAQEALA

SEQ ID NO: 176747 - protein, 11 aa, Borrelia garinii
KAAQEALANSV

SEQ ID NO: 176748 - protein, 11 aa, Borrelia garinii
AAQEALANSVK

SEQ ID NO: 176749 - protein, 11 aa, Borrelia garinii
QEALANSVKEL

SEQ ID NO: 176750 - protein, 11 aa, Borrelia garinii
SVKELTNPVVA

SEQ ID NO: 176751 - protein, 11 aa, Borrelia garinii
LTNPVVAESPK

SEQ ID NO: 176752 - protein, 15 aa, Borrelia garinii
AFTNRLKGSHAQLGV

SEQ ID NO: 176753 - protein, 9 aa, Borrelia garinii
LKGSHAQLG

SEQ ID NO: 176754 - protein, 15 aa, Borrelia garinii
AFVLAVKEVEALISS

SEQ ID NO: 176755 - protein, 9 aa, Borrelia garinii
VKEVEALIS

SEQ ID NO: 176756 - protein, 15 aa, Borrelia garinii
AGAYAISTLITEKLS

SEQ ID NO: 176757 - protein, 9 aa, Borrelia garinii
ISTLITEKL

SEQ ID NO: 176758 - protein, 15 aa, Borrelia garinii
AGQNGSLLAGAYAIS

SEQ ID NO: 176759 - protein, 9 aa, Borrelia garinii
GQNGSLLAG

SEQ ID NO: 176760 - protein, 15 aa, Borrelia garinii
AIGKVIHQNNGLNAN

SEQ ID NO: 176761 - protein, 9 aa, Borrelia garinii
IHQNNGLNA

SEQ ID NO: 176762 - protein, 15 aa, Borrelia garinii
AILKSNPTKDKGAKE

SEQ ID NO: 176763 - protein, 9 aa, Borrelia garinii
LKSNPTKDK

SEQ ID NO: 176764 - protein, 15 aa, Borrelia garinii
AISTLITEKLSKLKN

SEQ ID NO: 176765 - protein, 9 aa, Borrelia garinii
ISTLITEKL

SEQ ID NO: 176766 - protein, 15 aa, Borrelia garinii
AKEAILKSNPTKDKG

SEQ ID NO: 176767 - protein, 9 aa, Borrelia garinii
EAILKSNPT

SEQ ID NO: 176768 - protein, 15 aa, Borrelia garinii
AKEAILKSNPTKDKG

SEQ ID NO: 176769 - protein, 9 aa, Borrelia garinii
LKSNPTKDK

SEQ ID NO: 176770 - protein, 15 aa, Borrelia garinii
AKGPNLTVISKKITD

SEQ ID NO: 176771 - protein, 9 aa, Borrelia garinii
LTVISKKIT

SEQ ID NO: 176772 - protein, 15 aa, Borrelia garinii
ALANSVKELTNPVVA

SEQ ID NO: 176773 - protein, 9 aa, Borrelia garinii
LANSVKELT

SEQ ID NO: 176774 - protein, 15 aa, Borrelia garinii
ALANSVKELTNPVVA

SEQ ID NO: 176775 - protein, 9 aa, Borrelia garinii
SVKELTNPV

SEQ ID NO: 176776 - protein, 15 aa, Borrelia garinii
ALANSVKELTNPVVA

SEQ ID NO: 176777 - protein, 9 aa, Borrelia garinii
VKELTNPVV

SEQ ID NO: 176778 - protein, 15 aa, Borrelia garinii
ANSVKELTNPVVAES

SEQ ID NO: 176779 - protein, 9 aa, Borrelia garinii
SVKELTNPV

SEQ ID NO: 176780 - protein, 15 aa, Borrelia garinii
ANSVKELTNPVVAES

SEQ ID NO: 176781 - protein, 9 aa, Borrelia garinii
VKELTNPVV

SEQ ID NO: 176782 - protein, 15 aa, Borrelia garinii
AQEALANSVKELTNP

SEQ ID NO: 176783 - protein, 9 aa, Borrelia garinii
LANSVKELT

SEQ ID NO: 176784 - protein, 15 aa, Borrelia garinii
AQLGVAAATDDHAKE

SEQ ID NO: 176785 - protein, 9 aa, Borrelia garinii
LGVAAATDD

SEQ ID NO: 176786 - protein, 15 aa, Borrelia garinii
AYAISTLITEKLSKL

SEQ ID NO: 176787 - protein, 9 aa, Borrelia garinii
ISTLITEKL

SEQ ID NO: 176788 - protein, 15 aa, Borrelia garinii
DELANKAIGKVIHQN

SEQ ID NO: 176789 - protein, 9 aa, Borrelia garinii
LANKAIGKV

SEQ ID NO: 176790 - protein, 15 aa, Borrelia garinii
EAFTNRLKGSHAQLG

SEQ ID NO: 176791 - protein, 9 aa, Borrelia garinii
TNRLKGSHA

SEQ ID NO: 176792 - protein, 15 aa, Borrelia garinii
EAILKSNPTKDKGAK

SEQ ID NO: 176793 - protein, 9 aa, Borrelia garinii
LKSNPTKDK

SEQ ID NO: 176794 - protein, 15 aa, Borrelia garinii
EALANSVKELTNPVV

SEQ ID NO: 176795 - protein, 9 aa, Borrelia garinii
LANSVKELT

SEQ ID NO: 176796 - protein, 15 aa, Borrelia garinii
EALANSVKELTNPVV

SEQ ID NO: 176797 - protein, 9 aa, Borrelia garinii
SVKELTNPV

SEQ ID NO: 176798 - protein, 15 aa, Borrelia garinii
ESLAKAAQEALANSV

SEQ ID NO: 176799 - protein, 9 aa, Borrelia garinii
LAKAAQEAL

SEQ ID NO: 176800 - protein, 15 aa, Borrelia garinii
ESVESLAKAAQEALA

SEQ ID NO: 176801 - protein, 9 aa, Borrelia garinii
SLAKAAQEA

SEQ ID NO: 176802 - protein, 15 aa, Borrelia garinii
FTNRLKGSHAQLGVA

SEQ ID NO: 176803 - protein, 9 aa, Borrelia garinii
LKGSHAQLG

SEQ ID NO: 176804 - protein, 15 aa, Borrelia garinii
FVLAVKEVEALISSI

SEQ ID NO: 176805 - protein, 9 aa, Borrelia garinii
VKEVEALIS

SEQ ID NO: 176806 - protein, 15 aa, Borrelia garinii
GAYAISTLITEKLSK

SEQ ID NO: 176807 - protein, 9 aa, Borrelia garinii
ISTLITEKL

SEQ ID NO: 176808 - protein, 15 aa, Borrelia garinii
GKVIHQNNGLNANAG

SEQ ID NO: 176809 - protein, 9 aa, Borrelia garinii
HQNNGLNAN

SEQ ID NO: 176810 - protein, 15 aa, Borrelia garinii
GLNANAGQNGSLLAG

SEQ ID NO: 176811 - protein, 9 aa, Borrelia garinii
LNANAGQNG

SEQ ID NO: 176812 - protein, 15 aa, Borrelia garinii
GPNLTVISKKITDSN

SEQ ID NO: 176813 - protein, 9 aa, Borrelia garinii
LTVISKKIT

SEQ ID NO: 176814 - protein, 15 aa, Borrelia garinii
GQNGSLLAGAYAIST

SEQ ID NO: 176815 - protein, 9 aa, Borrelia garinii
LLAGAYAIS

SEQ ID NO: 176816 - protein, 15 aa, Borrelia garinii
GSHAQLGVAAATDDH

SEQ ID NO: 176817 - protein, 9 aa, Borrelia garinii
LGVAAATDD

SEQ ID NO: 176818 - protein, 15 aa, Borrelia garinii
GSLLAGAYAISTLIT

SEQ ID NO: 176819 - protein, 9 aa, Borrelia garinii
LAGAYAIST

SEQ ID NO: 176820 - protein, 15 aa, Borrelia garinii
HAKEAILKSNPTKDK

SEQ ID NO: 176821 - protein, 9 aa, Borrelia garinii
EAILKSNPT

SEQ ID NO: 176822 - protein, 15 aa, Borrelia garinii
HAQLGVAAATDDHAK

SEQ ID NO: 176823 - protein, 9 aa, Borrelia garinii
LGVAAATDD

SEQ ID NO: 176824 - protein, 15 aa, Borrelia garinii
HQNNGLNANAGQNGS

SEQ ID NO: 176825 - protein, 9 aa, Borrelia garinii
LNANAGQNG

SEQ ID NO: 176826 - protein, 15 aa, Borrelia garinii
IDELANKAIGKVIHQ

SEQ ID NO: 176827 - protein, 9 aa, Borrelia garinii
LANKAIGKV

SEQ ID NO: 176828 - protein, 15 aa, Borrelia garinii
IGKVIHQNNGLNANA

SEQ ID NO: 176829 - protein, 9 aa, Borrelia garinii
HQNNGLNAN

SEQ ID NO: 176830 - protein, 15 aa, Borrelia garinii
IHQNNGLNANAGQNG

SEQ ID NO: 176831 - protein, 9 aa, Borrelia garinii
NNGLNANAG

SEQ ID NO: 176832 - protein, 15 aa, Borrelia garinii
ILMTLFLFISCNNSG

SEQ ID NO: 176833 - protein, 9 aa, Borrelia garinii
FLFISCNNS

SEQ ID NO: 176834 - protein, 15 aa, Borrelia garinii
ISKKITDSNAFVLAV

SEQ ID NO: 176835 - protein, 9 aa, Borrelia garinii
ITDSNAFVL

SEQ ID NO: 176836 - protein, 15 aa, Borrelia garinii
ISSIDELANKAIGKV

SEQ ID NO: 176837 - protein, 9 aa, Borrelia garinii
IDELANKAI

SEQ ID NO: 176838 - protein, 15 aa, Borrelia garinii
ISTLITEKLSKLKNS

SEQ ID NO: 176839 - protein, 9 aa, Borrelia garinii
ISTLITEKL

SEQ ID NO: 176840 - protein, 15 aa, Borrelia garinii
ITDSNAFVLAVKEVE

SEQ ID NO: 176841 - protein, 9 aa, Borrelia garinii
ITDSNAFVL

SEQ ID NO: 176842 - protein, 15 aa, Borrelia garinii
KEAILKSNPTKDKGA

SEQ ID NO: 176843 - protein, 9 aa, Borrelia garinii
LKSNPTKDK

SEQ ID NO: 176844 - protein, 15 aa, Borrelia garinii
KGPNLTVISKKITDS

SEQ ID NO: 176845 - protein, 9 aa, Borrelia garinii
LTVISKKIT

SEQ ID NO: 176846 - protein, 15 aa, Borrelia garinii
KGSHAQLGVAAATDD

SEQ ID NO: 176847 - protein, 9 aa, Borrelia garinii
AQLGVAAAT

SEQ ID NO: 176848 - protein, 15 aa, Borrelia garinii
KITDSNAFVLAVKEV

SEQ ID NO: 176849 - protein, 9 aa, Borrelia garinii
ITDSNAFVL

SEQ ID NO: 176850 - protein, 15 aa, Borrelia garinii
KKITDSNAFVLAVKE

SEQ ID NO: 176851 - protein, 9 aa, Borrelia garinii
ITDSNAFVL

SEQ ID NO: 176852 - protein, 15 aa, Borrelia garinii
KVIHQNNGLNANAGQ

SEQ ID NO: 176853 - protein, 9 aa, Borrelia garinii
HQNNGLNAN

SEQ ID NO: 176854 - protein, 15 aa, Borrelia garinii
KAAQEALANSVKELT

SEQ ID NO: 176855 - protein, 9 aa, Borrelia garinii
EALANSVKE

SEQ ID NO: 176856 - protein, 15 aa, Borrelia garinii
LAGAYAISTLITEKL

SEQ ID NO: 176857 - protein, 9 aa, Borrelia garinii
LAGAYAIST

SEQ ID NO: 176858 - protein, 15 aa, Borrelia garinii
LAGAYAISTLITEKL

SEQ ID NO: 176859 - protein, 9 aa, Borrelia garinii
YAISTLITE

SEQ ID NO: 176860 - protein, 15 aa, Borrelia garinii
LANSVKELTNPVVAE

SEQ ID NO: 176861 - protein, 9 aa, Borrelia garinii
LANSVKELT

SEQ ID NO: 176862 - protein, 15 aa, Borrelia garinii
LANSVKELTNPVVAE

SEQ ID NO: 176863 - protein, 9 aa, Borrelia garinii
SVKELTNPV

SEQ ID NO: 176864 - protein, 15 aa, Borrelia garinii
LANSVKELTNPVVAE

SEQ ID NO: 176865 - protein, 9 aa, Borrelia garinii
VKELTNPVV

SEQ ID NO: 176866 - protein, 15 aa, Borrelia garinii
LAVKEVEALISSIDE

SEQ ID NO: 176867 - protein, 9 aa, Borrelia garinii
VKEVEALIS

SEQ ID NO: 176868 - protein, 15 aa, Borrelia garinii
LFLFISCNNSGGDTA

SEQ ID NO: 176869 - protein, 9 aa, Borrelia garinii
LFISCNNSG

SEQ ID NO: 176870 - protein, 15 aa, Borrelia garinii
LKGSHAQLGVAAATD

SEQ ID NO: 176871 - protein, 9 aa, Borrelia garinii
LKGSHAQLG

SEQ ID NO: 176872 - protein, 15 aa, Borrelia garinii
LLAGAYAISTLITEK

SEQ ID NO: 176873 - protein, 9 aa, Borrelia garinii
LAGAYAIST

SEQ ID NO: 176874 - protein, 15 aa, Borrelia garinii
LMTLFLFISCNNSGG

SEQ ID NO: 176875 - protein, 9 aa, Borrelia garinii
LFISCNNSG

SEQ ID NO: 176876 - protein, 15 aa, Borrelia garinii
LNANAGQNGSLLAGA

SEQ ID NO: 176877 - protein, 9 aa, Borrelia garinii
LNANAGQNG

SEQ ID NO: 176878 - protein, 15 aa, Borrelia garinii
LTVISKKITDSNAFV

SEQ ID NO: 176879 - protein, 9 aa, Borrelia garinii
LTVISKKIT

SEQ ID NO: 176880 - protein, 15 aa, Borrelia garinii
MTLFLFISCNNSGGD

SEQ ID NO: 176881 - protein, 9 aa, Borrelia garinii
LFISCNNSG

SEQ ID NO: 176882 - protein, 15 aa, Borrelia garinii
NAFVLAVKEVEALIS

SEQ ID NO: 176883 - protein, 9 aa, Borrelia garinii
LAVKEVEAL

SEQ ID NO: 176884 - protein, 15 aa, Borrelia garinii
NGLNANAGQNGSLLA

SEQ ID NO: 176885 - protein, 9 aa, Borrelia garinii
LNANAGQNG

SEQ ID NO: 176886 - protein, 15 aa, Borrelia garinii
NGSLLAGAYAISTLI

SEQ ID NO: 176887 - protein, 9 aa, Borrelia garinii
LAGAYAIST

SEQ ID NO: 176888 - protein, 15 aa, Borrelia garinii
NLTVISKKITDSNAF

SEQ ID NO: 176889 - protein, 9 aa, Borrelia garinii
LTVISKKIT

SEQ ID NO: 176890 - protein, 15 aa, Borrelia garinii
NNGLNANAGQNGSLL

SEQ ID NO: 176891 - protein, 9 aa, Borrelia garinii
LNANAGQNG

SEQ ID NO: 176892 - protein, 15 aa, Borrelia garinii
NRLKGSHAQLGVAAA

SEQ ID NO: 176893 - protein, 9 aa, Borrelia garinii
LKGSHAQLG

SEQ ID NO: 176894 - protein, 15 aa, Borrelia garinii
NSVKELTNPVVAESP

SEQ ID NO: 176895 - protein, 9 aa, Borrelia garinii
LTNPVVAES

SEQ ID NO: 176896 - protein, 15 aa, Borrelia garinii
NSVKELTNPVVAESP

SEQ ID NO: 176897 - protein, 9 aa, Borrelia garinii
VKELTNPVV

SEQ ID NO: 176898 - protein, 15 aa, Borrelia garinii
PNLTVISKKITDSNA

SEQ ID NO: 176899 - protein, 9 aa, Borrelia garinii
LTVISKKIT

SEQ ID NO: 176900 - protein, 15 aa, Borrelia garinii
QEALANSVKELTNPV

SEQ ID NO: 176901 - protein, 9 aa, Borrelia garinii
LANSVKELT

SEQ ID NO: 176902 - protein, 15 aa, Borrelia garinii
QNGSLLAGAYAISTL

SEQ ID NO: 176903 - protein, 9 aa, Borrelia garinii
LAGAYAIST

SEQ ID NO: 176904 - protein, 15 aa, Borrelia garinii
QNNGLNANAGQNGSL

SEQ ID NO: 176905 - protein, 9 aa, Borrelia garinii
LNANAGQNG

SEQ ID NO: 176906 - protein, 15 aa, Borrelia garinii
RLKGSHAQLGVAAAT

SEQ ID NO: 176907 - protein, 9 aa, Borrelia garinii
LKGSHAQLG

SEQ ID NO: 176908 - protein, 15 aa, Borrelia garinii
SAKGPNLTVISKKIT

SEQ ID NO: 176909 - protein, 9 aa, Borrelia garinii
KGPNLTVIS

SEQ ID NO: 176910 - protein, 15 aa, Borrelia garinii
SESVESLAKAAQEAL

SEQ ID NO: 176911 - protein, 9 aa, Borrelia garinii
SLAKAAQEA

SEQ ID NO: 176912 - protein, 15 aa, Borrelia garinii
SHAQLGVAAATDDHA

SEQ ID NO: 176913 - protein, 9 aa, Borrelia garinii
LGVAAATDD

SEQ ID NO: 176914 - protein, 15 aa, Borrelia garinii
SIDELANKAIGKVIH

SEQ ID NO: 176915 - protein, 9 aa, Borrelia garinii
LANKAIGKV

SEQ ID NO: 176916 - protein, 15 aa, Borrelia garinii
SKKITDSNAFVLAVK

SEQ ID NO: 176917 - protein, 9 aa, Borrelia garinii
ITDSNAFVL

SEQ ID NO: 176918 - protein, 15 aa, Borrelia garinii
SLAKAAQEALANSVK

SEQ ID NO: 176919 - protein, 9 aa, Borrelia garinii
AQEALANSV

SEQ ID NO: 176920 - protein, 15 aa, Borrelia garinii
SLLAGAYAISTLITE

SEQ ID NO: 176921 - protein, 9 aa, Borrelia garinii
LAGAYAIST

SEQ ID NO: 176922 - protein, 15 aa, Borrelia garinii
SSIDELANKAIGKVI

SEQ ID NO: 176923 - protein, 9 aa, Borrelia garinii
LANKAIGKV

SEQ ID NO: 176924 - protein, 15 aa, Borrelia garinii
SVESLAKAAQEALAN

SEQ ID NO: 176925 - protein, 9 aa, Borrelia garinii
LAKAAQEAL

SEQ ID NO: 176926 - protein, 15 aa, Borrelia garinii
SVKELTNPVVAESPK

SEQ ID NO: 176927 - protein, 9 aa, Borrelia garinii
LTNPVVAES

SEQ ID NO: 176928 - protein, 15 aa, Borrelia garinii
TLFLFISCNNSGGDT

SEQ ID NO: 176929 - protein, 9 aa, Borrelia garinii
LFISCNNSG

SEQ ID NO: 176930 - protein, 15 aa, Borrelia garinii
TNRLKGSHAQLGVAA

SEQ ID NO: 176931 - protein, 9 aa, Borrelia garinii
LKGSHAQLG

SEQ ID NO: 176932 - protein, 15 aa, Borrelia garinii
TVISKKITDSNAFVL

SEQ ID NO: 176933 - protein, 9 aa, Borrelia garinii
SKKITDSNA

SEQ ID NO: 176934 - protein, 15 aa, Borrelia garinii
VESLAKAAQEALANS

SEQ ID NO: 176935 - protein, 9 aa, Borrelia garinii
LAKAAQEAL

SEQ ID NO: 176936 - protein, 15 aa, Borrelia garinii
VISKKITDSNAFVLA

SEQ ID NO: 176937 - protein, 9 aa, Borrelia garinii
ITDSNAFVL

SEQ ID NO: 176938 - protein, 15 aa, Borrelia garinii
VLAVKEVEALISSID

SEQ ID NO: 176939 - protein, 9 aa, Borrelia garinii
VKEVEALIS

SEQ ID NO: 176940 - protein, 15 aa, Borrelia garinii
YAISTLITEKLSKLK

SEQ ID NO: 176941 - protein, 9 aa, Borrelia garinii
ISTLITEKL

SEQ ID NO: 176942 - protein, 15 aa, Borrelia garinii
AAQEALANSVKELTN

SEQ ID NO: 176943 - protein, 9 aa, Borrelia garinii
LANSVKELT

SEQ ID NO: 176944 - protein, 8 aa, Borrelia garinii
KISSAIFL

SEQ ID NO: 176945 - protein, 8 aa, Borrelia garinii
SAIFLTAL

SEQ ID NO: 176946 - protein, 8 aa, Borrelia garinii
AIFLTALL

SEQ ID NO: 176947 - protein, 8 aa, Borrelia garinii
IFLTALLV

SEQ ID NO: 176948 - protein, 8 aa, Borrelia garinii
FLTALLVF

SEQ ID NO: 176949 - protein, 8 aa, Borrelia garinii
LTALLVFI

SEQ ID NO: 176950 - protein, 8 aa, Borrelia garinii
ALLVFINC

SEQ ID NO: 176951 - protein, 8 aa, Borrelia garinii
LLVFINCK

SEQ ID NO: 176952 - protein, 8 aa, Borrelia garinii
FINCKNNA

SEQ ID NO: 176953 - protein, 8 aa, Borrelia garinii
FYESIINL

SEQ ID NO: 176954 - protein, 8 aa, Borrelia garinii
IINLGNGF

SEQ ID NO: 176955 - protein, 8 aa, Borrelia garinii
FIDVFNAF

SEQ ID NO: 176956 - protein, 8 aa, Borrelia garinii
FNAFSGLV

SEQ ID NO: 176957 - protein, 8 aa, Borrelia garinii
GLVADTFF

SEQ ID NO: 176958 - protein, 8 aa, Borrelia garinii
LVADTFFK

SEQ ID NO: 176959 - protein, 8 aa, Borrelia garinii
TFFKSDPK

SEQ ID NO: 176960 - protein, 8 aa, Borrelia garinii
KSDVKTYF

SEQ ID NO: 176961 - protein, 8 aa, Borrelia garinii
FESISSTL

SEQ ID NO: 176962 - protein, 8 aa, Borrelia garinii
ESISSTLK

SEQ ID NO: 176963 - protein, 8 aa, Borrelia garinii
SISSTLKA

SEQ ID NO: 176964 - protein, 8 aa, Borrelia garinii
SSTLKATK

SEQ ID NO: 176965 - protein, 8 aa, Borrelia garinii
TLKATKGK

SEQ ID NO: 176966 - protein, 8 aa, Borrelia garinii
KLDELVSA

SEQ ID NO: 176967 - protein, 8 aa, Borrelia garinii
KASVESAV

SEQ ID NO: 176968 - protein, 8 aa, Borrelia garinii
SAVDEVSK

SEQ ID NO: 176969 - protein, 8 aa, Borrelia garinii
KWLEEMIK

SEQ ID NO: 176970 - protein, 8 aa, Borrelia garinii
WLEEMIKA

SEQ ID NO: 176971 - protein, 8 aa, Borrelia garinii
MIKAAEEA

SEQ ID NO: 176972 - protein, 8 aa, Borrelia garinii
KAAEEAAK

SEQ ID NO: 176973 - protein, 8 aa, Borrelia garinii
DSAANHGA

SEQ ID NO: 176974 - protein, 8 aa, Borrelia garinii
SAANHGAK

SEQ ID NO: 176975 - protein, 8 aa, Borrelia garinii
DSVKGIAK

SEQ ID NO: 176976 - protein, 8 aa, Borrelia garinii
KGIAKGIK

SEQ ID NO: 176977 - protein, 8 aa, Borrelia garinii
GIKGIVDA

SEQ ID NO: 176978 - protein, 8 aa, Borrelia garinii
GIVDAAGK

SEQ ID NO: 176979 - protein, 8 aa, Borrelia garinii
AGKALGEK

SEQ ID NO: 176980 - protein, 8 aa, Borrelia garinii
ALGEKGAL

SEQ ID NO: 176981 - protein, 8 aa, Borrelia garinii
ALKDVKAA

SEQ ID NO: 176982 - protein, 8 aa, Borrelia garinii
EANADAGK

SEQ ID NO: 176983 - protein, 8 aa, Borrelia garinii
FAGNANAA

SEQ ID NO: 176984 - protein, 8 aa, Borrelia garinii
NAAVGAAA

SEQ ID NO: 176985 - protein, 8 aa, Borrelia garinii
GAAADIAK

SEQ ID NO: 176986 - protein, 8 aa, Borrelia garinii
IAKAAGAV

SEQ ID NO: 176987 - protein, 8 aa, Borrelia garinii
KAAGAVTA

SEQ ID NO: 176988 - protein, 8 aa, Borrelia garinii
AAGAVTAV

SEQ ID NO: 176989 - protein, 8 aa, Borrelia garinii
AVSGEQIL

SEQ ID NO: 176990 - protein, 8 aa, Borrelia garinii
VSGEQILK

SEQ ID NO: 176991 - protein, 8 aa, Borrelia garinii
ILKAIVEA

SEQ ID NO: 176992 - protein, 8 aa, Borrelia garinii
DPANQAGK

SEQ ID NO: 176993 - protein, 8 aa, Borrelia garinii
AEEAKNPI

SEQ ID NO: 176994 - protein, 8 aa, Borrelia garinii
DDNGAAFK

SEQ ID NO: 176995 - protein, 8 aa, Borrelia garinii
AAFKDEMK

SEQ ID NO: 176996 - protein, 8 aa, Borrelia garinii
AFKDEMKK

SEQ ID NO: 176997 - protein, 8 aa, Borrelia garinii
KIAAAIVL

SEQ ID NO: 176998 - protein, 8 aa, Borrelia garinii
IAAAIVLR

SEQ ID NO: 176999 - protein, 8 aa, Borrelia garinii
AAIVLRGV

SEQ ID NO: 177000 - protein, 8 aa, Borrelia garinii
IVLRGVAK

SEQ ID NO: 177001 - protein, 8 aa, Borrelia garinii
AKDGKFAV

SEQ ID NO: 177002 - protein, 9 aa, Borrelia garinii
KISSAIFLT

SEQ ID NO: 177003 - protein, 9 aa, Borrelia garinii
ISSAIFLTA

SEQ ID NO: 177004 - protein, 9 aa, Borrelia garinii
SSAIFLTAL

SEQ ID NO: 177005 - protein, 9 aa, Borrelia garinii
SAIFLTALL

SEQ ID NO: 177006 - protein, 9 aa, Borrelia garinii
AIFLTALLV

SEQ ID NO: 177007 - protein, 9 aa, Borrelia garinii
IFLTALLVF

SEQ ID NO: 177008 - protein, 9 aa, Borrelia garinii
FLTALLVFI

SEQ ID NO: 177009 - protein, 9 aa, Borrelia garinii
ALLVFINCK

SEQ ID NO: 177010 - protein, 9 aa, Borrelia garinii
FINCKNNAV

SEQ ID NO: 177011 - protein, 9 aa, Borrelia garinii
AVGKGNDDK

SEQ ID NO: 177012 - protein, 9 aa, Borrelia garinii
SVKTFYESI

SEQ ID NO: 177013 - protein, 9 aa, Borrelia garinii
TFYESIINL

SEQ ID NO: 177014 - protein, 9 aa, Borrelia garinii
SIINLGNGF

SEQ ID NO: 177015 - protein, 9 aa, Borrelia garinii
IINLGNGFI

SEQ ID NO: 177016 - protein, 9 aa, Borrelia garinii
NLGNGFIDV

SEQ ID NO: 177017 - protein, 9 aa, Borrelia garinii
GFIDVFNAF

SEQ ID NO: 177018 - protein, 9 aa, Borrelia garinii
DVFNAFSGL

SEQ ID NO: 177019 - protein, 9 aa, Borrelia garinii
FSGLVADTF

SEQ ID NO: 177020 - protein, 9 aa, Borrelia garinii
GLVADTFFK

SEQ ID NO: 177021 - protein, 9 aa, Borrelia garinii
LVADTFFKS

SEQ ID NO: 177022 - protein, 9 aa, Borrelia garinii
DTFFKSDPK

SEQ ID NO: 177023 - protein, 9 aa, Borrelia garinii
TFFKSDPKK

SEQ ID NO: 177024 - protein, 9 aa, Borrelia garinii
DVKTYFESI

SEQ ID NO: 177025 - protein, 9 aa, Borrelia garinii
YFESISSTL

SEQ ID NO: 177026 - protein, 9 aa, Borrelia garinii
ISSTLKATK

SEQ ID NO: 177027 - protein, 9 aa, Borrelia garinii
STLKATKGK

SEQ ID NO: 177028 - protein, 9 aa, Borrelia garinii
TLKATKGKL

SEQ ID NO: 177029 - protein, 9 aa, Borrelia garinii
ATKGKLDEL

SEQ ID NO: 177030 - protein, 9 aa, Borrelia garinii
KLDELVSAK

SEQ ID NO: 177031 - protein, 9 aa, Borrelia garinii
EGGSVKASV

SEQ ID NO: 177032 - protein, 9 aa, Borrelia garinii
SVKASVESA

SEQ ID NO: 177033 - protein, 9 aa, Borrelia garinii
SVESAVDEV

SEQ ID NO: 177034 - protein, 9 aa, Borrelia garinii
ESAVDEVSK

SEQ ID NO: 177035 - protein, 9 aa, Borrelia garinii
SAVDEVSKW

SEQ ID NO: 177036 - protein, 9 aa, Borrelia garinii
AVDEVSKWL

SEQ ID NO: 177037 - protein, 9 aa, Borrelia garinii
EVSKWLEEM

SEQ ID NO: 177038 - protein, 9 aa, Borrelia garinii
WLEEMIKAA

SEQ ID NO: 177039 - protein, 9 aa, Borrelia garinii
EMIKAAEEA

SEQ ID NO: 177040 - protein, 9 aa, Borrelia garinii
MIKAAEEAA

SEQ ID NO: 177041 - protein, 9 aa, Borrelia garinii
KAAEEAAKV

SEQ ID NO: 177042 - protein, 9 aa, Borrelia garinii
DSAANHGAK

SEQ ID NO: 177043 - protein, 9 aa, Borrelia garinii
ANHGAKADK

SEQ ID NO: 177044 - protein, 9 aa, Borrelia garinii
SVKGIAKGI

SEQ ID NO: 177045 - protein, 9 aa, Borrelia garinii
GIAKGIKGI

SEQ ID NO: 177046 - protein, 9 aa, Borrelia garinii
GIKGIVDAA

SEQ ID NO: 177047 - protein, 9 aa, Borrelia garinii
IVDAAGKAL

SEQ ID NO: 177048 - protein, 9 aa, Borrelia garinii
AAGKALGEK

SEQ ID NO: 177049 - protein, 9 aa, Borrelia garinii
ALGEKGALK

SEQ ID NO: 177050 - protein, 9 aa, Borrelia garinii
ALKDVKAAA

SEQ ID NO: 177051 - protein, 9 aa, Borrelia garinii
NADAGKLFA

SEQ ID NO: 177052 - protein, 9 aa, Borrelia garinii
KLFAGNANA

SEQ ID NO: 177053 - protein, 9 aa, Borrelia garinii
FAGNANAAV

SEQ ID NO: 177054 - protein, 9 aa, Borrelia garinii
NANAAVGAA

SEQ ID NO: 177055 - protein, 9 aa, Borrelia garinii
DIAKAAGAV

SEQ ID NO: 177056 - protein, 9 aa, Borrelia garinii
KAAGAVTAV

SEQ ID NO: 177057 - protein, 9 aa, Borrelia garinii
TAVSGEQIL

SEQ ID NO: 177058 - protein, 9 aa, Borrelia garinii
AVSGEQILK

SEQ ID NO: 177059 - protein, 9 aa, Borrelia garinii
QILKAIVEA

SEQ ID NO: 177060 - protein, 9 aa, Borrelia garinii
ILKAIVEAA

SEQ ID NO: 177061 - protein, 9 aa, Borrelia garinii
AGKKAEEAK

SEQ ID NO: 177062 - protein, 9 aa, Borrelia garinii
AEEAKNPIA

SEQ ID NO: 177063 - protein, 9 aa, Borrelia garinii
EEAKNPIAA

SEQ ID NO: 177064 - protein, 9 aa, Borrelia garinii
NPIAAAIGT

SEQ ID NO: 177065 - protein, 9 aa, Borrelia garinii
TDDDNGAAF

SEQ ID NO: 177066 - protein, 9 aa, Borrelia garinii
GAAFKDEMK

SEQ ID NO: 177067 - protein, 9 aa, Borrelia garinii
AAFKDEMKK

SEQ ID NO: 177068 - protein, 9 aa, Borrelia garinii
KIAAAIVLR

SEQ ID NO: 177069 - protein, 9 aa, Borrelia garinii
AAAIVLRGV

SEQ ID NO: 177070 - protein, 9 aa, Borrelia garinii
AIVLRGVAK

SEQ ID NO: 177071 - protein, 9 aa, Borrelia garinii
VAKDGKFAV

SEQ ID NO: 177072 - protein, 10 aa, Borrelia garinii
KISSAIFLTA

SEQ ID NO: 177073 - protein, 10 aa, Borrelia garinii
ISSAIFLTAL

SEQ ID NO: 177074 - protein, 10 aa, Borrelia garinii
SSAIFLTALL

SEQ ID NO: 177075 - protein, 10 aa, Borrelia garinii
SAIFLTALLV

SEQ ID NO: 177076 - protein, 10 aa, Borrelia garinii
AIFLTALLVF

SEQ ID NO: 177077 - protein, 10 aa, Borrelia garinii
IFLTALLVFI

SEQ ID NO: 177078 - protein, 10 aa, Borrelia garinii
FLTALLVFIN

SEQ ID NO: 177079 - protein, 10 aa, Borrelia garinii
TALLVFINCK

SEQ ID NO: 177080 - protein, 10 aa, Borrelia garinii
DSVKTFYESI

SEQ ID NO: 177081 - protein, 10 aa, Borrelia garinii
SVKTFYESII

SEQ ID NO: 177082 - protein, 10 aa, Borrelia garinii
KTFYESIINL

SEQ ID NO: 177083 - protein, 10 aa, Borrelia garinii
ESIINLGNGF

SEQ ID NO: 177084 - protein, 10 aa, Borrelia garinii
SIINLGNGFI

SEQ ID NO: 177085 - protein, 10 aa, Borrelia garinii
NGFIDVFNAF

SEQ ID NO: 177086 - protein, 10 aa, Borrelia garinii
DVFNAFSGLV

SEQ ID NO: 177087 - protein, 10 aa, Borrelia garinii
AFSGLVADTF

SEQ ID NO: 177088 - protein, 10 aa, Borrelia garinii
FSGLVADTFF

SEQ ID NO: 177089 - protein, 10 aa, Borrelia garinii
SGLVADTFFK

SEQ ID NO: 177090 - protein, 10 aa, Borrelia garinii
GLVADTFFKS

SEQ ID NO: 177091 - protein, 10 aa, Borrelia garinii
ADTFFKSDPK

SEQ ID NO: 177092 - protein, 10 aa, Borrelia garinii
DTFFKSDPKK

SEQ ID NO: 177093 - protein, 10 aa, Borrelia garinii
DPKKSDVKTY

SEQ ID NO: 177094 - protein, 10 aa, Borrelia garinii
KTYFESISST

SEQ ID NO: 177095 - protein, 10 aa, Borrelia garinii
TYFESISSTL

SEQ ID NO: 177096 - protein, 10 aa, Borrelia garinii
YFESISSTLK

SEQ ID NO: 177097 - protein, 10 aa, Borrelia garinii
SISSTLKATK

SEQ ID NO: 177098 - protein, 10 aa, Borrelia garinii
SSTLKATKGK

SEQ ID NO: 177099 - protein, 10 aa, Borrelia garinii
ATKGKLDELV

SEQ ID NO: 177100 - protein, 10 aa, Borrelia garinii
KLDELVSAKK

SEQ ID NO: 177101 - protein, 10 aa, Borrelia garinii
SAKKGEGGSV

SEQ ID NO: 177102 - protein, 10 aa, Borrelia garinii
SVKASVESAV

SEQ ID NO: 177103 - protein, 10 aa, Borrelia garinii
ASVESAVDEV

SEQ ID NO: 177104 - protein, 10 aa, Borrelia garinii
ESAVDEVSKW

SEQ ID NO: 177105 - protein, 10 aa, Borrelia garinii
SAVDEVSKWL

SEQ ID NO: 177106 - protein, 10 aa, Borrelia garinii
EVSKWLEEMI

SEQ ID NO: 177107 - protein, 10 aa, Borrelia garinii
VSKWLEEMIK

SEQ ID NO: 177108 - protein, 10 aa, Borrelia garinii
EEMIKAAEEA

SEQ ID NO: 177109 - protein, 10 aa, Borrelia garinii
MIKAAEEAAK

SEQ ID NO: 177110 - protein, 10 aa, Borrelia garinii
AEEAAKVGGT

SEQ ID NO: 177111 - protein, 10 aa, Borrelia garinii
KVGGTGGDGK

SEQ ID NO: 177112 - protein, 10 aa, Borrelia garinii
AANHGAKADK

SEQ ID NO: 177113 - protein, 10 aa, Borrelia garinii
HGAKADKDSV

SEQ ID NO: 177114 - protein, 10 aa, Borrelia garinii
SVKGIAKGIK

SEQ ID NO: 177115 - protein, 10 aa, Borrelia garinii
GIAKGIKGIV

SEQ ID NO: 177116 - protein, 10 aa, Borrelia garinii
GIVDAAGKAL

SEQ ID NO: 177117 - protein, 10 aa, Borrelia garinii
DAAGKALGEK

SEQ ID NO: 177118 - protein, 10 aa, Borrelia garinii
KALGEKGALK

SEQ ID NO: 177119 - protein, 10 aa, Borrelia garinii
EANADAGKLF

SEQ ID NO: 177120 - protein, 10 aa, Borrelia garinii
KLFAGNANAA

SEQ ID NO: 177121 - protein, 10 aa, Borrelia garinii
LFAGNANAAV

SEQ ID NO: 177122 - protein, 10 aa, Borrelia garinii
NANAAVGAAA

SEQ ID NO: 177123 - protein, 10 aa, Borrelia garinii
AVGAAADIAK

SEQ ID NO: 177124 - protein, 10 aa, Borrelia garinii
AKAAGAVTAV

SEQ ID NO: 177125 - protein, 10 aa, Borrelia garinii
TAVSGEQILK

SEQ ID NO: 177126 - protein, 10 aa, Borrelia garinii
AVSGEQILKA

SEQ ID NO: 177127 - protein, 10 aa, Borrelia garinii
QILKAIVEAA

SEQ ID NO: 177128 - protein, 10 aa, Borrelia garinii
AIVEAAGDPA

SEQ ID NO: 177129 - protein, 10 aa, Borrelia garinii
EAAGDPANQA

SEQ ID NO: 177130 - protein, 10 aa, Borrelia garinii
AEEAKNPIAA

SEQ ID NO: 177131 - protein, 10 aa, Borrelia garinii
EEAKNPIAAA

SEQ ID NO: 177132 - protein, 10 aa, Borrelia garinii
EAKNPIAAAI

SEQ ID NO: 177133 - protein, 10 aa, Borrelia garinii
GTDDDNGAAF

SEQ ID NO: 177134 - protein, 10 aa, Borrelia garinii
NGAAFKDEMK

SEQ ID NO: 177135 - protein, 10 aa, Borrelia garinii
GAAFKDEMKK

SEQ ID NO: 177136 - protein, 10 aa, Borrelia garinii
DKIAAAIVLR

SEQ ID NO: 177137 - protein, 10 aa, Borrelia garinii
IAAAIVLRGV

SEQ ID NO: 177138 - protein, 10 aa, Borrelia garinii
AAIVLRGVAK

SEQ ID NO: 177139 - protein, 10 aa, Borrelia garinii
VLRGVAKDGK

SEQ ID NO: 177140 - protein, 10 aa, Borrelia garinii
GVAKDGKFAV

SEQ ID NO: 177141 - protein, 10 aa, Borrelia garinii
VAKDGKFAVK

SEQ ID NO: 177142 - protein, 11 aa, Borrelia garinii
KKISSAIFLTA

SEQ ID NO: 177143 - protein, 11 aa, Borrelia garinii
KISSAIFLTAL

SEQ ID NO: 177144 - protein, 11 aa, Borrelia garinii
ISSAIFLTALL

SEQ ID NO: 177145 - protein, 11 aa, Borrelia garinii
SSAIFLTALLV

SEQ ID NO: 177146 - protein, 11 aa, Borrelia garinii
SAIFLTALLVF

SEQ ID NO: 177147 - protein, 11 aa, Borrelia garinii
AIFLTALLVFI

SEQ ID NO: 177148 - protein, 11 aa, Borrelia garinii
FLTALLVFINC

SEQ ID NO: 177149 - protein, 11 aa, Borrelia garinii
LTALLVFINCK

SEQ ID NO: 177150 - protein, 11 aa, Borrelia garinii
LLVFINCKNNA

SEQ ID NO: 177151 - protein, 11 aa, Borrelia garinii
LVFINCKNNAV

SEQ ID NO: 177152 - protein, 11 aa, Borrelia garinii
FINCKNNAVGK

SEQ ID NO: 177153 - protein, 11 aa, Borrelia garinii
YESIINLGNGF

SEQ ID NO: 177154 - protein, 11 aa, Borrelia garinii
ESIINLGNGFI

SEQ ID NO: 177155 - protein, 11 aa, Borrelia garinii
IINLGNGFIDV

SEQ ID NO: 177156 - protein, 11 aa, Borrelia garinii
FIDVFNAFSGL

SEQ ID NO: 177157 - protein, 11 aa, Borrelia garinii
DVFNAFSGLVA

SEQ ID NO: 177158 - protein, 11 aa, Borrelia garinii
NAFSGLVADTF

SEQ ID NO: 177159 - protein, 11 aa, Borrelia garinii
AFSGLVADTFF

SEQ ID NO: 177160 - protein, 11 aa, Borrelia garinii
FSGLVADTFFK

SEQ ID NO: 177161 - protein, 11 aa, Borrelia garinii
VADTFFKSDPK

SEQ ID NO: 177162 - protein, 11 aa, Borrelia garinii
DPKKSDVKTYF

SEQ ID NO: 177163 - protein, 11 aa, Borrelia garinii
KTYFESISSTL

SEQ ID NO: 177164 - protein, 11 aa, Borrelia garinii
TYFESISSTLK

SEQ ID NO: 177165 - protein, 11 aa, Borrelia garinii
ESISSTLKATK

SEQ ID NO: 177166 - protein, 11 aa, Borrelia garinii
ISSTLKATKGK

SEQ ID NO: 177167 - protein, 11 aa, Borrelia garinii
KATKGKLDELV

SEQ ID NO: 177168 - protein, 11 aa, Borrelia garinii
KGKLDELVSAK

SEQ ID NO: 177169 - protein, 11 aa, Borrelia garinii
SAKKGEGGSVK

SEQ ID NO: 177170 - protein, 11 aa, Borrelia garinii
KASVESAVDEV

SEQ ID NO: 177171 - protein, 11 aa, Borrelia garinii
SVESAVDEVSK

SEQ ID NO: 177172 - protein, 11 aa, Borrelia garinii
ESAVDEVSKWL

SEQ ID NO: 177173 - protein, 11 aa, Borrelia garinii
EVSKWLEEMIK

SEQ ID NO: 177174 - protein, 11 aa, Borrelia garinii
EEMIKAAEEAA

SEQ ID NO: 177175 - protein, 11 aa, Borrelia garinii
EMIKAAEEAAK

SEQ ID NO: 177176 - protein, 11 aa, Borrelia garinii
MIKAAEEAAKV

SEQ ID NO: 177177 - protein, 11 aa, Borrelia garinii
KIGDSAANHGA

SEQ ID NO: 177178 - protein, 11 aa, Borrelia garinii
SAANHGAKADK

SEQ ID NO: 177179 - protein, 11 aa, Borrelia garinii
DSVKGIAKGIK

SEQ ID NO: 177180 - protein, 11 aa, Borrelia garinii
GIKGIVDAAGK

SEQ ID NO: 177181 - protein, 11 aa, Borrelia garinii
ALGEKGALKDV

SEQ ID NO: 177182 - protein, 11 aa, Borrelia garinii
DEANADAGKLF

SEQ ID NO: 177183 - protein, 11 aa, Borrelia garinii
KLFAGNANAAV

SEQ ID NO: 177184 - protein, 11 aa, Borrelia garinii
FAGNANAAVGA

SEQ ID NO: 177185 - protein, 11 aa, Borrelia garinii
AAVGAAADIAK

SEQ ID NO: 177186 - protein, 11 aa, Borrelia garinii
AAADIAKAAGA

SEQ ID NO: 177187 - protein, 11 aa, Borrelia garinii
IAKAAGAVTAV

SEQ ID NO: 177188 - protein, 11 aa, Borrelia garinii
AVTAVSGEQIL

SEQ ID NO: 177189 - protein, 11 aa, Borrelia garinii
VTAVSGEQILK

SEQ ID NO: 177190 - protein, 11 aa, Borrelia garinii
AVSGEQILKAI

SEQ ID NO: 177191 - protein, 11 aa, Borrelia garinii
AAGDPANQAGK

SEQ ID NO: 177192 - protein, 11 aa, Borrelia garinii
AEEAKNPIAAA

SEQ ID NO: 177193 - protein, 11 aa, Borrelia garinii
EEAKNPIAAAI

SEQ ID NO: 177194 - protein, 11 aa, Borrelia garinii
IGTDDDNGAAF

SEQ ID NO: 177195 - protein, 11 aa, Borrelia garinii
GTDDDNGAAFK

SEQ ID NO: 177196 - protein, 11 aa, Borrelia garinii
NGAAFKDEMKK

SEQ ID NO: 177197 - protein, 11 aa, Borrelia garinii
AFKDEMKKSDK

SEQ ID NO: 177198 - protein, 11 aa, Borrelia garinii
KSDKIAAAIVL

SEQ ID NO: 177199 - protein, 11 aa, Borrelia garinii
KIAAAIVLRGV

SEQ ID NO: 177200 - protein, 11 aa, Borrelia garinii
IAAAIVLRGVA

SEQ ID NO: 177201 - protein, 11 aa, Borrelia garinii
AAAIVLRGVAK

SEQ ID NO: 177202 - protein, 11 aa, Borrelia garinii
IVLRGVAKDGK

SEQ ID NO: 177203 - protein, 11 aa, Borrelia garinii
VLRGVAKDGKF

SEQ ID NO: 177204 - protein, 11 aa, Borrelia garinii
GVAKDGKFAVK

SEQ ID NO: 177205 - protein, 15 aa, Borrelia garinii
ADAFSKADPKKSDVK

SEQ ID NO: 177206 - protein, 9 aa, Borrelia garinii
FSKADPKKS

SEQ ID NO: 177207 - protein, 15 aa, Borrelia garinii
ADAGDVKDAAAAVGA

SEQ ID NO: 177208 - protein, 9 aa, Borrelia garinii
VKDAAAAVG

SEQ ID NO: 177209 - protein, 15 aa, Borrelia garinii
ADKESVNGIAGAIKG

SEQ ID NO: 177210 - protein, 9 aa, Borrelia garinii
VNGIAGAIK

SEQ ID NO: 177211 - protein, 15 aa, Borrelia garinii
AFSGLVADAFSKADP

SEQ ID NO: 177212 - protein, 9 aa, Borrelia garinii
LVADAFSKA

SEQ ID NO: 177213 - protein, 15 aa, Borrelia garinii
AFSKADPKKSDVKTY

SEQ ID NO: 177214 - protein, 9 aa, Borrelia garinii
FSKADPKKS

SEQ ID NO: 177215 - protein, 15 aa, Borrelia garinii
AGDVKDAAAAVGAVS

SEQ ID NO: 177216 - protein, 9 aa, Borrelia garinii
VKDAAAAVG

SEQ ID NO: 177217 - protein, 15 aa, Borrelia garinii
AGKLFGTAAGADAGD

SEQ ID NO: 177218 - protein, 9 aa, Borrelia garinii
FGTAAGADA

SEQ ID NO: 177219 - protein, 15 aa, Borrelia garinii
AIFIVAFLALIGCKN

SEQ ID NO: 177220 - protein, 9 aa, Borrelia garinii
IVAFLALIG

SEQ ID NO: 177221 - protein, 15 aa, Borrelia garinii
AIVTAAGQAGQAGKK

SEQ ID NO: 177222 - protein, 9 aa, Borrelia garinii
IVTAAGQAG

SEQ ID NO: 177223 - protein, 15 aa, Borrelia garinii
AKNAIEAAIGAAGDA

SEQ ID NO: 177224 - protein, 9 aa, Borrelia garinii
IEAAIGAAG

SEQ ID NO: 177225 - protein, 15 aa, Borrelia garinii
ALVLRGVAKDGKFAG

SEQ ID NO: 177226 - protein, 9 aa, Borrelia garinii
LRGVAKDGK

SEQ ID NO: 177227 - protein, 15 aa, Borrelia garinii
ASIFYQSIINLGNGF

SEQ ID NO: 177228 - protein, 9 aa, Borrelia garinii
FYQSIINLG

SEQ ID NO: 177229 - protein, 15 aa, Borrelia garinii
ASIFYQSIINLGNGF

SEQ ID NO: 177230 - protein, 9 aa, Borrelia garinii
YQSIINLGN

SEQ ID NO: 177231 - protein, 15 aa, Borrelia garinii
AVSGEQILNAIVTAA

SEQ ID NO: 177232 - protein, 9 aa, Borrelia garinii
EQILNAIVT

SEQ ID NO: 177233 - protein, 15 aa, Borrelia garinii
AVSGEQILNAIVTAA

SEQ ID NO: 177234 - protein, 9 aa, Borrelia garinii
VSGEQILNA

SEQ ID NO: 177235 - protein, 15 aa, Borrelia garinii
DAFSKADPKKSDVKT

SEQ ID NO: 177236 - protein, 9 aa, Borrelia garinii
FSKADPKKS

SEQ ID NO: 177237 - protein, 15 aa, Borrelia garinii
DAGDVKDAAAAVGAV

SEQ ID NO: 177238 - protein, 9 aa, Borrelia garinii
VKDAAAAVG

SEQ ID NO: 177239 - protein, 15 aa, Borrelia garinii
DEAKNAIEAAIGAAG

SEQ ID NO: 177240 - protein, 9 aa, Borrelia garinii
KNAIEAAIG

SEQ ID NO: 177241 - protein, 15 aa, Borrelia garinii
DIKKKNDQIAAALVL

SEQ ID NO: 177242 - protein, 9 aa, Borrelia garinii
IKKKNDQIA

SEQ ID NO: 177243 - protein, 15 aa, Borrelia garinii
DKESVNGIAGAIKGI

SEQ ID NO: 177244 - protein, 9 aa, Borrelia garinii
VNGIAGAIK

SEQ ID NO: 177245 - protein, 15 aa, Borrelia garinii
DKIGNVAAGGGAGAD

SEQ ID NO: 177246 - protein, 9 aa, Borrelia garinii
IGNVAAGGG

SEQ ID NO: 177247 - protein, 15 aa, Borrelia garinii
DQIAAALVLRGVAKD

SEQ ID NO: 177248 - protein, 9 aa, Borrelia garinii
IAAALVLRG

SEQ ID NO: 177249 - protein, 15 aa, Borrelia garinii
DTAASIFYQSIINLG

SEQ ID NO: 177250 - protein, 9 aa, Borrelia garinii
IFYQSIINL

SEQ ID NO: 177251 - protein, 15 aa, Borrelia garinii
DTAASIFYQSIINLG

SEQ ID NO: 177252 - protein, 9 aa, Borrelia garinii
SIFYQSIIN

SEQ ID NO: 177253 - protein, 15 aa, Borrelia garinii
DVKDAAAAVGAVSGE

SEQ ID NO: 177254 - protein, 9 aa, Borrelia garinii
VKDAAAAVG

SEQ ID NO: 177255 - protein, 15 aa, Borrelia garinii
DAAAAVGAVSGEQIL

SEQ ID NO: 177256 - protein, 9 aa, Borrelia garinii
VGAVSGEQI

SEQ ID NO: 177257 - protein, 15 aa, Borrelia garinii
EAKNAIEAAIGAAGD

SEQ ID NO: 177258 - protein, 9 aa, Borrelia garinii
IEAAIGAAG

SEQ ID NO: 177259 - protein, 15 aa, Borrelia garinii
EGVKFAPKAAADAAA

SEQ ID NO: 177260 - protein, 9 aa, Borrelia garinii
FAPKAAADA

SEQ ID NO: 177261 - protein, 15 aa, Borrelia garinii
EQILNAIVTAAGQAG

SEQ ID NO: 177262 - protein, 9 aa, Borrelia garinii
ILNAIVTAA

SEQ ID NO: 177263 - protein, 15 aa, Borrelia garinii
EQILNAIVTAAGQAG

SEQ ID NO: 177264 - protein, 9 aa, Borrelia garinii
LNAIVTAAG

SEQ ID NO: 177265 - protein, 15 aa, Borrelia garinii
ESVNGIAGAIKGIVE

SEQ ID NO: 177266 - protein, 9 aa, Borrelia garinii
VNGIAGAIK

SEQ ID NO: 177267 - protein, 15 aa, Borrelia garinii
EVFNAFSGLVADAFS

SEQ ID NO: 177268 - protein, 9 aa, Borrelia garinii
FNAFSGLVA

SEQ ID NO: 177269 - protein, 15 aa, Borrelia garinii
EVFNAFSGLVADAFS

SEQ ID NO: 177270 - protein, 9 aa, Borrelia garinii
VFNAFSGLV

SEQ ID NO: 177271 - protein, 15 aa, Borrelia garinii
FAPKAAADAAAADGN

SEQ ID NO: 177272 - protein, 9 aa, Borrelia garinii
FAPKAAADA

SEQ ID NO: 177273 - protein, 15 aa, Borrelia garinii
FGTAAGADAGDVKDA

SEQ ID NO: 177274 - protein, 9 aa, Borrelia garinii
FGTAAGADA

SEQ ID NO: 177275 - protein, 15 aa, Borrelia garinii
FIEVFNAFSGLVADA

SEQ ID NO: 177276 - protein, 9 aa, Borrelia garinii
FNAFSGLVA

SEQ ID NO: 177277 - protein, 15 aa, Borrelia garinii
FIEVFNAFSGLVADA

SEQ ID NO: 177278 - protein, 9 aa, Borrelia garinii
VFNAFSGLV

SEQ ID NO: 177279 - protein, 15 aa, Borrelia garinii
FIVAFLALIGCKNNV

SEQ ID NO: 177280 - protein, 9 aa, Borrelia garinii
IVAFLALIG

SEQ ID NO: 177281 - protein, 15 aa, Borrelia garinii
FNAFSGLVADAFSKA

SEQ ID NO: 177282 - protein, 9 aa, Borrelia garinii
FSGLVADAF

SEQ ID NO: 177283 - protein, 15 aa, Borrelia garinii
FSGLVADAFSKADPK

SEQ ID NO: 177284 - protein, 9 aa, Borrelia garinii
LVADAFSKA

SEQ ID NO: 177285 - protein, 15 aa, Borrelia garinii
FSKADPKKSDVKTYF

SEQ ID NO: 177286 - protein, 9 aa, Borrelia garinii
FSKADPKKS

SEQ ID NO: 177287 - protein, 15 aa, Borrelia garinii
FYQSIINLGNGFIEV

SEQ ID NO: 177288 - protein, 9 aa, Borrelia garinii
FYQSIINLG

SEQ ID NO: 177289 - protein, 15 aa, Borrelia garinii
FYQSIINLGNGFIEV

SEQ ID NO: 177290 - protein, 9 aa, Borrelia garinii
IINLGNGFI

SEQ ID NO: 177291 - protein, 15 aa, Borrelia garinii
FYQSIINLGNGFIEV

SEQ ID NO: 177292 - protein, 9 aa, Borrelia garinii
YQSIINLGN

SEQ ID NO: 177293 - protein, 15 aa, Borrelia garinii
GADAGDVKDAAAAVG

SEQ ID NO: 177294 - protein, 9 aa, Borrelia garinii
AGDVKDAAA

SEQ ID NO: 177295 - protein, 15 aa, Borrelia garinii
GDVKDAAAAVGAVSG

SEQ ID NO: 177296 - protein, 9 aa, Borrelia garinii
VKDAAAAVG

SEQ ID NO: 177297 - protein, 15 aa, Borrelia garinii
GEQILNAIVTAAGQA

SEQ ID NO: 177298 - protein, 9 aa, Borrelia garinii
ILNAIVTAA

SEQ ID NO: 177299 - protein, 15 aa, Borrelia garinii
GEQILNAIVTAAGQA

SEQ ID NO: 177300 - protein, 9 aa, Borrelia garinii
LNAIVTAAG

SEQ ID NO: 177301 - protein, 15 aa, Borrelia garinii
GFIEVFNAFSGLVAD

SEQ ID NO: 177302 - protein, 9 aa, Borrelia garinii
FNAFSGLVA

SEQ ID NO: 177303 - protein, 15 aa, Borrelia garinii
GFIEVFNAFSGLVAD

SEQ ID NO: 177304 - protein, 9 aa, Borrelia garinii
VFNAFSGLV

SEQ ID NO: 177305 - protein, 15 aa, Borrelia garinii
GGGSDKIGNVAAGGG

SEQ ID NO: 177306 - protein, 9 aa, Borrelia garinii
KIGNVAAGG

SEQ ID NO: 177307 - protein, 15 aa, Borrelia garinii
GGSDKIGNVAAGGGA

SEQ ID NO: 177308 - protein, 9 aa, Borrelia garinii
IGNVAAGGG

SEQ ID NO: 177309 - protein, 15 aa, Borrelia garinii
GKLFGTAAGADAGDV

SEQ ID NO: 177310 - protein, 9 aa, Borrelia garinii
FGTAAGADA

SEQ ID NO: 177311 - protein, 15 aa, Borrelia garinii
GLVADAFSKADPKKS

SEQ ID NO: 177312 - protein, 9 aa, Borrelia garinii
AFSKADPKK

SEQ ID NO: 177313 - protein, 15 aa, Borrelia garinii
GLVADAFSKADPKKS

SEQ ID NO: 177314 - protein, 9 aa, Borrelia garinii
VADAFSKAD

SEQ ID NO: 177315 - protein, 15 aa, Borrelia garinii
GNGFIEVFNAFSGLV

SEQ ID NO: 177316 - protein, 9 aa, Borrelia garinii
FIEVFNAFS

SEQ ID NO: 177317 - protein, 15 aa, Borrelia garinii
GNVAAGGGAGADKES

SEQ ID NO: 177318 - protein, 9 aa, Borrelia garinii
VAAGGGAGA

SEQ ID NO: 177319 - protein, 15 aa, Borrelia garinii
GSDKIGNVAAGGGAG

SEQ ID NO: 177320 - protein, 9 aa, Borrelia garinii
IGNVAAGGG

SEQ ID NO: 177321 - protein, 15 aa, Borrelia garinii
GVKFAPKAAADAAAA

SEQ ID NO: 177322 - protein, 9 aa, Borrelia garinii
FAPKAAADA

SEQ ID NO: 177323 - protein, 15 aa, Borrelia garinii
IEVFNAFSGLVADAF

SEQ ID NO: 177324 - protein, 9 aa, Borrelia garinii
FNAFSGLVA

SEQ ID NO: 177325 - protein, 15 aa, Borrelia garinii
IEVFNAFSGLVADAF

SEQ ID NO: 177326 - protein, 9 aa, Borrelia garinii
VFNAFSGLV

SEQ ID NO: 177327 - protein, 15 aa, Borrelia garinii
IFIVAFLALIGCKNN

SEQ ID NO: 177328 - protein, 9 aa, Borrelia garinii
IVAFLALIG

SEQ ID NO: 177329 - protein, 15 aa, Borrelia garinii
IFYQSIINLGNGFIE

SEQ ID NO: 177330 - protein, 9 aa, Borrelia garinii
FYQSIINLG

SEQ ID NO: 177331 - protein, 15 aa, Borrelia garinii
IFYQSIINLGNGFIE

SEQ ID NO: 177332 - protein, 9 aa, Borrelia garinii
IINLGNGFI

SEQ ID NO: 177333 - protein, 15 aa, Borrelia garinii
IFYQSIINLGNGFIE

SEQ ID NO: 177334 - protein, 9 aa, Borrelia garinii
YQSIINLGN

SEQ ID NO: 177335 - protein, 15 aa, Borrelia garinii
IGNVAAGGGAGADKE

SEQ ID NO: 177336 - protein, 9 aa, Borrelia garinii
VAAGGGAGA

SEQ ID NO: 177337 - protein, 15 aa, Borrelia garinii
IKKKNDQIAAALVLR

SEQ ID NO: 177338 - protein, 9 aa, Borrelia garinii
DQIAAALVL

SEQ ID NO: 177339 - protein, 15 aa, Borrelia garinii
ILNAIVTAAGQAGQA

SEQ ID NO: 177340 - protein, 9 aa, Borrelia garinii
ILNAIVTAA

SEQ ID NO: 177341 - protein, 15 aa, Borrelia garinii
ILNAIVTAAGQAGQA

SEQ ID NO: 177342 - protein, 9 aa, Borrelia garinii
IVTAAGQAG

SEQ ID NO: 177343 - protein, 15 aa, Borrelia garinii
ISSAIFIVAFLALIG

SEQ ID NO: 177344 - protein, 9 aa, Borrelia garinii
FIVAFLALI

SEQ ID NO: 177345 - protein, 15 aa, Borrelia garinii
IVAFLALIGCKNNVG

SEQ ID NO: 177346 - protein, 9 aa, Borrelia garinii
IVAFLALIG

SEQ ID NO: 177347 - protein, 15 aa, Borrelia garinii
IVTAAGQAGQAGKKA

SEQ ID NO: 177348 - protein, 9 aa, Borrelia garinii
IVTAAGQAG

SEQ ID NO: 177349 - protein, 15 aa, Borrelia garinii
IAAALVLRGVAKDGK

SEQ ID NO: 177350 - protein, 9 aa, Borrelia garinii
ALVLRGVAK

SEQ ID NO: 177351 - protein, 15 aa, Borrelia garinii
IAAALVLRGVAKDGK

SEQ ID NO: 177352 - protein, 9 aa, Borrelia garinii
IAAALVLRG

SEQ ID NO: 177353 - protein, 15 aa, Borrelia garinii
KAGKLFGTAAGADAG

SEQ ID NO: 177354 - protein, 9 aa, Borrelia garinii
FGTAAGADA

SEQ ID NO: 177355 - protein, 15 aa, Borrelia garinii
KDAAAAVGAVSGEQI

SEQ ID NO: 177356 - protein, 9 aa, Borrelia garinii
AAAVGAVSG

SEQ ID NO: 177357 - protein, 15 aa, Borrelia garinii
KESVNGIAGAIKGIV

SEQ ID NO: 177358 - protein, 9 aa, Borrelia garinii
VNGIAGAIK

SEQ ID NO: 177359 - protein, 15 aa, Borrelia garinii
KFAPKAAADAAAADG

SEQ ID NO: 177360 - protein, 9 aa, Borrelia garinii
FAPKAAADA

SEQ ID NO: 177361 - protein, 15 aa, Borrelia garinii
KIGNVAAGGGAGADK

SEQ ID NO: 177362 - protein, 9 aa, Borrelia garinii
VAAGGGAGA

SEQ ID NO: 177363 - protein, 15 aa, Borrelia garinii
KISSAIFIVAFLALI

SEQ ID NO: 177364 - protein, 9 aa, Borrelia garinii
IFIVAFLAL

SEQ ID NO: 177365 - protein, 15 aa, Borrelia garinii
KKAGKLFGTAAGADA

SEQ ID NO: 177366 - protein, 9 aa, Borrelia garinii
LFGTAAGAD

SEQ ID NO: 177367 - protein, 15 aa, Borrelia garinii
KKKNDQIAAALVLRG

SEQ ID NO: 177368 - protein, 9 aa, Borrelia garinii
DQIAAALVL

SEQ ID NO: 177369 - protein, 15 aa, Borrelia garinii
KKNDQIAAALVLRGV

SEQ ID NO: 177370 - protein, 9 aa, Borrelia garinii
IAAALVLRG

SEQ ID NO: 177371 - protein, 15 aa, Borrelia garinii
KLFGTAAGADAGDVK

SEQ ID NO: 177372 - protein, 9 aa, Borrelia garinii
FGTAAGADA

SEQ ID NO: 177373 - protein, 15 aa, Borrelia garinii
KNAIEAAIGAAGDAD

SEQ ID NO: 177374 - protein, 9 aa, Borrelia garinii
IEAAIGAAG

SEQ ID NO: 177375 - protein, 15 aa, Borrelia garinii
KNDQIAAALVLRGVA

SEQ ID NO: 177376 - protein, 9 aa, Borrelia garinii
IAAALVLRG

SEQ ID NO: 177377 - protein, 15 aa, Borrelia garinii
KVEGVKFAPKAAADA

SEQ ID NO: 177378 - protein, 9 aa, Borrelia garinii
VKFAPKAAA

SEQ ID NO: 177379 - protein, 15 aa, Borrelia garinii
LFGTAAGADAGDVKD

SEQ ID NO: 177380 - protein, 9 aa, Borrelia garinii
FGTAAGADA

SEQ ID NO: 177381 - protein, 15 aa, Borrelia garinii
LNAIVTAAGQAGQAG

SEQ ID NO: 177382 - protein, 9 aa, Borrelia garinii
IVTAAGQAG

SEQ ID NO: 177383 - protein, 15 aa, Borrelia garinii
LVADAFSKADPKKSD

SEQ ID NO: 177384 - protein, 9 aa, Borrelia garinii
FSKADPKKS

SEQ ID NO: 177385 - protein, 15 aa, Borrelia garinii
MKKISSAIFIVAFLA

SEQ ID NO: 177386 - protein, 9 aa, Borrelia garinii
MKKISSAIF

SEQ ID NO: 177387 - protein, 15 aa, Borrelia garinii
NAFSGLVADAFSKAD

SEQ ID NO: 177388 - protein, 9 aa, Borrelia garinii
FSGLVADAF

SEQ ID NO: 177389 - protein, 15 aa, Borrelia garinii
NAIEAAIGAAGDADF

SEQ ID NO: 177390 - protein, 9 aa, Borrelia garinii
IEAAIGAAG

SEQ ID NO: 177391 - protein, 15 aa, Borrelia garinii
NAIVTAAGQAGQAGK

SEQ ID NO: 177392 - protein, 9 aa, Borrelia garinii
IVTAAGQAG

SEQ ID NO: 177393 - protein, 15 aa, Borrelia garinii
NDQIAAALVLRGVAK

SEQ ID NO: 177394 - protein, 9 aa, Borrelia garinii
IAAALVLRG

SEQ ID NO: 177395 - protein, 15 aa, Borrelia garinii
NGFIEVFNAFSGLVA

SEQ ID NO: 177396 - protein, 9 aa, Borrelia garinii
FIEVFNAFS

SEQ ID NO: 177397 - protein, 15 aa, Borrelia garinii
NGFIEVFNAFSGLVA

SEQ ID NO: 177398 - protein, 9 aa, Borrelia garinii
VFNAFSGLV

SEQ ID NO: 177399 - protein, 15 aa, Borrelia garinii
QILNAIVTAAGQAGQ

SEQ ID NO: 177400 - protein, 9 aa, Borrelia garinii
ILNAIVTAA

SEQ ID NO: 177401 - protein, 15 aa, Borrelia garinii
QILNAIVTAAGQAGQ

SEQ ID NO: 177402 - protein, 9 aa, Borrelia garinii
IVTAAGQAG

SEQ ID NO: 177403 - protein, 15 aa, Borrelia garinii
QIAAALVLRGVAKDG

SEQ ID NO: 177404 - protein, 9 aa, Borrelia garinii
IAAALVLRG

SEQ ID NO: 177405 - protein, 15 aa, Borrelia garinii
QSIINLGNGFIEVFN

SEQ ID NO: 177406 - protein, 9 aa, Borrelia garinii
IINLGNGFI

SEQ ID NO: 177407 - protein, 15 aa, Borrelia garinii
SAIFIVAFLALIGCK

SEQ ID NO: 177408 - protein, 9 aa, Borrelia garinii
IVAFLALIG

SEQ ID NO: 177409 - protein, 15 aa, Borrelia garinii
SDKIGNVAAGGGAGA

SEQ ID NO: 177410 - protein, 9 aa, Borrelia garinii
IGNVAAGGG

SEQ ID NO: 177411 - protein, 15 aa, Borrelia garinii
SGEQILNAIVTAAGQ

SEQ ID NO: 177412 - protein, 9 aa, Borrelia garinii
ILNAIVTAA

SEQ ID NO: 177413 - protein, 15 aa, Borrelia garinii
SGEQILNAIVTAAGQ

SEQ ID NO: 177414 - protein, 9 aa, Borrelia garinii
LNAIVTAAG

SEQ ID NO: 177415 - protein, 15 aa, Borrelia garinii
SIFYQSIINLGNGFI

SEQ ID NO: 177416 - protein, 9 aa, Borrelia garinii
FYQSIINLG

SEQ ID NO: 177417 - protein, 15 aa, Borrelia garinii
SIFYQSIINLGNGFI

SEQ ID NO: 177418 - protein, 9 aa, Borrelia garinii
YQSIINLGN

SEQ ID NO: 177419 - protein, 15 aa, Borrelia garinii
SIINLGNGFIEVFNA

SEQ ID NO: 177420 - protein, 9 aa, Borrelia garinii
IINLGNGFI

SEQ ID NO: 177421 - protein, 15 aa, Borrelia garinii
SSAIFIVAFLALIGC

SEQ ID NO: 177422 - protein, 9 aa, Borrelia garinii
IVAFLALIG

SEQ ID NO: 177423 - protein, 15 aa, Borrelia garinii
TAASIFYQSIINLGN

SEQ ID NO: 177424 - protein, 9 aa, Borrelia garinii
FYQSIINLG

SEQ ID NO: 177425 - protein, 15 aa, Borrelia garinii
VADAFSKADPKKSDV

SEQ ID NO: 177426 - protein, 9 aa, Borrelia garinii
FSKADPKKS

SEQ ID NO: 177427 - protein, 15 aa, Borrelia garinii
VEGVKFAPKAAADAA

SEQ ID NO: 177428 - protein, 9 aa, Borrelia garinii
FAPKAAADA

SEQ ID NO: 177429 - protein, 15 aa, Borrelia garinii
VFNAFSGLVADAFSK

SEQ ID NO: 177430 - protein, 9 aa, Borrelia garinii
VFNAFSGLV

SEQ ID NO: 177431 - protein, 15 aa, Borrelia garinii
VGAVSGEQILNAIVT

SEQ ID NO: 177432 - protein, 9 aa, Borrelia garinii
VSGEQILNA

SEQ ID NO: 177433 - protein, 15 aa, Borrelia garinii
VKDAAAAVGAVSGEQ

SEQ ID NO: 177434 - protein, 9 aa, Borrelia garinii
VKDAAAAVG

SEQ ID NO: 177435 - protein, 15 aa, Borrelia garinii
VKFAPKAAADAAAAD

SEQ ID NO: 177436 - protein, 9 aa, Borrelia garinii
FAPKAAADA

SEQ ID NO: 177437 - protein, 15 aa, Borrelia garinii
VSGEQILNAIVTAAG

SEQ ID NO: 177438 - protein, 9 aa, Borrelia garinii
ILNAIVTAA

SEQ ID NO: 177439 - protein, 15 aa, Borrelia garinii
YQSIINLGNGFIEVF

SEQ ID NO: 177440 - protein, 9 aa, Borrelia garinii
IINLGNGFI

SEQ ID NO: 177441 - protein, 15 aa, Borrelia garinii
YQSIINLGNGFIEVF

SEQ ID NO: 177442 - protein, 9 aa, Borrelia garinii
YQSIINLGN

SEQ ID NO: 177443 - protein, 15 aa, Borrelia garinii
AAALVLRGVAKDGKF

SEQ ID NO: 177444 - protein, 9 aa, Borrelia garinii
LRGVAKDGK

SEQ ID NO: 177445 - protein, 15 aa, Borrelia garinii
AAALVLRGVAKDGKF

SEQ ID NO: 177446 - protein, 9 aa, Borrelia garinii
VLRGVAKDG

SEQ ID NO: 177447 - protein, 15 aa, Borrelia garinii
AAAVGAVSGEQILNA

SEQ ID NO: 177448 - protein, 9 aa, Borrelia garinii
VGAVSGEQI

SEQ ID NO: 177449 - protein, 15 aa, Borrelia garinii
AALVLRGVAKDGKFA

SEQ ID NO: 177450 - protein, 9 aa, Borrelia garinii
LRGVAKDGK

SEQ ID NO: 177451 - protein, 15 aa, Borrelia garinii
AALVLRGVAKDGKFA

SEQ ID NO: 177452 - protein, 9 aa, Borrelia garinii
VLRGVAKDG

SEQ ID NO: 177453 - protein, 15 aa, Borrelia garinii
AASIFYQSIINLGNG

SEQ ID NO: 177454 - protein, 9 aa, Borrelia garinii
FYQSIINLG

SEQ ID NO: 177455 - protein, 15 aa, Borrelia garinii
AASIFYQSIINLGNG

SEQ ID NO: 177456 - protein, 9 aa, Borrelia garinii
YQSIINLGN

SEQ ID NO: 177457 - protein, 15 aa, Borrelia garinii
AAAAVGAVSGEQILN

SEQ ID NO: 177458 - protein, 9 aa, Borrelia garinii
VGAVSGEQI

SEQ ID NO: 177459 - protein, 9 aa, Borrelia
FTLEGTLAA

SEQ ID NO: 177460 - protein, 9 aa, Borrelia
TLVSKKVTL

SEQ ID NO: 177461 - protein, 8 aa, Borrelia
IMLEGNLV

SEQ ID NO: 177462 - protein, 8 aa, Borrelia
TMSITDDL

SEQ ID NO: 177463 - protein, 8 aa, Borrelia
LMTLFLFI

SEQ ID NO: 177464 - protein, 8 aa, Borrelia
LLAGAYAI

SEQ ID NO: 177465 - protein, 8 aa, Borrelia
QASWTLRV

SEQ ID NO: 177466 - protein, 8 aa, Borrelia
IAVNIYAA

SEQ ID NO: 177467 - protein, 8 aa, Borrelia
LSAIVTAA

SEQ ID NO: 177468 - protein, 8 aa, Borrelia
ILSAIVTA

SEQ ID NO: 177469 - protein, 8 aa, Borrelia
IICAVFVL

SEQ ID NO: 177470 - protein, 8 aa, Borrelia
IWSNPNYI

SEQ ID NO: 177471 - protein, 8 aa, Borrelia
IICAVFVL

SEQ ID NO: 177472 - protein, 8 aa, Borrelia
FSEFTVNI

SEQ ID NO: 177473 - protein, 8 aa, Borrelia
MYSDGIDI

SEQ ID NO: 177474 - protein, 8 aa, Borrelia
LAPNNVIT

SEQ ID NO: 177475 - protein, 8 aa, Borrelia
LIGVVFRI

SEQ ID NO: 177476 - protein, 8 aa, Borrelia
VGDALYLI

SEQ ID NO: 177477 - protein, 8 aa, Borrelia
MTEDAYEV

SEQ ID NO: 177478 - protein, 8 aa, Borrelia
LNQDQSYI

SEQ ID NO: 177479 - protein, 8 aa, Borrelia
MYGYEAGA

SEQ ID NO: 177480 - protein, 8 aa, Borrelia
LAPNNVLV

SEQ ID NO: 177481 - protein, 8 aa, Borrelia
ILKAKIKA

SEQ ID NO: 177482 - protein, 8 aa, Borrelia
TADGIIAI

SEQ ID NO: 177483 - protein, 8 aa, Borrelia
LAACNFGL

SEQ ID NO: 177484 - protein, 8 aa, Borrelia
LVACSIGL

SEQ ID NO: 177485 - protein, 8 aa, Borrelia
LFILSLSA

SEQ ID NO: 177486 - protein, 9 aa, Borrelia
KLNIIKLNI

SEQ ID NO: 177487 - protein, 8 aa, Borrelia
LNYEIEKI

SEQ ID NO: 177488 - protein, 9 aa, Borrelia
KLNILTTIL

SEQ ID NO: 177489 - protein, 8 aa, Borrelia
MLISISLL

SEQ ID NO: 177490 - protein, 9 aa, Borrelia
LIDDFAIEL

SEQ ID NO: 177491 - protein, 8 aa, Borrelia
LSCDVSRL

SEQ ID NO: 177492 - protein, 8 aa, Borrelia
LLDFASFV

SEQ ID NO: 177493 - protein, 8 aa, Borrelia
LNTNEDFV

SEQ ID NO: 177494 - protein, 8 aa, Borrelia
IAYDSADV

SEQ ID NO: 177495 - protein, 9 aa, Borrelia
IVFLSCSGK

SEQ ID NO: 177496 - protein, 9 aa, Borrelia
FLTGYIAAK

SEQ ID NO: 177497 - protein, 9 aa, Borrelia
EIFIKQILK

SEQ ID NO: 177498 - protein, 9 aa, Borrelia
ALYLITGEY

SEQ ID NO: 177499 - protein, 9 aa, Borrelia
KEMARFMYK

SEQ ID NO: 177500 - protein, 9 aa, Borrelia
YIAAKMSRK

SEQ ID NO: 177501 - protein, 9 aa, Borrelia
SLMYSLTKK

SEQ ID NO: 177502 - protein, 9 aa, Borrelia
RSTASNMYR

SEQ ID NO: 177503 - protein, 9 aa, Borrelia
IIAIVKVMK

SEQ ID NO: 177504 - protein, 9 aa, Borrelia
FTNTQTGSK

SEQ ID NO: 177505 - protein, 9 aa, Borrelia
FTGLKTGSK

SEQ ID NO: 177506 - protein, 9 aa, Borrelia
LFEAFTGLK

SEQ ID NO: 177507 - protein, 9 aa, Borrelia
LLTSGMPSK

SEQ ID NO: 177508 - protein, 9 aa, Borrelia
LILALIACK

SEQ ID NO: 177509 - protein, 9 aa, Borrelia
KTKNLVFTK

SEQ ID NO: 177510 - protein, 9 aa, Borrelia
ISVNSQKTK

SEQ ID NO: 177511 - protein, 9 aa, Borrelia
VTLKKEIEK

SEQ ID NO: 177512 - protein, 9 aa, Borrelia
RTNGTTLEY

SEQ ID NO: 177513 - protein, 9 aa, Borrelia
MTDADNATK

SEQ ID NO: 177514 - protein, 9 aa, Borrelia
LANKAIGKK

SEQ ID NO: 177515 - protein, 9 aa, Borrelia
ILMTLFLFI

SEQ ID NO: 177516 - protein, 9 aa, Borrelia
AISTLITEK

SEQ ID NO: 177517 - protein, 9 aa, Borrelia
GSFKTSLYY

SEQ ID NO: 177518 - protein, 9 aa, Borrelia
NLGTLVIRK

SEQ ID NO: 177519 - protein, 9 aa, Borrelia
VFVLIISCK

SEQ ID NO: 177520 - protein, 9 aa, Borrelia
RVSKSHSSK

SEQ ID NO: 177521 - protein, 9 aa, Borrelia
SINAANLSK

SEQ ID NO: 177522 - protein, 9 aa, Borrelia
KINTPASLS

SEQ ID NO: 177523 - protein, 9 aa, Borrelia
SQASRNTSK

SEQ ID NO: 177524 - protein, 9 aa, Borrelia
FQNRLESIK

SEQ ID NO: 177525 - protein, 9 aa, Borrelia
AVSGEQILK

SEQ ID NO: 177526 - protein, 9 aa, Borrelia
AIVLRGLAK

SEQ ID NO: 177527 - protein, 9 aa, Borrelia
KQILADLPK

SEQ ID NO: 177528 - protein, 9 aa, Borrelia
QLNSDKIDY

SEQ ID NO: 177529 - protein, 9 aa, Borrelia
RIIYSSLNY

SEQ ID NO: 177530 - protein, 9 aa, Borrelia
SSLNYEIEK

SEQ ID NO: 177531 - protein, 9 aa, Borrelia
RSRYNNFYK

SEQ ID NO: 177532 - protein, 9 aa, Borrelia
ESFDVISSK

SEQ ID NO: 177533 - protein, 9 aa, Borrelia
LIALKCIVK

SEQ ID NO: 177534 - protein, 9 aa, Borrelia
RSFEKFKKK

SEQ ID NO: 177535 - protein, 9 aa, Borrelia
FLFASSQSY

SEQ ID NO: 177536 - protein, 9 aa, Borrelia
RINLNLKRK

SEQ ID NO: 177537 - protein, 9 aa, Artificial Sequence
  Artificial protein sequence
GLFGAGAFK

SEQ ID NO: 177538 - protein, 9 aa, Artificial Sequence
  Artificial protein sequence
GVYAGAVMK

SEQ ID NO: 177539 - protein, 8 aa, Borrelia afzelii
MKKNTLSA

SEQ ID NO: 177540 - protein, 8 aa, Borrelia afzelii
KKNTLSAI

SEQ ID NO: 177541 - protein, 8 aa, Borrelia afzelii
KNTLSAIL

SEQ ID NO: 177542 - protein, 8 aa, Borrelia afzelii
NTLSAILM

SEQ ID NO: 177543 - protein, 8 aa, Borrelia afzelii
TLSAILMT

SEQ ID NO: 177544 - protein, 8 aa, Borrelia afzelii
LSAILMTL

SEQ ID NO: 177545 - protein, 8 aa, Borrelia afzelii
SAILMTLF

SEQ ID NO: 177546 - protein, 8 aa, Borrelia afzelii
AILMTLFL

SEQ ID NO: 177547 - protein, 8 aa, Borrelia afzelii
ILMTLFLF

SEQ ID NO: 177548 - protein, 8 aa, Borrelia afzelii
LMTLFLFI

SEQ ID NO: 177549 - protein, 8 aa, Borrelia afzelii
MTLFLFIS

SEQ ID NO: 177550 - protein, 8 aa, Borrelia afzelii
TLFLFISC

SEQ ID NO: 177551 - protein, 8 aa, Borrelia afzelii
LFLFISCN

SEQ ID NO: 177552 - protein, 8 aa, Borrelia afzelii
FLFISCNN

SEQ ID NO: 177553 - protein, 8 aa, Borrelia afzelii
LFISCNNS

SEQ ID NO: 177554 - protein, 8 aa, Borrelia afzelii
FISCNNSG

SEQ ID NO: 177555 - protein, 8 aa, Borrelia afzelii
ISCNNSGK

SEQ ID NO: 177556 - protein, 8 aa, Borrelia afzelii
SCNNSGKG

SEQ ID NO: 177557 - protein, 8 aa, Borrelia afzelii
CNNSGKGG

SEQ ID NO: 177558 - protein, 8 aa, Borrelia afzelii
NNSGKGGD

SEQ ID NO: 177559 - protein, 8 aa, Borrelia afzelii
NSGKGGDS

SEQ ID NO: 177560 - protein, 8 aa, Borrelia afzelii
SGKGGDSA

SEQ ID NO: 177561 - protein, 8 aa, Borrelia afzelii
GKGGDSAS

SEQ ID NO: 177562 - protein, 8 aa, Borrelia afzelii
KGGDSAST

SEQ ID NO: 177563 - protein, 8 aa, Borrelia afzelii
GGDSASTN

SEQ ID NO: 177564 - protein, 8 aa, Borrelia afzelii
GDSASTNP

SEQ ID NO: 177565 - protein, 8 aa, Borrelia afzelii
DSASTNPA

SEQ ID NO: 177566 - protein, 8 aa, Borrelia afzelii
SASTNPAD

SEQ ID NO: 177567 - protein, 8 aa, Borrelia afzelii
ASTNPADE

SEQ ID NO: 177568 - protein, 8 aa, Borrelia afzelii
STNPADES

SEQ ID NO: 177569 - protein, 8 aa, Borrelia afzelii
TNPADESA

SEQ ID NO: 177570 - protein, 8 aa, Borrelia afzelii
NPADESAK

SEQ ID NO: 177571 - protein, 8 aa, Borrelia afzelii
PADESAKG

SEQ ID NO: 177572 - protein, 8 aa, Borrelia afzelii
ADESAKGP

SEQ ID NO: 177573 - protein, 8 aa, Borrelia afzelii
DESAKGPN

SEQ ID NO: 177574 - protein, 8 aa, Borrelia afzelii
ESAKGPNL

SEQ ID NO: 177575 - protein, 8 aa, Borrelia afzelii
SAKGPNLT

SEQ ID NO: 177576 - protein, 8 aa, Borrelia afzelii
AKGPNLTE

SEQ ID NO: 177577 - protein, 8 aa, Borrelia afzelii
KGPNLTEI

SEQ ID NO: 177578 - protein, 8 aa, Borrelia afzelii
GPNLTEIS

SEQ ID NO: 177579 - protein, 8 aa, Borrelia afzelii
PNLTEISK

SEQ ID NO: 177580 - protein, 8 aa, Borrelia afzelii
NLTEISKK

SEQ ID NO: 177581 - protein, 8 aa, Borrelia afzelii
LTEISKKI

SEQ ID NO: 177582 - protein, 8 aa, Borrelia afzelii
TEISKKIT

SEQ ID NO: 177583 - protein, 8 aa, Borrelia afzelii
EISKKITD

SEQ ID NO: 177584 - protein, 8 aa, Borrelia afzelii
ISKKITDS

SEQ ID NO: 177585 - protein, 8 aa, Borrelia afzelii
SKKITDSN

SEQ ID NO: 177586 - protein, 8 aa, Borrelia afzelii
KKITDSNA

SEQ ID NO: 177587 - protein, 8 aa, Borrelia afzelii
KITDSNAF

SEQ ID NO: 177588 - protein, 8 aa, Borrelia afzelii
ITDSNAFV

SEQ ID NO: 177589 - protein, 8 aa, Borrelia afzelii
TDSNAFVL

SEQ ID NO: 177590 - protein, 8 aa, Borrelia afzelii
DSNAFVLA

SEQ ID NO: 177591 - protein, 8 aa, Borrelia afzelii
SNAFVLAV

SEQ ID NO: 177592 - protein, 8 aa, Borrelia afzelii
NAFVLAVK

SEQ ID NO: 177593 - protein, 8 aa, Borrelia afzelii
AFVLAVKE

SEQ ID NO: 177594 - protein, 8 aa, Borrelia afzelii
FVLAVKEV

SEQ ID NO: 177595 - protein, 8 aa, Borrelia afzelii
VLAVKEVE

SEQ ID NO: 177596 - protein, 8 aa, Borrelia afzelii
LAVKEVET

SEQ ID NO: 177597 - protein, 8 aa, Borrelia afzelii
AVKEVETL

SEQ ID NO: 177598 - protein, 8 aa, Borrelia afzelii
VKEVETLV

SEQ ID NO: 177599 - protein, 8 aa, Borrelia afzelii
KEVETLVS

SEQ ID NO: 177600 - protein, 8 aa, Borrelia afzelii
EVETLVSS

SEQ ID NO: 177601 - protein, 8 aa, Borrelia afzelii
VETLVSSI

SEQ ID NO: 177602 - protein, 8 aa, Borrelia afzelii
ETLVSSID

SEQ ID NO: 177603 - protein, 8 aa, Borrelia afzelii
TLVSSIDE

SEQ ID NO: 177604 - protein, 8 aa, Borrelia afzelii
LVSSIDEL

SEQ ID NO: 177605 - protein, 8 aa, Borrelia afzelii
VSSIDELA

SEQ ID NO: 177606 - protein, 8 aa, Borrelia afzelii
SSIDELAN

SEQ ID NO: 177607 - protein, 8 aa, Borrelia afzelii
SIDELANK

SEQ ID NO: 177608 - protein, 8 aa, Borrelia afzelii
IDELANKA

SEQ ID NO: 177609 - protein, 8 aa, Borrelia afzelii
DELANKAI

SEQ ID NO: 177610 - protein, 8 aa, Borrelia afzelii
ELANKAIG

SEQ ID NO: 177611 - protein, 8 aa, Borrelia afzelii
LANKAIGK

SEQ ID NO: 177612 - protein, 8 aa, Borrelia afzelii
ANKAIGKK

SEQ ID NO: 177613 - protein, 8 aa, Borrelia afzelii
NKAIGKKI

SEQ ID NO: 177614 - protein, 8 aa, Borrelia afzelii
KAIGKKIQ

SEQ ID NO: 177615 - protein, 8 aa, Borrelia afzelii
AIGKKIQQ

SEQ ID NO: 177616 - protein, 8 aa, Borrelia afzelii
IGKKIQQN

SEQ ID NO: 177617 - protein, 8 aa, Borrelia afzelii
GKKIQQNG

SEQ ID NO: 177618 - protein, 8 aa, Borrelia afzelii
KKIQQNGL

SEQ ID NO: 177619 - protein, 8 aa, Borrelia afzelii
KIQQNGLG

SEQ ID NO: 177620 - protein, 8 aa, Borrelia afzelii
IQQNGLGA

SEQ ID NO: 177621 - protein, 8 aa, Borrelia afzelii
QQNGLGAE

SEQ ID NO: 177622 - protein, 8 aa, Borrelia afzelii
QNGLGAEA

SEQ ID NO: 177623 - protein, 8 aa, Borrelia afzelii
NGLGAEAN

SEQ ID NO: 177624 - protein, 8 aa, Borrelia afzelii
GLGAEANR

SEQ ID NO: 177625 - protein, 8 aa, Borrelia afzelii
LGAEANRN

SEQ ID NO: 177626 - protein, 8 aa, Borrelia afzelii
GAEANRNE

SEQ ID NO: 177627 - protein, 8 aa, Borrelia afzelii
AEANRNES

SEQ ID NO: 177628 - protein, 8 aa, Borrelia afzelii
EANRNESL

SEQ ID NO: 177629 - protein, 8 aa, Borrelia afzelii
ANRNESLL

SEQ ID NO: 177630 - protein, 8 aa, Borrelia afzelii
NRNESLLA

SEQ ID NO: 177631 - protein, 8 aa, Borrelia afzelii
RNESLLAG

SEQ ID NO: 177632 - protein, 8 aa, Borrelia afzelii
NESLLAGV

SEQ ID NO: 177633 - protein, 8 aa, Borrelia afzelii
ESLLAGVH

SEQ ID NO: 177634 - protein, 8 aa, Borrelia afzelii
SLLAGVHE

SEQ ID NO: 177635 - protein, 8 aa, Borrelia afzelii
LLAGVHEI

SEQ ID NO: 177636 - protein, 8 aa, Borrelia afzelii
LAGVHEIS

SEQ ID NO: 177637 - protein, 8 aa, Borrelia afzelii
AGVHEIST

SEQ ID NO: 177638 - protein, 8 aa, Borrelia afzelii
GVHEISTL

SEQ ID NO: 177639 - protein, 8 aa, Borrelia afzelii
VHEISTLI

SEQ ID NO: 177640 - protein, 8 aa, Borrelia afzelii
HEISTLIT

SEQ ID NO: 177641 - protein, 8 aa, Borrelia afzelii
EISTLITE

SEQ ID NO: 177642 - protein, 8 aa, Borrelia afzelii
ISTLITEK

SEQ ID NO: 177643 - protein, 8 aa, Borrelia afzelii
STLITEKL

SEQ ID NO: 177644 - protein, 8 aa, Borrelia afzelii
TLITEKLS

SEQ ID NO: 177645 - protein, 8 aa, Borrelia afzelii
LITEKLSK

SEQ ID NO: 177646 - protein, 8 aa, Borrelia afzelii
ITEKLSKL

SEQ ID NO: 177647 - protein, 8 aa, Borrelia afzelii
TEKLSKLK

SEQ ID NO: 177648 - protein, 8 aa, Borrelia afzelii
EKLSKLKN

SEQ ID NO: 177649 - protein, 8 aa, Borrelia afzelii
KLSKLKNS

SEQ ID NO: 177650 - protein, 8 aa, Borrelia afzelii
LSKLKNSG

SEQ ID NO: 177651 - protein, 8 aa, Borrelia afzelii
SKLKNSGE

SEQ ID NO: 177652 - protein, 8 aa, Borrelia afzelii
KLKNSGEL

SEQ ID NO: 177653 - protein, 8 aa, Borrelia afzelii
LKNSGELK

SEQ ID NO: 177654 - protein, 8 aa, Borrelia afzelii
KNSGELKA

SEQ ID NO: 177655 - protein, 8 aa, Borrelia afzelii
NSGELKAK

SEQ ID NO: 177656 - protein, 8 aa, Borrelia afzelii
SGELKAKI

SEQ ID NO: 177657 - protein, 8 aa, Borrelia afzelii
GELKAKIE

SEQ ID NO: 177658 - protein, 8 aa, Borrelia afzelii
ELKAKIED

SEQ ID NO: 177659 - protein, 8 aa, Borrelia afzelii
LKAKIEDA

SEQ ID NO: 177660 - protein, 8 aa, Borrelia afzelii
KAKIEDAK

SEQ ID NO: 177661 - protein, 8 aa, Borrelia afzelii
AKIEDAKK

SEQ ID NO: 177662 - protein, 8 aa, Borrelia afzelii
KIEDAKKC

SEQ ID NO: 177663 - protein, 8 aa, Borrelia afzelii
IEDAKKCS

SEQ ID NO: 177664 - protein, 8 aa, Borrelia afzelii
EDAKKCSE

SEQ ID NO: 177665 - protein, 8 aa, Borrelia afzelii
DAKKCSEE

SEQ ID NO: 177666 - protein, 8 aa, Borrelia afzelii
AKKCSEEF

SEQ ID NO: 177667 - protein, 8 aa, Borrelia afzelii
KKCSEEFT

SEQ ID NO: 177668 - protein, 8 aa, Borrelia afzelii
KCSEEFTN

SEQ ID NO: 177669 - protein, 8 aa, Borrelia afzelii
CSEEFTNK

SEQ ID NO: 177670 - protein, 8 aa, Borrelia afzelii
SEEFTNKL

SEQ ID NO: 177671 - protein, 8 aa, Borrelia afzelii
EEFTNKLR

SEQ ID NO: 177672 - protein, 8 aa, Borrelia afzelii
EFTNKLRV

SEQ ID NO: 177673 - protein, 8 aa, Borrelia afzelii
FTNKLRVS

SEQ ID NO: 177674 - protein, 8 aa, Borrelia afzelii
TNKLRVSH

SEQ ID NO: 177675 - protein, 8 aa, Borrelia afzelii
NKLRVSHA

SEQ ID NO: 177676 - protein, 8 aa, Borrelia afzelii
KLRVSHAD

SEQ ID NO: 177677 - protein, 8 aa, Borrelia afzelii
LRVSHADL

SEQ ID NO: 177678 - protein, 8 aa, Borrelia afzelii
RVSHADLG

SEQ ID NO: 177679 - protein, 8 aa, Borrelia afzelii
VSHADLGK

SEQ ID NO: 177680 - protein, 8 aa, Borrelia afzelii
SHADLGKQ

SEQ ID NO: 177681 - protein, 8 aa, Borrelia afzelii
HADLGKQG

SEQ ID NO: 177682 - protein, 8 aa, Borrelia afzelii
ADLGKQGV

SEQ ID NO: 177683 - protein, 8 aa, Borrelia afzelii
DLGKQGVN

SEQ ID NO: 177684 - protein, 8 aa, Borrelia afzelii
LGKQGVND

SEQ ID NO: 177685 - protein, 8 aa, Borrelia afzelii
GKQGVNDD

SEQ ID NO: 177686 - protein, 8 aa, Borrelia afzelii
KQGVNDDD

SEQ ID NO: 177687 - protein, 8 aa, Borrelia afzelii
QGVNDDDA

SEQ ID NO: 177688 - protein, 8 aa, Borrelia afzelii
GVNDDDAK

SEQ ID NO: 177689 - protein, 8 aa, Borrelia afzelii
VNDDDAKK

SEQ ID NO: 177690 - protein, 8 aa, Borrelia afzelii
NDDDAKKA

SEQ ID NO: 177691 - protein, 8 aa, Borrelia afzelii
DDDAKKAI

SEQ ID NO: 177692 - protein, 8 aa, Borrelia afzelii
DDAKKAIL

SEQ ID NO: 177693 - protein, 8 aa, Borrelia afzelii
DAKKAILK

SEQ ID NO: 177694 - protein, 8 aa, Borrelia afzelii
AKKAILKT

SEQ ID NO: 177695 - protein, 8 aa, Borrelia afzelii
KKAILKTN

SEQ ID NO: 177696 - protein, 8 aa, Borrelia afzelii
KAILKTNA

SEQ ID NO: 177697 - protein, 8 aa, Borrelia afzelii
AILKTNAD

SEQ ID NO: 177698 - protein, 8 aa, Borrelia afzelii
ILKTNADK

SEQ ID NO: 177699 - protein, 8 aa, Borrelia afzelii
LKTNADKT

SEQ ID NO: 177700 - protein, 8 aa, Borrelia afzelii
KTNADKTK

SEQ ID NO: 177701 - protein, 8 aa, Borrelia afzelii
TNADKTKG

SEQ ID NO: 177702 - protein, 8 aa, Borrelia afzelii
NADKTKGA

SEQ ID NO: 177703 - protein, 8 aa, Borrelia afzelii
ADKTKGAE

SEQ ID NO: 177704 - protein, 8 aa, Borrelia afzelii
DKTKGAEE

SEQ ID NO: 177705 - protein, 8 aa, Borrelia afzelii
KTKGAEEL

SEQ ID NO: 177706 - protein, 8 aa, Borrelia afzelii
TKGAEELG

SEQ ID NO: 177707 - protein, 8 aa, Borrelia afzelii
KGAEELGK

SEQ ID NO: 177708 - protein, 8 aa, Borrelia afzelii
GAEELGKL

SEQ ID NO: 177709 - protein, 8 aa, Borrelia afzelii
AEELGKLF

SEQ ID NO: 177710 - protein, 8 aa, Borrelia afzelii
EELGKLFK

SEQ ID NO: 177711 - protein, 8 aa, Borrelia afzelii
ELGKLFKS

SEQ ID NO: 177712 - protein, 8 aa, Borrelia afzelii
LGKLFKSV

SEQ ID NO: 177713 - protein, 8 aa, Borrelia afzelii
GKLFKSVE

SEQ ID NO: 177714 - protein, 8 aa, Borrelia afzelii
KLFKSVEG

SEQ ID NO: 177715 - protein, 8 aa, Borrelia afzelii
LFKSVEGL

SEQ ID NO: 177716 - protein, 8 aa, Borrelia afzelii
FKSVEGLV

SEQ ID NO: 177717 - protein, 8 aa, Borrelia afzelii
KSVEGLVK

SEQ ID NO: 177718 - protein, 8 aa, Borrelia afzelii
SVEGLVKA

SEQ ID NO: 177719 - protein, 8 aa, Borrelia afzelii
VEGLVKAA

SEQ ID NO: 177720 - protein, 8 aa, Borrelia afzelii
EGLVKAAQ

SEQ ID NO: 177721 - protein, 8 aa, Borrelia afzelii
GLVKAAQE

SEQ ID NO: 177722 - protein, 8 aa, Borrelia afzelii
LVKAAQEA

SEQ ID NO: 177723 - protein, 8 aa, Borrelia afzelii
VKAAQEAL

SEQ ID NO: 177724 - protein, 8 aa, Borrelia afzelii
KAAQEALT

SEQ ID NO: 177725 - protein, 8 aa, Borrelia afzelii
AAQEALTN

SEQ ID NO: 177726 - protein, 8 aa, Borrelia afzelii
AQEALTNS

SEQ ID NO: 177727 - protein, 8 aa, Borrelia afzelii
QEALTNSV

SEQ ID NO: 177728 - protein, 8 aa, Borrelia afzelii
EALTNSVK

SEQ ID NO: 177729 - protein, 8 aa, Borrelia afzelii
ALTNSVKE

SEQ ID NO: 177730 - protein, 8 aa, Borrelia afzelii
LTNSVKEL

SEQ ID NO: 177731 - protein, 8 aa, Borrelia afzelii
TNSVKELT

SEQ ID NO: 177732 - protein, 8 aa, Borrelia afzelii
NSVKELTS

SEQ ID NO: 177733 - protein, 8 aa, Borrelia afzelii
SVKELTSP

SEQ ID NO: 177734 - protein, 8 aa, Borrelia afzelii
VKELTSPV

SEQ ID NO: 177735 - protein, 8 aa, Borrelia afzelii
KELTSPVV

SEQ ID NO: 177736 - protein, 8 aa, Borrelia afzelii
ELTSPVVA

SEQ ID NO: 177737 - protein, 8 aa, Borrelia afzelii
LTSPVVAE

SEQ ID NO: 177738 - protein, 8 aa, Borrelia afzelii
TSPVVAES

SEQ ID NO: 177739 - protein, 8 aa, Borrelia afzelii
SPVVAESP

SEQ ID NO: 177740 - protein, 8 aa, Borrelia afzelii
PVVAESPK

SEQ ID NO: 177741 - protein, 8 aa, Borrelia afzelii
VVAESPKK

SEQ ID NO: 177742 - protein, 8 aa, Borrelia afzelii
VAESPKKP

SEQ ID NO: 177743 - protein, 9 aa, Borrelia afzelii
MKKNTLSAI

SEQ ID NO: 177744 - protein, 9 aa, Borrelia afzelii
KKNTLSAIL

SEQ ID NO: 177745 - protein, 9 aa, Borrelia afzelii
KNTLSAILM

SEQ ID NO: 177746 - protein, 9 aa, Borrelia afzelii
NTLSAILMT

SEQ ID NO: 177747 - protein, 9 aa, Borrelia afzelii
TLSAILMTL

SEQ ID NO: 177748 - protein, 9 aa, Borrelia afzelii
LSAILMTLF

SEQ ID NO: 177749 - protein, 9 aa, Borrelia afzelii
SAILMTLFL

SEQ ID NO: 177750 - protein, 9 aa, Borrelia afzelii
AILMTLFLF

SEQ ID NO: 177751 - protein, 9 aa, Borrelia afzelii
ILMTLFLFI

SEQ ID NO: 177752 - protein, 9 aa, Borrelia afzelii
LMTLFLFIS

SEQ ID NO: 177753 - protein, 9 aa, Borrelia afzelii
MTLFLFISC

SEQ ID NO: 177754 - protein, 9 aa, Borrelia afzelii
TLFLFISCN

SEQ ID NO: 177755 - protein, 9 aa, Borrelia afzelii
LFLFISCNN

SEQ ID NO: 177756 - protein, 9 aa, Borrelia afzelii
FLFISCNNS

SEQ ID NO: 177757 - protein, 9 aa, Borrelia afzelii
LFISCNNSG

SEQ ID NO: 177758 - protein, 9 aa, Borrelia afzelii
FISCNNSGK

SEQ ID NO: 177759 - protein, 9 aa, Borrelia afzelii
ISCNNSGKG

SEQ ID NO: 177760 - protein, 9 aa, Borrelia afzelii
SCNNSGKGG

SEQ ID NO: 177761 - protein, 9 aa, Borrelia afzelii
CNNSGKGGD

SEQ ID NO: 177762 - protein, 9 aa, Borrelia afzelii
NNSGKGGDS

SEQ ID NO: 177763 - protein, 9 aa, Borrelia afzelii
NSGKGGDSA

SEQ ID NO: 177764 - protein, 9 aa, Borrelia afzelii
SGKGGDSAS

SEQ ID NO: 177765 - protein, 9 aa, Borrelia afzelii
GKGGDSAST

SEQ ID NO: 177766 - protein, 9 aa, Borrelia afzelii
KGGDSASTN

SEQ ID NO: 177767 - protein, 9 aa, Borrelia afzelii
GGDSASTNP

SEQ ID NO: 177768 - protein, 9 aa, Borrelia afzelii
GDSASTNPA

SEQ ID NO: 177769 - protein, 9 aa, Borrelia afzelii
DSASTNPAD

SEQ ID NO: 177770 - protein, 9 aa, Borrelia afzelii
SASTNPADE

SEQ ID NO: 177771 - protein, 9 aa, Borrelia afzelii
ASTNPADES

SEQ ID NO: 177772 - protein, 9 aa, Borrelia afzelii
STNPADESA

SEQ ID NO: 177773 - protein, 9 aa, Borrelia afzelii
TNPADESAK

SEQ ID NO: 177774 - protein, 9 aa, Borrelia afzelii
NPADESAKG

SEQ ID NO: 177775 - protein, 9 aa, Borrelia afzelii
PADESAKGP

SEQ ID NO: 177776 - protein, 9 aa, Borrelia afzelii
ADESAKGPN

SEQ ID NO: 177777 - protein, 9 aa, Borrelia afzelii
DESAKGPNL

SEQ ID NO: 177778 - protein, 9 aa, Borrelia afzelii
ESAKGPNLT

SEQ ID NO: 177779 - protein, 9 aa, Borrelia afzelii
SAKGPNLTE

SEQ ID NO: 177780 - protein, 9 aa, Borrelia afzelii
AKGPNLTEI

SEQ ID NO: 177781 - protein, 9 aa, Borrelia afzelii
KGPNLTEIS

SEQ ID NO: 177782 - protein, 9 aa, Borrelia afzelii
GPNLTEISK

SEQ ID NO: 177783 - protein, 9 aa, Borrelia afzelii
PNLTEISKK

SEQ ID NO: 177784 - protein, 9 aa, Borrelia afzelii
NLTEISKKI

SEQ ID NO: 177785 - protein, 9 aa, Borrelia afzelii
LTEISKKIT

SEQ ID NO: 177786 - protein, 9 aa, Borrelia afzelii
TEISKKITD

SEQ ID NO: 177787 - protein, 9 aa, Borrelia afzelii
EISKKITDS

SEQ ID NO: 177788 - protein, 9 aa, Borrelia afzelii
ISKKITDSN

SEQ ID NO: 177789 - protein, 9 aa, Borrelia afzelii
SKKITDSNA

SEQ ID NO: 177790 - protein, 9 aa, Borrelia afzelii
KKITDSNAF

SEQ ID NO: 177791 - protein, 9 aa, Borrelia afzelii
KITDSNAFV

SEQ ID NO: 177792 - protein, 9 aa, Borrelia afzelii
ITDSNAFVL

SEQ ID NO: 177793 - protein, 9 aa, Borrelia afzelii
TDSNAFVLA

SEQ ID NO: 177794 - protein, 9 aa, Borrelia afzelii
DSNAFVLAV

SEQ ID NO: 177795 - protein, 9 aa, Borrelia afzelii
SNAFVLAVK

SEQ ID NO: 177796 - protein, 9 aa, Borrelia afzelii
NAFVLAVKE

SEQ ID NO: 177797 - protein, 9 aa, Borrelia afzelii
AFVLAVKEV

SEQ ID NO: 177798 - protein, 9 aa, Borrelia afzelii
FVLAVKEVE

SEQ ID NO: 177799 - protein, 9 aa, Borrelia afzelii
VLAVKEVET

SEQ ID NO: 177800 - protein, 9 aa, Borrelia afzelii
LAVKEVETL

SEQ ID NO: 177801 - protein, 9 aa, Borrelia afzelii
AVKEVETLV

SEQ ID NO: 177802 - protein, 9 aa, Borrelia afzelii
VKEVETLVS

SEQ ID NO: 177803 - protein, 9 aa, Borrelia afzelii
KEVETLVSS

SEQ ID NO: 177804 - protein, 9 aa, Borrelia afzelii
EVETLVSSI

SEQ ID NO: 177805 - protein, 9 aa, Borrelia afzelii
VETLVSSID

SEQ ID NO: 177806 - protein, 9 aa, Borrelia afzelii
ETLVSSIDE

SEQ ID NO: 177807 - protein, 9 aa, Borrelia afzelii
TLVSSIDEL

SEQ ID NO: 177808 - protein, 9 aa, Borrelia afzelii
LVSSIDELA

SEQ ID NO: 177809 - protein, 9 aa, Borrelia afzelii
VSSIDELAN

SEQ ID NO: 177810 - protein, 9 aa, Borrelia afzelii
SSIDELANK

SEQ ID NO: 177811 - protein, 9 aa, Borrelia afzelii
SIDELANKA

SEQ ID NO: 177812 - protein, 9 aa, Borrelia afzelii
IDELANKAI

SEQ ID NO: 177813 - protein, 9 aa, Borrelia afzelii
DELANKAIG

SEQ ID NO: 177814 - protein, 9 aa, Borrelia afzelii
ELANKAIGK

SEQ ID NO: 177815 - protein, 9 aa, Borrelia afzelii
LANKAIGKK

SEQ ID NO: 177816 - protein, 9 aa, Borrelia afzelii
ANKAIGKKI

SEQ ID NO: 177817 - protein, 9 aa, Borrelia afzelii
NKAIGKKIQ

SEQ ID NO: 177818 - protein, 9 aa, Borrelia afzelii
KAIGKKIQQ

SEQ ID NO: 177819 - protein, 9 aa, Borrelia afzelii
AIGKKIQQN

SEQ ID NO: 177820 - protein, 9 aa, Borrelia afzelii
IGKKIQQNG

SEQ ID NO: 177821 - protein, 9 aa, Borrelia afzelii
GKKIQQNGL

SEQ ID NO: 177822 - protein, 9 aa, Borrelia afzelii
KKIQQNGLG

SEQ ID NO: 177823 - protein, 9 aa, Borrelia afzelii
KIQQNGLGA

SEQ ID NO: 177824 - protein, 9 aa, Borrelia afzelii
IQQNGLGAE

SEQ ID NO: 177825 - protein, 9 aa, Borrelia afzelii
QQNGLGAEA

SEQ ID NO: 177826 - protein, 9 aa, Borrelia afzelii
QNGLGAEAN

SEQ ID NO: 177827 - protein, 9 aa, Borrelia afzelii
NGLGAEANR

SEQ ID NO: 177828 - protein, 9 aa, Borrelia afzelii
GLGAEANRN

SEQ ID NO: 177829 - protein, 9 aa, Borrelia afzelii
LGAEANRNE

SEQ ID NO: 177830 - protein, 9 aa, Borrelia afzelii
GAEANRNES

SEQ ID NO: 177831 - protein, 9 aa, Borrelia afzelii
AEANRNESL

SEQ ID NO: 177832 - protein, 9 aa, Borrelia afzelii
EANRNESLL

SEQ ID NO: 177833 - protein, 9 aa, Borrelia afzelii
ANRNESLLA

SEQ ID NO: 177834 - protein, 9 aa, Borrelia afzelii
NRNESLLAG

SEQ ID NO: 177835 - protein, 9 aa, Borrelia afzelii
RNESLLAGV

SEQ ID NO: 177836 - protein, 9 aa, Borrelia afzelii
NESLLAGVH

SEQ ID NO: 177837 - protein, 9 aa, Borrelia afzelii
ESLLAGVHE

SEQ ID NO: 177838 - protein, 9 aa, Borrelia afzelii
SLLAGVHEI

SEQ ID NO: 177839 - protein, 9 aa, Borrelia afzelii
LLAGVHEIS

SEQ ID NO: 177840 - protein, 9 aa, Borrelia afzelii
LAGVHEIST

SEQ ID NO: 177841 - protein, 9 aa, Borrelia afzelii
AGVHEISTL

SEQ ID NO: 177842 - protein, 9 aa, Borrelia afzelii
GVHEISTLI

SEQ ID NO: 177843 - protein, 9 aa, Borrelia afzelii
VHEISTLIT

SEQ ID NO: 177844 - protein, 9 aa, Borrelia afzelii
HEISTLITE

SEQ ID NO: 177845 - protein, 9 aa, Borrelia afzelii
EISTLITEK

SEQ ID NO: 177846 - protein, 9 aa, Borrelia afzelii
ISTLITEKL

SEQ ID NO: 177847 - protein, 9 aa, Borrelia afzelii
STLITEKLS

SEQ ID NO: 177848 - protein, 9 aa, Borrelia afzelii
TLITEKLSK

SEQ ID NO: 177849 - protein, 9 aa, Borrelia afzelii
LITEKLSKL

SEQ ID NO: 177850 - protein, 9 aa, Borrelia afzelii
ITEKLSKLK

SEQ ID NO: 177851 - protein, 9 aa, Borrelia afzelii
TEKLSKLKN

SEQ ID NO: 177852 - protein, 9 aa, Borrelia afzelii
EKLSKLKNS

SEQ ID NO: 177853 - protein, 9 aa, Borrelia afzelii
KLSKLKNSG

SEQ ID NO: 177854 - protein, 9 aa, Borrelia afzelii
LSKLKNSGE

SEQ ID NO: 177855 - protein, 9 aa, Borrelia afzelii
SKLKNSGEL

SEQ ID NO: 177856 - protein, 9 aa, Borrelia afzelii
KLKNSGELK

SEQ ID NO: 177857 - protein, 9 aa, Borrelia afzelii
LKNSGELKA

SEQ ID NO: 177858 - protein, 9 aa, Borrelia afzelii
KNSGELKAK

SEQ ID NO: 177859 - protein, 9 aa, Borrelia afzelii
NSGELKAKI

SEQ ID NO: 177860 - protein, 9 aa, Borrelia afzelii
SGELKAKIE

SEQ ID NO: 177861 - protein, 9 aa, Borrelia afzelii
GELKAKIED

SEQ ID NO: 177862 - protein, 9 aa, Borrelia afzelii
ELKAKIEDA

SEQ ID NO: 177863 - protein, 9 aa, Borrelia afzelii
LKAKIEDAK

SEQ ID NO: 177864 - protein, 9 aa, Borrelia afzelii
KAKIEDAKK

SEQ ID NO: 177865 - protein, 9 aa, Borrelia afzelii
AKIEDAKKC

SEQ ID NO: 177866 - protein, 9 aa, Borrelia afzelii
KIEDAKKCS

SEQ ID NO: 177867 - protein, 9 aa, Borrelia afzelii
IEDAKKCSE

SEQ ID NO: 177868 - protein, 9 aa, Borrelia afzelii
EDAKKCSEE

SEQ ID NO: 177869 - protein, 9 aa, Borrelia afzelii
DAKKCSEEF

SEQ ID NO: 177870 - protein, 9 aa, Borrelia afzelii
AKKCSEEFT

SEQ ID NO: 177871 - protein, 9 aa, Borrelia afzelii
KKCSEEFTN

SEQ ID NO: 177872 - protein, 9 aa, Borrelia afzelii
KCSEEFTNK

SEQ ID NO: 177873 - protein, 9 aa, Borrelia afzelii
CSEEFTNKL

SEQ ID NO: 177874 - protein, 9 aa, Borrelia afzelii
SEEFTNKLR

SEQ ID NO: 177875 - protein, 9 aa, Borrelia afzelii
EEFTNKLRV

SEQ ID NO: 177876 - protein, 9 aa, Borrelia afzelii
EFTNKLRVS

SEQ ID NO: 177877 - protein, 9 aa, Borrelia afzelii
FTNKLRVSH

SEQ ID NO: 177878 - protein, 9 aa, Borrelia afzelii
TNKLRVSHA

SEQ ID NO: 177879 - protein, 9 aa, Borrelia afzelii
NKLRVSHAD

SEQ ID NO: 177880 - protein, 9 aa, Borrelia afzelii
KLRVSHADL

SEQ ID NO: 177881 - protein, 9 aa, Borrelia afzelii
LRVSHADLG

SEQ ID NO: 177882 - protein, 9 aa, Borrelia afzelii
RVSHADLGK

SEQ ID NO: 177883 - protein, 9 aa, Borrelia afzelii
VSHADLGKQ

SEQ ID NO: 177884 - protein, 9 aa, Borrelia afzelii
SHADLGKQG

SEQ ID NO: 177885 - protein, 9 aa, Borrelia afzelii
HADLGKQGV

SEQ ID NO: 177886 - protein, 9 aa, Borrelia afzelii
ADLGKQGVN

SEQ ID NO: 177887 - protein, 9 aa, Borrelia afzelii
DLGKQGVND

SEQ ID NO: 177888 - protein, 9 aa, Borrelia afzelii
LGKQGVNDD

SEQ ID NO: 177889 - protein, 9 aa, Borrelia afzelii
GKQGVNDDD

SEQ ID NO: 177890 - protein, 9 aa, Borrelia afzelii
KQGVNDDDA

SEQ ID NO: 177891 - protein, 9 aa, Borrelia afzelii
QGVNDDDAK

SEQ ID NO: 177892 - protein, 9 aa, Borrelia afzelii
GVNDDDAKK

SEQ ID NO: 177893 - protein, 9 aa, Borrelia afzelii
VNDDDAKKA

SEQ ID NO: 177894 - protein, 9 aa, Borrelia afzelii
NDDDAKKAI

SEQ ID NO: 177895 - protein, 9 aa, Borrelia afzelii
DDDAKKAIL

SEQ ID NO: 177896 - protein, 9 aa, Borrelia afzelii
DDAKKAILK

SEQ ID NO: 177897 - protein, 9 aa, Borrelia afzelii
DAKKAILKT

SEQ ID NO: 177898 - protein, 9 aa, Borrelia afzelii
AKKAILKTN

SEQ ID NO: 177899 - protein, 9 aa, Borrelia afzelii
KKAILKTNA

SEQ ID NO: 177900 - protein, 9 aa, Borrelia afzelii
KAILKTNAD

SEQ ID NO: 177901 - protein, 9 aa, Borrelia afzelii
AILKTNADK

SEQ ID NO: 177902 - protein, 9 aa, Borrelia afzelii
ILKTNADKT

SEQ ID NO: 177903 - protein, 9 aa, Borrelia afzelii
LKTNADKTK

SEQ ID NO: 177904 - protein, 9 aa, Borrelia afzelii
KTNADKTKG

SEQ ID NO: 177905 - protein, 9 aa, Borrelia afzelii
TNADKTKGA

SEQ ID NO: 177906 - protein, 9 aa, Borrelia afzelii
NADKTKGAE

SEQ ID NO: 177907 - protein, 9 aa, Borrelia afzelii
ADKTKGAEE

SEQ ID NO: 177908 - protein, 9 aa, Borrelia afzelii
DKTKGAEEL

SEQ ID NO: 177909 - protein, 9 aa, Borrelia afzelii
KTKGAEELG

SEQ ID NO: 177910 - protein, 9 aa, Borrelia afzelii
TKGAEELGK

SEQ ID NO: 177911 - protein, 9 aa, Borrelia afzelii
KGAEELGKL

SEQ ID NO: 177912 - protein, 9 aa, Borrelia afzelii
GAEELGKLF

SEQ ID NO: 177913 - protein, 9 aa, Borrelia afzelii
AEELGKLFK

SEQ ID NO: 177914 - protein, 9 aa, Borrelia afzelii
EELGKLFKS

SEQ ID NO: 177915 - protein, 9 aa, Borrelia afzelii
ELGKLFKSV

SEQ ID NO: 177916 - protein, 9 aa, Borrelia afzelii
LGKLFKSVE

SEQ ID NO: 177917 - protein, 9 aa, Borrelia afzelii
GKLFKSVEG

SEQ ID NO: 177918 - protein, 9 aa, Borrelia afzelii
KLFKSVEGL

SEQ ID NO: 177919 - protein, 9 aa, Borrelia afzelii
LFKSVEGLV

SEQ ID NO: 177920 - protein, 9 aa, Borrelia afzelii
FKSVEGLVK

SEQ ID NO: 177921 - protein, 9 aa, Borrelia afzelii
KSVEGLVKA

SEQ ID NO: 177922 - protein, 9 aa, Borrelia afzelii
SVEGLVKAA

SEQ ID NO: 177923 - protein, 9 aa, Borrelia afzelii
VEGLVKAAQ

SEQ ID NO: 177924 - protein, 9 aa, Borrelia afzelii
EGLVKAAQE

SEQ ID NO: 177925 - protein, 9 aa, Borrelia afzelii
GLVKAAQEA

SEQ ID NO: 177926 - protein, 9 aa, Borrelia afzelii
LVKAAQEAL

SEQ ID NO: 177927 - protein, 9 aa, Borrelia afzelii
VKAAQEALT

SEQ ID NO: 177928 - protein, 9 aa, Borrelia afzelii
KAAQEALTN

SEQ ID NO: 177929 - protein, 9 aa, Borrelia afzelii
AAQEALTNS

SEQ ID NO: 177930 - protein, 9 aa, Borrelia afzelii
AQEALTNSV

SEQ ID NO: 177931 - protein, 9 aa, Borrelia afzelii
QEALTNSVK

SEQ ID NO: 177932 - protein, 9 aa, Borrelia afzelii
EALTNSVKE

SEQ ID NO: 177933 - protein, 9 aa, Borrelia afzelii
ALTNSVKEL

SEQ ID NO: 177934 - protein, 9 aa, Borrelia afzelii
LTNSVKELT

SEQ ID NO: 177935 - protein, 9 aa, Borrelia afzelii
TNSVKELTS

SEQ ID NO: 177936 - protein, 9 aa, Borrelia afzelii
NSVKELTSP

SEQ ID NO: 177937 - protein, 9 aa, Borrelia afzelii
SVKELTSPV

SEQ ID NO: 177938 - protein, 9 aa, Borrelia afzelii
VKELTSPVV

SEQ ID NO: 177939 - protein, 9 aa, Borrelia afzelii
KELTSPVVA

SEQ ID NO: 177940 - protein, 9 aa, Borrelia afzelii
ELTSPVVAE

SEQ ID NO: 177941 - protein, 9 aa, Borrelia afzelii
LTSPVVAES

SEQ ID NO: 177942 - protein, 9 aa, Borrelia afzelii
TSPVVAESP

SEQ ID NO: 177943 - protein, 9 aa, Borrelia afzelii
SPVVAESPK

SEQ ID NO: 177944 - protein, 9 aa, Borrelia afzelii
PVVAESPKK

SEQ ID NO: 177945 - protein, 9 aa, Borrelia afzelii
VVAESPKKP

SEQ ID NO: 177946 - protein, 10 aa, Borrelia afzelii
MKKNTLSAIL

SEQ ID NO: 177947 - protein, 10 aa, Borrelia afzelii
KKNTLSAILM

SEQ ID NO: 177948 - protein, 10 aa, Borrelia afzelii
KNTLSAILMT

SEQ ID NO: 177949 - protein, 10 aa, Borrelia afzelii
NTLSAILMTL

SEQ ID NO: 177950 - protein, 10 aa, Borrelia afzelii
TLSAILMTLF

SEQ ID NO: 177951 - protein, 10 aa, Borrelia afzelii
LSAILMTLFL

SEQ ID NO: 177952 - protein, 10 aa, Borrelia afzelii
SAILMTLFLF

SEQ ID NO: 177953 - protein, 10 aa, Borrelia afzelii
AILMTLFLFI

SEQ ID NO: 177954 - protein, 10 aa, Borrelia afzelii
ILMTLFLFIS

SEQ ID NO: 177955 - protein, 10 aa, Borrelia afzelii
LMTLFLFISC

SEQ ID NO: 177956 - protein, 10 aa, Borrelia afzelii
MTLFLFISCN

SEQ ID NO: 177957 - protein, 10 aa, Borrelia afzelii
TLFLFISCNN

SEQ ID NO: 177958 - protein, 10 aa, Borrelia afzelii
LFLFISCNNS

SEQ ID NO: 177959 - protein, 10 aa, Borrelia afzelii
FLFISCNNSG

SEQ ID NO: 177960 - protein, 10 aa, Borrelia afzelii
LFISCNNSGK

SEQ ID NO: 177961 - protein, 10 aa, Borrelia afzelii
FISCNNSGKG

SEQ ID NO: 177962 - protein, 10 aa, Borrelia afzelii
ISCNNSGKGG

SEQ ID NO: 177963 - protein, 10 aa, Borrelia afzelii
SCNNSGKGGD

SEQ ID NO: 177964 - protein, 10 aa, Borrelia afzelii
CNNSGKGGDS

SEQ ID NO: 177965 - protein, 10 aa, Borrelia afzelii
NNSGKGGDSA

SEQ ID NO: 177966 - protein, 10 aa, Borrelia afzelii
NSGKGGDSAS

SEQ ID NO: 177967 - protein, 10 aa, Borrelia afzelii
SGKGGDSAST

SEQ ID NO: 177968 - protein, 10 aa, Borrelia afzelii
GKGGDSASTN

SEQ ID NO: 177969 - protein, 10 aa, Borrelia afzelii
KGGDSASTNP

SEQ ID NO: 177970 - protein, 10 aa, Borrelia afzelii
GGDSASTNPA

SEQ ID NO: 177971 - protein, 10 aa, Borrelia afzelii
GDSASTNPAD

SEQ ID NO: 177972 - protein, 10 aa, Borrelia afzelii
DSASTNPADE

SEQ ID NO: 177973 - protein, 10 aa, Borrelia afzelii
SASTNPADES

SEQ ID NO: 177974 - protein, 10 aa, Borrelia afzelii
ASTNPADESA

SEQ ID NO: 177975 - protein, 10 aa, Borrelia afzelii
STNPADESAK

SEQ ID NO: 177976 - protein, 10 aa, Borrelia afzelii
TNPADESAKG

SEQ ID NO: 177977 - protein, 10 aa, Borrelia afzelii
NPADESAKGP

SEQ ID NO: 177978 - protein, 10 aa, Borrelia afzelii
PADESAKGPN

SEQ ID NO: 177979 - protein, 10 aa, Borrelia afzelii
ADESAKGPNL

SEQ ID NO: 177980 - protein, 10 aa, Borrelia afzelii
DESAKGPNLT

SEQ ID NO: 177981 - protein, 10 aa, Borrelia afzelii
ESAKGPNLTE

SEQ ID NO: 177982 - protein, 10 aa, Borrelia afzelii
SAKGPNLTEI

SEQ ID NO: 177983 - protein, 10 aa, Borrelia afzelii
AKGPNLTEIS

SEQ ID NO: 177984 - protein, 10 aa, Borrelia afzelii
KGPNLTEISK

SEQ ID NO: 177985 - protein, 10 aa, Borrelia afzelii
GPNLTEISKK

SEQ ID NO: 177986 - protein, 10 aa, Borrelia afzelii
PNLTEISKKI

SEQ ID NO: 177987 - protein, 10 aa, Borrelia afzelii
NLTEISKKIT

SEQ ID NO: 177988 - protein, 10 aa, Borrelia afzelii
LTEISKKITD

SEQ ID NO: 177989 - protein, 10 aa, Borrelia afzelii
TEISKKITDS

SEQ ID NO: 177990 - protein, 10 aa, Borrelia afzelii
EISKKITDSN

SEQ ID NO: 177991 - protein, 10 aa, Borrelia afzelii
ISKKITDSNA

SEQ ID NO: 177992 - protein, 10 aa, Borrelia afzelii
SKKITDSNAF

SEQ ID NO: 177993 - protein, 10 aa, Borrelia afzelii
KKITDSNAFV

SEQ ID NO: 177994 - protein, 10 aa, Borrelia afzelii
KITDSNAFVL

SEQ ID NO: 177995 - protein, 10 aa, Borrelia afzelii
ITDSNAFVLA

SEQ ID NO: 177996 - protein, 10 aa, Borrelia afzelii
TDSNAFVLAV

SEQ ID NO: 177997 - protein, 10 aa, Borrelia afzelii
DSNAFVLAVK

SEQ ID NO: 177998 - protein, 10 aa, Borrelia afzelii
SNAFVLAVKE

SEQ ID NO: 177999 - protein, 10 aa, Borrelia afzelii
NAFVLAVKEV

SEQ ID NO: 178000 - protein, 10 aa, Borrelia afzelii
AFVLAVKEVE

SEQ ID NO: 178001 - protein, 10 aa, Borrelia afzelii
FVLAVKEVET

SEQ ID NO: 178002 - protein, 10 aa, Borrelia afzelii
VLAVKEVETL

SEQ ID NO: 178003 - protein, 10 aa, Borrelia afzelii
LAVKEVETLV

SEQ ID NO: 178004 - protein, 10 aa, Borrelia afzelii
AVKEVETLVS

SEQ ID NO: 178005 - protein, 10 aa, Borrelia afzelii
VKEVETLVSS

SEQ ID NO: 178006 - protein, 10 aa, Borrelia afzelii
KEVETLVSSI

SEQ ID NO: 178007 - protein, 10 aa, Borrelia afzelii
EVETLVSSID

SEQ ID NO: 178008 - protein, 10 aa, Borrelia afzelii
VETLVSSIDE

SEQ ID NO: 178009 - protein, 10 aa, Borrelia afzelii
ETLVSSIDEL

SEQ ID NO: 178010 - protein, 10 aa, Borrelia afzelii
TLVSSIDELA

SEQ ID NO: 178011 - protein, 10 aa, Borrelia afzelii
LVSSIDELAN

SEQ ID NO: 178012 - protein, 10 aa, Borrelia afzelii
VSSIDELANK

SEQ ID NO: 178013 - protein, 10 aa, Borrelia afzelii
SSIDELANKA

SEQ ID NO: 178014 - protein, 10 aa, Borrelia afzelii
SIDELANKAI

SEQ ID NO: 178015 - protein, 10 aa, Borrelia afzelii
IDELANKAIG

SEQ ID NO: 178016 - protein, 10 aa, Borrelia afzelii
DELANKAIGK

SEQ ID NO: 178017 - protein, 10 aa, Borrelia afzelii
ELANKAIGKK

SEQ ID NO: 178018 - protein, 10 aa, Borrelia afzelii
LANKAIGKKI

SEQ ID NO: 178019 - protein, 10 aa, Borrelia afzelii
ANKAIGKKIQ

SEQ ID NO: 178020 - protein, 10 aa, Borrelia afzelii
NKAIGKKIQQ

SEQ ID NO: 178021 - protein, 10 aa, Borrelia afzelii
KAIGKKIQQN

SEQ ID NO: 178022 - protein, 10 aa, Borrelia afzelii
AIGKKIQQNG

SEQ ID NO: 178023 - protein, 10 aa, Borrelia afzelii
IGKKIQQNGL

SEQ ID NO: 178024 - protein, 10 aa, Borrelia afzelii
GKKIQQNGLG

SEQ ID NO: 178025 - protein, 10 aa, Borrelia afzelii
KKIQQNGLGA

SEQ ID NO: 178026 - protein, 10 aa, Borrelia afzelii
KIQQNGLGAE

SEQ ID NO: 178027 - protein, 10 aa, Borrelia afzelii
IQQNGLGAEA

SEQ ID NO: 178028 - protein, 10 aa, Borrelia afzelii
QQNGLGAEAN

SEQ ID NO: 178029 - protein, 10 aa, Borrelia afzelii
QNGLGAEANR

SEQ ID NO: 178030 - protein, 10 aa, Borrelia afzelii
NGLGAEANRN

SEQ ID NO: 178031 - protein, 10 aa, Borrelia afzelii
GLGAEANRNE

SEQ ID NO: 178032 - protein, 10 aa, Borrelia afzelii
LGAEANRNES

SEQ ID NO: 178033 - protein, 10 aa, Borrelia afzelii
GAEANRNESL

SEQ ID NO: 178034 - protein, 10 aa, Borrelia afzelii
AEANRNESLL

SEQ ID NO: 178035 - protein, 10 aa, Borrelia afzelii
EANRNESLLA

SEQ ID NO: 178036 - protein, 10 aa, Borrelia afzelii
ANRNESLLAG

SEQ ID NO: 178037 - protein, 10 aa, Borrelia afzelii
NRNESLLAGV

SEQ ID NO: 178038 - protein, 10 aa, Borrelia afzelii
RNESLLAGVH

SEQ ID NO: 178039 - protein, 10 aa, Borrelia afzelii
NESLLAGVHE

SEQ ID NO: 178040 - protein, 10 aa, Borrelia afzelii
ESLLAGVHEI

SEQ ID NO: 178041 - protein, 10 aa, Borrelia afzelii
SLLAGVHEIS

SEQ ID NO: 178042 - protein, 10 aa, Borrelia afzelii
LLAGVHEIST

SEQ ID NO: 178043 - protein, 10 aa, Borrelia afzelii
LAGVHEISTL

SEQ ID NO: 178044 - protein, 10 aa, Borrelia afzelii
AGVHEISTLI

SEQ ID NO: 178045 - protein, 10 aa, Borrelia afzelii
GVHEISTLIT

SEQ ID NO: 178046 - protein, 10 aa, Borrelia afzelii
VHEISTLITE

SEQ ID NO: 178047 - protein, 10 aa, Borrelia afzelii
HEISTLITEK

SEQ ID NO: 178048 - protein, 10 aa, Borrelia afzelii
EISTLITEKL

SEQ ID NO: 178049 - protein, 10 aa, Borrelia afzelii
ISTLITEKLS

SEQ ID NO: 178050 - protein, 10 aa, Borrelia afzelii
STLITEKLSK

SEQ ID NO: 178051 - protein, 10 aa, Borrelia afzelii
TLITEKLSKL

SEQ ID NO: 178052 - protein, 10 aa, Borrelia afzelii
LITEKLSKLK

SEQ ID NO: 178053 - protein, 10 aa, Borrelia afzelii
ITEKLSKLKN

SEQ ID NO: 178054 - protein, 10 aa, Borrelia afzelii
TEKLSKLKNS

SEQ ID NO: 178055 - protein, 10 aa, Borrelia afzelii
EKLSKLKNSG

SEQ ID NO: 178056 - protein, 10 aa, Borrelia afzelii
KLSKLKNSGE

SEQ ID NO: 178057 - protein, 10 aa, Borrelia afzelii
LSKLKNSGEL

SEQ ID NO: 178058 - protein, 10 aa, Borrelia afzelii
SKLKNSGELK

SEQ ID NO: 178059 - protein, 10 aa, Borrelia afzelii
KLKNSGELKA

SEQ ID NO: 178060 - protein, 10 aa, Borrelia afzelii
LKNSGELKAK

SEQ ID NO: 178061 - protein, 10 aa, Borrelia afzelii
KNSGELKAKI

SEQ ID NO: 178062 - protein, 10 aa, Borrelia afzelii
NSGELKAKIE

SEQ ID NO: 178063 - protein, 10 aa, Borrelia afzelii
SGELKAKIED

SEQ ID NO: 178064 - protein, 10 aa, Borrelia afzelii
GELKAKIEDA

SEQ ID NO: 178065 - protein, 10 aa, Borrelia afzelii
ELKAKIEDAK

SEQ ID NO: 178066 - protein, 10 aa, Borrelia afzelii
LKAKIEDAKK

SEQ ID NO: 178067 - protein, 10 aa, Borrelia afzelii
KAKIEDAKKC

SEQ ID NO: 178068 - protein, 10 aa, Borrelia afzelii
AKIEDAKKCS

SEQ ID NO: 178069 - protein, 10 aa, Borrelia afzelii
KIEDAKKCSE

SEQ ID NO: 178070 - protein, 10 aa, Borrelia afzelii
IEDAKKCSEE

SEQ ID NO: 178071 - protein, 10 aa, Borrelia afzelii
EDAKKCSEEF

SEQ ID NO: 178072 - protein, 10 aa, Borrelia afzelii
DAKKCSEEFT

SEQ ID NO: 178073 - protein, 10 aa, Borrelia afzelii
AKKCSEEFTN

SEQ ID NO: 178074 - protein, 10 aa, Borrelia afzelii
KKCSEEFTNK

SEQ ID NO: 178075 - protein, 10 aa, Borrelia afzelii
KCSEEFTNKL

SEQ ID NO: 178076 - protein, 10 aa, Borrelia afzelii
CSEEFTNKLR

SEQ ID NO: 178077 - protein, 10 aa, Borrelia afzelii
SEEFTNKLRV

SEQ ID NO: 178078 - protein, 10 aa, Borrelia afzelii
EEFTNKLRVS

SEQ ID NO: 178079 - protein, 10 aa, Borrelia afzelii
EFTNKLRVSH

SEQ ID NO: 178080 - protein, 10 aa, Borrelia afzelii
FTNKLRVSHA

SEQ ID NO: 178081 - protein, 10 aa, Borrelia afzelii
TNKLRVSHAD

SEQ ID NO: 178082 - protein, 10 aa, Borrelia afzelii
NKLRVSHADL

SEQ ID NO: 178083 - protein, 10 aa, Borrelia afzelii
KLRVSHADLG

SEQ ID NO: 178084 - protein, 10 aa, Borrelia afzelii
LRVSHADLGK

SEQ ID NO: 178085 - protein, 10 aa, Borrelia afzelii
RVSHADLGKQ

SEQ ID NO: 178086 - protein, 10 aa, Borrelia afzelii
VSHADLGKQG

SEQ ID NO: 178087 - protein, 10 aa, Borrelia afzelii
SHADLGKQGV

SEQ ID NO: 178088 - protein, 10 aa, Borrelia afzelii
HADLGKQGVN

SEQ ID NO: 178089 - protein, 10 aa, Borrelia afzelii
ADLGKQGVND

SEQ ID NO: 178090 - protein, 10 aa, Borrelia afzelii
DLGKQGVNDD

SEQ ID NO: 178091 - protein, 10 aa, Borrelia afzelii
LGKQGVNDDD

SEQ ID NO: 178092 - protein, 10 aa, Borrelia afzelii
GKQGVNDDDA

SEQ ID NO: 178093 - protein, 10 aa, Borrelia afzelii
KQGVNDDDAK

SEQ ID NO: 178094 - protein, 10 aa, Borrelia afzelii
QGVNDDDAKK

SEQ ID NO: 178095 - protein, 10 aa, Borrelia afzelii
GVNDDDAKKA

SEQ ID NO: 178096 - protein, 10 aa, Borrelia afzelii
VNDDDAKKAI

SEQ ID NO: 178097 - protein, 10 aa, Borrelia afzelii
NDDDAKKAIL

SEQ ID NO: 178098 - protein, 10 aa, Borrelia afzelii
DDDAKKAILK

SEQ ID NO: 178099 - protein, 10 aa, Borrelia afzelii
DDAKKAILKT

SEQ ID NO: 178100 - protein, 10 aa, Borrelia afzelii
DAKKAILKTN

SEQ ID NO: 178101 - protein, 10 aa, Borrelia afzelii
AKKAILKTNA

SEQ ID NO: 178102 - protein, 10 aa, Borrelia afzelii
KKAILKTNAD

SEQ ID NO: 178103 - protein, 10 aa, Borrelia afzelii
KAILKTNADK

SEQ ID NO: 178104 - protein, 10 aa, Borrelia afzelii
AILKTNADKT

SEQ ID NO: 178105 - protein, 10 aa, Borrelia afzelii
ILKTNADKTK

SEQ ID NO: 178106 - protein, 10 aa, Borrelia afzelii
LKTNADKTKG

SEQ ID NO: 178107 - protein, 10 aa, Borrelia afzelii
KTNADKTKGA

SEQ ID NO: 178108 - protein, 10 aa, Borrelia afzelii
TNADKTKGAE

SEQ ID NO: 178109 - protein, 10 aa, Borrelia afzelii
NADKTKGAEE

SEQ ID NO: 178110 - protein, 10 aa, Borrelia afzelii
ADKTKGAEEL

SEQ ID NO: 178111 - protein, 10 aa, Borrelia afzelii
DKTKGAEELG

SEQ ID NO: 178112 - protein, 10 aa, Borrelia afzelii
KTKGAEELGK

SEQ ID NO: 178113 - protein, 10 aa, Borrelia afzelii
TKGAEELGKL

SEQ ID NO: 178114 - protein, 10 aa, Borrelia afzelii
KGAEELGKLF

SEQ ID NO: 178115 - protein, 10 aa, Borrelia afzelii
GAEELGKLFK

SEQ ID NO: 178116 - protein, 10 aa, Borrelia afzelii
AEELGKLFKS

SEQ ID NO: 178117 - protein, 10 aa, Borrelia afzelii
EELGKLFKSV

SEQ ID NO: 178118 - protein, 10 aa, Borrelia afzelii
ELGKLFKSVE

SEQ ID NO: 178119 - protein, 10 aa, Borrelia afzelii
LGKLFKSVEG

SEQ ID NO: 178120 - protein, 10 aa, Borrelia afzelii
GKLFKSVEGL

SEQ ID NO: 178121 - protein, 10 aa, Borrelia afzelii
KLFKSVEGLV

SEQ ID NO: 178122 - protein, 10 aa, Borrelia afzelii
LFKSVEGLVK

SEQ ID NO: 178123 - protein, 10 aa, Borrelia afzelii
FKSVEGLVKA

SEQ ID NO: 178124 - protein, 10 aa, Borrelia afzelii
KSVEGLVKAA

SEQ ID NO: 178125 - protein, 10 aa, Borrelia afzelii
SVEGLVKAAQ

SEQ ID NO: 178126 - protein, 10 aa, Borrelia afzelii
VEGLVKAAQE

SEQ ID NO: 178127 - protein, 10 aa, Borrelia afzelii
EGLVKAAQEA

SEQ ID NO: 178128 - protein, 10 aa, Borrelia afzelii
GLVKAAQEAL

SEQ ID NO: 178129 - protein, 10 aa, Borrelia afzelii
LVKAAQEALT

SEQ ID NO: 178130 - protein, 10 aa, Borrelia afzelii
VKAAQEALTN

SEQ ID NO: 178131 - protein, 10 aa, Borrelia afzelii
KAAQEALTNS

SEQ ID NO: 178132 - protein, 10 aa, Borrelia afzelii
AAQEALTNSV

SEQ ID NO: 178133 - protein, 10 aa, Borrelia afzelii
AQEALTNSVK

SEQ ID NO: 178134 - protein, 10 aa, Borrelia afzelii
QEALTNSVKE

SEQ ID NO: 178135 - protein, 10 aa, Borrelia afzelii
EALTNSVKEL

SEQ ID NO: 178136 - protein, 10 aa, Borrelia afzelii
ALTNSVKELT

SEQ ID NO: 178137 - protein, 10 aa, Borrelia afzelii
LTNSVKELTS

SEQ ID NO: 178138 - protein, 10 aa, Borrelia afzelii
TNSVKELTSP

SEQ ID NO: 178139 - protein, 10 aa, Borrelia afzelii
NSVKELTSPV

SEQ ID NO: 178140 - protein, 10 aa, Borrelia afzelii
SVKELTSPVV

SEQ ID NO: 178141 - protein, 10 aa, Borrelia afzelii
VKELTSPVVA

SEQ ID NO: 178142 - protein, 10 aa, Borrelia afzelii
KELTSPVVAE

SEQ ID NO: 178143 - protein, 10 aa, Borrelia afzelii
ELTSPVVAES

SEQ ID NO: 178144 - protein, 10 aa, Borrelia afzelii
LTSPVVAESP

SEQ ID NO: 178145 - protein, 10 aa, Borrelia afzelii
TSPVVAESPK

SEQ ID NO: 178146 - protein, 10 aa, Borrelia afzelii
SPVVAESPKK

SEQ ID NO: 178147 - protein, 10 aa, Borrelia afzelii
PVVAESPKKP

SEQ ID NO: 178148 - protein, 11 aa, Borrelia afzelii
MKKNTLSAILM

SEQ ID NO: 178149 - protein, 11 aa, Borrelia afzelii
KKNTLSAILMT

SEQ ID NO: 178150 - protein, 11 aa, Borrelia afzelii
KNTLSAILMTL

SEQ ID NO: 178151 - protein, 11 aa, Borrelia afzelii
NTLSAILMTLF

SEQ ID NO: 178152 - protein, 11 aa, Borrelia afzelii
TLSAILMTLFL

SEQ ID NO: 178153 - protein, 11 aa, Borrelia afzelii
LSAILMTLFLF

SEQ ID NO: 178154 - protein, 11 aa, Borrelia afzelii
SAILMTLFLFI

SEQ ID NO: 178155 - protein, 11 aa, Borrelia afzelii
AILMTLFLFIS

SEQ ID NO: 178156 - protein, 11 aa, Borrelia afzelii
ILMTLFLFISC

SEQ ID NO: 178157 - protein, 11 aa, Borrelia afzelii
LMTLFLFISCN

SEQ ID NO: 178158 - protein, 11 aa, Borrelia afzelii
MTLFLFISCNN

SEQ ID NO: 178159 - protein, 11 aa, Borrelia afzelii
TLFLFISCNNS

SEQ ID NO: 178160 - protein, 11 aa, Borrelia afzelii
LFLFISCNNSG

SEQ ID NO: 178161 - protein, 11 aa, Borrelia afzelii
FLFISCNNSGK

SEQ ID NO: 178162 - protein, 11 aa, Borrelia afzelii
LFISCNNSGKG

SEQ ID NO: 178163 - protein, 11 aa, Borrelia afzelii
FISCNNSGKGG

SEQ ID NO: 178164 - protein, 11 aa, Borrelia afzelii
ISCNNSGKGGD

SEQ ID NO: 178165 - protein, 11 aa, Borrelia afzelii
SCNNSGKGGDS

SEQ ID NO: 178166 - protein, 11 aa, Borrelia afzelii
CNNSGKGGDSA

SEQ ID NO: 178167 - protein, 11 aa, Borrelia afzelii
NNSGKGGDSAS

SEQ ID NO: 178168 - protein, 11 aa, Borrelia afzelii
NSGKGGDSAST

SEQ ID NO: 178169 - protein, 11 aa, Borrelia afzelii
SGKGGDSASTN

SEQ ID NO: 178170 - protein, 11 aa, Borrelia afzelii
GKGGDSASTNP

SEQ ID NO: 178171 - protein, 11 aa, Borrelia afzelii
KGGDSASTNPA

SEQ ID NO: 178172 - protein, 11 aa, Borrelia afzelii
GGDSASTNPAD

SEQ ID NO: 178173 - protein, 11 aa, Borrelia afzelii
GDSASTNPADE

SEQ ID NO: 178174 - protein, 11 aa, Borrelia afzelii
DSASTNPADES

SEQ ID NO: 178175 - protein, 11 aa, Borrelia afzelii
SASTNPADESA

SEQ ID NO: 178176 - protein, 11 aa, Borrelia afzelii
ASTNPADESAK

SEQ ID NO: 178177 - protein, 11 aa, Borrelia afzelii
STNPADESAKG

SEQ ID NO: 178178 - protein, 11 aa, Borrelia afzelii
TNPADESAKGP

SEQ ID NO: 178179 - protein, 11 aa, Borrelia afzelii
NPADESAKGPN

SEQ ID NO: 178180 - protein, 11 aa, Borrelia afzelii
PADESAKGPNL

SEQ ID NO: 178181 - protein, 11 aa, Borrelia afzelii
ADESAKGPNLT

SEQ ID NO: 178182 - protein, 11 aa, Borrelia afzelii
DESAKGPNLTE

SEQ ID NO: 178183 - protein, 11 aa, Borrelia afzelii
ESAKGPNLTEI

SEQ ID NO: 178184 - protein, 11 aa, Borrelia afzelii
SAKGPNLTEIS

SEQ ID NO: 178185 - protein, 11 aa, Borrelia afzelii
AKGPNLTEISK

SEQ ID NO: 178186 - protein, 11 aa, Borrelia afzelii
KGPNLTEISKK

SEQ ID NO: 178187 - protein, 11 aa, Borrelia afzelii
GPNLTEISKKI

SEQ ID NO: 178188 - protein, 11 aa, Borrelia afzelii
PNLTEISKKIT

SEQ ID NO: 178189 - protein, 11 aa, Borrelia afzelii
NLTEISKKITD

SEQ ID NO: 178190 - protein, 11 aa, Borrelia afzelii
LTEISKKITDS

SEQ ID NO: 178191 - protein, 11 aa, Borrelia afzelii
TEISKKITDSN

SEQ ID NO: 178192 - protein, 11 aa, Borrelia afzelii
EISKKITDSNA

SEQ ID NO: 178193 - protein, 11 aa, Borrelia afzelii
ISKKITDSNAF

SEQ ID NO: 178194 - protein, 11 aa, Borrelia afzelii
SKKITDSNAFV

SEQ ID NO: 178195 - protein, 11 aa, Borrelia afzelii
KKITDSNAFVL

SEQ ID NO: 178196 - protein, 11 aa, Borrelia afzelii
KITDSNAFVLA

SEQ ID NO: 178197 - protein, 11 aa, Borrelia afzelii
ITDSNAFVLAV

SEQ ID NO: 178198 - protein, 11 aa, Borrelia afzelii
TDSNAFVLAVK

SEQ ID NO: 178199 - protein, 11 aa, Borrelia afzelii
DSNAFVLAVKE

SEQ ID NO: 178200 - protein, 11 aa, Borrelia afzelii
SNAFVLAVKEV

SEQ ID NO: 178201 - protein, 11 aa, Borrelia afzelii
NAFVLAVKEVE

SEQ ID NO: 178202 - protein, 11 aa, Borrelia afzelii
AFVLAVKEVET

SEQ ID NO: 178203 - protein, 11 aa, Borrelia afzelii
FVLAVKEVETL

SEQ ID NO: 178204 - protein, 11 aa, Borrelia afzelii
VLAVKEVETLV

SEQ ID NO: 178205 - protein, 11 aa, Borrelia afzelii
LAVKEVETLVS

SEQ ID NO: 178206 - protein, 11 aa, Borrelia afzelii
AVKEVETLVSS

SEQ ID NO: 178207 - protein, 11 aa, Borrelia afzelii
VKEVETLVSSI

SEQ ID NO: 178208 - protein, 11 aa, Borrelia afzelii
KEVETLVSSID

SEQ ID NO: 178209 - protein, 11 aa, Borrelia afzelii
EVETLVSSIDE

SEQ ID NO: 178210 - protein, 11 aa, Borrelia afzelii
VETLVSSIDEL

SEQ ID NO: 178211 - protein, 11 aa, Borrelia afzelii
ETLVSSIDELA

SEQ ID NO: 178212 - protein, 11 aa, Borrelia afzelii
TLVSSIDELAN

SEQ ID NO: 178213 - protein, 11 aa, Borrelia afzelii
LVSSIDELANK

SEQ ID NO: 178214 - protein, 11 aa, Borrelia afzelii
VSSIDELANKA

SEQ ID NO: 178215 - protein, 11 aa, Borrelia afzelii
SSIDELANKAI

SEQ ID NO: 178216 - protein, 11 aa, Borrelia afzelii
SIDELANKAIG

SEQ ID NO: 178217 - protein, 11 aa, Borrelia afzelii
IDELANKAIGK

SEQ ID NO: 178218 - protein, 11 aa, Borrelia afzelii
DELANKAIGKK

SEQ ID NO: 178219 - protein, 11 aa, Borrelia afzelii
ELANKAIGKKI

SEQ ID NO: 178220 - protein, 11 aa, Borrelia afzelii
LANKAIGKKIQ

SEQ ID NO: 178221 - protein, 11 aa, Borrelia afzelii
ANKAIGKKIQQ

SEQ ID NO: 178222 - protein, 11 aa, Borrelia afzelii
NKAIGKKIQQN

SEQ ID NO: 178223 - protein, 11 aa, Borrelia afzelii
KAIGKKIQQNG

SEQ ID NO: 178224 - protein, 11 aa, Borrelia afzelii
AIGKKIQQNGL

SEQ ID NO: 178225 - protein, 11 aa, Borrelia afzelii
IGKKIQQNGLG

SEQ ID NO: 178226 - protein, 11 aa, Borrelia afzelii
GKKIQQNGLGA

SEQ ID NO: 178227 - protein, 11 aa, Borrelia afzelii
KKIQQNGLGAE

SEQ ID NO: 178228 - protein, 11 aa, Borrelia afzelii
KIQQNGLGAEA

SEQ ID NO: 178229 - protein, 11 aa, Borrelia afzelii
IQQNGLGAEAN

SEQ ID NO: 178230 - protein, 11 aa, Borrelia afzelii
QQNGLGAEANR

SEQ ID NO: 178231 - protein, 11 aa, Borrelia afzelii
QNGLGAEANRN

SEQ ID NO: 178232 - protein, 11 aa, Borrelia afzelii
NGLGAEANRNE

SEQ ID NO: 178233 - protein, 11 aa, Borrelia afzelii
GLGAEANRNES

SEQ ID NO: 178234 - protein, 11 aa, Borrelia afzelii
LGAEANRNESL

SEQ ID NO: 178235 - protein, 11 aa, Borrelia afzelii
GAEANRNESLL

SEQ ID NO: 178236 - protein, 11 aa, Borrelia afzelii
AEANRNESLLA

SEQ ID NO: 178237 - protein, 11 aa, Borrelia afzelii
EANRNESLLAG

SEQ ID NO: 178238 - protein, 11 aa, Borrelia afzelii
ANRNESLLAGV

SEQ ID NO: 178239 - protein, 11 aa, Borrelia afzelii
NRNESLLAGVH

SEQ ID NO: 178240 - protein, 11 aa, Borrelia afzelii
RNESLLAGVHE

SEQ ID NO: 178241 - protein, 11 aa, Borrelia afzelii
NESLLAGVHEI

SEQ ID NO: 178242 - protein, 11 aa, Borrelia afzelii
ESLLAGVHEIS

SEQ ID NO: 178243 - protein, 11 aa, Borrelia afzelii
SLLAGVHEIST

SEQ ID NO: 178244 - protein, 11 aa, Borrelia afzelii
LLAGVHEISTL

SEQ ID NO: 178245 - protein, 11 aa, Borrelia afzelii
LAGVHEISTLI

SEQ ID NO: 178246 - protein, 11 aa, Borrelia afzelii
AGVHEISTLIT

SEQ ID NO: 178247 - protein, 11 aa, Borrelia afzelii
GVHEISTLITE

SEQ ID NO: 178248 - protein, 11 aa, Borrelia afzelii
VHEISTLITEK

SEQ ID NO: 178249 - protein, 11 aa, Borrelia afzelii
HEISTLITEKL

SEQ ID NO: 178250 - protein, 11 aa, Borrelia afzelii
EISTLITEKLS

SEQ ID NO: 178251 - protein, 11 aa, Borrelia afzelii
ISTLITEKLSK

SEQ ID NO: 178252 - protein, 11 aa, Borrelia afzelii
STLITEKLSKL

SEQ ID NO: 178253 - protein, 11 aa, Borrelia afzelii
TLITEKLSKLK

SEQ ID NO: 178254 - protein, 11 aa, Borrelia afzelii
LITEKLSKLKN

SEQ ID NO: 178255 - protein, 11 aa, Borrelia afzelii
ITEKLSKLKNS

SEQ ID NO: 178256 - protein, 11 aa, Borrelia afzelii
TEKLSKLKNSG

SEQ ID NO: 178257 - protein, 11 aa, Borrelia afzelii
EKLSKLKNSGE

SEQ ID NO: 178258 - protein, 11 aa, Borrelia afzelii
KLSKLKNSGEL

SEQ ID NO: 178259 - protein, 11 aa, Borrelia afzelii
LSKLKNSGELK

SEQ ID NO: 178260 - protein, 11 aa, Borrelia afzelii
SKLKNSGELKA

SEQ ID NO: 178261 - protein, 11 aa, Borrelia afzelii
KLKNSGELKAK

SEQ ID NO: 178262 - protein, 11 aa, Borrelia afzelii
LKNSGELKAKI

SEQ ID NO: 178263 - protein, 11 aa, Borrelia afzelii
KNSGELKAKIE

SEQ ID NO: 178264 - protein, 11 aa, Borrelia afzelii
NSGELKAKIED

SEQ ID NO: 178265 - protein, 11 aa, Borrelia afzelii
SGELKAKIEDA

SEQ ID NO: 178266 - protein, 11 aa, Borrelia afzelii
GELKAKIEDAK

SEQ ID NO: 178267 - protein, 11 aa, Borrelia afzelii
ELKAKIEDAKK

SEQ ID NO: 178268 - protein, 11 aa, Borrelia afzelii
LKAKIEDAKKC

SEQ ID NO: 178269 - protein, 11 aa, Borrelia afzelii
KAKIEDAKKCS

SEQ ID NO: 178270 - protein, 11 aa, Borrelia afzelii
AKIEDAKKCSE

SEQ ID NO: 178271 - protein, 11 aa, Borrelia afzelii
KIEDAKKCSEE

SEQ ID NO: 178272 - protein, 11 aa, Borrelia afzelii
IEDAKKCSEEF

SEQ ID NO: 178273 - protein, 11 aa, Borrelia afzelii
EDAKKCSEEFT

SEQ ID NO: 178274 - protein, 11 aa, Borrelia afzelii
DAKKCSEEFTN

SEQ ID NO: 178275 - protein, 11 aa, Borrelia afzelii
AKKCSEEFTNK

SEQ ID NO: 178276 - protein, 11 aa, Borrelia afzelii
KKCSEEFTNKL

SEQ ID NO: 178277 - protein, 11 aa, Borrelia afzelii
KCSEEFTNKLR

SEQ ID NO: 178278 - protein, 11 aa, Borrelia afzelii
CSEEFTNKLRV

SEQ ID NO: 178279 - protein, 11 aa, Borrelia afzelii
SEEFTNKLRVS

SEQ ID NO: 178280 - protein, 11 aa, Borrelia afzelii
EEFTNKLRVSH

SEQ ID NO: 178281 - protein, 11 aa, Borrelia afzelii
EFTNKLRVSHA

SEQ ID NO: 178282 - protein, 11 aa, Borrelia afzelii
FTNKLRVSHAD

SEQ ID NO: 178283 - protein, 11 aa, Borrelia afzelii
TNKLRVSHADL

SEQ ID NO: 178284 - protein, 11 aa, Borrelia afzelii
NKLRVSHADLG

SEQ ID NO: 178285 - protein, 11 aa, Borrelia afzelii
KLRVSHADLGK

SEQ ID NO: 178286 - protein, 11 aa, Borrelia afzelii
LRVSHADLGKQ

SEQ ID NO: 178287 - protein, 11 aa, Borrelia afzelii
RVSHADLGKQG

SEQ ID NO: 178288 - protein, 11 aa, Borrelia afzelii
VSHADLGKQGV

SEQ ID NO: 178289 - protein, 11 aa, Borrelia afzelii
SHADLGKQGVN

SEQ ID NO: 178290 - protein, 11 aa, Borrelia afzelii
HADLGKQGVND

SEQ ID NO: 178291 - protein, 11 aa, Borrelia afzelii
ADLGKQGVNDD

SEQ ID NO: 178292 - protein, 11 aa, Borrelia afzelii
DLGKQGVNDDD

SEQ ID NO: 178293 - protein, 11 aa, Borrelia afzelii
LGKQGVNDDDA

SEQ ID NO: 178294 - protein, 11 aa, Borrelia afzelii
GKQGVNDDDAK

SEQ ID NO: 178295 - protein, 11 aa, Borrelia afzelii
KQGVNDDDAKK

SEQ ID NO: 178296 - protein, 11 aa, Borrelia afzelii
QGVNDDDAKKA

SEQ ID NO: 178297 - protein, 11 aa, Borrelia afzelii
GVNDDDAKKAI

SEQ ID NO: 178298 - protein, 11 aa, Borrelia afzelii
VNDDDAKKAIL

SEQ ID NO: 178299 - protein, 11 aa, Borrelia afzelii
NDDDAKKAILK

SEQ ID NO: 178300 - protein, 11 aa, Borrelia afzelii
DDDAKKAILKT

SEQ ID NO: 178301 - protein, 11 aa, Borrelia afzelii
DDAKKAILKTN

SEQ ID NO: 178302 - protein, 11 aa, Borrelia afzelii
DAKKAILKTNA

SEQ ID NO: 178303 - protein, 11 aa, Borrelia afzelii
AKKAILKTNAD

SEQ ID NO: 178304 - protein, 11 aa, Borrelia afzelii
KKAILKTNADK

SEQ ID NO: 178305 - protein, 11 aa, Borrelia afzelii
KAILKTNADKT

SEQ ID NO: 178306 - protein, 11 aa, Borrelia afzelii
AILKTNADKTK

SEQ ID NO: 178307 - protein, 11 aa, Borrelia afzelii
ILKTNADKTKG

SEQ ID NO: 178308 - protein, 11 aa, Borrelia afzelii
LKTNADKTKGA

SEQ ID NO: 178309 - protein, 11 aa, Borrelia afzelii
KTNADKTKGAE

SEQ ID NO: 178310 - protein, 11 aa, Borrelia afzelii
TNADKTKGAEE

SEQ ID NO: 178311 - protein, 11 aa, Borrelia afzelii
NADKTKGAEEL

SEQ ID NO: 178312 - protein, 11 aa, Borrelia afzelii
ADKTKGAEELG

SEQ ID NO: 178313 - protein, 11 aa, Borrelia afzelii
DKTKGAEELGK

SEQ ID NO: 178314 - protein, 11 aa, Borrelia afzelii
KTKGAEELGKL

SEQ ID NO: 178315 - protein, 11 aa, Borrelia afzelii
TKGAEELGKLF

SEQ ID NO: 178316 - protein, 11 aa, Borrelia afzelii
KGAEELGKLFK

SEQ ID NO: 178317 - protein, 11 aa, Borrelia afzelii
GAEELGKLFKS

SEQ ID NO: 178318 - protein, 11 aa, Borrelia afzelii
AEELGKLFKSV

SEQ ID NO: 178319 - protein, 11 aa, Borrelia afzelii
EELGKLFKSVE

SEQ ID NO: 178320 - protein, 11 aa, Borrelia afzelii
ELGKLFKSVEG

SEQ ID NO: 178321 - protein, 11 aa, Borrelia afzelii
LGKLFKSVEGL

SEQ ID NO: 178322 - protein, 11 aa, Borrelia afzelii
GKLFKSVEGLV

SEQ ID NO: 178323 - protein, 11 aa, Borrelia afzelii
KLFKSVEGLVK

SEQ ID NO: 178324 - protein, 11 aa, Borrelia afzelii
LFKSVEGLVKA

SEQ ID NO: 178325 - protein, 11 aa, Borrelia afzelii
FKSVEGLVKAA

SEQ ID NO: 178326 - protein, 11 aa, Borrelia afzelii
KSVEGLVKAAQ

SEQ ID NO: 178327 - protein, 11 aa, Borrelia afzelii
SVEGLVKAAQE

SEQ ID NO: 178328 - protein, 11 aa, Borrelia afzelii
VEGLVKAAQEA

SEQ ID NO: 178329 - protein, 11 aa, Borrelia afzelii
EGLVKAAQEAL

SEQ ID NO: 178330 - protein, 11 aa, Borrelia afzelii
GLVKAAQEALT

SEQ ID NO: 178331 - protein, 11 aa, Borrelia afzelii
LVKAAQEALTN

SEQ ID NO: 178332 - protein, 11 aa, Borrelia afzelii
VKAAQEALTNS

SEQ ID NO: 178333 - protein, 11 aa, Borrelia afzelii
KAAQEALTNSV

SEQ ID NO: 178334 - protein, 11 aa, Borrelia afzelii
AAQEALTNSVK

SEQ ID NO: 178335 - protein, 11 aa, Borrelia afzelii
AQEALTNSVKE

SEQ ID NO: 178336 - protein, 11 aa, Borrelia afzelii
QEALTNSVKEL

SEQ ID NO: 178337 - protein, 11 aa, Borrelia afzelii
EALTNSVKELT

SEQ ID NO: 178338 - protein, 11 aa, Borrelia afzelii
ALTNSVKELTS

SEQ ID NO: 178339 - protein, 11 aa, Borrelia afzelii
LTNSVKELTSP

SEQ ID NO: 178340 - protein, 11 aa, Borrelia afzelii
TNSVKELTSPV

SEQ ID NO: 178341 - protein, 11 aa, Borrelia afzelii
NSVKELTSPVV

SEQ ID NO: 178342 - protein, 11 aa, Borrelia afzelii
SVKELTSPVVA

SEQ ID NO: 178343 - protein, 11 aa, Borrelia afzelii
VKELTSPVVAE

SEQ ID NO: 178344 - protein, 11 aa, Borrelia afzelii
KELTSPVVAES

SEQ ID NO: 178345 - protein, 11 aa, Borrelia afzelii
ELTSPVVAESP

SEQ ID NO: 178346 - protein, 11 aa, Borrelia afzelii
LTSPVVAESPK

SEQ ID NO: 178347 - protein, 11 aa, Borrelia afzelii
TSPVVAESPKK

SEQ ID NO: 178348 - protein, 11 aa, Borrelia afzelii
SPVVAESPKKP

SEQ ID NO: 178349 - protein, 13 aa, Borrelia afzelii
MKKNTLSAILMTL

SEQ ID NO: 178350 - protein, 13 aa, Borrelia afzelii
KKNTLSAILMTLF

SEQ ID NO: 178351 - protein, 13 aa, Borrelia afzelii
KNTLSAILMTLFL

SEQ ID NO: 178352 - protein, 13 aa, Borrelia afzelii
NTLSAILMTLFLF

SEQ ID NO: 178353 - protein, 13 aa, Borrelia afzelii
TLSAILMTLFLFI

SEQ ID NO: 178354 - protein, 13 aa, Borrelia afzelii
LSAILMTLFLFIS

SEQ ID NO: 178355 - protein, 13 aa, Borrelia afzelii
SAILMTLFLFISC

SEQ ID NO: 178356 - protein, 13 aa, Borrelia afzelii
AILMTLFLFISCN

SEQ ID NO: 178357 - protein, 13 aa, Borrelia afzelii
ILMTLFLFISCNN

SEQ ID NO: 178358 - protein, 13 aa, Borrelia afzelii
LMTLFLFISCNNS

SEQ ID NO: 178359 - protein, 13 aa, Borrelia afzelii
MTLFLFISCNNSG

SEQ ID NO: 178360 - protein, 13 aa, Borrelia afzelii
TLFLFISCNNSGK

SEQ ID NO: 178361 - protein, 13 aa, Borrelia afzelii
LFLFISCNNSGKG

SEQ ID NO: 178362 - protein, 13 aa, Borrelia afzelii
FLFISCNNSGKGG

SEQ ID NO: 178363 - protein, 13 aa, Borrelia afzelii
LFISCNNSGKGGD

SEQ ID NO: 178364 - protein, 13 aa, Borrelia afzelii
FISCNNSGKGGDS

SEQ ID NO: 178365 - protein, 13 aa, Borrelia afzelii
ISCNNSGKGGDSA

SEQ ID NO: 178366 - protein, 13 aa, Borrelia afzelii
SCNNSGKGGDSAS

SEQ ID NO: 178367 - protein, 13 aa, Borrelia afzelii
CNNSGKGGDSAST

SEQ ID NO: 178368 - protein, 13 aa, Borrelia afzelii
NNSGKGGDSASTN

SEQ ID NO: 178369 - protein, 13 aa, Borrelia afzelii
NSGKGGDSASTNP

SEQ ID NO: 178370 - protein, 13 aa, Borrelia afzelii
SGKGGDSASTNPA

SEQ ID NO: 178371 - protein, 13 aa, Borrelia afzelii
GKGGDSASTNPAD

SEQ ID NO: 178372 - protein, 13 aa, Borrelia afzelii
KGGDSASTNPADE

SEQ ID NO: 178373 - protein, 13 aa, Borrelia afzelii
GGDSASTNPADES

SEQ ID NO: 178374 - protein, 13 aa, Borrelia afzelii
GDSASTNPADESA

SEQ ID NO: 178375 - protein, 13 aa, Borrelia afzelii
DSASTNPADESAK

SEQ ID NO: 178376 - protein, 13 aa, Borrelia afzelii
SASTNPADESAKG

SEQ ID NO: 178377 - protein, 13 aa, Borrelia afzelii
ASTNPADESAKGP

SEQ ID NO: 178378 - protein, 13 aa, Borrelia afzelii
STNPADESAKGPN

SEQ ID NO: 178379 - protein, 13 aa, Borrelia afzelii
TNPADESAKGPNL

SEQ ID NO: 178380 - protein, 13 aa, Borrelia afzelii
NPADESAKGPNLT

SEQ ID NO: 178381 - protein, 13 aa, Borrelia afzelii
PADESAKGPNLTE

SEQ ID NO: 178382 - protein, 13 aa, Borrelia afzelii
ADESAKGPNLTEI

SEQ ID NO: 178383 - protein, 13 aa, Borrelia afzelii
DESAKGPNLTEIS

SEQ ID NO: 178384 - protein, 13 aa, Borrelia afzelii
ESAKGPNLTEISK

SEQ ID NO: 178385 - protein, 13 aa, Borrelia afzelii
SAKGPNLTEISKK

SEQ ID NO: 178386 - protein, 13 aa, Borrelia afzelii
AKGPNLTEISKKI

SEQ ID NO: 178387 - protein, 13 aa, Borrelia afzelii
KGPNLTEISKKIT

SEQ ID NO: 178388 - protein, 13 aa, Borrelia afzelii
GPNLTEISKKITD

SEQ ID NO: 178389 - protein, 13 aa, Borrelia afzelii
PNLTEISKKITDS

SEQ ID NO: 178390 - protein, 13 aa, Borrelia afzelii
NLTEISKKITDSN

SEQ ID NO: 178391 - protein, 13 aa, Borrelia afzelii
LTEISKKITDSNA

SEQ ID NO: 178392 - protein, 13 aa, Borrelia afzelii
TEISKKITDSNAF

SEQ ID NO: 178393 - protein, 13 aa, Borrelia afzelii
EISKKITDSNAFV

SEQ ID NO: 178394 - protein, 13 aa, Borrelia afzelii
ISKKITDSNAFVL

SEQ ID NO: 178395 - protein, 13 aa, Borrelia afzelii
SKKITDSNAFVLA

SEQ ID NO: 178396 - protein, 13 aa, Borrelia afzelii
KKITDSNAFVLAV

SEQ ID NO: 178397 - protein, 13 aa, Borrelia afzelii
KITDSNAFVLAVK

SEQ ID NO: 178398 - protein, 13 aa, Borrelia afzelii
ITDSNAFVLAVKE

SEQ ID NO: 178399 - protein, 13 aa, Borrelia afzelii
TDSNAFVLAVKEV

SEQ ID NO: 178400 - protein, 13 aa, Borrelia afzelii
DSNAFVLAVKEVE

SEQ ID NO: 178401 - protein, 13 aa, Borrelia afzelii
SNAFVLAVKEVET

SEQ ID NO: 178402 - protein, 13 aa, Borrelia afzelii
NAFVLAVKEVETL

SEQ ID NO: 178403 - protein, 13 aa, Borrelia afzelii
AFVLAVKEVETLV

SEQ ID NO: 178404 - protein, 13 aa, Borrelia afzelii
FVLAVKEVETLVS

SEQ ID NO: 178405 - protein, 13 aa, Borrelia afzelii
VLAVKEVETLVSS

SEQ ID NO: 178406 - protein, 13 aa, Borrelia afzelii
LAVKEVETLVSSI

SEQ ID NO: 178407 - protein, 13 aa, Borrelia afzelii
AVKEVETLVSSID

SEQ ID NO: 178408 - protein, 13 aa, Borrelia afzelii
VKEVETLVSSIDE

SEQ ID NO: 178409 - protein, 13 aa, Borrelia afzelii
KEVETLVSSIDEL

SEQ ID NO: 178410 - protein, 13 aa, Borrelia afzelii
EVETLVSSIDELA

SEQ ID NO: 178411 - protein, 13 aa, Borrelia afzelii
VETLVSSIDELAN

SEQ ID NO: 178412 - protein, 13 aa, Borrelia afzelii
ETLVSSIDELANK

SEQ ID NO: 178413 - protein, 13 aa, Borrelia afzelii
TLVSSIDELANKA

SEQ ID NO: 178414 - protein, 13 aa, Borrelia afzelii
LVSSIDELANKAI

SEQ ID NO: 178415 - protein, 13 aa, Borrelia afzelii
VSSIDELANKAIG

SEQ ID NO: 178416 - protein, 13 aa, Borrelia afzelii
SSIDELANKAIGK

SEQ ID NO: 178417 - protein, 13 aa, Borrelia afzelii
SIDELANKAIGKK

SEQ ID NO: 178418 - protein, 13 aa, Borrelia afzelii
IDELANKAIGKKI

SEQ ID NO: 178419 - protein, 13 aa, Borrelia afzelii
DELANKAIGKKIQ

SEQ ID NO: 178420 - protein, 13 aa, Borrelia afzelii
ELANKAIGKKIQQ

SEQ ID NO: 178421 - protein, 13 aa, Borrelia afzelii
LANKAIGKKIQQN

SEQ ID NO: 178422 - protein, 13 aa, Borrelia afzelii
ANKAIGKKIQQNG

SEQ ID NO: 178423 - protein, 13 aa, Borrelia afzelii
NKAIGKKIQQNGL

SEQ ID NO: 178424 - protein, 13 aa, Borrelia afzelii
KAIGKKIQQNGLG

SEQ ID NO: 178425 - protein, 13 aa, Borrelia afzelii
AIGKKIQQNGLGA

SEQ ID NO: 178426 - protein, 13 aa, Borrelia afzelii
IGKKIQQNGLGAE

SEQ ID NO: 178427 - protein, 13 aa, Borrelia afzelii
GKKIQQNGLGAEA

SEQ ID NO: 178428 - protein, 13 aa, Borrelia afzelii
KKIQQNGLGAEAN

SEQ ID NO: 178429 - protein, 13 aa, Borrelia afzelii
KIQQNGLGAEANR

SEQ ID NO: 178430 - protein, 13 aa, Borrelia afzelii
IQQNGLGAEANRN

SEQ ID NO: 178431 - protein, 13 aa, Borrelia afzelii
QQNGLGAEANRNE

SEQ ID NO: 178432 - protein, 13 aa, Borrelia afzelii
QNGLGAEANRNES

SEQ ID NO: 178433 - protein, 13 aa, Borrelia afzelii
NGLGAEANRNESL

SEQ ID NO: 178434 - protein, 13 aa, Borrelia afzelii
GLGAEANRNESLL

SEQ ID NO: 178435 - protein, 13 aa, Borrelia afzelii
LGAEANRNESLLA

SEQ ID NO: 178436 - protein, 13 aa, Borrelia afzelii
GAEANRNESLLAG

SEQ ID NO: 178437 - protein, 13 aa, Borrelia afzelii
AEANRNESLLAGV

SEQ ID NO: 178438 - protein, 13 aa, Borrelia afzelii
EANRNESLLAGVH

SEQ ID NO: 178439 - protein, 13 aa, Borrelia afzelii
ANRNESLLAGVHE

SEQ ID NO: 178440 - protein, 13 aa, Borrelia afzelii
NRNESLLAGVHEI

SEQ ID NO: 178441 - protein, 13 aa, Borrelia afzelii
RNESLLAGVHEIS

SEQ ID NO: 178442 - protein, 13 aa, Borrelia afzelii
NESLLAGVHEIST

SEQ ID NO: 178443 - protein, 13 aa, Borrelia afzelii
ESLLAGVHEISTL

SEQ ID NO: 178444 - protein, 13 aa, Borrelia afzelii
SLLAGVHEISTLI

SEQ ID NO: 178445 - protein, 13 aa, Borrelia afzelii
LLAGVHEISTLIT

SEQ ID NO: 178446 - protein, 13 aa, Borrelia afzelii
LAGVHEISTLITE

SEQ ID NO: 178447 - protein, 13 aa, Borrelia afzelii
AGVHEISTLITEK

SEQ ID NO: 178448 - protein, 13 aa, Borrelia afzelii
GVHEISTLITEKL

SEQ ID NO: 178449 - protein, 13 aa, Borrelia afzelii
VHEISTLITEKLS

SEQ ID NO: 178450 - protein, 13 aa, Borrelia afzelii
HEISTLITEKLSK

SEQ ID NO: 178451 - protein, 13 aa, Borrelia afzelii
EISTLITEKLSKL

SEQ ID NO: 178452 - protein, 13 aa, Borrelia afzelii
ISTLITEKLSKLK

SEQ ID NO: 178453 - protein, 13 aa, Borrelia afzelii
STLITEKLSKLKN

SEQ ID NO: 178454 - protein, 13 aa, Borrelia afzelii
TLITEKLSKLKNS

SEQ ID NO: 178455 - protein, 13 aa, Borrelia afzelii
LITEKLSKLKNSG

SEQ ID NO: 178456 - protein, 13 aa, Borrelia afzelii
ITEKLSKLKNSGE

SEQ ID NO: 178457 - protein, 13 aa, Borrelia afzelii
TEKLSKLKNSGEL

SEQ ID NO: 178458 - protein, 13 aa, Borrelia afzelii
EKLSKLKNSGELK

SEQ ID NO: 178459 - protein, 13 aa, Borrelia afzelii
KLSKLKNSGELKA

SEQ ID NO: 178460 - protein, 13 aa, Borrelia afzelii
LSKLKNSGELKAK

SEQ ID NO: 178461 - protein, 13 aa, Borrelia afzelii
SKLKNSGELKAKI

SEQ ID NO: 178462 - protein, 13 aa, Borrelia afzelii
KLKNSGELKAKIE

SEQ ID NO: 178463 - protein, 13 aa, Borrelia afzelii
LKNSGELKAKIED

SEQ ID NO: 178464 - protein, 13 aa, Borrelia afzelii
KNSGELKAKIEDA

SEQ ID NO: 178465 - protein, 13 aa, Borrelia afzelii
NSGELKAKIEDAK

SEQ ID NO: 178466 - protein, 13 aa, Borrelia afzelii
SGELKAKIEDAKK

SEQ ID NO: 178467 - protein, 13 aa, Borrelia afzelii
GELKAKIEDAKKC

SEQ ID NO: 178468 - protein, 13 aa, Borrelia afzelii
ELKAKIEDAKKCS

SEQ ID NO: 178469 - protein, 13 aa, Borrelia afzelii
LKAKIEDAKKCSE

SEQ ID NO: 178470 - protein, 13 aa, Borrelia afzelii
KAKIEDAKKCSEE

SEQ ID NO: 178471 - protein, 13 aa, Borrelia afzelii
AKIEDAKKCSEEF

SEQ ID NO: 178472 - protein, 13 aa, Borrelia afzelii
KIEDAKKCSEEFT

SEQ ID NO: 178473 - protein, 13 aa, Borrelia afzelii
IEDAKKCSEEFTN

SEQ ID NO: 178474 - protein, 13 aa, Borrelia afzelii
EDAKKCSEEFTNK

SEQ ID NO: 178475 - protein, 13 aa, Borrelia afzelii
DAKKCSEEFTNKL

SEQ ID NO: 178476 - protein, 13 aa, Borrelia afzelii
AKKCSEEFTNKLR

SEQ ID NO: 178477 - protein, 13 aa, Borrelia afzelii
KKCSEEFTNKLRV

SEQ ID NO: 178478 - protein, 13 aa, Borrelia afzelii
KCSEEFTNKLRVS

SEQ ID NO: 178479 - protein, 13 aa, Borrelia afzelii
CSEEFTNKLRVSH

SEQ ID NO: 178480 - protein, 13 aa, Borrelia afzelii
SEEFTNKLRVSHA

SEQ ID NO: 178481 - protein, 13 aa, Borrelia afzelii
EEFTNKLRVSHAD

SEQ ID NO: 178482 - protein, 13 aa, Borrelia afzelii
EFTNKLRVSHADL

SEQ ID NO: 178483 - protein, 13 aa, Borrelia afzelii
FTNKLRVSHADLG

SEQ ID NO: 178484 - protein, 13 aa, Borrelia afzelii
TNKLRVSHADLGK

SEQ ID NO: 178485 - protein, 13 aa, Borrelia afzelii
NKLRVSHADLGKQ

SEQ ID NO: 178486 - protein, 13 aa, Borrelia afzelii
KLRVSHADLGKQG

SEQ ID NO: 178487 - protein, 13 aa, Borrelia afzelii
LRVSHADLGKQGV

SEQ ID NO: 178488 - protein, 13 aa, Borrelia afzelii
RVSHADLGKQGVN

SEQ ID NO: 178489 - protein, 13 aa, Borrelia afzelii
VSHADLGKQGVND

SEQ ID NO: 178490 - protein, 13 aa, Borrelia afzelii
SHADLGKQGVNDD

SEQ ID NO: 178491 - protein, 13 aa, Borrelia afzelii
HADLGKQGVNDDD

SEQ ID NO: 178492 - protein, 13 aa, Borrelia afzelii
ADLGKQGVNDDDA

SEQ ID NO: 178493 - protein, 13 aa, Borrelia afzelii
DLGKQGVNDDDAK

SEQ ID NO: 178494 - protein, 13 aa, Borrelia afzelii
LGKQGVNDDDAKK

SEQ ID NO: 178495 - protein, 13 aa, Borrelia afzelii
GKQGVNDDDAKKA

SEQ ID NO: 178496 - protein, 13 aa, Borrelia afzelii
KQGVNDDDAKKAI

SEQ ID NO: 178497 - protein, 13 aa, Borrelia afzelii
QGVNDDDAKKAIL

SEQ ID NO: 178498 - protein, 13 aa, Borrelia afzelii
GVNDDDAKKAILK

SEQ ID NO: 178499 - protein, 13 aa, Borrelia afzelii
VNDDDAKKAILKT

SEQ ID NO: 178500 - protein, 13 aa, Borrelia afzelii
NDDDAKKAILKTN

SEQ ID NO: 178501 - protein, 13 aa, Borrelia afzelii
DDDAKKAILKTNA

SEQ ID NO: 178502 - protein, 13 aa, Borrelia afzelii
DDAKKAILKTNAD

SEQ ID NO: 178503 - protein, 13 aa, Borrelia afzelii
DAKKAILKTNADK

SEQ ID NO: 178504 - protein, 13 aa, Borrelia afzelii
AKKAILKTNADKT

SEQ ID NO: 178505 - protein, 13 aa, Borrelia afzelii
KKAILKTNADKTK

SEQ ID NO: 178506 - protein, 13 aa, Borrelia afzelii
KAILKTNADKTKG

SEQ ID NO: 178507 - protein, 13 aa, Borrelia afzelii
AILKTNADKTKGA

SEQ ID NO: 178508 - protein, 13 aa, Borrelia afzelii
ILKTNADKTKGAE

SEQ ID NO: 178509 - protein, 13 aa, Borrelia afzelii
LKTNADKTKGAEE

SEQ ID NO: 178510 - protein, 13 aa, Borrelia afzelii
KTNADKTKGAEEL

SEQ ID NO: 178511 - protein, 13 aa, Borrelia afzelii
TNADKTKGAEELG

SEQ ID NO: 178512 - protein, 13 aa, Borrelia afzelii
NADKTKGAEELGK

SEQ ID NO: 178513 - protein, 13 aa, Borrelia afzelii
ADKTKGAEELGKL

SEQ ID NO: 178514 - protein, 13 aa, Borrelia afzelii
DKTKGAEELGKLF

SEQ ID NO: 178515 - protein, 13 aa, Borrelia afzelii
KTKGAEELGKLFK

SEQ ID NO: 178516 - protein, 13 aa, Borrelia afzelii
TKGAEELGKLFKS

SEQ ID NO: 178517 - protein, 13 aa, Borrelia afzelii
KGAEELGKLFKSV

SEQ ID NO: 178518 - protein, 13 aa, Borrelia afzelii
GAEELGKLFKSVE

SEQ ID NO: 178519 - protein, 13 aa, Borrelia afzelii
AEELGKLFKSVEG

SEQ ID NO: 178520 - protein, 13 aa, Borrelia afzelii
EELGKLFKSVEGL

SEQ ID NO: 178521 - protein, 13 aa, Borrelia afzelii
ELGKLFKSVEGLV

SEQ ID NO: 178522 - protein, 13 aa, Borrelia afzelii
LGKLFKSVEGLVK

SEQ ID NO: 178523 - protein, 13 aa, Borrelia afzelii
GKLFKSVEGLVKA

SEQ ID NO: 178524 - protein, 13 aa, Borrelia afzelii
KLFKSVEGLVKAA

SEQ ID NO: 178525 - protein, 13 aa, Borrelia afzelii
LFKSVEGLVKAAQ

SEQ ID NO: 178526 - protein, 13 aa, Borrelia afzelii
FKSVEGLVKAAQE

SEQ ID NO: 178527 - protein, 13 aa, Borrelia afzelii
KSVEGLVKAAQEA

SEQ ID NO: 178528 - protein, 13 aa, Borrelia afzelii
SVEGLVKAAQEAL

SEQ ID NO: 178529 - protein, 13 aa, Borrelia afzelii
VEGLVKAAQEALT

SEQ ID NO: 178530 - protein, 13 aa, Borrelia afzelii
EGLVKAAQEALTN

SEQ ID NO: 178531 - protein, 13 aa, Borrelia afzelii
GLVKAAQEALTNS

SEQ ID NO: 178532 - protein, 13 aa, Borrelia afzelii
LVKAAQEALTNSV

SEQ ID NO: 178533 - protein, 13 aa, Borrelia afzelii
VKAAQEALTNSVK

SEQ ID NO: 178534 - protein, 13 aa, Borrelia afzelii
KAAQEALTNSVKE

SEQ ID NO: 178535 - protein, 13 aa, Borrelia afzelii
AAQEALTNSVKEL

SEQ ID NO: 178536 - protein, 13 aa, Borrelia afzelii
AQEALTNSVKELT

SEQ ID NO: 178537 - protein, 13 aa, Borrelia afzelii
QEALTNSVKELTS

SEQ ID NO: 178538 - protein, 13 aa, Borrelia afzelii
EALTNSVKELTSP

SEQ ID NO: 178539 - protein, 13 aa, Borrelia afzelii
ALTNSVKELTSPV

SEQ ID NO: 178540 - protein, 13 aa, Borrelia afzelii
LTNSVKELTSPVV

SEQ ID NO: 178541 - protein, 13 aa, Borrelia afzelii
TNSVKELTSPVVA

SEQ ID NO: 178542 - protein, 13 aa, Borrelia afzelii
NSVKELTSPVVAE

SEQ ID NO: 178543 - protein, 13 aa, Borrelia afzelii
SVKELTSPVVAES

SEQ ID NO: 178544 - protein, 13 aa, Borrelia afzelii
VKELTSPVVAESP

SEQ ID NO: 178545 - protein, 13 aa, Borrelia afzelii
KELTSPVVAESPK

SEQ ID NO: 178546 - protein, 13 aa, Borrelia afzelii
ELTSPVVAESPKK

SEQ ID NO: 178547 - protein, 13 aa, Borrelia afzelii
LTSPVVAESPKKP

SEQ ID NO: 178548 - protein, 14 aa, Borrelia afzelii
MKKNTLSAILMTLF

SEQ ID NO: 178549 - protein, 14 aa, Borrelia afzelii
KKNTLSAILMTLFL

SEQ ID NO: 178550 - protein, 14 aa, Borrelia afzelii
KNTLSAILMTLFLF

SEQ ID NO: 178551 - protein, 14 aa, Borrelia afzelii
NTLSAILMTLFLFI

SEQ ID NO: 178552 - protein, 14 aa, Borrelia afzelii
TLSAILMTLFLFIS

SEQ ID NO: 178553 - protein, 14 aa, Borrelia afzelii
LSAILMTLFLFISC

SEQ ID NO: 178554 - protein, 14 aa, Borrelia afzelii
SAILMTLFLFISCN

SEQ ID NO: 178555 - protein, 14 aa, Borrelia afzelii
AILMTLFLFISCNN

SEQ ID NO: 178556 - protein, 14 aa, Borrelia afzelii
ILMTLFLFISCNNS

SEQ ID NO: 178557 - protein, 14 aa, Borrelia afzelii
LMTLFLFISCNNSG

SEQ ID NO: 178558 - protein, 14 aa, Borrelia afzelii
MTLFLFISCNNSGK

SEQ ID NO: 178559 - protein, 14 aa, Borrelia afzelii
TLFLFISCNNSGKG

SEQ ID NO: 178560 - protein, 14 aa, Borrelia afzelii
LFLFISCNNSGKGG

SEQ ID NO: 178561 - protein, 14 aa, Borrelia afzelii
FLFISCNNSGKGGD

SEQ ID NO: 178562 - protein, 14 aa, Borrelia afzelii
LFISCNNSGKGGDS

SEQ ID NO: 178563 - protein, 14 aa, Borrelia afzelii
FISCNNSGKGGDSA

SEQ ID NO: 178564 - protein, 14 aa, Borrelia afzelii
ISCNNSGKGGDSAS

SEQ ID NO: 178565 - protein, 14 aa, Borrelia afzelii
SCNNSGKGGDSAST

SEQ ID NO: 178566 - protein, 14 aa, Borrelia afzelii
CNNSGKGGDSASTN

SEQ ID NO: 178567 - protein, 14 aa, Borrelia afzelii
NNSGKGGDSASTNP

SEQ ID NO: 178568 - protein, 14 aa, Borrelia afzelii
NSGKGGDSASTNPA

SEQ ID NO: 178569 - protein, 14 aa, Borrelia afzelii
SGKGGDSASTNPAD

SEQ ID NO: 178570 - protein, 14 aa, Borrelia afzelii
GKGGDSASTNPADE

SEQ ID NO: 178571 - protein, 14 aa, Borrelia afzelii
KGGDSASTNPADES

SEQ ID NO: 178572 - protein, 14 aa, Borrelia afzelii
GGDSASTNPADESA

SEQ ID NO: 178573 - protein, 14 aa, Borrelia afzelii
GDSASTNPADESAK

SEQ ID NO: 178574 - protein, 14 aa, Borrelia afzelii
DSASTNPADESAKG

SEQ ID NO: 178575 - protein, 14 aa, Borrelia afzelii
SASTNPADESAKGP

SEQ ID NO: 178576 - protein, 14 aa, Borrelia afzelii
ASTNPADESAKGPN

SEQ ID NO: 178577 - protein, 14 aa, Borrelia afzelii
STNPADESAKGPNL

SEQ ID NO: 178578 - protein, 14 aa, Borrelia afzelii
TNPADESAKGPNLT

SEQ ID NO: 178579 - protein, 14 aa, Borrelia afzelii
NPADESAKGPNLTE

SEQ ID NO: 178580 - protein, 14 aa, Borrelia afzelii
PADESAKGPNLTEI

SEQ ID NO: 178581 - protein, 14 aa, Borrelia afzelii
ADESAKGPNLTEIS

SEQ ID NO: 178582 - protein, 14 aa, Borrelia afzelii
DESAKGPNLTEISK

SEQ ID NO: 178583 - protein, 14 aa, Borrelia afzelii
ESAKGPNLTEISKK

SEQ ID NO: 178584 - protein, 14 aa, Borrelia afzelii
SAKGPNLTEISKKI

SEQ ID NO: 178585 - protein, 14 aa, Borrelia afzelii
AKGPNLTEISKKIT

SEQ ID NO: 178586 - protein, 14 aa, Borrelia afzelii
KGPNLTEISKKITD

SEQ ID NO: 178587 - protein, 14 aa, Borrelia afzelii
GPNLTEISKKITDS

SEQ ID NO: 178588 - protein, 14 aa, Borrelia afzelii
PNLTEISKKITDSN

SEQ ID NO: 178589 - protein, 14 aa, Borrelia afzelii
NLTEISKKITDSNA

SEQ ID NO: 178590 - protein, 14 aa, Borrelia afzelii
LTEISKKITDSNAF

SEQ ID NO: 178591 - protein, 14 aa, Borrelia afzelii
TEISKKITDSNAFV

SEQ ID NO: 178592 - protein, 14 aa, Borrelia afzelii
EISKKITDSNAFVL

SEQ ID NO: 178593 - protein, 14 aa, Borrelia afzelii
ISKKITDSNAFVLA

SEQ ID NO: 178594 - protein, 14 aa, Borrelia afzelii
SKKITDSNAFVLAV

SEQ ID NO: 178595 - protein, 14 aa, Borrelia afzelii
KKITDSNAFVLAVK

SEQ ID NO: 178596 - protein, 14 aa, Borrelia afzelii
KITDSNAFVLAVKE

SEQ ID NO: 178597 - protein, 14 aa, Borrelia afzelii
ITDSNAFVLAVKEV

SEQ ID NO: 178598 - protein, 14 aa, Borrelia afzelii
TDSNAFVLAVKEVE

SEQ ID NO: 178599 - protein, 14 aa, Borrelia afzelii
DSNAFVLAVKEVET

SEQ ID NO: 178600 - protein, 14 aa, Borrelia afzelii
SNAFVLAVKEVETL

SEQ ID NO: 178601 - protein, 14 aa, Borrelia afzelii
NAFVLAVKEVETLV

SEQ ID NO: 178602 - protein, 14 aa, Borrelia afzelii
AFVLAVKEVETLVS

SEQ ID NO: 178603 - protein, 14 aa, Borrelia afzelii
FVLAVKEVETLVSS

SEQ ID NO: 178604 - protein, 14 aa, Borrelia afzelii
VLAVKEVETLVSSI

SEQ ID NO: 178605 - protein, 14 aa, Borrelia afzelii
LAVKEVETLVSSID

SEQ ID NO: 178606 - protein, 14 aa, Borrelia afzelii
AVKEVETLVSSIDE

SEQ ID NO: 178607 - protein, 14 aa, Borrelia afzelii
VKEVETLVSSIDEL

SEQ ID NO: 178608 - protein, 14 aa, Borrelia afzelii
KEVETLVSSIDELA

SEQ ID NO: 178609 - protein, 14 aa, Borrelia afzelii
EVETLVSSIDELAN

SEQ ID NO: 178610 - protein, 14 aa, Borrelia afzelii
VETLVSSIDELANK

SEQ ID NO: 178611 - protein, 14 aa, Borrelia afzelii
ETLVSSIDELANKA

SEQ ID NO: 178612 - protein, 14 aa, Borrelia afzelii
TLVSSIDELANKAI

SEQ ID NO: 178613 - protein, 14 aa, Borrelia afzelii
LVSSIDELANKAIG

SEQ ID NO: 178614 - protein, 14 aa, Borrelia afzelii
VSSIDELANKAIGK

SEQ ID NO: 178615 - protein, 14 aa, Borrelia afzelii
SSIDELANKAIGKK

SEQ ID NO: 178616 - protein, 14 aa, Borrelia afzelii
SIDELANKAIGKKI

SEQ ID NO: 178617 - protein, 14 aa, Borrelia afzelii
IDELANKAIGKKIQ

SEQ ID NO: 178618 - protein, 14 aa, Borrelia afzelii
DELANKAIGKKIQQ

SEQ ID NO: 178619 - protein, 14 aa, Borrelia afzelii
ELANKAIGKKIQQN

SEQ ID NO: 178620 - protein, 14 aa, Borrelia afzelii
LANKAIGKKIQQNG

SEQ ID NO: 178621 - protein, 14 aa, Borrelia afzelii
ANKAIGKKIQQNGL

SEQ ID NO: 178622 - protein, 14 aa, Borrelia afzelii
NKAIGKKIQQNGLG

SEQ ID NO: 178623 - protein, 14 aa, Borrelia afzelii
KAIGKKIQQNGLGA

SEQ ID NO: 178624 - protein, 14 aa, Borrelia afzelii
AIGKKIQQNGLGAE

SEQ ID NO: 178625 - protein, 14 aa, Borrelia afzelii
IGKKIQQNGLGAEA

SEQ ID NO: 178626 - protein, 14 aa, Borrelia afzelii
GKKIQQNGLGAEAN

SEQ ID NO: 178627 - protein, 14 aa, Borrelia afzelii
KKIQQNGLGAEANR

SEQ ID NO: 178628 - protein, 14 aa, Borrelia afzelii
KIQQNGLGAEANRN

SEQ ID NO: 178629 - protein, 14 aa, Borrelia afzelii
IQQNGLGAEANRNE

SEQ ID NO: 178630 - protein, 14 aa, Borrelia afzelii
QQNGLGAEANRNES

SEQ ID NO: 178631 - protein, 14 aa, Borrelia afzelii
QNGLGAEANRNESL

SEQ ID NO: 178632 - protein, 14 aa, Borrelia afzelii
NGLGAEANRNESLL

SEQ ID NO: 178633 - protein, 14 aa, Borrelia afzelii
GLGAEANRNESLLA

SEQ ID NO: 178634 - protein, 14 aa, Borrelia afzelii
LGAEANRNESLLAG

SEQ ID NO: 178635 - protein, 14 aa, Borrelia afzelii
GAEANRNESLLAGV

SEQ ID NO: 178636 - protein, 14 aa, Borrelia afzelii
AEANRNESLLAGVH

SEQ ID NO: 178637 - protein, 14 aa, Borrelia afzelii
EANRNESLLAGVHE

SEQ ID NO: 178638 - protein, 14 aa, Borrelia afzelii
ANRNESLLAGVHEI

SEQ ID NO: 178639 - protein, 14 aa, Borrelia afzelii
NRNESLLAGVHEIS

SEQ ID NO: 178640 - protein, 14 aa, Borrelia afzelii
RNESLLAGVHEIST

SEQ ID NO: 178641 - protein, 14 aa, Borrelia afzelii
NESLLAGVHEISTL

SEQ ID NO: 178642 - protein, 14 aa, Borrelia afzelii
ESLLAGVHEISTLI

SEQ ID NO: 178643 - protein, 14 aa, Borrelia afzelii
SLLAGVHEISTLIT

SEQ ID NO: 178644 - protein, 14 aa, Borrelia afzelii
LLAGVHEISTLITE

SEQ ID NO: 178645 - protein, 14 aa, Borrelia afzelii
LAGVHEISTLITEK

SEQ ID NO: 178646 - protein, 14 aa, Borrelia afzelii
AGVHEISTLITEKL

SEQ ID NO: 178647 - protein, 14 aa, Borrelia afzelii
GVHEISTLITEKLS

SEQ ID NO: 178648 - protein, 14 aa, Borrelia afzelii
VHEISTLITEKLSK

SEQ ID NO: 178649 - protein, 14 aa, Borrelia afzelii
HEISTLITEKLSKL

SEQ ID NO: 178650 - protein, 14 aa, Borrelia afzelii
EISTLITEKLSKLK

SEQ ID NO: 178651 - protein, 14 aa, Borrelia afzelii
ISTLITEKLSKLKN

SEQ ID NO: 178652 - protein, 14 aa, Borrelia afzelii
STLITEKLSKLKNS

SEQ ID NO: 178653 - protein, 14 aa, Borrelia afzelii
TLITEKLSKLKNSG

SEQ ID NO: 178654 - protein, 14 aa, Borrelia afzelii
LITEKLSKLKNSGE

SEQ ID NO: 178655 - protein, 14 aa, Borrelia afzelii
ITEKLSKLKNSGEL

SEQ ID NO: 178656 - protein, 14 aa, Borrelia afzelii
TEKLSKLKNSGELK

SEQ ID NO: 178657 - protein, 14 aa, Borrelia afzelii
EKLSKLKNSGELKA

SEQ ID NO: 178658 - protein, 14 aa, Borrelia afzelii
KLSKLKNSGELKAK

SEQ ID NO: 178659 - protein, 14 aa, Borrelia afzelii
LSKLKNSGELKAKI

SEQ ID NO: 178660 - protein, 14 aa, Borrelia afzelii
SKLKNSGELKAKIE

SEQ ID NO: 178661 - protein, 14 aa, Borrelia afzelii
KLKNSGELKAKIED

SEQ ID NO: 178662 - protein, 14 aa, Borrelia afzelii
LKNSGELKAKIEDA

SEQ ID NO: 178663 - protein, 14 aa, Borrelia afzelii
KNSGELKAKIEDAK

SEQ ID NO: 178664 - protein, 14 aa, Borrelia afzelii
NSGELKAKIEDAKK

SEQ ID NO: 178665 - protein, 14 aa, Borrelia afzelii
SGELKAKIEDAKKC

SEQ ID NO: 178666 - protein, 14 aa, Borrelia afzelii
GELKAKIEDAKKCS

SEQ ID NO: 178667 - protein, 14 aa, Borrelia afzelii
ELKAKIEDAKKCSE

SEQ ID NO: 178668 - protein, 14 aa, Borrelia afzelii
LKAKIEDAKKCSEE

SEQ ID NO: 178669 - protein, 14 aa, Borrelia afzelii
KAKIEDAKKCSEEF

SEQ ID NO: 178670 - protein, 14 aa, Borrelia afzelii
AKIEDAKKCSEEFT

SEQ ID NO: 178671 - protein, 14 aa, Borrelia afzelii
KIEDAKKCSEEFTN

SEQ ID NO: 178672 - protein, 14 aa, Borrelia afzelii
IEDAKKCSEEFTNK

SEQ ID NO: 178673 - protein, 14 aa, Borrelia afzelii
EDAKKCSEEFTNKL

SEQ ID NO: 178674 - protein, 14 aa, Borrelia afzelii
DAKKCSEEFTNKLR

SEQ ID NO: 178675 - protein, 14 aa, Borrelia afzelii
AKKCSEEFTNKLRV

SEQ ID NO: 178676 - protein, 14 aa, Borrelia afzelii
KKCSEEFTNKLRVS

SEQ ID NO: 178677 - protein, 14 aa, Borrelia afzelii
KCSEEFTNKLRVSH

SEQ ID NO: 178678 - protein, 14 aa, Borrelia afzelii
CSEEFTNKLRVSHA

SEQ ID NO: 178679 - protein, 14 aa, Borrelia afzelii
SEEFTNKLRVSHAD

SEQ ID NO: 178680 - protein, 14 aa, Borrelia afzelii
EEFTNKLRVSHADL

SEQ ID NO: 178681 - protein, 14 aa, Borrelia afzelii
EFTNKLRVSHADLG

SEQ ID NO: 178682 - protein, 14 aa, Borrelia afzelii
FTNKLRVSHADLGK

SEQ ID NO: 178683 - protein, 14 aa, Borrelia afzelii
TNKLRVSHADLGKQ

SEQ ID NO: 178684 - protein, 14 aa, Borrelia afzelii
NKLRVSHADLGKQG

SEQ ID NO: 178685 - protein, 14 aa, Borrelia afzelii
KLRVSHADLGKQGV

SEQ ID NO: 178686 - protein, 14 aa, Borrelia afzelii
LRVSHADLGKQGVN

SEQ ID NO: 178687 - protein, 14 aa, Borrelia afzelii
RVSHADLGKQGVND

SEQ ID NO: 178688 - protein, 14 aa, Borrelia afzelii
VSHADLGKQGVNDD

SEQ ID NO: 178689 - protein, 14 aa, Borrelia afzelii
SHADLGKQGVNDDD

SEQ ID NO: 178690 - protein, 14 aa, Borrelia afzelii
HADLGKQGVNDDDA

SEQ ID NO: 178691 - protein, 14 aa, Borrelia afzelii
ADLGKQGVNDDDAK

SEQ ID NO: 178692 - protein, 14 aa, Borrelia afzelii
DLGKQGVNDDDAKK

SEQ ID NO: 178693 - protein, 14 aa, Borrelia afzelii
LGKQGVNDDDAKKA

SEQ ID NO: 178694 - protein, 14 aa, Borrelia afzelii
GKQGVNDDDAKKAI

SEQ ID NO: 178695 - protein, 14 aa, Borrelia afzelii
KQGVNDDDAKKAIL

SEQ ID NO: 178696 - protein, 14 aa, Borrelia afzelii
QGVNDDDAKKAILK

SEQ ID NO: 178697 - protein, 14 aa, Borrelia afzelii
GVNDDDAKKAILKT

SEQ ID NO: 178698 - protein, 14 aa, Borrelia afzelii
VNDDDAKKAILKTN

SEQ ID NO: 178699 - protein, 14 aa, Borrelia afzelii
NDDDAKKAILKTNA

SEQ ID NO: 178700 - protein, 14 aa, Borrelia afzelii
DDDAKKAILKTNAD

SEQ ID NO: 178701 - protein, 14 aa, Borrelia afzelii
DDAKKAILKTNADK

SEQ ID NO: 178702 - protein, 14 aa, Borrelia afzelii
DAKKAILKTNADKT

SEQ ID NO: 178703 - protein, 14 aa, Borrelia afzelii
AKKAILKTNADKTK

SEQ ID NO: 178704 - protein, 14 aa, Borrelia afzelii
KKAILKTNADKTKG

SEQ ID NO: 178705 - protein, 14 aa, Borrelia afzelii
KAILKTNADKTKGA

SEQ ID NO: 178706 - protein, 14 aa, Borrelia afzelii
AILKTNADKTKGAE

SEQ ID NO: 178707 - protein, 14 aa, Borrelia afzelii
ILKTNADKTKGAEE

SEQ ID NO: 178708 - protein, 14 aa, Borrelia afzelii
LKTNADKTKGAEEL

SEQ ID NO: 178709 - protein, 14 aa, Borrelia afzelii
KTNADKTKGAEELG

SEQ ID NO: 178710 - protein, 14 aa, Borrelia afzelii
TNADKTKGAEELGK

SEQ ID NO: 178711 - protein, 14 aa, Borrelia afzelii
NADKTKGAEELGKL

SEQ ID NO: 178712 - protein, 14 aa, Borrelia afzelii
ADKTKGAEELGKLF

SEQ ID NO: 178713 - protein, 14 aa, Borrelia afzelii
DKTKGAEELGKLFK

SEQ ID NO: 178714 - protein, 14 aa, Borrelia afzelii
KTKGAEELGKLFKS

SEQ ID NO: 178715 - protein, 14 aa, Borrelia afzelii
TKGAEELGKLFKSV

SEQ ID NO: 178716 - protein, 14 aa, Borrelia afzelii
KGAEELGKLFKSVE

SEQ ID NO: 178717 - protein, 14 aa, Borrelia afzelii
GAEELGKLFKSVEG

SEQ ID NO: 178718 - protein, 14 aa, Borrelia afzelii
AEELGKLFKSVEGL

SEQ ID NO: 178719 - protein, 14 aa, Borrelia afzelii
EELGKLFKSVEGLV

SEQ ID NO: 178720 - protein, 14 aa, Borrelia afzelii
ELGKLFKSVEGLVK

SEQ ID NO: 178721 - protein, 14 aa, Borrelia afzelii
LGKLFKSVEGLVKA

SEQ ID NO: 178722 - protein, 14 aa, Borrelia afzelii
GKLFKSVEGLVKAA

SEQ ID NO: 178723 - protein, 14 aa, Borrelia afzelii
KLFKSVEGLVKAAQ

SEQ ID NO: 178724 - protein, 14 aa, Borrelia afzelii
LFKSVEGLVKAAQE

SEQ ID NO: 178725 - protein, 14 aa, Borrelia afzelii
FKSVEGLVKAAQEA

SEQ ID NO: 178726 - protein, 14 aa, Borrelia afzelii
KSVEGLVKAAQEAL

SEQ ID NO: 178727 - protein, 14 aa, Borrelia afzelii
SVEGLVKAAQEALT

SEQ ID NO: 178728 - protein, 14 aa, Borrelia afzelii
VEGLVKAAQEALTN

SEQ ID NO: 178729 - protein, 14 aa, Borrelia afzelii
EGLVKAAQEALTNS

SEQ ID NO: 178730 - protein, 14 aa, Borrelia afzelii
GLVKAAQEALTNSV

SEQ ID NO: 178731 - protein, 14 aa, Borrelia afzelii
LVKAAQEALTNSVK

SEQ ID NO: 178732 - protein, 14 aa, Borrelia afzelii
VKAAQEALTNSVKE

SEQ ID NO: 178733 - protein, 14 aa, Borrelia afzelii
KAAQEALTNSVKEL

SEQ ID NO: 178734 - protein, 14 aa, Borrelia afzelii
AAQEALTNSVKELT

SEQ ID NO: 178735 - protein, 14 aa, Borrelia afzelii
AQEALTNSVKELTS

SEQ ID NO: 178736 - protein, 14 aa, Borrelia afzelii
QEALTNSVKELTSP

SEQ ID NO: 178737 - protein, 14 aa, Borrelia afzelii
EALTNSVKELTSPV

SEQ ID NO: 178738 - protein, 14 aa, Borrelia afzelii
ALTNSVKELTSPVV

SEQ ID NO: 178739 - protein, 14 aa, Borrelia afzelii
LTNSVKELTSPVVA

SEQ ID NO: 178740 - protein, 14 aa, Borrelia afzelii
TNSVKELTSPVVAE

SEQ ID NO: 178741 - protein, 14 aa, Borrelia afzelii
NSVKELTSPVVAES

SEQ ID NO: 178742 - protein, 14 aa, Borrelia afzelii
SVKELTSPVVAESP

SEQ ID NO: 178743 - protein, 14 aa, Borrelia afzelii
VKELTSPVVAESPK

SEQ ID NO: 178744 - protein, 14 aa, Borrelia afzelii
KELTSPVVAESPKK

SEQ ID NO: 178745 - protein, 14 aa, Borrelia afzelii
ELTSPVVAESPKKP

SEQ ID NO: 178746 - protein, 15 aa, Borrelia afzelii
MKKNTLSAILMTLFL

SEQ ID NO: 178747 - protein, 15 aa, Borrelia afzelii
KKNTLSAILMTLFLF

SEQ ID NO: 178748 - protein, 15 aa, Borrelia afzelii
KNTLSAILMTLFLFI

SEQ ID NO: 178749 - protein, 15 aa, Borrelia afzelii
NTLSAILMTLFLFIS

SEQ ID NO: 178750 - protein, 15 aa, Borrelia afzelii
TLSAILMTLFLFISC

SEQ ID NO: 178751 - protein, 15 aa, Borrelia afzelii
LSAILMTLFLFISCN

SEQ ID NO: 178752 - protein, 15 aa, Borrelia afzelii
SAILMTLFLFISCNN

SEQ ID NO: 178753 - protein, 15 aa, Borrelia afzelii
AILMTLFLFISCNNS

SEQ ID NO: 178754 - protein, 15 aa, Borrelia afzelii
ILMTLFLFISCNNSG

SEQ ID NO: 178755 - protein, 15 aa, Borrelia afzelii
LMTLFLFISCNNSGK

SEQ ID NO: 178756 - protein, 15 aa, Borrelia afzelii
MTLFLFISCNNSGKG

SEQ ID NO: 178757 - protein, 15 aa, Borrelia afzelii
TLFLFISCNNSGKGG

SEQ ID NO: 178758 - protein, 15 aa, Borrelia afzelii
LFLFISCNNSGKGGD

SEQ ID NO: 178759 - protein, 15 aa, Borrelia afzelii
FLFISCNNSGKGGDS

SEQ ID NO: 178760 - protein, 15 aa, Borrelia afzelii
LFISCNNSGKGGDSA

SEQ ID NO: 178761 - protein, 15 aa, Borrelia afzelii
FISCNNSGKGGDSAS

SEQ ID NO: 178762 - protein, 15 aa, Borrelia afzelii
ISCNNSGKGGDSAST

SEQ ID NO: 178763 - protein, 15 aa, Borrelia afzelii
SCNNSGKGGDSASTN

SEQ ID NO: 178764 - protein, 15 aa, Borrelia afzelii
CNNSGKGGDSASTNP

SEQ ID NO: 178765 - protein, 15 aa, Borrelia afzelii
NNSGKGGDSASTNPA

SEQ ID NO: 178766 - protein, 15 aa, Borrelia afzelii
NSGKGGDSASTNPAD

SEQ ID NO: 178767 - protein, 15 aa, Borrelia afzelii
SGKGGDSASTNPADE

SEQ ID NO: 178768 - protein, 15 aa, Borrelia afzelii
GKGGDSASTNPADES

SEQ ID NO: 178769 - protein, 15 aa, Borrelia afzelii
KGGDSASTNPADESA

SEQ ID NO: 178770 - protein, 15 aa, Borrelia afzelii
GGDSASTNPADESAK

SEQ ID NO: 178771 - protein, 15 aa, Borrelia afzelii
GDSASTNPADESAKG

SEQ ID NO: 178772 - protein, 15 aa, Borrelia afzelii
DSASTNPADESAKGP

SEQ ID NO: 178773 - protein, 15 aa, Borrelia afzelii
SASTNPADESAKGPN

SEQ ID NO: 178774 - protein, 15 aa, Borrelia afzelii
ASTNPADESAKGPNL

SEQ ID NO: 178775 - protein, 15 aa, Borrelia afzelii
STNPADESAKGPNLT

SEQ ID NO: 178776 - protein, 15 aa, Borrelia afzelii
TNPADESAKGPNLTE

SEQ ID NO: 178777 - protein, 15 aa, Borrelia afzelii
NPADESAKGPNLTEI

SEQ ID NO: 178778 - protein, 15 aa, Borrelia afzelii
PADESAKGPNLTEIS

SEQ ID NO: 178779 - protein, 15 aa, Borrelia afzelii
ADESAKGPNLTEISK

SEQ ID NO: 178780 - protein, 15 aa, Borrelia afzelii
DESAKGPNLTEISKK

SEQ ID NO: 178781 - protein, 15 aa, Borrelia afzelii
ESAKGPNLTEISKKI

SEQ ID NO: 178782 - protein, 15 aa, Borrelia afzelii
SAKGPNLTEISKKIT

SEQ ID NO: 178783 - protein, 15 aa, Borrelia afzelii
AKGPNLTEISKKITD

SEQ ID NO: 178784 - protein, 15 aa, Borrelia afzelii
KGPNLTEISKKITDS

SEQ ID NO: 178785 - protein, 15 aa, Borrelia afzelii
GPNLTEISKKITDSN

SEQ ID NO: 178786 - protein, 15 aa, Borrelia afzelii
PNLTEISKKITDSNA

SEQ ID NO: 178787 - protein, 15 aa, Borrelia afzelii
NLTEISKKITDSNAF

SEQ ID NO: 178788 - protein, 15 aa, Borrelia afzelii
LTEISKKITDSNAFV

SEQ ID NO: 178789 - protein, 15 aa, Borrelia afzelii
TEISKKITDSNAFVL

SEQ ID NO: 178790 - protein, 15 aa, Borrelia afzelii
EISKKITDSNAFVLA

SEQ ID NO: 178791 - protein, 15 aa, Borrelia afzelii
ISKKITDSNAFVLAV

SEQ ID NO: 178792 - protein, 15 aa, Borrelia afzelii
SKKITDSNAFVLAVK

SEQ ID NO: 178793 - protein, 15 aa, Borrelia afzelii
KKITDSNAFVLAVKE

SEQ ID NO: 178794 - protein, 15 aa, Borrelia afzelii
KITDSNAFVLAVKEV

SEQ ID NO: 178795 - protein, 15 aa, Borrelia afzelii
ITDSNAFVLAVKEVE

SEQ ID NO: 178796 - protein, 15 aa, Borrelia afzelii
TDSNAFVLAVKEVET

SEQ ID NO: 178797 - protein, 15 aa, Borrelia afzelii
DSNAFVLAVKEVETL

SEQ ID NO: 178798 - protein, 15 aa, Borrelia afzelii
SNAFVLAVKEVETLV

SEQ ID NO: 178799 - protein, 15 aa, Borrelia afzelii
NAFVLAVKEVETLVS

SEQ ID NO: 178800 - protein, 15 aa, Borrelia afzelii
AFVLAVKEVETLVSS

SEQ ID NO: 178801 - protein, 15 aa, Borrelia afzelii
FVLAVKEVETLVSSI

SEQ ID NO: 178802 - protein, 15 aa, Borrelia afzelii
VLAVKEVETLVSSID

SEQ ID NO: 178803 - protein, 15 aa, Borrelia afzelii
LAVKEVETLVSSIDE

SEQ ID NO: 178804 - protein, 15 aa, Borrelia afzelii
AVKEVETLVSSIDEL

SEQ ID NO: 178805 - protein, 15 aa, Borrelia afzelii
VKEVETLVSSIDELA

SEQ ID NO: 178806 - protein, 15 aa, Borrelia afzelii
KEVETLVSSIDELAN

SEQ ID NO: 178807 - protein, 15 aa, Borrelia afzelii
EVETLVSSIDELANK

SEQ ID NO: 178808 - protein, 15 aa, Borrelia afzelii
VETLVSSIDELANKA

SEQ ID NO: 178809 - protein, 15 aa, Borrelia afzelii
ETLVSSIDELANKAI

SEQ ID NO: 178810 - protein, 15 aa, Borrelia afzelii
TLVSSIDELANKAIG

SEQ ID NO: 178811 - protein, 15 aa, Borrelia afzelii
LVSSIDELANKAIGK

SEQ ID NO: 178812 - protein, 15 aa, Borrelia afzelii
VSSIDELANKAIGKK

SEQ ID NO: 178813 - protein, 15 aa, Borrelia afzelii
SSIDELANKAIGKKI

SEQ ID NO: 178814 - protein, 15 aa, Borrelia afzelii
SIDELANKAIGKKIQ

SEQ ID NO: 178815 - protein, 15 aa, Borrelia afzelii
IDELANKAIGKKIQQ

SEQ ID NO: 178816 - protein, 15 aa, Borrelia afzelii
DELANKAIGKKIQQN

SEQ ID NO: 178817 - protein, 15 aa, Borrelia afzelii
ELANKAIGKKIQQNG

SEQ ID NO: 178818 - protein, 15 aa, Borrelia afzelii
LANKAIGKKIQQNGL

SEQ ID NO: 178819 - protein, 15 aa, Borrelia afzelii
ANKAIGKKIQQNGLG

SEQ ID NO: 178820 - protein, 15 aa, Borrelia afzelii
NKAIGKKIQQNGLGA

SEQ ID NO: 178821 - protein, 15 aa, Borrelia afzelii
KAIGKKIQQNGLGAE

SEQ ID NO: 178822 - protein, 15 aa, Borrelia afzelii
AIGKKIQQNGLGAEA

SEQ ID NO: 178823 - protein, 15 aa, Borrelia afzelii
IGKKIQQNGLGAEAN

SEQ ID NO: 178824 - protein, 15 aa, Borrelia afzelii
GKKIQQNGLGAEANR

SEQ ID NO: 178825 - protein, 15 aa, Borrelia afzelii
KKIQQNGLGAEANRN

SEQ ID NO: 178826 - protein, 15 aa, Borrelia afzelii
KIQQNGLGAEANRNE

SEQ ID NO: 178827 - protein, 15 aa, Borrelia afzelii
IQQNGLGAEANRNES

SEQ ID NO: 178828 - protein, 15 aa, Borrelia afzelii
QQNGLGAEANRNESL

SEQ ID NO: 178829 - protein, 15 aa, Borrelia afzelii
QNGLGAEANRNESLL

SEQ ID NO: 178830 - protein, 15 aa, Borrelia afzelii
NGLGAEANRNESLLA

SEQ ID NO: 178831 - protein, 15 aa, Borrelia afzelii
GLGAEANRNESLLAG

SEQ ID NO: 178832 - protein, 15 aa, Borrelia afzelii
LGAEANRNESLLAGV

SEQ ID NO: 178833 - protein, 15 aa, Borrelia afzelii
GAEANRNESLLAGVH

SEQ ID NO: 178834 - protein, 15 aa, Borrelia afzelii
AEANRNESLLAGVHE

SEQ ID NO: 178835 - protein, 15 aa, Borrelia afzelii
EANRNESLLAGVHEI

SEQ ID NO: 178836 - protein, 15 aa, Borrelia afzelii
ANRNESLLAGVHEIS

SEQ ID NO: 178837 - protein, 15 aa, Borrelia afzelii
NRNESLLAGVHEIST

SEQ ID NO: 178838 - protein, 15 aa, Borrelia afzelii
RNESLLAGVHEISTL

SEQ ID NO: 178839 - protein, 15 aa, Borrelia afzelii
NESLLAGVHEISTLI

SEQ ID NO: 178840 - protein, 15 aa, Borrelia afzelii
ESLLAGVHEISTLIT

SEQ ID NO: 178841 - protein, 15 aa, Borrelia afzelii
SLLAGVHEISTLITE

SEQ ID NO: 178842 - protein, 15 aa, Borrelia afzelii
LLAGVHEISTLITEK

SEQ ID NO: 178843 - protein, 15 aa, Borrelia afzelii
LAGVHEISTLITEKL

SEQ ID NO: 178844 - protein, 15 aa, Borrelia afzelii
AGVHEISTLITEKLS

SEQ ID NO: 178845 - protein, 15 aa, Borrelia afzelii
GVHEISTLITEKLSK

SEQ ID NO: 178846 - protein, 15 aa, Borrelia afzelii
VHEISTLITEKLSKL

SEQ ID NO: 178847 - protein, 15 aa, Borrelia afzelii
HEISTLITEKLSKLK

SEQ ID NO: 178848 - protein, 15 aa, Borrelia afzelii
EISTLITEKLSKLKN

SEQ ID NO: 178849 - protein, 15 aa, Borrelia afzelii
ISTLITEKLSKLKNS

SEQ ID NO: 178850 - protein, 15 aa, Borrelia afzelii
STLITEKLSKLKNSG

SEQ ID NO: 178851 - protein, 15 aa, Borrelia afzelii
TLITEKLSKLKNSGE

SEQ ID NO: 178852 - protein, 15 aa, Borrelia afzelii
LITEKLSKLKNSGEL

SEQ ID NO: 178853 - protein, 15 aa, Borrelia afzelii
ITEKLSKLKNSGELK

SEQ ID NO: 178854 - protein, 15 aa, Borrelia afzelii
TEKLSKLKNSGELKA

SEQ ID NO: 178855 - protein, 15 aa, Borrelia afzelii
EKLSKLKNSGELKAK

SEQ ID NO: 178856 - protein, 15 aa, Borrelia afzelii
KLSKLKNSGELKAKI

SEQ ID NO: 178857 - protein, 15 aa, Borrelia afzelii
LSKLKNSGELKAKIE

SEQ ID NO: 178858 - protein, 15 aa, Borrelia afzelii
SKLKNSGELKAKIED

SEQ ID NO: 178859 - protein, 15 aa, Borrelia afzelii
KLKNSGELKAKIEDA

SEQ ID NO: 178860 - protein, 15 aa, Borrelia afzelii
LKNSGELKAKIEDAK

SEQ ID NO: 178861 - protein, 15 aa, Borrelia afzelii
KNSGELKAKIEDAKK

SEQ ID NO: 178862 - protein, 15 aa, Borrelia afzelii
NSGELKAKIEDAKKC

SEQ ID NO: 178863 - protein, 15 aa, Borrelia afzelii
SGELKAKIEDAKKCS

SEQ ID NO: 178864 - protein, 15 aa, Borrelia afzelii
GELKAKIEDAKKCSE

SEQ ID NO: 178865 - protein, 15 aa, Borrelia afzelii
ELKAKIEDAKKCSEE

SEQ ID NO: 178866 - protein, 15 aa, Borrelia afzelii
LKAKIEDAKKCSEEF

SEQ ID NO: 178867 - protein, 15 aa, Borrelia afzelii
KAKIEDAKKCSEEFT

SEQ ID NO: 178868 - protein, 15 aa, Borrelia afzelii
AKIEDAKKCSEEFTN

SEQ ID NO: 178869 - protein, 15 aa, Borrelia afzelii
KIEDAKKCSEEFTNK

SEQ ID NO: 178870 - protein, 15 aa, Borrelia afzelii
IEDAKKCSEEFTNKL

SEQ ID NO: 178871 - protein, 15 aa, Borrelia afzelii
EDAKKCSEEFTNKLR

SEQ ID NO: 178872 - protein, 15 aa, Borrelia afzelii
DAKKCSEEFTNKLRV

SEQ ID NO: 178873 - protein, 15 aa, Borrelia afzelii
AKKCSEEFTNKLRVS

SEQ ID NO: 178874 - protein, 15 aa, Borrelia afzelii
KKCSEEFTNKLRVSH

SEQ ID NO: 178875 - protein, 15 aa, Borrelia afzelii
KCSEEFTNKLRVSHA

SEQ ID NO: 178876 - protein, 15 aa, Borrelia afzelii
CSEEFTNKLRVSHAD

SEQ ID NO: 178877 - protein, 15 aa, Borrelia afzelii
SEEFTNKLRVSHADL

SEQ ID NO: 178878 - protein, 15 aa, Borrelia afzelii
EEFTNKLRVSHADLG

SEQ ID NO: 178879 - protein, 15 aa, Borrelia afzelii
EFTNKLRVSHADLGK

SEQ ID NO: 178880 - protein, 15 aa, Borrelia afzelii
FTNKLRVSHADLGKQ

SEQ ID NO: 178881 - protein, 15 aa, Borrelia afzelii
TNKLRVSHADLGKQG

SEQ ID NO: 178882 - protein, 15 aa, Borrelia afzelii
NKLRVSHADLGKQGV

SEQ ID NO: 178883 - protein, 15 aa, Borrelia afzelii
KLRVSHADLGKQGVN

SEQ ID NO: 178884 - protein, 15 aa, Borrelia afzelii
LRVSHADLGKQGVND

SEQ ID NO: 178885 - protein, 15 aa, Borrelia afzelii
RVSHADLGKQGVNDD

SEQ ID NO: 178886 - protein, 15 aa, Borrelia afzelii
VSHADLGKQGVNDDD

SEQ ID NO: 178887 - protein, 15 aa, Borrelia afzelii
SHADLGKQGVNDDDA

SEQ ID NO: 178888 - protein, 15 aa, Borrelia afzelii
HADLGKQGVNDDDAK

SEQ ID NO: 178889 - protein, 15 aa, Borrelia afzelii
ADLGKQGVNDDDAKK

SEQ ID NO: 178890 - protein, 15 aa, Borrelia afzelii
DLGKQGVNDDDAKKA

SEQ ID NO: 178891 - protein, 15 aa, Borrelia afzelii
LGKQGVNDDDAKKAI

SEQ ID NO: 178892 - protein, 15 aa, Borrelia afzelii
GKQGVNDDDAKKAIL

SEQ ID NO: 178893 - protein, 15 aa, Borrelia afzelii
KQGVNDDDAKKAILK

SEQ ID NO: 178894 - protein, 15 aa, Borrelia afzelii
QGVNDDDAKKAILKT

SEQ ID NO: 178895 - protein, 15 aa, Borrelia afzelii
GVNDDDAKKAILKTN

SEQ ID NO: 178896 - protein, 15 aa, Borrelia afzelii
VNDDDAKKAILKTNA

SEQ ID NO: 178897 - protein, 15 aa, Borrelia afzelii
NDDDAKKAILKTNAD

SEQ ID NO: 178898 - protein, 15 aa, Borrelia afzelii
DDDAKKAILKTNADK

SEQ ID NO: 178899 - protein, 15 aa, Borrelia afzelii
DDAKKAILKTNADKT

SEQ ID NO: 178900 - protein, 15 aa, Borrelia afzelii
DAKKAILKTNADKTK

SEQ ID NO: 178901 - protein, 15 aa, Borrelia afzelii
AKKAILKTNADKTKG

SEQ ID NO: 178902 - protein, 15 aa, Borrelia afzelii
KKAILKTNADKTKGA

SEQ ID NO: 178903 - protein, 15 aa, Borrelia afzelii
KAILKTNADKTKGAE

SEQ ID NO: 178904 - protein, 15 aa, Borrelia afzelii
AILKTNADKTKGAEE

SEQ ID NO: 178905 - protein, 15 aa, Borrelia afzelii
ILKTNADKTKGAEEL

SEQ ID NO: 178906 - protein, 15 aa, Borrelia afzelii
LKTNADKTKGAEELG

SEQ ID NO: 178907 - protein, 15 aa, Borrelia afzelii
KTNADKTKGAEELGK

SEQ ID NO: 178908 - protein, 15 aa, Borrelia afzelii
TNADKTKGAEELGKL

SEQ ID NO: 178909 - protein, 15 aa, Borrelia afzelii
NADKTKGAEELGKLF

SEQ ID NO: 178910 - protein, 15 aa, Borrelia afzelii
ADKTKGAEELGKLFK

SEQ ID NO: 178911 - protein, 15 aa, Borrelia afzelii
DKTKGAEELGKLFKS

SEQ ID NO: 178912 - protein, 15 aa, Borrelia afzelii
KTKGAEELGKLFKSV

SEQ ID NO: 178913 - protein, 15 aa, Borrelia afzelii
TKGAEELGKLFKSVE

SEQ ID NO: 178914 - protein, 15 aa, Borrelia afzelii
KGAEELGKLFKSVEG

SEQ ID NO: 178915 - protein, 15 aa, Borrelia afzelii
GAEELGKLFKSVEGL

SEQ ID NO: 178916 - protein, 15 aa, Borrelia afzelii
AEELGKLFKSVEGLV

SEQ ID NO: 178917 - protein, 15 aa, Borrelia afzelii
EELGKLFKSVEGLVK

SEQ ID NO: 178918 - protein, 15 aa, Borrelia afzelii
ELGKLFKSVEGLVKA

SEQ ID NO: 178919 - protein, 15 aa, Borrelia afzelii
LGKLFKSVEGLVKAA

SEQ ID NO: 178920 - protein, 15 aa, Borrelia afzelii
GKLFKSVEGLVKAAQ

SEQ ID NO: 178921 - protein, 15 aa, Borrelia afzelii
KLFKSVEGLVKAAQE

SEQ ID NO: 178922 - protein, 15 aa, Borrelia afzelii
LFKSVEGLVKAAQEA

SEQ ID NO: 178923 - protein, 15 aa, Borrelia afzelii
FKSVEGLVKAAQEAL

SEQ ID NO: 178924 - protein, 15 aa, Borrelia afzelii
KSVEGLVKAAQEALT

SEQ ID NO: 178925 - protein, 15 aa, Borrelia afzelii
SVEGLVKAAQEALTN

SEQ ID NO: 178926 - protein, 15 aa, Borrelia afzelii
VEGLVKAAQEALTNS

SEQ ID NO: 178927 - protein, 15 aa, Borrelia afzelii
EGLVKAAQEALTNSV

SEQ ID NO: 178928 - protein, 15 aa, Borrelia afzelii
GLVKAAQEALTNSVK

SEQ ID NO: 178929 - protein, 15 aa, Borrelia afzelii
LVKAAQEALTNSVKE

SEQ ID NO: 178930 - protein, 15 aa, Borrelia afzelii
VKAAQEALTNSVKEL

SEQ ID NO: 178931 - protein, 15 aa, Borrelia afzelii
KAAQEALTNSVKELT

SEQ ID NO: 178932 - protein, 15 aa, Borrelia afzelii
AAQEALTNSVKELTS

SEQ ID NO: 178933 - protein, 15 aa, Borrelia afzelii
AQEALTNSVKELTSP

SEQ ID NO: 178934 - protein, 15 aa, Borrelia afzelii
QEALTNSVKELTSPV

SEQ ID NO: 178935 - protein, 15 aa, Borrelia afzelii
EALTNSVKELTSPVV

SEQ ID NO: 178936 - protein, 15 aa, Borrelia afzelii
ALTNSVKELTSPVVA

SEQ ID NO: 178937 - protein, 15 aa, Borrelia afzelii
LTNSVKELTSPVVAE

SEQ ID NO: 178938 - protein, 15 aa, Borrelia afzelii
TNSVKELTSPVVAES

SEQ ID NO: 178939 - protein, 15 aa, Borrelia afzelii
NSVKELTSPVVAESP

SEQ ID NO: 178940 - protein, 15 aa, Borrelia afzelii
SVKELTSPVVAESPK

SEQ ID NO: 178941 - protein, 15 aa, Borrelia afzelii
VKELTSPVVAESPKK

SEQ ID NO: 178942 - protein, 15 aa, Borrelia afzelii
KELTSPVVAESPKKP

SEQ ID NO: 178943 - protein, 16 aa, Borrelia afzelii
MKKNTLSAILMTLFLF

SEQ ID NO: 178944 - protein, 16 aa, Borrelia afzelii
KKNTLSAILMTLFLFI

SEQ ID NO: 178945 - protein, 16 aa, Borrelia afzelii
KNTLSAILMTLFLFIS

SEQ ID NO: 178946 - protein, 16 aa, Borrelia afzelii
NTLSAILMTLFLFISC

SEQ ID NO: 178947 - protein, 16 aa, Borrelia afzelii
TLSAILMTLFLFISCN

SEQ ID NO: 178948 - protein, 16 aa, Borrelia afzelii
LSAILMTLFLFISCNN

SEQ ID NO: 178949 - protein, 16 aa, Borrelia afzelii
SAILMTLFLFISCNNS

SEQ ID NO: 178950 - protein, 16 aa, Borrelia afzelii
AILMTLFLFISCNNSG

SEQ ID NO: 178951 - protein, 16 aa, Borrelia afzelii
ILMTLFLFISCNNSGK

SEQ ID NO: 178952 - protein, 16 aa, Borrelia afzelii
LMTLFLFISCNNSGKG

SEQ ID NO: 178953 - protein, 16 aa, Borrelia afzelii
MTLFLFISCNNSGKGG

SEQ ID NO: 178954 - protein, 16 aa, Borrelia afzelii
TLFLFISCNNSGKGGD

SEQ ID NO: 178955 - protein, 16 aa, Borrelia afzelii
LFLFISCNNSGKGGDS

SEQ ID NO: 178956 - protein, 16 aa, Borrelia afzelii
FLFISCNNSGKGGDSA

SEQ ID NO: 178957 - protein, 16 aa, Borrelia afzelii
LFISCNNSGKGGDSAS

SEQ ID NO: 178958 - protein, 16 aa, Borrelia afzelii
FISCNNSGKGGDSAST

SEQ ID NO: 178959 - protein, 16 aa, Borrelia afzelii
ISCNNSGKGGDSASTN

SEQ ID NO: 178960 - protein, 16 aa, Borrelia afzelii
SCNNSGKGGDSASTNP

SEQ ID NO: 178961 - protein, 16 aa, Borrelia afzelii
CNNSGKGGDSASTNPA

SEQ ID NO: 178962 - protein, 16 aa, Borrelia afzelii
NNSGKGGDSASTNPAD

SEQ ID NO: 178963 - protein, 16 aa, Borrelia afzelii
NSGKGGDSASTNPADE

SEQ ID NO: 178964 - protein, 16 aa, Borrelia afzelii
SGKGGDSASTNPADES

SEQ ID NO: 178965 - protein, 16 aa, Borrelia afzelii
GKGGDSASTNPADESA

SEQ ID NO: 178966 - protein, 16 aa, Borrelia afzelii
KGGDSASTNPADESAK

SEQ ID NO: 178967 - protein, 16 aa, Borrelia afzelii
GGDSASTNPADESAKG

SEQ ID NO: 178968 - protein, 16 aa, Borrelia afzelii
GDSASTNPADESAKGP

SEQ ID NO: 178969 - protein, 16 aa, Borrelia afzelii
DSASTNPADESAKGPN

SEQ ID NO: 178970 - protein, 16 aa, Borrelia afzelii
SASTNPADESAKGPNL

SEQ ID NO: 178971 - protein, 16 aa, Borrelia afzelii
ASTNPADESAKGPNLT

SEQ ID NO: 178972 - protein, 16 aa, Borrelia afzelii
STNPADESAKGPNLTE

SEQ ID NO: 178973 - protein, 16 aa, Borrelia afzelii
TNPADESAKGPNLTEI

SEQ ID NO: 178974 - protein, 16 aa, Borrelia afzelii
NPADESAKGPNLTEIS

SEQ ID NO: 178975 - protein, 16 aa, Borrelia afzelii
PADESAKGPNLTEISK

SEQ ID NO: 178976 - protein, 16 aa, Borrelia afzelii
ADESAKGPNLTEISKK

SEQ ID NO: 178977 - protein, 16 aa, Borrelia afzelii
DESAKGPNLTEISKKI

SEQ ID NO: 178978 - protein, 16 aa, Borrelia afzelii
ESAKGPNLTEISKKIT

SEQ ID NO: 178979 - protein, 16 aa, Borrelia afzelii
SAKGPNLTEISKKITD

SEQ ID NO: 178980 - protein, 16 aa, Borrelia afzelii
AKGPNLTEISKKITDS

SEQ ID NO: 178981 - protein, 16 aa, Borrelia afzelii
KGPNLTEISKKITDSN

SEQ ID NO: 178982 - protein, 16 aa, Borrelia afzelii
GPNLTEISKKITDSNA

SEQ ID NO: 178983 - protein, 16 aa, Borrelia afzelii
PNLTEISKKITDSNAF

SEQ ID NO: 178984 - protein, 16 aa, Borrelia afzelii
NLTEISKKITDSNAFV

SEQ ID NO: 178985 - protein, 16 aa, Borrelia afzelii
LTEISKKITDSNAFVL

SEQ ID NO: 178986 - protein, 16 aa, Borrelia afzelii
TEISKKITDSNAFVLA

SEQ ID NO: 178987 - protein, 16 aa, Borrelia afzelii
EISKKITDSNAFVLAV

SEQ ID NO: 178988 - protein, 16 aa, Borrelia afzelii
ISKKITDSNAFVLAVK

SEQ ID NO: 178989 - protein, 16 aa, Borrelia afzelii
SKKITDSNAFVLAVKE

SEQ ID NO: 178990 - protein, 16 aa, Borrelia afzelii
KKITDSNAFVLAVKEV

SEQ ID NO: 178991 - protein, 16 aa, Borrelia afzelii
KITDSNAFVLAVKEVE

SEQ ID NO: 178992 - protein, 16 aa, Borrelia afzelii
ITDSNAFVLAVKEVET

SEQ ID NO: 178993 - protein, 16 aa, Borrelia afzelii
TDSNAFVLAVKEVETL

SEQ ID NO: 178994 - protein, 16 aa, Borrelia afzelii
DSNAFVLAVKEVETLV

SEQ ID NO: 178995 - protein, 16 aa, Borrelia afzelii
SNAFVLAVKEVETLVS

SEQ ID NO: 178996 - protein, 16 aa, Borrelia afzelii
NAFVLAVKEVETLVSS

SEQ ID NO: 178997 - protein, 16 aa, Borrelia afzelii
AFVLAVKEVETLVSSI

SEQ ID NO: 178998 - protein, 16 aa, Borrelia afzelii
FVLAVKEVETLVSSID

SEQ ID NO: 178999 - protein, 16 aa, Borrelia afzelii
VLAVKEVETLVSSIDE

SEQ ID NO: 179000 - protein, 16 aa, Borrelia afzelii
LAVKEVETLVSSIDEL

SEQ ID NO: 179001 - protein, 16 aa, Borrelia afzelii
AVKEVETLVSSIDELA

SEQ ID NO: 179002 - protein, 16 aa, Borrelia afzelii
VKEVETLVSSIDELAN

SEQ ID NO: 179003 - protein, 16 aa, Borrelia afzelii
KEVETLVSSIDELANK

SEQ ID NO: 179004 - protein, 16 aa, Borrelia afzelii
EVETLVSSIDELANKA

SEQ ID NO: 179005 - protein, 16 aa, Borrelia afzelii
VETLVSSIDELANKAI

SEQ ID NO: 179006 - protein, 16 aa, Borrelia afzelii
ETLVSSIDELANKAIG

SEQ ID NO: 179007 - protein, 16 aa, Borrelia afzelii
TLVSSIDELANKAIGK

SEQ ID NO: 179008 - protein, 16 aa, Borrelia afzelii
LVSSIDELANKAIGKK

SEQ ID NO: 179009 - protein, 16 aa, Borrelia afzelii
VSSIDELANKAIGKKI

SEQ ID NO: 179010 - protein, 16 aa, Borrelia afzelii
SSIDELANKAIGKKIQ

SEQ ID NO: 179011 - protein, 16 aa, Borrelia afzelii
SIDELANKAIGKKIQQ

SEQ ID NO: 179012 - protein, 16 aa, Borrelia afzelii
IDELANKAIGKKIQQN

SEQ ID NO: 179013 - protein, 16 aa, Borrelia afzelii
DELANKAIGKKIQQNG

SEQ ID NO: 179014 - protein, 16 aa, Borrelia afzelii
ELANKAIGKKIQQNGL

SEQ ID NO: 179015 - protein, 16 aa, Borrelia afzelii
LANKAIGKKIQQNGLG

SEQ ID NO: 179016 - protein, 16 aa, Borrelia afzelii
ANKAIGKKIQQNGLGA

SEQ ID NO: 179017 - protein, 16 aa, Borrelia afzelii
NKAIGKKIQQNGLGAE

SEQ ID NO: 179018 - protein, 16 aa, Borrelia afzelii
KAIGKKIQQNGLGAEA

SEQ ID NO: 179019 - protein, 16 aa, Borrelia afzelii
AIGKKIQQNGLGAEAN

SEQ ID NO: 179020 - protein, 16 aa, Borrelia afzelii
IGKKIQQNGLGAEANR

SEQ ID NO: 179021 - protein, 16 aa, Borrelia afzelii
GKKIQQNGLGAEANRN

SEQ ID NO: 179022 - protein, 16 aa, Borrelia afzelii
KKIQQNGLGAEANRNE

SEQ ID NO: 179023 - protein, 16 aa, Borrelia afzelii
KIQQNGLGAEANRNES

SEQ ID NO: 179024 - protein, 16 aa, Borrelia afzelii
IQQNGLGAEANRNESL

SEQ ID NO: 179025 - protein, 16 aa, Borrelia afzelii
QQNGLGAEANRNESLL

SEQ ID NO: 179026 - protein, 16 aa, Borrelia afzelii
QNGLGAEANRNESLLA

SEQ ID NO: 179027 - protein, 16 aa, Borrelia afzelii
NGLGAEANRNESLLAG

SEQ ID NO: 179028 - protein, 16 aa, Borrelia afzelii
GLGAEANRNESLLAGV

SEQ ID NO: 179029 - protein, 16 aa, Borrelia afzelii
LGAEANRNESLLAGVH

SEQ ID NO: 179030 - protein, 16 aa, Borrelia afzelii
GAEANRNESLLAGVHE

SEQ ID NO: 179031 - protein, 16 aa, Borrelia afzelii
AEANRNESLLAGVHEI

SEQ ID NO: 179032 - protein, 16 aa, Borrelia afzelii
EANRNESLLAGVHEIS

SEQ ID NO: 179033 - protein, 16 aa, Borrelia afzelii
ANRNESLLAGVHEIST

SEQ ID NO: 179034 - protein, 16 aa, Borrelia afzelii
NRNESLLAGVHEISTL

SEQ ID NO: 179035 - protein, 16 aa, Borrelia afzelii
RNESLLAGVHEISTLI

SEQ ID NO: 179036 - protein, 16 aa, Borrelia afzelii
NESLLAGVHEISTLIT

SEQ ID NO: 179037 - protein, 16 aa, Borrelia afzelii
ESLLAGVHEISTLITE

SEQ ID NO: 179038 - protein, 16 aa, Borrelia afzelii
SLLAGVHEISTLITEK

SEQ ID NO: 179039 - protein, 16 aa, Borrelia afzelii
LLAGVHEISTLITEKL

SEQ ID NO: 179040 - protein, 16 aa, Borrelia afzelii
LAGVHEISTLITEKLS

SEQ ID NO: 179041 - protein, 16 aa, Borrelia afzelii
AGVHEISTLITEKLSK

SEQ ID NO: 179042 - protein, 16 aa, Borrelia afzelii
GVHEISTLITEKLSKL

SEQ ID NO: 179043 - protein, 16 aa, Borrelia afzelii
VHEISTLITEKLSKLK

SEQ ID NO: 179044 - protein, 16 aa, Borrelia afzelii
HEISTLITEKLSKLKN

SEQ ID NO: 179045 - protein, 16 aa, Borrelia afzelii
EISTLITEKLSKLKNS

SEQ ID NO: 179046 - protein, 16 aa, Borrelia afzelii
ISTLITEKLSKLKNSG

SEQ ID NO: 179047 - protein, 16 aa, Borrelia afzelii
STLITEKLSKLKNSGE

SEQ ID NO: 179048 - protein, 16 aa, Borrelia afzelii
TLITEKLSKLKNSGEL

SEQ ID NO: 179049 - protein, 16 aa, Borrelia afzelii
LITEKLSKLKNSGELK

SEQ ID NO: 179050 - protein, 16 aa, Borrelia afzelii
ITEKLSKLKNSGELKA

SEQ ID NO: 179051 - protein, 16 aa, Borrelia afzelii
TEKLSKLKNSGELKAK

SEQ ID NO: 179052 - protein, 16 aa, Borrelia afzelii
EKLSKLKNSGELKAKI

SEQ ID NO: 179053 - protein, 16 aa, Borrelia afzelii
KLSKLKNSGELKAKIE

SEQ ID NO: 179054 - protein, 16 aa, Borrelia afzelii
LSKLKNSGELKAKIED

SEQ ID NO: 179055 - protein, 16 aa, Borrelia afzelii
SKLKNSGELKAKIEDA

SEQ ID NO: 179056 - protein, 16 aa, Borrelia afzelii
KLKNSGELKAKIEDAK

SEQ ID NO: 179057 - protein, 16 aa, Borrelia afzelii
LKNSGELKAKIEDAKK

SEQ ID NO: 179058 - protein, 16 aa, Borrelia afzelii
KNSGELKAKIEDAKKC

SEQ ID NO: 179059 - protein, 16 aa, Borrelia afzelii
NSGELKAKIEDAKKCS

SEQ ID NO: 179060 - protein, 16 aa, Borrelia afzelii
SGELKAKIEDAKKCSE

SEQ ID NO: 179061 - protein, 16 aa, Borrelia afzelii
GELKAKIEDAKKCSEE

SEQ ID NO: 179062 - protein, 16 aa, Borrelia afzelii
ELKAKIEDAKKCSEEF

SEQ ID NO: 179063 - protein, 16 aa, Borrelia afzelii
LKAKIEDAKKCSEEFT

SEQ ID NO: 179064 - protein, 16 aa, Borrelia afzelii
KAKIEDAKKCSEEFTN

SEQ ID NO: 179065 - protein, 16 aa, Borrelia afzelii
AKIEDAKKCSEEFTNK

SEQ ID NO: 179066 - protein, 16 aa, Borrelia afzelii
KIEDAKKCSEEFTNKL

SEQ ID NO: 179067 - protein, 16 aa, Borrelia afzelii
IEDAKKCSEEFTNKLR

SEQ ID NO: 179068 - protein, 16 aa, Borrelia afzelii
EDAKKCSEEFTNKLRV

SEQ ID NO: 179069 - protein, 16 aa, Borrelia afzelii
DAKKCSEEFTNKLRVS

SEQ ID NO: 179070 - protein, 16 aa, Borrelia afzelii
AKKCSEEFTNKLRVSH

SEQ ID NO: 179071 - protein, 16 aa, Borrelia afzelii
KKCSEEFTNKLRVSHA

SEQ ID NO: 179072 - protein, 16 aa, Borrelia afzelii
KCSEEFTNKLRVSHAD

SEQ ID NO: 179073 - protein, 16 aa, Borrelia afzelii
CSEEFTNKLRVSHADL

SEQ ID NO: 179074 - protein, 16 aa, Borrelia afzelii
SEEFTNKLRVSHADLG

SEQ ID NO: 179075 - protein, 16 aa, Borrelia afzelii
EEFTNKLRVSHADLGK

SEQ ID NO: 179076 - protein, 16 aa, Borrelia afzelii
EFTNKLRVSHADLGKQ

SEQ ID NO: 179077 - protein, 16 aa, Borrelia afzelii
FTNKLRVSHADLGKQG

SEQ ID NO: 179078 - protein, 16 aa, Borrelia afzelii
TNKLRVSHADLGKQGV

SEQ ID NO: 179079 - protein, 16 aa, Borrelia afzelii
NKLRVSHADLGKQGVN

SEQ ID NO: 179080 - protein, 16 aa, Borrelia afzelii
KLRVSHADLGKQGVND

SEQ ID NO: 179081 - protein, 16 aa, Borrelia afzelii
LRVSHADLGKQGVNDD

SEQ ID NO: 179082 - protein, 16 aa, Borrelia afzelii
RVSHADLGKQGVNDDD

SEQ ID NO: 179083 - protein, 16 aa, Borrelia afzelii
VSHADLGKQGVNDDDA

SEQ ID NO: 179084 - protein, 16 aa, Borrelia afzelii
SHADLGKQGVNDDDAK

SEQ ID NO: 179085 - protein, 16 aa, Borrelia afzelii
HADLGKQGVNDDDAKK

SEQ ID NO: 179086 - protein, 16 aa, Borrelia afzelii
ADLGKQGVNDDDAKKA

SEQ ID NO: 179087 - protein, 16 aa, Borrelia afzelii
DLGKQGVNDDDAKKAI

SEQ ID NO: 179088 - protein, 16 aa, Borrelia afzelii
LGKQGVNDDDAKKAIL

SEQ ID NO: 179089 - protein, 16 aa, Borrelia afzelii
GKQGVNDDDAKKAILK

SEQ ID NO: 179090 - protein, 16 aa, Borrelia afzelii
KQGVNDDDAKKAILKT

SEQ ID NO: 179091 - protein, 16 aa, Borrelia afzelii
QGVNDDDAKKAILKTN

SEQ ID NO: 179092 - protein, 16 aa, Borrelia afzelii
GVNDDDAKKAILKTNA

SEQ ID NO: 179093 - protein, 16 aa, Borrelia afzelii
VNDDDAKKAILKTNAD

SEQ ID NO: 179094 - protein, 16 aa, Borrelia afzelii
NDDDAKKAILKTNADK

SEQ ID NO: 179095 - protein, 16 aa, Borrelia afzelii
DDDAKKAILKTNADKT

SEQ ID NO: 179096 - protein, 16 aa, Borrelia afzelii
DDAKKAILKTNADKTK

SEQ ID NO: 179097 - protein, 16 aa, Borrelia afzelii
DAKKAILKTNADKTKG

SEQ ID NO: 179098 - protein, 16 aa, Borrelia afzelii
AKKAILKTNADKTKGA

SEQ ID NO: 179099 - protein, 16 aa, Borrelia afzelii
KKAILKTNADKTKGAE

SEQ ID NO: 179100 - protein, 16 aa, Borrelia afzelii
KAILKTNADKTKGAEE

SEQ ID NO: 179101 - protein, 16 aa, Borrelia afzelii
AILKTNADKTKGAEEL

SEQ ID NO: 179102 - protein, 16 aa, Borrelia afzelii
ILKTNADKTKGAEELG

SEQ ID NO: 179103 - protein, 16 aa, Borrelia afzelii
LKTNADKTKGAEELGK

SEQ ID NO: 179104 - protein, 16 aa, Borrelia afzelii
KTNADKTKGAEELGKL

SEQ ID NO: 179105 - protein, 16 aa, Borrelia afzelii
TNADKTKGAEELGKLF

SEQ ID NO: 179106 - protein, 16 aa, Borrelia afzelii
NADKTKGAEELGKLFK

SEQ ID NO: 179107 - protein, 16 aa, Borrelia afzelii
ADKTKGAEELGKLFKS

SEQ ID NO: 179108 - protein, 16 aa, Borrelia afzelii
DKTKGAEELGKLFKSV

SEQ ID NO: 179109 - protein, 16 aa, Borrelia afzelii
KTKGAEELGKLFKSVE

SEQ ID NO: 179110 - protein, 16 aa, Borrelia afzelii
TKGAEELGKLFKSVEG

SEQ ID NO: 179111 - protein, 16 aa, Borrelia afzelii
KGAEELGKLFKSVEGL

SEQ ID NO: 179112 - protein, 16 aa, Borrelia afzelii
GAEELGKLFKSVEGLV

SEQ ID NO: 179113 - protein, 16 aa, Borrelia afzelii
AEELGKLFKSVEGLVK

SEQ ID NO: 179114 - protein, 16 aa, Borrelia afzelii
EELGKLFKSVEGLVKA

SEQ ID NO: 179115 - protein, 16 aa, Borrelia afzelii
ELGKLFKSVEGLVKAA

SEQ ID NO: 179116 - protein, 16 aa, Borrelia afzelii
LGKLFKSVEGLVKAAQ

SEQ ID NO: 179117 - protein, 16 aa, Borrelia afzelii
GKLFKSVEGLVKAAQE

SEQ ID NO: 179118 - protein, 16 aa, Borrelia afzelii
KLFKSVEGLVKAAQEA

SEQ ID NO: 179119 - protein, 16 aa, Borrelia afzelii
LFKSVEGLVKAAQEAL

SEQ ID NO: 179120 - protein, 16 aa, Borrelia afzelii
FKSVEGLVKAAQEALT

SEQ ID NO: 179121 - protein, 16 aa, Borrelia afzelii
KSVEGLVKAAQEALTN

SEQ ID NO: 179122 - protein, 16 aa, Borrelia afzelii
SVEGLVKAAQEALTNS

SEQ ID NO: 179123 - protein, 16 aa, Borrelia afzelii
VEGLVKAAQEALTNSV

SEQ ID NO: 179124 - protein, 16 aa, Borrelia afzelii
EGLVKAAQEALTNSVK

SEQ ID NO: 179125 - protein, 16 aa, Borrelia afzelii
GLVKAAQEALTNSVKE

SEQ ID NO: 179126 - protein, 16 aa, Borrelia afzelii
LVKAAQEALTNSVKEL

SEQ ID NO: 179127 - protein, 16 aa, Borrelia afzelii
VKAAQEALTNSVKELT

SEQ ID NO: 179128 - protein, 16 aa, Borrelia afzelii
KAAQEALTNSVKELTS

SEQ ID NO: 179129 - protein, 16 aa, Borrelia afzelii
AAQEALTNSVKELTSP

SEQ ID NO: 179130 - protein, 16 aa, Borrelia afzelii
AQEALTNSVKELTSPV

SEQ ID NO: 179131 - protein, 16 aa, Borrelia afzelii
QEALTNSVKELTSPVV

SEQ ID NO: 179132 - protein, 16 aa, Borrelia afzelii
EALTNSVKELTSPVVA

SEQ ID NO: 179133 - protein, 16 aa, Borrelia afzelii
ALTNSVKELTSPVVAE

SEQ ID NO: 179134 - protein, 16 aa, Borrelia afzelii
LTNSVKELTSPVVAES

SEQ ID NO: 179135 - protein, 16 aa, Borrelia afzelii
TNSVKELTSPVVAESP

SEQ ID NO: 179136 - protein, 16 aa, Borrelia afzelii
NSVKELTSPVVAESPK

SEQ ID NO: 179137 - protein, 16 aa, Borrelia afzelii
SVKELTSPVVAESPKK

SEQ ID NO: 179138 - protein, 16 aa, Borrelia afzelii
VKELTSPVVAESPKKP

SEQ ID NO: 179139 - protein, 9 aa, Borrelia burgdorferi
YLLGIGLIL

SEQ ID NO: 179140 - protein, 9 aa, Borrelia burgdorferi
FTLEGTLAA

SEQ ID NO: 179141 - protein, 9 aa, Borrelia burgdorferi
KTSTLTISV

SEQ ID NO: 179142 - protein, 9 aa, Borrelia burgdorferi
FTKEDTITV

SEQ ID NO: 179143 - protein, 9 aa, Borrelia burgdorferi
ALIACKQNV

SEQ ID NO: 179144 - protein, 9 aa, Borrelia burgdorferi
LLGIGLILA

SEQ ID NO: 179145 - protein, 9 aa, Borrelia burgdorferi
SLEATVDKL

SEQ ID NO: 179146 - protein, 9 aa, Borrelia burgdorferi
ILKSGEITV

SEQ ID NO: 179147 - protein, 9 aa, Borrelia burgdorferi
KVTEGTVVL

SEQ ID NO: 179148 - protein, 9 aa, Borrelia burgdorferi
STLDEKNSV

SEQ ID NO: 179149 - protein, 9 aa, Borrelia burgdorferi
TLVSKKVTL

SEQ ID NO: 179150 - protein, 9 aa, Borrelia burgdorferi
GIGLILALI

SEQ ID NO: 179151 - protein, 10 aa, Borrelia burgdorferi
YLLGIGLILA

SEQ ID NO: 179152 - protein, 10 aa, Borrelia burgdorferi
TLDEKNSVSV

SEQ ID NO: 179153 - protein, 10 aa, Borrelia burgdorferi
ALDDSDTTQA

SEQ ID NO: 179154 - protein, 10 aa, Borrelia burgdorferi
LLGIGLILAL

SEQ ID NO: 179155 - protein, 10 aa, Borrelia burgdorferi
NILKSGEITV

SEQ ID NO: 179156 - protein, 10 aa, Borrelia burgdorferi
TLAADGKTTL

SEQ ID NO: 179157 - protein, 10 aa, Borrelia burgdorferi
VLKDFTLEGT

SEQ ID NO: 179158 - protein, 10 aa, Borrelia burgdorferi
YSLEATVDKL

SEQ ID NO: 179159 - protein, 11 aa, Borrelia burgdorferi
YLLGIGLILAL

SEQ ID NO: 179160 - protein, 11 aa, Borrelia burgdorferi
LVFTKEDTITV

SEQ ID NO: 179161 - protein, 11 aa, Borrelia burgdorferi
LLGIGLILALI

SEQ ID NO: 179162 - protein, 11 aa, Borrelia burgdorferi
ILALIACKQNV

SEQ ID NO: 179163 - protein, 11 aa, Borrelia burgdorferi
STLDEKNSVSV

SEQ ID NO: 179164 - protein, 11 aa, Borrelia burgdorferi
ALDDSDTTQAT

SEQ ID NO: 179165 - protein, 11 aa, Borrelia burgdorferi
VLKDFTLEGTL

SEQ ID NO: 179166 - protein, 11 aa, Borrelia burgdorferi
SLEATVDKLEL

SEQ ID NO: 179167 - protein, 11 aa, Borrelia burgdorferi
ILKSGEITVAL

SEQ ID NO: 179168 - protein, 11 aa, Borrelia burgdorferi
ALIACKQNVST

SEQ ID NO: 179169 - protein, 11 aa, Borrelia burgdorferi
TTLKVTEGTVV

SEQ ID NO: 179170 - protein, 11 aa, Borrelia burgdorferi
LAADGKTTLKV

SEQ ID NO: 179171 - protein, 11 aa, Borrelia burgdorferi
LIACKQNVSTL

SEQ ID NO: 179172 - protein, 9 aa, Borrelia burgdorferi
VVLSKNILK

SEQ ID NO: 179173 - protein, 9 aa, Borrelia burgdorferi
KTKNLVFTK

SEQ ID NO: 179174 - protein, 9 aa, Borrelia burgdorferi
LVSKKVTLK

SEQ ID NO: 179175 - protein, 9 aa, Borrelia burgdorferi
LILALIACK

SEQ ID NO: 179176 - protein, 9 aa, Borrelia burgdorferi
LTISVNSQK

SEQ ID NO: 179177 - protein, 9 aa, Borrelia burgdorferi
KAVEITTLK

SEQ ID NO: 179178 - protein, 9 aa, Borrelia burgdorferi
AADGKTTLK

SEQ ID NO: 179179 - protein, 9 aa, Borrelia burgdorferi
ISVNSQKTK

SEQ ID NO: 179180 - protein, 9 aa, Borrelia burgdorferi
RANGTRLEY

SEQ ID NO: 179181 - protein, 9 aa, Borrelia burgdorferi
SQTKFEIFK

SEQ ID NO: 179182 - protein, 9 aa, Borrelia burgdorferi
KSDGSGKAK

SEQ ID NO: 179183 - protein, 9 aa, Borrelia burgdorferi
TQATKKTGK

SEQ ID NO: 179184 - protein, 9 aa, Borrelia burgdorferi
MTELVSKEK

SEQ ID NO: 179185 - protein, 10 aa, Borrelia burgdorferi
TLVSKKVTLK

SEQ ID NO: 179186 - protein, 10 aa, Borrelia burgdorferi
TLTISVNSQK

SEQ ID NO: 179187 - protein, 10 aa, Borrelia burgdorferi
TVVLSKNILK

SEQ ID NO: 179188 - protein, 10 aa, Borrelia burgdorferi
GLILALIACK

SEQ ID NO: 179189 - protein, 10 aa, Borrelia burgdorferi
TLKELKNALK

SEQ ID NO: 179190 - protein, 10 aa, Borrelia burgdorferi
LSQTKFEIFK

SEQ ID NO: 179191 - protein, 10 aa, Borrelia burgdorferi
LAADGKTTLK

SEQ ID NO: 179192 - protein, 10 aa, Borrelia burgdorferi
VTEGTVVLSK

SEQ ID NO: 179193 - protein, 10 aa, Borrelia burgdorferi
KLELKGTSDK

SEQ ID NO: 179194 - protein, 10 aa, Borrelia burgdorferi
TTQATKKTGK

SEQ ID NO: 179195 - protein, 10 aa, Borrelia burgdorferi
GMTELVSKEK

SEQ ID NO: 179196 - protein, 10 aa, Borrelia burgdorferi
KYSLEATVDK

SEQ ID NO: 179197 - protein, 10 aa, Borrelia burgdorferi
KQNVSTLDEK

SEQ ID NO: 179198 - protein, 10 aa, Borrelia burgdorferi
TIADDLSQTK

SEQ ID NO: 179199 - protein, 10 aa, Borrelia burgdorferi
TISVNSQKTK

SEQ ID NO: 179200 - protein, 10 aa, Borrelia burgdorferi
KEDAKTLVSK

SEQ ID NO: 179201 - protein, 10 aa, Borrelia burgdorferi
GSGKAKEVLK

SEQ ID NO: 179202 - protein, 10 aa, Borrelia burgdorferi
KTIVRANGTR

SEQ ID NO: 179203 - protein, 10 aa, Borrelia burgdorferi
GTLEGEKTDK

SEQ ID NO: 179204 - protein, 10 aa, Borrelia burgdorferi
GKAVEITTLK

SEQ ID NO: 179205 - protein, 10 aa, Borrelia burgdorferi
GTRLEYTDIK

SEQ ID NO: 179206 - protein, 10 aa, Borrelia burgdorferi
VSKKVTLKDK

SEQ ID NO: 179207 - protein, 10 aa, Borrelia burgdorferi
IKSDGSGKAK

SEQ ID NO: 179208 - protein, 11 aa, Borrelia burgdorferi
TLAADGKTTLK

SEQ ID NO: 179209 - protein, 11 aa, Borrelia burgdorferi
STLTISVNSQK

SEQ ID NO: 179210 - protein, 11 aa, Borrelia burgdorferi
KTLVSKKVTLK

SEQ ID NO: 179211 - protein, 11 aa, Borrelia burgdorferi
KVTEGTVVLSK

SEQ ID NO: 179212 - protein, 11 aa, Borrelia burgdorferi
TTLKELKNALK

SEQ ID NO: 179213 - protein, 11 aa, Borrelia burgdorferi
LTISVNSQKTK

SEQ ID NO: 179214 - protein, 11 aa, Borrelia burgdorferi
GTVVLSKNILK

SEQ ID NO: 179215 - protein, 11 aa, Borrelia burgdorferi
FTKEDTITVQK

SEQ ID NO: 179216 - protein, 11 aa, Borrelia burgdorferi
IVRANGTRLEY

SEQ ID NO: 179217 - protein, 11 aa, Borrelia burgdorferi
TLKDKSSTEEK

SEQ ID NO: 179218 - protein, 11 aa, Borrelia burgdorferi
LVSKKVTLKDK

SEQ ID NO: 179219 - protein, 11 aa, Borrelia burgdorferi
KFNEKGETSEK

SEQ ID NO: 179220 - protein, 11 aa, Borrelia burgdorferi
LTIADDLSQTK

SEQ ID NO: 179221 - protein, 11 aa, Borrelia burgdorferi
SQKTKNLVFTK

SEQ ID NO: 179222 - protein, 11 aa, Borrelia burgdorferi
KSSTEEKFNEK

SEQ ID NO: 179223 - protein, 11 aa, Borrelia burgdorferi
ATKKTGKWDSK

SEQ ID NO: 179224 - protein, 9 aa, Borrelia burgdorferi
VVLSKNILK

SEQ ID NO: 179225 - protein, 9 aa, Borrelia burgdorferi
KTKNLVFTK

SEQ ID NO: 179226 - protein, 9 aa, Borrelia burgdorferi
SQTKFEIFK

SEQ ID NO: 179227 - protein, 9 aa, Borrelia burgdorferi
LTISVNSQK

SEQ ID NO: 179228 - protein, 9 aa, Borrelia burgdorferi
ATVDKLELK

SEQ ID NO: 179229 - protein, 9 aa, Borrelia burgdorferi
LILALIACK

SEQ ID NO: 179230 - protein, 9 aa, Borrelia burgdorferi
STEEKFNEK

SEQ ID NO: 179231 - protein, 9 aa, Borrelia burgdorferi
KAVEITTLK

SEQ ID NO: 179232 - protein, 9 aa, Borrelia burgdorferi
LVSKKVTLK

SEQ ID NO: 179233 - protein, 9 aa, Borrelia burgdorferi
MTELVSKEK

SEQ ID NO: 179234 - protein, 9 aa, Borrelia burgdorferi
AADGKTTLK

SEQ ID NO: 179235 - protein, 9 aa, Borrelia burgdorferi
SAGTNLEGK

SEQ ID NO: 179236 - protein, 9 aa, Borrelia burgdorferi
YSLEATVDK

SEQ ID NO: 179237 - protein, 9 aa, Borrelia burgdorferi
GSGTLEGEK

SEQ ID NO: 179238 - protein, 9 aa, Borrelia burgdorferi
TQATKKTGK

SEQ ID NO: 179239 - protein, 9 aa, Borrelia burgdorferi
RANGTRLEY

SEQ ID NO: 179240 - protein, 9 aa, Borrelia burgdorferi
IADDLSQTK

SEQ ID NO: 179241 - protein, 9 aa, Borrelia burgdorferi
ISVNSQKTK

SEQ ID NO: 179242 - protein, 9 aa, Borrelia burgdorferi
KSDGSGKAK

SEQ ID NO: 179243 - protein, 9 aa, Borrelia burgdorferi
GGMTELVSK

SEQ ID NO: 179244 - protein, 9 aa, Borrelia burgdorferi
TEGTVVLSK

SEQ ID NO: 179245 - protein, 9 aa, Borrelia burgdorferi
EITTLKELK

SEQ ID NO: 179246 - protein, 9 aa, Borrelia burgdorferi
TIVRANGTR

SEQ ID NO: 179247 - protein, 10 aa, Borrelia burgdorferi
TVVLSKNILK

SEQ ID NO: 179248 - protein, 10 aa, Borrelia burgdorferi
TTQATKKTGK

SEQ ID NO: 179249 - protein, 10 aa, Borrelia burgdorferi
TIADDLSQTK

SEQ ID NO: 179250 - protein, 10 aa, Borrelia burgdorferi
VTEGTVVLSK

SEQ ID NO: 179251 - protein, 10 aa, Borrelia burgdorferi
LSQTKFEIFK

SEQ ID NO: 179252 - protein, 10 aa, Borrelia burgdorferi
SSTEEKFNEK

SEQ ID NO: 179253 - protein, 10 aa, Borrelia burgdorferi
GLILALIACK

SEQ ID NO: 179254 - protein, 10 aa, Borrelia burgdorferi
KQNVSTLDEK

SEQ ID NO: 179255 - protein, 10 aa, Borrelia burgdorferi
TLTISVNSQK

SEQ ID NO: 179256 - protein, 10 aa, Borrelia burgdorferi
TLVSKKVTLK

SEQ ID NO: 179257 - protein, 10 aa, Borrelia burgdorferi
TISVNSQKTK

SEQ ID NO: 179258 - protein, 10 aa, Borrelia burgdorferi
LAADGKTTLK

SEQ ID NO: 179259 - protein, 10 aa, Borrelia burgdorferi
GMTELVSKEK

SEQ ID NO: 179260 - protein, 10 aa, Borrelia burgdorferi
TLKELKNALK

SEQ ID NO: 179261 - protein, 10 aa, Borrelia burgdorferi
KTIVRANGTR

SEQ ID NO: 179262 - protein, 10 aa, Borrelia burgdorferi
GSGKAKEVLK

SEQ ID NO: 179263 - protein, 10 aa, Borrelia burgdorferi
GTLEGEKTDK

SEQ ID NO: 179264 - protein, 10 aa, Borrelia burgdorferi
VSKKVTLKDK

SEQ ID NO: 179265 - protein, 10 aa, Borrelia burgdorferi
GTRLEYTDIK

SEQ ID NO: 179266 - protein, 10 aa, Borrelia burgdorferi
KLELKGTSDK

SEQ ID NO: 179267 - protein, 10 aa, Borrelia burgdorferi
DSAGTNLEGK

SEQ ID NO: 179268 - protein, 11 aa, Borrelia burgdorferi
STLTISVNSQK

SEQ ID NO: 179269 - protein, 11 aa, Borrelia burgdorferi
TTLKELKNALK

SEQ ID NO: 179270 - protein, 11 aa, Borrelia burgdorferi
KVTEGTVVLSK

SEQ ID NO: 179271 - protein, 11 aa, Borrelia burgdorferi
KTLVSKKVTLK

SEQ ID NO: 179272 - protein, 11 aa, Borrelia burgdorferi
GTVVLSKNILK

SEQ ID NO: 179273 - protein, 11 aa, Borrelia burgdorferi
LTIADDLSQTK

SEQ ID NO: 179274 - protein, 11 aa, Borrelia burgdorferi
TLAADGKTTLK

SEQ ID NO: 179275 - protein, 11 aa, Borrelia burgdorferi
AVEITTLKELK

SEQ ID NO: 179276 - protein, 11 aa, Borrelia burgdorferi
LTISVNSQKTK

SEQ ID NO: 179277 - protein, 11 aa, Borrelia burgdorferi
SQKTKNLVFTK

SEQ ID NO: 179278 - protein, 11 aa, Borrelia burgdorferi
KSSTEEKFNEK

SEQ ID NO: 179279 - protein, 11 aa, Borrelia burgdorferi
ATKKTGKWDSK

SEQ ID NO: 179280 - protein, 11 aa, Borrelia burgdorferi
TLKDKSSTEEK

SEQ ID NO: 179281 - protein, 11 aa, Borrelia burgdorferi
FTKEDTITVQK

SEQ ID NO: 179282 - protein, 11 aa, Borrelia burgdorferi
TLEGTLAADGK

SEQ ID NO: 179283 - protein, 11 aa, Borrelia burgdorferi
LVSKKVTLKDK

SEQ ID NO: 179284 - protein, 11 aa, Borrelia burgdorferi
MTELVSKEKDK

SEQ ID NO: 179285 - protein, 11 aa, Borrelia burgdorferi
DLSQTKFEIFK

SEQ ID NO: 179286 - protein, 11 aa, Borrelia burgdorferi
YTDIKSDGSGK

SEQ ID NO: 179287 - protein, 11 aa, Borrelia burgdorferi
LVSKEKDKDGK

SEQ ID NO: 179288 - protein, 11 aa, Borrelia burgdorferi
KFNEKGETSEK

SEQ ID NO: 179289 - protein, 11 aa, Borrelia burgdorferi
IGLILALIACK

SEQ ID NO: 179290 - protein, 9 aa, Borrelia burgdorferi
KYLLGIGLI

SEQ ID NO: 179291 - protein, 9 aa, Borrelia burgdorferi
KWDSKTSTL

SEQ ID NO: 179292 - protein, 9 aa, Borrelia burgdorferi
KYDSAGTNL

SEQ ID NO: 179293 - protein, 10 aa, Borrelia burgdorferi
KYLLGIGLIL

SEQ ID NO: 179294 - protein, 11 aa, Borrelia burgdorferi
KWDSKTSTLTI

SEQ ID NO: 179295 - protein, 11 aa, Borrelia burgdorferi
KYSLEATVDKL

SEQ ID NO: 179296 - protein, 11 aa, Borrelia burgdorferi
IVRANGTRLEY

SEQ ID NO: 179297 - protein, 11 aa, Borrelia burgdorferi
TIADDLSQTKF

SEQ ID NO: 179298 - protein, 9 aa, Borrelia burgdorferi
LTISVNSQK

SEQ ID NO: 179299 - protein, 9 aa, Borrelia burgdorferi
ETSEKTIVR

SEQ ID NO: 179300 - protein, 9 aa, Borrelia burgdorferi
MTELVSKEK

SEQ ID NO: 179301 - protein, 9 aa, Borrelia burgdorferi
EITTLKELK

SEQ ID NO: 179302 - protein, 9 aa, Borrelia burgdorferi
TIVRANGTR

SEQ ID NO: 179303 - protein, 9 aa, Borrelia burgdorferi
KAVEITTLK

SEQ ID NO: 179304 - protein, 9 aa, Borrelia burgdorferi
DAKTLVSKK

SEQ ID NO: 179305 - protein, 9 aa, Borrelia burgdorferi
KTKNLVFTK

SEQ ID NO: 179306 - protein, 9 aa, Borrelia burgdorferi
STEEKFNEK

SEQ ID NO: 179307 - protein, 9 aa, Borrelia burgdorferi
ATVDKLELK

SEQ ID NO: 179308 - protein, 9 aa, Borrelia burgdorferi
LVSKKVTLK

SEQ ID NO: 179309 - protein, 9 aa, Borrelia burgdorferi
SQTKFEIFK

SEQ ID NO: 179310 - protein, 9 aa, Borrelia burgdorferi
YSLEATVDK

SEQ ID NO: 179311 - protein, 9 aa, Borrelia burgdorferi
EGTLAADGK

SEQ ID NO: 179312 - protein, 9 aa, Borrelia burgdorferi
ISVNSQKTK

SEQ ID NO: 179313 - protein, 9 aa, Borrelia burgdorferi
LILALIACK

SEQ ID NO: 179314 - protein, 9 aa, Borrelia burgdorferi
DIKSDGSGK

SEQ ID NO: 179315 - protein, 9 aa, Borrelia burgdorferi
VVLSKNILK

SEQ ID NO: 179316 - protein, 9 aa, Borrelia burgdorferi
EDAKTLVSK

SEQ ID NO: 179317 - protein, 9 aa, Borrelia burgdorferi
DSDTTQATK

SEQ ID NO: 179318 - protein, 9 aa, Borrelia burgdorferi
SAGTNLEGK

SEQ ID NO: 179319 - protein, 10 aa, Borrelia burgdorferi
TVVLSKNILK

SEQ ID NO: 179320 - protein, 10 aa, Borrelia burgdorferi
TLTISVNSQK

SEQ ID NO: 179321 - protein, 10 aa, Borrelia burgdorferi
EATVDKLELK

SEQ ID NO: 179322 - protein, 10 aa, Borrelia burgdorferi
TIADDLSQTK

SEQ ID NO: 179323 - protein, 10 aa, Borrelia burgdorferi
DSAGTNLEGK

SEQ ID NO: 179324 - protein, 10 aa, Borrelia burgdorferi
TTQATKKTGK

SEQ ID NO: 179325 - protein, 10 aa, Borrelia burgdorferi
LAADGKTTLK

SEQ ID NO: 179326 - protein, 10 aa, Borrelia burgdorferi
KTIVRANGTR

SEQ ID NO: 179327 - protein, 10 aa, Borrelia burgdorferi
TISVNSQKTK

SEQ ID NO: 179328 - protein, 10 aa, Borrelia burgdorferi
TLVSKKVTLK

SEQ ID NO: 179329 - protein, 10 aa, Borrelia burgdorferi
SSTEEKFNEK

SEQ ID NO: 179330 - protein, 10 aa, Borrelia burgdorferi
TLKELKNALK

SEQ ID NO: 179331 - protein, 10 aa, Borrelia burgdorferi
LSQTKFEIFK

SEQ ID NO: 179332 - protein, 10 aa, Borrelia burgdorferi
VTEGTVVLSK

SEQ ID NO: 179333 - protein, 10 aa, Borrelia burgdorferi
EDAKTLVSKK

SEQ ID NO: 179334 - protein, 10 aa, Borrelia burgdorferi
DSDTTQATKK

SEQ ID NO: 179335 - protein, 10 aa, Borrelia burgdorferi
GLILALIACK

SEQ ID NO: 179336 - protein, 9 aa, Borrelia burgdorferi
IVRANGTRL

SEQ ID NO: 179337 - protein, 9 aa, Borrelia burgdorferi
KVTEGTVVL

SEQ ID NO: 179338 - protein, 9 aa, Borrelia burgdorferi
LAADGKTTL

SEQ ID NO: 179339 - protein, 9 aa, Borrelia burgdorferi
LPGGMTELV

SEQ ID NO: 179340 - protein, 9 aa, Borrelia burgdorferi
TVVLSKNIL

SEQ ID NO: 179341 - protein, 11 aa, Borrelia burgdorferi
KAVEITTLKEL

SEQ ID NO: 179342 - protein, 9 aa, Borrelia burgdorferi
TLKELKNAL

SEQ ID NO: 179343 - protein, 11 aa, Borrelia burgdorferi
ILKSGEITVAL

SEQ ID NO: 179344 - protein, 11 aa, Borrelia burgdorferi
YLLGIGLILAL

SEQ ID NO: 179345 - protein, 11 aa, Borrelia burgdorferi
TLKVTEGTVVL

SEQ ID NO: 179346 - protein, 9 aa, Borrelia burgdorferi
SQKTKNLVF

SEQ ID NO: 179347 - protein, 9 aa, Borrelia burgdorferi
RANGTRLEY

SEQ ID NO: 179348 - protein, 9 aa, Borrelia burgdorferi
YLLGIGLIL

SEQ ID NO: 179349 - protein, 9 aa, Borrelia burgdorferi
KVTEGTVVL

SEQ ID NO: 179350 - protein, 9 aa, Borrelia burgdorferi
TLKELKNAL

SEQ ID NO: 179351 - protein, 9 aa, Borrelia burgdorferi
KAKEVLKDF

SEQ ID NO: 179352 - protein, 9 aa, Borrelia burgdorferi
IVRANGTRL

SEQ ID NO: 179353 - protein, 9 aa, Borrelia burgdorferi
LGIGLILAL

SEQ ID NO: 179354 - protein, 10 aa, Borrelia burgdorferi
TLAADGKTTL

SEQ ID NO: 179355 - protein, 11 aa, Borrelia burgdorferi
IVRANGTRLEY

SEQ ID NO: 179356 - protein, 11 aa, Borrelia burgdorferi
YLLGIGLILAL

SEQ ID NO: 179357 - protein, 11 aa, Borrelia burgdorferi
VQKYDSAGTNL

SEQ ID NO: 179358 - protein, 11 aa, Borrelia burgdorferi
ILKSGEITVAL

SEQ ID NO: 179359 - protein, 11 aa, Borrelia burgdorferi
VSKEKDKDGKY

SEQ ID NO: 179360 - protein, 11 aa, Borrelia burgdorferi
VLKDFTLEGTL

SEQ ID NO: 179361 - protein, 11 aa, Borrelia burgdorferi
TLKVTEGTVVL

SEQ ID NO: 179362 - protein, 11 aa, Borrelia burgdorferi
VNSQKTKNLVF

SEQ ID NO: 179363 - protein, 9 aa, Borrelia burgdorferi
KKYLLGIGL

SEQ ID NO: 179364 - protein, 10 aa, Borrelia burgdorferi
VRANGTRLEY

SEQ ID NO: 179365 - protein, 10 aa, Borrelia burgdorferi
GKWDSKTSTL

SEQ ID NO: 179366 - protein, 11 aa, Borrelia burgdorferi
KKYLLGIGLIL

SEQ ID NO: 179367 - protein, 9 aa, Borrelia burgdorferi
LAADGKTTL

SEQ ID NO: 179368 - protein, 9 aa, Borrelia burgdorferi
RANGTRLEY

SEQ ID NO: 179369 - protein, 9 aa, Borrelia burgdorferi
FTLEGTLAA

SEQ ID NO: 179370 - protein, 9 aa, Borrelia burgdorferi
TVVLSKNIL

SEQ ID NO: 179371 - protein, 9 aa, Borrelia burgdorferi
VALDDSDTT

SEQ ID NO: 179372 - protein, 9 aa, Borrelia burgdorferi
YLLGIGLIL

SEQ ID NO: 179373 - protein, 9 aa, Borrelia burgdorferi
LPGGMTELV

SEQ ID NO: 179374 - protein, 10 aa, Borrelia burgdorferi
IADDLSQTKF

SEQ ID NO: 179375 - protein, 10 aa, Borrelia burgdorferi
LPGGMTELVS

SEQ ID NO: 179376 - protein, 10 aa, Borrelia burgdorferi
LKVTEGTVVL

SEQ ID NO: 179377 - protein, 10 aa, Borrelia burgdorferi
YSLEATVDKL

SEQ ID NO: 179378 - protein, 11 aa, Borrelia burgdorferi
YLLGIGLILAL

SEQ ID NO: 179379 - protein, 11 aa, Borrelia burgdorferi
NSVSVDLPGGM

SEQ ID NO: 179380 - protein, 11 aa, Borrelia burgdorferi
IVRANGTRLEY

SEQ ID NO: 179381 - protein, 11 aa, Borrelia burgdorferi
TIADDLSQTKF

SEQ ID NO: 179382 - protein, 11 aa, Borrelia burgdorferi
KAVEITTLKEL

SEQ ID NO: 179383 - protein, 9 aa, Borrelia burgdorferi
KEVLKDFTL

SEQ ID NO: 179384 - protein, 9 aa, Borrelia burgdorferi
GEITVALDD

SEQ ID NO: 179385 - protein, 9 aa, Borrelia burgdorferi
KEKDKDGKY

SEQ ID NO: 179386 - protein, 9 aa, Borrelia burgdorferi
KEDAKTLVS

SEQ ID NO: 179387 - protein, 10 aa, Borrelia burgdorferi
GEITVALDDS

SEQ ID NO: 179388 - protein, 10 aa, Borrelia burgdorferi
KEDTITVQKY

SEQ ID NO: 179389 - protein, 11 aa, Borrelia burgdorferi
GEITVALDDSD

SEQ ID NO: 179390 - protein, 11 aa, Borrelia burgdorferi
KEVLKDFTLEG

SEQ ID NO: 179391 - protein, 9 aa, Borrelia burgdorferi
LPGGMTELV

SEQ ID NO: 179392 - protein, 11 aa, Borrelia burgdorferi
TTQATKKTGKW

SEQ ID NO: 179393 - protein, 11 aa, Borrelia garinii
NQDEAIAVNIY

SEQ ID NO: 179394 - protein, 11 aa, Borrelia garinii
ELAVQSGNGTY

SEQ ID NO: 179395 - protein, 9 aa, Borrelia garinii
SQASWTLRV

SEQ ID NO: 179396 - protein, 9 aa, Borrelia garinii
QLTDEINRI

SEQ ID NO: 179397 - protein, 9 aa, Borrelia garinii
AQAAQTAPV

SEQ ID NO: 179398 - protein, 9 aa, Borrelia garinii
AIAVNIYAA

SEQ ID NO: 179399 - protein, 9 aa, Borrelia garinii
SLAKIENAI

SEQ ID NO: 179400 - protein, 9 aa, Borrelia garinii
AVNIYAANV

SEQ ID NO: 179401 - protein, 9 aa, Borrelia garinii
AQYNQMHML

SEQ ID NO: 179402 - protein, 9 aa, Borrelia garinii
TTVDANTSL

SEQ ID NO: 179403 - protein, 9 aa, Borrelia garinii
SQGGVNSPV

SEQ ID NO: 179404 - protein, 9 aa, Borrelia garinii
QTAPVQEGV

SEQ ID NO: 179405 - protein, 10 aa, Borrelia garinii
NIYAANVANL

SEQ ID NO: 179406 - protein, 10 aa, Borrelia garinii
NLNEVEKVLV

SEQ ID NO: 179407 - protein, 10 aa, Borrelia garinii
VLVRMKELAV

SEQ ID NO: 179408 - protein, 10 aa, Borrelia garinii
QLTDEINRIA

SEQ ID NO: 179409 - protein, 10 aa, Borrelia garinii
NLFSGEGAQA

SEQ ID NO: 179410 - protein, 10 aa, Borrelia garinii
IAVNIYAANV

SEQ ID NO: 179411 - protein, 11 aa, Borrelia garinii
SLSGSQASWTL

SEQ ID NO: 179412 - protein, 11 aa, Borrelia garinii
MLSNKSASQNV

SEQ ID NO: 179413 - protein, 11 aa, Borrelia garinii
AIAVNIYAANV

SEQ ID NO: 179414 - protein, 11 aa, Borrelia garinii
SQASWTLRVHV

SEQ ID NO: 179415 - protein, 11 aa, Borrelia garinii
GMQPAKINTPA

SEQ ID NO: 179416 - protein, 11 aa, Borrelia garinii
KVLVRMKELAV

SEQ ID NO: 179417 - protein, 11 aa, Borrelia garinii
SLAKIENAIRM

SEQ ID NO: 179418 - protein, 11 aa, Borrelia garinii
NLFSGEGAQAA

SEQ ID NO: 179419 - protein, 9 aa, Borrelia garinii
NQMHMLSNK

SEQ ID NO: 179420 - protein, 9 aa, Borrelia garinii
GSQASWTLR

SEQ ID NO: 179421 - protein, 10 aa, Borrelia garinii
TVDANTSLAK

SEQ ID NO: 179422 - protein, 10 aa, Borrelia garinii
YNQMHMLSNK

SEQ ID NO: 179423 - protein, 11 aa, Borrelia garinii
LSGSQASWTLR

SEQ ID NO: 179424 - protein, 11 aa, Borrelia garinii
TTVDANTSLAK

SEQ ID NO: 179425 - protein, 11 aa, Borrelia garinii
LSNKSASQNVR

SEQ ID NO: 179426 - protein, 9 aa, Borrelia garinii
NQMHMLSNK

SEQ ID NO: 179427 - protein, 9 aa, Borrelia garinii
GSQASWTLR

SEQ ID NO: 179428 - protein, 9 aa, Borrelia garinii
AVQSGNGTY

SEQ ID NO: 179429 - protein, 10 aa, Borrelia garinii
TVDANTSLAK

SEQ ID NO: 179430 - protein, 10 aa, Borrelia garinii
YNQMHMLSNK

SEQ ID NO: 179431 - protein, 10 aa, Borrelia garinii
EVEKVLVRMK

SEQ ID NO: 179432 - protein, 11 aa, Borrelia garinii
TTVDANTSLAK

SEQ ID NO: 179433 - protein, 11 aa, Borrelia garinii
TTEGNLNEVEK

SEQ ID NO: 179434 - protein, 11 aa, Borrelia garinii
TAEELGMQPAK

SEQ ID NO: 179435 - protein, 11 aa, Borrelia garinii
TSLAKIENAIR

SEQ ID NO: 179436 - protein, 11 aa, Borrelia garinii
QYNQMHMLSNK

SEQ ID NO: 179437 - protein, 11 aa, Borrelia garinii
LSGSQASWTLR

SEQ ID NO: 179438 - protein, 11 aa, Borrelia garinii
LSNKSASQNVR

SEQ ID NO: 179439 - protein, 9 aa, Borrelia garinii
IYAANVANL

SEQ ID NO: 179440 - protein, 9 aa, Borrelia garinii
YAANVANLF

SEQ ID NO: 179441 - protein, 10 aa, Borrelia garinii
IYAANVANLF

SEQ ID NO: 179442 - protein, 10 aa, Borrelia garinii
TYSDADRGSI

SEQ ID NO: 179443 - protein, 11 aa, Borrelia garinii
IYAANVANLFS

SEQ ID NO: 179444 - protein, 9 aa, Borrelia garinii
AVQSGNGTY

SEQ ID NO: 179445 - protein, 9 aa, Borrelia garinii
YAANVANLF

SEQ ID NO: 179446 - protein, 11 aa, Borrelia garinii
ELAVQSGNGTY

SEQ ID NO: 179447 - protein, 11 aa, Borrelia garinii
EINRIADQAQY

SEQ ID NO: 179448 - protein, 9 aa, Borrelia garinii
LAKIENAIR

SEQ ID NO: 179449 - protein, 9 aa, Borrelia garinii
EGNLNEVEK

SEQ ID NO: 179450 - protein, 9 aa, Borrelia garinii
YAANVANLF

SEQ ID NO: 179451 - protein, 9 aa, Borrelia garinii
NGTYSDADR

SEQ ID NO: 179452 - protein, 9 aa, Borrelia garinii
GSQASWTLR

SEQ ID NO: 179453 - protein, 9 aa, Borrelia garinii
NQMHMLSNK

SEQ ID NO: 179454 - protein, 9 aa, Borrelia garinii
TSKAINFIQ

SEQ ID NO: 179455 - protein, 9 aa, Borrelia garinii
NKSASQNVR

SEQ ID NO: 179456 - protein, 10 aa, Borrelia garinii
EVEKVLVRMK

SEQ ID NO: 179457 - protein, 10 aa, Borrelia garinii
SLAKIENAIR

SEQ ID NO: 179458 - protein, 10 aa, Borrelia garinii
TVDANTSLAK

SEQ ID NO: 179459 - protein, 10 aa, Borrelia garinii
NTSKAINFIQ

SEQ ID NO: 179460 - protein, 10 aa, Borrelia garinii
SGSQASWTLR

SEQ ID NO: 179461 - protein, 10 aa, Borrelia garinii
TTVDANTSLA

SEQ ID NO: 179462 - protein, 11 aa, Borrelia garinii
TTVDANTSLAK

SEQ ID NO: 179463 - protein, 11 aa, Borrelia garinii
TTEGNLNEVEK

SEQ ID NO: 179464 - protein, 11 aa, Borrelia garinii
EIEQLTDEINR

SEQ ID NO: 179465 - protein, 11 aa, Borrelia garinii
LSNKSASQNVR

SEQ ID NO: 179466 - protein, 11 aa, Borrelia garinii
TSLAKIENAIR

SEQ ID NO: 179467 - protein, 11 aa, Borrelia garinii
EINRIADQAQY

SEQ ID NO: 179468 - protein, 11 aa, Borrelia garinii
NLNEVEKVLVR

SEQ ID NO: 179469 - protein, 11 aa, Borrelia garinii
LSGSQASWTLR

SEQ ID NO: 179470 - protein, 11 aa, Borrelia garinii
TAEELGMQPAK

SEQ ID NO: 179471 - protein, 11 aa, Borrelia garinii
QYNQMHMLSNK

SEQ ID NO: 179472 - protein, 11 aa, Borrelia garinii
NIYAANVANLF

SEQ ID NO: 179473 - protein, 11 aa, Borrelia garinii
QTAPVQEGVQQ

SEQ ID NO: 179474 - protein, 9 aa, Borrelia garinii
SPVNVTTTV

SEQ ID NO: 179475 - protein, 9 aa, Borrelia garinii
QPAKINTPA

SEQ ID NO: 179476 - protein, 9 aa, Borrelia garinii
QPAPATAPS

SEQ ID NO: 179477 - protein, 9 aa, Borrelia garinii
LVRMKELAV

SEQ ID NO: 179478 - protein, 9 aa, Borrelia garinii
TPASLSGSQ

SEQ ID NO: 179479 - protein, 9 aa, Borrelia garinii
APSQGGVNS

SEQ ID NO: 179480 - protein, 9 aa, Borrelia garinii
APATAPSQG

SEQ ID NO: 179481 - protein, 9 aa, Borrelia garinii
APVQEGVQQ

SEQ ID NO: 179482 - protein, 10 aa, Borrelia garinii
TPASLSGSQA

SEQ ID NO: 179483 - protein, 10 aa, Borrelia garinii
SPVNVTTTVD

SEQ ID NO: 179484 - protein, 10 aa, Borrelia garinii
APSQGGVNSP

SEQ ID NO: 179485 - protein, 10 aa, Borrelia garinii
QPAKINTPAS

SEQ ID NO: 179486 - protein, 11 aa, Borrelia garinii
APSQGGVNSPV

SEQ ID NO: 179487 - protein, 11 aa, Borrelia garinii
QPAKINTPASL

SEQ ID NO: 179488 - protein, 11 aa, Borrelia garinii
APATAPSQGGV

SEQ ID NO: 179489 - protein, 11 aa, Borrelia garinii
SPVNVTTTVDA

SEQ ID NO: 179490 - protein, 11 aa, Borrelia garinii
TPASLSGSQAS

SEQ ID NO: 179491 - protein, 9 aa, Borrelia garinii
KVLVRMKEL

SEQ ID NO: 179492 - protein, 11 aa, Borrelia garinii
VEKVLVRMKEL

SEQ ID NO: 179493 - protein, 9 aa, Borrelia garinii
YAANVANLF

SEQ ID NO: 179494 - protein, 9 aa, Borrelia garinii
AVQSGNGTY

SEQ ID NO: 179495 - protein, 9 aa, Borrelia garinii
AQAAQTAPV

SEQ ID NO: 179496 - protein, 9 aa, Borrelia garinii
AQYNQMHML

SEQ ID NO: 179497 - protein, 9 aa, Borrelia garinii
SQGGVNSPV

SEQ ID NO: 179498 - protein, 9 aa, Borrelia garinii
SLSGSQASW

SEQ ID NO: 179499 - protein, 9 aa, Borrelia garinii
SQASWTLRV

SEQ ID NO: 179500 - protein, 9 aa, Borrelia garinii
IQIEIEQLT

SEQ ID NO: 179501 - protein, 10 aa, Borrelia garinii
LAVQSGNGTY

SEQ ID NO: 179502 - protein, 10 aa, Borrelia garinii
SQASWTLRVH

SEQ ID NO: 179503 - protein, 10 aa, Borrelia garinii
SQNVRTAEEL

SEQ ID NO: 179504 - protein, 10 aa, Borrelia garinii
VQQEGAQQPA

SEQ ID NO: 179505 - protein, 10 aa, Borrelia garinii
INRIADQAQY

SEQ ID NO: 179506 - protein, 10 aa, Borrelia garinii
AQAAQTAPVQ

SEQ ID NO: 179507 - protein, 10 aa, Borrelia garinii
MQPAKINTPA

SEQ ID NO: 179508 - protein, 11 aa, Borrelia garinii
ELAVQSGNGTY

SEQ ID NO: 179509 - protein, 11 aa, Borrelia garinii
NIYAANVANLF

SEQ ID NO: 179510 - protein, 11 aa, Borrelia garinii
NQDEAIAVNIY

SEQ ID NO: 179511 - protein, 11 aa, Borrelia garinii
SLSGSQASWTL

SEQ ID NO: 179512 - protein, 9 aa, Borrelia garinii
NRIADQAQY

SEQ ID NO: 179513 - protein, 9 aa, Borrelia garinii
YAANVANLF

SEQ ID NO: 179514 - protein, 9 aa, Borrelia garinii
QPAPATAPS

SEQ ID NO: 179515 - protein, 9 aa, Borrelia garinii
SPVNVTTTV

SEQ ID NO: 179516 - protein, 9 aa, Borrelia garinii
DEAIAVNIY

SEQ ID NO: 179517 - protein, 9 aa, Borrelia garinii
TTVDANTSL

SEQ ID NO: 179518 - protein, 9 aa, Borrelia garinii
LAVQSGNGT

SEQ ID NO: 179519 - protein, 9 aa, Borrelia garinii
QPAKINTPA

SEQ ID NO: 179520 - protein, 9 aa, Borrelia garinii
AVQSGNGTY

SEQ ID NO: 179521 - protein, 9 aa, Borrelia garinii
QASWTLRVH

SEQ ID NO: 179522 - protein, 9 aa, Borrelia garinii
IAVNIYAAN

SEQ ID NO: 179523 - protein, 10 aa, Borrelia garinii
LAVQSGNGTY

SEQ ID NO: 179524 - protein, 10 aa, Borrelia garinii
IADQAQYNQM

SEQ ID NO: 179525 - protein, 10 aa, Borrelia garinii
QPAKINTPAS

SEQ ID NO: 179526 - protein, 10 aa, Borrelia garinii
LAKIENAIRM

SEQ ID NO: 179527 - protein, 10 aa, Borrelia garinii
QPAPATAPSQ

SEQ ID NO: 179528 - protein, 10 aa, Borrelia garinii
YAANVANLFS

SEQ ID NO: 179529 - protein, 10 aa, Borrelia garinii
TAEELGMQPA

SEQ ID NO: 179530 - protein, 10 aa, Borrelia garinii
EAIAVNIYAA

SEQ ID NO: 179531 - protein, 10 aa, Borrelia garinii
QAQYNQMHML

SEQ ID NO: 179532 - protein, 10 aa, Borrelia garinii
TPASLSGSQA

SEQ ID NO: 179533 - protein, 10 aa, Borrelia garinii
SPVNVTTTVD

SEQ ID NO: 179534 - protein, 11 aa, Borrelia garinii
TPASLSGSQAS

SEQ ID NO: 179535 - protein, 11 aa, Borrelia garinii
ELAVQSGNGTY

SEQ ID NO: 179536 - protein, 11 aa, Borrelia garinii
NQDEAIAVNIY

SEQ ID NO: 179537 - protein, 11 aa, Borrelia garinii
QPAKINTPASL

SEQ ID NO: 179538 - protein, 11 aa, Borrelia garinii
IAVNIYAANVA

SEQ ID NO: 179539 - protein, 11 aa, Borrelia garinii
NIYAANVANLF

SEQ ID NO: 179540 - protein, 11 aa, Borrelia garinii
SPVNVTTTVDA

SEQ ID NO: 179541 - protein, 11 aa, Borrelia garinii
EINRIADQAQY

SEQ ID NO: 179542 - protein, 11 aa, Borrelia garinii
IADQAQYNQMH

SEQ ID NO: 179543 - protein, 11 aa, Borrelia garinii
APSQGGVNSPV

SEQ ID NO: 179544 - protein, 11 aa, Borrelia garinii
LAVQSGNGTYS

SEQ ID NO: 179545 - protein, 10 aa, Borrelia garinii
EELGMQPAKI

SEQ ID NO: 179546 - protein, 10 aa, Borrelia garinii
NEVEKVLVRM

SEQ ID NO: 179547 - protein, 10 aa, Borrelia garinii
DEINRIADQA

SEQ ID NO: 179548 - protein, 11 aa, Borrelia garinii
DEINRIADQAQ

SEQ ID NO: 179549 - protein, 9 aa, Borrelia garinii
SPVNVTTTV

SEQ ID NO: 179550 - protein, 11 aa, Borrelia garinii
APATAPSQGGV

SEQ ID NO: 179551 - protein, 11 aa, Borrelia garinii
APSQGGVNSPV

SEQ ID NO: 179552 - protein, 10 aa, Borrelia garinii
ASLSGSQASW

SEQ ID NO: 179553 - protein, 8 aa, Homo sapiens
HLADSPAV

SEQ ID NO: 179554 - protein, 8 aa, Homo sapiens
FLTGMTVA

SEQ ID NO: 179555 - protein, 8 aa, Homo sapiens
AAWMATYL

SEQ ID NO: 179556 - protein, 8 aa, Homo sapiens
VLVSRIAA

SEQ ID NO: 179557 - protein, 8 aa, Homo sapiens
YQSFEQVV

SEQ ID NO: 179558 - protein, 8 aa, Homo sapiens
GALCVESV

SEQ ID NO: 179559 - protein, 8 aa, Homo sapiens
VLLGSLFS

SEQ ID NO: 179560 - protein, 8 aa, Homo sapiens
FLTGMTVA

SEQ ID NO: 179561 - protein, 8 aa, Homo sapiens
HLADSPAV

SEQ ID NO: 179562 - protein, 8 aa, Homo sapiens
YQSFEQVV

SEQ ID NO: 179563 - protein, 8 aa, Homo sapiens
TVAGVVLL

SEQ ID NO: 179564 - protein, 8 aa, Homo sapiens
FLSYKLSQ

SEQ ID NO: 179565 - protein, 8 aa, Homo sapiens
MAAVKQAL

SEQ ID NO: 179566 - protein, 8 aa, Homo sapiens
SLDAREVI

SEQ ID NO: 179567 - protein, 8 aa, Homo sapiens
ELYGNNAA

SEQ ID NO: 179568 - protein, 8 aa, Homo sapiens
MTVAGVVL

SEQ ID NO: 179569 - protein, 8 aa, Homo sapiens
VLVSRIAA

SEQ ID NO: 179570 - protein, 8 aa, Homo sapiens
SQSNRELV

SEQ ID NO: 179571 - protein, 8 aa, Homo sapiens
FLTGMTVA

SEQ ID NO: 179572 - protein, 8 aa, Homo sapiens
HLADSPAV

SEQ ID NO: 179573 - protein, 8 aa, Homo sapiens
VLVSRIAA

SEQ ID NO: 179574 - protein, 8 aa, Homo sapiens
MQVLVSRI

SEQ ID NO: 179575 - protein, 8 aa, Homo sapiens
FLSYKLSQ

SEQ ID NO: 179576 - protein, 8 aa, Homo sapiens
GVNWGRIV

SEQ ID NO: 179577 - protein, 8 aa, Homo sapiens
GMTVAGVV

SEQ ID NO: 179578 - protein, 8 aa, Homo sapiens
YQSFEQVV

SEQ ID NO: 179579 - protein, 8 aa, Homo sapiens
RIAAWMAT

SEQ ID NO: 179580 - protein, 8 aa, Homo sapiens
EVIPMAAV

SEQ ID NO: 179581 - protein, 8 aa, Homo sapiens
SQSNRELV

SEQ ID NO: 179582 - protein, 8 aa, Homo sapiens
MTVAGVVL

SEQ ID NO: 179583 - protein, 8 aa, Homo sapiens
GALCVESV

SEQ ID NO: 179584 - protein, 8 aa, Homo sapiens
GVVLLGSL

SEQ ID NO: 179585 - protein, 8 aa, Homo sapiens
TVAGVVLL

SEQ ID NO: 179586 - protein, 8 aa, Homo sapiens
HLADSPAV

SEQ ID NO: 179587 - protein, 8 aa, Homo sapiens
SVDKEMQV

SEQ ID NO: 179588 - protein, 8 aa, Homo sapiens
HLADSPAV

SEQ ID NO: 179589 - protein, 8 aa, Homo sapiens
MQVLVSRI

SEQ ID NO: 179590 - protein, 8 aa, Homo sapiens
FLTGMTVA

SEQ ID NO: 179591 - protein, 8 aa, Homo sapiens
SQSNRELV

SEQ ID NO: 179592 - protein, 8 aa, Homo sapiens
YQSFEQVV

SEQ ID NO: 179593 - protein, 8 aa, Homo sapiens
RIVAFFSF

SEQ ID NO: 179594 - protein, 8 aa, Homo sapiens
RIAAWMAT

SEQ ID NO: 179595 - protein, 8 aa, Homo sapiens
GALCVESV

SEQ ID NO: 179596 - protein, 8 aa, Homo sapiens
AAWMATYL

SEQ ID NO: 179597 - protein, 8 aa, Homo sapiens
MTVAGVVL

SEQ ID NO: 179598 - protein, 8 aa, Homo sapiens
VLVSRIAA

SEQ ID NO: 179599 - protein, 8 aa, Homo sapiens
SEMETPSA

SEQ ID NO: 179600 - protein, 8 aa, Homo sapiens
EVIPMAAV

SEQ ID NO: 179601 - protein, 8 aa, Homo sapiens
SVDKEMQV

SEQ ID NO: 179602 - protein, 8 aa, Homo sapiens
HLADSPAV

SEQ ID NO: 179603 - protein, 8 aa, Homo sapiens
SVDKEMQV

SEQ ID NO: 179604 - protein, 8 aa, Homo sapiens
FLTGMTVA

SEQ ID NO: 179605 - protein, 8 aa, Homo sapiens
SLDAREVI

SEQ ID NO: 179606 - protein, 8 aa, Homo sapiens
ELYGNNAA

SEQ ID NO: 179607 - protein, 8 aa, Homo sapiens
TVAGVVLL

SEQ ID NO: 179608 - protein, 8 aa, Homo sapiens
YLNDHLEP

SEQ ID NO: 179609 - protein, 8 aa, Homo sapiens
EVIPMAAV

SEQ ID NO: 179610 - protein, 8 aa, Homo sapiens
GMTVAGVV

SEQ ID NO: 179611 - protein, 8 aa, Homo sapiens
VLVSRIAA

SEQ ID NO: 179612 - protein, 8 aa, Homo sapiens
VLLGSLFS

SEQ ID NO: 179613 - protein, 8 aa, Homo sapiens
GVNWGRIV

SEQ ID NO: 179614 - protein, 8 aa, Homo sapiens
WFLTGMTV

SEQ ID NO: 179615 - protein, 8 aa, Homo sapiens
SFGGALCV

SEQ ID NO: 179616 - protein, 8 aa, Homo sapiens
SSLDAREV

SEQ ID NO: 179617 - protein, 8 aa, Homo sapiens
DLTSQLHI

SEQ ID NO: 179618 - protein, 8 aa, Homo sapiens
YQSFEQVV

SEQ ID NO: 179619 - protein, 8 aa, Homo sapiens
PMAAVKQA

SEQ ID NO: 179620 - protein, 8 aa, Homo sapiens
FLSYKLSQ

SEQ ID NO: 179621 - protein, 8 aa, Homo sapiens
AAWMATYL

SEQ ID NO: 179622 - protein, 8 aa, Homo sapiens
SQSNRELV

SEQ ID NO: 179623 - protein, 8 aa, Homo sapiens
GALCVESV

SEQ ID NO: 179624 - protein, 8 aa, Homo sapiens
HLADSPAV

SEQ ID NO: 179625 - protein, 8 aa, Homo sapiens
ELYGNNAA

SEQ ID NO: 179626 - protein, 8 aa, Homo sapiens
FLTGMTVA

SEQ ID NO: 179627 - protein, 8 aa, Homo sapiens
SVDKEMQV

SEQ ID NO: 179628 - protein, 8 aa, Homo sapiens
SLDAREVI

SEQ ID NO: 179629 - protein, 8 aa, Homo sapiens
VLVSRIAA

SEQ ID NO: 179630 - protein, 8 aa, Homo sapiens
YLNDHLEP

SEQ ID NO: 179631 - protein, 8 aa, Homo sapiens
YQSFEQVV

SEQ ID NO: 179632 - protein, 8 aa, Homo sapiens
EVIPMAAV

SEQ ID NO: 179633 - protein, 8 aa, Homo sapiens
VLLGSLFS

SEQ ID NO: 179634 - protein, 8 aa, Homo sapiens
FLSYKLSQ

SEQ ID NO: 179635 - protein, 8 aa, Homo sapiens
WFLTGMTV

SEQ ID NO: 179636 - protein, 8 aa, Homo sapiens
GMTVAGVV

SEQ ID NO: 179637 - protein, 8 aa, Homo sapiens
HLADSPAV

SEQ ID NO: 179638 - protein, 8 aa, Homo sapiens
SVDKEMQV

SEQ ID NO: 179639 - protein, 8 aa, Homo sapiens
FLTGMTVA

SEQ ID NO: 179640 - protein, 8 aa, Homo sapiens
ELYGNNAA

SEQ ID NO: 179641 - protein, 8 aa, Homo sapiens
EVIPMAAV

SEQ ID NO: 179642 - protein, 8 aa, Homo sapiens
TVAGVVLL

SEQ ID NO: 179643 - protein, 8 aa, Homo sapiens
SLDAREVI

SEQ ID NO: 179644 - protein, 8 aa, Homo sapiens
SFGGALCV

SEQ ID NO: 179645 - protein, 8 aa, Homo sapiens
GMTVAGVV

SEQ ID NO: 179646 - protein, 8 aa, Homo sapiens
AAWMATYL

SEQ ID NO: 179647 - protein, 8 aa, Homo sapiens
VLVSRIAA

SEQ ID NO: 179648 - protein, 8 aa, Homo sapiens
WFLTGMTV

SEQ ID NO: 179649 - protein, 8 aa, Homo sapiens
FLSYKLSQ

SEQ ID NO: 179650 - protein, 8 aa, Homo sapiens
DLTSQLHI

SEQ ID NO: 179651 - protein, 8 aa, Homo sapiens
GVNWGRIV

SEQ ID NO: 179652 - protein, 8 aa, Homo sapiens
PMAAVKQA

SEQ ID NO: 179653 - protein, 8 aa, Homo sapiens
AYQSFEQV

SEQ ID NO: 179654 - protein, 8 aa, Homo sapiens
VLLGSLFS

SEQ ID NO: 179655 - protein, 8 aa, Homo sapiens
GALCVESV

SEQ ID NO: 179656 - protein, 8 aa, Homo sapiens
HLADSPAV

SEQ ID NO: 179657 - protein, 8 aa, Homo sapiens
FLTGMTVA

SEQ ID NO: 179658 - protein, 8 aa, Homo sapiens
SVDKEMQV

SEQ ID NO: 179659 - protein, 8 aa, Homo sapiens
SLDAREVI

SEQ ID NO: 179660 - protein, 8 aa, Homo sapiens
TVAGVVLL

SEQ ID NO: 179661 - protein, 8 aa, Homo sapiens
ELYGNNAA

SEQ ID NO: 179662 - protein, 8 aa, Homo sapiens
WFLTGMTV

SEQ ID NO: 179663 - protein, 8 aa, Homo sapiens
AAWMATYL

SEQ ID NO: 179664 - protein, 8 aa, Homo sapiens
DLTSQLHI

SEQ ID NO: 179665 - protein, 8 aa, Homo sapiens
VLLGSLFS

SEQ ID NO: 179666 - protein, 8 aa, Homo sapiens
LSYKLSQK

SEQ ID NO: 179667 - protein, 8 aa, Homo sapiens
VVDFLSYK

SEQ ID NO: 179668 - protein, 8 aa, Homo sapiens
LLGSLFSR

SEQ ID NO: 179669 - protein, 8 aa, Homo sapiens
VVDFLSYK

SEQ ID NO: 179670 - protein, 8 aa, Homo sapiens
LSYKLSQK

SEQ ID NO: 179671 - protein, 8 aa, Homo sapiens
VIPMAAVK

SEQ ID NO: 179672 - protein, 8 aa, Homo sapiens
QVVNELFR

SEQ ID NO: 179673 - protein, 8 aa, Homo sapiens
LVVDFLSY

SEQ ID NO: 179674 - protein, 8 aa, Homo sapiens
NAAAESRK

SEQ ID NO: 179675 - protein, 8 aa, Homo sapiens
NWGRIVAF

SEQ ID NO: 179676 - protein, 8 aa, Homo sapiens
RIVAFFSF

SEQ ID NO: 179677 - protein, 8 aa, Homo sapiens
VVLLGSLF

SEQ ID NO: 179678 - protein, 8 aa, Homo sapiens
NWGRIVAF

SEQ ID NO: 179679 - protein, 8 aa, Homo sapiens
AYQSFEQV

SEQ ID NO: 179680 - protein, 8 aa, Homo sapiens
EVIPMAAV

SEQ ID NO: 179681 - protein, 8 aa, Homo sapiens
LVVDFLSY

SEQ ID NO: 179682 - protein, 8 aa, Homo sapiens
EVIPMAAV

SEQ ID NO: 179683 - protein, 8 aa, Homo sapiens
LVVDFLSY

SEQ ID NO: 179684 - protein, 8 aa, Homo sapiens
HITPGTAY

SEQ ID NO: 179685 - protein, 8 aa, Homo sapiens
ELRYRRAF

SEQ ID NO: 179686 - protein, 8 aa, Homo sapiens
RIVAFFSF

SEQ ID NO: 179687 - protein, 8 aa, Homo sapiens
HITPGTAY

SEQ ID NO: 179688 - protein, 8 aa, Homo sapiens
LVVDFLSY

SEQ ID NO: 179689 - protein, 8 aa, Homo sapiens
KGQERFNR

SEQ ID NO: 179690 - protein, 8 aa, Homo sapiens
LLGSLFSR

SEQ ID NO: 179691 - protein, 8 aa, Homo sapiens
EMQVLVSR

SEQ ID NO: 179692 - protein, 8 aa, Homo sapiens
HSSSLDAR

SEQ ID NO: 179693 - protein, 8 aa, Homo sapiens
AAVKQALR

SEQ ID NO: 179694 - protein, 8 aa, Homo sapiens
EFELRYRR

SEQ ID NO: 179695 - protein, 8 aa, Homo sapiens
QVVNELFR

SEQ ID NO: 179696 - protein, 8 aa, Homo sapiens
LSYKLSQK

SEQ ID NO: 179697 - protein, 8 aa, Homo sapiens
EFELRYRR

SEQ ID NO: 179698 - protein, 8 aa, Homo sapiens
EMQVLVSR

SEQ ID NO: 179699 - protein, 8 aa, Homo sapiens
DEFELRYR

SEQ ID NO: 179700 - protein, 8 aa, Homo sapiens
ESRKGQER

SEQ ID NO: 179701 - protein, 8 aa, Homo sapiens
LLGSLFSR

SEQ ID NO: 179702 - protein, 8 aa, Homo sapiens
HSSSLDAR

SEQ ID NO: 179703 - protein, 8 aa, Homo sapiens
QVVNELFR

SEQ ID NO: 179704 - protein, 8 aa, Homo sapiens
HSSSLDAR

SEQ ID NO: 179705 - protein, 8 aa, Homo sapiens
NAAAESRK

SEQ ID NO: 179706 - protein, 8 aa, Homo sapiens
LSYKLSQK

SEQ ID NO: 179707 - protein, 8 aa, Homo sapiens
EMQVLVSR

SEQ ID NO: 179708 - protein, 8 aa, Homo sapiens
NNAAAESR

SEQ ID NO: 179709 - protein, 8 aa, Homo sapiens
AAVKQALR

SEQ ID NO: 179710 - protein, 8 aa, Homo sapiens
ESRKGQER

SEQ ID NO: 179711 - protein, 8 aa, Homo sapiens
IAAWMATY

SEQ ID NO: 179712 - protein, 8 aa, Homo sapiens
EFELRYRR

SEQ ID NO: 179713 - protein, 8 aa, Homo sapiens
TAYQSFEQ

SEQ ID NO: 179714 - protein, 8 aa, Homo sapiens
VVDFLSYK

SEQ ID NO: 179715 - protein, 8 aa, Homo sapiens
DEFELRYR

SEQ ID NO: 179716 - protein, 8 aa, Homo sapiens
FSDVEENR

SEQ ID NO: 179717 - protein, 8 aa, Homo sapiens
LLGSLFSR

SEQ ID NO: 179718 - protein, 8 aa, Homo sapiens
EVIPMAAV

SEQ ID NO: 179719 - protein, 8 aa, Homo sapiens
TVAGVVLL

SEQ ID NO: 179720 - protein, 8 aa, Homo sapiens
TGMTVAGV

SEQ ID NO: 179721 - protein, 8 aa, Homo sapiens
MTVAGVVL

SEQ ID NO: 179722 - protein, 8 aa, Homo sapiens
MAAVKQAL

SEQ ID NO: 179723 - protein, 8 aa, Homo sapiens
HLADSPAV

SEQ ID NO: 179724 - protein, 8 aa, Homo sapiens
ERFNRWFL

SEQ ID NO: 179725 - protein, 8 aa, Homo sapiens
DSPAVNGA

SEQ ID NO: 179726 - protein, 8 aa, Homo sapiens
ELYGNNAA

SEQ ID NO: 179727 - protein, 8 aa, Homo sapiens
EAGDEFEL

SEQ ID NO: 179728 - protein, 8 aa, Homo sapiens
EVIPMAAV

SEQ ID NO: 179729 - protein, 8 aa, Homo sapiens
HLADSPAV

SEQ ID NO: 179730 - protein, 8 aa, Homo sapiens
ELYGNNAA

SEQ ID NO: 179731 - protein, 8 aa, Homo sapiens
MTVAGVVL

SEQ ID NO: 179732 - protein, 8 aa, Homo sapiens
TVAGVVLL

SEQ ID NO: 179733 - protein, 8 aa, Homo sapiens
EAGDEFEL

SEQ ID NO: 179734 - protein, 8 aa, Homo sapiens
SVDKEMQV

SEQ ID NO: 179735 - protein, 8 aa, Homo sapiens
WFLTGMTV

SEQ ID NO: 179736 - protein, 8 aa, Homo sapiens
SPAVNGAT

SEQ ID NO: 179737 - protein, 8 aa, Homo sapiens
MAAVKQAL

SEQ ID NO: 179738 - protein, 8 aa, Homo sapiens
AAWMATYL

SEQ ID NO: 179739 - protein, 8 aa, Homo sapiens
ELRYRRAF

SEQ ID NO: 179740 - protein, 8 aa, Homo sapiens
LVVDFLSY

SEQ ID NO: 179741 - protein, 8 aa, Homo sapiens
RIVAFFSF

SEQ ID NO: 179742 - protein, 8 aa, Homo sapiens
HITPGTAY

SEQ ID NO: 179743 - protein, 8 aa, Homo sapiens
IAAWMATY

SEQ ID NO: 179744 - protein, 8 aa, Homo sapiens
ELRYRRAF

SEQ ID NO: 179745 - protein, 8 aa, Homo sapiens
VVLLGSLF

SEQ ID NO: 179746 - protein, 8 aa, Homo sapiens
QERFNRWF

SEQ ID NO: 179747 - protein, 8 aa, Homo sapiens
RELVVDFL

SEQ ID NO: 179748 - protein, 8 aa, Homo sapiens
FEQVVNEL

SEQ ID NO: 179749 - protein, 8 aa, Homo sapiens
NRWFLTGM

SEQ ID NO: 179750 - protein, 8 aa, Homo sapiens
IAAWMATY

SEQ ID NO: 179751 - protein, 8 aa, Homo sapiens
LVVDFLSY

SEQ ID NO: 179752 - protein, 8 aa, Homo sapiens
MAAVKQAL

SEQ ID NO: 179753 - protein, 8 aa, Homo sapiens
HITPGTAY

SEQ ID NO: 179754 - protein, 8 aa, Homo sapiens
DAREVIPM

SEQ ID NO: 179755 - protein, 8 aa, Homo sapiens
FFSFGGAL

SEQ ID NO: 179756 - protein, 8 aa, Homo sapiens
SPAVNGAT

SEQ ID NO: 179757 - protein, 8 aa, Homo sapiens
AAWMATYL

SEQ ID NO: 179758 - protein, 8 aa, Homo sapiens
MTVAGVVL

SEQ ID NO: 179759 - protein, 8 aa, Homo sapiens
RELVVDFL

SEQ ID NO: 179760 - protein, 8 aa, Homo sapiens
FEQVVNEL

SEQ ID NO: 179761 - protein, 8 aa, Homo sapiens
RELVVDFL

SEQ ID NO: 179762 - protein, 8 aa, Homo sapiens
KEMQVLVS

SEQ ID NO: 179763 - protein, 8 aa, Homo sapiens
REVIPMAA

SEQ ID NO: 179764 - protein, 8 aa, Homo sapiens
LVSRIAAW

SEQ ID NO: 179765 - protein, 8 aa, Homo sapiens
IAAWMATY

SEQ ID NO: 179766 - protein, 8 aa, Homo sapiens
LSQKGYSW

SEQ ID NO: 179767 - protein, 8 aa, Homo sapiens
KGYSWSQF

SEQ ID NO: 179768 - protein, 8 aa, Homo sapiens
RIVAFFSF

SEQ ID NO: 179769 - protein, 8 aa, Homo sapiens
AINGNPSW

SEQ ID NO: 179770 - protein, 9 aa, Homo sapiens
FSDLTSQLH

SEQ ID NO: 179771 - protein, 9 aa, Homo sapiens
FSFGGALCV

SEQ ID NO: 179772 - protein, 9 aa, Homo sapiens
MTVAGVVLL

SEQ ID NO: 179773 - protein, 9 aa, Homo sapiens
YLNDHLEPW

SEQ ID NO: 179774 - protein, 9 aa, Homo sapiens
MTVAGVVLL

SEQ ID NO: 179775 - protein, 9 aa, Homo sapiens
IAAWMATYL

SEQ ID NO: 179776 - protein, 9 aa, Homo sapiens
FLTGMTVAG

SEQ ID NO: 179777 - protein, 9 aa, Homo sapiens
FLSYKLSQK

SEQ ID NO: 179778 - protein, 9 aa, Homo sapiens
LVSRIAAWM

SEQ ID NO: 179779 - protein, 9 aa, Homo sapiens
VVDFLSYKL

SEQ ID NO: 179780 - protein, 9 aa, Homo sapiens
ELYGNNAAA

SEQ ID NO: 179781 - protein, 9 aa, Homo sapiens
PMAAVKQAL

SEQ ID NO: 179782 - protein, 9 aa, Homo sapiens
GMTVAGVVL

SEQ ID NO: 179783 - protein, 9 aa, Homo sapiens
LTGMTVAGV

SEQ ID NO: 179784 - protein, 9 aa, Homo sapiens
MTVAGVVLL

SEQ ID NO: 179785 - protein, 9 aa, Homo sapiens
IAAWMATYL

SEQ ID NO: 179786 - protein, 9 aa, Homo sapiens
AVKQALREA

SEQ ID NO: 179787 - protein, 9 aa, Homo sapiens
QLHITPGTA

SEQ ID NO: 179788 - protein, 9 aa, Homo sapiens
YLNDHLEPW

SEQ ID NO: 179789 - protein, 9 aa, Homo sapiens
TAYQSFEQV

SEQ ID NO: 179790 - protein, 9 aa, Homo sapiens
FLSYKLSQK

SEQ ID NO: 179791 - protein, 9 aa, Homo sapiens
LTGMTVAGV

SEQ ID NO: 179792 - protein, 9 aa, Homo sapiens
MTVAGVVLL

SEQ ID NO: 179793 - protein, 9 aa, Homo sapiens
SQLHITPGT

SEQ ID NO: 179794 - protein, 9 aa, Homo sapiens
MTVAGVVLL

SEQ ID NO: 179795 - protein, 9 aa, Homo sapiens
TAYQSFEQV

SEQ ID NO: 179796 - protein, 9 aa, Homo sapiens
SQSNRELVV

SEQ ID NO: 179797 - protein, 9 aa, Homo sapiens
FSFGGALCV

SEQ ID NO: 179798 - protein, 9 aa, Homo sapiens
REVIPMAAV

SEQ ID NO: 179799 - protein, 9 aa, Homo sapiens
IAAWMATYL

SEQ ID NO: 179800 - protein, 9 aa, Homo sapiens
MQVLVSRIA

SEQ ID NO: 179801 - protein, 9 aa, Homo sapiens
LTGMTVAGV

SEQ ID NO: 179802 - protein, 9 aa, Homo sapiens
YLNDHLEPW

SEQ ID NO: 179803 - protein, 9 aa, Homo sapiens
SEMETPSAI

SEQ ID NO: 179804 - protein, 9 aa, Homo sapiens
ELYGNNAAA

SEQ ID NO: 179805 - protein, 9 aa, Homo sapiens
FSFGGALCV

SEQ ID NO: 179806 - protein, 9 aa, Homo sapiens
PMAAVKQAL

SEQ ID NO: 179807 - protein, 9 aa, Homo sapiens
YLNDHLEPW

SEQ ID NO: 179808 - protein, 9 aa, Homo sapiens
SVDKEMQVL

SEQ ID NO: 179809 - protein, 9 aa, Homo sapiens
VVDFLSYKL

SEQ ID NO: 179810 - protein, 9 aa, Homo sapiens
MTVAGVVLL

SEQ ID NO: 179811 - protein, 9 aa, Homo sapiens
HITPGTAYQ

SEQ ID NO: 179812 - protein, 9 aa, Homo sapiens
TAYQSFEQV

SEQ ID NO: 179813 - protein, 9 aa, Homo sapiens
VLLGSLFSR

SEQ ID NO: 179814 - protein, 9 aa, Homo sapiens
FLTGMTVAG

SEQ ID NO: 179815 - protein, 9 aa, Homo sapiens
GVNWGRIVA

SEQ ID NO: 179816 - protein, 9 aa, Homo sapiens
GMTVAGVVL

SEQ ID NO: 179817 - protein, 9 aa, Homo sapiens
GGWDTFVEL

SEQ ID NO: 179818 - protein, 9 aa, Homo sapiens
AFSDLTSQL

SEQ ID NO: 179819 - protein, 9 aa, Homo sapiens
HLEPWIQEN

SEQ ID NO: 179820 - protein, 9 aa, Homo sapiens
ELYGNNAAA

SEQ ID NO: 179821 - protein, 9 aa, Homo sapiens
PMAAVKQAL

SEQ ID NO: 179822 - protein, 9 aa, Homo sapiens
FSFGGALCV

SEQ ID NO: 179823 - protein, 9 aa, Homo sapiens
YLNDHLEPW

SEQ ID NO: 179824 - protein, 9 aa, Homo sapiens
VLLGSLFSR

SEQ ID NO: 179825 - protein, 9 aa, Homo sapiens
VVDFLSYKL

SEQ ID NO: 179826 - protein, 9 aa, Homo sapiens
SVDKEMQVL

SEQ ID NO: 179827 - protein, 9 aa, Homo sapiens
FLTGMTVAG

SEQ ID NO: 179828 - protein, 9 aa, Homo sapiens
AYQSFEQVV

SEQ ID NO: 179829 - protein, 9 aa, Homo sapiens
ELYGNNAAA

SEQ ID NO: 179830 - protein, 9 aa, Homo sapiens
PMAAVKQAL

SEQ ID NO: 179831 - protein, 9 aa, Homo sapiens
FSFGGALCV

SEQ ID NO: 179832 - protein, 9 aa, Homo sapiens
TAYQSFEQV

SEQ ID NO: 179833 - protein, 9 aa, Homo sapiens
HITPGTAYQ

SEQ ID NO: 179834 - protein, 9 aa, Homo sapiens
GMTVAGVVL

SEQ ID NO: 179835 - protein, 9 aa, Homo sapiens
PMAAVKQAL

SEQ ID NO: 179836 - protein, 9 aa, Homo sapiens
FSFGGALCV

SEQ ID NO: 179837 - protein, 9 aa, Homo sapiens
ELYGNNAAA

SEQ ID NO: 179838 - protein, 9 aa, Homo sapiens
TAYQSFEQV

SEQ ID NO: 179839 - protein, 9 aa, Homo sapiens
YLNDHLEPW

SEQ ID NO: 179840 - protein, 9 aa, Homo sapiens
VLLGSLFSR

SEQ ID NO: 179841 - protein, 9 aa, Homo sapiens
LTGMTVAGV

SEQ ID NO: 179842 - protein, 9 aa, Homo sapiens
LLGSLFSRK

SEQ ID NO: 179843 - protein, 9 aa, Homo sapiens
FLSYKLSQK

SEQ ID NO: 179844 - protein, 9 aa, Homo sapiens
RIAAWMATY

SEQ ID NO: 179845 - protein, 9 aa, Homo sapiens
VLLGSLFSR

SEQ ID NO: 179846 - protein, 9 aa, Homo sapiens
LVVDFLSYK

SEQ ID NO: 179847 - protein, 9 aa, Homo sapiens
LVVDFLSYK

SEQ ID NO: 179848 - protein, 9 aa, Homo sapiens
LLGSLFSRK

SEQ ID NO: 179849 - protein, 9 aa, Homo sapiens
VLLGSLFSR

SEQ ID NO: 179850 - protein, 9 aa, Homo sapiens
RIAAWMATY

SEQ ID NO: 179851 - protein, 9 aa, Homo sapiens
ALCVESVDK

SEQ ID NO: 179852 - protein, 9 aa, Homo sapiens
EVIPMAAVK

SEQ ID NO: 179853 - protein, 9 aa, Homo sapiens
FLSYKLSQK

SEQ ID NO: 179854 - protein, 9 aa, Homo sapiens
RYRRAFSDL

SEQ ID NO: 179855 - protein, 9 aa, Homo sapiens
NWGRIVAFF

SEQ ID NO: 179856 - protein, 9 aa, Homo sapiens
GRIVAFFSF

SEQ ID NO: 179857 - protein, 9 aa, Homo sapiens
NWGRIVAFF

SEQ ID NO: 179858 - protein, 9 aa, Homo sapiens
RYRRAFSDL

SEQ ID NO: 179859 - protein, 9 aa, Homo sapiens
RYRRAFSDL

SEQ ID NO: 179860 - protein, 9 aa, Homo sapiens
SFEQVVNEL

SEQ ID NO: 179861 - protein, 9 aa, Homo sapiens
AYQSFEQVV

SEQ ID NO: 179862 - protein, 9 aa, Homo sapiens
ELVVDFLSY

SEQ ID NO: 179863 - protein, 9 aa, Homo sapiens
RIAAWMATY

SEQ ID NO: 179864 - protein, 9 aa, Homo sapiens
RIAAWMATY

SEQ ID NO: 179865 - protein, 9 aa, Homo sapiens
ELVVDFLSY

SEQ ID NO: 179866 - protein, 9 aa, Homo sapiens
LVSRIAAWM

SEQ ID NO: 179867 - protein, 9 aa, Homo sapiens
SVDKEMQVL

SEQ ID NO: 179868 - protein, 9 aa, Homo sapiens
EVIPMAAVK

SEQ ID NO: 179869 - protein, 9 aa, Homo sapiens
MTVAGVVLL

SEQ ID NO: 179870 - protein, 9 aa, Homo sapiens
LHITPGTAY

SEQ ID NO: 179871 - protein, 9 aa, Homo sapiens
ELVVDFLSY

SEQ ID NO: 179872 - protein, 9 aa, Homo sapiens
RIAAWMATY

SEQ ID NO: 179873 - protein, 9 aa, Homo sapiens
MAAVKQALR

SEQ ID NO: 179874 - protein, 9 aa, Homo sapiens
VLLGSLFSR

SEQ ID NO: 179875 - protein, 9 aa, Homo sapiens
LVVDFLSYK

SEQ ID NO: 179876 - protein, 9 aa, Homo sapiens
KEMQVLVSR

SEQ ID NO: 179877 - protein, 9 aa, Homo sapiens
DEFELRYRR

SEQ ID NO: 179878 - protein, 9 aa, Homo sapiens
MAAVKQALR

SEQ ID NO: 179879 - protein, 9 aa, Homo sapiens
ELRYRRAFS

SEQ ID NO: 179880 - protein, 9 aa, Homo sapiens
VLLGSLFSR

SEQ ID NO: 179881 - protein, 9 aa, Homo sapiens
EAGDEFELR

SEQ ID NO: 179882 - protein, 9 aa, Homo sapiens
QFSDVEENR

SEQ ID NO: 179883 - protein, 9 aa, Homo sapiens
EVIPMAAVK

SEQ ID NO: 179884 - protein, 9 aa, Homo sapiens
MAAVKQALR

SEQ ID NO: 179885 - protein, 9 aa, Homo sapiens
LVVDFLSYK

SEQ ID NO: 179886 - protein, 9 aa, Homo sapiens
EAGDEFELR

SEQ ID NO: 179887 - protein, 9 aa, Homo sapiens
EQVVNELFR

SEQ ID NO: 179888 - protein, 9 aa, Homo sapiens
FLSYKLSQK

SEQ ID NO: 179889 - protein, 9 aa, Homo sapiens
DEFELRYRR

SEQ ID NO: 179890 - protein, 9 aa, Homo sapiens
QFSDVEENR

SEQ ID NO: 179891 - protein, 9 aa, Homo sapiens
NNAAAESRK

SEQ ID NO: 179892 - protein, 9 aa, Homo sapiens
VLLGSLFSR

SEQ ID NO: 179893 - protein, 9 aa, Homo sapiens
MTVAGVVLL

SEQ ID NO: 179894 - protein, 9 aa, Homo sapiens
TAYQSFEQV

SEQ ID NO: 179895 - protein, 9 aa, Homo sapiens
TGMTVAGVV

SEQ ID NO: 179896 - protein, 9 aa, Homo sapiens
MSQSNRELV

SEQ ID NO: 179897 - protein, 9 aa, Homo sapiens
YSWSQFSDV

SEQ ID NO: 179898 - protein, 9 aa, Homo sapiens
FSFGGALCV

SEQ ID NO: 179899 - protein, 9 aa, Homo sapiens
ESVDKEMQV

SEQ ID NO: 179900 - protein, 9 aa, Homo sapiens
MATYLNDHL

SEQ ID NO: 179901 - protein, 9 aa, Homo sapiens
ELYGNNAAA

SEQ ID NO: 179902 - protein, 9 aa, Homo sapiens
VAFFSFGGA

SEQ ID NO: 179903 - protein, 9 aa, Homo sapiens
LTGMTVAGV

SEQ ID NO: 179904 - protein, 9 aa, Homo sapiens
IAAWMATYL

SEQ ID NO: 179905 - protein, 9 aa, Homo sapiens
MTVAGVVLL

SEQ ID NO: 179906 - protein, 9 aa, Homo sapiens
TAYQSFEQV

SEQ ID NO: 179907 - protein, 9 aa, Homo sapiens
ELYGNNAAA

SEQ ID NO: 179908 - protein, 9 aa, Homo sapiens
FSFGGALCV

SEQ ID NO: 179909 - protein, 9 aa, Homo sapiens
LTGMTVAGV

SEQ ID NO: 179910 - protein, 9 aa, Homo sapiens
YSWSQFSDV

SEQ ID NO: 179911 - protein, 9 aa, Homo sapiens
APEGTESEM

SEQ ID NO: 179912 - protein, 9 aa, Homo sapiens
SPAVNGATG

SEQ ID NO: 179913 - protein, 9 aa, Homo sapiens
TPGTAYQSF

SEQ ID NO: 179914 - protein, 9 aa, Homo sapiens
FELRYRRAF

SEQ ID NO: 179915 - protein, 9 aa, Homo sapiens
RIAAWMATY

SEQ ID NO: 179916 - protein, 9 aa, Homo sapiens
ALREAGDEF

SEQ ID NO: 179917 - protein, 9 aa, Homo sapiens
FELRYRRAF

SEQ ID NO: 179918 - protein, 9 aa, Homo sapiens
QERFNRWFL

SEQ ID NO: 179919 - protein, 9 aa, Homo sapiens
FEQVVNELF

SEQ ID NO: 179920 - protein, 9 aa, Homo sapiens
QENGGWDTF

SEQ ID NO: 179921 - protein, 9 aa, Homo sapiens
GRIVAFFSF

SEQ ID NO: 179922 - protein, 9 aa, Homo sapiens
RRAFSDLTS

SEQ ID NO: 179923 - protein, 9 aa, Homo sapiens
TPGTAYQSF

SEQ ID NO: 179924 - protein, 9 aa, Homo sapiens
IAAWMATYL

SEQ ID NO: 179925 - protein, 9 aa, Homo sapiens
APEGTESEM

SEQ ID NO: 179926 - protein, 9 aa, Homo sapiens
ELVVDFLSY

SEQ ID NO: 179927 - protein, 9 aa, Homo sapiens
LHITPGTAY

SEQ ID NO: 179928 - protein, 9 aa, Homo sapiens
NPSWHLADS

SEQ ID NO: 179929 - protein, 9 aa, Homo sapiens
RIAAWMATY

SEQ ID NO: 179930 - protein, 9 aa, Homo sapiens
REAGDEFEL

SEQ ID NO: 179931 - protein, 9 aa, Homo sapiens
QERFNRWFL

SEQ ID NO: 179932 - protein, 9 aa, Homo sapiens
QENGGWDTF

SEQ ID NO: 179933 - protein, 9 aa, Homo sapiens
FEQVVNELF

SEQ ID NO: 179934 - protein, 9 aa, Homo sapiens
FELRYRRAF

SEQ ID NO: 179935 - protein, 9 aa, Homo sapiens
SEMETPSAI

SEQ ID NO: 179936 - protein, 9 aa, Homo sapiens
FELRYRRAF

SEQ ID NO: 179937 - protein, 9 aa, Homo sapiens
QENGGWDTF

SEQ ID NO: 179938 - protein, 9 aa, Homo sapiens
SEMETPSAI

SEQ ID NO: 179939 - protein, 9 aa, Homo sapiens
RELVVDFLS

SEQ ID NO: 179940 - protein, 9 aa, Homo sapiens
REVIPMAAV

SEQ ID NO: 179941 - protein, 9 aa, Homo sapiens
IAAWMATYL

SEQ ID NO: 179942 - protein, 9 aa, Homo sapiens
IPMAAVKQA

SEQ ID NO: 179943 - protein, 9 aa, Homo sapiens
SAINGNPSW

SEQ ID NO: 179944 - protein, 9 aa, Homo sapiens
KLSQKGYSW

SEQ ID NO: 179945 - protein, 9 aa, Homo sapiens
IAAWMATYL

SEQ ID NO: 179946 - protein, 9 aa, Homo sapiens
YLNDHLEPW

SEQ ID NO: 179947 - protein, 10 aa, Homo sapiens
FSDLTSQLHI

SEQ ID NO: 179948 - protein, 10 aa, Homo sapiens
YLNDHLEPWI

SEQ ID NO: 179949 - protein, 10 aa, Homo sapiens
FLTGMTVAGV

SEQ ID NO: 179950 - protein, 10 aa, Homo sapiens
RIAAWMATYL

SEQ ID NO: 179951 - protein, 10 aa, Homo sapiens
WMATYLNDHL

SEQ ID NO: 179952 - protein, 10 aa, Homo sapiens
LVVDFLSYKL

SEQ ID NO: 179953 - protein, 10 aa, Homo sapiens
SLDAREVIPM

SEQ ID NO: 179954 - protein, 10 aa, Homo sapiens
VLVSRIAAWM

SEQ ID NO: 179955 - protein, 10 aa, Homo sapiens
SVDKEMQVLV

SEQ ID NO: 179956 - protein, 10 aa, Homo sapiens
GMTVAGVVLL

SEQ ID NO: 179957 - protein, 10 aa, Homo sapiens
FLTGMTVAGV

SEQ ID NO: 179958 - protein, 10 aa, Homo sapiens
WMATYLNDHL

SEQ ID NO: 179959 - protein, 10 aa, Homo sapiens
RIAAWMATYL

SEQ ID NO: 179960 - protein, 10 aa, Homo sapiens
LVVDFLSYKL

SEQ ID NO: 179961 - protein, 10 aa, Homo sapiens
RAFSDLTSQL

SEQ ID NO: 179962 - protein, 10 aa, Homo sapiens
SLDAREVIPM

SEQ ID NO: 179963 - protein, 10 aa, Homo sapiens
YLNDHLEPWI

SEQ ID NO: 179964 - protein, 10 aa, Homo sapiens
GMTVAGVVLL

SEQ ID NO: 179965 - protein, 10 aa, Homo sapiens
FGGALCVESV

SEQ ID NO: 179966 - protein, 10 aa, Homo sapiens
VLVSRIAAWM

SEQ ID NO: 179967 - protein, 10 aa, Homo sapiens
FLTGMTVAGV

SEQ ID NO: 179968 - protein, 10 aa, Homo sapiens
YLNDHLEPWI

SEQ ID NO: 179969 - protein, 10 aa, Homo sapiens
RIAAWMATYL

SEQ ID NO: 179970 - protein, 10 aa, Homo sapiens
WMATYLNDHL

SEQ ID NO: 179971 - protein, 10 aa, Homo sapiens
VLVSRIAAWM

SEQ ID NO: 179972 - protein, 10 aa, Homo sapiens
IVAFFSFGGA

SEQ ID NO: 179973 - protein, 10 aa, Homo sapiens
LVVDFLSYKL

SEQ ID NO: 179974 - protein, 10 aa, Homo sapiens
VVNELFRDGV

SEQ ID NO: 179975 - protein, 10 aa, Homo sapiens
GMTVAGVVLL

SEQ ID NO: 179976 - protein, 10 aa, Homo sapiens
RAFSDLTSQL

SEQ ID NO: 179977 - protein, 10 aa, Homo sapiens
LTGMTVAGVV

SEQ ID NO: 179978 - protein, 10 aa, Homo sapiens
GTAYQSFEQV

SEQ ID NO: 179979 - protein, 10 aa, Homo sapiens
FLTGMTVAGV

SEQ ID NO: 179980 - protein, 10 aa, Homo sapiens
YLNDHLEPWI

SEQ ID NO: 179981 - protein, 10 aa, Homo sapiens
SLDAREVIPM

SEQ ID NO: 179982 - protein, 10 aa, Homo sapiens
RIAAWMATYL

SEQ ID NO: 179983 - protein, 10 aa, Homo sapiens
LVVDFLSYKL

SEQ ID NO: 179984 - protein, 10 aa, Homo sapiens
AINGNPSWHL

SEQ ID NO: 179985 - protein, 10 aa, Homo sapiens
FLTGMTVAGV

SEQ ID NO: 179986 - protein, 10 aa, Homo sapiens
RIAAWMATYL

SEQ ID NO: 179987 - protein, 10 aa, Homo sapiens
YLNDHLEPWI

SEQ ID NO: 179988 - protein, 10 aa, Homo sapiens
MQVLVSRIAA

SEQ ID NO: 179989 - protein, 10 aa, Homo sapiens
LVVDFLSYKL

SEQ ID NO: 179990 - protein, 10 aa, Homo sapiens
WMATYLNDHL

SEQ ID NO: 179991 - protein, 10 aa, Homo sapiens
SQLHITPGTA

SEQ ID NO: 179992 - protein, 10 aa, Homo sapiens
GTAYQSFEQV

SEQ ID NO: 179993 - protein, 10 aa, Homo sapiens
SVDKEMQVLV

SEQ ID NO: 179994 - protein, 10 aa, Homo sapiens
RAFSDLTSQL

SEQ ID NO: 179995 - protein, 10 aa, Homo sapiens
KEMQVLVSRI

SEQ ID NO: 179996 - protein, 10 aa, Homo sapiens
IQENGGWDTF

SEQ ID NO: 179997 - protein, 10 aa, Homo sapiens
IVAFFSFGGA

SEQ ID NO: 179998 - protein, 10 aa, Homo sapiens
VVNELFRDGV

SEQ ID NO: 179999 - protein, 10 aa, Homo sapiens
TAYQSFEQVV

SEQ ID NO: 180000 - protein, 10 aa, Homo sapiens
FLTGMTVAGV

SEQ ID NO: 180001 - protein, 10 aa, Homo sapiens
YLNDHLEPWI

SEQ ID NO: 180002 - protein, 10 aa, Homo sapiens
SVDKEMQVLV

SEQ ID NO: 180003 - protein, 10 aa, Homo sapiens
SLDAREVIPM

SEQ ID NO: 180004 - protein, 10 aa, Homo sapiens
GMTVAGVVLL

SEQ ID NO: 180005 - protein, 10 aa, Homo sapiens
LVVDFLSYKL

SEQ ID NO: 180006 - protein, 10 aa, Homo sapiens
RIAAWMATYL

SEQ ID NO: 180007 - protein, 10 aa, Homo sapiens
VVNELFRDGV

SEQ ID NO: 180008 - protein, 10 aa, Homo sapiens
AINGNPSWHL

SEQ ID NO: 180009 - protein, 10 aa, Homo sapiens
WMATYLNDHL

SEQ ID NO: 180010 - protein, 10 aa, Homo sapiens
TAYQSFEQVV

SEQ ID NO: 180011 - protein, 10 aa, Homo sapiens
VLVSRIAAWM

SEQ ID NO: 180012 - protein, 10 aa, Homo sapiens
FFSFGGALCV

SEQ ID NO: 180013 - protein, 10 aa, Homo sapiens
VLLGSLFSRK

SEQ ID NO: 180014 - protein, 10 aa, Homo sapiens
RAFSDLTSQL

SEQ ID NO: 180015 - protein, 10 aa, Homo sapiens
GTAYQSFEQV

SEQ ID NO: 180016 - protein, 10 aa, Homo sapiens
FLTGMTVAGV

SEQ ID NO: 180017 - protein, 10 aa, Homo sapiens
YLNDHLEPWI

SEQ ID NO: 180018 - protein, 10 aa, Homo sapiens
SVDKEMQVLV

SEQ ID NO: 180019 - protein, 10 aa, Homo sapiens
WMATYLNDHL

SEQ ID NO: 180020 - protein, 10 aa, Homo sapiens
VVNELFRDGV

SEQ ID NO: 180021 - protein, 10 aa, Homo sapiens
LVVDFLSYKL

SEQ ID NO: 180022 - protein, 10 aa, Homo sapiens
VLVSRIAAWM

SEQ ID NO: 180023 - protein, 10 aa, Homo sapiens
SLDAREVIPM

SEQ ID NO: 180024 - protein, 10 aa, Homo sapiens
AINGNPSWHL

SEQ ID NO: 180025 - protein, 10 aa, Homo sapiens
RIAAWMATYL

SEQ ID NO: 180026 - protein, 10 aa, Homo sapiens
FFSFGGALCV

SEQ ID NO: 180027 - protein, 10 aa, Homo sapiens
VLLGSLFSRK

SEQ ID NO: 180028 - protein, 10 aa, Homo sapiens
TAYQSFEQVV

SEQ ID NO: 180029 - protein, 10 aa, Homo sapiens
ELYGNNAAAE

SEQ ID NO: 180030 - protein, 10 aa, Homo sapiens
GMTVAGVVLL

SEQ ID NO: 180031 - protein, 10 aa, Homo sapiens
FLTGMTVAGV

SEQ ID NO: 180032 - protein, 10 aa, Homo sapiens
YLNDHLEPWI

SEQ ID NO: 180033 - protein, 10 aa, Homo sapiens
SVDKEMQVLV

SEQ ID NO: 180034 - protein, 10 aa, Homo sapiens
WMATYLNDHL

SEQ ID NO: 180035 - protein, 10 aa, Homo sapiens
RIAAWMATYL

SEQ ID NO: 180036 - protein, 10 aa, Homo sapiens
AINGNPSWHL

SEQ ID NO: 180037 - protein, 10 aa, Homo sapiens
VLVSRIAAWM

SEQ ID NO: 180038 - protein, 10 aa, Homo sapiens
LVVDFLSYKL

SEQ ID NO: 180039 - protein, 10 aa, Homo sapiens
SLDAREVIPM

SEQ ID NO: 180040 - protein, 10 aa, Homo sapiens
GMTVAGVVLL

SEQ ID NO: 180041 - protein, 10 aa, Homo sapiens
TAYQSFEQVV

SEQ ID NO: 180042 - protein, 10 aa, Homo sapiens
FFSFGGALCV

SEQ ID NO: 180043 - protein, 10 aa, Homo sapiens
GTAYQSFEQV

SEQ ID NO: 180044 - protein, 10 aa, Homo sapiens
FLTGMTVAGV

SEQ ID NO: 180045 - protein, 10 aa, Homo sapiens
YLNDHLEPWI

SEQ ID NO: 180046 - protein, 10 aa, Homo sapiens
WMATYLNDHL

SEQ ID NO: 180047 - protein, 10 aa, Homo sapiens
AINGNPSWHL

SEQ ID NO: 180048 - protein, 10 aa, Homo sapiens
LVVDFLSYKL

SEQ ID NO: 180049 - protein, 10 aa, Homo sapiens
SVDKEMQVLV

SEQ ID NO: 180050 - protein, 10 aa, Homo sapiens
RIAAWMATYL

SEQ ID NO: 180051 - protein, 10 aa, Homo sapiens
SLDAREVIPM

SEQ ID NO: 180052 - protein, 10 aa, Homo sapiens
VLVSRIAAWM

SEQ ID NO: 180053 - protein, 10 aa, Homo sapiens
VLLGSLFSRK

SEQ ID NO: 180054 - protein, 10 aa, Homo sapiens
ELVVDFLSYK

SEQ ID NO: 180055 - protein, 10 aa, Homo sapiens
GALCVESVDK

SEQ ID NO: 180056 - protein, 10 aa, Homo sapiens
VVLLGSLFSR

SEQ ID NO: 180057 - protein, 10 aa, Homo sapiens
REVIPMAAVK

SEQ ID NO: 180058 - protein, 10 aa, Homo sapiens
VLLGSLFSRK

SEQ ID NO: 180059 - protein, 10 aa, Homo sapiens
VVLLGSLFSR

SEQ ID NO: 180060 - protein, 10 aa, Homo sapiens
GALCVESVDK

SEQ ID NO: 180061 - protein, 10 aa, Homo sapiens
SQFSDVEENR

SEQ ID NO: 180062 - protein, 10 aa, Homo sapiens
SFEQVVNELF

SEQ ID NO: 180063 - protein, 10 aa, Homo sapiens
TYLNDHLEPW

SEQ ID NO: 180064 - protein, 10 aa, Homo sapiens
SFEQVVNELF

SEQ ID NO: 180065 - protein, 10 aa, Homo sapiens
TYLNDHLEPW

SEQ ID NO: 180066 - protein, 10 aa, Homo sapiens
ITPGTAYQSF

SEQ ID NO: 180067 - protein, 10 aa, Homo sapiens
TYLNDHLEPW

SEQ ID NO: 180068 - protein, 10 aa, Homo sapiens
SFEQVVNELF

SEQ ID NO: 180069 - protein, 10 aa, Homo sapiens
ITPGTAYQSF

SEQ ID NO: 180070 - protein, 10 aa, Homo sapiens
EAPEGTESEM

SEQ ID NO: 180071 - protein, 10 aa, Homo sapiens
RIAAWMATYL

SEQ ID NO: 180072 - protein, 10 aa, Homo sapiens
ITPGTAYQSF

SEQ ID NO: 180073 - protein, 10 aa, Homo sapiens
VLVSRIAAWM

SEQ ID NO: 180074 - protein, 10 aa, Homo sapiens
EAPEGTESEM

SEQ ID NO: 180075 - protein, 10 aa, Homo sapiens
ESVDKEMQVL

SEQ ID NO: 180076 - protein, 10 aa, Homo sapiens
EFELRYRRAF

SEQ ID NO: 180077 - protein, 10 aa, Homo sapiens
QLHITPGTAY

SEQ ID NO: 180078 - protein, 10 aa, Homo sapiens
VVLLGSLFSR

SEQ ID NO: 180079 - protein, 10 aa, Homo sapiens
LFRDGVNWGR

SEQ ID NO: 180080 - protein, 10 aa, Homo sapiens
SRKGQERFNR

SEQ ID NO: 180081 - protein, 10 aa, Homo sapiens
PMAAVKQALR

SEQ ID NO: 180082 - protein, 10 aa, Homo sapiens
VVLLGSLFSR

SEQ ID NO: 180083 - protein, 10 aa, Homo sapiens
LFRDGVNWGR

SEQ ID NO: 180084 - protein, 10 aa, Homo sapiens
DFLSYKLSQK

SEQ ID NO: 180085 - protein, 10 aa, Homo sapiens
ELVVDFLSYK

SEQ ID NO: 180086 - protein, 10 aa, Homo sapiens
SQFSDVEENR

SEQ ID NO: 180087 - protein, 10 aa, Homo sapiens
VVLLGSLFSR

SEQ ID NO: 180088 - protein, 10 aa, Homo sapiens
YGNNAAAESR

SEQ ID NO: 180089 - protein, 10 aa, Homo sapiens
EVIPMAAVKQ

SEQ ID NO: 180090 - protein, 10 aa, Homo sapiens
MATYLNDHLE

SEQ ID NO: 180091 - protein, 10 aa, Homo sapiens
IVAFFSFGGA

SEQ ID NO: 180092 - protein, 10 aa, Homo sapiens
GTAYQSFEQV

SEQ ID NO: 180093 - protein, 10 aa, Homo sapiens
LVVDFLSYKL

SEQ ID NO: 180094 - protein, 10 aa, Homo sapiens
QSFEQVVNEL

SEQ ID NO: 180095 - protein, 10 aa, Homo sapiens
FLTGMTVAGV

SEQ ID NO: 180096 - protein, 10 aa, Homo sapiens
TAYQSFEQVV

SEQ ID NO: 180097 - protein, 10 aa, Homo sapiens
RIAAWMATYL

SEQ ID NO: 180098 - protein, 10 aa, Homo sapiens
NGATGHSSSL

SEQ ID NO: 180099 - protein, 10 aa, Homo sapiens
TVAGVVLLGS

SEQ ID NO: 180100 - protein, 10 aa, Homo sapiens
FGGALCVESV

SEQ ID NO: 180101 - protein, 10 aa, Homo sapiens
VVNELFRDGV

SEQ ID NO: 180102 - protein, 10 aa, Homo sapiens
LVSRIAAWMA

SEQ ID NO: 180103 - protein, 10 aa, Homo sapiens
TGMTVAGVVL

SEQ ID NO: 180104 - protein, 10 aa, Homo sapiens
SVDKEMQVLV

SEQ ID NO: 180105 - protein, 10 aa, Homo sapiens
FLTGMTVAGV

SEQ ID NO: 180106 - protein, 10 aa, Homo sapiens
TAYQSFEQVV

SEQ ID NO: 180107 - protein, 10 aa, Homo sapiens
LVVDFLSYKL

SEQ ID NO: 180108 - protein, 10 aa, Homo sapiens
RIAAWMATYL

SEQ ID NO: 180109 - protein, 10 aa, Homo sapiens
GTAYQSFEQV

SEQ ID NO: 180110 - protein, 10 aa, Homo sapiens
IPMAAVKQAL

SEQ ID NO: 180111 - protein, 10 aa, Homo sapiens
SQKGYSWSQF

SEQ ID NO: 180112 - protein, 10 aa, Homo sapiens
QLHITPGTAY

SEQ ID NO: 180113 - protein, 10 aa, Homo sapiens
GVNWGRIVAF

SEQ ID NO: 180114 - protein, 10 aa, Homo sapiens
IQENGGWDTF

SEQ ID NO: 180115 - protein, 10 aa, Homo sapiens
LSYKLSQKGY

SEQ ID NO: 180116 - protein, 10 aa, Homo sapiens
RELVVDFLSY

SEQ ID NO: 180117 - protein, 10 aa, Homo sapiens
SRIAAWMATY

SEQ ID NO: 180118 - protein, 10 aa, Homo sapiens
RRAFSDLTSQ

SEQ ID NO: 180119 - protein, 10 aa, Homo sapiens
IPMAAVKQAL

SEQ ID NO: 180120 - protein, 10 aa, Homo sapiens
EPWIQENGGW

SEQ ID NO: 180121 - protein, 10 aa, Homo sapiens
EAGDEFELRY

SEQ ID NO: 180122 - protein, 10 aa, Homo sapiens
EAPEGTESEM

SEQ ID NO: 180123 - protein, 10 aa, Homo sapiens
QALREAGDEF

SEQ ID NO: 180124 - protein, 10 aa, Homo sapiens
SPAVNGATGH

SEQ ID NO: 180125 - protein, 10 aa, Homo sapiens
TPSAINGNPS

SEQ ID NO: 180126 - protein, 10 aa, Homo sapiens
GVNWGRIVAF

SEQ ID NO: 180127 - protein, 10 aa, Homo sapiens
VAFFSFGGAL

SEQ ID NO: 180128 - protein, 10 aa, Homo sapiens
FVELYGNNAA

SEQ ID NO: 180129 - protein, 10 aa, Homo sapiens
AESRKGQERF

SEQ ID NO: 180130 - protein, 10 aa, Homo sapiens
EPWIQENGGW

SEQ ID NO: 180131 - protein, 10 aa, Homo sapiens
QSNRELVVDF

SEQ ID NO: 180132 - protein, 10 aa, Homo sapiens
QVLVSRIAAW

SEQ ID NO: 180133 - protein, 10 aa, Homo sapiens
PSAINGNPSW

SEQ ID NO: 180134 - protein, 11 aa, Homo sapiens
FLTGMTVAGVV

SEQ ID NO: 180135 - protein, 11 aa, Homo sapiens
SLDAREVIPMA

SEQ ID NO: 180136 - protein, 11 aa, Homo sapiens
VLVSRIAAWMA

SEQ ID NO: 180137 - protein, 11 aa, Homo sapiens
HLADSPAVNGA

SEQ ID NO: 180138 - protein, 11 aa, Homo sapiens
YLNDHLEPWIQ

SEQ ID NO: 180139 - protein, 11 aa, Homo sapiens
ALREAGDEFEL

SEQ ID NO: 180140 - protein, 11 aa, Homo sapiens
YQSFEQVVNEL

SEQ ID NO: 180141 - protein, 11 aa, Homo sapiens
HLADSPAVNGA

SEQ ID NO: 180142 - protein, 11 aa, Homo sapiens
FLTGMTVAGVV

SEQ ID NO: 180143 - protein, 11 aa, Homo sapiens
YQSFEQVVNEL

SEQ ID NO: 180144 - protein, 11 aa, Homo sapiens
ALREAGDEFEL

SEQ ID NO: 180145 - protein, 11 aa, Homo sapiens
YLNDHLEPWIQ

SEQ ID NO: 180146 - protein, 11 aa, Homo sapiens
IVAFFSFGGAL

SEQ ID NO: 180147 - protein, 11 aa, Homo sapiens
TVAGVVLLGSL

SEQ ID NO: 180148 - protein, 11 aa, Homo sapiens
VLVSRIAAWMA

SEQ ID NO: 180149 - protein, 11 aa, Homo sapiens
KLSQKGYSWSQ

SEQ ID NO: 180150 - protein, 11 aa, Homo sapiens
ELVVDFLSYKL

SEQ ID NO: 180151 - protein, 11 aa, Homo sapiens
SLDAREVIPMA

SEQ ID NO: 180152 - protein, 11 aa, Homo sapiens
FLTGMTVAGVV

SEQ ID NO: 180153 - protein, 11 aa, Homo sapiens
HLADSPAVNGA

SEQ ID NO: 180154 - protein, 11 aa, Homo sapiens
RIVAFFSFGGA

SEQ ID NO: 180155 - protein, 11 aa, Homo sapiens
VLVSRIAAWMA

SEQ ID NO: 180156 - protein, 11 aa, Homo sapiens
TVAGVVLLGSL

SEQ ID NO: 180157 - protein, 11 aa, Homo sapiens
ALREAGDEFEL

SEQ ID NO: 180158 - protein, 11 aa, Homo sapiens
YQSFEQVVNEL

SEQ ID NO: 180159 - protein, 11 aa, Homo sapiens
YLNDHLEPWIQ

SEQ ID NO: 180160 - protein, 11 aa, Homo sapiens
AINGNPSWHLA

SEQ ID NO: 180161 - protein, 11 aa, Homo sapiens
FNRWFLTGMTV

SEQ ID NO: 180162 - protein, 11 aa, Homo sapiens
IVAFFSFGGAL

SEQ ID NO: 180163 - protein, 11 aa, Homo sapiens
SLDAREVIPMA

SEQ ID NO: 180164 - protein, 11 aa, Homo sapiens
MAAVKQALREA

SEQ ID NO: 180165 - protein, 11 aa, Homo sapiens
QVVNELFRDGV

SEQ ID NO: 180166 - protein, 11 aa, Homo sapiens
FLTGMTVAGVV

SEQ ID NO: 180167 - protein, 11 aa, Homo sapiens
ALREAGDEFEL

SEQ ID NO: 180168 - protein, 11 aa, Homo sapiens
VLVSRIAAWMA

SEQ ID NO: 180169 - protein, 11 aa, Homo sapiens
YLNDHLEPWIQ

SEQ ID NO: 180170 - protein, 11 aa, Homo sapiens
SLDAREVIPMA

SEQ ID NO: 180171 - protein, 11 aa, Homo sapiens
FLTGMTVAGVV

SEQ ID NO: 180172 - protein, 11 aa, Homo sapiens
RIVAFFSFGGA

SEQ ID NO: 180173 - protein, 11 aa, Homo sapiens
IQENGGWDTFV

SEQ ID NO: 180174 - protein, 11 aa, Homo sapiens
YQSFEQVVNEL

SEQ ID NO: 180175 - protein, 11 aa, Homo sapiens
SAINGNPSWHL

SEQ ID NO: 180176 - protein, 11 aa, Homo sapiens
QVVNELFRDGV

SEQ ID NO: 180177 - protein, 11 aa, Homo sapiens
VLVSRIAAWMA

SEQ ID NO: 180178 - protein, 11 aa, Homo sapiens
KQALREAGDEF

SEQ ID NO: 180179 - protein, 11 aa, Homo sapiens
HLADSPAVNGA

SEQ ID NO: 180180 - protein, 11 aa, Homo sapiens
TVAGVVLLGSL

SEQ ID NO: 180181 - protein, 11 aa, Homo sapiens
ALREAGDEFEL

SEQ ID NO: 180182 - protein, 11 aa, Homo sapiens
SQLHITPGTAY

SEQ ID NO: 180183 - protein, 11 aa, Homo sapiens
FLTGMTVAGVV

SEQ ID NO: 180184 - protein, 11 aa, Homo sapiens
SLDAREVIPMA

SEQ ID NO: 180185 - protein, 11 aa, Homo sapiens
YLNDHLEPWIQ

SEQ ID NO: 180186 - protein, 11 aa, Homo sapiens
ALREAGDEFEL

SEQ ID NO: 180187 - protein, 11 aa, Homo sapiens
HLADSPAVNGA

SEQ ID NO: 180188 - protein, 11 aa, Homo sapiens
VLVSRIAAWMA

SEQ ID NO: 180189 - protein, 11 aa, Homo sapiens
KLSQKGYSWSQ

SEQ ID NO: 180190 - protein, 11 aa, Homo sapiens
ELVVDFLSYKL

SEQ ID NO: 180191 - protein, 11 aa, Homo sapiens
TVAGVVLLGSL

SEQ ID NO: 180192 - protein, 11 aa, Homo sapiens
AINGNPSWHLA

SEQ ID NO: 180193 - protein, 11 aa, Homo sapiens
WFLTGMTVAGV

SEQ ID NO: 180194 - protein, 11 aa, Homo sapiens
AFFSFGGALCV

SEQ ID NO: 180195 - protein, 11 aa, Homo sapiens
SFGGALCVESV

SEQ ID NO: 180196 - protein, 11 aa, Homo sapiens
VIPMAAVKQAL

SEQ ID NO: 180197 - protein, 11 aa, Homo sapiens
QVVNELFRDGV

SEQ ID NO: 180198 - protein, 11 aa, Homo sapiens
FRDGVNWGRIV

SEQ ID NO: 180199 - protein, 11 aa, Homo sapiens
SAINGNPSWHL

SEQ ID NO: 180200 - protein, 11 aa, Homo sapiens
ELYGNNAAAES

SEQ ID NO: 180201 - protein, 11 aa, Homo sapiens
CVESVDKEMQV

SEQ ID NO: 180202 - protein, 11 aa, Homo sapiens
GTAYQSFEQVV

SEQ ID NO: 180203 - protein, 11 aa, Homo sapiens
IVAFFSFGGAL

SEQ ID NO: 180204 - protein, 11 aa, Homo sapiens
FLTGMTVAGVV

SEQ ID NO: 180205 - protein, 11 aa, Homo sapiens
YLNDHLEPWIQ

SEQ ID NO: 180206 - protein, 11 aa, Homo sapiens
ALREAGDEFEL

SEQ ID NO: 180207 - protein, 11 aa, Homo sapiens
SLDAREVIPMA

SEQ ID NO: 180208 - protein, 11 aa, Homo sapiens
HLADSPAVNGA

SEQ ID NO: 180209 - protein, 11 aa, Homo sapiens
VLVSRIAAWMA

SEQ ID NO: 180210 - protein, 11 aa, Homo sapiens
VIPMAAVKQAL

SEQ ID NO: 180211 - protein, 11 aa, Homo sapiens
KLSQKGYSWSQ

SEQ ID NO: 180212 - protein, 11 aa, Homo sapiens
WFLTGMTVAGV

SEQ ID NO: 180213 - protein, 11 aa, Homo sapiens
ELVVDFLSYKL

SEQ ID NO: 180214 - protein, 11 aa, Homo sapiens
FRDGVNWGRIV

SEQ ID NO: 180215 - protein, 11 aa, Homo sapiens
FLTGMTVAGVV

SEQ ID NO: 180216 - protein, 11 aa, Homo sapiens
ALREAGDEFEL

SEQ ID NO: 180217 - protein, 11 aa, Homo sapiens
SLDAREVIPMA

SEQ ID NO: 180218 - protein, 11 aa, Homo sapiens
VLVSRIAAWMA

SEQ ID NO: 180219 - protein, 11 aa, Homo sapiens
CVESVDKEMQV

SEQ ID NO: 180220 - protein, 11 aa, Homo sapiens
HLADSPAVNGA

SEQ ID NO: 180221 - protein, 11 aa, Homo sapiens
SFGGALCVESV

SEQ ID NO: 180222 - protein, 11 aa, Homo sapiens
YLNDHLEPWIQ

SEQ ID NO: 180223 - protein, 11 aa, Homo sapiens
KLSQKGYSWSQ

SEQ ID NO: 180224 - protein, 11 aa, Homo sapiens
ELVVDFLSYKL

SEQ ID NO: 180225 - protein, 11 aa, Homo sapiens
TVAGVVLLGSL

SEQ ID NO: 180226 - protein, 11 aa, Homo sapiens
AFFSFGGALCV

SEQ ID NO: 180227 - protein, 11 aa, Homo sapiens
IQENGGWDTFV

SEQ ID NO: 180228 - protein, 11 aa, Homo sapiens
QVVNELFRDGV

SEQ ID NO: 180229 - protein, 11 aa, Homo sapiens
VIPMAAVKQAL

SEQ ID NO: 180230 - protein, 11 aa, Homo sapiens
ELYGNNAAAES

SEQ ID NO: 180231 - protein, 11 aa, Homo sapiens
SAINGNPSWHL

SEQ ID NO: 180232 - protein, 11 aa, Homo sapiens
WFLTGMTVAGV

SEQ ID NO: 180233 - protein, 11 aa, Homo sapiens
AINGNPSWHLA

SEQ ID NO: 180234 - protein, 11 aa, Homo sapiens
FLTGMTVAGVV

SEQ ID NO: 180235 - protein, 11 aa, Homo sapiens
HLADSPAVNGA

SEQ ID NO: 180236 - protein, 11 aa, Homo sapiens
YLNDHLEPWIQ

SEQ ID NO: 180237 - protein, 11 aa, Homo sapiens
SLDAREVIPMA

SEQ ID NO: 180238 - protein, 11 aa, Homo sapiens
ALREAGDEFEL

SEQ ID NO: 180239 - protein, 11 aa, Homo sapiens
WFLTGMTVAGV

SEQ ID NO: 180240 - protein, 11 aa, Homo sapiens
VLVSRIAAWMA

SEQ ID NO: 180241 - protein, 11 aa, Homo sapiens
VVLLGSLFSRK

SEQ ID NO: 180242 - protein, 11 aa, Homo sapiens
VVLLGSLFSRK

SEQ ID NO: 180243 - protein, 11 aa, Homo sapiens
GVVLLGSLFSR

SEQ ID NO: 180244 - protein, 11 aa, Homo sapiens
ATGHSSSLDAR

SEQ ID NO: 180245 - protein, 11 aa, Homo sapiens
RELVVDFLSYK

SEQ ID NO: 180246 - protein, 11 aa, Homo sapiens
NWGRIVAFFSF

SEQ ID NO: 180247 - protein, 11 aa, Homo sapiens
TYLNDHLEPWI

SEQ ID NO: 180248 - protein, 11 aa, Homo sapiens
AWMATYLNDHL

SEQ ID NO: 180249 - protein, 11 aa, Homo sapiens
SYKLSQKGYSW

SEQ ID NO: 180250 - protein, 11 aa, Homo sapiens
NWGRIVAFFSF

SEQ ID NO: 180251 - protein, 11 aa, Homo sapiens
TYLNDHLEPWI

SEQ ID NO: 180252 - protein, 11 aa, Homo sapiens
AWMATYLNDHL

SEQ ID NO: 180253 - protein, 11 aa, Homo sapiens
TYLNDHLEPWI

SEQ ID NO: 180254 - protein, 11 aa, Homo sapiens
AWMATYLNDHL

SEQ ID NO: 180255 - protein, 11 aa, Homo sapiens
SYKLSQKGYSW

SEQ ID NO: 180256 - protein, 11 aa, Homo sapiens
HITPGTAYQSF

SEQ ID NO: 180257 - protein, 11 aa, Homo sapiens
QVLVSRIAAWM

SEQ ID NO: 180258 - protein, 11 aa, Homo sapiens
HITPGTAYQSF

SEQ ID NO: 180259 - protein, 11 aa, Homo sapiens
WIQENGGWDTF

SEQ ID NO: 180260 - protein, 11 aa, Homo sapiens
FLSYKLSQKGY

SEQ ID NO: 180261 - protein, 11 aa, Homo sapiens
DGVNWGRIVAF

SEQ ID NO: 180262 - protein, 11 aa, Homo sapiens
TVAGVVLLGSL

SEQ ID NO: 180263 - protein, 11 aa, Homo sapiens
SQLHITPGTAY

SEQ ID NO: 180264 - protein, 11 aa, Homo sapiens
VVLLGSLFSRK

SEQ ID NO: 180265 - protein, 11 aa, Homo sapiens
RYRRAFSDLTS

SEQ ID NO: 180266 - protein, 11 aa, Homo sapiens
GVVLLGSLFSR

SEQ ID NO: 180267 - protein, 11 aa, Homo sapiens
SFEQVVNELFR

SEQ ID NO: 180268 - protein, 11 aa, Homo sapiens
ESRKGQERFNR

SEQ ID NO: 180269 - protein, 11 aa, Homo sapiens
ATGHSSSLDAR

SEQ ID NO: 180270 - protein, 11 aa, Homo sapiens
RELVVDFLSYK

SEQ ID NO: 180271 - protein, 11 aa, Homo sapiens
LYGNNAAAESR

SEQ ID NO: 180272 - protein, 11 aa, Homo sapiens
ESRKGQERFNR

SEQ ID NO: 180273 - protein, 11 aa, Homo sapiens
ELFRDGVNWGR

SEQ ID NO: 180274 - protein, 11 aa, Homo sapiens
EAGDEFELRYR

SEQ ID NO: 180275 - protein, 11 aa, Homo sapiens
SFEQVVNELFR

SEQ ID NO: 180276 - protein, 11 aa, Homo sapiens
GVVLLGSLFSR

SEQ ID NO: 180277 - protein, 11 aa, Homo sapiens
EFELRYRRAFS

SEQ ID NO: 180278 - protein, 11 aa, Homo sapiens
ELFRDGVNWGR

SEQ ID NO: 180279 - protein, 11 aa, Homo sapiens
WSQFSDVEENR

SEQ ID NO: 180280 - protein, 11 aa, Homo sapiens
ESRKGQERFNR

SEQ ID NO: 180281 - protein, 11 aa, Homo sapiens
EAGDEFELRYR

SEQ ID NO: 180282 - protein, 11 aa, Homo sapiens
GVVLLGSLFSR

SEQ ID NO: 180283 - protein, 11 aa, Homo sapiens
IPMAAVKQALR

SEQ ID NO: 180284 - protein, 11 aa, Homo sapiens
SFEQVVNELFR

SEQ ID NO: 180285 - protein, 11 aa, Homo sapiens
TVAGVVLLGSL

SEQ ID NO: 180286 - protein, 11 aa, Homo sapiens
QVVNELFRDGV

SEQ ID NO: 180287 - protein, 11 aa, Homo sapiens
IVAFFSFGGAL

SEQ ID NO: 180288 - protein, 11 aa, Homo sapiens
ESVDKEMQVLV

SEQ ID NO: 180289 - protein, 11 aa, Homo sapiens
TGMTVAGVVLL

SEQ ID NO: 180290 - protein, 11 aa, Homo sapiens
ELVVDFLSYKL

SEQ ID NO: 180291 - protein, 11 aa, Homo sapiens
RIVAFFSFGGA

SEQ ID NO: 180292 - protein, 11 aa, Homo sapiens
DTFVELYGNNA

SEQ ID NO: 180293 - protein, 11 aa, Homo sapiens
EVIPMAAVKQA

SEQ ID NO: 180294 - protein, 11 aa, Homo sapiens
GTAYQSFEQVV

SEQ ID NO: 180295 - protein, 11 aa, Homo sapiens
DAREVIPMAAV

SEQ ID NO: 180296 - protein, 11 aa, Homo sapiens
HLADSPAVNGA

SEQ ID NO: 180297 - protein, 11 aa, Homo sapiens
MTVAGVVLLGS

SEQ ID NO: 180298 - protein, 11 aa, Homo sapiens
ETPSAINGNPS

SEQ ID NO: 180299 - protein, 11 aa, Homo sapiens
FLTGMTVAGVV

SEQ ID NO: 180300 - protein, 11 aa, Homo sapiens
HSSSLDAREVI

SEQ ID NO: 180301 - protein, 11 aa, Homo sapiens
SAINGNPSWHL

SEQ ID NO: 180302 - protein, 11 aa, Homo sapiens
DAREVIPMAAV

SEQ ID NO: 180303 - protein, 11 aa, Homo sapiens
ESVDKEMQVLV

SEQ ID NO: 180304 - protein, 11 aa, Homo sapiens
HLADSPAVNGA

SEQ ID NO: 180305 - protein, 11 aa, Homo sapiens
PSWHLADSPAV

SEQ ID NO: 180306 - protein, 11 aa, Homo sapiens
WFLTGMTVAGV

SEQ ID NO: 180307 - protein, 11 aa, Homo sapiens
EVIPMAAVKQA

SEQ ID NO: 180308 - protein, 11 aa, Homo sapiens
ELVVDFLSYKL

SEQ ID NO: 180309 - protein, 11 aa, Homo sapiens
TVAGVVLLGSL

SEQ ID NO: 180310 - protein, 11 aa, Homo sapiens
DTFVELYGNNA

SEQ ID NO: 180311 - protein, 11 aa, Homo sapiens
IVAFFSFGGAL

SEQ ID NO: 180312 - protein, 11 aa, Homo sapiens
NPSWHLADSPA

SEQ ID NO: 180313 - protein, 11 aa, Homo sapiens
SPAVNGATGHS

SEQ ID NO: 180314 - protein, 11 aa, Homo sapiens
SQLHITPGTAY

SEQ ID NO: 180315 - protein, 11 aa, Homo sapiens
KQALREAGDEF

SEQ ID NO: 180316 - protein, 11 aa, Homo sapiens
SQSNRELVVDF

SEQ ID NO: 180317 - protein, 11 aa, Homo sapiens
YQSFEQVVNEL

SEQ ID NO: 180318 - protein, 11 aa, Homo sapiens
MQVLVSRIAAW

SEQ ID NO: 180319 - protein, 11 aa, Homo sapiens
VSRIAAWMATY

SEQ ID NO: 180320 - protein, 11 aa, Homo sapiens
FLSYKLSQKGY

SEQ ID NO: 180321 - protein, 11 aa, Homo sapiens
WIQENGGWDTF

SEQ ID NO: 180322 - protein, 11 aa, Homo sapiens
QSFEQVVNELF

SEQ ID NO: 180323 - protein, 11 aa, Homo sapiens
HITPGTAYQSF

SEQ ID NO: 180324 - protein, 11 aa, Homo sapiens
GVNWGRIVAFF

SEQ ID NO: 180325 - protein, 11 aa, Homo sapiens
DEFELRYRRAF

SEQ ID NO: 180326 - protein, 11 aa, Homo sapiens
REAGDEFELRY

SEQ ID NO: 180327 - protein, 11 aa, Homo sapiens
SQLHITPGTAY

SEQ ID NO: 180328 - protein, 11 aa, Homo sapiens
VESVDKEMQVL

SEQ ID NO: 180329 - protein, 11 aa, Homo sapiens
LEPWIQENGGW

SEQ ID NO: 180330 - protein, 11 aa, Homo sapiens
FNRWFLTGMTV

SEQ ID NO: 180331 - protein, 11 aa, Homo sapiens
RRAFSDLTSQL

SEQ ID NO: 180332 - protein, 11 aa, Homo sapiens
SRIAAWMATYL

SEQ ID NO: 180333 - protein, 11 aa, Homo sapiens
NPSWHLADSPA

SEQ ID NO: 180334 - protein, 11 aa, Homo sapiens
TPSAINGNPSW

SEQ ID NO: 180335 - protein, 11 aa, Homo sapiens
WIQENGGWDTF

SEQ ID NO: 180336 - protein, 11 aa, Homo sapiens
DGVNWGRIVAF

SEQ ID NO: 180337 - protein, 11 aa, Homo sapiens
YQSFEQVVNEL

SEQ ID NO: 180338 - protein, 11 aa, Homo sapiens
VESVDKEMQVL

SEQ ID NO: 180339 - protein, 11 aa, Homo sapiens
TESEMETPSAI

SEQ ID NO: 180340 - protein, 11 aa, Homo sapiens
EENRTEAPEGT

SEQ ID NO: 180341 - protein, 11 aa, Homo sapiens
TPSAINGNPSW

SEQ ID NO: 180342 - protein, 11 aa, Homo sapiens
NPSWHLADSPA

SEQ ID NO: 180343 - protein, 11 aa, Homo sapiens
ATYLNDHLEPW

SEQ ID NO: 180344 - protein, 11 aa, Homo sapiens
ATYLNDHLEPW

SEQ ID NO: 180345 - protein, 11 aa, Homo sapiens
QSFEQVVNELF

SEQ ID NO: 180346 - protein, 15 aa, Homo sapiens
RWFLTGMTVAGVVLL

SEQ ID NO: 180347 - protein, 9 aa, Homo sapiens
LTGMTVAGV

SEQ ID NO: 180348 - protein, 15 aa, Homo sapiens
RFNRWFLTGMTVAGV

SEQ ID NO: 180349 - protein, 9 aa, Homo sapiens
FLTGMTVAG

SEQ ID NO: 180350 - protein, 15 aa, Homo sapiens
FNRWFLTGMTVAGVV

SEQ ID NO: 180351 - protein, 9 aa, Homo sapiens
LTGMTVAGV

SEQ ID NO: 180352 - protein, 15 aa, Homo sapiens
NRWFLTGMTVAGVVL

SEQ ID NO: 180353 - protein, 9 aa, Homo sapiens
LTGMTVAGV

SEQ ID NO: 180354 - protein, 15 aa, Homo sapiens
WFLTGMTVAGVVLLG

SEQ ID NO: 180355 - protein, 9 aa, Homo sapiens
LTGMTVAGV

SEQ ID NO: 180356 - protein, 15 aa, Homo sapiens
DAREVIPMAAVKQAL

SEQ ID NO: 180357 - protein, 9 aa, Homo sapiens
VIPMAAVKQ

SEQ ID NO: 180358 - protein, 15 aa, Homo sapiens
AREVIPMAAVKQALR

SEQ ID NO: 180359 - protein, 9 aa, Homo sapiens
VIPMAAVKQ

SEQ ID NO: 180360 - protein, 15 aa, Homo sapiens
REVIPMAAVKQALRE

SEQ ID NO: 180361 - protein, 9 aa, Homo sapiens
VIPMAAVKQ

SEQ ID NO: 180362 - protein, 15 aa, Homo sapiens
LDAREVIPMAAVKQA

SEQ ID NO: 180363 - protein, 9 aa, Homo sapiens
VIPMAAVKQ

SEQ ID NO: 180364 - protein, 15 aa, Homo sapiens
KEMQVLVSRIAAWMA

SEQ ID NO: 180365 - protein, 9 aa, Homo sapiens
MQVLVSRIA

SEQ ID NO: 180366 - protein, 15 aa, Homo sapiens
LTSQLHITPGTAYQS

SEQ ID NO: 180367 - protein, 9 aa, Homo sapiens
LHITPGTAY

SEQ ID NO: 180368 - protein, 15 aa, Homo sapiens
TSQLHITPGTAYQSF

SEQ ID NO: 180369 - protein, 9 aa, Homo sapiens
ITPGTAYQS

SEQ ID NO: 180370 - protein, 15 aa, Homo sapiens
SLDAREVIPMAAVKQ

SEQ ID NO: 180371 - protein, 9 aa, Homo sapiens
AREVIPMAA

SEQ ID NO: 180372 - protein, 15 aa, Homo sapiens
SQLHITPGTAYQSFE

SEQ ID NO: 180373 - protein, 9 aa, Homo sapiens
ITPGTAYQS

SEQ ID NO: 180374 - protein, 15 aa, Homo sapiens
FLTGMTVAGVVLLGS

SEQ ID NO: 180375 - protein, 9 aa, Homo sapiens
LTGMTVAGV

SEQ ID NO: 180376 - protein, 15 aa, Homo sapiens
DKEMQVLVSRIAAWM

SEQ ID NO: 180377 - protein, 9 aa, Homo sapiens
MQVLVSRIA

SEQ ID NO: 180378 - protein, 15 aa, Homo sapiens
QLHITPGTAYQSFEQ

SEQ ID NO: 180379 - protein, 9 aa, Homo sapiens
ITPGTAYQS

SEQ ID NO: 180380 - protein, 15 aa, Homo sapiens
LHITPGTAYQSFEQV

SEQ ID NO: 180381 - protein, 9 aa, Homo sapiens
ITPGTAYQS

SEQ ID NO: 180382 - protein, 15 aa, Homo sapiens
SVDKEMQVLVSRIAA

SEQ ID NO: 180383 - protein, 9 aa, Homo sapiens
MQVLVSRIA

SEQ ID NO: 180384 - protein, 15 aa, Homo sapiens
EVIPMAAVKQALREA

SEQ ID NO: 180385 - protein, 9 aa, Homo sapiens
IPMAAVKQA

SEQ ID NO: 180386 - protein, 15 aa, Homo sapiens
ESVDKEMQVLVSRIA

SEQ ID NO: 180387 - protein, 9 aa, Homo sapiens
VDKEMQVLV

SEQ ID NO: 180388 - protein, 15 aa, Homo sapiens
VDKEMQVLVSRIAAW

SEQ ID NO: 180389 - protein, 9 aa, Homo sapiens
MQVLVSRIA

SEQ ID NO: 180390 - protein, 15 aa, Homo sapiens
LTGMTVAGVVLLGSL

SEQ ID NO: 180391 - protein, 9 aa, Homo sapiens
LTGMTVAGV

SEQ ID NO: 180392 - protein, 15 aa, Homo sapiens
ERFNRWFLTGMTVAG

SEQ ID NO: 180393 - protein, 9 aa, Homo sapiens
FNRWFLTGM

SEQ ID NO: 180394 - protein, 15 aa, Homo sapiens
ETPSAINGNPSWHLA

SEQ ID NO: 180395 - protein, 9 aa, Homo sapiens
INGNPSWHL

SEQ ID NO: 180396 - protein, 15 aa, Homo sapiens
TPSAINGNPSWHLAD

SEQ ID NO: 180397 - protein, 9 aa, Homo sapiens
INGNPSWHL

SEQ ID NO: 180398 - protein, 15 aa, Homo sapiens
PSAINGNPSWHLADS

SEQ ID NO: 180399 - protein, 9 aa, Homo sapiens
INGNPSWHL

SEQ ID NO: 180400 - protein, 15 aa, Homo sapiens
SAINGNPSWHLADSP

SEQ ID NO: 180401 - protein, 9 aa, Homo sapiens
INGNPSWHL

SEQ ID NO: 180402 - protein, 15 aa, Homo sapiens
METPSAINGNPSWHL

SEQ ID NO: 180403 - protein, 9 aa, Homo sapiens
PSAINGNPS

SEQ ID NO: 180404 - protein, 15 aa, Homo sapiens
EMQVLVSRIAAWMAT

SEQ ID NO: 180405 - protein, 9 aa, Homo sapiens
MQVLVSRIA

SEQ ID NO: 180406 - protein, 15 aa, Homo sapiens
VIPMAAVKQALREAG

SEQ ID NO: 180407 - protein, 9 aa, Homo sapiens
VIPMAAVKQ

SEQ ID NO: 180408 - protein, 15 aa, Homo sapiens
MQVLVSRIAAWMATY

SEQ ID NO: 180409 - protein, 9 aa, Homo sapiens
MQVLVSRIA

SEQ ID NO: 180410 - protein, 15 aa, Homo sapiens
VLVSRIAAWMATYLN

SEQ ID NO: 180411 - protein, 9 aa, Homo sapiens
IAAWMATYL

SEQ ID NO: 180412 - protein, 15 aa, Homo sapiens
GMTVAGVVLLGSLFS

SEQ ID NO: 180413 - protein, 9 aa, Homo sapiens
MTVAGVVLL

SEQ ID NO: 180414 - protein, 15 aa, Homo sapiens
MTVAGVVLLGSLFSR

SEQ ID NO: 180415 - protein, 9 aa, Homo sapiens
VVLLGSLFS

SEQ ID NO: 180416 - protein, 15 aa, Homo sapiens
INGNPSWHLADSPAV

SEQ ID NO: 180417 - protein, 9 aa, Homo sapiens
INGNPSWHL

SEQ ID NO: 180418 - protein, 15 aa, Homo sapiens
VELYGNNAAAESRKG

SEQ ID NO: 180419 - protein, 9 aa, Homo sapiens
YGNNAAAES

SEQ ID NO: 180420 - protein, 15 aa, Homo sapiens
TVAGVVLLGSLFSRK

SEQ ID NO: 180421 - protein, 9 aa, Homo sapiens
VVLLGSLFS

SEQ ID NO: 180422 - protein, 15 aa, Homo sapiens
QVLVSRIAAWMATYL

SEQ ID NO: 180423 - protein, 9 aa, Homo sapiens
VSRIAAWMA

SEQ ID NO: 180424 - protein, 15 aa, Homo sapiens
FVELYGNNAAAESRK

SEQ ID NO: 180425 - protein, 9 aa, Homo sapiens
YGNNAAAES

SEQ ID NO: 180426 - protein, 15 aa, Homo sapiens
ELYGNNAAAESRKGQ

SEQ ID NO: 180427 - protein, 9 aa, Homo sapiens
YGNNAAAES

SEQ ID NO: 180428 - protein, 15 aa, Homo sapiens
LRYRRAFSDLTSQLH

SEQ ID NO: 180429 - protein, 9 aa, Homo sapiens
YRRAFSDLT

SEQ ID NO: 180430 - protein, 15 aa, Homo sapiens
LVSRIAAWMATYLND

SEQ ID NO: 180431 - protein, 9 aa, Homo sapiens
IAAWMATYL

SEQ ID NO: 180432 - protein, 15 aa, Homo sapiens
TFVELYGNNAAAESR

SEQ ID NO: 180433 - protein, 9 aa, Homo sapiens
YGNNAAAES

SEQ ID NO: 180434 - protein, 15 aa, Homo sapiens
DTFVELYGNNAAAES

SEQ ID NO: 180435 - protein, 9 aa, Homo sapiens
FVELYGNNA

SEQ ID NO: 180436 - protein, 15 aa, Homo sapiens
NPSWHLADSPAVNGA

SEQ ID NO: 180437 - protein, 9 aa, Homo sapiens
WHLADSPAV

SEQ ID NO: 180438 - protein, 15 aa, Homo sapiens
PSWHLADSPAVNGAT

SEQ ID NO: 180439 - protein, 9 aa, Homo sapiens
WHLADSPAV

SEQ ID NO: 180440 - protein, 15 aa, Homo sapiens
TGMTVAGVVLLGSLF

SEQ ID NO: 180441 - protein, 9 aa, Homo sapiens
MTVAGVVLL

SEQ ID NO: 180442 - protein, 15 aa, Homo sapiens
VSRIAAWMATYLNDH

SEQ ID NO: 180443 - protein, 9 aa, Homo sapiens
IAAWMATYL

SEQ ID NO: 180444 - protein, 15 aa, Homo sapiens
GNPSWHLADSPAVNG

SEQ ID NO: 180445 - protein, 9 aa, Homo sapiens
WHLADSPAV

SEQ ID NO: 180446 - protein, 15 aa, Homo sapiens
LADSPAVNGATGHSS

SEQ ID NO: 180447 - protein, 9 aa, Homo sapiens
LADSPAVNG

SEQ ID NO: 180448 - protein, 15 aa, Homo sapiens
ELRYRRAFSDLTSQL

SEQ ID NO: 180449 - protein, 9 aa, Homo sapiens
YRRAFSDLT

SEQ ID NO: 180450 - protein, 15 aa, Homo sapiens
SRIAAWMATYLNDHL

SEQ ID NO: 180451 - protein, 9 aa, Homo sapiens
IAAWMATYL

SEQ ID NO: 180452 - protein, 15 aa, Homo sapiens
FELRYRRAFSDLTSQ

SEQ ID NO: 180453 - protein, 9 aa, Homo sapiens
YRRAFSDLT

SEQ ID NO: 180454 - protein, 15 aa, Homo sapiens
EFELRYRRAFSDLTS

SEQ ID NO: 180455 - protein, 9 aa, Homo sapiens
YRRAFSDLT

SEQ ID NO: 180456 - protein, 15 aa, Homo sapiens
DEFELRYRRAFSDLT

SEQ ID NO: 180457 - protein, 9 aa, Homo sapiens
LRYRRAFSD

SEQ ID NO: 180458 - protein, 15 aa, Homo sapiens
IVAFFSFGGALCVES

SEQ ID NO: 180459 - protein, 9 aa, Homo sapiens
FSFGGALCV

SEQ ID NO: 180460 - protein, 15 aa, Homo sapiens
SWHLADSPAVNGATG

SEQ ID NO: 180461 - protein, 9 aa, Homo sapiens
LADSPAVNG

SEQ ID NO: 180462 - protein, 15 aa, Homo sapiens
DSPAVNGATGHSSSL

SEQ ID NO: 180463 - protein, 9 aa, Homo sapiens
VNGATGHSS

SEQ ID NO: 180464 - protein, 15 aa, Homo sapiens
SPAVNGATGHSSSLD

SEQ ID NO: 180465 - protein, 9 aa, Homo sapiens
VNGATGHSS

SEQ ID NO: 180466 - protein, 15 aa, Homo sapiens
VAFFSFGGALCVESV

SEQ ID NO: 180467 - protein, 9 aa, Homo sapiens
FSFGGALCV

SEQ ID NO: 180468 - protein, 15 aa, Homo sapiens
ADSPAVNGATGHSSS

SEQ ID NO: 180469 - protein, 9 aa, Homo sapiens
VNGATGHSS

SEQ ID NO: 180470 - protein, 15 aa, Homo sapiens
AFFSFGGALCVESVD

SEQ ID NO: 180471 - protein, 9 aa, Homo sapiens
FSFGGALCV

SEQ ID NO: 180472 - protein, 15 aa, Homo sapiens
WHLADSPAVNGATGH

SEQ ID NO: 180473 - protein, 9 aa, Homo sapiens
LADSPAVNG

SEQ ID NO: 180474 - protein, 15 aa, Homo sapiens
HITPGTAYQSFEQVV

SEQ ID NO: 180475 - protein, 9 aa, Homo sapiens
ITPGTAYQS

SEQ ID NO: 180476 - protein, 15 aa, Homo sapiens
ITPGTAYQSFEQVVN

SEQ ID NO: 180477 - protein, 9 aa, Homo sapiens
ITPGTAYQS

SEQ ID NO: 180478 - protein, 15 aa, Homo sapiens
AINGNPSWHLADSPA

SEQ ID NO: 180479 - protein, 9 aa, Homo sapiens
INGNPSWHL

SEQ ID NO: 180480 - protein, 15 aa, Homo sapiens
PAVNGATGHSSSLDA

SEQ ID NO: 180481 - protein, 9 aa, Homo sapiens
VNGATGHSS

SEQ ID NO: 180482 - protein, 15 aa, Homo sapiens
RYRRAFSDLTSQLHI

SEQ ID NO: 180483 - protein, 9 aa, Homo sapiens
YRRAFSDLT

SEQ ID NO: 180484 - protein, 15 aa, Homo sapiens
YRRAFSDLTSQLHIT

SEQ ID NO: 180485 - protein, 9 aa, Homo sapiens
YRRAFSDLT

SEQ ID NO: 180486 - protein, 15 aa, Homo sapiens
NGNPSWHLADSPAVN

SEQ ID NO: 180487 - protein, 9 aa, Homo sapiens
WHLADSPAV

SEQ ID NO: 180488 - protein, 15 aa, Homo sapiens
GRIVAFFSFGGALCV

SEQ ID NO: 180489 - protein, 9 aa, Homo sapiens
IVAFFSFGG

SEQ ID NO: 180490 - protein, 15 aa, Homo sapiens
LYGNNAAAESRKGQE

SEQ ID NO: 180491 - protein, 9 aa, Homo sapiens
YGNNAAAES

SEQ ID NO: 180492 - protein, 15 aa, Homo sapiens
RIAAWMATYLNDHLE

SEQ ID NO: 180493 - protein, 9 aa, Homo sapiens
AAWMATYLN

SEQ ID NO: 180494 - protein, 15 aa, Homo sapiens
YGNNAAAESRKGQER

SEQ ID NO: 180495 - protein, 9 aa, Homo sapiens
YGNNAAAES

SEQ ID NO: 180496 - protein, 15 aa, Homo sapiens
RIVAFFSFGGALCVE

SEQ ID NO: 180497 - protein, 9 aa, Homo sapiens
FSFGGALCV

SEQ ID NO: 180498 - protein, 15 aa, Homo sapiens
FRDGVNWGRIVAFFS

SEQ ID NO: 180499 - protein, 9 aa, Homo sapiens
VNWGRIVAF

SEQ ID NO: 180500 - protein, 15 aa, Homo sapiens
FFSFGGALCVESVDK

SEQ ID NO: 180501 - protein, 9 aa, Homo sapiens
FSFGGALCV

SEQ ID NO: 180502 - protein, 15 aa, Homo sapiens
FSFGGALCVESVDKE

SEQ ID NO: 180503 - protein, 9 aa, Homo sapiens
FSFGGALCV

SEQ ID NO: 180504 - protein, 15 aa, Homo sapiens
RDGVNWGRIVAFFSF

SEQ ID NO: 180505 - protein, 9 aa, Homo sapiens
VNWGRIVAF

SEQ ID NO: 180506 - protein, 15 aa, Homo sapiens
DGVNWGRIVAFFSFG

SEQ ID NO: 180507 - protein, 9 aa, Homo sapiens
VNWGRIVAF

SEQ ID NO: 180508 - protein, 15 aa, Homo sapiens
IPMAAVKQALREAGD

SEQ ID NO: 180509 - protein, 9 aa, Homo sapiens
IPMAAVKQA

SEQ ID NO: 180510 - protein, 15 aa, Homo sapiens
RRAFSDLTSQLHITP

SEQ ID NO: 180511 - protein, 9 aa, Homo sapiens
FSDLTSQLH

SEQ ID NO: 180512 - protein, 15 aa, Homo sapiens
RAFSDLTSQLHITPG

SEQ ID NO: 180513 - protein, 9 aa, Homo sapiens
FSDLTSQLH

SEQ ID NO: 180514 - protein, 15 aa, Homo sapiens
HLADSPAVNGATGHS

SEQ ID NO: 180515 - protein, 9 aa, Homo sapiens
LADSPAVNG

SEQ ID NO: 180516 - protein, 15 aa, Homo sapiens
GVNWGRIVAFFSFGG

SEQ ID NO: 180517 - protein, 9 aa, Homo sapiens
VNWGRIVAF

SEQ ID NO: 180518 - protein, 15 aa, Homo sapiens
IAAWMATYLNDHLEP

SEQ ID NO: 180519 - protein, 9 aa, Homo sapiens
IAAWMATYL

SEQ ID NO: 180520 - protein, 15 aa, Homo sapiens
AVNGATGHSSSLDAR

SEQ ID NO: 180521 - protein, 9 aa, Homo sapiens
VNGATGHSS

SEQ ID NO: 180522 - protein, 15 aa, Homo sapiens
VNWGRIVAFFSFGGA

SEQ ID NO: 180523 - protein, 9 aa, Homo sapiens
VNWGRIVAF

SEQ ID NO: 180524 - protein, 15 aa, Homo sapiens
ELVVDFLSYKLSQKG

SEQ ID NO: 180525 - protein, 9 aa, Homo sapiens
VVDFLSYKL

SEQ ID NO: 180526 - protein, 15 aa, Homo sapiens
ELFRDGVNWGRIVAF

SEQ ID NO: 180527 - protein, 9 aa, Homo sapiens
FRDGVNWGR

SEQ ID NO: 180528 - protein, 15 aa, Homo sapiens
VNGATGHSSSLDARE

SEQ ID NO: 180529 - protein, 9 aa, Homo sapiens
VNGATGHSS

SEQ ID NO: 180530 - protein, 15 aa, Homo sapiens
LFRDGVNWGRIVAFF

SEQ ID NO: 180531 - protein, 9 aa, Homo sapiens
VNWGRIVAF

SEQ ID NO: 180532 - protein, 15 aa, Homo sapiens
LVVDFLSYKLSQKGY

SEQ ID NO: 180533 - protein, 9 aa, Homo sapiens
LSYKLSQKG

SEQ ID NO: 180534 - protein, 15 aa, Homo sapiens
VVDFLSYKLSQKGYS

SEQ ID NO: 180535 - protein, 9 aa, Homo sapiens
LSYKLSQKG

SEQ ID NO: 180536 - protein, 15 aa, Homo sapiens
QERFNRWFLTGMTVA

SEQ ID NO: 180537 - protein, 9 aa, Homo sapiens
FNRWFLTGM

SEQ ID NO: 180538 - protein, 15 aa, Homo sapiens
ESEMETPSAINGNPS

SEQ ID NO: 180539 - protein, 9 aa, Homo sapiens
METPSAING

SEQ ID NO: 180540 - protein, 15 aa, Homo sapiens
GTESEMETPSAINGN

SEQ ID NO: 180541 - protein, 9 aa, Homo sapiens
METPSAING

SEQ ID NO: 180542 - protein, 15 aa, Homo sapiens
DLTSQLHITPGTAYQ

SEQ ID NO: 180543 - protein, 9 aa, Homo sapiens
LHITPGTAY

SEQ ID NO: 180544 - protein, 15 aa, Homo sapiens
EGTESEMETPSAING

SEQ ID NO: 180545 - protein, 9 aa, Homo sapiens
ESEMETPSA

SEQ ID NO: 180546 - protein, 15 aa, Homo sapiens
SEMETPSAINGNPSW

SEQ ID NO: 180547 - protein, 9 aa, Homo sapiens
METPSAING

SEQ ID NO: 180548 - protein, 15 aa, Homo sapiens
SDLTSQLHITPGTAY

SEQ ID NO: 180549 - protein, 9 aa, Homo sapiens
SQLHITPGT

SEQ ID NO: 180550 - protein, 15 aa, Homo sapiens
VDFLSYKLSQKGYSW

SEQ ID NO: 180551 - protein, 9 aa, Homo sapiens
LSYKLSQKG

SEQ ID NO: 180552 - protein, 15 aa, Homo sapiens
TESEMETPSAINGNP

SEQ ID NO: 180553 - protein, 9 aa, Homo sapiens
METPSAING

SEQ ID NO: 180554 - protein, 15 aa, Homo sapiens
AAWMATYLNDHLEPW

SEQ ID NO: 180555 - protein, 9 aa, Homo sapiens
AAWMATYLN

SEQ ID NO: 180556 - protein, 15 aa, Homo sapiens
DFLSYKLSQKGYSWS

SEQ ID NO: 180557 - protein, 9 aa, Homo sapiens
LSYKLSQKG

SEQ ID NO: 180558 - protein, 15 aa, Homo sapiens
AFSDLTSQLHITPGT

SEQ ID NO: 180559 - protein, 9 aa, Homo sapiens
FSDLTSQLH

SEQ ID NO: 180560 - protein, 15 aa, Homo sapiens
FSDLTSQLHITPGTA

SEQ ID NO: 180561 - protein, 9 aa, Homo sapiens
FSDLTSQLH

SEQ ID NO: 180562 - protein, 15 aa, Homo sapiens
WGRIVAFFSFGGALC

SEQ ID NO: 180563 - protein, 9 aa, Homo sapiens
IVAFFSFGG

SEQ ID NO: 180564 - protein, 15 aa, Homo sapiens
GQERFNRWFLTGMTV

SEQ ID NO: 180565 - protein, 9 aa, Homo sapiens
FNRWFLTGM

SEQ ID NO: 180566 - protein, 15 aa, Homo sapiens
LRYRRAFSDLTSQLH

SEQ ID NO: 180567 - protein, 9 aa, Homo sapiens
YRRAFSDLT

SEQ ID NO: 180568 - protein, 15 aa, Homo sapiens
FELRYRRAFSDLTSQ

SEQ ID NO: 180569 - protein, 9 aa, Homo sapiens
YRRAFSDLT

SEQ ID NO: 180570 - protein, 15 aa, Homo sapiens
EFELRYRRAFSDLTS

SEQ ID NO: 180571 - protein, 9 aa, Homo sapiens
YRRAFSDLT

SEQ ID NO: 180572 - protein, 15 aa, Homo sapiens
DEFELRYRRAFSDLT

SEQ ID NO: 180573 - protein, 9 aa, Homo sapiens
DEFELRYRR

SEQ ID NO: 180574 - protein, 15 aa, Homo sapiens
ELRYRRAFSDLTSQL

SEQ ID NO: 180575 - protein, 9 aa, Homo sapiens
YRRAFSDLT

SEQ ID NO: 180576 - protein, 15 aa, Homo sapiens
NGGWDTFVELYGNNA

SEQ ID NO: 180577 - protein, 9 aa, Homo sapiens
WDTFVELYG

SEQ ID NO: 180578 - protein, 15 aa, Homo sapiens
GGWDTFVELYGNNAA

SEQ ID NO: 180579 - protein, 9 aa, Homo sapiens
FVELYGNNA

SEQ ID NO: 180580 - protein, 15 aa, Homo sapiens
WDTFVELYGNNAAAE

SEQ ID NO: 180581 - protein, 9 aa, Homo sapiens
FVELYGNNA

SEQ ID NO: 180582 - protein, 15 aa, Homo sapiens
GWDTFVELYGNNAAA

SEQ ID NO: 180583 - protein, 9 aa, Homo sapiens
FVELYGNNA

SEQ ID NO: 180584 - protein, 15 aa, Homo sapiens
DTFVELYGNNAAAES

SEQ ID NO: 180585 - protein, 9 aa, Homo sapiens
FVELYGNNA

SEQ ID NO: 180586 - protein, 15 aa, Homo sapiens
RYRRAFSDLTSQLHI

SEQ ID NO: 180587 - protein, 9 aa, Homo sapiens
YRRAFSDLT

SEQ ID NO: 180588 - protein, 15 aa, Homo sapiens
YRRAFSDLTSQLHIT

SEQ ID NO: 180589 - protein, 9 aa, Homo sapiens
YRRAFSDLT

SEQ ID NO: 180590 - protein, 15 aa, Homo sapiens
ESVDKEMQVLVSRIA

SEQ ID NO: 180591 - protein, 9 aa, Homo sapiens
KEMQVLVSR

SEQ ID NO: 180592 - protein, 15 aa, Homo sapiens
VDKEMQVLVSRIAAW

SEQ ID NO: 180593 - protein, 9 aa, Homo sapiens
MQVLVSRIA

SEQ ID NO: 180594 - protein, 15 aa, Homo sapiens
ERFNRWFLTGMTVAG

SEQ ID NO: 180595 - protein, 9 aa, Homo sapiens
WFLTGMTVA

SEQ ID NO: 180596 - protein, 15 aa, Homo sapiens
SVDKEMQVLVSRIAA

SEQ ID NO: 180597 - protein, 9 aa, Homo sapiens
MQVLVSRIA

SEQ ID NO: 180598 - protein, 15 aa, Homo sapiens
RFNRWFLTGMTVAGV

SEQ ID NO: 180599 - protein, 9 aa, Homo sapiens
FLTGMTVAG

SEQ ID NO: 180600 - protein, 15 aa, Homo sapiens
FNRWFLTGMTVAGVV

SEQ ID NO: 180601 - protein, 9 aa, Homo sapiens
FLTGMTVAG

SEQ ID NO: 180602 - protein, 15 aa, Homo sapiens
KEMQVLVSRIAAWMA

SEQ ID NO: 180603 - protein, 9 aa, Homo sapiens
MQVLVSRIA

SEQ ID NO: 180604 - protein, 15 aa, Homo sapiens
DKEMQVLVSRIAAWM

SEQ ID NO: 180605 - protein, 9 aa, Homo sapiens
MQVLVSRIA

SEQ ID NO: 180606 - protein, 15 aa, Homo sapiens
NRWFLTGMTVAGVVL

SEQ ID NO: 180607 - protein, 9 aa, Homo sapiens
FLTGMTVAG

SEQ ID NO: 180608 - protein, 15 aa, Homo sapiens
AAWMATYLNDHLEPW

SEQ ID NO: 180609 - protein, 9 aa, Homo sapiens
WMATYLNDH

SEQ ID NO: 180610 - protein, 15 aa, Homo sapiens
SRIAAWMATYLNDHL

SEQ ID NO: 180611 - protein, 9 aa, Homo sapiens
WMATYLNDH

SEQ ID NO: 180612 - protein, 15 aa, Homo sapiens
RIAAWMATYLNDHLE

SEQ ID NO: 180613 - protein, 9 aa, Homo sapiens
WMATYLNDH

SEQ ID NO: 180614 - protein, 15 aa, Homo sapiens
IAAWMATYLNDHLEP

SEQ ID NO: 180615 - protein, 9 aa, Homo sapiens
WMATYLNDH

SEQ ID NO: 180616 - protein, 15 aa, Homo sapiens
VSRIAAWMATYLNDH

SEQ ID NO: 180617 - protein, 9 aa, Homo sapiens
AAWMATYLN

SEQ ID NO: 180618 - protein, 15 aa, Homo sapiens
TVAGVVLLGSLFSRK

SEQ ID NO: 180619 - protein, 9 aa, Homo sapiens
VVLLGSLFS

SEQ ID NO: 180620 - protein, 15 aa, Homo sapiens
RFNRWFLTGMTVAGV

SEQ ID NO: 180621 - protein, 9 aa, Homo sapiens
FLTGMTVAG

SEQ ID NO: 180622 - protein, 15 aa, Homo sapiens
FNRWFLTGMTVAGVV

SEQ ID NO: 180623 - protein, 9 aa, Homo sapiens
FLTGMTVAG

SEQ ID NO: 180624 - protein, 15 aa, Homo sapiens
NRWFLTGMTVAGVVL

SEQ ID NO: 180625 - protein, 9 aa, Homo sapiens
FLTGMTVAG

SEQ ID NO: 180626 - protein, 15 aa, Homo sapiens
ERFNRWFLTGMTVAG

SEQ ID NO: 180627 - protein, 9 aa, Homo sapiens
WFLTGMTVA

SEQ ID NO: 180628 - protein, 15 aa, Homo sapiens
AWMATYLNDHLEPWI

SEQ ID NO: 180629 - protein, 9 aa, Homo sapiens
WMATYLNDH

SEQ ID NO: 180630 - protein, 15 aa, Homo sapiens
RWFLTGMTVAGVVLL

SEQ ID NO: 180631 - protein, 9 aa, Homo sapiens
FLTGMTVAG

SEQ ID NO: 180632 - protein, 15 aa, Homo sapiens
DTFVELYGNNAAAES

SEQ ID NO: 180633 - protein, 9 aa, Homo sapiens
FVELYGNNA

SEQ ID NO: 180634 - protein, 15 aa, Homo sapiens
GWDTFVELYGNNAAA

SEQ ID NO: 180635 - protein, 9 aa, Homo sapiens
FVELYGNNA

SEQ ID NO: 180636 - protein, 15 aa, Homo sapiens
WMATYLNDHLEPWIQ

SEQ ID NO: 180637 - protein, 9 aa, Homo sapiens
WMATYLNDH

SEQ ID NO: 180638 - protein, 15 aa, Homo sapiens
WDTFVELYGNNAAAE

SEQ ID NO: 180639 - protein, 9 aa, Homo sapiens
FVELYGNNA

SEQ ID NO: 180640 - protein, 15 aa, Homo sapiens
GGWDTFVELYGNNAA

SEQ ID NO: 180641 - protein, 9 aa, Homo sapiens
FVELYGNNA

SEQ ID NO: 180642 - protein, 15 aa, Homo sapiens
NGGWDTFVELYGNNA

SEQ ID NO: 180643 - protein, 9 aa, Homo sapiens
GWDTFVELY

SEQ ID NO: 180644 - protein, 15 aa, Homo sapiens
TAYQSFEQVVNELFR

SEQ ID NO: 180645 - protein, 9 aa, Homo sapiens
YQSFEQVVN

SEQ ID NO: 180646 - protein, 15 aa, Homo sapiens
GTAYQSFEQVVNELF

SEQ ID NO: 180647 - protein, 9 aa, Homo sapiens
YQSFEQVVN

SEQ ID NO: 180648 - protein, 15 aa, Homo sapiens
TPGTAYQSFEQVVNE

SEQ ID NO: 180649 - protein, 9 aa, Homo sapiens
YQSFEQVVN

SEQ ID NO: 180650 - protein, 15 aa, Homo sapiens
PGTAYQSFEQVVNEL

SEQ ID NO: 180651 - protein, 9 aa, Homo sapiens
YQSFEQVVN

SEQ ID NO: 180652 - protein, 15 aa, Homo sapiens
ITPGTAYQSFEQVVN

SEQ ID NO: 180653 - protein, 9 aa, Homo sapiens
AYQSFEQVV

SEQ ID NO: 180654 - protein, 15 aa, Homo sapiens
VSRIAAWMATYLNDH

SEQ ID NO: 180655 - protein, 9 aa, Homo sapiens
AAWMATYLN

SEQ ID NO: 180656 - protein, 15 aa, Homo sapiens
LVSRIAAWMATYLND

SEQ ID NO: 180657 - protein, 9 aa, Homo sapiens
AAWMATYLN

SEQ ID NO: 180658 - protein, 15 aa, Homo sapiens
VLVSRIAAWMATYLN

SEQ ID NO: 180659 - protein, 9 aa, Homo sapiens
IAAWMATYL

SEQ ID NO: 180660 - protein, 15 aa, Homo sapiens
SRIAAWMATYLNDHL

SEQ ID NO: 180661 - protein, 9 aa, Homo sapiens
AAWMATYLN

SEQ ID NO: 180662 - protein, 15 aa, Homo sapiens
LRYRRAFSDLTSQLH

SEQ ID NO: 180663 - protein, 9 aa, Homo sapiens
YRRAFSDLT

SEQ ID NO: 180664 - protein, 15 aa, Homo sapiens
FELRYRRAFSDLTSQ

SEQ ID NO: 180665 - protein, 9 aa, Homo sapiens
YRRAFSDLT

SEQ ID NO: 180666 - protein, 15 aa, Homo sapiens
EFELRYRRAFSDLTS

SEQ ID NO: 180667 - protein, 9 aa, Homo sapiens
YRRAFSDLT

SEQ ID NO: 180668 - protein, 15 aa, Homo sapiens
RIAAWMATYLNDHLE

SEQ ID NO: 180669 - protein, 9 aa, Homo sapiens
AAWMATYLN

SEQ ID NO: 180670 - protein, 15 aa, Homo sapiens
AYQSFEQVVNELFRD

SEQ ID NO: 180671 - protein, 9 aa, Homo sapiens
YQSFEQVVN

SEQ ID NO: 180672 - protein, 15 aa, Homo sapiens
YQSFEQVVNELFRDG

SEQ ID NO: 180673 - protein, 9 aa, Homo sapiens
YQSFEQVVN

SEQ ID NO: 180674 - protein, 15 aa, Homo sapiens
ELRYRRAFSDLTSQL

SEQ ID NO: 180675 - protein, 9 aa, Homo sapiens
YRRAFSDLT

SEQ ID NO: 180676 - protein, 15 aa, Homo sapiens
SQKGYSWSQFSDVEE

SEQ ID NO: 180677 - protein, 9 aa, Homo sapiens
GYSWSQFSD

SEQ ID NO: 180678 - protein, 15 aa, Homo sapiens
DEFELRYRRAFSDLT

SEQ ID NO: 180679 - protein, 9 aa, Homo sapiens
LRYRRAFSD

SEQ ID NO: 180680 - protein, 15 aa, Homo sapiens
QKGYSWSQFSDVEEN

SEQ ID NO: 180681 - protein, 9 aa, Homo sapiens
WSQFSDVEE

SEQ ID NO: 180682 - protein, 15 aa, Homo sapiens
RYRRAFSDLTSQLHI

SEQ ID NO: 180683 - protein, 9 aa, Homo sapiens
YRRAFSDLT

SEQ ID NO: 180684 - protein, 15 aa, Homo sapiens
KGYSWSQFSDVEENR

SEQ ID NO: 180685 - protein, 9 aa, Homo sapiens
WSQFSDVEE

SEQ ID NO: 180686 - protein, 15 aa, Homo sapiens
IAAWMATYLNDHLEP

SEQ ID NO: 180687 - protein, 9 aa, Homo sapiens
AAWMATYLN

SEQ ID NO: 180688 - protein, 15 aa, Homo sapiens
GYSWSQFSDVEENRT

SEQ ID NO: 180689 - protein, 9 aa, Homo sapiens
WSQFSDVEE

SEQ ID NO: 180690 - protein, 15 aa, Homo sapiens
KEMQVLVSRIAAWMA

SEQ ID NO: 180691 - protein, 9 aa, Homo sapiens
VLVSRIAAW

SEQ ID NO: 180692 - protein, 15 aa, Homo sapiens
MQVLVSRIAAWMATY

SEQ ID NO: 180693 - protein, 9 aa, Homo sapiens
VLVSRIAAW

SEQ ID NO: 180694 - protein, 15 aa, Homo sapiens
EMQVLVSRIAAWMAT

SEQ ID NO: 180695 - protein, 9 aa, Homo sapiens
VLVSRIAAW

SEQ ID NO: 180696 - protein, 15 aa, Homo sapiens
DKEMQVLVSRIAAWM

SEQ ID NO: 180697 - protein, 9 aa, Homo sapiens
VLVSRIAAW

SEQ ID NO: 180698 - protein, 15 aa, Homo sapiens
QVLVSRIAAWMATYL

SEQ ID NO: 180699 - protein, 9 aa, Homo sapiens
VLVSRIAAW

SEQ ID NO: 180700 - protein, 15 aa, Homo sapiens
ETPSAINGNPSWHLA

SEQ ID NO: 180701 - protein, 9 aa, Homo sapiens
INGNPSWHL

SEQ ID NO: 180702 - protein, 15 aa, Homo sapiens
METPSAINGNPSWHL

SEQ ID NO: 180703 - protein, 9 aa, Homo sapiens
AINGNPSWH

SEQ ID NO: 180704 - protein, 15 aa, Homo sapiens
VDKEMQVLVSRIAAW

SEQ ID NO: 180705 - protein, 9 aa, Homo sapiens
MQVLVSRIA

SEQ ID NO: 180706 - protein, 15 aa, Homo sapiens
TPSAINGNPSWHLAD

SEQ ID NO: 180707 - protein, 9 aa, Homo sapiens
INGNPSWHL

SEQ ID NO: 180708 - protein, 15 aa, Homo sapiens
PSAINGNPSWHLADS

SEQ ID NO: 180709 - protein, 9 aa, Homo sapiens
INGNPSWHL

SEQ ID NO: 180710 - protein, 15 aa, Homo sapiens
VLVSRIAAWMATYLN

SEQ ID NO: 180711 - protein, 9 aa, Homo sapiens
VLVSRIAAW

SEQ ID NO: 180712 - protein, 15 aa, Homo sapiens
SAINGNPSWHLADSP

SEQ ID NO: 180713 - protein, 9 aa, Homo sapiens
INGNPSWHL

SEQ ID NO: 180714 - protein, 15 aa, Homo sapiens
LRYRRAFSDLTSQLH

SEQ ID NO: 180715 - protein, 9 aa, Homo sapiens
YRRAFSDLT

SEQ ID NO: 180716 - protein, 15 aa, Homo sapiens
RYRRAFSDLTSQLHI

SEQ ID NO: 180717 - protein, 9 aa, Homo sapiens
FSDLTSQLH

SEQ ID NO: 180718 - protein, 15 aa, Homo sapiens
YRRAFSDLTSQLHIT

SEQ ID NO: 180719 - protein, 9 aa, Homo sapiens
FSDLTSQLH

SEQ ID NO: 180720 - protein, 15 aa, Homo sapiens
INGNPSWHLADSPAV

SEQ ID NO: 180721 - protein, 9 aa, Homo sapiens
INGNPSWHL

SEQ ID NO: 180722 - protein, 15 aa, Homo sapiens
PSWHLADSPAVNGAT

SEQ ID NO: 180723 - protein, 9 aa, Homo sapiens
WHLADSPAV

SEQ ID NO: 180724 - protein, 15 aa, Homo sapiens
NPSWHLADSPAVNGA

SEQ ID NO: 180725 - protein, 9 aa, Homo sapiens
WHLADSPAV

SEQ ID NO: 180726 - protein, 15 aa, Homo sapiens
GNPSWHLADSPAVNG

SEQ ID NO: 180727 - protein, 9 aa, Homo sapiens
WHLADSPAV

SEQ ID NO: 180728 - protein, 15 aa, Homo sapiens
INGNPSWHLADSPAV

SEQ ID NO: 180729 - protein, 9 aa, Homo sapiens
SWHLADSPA

SEQ ID NO: 180730 - protein, 15 aa, Homo sapiens
NGNPSWHLADSPAVN

SEQ ID NO: 180731 - protein, 9 aa, Homo sapiens
WHLADSPAV

SEQ ID NO: 180732 - protein, 15 aa, Homo sapiens
SWHLADSPAVNGATG

SEQ ID NO: 180733 - protein, 9 aa, Homo sapiens
WHLADSPAV

SEQ ID NO: 180734 - protein, 15 aa, Homo sapiens
WHLADSPAVNGATGH

SEQ ID NO: 180735 - protein, 9 aa, Homo sapiens
WHLADSPAV

SEQ ID NO: 180736 - protein, 15 aa, Homo sapiens
RWFLTGMTVAGVVLL

SEQ ID NO: 180737 - protein, 9 aa, Homo sapiens
FLTGMTVAG

SEQ ID NO: 180738 - protein, 15 aa, Homo sapiens
WFLTGMTVAGVVLLG

SEQ ID NO: 180739 - protein, 9 aa, Homo sapiens
MTVAGVVLL

SEQ ID NO: 180740 - protein, 15 aa, Homo sapiens
FLTGMTVAGVVLLGS

SEQ ID NO: 180741 - protein, 9 aa, Homo sapiens
MTVAGVVLL

SEQ ID NO: 180742 - protein, 15 aa, Homo sapiens
KEMQVLVSRIAAWMA

SEQ ID NO: 180743 - protein, 9 aa, Homo sapiens
MQVLVSRIA

SEQ ID NO: 180744 - protein, 15 aa, Homo sapiens
FRDGVNWGRIVAFFS

SEQ ID NO: 180745 - protein, 9 aa, Homo sapiens
GVNWGRIVA

SEQ ID NO: 180746 - protein, 15 aa, Homo sapiens
DKEMQVLVSRIAAWM

SEQ ID NO: 180747 - protein, 9 aa, Homo sapiens
MQVLVSRIA

SEQ ID NO: 180748 - protein, 15 aa, Homo sapiens
VDKEMQVLVSRIAAW

SEQ ID NO: 180749 - protein, 9 aa, Homo sapiens
MQVLVSRIA

SEQ ID NO: 180750 - protein, 15 aa, Homo sapiens
RDGVNWGRIVAFFSF

SEQ ID NO: 180751 - protein, 9 aa, Homo sapiens
GVNWGRIVA

SEQ ID NO: 180752 - protein, 15 aa, Homo sapiens
SVDKEMQVLVSRIAA

SEQ ID NO: 180753 - protein, 9 aa, Homo sapiens
MQVLVSRIA

SEQ ID NO: 180754 - protein, 15 aa, Homo sapiens
MTVAGVVLLGSLFSR

SEQ ID NO: 180755 - protein, 9 aa, Homo sapiens
VVLLGSLFS

SEQ ID NO: 180756 - protein, 15 aa, Homo sapiens
TGMTVAGVVLLGSLF

SEQ ID NO: 180757 - protein, 9 aa, Homo sapiens
MTVAGVVLL

SEQ ID NO: 180758 - protein, 15 aa, Homo sapiens
FLTGMTVAGVVLLGS

SEQ ID NO: 180759 - protein, 9 aa, Homo sapiens
MTVAGVVLL

SEQ ID NO: 180760 - protein, 15 aa, Homo sapiens
GMTVAGVVLLGSLFS

SEQ ID NO: 180761 - protein, 9 aa, Homo sapiens
MTVAGVVLL

SEQ ID NO: 180762 - protein, 15 aa, Homo sapiens
RWFLTGMTVAGVVLL

SEQ ID NO: 180763 - protein, 9 aa, Homo sapiens
FLTGMTVAG

SEQ ID NO: 180764 - protein, 15 aa, Homo sapiens
LTGMTVAGVVLLGSL

SEQ ID NO: 180765 - protein, 9 aa, Homo sapiens
MTVAGVVLL

SEQ ID NO: 180766 - protein, 15 aa, Homo sapiens
WFLTGMTVAGVVLLG

SEQ ID NO: 180767 - protein, 9 aa, Homo sapiens
MTVAGVVLL

SEQ ID NO: 180768 - protein, 15 aa, Homo sapiens
DTFVELYGNNAAAES

SEQ ID NO: 180769 - protein, 9 aa, Homo sapiens
VELYGNNAA

SEQ ID NO: 180770 - protein, 15 aa, Homo sapiens
TFVELYGNNAAAESR

SEQ ID NO: 180771 - protein, 9 aa, Homo sapiens
YGNNAAAES

SEQ ID NO: 180772 - protein, 15 aa, Homo sapiens
FVELYGNNAAAESRK

SEQ ID NO: 180773 - protein, 9 aa, Homo sapiens
YGNNAAAES

SEQ ID NO: 180774 - protein, 15 aa, Homo sapiens
VELYGNNAAAESRKG

SEQ ID NO: 180775 - protein, 9 aa, Homo sapiens
YGNNAAAES

SEQ ID NO: 180776 - protein, 15 aa, Homo sapiens
TVAGVVLLGSLFSRK

SEQ ID NO: 180777 - protein, 9 aa, Homo sapiens
VVLLGSLFS

SEQ ID NO: 180778 - protein, 15 aa, Homo sapiens
ELYGNNAAAESRKGQ

SEQ ID NO: 180779 - protein, 9 aa, Homo sapiens
YGNNAAAES

SEQ ID NO: 180780 - protein, 15 aa, Homo sapiens
TVAGVVLLGSLFSRK

SEQ ID NO: 180781 - protein, 9 aa, Homo sapiens
VLLGSLFSR

SEQ ID NO: 180782 - protein, 15 aa, Homo sapiens
MTVAGVVLLGSLFSR

SEQ ID NO: 180783 - protein, 9 aa, Homo sapiens
VVLLGSLFS

SEQ ID NO: 180784 - protein, 15 aa, Homo sapiens
RELVVDFLSYKLSQK

SEQ ID NO: 180785 - protein, 9 aa, Homo sapiens
LVVDFLSYK

SEQ ID NO: 180786 - protein, 15 aa, Homo sapiens
ELVVDFLSYKLSQKG

SEQ ID NO: 180787 - protein, 9 aa, Homo sapiens
FLSYKLSQK

SEQ ID NO: 180788 - protein, 15 aa, Homo sapiens
KEMQVLVSRIAAWMA

SEQ ID NO: 180789 - protein, 9 aa, Homo sapiens
MQVLVSRIA

SEQ ID NO: 180790 - protein, 15 aa, Homo sapiens
DKEMQVLVSRIAAWM

SEQ ID NO: 180791 - protein, 9 aa, Homo sapiens
MQVLVSRIA

SEQ ID NO: 180792 - protein, 15 aa, Homo sapiens
RFNRWFLTGMTVAGV

SEQ ID NO: 180793 - protein, 9 aa, Homo sapiens
FNRWFLTGM

SEQ ID NO: 180794 - protein, 15 aa, Homo sapiens
SRIAAWMATYLNDHL

SEQ ID NO: 180795 - protein, 9 aa, Homo sapiens
WMATYLNDH

SEQ ID NO: 180796 - protein, 15 aa, Homo sapiens
FNRWFLTGMTVAGVV

SEQ ID NO: 180797 - protein, 9 aa, Homo sapiens
LTGMTVAGV

SEQ ID NO: 180798 - protein, 15 aa, Homo sapiens
LVVDFLSYKLSQKGY

SEQ ID NO: 180799 - protein, 9 aa, Homo sapiens
FLSYKLSQK

SEQ ID NO: 180800 - protein, 15 aa, Homo sapiens
NRELVVDFLSYKLSQ

SEQ ID NO: 180801 - protein, 9 aa, Homo sapiens
LVVDFLSYK

SEQ ID NO: 180802 - protein, 15 aa, Homo sapiens
VNWGRIVAFFSFGGA

SEQ ID NO: 180803 - protein, 9 aa, Homo sapiens
IVAFFSFGG

SEQ ID NO: 180804 - protein, 15 aa, Homo sapiens
SNRELVVDFLSYKLS

SEQ ID NO: 180805 - protein, 9 aa, Homo sapiens
LVVDFLSYK

SEQ ID NO: 180806 - protein, 15 aa, Homo sapiens
MQVLVSRIAAWMATY

SEQ ID NO: 180807 - protein, 9 aa, Homo sapiens
LVSRIAAWM

SEQ ID NO: 180808 - protein, 15 aa, Homo sapiens
VSRIAAWMATYLNDH

SEQ ID NO: 180809 - protein, 9 aa, Homo sapiens
IAAWMATYL

SEQ ID NO: 180810 - protein, 15 aa, Homo sapiens
EMQVLVSRIAAWMAT

SEQ ID NO: 180811 - protein, 9 aa, Homo sapiens
VLVSRIAAW

SEQ ID NO: 180812 - protein, 15 aa, Homo sapiens
RIAAWMATYLNDHLE

SEQ ID NO: 180813 - protein, 9 aa, Homo sapiens
WMATYLNDH

SEQ ID NO: 180814 - protein, 15 aa, Homo sapiens
NELFRDGVNWGRIVA

SEQ ID NO: 180815 - protein, 9 aa, Homo sapiens
LFRDGVNWG

SEQ ID NO: 180816 - protein, 15 aa, Homo sapiens
QVVNELFRDGVNWGR

SEQ ID NO: 180817 - protein, 9 aa, Homo sapiens
LFRDGVNWG

SEQ ID NO: 180818 - protein, 15 aa, Homo sapiens
VVNELFRDGVNWGRI

SEQ ID NO: 180819 - protein, 9 aa, Homo sapiens
LFRDGVNWG

SEQ ID NO: 180820 - protein, 15 aa, Homo sapiens
IAAWMATYLNDHLEP

SEQ ID NO: 180821 - protein, 9 aa, Homo sapiens
WMATYLNDH

SEQ ID NO: 180822 - protein, 15 aa, Homo sapiens
WGRIVAFFSFGGALC

SEQ ID NO: 180823 - protein, 9 aa, Homo sapiens
IVAFFSFGG

SEQ ID NO: 180824 - protein, 15 aa, Homo sapiens
NWGRIVAFFSFGGAL

SEQ ID NO: 180825 - protein, 9 aa, Homo sapiens
IVAFFSFGG

SEQ ID NO: 180826 - protein, 15 aa, Homo sapiens
QERFNRWFLTGMTVA

SEQ ID NO: 180827 - protein, 9 aa, Homo sapiens
FNRWFLTGM

SEQ ID NO: 180828 - protein, 15 aa, Homo sapiens
ERFNRWFLTGMTVAG

SEQ ID NO: 180829 - protein, 9 aa, Homo sapiens
FNRWFLTGM

SEQ ID NO: 180830 - protein, 15 aa, Homo sapiens
GRIVAFFSFGGALCV

SEQ ID NO: 180831 - protein, 9 aa, Homo sapiens
IVAFFSFGG

SEQ ID NO: 180832 - protein, 15 aa, Homo sapiens
VVDFLSYKLSQKGYS

SEQ ID NO: 180833 - protein, 9 aa, Homo sapiens
FLSYKLSQK

SEQ ID NO: 180834 - protein, 15 aa, Homo sapiens
VDKEMQVLVSRIAAW

SEQ ID NO: 180835 - protein, 9 aa, Homo sapiens
MQVLVSRIA

SEQ ID NO: 180836 - protein, 15 aa, Homo sapiens
AAWMATYLNDHLEPW

SEQ ID NO: 180837 - protein, 9 aa, Homo sapiens
WMATYLNDH

SEQ ID NO: 180838 - protein, 15 aa, Homo sapiens
QSNRELVVDFLSYKL

SEQ ID NO: 180839 - protein, 9 aa, Homo sapiens
LVVDFLSYK

SEQ ID NO: 180840 - protein, 15 aa, Homo sapiens
VNELFRDGVNWGRIV

SEQ ID NO: 180841 - protein, 9 aa, Homo sapiens
LFRDGVNWG

SEQ ID NO: 180842 - protein, 15 aa, Homo sapiens
GVNWGRIVAFFSFGG

SEQ ID NO: 180843 - protein, 9 aa, Homo sapiens
VNWGRIVAF

SEQ ID NO: 180844 - protein, 15 aa, Homo sapiens
ELFRDGVNWGRIVAF

SEQ ID NO: 180845 - protein, 9 aa, Homo sapiens
LFRDGVNWG

SEQ ID NO: 180846 - protein, 15 aa, Homo sapiens
GMTVAGVVLLGSLFS

SEQ ID NO: 180847 - protein, 9 aa, Homo sapiens
VAGVVLLGS

SEQ ID NO: 180848 - protein, 15 aa, Homo sapiens
EQVVNELFRDGVNWG

SEQ ID NO: 180849 - protein, 9 aa, Homo sapiens
VVNELFRDG

SEQ ID NO: 180850 - protein, 15 aa, Homo sapiens
RIVAFFSFGGALCVE

SEQ ID NO: 180851 - protein, 9 aa, Homo sapiens
IVAFFSFGG

SEQ ID NO: 180852 - protein, 15 aa, Homo sapiens
NRWFLTGMTVAGVVL

SEQ ID NO: 180853 - protein, 9 aa, Homo sapiens
LTGMTVAGV

SEQ ID NO: 180854 - protein, 15 aa, Homo sapiens
LRYRRAFSDLTSQLH

SEQ ID NO: 180855 - protein, 9 aa, Homo sapiens
YRRAFSDLT

SEQ ID NO: 180856 - protein, 15 aa, Homo sapiens
RYRRAFSDLTSQLHI

SEQ ID NO: 180857 - protein, 9 aa, Homo sapiens
FSDLTSQLH

SEQ ID NO: 180858 - protein, 192 aa, Borrelia burgdorferi
EGAIKEVSELLDKLVKAVKTAEGASSGTDAIGEVVANAGAAKVADKASVTGIAKGIKEIVEAAGGSEKLKVAAATGESNKGAGKLFGKAGAGANAGDSEAASKAAGAVSAVSGEQILSAIVTAADAAEQEGKKPEEAKNPIAAAIGKGNADDGAEFGQEGMKKDDQIAAAIALRGMAKDGKFAVKSGEKEKA

SEQ ID NO: 180859 - protein, 8 aa, Borrelia burgdorferi
EGAIKEVS

SEQ ID NO: 180860 - protein, 8 aa, Borrelia burgdorferi
GAIKEVSE

SEQ ID NO: 180861 - protein, 8 aa, Borrelia burgdorferi
AIKEVSEL

SEQ ID NO: 180862 - protein, 8 aa, Borrelia burgdorferi
IKEVSELL

SEQ ID NO: 180863 - protein, 8 aa, Borrelia burgdorferi
KEVSELLD

SEQ ID NO: 180864 - protein, 8 aa, Borrelia burgdorferi
EVSELLDK

SEQ ID NO: 180865 - protein, 8 aa, Borrelia burgdorferi
VSELLDKL

SEQ ID NO: 180866 - protein, 8 aa, Borrelia burgdorferi
SELLDKLV

SEQ ID NO: 180867 - protein, 8 aa, Borrelia burgdorferi
ELLDKLVK

SEQ ID NO: 180868 - protein, 8 aa, Borrelia burgdorferi
LLDKLVKA

SEQ ID NO: 180869 - protein, 8 aa, Borrelia burgdorferi
LDKLVKAV

SEQ ID NO: 180870 - protein, 8 aa, Borrelia burgdorferi
DKLVKAVK

SEQ ID NO: 180871 - protein, 8 aa, Borrelia burgdorferi
KLVKAVKT

SEQ ID NO: 180872 - protein, 8 aa, Borrelia burgdorferi
LVKAVKTA

SEQ ID NO: 180873 - protein, 8 aa, Borrelia burgdorferi
VKAVKTAE

SEQ ID NO: 180874 - protein, 8 aa, Borrelia burgdorferi
KAVKTAEG

SEQ ID NO: 180875 - protein, 8 aa, Borrelia burgdorferi
AVKTAEGA

SEQ ID NO: 180876 - protein, 8 aa, Borrelia burgdorferi
VKTAEGAS

SEQ ID NO: 180877 - protein, 8 aa, Borrelia burgdorferi
KTAEGASS

SEQ ID NO: 180878 - protein, 8 aa, Borrelia burgdorferi
TAEGASSG

SEQ ID NO: 180879 - protein, 8 aa, Borrelia burgdorferi
AEGASSGT

SEQ ID NO: 180880 - protein, 8 aa, Borrelia burgdorferi
EGASSGTD

SEQ ID NO: 180881 - protein, 8 aa, Borrelia burgdorferi
GASSGTDA

SEQ ID NO: 180882 - protein, 8 aa, Borrelia burgdorferi
ASSGTDAI

SEQ ID NO: 180883 - protein, 8 aa, Borrelia burgdorferi
SSGTDAIG

SEQ ID NO: 180884 - protein, 8 aa, Borrelia burgdorferi
SGTDAIGE

SEQ ID NO: 180885 - protein, 8 aa, Borrelia burgdorferi
GTDAIGEV

SEQ ID NO: 180886 - protein, 8 aa, Borrelia burgdorferi
TDAIGEVV

SEQ ID NO: 180887 - protein, 8 aa, Borrelia burgdorferi
DAIGEVVA

SEQ ID NO: 180888 - protein, 8 aa, Borrelia burgdorferi
AIGEVVAN

SEQ ID NO: 180889 - protein, 8 aa, Borrelia burgdorferi
IGEVVANA

SEQ ID NO: 180890 - protein, 8 aa, Borrelia burgdorferi
GEVVANAG

SEQ ID NO: 180891 - protein, 8 aa, Borrelia burgdorferi
EVVANAGA

SEQ ID NO: 180892 - protein, 8 aa, Borrelia burgdorferi
VVANAGAA

SEQ ID NO: 180893 - protein, 8 aa, Borrelia burgdorferi
VANAGAAK

SEQ ID NO: 180894 - protein, 8 aa, Borrelia burgdorferi
ANAGAAKV

SEQ ID NO: 180895 - protein, 8 aa, Borrelia burgdorferi
NAGAAKVA

SEQ ID NO: 180896 - protein, 8 aa, Borrelia burgdorferi
AGAAKVAD

SEQ ID NO: 180897 - protein, 8 aa, Borrelia burgdorferi
GAAKVADK

SEQ ID NO: 180898 - protein, 8 aa, Borrelia burgdorferi
AAKVADKA

SEQ ID NO: 180899 - protein, 8 aa, Borrelia burgdorferi
AKVADKAS

SEQ ID NO: 180900 - protein, 8 aa, Borrelia burgdorferi
KVADKASV

SEQ ID NO: 180901 - protein, 8 aa, Borrelia burgdorferi
VADKASVT

SEQ ID NO: 180902 - protein, 8 aa, Borrelia burgdorferi
ADKASVTG

SEQ ID NO: 180903 - protein, 8 aa, Borrelia burgdorferi
DKASVTGI

SEQ ID NO: 180904 - protein, 8 aa, Borrelia burgdorferi
KASVTGIA

SEQ ID NO: 180905 - protein, 8 aa, Borrelia burgdorferi
ASVTGIAK

SEQ ID NO: 180906 - protein, 8 aa, Borrelia burgdorferi
SVTGIAKG

SEQ ID NO: 180907 - protein, 8 aa, Borrelia burgdorferi
VTGIAKGI

SEQ ID NO: 180908 - protein, 8 aa, Borrelia burgdorferi
TGIAKGIK

SEQ ID NO: 180909 - protein, 8 aa, Borrelia burgdorferi
GIAKGIKE

SEQ ID NO: 180910 - protein, 8 aa, Borrelia burgdorferi
IAKGIKEI

SEQ ID NO: 180911 - protein, 8 aa, Borrelia burgdorferi
AKGIKEIV

SEQ ID NO: 180912 - protein, 8 aa, Borrelia burgdorferi
KGIKEIVE

SEQ ID NO: 180913 - protein, 8 aa, Borrelia burgdorferi
GIKEIVEA

SEQ ID NO: 180914 - protein, 8 aa, Borrelia burgdorferi
IKEIVEAA

SEQ ID NO: 180915 - protein, 8 aa, Borrelia burgdorferi
KEIVEAAG

SEQ ID NO: 180916 - protein, 8 aa, Borrelia burgdorferi
EIVEAAGG

SEQ ID NO: 180917 - protein, 8 aa, Borrelia burgdorferi
IVEAAGGS

SEQ ID NO: 180918 - protein, 8 aa, Borrelia burgdorferi
VEAAGGSE

SEQ ID NO: 180919 - protein, 8 aa, Borrelia burgdorferi
EAAGGSEK

SEQ ID NO: 180920 - protein, 8 aa, Borrelia burgdorferi
AAGGSEKL

SEQ ID NO: 180921 - protein, 8 aa, Borrelia burgdorferi
AGGSEKLK

SEQ ID NO: 180922 - protein, 8 aa, Borrelia burgdorferi
GGSEKLKV

SEQ ID NO: 180923 - protein, 8 aa, Borrelia burgdorferi
GSEKLKVA

SEQ ID NO: 180924 - protein, 8 aa, Borrelia burgdorferi
SEKLKVAA

SEQ ID NO: 180925 - protein, 8 aa, Borrelia burgdorferi
EKLKVAAA

SEQ ID NO: 180926 - protein, 8 aa, Borrelia burgdorferi
KLKVAAAT

SEQ ID NO: 180927 - protein, 8 aa, Borrelia burgdorferi
LKVAAATG

SEQ ID NO: 180928 - protein, 8 aa, Borrelia burgdorferi
KVAAATGE

SEQ ID NO: 180929 - protein, 8 aa, Borrelia burgdorferi
VAAATGES

SEQ ID NO: 180930 - protein, 8 aa, Borrelia burgdorferi
AAATGESN

SEQ ID NO: 180931 - protein, 8 aa, Borrelia burgdorferi
AATGESNK

SEQ ID NO: 180932 - protein, 8 aa, Borrelia burgdorferi
ATGESNKG

SEQ ID NO: 180933 - protein, 8 aa, Borrelia burgdorferi
TGESNKGA

SEQ ID NO: 180934 - protein, 8 aa, Borrelia burgdorferi
GESNKGAG

SEQ ID NO: 180935 - protein, 8 aa, Borrelia burgdorferi
ESNKGAGK

SEQ ID NO: 180936 - protein, 8 aa, Borrelia burgdorferi
SNKGAGKL

SEQ ID NO: 180937 - protein, 8 aa, Borrelia burgdorferi
NKGAGKLF

SEQ ID NO: 180938 - protein, 8 aa, Borrelia burgdorferi
KGAGKLFG

SEQ ID NO: 180939 - protein, 8 aa, Borrelia burgdorferi
GAGKLFGK

SEQ ID NO: 180940 - protein, 8 aa, Borrelia burgdorferi
AGKLFGKA

SEQ ID NO: 180941 - protein, 8 aa, Borrelia burgdorferi
GKLFGKAG

SEQ ID NO: 180942 - protein, 8 aa, Borrelia burgdorferi
KLFGKAGA

SEQ ID NO: 180943 - protein, 8 aa, Borrelia burgdorferi
LFGKAGAG

SEQ ID NO: 180944 - protein, 8 aa, Borrelia burgdorferi
FGKAGAGA

SEQ ID NO: 180945 - protein, 8 aa, Borrelia burgdorferi
GKAGAGAN

SEQ ID NO: 180946 - protein, 8 aa, Borrelia burgdorferi
KAGAGANA

SEQ ID NO: 180947 - protein, 8 aa, Borrelia burgdorferi
AGAGANAG

SEQ ID NO: 180948 - protein, 8 aa, Borrelia burgdorferi
GAGANAGD

SEQ ID NO: 180949 - protein, 8 aa, Borrelia burgdorferi
AGANAGDS

SEQ ID NO: 180950 - protein, 8 aa, Borrelia burgdorferi
GANAGDSE

SEQ ID NO: 180951 - protein, 8 aa, Borrelia burgdorferi
ANAGDSEA

SEQ ID NO: 180952 - protein, 8 aa, Borrelia burgdorferi
NAGDSEAA

SEQ ID NO: 180953 - protein, 8 aa, Borrelia burgdorferi
AGDSEAAS

SEQ ID NO: 180954 - protein, 8 aa, Borrelia burgdorferi
GDSEAASK

SEQ ID NO: 180955 - protein, 8 aa, Borrelia burgdorferi
DSEAASKA

SEQ ID NO: 180956 - protein, 8 aa, Borrelia burgdorferi
SEAASKAA

SEQ ID NO: 180957 - protein, 8 aa, Borrelia burgdorferi
EAASKAAG

SEQ ID NO: 180958 - protein, 8 aa, Borrelia burgdorferi
AASKAAGA

SEQ ID NO: 180959 - protein, 8 aa, Borrelia burgdorferi
ASKAAGAV

SEQ ID NO: 180960 - protein, 8 aa, Borrelia burgdorferi
SKAAGAVS

SEQ ID NO: 180961 - protein, 8 aa, Borrelia burgdorferi
KAAGAVSA

SEQ ID NO: 180962 - protein, 8 aa, Borrelia burgdorferi
AAGAVSAV

SEQ ID NO: 180963 - protein, 8 aa, Borrelia burgdorferi
AGAVSAVS

SEQ ID NO: 180964 - protein, 8 aa, Borrelia burgdorferi
GAVSAVSG

SEQ ID NO: 180965 - protein, 8 aa, Borrelia burgdorferi
AVSAVSGE

SEQ ID NO: 180966 - protein, 8 aa, Borrelia burgdorferi
VSAVSGEQ

SEQ ID NO: 180967 - protein, 8 aa, Borrelia burgdorferi
SAVSGEQI

SEQ ID NO: 180968 - protein, 8 aa, Borrelia burgdorferi
AVSGEQIL

SEQ ID NO: 180969 - protein, 8 aa, Borrelia burgdorferi
VSGEQILS

SEQ ID NO: 180970 - protein, 8 aa, Borrelia burgdorferi
SGEQILSA

SEQ ID NO: 180971 - protein, 8 aa, Borrelia burgdorferi
GEQILSAI

SEQ ID NO: 180972 - protein, 8 aa, Borrelia burgdorferi
EQILSAIV

SEQ ID NO: 180973 - protein, 8 aa, Borrelia burgdorferi
QILSAIVT

SEQ ID NO: 180974 - protein, 8 aa, Borrelia burgdorferi
ILSAIVTA

SEQ ID NO: 180975 - protein, 8 aa, Borrelia burgdorferi
LSAIVTAA

SEQ ID NO: 180976 - protein, 8 aa, Borrelia burgdorferi
SAIVTAAD

SEQ ID NO: 180977 - protein, 8 aa, Borrelia burgdorferi
AIVTAADA

SEQ ID NO: 180978 - protein, 8 aa, Borrelia burgdorferi
IVTAADAA

SEQ ID NO: 180979 - protein, 8 aa, Borrelia burgdorferi
VTAADAAE

SEQ ID NO: 180980 - protein, 8 aa, Borrelia burgdorferi
TAADAAEQ

SEQ ID NO: 180981 - protein, 8 aa, Borrelia burgdorferi
AADAAEQE

SEQ ID NO: 180982 - protein, 8 aa, Borrelia burgdorferi
ADAAEQEG

SEQ ID NO: 180983 - protein, 8 aa, Borrelia burgdorferi
DAAEQEGK

SEQ ID NO: 180984 - protein, 8 aa, Borrelia burgdorferi
AAEQEGKK

SEQ ID NO: 180985 - protein, 8 aa, Borrelia burgdorferi
AEQEGKKP

SEQ ID NO: 180986 - protein, 8 aa, Borrelia burgdorferi
EQEGKKPE

SEQ ID NO: 180987 - protein, 8 aa, Borrelia burgdorferi
QEGKKPEE

SEQ ID NO: 180988 - protein, 8 aa, Borrelia burgdorferi
EGKKPEEA

SEQ ID NO: 180989 - protein, 8 aa, Borrelia burgdorferi
GKKPEEAK

SEQ ID NO: 180990 - protein, 8 aa, Borrelia burgdorferi
KKPEEAKN

SEQ ID NO: 180991 - protein, 8 aa, Borrelia burgdorferi
KPEEAKNP

SEQ ID NO: 180992 - protein, 8 aa, Borrelia burgdorferi
PEEAKNPI

SEQ ID NO: 180993 - protein, 8 aa, Borrelia burgdorferi
EEAKNPIA

SEQ ID NO: 180994 - protein, 8 aa, Borrelia burgdorferi
EAKNPIAA

SEQ ID NO: 180995 - protein, 8 aa, Borrelia burgdorferi
AKNPIAAA

SEQ ID NO: 180996 - protein, 8 aa, Borrelia burgdorferi
KNPIAAAI

SEQ ID NO: 180997 - protein, 8 aa, Borrelia burgdorferi
NPIAAAIG

SEQ ID NO: 180998 - protein, 8 aa, Borrelia burgdorferi
PIAAAIGK

SEQ ID NO: 180999 - protein, 8 aa, Borrelia burgdorferi
IAAAIGKG

SEQ ID NO: 181000 - protein, 8 aa, Borrelia burgdorferi
AAAIGKGN

SEQ ID NO: 181001 - protein, 8 aa, Borrelia burgdorferi
AAIGKGNA

SEQ ID NO: 181002 - protein, 8 aa, Borrelia burgdorferi
AIGKGNAD

SEQ ID NO: 181003 - protein, 8 aa, Borrelia burgdorferi
IGKGNADD

SEQ ID NO: 181004 - protein, 8 aa, Borrelia burgdorferi
GKGNADDG

SEQ ID NO: 181005 - protein, 8 aa, Borrelia burgdorferi
KGNADDGA

SEQ ID NO: 181006 - protein, 8 aa, Borrelia burgdorferi
GNADDGAE

SEQ ID NO: 181007 - protein, 8 aa, Borrelia burgdorferi
NADDGAEF

SEQ ID NO: 181008 - protein, 8 aa, Borrelia burgdorferi
ADDGAEFG

SEQ ID NO: 181009 - protein, 8 aa, Borrelia burgdorferi
DDGAEFGQ

SEQ ID NO: 181010 - protein, 8 aa, Borrelia burgdorferi
DGAEFGQE

SEQ ID NO: 181011 - protein, 8 aa, Borrelia burgdorferi
GAEFGQEG

SEQ ID NO: 181012 - protein, 8 aa, Borrelia burgdorferi
AEFGQEGM

SEQ ID NO: 181013 - protein, 8 aa, Borrelia burgdorferi
EFGQEGMK

SEQ ID NO: 181014 - protein, 8 aa, Borrelia burgdorferi
FGQEGMKK

SEQ ID NO: 181015 - protein, 8 aa, Borrelia burgdorferi
GQEGMKKD

SEQ ID NO: 181016 - protein, 8 aa, Borrelia burgdorferi
QEGMKKDD

SEQ ID NO: 181017 - protein, 8 aa, Borrelia burgdorferi
EGMKKDDQ

SEQ ID NO: 181018 - protein, 8 aa, Borrelia burgdorferi
GMKKDDQI

SEQ ID NO: 181019 - protein, 8 aa, Borrelia burgdorferi
MKKDDQIA

SEQ ID NO: 181020 - protein, 8 aa, Borrelia burgdorferi
KKDDQIAA

SEQ ID NO: 181021 - protein, 8 aa, Borrelia burgdorferi
KDDQIAAA

SEQ ID NO: 181022 - protein, 8 aa, Borrelia burgdorferi
DDQIAAAI

SEQ ID NO: 181023 - protein, 8 aa, Borrelia burgdorferi
DQIAAAIA

SEQ ID NO: 181024 - protein, 8 aa, Borrelia burgdorferi
QIAAAIAL

SEQ ID NO: 181025 - protein, 8 aa, Borrelia burgdorferi
IAAAIALR

SEQ ID NO: 181026 - protein, 8 aa, Borrelia burgdorferi
AAAIALRG

SEQ ID NO: 181027 - protein, 8 aa, Borrelia burgdorferi
AAIALRGM

SEQ ID NO: 181028 - protein, 8 aa, Borrelia burgdorferi
AIALRGMA

SEQ ID NO: 181029 - protein, 8 aa, Borrelia burgdorferi
IALRGMAK

SEQ ID NO: 181030 - protein, 8 aa, Borrelia burgdorferi
ALRGMAKD

SEQ ID NO: 181031 - protein, 8 aa, Borrelia burgdorferi
LRGMAKDG

SEQ ID NO: 181032 - protein, 8 aa, Borrelia burgdorferi
RGMAKDGK

SEQ ID NO: 181033 - protein, 8 aa, Borrelia burgdorferi
GMAKDGKF

SEQ ID NO: 181034 - protein, 8 aa, Borrelia burgdorferi
MAKDGKFA

SEQ ID NO: 181035 - protein, 8 aa, Borrelia burgdorferi
AKDGKFAV

SEQ ID NO: 181036 - protein, 8 aa, Borrelia burgdorferi
KDGKFAVK

SEQ ID NO: 181037 - protein, 8 aa, Borrelia burgdorferi
DGKFAVKS

SEQ ID NO: 181038 - protein, 8 aa, Borrelia burgdorferi
GKFAVKSG

SEQ ID NO: 181039 - protein, 8 aa, Borrelia burgdorferi
KFAVKSGE

SEQ ID NO: 181040 - protein, 8 aa, Borrelia burgdorferi
FAVKSGEK

SEQ ID NO: 181041 - protein, 8 aa, Borrelia burgdorferi
AVKSGEKE

SEQ ID NO: 181042 - protein, 8 aa, Borrelia burgdorferi
VKSGEKEK

SEQ ID NO: 181043 - protein, 8 aa, Borrelia burgdorferi
KSGEKEKA

SEQ ID NO: 181044 - protein, 9 aa, Borrelia burgdorferi
EGAIKEVSE

SEQ ID NO: 181045 - protein, 9 aa, Borrelia burgdorferi
GAIKEVSEL

SEQ ID NO: 181046 - protein, 9 aa, Borrelia burgdorferi
AIKEVSELL

SEQ ID NO: 181047 - protein, 9 aa, Borrelia burgdorferi
IKEVSELLD

SEQ ID NO: 181048 - protein, 9 aa, Borrelia burgdorferi
KEVSELLDK

SEQ ID NO: 181049 - protein, 9 aa, Borrelia burgdorferi
EVSELLDKL

SEQ ID NO: 181050 - protein, 9 aa, Borrelia burgdorferi
VSELLDKLV

SEQ ID NO: 181051 - protein, 9 aa, Borrelia burgdorferi
SELLDKLVK

SEQ ID NO: 181052 - protein, 9 aa, Borrelia burgdorferi
ELLDKLVKA

SEQ ID NO: 181053 - protein, 9 aa, Borrelia burgdorferi
LLDKLVKAV

SEQ ID NO: 181054 - protein, 9 aa, Borrelia burgdorferi
LDKLVKAVK

SEQ ID NO: 181055 - protein, 9 aa, Borrelia burgdorferi
DKLVKAVKT

SEQ ID NO: 181056 - protein, 9 aa, Borrelia burgdorferi
KLVKAVKTA

SEQ ID NO: 181057 - protein, 9 aa, Borrelia burgdorferi
LVKAVKTAE

SEQ ID NO: 181058 - protein, 9 aa, Borrelia burgdorferi
VKAVKTAEG

SEQ ID NO: 181059 - protein, 9 aa, Borrelia burgdorferi
KAVKTAEGA

SEQ ID NO: 181060 - protein, 9 aa, Borrelia burgdorferi
AVKTAEGAS

SEQ ID NO: 181061 - protein, 9 aa, Borrelia burgdorferi
VKTAEGASS

SEQ ID NO: 181062 - protein, 9 aa, Borrelia burgdorferi
KTAEGASSG

SEQ ID NO: 181063 - protein, 9 aa, Borrelia burgdorferi
TAEGASSGT

SEQ ID NO: 181064 - protein, 9 aa, Borrelia burgdorferi
AEGASSGTD

SEQ ID NO: 181065 - protein, 9 aa, Borrelia burgdorferi
EGASSGTDA

SEQ ID NO: 181066 - protein, 9 aa, Borrelia burgdorferi
GASSGTDAI

SEQ ID NO: 181067 - protein, 9 aa, Borrelia burgdorferi
ASSGTDAIG

SEQ ID NO: 181068 - protein, 9 aa, Borrelia burgdorferi
SSGTDAIGE

SEQ ID NO: 181069 - protein, 9 aa, Borrelia burgdorferi
SGTDAIGEV

SEQ ID NO: 181070 - protein, 9 aa, Borrelia burgdorferi
GTDAIGEVV

SEQ ID NO: 181071 - protein, 9 aa, Borrelia burgdorferi
TDAIGEVVA

SEQ ID NO: 181072 - protein, 9 aa, Borrelia burgdorferi
DAIGEVVAN

SEQ ID NO: 181073 - protein, 9 aa, Borrelia burgdorferi
AIGEVVANA

SEQ ID NO: 181074 - protein, 9 aa, Borrelia burgdorferi
IGEVVANAG

SEQ ID NO: 181075 - protein, 9 aa, Borrelia burgdorferi
GEVVANAGA

SEQ ID NO: 181076 - protein, 9 aa, Borrelia burgdorferi
EVVANAGAA

SEQ ID NO: 181077 - protein, 9 aa, Borrelia burgdorferi
VVANAGAAK

SEQ ID NO: 181078 - protein, 9 aa, Borrelia burgdorferi
VANAGAAKV

SEQ ID NO: 181079 - protein, 9 aa, Borrelia burgdorferi
ANAGAAKVA

SEQ ID NO: 181080 - protein, 9 aa, Borrelia burgdorferi
NAGAAKVAD

SEQ ID NO: 181081 - protein, 9 aa, Borrelia burgdorferi
AGAAKVADK

SEQ ID NO: 181082 - protein, 9 aa, Borrelia burgdorferi
GAAKVADKA

SEQ ID NO: 181083 - protein, 9 aa, Borrelia burgdorferi
AAKVADKAS

SEQ ID NO: 181084 - protein, 9 aa, Borrelia burgdorferi
AKVADKASV

SEQ ID NO: 181085 - protein, 9 aa, Borrelia burgdorferi
KVADKASVT

SEQ ID NO: 181086 - protein, 9 aa, Borrelia burgdorferi
VADKASVTG

SEQ ID NO: 181087 - protein, 9 aa, Borrelia burgdorferi
ADKASVTGI

SEQ ID NO: 181088 - protein, 9 aa, Borrelia burgdorferi
DKASVTGIA

SEQ ID NO: 181089 - protein, 9 aa, Borrelia burgdorferi
KASVTGIAK

SEQ ID NO: 181090 - protein, 9 aa, Borrelia burgdorferi
ASVTGIAKG

SEQ ID NO: 181091 - protein, 9 aa, Borrelia burgdorferi
SVTGIAKGI

SEQ ID NO: 181092 - protein, 9 aa, Borrelia burgdorferi
VTGIAKGIK

SEQ ID NO: 181093 - protein, 9 aa, Borrelia burgdorferi
TGIAKGIKE

SEQ ID NO: 181094 - protein, 9 aa, Borrelia burgdorferi
GIAKGIKEI

SEQ ID NO: 181095 - protein, 9 aa, Borrelia burgdorferi
IAKGIKEIV

SEQ ID NO: 181096 - protein, 9 aa, Borrelia burgdorferi
AKGIKEIVE

SEQ ID NO: 181097 - protein, 9 aa, Borrelia burgdorferi
KGIKEIVEA

SEQ ID NO: 181098 - protein, 9 aa, Borrelia burgdorferi
GIKEIVEAA

SEQ ID NO: 181099 - protein, 9 aa, Borrelia burgdorferi
IKEIVEAAG

SEQ ID NO: 181100 - protein, 9 aa, Borrelia burgdorferi
KEIVEAAGG

SEQ ID NO: 181101 - protein, 9 aa, Borrelia burgdorferi
EIVEAAGGS

SEQ ID NO: 181102 - protein, 9 aa, Borrelia burgdorferi
IVEAAGGSE

SEQ ID NO: 181103 - protein, 9 aa, Borrelia burgdorferi
VEAAGGSEK

SEQ ID NO: 181104 - protein, 9 aa, Borrelia burgdorferi
EAAGGSEKL

SEQ ID NO: 181105 - protein, 9 aa, Borrelia burgdorferi
AAGGSEKLK

SEQ ID NO: 181106 - protein, 9 aa, Borrelia burgdorferi
AGGSEKLKV

SEQ ID NO: 181107 - protein, 9 aa, Borrelia burgdorferi
GGSEKLKVA

SEQ ID NO: 181108 - protein, 9 aa, Borrelia burgdorferi
GSEKLKVAA

SEQ ID NO: 181109 - protein, 9 aa, Borrelia burgdorferi
SEKLKVAAA

SEQ ID NO: 181110 - protein, 9 aa, Borrelia burgdorferi
EKLKVAAAT

SEQ ID NO: 181111 - protein, 9 aa, Borrelia burgdorferi
KLKVAAATG

SEQ ID NO: 181112 - protein, 9 aa, Borrelia burgdorferi
LKVAAATGE

SEQ ID NO: 181113 - protein, 9 aa, Borrelia burgdorferi
KVAAATGES

SEQ ID NO: 181114 - protein, 9 aa, Borrelia burgdorferi
VAAATGESN

SEQ ID NO: 181115 - protein, 9 aa, Borrelia burgdorferi
AAATGESNK

SEQ ID NO: 181116 - protein, 9 aa, Borrelia burgdorferi
AATGESNKG

SEQ ID NO: 181117 - protein, 9 aa, Borrelia burgdorferi
ATGESNKGA

SEQ ID NO: 181118 - protein, 9 aa, Borrelia burgdorferi
TGESNKGAG

SEQ ID NO: 181119 - protein, 9 aa, Borrelia burgdorferi
GESNKGAGK

SEQ ID NO: 181120 - protein, 9 aa, Borrelia burgdorferi
ESNKGAGKL

SEQ ID NO: 181121 - protein, 9 aa, Borrelia burgdorferi
SNKGAGKLF

SEQ ID NO: 181122 - protein, 9 aa, Borrelia burgdorferi
NKGAGKLFG

SEQ ID NO: 181123 - protein, 9 aa, Borrelia burgdorferi
KGAGKLFGK

SEQ ID NO: 181124 - protein, 9 aa, Borrelia burgdorferi
GAGKLFGKA

SEQ ID NO: 181125 - protein, 9 aa, Borrelia burgdorferi
AGKLFGKAG

SEQ ID NO: 181126 - protein, 9 aa, Borrelia burgdorferi
GKLFGKAGA

SEQ ID NO: 181127 - protein, 9 aa, Borrelia burgdorferi
KLFGKAGAG

SEQ ID NO: 181128 - protein, 9 aa, Borrelia burgdorferi
LFGKAGAGA

SEQ ID NO: 181129 - protein, 9 aa, Borrelia burgdorferi
FGKAGAGAN

SEQ ID NO: 181130 - protein, 9 aa, Borrelia burgdorferi
GKAGAGANA

SEQ ID NO: 181131 - protein, 9 aa, Borrelia burgdorferi
KAGAGANAG

SEQ ID NO: 181132 - protein, 9 aa, Borrelia burgdorferi
AGAGANAGD

SEQ ID NO: 181133 - protein, 9 aa, Borrelia burgdorferi
GAGANAGDS

SEQ ID NO: 181134 - protein, 9 aa, Borrelia burgdorferi
AGANAGDSE

SEQ ID NO: 181135 - protein, 9 aa, Borrelia burgdorferi
GANAGDSEA

SEQ ID NO: 181136 - protein, 9 aa, Borrelia burgdorferi
ANAGDSEAA

SEQ ID NO: 181137 - protein, 9 aa, Borrelia burgdorferi
NAGDSEAAS

SEQ ID NO: 181138 - protein, 9 aa, Borrelia burgdorferi
AGDSEAASK

SEQ ID NO: 181139 - protein, 9 aa, Borrelia burgdorferi
GDSEAASKA

SEQ ID NO: 181140 - protein, 9 aa, Borrelia burgdorferi
DSEAASKAA

SEQ ID NO: 181141 - protein, 9 aa, Borrelia burgdorferi
SEAASKAAG

SEQ ID NO: 181142 - protein, 9 aa, Borrelia burgdorferi
EAASKAAGA

SEQ ID NO: 181143 - protein, 9 aa, Borrelia burgdorferi
AASKAAGAV

SEQ ID NO: 181144 - protein, 9 aa, Borrelia burgdorferi
ASKAAGAVS

SEQ ID NO: 181145 - protein, 9 aa, Borrelia burgdorferi
SKAAGAVSA

SEQ ID NO: 181146 - protein, 9 aa, Borrelia burgdorferi
KAAGAVSAV

SEQ ID NO: 181147 - protein, 9 aa, Borrelia burgdorferi
AAGAVSAVS

SEQ ID NO: 181148 - protein, 9 aa, Borrelia burgdorferi
AGAVSAVSG

SEQ ID NO: 181149 - protein, 9 aa, Borrelia burgdorferi
GAVSAVSGE

SEQ ID NO: 181150 - protein, 9 aa, Borrelia burgdorferi
AVSAVSGEQ

SEQ ID NO: 181151 - protein, 9 aa, Borrelia burgdorferi
VSAVSGEQI

SEQ ID NO: 181152 - protein, 9 aa, Borrelia burgdorferi
SAVSGEQIL

SEQ ID NO: 181153 - protein, 9 aa, Borrelia burgdorferi
AVSGEQILS

SEQ ID NO: 181154 - protein, 9 aa, Borrelia burgdorferi
VSGEQILSA

SEQ ID NO: 181155 - protein, 9 aa, Borrelia burgdorferi
SGEQILSAI

SEQ ID NO: 181156 - protein, 9 aa, Borrelia burgdorferi
GEQILSAIV

SEQ ID NO: 181157 - protein, 9 aa, Borrelia burgdorferi
EQILSAIVT

SEQ ID NO: 181158 - protein, 9 aa, Borrelia burgdorferi
QILSAIVTA

SEQ ID NO: 181159 - protein, 9 aa, Borrelia burgdorferi
ILSAIVTAA

SEQ ID NO: 181160 - protein, 9 aa, Borrelia burgdorferi
LSAIVTAAD

SEQ ID NO: 181161 - protein, 9 aa, Borrelia burgdorferi
SAIVTAADA

SEQ ID NO: 181162 - protein, 9 aa, Borrelia burgdorferi
AIVTAADAA

SEQ ID NO: 181163 - protein, 9 aa, Borrelia burgdorferi
IVTAADAAE

SEQ ID NO: 181164 - protein, 9 aa, Borrelia burgdorferi
VTAADAAEQ

SEQ ID NO: 181165 - protein, 9 aa, Borrelia burgdorferi
TAADAAEQE

SEQ ID NO: 181166 - protein, 9 aa, Borrelia burgdorferi
AADAAEQEG

SEQ ID NO: 181167 - protein, 9 aa, Borrelia burgdorferi
ADAAEQEGK

SEQ ID NO: 181168 - protein, 9 aa, Borrelia burgdorferi
DAAEQEGKK

SEQ ID NO: 181169 - protein, 9 aa, Borrelia burgdorferi
AAEQEGKKP

SEQ ID NO: 181170 - protein, 9 aa, Borrelia burgdorferi
AEQEGKKPE

SEQ ID NO: 181171 - protein, 9 aa, Borrelia burgdorferi
EQEGKKPEE

SEQ ID NO: 181172 - protein, 9 aa, Borrelia burgdorferi
QEGKKPEEA

SEQ ID NO: 181173 - protein, 9 aa, Borrelia burgdorferi
EGKKPEEAK

SEQ ID NO: 181174 - protein, 9 aa, Borrelia burgdorferi
GKKPEEAKN

SEQ ID NO: 181175 - protein, 9 aa, Borrelia burgdorferi
KKPEEAKNP

SEQ ID NO: 181176 - protein, 9 aa, Borrelia burgdorferi
KPEEAKNPI

SEQ ID NO: 181177 - protein, 9 aa, Borrelia burgdorferi
PEEAKNPIA

SEQ ID NO: 181178 - protein, 9 aa, Borrelia burgdorferi
EEAKNPIAA

SEQ ID NO: 181179 - protein, 9 aa, Borrelia burgdorferi
EAKNPIAAA

SEQ ID NO: 181180 - protein, 9 aa, Borrelia burgdorferi
AKNPIAAAI

SEQ ID NO: 181181 - protein, 9 aa, Borrelia burgdorferi
KNPIAAAIG

SEQ ID NO: 181182 - protein, 9 aa, Borrelia burgdorferi
NPIAAAIGK

SEQ ID NO: 181183 - protein, 9 aa, Borrelia burgdorferi
PIAAAIGKG

SEQ ID NO: 181184 - protein, 9 aa, Borrelia burgdorferi
IAAAIGKGN

SEQ ID NO: 181185 - protein, 9 aa, Borrelia burgdorferi
AAAIGKGNA

SEQ ID NO: 181186 - protein, 9 aa, Borrelia burgdorferi
AAIGKGNAD

SEQ ID NO: 181187 - protein, 9 aa, Borrelia burgdorferi
AIGKGNADD

SEQ ID NO: 181188 - protein, 9 aa, Borrelia burgdorferi
IGKGNADDG

SEQ ID NO: 181189 - protein, 9 aa, Borrelia burgdorferi
GKGNADDGA

SEQ ID NO: 181190 - protein, 9 aa, Borrelia burgdorferi
KGNADDGAE

SEQ ID NO: 181191 - protein, 9 aa, Borrelia burgdorferi
GNADDGAEF

SEQ ID NO: 181192 - protein, 9 aa, Borrelia burgdorferi
NADDGAEFG

SEQ ID NO: 181193 - protein, 9 aa, Borrelia burgdorferi
ADDGAEFGQ

SEQ ID NO: 181194 - protein, 9 aa, Borrelia burgdorferi
DDGAEFGQE

SEQ ID NO: 181195 - protein, 9 aa, Borrelia burgdorferi
DGAEFGQEG

SEQ ID NO: 181196 - protein, 9 aa, Borrelia burgdorferi
GAEFGQEGM

SEQ ID NO: 181197 - protein, 9 aa, Borrelia burgdorferi
AEFGQEGMK

SEQ ID NO: 181198 - protein, 9 aa, Borrelia burgdorferi
EFGQEGMKK

SEQ ID NO: 181199 - protein, 9 aa, Borrelia burgdorferi
FGQEGMKKD

SEQ ID NO: 181200 - protein, 9 aa, Borrelia burgdorferi
GQEGMKKDD

SEQ ID NO: 181201 - protein, 9 aa, Borrelia burgdorferi
QEGMKKDDQ

SEQ ID NO: 181202 - protein, 9 aa, Borrelia burgdorferi
EGMKKDDQI

SEQ ID NO: 181203 - protein, 9 aa, Borrelia burgdorferi
GMKKDDQIA

SEQ ID NO: 181204 - protein, 9 aa, Borrelia burgdorferi
MKKDDQIAA

SEQ ID NO: 181205 - protein, 9 aa, Borrelia burgdorferi
KKDDQIAAA

SEQ ID NO: 181206 - protein, 9 aa, Borrelia burgdorferi
KDDQIAAAI

SEQ ID NO: 181207 - protein, 9 aa, Borrelia burgdorferi
DDQIAAAIA

SEQ ID NO: 181208 - protein, 9 aa, Borrelia burgdorferi
DQIAAAIAL

SEQ ID NO: 181209 - protein, 9 aa, Borrelia burgdorferi
QIAAAIALR

SEQ ID NO: 181210 - protein, 9 aa, Borrelia burgdorferi
IAAAIALRG

SEQ ID NO: 181211 - protein, 9 aa, Borrelia burgdorferi
AAAIALRGM

SEQ ID NO: 181212 - protein, 9 aa, Borrelia burgdorferi
AAIALRGMA

SEQ ID NO: 181213 - protein, 9 aa, Borrelia burgdorferi
AIALRGMAK

SEQ ID NO: 181214 - protein, 9 aa, Borrelia burgdorferi
IALRGMAKD

SEQ ID NO: 181215 - protein, 9 aa, Borrelia burgdorferi
ALRGMAKDG

SEQ ID NO: 181216 - protein, 9 aa, Borrelia burgdorferi
LRGMAKDGK

SEQ ID NO: 181217 - protein, 9 aa, Borrelia burgdorferi
RGMAKDGKF

SEQ ID NO: 181218 - protein, 9 aa, Borrelia burgdorferi
GMAKDGKFA

SEQ ID NO: 181219 - protein, 9 aa, Borrelia burgdorferi
MAKDGKFAV

SEQ ID NO: 181220 - protein, 9 aa, Borrelia burgdorferi
AKDGKFAVK

SEQ ID NO: 181221 - protein, 9 aa, Borrelia burgdorferi
KDGKFAVKS

SEQ ID NO: 181222 - protein, 9 aa, Borrelia burgdorferi
DGKFAVKSG

SEQ ID NO: 181223 - protein, 9 aa, Borrelia burgdorferi
GKFAVKSGE

SEQ ID NO: 181224 - protein, 9 aa, Borrelia burgdorferi
KFAVKSGEK

SEQ ID NO: 181225 - protein, 9 aa, Borrelia burgdorferi
FAVKSGEKE

SEQ ID NO: 181226 - protein, 9 aa, Borrelia burgdorferi
AVKSGEKEK

SEQ ID NO: 181227 - protein, 9 aa, Borrelia burgdorferi
VKSGEKEKA

SEQ ID NO: 181228 - protein, 10 aa, Borrelia burgdorferi
EGAIKEVSEL

SEQ ID NO: 181229 - protein, 10 aa, Borrelia burgdorferi
GAIKEVSELL

SEQ ID NO: 181230 - protein, 10 aa, Borrelia burgdorferi
AIKEVSELLD

SEQ ID NO: 181231 - protein, 10 aa, Borrelia burgdorferi
IKEVSELLDK

SEQ ID NO: 181232 - protein, 10 aa, Borrelia burgdorferi
KEVSELLDKL

SEQ ID NO: 181233 - protein, 10 aa, Borrelia burgdorferi
EVSELLDKLV

SEQ ID NO: 181234 - protein, 10 aa, Borrelia burgdorferi
VSELLDKLVK

SEQ ID NO: 181235 - protein, 10 aa, Borrelia burgdorferi
SELLDKLVKA

SEQ ID NO: 181236 - protein, 10 aa, Borrelia burgdorferi
ELLDKLVKAV

SEQ ID NO: 181237 - protein, 10 aa, Borrelia burgdorferi
LLDKLVKAVK

SEQ ID NO: 181238 - protein, 10 aa, Borrelia burgdorferi
LDKLVKAVKT

SEQ ID NO: 181239 - protein, 10 aa, Borrelia burgdorferi
DKLVKAVKTA

SEQ ID NO: 181240 - protein, 10 aa, Borrelia burgdorferi
KLVKAVKTAE

SEQ ID NO: 181241 - protein, 10 aa, Borrelia burgdorferi
LVKAVKTAEG

SEQ ID NO: 181242 - protein, 10 aa, Borrelia burgdorferi
VKAVKTAEGA

SEQ ID NO: 181243 - protein, 10 aa, Borrelia burgdorferi
KAVKTAEGAS

SEQ ID NO: 181244 - protein, 10 aa, Borrelia burgdorferi
AVKTAEGASS

SEQ ID NO: 181245 - protein, 10 aa, Borrelia burgdorferi
VKTAEGASSG

SEQ ID NO: 181246 - protein, 10 aa, Borrelia burgdorferi
KTAEGASSGT

SEQ ID NO: 181247 - protein, 10 aa, Borrelia burgdorferi
TAEGASSGTD

SEQ ID NO: 181248 - protein, 10 aa, Borrelia burgdorferi
AEGASSGTDA

SEQ ID NO: 181249 - protein, 10 aa, Borrelia burgdorferi
EGASSGTDAI

SEQ ID NO: 181250 - protein, 10 aa, Borrelia burgdorferi
GASSGTDAIG

SEQ ID NO: 181251 - protein, 10 aa, Borrelia burgdorferi
ASSGTDAIGE

SEQ ID NO: 181252 - protein, 10 aa, Borrelia burgdorferi
SSGTDAIGEV

SEQ ID NO: 181253 - protein, 10 aa, Borrelia burgdorferi
SGTDAIGEVV

SEQ ID NO: 181254 - protein, 10 aa, Borrelia burgdorferi
GTDAIGEVVA

SEQ ID NO: 181255 - protein, 10 aa, Borrelia burgdorferi
TDAIGEVVAN

SEQ ID NO: 181256 - protein, 10 aa, Borrelia burgdorferi
DAIGEVVANA

SEQ ID NO: 181257 - protein, 10 aa, Borrelia burgdorferi
AIGEVVANAG

SEQ ID NO: 181258 - protein, 10 aa, Borrelia burgdorferi
IGEVVANAGA

SEQ ID NO: 181259 - protein, 10 aa, Borrelia burgdorferi
GEVVANAGAA

SEQ ID NO: 181260 - protein, 10 aa, Borrelia burgdorferi
EVVANAGAAK

SEQ ID NO: 181261 - protein, 10 aa, Borrelia burgdorferi
VVANAGAAKV

SEQ ID NO: 181262 - protein, 10 aa, Borrelia burgdorferi
VANAGAAKVA

SEQ ID NO: 181263 - protein, 10 aa, Borrelia burgdorferi
ANAGAAKVAD

SEQ ID NO: 181264 - protein, 10 aa, Borrelia burgdorferi
NAGAAKVADK

SEQ ID NO: 181265 - protein, 10 aa, Borrelia burgdorferi
AGAAKVADKA

SEQ ID NO: 181266 - protein, 10 aa, Borrelia burgdorferi
GAAKVADKAS

SEQ ID NO: 181267 - protein, 10 aa, Borrelia burgdorferi
AAKVADKASV

SEQ ID NO: 181268 - protein, 10 aa, Borrelia burgdorferi
AKVADKASVT

SEQ ID NO: 181269 - protein, 10 aa, Borrelia burgdorferi
KVADKASVTG

SEQ ID NO: 181270 - protein, 10 aa, Borrelia burgdorferi
VADKASVTGI

SEQ ID NO: 181271 - protein, 10 aa, Borrelia burgdorferi
ADKASVTGIA

SEQ ID NO: 181272 - protein, 10 aa, Borrelia burgdorferi
DKASVTGIAK

SEQ ID NO: 181273 - protein, 10 aa, Borrelia burgdorferi
KASVTGIAKG

SEQ ID NO: 181274 - protein, 10 aa, Borrelia burgdorferi
ASVTGIAKGI

SEQ ID NO: 181275 - protein, 10 aa, Borrelia burgdorferi
SVTGIAKGIK

SEQ ID NO: 181276 - protein, 10 aa, Borrelia burgdorferi
VTGIAKGIKE

SEQ ID NO: 181277 - protein, 10 aa, Borrelia burgdorferi
TGIAKGIKEI

SEQ ID NO: 181278 - protein, 10 aa, Borrelia burgdorferi
GIAKGIKEIV

SEQ ID NO: 181279 - protein, 10 aa, Borrelia burgdorferi
IAKGIKEIVE

SEQ ID NO: 181280 - protein, 10 aa, Borrelia burgdorferi
AKGIKEIVEA

SEQ ID NO: 181281 - protein, 10 aa, Borrelia burgdorferi
KGIKEIVEAA

SEQ ID NO: 181282 - protein, 10 aa, Borrelia burgdorferi
GIKEIVEAAG

SEQ ID NO: 181283 - protein, 10 aa, Borrelia burgdorferi
IKEIVEAAGG

SEQ ID NO: 181284 - protein, 10 aa, Borrelia burgdorferi
KEIVEAAGGS

SEQ ID NO: 181285 - protein, 10 aa, Borrelia burgdorferi
EIVEAAGGSE

SEQ ID NO: 181286 - protein, 10 aa, Borrelia burgdorferi
IVEAAGGSEK

SEQ ID NO: 181287 - protein, 10 aa, Borrelia burgdorferi
VEAAGGSEKL

SEQ ID NO: 181288 - protein, 10 aa, Borrelia burgdorferi
EAAGGSEKLK

SEQ ID NO: 181289 - protein, 10 aa, Borrelia burgdorferi
AAGGSEKLKV

SEQ ID NO: 181290 - protein, 10 aa, Borrelia burgdorferi
AGGSEKLKVA

SEQ ID NO: 181291 - protein, 10 aa, Borrelia burgdorferi
GGSEKLKVAA

SEQ ID NO: 181292 - protein, 10 aa, Borrelia burgdorferi
GSEKLKVAAA

SEQ ID NO: 181293 - protein, 10 aa, Borrelia burgdorferi
SEKLKVAAAT

SEQ ID NO: 181294 - protein, 10 aa, Borrelia burgdorferi
EKLKVAAATG

SEQ ID NO: 181295 - protein, 10 aa, Borrelia burgdorferi
KLKVAAATGE

SEQ ID NO: 181296 - protein, 10 aa, Borrelia burgdorferi
LKVAAATGES

SEQ ID NO: 181297 - protein, 10 aa, Borrelia burgdorferi
KVAAATGESN

SEQ ID NO: 181298 - protein, 10 aa, Borrelia burgdorferi
VAAATGESNK

SEQ ID NO: 181299 - protein, 10 aa, Borrelia burgdorferi
AAATGESNKG

SEQ ID NO: 181300 - protein, 10 aa, Borrelia burgdorferi
AATGESNKGA

SEQ ID NO: 181301 - protein, 10 aa, Borrelia burgdorferi
ATGESNKGAG

SEQ ID NO: 181302 - protein, 10 aa, Borrelia burgdorferi
TGESNKGAGK

SEQ ID NO: 181303 - protein, 10 aa, Borrelia burgdorferi
GESNKGAGKL

SEQ ID NO: 181304 - protein, 10 aa, Borrelia burgdorferi
ESNKGAGKLF

SEQ ID NO: 181305 - protein, 10 aa, Borrelia burgdorferi
SNKGAGKLFG

SEQ ID NO: 181306 - protein, 10 aa, Borrelia burgdorferi
NKGAGKLFGK

SEQ ID NO: 181307 - protein, 10 aa, Borrelia burgdorferi
KGAGKLFGKA

SEQ ID NO: 181308 - protein, 10 aa, Borrelia burgdorferi
GAGKLFGKAG

SEQ ID NO: 181309 - protein, 10 aa, Borrelia burgdorferi
AGKLFGKAGA

SEQ ID NO: 181310 - protein, 10 aa, Borrelia burgdorferi
GKLFGKAGAG

SEQ ID NO: 181311 - protein, 10 aa, Borrelia burgdorferi
KLFGKAGAGA

SEQ ID NO: 181312 - protein, 10 aa, Borrelia burgdorferi
LFGKAGAGAN

SEQ ID NO: 181313 - protein, 10 aa, Borrelia burgdorferi
FGKAGAGANA

SEQ ID NO: 181314 - protein, 10 aa, Borrelia burgdorferi
GKAGAGANAG

SEQ ID NO: 181315 - protein, 10 aa, Borrelia burgdorferi
KAGAGANAGD

SEQ ID NO: 181316 - protein, 10 aa, Borrelia burgdorferi
AGAGANAGDS

SEQ ID NO: 181317 - protein, 10 aa, Borrelia burgdorferi
GAGANAGDSE

SEQ ID NO: 181318 - protein, 10 aa, Borrelia burgdorferi
AGANAGDSEA

SEQ ID NO: 181319 - protein, 10 aa, Borrelia burgdorferi
GANAGDSEAA

SEQ ID NO: 181320 - protein, 10 aa, Borrelia burgdorferi
ANAGDSEAAS

SEQ ID NO: 181321 - protein, 10 aa, Borrelia burgdorferi
NAGDSEAASK

SEQ ID NO: 181322 - protein, 10 aa, Borrelia burgdorferi
AGDSEAASKA

SEQ ID NO: 181323 - protein, 10 aa, Borrelia burgdorferi
GDSEAASKAA

SEQ ID NO: 181324 - protein, 10 aa, Borrelia burgdorferi
DSEAASKAAG

SEQ ID NO: 181325 - protein, 10 aa, Borrelia burgdorferi
SEAASKAAGA

SEQ ID NO: 181326 - protein, 10 aa, Borrelia burgdorferi
EAASKAAGAV

SEQ ID NO: 181327 - protein, 10 aa, Borrelia burgdorferi
AASKAAGAVS

SEQ ID NO: 181328 - protein, 10 aa, Borrelia burgdorferi
ASKAAGAVSA

SEQ ID NO: 181329 - protein, 10 aa, Borrelia burgdorferi
SKAAGAVSAV

SEQ ID NO: 181330 - protein, 10 aa, Borrelia burgdorferi
KAAGAVSAVS

SEQ ID NO: 181331 - protein, 10 aa, Borrelia burgdorferi
AAGAVSAVSG

SEQ ID NO: 181332 - protein, 10 aa, Borrelia burgdorferi
AGAVSAVSGE

SEQ ID NO: 181333 - protein, 10 aa, Borrelia burgdorferi
GAVSAVSGEQ

SEQ ID NO: 181334 - protein, 10 aa, Borrelia burgdorferi
AVSAVSGEQI

SEQ ID NO: 181335 - protein, 10 aa, Borrelia burgdorferi
VSAVSGEQIL

SEQ ID NO: 181336 - protein, 10 aa, Borrelia burgdorferi
SAVSGEQILS

SEQ ID NO: 181337 - protein, 10 aa, Borrelia burgdorferi
AVSGEQILSA

SEQ ID NO: 181338 - protein, 10 aa, Borrelia burgdorferi
VSGEQILSAI

SEQ ID NO: 181339 - protein, 10 aa, Borrelia burgdorferi
SGEQILSAIV

SEQ ID NO: 181340 - protein, 10 aa, Borrelia burgdorferi
GEQILSAIVT

SEQ ID NO: 181341 - protein, 10 aa, Borrelia burgdorferi
EQILSAIVTA

SEQ ID NO: 181342 - protein, 10 aa, Borrelia burgdorferi
QILSAIVTAA

SEQ ID NO: 181343 - protein, 10 aa, Borrelia burgdorferi
ILSAIVTAAD

SEQ ID NO: 181344 - protein, 10 aa, Borrelia burgdorferi
LSAIVTAADA

SEQ ID NO: 181345 - protein, 10 aa, Borrelia burgdorferi
SAIVTAADAA

SEQ ID NO: 181346 - protein, 10 aa, Borrelia burgdorferi
AIVTAADAAE

SEQ ID NO: 181347 - protein, 10 aa, Borrelia burgdorferi
IVTAADAAEQ

SEQ ID NO: 181348 - protein, 10 aa, Borrelia burgdorferi
VTAADAAEQE

SEQ ID NO: 181349 - protein, 10 aa, Borrelia burgdorferi
TAADAAEQEG

SEQ ID NO: 181350 - protein, 10 aa, Borrelia burgdorferi
AADAAEQEGK

SEQ ID NO: 181351 - protein, 10 aa, Borrelia burgdorferi
ADAAEQEGKK

SEQ ID NO: 181352 - protein, 10 aa, Borrelia burgdorferi
DAAEQEGKKP

SEQ ID NO: 181353 - protein, 10 aa, Borrelia burgdorferi
AAEQEGKKPE

SEQ ID NO: 181354 - protein, 10 aa, Borrelia burgdorferi
AEQEGKKPEE

SEQ ID NO: 181355 - protein, 10 aa, Borrelia burgdorferi
EQEGKKPEEA

SEQ ID NO: 181356 - protein, 10 aa, Borrelia burgdorferi
QEGKKPEEAK

SEQ ID NO: 181357 - protein, 10 aa, Borrelia burgdorferi
EGKKPEEAKN

SEQ ID NO: 181358 - protein, 10 aa, Borrelia burgdorferi
GKKPEEAKNP

SEQ ID NO: 181359 - protein, 10 aa, Borrelia burgdorferi
KKPEEAKNPI

SEQ ID NO: 181360 - protein, 10 aa, Borrelia burgdorferi
KPEEAKNPIA

SEQ ID NO: 181361 - protein, 10 aa, Borrelia burgdorferi
PEEAKNPIAA

SEQ ID NO: 181362 - protein, 10 aa, Borrelia burgdorferi
EEAKNPIAAA

SEQ ID NO: 181363 - protein, 10 aa, Borrelia burgdorferi
EAKNPIAAAI

SEQ ID NO: 181364 - protein, 10 aa, Borrelia burgdorferi
AKNPIAAAIG

SEQ ID NO: 181365 - protein, 10 aa, Borrelia burgdorferi
KNPIAAAIGK

SEQ ID NO: 181366 - protein, 10 aa, Borrelia burgdorferi
NPIAAAIGKG

SEQ ID NO: 181367 - protein, 10 aa, Borrelia burgdorferi
PIAAAIGKGN

SEQ ID NO: 181368 - protein, 10 aa, Borrelia burgdorferi
IAAAIGKGNA

SEQ ID NO: 181369 - protein, 10 aa, Borrelia burgdorferi
AAAIGKGNAD

SEQ ID NO: 181370 - protein, 10 aa, Borrelia burgdorferi
AAIGKGNADD

SEQ ID NO: 181371 - protein, 10 aa, Borrelia burgdorferi
AIGKGNADDG

SEQ ID NO: 181372 - protein, 10 aa, Borrelia burgdorferi
IGKGNADDGA

SEQ ID NO: 181373 - protein, 10 aa, Borrelia burgdorferi
GKGNADDGAE

SEQ ID NO: 181374 - protein, 10 aa, Borrelia burgdorferi
KGNADDGAEF

SEQ ID NO: 181375 - protein, 10 aa, Borrelia burgdorferi
GNADDGAEFG

SEQ ID NO: 181376 - protein, 10 aa, Borrelia burgdorferi
NADDGAEFGQ

SEQ ID NO: 181377 - protein, 10 aa, Borrelia burgdorferi
ADDGAEFGQE

SEQ ID NO: 181378 - protein, 10 aa, Borrelia burgdorferi
DDGAEFGQEG

SEQ ID NO: 181379 - protein, 10 aa, Borrelia burgdorferi
DGAEFGQEGM

SEQ ID NO: 181380 - protein, 10 aa, Borrelia burgdorferi
GAEFGQEGMK

SEQ ID NO: 181381 - protein, 10 aa, Borrelia burgdorferi
AEFGQEGMKK

SEQ ID NO: 181382 - protein, 10 aa, Borrelia burgdorferi
EFGQEGMKKD

SEQ ID NO: 181383 - protein, 10 aa, Borrelia burgdorferi
FGQEGMKKDD

SEQ ID NO: 181384 - protein, 10 aa, Borrelia burgdorferi
GQEGMKKDDQ

SEQ ID NO: 181385 - protein, 10 aa, Borrelia burgdorferi
QEGMKKDDQI

SEQ ID NO: 181386 - protein, 10 aa, Borrelia burgdorferi
EGMKKDDQIA

SEQ ID NO: 181387 - protein, 10 aa, Borrelia burgdorferi
GMKKDDQIAA

SEQ ID NO: 181388 - protein, 10 aa, Borrelia burgdorferi
MKKDDQIAAA

SEQ ID NO: 181389 - protein, 10 aa, Borrelia burgdorferi
KKDDQIAAAI

SEQ ID NO: 181390 - protein, 10 aa, Borrelia burgdorferi
KDDQIAAAIA

SEQ ID NO: 181391 - protein, 10 aa, Borrelia burgdorferi
DDQIAAAIAL

SEQ ID NO: 181392 - protein, 10 aa, Borrelia burgdorferi
DQIAAAIALR

SEQ ID NO: 181393 - protein, 10 aa, Borrelia burgdorferi
QIAAAIALRG

SEQ ID NO: 181394 - protein, 10 aa, Borrelia burgdorferi
IAAAIALRGM

SEQ ID NO: 181395 - protein, 10 aa, Borrelia burgdorferi
AAAIALRGMA

SEQ ID NO: 181396 - protein, 10 aa, Borrelia burgdorferi
AAIALRGMAK

SEQ ID NO: 181397 - protein, 10 aa, Borrelia burgdorferi
AIALRGMAKD

SEQ ID NO: 181398 - protein, 10 aa, Borrelia burgdorferi
IALRGMAKDG

SEQ ID NO: 181399 - protein, 10 aa, Borrelia burgdorferi
ALRGMAKDGK

SEQ ID NO: 181400 - protein, 10 aa, Borrelia burgdorferi
LRGMAKDGKF

SEQ ID NO: 181401 - protein, 10 aa, Borrelia burgdorferi
RGMAKDGKFA

SEQ ID NO: 181402 - protein, 10 aa, Borrelia burgdorferi
GMAKDGKFAV

SEQ ID NO: 181403 - protein, 10 aa, Borrelia burgdorferi
MAKDGKFAVK

SEQ ID NO: 181404 - protein, 10 aa, Borrelia burgdorferi
AKDGKFAVKS

SEQ ID NO: 181405 - protein, 10 aa, Borrelia burgdorferi
KDGKFAVKSG

SEQ ID NO: 181406 - protein, 10 aa, Borrelia burgdorferi
DGKFAVKSGE

SEQ ID NO: 181407 - protein, 10 aa, Borrelia burgdorferi
GKFAVKSGEK

SEQ ID NO: 181408 - protein, 10 aa, Borrelia burgdorferi
KFAVKSGEKE

SEQ ID NO: 181409 - protein, 10 aa, Borrelia burgdorferi
FAVKSGEKEK

SEQ ID NO: 181410 - protein, 10 aa, Borrelia burgdorferi
AVKSGEKEKA

SEQ ID NO: 181411 - protein, 11 aa, Borrelia burgdorferi
EGAIKEVSELL

SEQ ID NO: 181412 - protein, 11 aa, Borrelia burgdorferi
GAIKEVSELLD

SEQ ID NO: 181413 - protein, 11 aa, Borrelia burgdorferi
AIKEVSELLDK

SEQ ID NO: 181414 - protein, 11 aa, Borrelia burgdorferi
IKEVSELLDKL

SEQ ID NO: 181415 - protein, 11 aa, Borrelia burgdorferi
KEVSELLDKLV

SEQ ID NO: 181416 - protein, 11 aa, Borrelia burgdorferi
EVSELLDKLVK

SEQ ID NO: 181417 - protein, 11 aa, Borrelia burgdorferi
VSELLDKLVKA

SEQ ID NO: 181418 - protein, 11 aa, Borrelia burgdorferi
SELLDKLVKAV

SEQ ID NO: 181419 - protein, 11 aa, Borrelia burgdorferi
ELLDKLVKAVK

SEQ ID NO: 181420 - protein, 11 aa, Borrelia burgdorferi
LLDKLVKAVKT

SEQ ID NO: 181421 - protein, 11 aa, Borrelia burgdorferi
LDKLVKAVKTA

SEQ ID NO: 181422 - protein, 11 aa, Borrelia burgdorferi
DKLVKAVKTAE

SEQ ID NO: 181423 - protein, 11 aa, Borrelia burgdorferi
KLVKAVKTAEG

SEQ ID NO: 181424 - protein, 11 aa, Borrelia burgdorferi
LVKAVKTAEGA

SEQ ID NO: 181425 - protein, 11 aa, Borrelia burgdorferi
VKAVKTAEGAS

SEQ ID NO: 181426 - protein, 11 aa, Borrelia burgdorferi
KAVKTAEGASS

SEQ ID NO: 181427 - protein, 11 aa, Borrelia burgdorferi
AVKTAEGASSG

SEQ ID NO: 181428 - protein, 11 aa, Borrelia burgdorferi
VKTAEGASSGT

SEQ ID NO: 181429 - protein, 11 aa, Borrelia burgdorferi
KTAEGASSGTD

SEQ ID NO: 181430 - protein, 11 aa, Borrelia burgdorferi
TAEGASSGTDA

SEQ ID NO: 181431 - protein, 11 aa, Borrelia burgdorferi
AEGASSGTDAI

SEQ ID NO: 181432 - protein, 11 aa, Borrelia burgdorferi
EGASSGTDAIG

SEQ ID NO: 181433 - protein, 11 aa, Borrelia burgdorferi
GASSGTDAIGE

SEQ ID NO: 181434 - protein, 11 aa, Borrelia burgdorferi
ASSGTDAIGEV

SEQ ID NO: 181435 - protein, 11 aa, Borrelia burgdorferi
SSGTDAIGEVV

SEQ ID NO: 181436 - protein, 11 aa, Borrelia burgdorferi
SGTDAIGEVVA

SEQ ID NO: 181437 - protein, 11 aa, Borrelia burgdorferi
GTDAIGEVVAN

SEQ ID NO: 181438 - protein, 11 aa, Borrelia burgdorferi
TDAIGEVVANA

SEQ ID NO: 181439 - protein, 11 aa, Borrelia burgdorferi
DAIGEVVANAG

SEQ ID NO: 181440 - protein, 11 aa, Borrelia burgdorferi
AIGEVVANAGA

SEQ ID NO: 181441 - protein, 11 aa, Borrelia burgdorferi
IGEVVANAGAA

SEQ ID NO: 181442 - protein, 11 aa, Borrelia burgdorferi
GEVVANAGAAK

SEQ ID NO: 181443 - protein, 11 aa, Borrelia burgdorferi
EVVANAGAAKV

SEQ ID NO: 181444 - protein, 11 aa, Borrelia burgdorferi
VVANAGAAKVA

SEQ ID NO: 181445 - protein, 11 aa, Borrelia burgdorferi
VANAGAAKVAD

SEQ ID NO: 181446 - protein, 11 aa, Borrelia burgdorferi
ANAGAAKVADK

SEQ ID NO: 181447 - protein, 11 aa, Borrelia burgdorferi
NAGAAKVADKA

SEQ ID NO: 181448 - protein, 11 aa, Borrelia burgdorferi
AGAAKVADKAS

SEQ ID NO: 181449 - protein, 11 aa, Borrelia burgdorferi
GAAKVADKASV

SEQ ID NO: 181450 - protein, 11 aa, Borrelia burgdorferi
AAKVADKASVT

SEQ ID NO: 181451 - protein, 11 aa, Borrelia burgdorferi
AKVADKASVTG

SEQ ID NO: 181452 - protein, 11 aa, Borrelia burgdorferi
KVADKASVTGI

SEQ ID NO: 181453 - protein, 11 aa, Borrelia burgdorferi
VADKASVTGIA

SEQ ID NO: 181454 - protein, 11 aa, Borrelia burgdorferi
ADKASVTGIAK

SEQ ID NO: 181455 - protein, 11 aa, Borrelia burgdorferi
DKASVTGIAKG

SEQ ID NO: 181456 - protein, 11 aa, Borrelia burgdorferi
KASVTGIAKGI

SEQ ID NO: 181457 - protein, 11 aa, Borrelia burgdorferi
ASVTGIAKGIK

SEQ ID NO: 181458 - protein, 11 aa, Borrelia burgdorferi
SVTGIAKGIKE

SEQ ID NO: 181459 - protein, 11 aa, Borrelia burgdorferi
VTGIAKGIKEI

SEQ ID NO: 181460 - protein, 11 aa, Borrelia burgdorferi
TGIAKGIKEIV

SEQ ID NO: 181461 - protein, 11 aa, Borrelia burgdorferi
GIAKGIKEIVE

SEQ ID NO: 181462 - protein, 11 aa, Borrelia burgdorferi
IAKGIKEIVEA

SEQ ID NO: 181463 - protein, 11 aa, Borrelia burgdorferi
AKGIKEIVEAA

SEQ ID NO: 181464 - protein, 11 aa, Borrelia burgdorferi
KGIKEIVEAAG

SEQ ID NO: 181465 - protein, 11 aa, Borrelia burgdorferi
GIKEIVEAAGG

SEQ ID NO: 181466 - protein, 11 aa, Borrelia burgdorferi
IKEIVEAAGGS

SEQ ID NO: 181467 - protein, 11 aa, Borrelia burgdorferi
KEIVEAAGGSE

SEQ ID NO: 181468 - protein, 11 aa, Borrelia burgdorferi
EIVEAAGGSEK

SEQ ID NO: 181469 - protein, 11 aa, Borrelia burgdorferi
IVEAAGGSEKL

SEQ ID NO: 181470 - protein, 11 aa, Borrelia burgdorferi
VEAAGGSEKLK

SEQ ID NO: 181471 - protein, 11 aa, Borrelia burgdorferi
EAAGGSEKLKV

SEQ ID NO: 181472 - protein, 11 aa, Borrelia burgdorferi
AAGGSEKLKVA

SEQ ID NO: 181473 - protein, 11 aa, Borrelia burgdorferi
AGGSEKLKVAA

SEQ ID NO: 181474 - protein, 11 aa, Borrelia burgdorferi
GGSEKLKVAAA

SEQ ID NO: 181475 - protein, 11 aa, Borrelia burgdorferi
GSEKLKVAAAT

SEQ ID NO: 181476 - protein, 11 aa, Borrelia burgdorferi
SEKLKVAAATG

SEQ ID NO: 181477 - protein, 11 aa, Borrelia burgdorferi
EKLKVAAATGE

SEQ ID NO: 181478 - protein, 11 aa, Borrelia burgdorferi
KLKVAAATGES

SEQ ID NO: 181479 - protein, 11 aa, Borrelia burgdorferi
LKVAAATGESN

SEQ ID NO: 181480 - protein, 11 aa, Borrelia burgdorferi
KVAAATGESNK

SEQ ID NO: 181481 - protein, 11 aa, Borrelia burgdorferi
VAAATGESNKG

SEQ ID NO: 181482 - protein, 11 aa, Borrelia burgdorferi
AAATGESNKGA

SEQ ID NO: 181483 - protein, 11 aa, Borrelia burgdorferi
AATGESNKGAG

SEQ ID NO: 181484 - protein, 11 aa, Borrelia burgdorferi
ATGESNKGAGK

SEQ ID NO: 181485 - protein, 11 aa, Borrelia burgdorferi
TGESNKGAGKL

SEQ ID NO: 181486 - protein, 11 aa, Borrelia burgdorferi
GESNKGAGKLF

SEQ ID NO: 181487 - protein, 11 aa, Borrelia burgdorferi
ESNKGAGKLFG

SEQ ID NO: 181488 - protein, 11 aa, Borrelia burgdorferi
SNKGAGKLFGK

SEQ ID NO: 181489 - protein, 11 aa, Borrelia burgdorferi
NKGAGKLFGKA

SEQ ID NO: 181490 - protein, 11 aa, Borrelia burgdorferi
KGAGKLFGKAG

SEQ ID NO: 181491 - protein, 11 aa, Borrelia burgdorferi
GAGKLFGKAGA

SEQ ID NO: 181492 - protein, 11 aa, Borrelia burgdorferi
AGKLFGKAGAG

SEQ ID NO: 181493 - protein, 11 aa, Borrelia burgdorferi
GKLFGKAGAGA

SEQ ID NO: 181494 - protein, 11 aa, Borrelia burgdorferi
KLFGKAGAGAN

SEQ ID NO: 181495 - protein, 11 aa, Borrelia burgdorferi
LFGKAGAGANA

SEQ ID NO: 181496 - protein, 11 aa, Borrelia burgdorferi
FGKAGAGANAG

SEQ ID NO: 181497 - protein, 11 aa, Borrelia burgdorferi
GKAGAGANAGD

SEQ ID NO: 181498 - protein, 11 aa, Borrelia burgdorferi
KAGAGANAGDS

SEQ ID NO: 181499 - protein, 11 aa, Borrelia burgdorferi
AGAGANAGDSE

SEQ ID NO: 181500 - protein, 11 aa, Borrelia burgdorferi
GAGANAGDSEA

SEQ ID NO: 181501 - protein, 11 aa, Borrelia burgdorferi
AGANAGDSEAA

SEQ ID NO: 181502 - protein, 11 aa, Borrelia burgdorferi
GANAGDSEAAS

SEQ ID NO: 181503 - protein, 11 aa, Borrelia burgdorferi
ANAGDSEAASK

SEQ ID NO: 181504 - protein, 11 aa, Borrelia burgdorferi
NAGDSEAASKA

SEQ ID NO: 181505 - protein, 11 aa, Borrelia burgdorferi
AGDSEAASKAA

SEQ ID NO: 181506 - protein, 11 aa, Borrelia burgdorferi
GDSEAASKAAG

SEQ ID NO: 181507 - protein, 11 aa, Borrelia burgdorferi
DSEAASKAAGA

SEQ ID NO: 181508 - protein, 11 aa, Borrelia burgdorferi
SEAASKAAGAV

SEQ ID NO: 181509 - protein, 11 aa, Borrelia burgdorferi
EAASKAAGAVS

SEQ ID NO: 181510 - protein, 11 aa, Borrelia burgdorferi
AASKAAGAVSA

SEQ ID NO: 181511 - protein, 11 aa, Borrelia burgdorferi
ASKAAGAVSAV

SEQ ID NO: 181512 - protein, 11 aa, Borrelia burgdorferi
SKAAGAVSAVS

SEQ ID NO: 181513 - protein, 11 aa, Borrelia burgdorferi
KAAGAVSAVSG

SEQ ID NO: 181514 - protein, 11 aa, Borrelia burgdorferi
AAGAVSAVSGE

SEQ ID NO: 181515 - protein, 11 aa, Borrelia burgdorferi
AGAVSAVSGEQ

SEQ ID NO: 181516 - protein, 11 aa, Borrelia burgdorferi
GAVSAVSGEQI

SEQ ID NO: 181517 - protein, 11 aa, Borrelia burgdorferi
AVSAVSGEQIL

SEQ ID NO: 181518 - protein, 11 aa, Borrelia burgdorferi
VSAVSGEQILS

SEQ ID NO: 181519 - protein, 11 aa, Borrelia burgdorferi
SAVSGEQILSA

SEQ ID NO: 181520 - protein, 11 aa, Borrelia burgdorferi
AVSGEQILSAI

SEQ ID NO: 181521 - protein, 11 aa, Borrelia burgdorferi
VSGEQILSAIV

SEQ ID NO: 181522 - protein, 11 aa, Borrelia burgdorferi
SGEQILSAIVT

SEQ ID NO: 181523 - protein, 11 aa, Borrelia burgdorferi
GEQILSAIVTA

SEQ ID NO: 181524 - protein, 11 aa, Borrelia burgdorferi
EQILSAIVTAA

SEQ ID NO: 181525 - protein, 11 aa, Borrelia burgdorferi
QILSAIVTAAD

SEQ ID NO: 181526 - protein, 11 aa, Borrelia burgdorferi
ILSAIVTAADA

SEQ ID NO: 181527 - protein, 11 aa, Borrelia burgdorferi
LSAIVTAADAA

SEQ ID NO: 181528 - protein, 11 aa, Borrelia burgdorferi
SAIVTAADAAE

SEQ ID NO: 181529 - protein, 11 aa, Borrelia burgdorferi
AIVTAADAAEQ

SEQ ID NO: 181530 - protein, 11 aa, Borrelia burgdorferi
IVTAADAAEQE

SEQ ID NO: 181531 - protein, 11 aa, Borrelia burgdorferi
VTAADAAEQEG

SEQ ID NO: 181532 - protein, 11 aa, Borrelia burgdorferi
TAADAAEQEGK

SEQ ID NO: 181533 - protein, 11 aa, Borrelia burgdorferi
AADAAEQEGKK

SEQ ID NO: 181534 - protein, 11 aa, Borrelia burgdorferi
ADAAEQEGKKP

SEQ ID NO: 181535 - protein, 11 aa, Borrelia burgdorferi
DAAEQEGKKPE

SEQ ID NO: 181536 - protein, 11 aa, Borrelia burgdorferi
AAEQEGKKPEE

SEQ ID NO: 181537 - protein, 11 aa, Borrelia burgdorferi
AEQEGKKPEEA

SEQ ID NO: 181538 - protein, 11 aa, Borrelia burgdorferi
EQEGKKPEEAK

SEQ ID NO: 181539 - protein, 11 aa, Borrelia burgdorferi
QEGKKPEEAKN

SEQ ID NO: 181540 - protein, 11 aa, Borrelia burgdorferi
EGKKPEEAKNP

SEQ ID NO: 181541 - protein, 11 aa, Borrelia burgdorferi
GKKPEEAKNPI

SEQ ID NO: 181542 - protein, 11 aa, Borrelia burgdorferi
KKPEEAKNPIA

SEQ ID NO: 181543 - protein, 11 aa, Borrelia burgdorferi
KPEEAKNPIAA

SEQ ID NO: 181544 - protein, 11 aa, Borrelia burgdorferi
PEEAKNPIAAA

SEQ ID NO: 181545 - protein, 11 aa, Borrelia burgdorferi
EEAKNPIAAAI

SEQ ID NO: 181546 - protein, 11 aa, Borrelia burgdorferi
EAKNPIAAAIG

SEQ ID NO: 181547 - protein, 11 aa, Borrelia burgdorferi
AKNPIAAAIGK

SEQ ID NO: 181548 - protein, 11 aa, Borrelia burgdorferi
KNPIAAAIGKG

SEQ ID NO: 181549 - protein, 11 aa, Borrelia burgdorferi
NPIAAAIGKGN

SEQ ID NO: 181550 - protein, 11 aa, Borrelia burgdorferi
PIAAAIGKGNA

SEQ ID NO: 181551 - protein, 11 aa, Borrelia burgdorferi
IAAAIGKGNAD

SEQ ID NO: 181552 - protein, 11 aa, Borrelia burgdorferi
AAAIGKGNADD

SEQ ID NO: 181553 - protein, 11 aa, Borrelia burgdorferi
AAIGKGNADDG

SEQ ID NO: 181554 - protein, 11 aa, Borrelia burgdorferi
AIGKGNADDGA

SEQ ID NO: 181555 - protein, 11 aa, Borrelia burgdorferi
IGKGNADDGAE

SEQ ID NO: 181556 - protein, 11 aa, Borrelia burgdorferi
GKGNADDGAEF

SEQ ID NO: 181557 - protein, 11 aa, Borrelia burgdorferi
KGNADDGAEFG

SEQ ID NO: 181558 - protein, 11 aa, Borrelia burgdorferi
GNADDGAEFGQ

SEQ ID NO: 181559 - protein, 11 aa, Borrelia burgdorferi
NADDGAEFGQE

SEQ ID NO: 181560 - protein, 11 aa, Borrelia burgdorferi
ADDGAEFGQEG

SEQ ID NO: 181561 - protein, 11 aa, Borrelia burgdorferi
DDGAEFGQEGM

SEQ ID NO: 181562 - protein, 11 aa, Borrelia burgdorferi
DGAEFGQEGMK

SEQ ID NO: 181563 - protein, 11 aa, Borrelia burgdorferi
GAEFGQEGMKK

SEQ ID NO: 181564 - protein, 11 aa, Borrelia burgdorferi
AEFGQEGMKKD

SEQ ID NO: 181565 - protein, 11 aa, Borrelia burgdorferi
EFGQEGMKKDD

SEQ ID NO: 181566 - protein, 11 aa, Borrelia burgdorferi
FGQEGMKKDDQ

SEQ ID NO: 181567 - protein, 11 aa, Borrelia burgdorferi
GQEGMKKDDQI

SEQ ID NO: 181568 - protein, 11 aa, Borrelia burgdorferi
QEGMKKDDQIA

SEQ ID NO: 181569 - protein, 11 aa, Borrelia burgdorferi
EGMKKDDQIAA

SEQ ID NO: 181570 - protein, 11 aa, Borrelia burgdorferi
GMKKDDQIAAA

SEQ ID NO: 181571 - protein, 11 aa, Borrelia burgdorferi
MKKDDQIAAAI

SEQ ID NO: 181572 - protein, 11 aa, Borrelia burgdorferi
KKDDQIAAAIA

SEQ ID NO: 181573 - protein, 11 aa, Borrelia burgdorferi
KDDQIAAAIAL

SEQ ID NO: 181574 - protein, 11 aa, Borrelia burgdorferi
DDQIAAAIALR

SEQ ID NO: 181575 - protein, 11 aa, Borrelia burgdorferi
DQIAAAIALRG

SEQ ID NO: 181576 - protein, 11 aa, Borrelia burgdorferi
QIAAAIALRGM

SEQ ID NO: 181577 - protein, 11 aa, Borrelia burgdorferi
IAAAIALRGMA

SEQ ID NO: 181578 - protein, 11 aa, Borrelia burgdorferi
AAAIALRGMAK

SEQ ID NO: 181579 - protein, 11 aa, Borrelia burgdorferi
AAIALRGMAKD

SEQ ID NO: 181580 - protein, 11 aa, Borrelia burgdorferi
AIALRGMAKDG

SEQ ID NO: 181581 - protein, 11 aa, Borrelia burgdorferi
IALRGMAKDGK

SEQ ID NO: 181582 - protein, 11 aa, Borrelia burgdorferi
ALRGMAKDGKF

SEQ ID NO: 181583 - protein, 11 aa, Borrelia burgdorferi
LRGMAKDGKFA

SEQ ID NO: 181584 - protein, 11 aa, Borrelia burgdorferi
RGMAKDGKFAV

SEQ ID NO: 181585 - protein, 11 aa, Borrelia burgdorferi
GMAKDGKFAVK

SEQ ID NO: 181586 - protein, 11 aa, Borrelia burgdorferi
MAKDGKFAVKS

SEQ ID NO: 181587 - protein, 11 aa, Borrelia burgdorferi
AKDGKFAVKSG

SEQ ID NO: 181588 - protein, 11 aa, Borrelia burgdorferi
KDGKFAVKSGE

SEQ ID NO: 181589 - protein, 11 aa, Borrelia burgdorferi
DGKFAVKSGEK

SEQ ID NO: 181590 - protein, 11 aa, Borrelia burgdorferi
GKFAVKSGEKE

SEQ ID NO: 181591 - protein, 11 aa, Borrelia burgdorferi
KFAVKSGEKEK

SEQ ID NO: 181592 - protein, 11 aa, Borrelia burgdorferi
FAVKSGEKEKA

SEQ ID NO: 181593 - protein, 13 aa, Borrelia burgdorferi
EGAIKEVSELLDK

SEQ ID NO: 181594 - protein, 13 aa, Borrelia burgdorferi
GAIKEVSELLDKL

SEQ ID NO: 181595 - protein, 13 aa, Borrelia burgdorferi
AIKEVSELLDKLV

SEQ ID NO: 181596 - protein, 13 aa, Borrelia burgdorferi
IKEVSELLDKLVK

SEQ ID NO: 181597 - protein, 13 aa, Borrelia burgdorferi
KEVSELLDKLVKA

SEQ ID NO: 181598 - protein, 13 aa, Borrelia burgdorferi
EVSELLDKLVKAV

SEQ ID NO: 181599 - protein, 13 aa, Borrelia burgdorferi
VSELLDKLVKAVK

SEQ ID NO: 181600 - protein, 13 aa, Borrelia burgdorferi
SELLDKLVKAVKT

SEQ ID NO: 181601 - protein, 13 aa, Borrelia burgdorferi
ELLDKLVKAVKTA

SEQ ID NO: 181602 - protein, 13 aa, Borrelia burgdorferi
LLDKLVKAVKTAE

SEQ ID NO: 181603 - protein, 13 aa, Borrelia burgdorferi
LDKLVKAVKTAEG

SEQ ID NO: 181604 - protein, 13 aa, Borrelia burgdorferi
DKLVKAVKTAEGA

SEQ ID NO: 181605 - protein, 13 aa, Borrelia burgdorferi
KLVKAVKTAEGAS

SEQ ID NO: 181606 - protein, 13 aa, Borrelia burgdorferi
LVKAVKTAEGASS

SEQ ID NO: 181607 - protein, 13 aa, Borrelia burgdorferi
VKAVKTAEGASSG

SEQ ID NO: 181608 - protein, 13 aa, Borrelia burgdorferi
KAVKTAEGASSGT

SEQ ID NO: 181609 - protein, 13 aa, Borrelia burgdorferi
AVKTAEGASSGTD

SEQ ID NO: 181610 - protein, 13 aa, Borrelia burgdorferi
VKTAEGASSGTDA

SEQ ID NO: 181611 - protein, 13 aa, Borrelia burgdorferi
KTAEGASSGTDAI

SEQ ID NO: 181612 - protein, 13 aa, Borrelia burgdorferi
TAEGASSGTDAIG

SEQ ID NO: 181613 - protein, 13 aa, Borrelia burgdorferi
AEGASSGTDAIGE

SEQ ID NO: 181614 - protein, 13 aa, Borrelia burgdorferi
EGASSGTDAIGEV

SEQ ID NO: 181615 - protein, 13 aa, Borrelia burgdorferi
GASSGTDAIGEVV

SEQ ID NO: 181616 - protein, 13 aa, Borrelia burgdorferi
ASSGTDAIGEVVA

SEQ ID NO: 181617 - protein, 13 aa, Borrelia burgdorferi
SSGTDAIGEVVAN

SEQ ID NO: 181618 - protein, 13 aa, Borrelia burgdorferi
SGTDAIGEVVANA

SEQ ID NO: 181619 - protein, 13 aa, Borrelia burgdorferi
GTDAIGEVVANAG

SEQ ID NO: 181620 - protein, 13 aa, Borrelia burgdorferi
TDAIGEVVANAGA

SEQ ID NO: 181621 - protein, 13 aa, Borrelia burgdorferi
DAIGEVVANAGAA

SEQ ID NO: 181622 - protein, 13 aa, Borrelia burgdorferi
AIGEVVANAGAAK

SEQ ID NO: 181623 - protein, 13 aa, Borrelia burgdorferi
IGEVVANAGAAKV

SEQ ID NO: 181624 - protein, 13 aa, Borrelia burgdorferi
GEVVANAGAAKVA

SEQ ID NO: 181625 - protein, 13 aa, Borrelia burgdorferi
EVVANAGAAKVAD

SEQ ID NO: 181626 - protein, 13 aa, Borrelia burgdorferi
VVANAGAAKVADK

SEQ ID NO: 181627 - protein, 13 aa, Borrelia burgdorferi
VANAGAAKVADKA

SEQ ID NO: 181628 - protein, 13 aa, Borrelia burgdorferi
ANAGAAKVADKAS

SEQ ID NO: 181629 - protein, 13 aa, Borrelia burgdorferi
NAGAAKVADKASV

SEQ ID NO: 181630 - protein, 13 aa, Borrelia burgdorferi
AGAAKVADKASVT

SEQ ID NO: 181631 - protein, 13 aa, Borrelia burgdorferi
GAAKVADKASVTG

SEQ ID NO: 181632 - protein, 13 aa, Borrelia burgdorferi
AAKVADKASVTGI

SEQ ID NO: 181633 - protein, 13 aa, Borrelia burgdorferi
AKVADKASVTGIA

SEQ ID NO: 181634 - protein, 13 aa, Borrelia burgdorferi
KVADKASVTGIAK

SEQ ID NO: 181635 - protein, 13 aa, Borrelia burgdorferi
VADKASVTGIAKG

SEQ ID NO: 181636 - protein, 13 aa, Borrelia burgdorferi
ADKASVTGIAKGI

SEQ ID NO: 181637 - protein, 13 aa, Borrelia burgdorferi
DKASVTGIAKGIK

SEQ ID NO: 181638 - protein, 13 aa, Borrelia burgdorferi
KASVTGIAKGIKE

SEQ ID NO: 181639 - protein, 13 aa, Borrelia burgdorferi
ASVTGIAKGIKEI

SEQ ID NO: 181640 - protein, 13 aa, Borrelia burgdorferi
SVTGIAKGIKEIV

SEQ ID NO: 181641 - protein, 13 aa, Borrelia burgdorferi
VTGIAKGIKEIVE

SEQ ID NO: 181642 - protein, 13 aa, Borrelia burgdorferi
TGIAKGIKEIVEA

SEQ ID NO: 181643 - protein, 13 aa, Borrelia burgdorferi
GIAKGIKEIVEAA

SEQ ID NO: 181644 - protein, 13 aa, Borrelia burgdorferi
IAKGIKEIVEAAG

SEQ ID NO: 181645 - protein, 13 aa, Borrelia burgdorferi
AKGIKEIVEAAGG

SEQ ID NO: 181646 - protein, 13 aa, Borrelia burgdorferi
KGIKEIVEAAGGS

SEQ ID NO: 181647 - protein, 13 aa, Borrelia burgdorferi
GIKEIVEAAGGSE

SEQ ID NO: 181648 - protein, 13 aa, Borrelia burgdorferi
IKEIVEAAGGSEK

SEQ ID NO: 181649 - protein, 13 aa, Borrelia burgdorferi
KEIVEAAGGSEKL

SEQ ID NO: 181650 - protein, 13 aa, Borrelia burgdorferi
EIVEAAGGSEKLK

SEQ ID NO: 181651 - protein, 13 aa, Borrelia burgdorferi
IVEAAGGSEKLKV

SEQ ID NO: 181652 - protein, 13 aa, Borrelia burgdorferi
VEAAGGSEKLKVA

SEQ ID NO: 181653 - protein, 13 aa, Borrelia burgdorferi
EAAGGSEKLKVAA

SEQ ID NO: 181654 - protein, 13 aa, Borrelia burgdorferi
AAGGSEKLKVAAA

SEQ ID NO: 181655 - protein, 13 aa, Borrelia burgdorferi
AGGSEKLKVAAAT

SEQ ID NO: 181656 - protein, 13 aa, Borrelia burgdorferi
GGSEKLKVAAATG

SEQ ID NO: 181657 - protein, 13 aa, Borrelia burgdorferi
GSEKLKVAAATGE

SEQ ID NO: 181658 - protein, 13 aa, Borrelia burgdorferi
SEKLKVAAATGES

SEQ ID NO: 181659 - protein, 13 aa, Borrelia burgdorferi
EKLKVAAATGESN

SEQ ID NO: 181660 - protein, 13 aa, Borrelia burgdorferi
KLKVAAATGESNK

SEQ ID NO: 181661 - protein, 13 aa, Borrelia burgdorferi
LKVAAATGESNKG

SEQ ID NO: 181662 - protein, 13 aa, Borrelia burgdorferi
KVAAATGESNKGA

SEQ ID NO: 181663 - protein, 13 aa, Borrelia burgdorferi
VAAATGESNKGAG

SEQ ID NO: 181664 - protein, 13 aa, Borrelia burgdorferi
AAATGESNKGAGK

SEQ ID NO: 181665 - protein, 13 aa, Borrelia burgdorferi
AATGESNKGAGKL

SEQ ID NO: 181666 - protein, 13 aa, Borrelia burgdorferi
ATGESNKGAGKLF

SEQ ID NO: 181667 - protein, 13 aa, Borrelia burgdorferi
TGESNKGAGKLFG

SEQ ID NO: 181668 - protein, 13 aa, Borrelia burgdorferi
GESNKGAGKLFGK

SEQ ID NO: 181669 - protein, 13 aa, Borrelia burgdorferi
ESNKGAGKLFGKA

SEQ ID NO: 181670 - protein, 13 aa, Borrelia burgdorferi
SNKGAGKLFGKAG

SEQ ID NO: 181671 - protein, 13 aa, Borrelia burgdorferi
NKGAGKLFGKAGA

SEQ ID NO: 181672 - protein, 13 aa, Borrelia burgdorferi
KGAGKLFGKAGAG

SEQ ID NO: 181673 - protein, 13 aa, Borrelia burgdorferi
GAGKLFGKAGAGA

SEQ ID NO: 181674 - protein, 13 aa, Borrelia burgdorferi
AGKLFGKAGAGAN

SEQ ID NO: 181675 - protein, 13 aa, Borrelia burgdorferi
GKLFGKAGAGANA

SEQ ID NO: 181676 - protein, 13 aa, Borrelia burgdorferi
KLFGKAGAGANAG

SEQ ID NO: 181677 - protein, 13 aa, Borrelia burgdorferi
LFGKAGAGANAGD

SEQ ID NO: 181678 - protein, 13 aa, Borrelia burgdorferi
FGKAGAGANAGDS

SEQ ID NO: 181679 - protein, 13 aa, Borrelia burgdorferi
GKAGAGANAGDSE

SEQ ID NO: 181680 - protein, 13 aa, Borrelia burgdorferi
KAGAGANAGDSEA

SEQ ID NO: 181681 - protein, 13 aa, Borrelia burgdorferi
AGAGANAGDSEAA

SEQ ID NO: 181682 - protein, 13 aa, Borrelia burgdorferi
GAGANAGDSEAAS

SEQ ID NO: 181683 - protein, 13 aa, Borrelia burgdorferi
AGANAGDSEAASK

SEQ ID NO: 181684 - protein, 13 aa, Borrelia burgdorferi
GANAGDSEAASKA

SEQ ID NO: 181685 - protein, 13 aa, Borrelia burgdorferi
ANAGDSEAASKAA

SEQ ID NO: 181686 - protein, 13 aa, Borrelia burgdorferi
NAGDSEAASKAAG

SEQ ID NO: 181687 - protein, 13 aa, Borrelia burgdorferi
AGDSEAASKAAGA

SEQ ID NO: 181688 - protein, 13 aa, Borrelia burgdorferi
GDSEAASKAAGAV

SEQ ID NO: 181689 - protein, 13 aa, Borrelia burgdorferi
DSEAASKAAGAVS

SEQ ID NO: 181690 - protein, 13 aa, Borrelia burgdorferi
SEAASKAAGAVSA

SEQ ID NO: 181691 - protein, 13 aa, Borrelia burgdorferi
EAASKAAGAVSAV

SEQ ID NO: 181692 - protein, 13 aa, Borrelia burgdorferi
AASKAAGAVSAVS

SEQ ID NO: 181693 - protein, 13 aa, Borrelia burgdorferi
ASKAAGAVSAVSG

SEQ ID NO: 181694 - protein, 13 aa, Borrelia burgdorferi
SKAAGAVSAVSGE

SEQ ID NO: 181695 - protein, 13 aa, Borrelia burgdorferi
KAAGAVSAVSGEQ

SEQ ID NO: 181696 - protein, 13 aa, Borrelia burgdorferi
AAGAVSAVSGEQI

SEQ ID NO: 181697 - protein, 13 aa, Borrelia burgdorferi
AGAVSAVSGEQIL

SEQ ID NO: 181698 - protein, 13 aa, Borrelia burgdorferi
GAVSAVSGEQILS

SEQ ID NO: 181699 - protein, 13 aa, Borrelia burgdorferi
AVSAVSGEQILSA

SEQ ID NO: 181700 - protein, 13 aa, Borrelia burgdorferi
VSAVSGEQILSAI

SEQ ID NO: 181701 - protein, 13 aa, Borrelia burgdorferi
SAVSGEQILSAIV

SEQ ID NO: 181702 - protein, 13 aa, Borrelia burgdorferi
AVSGEQILSAIVT

SEQ ID NO: 181703 - protein, 13 aa, Borrelia burgdorferi
VSGEQILSAIVTA

SEQ ID NO: 181704 - protein, 13 aa, Borrelia burgdorferi
SGEQILSAIVTAA

SEQ ID NO: 181705 - protein, 13 aa, Borrelia burgdorferi
GEQILSAIVTAAD

SEQ ID NO: 181706 - protein, 13 aa, Borrelia burgdorferi
EQILSAIVTAADA

SEQ ID NO: 181707 - protein, 13 aa, Borrelia burgdorferi
QILSAIVTAADAA

SEQ ID NO: 181708 - protein, 13 aa, Borrelia burgdorferi
ILSAIVTAADAAE

SEQ ID NO: 181709 - protein, 13 aa, Borrelia burgdorferi
LSAIVTAADAAEQ

SEQ ID NO: 181710 - protein, 13 aa, Borrelia burgdorferi
SAIVTAADAAEQE

SEQ ID NO: 181711 - protein, 13 aa, Borrelia burgdorferi
AIVTAADAAEQEG

SEQ ID NO: 181712 - protein, 13 aa, Borrelia burgdorferi
IVTAADAAEQEGK

SEQ ID NO: 181713 - protein, 13 aa, Borrelia burgdorferi
VTAADAAEQEGKK

SEQ ID NO: 181714 - protein, 13 aa, Borrelia burgdorferi
TAADAAEQEGKKP

SEQ ID NO: 181715 - protein, 13 aa, Borrelia burgdorferi
AADAAEQEGKKPE

SEQ ID NO: 181716 - protein, 13 aa, Borrelia burgdorferi
ADAAEQEGKKPEE

SEQ ID NO: 181717 - protein, 13 aa, Borrelia burgdorferi
DAAEQEGKKPEEA

SEQ ID NO: 181718 - protein, 13 aa, Borrelia burgdorferi
AAEQEGKKPEEAK

SEQ ID NO: 181719 - protein, 13 aa, Borrelia burgdorferi
AEQEGKKPEEAKN

SEQ ID NO: 181720 - protein, 13 aa, Borrelia burgdorferi
EQEGKKPEEAKNP

SEQ ID NO: 181721 - protein, 13 aa, Borrelia burgdorferi
QEGKKPEEAKNPI

SEQ ID NO: 181722 - protein, 13 aa, Borrelia burgdorferi
EGKKPEEAKNPIA

SEQ ID NO: 181723 - protein, 13 aa, Borrelia burgdorferi
GKKPEEAKNPIAA

SEQ ID NO: 181724 - protein, 13 aa, Borrelia burgdorferi
KKPEEAKNPIAAA

SEQ ID NO: 181725 - protein, 13 aa, Borrelia burgdorferi
KPEEAKNPIAAAI

SEQ ID NO: 181726 - protein, 13 aa, Borrelia burgdorferi
PEEAKNPIAAAIG

SEQ ID NO: 181727 - protein, 13 aa, Borrelia burgdorferi
EEAKNPIAAAIGK

SEQ ID NO: 181728 - protein, 13 aa, Borrelia burgdorferi
EAKNPIAAAIGKG

SEQ ID NO: 181729 - protein, 13 aa, Borrelia burgdorferi
AKNPIAAAIGKGN

SEQ ID NO: 181730 - protein, 13 aa, Borrelia burgdorferi
KNPIAAAIGKGNA

SEQ ID NO: 181731 - protein, 13 aa, Borrelia burgdorferi
NPIAAAIGKGNAD

SEQ ID NO: 181732 - protein, 13 aa, Borrelia burgdorferi
PIAAAIGKGNADD

SEQ ID NO: 181733 - protein, 13 aa, Borrelia burgdorferi
IAAAIGKGNADDG

SEQ ID NO: 181734 - protein, 13 aa, Borrelia burgdorferi
AAAIGKGNADDGA

SEQ ID NO: 181735 - protein, 13 aa, Borrelia burgdorferi
AAIGKGNADDGAE

SEQ ID NO: 181736 - protein, 13 aa, Borrelia burgdorferi
AIGKGNADDGAEF

SEQ ID NO: 181737 - protein, 13 aa, Borrelia burgdorferi
IGKGNADDGAEFG

SEQ ID NO: 181738 - protein, 13 aa, Borrelia burgdorferi
GKGNADDGAEFGQ

SEQ ID NO: 181739 - protein, 13 aa, Borrelia burgdorferi
KGNADDGAEFGQE

SEQ ID NO: 181740 - protein, 13 aa, Borrelia burgdorferi
GNADDGAEFGQEG

SEQ ID NO: 181741 - protein, 13 aa, Borrelia burgdorferi
NADDGAEFGQEGM

SEQ ID NO: 181742 - protein, 13 aa, Borrelia burgdorferi
ADDGAEFGQEGMK

SEQ ID NO: 181743 - protein, 13 aa, Borrelia burgdorferi
DDGAEFGQEGMKK

SEQ ID NO: 181744 - protein, 13 aa, Borrelia burgdorferi
DGAEFGQEGMKKD

SEQ ID NO: 181745 - protein, 13 aa, Borrelia burgdorferi
GAEFGQEGMKKDD

SEQ ID NO: 181746 - protein, 13 aa, Borrelia burgdorferi
AEFGQEGMKKDDQ

SEQ ID NO: 181747 - protein, 13 aa, Borrelia burgdorferi
EFGQEGMKKDDQI

SEQ ID NO: 181748 - protein, 13 aa, Borrelia burgdorferi
FGQEGMKKDDQIA

SEQ ID NO: 181749 - protein, 13 aa, Borrelia burgdorferi
GQEGMKKDDQIAA

SEQ ID NO: 181750 - protein, 13 aa, Borrelia burgdorferi
QEGMKKDDQIAAA

SEQ ID NO: 181751 - protein, 13 aa, Borrelia burgdorferi
EGMKKDDQIAAAI

SEQ ID NO: 181752 - protein, 13 aa, Borrelia burgdorferi
GMKKDDQIAAAIA

SEQ ID NO: 181753 - protein, 13 aa, Borrelia burgdorferi
MKKDDQIAAAIAL

SEQ ID NO: 181754 - protein, 13 aa, Borrelia burgdorferi
KKDDQIAAAIALR

SEQ ID NO: 181755 - protein, 13 aa, Borrelia burgdorferi
KDDQIAAAIALRG

SEQ ID NO: 181756 - protein, 13 aa, Borrelia burgdorferi
DDQIAAAIALRGM

SEQ ID NO: 181757 - protein, 13 aa, Borrelia burgdorferi
DQIAAAIALRGMA

SEQ ID NO: 181758 - protein, 13 aa, Borrelia burgdorferi
QIAAAIALRGMAK

SEQ ID NO: 181759 - protein, 13 aa, Borrelia burgdorferi
IAAAIALRGMAKD

SEQ ID NO: 181760 - protein, 13 aa, Borrelia burgdorferi
AAAIALRGMAKDG

SEQ ID NO: 181761 - protein, 13 aa, Borrelia burgdorferi
AAIALRGMAKDGK

SEQ ID NO: 181762 - protein, 13 aa, Borrelia burgdorferi
AIALRGMAKDGKF

SEQ ID NO: 181763 - protein, 13 aa, Borrelia burgdorferi
IALRGMAKDGKFA

SEQ ID NO: 181764 - protein, 13 aa, Borrelia burgdorferi
ALRGMAKDGKFAV

SEQ ID NO: 181765 - protein, 13 aa, Borrelia burgdorferi
LRGMAKDGKFAVK

SEQ ID NO: 181766 - protein, 13 aa, Borrelia burgdorferi
RGMAKDGKFAVKS

SEQ ID NO: 181767 - protein, 13 aa, Borrelia burgdorferi
GMAKDGKFAVKSG

SEQ ID NO: 181768 - protein, 13 aa, Borrelia burgdorferi
MAKDGKFAVKSGE

SEQ ID NO: 181769 - protein, 13 aa, Borrelia burgdorferi
AKDGKFAVKSGEK

SEQ ID NO: 181770 - protein, 13 aa, Borrelia burgdorferi
KDGKFAVKSGEKE

SEQ ID NO: 181771 - protein, 13 aa, Borrelia burgdorferi
DGKFAVKSGEKEK

SEQ ID NO: 181772 - protein, 13 aa, Borrelia burgdorferi
GKFAVKSGEKEKA

SEQ ID NO: 181773 - protein, 14 aa, Borrelia burgdorferi
EGAIKEVSELLDKL

SEQ ID NO: 181774 - protein, 14 aa, Borrelia burgdorferi
GAIKEVSELLDKLV

SEQ ID NO: 181775 - protein, 14 aa, Borrelia burgdorferi
AIKEVSELLDKLVK

SEQ ID NO: 181776 - protein, 14 aa, Borrelia burgdorferi
IKEVSELLDKLVKA

SEQ ID NO: 181777 - protein, 14 aa, Borrelia burgdorferi
KEVSELLDKLVKAV

SEQ ID NO: 181778 - protein, 14 aa, Borrelia burgdorferi
EVSELLDKLVKAVK

SEQ ID NO: 181779 - protein, 14 aa, Borrelia burgdorferi
VSELLDKLVKAVKT

SEQ ID NO: 181780 - protein, 14 aa, Borrelia burgdorferi
SELLDKLVKAVKTA

SEQ ID NO: 181781 - protein, 14 aa, Borrelia burgdorferi
ELLDKLVKAVKTAE

SEQ ID NO: 181782 - protein, 14 aa, Borrelia burgdorferi
LLDKLVKAVKTAEG

SEQ ID NO: 181783 - protein, 14 aa, Borrelia burgdorferi
LDKLVKAVKTAEGA

SEQ ID NO: 181784 - protein, 14 aa, Borrelia burgdorferi
DKLVKAVKTAEGAS

SEQ ID NO: 181785 - protein, 14 aa, Borrelia burgdorferi
KLVKAVKTAEGASS

SEQ ID NO: 181786 - protein, 14 aa, Borrelia burgdorferi
LVKAVKTAEGASSG

SEQ ID NO: 181787 - protein, 14 aa, Borrelia burgdorferi
VKAVKTAEGASSGT

SEQ ID NO: 181788 - protein, 14 aa, Borrelia burgdorferi
KAVKTAEGASSGTD

SEQ ID NO: 181789 - protein, 14 aa, Borrelia burgdorferi
AVKTAEGASSGTDA

SEQ ID NO: 181790 - protein, 14 aa, Borrelia burgdorferi
VKTAEGASSGTDAI

SEQ ID NO: 181791 - protein, 14 aa, Borrelia burgdorferi
KTAEGASSGTDAIG

SEQ ID NO: 181792 - protein, 14 aa, Borrelia burgdorferi
TAEGASSGTDAIGE

SEQ ID NO: 181793 - protein, 14 aa, Borrelia burgdorferi
AEGASSGTDAIGEV

SEQ ID NO: 181794 - protein, 14 aa, Borrelia burgdorferi
EGASSGTDAIGEVV

SEQ ID NO: 181795 - protein, 14 aa, Borrelia burgdorferi
GASSGTDAIGEVVA

SEQ ID NO: 181796 - protein, 14 aa, Borrelia burgdorferi
ASSGTDAIGEVVAN

SEQ ID NO: 181797 - protein, 14 aa, Borrelia burgdorferi
SSGTDAIGEVVANA

SEQ ID NO: 181798 - protein, 14 aa, Borrelia burgdorferi
SGTDAIGEVVANAG

SEQ ID NO: 181799 - protein, 14 aa, Borrelia burgdorferi
GTDAIGEVVANAGA

SEQ ID NO: 181800 - protein, 14 aa, Borrelia burgdorferi
TDAIGEVVANAGAA

SEQ ID NO: 181801 - protein, 14 aa, Borrelia burgdorferi
DAIGEVVANAGAAK

SEQ ID NO: 181802 - protein, 14 aa, Borrelia burgdorferi
AIGEVVANAGAAKV

SEQ ID NO: 181803 - protein, 14 aa, Borrelia burgdorferi
IGEVVANAGAAKVA

SEQ ID NO: 181804 - protein, 14 aa, Borrelia burgdorferi
GEVVANAGAAKVAD

SEQ ID NO: 181805 - protein, 14 aa, Borrelia burgdorferi
EVVANAGAAKVADK

SEQ ID NO: 181806 - protein, 14 aa, Borrelia burgdorferi
VVANAGAAKVADKA

SEQ ID NO: 181807 - protein, 14 aa, Borrelia burgdorferi
VANAGAAKVADKAS

SEQ ID NO: 181808 - protein, 14 aa, Borrelia burgdorferi
ANAGAAKVADKASV

SEQ ID NO: 181809 - protein, 14 aa, Borrelia burgdorferi
NAGAAKVADKASVT

SEQ ID NO: 181810 - protein, 14 aa, Borrelia burgdorferi
AGAAKVADKASVTG

SEQ ID NO: 181811 - protein, 14 aa, Borrelia burgdorferi
GAAKVADKASVTGI

SEQ ID NO: 181812 - protein, 14 aa, Borrelia burgdorferi
AAKVADKASVTGIA

SEQ ID NO: 181813 - protein, 14 aa, Borrelia burgdorferi
AKVADKASVTGIAK

SEQ ID NO: 181814 - protein, 14 aa, Borrelia burgdorferi
KVADKASVTGIAKG

SEQ ID NO: 181815 - protein, 14 aa, Borrelia burgdorferi
VADKASVTGIAKGI

SEQ ID NO: 181816 - protein, 14 aa, Borrelia burgdorferi
ADKASVTGIAKGIK

SEQ ID NO: 181817 - protein, 14 aa, Borrelia burgdorferi
DKASVTGIAKGIKE

SEQ ID NO: 181818 - protein, 14 aa, Borrelia burgdorferi
KASVTGIAKGIKEI

SEQ ID NO: 181819 - protein, 14 aa, Borrelia burgdorferi
ASVTGIAKGIKEIV

SEQ ID NO: 181820 - protein, 14 aa, Borrelia burgdorferi
SVTGIAKGIKEIVE

SEQ ID NO: 181821 - protein, 14 aa, Borrelia burgdorferi
VTGIAKGIKEIVEA

SEQ ID NO: 181822 - protein, 14 aa, Borrelia burgdorferi
TGIAKGIKEIVEAA

SEQ ID NO: 181823 - protein, 14 aa, Borrelia burgdorferi
GIAKGIKEIVEAAG

SEQ ID NO: 181824 - protein, 14 aa, Borrelia burgdorferi
IAKGIKEIVEAAGG

SEQ ID NO: 181825 - protein, 14 aa, Borrelia burgdorferi
AKGIKEIVEAAGGS

SEQ ID NO: 181826 - protein, 14 aa, Borrelia burgdorferi
KGIKEIVEAAGGSE

SEQ ID NO: 181827 - protein, 14 aa, Borrelia burgdorferi
GIKEIVEAAGGSEK

SEQ ID NO: 181828 - protein, 14 aa, Borrelia burgdorferi
IKEIVEAAGGSEKL

SEQ ID NO: 181829 - protein, 14 aa, Borrelia burgdorferi
KEIVEAAGGSEKLK

SEQ ID NO: 181830 - protein, 14 aa, Borrelia burgdorferi
EIVEAAGGSEKLKV

SEQ ID NO: 181831 - protein, 14 aa, Borrelia burgdorferi
IVEAAGGSEKLKVA

SEQ ID NO: 181832 - protein, 14 aa, Borrelia burgdorferi
VEAAGGSEKLKVAA

SEQ ID NO: 181833 - protein, 14 aa, Borrelia burgdorferi
EAAGGSEKLKVAAA

SEQ ID NO: 181834 - protein, 14 aa, Borrelia burgdorferi
AAGGSEKLKVAAAT

SEQ ID NO: 181835 - protein, 14 aa, Borrelia burgdorferi
AGGSEKLKVAAATG

SEQ ID NO: 181836 - protein, 14 aa, Borrelia burgdorferi
GGSEKLKVAAATGE

SEQ ID NO: 181837 - protein, 14 aa, Borrelia burgdorferi
GSEKLKVAAATGES

SEQ ID NO: 181838 - protein, 14 aa, Borrelia burgdorferi
SEKLKVAAATGESN

SEQ ID NO: 181839 - protein, 14 aa, Borrelia burgdorferi
EKLKVAAATGESNK

SEQ ID NO: 181840 - protein, 14 aa, Borrelia burgdorferi
KLKVAAATGESNKG

SEQ ID NO: 181841 - protein, 14 aa, Borrelia burgdorferi
LKVAAATGESNKGA

SEQ ID NO: 181842 - protein, 14 aa, Borrelia burgdorferi
KVAAATGESNKGAG

SEQ ID NO: 181843 - protein, 14 aa, Borrelia burgdorferi
VAAATGESNKGAGK

SEQ ID NO: 181844 - protein, 14 aa, Borrelia burgdorferi
AAATGESNKGAGKL

SEQ ID NO: 181845 - protein, 14 aa, Borrelia burgdorferi
AATGESNKGAGKLF

SEQ ID NO: 181846 - protein, 14 aa, Borrelia burgdorferi
ATGESNKGAGKLFG

SEQ ID NO: 181847 - protein, 14 aa, Borrelia burgdorferi
TGESNKGAGKLFGK

SEQ ID NO: 181848 - protein, 14 aa, Borrelia burgdorferi
GESNKGAGKLFGKA

SEQ ID NO: 181849 - protein, 14 aa, Borrelia burgdorferi
ESNKGAGKLFGKAG

SEQ ID NO: 181850 - protein, 14 aa, Borrelia burgdorferi
SNKGAGKLFGKAGA

SEQ ID NO: 181851 - protein, 14 aa, Borrelia burgdorferi
NKGAGKLFGKAGAG

SEQ ID NO: 181852 - protein, 14 aa, Borrelia burgdorferi
KGAGKLFGKAGAGA

SEQ ID NO: 181853 - protein, 14 aa, Borrelia burgdorferi
GAGKLFGKAGAGAN

SEQ ID NO: 181854 - protein, 14 aa, Borrelia burgdorferi
AGKLFGKAGAGANA

SEQ ID NO: 181855 - protein, 14 aa, Borrelia burgdorferi
GKLFGKAGAGANAG

SEQ ID NO: 181856 - protein, 14 aa, Borrelia burgdorferi
KLFGKAGAGANAGD

SEQ ID NO: 181857 - protein, 14 aa, Borrelia burgdorferi
LFGKAGAGANAGDS

SEQ ID NO: 181858 - protein, 14 aa, Borrelia burgdorferi
FGKAGAGANAGDSE

SEQ ID NO: 181859 - protein, 14 aa, Borrelia burgdorferi
GKAGAGANAGDSEA

SEQ ID NO: 181860 - protein, 14 aa, Borrelia burgdorferi
KAGAGANAGDSEAA

SEQ ID NO: 181861 - protein, 14 aa, Borrelia burgdorferi
AGAGANAGDSEAAS

SEQ ID NO: 181862 - protein, 14 aa, Borrelia burgdorferi
GAGANAGDSEAASK

SEQ ID NO: 181863 - protein, 14 aa, Borrelia burgdorferi
AGANAGDSEAASKA

SEQ ID NO: 181864 - protein, 14 aa, Borrelia burgdorferi
GANAGDSEAASKAA

SEQ ID NO: 181865 - protein, 14 aa, Borrelia burgdorferi
ANAGDSEAASKAAG

SEQ ID NO: 181866 - protein, 14 aa, Borrelia burgdorferi
NAGDSEAASKAAGA

SEQ ID NO: 181867 - protein, 14 aa, Borrelia burgdorferi
AGDSEAASKAAGAV

SEQ ID NO: 181868 - protein, 14 aa, Borrelia burgdorferi
GDSEAASKAAGAVS

SEQ ID NO: 181869 - protein, 14 aa, Borrelia burgdorferi
DSEAASKAAGAVSA

SEQ ID NO: 181870 - protein, 14 aa, Borrelia burgdorferi
SEAASKAAGAVSAV

SEQ ID NO: 181871 - protein, 14 aa, Borrelia burgdorferi
EAASKAAGAVSAVS

SEQ ID NO: 181872 - protein, 14 aa, Borrelia burgdorferi
AASKAAGAVSAVSG

SEQ ID NO: 181873 - protein, 14 aa, Borrelia burgdorferi
ASKAAGAVSAVSGE

SEQ ID NO: 181874 - protein, 14 aa, Borrelia burgdorferi
SKAAGAVSAVSGEQ

SEQ ID NO: 181875 - protein, 14 aa, Borrelia burgdorferi
KAAGAVSAVSGEQI

SEQ ID NO: 181876 - protein, 14 aa, Borrelia burgdorferi
AAGAVSAVSGEQIL

SEQ ID NO: 181877 - protein, 14 aa, Borrelia burgdorferi
AGAVSAVSGEQILS

SEQ ID NO: 181878 - protein, 14 aa, Borrelia burgdorferi
GAVSAVSGEQILSA

SEQ ID NO: 181879 - protein, 14 aa, Borrelia burgdorferi
AVSAVSGEQILSAI

SEQ ID NO: 181880 - protein, 14 aa, Borrelia burgdorferi
VSAVSGEQILSAIV

SEQ ID NO: 181881 - protein, 14 aa, Borrelia burgdorferi
SAVSGEQILSAIVT

SEQ ID NO: 181882 - protein, 14 aa, Borrelia burgdorferi
AVSGEQILSAIVTA

SEQ ID NO: 181883 - protein, 14 aa, Borrelia burgdorferi
VSGEQILSAIVTAA

SEQ ID NO: 181884 - protein, 14 aa, Borrelia burgdorferi
SGEQILSAIVTAAD

SEQ ID NO: 181885 - protein, 14 aa, Borrelia burgdorferi
GEQILSAIVTAADA

SEQ ID NO: 181886 - protein, 14 aa, Borrelia burgdorferi
EQILSAIVTAADAA

SEQ ID NO: 181887 - protein, 14 aa, Borrelia burgdorferi
QILSAIVTAADAAE

SEQ ID NO: 181888 - protein, 14 aa, Borrelia burgdorferi
ILSAIVTAADAAEQ

SEQ ID NO: 181889 - protein, 14 aa, Borrelia burgdorferi
LSAIVTAADAAEQE

SEQ ID NO: 181890 - protein, 14 aa, Borrelia burgdorferi
SAIVTAADAAEQEG

SEQ ID NO: 181891 - protein, 14 aa, Borrelia burgdorferi
AIVTAADAAEQEGK

SEQ ID NO: 181892 - protein, 14 aa, Borrelia burgdorferi
IVTAADAAEQEGKK

SEQ ID NO: 181893 - protein, 14 aa, Borrelia burgdorferi
VTAADAAEQEGKKP

SEQ ID NO: 181894 - protein, 14 aa, Borrelia burgdorferi
TAADAAEQEGKKPE

SEQ ID NO: 181895 - protein, 14 aa, Borrelia burgdorferi
AADAAEQEGKKPEE

SEQ ID NO: 181896 - protein, 14 aa, Borrelia burgdorferi
ADAAEQEGKKPEEA

SEQ ID NO: 181897 - protein, 14 aa, Borrelia burgdorferi
DAAEQEGKKPEEAK

SEQ ID NO: 181898 - protein, 14 aa, Borrelia burgdorferi
AAEQEGKKPEEAKN

SEQ ID NO: 181899 - protein, 14 aa, Borrelia burgdorferi
AEQEGKKPEEAKNP

SEQ ID NO: 181900 - protein, 14 aa, Borrelia burgdorferi
EQEGKKPEEAKNPI

SEQ ID NO: 181901 - protein, 14 aa, Borrelia burgdorferi
QEGKKPEEAKNPIA

SEQ ID NO: 181902 - protein, 14 aa, Borrelia burgdorferi
EGKKPEEAKNPIAA

SEQ ID NO: 181903 - protein, 14 aa, Borrelia burgdorferi
GKKPEEAKNPIAAA

SEQ ID NO: 181904 - protein, 14 aa, Borrelia burgdorferi
KKPEEAKNPIAAAI

SEQ ID NO: 181905 - protein, 14 aa, Borrelia burgdorferi
KPEEAKNPIAAAIG

SEQ ID NO: 181906 - protein, 14 aa, Borrelia burgdorferi
PEEAKNPIAAAIGK

SEQ ID NO: 181907 - protein, 14 aa, Borrelia burgdorferi
EEAKNPIAAAIGKG

SEQ ID NO: 181908 - protein, 14 aa, Borrelia burgdorferi
EAKNPIAAAIGKGN

SEQ ID NO: 181909 - protein, 14 aa, Borrelia burgdorferi
AKNPIAAAIGKGNA

SEQ ID NO: 181910 - protein, 14 aa, Borrelia burgdorferi
KNPIAAAIGKGNAD

SEQ ID NO: 181911 - protein, 14 aa, Borrelia burgdorferi
NPIAAAIGKGNADD

SEQ ID NO: 181912 - protein, 14 aa, Borrelia burgdorferi
PIAAAIGKGNADDG

SEQ ID NO: 181913 - protein, 14 aa, Borrelia burgdorferi
IAAAIGKGNADDGA

SEQ ID NO: 181914 - protein, 14 aa, Borrelia burgdorferi
AAAIGKGNADDGAE

SEQ ID NO: 181915 - protein, 14 aa, Borrelia burgdorferi
AAIGKGNADDGAEF

SEQ ID NO: 181916 - protein, 14 aa, Borrelia burgdorferi
AIGKGNADDGAEFG

SEQ ID NO: 181917 - protein, 14 aa, Borrelia burgdorferi
IGKGNADDGAEFGQ

SEQ ID NO: 181918 - protein, 14 aa, Borrelia burgdorferi
GKGNADDGAEFGQE

SEQ ID NO: 181919 - protein, 14 aa, Borrelia burgdorferi
KGNADDGAEFGQEG

SEQ ID NO: 181920 - protein, 14 aa, Borrelia burgdorferi
GNADDGAEFGQEGM

SEQ ID NO: 181921 - protein, 14 aa, Borrelia burgdorferi
NADDGAEFGQEGMK

SEQ ID NO: 181922 - protein, 14 aa, Borrelia burgdorferi
ADDGAEFGQEGMKK

SEQ ID NO: 181923 - protein, 14 aa, Borrelia burgdorferi
DDGAEFGQEGMKKD

SEQ ID NO: 181924 - protein, 14 aa, Borrelia burgdorferi
DGAEFGQEGMKKDD

SEQ ID NO: 181925 - protein, 14 aa, Borrelia burgdorferi
GAEFGQEGMKKDDQ

SEQ ID NO: 181926 - protein, 14 aa, Borrelia burgdorferi
AEFGQEGMKKDDQI

SEQ ID NO: 181927 - protein, 14 aa, Borrelia burgdorferi
EFGQEGMKKDDQIA

SEQ ID NO: 181928 - protein, 14 aa, Borrelia burgdorferi
FGQEGMKKDDQIAA

SEQ ID NO: 181929 - protein, 14 aa, Borrelia burgdorferi
GQEGMKKDDQIAAA

SEQ ID NO: 181930 - protein, 14 aa, Borrelia burgdorferi
QEGMKKDDQIAAAI

SEQ ID NO: 181931 - protein, 14 aa, Borrelia burgdorferi
EGMKKDDQIAAAIA

SEQ ID NO: 181932 - protein, 14 aa, Borrelia burgdorferi
GMKKDDQIAAAIAL

SEQ ID NO: 181933 - protein, 14 aa, Borrelia burgdorferi
MKKDDQIAAAIALR

SEQ ID NO: 181934 - protein, 14 aa, Borrelia burgdorferi
KKDDQIAAAIALRG

SEQ ID NO: 181935 - protein, 14 aa, Borrelia burgdorferi
KDDQIAAAIALRGM

SEQ ID NO: 181936 - protein, 14 aa, Borrelia burgdorferi
DDQIAAAIALRGMA

SEQ ID NO: 181937 - protein, 14 aa, Borrelia burgdorferi
DQIAAAIALRGMAK

SEQ ID NO: 181938 - protein, 14 aa, Borrelia burgdorferi
QIAAAIALRGMAKD

SEQ ID NO: 181939 - protein, 14 aa, Borrelia burgdorferi
IAAAIALRGMAKDG

SEQ ID NO: 181940 - protein, 14 aa, Borrelia burgdorferi
AAAIALRGMAKDGK

SEQ ID NO: 181941 - protein, 14 aa, Borrelia burgdorferi
AAIALRGMAKDGKF

SEQ ID NO: 181942 - protein, 14 aa, Borrelia burgdorferi
AIALRGMAKDGKFA

SEQ ID NO: 181943 - protein, 14 aa, Borrelia burgdorferi
IALRGMAKDGKFAV

SEQ ID NO: 181944 - protein, 14 aa, Borrelia burgdorferi
ALRGMAKDGKFAVK

SEQ ID NO: 181945 - protein, 14 aa, Borrelia burgdorferi
LRGMAKDGKFAVKS

SEQ ID NO: 181946 - protein, 14 aa, Borrelia burgdorferi
RGMAKDGKFAVKSG

SEQ ID NO: 181947 - protein, 14 aa, Borrelia burgdorferi
GMAKDGKFAVKSGE

SEQ ID NO: 181948 - protein, 14 aa, Borrelia burgdorferi
MAKDGKFAVKSGEK

SEQ ID NO: 181949 - protein, 14 aa, Borrelia burgdorferi
AKDGKFAVKSGEKE

SEQ ID NO: 181950 - protein, 14 aa, Borrelia burgdorferi
KDGKFAVKSGEKEK

SEQ ID NO: 181951 - protein, 14 aa, Borrelia burgdorferi
DGKFAVKSGEKEKA

SEQ ID NO: 181952 - protein, 15 aa, Borrelia burgdorferi
EGAIKEVSELLDKLV

SEQ ID NO: 181953 - protein, 15 aa, Borrelia burgdorferi
GAIKEVSELLDKLVK

SEQ ID NO: 181954 - protein, 15 aa, Borrelia burgdorferi
AIKEVSELLDKLVKA

SEQ ID NO: 181955 - protein, 15 aa, Borrelia burgdorferi
IKEVSELLDKLVKAV

SEQ ID NO: 181956 - protein, 15 aa, Borrelia burgdorferi
KEVSELLDKLVKAVK

SEQ ID NO: 181957 - protein, 15 aa, Borrelia burgdorferi
EVSELLDKLVKAVKT

SEQ ID NO: 181958 - protein, 15 aa, Borrelia burgdorferi
VSELLDKLVKAVKTA

SEQ ID NO: 181959 - protein, 15 aa, Borrelia burgdorferi
SELLDKLVKAVKTAE

SEQ ID NO: 181960 - protein, 15 aa, Borrelia burgdorferi
ELLDKLVKAVKTAEG

SEQ ID NO: 181961 - protein, 15 aa, Borrelia burgdorferi
LLDKLVKAVKTAEGA

SEQ ID NO: 181962 - protein, 15 aa, Borrelia burgdorferi
LDKLVKAVKTAEGAS

SEQ ID NO: 181963 - protein, 15 aa, Borrelia burgdorferi
DKLVKAVKTAEGASS

SEQ ID NO: 181964 - protein, 15 aa, Borrelia burgdorferi
KLVKAVKTAEGASSG

SEQ ID NO: 181965 - protein, 15 aa, Borrelia burgdorferi
LVKAVKTAEGASSGT

SEQ ID NO: 181966 - protein, 15 aa, Borrelia burgdorferi
VKAVKTAEGASSGTD

SEQ ID NO: 181967 - protein, 15 aa, Borrelia burgdorferi
KAVKTAEGASSGTDA

SEQ ID NO: 181968 - protein, 15 aa, Borrelia burgdorferi
AVKTAEGASSGTDAI

SEQ ID NO: 181969 - protein, 15 aa, Borrelia burgdorferi
VKTAEGASSGTDAIG

SEQ ID NO: 181970 - protein, 15 aa, Borrelia burgdorferi
KTAEGASSGTDAIGE

SEQ ID NO: 181971 - protein, 15 aa, Borrelia burgdorferi
TAEGASSGTDAIGEV

SEQ ID NO: 181972 - protein, 15 aa, Borrelia burgdorferi
AEGASSGTDAIGEVV

SEQ ID NO: 181973 - protein, 15 aa, Borrelia burgdorferi
EGASSGTDAIGEVVA

SEQ ID NO: 181974 - protein, 15 aa, Borrelia burgdorferi
GASSGTDAIGEVVAN

SEQ ID NO: 181975 - protein, 15 aa, Borrelia burgdorferi
ASSGTDAIGEVVANA

SEQ ID NO: 181976 - protein, 15 aa, Borrelia burgdorferi
SSGTDAIGEVVANAG

SEQ ID NO: 181977 - protein, 15 aa, Borrelia burgdorferi
SGTDAIGEVVANAGA

SEQ ID NO: 181978 - protein, 15 aa, Borrelia burgdorferi
GTDAIGEVVANAGAA

SEQ ID NO: 181979 - protein, 15 aa, Borrelia burgdorferi
TDAIGEVVANAGAAK

SEQ ID NO: 181980 - protein, 15 aa, Borrelia burgdorferi
DAIGEVVANAGAAKV

SEQ ID NO: 181981 - protein, 15 aa, Borrelia burgdorferi
AIGEVVANAGAAKVA

SEQ ID NO: 181982 - protein, 15 aa, Borrelia burgdorferi
IGEVVANAGAAKVAD

SEQ ID NO: 181983 - protein, 15 aa, Borrelia burgdorferi
GEVVANAGAAKVADK

SEQ ID NO: 181984 - protein, 15 aa, Borrelia burgdorferi
EVVANAGAAKVADKA

SEQ ID NO: 181985 - protein, 15 aa, Borrelia burgdorferi
VVANAGAAKVADKAS

SEQ ID NO: 181986 - protein, 15 aa, Borrelia burgdorferi
VANAGAAKVADKASV

SEQ ID NO: 181987 - protein, 15 aa, Borrelia burgdorferi
ANAGAAKVADKASVT

SEQ ID NO: 181988 - protein, 15 aa, Borrelia burgdorferi
NAGAAKVADKASVTG

SEQ ID NO: 181989 - protein, 15 aa, Borrelia burgdorferi
AGAAKVADKASVTGI

SEQ ID NO: 181990 - protein, 15 aa, Borrelia burgdorferi
GAAKVADKASVTGIA

SEQ ID NO: 181991 - protein, 15 aa, Borrelia burgdorferi
AAKVADKASVTGIAK

SEQ ID NO: 181992 - protein, 15 aa, Borrelia burgdorferi
AKVADKASVTGIAKG

SEQ ID NO: 181993 - protein, 15 aa, Borrelia burgdorferi
KVADKASVTGIAKGI

SEQ ID NO: 181994 - protein, 15 aa, Borrelia burgdorferi
VADKASVTGIAKGIK

SEQ ID NO: 181995 - protein, 15 aa, Borrelia burgdorferi
ADKASVTGIAKGIKE

SEQ ID NO: 181996 - protein, 15 aa, Borrelia burgdorferi
DKASVTGIAKGIKEI

SEQ ID NO: 181997 - protein, 15 aa, Borrelia burgdorferi
KASVTGIAKGIKEIV

SEQ ID NO: 181998 - protein, 15 aa, Borrelia burgdorferi
ASVTGIAKGIKEIVE

SEQ ID NO: 181999 - protein, 15 aa, Borrelia burgdorferi
SVTGIAKGIKEIVEA

SEQ ID NO: 182000 - protein, 15 aa, Borrelia burgdorferi
VTGIAKGIKEIVEAA

SEQ ID NO: 182001 - protein, 15 aa, Borrelia burgdorferi
TGIAKGIKEIVEAAG

SEQ ID NO: 182002 - protein, 15 aa, Borrelia burgdorferi
GIAKGIKEIVEAAGG

SEQ ID NO: 182003 - protein, 15 aa, Borrelia burgdorferi
IAKGIKEIVEAAGGS

SEQ ID NO: 182004 - protein, 15 aa, Borrelia burgdorferi
AKGIKEIVEAAGGSE

SEQ ID NO: 182005 - protein, 15 aa, Borrelia burgdorferi
KGIKEIVEAAGGSEK

SEQ ID NO: 182006 - protein, 15 aa, Borrelia burgdorferi
GIKEIVEAAGGSEKL

SEQ ID NO: 182007 - protein, 15 aa, Borrelia burgdorferi
IKEIVEAAGGSEKLK

SEQ ID NO: 182008 - protein, 15 aa, Borrelia burgdorferi
KEIVEAAGGSEKLKV

SEQ ID NO: 182009 - protein, 15 aa, Borrelia burgdorferi
EIVEAAGGSEKLKVA

SEQ ID NO: 182010 - protein, 15 aa, Borrelia burgdorferi
IVEAAGGSEKLKVAA

SEQ ID NO: 182011 - protein, 15 aa, Borrelia burgdorferi
VEAAGGSEKLKVAAA

SEQ ID NO: 182012 - protein, 15 aa, Borrelia burgdorferi
EAAGGSEKLKVAAAT

SEQ ID NO: 182013 - protein, 15 aa, Borrelia burgdorferi
AAGGSEKLKVAAATG

SEQ ID NO: 182014 - protein, 15 aa, Borrelia burgdorferi
AGGSEKLKVAAATGE

SEQ ID NO: 182015 - protein, 15 aa, Borrelia burgdorferi
GGSEKLKVAAATGES

SEQ ID NO: 182016 - protein, 15 aa, Borrelia burgdorferi
GSEKLKVAAATGESN

SEQ ID NO: 182017 - protein, 15 aa, Borrelia burgdorferi
SEKLKVAAATGESNK

SEQ ID NO: 182018 - protein, 15 aa, Borrelia burgdorferi
EKLKVAAATGESNKG

SEQ ID NO: 182019 - protein, 15 aa, Borrelia burgdorferi
KLKVAAATGESNKGA

SEQ ID NO: 182020 - protein, 15 aa, Borrelia burgdorferi
LKVAAATGESNKGAG

SEQ ID NO: 182021 - protein, 15 aa, Borrelia burgdorferi
KVAAATGESNKGAGK

SEQ ID NO: 182022 - protein, 15 aa, Borrelia burgdorferi
VAAATGESNKGAGKL

SEQ ID NO: 182023 - protein, 15 aa, Borrelia burgdorferi
AAATGESNKGAGKLF

SEQ ID NO: 182024 - protein, 15 aa, Borrelia burgdorferi
AATGESNKGAGKLFG

SEQ ID NO: 182025 - protein, 15 aa, Borrelia burgdorferi
ATGESNKGAGKLFGK

SEQ ID NO: 182026 - protein, 15 aa, Borrelia burgdorferi
TGESNKGAGKLFGKA

SEQ ID NO: 182027 - protein, 15 aa, Borrelia burgdorferi
GESNKGAGKLFGKAG

SEQ ID NO: 182028 - protein, 15 aa, Borrelia burgdorferi
ESNKGAGKLFGKAGA

SEQ ID NO: 182029 - protein, 15 aa, Borrelia burgdorferi
SNKGAGKLFGKAGAG

SEQ ID NO: 182030 - protein, 15 aa, Borrelia burgdorferi
NKGAGKLFGKAGAGA

SEQ ID NO: 182031 - protein, 15 aa, Borrelia burgdorferi
KGAGKLFGKAGAGAN

SEQ ID NO: 182032 - protein, 15 aa, Borrelia burgdorferi
GAGKLFGKAGAGANA

SEQ ID NO: 182033 - protein, 15 aa, Borrelia burgdorferi
AGKLFGKAGAGANAG

SEQ ID NO: 182034 - protein, 15 aa, Borrelia burgdorferi
GKLFGKAGAGANAGD

SEQ ID NO: 182035 - protein, 15 aa, Borrelia burgdorferi
KLFGKAGAGANAGDS

SEQ ID NO: 182036 - protein, 15 aa, Borrelia burgdorferi
LFGKAGAGANAGDSE

SEQ ID NO: 182037 - protein, 15 aa, Borrelia burgdorferi
FGKAGAGANAGDSEA

SEQ ID NO: 182038 - protein, 15 aa, Borrelia burgdorferi
GKAGAGANAGDSEAA

SEQ ID NO: 182039 - protein, 15 aa, Borrelia burgdorferi
KAGAGANAGDSEAAS

SEQ ID NO: 182040 - protein, 15 aa, Borrelia burgdorferi
AGAGANAGDSEAASK

SEQ ID NO: 182041 - protein, 15 aa, Borrelia burgdorferi
GAGANAGDSEAASKA

SEQ ID NO: 182042 - protein, 15 aa, Borrelia burgdorferi
AGANAGDSEAASKAA

SEQ ID NO: 182043 - protein, 15 aa, Borrelia burgdorferi
GANAGDSEAASKAAG

SEQ ID NO: 182044 - protein, 15 aa, Borrelia burgdorferi
ANAGDSEAASKAAGA

SEQ ID NO: 182045 - protein, 15 aa, Borrelia burgdorferi
NAGDSEAASKAAGAV

SEQ ID NO: 182046 - protein, 15 aa, Borrelia burgdorferi
AGDSEAASKAAGAVS

SEQ ID NO: 182047 - protein, 15 aa, Borrelia burgdorferi
GDSEAASKAAGAVSA

SEQ ID NO: 182048 - protein, 15 aa, Borrelia burgdorferi
DSEAASKAAGAVSAV

SEQ ID NO: 182049 - protein, 15 aa, Borrelia burgdorferi
SEAASKAAGAVSAVS

SEQ ID NO: 182050 - protein, 15 aa, Borrelia burgdorferi
EAASKAAGAVSAVSG

SEQ ID NO: 182051 - protein, 15 aa, Borrelia burgdorferi
AASKAAGAVSAVSGE

SEQ ID NO: 182052 - protein, 15 aa, Borrelia burgdorferi
ASKAAGAVSAVSGEQ

SEQ ID NO: 182053 - protein, 15 aa, Borrelia burgdorferi
SKAAGAVSAVSGEQI

SEQ ID NO: 182054 - protein, 15 aa, Borrelia burgdorferi
KAAGAVSAVSGEQIL

SEQ ID NO: 182055 - protein, 15 aa, Borrelia burgdorferi
AAGAVSAVSGEQILS

SEQ ID NO: 182056 - protein, 15 aa, Borrelia burgdorferi
AGAVSAVSGEQILSA

SEQ ID NO: 182057 - protein, 15 aa, Borrelia burgdorferi
GAVSAVSGEQILSAI

SEQ ID NO: 182058 - protein, 15 aa, Borrelia burgdorferi
AVSAVSGEQILSAIV

SEQ ID NO: 182059 - protein, 15 aa, Borrelia burgdorferi
VSAVSGEQILSAIVT

SEQ ID NO: 182060 - protein, 15 aa, Borrelia burgdorferi
SAVSGEQILSAIVTA

SEQ ID NO: 182061 - protein, 15 aa, Borrelia burgdorferi
AVSGEQILSAIVTAA

SEQ ID NO: 182062 - protein, 15 aa, Borrelia burgdorferi
VSGEQILSAIVTAAD

SEQ ID NO: 182063 - protein, 15 aa, Borrelia burgdorferi
SGEQILSAIVTAADA

SEQ ID NO: 182064 - protein, 15 aa, Borrelia burgdorferi
GEQILSAIVTAADAA

SEQ ID NO: 182065 - protein, 15 aa, Borrelia burgdorferi
EQILSAIVTAADAAE

SEQ ID NO: 182066 - protein, 15 aa, Borrelia burgdorferi
QILSAIVTAADAAEQ

SEQ ID NO: 182067 - protein, 15 aa, Borrelia burgdorferi
ILSAIVTAADAAEQE

SEQ ID NO: 182068 - protein, 15 aa, Borrelia burgdorferi
LSAIVTAADAAEQEG

SEQ ID NO: 182069 - protein, 15 aa, Borrelia burgdorferi
SAIVTAADAAEQEGK

SEQ ID NO: 182070 - protein, 15 aa, Borrelia burgdorferi
AIVTAADAAEQEGKK

SEQ ID NO: 182071 - protein, 15 aa, Borrelia burgdorferi
IVTAADAAEQEGKKP

SEQ ID NO: 182072 - protein, 15 aa, Borrelia burgdorferi
VTAADAAEQEGKKPE

SEQ ID NO: 182073 - protein, 15 aa, Borrelia burgdorferi
TAADAAEQEGKKPEE

SEQ ID NO: 182074 - protein, 15 aa, Borrelia burgdorferi
AADAAEQEGKKPEEA

SEQ ID NO: 182075 - protein, 15 aa, Borrelia burgdorferi
ADAAEQEGKKPEEAK

SEQ ID NO: 182076 - protein, 15 aa, Borrelia burgdorferi
DAAEQEGKKPEEAKN

SEQ ID NO: 182077 - protein, 15 aa, Borrelia burgdorferi
AAEQEGKKPEEAKNP

SEQ ID NO: 182078 - protein, 15 aa, Borrelia burgdorferi
AEQEGKKPEEAKNPI

SEQ ID NO: 182079 - protein, 15 aa, Borrelia burgdorferi
EQEGKKPEEAKNPIA

SEQ ID NO: 182080 - protein, 15 aa, Borrelia burgdorferi
QEGKKPEEAKNPIAA

SEQ ID NO: 182081 - protein, 15 aa, Borrelia burgdorferi
EGKKPEEAKNPIAAA

SEQ ID NO: 182082 - protein, 15 aa, Borrelia burgdorferi
GKKPEEAKNPIAAAI

SEQ ID NO: 182083 - protein, 15 aa, Borrelia burgdorferi
KKPEEAKNPIAAAIG

SEQ ID NO: 182084 - protein, 15 aa, Borrelia burgdorferi
KPEEAKNPIAAAIGK

SEQ ID NO: 182085 - protein, 15 aa, Borrelia burgdorferi
PEEAKNPIAAAIGKG

SEQ ID NO: 182086 - protein, 15 aa, Borrelia burgdorferi
EEAKNPIAAAIGKGN

SEQ ID NO: 182087 - protein, 15 aa, Borrelia burgdorferi
EAKNPIAAAIGKGNA

SEQ ID NO: 182088 - protein, 15 aa, Borrelia burgdorferi
AKNPIAAAIGKGNAD

SEQ ID NO: 182089 - protein, 15 aa, Borrelia burgdorferi
KNPIAAAIGKGNADD

SEQ ID NO: 182090 - protein, 15 aa, Borrelia burgdorferi
NPIAAAIGKGNADDG

SEQ ID NO: 182091 - protein, 15 aa, Borrelia burgdorferi
PIAAAIGKGNADDGA

SEQ ID NO: 182092 - protein, 15 aa, Borrelia burgdorferi
IAAAIGKGNADDGAE

SEQ ID NO: 182093 - protein, 15 aa, Borrelia burgdorferi
AAAIGKGNADDGAEF

SEQ ID NO: 182094 - protein, 15 aa, Borrelia burgdorferi
AAIGKGNADDGAEFG

SEQ ID NO: 182095 - protein, 15 aa, Borrelia burgdorferi
AIGKGNADDGAEFGQ

SEQ ID NO: 182096 - protein, 15 aa, Borrelia burgdorferi
IGKGNADDGAEFGQE

SEQ ID NO: 182097 - protein, 15 aa, Borrelia burgdorferi
GKGNADDGAEFGQEG

SEQ ID NO: 182098 - protein, 15 aa, Borrelia burgdorferi
KGNADDGAEFGQEGM

SEQ ID NO: 182099 - protein, 15 aa, Borrelia burgdorferi
GNADDGAEFGQEGMK

SEQ ID NO: 182100 - protein, 15 aa, Borrelia burgdorferi
NADDGAEFGQEGMKK

SEQ ID NO: 182101 - protein, 15 aa, Borrelia burgdorferi
ADDGAEFGQEGMKKD

SEQ ID NO: 182102 - protein, 15 aa, Borrelia burgdorferi
DDGAEFGQEGMKKDD

SEQ ID NO: 182103 - protein, 15 aa, Borrelia burgdorferi
DGAEFGQEGMKKDDQ

SEQ ID NO: 182104 - protein, 15 aa, Borrelia burgdorferi
GAEFGQEGMKKDDQI

SEQ ID NO: 182105 - protein, 15 aa, Borrelia burgdorferi
AEFGQEGMKKDDQIA

SEQ ID NO: 182106 - protein, 15 aa, Borrelia burgdorferi
EFGQEGMKKDDQIAA

SEQ ID NO: 182107 - protein, 15 aa, Borrelia burgdorferi
FGQEGMKKDDQIAAA

SEQ ID NO: 182108 - protein, 15 aa, Borrelia burgdorferi
GQEGMKKDDQIAAAI

SEQ ID NO: 182109 - protein, 15 aa, Borrelia burgdorferi
QEGMKKDDQIAAAIA

SEQ ID NO: 182110 - protein, 15 aa, Borrelia burgdorferi
EGMKKDDQIAAAIAL

SEQ ID NO: 182111 - protein, 15 aa, Borrelia burgdorferi
GMKKDDQIAAAIALR

SEQ ID NO: 182112 - protein, 15 aa, Borrelia burgdorferi
MKKDDQIAAAIALRG

SEQ ID NO: 182113 - protein, 15 aa, Borrelia burgdorferi
KKDDQIAAAIALRGM

SEQ ID NO: 182114 - protein, 15 aa, Borrelia burgdorferi
KDDQIAAAIALRGMA

SEQ ID NO: 182115 - protein, 15 aa, Borrelia burgdorferi
DDQIAAAIALRGMAK

SEQ ID NO: 182116 - protein, 15 aa, Borrelia burgdorferi
DQIAAAIALRGMAKD

SEQ ID NO: 182117 - protein, 15 aa, Borrelia burgdorferi
QIAAAIALRGMAKDG

SEQ ID NO: 182118 - protein, 15 aa, Borrelia burgdorferi
IAAAIALRGMAKDGK

SEQ ID NO: 182119 - protein, 15 aa, Borrelia burgdorferi
AAAIALRGMAKDGKF

SEQ ID NO: 182120 - protein, 15 aa, Borrelia burgdorferi
AAIALRGMAKDGKFA

SEQ ID NO: 182121 - protein, 15 aa, Borrelia burgdorferi
AIALRGMAKDGKFAV

SEQ ID NO: 182122 - protein, 15 aa, Borrelia burgdorferi
IALRGMAKDGKFAVK

SEQ ID NO: 182123 - protein, 15 aa, Borrelia burgdorferi
ALRGMAKDGKFAVKS

SEQ ID NO: 182124 - protein, 15 aa, Borrelia burgdorferi
LRGMAKDGKFAVKSG

SEQ ID NO: 182125 - protein, 15 aa, Borrelia burgdorferi
RGMAKDGKFAVKSGE

SEQ ID NO: 182126 - protein, 15 aa, Borrelia burgdorferi
GMAKDGKFAVKSGEK

SEQ ID NO: 182127 - protein, 15 aa, Borrelia burgdorferi
MAKDGKFAVKSGEKE

SEQ ID NO: 182128 - protein, 15 aa, Borrelia burgdorferi
AKDGKFAVKSGEKEK

SEQ ID NO: 182129 - protein, 15 aa, Borrelia burgdorferi
KDGKFAVKSGEKEKA

SEQ ID NO: 182130 - protein, 16 aa, Borrelia burgdorferi
EGAIKEVSELLDKLVK

SEQ ID NO: 182131 - protein, 16 aa, Borrelia burgdorferi
GAIKEVSELLDKLVKA

SEQ ID NO: 182132 - protein, 16 aa, Borrelia burgdorferi
AIKEVSELLDKLVKAV

SEQ ID NO: 182133 - protein, 16 aa, Borrelia burgdorferi
IKEVSELLDKLVKAVK

SEQ ID NO: 182134 - protein, 16 aa, Borrelia burgdorferi
KEVSELLDKLVKAVKT

SEQ ID NO: 182135 - protein, 16 aa, Borrelia burgdorferi
EVSELLDKLVKAVKTA

SEQ ID NO: 182136 - protein, 16 aa, Borrelia burgdorferi
VSELLDKLVKAVKTAE

SEQ ID NO: 182137 - protein, 16 aa, Borrelia burgdorferi
SELLDKLVKAVKTAEG

SEQ ID NO: 182138 - protein, 16 aa, Borrelia burgdorferi
ELLDKLVKAVKTAEGA

SEQ ID NO: 182139 - protein, 16 aa, Borrelia burgdorferi
LLDKLVKAVKTAEGAS

SEQ ID NO: 182140 - protein, 16 aa, Borrelia burgdorferi
LDKLVKAVKTAEGASS

SEQ ID NO: 182141 - protein, 16 aa, Borrelia burgdorferi
DKLVKAVKTAEGASSG

SEQ ID NO: 182142 - protein, 16 aa, Borrelia burgdorferi
KLVKAVKTAEGASSGT

SEQ ID NO: 182143 - protein, 16 aa, Borrelia burgdorferi
LVKAVKTAEGASSGTD

SEQ ID NO: 182144 - protein, 16 aa, Borrelia burgdorferi
VKAVKTAEGASSGTDA

SEQ ID NO: 182145 - protein, 16 aa, Borrelia burgdorferi
KAVKTAEGASSGTDAI

SEQ ID NO: 182146 - protein, 16 aa, Borrelia burgdorferi
AVKTAEGASSGTDAIG

SEQ ID NO: 182147 - protein, 16 aa, Borrelia burgdorferi
VKTAEGASSGTDAIGE

SEQ ID NO: 182148 - protein, 16 aa, Borrelia burgdorferi
KTAEGASSGTDAIGEV

SEQ ID NO: 182149 - protein, 16 aa, Borrelia burgdorferi
TAEGASSGTDAIGEVV

SEQ ID NO: 182150 - protein, 16 aa, Borrelia burgdorferi
AEGASSGTDAIGEVVA

SEQ ID NO: 182151 - protein, 16 aa, Borrelia burgdorferi
EGASSGTDAIGEVVAN

SEQ ID NO: 182152 - protein, 16 aa, Borrelia burgdorferi
GASSGTDAIGEVVANA

SEQ ID NO: 182153 - protein, 16 aa, Borrelia burgdorferi
ASSGTDAIGEVVANAG

SEQ ID NO: 182154 - protein, 16 aa, Borrelia burgdorferi
SSGTDAIGEVVANAGA

SEQ ID NO: 182155 - protein, 16 aa, Borrelia burgdorferi
SGTDAIGEVVANAGAA

SEQ ID NO: 182156 - protein, 16 aa, Borrelia burgdorferi
GTDAIGEVVANAGAAK

SEQ ID NO: 182157 - protein, 16 aa, Borrelia burgdorferi
TDAIGEVVANAGAAKV

SEQ ID NO: 182158 - protein, 16 aa, Borrelia burgdorferi
DAIGEVVANAGAAKVA

SEQ ID NO: 182159 - protein, 16 aa, Borrelia burgdorferi
AIGEVVANAGAAKVAD

SEQ ID NO: 182160 - protein, 16 aa, Borrelia burgdorferi
IGEVVANAGAAKVADK

SEQ ID NO: 182161 - protein, 16 aa, Borrelia burgdorferi
GEVVANAGAAKVADKA

SEQ ID NO: 182162 - protein, 16 aa, Borrelia burgdorferi
EVVANAGAAKVADKAS

SEQ ID NO: 182163 - protein, 16 aa, Borrelia burgdorferi
VVANAGAAKVADKASV

SEQ ID NO: 182164 - protein, 16 aa, Borrelia burgdorferi
VANAGAAKVADKASVT

SEQ ID NO: 182165 - protein, 16 aa, Borrelia burgdorferi
ANAGAAKVADKASVTG

SEQ ID NO: 182166 - protein, 16 aa, Borrelia burgdorferi
NAGAAKVADKASVTGI

SEQ ID NO: 182167 - protein, 16 aa, Borrelia burgdorferi
AGAAKVADKASVTGIA

SEQ ID NO: 182168 - protein, 16 aa, Borrelia burgdorferi
GAAKVADKASVTGIAK

SEQ ID NO: 182169 - protein, 16 aa, Borrelia burgdorferi
AAKVADKASVTGIAKG

SEQ ID NO: 182170 - protein, 16 aa, Borrelia burgdorferi
AKVADKASVTGIAKGI

SEQ ID NO: 182171 - protein, 16 aa, Borrelia burgdorferi
KVADKASVTGIAKGIK

SEQ ID NO: 182172 - protein, 16 aa, Borrelia burgdorferi
VADKASVTGIAKGIKE

SEQ ID NO: 182173 - protein, 16 aa, Borrelia burgdorferi
ADKASVTGIAKGIKEI

SEQ ID NO: 182174 - protein, 16 aa, Borrelia burgdorferi
DKASVTGIAKGIKEIV

SEQ ID NO: 182175 - protein, 16 aa, Borrelia burgdorferi
KASVTGIAKGIKEIVE

SEQ ID NO: 182176 - protein, 16 aa, Borrelia burgdorferi
ASVTGIAKGIKEIVEA

SEQ ID NO: 182177 - protein, 16 aa, Borrelia burgdorferi
SVTGIAKGIKEIVEAA

SEQ ID NO: 182178 - protein, 16 aa, Borrelia burgdorferi
VTGIAKGIKEIVEAAG

SEQ ID NO: 182179 - protein, 16 aa, Borrelia burgdorferi
TGIAKGIKEIVEAAGG

SEQ ID NO: 182180 - protein, 16 aa, Borrelia burgdorferi
GIAKGIKEIVEAAGGS

SEQ ID NO: 182181 - protein, 16 aa, Borrelia burgdorferi
IAKGIKEIVEAAGGSE

SEQ ID NO: 182182 - protein, 16 aa, Borrelia burgdorferi
AKGIKEIVEAAGGSEK

SEQ ID NO: 182183 - protein, 16 aa, Borrelia burgdorferi
KGIKEIVEAAGGSEKL

SEQ ID NO: 182184 - protein, 16 aa, Borrelia burgdorferi
GIKEIVEAAGGSEKLK

SEQ ID NO: 182185 - protein, 16 aa, Borrelia burgdorferi
IKEIVEAAGGSEKLKV

SEQ ID NO: 182186 - protein, 16 aa, Borrelia burgdorferi
KEIVEAAGGSEKLKVA

SEQ ID NO: 182187 - protein, 16 aa, Borrelia burgdorferi
EIVEAAGGSEKLKVAA

SEQ ID NO: 182188 - protein, 16 aa, Borrelia burgdorferi
IVEAAGGSEKLKVAAA

SEQ ID NO: 182189 - protein, 16 aa, Borrelia burgdorferi
VEAAGGSEKLKVAAAT

SEQ ID NO: 182190 - protein, 16 aa, Borrelia burgdorferi
EAAGGSEKLKVAAATG

SEQ ID NO: 182191 - protein, 16 aa, Borrelia burgdorferi
AAGGSEKLKVAAATGE

SEQ ID NO: 182192 - protein, 16 aa, Borrelia burgdorferi
AGGSEKLKVAAATGES

SEQ ID NO: 182193 - protein, 16 aa, Borrelia burgdorferi
GGSEKLKVAAATGESN

SEQ ID NO: 182194 - protein, 16 aa, Borrelia burgdorferi
GSEKLKVAAATGESNK

SEQ ID NO: 182195 - protein, 16 aa, Borrelia burgdorferi
SEKLKVAAATGESNKG

SEQ ID NO: 182196 - protein, 16 aa, Borrelia burgdorferi
EKLKVAAATGESNKGA

SEQ ID NO: 182197 - protein, 16 aa, Borrelia burgdorferi
KLKVAAATGESNKGAG

SEQ ID NO: 182198 - protein, 16 aa, Borrelia burgdorferi
LKVAAATGESNKGAGK

SEQ ID NO: 182199 - protein, 16 aa, Borrelia burgdorferi
KVAAATGESNKGAGKL

SEQ ID NO: 182200 - protein, 16 aa, Borrelia burgdorferi
VAAATGESNKGAGKLF

SEQ ID NO: 182201 - protein, 16 aa, Borrelia burgdorferi
AAATGESNKGAGKLFG

SEQ ID NO: 182202 - protein, 16 aa, Borrelia burgdorferi
AATGESNKGAGKLFGK

SEQ ID NO: 182203 - protein, 16 aa, Borrelia burgdorferi
ATGESNKGAGKLFGKA

SEQ ID NO: 182204 - protein, 16 aa, Borrelia burgdorferi
TGESNKGAGKLFGKAG

SEQ ID NO: 182205 - protein, 16 aa, Borrelia burgdorferi
GESNKGAGKLFGKAGA

SEQ ID NO: 182206 - protein, 16 aa, Borrelia burgdorferi
ESNKGAGKLFGKAGAG

SEQ ID NO: 182207 - protein, 16 aa, Borrelia burgdorferi
SNKGAGKLFGKAGAGA

SEQ ID NO: 182208 - protein, 16 aa, Borrelia burgdorferi
NKGAGKLFGKAGAGAN

SEQ ID NO: 182209 - protein, 16 aa, Borrelia burgdorferi
KGAGKLFGKAGAGANA

SEQ ID NO: 182210 - protein, 16 aa, Borrelia burgdorferi
GAGKLFGKAGAGANAG

SEQ ID NO: 182211 - protein, 16 aa, Borrelia burgdorferi
AGKLFGKAGAGANAGD

SEQ ID NO: 182212 - protein, 16 aa, Borrelia burgdorferi
GKLFGKAGAGANAGDS

SEQ ID NO: 182213 - protein, 16 aa, Borrelia burgdorferi
KLFGKAGAGANAGDSE

SEQ ID NO: 182214 - protein, 16 aa, Borrelia burgdorferi
LFGKAGAGANAGDSEA

SEQ ID NO: 182215 - protein, 16 aa, Borrelia burgdorferi
FGKAGAGANAGDSEAA

SEQ ID NO: 182216 - protein, 16 aa, Borrelia burgdorferi
GKAGAGANAGDSEAAS

SEQ ID NO: 182217 - protein, 16 aa, Borrelia burgdorferi
KAGAGANAGDSEAASK

SEQ ID NO: 182218 - protein, 16 aa, Borrelia burgdorferi
AGAGANAGDSEAASKA

SEQ ID NO: 182219 - protein, 16 aa, Borrelia burgdorferi
GAGANAGDSEAASKAA

SEQ ID NO: 182220 - protein, 16 aa, Borrelia burgdorferi
AGANAGDSEAASKAAG

SEQ ID NO: 182221 - protein, 16 aa, Borrelia burgdorferi
GANAGDSEAASKAAGA

SEQ ID NO: 182222 - protein, 16 aa, Borrelia burgdorferi
ANAGDSEAASKAAGAV

SEQ ID NO: 182223 - protein, 16 aa, Borrelia burgdorferi
NAGDSEAASKAAGAVS

SEQ ID NO: 182224 - protein, 16 aa, Borrelia burgdorferi
AGDSEAASKAAGAVSA

SEQ ID NO: 182225 - protein, 16 aa, Borrelia burgdorferi
GDSEAASKAAGAVSAV

SEQ ID NO: 182226 - protein, 16 aa, Borrelia burgdorferi
DSEAASKAAGAVSAVS

SEQ ID NO: 182227 - protein, 16 aa, Borrelia burgdorferi
SEAASKAAGAVSAVSG

SEQ ID NO: 182228 - protein, 16 aa, Borrelia burgdorferi
EAASKAAGAVSAVSGE

SEQ ID NO: 182229 - protein, 16 aa, Borrelia burgdorferi
AASKAAGAVSAVSGEQ

SEQ ID NO: 182230 - protein, 16 aa, Borrelia burgdorferi
ASKAAGAVSAVSGEQI

SEQ ID NO: 182231 - protein, 16 aa, Borrelia burgdorferi
SKAAGAVSAVSGEQIL

SEQ ID NO: 182232 - protein, 16 aa, Borrelia burgdorferi
KAAGAVSAVSGEQILS

SEQ ID NO: 182233 - protein, 16 aa, Borrelia burgdorferi
AAGAVSAVSGEQILSA

SEQ ID NO: 182234 - protein, 16 aa, Borrelia burgdorferi
AGAVSAVSGEQILSAI

SEQ ID NO: 182235 - protein, 16 aa, Borrelia burgdorferi
GAVSAVSGEQILSAIV

SEQ ID NO: 182236 - protein, 16 aa, Borrelia burgdorferi
AVSAVSGEQILSAIVT

SEQ ID NO: 182237 - protein, 16 aa, Borrelia burgdorferi
VSAVSGEQILSAIVTA

SEQ ID NO: 182238 - protein, 16 aa, Borrelia burgdorferi
SAVSGEQILSAIVTAA

SEQ ID NO: 182239 - protein, 16 aa, Borrelia burgdorferi
AVSGEQILSAIVTAAD

SEQ ID NO: 182240 - protein, 16 aa, Borrelia burgdorferi
VSGEQILSAIVTAADA

SEQ ID NO: 182241 - protein, 16 aa, Borrelia burgdorferi
SGEQILSAIVTAADAA

SEQ ID NO: 182242 - protein, 16 aa, Borrelia burgdorferi
GEQILSAIVTAADAAE

SEQ ID NO: 182243 - protein, 16 aa, Borrelia burgdorferi
EQILSAIVTAADAAEQ

SEQ ID NO: 182244 - protein, 16 aa, Borrelia burgdorferi
QILSAIVTAADAAEQE

SEQ ID NO: 182245 - protein, 16 aa, Borrelia burgdorferi
ILSAIVTAADAAEQEG

SEQ ID NO: 182246 - protein, 16 aa, Borrelia burgdorferi
LSAIVTAADAAEQEGK

SEQ ID NO: 182247 - protein, 16 aa, Borrelia burgdorferi
SAIVTAADAAEQEGKK

SEQ ID NO: 182248 - protein, 16 aa, Borrelia burgdorferi
AIVTAADAAEQEGKKP

SEQ ID NO: 182249 - protein, 16 aa, Borrelia burgdorferi
IVTAADAAEQEGKKPE

SEQ ID NO: 182250 - protein, 16 aa, Borrelia burgdorferi
VTAADAAEQEGKKPEE

SEQ ID NO: 182251 - protein, 16 aa, Borrelia burgdorferi
TAADAAEQEGKKPEEA

SEQ ID NO: 182252 - protein, 16 aa, Borrelia burgdorferi
AADAAEQEGKKPEEAK

SEQ ID NO: 182253 - protein, 16 aa, Borrelia burgdorferi
ADAAEQEGKKPEEAKN

SEQ ID NO: 182254 - protein, 16 aa, Borrelia burgdorferi
DAAEQEGKKPEEAKNP

SEQ ID NO: 182255 - protein, 16 aa, Borrelia burgdorferi
AAEQEGKKPEEAKNPI

SEQ ID NO: 182256 - protein, 16 aa, Borrelia burgdorferi
AEQEGKKPEEAKNPIA

SEQ ID NO: 182257 - protein, 16 aa, Borrelia burgdorferi
EQEGKKPEEAKNPIAA

SEQ ID NO: 182258 - protein, 16 aa, Borrelia burgdorferi
QEGKKPEEAKNPIAAA

SEQ ID NO: 182259 - protein, 16 aa, Borrelia burgdorferi
EGKKPEEAKNPIAAAI

SEQ ID NO: 182260 - protein, 16 aa, Borrelia burgdorferi
GKKPEEAKNPIAAAIG

SEQ ID NO: 182261 - protein, 16 aa, Borrelia burgdorferi
KKPEEAKNPIAAAIGK

SEQ ID NO: 182262 - protein, 16 aa, Borrelia burgdorferi
KPEEAKNPIAAAIGKG

SEQ ID NO: 182263 - protein, 16 aa, Borrelia burgdorferi
PEEAKNPIAAAIGKGN

SEQ ID NO: 182264 - protein, 16 aa, Borrelia burgdorferi
EEAKNPIAAAIGKGNA

SEQ ID NO: 182265 - protein, 16 aa, Borrelia burgdorferi
EAKNPIAAAIGKGNAD

SEQ ID NO: 182266 - protein, 16 aa, Borrelia burgdorferi
AKNPIAAAIGKGNADD

SEQ ID NO: 182267 - protein, 16 aa, Borrelia burgdorferi
KNPIAAAIGKGNADDG

SEQ ID NO: 182268 - protein, 16 aa, Borrelia burgdorferi
NPIAAAIGKGNADDGA

SEQ ID NO: 182269 - protein, 16 aa, Borrelia burgdorferi
PIAAAIGKGNADDGAE

SEQ ID NO: 182270 - protein, 16 aa, Borrelia burgdorferi
IAAAIGKGNADDGAEF

SEQ ID NO: 182271 - protein, 16 aa, Borrelia burgdorferi
AAAIGKGNADDGAEFG

SEQ ID NO: 182272 - protein, 16 aa, Borrelia burgdorferi
AAIGKGNADDGAEFGQ

SEQ ID NO: 182273 - protein, 16 aa, Borrelia burgdorferi
AIGKGNADDGAEFGQE

SEQ ID NO: 182274 - protein, 16 aa, Borrelia burgdorferi
IGKGNADDGAEFGQEG

SEQ ID NO: 182275 - protein, 16 aa, Borrelia burgdorferi
GKGNADDGAEFGQEGM

SEQ ID NO: 182276 - protein, 16 aa, Borrelia burgdorferi
KGNADDGAEFGQEGMK

SEQ ID NO: 182277 - protein, 16 aa, Borrelia burgdorferi
GNADDGAEFGQEGMKK

SEQ ID NO: 182278 - protein, 16 aa, Borrelia burgdorferi
NADDGAEFGQEGMKKD

SEQ ID NO: 182279 - protein, 16 aa, Borrelia burgdorferi
ADDGAEFGQEGMKKDD

SEQ ID NO: 182280 - protein, 16 aa, Borrelia burgdorferi
DDGAEFGQEGMKKDDQ

SEQ ID NO: 182281 - protein, 16 aa, Borrelia burgdorferi
DGAEFGQEGMKKDDQI

SEQ ID NO: 182282 - protein, 16 aa, Borrelia burgdorferi
GAEFGQEGMKKDDQIA

SEQ ID NO: 182283 - protein, 16 aa, Borrelia burgdorferi
AEFGQEGMKKDDQIAA

SEQ ID NO: 182284 - protein, 16 aa, Borrelia burgdorferi
EFGQEGMKKDDQIAAA

SEQ ID NO: 182285 - protein, 16 aa, Borrelia burgdorferi
FGQEGMKKDDQIAAAI

SEQ ID NO: 182286 - protein, 16 aa, Borrelia burgdorferi
GQEGMKKDDQIAAAIA

SEQ ID NO: 182287 - protein, 16 aa, Borrelia burgdorferi
QEGMKKDDQIAAAIAL

SEQ ID NO: 182288 - protein, 16 aa, Borrelia burgdorferi
EGMKKDDQIAAAIALR

SEQ ID NO: 182289 - protein, 16 aa, Borrelia burgdorferi
GMKKDDQIAAAIALRG

SEQ ID NO: 182290 - protein, 16 aa, Borrelia burgdorferi
MKKDDQIAAAIALRGM

SEQ ID NO: 182291 - protein, 16 aa, Borrelia burgdorferi
KKDDQIAAAIALRGMA

SEQ ID NO: 182292 - protein, 16 aa, Borrelia burgdorferi
KDDQIAAAIALRGMAK

SEQ ID NO: 182293 - protein, 16 aa, Borrelia burgdorferi
DDQIAAAIALRGMAKD

SEQ ID NO: 182294 - protein, 16 aa, Borrelia burgdorferi
DQIAAAIALRGMAKDG

SEQ ID NO: 182295 - protein, 16 aa, Borrelia burgdorferi
QIAAAIALRGMAKDGK

SEQ ID NO: 182296 - protein, 16 aa, Borrelia burgdorferi
IAAAIALRGMAKDGKF

SEQ ID NO: 182297 - protein, 16 aa, Borrelia burgdorferi
AAAIALRGMAKDGKFA

SEQ ID NO: 182298 - protein, 16 aa, Borrelia burgdorferi
AAIALRGMAKDGKFAV

SEQ ID NO: 182299 - protein, 16 aa, Borrelia burgdorferi
AIALRGMAKDGKFAVK

SEQ ID NO: 182300 - protein, 16 aa, Borrelia burgdorferi
IALRGMAKDGKFAVKS

SEQ ID NO: 182301 - protein, 16 aa, Borrelia burgdorferi
ALRGMAKDGKFAVKSG

SEQ ID NO: 182302 - protein, 16 aa, Borrelia burgdorferi
LRGMAKDGKFAVKSGE

SEQ ID NO: 182303 - protein, 16 aa, Borrelia burgdorferi
RGMAKDGKFAVKSGEK

SEQ ID NO: 182304 - protein, 16 aa, Borrelia burgdorferi
GMAKDGKFAVKSGEKE

SEQ ID NO: 182305 - protein, 16 aa, Borrelia burgdorferi
MAKDGKFAVKSGEKEK

SEQ ID NO: 182306 - protein, 16 aa, Borrelia burgdorferi
AKDGKFAVKSGEKEKA

SEQ ID NO: 182307 - protein, 303 aa, Borrelia garinii
MKKISSAIFLLAFFVFTNCKNNAELAEAEAKNQSAKDFYHAIIKLGYGFVDVFNAIGGLVSDVFYKADPKKSDVKNYFDSIASILKETQTKLDALSKEQGGGDGGTQVVDAAKKAGEWIKEMHKAVEDTAKAGGEGGSESIANVAAGGGGNDGAGAKADVNSVTGIAKGMKAIVDAAGKAGVELKPAAAGGAAANDAGKLFASGANANAAANADDAEGAAEAAGKAVSAVSGDQILKAIVDAAGATAGKKANEATNAVEAAIGDDNAGQAGAAFAAGMQNKNDQIAAAIVLRGLAKSGKFANE

SEQ ID NO: 182308 - protein, 8 aa, Borrelia garinii
MKKISSAI

SEQ ID NO: 182309 - protein, 8 aa, Borrelia garinii
KKISSAIF

SEQ ID NO: 182310 - protein, 8 aa, Borrelia garinii
KISSAIFL

SEQ ID NO: 182311 - protein, 8 aa, Borrelia garinii
ISSAIFLL

SEQ ID NO: 182312 - protein, 8 aa, Borrelia garinii
SSAIFLLA

SEQ ID NO: 182313 - protein, 8 aa, Borrelia garinii
SAIFLLAF

SEQ ID NO: 182314 - protein, 8 aa, Borrelia garinii
AIFLLAFF

SEQ ID NO: 182315 - protein, 8 aa, Borrelia garinii
IFLLAFFV

SEQ ID NO: 182316 - protein, 8 aa, Borrelia garinii
FLLAFFVF

SEQ ID NO: 182317 - protein, 8 aa, Borrelia garinii
LLAFFVFT

SEQ ID NO: 182318 - protein, 8 aa, Borrelia garinii
LAFFVFTN

SEQ ID NO: 182319 - protein, 8 aa, Borrelia garinii
AFFVFTNC

SEQ ID NO: 182320 - protein, 8 aa, Borrelia garinii
FFVFTNCK

SEQ ID NO: 182321 - protein, 8 aa, Borrelia garinii
FVFTNCKN

SEQ ID NO: 182322 - protein, 8 aa, Borrelia garinii
VFTNCKNN

SEQ ID NO: 182323 - protein, 8 aa, Borrelia garinii
FTNCKNNA

SEQ ID NO: 182324 - protein, 8 aa, Borrelia garinii
TNCKNNAE

SEQ ID NO: 182325 - protein, 8 aa, Borrelia garinii
NCKNNAEL

SEQ ID NO: 182326 - protein, 8 aa, Borrelia garinii
CKNNAELA

SEQ ID NO: 182327 - protein, 8 aa, Borrelia garinii
KNNAELAE

SEQ ID NO: 182328 - protein, 8 aa, Borrelia garinii
NNAELAEA

SEQ ID NO: 182329 - protein, 8 aa, Borrelia garinii
NAELAEAE

SEQ ID NO: 182330 - protein, 8 aa, Borrelia garinii
AELAEAEA

SEQ ID NO: 182331 - protein, 8 aa, Borrelia garinii
ELAEAEAK

SEQ ID NO: 182332 - protein, 8 aa, Borrelia garinii
LAEAEAKN

SEQ ID NO: 182333 - protein, 8 aa, Borrelia garinii
AEAEAKNQ

SEQ ID NO: 182334 - protein, 8 aa, Borrelia garinii
EAEAKNQS

SEQ ID NO: 182335 - protein, 8 aa, Borrelia garinii
AEAKNQSA

SEQ ID NO: 182336 - protein, 8 aa, Borrelia garinii
EAKNQSAK

SEQ ID NO: 182337 - protein, 8 aa, Borrelia garinii
AKNQSAKD

SEQ ID NO: 182338 - protein, 8 aa, Borrelia garinii
KNQSAKDF

SEQ ID NO: 182339 - protein, 8 aa, Borrelia garinii
NQSAKDFY

SEQ ID NO: 182340 - protein, 8 aa, Borrelia garinii
QSAKDFYH

SEQ ID NO: 182341 - protein, 8 aa, Borrelia garinii
SAKDFYHA

SEQ ID NO: 182342 - protein, 8 aa, Borrelia garinii
AKDFYHAI

SEQ ID NO: 182343 - protein, 8 aa, Borrelia garinii
KDFYHAII

SEQ ID NO: 182344 - protein, 8 aa, Borrelia garinii
DFYHAIIK

SEQ ID NO: 182345 - protein, 8 aa, Borrelia garinii
FYHAIIKL

SEQ ID NO: 182346 - protein, 8 aa, Borrelia garinii
YHAIIKLG

SEQ ID NO: 182347 - protein, 8 aa, Borrelia garinii
HAIIKLGY

SEQ ID NO: 182348 - protein, 8 aa, Borrelia garinii
AIIKLGYG

SEQ ID NO: 182349 - protein, 8 aa, Borrelia garinii
IIKLGYGF

SEQ ID NO: 182350 - protein, 8 aa, Borrelia garinii
IKLGYGFV

SEQ ID NO: 182351 - protein, 8 aa, Borrelia garinii
KLGYGFVD

SEQ ID NO: 182352 - protein, 8 aa, Borrelia garinii
LGYGFVDV

SEQ ID NO: 182353 - protein, 8 aa, Borrelia garinii
GYGFVDVF

SEQ ID NO: 182354 - protein, 8 aa, Borrelia garinii
YGFVDVFN

SEQ ID NO: 182355 - protein, 8 aa, Borrelia garinii
GFVDVFNA

SEQ ID NO: 182356 - protein, 8 aa, Borrelia garinii
FVDVFNAI

SEQ ID NO: 182357 - protein, 8 aa, Borrelia garinii
VDVFNAIG

SEQ ID NO: 182358 - protein, 8 aa, Borrelia garinii
DVFNAIGG

SEQ ID NO: 182359 - protein, 8 aa, Borrelia garinii
VFNAIGGL

SEQ ID NO: 182360 - protein, 8 aa, Borrelia garinii
FNAIGGLV

SEQ ID NO: 182361 - protein, 8 aa, Borrelia garinii
NAIGGLVS

SEQ ID NO: 182362 - protein, 8 aa, Borrelia garinii
AIGGLVSD

SEQ ID NO: 182363 - protein, 8 aa, Borrelia garinii
IGGLVSDV

SEQ ID NO: 182364 - protein, 8 aa, Borrelia garinii
GGLVSDVF

SEQ ID NO: 182365 - protein, 8 aa, Borrelia garinii
GLVSDVFY

SEQ ID NO: 182366 - protein, 8 aa, Borrelia garinii
LVSDVFYK

SEQ ID NO: 182367 - protein, 8 aa, Borrelia garinii
VSDVFYKA

SEQ ID NO: 182368 - protein, 8 aa, Borrelia garinii
SDVFYKAD

SEQ ID NO: 182369 - protein, 8 aa, Borrelia garinii
DVFYKADP

SEQ ID NO: 182370 - protein, 8 aa, Borrelia garinii
VFYKADPK

SEQ ID NO: 182371 - protein, 8 aa, Borrelia garinii
FYKADPKK

SEQ ID NO: 182372 - protein, 8 aa, Borrelia garinii
YKADPKKS

SEQ ID NO: 182373 - protein, 8 aa, Borrelia garinii
KADPKKSD

SEQ ID NO: 182374 - protein, 8 aa, Borrelia garinii
ADPKKSDV

SEQ ID NO: 182375 - protein, 8 aa, Borrelia garinii
DPKKSDVK

SEQ ID NO: 182376 - protein, 8 aa, Borrelia garinii
PKKSDVKN

SEQ ID NO: 182377 - protein, 8 aa, Borrelia garinii
KKSDVKNY

SEQ ID NO: 182378 - protein, 8 aa, Borrelia garinii
KSDVKNYF

SEQ ID NO: 182379 - protein, 8 aa, Borrelia garinii
SDVKNYFD

SEQ ID NO: 182380 - protein, 8 aa, Borrelia garinii
DVKNYFDS

SEQ ID NO: 182381 - protein, 8 aa, Borrelia garinii
VKNYFDSI

SEQ ID NO: 182382 - protein, 8 aa, Borrelia garinii
KNYFDSIA

SEQ ID NO: 182383 - protein, 8 aa, Borrelia garinii
NYFDSIAS

SEQ ID NO: 182384 - protein, 8 aa, Borrelia garinii
YFDSIASI

SEQ ID NO: 182385 - protein, 8 aa, Borrelia garinii
FDSIASIL

SEQ ID NO: 182386 - protein, 8 aa, Borrelia garinii
DSIASILK

SEQ ID NO: 182387 - protein, 8 aa, Borrelia garinii
SIASILKE

SEQ ID NO: 182388 - protein, 8 aa, Borrelia garinii
IASILKET

SEQ ID NO: 182389 - protein, 8 aa, Borrelia garinii
ASILKETQ

SEQ ID NO: 182390 - protein, 8 aa, Borrelia garinii
SILKETQT

SEQ ID NO: 182391 - protein, 8 aa, Borrelia garinii
ILKETQTK

SEQ ID NO: 182392 - protein, 8 aa, Borrelia garinii
LKETQTKL

SEQ ID NO: 182393 - protein, 8 aa, Borrelia garinii
KETQTKLD

SEQ ID NO: 182394 - protein, 8 aa, Borrelia garinii
ETQTKLDA

SEQ ID NO: 182395 - protein, 8 aa, Borrelia garinii
TQTKLDAL

SEQ ID NO: 182396 - protein, 8 aa, Borrelia garinii
QTKLDALS

SEQ ID NO: 182397 - protein, 8 aa, Borrelia garinii
TKLDALSK

SEQ ID NO: 182398 - protein, 8 aa, Borrelia garinii
KLDALSKE

SEQ ID NO: 182399 - protein, 8 aa, Borrelia garinii
LDALSKEQ

SEQ ID NO: 182400 - protein, 8 aa, Borrelia garinii
DALSKEQG

SEQ ID NO: 182401 - protein, 8 aa, Borrelia garinii
ALSKEQGG

SEQ ID NO: 182402 - protein, 8 aa, Borrelia garinii
LSKEQGGG

SEQ ID NO: 182403 - protein, 8 aa, Borrelia garinii
SKEQGGGD

SEQ ID NO: 182404 - protein, 8 aa, Borrelia garinii
KEQGGGDG

SEQ ID NO: 182405 - protein, 8 aa, Borrelia garinii
EQGGGDGG

SEQ ID NO: 182406 - protein, 8 aa, Borrelia garinii
QGGGDGGT

SEQ ID NO: 182407 - protein, 8 aa, Borrelia garinii
GGGDGGTQ

SEQ ID NO: 182408 - protein, 8 aa, Borrelia garinii
GGDGGTQV

SEQ ID NO: 182409 - protein, 8 aa, Borrelia garinii
GDGGTQVV

SEQ ID NO: 182410 - protein, 8 aa, Borrelia garinii
DGGTQVVD

SEQ ID NO: 182411 - protein, 8 aa, Borrelia garinii
GGTQVVDA

SEQ ID NO: 182412 - protein, 8 aa, Borrelia garinii
GTQVVDAA

SEQ ID NO: 182413 - protein, 8 aa, Borrelia garinii
TQVVDAAK

SEQ ID NO: 182414 - protein, 8 aa, Borrelia garinii
QVVDAAKK

SEQ ID NO: 182415 - protein, 8 aa, Borrelia garinii
VVDAAKKA

SEQ ID NO: 182416 - protein, 8 aa, Borrelia garinii
VDAAKKAG

SEQ ID NO: 182417 - protein, 8 aa, Borrelia garinii
DAAKKAGE

SEQ ID NO: 182418 - protein, 8 aa, Borrelia garinii
AAKKAGEW

SEQ ID NO: 182419 - protein, 8 aa, Borrelia garinii
AKKAGEWI

SEQ ID NO: 182420 - protein, 8 aa, Borrelia garinii
KKAGEWIK

SEQ ID NO: 182421 - protein, 8 aa, Borrelia garinii
KAGEWIKE

SEQ ID NO: 182422 - protein, 8 aa, Borrelia garinii
AGEWIKEM

SEQ ID NO: 182423 - protein, 8 aa, Borrelia garinii
GEWIKEMH

SEQ ID NO: 182424 - protein, 8 aa, Borrelia garinii
EWIKEMHK

SEQ ID NO: 182425 - protein, 8 aa, Borrelia garinii
WIKEMHKA

SEQ ID NO: 182426 - protein, 8 aa, Borrelia garinii
IKEMHKAV

SEQ ID NO: 182427 - protein, 8 aa, Borrelia garinii
KEMHKAVE

SEQ ID NO: 182428 - protein, 8 aa, Borrelia garinii
EMHKAVED

SEQ ID NO: 182429 - protein, 8 aa, Borrelia garinii
MHKAVEDT

SEQ ID NO: 182430 - protein, 8 aa, Borrelia garinii
HKAVEDTA

SEQ ID NO: 182431 - protein, 8 aa, Borrelia garinii
KAVEDTAK

SEQ ID NO: 182432 - protein, 8 aa, Borrelia garinii
AVEDTAKA

SEQ ID NO: 182433 - protein, 8 aa, Borrelia garinii
VEDTAKAG

SEQ ID NO: 182434 - protein, 8 aa, Borrelia garinii
EDTAKAGG

SEQ ID NO: 182435 - protein, 8 aa, Borrelia garinii
DTAKAGGE

SEQ ID NO: 182436 - protein, 8 aa, Borrelia garinii
TAKAGGEG

SEQ ID NO: 182437 - protein, 8 aa, Borrelia garinii
AKAGGEGG

SEQ ID NO: 182438 - protein, 8 aa, Borrelia garinii
KAGGEGGS

SEQ ID NO: 182439 - protein, 8 aa, Borrelia garinii
AGGEGGSE

SEQ ID NO: 182440 - protein, 8 aa, Borrelia garinii
GGEGGSES

SEQ ID NO: 182441 - protein, 8 aa, Borrelia garinii
GEGGSESI

SEQ ID NO: 182442 - protein, 8 aa, Borrelia garinii
EGGSESIA

SEQ ID NO: 182443 - protein, 8 aa, Borrelia garinii
GGSESIAN

SEQ ID NO: 182444 - protein, 8 aa, Borrelia garinii
GSESIANV

SEQ ID NO: 182445 - protein, 8 aa, Borrelia garinii
SESIANVA

SEQ ID NO: 182446 - protein, 8 aa, Borrelia garinii
ESIANVAA

SEQ ID NO: 182447 - protein, 8 aa, Borrelia garinii
SIANVAAG

SEQ ID NO: 182448 - protein, 8 aa, Borrelia garinii
IANVAAGG

SEQ ID NO: 182449 - protein, 8 aa, Borrelia garinii
ANVAAGGG

SEQ ID NO: 182450 - protein, 8 aa, Borrelia garinii
NVAAGGGG

SEQ ID NO: 182451 - protein, 8 aa, Borrelia garinii
VAAGGGGN

SEQ ID NO: 182452 - protein, 8 aa, Borrelia garinii
AAGGGGND

SEQ ID NO: 182453 - protein, 8 aa, Borrelia garinii
AGGGGNDG

SEQ ID NO: 182454 - protein, 8 aa, Borrelia garinii
GGGGNDGA

SEQ ID NO: 182455 - protein, 8 aa, Borrelia garinii
GGGNDGAG

SEQ ID NO: 182456 - protein, 8 aa, Borrelia garinii
GGNDGAGA

SEQ ID NO: 182457 - protein, 8 aa, Borrelia garinii
GNDGAGAK

SEQ ID NO: 182458 - protein, 8 aa, Borrelia garinii
NDGAGAKA

SEQ ID NO: 182459 - protein, 8 aa, Borrelia garinii
DGAGAKAD

SEQ ID NO: 182460 - protein, 8 aa, Borrelia garinii
GAGAKADV

SEQ ID NO: 182461 - protein, 8 aa, Borrelia garinii
AGAKADVN

SEQ ID NO: 182462 - protein, 8 aa, Borrelia garinii
GAKADVNS

SEQ ID NO: 182463 - protein, 8 aa, Borrelia garinii
AKADVNSV

SEQ ID NO: 182464 - protein, 8 aa, Borrelia garinii
KADVNSVT

SEQ ID NO: 182465 - protein, 8 aa, Borrelia garinii
ADVNSVTG

SEQ ID NO: 182466 - protein, 8 aa, Borrelia garinii
DVNSVTGI

SEQ ID NO: 182467 - protein, 8 aa, Borrelia garinii
VNSVTGIA

SEQ ID NO: 182468 - protein, 8 aa, Borrelia garinii
NSVTGIAK

SEQ ID NO: 182469 - protein, 8 aa, Borrelia garinii
SVTGIAKG

SEQ ID NO: 182470 - protein, 8 aa, Borrelia garinii
VTGIAKGM

SEQ ID NO: 182471 - protein, 8 aa, Borrelia garinii
TGIAKGMK

SEQ ID NO: 182472 - protein, 8 aa, Borrelia garinii
GIAKGMKA

SEQ ID NO: 182473 - protein, 8 aa, Borrelia garinii
IAKGMKAI

SEQ ID NO: 182474 - protein, 8 aa, Borrelia garinii
AKGMKAIV

SEQ ID NO: 182475 - protein, 8 aa, Borrelia garinii
KGMKAIVD

SEQ ID NO: 182476 - protein, 8 aa, Borrelia garinii
GMKAIVDA

SEQ ID NO: 182477 - protein, 8 aa, Borrelia garinii
MKAIVDAA

SEQ ID NO: 182478 - protein, 8 aa, Borrelia garinii
KAIVDAAG

SEQ ID NO: 182479 - protein, 8 aa, Borrelia garinii
AIVDAAGK

SEQ ID NO: 182480 - protein, 8 aa, Borrelia garinii
IVDAAGKA

SEQ ID NO: 182481 - protein, 8 aa, Borrelia garinii
VDAAGKAG

SEQ ID NO: 182482 - protein, 8 aa, Borrelia garinii
DAAGKAGV

SEQ ID NO: 182483 - protein, 8 aa, Borrelia garinii
AAGKAGVE

SEQ ID NO: 182484 - protein, 8 aa, Borrelia garinii
AGKAGVEL

SEQ ID NO: 182485 - protein, 8 aa, Borrelia garinii
GKAGVELK

SEQ ID NO: 182486 - protein, 8 aa, Borrelia garinii
KAGVELKP

SEQ ID NO: 182487 - protein, 8 aa, Borrelia garinii
AGVELKPA

SEQ ID NO: 182488 - protein, 8 aa, Borrelia garinii
GVELKPAA

SEQ ID NO: 182489 - protein, 8 aa, Borrelia garinii
VELKPAAA

SEQ ID NO: 182490 - protein, 8 aa, Borrelia garinii
ELKPAAAG

SEQ ID NO: 182491 - protein, 8 aa, Borrelia garinii
LKPAAAGG

SEQ ID NO: 182492 - protein, 8 aa, Borrelia garinii
KPAAAGGA

SEQ ID NO: 182493 - protein, 8 aa, Borrelia garinii
PAAAGGAA

SEQ ID NO: 182494 - protein, 8 aa, Borrelia garinii
AAAGGAAA

SEQ ID NO: 182495 - protein, 8 aa, Borrelia garinii
AAGGAAAN

SEQ ID NO: 182496 - protein, 8 aa, Borrelia garinii
AGGAAAND

SEQ ID NO: 182497 - protein, 8 aa, Borrelia garinii
GGAAANDA

SEQ ID NO: 182498 - protein, 8 aa, Borrelia garinii
GAAANDAG

SEQ ID NO: 182499 - protein, 8 aa, Borrelia garinii
AAANDAGK

SEQ ID NO: 182500 - protein, 8 aa, Borrelia garinii
AANDAGKL

SEQ ID NO: 182501 - protein, 8 aa, Borrelia garinii
ANDAGKLF

SEQ ID NO: 182502 - protein, 8 aa, Borrelia garinii
NDAGKLFA

SEQ ID NO: 182503 - protein, 8 aa, Borrelia garinii
DAGKLFAS

SEQ ID NO: 182504 - protein, 8 aa, Borrelia garinii
AGKLFASG

SEQ ID NO: 182505 - protein, 8 aa, Borrelia garinii
GKLFASGA

SEQ ID NO: 182506 - protein, 8 aa, Borrelia garinii
KLFASGAN

SEQ ID NO: 182507 - protein, 8 aa, Borrelia garinii
LFASGANA

SEQ ID NO: 182508 - protein, 8 aa, Borrelia garinii
FASGANAN

SEQ ID NO: 182509 - protein, 8 aa, Borrelia garinii
ASGANANA

SEQ ID NO: 182510 - protein, 8 aa, Borrelia garinii
SGANANAA

SEQ ID NO: 182511 - protein, 8 aa, Borrelia garinii
GANANAAA

SEQ ID NO: 182512 - protein, 8 aa, Borrelia garinii
ANANAAAN

SEQ ID NO: 182513 - protein, 8 aa, Borrelia garinii
NANAAANA

SEQ ID NO: 182514 - protein, 8 aa, Borrelia garinii
ANAAANAD

SEQ ID NO: 182515 - protein, 8 aa, Borrelia garinii
NAAANADD

SEQ ID NO: 182516 - protein, 8 aa, Borrelia garinii
AAANADDA

SEQ ID NO: 182517 - protein, 8 aa, Borrelia garinii
AANADDAE

SEQ ID NO: 182518 - protein, 8 aa, Borrelia garinii
ANADDAEG

SEQ ID NO: 182519 - protein, 8 aa, Borrelia garinii
NADDAEGA

SEQ ID NO: 182520 - protein, 8 aa, Borrelia garinii
ADDAEGAA

SEQ ID NO: 182521 - protein, 8 aa, Borrelia garinii
DDAEGAAE

SEQ ID NO: 182522 - protein, 8 aa, Borrelia garinii
DAEGAAEA

SEQ ID NO: 182523 - protein, 8 aa, Borrelia garinii
AEGAAEAA

SEQ ID NO: 182524 - protein, 8 aa, Borrelia garinii
EGAAEAAG

SEQ ID NO: 182525 - protein, 8 aa, Borrelia garinii
GAAEAAGK

SEQ ID NO: 182526 - protein, 8 aa, Borrelia garinii
AAEAAGKA

SEQ ID NO: 182527 - protein, 8 aa, Borrelia garinii
AEAAGKAV

SEQ ID NO: 182528 - protein, 8 aa, Borrelia garinii
EAAGKAVS

SEQ ID NO: 182529 - protein, 8 aa, Borrelia garinii
AAGKAVSA

SEQ ID NO: 182530 - protein, 8 aa, Borrelia garinii
AGKAVSAV

SEQ ID NO: 182531 - protein, 8 aa, Borrelia garinii
GKAVSAVS

SEQ ID NO: 182532 - protein, 8 aa, Borrelia garinii
KAVSAVSG

SEQ ID NO: 182533 - protein, 8 aa, Borrelia garinii
AVSAVSGD

SEQ ID NO: 182534 - protein, 8 aa, Borrelia garinii
VSAVSGDQ

SEQ ID NO: 182535 - protein, 8 aa, Borrelia garinii
SAVSGDQI

SEQ ID NO: 182536 - protein, 8 aa, Borrelia garinii
AVSGDQIL

SEQ ID NO: 182537 - protein, 8 aa, Borrelia garinii
VSGDQILK

SEQ ID NO: 182538 - protein, 8 aa, Borrelia garinii
SGDQILKA

SEQ ID NO: 182539 - protein, 8 aa, Borrelia garinii
GDQILKAI

SEQ ID NO: 182540 - protein, 8 aa, Borrelia garinii
DQILKAIV

SEQ ID NO: 182541 - protein, 8 aa, Borrelia garinii
QILKAIVD

SEQ ID NO: 182542 - protein, 8 aa, Borrelia garinii
ILKAIVDA

SEQ ID NO: 182543 - protein, 8 aa, Borrelia garinii
LKAIVDAA

SEQ ID NO: 182544 - protein, 8 aa, Borrelia garinii
KAIVDAAG

SEQ ID NO: 182545 - protein, 8 aa, Borrelia garinii
AIVDAAGA

SEQ ID NO: 182546 - protein, 8 aa, Borrelia garinii
IVDAAGAT

SEQ ID NO: 182547 - protein, 8 aa, Borrelia garinii
VDAAGATA

SEQ ID NO: 182548 - protein, 8 aa, Borrelia garinii
DAAGATAG

SEQ ID NO: 182549 - protein, 8 aa, Borrelia garinii
AAGATAGK

SEQ ID NO: 182550 - protein, 8 aa, Borrelia garinii
AGATAGKK

SEQ ID NO: 182551 - protein, 8 aa, Borrelia garinii
GATAGKKA

SEQ ID NO: 182552 - protein, 8 aa, Borrelia garinii
ATAGKKAN

SEQ ID NO: 182553 - protein, 8 aa, Borrelia garinii
TAGKKANE

SEQ ID NO: 182554 - protein, 8 aa, Borrelia garinii
AGKKANEA

SEQ ID NO: 182555 - protein, 8 aa, Borrelia garinii
GKKANEAT

SEQ ID NO: 182556 - protein, 8 aa, Borrelia garinii
KKANEATN

SEQ ID NO: 182557 - protein, 8 aa, Borrelia garinii
KANEATNA

SEQ ID NO: 182558 - protein, 8 aa, Borrelia garinii
ANEATNAV

SEQ ID NO: 182559 - protein, 8 aa, Borrelia garinii
NEATNAVE

SEQ ID NO: 182560 - protein, 8 aa, Borrelia garinii
EATNAVEA

SEQ ID NO: 182561 - protein, 8 aa, Borrelia garinii
ATNAVEAA

SEQ ID NO: 182562 - protein, 8 aa, Borrelia garinii
TNAVEAAI

SEQ ID NO: 182563 - protein, 8 aa, Borrelia garinii
NAVEAAIG

SEQ ID NO: 182564 - protein, 8 aa, Borrelia garinii
AVEAAIGD

SEQ ID NO: 182565 - protein, 8 aa, Borrelia garinii
VEAAIGDD

SEQ ID NO: 182566 - protein, 8 aa, Borrelia garinii
EAAIGDDN

SEQ ID NO: 182567 - protein, 8 aa, Borrelia garinii
AAIGDDNA

SEQ ID NO: 182568 - protein, 8 aa, Borrelia garinii
AIGDDNAG

SEQ ID NO: 182569 - protein, 8 aa, Borrelia garinii
IGDDNAGQ

SEQ ID NO: 182570 - protein, 8 aa, Borrelia garinii
GDDNAGQA

SEQ ID NO: 182571 - protein, 8 aa, Borrelia garinii
DDNAGQAG

SEQ ID NO: 182572 - protein, 8 aa, Borrelia garinii
DNAGQAGA

SEQ ID NO: 182573 - protein, 8 aa, Borrelia garinii
NAGQAGAA

SEQ ID NO: 182574 - protein, 8 aa, Borrelia garinii
AGQAGAAF

SEQ ID NO: 182575 - protein, 8 aa, Borrelia garinii
GQAGAAFA

SEQ ID NO: 182576 - protein, 8 aa, Borrelia garinii
QAGAAFAA

SEQ ID NO: 182577 - protein, 8 aa, Borrelia garinii
AGAAFAAG

SEQ ID NO: 182578 - protein, 8 aa, Borrelia garinii
GAAFAAGM

SEQ ID NO: 182579 - protein, 8 aa, Borrelia garinii
AAFAAGMQ

SEQ ID NO: 182580 - protein, 8 aa, Borrelia garinii
AFAAGMQN

SEQ ID NO: 182581 - protein, 8 aa, Borrelia garinii
FAAGMQNK

SEQ ID NO: 182582 - protein, 8 aa, Borrelia garinii
AAGMQNKN

SEQ ID NO: 182583 - protein, 8 aa, Borrelia garinii
AGMQNKND

SEQ ID NO: 182584 - protein, 8 aa, Borrelia garinii
GMQNKNDQ

SEQ ID NO: 182585 - protein, 8 aa, Borrelia garinii
MQNKNDQI

SEQ ID NO: 182586 - protein, 8 aa, Borrelia garinii
QNKNDQIA

SEQ ID NO: 182587 - protein, 8 aa, Borrelia garinii
NKNDQIAA

SEQ ID NO: 182588 - protein, 8 aa, Borrelia garinii
KNDQIAAA

SEQ ID NO: 182589 - protein, 8 aa, Borrelia garinii
NDQIAAAI

SEQ ID NO: 182590 - protein, 8 aa, Borrelia garinii
DQIAAAIV

SEQ ID NO: 182591 - protein, 8 aa, Borrelia garinii
QIAAAIVL

SEQ ID NO: 182592 - protein, 8 aa, Borrelia garinii
IAAAIVLR

SEQ ID NO: 182593 - protein, 8 aa, Borrelia garinii
AAAIVLRG

SEQ ID NO: 182594 - protein, 8 aa, Borrelia garinii
AAIVLRGL

SEQ ID NO: 182595 - protein, 8 aa, Borrelia garinii
AIVLRGLA

SEQ ID NO: 182596 - protein, 8 aa, Borrelia garinii
IVLRGLAK

SEQ ID NO: 182597 - protein, 8 aa, Borrelia garinii
VLRGLAKS

SEQ ID NO: 182598 - protein, 8 aa, Borrelia garinii
LRGLAKSG

SEQ ID NO: 182599 - protein, 8 aa, Borrelia garinii
RGLAKSGK

SEQ ID NO: 182600 - protein, 8 aa, Borrelia garinii
GLAKSGKF

SEQ ID NO: 182601 - protein, 8 aa, Borrelia garinii
LAKSGKFA

SEQ ID NO: 182602 - protein, 8 aa, Borrelia garinii
AKSGKFAN

SEQ ID NO: 182603 - protein, 8 aa, Borrelia garinii
KSGKFANE

SEQ ID NO: 182604 - protein, 9 aa, Borrelia garinii
MKKISSAIF

SEQ ID NO: 182605 - protein, 9 aa, Borrelia garinii
KKISSAIFL

SEQ ID NO: 182606 - protein, 9 aa, Borrelia garinii
KISSAIFLL

SEQ ID NO: 182607 - protein, 9 aa, Borrelia garinii
ISSAIFLLA

SEQ ID NO: 182608 - protein, 9 aa, Borrelia garinii
SSAIFLLAF

SEQ ID NO: 182609 - protein, 9 aa, Borrelia garinii
SAIFLLAFF

SEQ ID NO: 182610 - protein, 9 aa, Borrelia garinii
AIFLLAFFV

SEQ ID NO: 182611 - protein, 9 aa, Borrelia garinii
IFLLAFFVF

SEQ ID NO: 182612 - protein, 9 aa, Borrelia garinii
FLLAFFVFT

SEQ ID NO: 182613 - protein, 9 aa, Borrelia garinii
LLAFFVFTN

SEQ ID NO: 182614 - protein, 9 aa, Borrelia garinii
LAFFVFTNC

SEQ ID NO: 182615 - protein, 9 aa, Borrelia garinii
AFFVFTNCK

SEQ ID NO: 182616 - protein, 9 aa, Borrelia garinii
FFVFTNCKN

SEQ ID NO: 182617 - protein, 9 aa, Borrelia garinii
FVFTNCKNN

SEQ ID NO: 182618 - protein, 9 aa, Borrelia garinii
VFTNCKNNA

SEQ ID NO: 182619 - protein, 9 aa, Borrelia garinii
FTNCKNNAE

SEQ ID NO: 182620 - protein, 9 aa, Borrelia garinii
TNCKNNAEL

SEQ ID NO: 182621 - protein, 9 aa, Borrelia garinii
NCKNNAELA

SEQ ID NO: 182622 - protein, 9 aa, Borrelia garinii
CKNNAELAE

SEQ ID NO: 182623 - protein, 9 aa, Borrelia garinii
KNNAELAEA

SEQ ID NO: 182624 - protein, 9 aa, Borrelia garinii
NNAELAEAE

SEQ ID NO: 182625 - protein, 9 aa, Borrelia garinii
NAELAEAEA

SEQ ID NO: 182626 - protein, 9 aa, Borrelia garinii
AELAEAEAK

SEQ ID NO: 182627 - protein, 9 aa, Borrelia garinii
ELAEAEAKN

SEQ ID NO: 182628 - protein, 9 aa, Borrelia garinii
LAEAEAKNQ

SEQ ID NO: 182629 - protein, 9 aa, Borrelia garinii
AEAEAKNQS

SEQ ID NO: 182630 - protein, 9 aa, Borrelia garinii
EAEAKNQSA

SEQ ID NO: 182631 - protein, 9 aa, Borrelia garinii
AEAKNQSAK

SEQ ID NO: 182632 - protein, 9 aa, Borrelia garinii
EAKNQSAKD

SEQ ID NO: 182633 - protein, 9 aa, Borrelia garinii
AKNQSAKDF

SEQ ID NO: 182634 - protein, 9 aa, Borrelia garinii
KNQSAKDFY

SEQ ID NO: 182635 - protein, 9 aa, Borrelia garinii
NQSAKDFYH

SEQ ID NO: 182636 - protein, 9 aa, Borrelia garinii
QSAKDFYHA

SEQ ID NO: 182637 - protein, 9 aa, Borrelia garinii
SAKDFYHAI

SEQ ID NO: 182638 - protein, 9 aa, Borrelia garinii
AKDFYHAII

SEQ ID NO: 182639 - protein, 9 aa, Borrelia garinii
KDFYHAIIK

SEQ ID NO: 182640 - protein, 9 aa, Borrelia garinii
DFYHAIIKL

SEQ ID NO: 182641 - protein, 9 aa, Borrelia garinii
FYHAIIKLG

SEQ ID NO: 182642 - protein, 9 aa, Borrelia garinii
YHAIIKLGY

SEQ ID NO: 182643 - protein, 9 aa, Borrelia garinii
HAIIKLGYG

SEQ ID NO: 182644 - protein, 9 aa, Borrelia garinii
AIIKLGYGF

SEQ ID NO: 182645 - protein, 9 aa, Borrelia garinii
IIKLGYGFV

SEQ ID NO: 182646 - protein, 9 aa, Borrelia garinii
IKLGYGFVD

SEQ ID NO: 182647 - protein, 9 aa, Borrelia garinii
KLGYGFVDV

SEQ ID NO: 182648 - protein, 9 aa, Borrelia garinii
LGYGFVDVF

SEQ ID NO: 182649 - protein, 9 aa, Borrelia garinii
GYGFVDVFN

SEQ ID NO: 182650 - protein, 9 aa, Borrelia garinii
YGFVDVFNA

SEQ ID NO: 182651 - protein, 9 aa, Borrelia garinii
GFVDVFNAI

SEQ ID NO: 182652 - protein, 9 aa, Borrelia garinii
FVDVFNAIG

SEQ ID NO: 182653 - protein, 9 aa, Borrelia garinii
VDVFNAIGG

SEQ ID NO: 182654 - protein, 9 aa, Borrelia garinii
DVFNAIGGL

SEQ ID NO: 182655 - protein, 9 aa, Borrelia garinii
VFNAIGGLV

SEQ ID NO: 182656 - protein, 9 aa, Borrelia garinii
FNAIGGLVS

SEQ ID NO: 182657 - protein, 9 aa, Borrelia garinii
NAIGGLVSD

SEQ ID NO: 182658 - protein, 9 aa, Borrelia garinii
AIGGLVSDV

SEQ ID NO: 182659 - protein, 9 aa, Borrelia garinii
IGGLVSDVF

SEQ ID NO: 182660 - protein, 9 aa, Borrelia garinii
GGLVSDVFY

SEQ ID NO: 182661 - protein, 9 aa, Borrelia garinii
GLVSDVFYK

SEQ ID NO: 182662 - protein, 9 aa, Borrelia garinii
LVSDVFYKA

SEQ ID NO: 182663 - protein, 9 aa, Borrelia garinii
VSDVFYKAD

SEQ ID NO: 182664 - protein, 9 aa, Borrelia garinii
SDVFYKADP

SEQ ID NO: 182665 - protein, 9 aa, Borrelia garinii
DVFYKADPK

SEQ ID NO: 182666 - protein, 9 aa, Borrelia garinii
VFYKADPKK

SEQ ID NO: 182667 - protein, 9 aa, Borrelia garinii
FYKADPKKS

SEQ ID NO: 182668 - protein, 9 aa, Borrelia garinii
YKADPKKSD

SEQ ID NO: 182669 - protein, 9 aa, Borrelia garinii
KADPKKSDV

SEQ ID NO: 182670 - protein, 9 aa, Borrelia garinii
ADPKKSDVK

SEQ ID NO: 182671 - protein, 9 aa, Borrelia garinii
DPKKSDVKN

SEQ ID NO: 182672 - protein, 9 aa, Borrelia garinii
PKKSDVKNY

SEQ ID NO: 182673 - protein, 9 aa, Borrelia garinii
KKSDVKNYF

SEQ ID NO: 182674 - protein, 9 aa, Borrelia garinii
KSDVKNYFD

SEQ ID NO: 182675 - protein, 9 aa, Borrelia garinii
SDVKNYFDS

SEQ ID NO: 182676 - protein, 9 aa, Borrelia garinii
DVKNYFDSI

SEQ ID NO: 182677 - protein, 9 aa, Borrelia garinii
VKNYFDSIA

SEQ ID NO: 182678 - protein, 9 aa, Borrelia garinii
KNYFDSIAS

SEQ ID NO: 182679 - protein, 9 aa, Borrelia garinii
NYFDSIASI

SEQ ID NO: 182680 - protein, 9 aa, Borrelia garinii
YFDSIASIL

SEQ ID NO: 182681 - protein, 9 aa, Borrelia garinii
FDSIASILK

SEQ ID NO: 182682 - protein, 9 aa, Borrelia garinii
DSIASILKE

SEQ ID NO: 182683 - protein, 9 aa, Borrelia garinii
SIASILKET

SEQ ID NO: 182684 - protein, 9 aa, Borrelia garinii
IASILKETQ

SEQ ID NO: 182685 - protein, 9 aa, Borrelia garinii
ASILKETQT

SEQ ID NO: 182686 - protein, 9 aa, Borrelia garinii
SILKETQTK

SEQ ID NO: 182687 - protein, 9 aa, Borrelia garinii
ILKETQTKL

SEQ ID NO: 182688 - protein, 9 aa, Borrelia garinii
LKETQTKLD

SEQ ID NO: 182689 - protein, 9 aa, Borrelia garinii
KETQTKLDA

SEQ ID NO: 182690 - protein, 9 aa, Borrelia garinii
ETQTKLDAL

SEQ ID NO: 182691 - protein, 9 aa, Borrelia garinii
TQTKLDALS

SEQ ID NO: 182692 - protein, 9 aa, Borrelia garinii
QTKLDALSK

SEQ ID NO: 182693 - protein, 9 aa, Borrelia garinii
TKLDALSKE

SEQ ID NO: 182694 - protein, 9 aa, Borrelia garinii
KLDALSKEQ

SEQ ID NO: 182695 - protein, 9 aa, Borrelia garinii
LDALSKEQG

SEQ ID NO: 182696 - protein, 9 aa, Borrelia garinii
DALSKEQGG

SEQ ID NO: 182697 - protein, 9 aa, Borrelia garinii
ALSKEQGGG

SEQ ID NO: 182698 - protein, 9 aa, Borrelia garinii
LSKEQGGGD

SEQ ID NO: 182699 - protein, 9 aa, Borrelia garinii
SKEQGGGDG

SEQ ID NO: 182700 - protein, 9 aa, Borrelia garinii
KEQGGGDGG

SEQ ID NO: 182701 - protein, 9 aa, Borrelia garinii
EQGGGDGGT

SEQ ID NO: 182702 - protein, 9 aa, Borrelia garinii
QGGGDGGTQ

SEQ ID NO: 182703 - protein, 9 aa, Borrelia garinii
GGGDGGTQV

SEQ ID NO: 182704 - protein, 9 aa, Borrelia garinii
GGDGGTQVV

SEQ ID NO: 182705 - protein, 9 aa, Borrelia garinii
GDGGTQVVD

SEQ ID NO: 182706 - protein, 9 aa, Borrelia garinii
DGGTQVVDA

SEQ ID NO: 182707 - protein, 9 aa, Borrelia garinii
GGTQVVDAA

SEQ ID NO: 182708 - protein, 9 aa, Borrelia garinii
GTQVVDAAK

SEQ ID NO: 182709 - protein, 9 aa, Borrelia garinii
TQVVDAAKK

SEQ ID NO: 182710 - protein, 9 aa, Borrelia garinii
QVVDAAKKA

SEQ ID NO: 182711 - protein, 9 aa, Borrelia garinii
VVDAAKKAG

SEQ ID NO: 182712 - protein, 9 aa, Borrelia garinii
VDAAKKAGE

SEQ ID NO: 182713 - protein, 9 aa, Borrelia garinii
DAAKKAGEW

SEQ ID NO: 182714 - protein, 9 aa, Borrelia garinii
AAKKAGEWI

SEQ ID NO: 182715 - protein, 9 aa, Borrelia garinii
AKKAGEWIK

SEQ ID NO: 182716 - protein, 9 aa, Borrelia garinii
KKAGEWIKE

SEQ ID NO: 182717 - protein, 9 aa, Borrelia garinii
KAGEWIKEM

SEQ ID NO: 182718 - protein, 9 aa, Borrelia garinii
AGEWIKEMH

SEQ ID NO: 182719 - protein, 9 aa, Borrelia garinii
GEWIKEMHK

SEQ ID NO: 182720 - protein, 9 aa, Borrelia garinii
EWIKEMHKA

SEQ ID NO: 182721 - protein, 9 aa, Borrelia garinii
WIKEMHKAV

SEQ ID NO: 182722 - protein, 9 aa, Borrelia garinii
IKEMHKAVE

SEQ ID NO: 182723 - protein, 9 aa, Borrelia garinii
KEMHKAVED

SEQ ID NO: 182724 - protein, 9 aa, Borrelia garinii
EMHKAVEDT

SEQ ID NO: 182725 - protein, 9 aa, Borrelia garinii
MHKAVEDTA

SEQ ID NO: 182726 - protein, 9 aa, Borrelia garinii
HKAVEDTAK

SEQ ID NO: 182727 - protein, 9 aa, Borrelia garinii
KAVEDTAKA

SEQ ID NO: 182728 - protein, 9 aa, Borrelia garinii
AVEDTAKAG

SEQ ID NO: 182729 - protein, 9 aa, Borrelia garinii
VEDTAKAGG

SEQ ID NO: 182730 - protein, 9 aa, Borrelia garinii
EDTAKAGGE

SEQ ID NO: 182731 - protein, 9 aa, Borrelia garinii
DTAKAGGEG

SEQ ID NO: 182732 - protein, 9 aa, Borrelia garinii
TAKAGGEGG

SEQ ID NO: 182733 - protein, 9 aa, Borrelia garinii
AKAGGEGGS

SEQ ID NO: 182734 - protein, 9 aa, Borrelia garinii
KAGGEGGSE

SEQ ID NO: 182735 - protein, 9 aa, Borrelia garinii
AGGEGGSES

SEQ ID NO: 182736 - protein, 9 aa, Borrelia garinii
GGEGGSESI

SEQ ID NO: 182737 - protein, 9 aa, Borrelia garinii
GEGGSESIA

SEQ ID NO: 182738 - protein, 9 aa, Borrelia garinii
EGGSESIAN

SEQ ID NO: 182739 - protein, 9 aa, Borrelia garinii
GGSESIANV

SEQ ID NO: 182740 - protein, 9 aa, Borrelia garinii
GSESIANVA

SEQ ID NO: 182741 - protein, 9 aa, Borrelia garinii
SESIANVAA

SEQ ID NO: 182742 - protein, 9 aa, Borrelia garinii
ESIANVAAG

SEQ ID NO: 182743 - protein, 9 aa, Borrelia garinii
SIANVAAGG

SEQ ID NO: 182744 - protein, 9 aa, Borrelia garinii
IANVAAGGG

SEQ ID NO: 182745 - protein, 9 aa, Borrelia garinii
ANVAAGGGG

SEQ ID NO: 182746 - protein, 9 aa, Borrelia garinii
NVAAGGGGN

SEQ ID NO: 182747 - protein, 9 aa, Borrelia garinii
VAAGGGGND

SEQ ID NO: 182748 - protein, 9 aa, Borrelia garinii
AAGGGGNDG

SEQ ID NO: 182749 - protein, 9 aa, Borrelia garinii
AGGGGNDGA

SEQ ID NO: 182750 - protein, 9 aa, Borrelia garinii
GGGGNDGAG

SEQ ID NO: 182751 - protein, 9 aa, Borrelia garinii
GGGNDGAGA

SEQ ID NO: 182752 - protein, 9 aa, Borrelia garinii
GGNDGAGAK

SEQ ID NO: 182753 - protein, 9 aa, Borrelia garinii
GNDGAGAKA

SEQ ID NO: 182754 - protein, 9 aa, Borrelia garinii
NDGAGAKAD

SEQ ID NO: 182755 - protein, 9 aa, Borrelia garinii
DGAGAKADV

SEQ ID NO: 182756 - protein, 9 aa, Borrelia garinii
GAGAKADVN

SEQ ID NO: 182757 - protein, 9 aa, Borrelia garinii
AGAKADVNS

SEQ ID NO: 182758 - protein, 9 aa, Borrelia garinii
GAKADVNSV

SEQ ID NO: 182759 - protein, 9 aa, Borrelia garinii
AKADVNSVT

SEQ ID NO: 182760 - protein, 9 aa, Borrelia garinii
KADVNSVTG

SEQ ID NO: 182761 - protein, 9 aa, Borrelia garinii
ADVNSVTGI

SEQ ID NO: 182762 - protein, 9 aa, Borrelia garinii
DVNSVTGIA

SEQ ID NO: 182763 - protein, 9 aa, Borrelia garinii
VNSVTGIAK

SEQ ID NO: 182764 - protein, 9 aa, Borrelia garinii
NSVTGIAKG

SEQ ID NO: 182765 - protein, 9 aa, Borrelia garinii
SVTGIAKGM

SEQ ID NO: 182766 - protein, 9 aa, Borrelia garinii
VTGIAKGMK

SEQ ID NO: 182767 - protein, 9 aa, Borrelia garinii
TGIAKGMKA

SEQ ID NO: 182768 - protein, 9 aa, Borrelia garinii
GIAKGMKAI

SEQ ID NO: 182769 - protein, 9 aa, Borrelia garinii
IAKGMKAIV

SEQ ID NO: 182770 - protein, 9 aa, Borrelia garinii
AKGMKAIVD

SEQ ID NO: 182771 - protein, 9 aa, Borrelia garinii
KGMKAIVDA

SEQ ID NO: 182772 - protein, 9 aa, Borrelia garinii
GMKAIVDAA

SEQ ID NO: 182773 - protein, 9 aa, Borrelia garinii
MKAIVDAAG

SEQ ID NO: 182774 - protein, 9 aa, Borrelia garinii
KAIVDAAGK

SEQ ID NO: 182775 - protein, 9 aa, Borrelia garinii
AIVDAAGKA

SEQ ID NO: 182776 - protein, 9 aa, Borrelia garinii
IVDAAGKAG

SEQ ID NO: 182777 - protein, 9 aa, Borrelia garinii
VDAAGKAGV

SEQ ID NO: 182778 - protein, 9 aa, Borrelia garinii
DAAGKAGVE

SEQ ID NO: 182779 - protein, 9 aa, Borrelia garinii
AAGKAGVEL

SEQ ID NO: 182780 - protein, 9 aa, Borrelia garinii
AGKAGVELK

SEQ ID NO: 182781 - protein, 9 aa, Borrelia garinii
GKAGVELKP

SEQ ID NO: 182782 - protein, 9 aa, Borrelia garinii
KAGVELKPA

SEQ ID NO: 182783 - protein, 9 aa, Borrelia garinii
AGVELKPAA

SEQ ID NO: 182784 - protein, 9 aa, Borrelia garinii
GVELKPAAA

SEQ ID NO: 182785 - protein, 9 aa, Borrelia garinii
VELKPAAAG

SEQ ID NO: 182786 - protein, 9 aa, Borrelia garinii
ELKPAAAGG

SEQ ID NO: 182787 - protein, 9 aa, Borrelia garinii
LKPAAAGGA

SEQ ID NO: 182788 - protein, 9 aa, Borrelia garinii
KPAAAGGAA

SEQ ID NO: 182789 - protein, 9 aa, Borrelia garinii
PAAAGGAAA

SEQ ID NO: 182790 - protein, 9 aa, Borrelia garinii
AAAGGAAAN

SEQ ID NO: 182791 - protein, 9 aa, Borrelia garinii
AAGGAAAND

SEQ ID NO: 182792 - protein, 9 aa, Borrelia garinii
AGGAAANDA

SEQ ID NO: 182793 - protein, 9 aa, Borrelia garinii
GGAAANDAG

SEQ ID NO: 182794 - protein, 9 aa, Borrelia garinii
GAAANDAGK

SEQ ID NO: 182795 - protein, 9 aa, Borrelia garinii
AAANDAGKL

SEQ ID NO: 182796 - protein, 9 aa, Borrelia garinii
AANDAGKLF

SEQ ID NO: 182797 - protein, 9 aa, Borrelia garinii
ANDAGKLFA

SEQ ID NO: 182798 - protein, 9 aa, Borrelia garinii
NDAGKLFAS

SEQ ID NO: 182799 - protein, 9 aa, Borrelia garinii
DAGKLFASG

SEQ ID NO: 182800 - protein, 9 aa, Borrelia garinii
AGKLFASGA

SEQ ID NO: 182801 - protein, 9 aa, Borrelia garinii
GKLFASGAN

SEQ ID NO: 182802 - protein, 9 aa, Borrelia garinii
KLFASGANA

SEQ ID NO: 182803 - protein, 9 aa, Borrelia garinii
LFASGANAN

SEQ ID NO: 182804 - protein, 9 aa, Borrelia garinii
FASGANANA

SEQ ID NO: 182805 - protein, 9 aa, Borrelia garinii
ASGANANAA

SEQ ID NO: 182806 - protein, 9 aa, Borrelia garinii
SGANANAAA

SEQ ID NO: 182807 - protein, 9 aa, Borrelia garinii
GANANAAAN

SEQ ID NO: 182808 - protein, 9 aa, Borrelia garinii
ANANAAANA

SEQ ID NO: 182809 - protein, 9 aa, Borrelia garinii
NANAAANAD

SEQ ID NO: 182810 - protein, 9 aa, Borrelia garinii
ANAAANADD

SEQ ID NO: 182811 - protein, 9 aa, Borrelia garinii
NAAANADDA

SEQ ID NO: 182812 - protein, 9 aa, Borrelia garinii
AAANADDAE

SEQ ID NO: 182813 - protein, 9 aa, Borrelia garinii
AANADDAEG

SEQ ID NO: 182814 - protein, 9 aa, Borrelia garinii
ANADDAEGA

SEQ ID NO: 182815 - protein, 9 aa, Borrelia garinii
NADDAEGAA

SEQ ID NO: 182816 - protein, 9 aa, Borrelia garinii
ADDAEGAAE

SEQ ID NO: 182817 - protein, 9 aa, Borrelia garinii
DDAEGAAEA

SEQ ID NO: 182818 - protein, 9 aa, Borrelia garinii
DAEGAAEAA

SEQ ID NO: 182819 - protein, 9 aa, Borrelia garinii
AEGAAEAAG

SEQ ID NO: 182820 - protein, 9 aa, Borrelia garinii
EGAAEAAGK

SEQ ID NO: 182821 - protein, 9 aa, Borrelia garinii
GAAEAAGKA

SEQ ID NO: 182822 - protein, 9 aa, Borrelia garinii
AAEAAGKAV

SEQ ID NO: 182823 - protein, 9 aa, Borrelia garinii
AEAAGKAVS

SEQ ID NO: 182824 - protein, 9 aa, Borrelia garinii
EAAGKAVSA

SEQ ID NO: 182825 - protein, 9 aa, Borrelia garinii
AAGKAVSAV

SEQ ID NO: 182826 - protein, 9 aa, Borrelia garinii
AGKAVSAVS

SEQ ID NO: 182827 - protein, 9 aa, Borrelia garinii
GKAVSAVSG

SEQ ID NO: 182828 - protein, 9 aa, Borrelia garinii
KAVSAVSGD

SEQ ID NO: 182829 - protein, 9 aa, Borrelia garinii
AVSAVSGDQ

SEQ ID NO: 182830 - protein, 9 aa, Borrelia garinii
VSAVSGDQI

SEQ ID NO: 182831 - protein, 9 aa, Borrelia garinii
SAVSGDQIL

SEQ ID NO: 182832 - protein, 9 aa, Borrelia garinii
AVSGDQILK

SEQ ID NO: 182833 - protein, 9 aa, Borrelia garinii
VSGDQILKA

SEQ ID NO: 182834 - protein, 9 aa, Borrelia garinii
SGDQILKAI

SEQ ID NO: 182835 - protein, 9 aa, Borrelia garinii
GDQILKAIV

SEQ ID NO: 182836 - protein, 9 aa, Borrelia garinii
DQILKAIVD

SEQ ID NO: 182837 - protein, 9 aa, Borrelia garinii
QILKAIVDA

SEQ ID NO: 182838 - protein, 9 aa, Borrelia garinii
ILKAIVDAA

SEQ ID NO: 182839 - protein, 9 aa, Borrelia garinii
LKAIVDAAG

SEQ ID NO: 182840 - protein, 9 aa, Borrelia garinii
KAIVDAAGA

SEQ ID NO: 182841 - protein, 9 aa, Borrelia garinii
AIVDAAGAT

SEQ ID NO: 182842 - protein, 9 aa, Borrelia garinii
IVDAAGATA

SEQ ID NO: 182843 - protein, 9 aa, Borrelia garinii
VDAAGATAG

SEQ ID NO: 182844 - protein, 9 aa, Borrelia garinii
DAAGATAGK

SEQ ID NO: 182845 - protein, 9 aa, Borrelia garinii
AAGATAGKK

SEQ ID NO: 182846 - protein, 9 aa, Borrelia garinii
AGATAGKKA

SEQ ID NO: 182847 - protein, 9 aa, Borrelia garinii
GATAGKKAN

SEQ ID NO: 182848 - protein, 9 aa, Borrelia garinii
ATAGKKANE

SEQ ID NO: 182849 - protein, 9 aa, Borrelia garinii
TAGKKANEA

SEQ ID NO: 182850 - protein, 9 aa, Borrelia garinii
AGKKANEAT

SEQ ID NO: 182851 - protein, 9 aa, Borrelia garinii
GKKANEATN

SEQ ID NO: 182852 - protein, 9 aa, Borrelia garinii
KKANEATNA

SEQ ID NO: 182853 - protein, 9 aa, Borrelia garinii
KANEATNAV

SEQ ID NO: 182854 - protein, 9 aa, Borrelia garinii
ANEATNAVE

SEQ ID NO: 182855 - protein, 9 aa, Borrelia garinii
NEATNAVEA

SEQ ID NO: 182856 - protein, 9 aa, Borrelia garinii
EATNAVEAA

SEQ ID NO: 182857 - protein, 9 aa, Borrelia garinii
ATNAVEAAI

SEQ ID NO: 182858 - protein, 9 aa, Borrelia garinii
TNAVEAAIG

SEQ ID NO: 182859 - protein, 9 aa, Borrelia garinii
NAVEAAIGD

SEQ ID NO: 182860 - protein, 9 aa, Borrelia garinii
AVEAAIGDD

SEQ ID NO: 182861 - protein, 9 aa, Borrelia garinii
VEAAIGDDN

SEQ ID NO: 182862 - protein, 9 aa, Borrelia garinii
EAAIGDDNA

SEQ ID NO: 182863 - protein, 9 aa, Borrelia garinii
AAIGDDNAG

SEQ ID NO: 182864 - protein, 9 aa, Borrelia garinii
AIGDDNAGQ

SEQ ID NO: 182865 - protein, 9 aa, Borrelia garinii
IGDDNAGQA

SEQ ID NO: 182866 - protein, 9 aa, Borrelia garinii
GDDNAGQAG

SEQ ID NO: 182867 - protein, 9 aa, Borrelia garinii
DDNAGQAGA

SEQ ID NO: 182868 - protein, 9 aa, Borrelia garinii
DNAGQAGAA

SEQ ID NO: 182869 - protein, 9 aa, Borrelia garinii
NAGQAGAAF

SEQ ID NO: 182870 - protein, 9 aa, Borrelia garinii
AGQAGAAFA

SEQ ID NO: 182871 - protein, 9 aa, Borrelia garinii
GQAGAAFAA

SEQ ID NO: 182872 - protein, 9 aa, Borrelia garinii
QAGAAFAAG

SEQ ID NO: 182873 - protein, 9 aa, Borrelia garinii
AGAAFAAGM

SEQ ID NO: 182874 - protein, 9 aa, Borrelia garinii
GAAFAAGMQ

SEQ ID NO: 182875 - protein, 9 aa, Borrelia garinii
AAFAAGMQN

SEQ ID NO: 182876 - protein, 9 aa, Borrelia garinii
AFAAGMQNK

SEQ ID NO: 182877 - protein, 9 aa, Borrelia garinii
FAAGMQNKN

SEQ ID NO: 182878 - protein, 9 aa, Borrelia garinii
AAGMQNKND

SEQ ID NO: 182879 - protein, 9 aa, Borrelia garinii
AGMQNKNDQ

SEQ ID NO: 182880 - protein, 9 aa, Borrelia garinii
GMQNKNDQI

SEQ ID NO: 182881 - protein, 9 aa, Borrelia garinii
MQNKNDQIA

SEQ ID NO: 182882 - protein, 9 aa, Borrelia garinii
QNKNDQIAA

SEQ ID NO: 182883 - protein, 9 aa, Borrelia garinii
NKNDQIAAA

SEQ ID NO: 182884 - protein, 9 aa, Borrelia garinii
KNDQIAAAI

SEQ ID NO: 182885 - protein, 9 aa, Borrelia garinii
NDQIAAAIV

SEQ ID NO: 182886 - protein, 9 aa, Borrelia garinii
DQIAAAIVL

SEQ ID NO: 182887 - protein, 9 aa, Borrelia garinii
QIAAAIVLR

SEQ ID NO: 182888 - protein, 9 aa, Borrelia garinii
IAAAIVLRG

SEQ ID NO: 182889 - protein, 9 aa, Borrelia garinii
AAAIVLRGL

SEQ ID NO: 182890 - protein, 9 aa, Borrelia garinii
AAIVLRGLA

SEQ ID NO: 182891 - protein, 9 aa, Borrelia garinii
AIVLRGLAK

SEQ ID NO: 182892 - protein, 9 aa, Borrelia garinii
IVLRGLAKS

SEQ ID NO: 182893 - protein, 9 aa, Borrelia garinii
VLRGLAKSG

SEQ ID NO: 182894 - protein, 9 aa, Borrelia garinii
LRGLAKSGK

SEQ ID NO: 182895 - protein, 9 aa, Borrelia garinii
RGLAKSGKF

SEQ ID NO: 182896 - protein, 9 aa, Borrelia garinii
GLAKSGKFA

SEQ ID NO: 182897 - protein, 9 aa, Borrelia garinii
LAKSGKFAN

SEQ ID NO: 182898 - protein, 9 aa, Borrelia garinii
AKSGKFANE

SEQ ID NO: 182899 - protein, 10 aa, Borrelia garinii
MKKISSAIFL

SEQ ID NO: 182900 - protein, 10 aa, Borrelia garinii
KKISSAIFLL

SEQ ID NO: 182901 - protein, 10 aa, Borrelia garinii
KISSAIFLLA

SEQ ID NO: 182902 - protein, 10 aa, Borrelia garinii
ISSAIFLLAF

SEQ ID NO: 182903 - protein, 10 aa, Borrelia garinii
SSAIFLLAFF

SEQ ID NO: 182904 - protein, 10 aa, Borrelia garinii
SAIFLLAFFV

SEQ ID NO: 182905 - protein, 10 aa, Borrelia garinii
AIFLLAFFVF

SEQ ID NO: 182906 - protein, 10 aa, Borrelia garinii
IFLLAFFVFT

SEQ ID NO: 182907 - protein, 10 aa, Borrelia garinii
FLLAFFVFTN

SEQ ID NO: 182908 - protein, 10 aa, Borrelia garinii
LLAFFVFTNC

SEQ ID NO: 182909 - protein, 10 aa, Borrelia garinii
LAFFVFTNCK

SEQ ID NO: 182910 - protein, 10 aa, Borrelia garinii
AFFVFTNCKN

SEQ ID NO: 182911 - protein, 10 aa, Borrelia garinii
FFVFTNCKNN

SEQ ID NO: 182912 - protein, 10 aa, Borrelia garinii
FVFTNCKNNA

SEQ ID NO: 182913 - protein, 10 aa, Borrelia garinii
VFTNCKNNAE

SEQ ID NO: 182914 - protein, 10 aa, Borrelia garinii
FTNCKNNAEL

SEQ ID NO: 182915 - protein, 10 aa, Borrelia garinii
TNCKNNAELA

SEQ ID NO: 182916 - protein, 10 aa, Borrelia garinii
NCKNNAELAE

SEQ ID NO: 182917 - protein, 10 aa, Borrelia garinii
CKNNAELAEA

SEQ ID NO: 182918 - protein, 10 aa, Borrelia garinii
KNNAELAEAE

SEQ ID NO: 182919 - protein, 10 aa, Borrelia garinii
NNAELAEAEA

SEQ ID NO: 182920 - protein, 10 aa, Borrelia garinii
NAELAEAEAK

SEQ ID NO: 182921 - protein, 10 aa, Borrelia garinii
AELAEAEAKN

SEQ ID NO: 182922 - protein, 10 aa, Borrelia garinii
ELAEAEAKNQ

SEQ ID NO: 182923 - protein, 10 aa, Borrelia garinii
LAEAEAKNQS

SEQ ID NO: 182924 - protein, 10 aa, Borrelia garinii
AEAEAKNQSA

SEQ ID NO: 182925 - protein, 10 aa, Borrelia garinii
EAEAKNQSAK

SEQ ID NO: 182926 - protein, 10 aa, Borrelia garinii
AEAKNQSAKD

SEQ ID NO: 182927 - protein, 10 aa, Borrelia garinii
EAKNQSAKDF

SEQ ID NO: 182928 - protein, 10 aa, Borrelia garinii
AKNQSAKDFY

SEQ ID NO: 182929 - protein, 10 aa, Borrelia garinii
KNQSAKDFYH

SEQ ID NO: 182930 - protein, 10 aa, Borrelia garinii
NQSAKDFYHA

SEQ ID NO: 182931 - protein, 10 aa, Borrelia garinii
QSAKDFYHAI

SEQ ID NO: 182932 - protein, 10 aa, Borrelia garinii
SAKDFYHAII

SEQ ID NO: 182933 - protein, 10 aa, Borrelia garinii
AKDFYHAIIK

SEQ ID NO: 182934 - protein, 10 aa, Borrelia garinii
KDFYHAIIKL

SEQ ID NO: 182935 - protein, 10 aa, Borrelia garinii
DFYHAIIKLG

SEQ ID NO: 182936 - protein, 10 aa, Borrelia garinii
FYHAIIKLGY

SEQ ID NO: 182937 - protein, 10 aa, Borrelia garinii
YHAIIKLGYG

SEQ ID NO: 182938 - protein, 10 aa, Borrelia garinii
HAIIKLGYGF

SEQ ID NO: 182939 - protein, 10 aa, Borrelia garinii
AIIKLGYGFV

SEQ ID NO: 182940 - protein, 10 aa, Borrelia garinii
IIKLGYGFVD

SEQ ID NO: 182941 - protein, 10 aa, Borrelia garinii
IKLGYGFVDV

SEQ ID NO: 182942 - protein, 10 aa, Borrelia garinii
KLGYGFVDVF

SEQ ID NO: 182943 - protein, 10 aa, Borrelia garinii
LGYGFVDVFN

SEQ ID NO: 182944 - protein, 10 aa, Borrelia garinii
GYGFVDVFNA

SEQ ID NO: 182945 - protein, 10 aa, Borrelia garinii
YGFVDVFNAI

SEQ ID NO: 182946 - protein, 10 aa, Borrelia garinii
GFVDVFNAIG

SEQ ID NO: 182947 - protein, 10 aa, Borrelia garinii
FVDVFNAIGG

SEQ ID NO: 182948 - protein, 10 aa, Borrelia garinii
VDVFNAIGGL

SEQ ID NO: 182949 - protein, 10 aa, Borrelia garinii
DVFNAIGGLV

SEQ ID NO: 182950 - protein, 10 aa, Borrelia garinii
VFNAIGGLVS

SEQ ID NO: 182951 - protein, 10 aa, Borrelia garinii
FNAIGGLVSD

SEQ ID NO: 182952 - protein, 10 aa, Borrelia garinii
NAIGGLVSDV

SEQ ID NO: 182953 - protein, 10 aa, Borrelia garinii
AIGGLVSDVF

SEQ ID NO: 182954 - protein, 10 aa, Borrelia garinii
IGGLVSDVFY

SEQ ID NO: 182955 - protein, 10 aa, Borrelia garinii
GGLVSDVFYK

SEQ ID NO: 182956 - protein, 10 aa, Borrelia garinii
GLVSDVFYKA

SEQ ID NO: 182957 - protein, 10 aa, Borrelia garinii
LVSDVFYKAD

SEQ ID NO: 182958 - protein, 10 aa, Borrelia garinii
VSDVFYKADP

SEQ ID NO: 182959 - protein, 10 aa, Borrelia garinii
SDVFYKADPK

SEQ ID NO: 182960 - protein, 10 aa, Borrelia garinii
DVFYKADPKK

SEQ ID NO: 182961 - protein, 10 aa, Borrelia garinii
VFYKADPKKS

SEQ ID NO: 182962 - protein, 10 aa, Borrelia garinii
FYKADPKKSD

SEQ ID NO: 182963 - protein, 10 aa, Borrelia garinii
YKADPKKSDV

SEQ ID NO: 182964 - protein, 10 aa, Borrelia garinii
KADPKKSDVK

SEQ ID NO: 182965 - protein, 10 aa, Borrelia garinii
ADPKKSDVKN

SEQ ID NO: 182966 - protein, 10 aa, Borrelia garinii
DPKKSDVKNY

SEQ ID NO: 182967 - protein, 10 aa, Borrelia garinii
PKKSDVKNYF

SEQ ID NO: 182968 - protein, 10 aa, Borrelia garinii
KKSDVKNYFD

SEQ ID NO: 182969 - protein, 10 aa, Borrelia garinii
KSDVKNYFDS

SEQ ID NO: 182970 - protein, 10 aa, Borrelia garinii
SDVKNYFDSI

SEQ ID NO: 182971 - protein, 10 aa, Borrelia garinii
DVKNYFDSIA

SEQ ID NO: 182972 - protein, 10 aa, Borrelia garinii
VKNYFDSIAS

SEQ ID NO: 182973 - protein, 10 aa, Borrelia garinii
KNYFDSIASI

SEQ ID NO: 182974 - protein, 10 aa, Borrelia garinii
NYFDSIASIL

SEQ ID NO: 182975 - protein, 10 aa, Borrelia garinii
YFDSIASILK

SEQ ID NO: 182976 - protein, 10 aa, Borrelia garinii
FDSIASILKE

SEQ ID NO: 182977 - protein, 10 aa, Borrelia garinii
DSIASILKET

SEQ ID NO: 182978 - protein, 10 aa, Borrelia garinii
SIASILKETQ

SEQ ID NO: 182979 - protein, 10 aa, Borrelia garinii
IASILKETQT

SEQ ID NO: 182980 - protein, 10 aa, Borrelia garinii
ASILKETQTK

SEQ ID NO: 182981 - protein, 10 aa, Borrelia garinii
SILKETQTKL

SEQ ID NO: 182982 - protein, 10 aa, Borrelia garinii
ILKETQTKLD

SEQ ID NO: 182983 - protein, 10 aa, Borrelia garinii
LKETQTKLDA

SEQ ID NO: 182984 - protein, 10 aa, Borrelia garinii
KETQTKLDAL

SEQ ID NO: 182985 - protein, 10 aa, Borrelia garinii
ETQTKLDALS

SEQ ID NO: 182986 - protein, 10 aa, Borrelia garinii
TQTKLDALSK

SEQ ID NO: 182987 - protein, 10 aa, Borrelia garinii
QTKLDALSKE

SEQ ID NO: 182988 - protein, 10 aa, Borrelia garinii
TKLDALSKEQ

SEQ ID NO: 182989 - protein, 10 aa, Borrelia garinii
KLDALSKEQG

SEQ ID NO: 182990 - protein, 10 aa, Borrelia garinii
LDALSKEQGG

SEQ ID NO: 182991 - protein, 10 aa, Borrelia garinii
DALSKEQGGG

SEQ ID NO: 182992 - protein, 10 aa, Borrelia garinii
ALSKEQGGGD

SEQ ID NO: 182993 - protein, 10 aa, Borrelia garinii
LSKEQGGGDG

SEQ ID NO: 182994 - protein, 10 aa, Borrelia garinii
SKEQGGGDGG

SEQ ID NO: 182995 - protein, 10 aa, Borrelia garinii
KEQGGGDGGT

SEQ ID NO: 182996 - protein, 10 aa, Borrelia garinii
EQGGGDGGTQ

SEQ ID NO: 182997 - protein, 10 aa, Borrelia garinii
QGGGDGGTQV

SEQ ID NO: 182998 - protein, 10 aa, Borrelia garinii
GGGDGGTQVV

SEQ ID NO: 182999 - protein, 10 aa, Borrelia garinii
GGDGGTQVVD

SEQ ID NO: 183000 - protein, 10 aa, Borrelia garinii
GDGGTQVVDA

SEQ ID NO: 183001 - protein, 10 aa, Borrelia garinii
DGGTQVVDAA

SEQ ID NO: 183002 - protein, 10 aa, Borrelia garinii
GGTQVVDAAK

SEQ ID NO: 183003 - protein, 10 aa, Borrelia garinii
GTQVVDAAKK

SEQ ID NO: 183004 - protein, 10 aa, Borrelia garinii
TQVVDAAKKA

SEQ ID NO: 183005 - protein, 10 aa, Borrelia garinii
QVVDAAKKAG

SEQ ID NO: 183006 - protein, 10 aa, Borrelia garinii
VVDAAKKAGE

SEQ ID NO: 183007 - protein, 10 aa, Borrelia garinii
VDAAKKAGEW

SEQ ID NO: 183008 - protein, 10 aa, Borrelia garinii
DAAKKAGEWI

SEQ ID NO: 183009 - protein, 10 aa, Borrelia garinii
AAKKAGEWIK

SEQ ID NO: 183010 - protein, 10 aa, Borrelia garinii
AKKAGEWIKE

SEQ ID NO: 183011 - protein, 10 aa, Borrelia garinii
KKAGEWIKEM

SEQ ID NO: 183012 - protein, 10 aa, Borrelia garinii
KAGEWIKEMH

SEQ ID NO: 183013 - protein, 10 aa, Borrelia garinii
AGEWIKEMHK

SEQ ID NO: 183014 - protein, 10 aa, Borrelia garinii
GEWIKEMHKA

SEQ ID NO: 183015 - protein, 10 aa, Borrelia garinii
EWIKEMHKAV

SEQ ID NO: 183016 - protein, 10 aa, Borrelia garinii
WIKEMHKAVE

SEQ ID NO: 183017 - protein, 10 aa, Borrelia garinii
IKEMHKAVED

SEQ ID NO: 183018 - protein, 10 aa, Borrelia garinii
KEMHKAVEDT

SEQ ID NO: 183019 - protein, 10 aa, Borrelia garinii
EMHKAVEDTA

SEQ ID NO: 183020 - protein, 10 aa, Borrelia garinii
MHKAVEDTAK

SEQ ID NO: 183021 - protein, 10 aa, Borrelia garinii
HKAVEDTAKA

SEQ ID NO: 183022 - protein, 10 aa, Borrelia garinii
KAVEDTAKAG

SEQ ID NO: 183023 - protein, 10 aa, Borrelia garinii
AVEDTAKAGG

SEQ ID NO: 183024 - protein, 10 aa, Borrelia garinii
VEDTAKAGGE

SEQ ID NO: 183025 - protein, 10 aa, Borrelia garinii
EDTAKAGGEG

SEQ ID NO: 183026 - protein, 10 aa, Borrelia garinii
DTAKAGGEGG

SEQ ID NO: 183027 - protein, 10 aa, Borrelia garinii
TAKAGGEGGS

SEQ ID NO: 183028 - protein, 10 aa, Borrelia garinii
AKAGGEGGSE

SEQ ID NO: 183029 - protein, 10 aa, Borrelia garinii
KAGGEGGSES

SEQ ID NO: 183030 - protein, 10 aa, Borrelia garinii
AGGEGGSESI

SEQ ID NO: 183031 - protein, 10 aa, Borrelia garinii
GGEGGSESIA

SEQ ID NO: 183032 - protein, 10 aa, Borrelia garinii
GEGGSESIAN

SEQ ID NO: 183033 - protein, 10 aa, Borrelia garinii
EGGSESIANV

SEQ ID NO: 183034 - protein, 10 aa, Borrelia garinii
GGSESIANVA

SEQ ID NO: 183035 - protein, 10 aa, Borrelia garinii
GSESIANVAA

SEQ ID NO: 183036 - protein, 10 aa, Borrelia garinii
SESIANVAAG

SEQ ID NO: 183037 - protein, 10 aa, Borrelia garinii
ESIANVAAGG

SEQ ID NO: 183038 - protein, 10 aa, Borrelia garinii
SIANVAAGGG

SEQ ID NO: 183039 - protein, 10 aa, Borrelia garinii
IANVAAGGGG

SEQ ID NO: 183040 - protein, 10 aa, Borrelia garinii
ANVAAGGGGN

SEQ ID NO: 183041 - protein, 10 aa, Borrelia garinii
NVAAGGGGND

SEQ ID NO: 183042 - protein, 10 aa, Borrelia garinii
VAAGGGGNDG

SEQ ID NO: 183043 - protein, 10 aa, Borrelia garinii
AAGGGGNDGA

SEQ ID NO: 183044 - protein, 10 aa, Borrelia garinii
AGGGGNDGAG

SEQ ID NO: 183045 - protein, 10 aa, Borrelia garinii
GGGGNDGAGA

SEQ ID NO: 183046 - protein, 10 aa, Borrelia garinii
GGGNDGAGAK

SEQ ID NO: 183047 - protein, 10 aa, Borrelia garinii
GGNDGAGAKA

SEQ ID NO: 183048 - protein, 10 aa, Borrelia garinii
GNDGAGAKAD

SEQ ID NO: 183049 - protein, 10 aa, Borrelia garinii
NDGAGAKADV

SEQ ID NO: 183050 - protein, 10 aa, Borrelia garinii
DGAGAKADVN

SEQ ID NO: 183051 - protein, 10 aa, Borrelia garinii
GAGAKADVNS

SEQ ID NO: 183052 - protein, 10 aa, Borrelia garinii
AGAKADVNSV

SEQ ID NO: 183053 - protein, 10 aa, Borrelia garinii
GAKADVNSVT

SEQ ID NO: 183054 - protein, 10 aa, Borrelia garinii
AKADVNSVTG

SEQ ID NO: 183055 - protein, 10 aa, Borrelia garinii
KADVNSVTGI

SEQ ID NO: 183056 - protein, 10 aa, Borrelia garinii
ADVNSVTGIA

SEQ ID NO: 183057 - protein, 10 aa, Borrelia garinii
DVNSVTGIAK

SEQ ID NO: 183058 - protein, 10 aa, Borrelia garinii
VNSVTGIAKG

SEQ ID NO: 183059 - protein, 10 aa, Borrelia garinii
NSVTGIAKGM

SEQ ID NO: 183060 - protein, 10 aa, Borrelia garinii
SVTGIAKGMK

SEQ ID NO: 183061 - protein, 10 aa, Borrelia garinii
VTGIAKGMKA

SEQ ID NO: 183062 - protein, 10 aa, Borrelia garinii
TGIAKGMKAI

SEQ ID NO: 183063 - protein, 10 aa, Borrelia garinii
GIAKGMKAIV

SEQ ID NO: 183064 - protein, 10 aa, Borrelia garinii
IAKGMKAIVD

SEQ ID NO: 183065 - protein, 10 aa, Borrelia garinii
AKGMKAIVDA

SEQ ID NO: 183066 - protein, 10 aa, Borrelia garinii
KGMKAIVDAA

SEQ ID NO: 183067 - protein, 10 aa, Borrelia garinii
GMKAIVDAAG

SEQ ID NO: 183068 - protein, 10 aa, Borrelia garinii
MKAIVDAAGK

SEQ ID NO: 183069 - protein, 10 aa, Borrelia garinii
KAIVDAAGKA

SEQ ID NO: 183070 - protein, 10 aa, Borrelia garinii
AIVDAAGKAG

SEQ ID NO: 183071 - protein, 10 aa, Borrelia garinii
IVDAAGKAGV

SEQ ID NO: 183072 - protein, 10 aa, Borrelia garinii
VDAAGKAGVE

SEQ ID NO: 183073 - protein, 10 aa, Borrelia garinii
DAAGKAGVEL

SEQ ID NO: 183074 - protein, 10 aa, Borrelia garinii
AAGKAGVELK

SEQ ID NO: 183075 - protein, 10 aa, Borrelia garinii
AGKAGVELKP

SEQ ID NO: 183076 - protein, 10 aa, Borrelia garinii
GKAGVELKPA

SEQ ID NO: 183077 - protein, 10 aa, Borrelia garinii
KAGVELKPAA

SEQ ID NO: 183078 - protein, 10 aa, Borrelia garinii
AGVELKPAAA

SEQ ID NO: 183079 - protein, 10 aa, Borrelia garinii
GVELKPAAAG

SEQ ID NO: 183080 - protein, 10 aa, Borrelia garinii
VELKPAAAGG

SEQ ID NO: 183081 - protein, 10 aa, Borrelia garinii
ELKPAAAGGA

SEQ ID NO: 183082 - protein, 10 aa, Borrelia garinii
LKPAAAGGAA

SEQ ID NO: 183083 - protein, 10 aa, Borrelia garinii
KPAAAGGAAA

SEQ ID NO: 183084 - protein, 10 aa, Borrelia garinii
PAAAGGAAAN

SEQ ID NO: 183085 - protein, 10 aa, Borrelia garinii
AAAGGAAAND

SEQ ID NO: 183086 - protein, 10 aa, Borrelia garinii
AAGGAAANDA

SEQ ID NO: 183087 - protein, 10 aa, Borrelia garinii
AGGAAANDAG

SEQ ID NO: 183088 - protein, 10 aa, Borrelia garinii
GGAAANDAGK

SEQ ID NO: 183089 - protein, 10 aa, Borrelia garinii
GAAANDAGKL

SEQ ID NO: 183090 - protein, 10 aa, Borrelia garinii
AAANDAGKLF

SEQ ID NO: 183091 - protein, 10 aa, Borrelia garinii
AANDAGKLFA

SEQ ID NO: 183092 - protein, 10 aa, Borrelia garinii
ANDAGKLFAS

SEQ ID NO: 183093 - protein, 10 aa, Borrelia garinii
NDAGKLFASG

SEQ ID NO: 183094 - protein, 10 aa, Borrelia garinii
DAGKLFASGA

SEQ ID NO: 183095 - protein, 10 aa, Borrelia garinii
AGKLFASGAN

SEQ ID NO: 183096 - protein, 10 aa, Borrelia garinii
GKLFASGANA

SEQ ID NO: 183097 - protein, 10 aa, Borrelia garinii
KLFASGANAN

SEQ ID NO: 183098 - protein, 10 aa, Borrelia garinii
LFASGANANA

SEQ ID NO: 183099 - protein, 10 aa, Borrelia garinii
FASGANANAA

SEQ ID NO: 183100 - protein, 10 aa, Borrelia garinii
ASGANANAAA

SEQ ID NO: 183101 - protein, 10 aa, Borrelia garinii
SGANANAAAN

SEQ ID NO: 183102 - protein, 10 aa, Borrelia garinii
GANANAAANA

SEQ ID NO: 183103 - protein, 10 aa, Borrelia garinii
ANANAAANAD

SEQ ID NO: 183104 - protein, 10 aa, Borrelia garinii
NANAAANADD

SEQ ID NO: 183105 - protein, 10 aa, Borrelia garinii
ANAAANADDA

SEQ ID NO: 183106 - protein, 10 aa, Borrelia garinii
NAAANADDAE

SEQ ID NO: 183107 - protein, 10 aa, Borrelia garinii
AAANADDAEG

SEQ ID NO: 183108 - protein, 10 aa, Borrelia garinii
AANADDAEGA

SEQ ID NO: 183109 - protein, 10 aa, Borrelia garinii
ANADDAEGAA

SEQ ID NO: 183110 - protein, 10 aa, Borrelia garinii
NADDAEGAAE

SEQ ID NO: 183111 - protein, 10 aa, Borrelia garinii
ADDAEGAAEA

SEQ ID NO: 183112 - protein, 10 aa, Borrelia garinii
DDAEGAAEAA

SEQ ID NO: 183113 - protein, 10 aa, Borrelia garinii
DAEGAAEAAG

SEQ ID NO: 183114 - protein, 10 aa, Borrelia garinii
AEGAAEAAGK

SEQ ID NO: 183115 - protein, 10 aa, Borrelia garinii
EGAAEAAGKA

SEQ ID NO: 183116 - protein, 10 aa, Borrelia garinii
GAAEAAGKAV

SEQ ID NO: 183117 - protein, 10 aa, Borrelia garinii
AAEAAGKAVS

SEQ ID NO: 183118 - protein, 10 aa, Borrelia garinii
AEAAGKAVSA

SEQ ID NO: 183119 - protein, 10 aa, Borrelia garinii
EAAGKAVSAV

SEQ ID NO: 183120 - protein, 10 aa, Borrelia garinii
AAGKAVSAVS

SEQ ID NO: 183121 - protein, 10 aa, Borrelia garinii
AGKAVSAVSG

SEQ ID NO: 183122 - protein, 10 aa, Borrelia garinii
GKAVSAVSGD

SEQ ID NO: 183123 - protein, 10 aa, Borrelia garinii
KAVSAVSGDQ

SEQ ID NO: 183124 - protein, 10 aa, Borrelia garinii
AVSAVSGDQI

SEQ ID NO: 183125 - protein, 10 aa, Borrelia garinii
VSAVSGDQIL

SEQ ID NO: 183126 - protein, 10 aa, Borrelia garinii
SAVSGDQILK

SEQ ID NO: 183127 - protein, 10 aa, Borrelia garinii
AVSGDQILKA

SEQ ID NO: 183128 - protein, 10 aa, Borrelia garinii
VSGDQILKAI

SEQ ID NO: 183129 - protein, 10 aa, Borrelia garinii
SGDQILKAIV

SEQ ID NO: 183130 - protein, 10 aa, Borrelia garinii
GDQILKAIVD

SEQ ID NO: 183131 - protein, 10 aa, Borrelia garinii
DQILKAIVDA

SEQ ID NO: 183132 - protein, 10 aa, Borrelia garinii
QILKAIVDAA

SEQ ID NO: 183133 - protein, 10 aa, Borrelia garinii
ILKAIVDAAG

SEQ ID NO: 183134 - protein, 10 aa, Borrelia garinii
LKAIVDAAGA

SEQ ID NO: 183135 - protein, 10 aa, Borrelia garinii
KAIVDAAGAT

SEQ ID NO: 183136 - protein, 10 aa, Borrelia garinii
AIVDAAGATA

SEQ ID NO: 183137 - protein, 10 aa, Borrelia garinii
IVDAAGATAG

SEQ ID NO: 183138 - protein, 10 aa, Borrelia garinii
VDAAGATAGK

SEQ ID NO: 183139 - protein, 10 aa, Borrelia garinii
DAAGATAGKK

SEQ ID NO: 183140 - protein, 10 aa, Borrelia garinii
AAGATAGKKA

SEQ ID NO: 183141 - protein, 10 aa, Borrelia garinii
AGATAGKKAN

SEQ ID NO: 183142 - protein, 10 aa, Borrelia garinii
GATAGKKANE

SEQ ID NO: 183143 - protein, 10 aa, Borrelia garinii
ATAGKKANEA

SEQ ID NO: 183144 - protein, 10 aa, Borrelia garinii
TAGKKANEAT

SEQ ID NO: 183145 - protein, 10 aa, Borrelia garinii
AGKKANEATN

SEQ ID NO: 183146 - protein, 10 aa, Borrelia garinii
GKKANEATNA

SEQ ID NO: 183147 - protein, 10 aa, Borrelia garinii
KKANEATNAV

SEQ ID NO: 183148 - protein, 10 aa, Borrelia garinii
KANEATNAVE

SEQ ID NO: 183149 - protein, 10 aa, Borrelia garinii
ANEATNAVEA

SEQ ID NO: 183150 - protein, 10 aa, Borrelia garinii
NEATNAVEAA

SEQ ID NO: 183151 - protein, 10 aa, Borrelia garinii
EATNAVEAAI

SEQ ID NO: 183152 - protein, 10 aa, Borrelia garinii
ATNAVEAAIG

SEQ ID NO: 183153 - protein, 10 aa, Borrelia garinii
TNAVEAAIGD

SEQ ID NO: 183154 - protein, 10 aa, Borrelia garinii
NAVEAAIGDD

SEQ ID NO: 183155 - protein, 10 aa, Borrelia garinii
AVEAAIGDDN

SEQ ID NO: 183156 - protein, 10 aa, Borrelia garinii
VEAAIGDDNA

SEQ ID NO: 183157 - protein, 10 aa, Borrelia garinii
EAAIGDDNAG

SEQ ID NO: 183158 - protein, 10 aa, Borrelia garinii
AAIGDDNAGQ

SEQ ID NO: 183159 - protein, 10 aa, Borrelia garinii
AIGDDNAGQA

SEQ ID NO: 183160 - protein, 10 aa, Borrelia garinii
IGDDNAGQAG

SEQ ID NO: 183161 - protein, 10 aa, Borrelia garinii
GDDNAGQAGA

SEQ ID NO: 183162 - protein, 10 aa, Borrelia garinii
DDNAGQAGAA

SEQ ID NO: 183163 - protein, 10 aa, Borrelia garinii
DNAGQAGAAF

SEQ ID NO: 183164 - protein, 10 aa, Borrelia garinii
NAGQAGAAFA

SEQ ID NO: 183165 - protein, 10 aa, Borrelia garinii
AGQAGAAFAA

SEQ ID NO: 183166 - protein, 10 aa, Borrelia garinii
GQAGAAFAAG

SEQ ID NO: 183167 - protein, 10 aa, Borrelia garinii
QAGAAFAAGM

SEQ ID NO: 183168 - protein, 10 aa, Borrelia garinii
AGAAFAAGMQ

SEQ ID NO: 183169 - protein, 10 aa, Borrelia garinii
GAAFAAGMQN

SEQ ID NO: 183170 - protein, 10 aa, Borrelia garinii
AAFAAGMQNK

SEQ ID NO: 183171 - protein, 10 aa, Borrelia garinii
AFAAGMQNKN

SEQ ID NO: 183172 - protein, 10 aa, Borrelia garinii
FAAGMQNKND

SEQ ID NO: 183173 - protein, 10 aa, Borrelia garinii
AAGMQNKNDQ

SEQ ID NO: 183174 - protein, 10 aa, Borrelia garinii
AGMQNKNDQI

SEQ ID NO: 183175 - protein, 10 aa, Borrelia garinii
GMQNKNDQIA

SEQ ID NO: 183176 - protein, 10 aa, Borrelia garinii
MQNKNDQIAA

SEQ ID NO: 183177 - protein, 10 aa, Borrelia garinii
QNKNDQIAAA

SEQ ID NO: 183178 - protein, 10 aa, Borrelia garinii
NKNDQIAAAI

SEQ ID NO: 183179 - protein, 10 aa, Borrelia garinii
KNDQIAAAIV

SEQ ID NO: 183180 - protein, 10 aa, Borrelia garinii
NDQIAAAIVL

SEQ ID NO: 183181 - protein, 10 aa, Borrelia garinii
DQIAAAIVLR

SEQ ID NO: 183182 - protein, 10 aa, Borrelia garinii
QIAAAIVLRG

SEQ ID NO: 183183 - protein, 10 aa, Borrelia garinii
IAAAIVLRGL

SEQ ID NO: 183184 - protein, 10 aa, Borrelia garinii
AAAIVLRGLA

SEQ ID NO: 183185 - protein, 10 aa, Borrelia garinii
AAIVLRGLAK

SEQ ID NO: 183186 - protein, 10 aa, Borrelia garinii
AIVLRGLAKS

SEQ ID NO: 183187 - protein, 10 aa, Borrelia garinii
IVLRGLAKSG

SEQ ID NO: 183188 - protein, 10 aa, Borrelia garinii
VLRGLAKSGK

SEQ ID NO: 183189 - protein, 10 aa, Borrelia garinii
LRGLAKSGKF

SEQ ID NO: 183190 - protein, 10 aa, Borrelia garinii
RGLAKSGKFA

SEQ ID NO: 183191 - protein, 10 aa, Borrelia garinii
GLAKSGKFAN

SEQ ID NO: 183192 - protein, 10 aa, Borrelia garinii
LAKSGKFANE

SEQ ID NO: 183193 - protein, 11 aa, Borrelia garinii
MKKISSAIFLL

SEQ ID NO: 183194 - protein, 11 aa, Borrelia garinii
KKISSAIFLLA

SEQ ID NO: 183195 - protein, 11 aa, Borrelia garinii
KISSAIFLLAF

SEQ ID NO: 183196 - protein, 11 aa, Borrelia garinii
ISSAIFLLAFF

SEQ ID NO: 183197 - protein, 11 aa, Borrelia garinii
SSAIFLLAFFV

SEQ ID NO: 183198 - protein, 11 aa, Borrelia garinii
SAIFLLAFFVF

SEQ ID NO: 183199 - protein, 11 aa, Borrelia garinii
AIFLLAFFVFT

SEQ ID NO: 183200 - protein, 11 aa, Borrelia garinii
IFLLAFFVFTN

SEQ ID NO: 183201 - protein, 11 aa, Borrelia garinii
FLLAFFVFTNC

SEQ ID NO: 183202 - protein, 11 aa, Borrelia garinii
LLAFFVFTNCK

SEQ ID NO: 183203 - protein, 11 aa, Borrelia garinii
LAFFVFTNCKN

SEQ ID NO: 183204 - protein, 11 aa, Borrelia garinii
AFFVFTNCKNN

SEQ ID NO: 183205 - protein, 11 aa, Borrelia garinii
FFVFTNCKNNA

SEQ ID NO: 183206 - protein, 11 aa, Borrelia garinii
FVFTNCKNNAE

SEQ ID NO: 183207 - protein, 11 aa, Borrelia garinii
VFTNCKNNAEL

SEQ ID NO: 183208 - protein, 11 aa, Borrelia garinii
FTNCKNNAELA

SEQ ID NO: 183209 - protein, 11 aa, Borrelia garinii
TNCKNNAELAE

SEQ ID NO: 183210 - protein, 11 aa, Borrelia garinii
NCKNNAELAEA

SEQ ID NO: 183211 - protein, 11 aa, Borrelia garinii
CKNNAELAEAE

SEQ ID NO: 183212 - protein, 11 aa, Borrelia garinii
KNNAELAEAEA

SEQ ID NO: 183213 - protein, 11 aa, Borrelia garinii
NNAELAEAEAK

SEQ ID NO: 183214 - protein, 11 aa, Borrelia garinii
NAELAEAEAKN

SEQ ID NO: 183215 - protein, 11 aa, Borrelia garinii
AELAEAEAKNQ

SEQ ID NO: 183216 - protein, 11 aa, Borrelia garinii
ELAEAEAKNQS

SEQ ID NO: 183217 - protein, 11 aa, Borrelia garinii
LAEAEAKNQSA

SEQ ID NO: 183218 - protein, 11 aa, Borrelia garinii
AEAEAKNQSAK

SEQ ID NO: 183219 - protein, 11 aa, Borrelia garinii
EAEAKNQSAKD

SEQ ID NO: 183220 - protein, 11 aa, Borrelia garinii
AEAKNQSAKDF

SEQ ID NO: 183221 - protein, 11 aa, Borrelia garinii
EAKNQSAKDFY

SEQ ID NO: 183222 - protein, 11 aa, Borrelia garinii
AKNQSAKDFYH

SEQ ID NO: 183223 - protein, 11 aa, Borrelia garinii
KNQSAKDFYHA

SEQ ID NO: 183224 - protein, 11 aa, Borrelia garinii
NQSAKDFYHAI

SEQ ID NO: 183225 - protein, 11 aa, Borrelia garinii
QSAKDFYHAII

SEQ ID NO: 183226 - protein, 11 aa, Borrelia garinii
SAKDFYHAIIK

SEQ ID NO: 183227 - protein, 11 aa, Borrelia garinii
AKDFYHAIIKL

SEQ ID NO: 183228 - protein, 11 aa, Borrelia garinii
KDFYHAIIKLG

SEQ ID NO: 183229 - protein, 11 aa, Borrelia garinii
DFYHAIIKLGY

SEQ ID NO: 183230 - protein, 11 aa, Borrelia garinii
FYHAIIKLGYG

SEQ ID NO: 183231 - protein, 11 aa, Borrelia garinii
YHAIIKLGYGF

SEQ ID NO: 183232 - protein, 11 aa, Borrelia garinii
HAIIKLGYGFV

SEQ ID NO: 183233 - protein, 11 aa, Borrelia garinii
AIIKLGYGFVD

SEQ ID NO: 183234 - protein, 11 aa, Borrelia garinii
IIKLGYGFVDV

SEQ ID NO: 183235 - protein, 11 aa, Borrelia garinii
IKLGYGFVDVF

SEQ ID NO: 183236 - protein, 11 aa, Borrelia garinii
KLGYGFVDVFN

SEQ ID NO: 183237 - protein, 11 aa, Borrelia garinii
LGYGFVDVFNA

SEQ ID NO: 183238 - protein, 11 aa, Borrelia garinii
GYGFVDVFNAI

SEQ ID NO: 183239 - protein, 11 aa, Borrelia garinii
YGFVDVFNAIG

SEQ ID NO: 183240 - protein, 11 aa, Borrelia garinii
GFVDVFNAIGG

SEQ ID NO: 183241 - protein, 11 aa, Borrelia garinii
FVDVFNAIGGL

SEQ ID NO: 183242 - protein, 11 aa, Borrelia garinii
VDVFNAIGGLV

SEQ ID NO: 183243 - protein, 11 aa, Borrelia garinii
DVFNAIGGLVS

SEQ ID NO: 183244 - protein, 11 aa, Borrelia garinii
VFNAIGGLVSD

SEQ ID NO: 183245 - protein, 11 aa, Borrelia garinii
FNAIGGLVSDV

SEQ ID NO: 183246 - protein, 11 aa, Borrelia garinii
NAIGGLVSDVF

SEQ ID NO: 183247 - protein, 11 aa, Borrelia garinii
AIGGLVSDVFY

SEQ ID NO: 183248 - protein, 11 aa, Borrelia garinii
IGGLVSDVFYK

SEQ ID NO: 183249 - protein, 11 aa, Borrelia garinii
GGLVSDVFYKA

SEQ ID NO: 183250 - protein, 11 aa, Borrelia garinii
GLVSDVFYKAD

SEQ ID NO: 183251 - protein, 11 aa, Borrelia garinii
LVSDVFYKADP

SEQ ID NO: 183252 - protein, 11 aa, Borrelia garinii
VSDVFYKADPK

SEQ ID NO: 183253 - protein, 11 aa, Borrelia garinii
SDVFYKADPKK

SEQ ID NO: 183254 - protein, 11 aa, Borrelia garinii
DVFYKADPKKS

SEQ ID NO: 183255 - protein, 11 aa, Borrelia garinii
VFYKADPKKSD

SEQ ID NO: 183256 - protein, 11 aa, Borrelia garinii
FYKADPKKSDV

SEQ ID NO: 183257 - protein, 11 aa, Borrelia garinii
YKADPKKSDVK

SEQ ID NO: 183258 - protein, 11 aa, Borrelia garinii
KADPKKSDVKN

SEQ ID NO: 183259 - protein, 11 aa, Borrelia garinii
ADPKKSDVKNY

SEQ ID NO: 183260 - protein, 11 aa, Borrelia garinii
DPKKSDVKNYF

SEQ ID NO: 183261 - protein, 11 aa, Borrelia garinii
PKKSDVKNYFD

SEQ ID NO: 183262 - protein, 11 aa, Borrelia garinii
KKSDVKNYFDS

SEQ ID NO: 183263 - protein, 11 aa, Borrelia garinii
KSDVKNYFDSI

SEQ ID NO: 183264 - protein, 11 aa, Borrelia garinii
SDVKNYFDSIA

SEQ ID NO: 183265 - protein, 11 aa, Borrelia garinii
DVKNYFDSIAS

SEQ ID NO: 183266 - protein, 11 aa, Borrelia garinii
VKNYFDSIASI

SEQ ID NO: 183267 - protein, 11 aa, Borrelia garinii
KNYFDSIASIL

SEQ ID NO: 183268 - protein, 11 aa, Borrelia garinii
NYFDSIASILK

SEQ ID NO: 183269 - protein, 11 aa, Borrelia garinii
YFDSIASILKE

SEQ ID NO: 183270 - protein, 11 aa, Borrelia garinii
FDSIASILKET

SEQ ID NO: 183271 - protein, 11 aa, Borrelia garinii
DSIASILKETQ

SEQ ID NO: 183272 - protein, 11 aa, Borrelia garinii
SIASILKETQT

SEQ ID NO: 183273 - protein, 11 aa, Borrelia garinii
IASILKETQTK

SEQ ID NO: 183274 - protein, 11 aa, Borrelia garinii
ASILKETQTKL

SEQ ID NO: 183275 - protein, 11 aa, Borrelia garinii
SILKETQTKLD

SEQ ID NO: 183276 - protein, 11 aa, Borrelia garinii
ILKETQTKLDA

SEQ ID NO: 183277 - protein, 11 aa, Borrelia garinii
LKETQTKLDAL

SEQ ID NO: 183278 - protein, 11 aa, Borrelia garinii
KETQTKLDALS

SEQ ID NO: 183279 - protein, 11 aa, Borrelia garinii
ETQTKLDALSK

SEQ ID NO: 183280 - protein, 11 aa, Borrelia garinii
TQTKLDALSKE

SEQ ID NO: 183281 - protein, 11 aa, Borrelia garinii
QTKLDALSKEQ

SEQ ID NO: 183282 - protein, 11 aa, Borrelia garinii
TKLDALSKEQG

SEQ ID NO: 183283 - protein, 11 aa, Borrelia garinii
KLDALSKEQGG

SEQ ID NO: 183284 - protein, 11 aa, Borrelia garinii
LDALSKEQGGG

SEQ ID NO: 183285 - protein, 11 aa, Borrelia garinii
DALSKEQGGGD

SEQ ID NO: 183286 - protein, 11 aa, Borrelia garinii
ALSKEQGGGDG

SEQ ID NO: 183287 - protein, 11 aa, Borrelia garinii
LSKEQGGGDGG

SEQ ID NO: 183288 - protein, 11 aa, Borrelia garinii
SKEQGGGDGGT

SEQ ID NO: 183289 - protein, 11 aa, Borrelia garinii
KEQGGGDGGTQ

SEQ ID NO: 183290 - protein, 11 aa, Borrelia garinii
EQGGGDGGTQV

SEQ ID NO: 183291 - protein, 11 aa, Borrelia garinii
QGGGDGGTQVV

SEQ ID NO: 183292 - protein, 11 aa, Borrelia garinii
GGGDGGTQVVD

SEQ ID NO: 183293 - protein, 11 aa, Borrelia garinii
GGDGGTQVVDA

SEQ ID NO: 183294 - protein, 11 aa, Borrelia garinii
GDGGTQVVDAA

SEQ ID NO: 183295 - protein, 11 aa, Borrelia garinii
DGGTQVVDAAK

SEQ ID NO: 183296 - protein, 11 aa, Borrelia garinii
GGTQVVDAAKK

SEQ ID NO: 183297 - protein, 11 aa, Borrelia garinii
GTQVVDAAKKA

SEQ ID NO: 183298 - protein, 11 aa, Borrelia garinii
TQVVDAAKKAG

SEQ ID NO: 183299 - protein, 11 aa, Borrelia garinii
QVVDAAKKAGE

SEQ ID NO: 183300 - protein, 11 aa, Borrelia garinii
VVDAAKKAGEW

SEQ ID NO: 183301 - protein, 11 aa, Borrelia garinii
VDAAKKAGEWI

SEQ ID NO: 183302 - protein, 11 aa, Borrelia garinii
DAAKKAGEWIK

SEQ ID NO: 183303 - protein, 11 aa, Borrelia garinii
AAKKAGEWIKE

SEQ ID NO: 183304 - protein, 11 aa, Borrelia garinii
AKKAGEWIKEM

SEQ ID NO: 183305 - protein, 11 aa, Borrelia garinii
KKAGEWIKEMH

SEQ ID NO: 183306 - protein, 11 aa, Borrelia garinii
KAGEWIKEMHK

SEQ ID NO: 183307 - protein, 11 aa, Borrelia garinii
AGEWIKEMHKA

SEQ ID NO: 183308 - protein, 11 aa, Borrelia garinii
GEWIKEMHKAV

SEQ ID NO: 183309 - protein, 11 aa, Borrelia garinii
EWIKEMHKAVE

SEQ ID NO: 183310 - protein, 11 aa, Borrelia garinii
WIKEMHKAVED

SEQ ID NO: 183311 - protein, 11 aa, Borrelia garinii
IKEMHKAVEDT

SEQ ID NO: 183312 - protein, 11 aa, Borrelia garinii
KEMHKAVEDTA

SEQ ID NO: 183313 - protein, 11 aa, Borrelia garinii
EMHKAVEDTAK

SEQ ID NO: 183314 - protein, 11 aa, Borrelia garinii
MHKAVEDTAKA

SEQ ID NO: 183315 - protein, 11 aa, Borrelia garinii
HKAVEDTAKAG

SEQ ID NO: 183316 - protein, 11 aa, Borrelia garinii
KAVEDTAKAGG

SEQ ID NO: 183317 - protein, 11 aa, Borrelia garinii
AVEDTAKAGGE

SEQ ID NO: 183318 - protein, 11 aa, Borrelia garinii
VEDTAKAGGEG

SEQ ID NO: 183319 - protein, 11 aa, Borrelia garinii
EDTAKAGGEGG

SEQ ID NO: 183320 - protein, 11 aa, Borrelia garinii
DTAKAGGEGGS

SEQ ID NO: 183321 - protein, 11 aa, Borrelia garinii
TAKAGGEGGSE

SEQ ID NO: 183322 - protein, 11 aa, Borrelia garinii
AKAGGEGGSES

SEQ ID NO: 183323 - protein, 11 aa, Borrelia garinii
KAGGEGGSESI

SEQ ID NO: 183324 - protein, 11 aa, Borrelia garinii
AGGEGGSESIA

SEQ ID NO: 183325 - protein, 11 aa, Borrelia garinii
GGEGGSESIAN

SEQ ID NO: 183326 - protein, 11 aa, Borrelia garinii
GEGGSESIANV

SEQ ID NO: 183327 - protein, 11 aa, Borrelia garinii
EGGSESIANVA

SEQ ID NO: 183328 - protein, 11 aa, Borrelia garinii
GGSESIANVAA

SEQ ID NO: 183329 - protein, 11 aa, Borrelia garinii
GSESIANVAAG

SEQ ID NO: 183330 - protein, 11 aa, Borrelia garinii
SESIANVAAGG

SEQ ID NO: 183331 - protein, 11 aa, Borrelia garinii
ESIANVAAGGG

SEQ ID NO: 183332 - protein, 11 aa, Borrelia garinii
SIANVAAGGGG

SEQ ID NO: 183333 - protein, 11 aa, Borrelia garinii
IANVAAGGGGN

SEQ ID NO: 183334 - protein, 11 aa, Borrelia garinii
ANVAAGGGGND

SEQ ID NO: 183335 - protein, 11 aa, Borrelia garinii
NVAAGGGGNDG

SEQ ID NO: 183336 - protein, 11 aa, Borrelia garinii
VAAGGGGNDGA

SEQ ID NO: 183337 - protein, 11 aa, Borrelia garinii
AAGGGGNDGAG

SEQ ID NO: 183338 - protein, 11 aa, Borrelia garinii
AGGGGNDGAGA

SEQ ID NO: 183339 - protein, 11 aa, Borrelia garinii
GGGGNDGAGAK

SEQ ID NO: 183340 - protein, 11 aa, Borrelia garinii
GGGNDGAGAKA

SEQ ID NO: 183341 - protein, 11 aa, Borrelia garinii
GGNDGAGAKAD

SEQ ID NO: 183342 - protein, 11 aa, Borrelia garinii
GNDGAGAKADV

SEQ ID NO: 183343 - protein, 11 aa, Borrelia garinii
NDGAGAKADVN

SEQ ID NO: 183344 - protein, 11 aa, Borrelia garinii
DGAGAKADVNS

SEQ ID NO: 183345 - protein, 11 aa, Borrelia garinii
GAGAKADVNSV

SEQ ID NO: 183346 - protein, 11 aa, Borrelia garinii
AGAKADVNSVT

SEQ ID NO: 183347 - protein, 11 aa, Borrelia garinii
GAKADVNSVTG

SEQ ID NO: 183348 - protein, 11 aa, Borrelia garinii
AKADVNSVTGI

SEQ ID NO: 183349 - protein, 11 aa, Borrelia garinii
KADVNSVTGIA

SEQ ID NO: 183350 - protein, 11 aa, Borrelia garinii
ADVNSVTGIAK

SEQ ID NO: 183351 - protein, 11 aa, Borrelia garinii
DVNSVTGIAKG

SEQ ID NO: 183352 - protein, 11 aa, Borrelia garinii
VNSVTGIAKGM

SEQ ID NO: 183353 - protein, 11 aa, Borrelia garinii
NSVTGIAKGMK

SEQ ID NO: 183354 - protein, 11 aa, Borrelia garinii
SVTGIAKGMKA

SEQ ID NO: 183355 - protein, 11 aa, Borrelia garinii
VTGIAKGMKAI

SEQ ID NO: 183356 - protein, 11 aa, Borrelia garinii
TGIAKGMKAIV

SEQ ID NO: 183357 - protein, 11 aa, Borrelia garinii
GIAKGMKAIVD

SEQ ID NO: 183358 - protein, 11 aa, Borrelia garinii
IAKGMKAIVDA

SEQ ID NO: 183359 - protein, 11 aa, Borrelia garinii
AKGMKAIVDAA

SEQ ID NO: 183360 - protein, 11 aa, Borrelia garinii
KGMKAIVDAAG

SEQ ID NO: 183361 - protein, 11 aa, Borrelia garinii
GMKAIVDAAGK

SEQ ID NO: 183362 - protein, 11 aa, Borrelia garinii
MKAIVDAAGKA

SEQ ID NO: 183363 - protein, 11 aa, Borrelia garinii
KAIVDAAGKAG

SEQ ID NO: 183364 - protein, 11 aa, Borrelia garinii
AIVDAAGKAGV

SEQ ID NO: 183365 - protein, 11 aa, Borrelia garinii
IVDAAGKAGVE

SEQ ID NO: 183366 - protein, 11 aa, Borrelia garinii
VDAAGKAGVEL

SEQ ID NO: 183367 - protein, 11 aa, Borrelia garinii
DAAGKAGVELK

SEQ ID NO: 183368 - protein, 11 aa, Borrelia garinii
AAGKAGVELKP

SEQ ID NO: 183369 - protein, 11 aa, Borrelia garinii
AGKAGVELKPA

SEQ ID NO: 183370 - protein, 11 aa, Borrelia garinii
GKAGVELKPAA

SEQ ID NO: 183371 - protein, 11 aa, Borrelia garinii
KAGVELKPAAA

SEQ ID NO: 183372 - protein, 11 aa, Borrelia garinii
AGVELKPAAAG

SEQ ID NO: 183373 - protein, 11 aa, Borrelia garinii
GVELKPAAAGG

SEQ ID NO: 183374 - protein, 11 aa, Borrelia garinii
VELKPAAAGGA

SEQ ID NO: 183375 - protein, 11 aa, Borrelia garinii
ELKPAAAGGAA

SEQ ID NO: 183376 - protein, 11 aa, Borrelia garinii
LKPAAAGGAAA

SEQ ID NO: 183377 - protein, 11 aa, Borrelia garinii
KPAAAGGAAAN

SEQ ID NO: 183378 - protein, 11 aa, Borrelia garinii
PAAAGGAAAND

SEQ ID NO: 183379 - protein, 11 aa, Borrelia garinii
AAAGGAAANDA

SEQ ID NO: 183380 - protein, 11 aa, Borrelia garinii
AAGGAAANDAG

SEQ ID NO: 183381 - protein, 11 aa, Borrelia garinii
AGGAAANDAGK

SEQ ID NO: 183382 - protein, 11 aa, Borrelia garinii
GGAAANDAGKL

SEQ ID NO: 183383 - protein, 11 aa, Borrelia garinii
GAAANDAGKLF

SEQ ID NO: 183384 - protein, 11 aa, Borrelia garinii
AAANDAGKLFA

SEQ ID NO: 183385 - protein, 11 aa, Borrelia garinii
AANDAGKLFAS

SEQ ID NO: 183386 - protein, 11 aa, Borrelia garinii
ANDAGKLFASG

SEQ ID NO: 183387 - protein, 11 aa, Borrelia garinii
NDAGKLFASGA

SEQ ID NO: 183388 - protein, 11 aa, Borrelia garinii
DAGKLFASGAN

SEQ ID NO: 183389 - protein, 11 aa, Borrelia garinii
AGKLFASGANA

SEQ ID NO: 183390 - protein, 11 aa, Borrelia garinii
GKLFASGANAN

SEQ ID NO: 183391 - protein, 11 aa, Borrelia garinii
KLFASGANANA

SEQ ID NO: 183392 - protein, 11 aa, Borrelia garinii
LFASGANANAA

SEQ ID NO: 183393 - protein, 11 aa, Borrelia garinii
FASGANANAAA

SEQ ID NO: 183394 - protein, 11 aa, Borrelia garinii
ASGANANAAAN

SEQ ID NO: 183395 - protein, 11 aa, Borrelia garinii
SGANANAAANA

SEQ ID NO: 183396 - protein, 11 aa, Borrelia garinii
GANANAAANAD

SEQ ID NO: 183397 - protein, 11 aa, Borrelia garinii
ANANAAANADD

SEQ ID NO: 183398 - protein, 11 aa, Borrelia garinii
NANAAANADDA

SEQ ID NO: 183399 - protein, 11 aa, Borrelia garinii
ANAAANADDAE

SEQ ID NO: 183400 - protein, 11 aa, Borrelia garinii
NAAANADDAEG

SEQ ID NO: 183401 - protein, 11 aa, Borrelia garinii
AAANADDAEGA

SEQ ID NO: 183402 - protein, 11 aa, Borrelia garinii
AANADDAEGAA

SEQ ID NO: 183403 - protein, 11 aa, Borrelia garinii
ANADDAEGAAE

SEQ ID NO: 183404 - protein, 11 aa, Borrelia garinii
NADDAEGAAEA

SEQ ID NO: 183405 - protein, 11 aa, Borrelia garinii
ADDAEGAAEAA

SEQ ID NO: 183406 - protein, 11 aa, Borrelia garinii
DDAEGAAEAAG

SEQ ID NO: 183407 - protein, 11 aa, Borrelia garinii
DAEGAAEAAGK

SEQ ID NO: 183408 - protein, 11 aa, Borrelia garinii
AEGAAEAAGKA

SEQ ID NO: 183409 - protein, 11 aa, Borrelia garinii
EGAAEAAGKAV

SEQ ID NO: 183410 - protein, 11 aa, Borrelia garinii
GAAEAAGKAVS

SEQ ID NO: 183411 - protein, 11 aa, Borrelia garinii
AAEAAGKAVSA

SEQ ID NO: 183412 - protein, 11 aa, Borrelia garinii
AEAAGKAVSAV

SEQ ID NO: 183413 - protein, 11 aa, Borrelia garinii
EAAGKAVSAVS

SEQ ID NO: 183414 - protein, 11 aa, Borrelia garinii
AAGKAVSAVSG

SEQ ID NO: 183415 - protein, 11 aa, Borrelia garinii
AGKAVSAVSGD

SEQ ID NO: 183416 - protein, 11 aa, Borrelia garinii
GKAVSAVSGDQ

SEQ ID NO: 183417 - protein, 11 aa, Borrelia garinii
KAVSAVSGDQI

SEQ ID NO: 183418 - protein, 11 aa, Borrelia garinii
AVSAVSGDQIL

SEQ ID NO: 183419 - protein, 11 aa, Borrelia garinii
VSAVSGDQILK

SEQ ID NO: 183420 - protein, 11 aa, Borrelia garinii
SAVSGDQILKA

SEQ ID NO: 183421 - protein, 11 aa, Borrelia garinii
AVSGDQILKAI

SEQ ID NO: 183422 - protein, 11 aa, Borrelia garinii
VSGDQILKAIV

SEQ ID NO: 183423 - protein, 11 aa, Borrelia garinii
SGDQILKAIVD

SEQ ID NO: 183424 - protein, 11 aa, Borrelia garinii
GDQILKAIVDA

SEQ ID NO: 183425 - protein, 11 aa, Borrelia garinii
DQILKAIVDAA

SEQ ID NO: 183426 - protein, 11 aa, Borrelia garinii
QILKAIVDAAG

SEQ ID NO: 183427 - protein, 11 aa, Borrelia garinii
ILKAIVDAAGA

SEQ ID NO: 183428 - protein, 11 aa, Borrelia garinii
LKAIVDAAGAT

SEQ ID NO: 183429 - protein, 11 aa, Borrelia garinii
KAIVDAAGATA

SEQ ID NO: 183430 - protein, 11 aa, Borrelia garinii
AIVDAAGATAG

SEQ ID NO: 183431 - protein, 11 aa, Borrelia garinii
IVDAAGATAGK

SEQ ID NO: 183432 - protein, 11 aa, Borrelia garinii
VDAAGATAGKK

SEQ ID NO: 183433 - protein, 11 aa, Borrelia garinii
DAAGATAGKKA

SEQ ID NO: 183434 - protein, 11 aa, Borrelia garinii
AAGATAGKKAN

SEQ ID NO: 183435 - protein, 11 aa, Borrelia garinii
AGATAGKKANE

SEQ ID NO: 183436 - protein, 11 aa, Borrelia garinii
GATAGKKANEA

SEQ ID NO: 183437 - protein, 11 aa, Borrelia garinii
ATAGKKANEAT

SEQ ID NO: 183438 - protein, 11 aa, Borrelia garinii
TAGKKANEATN

SEQ ID NO: 183439 - protein, 11 aa, Borrelia garinii
AGKKANEATNA

SEQ ID NO: 183440 - protein, 11 aa, Borrelia garinii
GKKANEATNAV

SEQ ID NO: 183441 - protein, 11 aa, Borrelia garinii
KKANEATNAVE

SEQ ID NO: 183442 - protein, 11 aa, Borrelia garinii
KANEATNAVEA

SEQ ID NO: 183443 - protein, 11 aa, Borrelia garinii
ANEATNAVEAA

SEQ ID NO: 183444 - protein, 11 aa, Borrelia garinii
NEATNAVEAAI

SEQ ID NO: 183445 - protein, 11 aa, Borrelia garinii
EATNAVEAAIG

SEQ ID NO: 183446 - protein, 11 aa, Borrelia garinii
ATNAVEAAIGD

SEQ ID NO: 183447 - protein, 11 aa, Borrelia garinii
TNAVEAAIGDD

SEQ ID NO: 183448 - protein, 11 aa, Borrelia garinii
NAVEAAIGDDN

SEQ ID NO: 183449 - protein, 11 aa, Borrelia garinii
AVEAAIGDDNA

SEQ ID NO: 183450 - protein, 11 aa, Borrelia garinii
VEAAIGDDNAG

SEQ ID NO: 183451 - protein, 11 aa, Borrelia garinii
EAAIGDDNAGQ

SEQ ID NO: 183452 - protein, 11 aa, Borrelia garinii
AAIGDDNAGQA

SEQ ID NO: 183453 - protein, 11 aa, Borrelia garinii
AIGDDNAGQAG

SEQ ID NO: 183454 - protein, 11 aa, Borrelia garinii
IGDDNAGQAGA

SEQ ID NO: 183455 - protein, 11 aa, Borrelia garinii
GDDNAGQAGAA

SEQ ID NO: 183456 - protein, 11 aa, Borrelia garinii
DDNAGQAGAAF

SEQ ID NO: 183457 - protein, 11 aa, Borrelia garinii
DNAGQAGAAFA

SEQ ID NO: 183458 - protein, 11 aa, Borrelia garinii
NAGQAGAAFAA

SEQ ID NO: 183459 - protein, 11 aa, Borrelia garinii
AGQAGAAFAAG

SEQ ID NO: 183460 - protein, 11 aa, Borrelia garinii
GQAGAAFAAGM

SEQ ID NO: 183461 - protein, 11 aa, Borrelia garinii
QAGAAFAAGMQ

SEQ ID NO: 183462 - protein, 11 aa, Borrelia garinii
AGAAFAAGMQN

SEQ ID NO: 183463 - protein, 11 aa, Borrelia garinii
GAAFAAGMQNK

SEQ ID NO: 183464 - protein, 11 aa, Borrelia garinii
AAFAAGMQNKN

SEQ ID NO: 183465 - protein, 11 aa, Borrelia garinii
AFAAGMQNKND

SEQ ID NO: 183466 - protein, 11 aa, Borrelia garinii
FAAGMQNKNDQ

SEQ ID NO: 183467 - protein, 11 aa, Borrelia garinii
AAGMQNKNDQI

SEQ ID NO: 183468 - protein, 11 aa, Borrelia garinii
AGMQNKNDQIA

SEQ ID NO: 183469 - protein, 11 aa, Borrelia garinii
GMQNKNDQIAA

SEQ ID NO: 183470 - protein, 11 aa, Borrelia garinii
MQNKNDQIAAA

SEQ ID NO: 183471 - protein, 11 aa, Borrelia garinii
QNKNDQIAAAI

SEQ ID NO: 183472 - protein, 11 aa, Borrelia garinii
NKNDQIAAAIV

SEQ ID NO: 183473 - protein, 11 aa, Borrelia garinii
KNDQIAAAIVL

SEQ ID NO: 183474 - protein, 11 aa, Borrelia garinii
NDQIAAAIVLR

SEQ ID NO: 183475 - protein, 11 aa, Borrelia garinii
DQIAAAIVLRG

SEQ ID NO: 183476 - protein, 11 aa, Borrelia garinii
QIAAAIVLRGL

SEQ ID NO: 183477 - protein, 11 aa, Borrelia garinii
IAAAIVLRGLA

SEQ ID NO: 183478 - protein, 11 aa, Borrelia garinii
AAAIVLRGLAK

SEQ ID NO: 183479 - protein, 11 aa, Borrelia garinii
AAIVLRGLAKS

SEQ ID NO: 183480 - protein, 11 aa, Borrelia garinii
AIVLRGLAKSG

SEQ ID NO: 183481 - protein, 11 aa, Borrelia garinii
IVLRGLAKSGK

SEQ ID NO: 183482 - protein, 11 aa, Borrelia garinii
VLRGLAKSGKF

SEQ ID NO: 183483 - protein, 11 aa, Borrelia garinii
LRGLAKSGKFA

SEQ ID NO: 183484 - protein, 11 aa, Borrelia garinii
RGLAKSGKFAN

SEQ ID NO: 183485 - protein, 11 aa, Borrelia garinii
GLAKSGKFANE

SEQ ID NO: 183486 - protein, 13 aa, Borrelia garinii
MKKISSAIFLLAF

SEQ ID NO: 183487 - protein, 13 aa, Borrelia garinii
KKISSAIFLLAFF

SEQ ID NO: 183488 - protein, 13 aa, Borrelia garinii
KISSAIFLLAFFV

SEQ ID NO: 183489 - protein, 13 aa, Borrelia garinii
ISSAIFLLAFFVF

SEQ ID NO: 183490 - protein, 13 aa, Borrelia garinii
SSAIFLLAFFVFT

SEQ ID NO: 183491 - protein, 13 aa, Borrelia garinii
SAIFLLAFFVFTN

SEQ ID NO: 183492 - protein, 13 aa, Borrelia garinii
AIFLLAFFVFTNC

SEQ ID NO: 183493 - protein, 13 aa, Borrelia garinii
IFLLAFFVFTNCK

SEQ ID NO: 183494 - protein, 13 aa, Borrelia garinii
FLLAFFVFTNCKN

SEQ ID NO: 183495 - protein, 13 aa, Borrelia garinii
LLAFFVFTNCKNN

SEQ ID NO: 183496 - protein, 13 aa, Borrelia garinii
LAFFVFTNCKNNA

SEQ ID NO: 183497 - protein, 13 aa, Borrelia garinii
AFFVFTNCKNNAE

SEQ ID NO: 183498 - protein, 13 aa, Borrelia garinii
FFVFTNCKNNAEL

SEQ ID NO: 183499 - protein, 13 aa, Borrelia garinii
FVFTNCKNNAELA

SEQ ID NO: 183500 - protein, 13 aa, Borrelia garinii
VFTNCKNNAELAE

SEQ ID NO: 183501 - protein, 13 aa, Borrelia garinii
FTNCKNNAELAEA

SEQ ID NO: 183502 - protein, 13 aa, Borrelia garinii
TNCKNNAELAEAE

SEQ ID NO: 183503 - protein, 13 aa, Borrelia garinii
NCKNNAELAEAEA

SEQ ID NO: 183504 - protein, 13 aa, Borrelia garinii
CKNNAELAEAEAK

SEQ ID NO: 183505 - protein, 13 aa, Borrelia garinii
KNNAELAEAEAKN

SEQ ID NO: 183506 - protein, 13 aa, Borrelia garinii
NNAELAEAEAKNQ

SEQ ID NO: 183507 - protein, 13 aa, Borrelia garinii
NAELAEAEAKNQS

SEQ ID NO: 183508 - protein, 13 aa, Borrelia garinii
AELAEAEAKNQSA

SEQ ID NO: 183509 - protein, 13 aa, Borrelia garinii
ELAEAEAKNQSAK

SEQ ID NO: 183510 - protein, 13 aa, Borrelia garinii
LAEAEAKNQSAKD

SEQ ID NO: 183511 - protein, 13 aa, Borrelia garinii
AEAEAKNQSAKDF

SEQ ID NO: 183512 - protein, 13 aa, Borrelia garinii
EAEAKNQSAKDFY

SEQ ID NO: 183513 - protein, 13 aa, Borrelia garinii
AEAKNQSAKDFYH

SEQ ID NO: 183514 - protein, 13 aa, Borrelia garinii
EAKNQSAKDFYHA

SEQ ID NO: 183515 - protein, 13 aa, Borrelia garinii
AKNQSAKDFYHAI

SEQ ID NO: 183516 - protein, 13 aa, Borrelia garinii
KNQSAKDFYHAII

SEQ ID NO: 183517 - protein, 13 aa, Borrelia garinii
NQSAKDFYHAIIK

SEQ ID NO: 183518 - protein, 13 aa, Borrelia garinii
QSAKDFYHAIIKL

SEQ ID NO: 183519 - protein, 13 aa, Borrelia garinii
SAKDFYHAIIKLG

SEQ ID NO: 183520 - protein, 13 aa, Borrelia garinii
AKDFYHAIIKLGY

SEQ ID NO: 183521 - protein, 13 aa, Borrelia garinii
KDFYHAIIKLGYG

SEQ ID NO: 183522 - protein, 13 aa, Borrelia garinii
DFYHAIIKLGYGF

SEQ ID NO: 183523 - protein, 13 aa, Borrelia garinii
FYHAIIKLGYGFV

SEQ ID NO: 183524 - protein, 13 aa, Borrelia garinii
YHAIIKLGYGFVD

SEQ ID NO: 183525 - protein, 13 aa, Borrelia garinii
HAIIKLGYGFVDV

SEQ ID NO: 183526 - protein, 13 aa, Borrelia garinii
AIIKLGYGFVDVF

SEQ ID NO: 183527 - protein, 13 aa, Borrelia garinii
IIKLGYGFVDVFN

SEQ ID NO: 183528 - protein, 13 aa, Borrelia garinii
IKLGYGFVDVFNA

SEQ ID NO: 183529 - protein, 13 aa, Borrelia garinii
KLGYGFVDVFNAI

SEQ ID NO: 183530 - protein, 13 aa, Borrelia garinii
LGYGFVDVFNAIG

SEQ ID NO: 183531 - protein, 13 aa, Borrelia garinii
GYGFVDVFNAIGG

SEQ ID NO: 183532 - protein, 13 aa, Borrelia garinii
YGFVDVFNAIGGL

SEQ ID NO: 183533 - protein, 13 aa, Borrelia garinii
GFVDVFNAIGGLV

SEQ ID NO: 183534 - protein, 13 aa, Borrelia garinii
FVDVFNAIGGLVS

SEQ ID NO: 183535 - protein, 13 aa, Borrelia garinii
VDVFNAIGGLVSD

SEQ ID NO: 183536 - protein, 13 aa, Borrelia garinii
DVFNAIGGLVSDV

SEQ ID NO: 183537 - protein, 13 aa, Borrelia garinii
VFNAIGGLVSDVF

SEQ ID NO: 183538 - protein, 13 aa, Borrelia garinii
FNAIGGLVSDVFY

SEQ ID NO: 183539 - protein, 13 aa, Borrelia garinii
NAIGGLVSDVFYK

SEQ ID NO: 183540 - protein, 13 aa, Borrelia garinii
AIGGLVSDVFYKA

SEQ ID NO: 183541 - protein, 13 aa, Borrelia garinii
IGGLVSDVFYKAD

SEQ ID NO: 183542 - protein, 13 aa, Borrelia garinii
GGLVSDVFYKADP

SEQ ID NO: 183543 - protein, 13 aa, Borrelia garinii
GLVSDVFYKADPK

SEQ ID NO: 183544 - protein, 13 aa, Borrelia garinii
LVSDVFYKADPKK

SEQ ID NO: 183545 - protein, 13 aa, Borrelia garinii
VSDVFYKADPKKS

SEQ ID NO: 183546 - protein, 13 aa, Borrelia garinii
SDVFYKADPKKSD

SEQ ID NO: 183547 - protein, 13 aa, Borrelia garinii
DVFYKADPKKSDV

SEQ ID NO: 183548 - protein, 13 aa, Borrelia garinii
VFYKADPKKSDVK

SEQ ID NO: 183549 - protein, 13 aa, Borrelia garinii
FYKADPKKSDVKN

SEQ ID NO: 183550 - protein, 13 aa, Borrelia garinii
YKADPKKSDVKNY

SEQ ID NO: 183551 - protein, 13 aa, Borrelia garinii
KADPKKSDVKNYF

SEQ ID NO: 183552 - protein, 13 aa, Borrelia garinii
ADPKKSDVKNYFD

SEQ ID NO: 183553 - protein, 13 aa, Borrelia garinii
DPKKSDVKNYFDS

SEQ ID NO: 183554 - protein, 13 aa, Borrelia garinii
PKKSDVKNYFDSI

SEQ ID NO: 183555 - protein, 13 aa, Borrelia garinii
KKSDVKNYFDSIA

SEQ ID NO: 183556 - protein, 13 aa, Borrelia garinii
KSDVKNYFDSIAS

SEQ ID NO: 183557 - protein, 13 aa, Borrelia garinii
SDVKNYFDSIASI

SEQ ID NO: 183558 - protein, 13 aa, Borrelia garinii
DVKNYFDSIASIL

SEQ ID NO: 183559 - protein, 13 aa, Borrelia garinii
VKNYFDSIASILK

SEQ ID NO: 183560 - protein, 13 aa, Borrelia garinii
KNYFDSIASILKE

SEQ ID NO: 183561 - protein, 13 aa, Borrelia garinii
NYFDSIASILKET

SEQ ID NO: 183562 - protein, 13 aa, Borrelia garinii
YFDSIASILKETQ

SEQ ID NO: 183563 - protein, 13 aa, Borrelia garinii
FDSIASILKETQT

SEQ ID NO: 183564 - protein, 13 aa, Borrelia garinii
DSIASILKETQTK

SEQ ID NO: 183565 - protein, 13 aa, Borrelia garinii
SIASILKETQTKL

SEQ ID NO: 183566 - protein, 13 aa, Borrelia garinii
IASILKETQTKLD

SEQ ID NO: 183567 - protein, 13 aa, Borrelia garinii
ASILKETQTKLDA

SEQ ID NO: 183568 - protein, 13 aa, Borrelia garinii
SILKETQTKLDAL

SEQ ID NO: 183569 - protein, 13 aa, Borrelia garinii
ILKETQTKLDALS

SEQ ID NO: 183570 - protein, 13 aa, Borrelia garinii
LKETQTKLDALSK

SEQ ID NO: 183571 - protein, 13 aa, Borrelia garinii
KETQTKLDALSKE

SEQ ID NO: 183572 - protein, 13 aa, Borrelia garinii
ETQTKLDALSKEQ

SEQ ID NO: 183573 - protein, 13 aa, Borrelia garinii
TQTKLDALSKEQG

SEQ ID NO: 183574 - protein, 13 aa, Borrelia garinii
QTKLDALSKEQGG

SEQ ID NO: 183575 - protein, 13 aa, Borrelia garinii
TKLDALSKEQGGG

SEQ ID NO: 183576 - protein, 13 aa, Borrelia garinii
KLDALSKEQGGGD

SEQ ID NO: 183577 - protein, 13 aa, Borrelia garinii
LDALSKEQGGGDG

SEQ ID NO: 183578 - protein, 13 aa, Borrelia garinii
DALSKEQGGGDGG

SEQ ID NO: 183579 - protein, 13 aa, Borrelia garinii
ALSKEQGGGDGGT

SEQ ID NO: 183580 - protein, 13 aa, Borrelia garinii
LSKEQGGGDGGTQ

SEQ ID NO: 183581 - protein, 13 aa, Borrelia garinii
SKEQGGGDGGTQV

SEQ ID NO: 183582 - protein, 13 aa, Borrelia garinii
KEQGGGDGGTQVV

SEQ ID NO: 183583 - protein, 13 aa, Borrelia garinii
EQGGGDGGTQVVD

SEQ ID NO: 183584 - protein, 13 aa, Borrelia garinii
QGGGDGGTQVVDA

SEQ ID NO: 183585 - protein, 13 aa, Borrelia garinii
GGGDGGTQVVDAA

SEQ ID NO: 183586 - protein, 13 aa, Borrelia garinii
GGDGGTQVVDAAK

SEQ ID NO: 183587 - protein, 13 aa, Borrelia garinii
GDGGTQVVDAAKK

SEQ ID NO: 183588 - protein, 13 aa, Borrelia garinii
DGGTQVVDAAKKA

SEQ ID NO: 183589 - protein, 13 aa, Borrelia garinii
GGTQVVDAAKKAG

SEQ ID NO: 183590 - protein, 13 aa, Borrelia garinii
GTQVVDAAKKAGE

SEQ ID NO: 183591 - protein, 13 aa, Borrelia garinii
TQVVDAAKKAGEW

SEQ ID NO: 183592 - protein, 13 aa, Borrelia garinii
QVVDAAKKAGEWI

SEQ ID NO: 183593 - protein, 13 aa, Borrelia garinii
VVDAAKKAGEWIK

SEQ ID NO: 183594 - protein, 13 aa, Borrelia garinii
VDAAKKAGEWIKE

SEQ ID NO: 183595 - protein, 13 aa, Borrelia garinii
DAAKKAGEWIKEM

SEQ ID NO: 183596 - protein, 13 aa, Borrelia garinii
AAKKAGEWIKEMH

SEQ ID NO: 183597 - protein, 13 aa, Borrelia garinii
AKKAGEWIKEMHK

SEQ ID NO: 183598 - protein, 13 aa, Borrelia garinii
KKAGEWIKEMHKA

SEQ ID NO: 183599 - protein, 13 aa, Borrelia garinii
KAGEWIKEMHKAV

SEQ ID NO: 183600 - protein, 13 aa, Borrelia garinii
AGEWIKEMHKAVE

SEQ ID NO: 183601 - protein, 13 aa, Borrelia garinii
GEWIKEMHKAVED

SEQ ID NO: 183602 - protein, 13 aa, Borrelia garinii
EWIKEMHKAVEDT

SEQ ID NO: 183603 - protein, 13 aa, Borrelia garinii
WIKEMHKAVEDTA

SEQ ID NO: 183604 - protein, 13 aa, Borrelia garinii
IKEMHKAVEDTAK

SEQ ID NO: 183605 - protein, 13 aa, Borrelia garinii
KEMHKAVEDTAKA

SEQ ID NO: 183606 - protein, 13 aa, Borrelia garinii
EMHKAVEDTAKAG

SEQ ID NO: 183607 - protein, 13 aa, Borrelia garinii
MHKAVEDTAKAGG

SEQ ID NO: 183608 - protein, 13 aa, Borrelia garinii
HKAVEDTAKAGGE

SEQ ID NO: 183609 - protein, 13 aa, Borrelia garinii
KAVEDTAKAGGEG

SEQ ID NO: 183610 - protein, 13 aa, Borrelia garinii
AVEDTAKAGGEGG

SEQ ID NO: 183611 - protein, 13 aa, Borrelia garinii
VEDTAKAGGEGGS

SEQ ID NO: 183612 - protein, 13 aa, Borrelia garinii
EDTAKAGGEGGSE

SEQ ID NO: 183613 - protein, 13 aa, Borrelia garinii
DTAKAGGEGGSES

SEQ ID NO: 183614 - protein, 13 aa, Borrelia garinii
TAKAGGEGGSESI

SEQ ID NO: 183615 - protein, 13 aa, Borrelia garinii
AKAGGEGGSESIA

SEQ ID NO: 183616 - protein, 13 aa, Borrelia garinii
KAGGEGGSESIAN

SEQ ID NO: 183617 - protein, 13 aa, Borrelia garinii
AGGEGGSESIANV

SEQ ID NO: 183618 - protein, 13 aa, Borrelia garinii
GGEGGSESIANVA

SEQ ID NO: 183619 - protein, 13 aa, Borrelia garinii
GEGGSESIANVAA

SEQ ID NO: 183620 - protein, 13 aa, Borrelia garinii
EGGSESIANVAAG

SEQ ID NO: 183621 - protein, 13 aa, Borrelia garinii
GGSESIANVAAGG

SEQ ID NO: 183622 - protein, 13 aa, Borrelia garinii
GSESIANVAAGGG

SEQ ID NO: 183623 - protein, 13 aa, Borrelia garinii
SESIANVAAGGGG

SEQ ID NO: 183624 - protein, 13 aa, Borrelia garinii
ESIANVAAGGGGN

SEQ ID NO: 183625 - protein, 13 aa, Borrelia garinii
SIANVAAGGGGND

SEQ ID NO: 183626 - protein, 13 aa, Borrelia garinii
IANVAAGGGGNDG

SEQ ID NO: 183627 - protein, 13 aa, Borrelia garinii
ANVAAGGGGNDGA

SEQ ID NO: 183628 - protein, 13 aa, Borrelia garinii
NVAAGGGGNDGAG

SEQ ID NO: 183629 - protein, 13 aa, Borrelia garinii
VAAGGGGNDGAGA

SEQ ID NO: 183630 - protein, 13 aa, Borrelia garinii
AAGGGGNDGAGAK

SEQ ID NO: 183631 - protein, 13 aa, Borrelia garinii
AGGGGNDGAGAKA

SEQ ID NO: 183632 - protein, 13 aa, Borrelia garinii
GGGGNDGAGAKAD

SEQ ID NO: 183633 - protein, 13 aa, Borrelia garinii
GGGNDGAGAKADV

SEQ ID NO: 183634 - protein, 13 aa, Borrelia garinii
GGNDGAGAKADVN

SEQ ID NO: 183635 - protein, 13 aa, Borrelia garinii
GNDGAGAKADVNS

SEQ ID NO: 183636 - protein, 13 aa, Borrelia garinii
NDGAGAKADVNSV

SEQ ID NO: 183637 - protein, 13 aa, Borrelia garinii
DGAGAKADVNSVT

SEQ ID NO: 183638 - protein, 13 aa, Borrelia garinii
GAGAKADVNSVTG

SEQ ID NO: 183639 - protein, 13 aa, Borrelia garinii
AGAKADVNSVTGI

SEQ ID NO: 183640 - protein, 13 aa, Borrelia garinii
GAKADVNSVTGIA

SEQ ID NO: 183641 - protein, 13 aa, Borrelia garinii
AKADVNSVTGIAK

SEQ ID NO: 183642 - protein, 13 aa, Borrelia garinii
KADVNSVTGIAKG

SEQ ID NO: 183643 - protein, 13 aa, Borrelia garinii
ADVNSVTGIAKGM

SEQ ID NO: 183644 - protein, 13 aa, Borrelia garinii
DVNSVTGIAKGMK

SEQ ID NO: 183645 - protein, 13 aa, Borrelia garinii
VNSVTGIAKGMKA

SEQ ID NO: 183646 - protein, 13 aa, Borrelia garinii
NSVTGIAKGMKAI

SEQ ID NO: 183647 - protein, 13 aa, Borrelia garinii
SVTGIAKGMKAIV

SEQ ID NO: 183648 - protein, 13 aa, Borrelia garinii
VTGIAKGMKAIVD

SEQ ID NO: 183649 - protein, 13 aa, Borrelia garinii
TGIAKGMKAIVDA

SEQ ID NO: 183650 - protein, 13 aa, Borrelia garinii
GIAKGMKAIVDAA

SEQ ID NO: 183651 - protein, 13 aa, Borrelia garinii
IAKGMKAIVDAAG

SEQ ID NO: 183652 - protein, 13 aa, Borrelia garinii
AKGMKAIVDAAGK

SEQ ID NO: 183653 - protein, 13 aa, Borrelia garinii
KGMKAIVDAAGKA

SEQ ID NO: 183654 - protein, 13 aa, Borrelia garinii
GMKAIVDAAGKAG

SEQ ID NO: 183655 - protein, 13 aa, Borrelia garinii
MKAIVDAAGKAGV

SEQ ID NO: 183656 - protein, 13 aa, Borrelia garinii
KAIVDAAGKAGVE

SEQ ID NO: 183657 - protein, 13 aa, Borrelia garinii
AIVDAAGKAGVEL

SEQ ID NO: 183658 - protein, 13 aa, Borrelia garinii
IVDAAGKAGVELK

SEQ ID NO: 183659 - protein, 13 aa, Borrelia garinii
VDAAGKAGVELKP

SEQ ID NO: 183660 - protein, 13 aa, Borrelia garinii
DAAGKAGVELKPA

SEQ ID NO: 183661 - protein, 13 aa, Borrelia garinii
AAGKAGVELKPAA

SEQ ID NO: 183662 - protein, 13 aa, Borrelia garinii
AGKAGVELKPAAA

SEQ ID NO: 183663 - protein, 13 aa, Borrelia garinii
GKAGVELKPAAAG

SEQ ID NO: 183664 - protein, 13 aa, Borrelia garinii
KAGVELKPAAAGG

SEQ ID NO: 183665 - protein, 13 aa, Borrelia garinii
AGVELKPAAAGGA

SEQ ID NO: 183666 - protein, 13 aa, Borrelia garinii
GVELKPAAAGGAA

SEQ ID NO: 183667 - protein, 13 aa, Borrelia garinii
VELKPAAAGGAAA

SEQ ID NO: 183668 - protein, 13 aa, Borrelia garinii
ELKPAAAGGAAAN

SEQ ID NO: 183669 - protein, 13 aa, Borrelia garinii
LKPAAAGGAAAND

SEQ ID NO: 183670 - protein, 13 aa, Borrelia garinii
KPAAAGGAAANDA

SEQ ID NO: 183671 - protein, 13 aa, Borrelia garinii
PAAAGGAAANDAG

SEQ ID NO: 183672 - protein, 13 aa, Borrelia garinii
AAAGGAAANDAGK

SEQ ID NO: 183673 - protein, 13 aa, Borrelia garinii
AAGGAAANDAGKL

SEQ ID NO: 183674 - protein, 13 aa, Borrelia garinii
AGGAAANDAGKLF

SEQ ID NO: 183675 - protein, 13 aa, Borrelia garinii
GGAAANDAGKLFA

SEQ ID NO: 183676 - protein, 13 aa, Borrelia garinii
GAAANDAGKLFAS

SEQ ID NO: 183677 - protein, 13 aa, Borrelia garinii
AAANDAGKLFASG

SEQ ID NO: 183678 - protein, 13 aa, Borrelia garinii
AANDAGKLFASGA

SEQ ID NO: 183679 - protein, 13 aa, Borrelia garinii
ANDAGKLFASGAN

SEQ ID NO: 183680 - protein, 13 aa, Borrelia garinii
NDAGKLFASGANA

SEQ ID NO: 183681 - protein, 13 aa, Borrelia garinii
DAGKLFASGANAN

SEQ ID NO: 183682 - protein, 13 aa, Borrelia garinii
AGKLFASGANANA

SEQ ID NO: 183683 - protein, 13 aa, Borrelia garinii
GKLFASGANANAA

SEQ ID NO: 183684 - protein, 13 aa, Borrelia garinii
KLFASGANANAAA

SEQ ID NO: 183685 - protein, 13 aa, Borrelia garinii
LFASGANANAAAN

SEQ ID NO: 183686 - protein, 13 aa, Borrelia garinii
FASGANANAAANA

SEQ ID NO: 183687 - protein, 13 aa, Borrelia garinii
ASGANANAAANAD

SEQ ID NO: 183688 - protein, 13 aa, Borrelia garinii
SGANANAAANADD

SEQ ID NO: 183689 - protein, 13 aa, Borrelia garinii
GANANAAANADDA

SEQ ID NO: 183690 - protein, 13 aa, Borrelia garinii
ANANAAANADDAE

SEQ ID NO: 183691 - protein, 13 aa, Borrelia garinii
NANAAANADDAEG

SEQ ID NO: 183692 - protein, 13 aa, Borrelia garinii
ANAAANADDAEGA

SEQ ID NO: 183693 - protein, 13 aa, Borrelia garinii
NAAANADDAEGAA

SEQ ID NO: 183694 - protein, 13 aa, Borrelia garinii
AAANADDAEGAAE

SEQ ID NO: 183695 - protein, 13 aa, Borrelia garinii
AANADDAEGAAEA

SEQ ID NO: 183696 - protein, 13 aa, Borrelia garinii
ANADDAEGAAEAA

SEQ ID NO: 183697 - protein, 13 aa, Borrelia garinii
NADDAEGAAEAAG

SEQ ID NO: 183698 - protein, 13 aa, Borrelia garinii
ADDAEGAAEAAGK

SEQ ID NO: 183699 - protein, 13 aa, Borrelia garinii
DDAEGAAEAAGKA

SEQ ID NO: 183700 - protein, 13 aa, Borrelia garinii
DAEGAAEAAGKAV

SEQ ID NO: 183701 - protein, 13 aa, Borrelia garinii
AEGAAEAAGKAVS

SEQ ID NO: 183702 - protein, 13 aa, Borrelia garinii
EGAAEAAGKAVSA

SEQ ID NO: 183703 - protein, 13 aa, Borrelia garinii
GAAEAAGKAVSAV

SEQ ID NO: 183704 - protein, 13 aa, Borrelia garinii
AAEAAGKAVSAVS

SEQ ID NO: 183705 - protein, 13 aa, Borrelia garinii
AEAAGKAVSAVSG

SEQ ID NO: 183706 - protein, 13 aa, Borrelia garinii
EAAGKAVSAVSGD

SEQ ID NO: 183707 - protein, 13 aa, Borrelia garinii
AAGKAVSAVSGDQ

SEQ ID NO: 183708 - protein, 13 aa, Borrelia garinii
AGKAVSAVSGDQI

SEQ ID NO: 183709 - protein, 13 aa, Borrelia garinii
GKAVSAVSGDQIL

SEQ ID NO: 183710 - protein, 13 aa, Borrelia garinii
KAVSAVSGDQILK

SEQ ID NO: 183711 - protein, 13 aa, Borrelia garinii
AVSAVSGDQILKA

SEQ ID NO: 183712 - protein, 13 aa, Borrelia garinii
VSAVSGDQILKAI

SEQ ID NO: 183713 - protein, 13 aa, Borrelia garinii
SAVSGDQILKAIV

SEQ ID NO: 183714 - protein, 13 aa, Borrelia garinii
AVSGDQILKAIVD

SEQ ID NO: 183715 - protein, 13 aa, Borrelia garinii
VSGDQILKAIVDA

SEQ ID NO: 183716 - protein, 13 aa, Borrelia garinii
SGDQILKAIVDAA

SEQ ID NO: 183717 - protein, 13 aa, Borrelia garinii
GDQILKAIVDAAG

SEQ ID NO: 183718 - protein, 13 aa, Borrelia garinii
DQILKAIVDAAGA

SEQ ID NO: 183719 - protein, 13 aa, Borrelia garinii
QILKAIVDAAGAT

SEQ ID NO: 183720 - protein, 13 aa, Borrelia garinii
ILKAIVDAAGATA

SEQ ID NO: 183721 - protein, 13 aa, Borrelia garinii
LKAIVDAAGATAG

SEQ ID NO: 183722 - protein, 13 aa, Borrelia garinii
KAIVDAAGATAGK

SEQ ID NO: 183723 - protein, 13 aa, Borrelia garinii
AIVDAAGATAGKK

SEQ ID NO: 183724 - protein, 13 aa, Borrelia garinii
IVDAAGATAGKKA

SEQ ID NO: 183725 - protein, 13 aa, Borrelia garinii
VDAAGATAGKKAN

SEQ ID NO: 183726 - protein, 13 aa, Borrelia garinii
DAAGATAGKKANE

SEQ ID NO: 183727 - protein, 13 aa, Borrelia garinii
AAGATAGKKANEA

SEQ ID NO: 183728 - protein, 13 aa, Borrelia garinii
AGATAGKKANEAT

SEQ ID NO: 183729 - protein, 13 aa, Borrelia garinii
GATAGKKANEATN

SEQ ID NO: 183730 - protein, 13 aa, Borrelia garinii
ATAGKKANEATNA

SEQ ID NO: 183731 - protein, 13 aa, Borrelia garinii
TAGKKANEATNAV

SEQ ID NO: 183732 - protein, 13 aa, Borrelia garinii
AGKKANEATNAVE

SEQ ID NO: 183733 - protein, 13 aa, Borrelia garinii
GKKANEATNAVEA

SEQ ID NO: 183734 - protein, 13 aa, Borrelia garinii
KKANEATNAVEAA

SEQ ID NO: 183735 - protein, 13 aa, Borrelia garinii
KANEATNAVEAAI

SEQ ID NO: 183736 - protein, 13 aa, Borrelia garinii
ANEATNAVEAAIG

SEQ ID NO: 183737 - protein, 13 aa, Borrelia garinii
NEATNAVEAAIGD

SEQ ID NO: 183738 - protein, 13 aa, Borrelia garinii
EATNAVEAAIGDD

SEQ ID NO: 183739 - protein, 13 aa, Borrelia garinii
ATNAVEAAIGDDN

SEQ ID NO: 183740 - protein, 13 aa, Borrelia garinii
TNAVEAAIGDDNA

SEQ ID NO: 183741 - protein, 13 aa, Borrelia garinii
NAVEAAIGDDNAG

SEQ ID NO: 183742 - protein, 13 aa, Borrelia garinii
AVEAAIGDDNAGQ

SEQ ID NO: 183743 - protein, 13 aa, Borrelia garinii
VEAAIGDDNAGQA

SEQ ID NO: 183744 - protein, 13 aa, Borrelia garinii
EAAIGDDNAGQAG

SEQ ID NO: 183745 - protein, 13 aa, Borrelia garinii
AAIGDDNAGQAGA

SEQ ID NO: 183746 - protein, 13 aa, Borrelia garinii
AIGDDNAGQAGAA

SEQ ID NO: 183747 - protein, 13 aa, Borrelia garinii
IGDDNAGQAGAAF

SEQ ID NO: 183748 - protein, 13 aa, Borrelia garinii
GDDNAGQAGAAFA

SEQ ID NO: 183749 - protein, 13 aa, Borrelia garinii
DDNAGQAGAAFAA

SEQ ID NO: 183750 - protein, 13 aa, Borrelia garinii
DNAGQAGAAFAAG

SEQ ID NO: 183751 - protein, 13 aa, Borrelia garinii
NAGQAGAAFAAGM

SEQ ID NO: 183752 - protein, 13 aa, Borrelia garinii
AGQAGAAFAAGMQ

SEQ ID NO: 183753 - protein, 13 aa, Borrelia garinii
GQAGAAFAAGMQN

SEQ ID NO: 183754 - protein, 13 aa, Borrelia garinii
QAGAAFAAGMQNK

SEQ ID NO: 183755 - protein, 13 aa, Borrelia garinii
AGAAFAAGMQNKN

SEQ ID NO: 183756 - protein, 13 aa, Borrelia garinii
GAAFAAGMQNKND

SEQ ID NO: 183757 - protein, 13 aa, Borrelia garinii
AAFAAGMQNKNDQ

SEQ ID NO: 183758 - protein, 13 aa, Borrelia garinii
AFAAGMQNKNDQI

SEQ ID NO: 183759 - protein, 13 aa, Borrelia garinii
FAAGMQNKNDQIA

SEQ ID NO: 183760 - protein, 13 aa, Borrelia garinii
AAGMQNKNDQIAA

SEQ ID NO: 183761 - protein, 13 aa, Borrelia garinii
AGMQNKNDQIAAA

SEQ ID NO: 183762 - protein, 13 aa, Borrelia garinii
GMQNKNDQIAAAI

SEQ ID NO: 183763 - protein, 13 aa, Borrelia garinii
MQNKNDQIAAAIV

SEQ ID NO: 183764 - protein, 13 aa, Borrelia garinii
QNKNDQIAAAIVL

SEQ ID NO: 183765 - protein, 13 aa, Borrelia garinii
NKNDQIAAAIVLR

SEQ ID NO: 183766 - protein, 13 aa, Borrelia garinii
KNDQIAAAIVLRG

SEQ ID NO: 183767 - protein, 13 aa, Borrelia garinii
NDQIAAAIVLRGL

SEQ ID NO: 183768 - protein, 13 aa, Borrelia garinii
DQIAAAIVLRGLA

SEQ ID NO: 183769 - protein, 13 aa, Borrelia garinii
QIAAAIVLRGLAK

SEQ ID NO: 183770 - protein, 13 aa, Borrelia garinii
IAAAIVLRGLAKS

SEQ ID NO: 183771 - protein, 13 aa, Borrelia garinii
AAAIVLRGLAKSG

SEQ ID NO: 183772 - protein, 13 aa, Borrelia garinii
AAIVLRGLAKSGK

SEQ ID NO: 183773 - protein, 13 aa, Borrelia garinii
AIVLRGLAKSGKF

SEQ ID NO: 183774 - protein, 13 aa, Borrelia garinii
IVLRGLAKSGKFA

SEQ ID NO: 183775 - protein, 13 aa, Borrelia garinii
VLRGLAKSGKFAN

SEQ ID NO: 183776 - protein, 13 aa, Borrelia garinii
LRGLAKSGKFANE

SEQ ID NO: 183777 - protein, 14 aa, Borrelia garinii
MKKISSAIFLLAFF

SEQ ID NO: 183778 - protein, 14 aa, Borrelia garinii
KKISSAIFLLAFFV

SEQ ID NO: 183779 - protein, 14 aa, Borrelia garinii
KISSAIFLLAFFVF

SEQ ID NO: 183780 - protein, 14 aa, Borrelia garinii
ISSAIFLLAFFVFT

SEQ ID NO: 183781 - protein, 14 aa, Borrelia garinii
SSAIFLLAFFVFTN

SEQ ID NO: 183782 - protein, 14 aa, Borrelia garinii
SAIFLLAFFVFTNC

SEQ ID NO: 183783 - protein, 14 aa, Borrelia garinii
AIFLLAFFVFTNCK

SEQ ID NO: 183784 - protein, 14 aa, Borrelia garinii
IFLLAFFVFTNCKN

SEQ ID NO: 183785 - protein, 14 aa, Borrelia garinii
FLLAFFVFTNCKNN

SEQ ID NO: 183786 - protein, 14 aa, Borrelia garinii
LLAFFVFTNCKNNA

SEQ ID NO: 183787 - protein, 14 aa, Borrelia garinii
LAFFVFTNCKNNAE

SEQ ID NO: 183788 - protein, 14 aa, Borrelia garinii
AFFVFTNCKNNAEL

SEQ ID NO: 183789 - protein, 14 aa, Borrelia garinii
FFVFTNCKNNAELA

SEQ ID NO: 183790 - protein, 14 aa, Borrelia garinii
FVFTNCKNNAELAE

SEQ ID NO: 183791 - protein, 14 aa, Borrelia garinii
VFTNCKNNAELAEA

SEQ ID NO: 183792 - protein, 14 aa, Borrelia garinii
FTNCKNNAELAEAE

SEQ ID NO: 183793 - protein, 14 aa, Borrelia garinii
TNCKNNAELAEAEA

SEQ ID NO: 183794 - protein, 14 aa, Borrelia garinii
NCKNNAELAEAEAK

SEQ ID NO: 183795 - protein, 14 aa, Borrelia garinii
CKNNAELAEAEAKN

SEQ ID NO: 183796 - protein, 14 aa, Borrelia garinii
KNNAELAEAEAKNQ

SEQ ID NO: 183797 - protein, 14 aa, Borrelia garinii
NNAELAEAEAKNQS

SEQ ID NO: 183798 - protein, 14 aa, Borrelia garinii
NAELAEAEAKNQSA

SEQ ID NO: 183799 - protein, 14 aa, Borrelia garinii
AELAEAEAKNQSAK

SEQ ID NO: 183800 - protein, 14 aa, Borrelia garinii
ELAEAEAKNQSAKD

SEQ ID NO: 183801 - protein, 14 aa, Borrelia garinii
LAEAEAKNQSAKDF

SEQ ID NO: 183802 - protein, 14 aa, Borrelia garinii
AEAEAKNQSAKDFY

SEQ ID NO: 183803 - protein, 14 aa, Borrelia garinii
EAEAKNQSAKDFYH

SEQ ID NO: 183804 - protein, 14 aa, Borrelia garinii
AEAKNQSAKDFYHA

SEQ ID NO: 183805 - protein, 14 aa, Borrelia garinii
EAKNQSAKDFYHAI

SEQ ID NO: 183806 - protein, 14 aa, Borrelia garinii
AKNQSAKDFYHAII

SEQ ID NO: 183807 - protein, 14 aa, Borrelia garinii
KNQSAKDFYHAIIK

SEQ ID NO: 183808 - protein, 14 aa, Borrelia garinii
NQSAKDFYHAIIKL

SEQ ID NO: 183809 - protein, 14 aa, Borrelia garinii
QSAKDFYHAIIKLG

SEQ ID NO: 183810 - protein, 14 aa, Borrelia garinii
SAKDFYHAIIKLGY

SEQ ID NO: 183811 - protein, 14 aa, Borrelia garinii
AKDFYHAIIKLGYG

SEQ ID NO: 183812 - protein, 14 aa, Borrelia garinii
KDFYHAIIKLGYGF

SEQ ID NO: 183813 - protein, 14 aa, Borrelia garinii
DFYHAIIKLGYGFV

SEQ ID NO: 183814 - protein, 14 aa, Borrelia garinii
FYHAIIKLGYGFVD

SEQ ID NO: 183815 - protein, 14 aa, Borrelia garinii
YHAIIKLGYGFVDV

SEQ ID NO: 183816 - protein, 14 aa, Borrelia garinii
HAIIKLGYGFVDVF

SEQ ID NO: 183817 - protein, 14 aa, Borrelia garinii
AIIKLGYGFVDVFN

SEQ ID NO: 183818 - protein, 14 aa, Borrelia garinii
IIKLGYGFVDVFNA

SEQ ID NO: 183819 - protein, 14 aa, Borrelia garinii
IKLGYGFVDVFNAI

SEQ ID NO: 183820 - protein, 14 aa, Borrelia garinii
KLGYGFVDVFNAIG

SEQ ID NO: 183821 - protein, 14 aa, Borrelia garinii
LGYGFVDVFNAIGG

SEQ ID NO: 183822 - protein, 14 aa, Borrelia garinii
GYGFVDVFNAIGGL

SEQ ID NO: 183823 - protein, 14 aa, Borrelia garinii
YGFVDVFNAIGGLV

SEQ ID NO: 183824 - protein, 14 aa, Borrelia garinii
GFVDVFNAIGGLVS

SEQ ID NO: 183825 - protein, 14 aa, Borrelia garinii
FVDVFNAIGGLVSD

SEQ ID NO: 183826 - protein, 14 aa, Borrelia garinii
VDVFNAIGGLVSDV

SEQ ID NO: 183827 - protein, 14 aa, Borrelia garinii
DVFNAIGGLVSDVF

SEQ ID NO: 183828 - protein, 14 aa, Borrelia garinii
VFNAIGGLVSDVFY

SEQ ID NO: 183829 - protein, 14 aa, Borrelia garinii
FNAIGGLVSDVFYK

SEQ ID NO: 183830 - protein, 14 aa, Borrelia garinii
NAIGGLVSDVFYKA

SEQ ID NO: 183831 - protein, 14 aa, Borrelia garinii
AIGGLVSDVFYKAD

SEQ ID NO: 183832 - protein, 14 aa, Borrelia garinii
IGGLVSDVFYKADP

SEQ ID NO: 183833 - protein, 14 aa, Borrelia garinii
GGLVSDVFYKADPK

SEQ ID NO: 183834 - protein, 14 aa, Borrelia garinii
GLVSDVFYKADPKK

SEQ ID NO: 183835 - protein, 14 aa, Borrelia garinii
LVSDVFYKADPKKS

SEQ ID NO: 183836 - protein, 14 aa, Borrelia garinii
VSDVFYKADPKKSD

SEQ ID NO: 183837 - protein, 14 aa, Borrelia garinii
SDVFYKADPKKSDV

SEQ ID NO: 183838 - protein, 14 aa, Borrelia garinii
DVFYKADPKKSDVK

SEQ ID NO: 183839 - protein, 14 aa, Borrelia garinii
VFYKADPKKSDVKN

SEQ ID NO: 183840 - protein, 14 aa, Borrelia garinii
FYKADPKKSDVKNY

SEQ ID NO: 183841 - protein, 14 aa, Borrelia garinii
YKADPKKSDVKNYF

SEQ ID NO: 183842 - protein, 14 aa, Borrelia garinii
KADPKKSDVKNYFD

SEQ ID NO: 183843 - protein, 14 aa, Borrelia garinii
ADPKKSDVKNYFDS

SEQ ID NO: 183844 - protein, 14 aa, Borrelia garinii
DPKKSDVKNYFDSI

SEQ ID NO: 183845 - protein, 14 aa, Borrelia garinii
PKKSDVKNYFDSIA

SEQ ID NO: 183846 - protein, 14 aa, Borrelia garinii
KKSDVKNYFDSIAS

SEQ ID NO: 183847 - protein, 14 aa, Borrelia garinii
KSDVKNYFDSIASI

SEQ ID NO: 183848 - protein, 14 aa, Borrelia garinii
SDVKNYFDSIASIL

SEQ ID NO: 183849 - protein, 14 aa, Borrelia garinii
DVKNYFDSIASILK

SEQ ID NO: 183850 - protein, 14 aa, Borrelia garinii
VKNYFDSIASILKE

SEQ ID NO: 183851 - protein, 14 aa, Borrelia garinii
KNYFDSIASILKET

SEQ ID NO: 183852 - protein, 14 aa, Borrelia garinii
NYFDSIASILKETQ

SEQ ID NO: 183853 - protein, 14 aa, Borrelia garinii
YFDSIASILKETQT

SEQ ID NO: 183854 - protein, 14 aa, Borrelia garinii
FDSIASILKETQTK

SEQ ID NO: 183855 - protein, 14 aa, Borrelia garinii
DSIASILKETQTKL

SEQ ID NO: 183856 - protein, 14 aa, Borrelia garinii
SIASILKETQTKLD

SEQ ID NO: 183857 - protein, 14 aa, Borrelia garinii
IASILKETQTKLDA

SEQ ID NO: 183858 - protein, 14 aa, Borrelia garinii
ASILKETQTKLDAL

SEQ ID NO: 183859 - protein, 14 aa, Borrelia garinii
SILKETQTKLDALS

SEQ ID NO: 183860 - protein, 14 aa, Borrelia garinii
ILKETQTKLDALSK

SEQ ID NO: 183861 - protein, 14 aa, Borrelia garinii
LKETQTKLDALSKE

SEQ ID NO: 183862 - protein, 14 aa, Borrelia garinii
KETQTKLDALSKEQ

SEQ ID NO: 183863 - protein, 14 aa, Borrelia garinii
ETQTKLDALSKEQG

SEQ ID NO: 183864 - protein, 14 aa, Borrelia garinii
TQTKLDALSKEQGG

SEQ ID NO: 183865 - protein, 14 aa, Borrelia garinii
QTKLDALSKEQGGG

SEQ ID NO: 183866 - protein, 14 aa, Borrelia garinii
TKLDALSKEQGGGD

SEQ ID NO: 183867 - protein, 14 aa, Borrelia garinii
KLDALSKEQGGGDG

SEQ ID NO: 183868 - protein, 14 aa, Borrelia garinii
LDALSKEQGGGDGG

SEQ ID NO: 183869 - protein, 14 aa, Borrelia garinii
DALSKEQGGGDGGT

SEQ ID NO: 183870 - protein, 14 aa, Borrelia garinii
ALSKEQGGGDGGTQ

SEQ ID NO: 183871 - protein, 14 aa, Borrelia garinii
LSKEQGGGDGGTQV

SEQ ID NO: 183872 - protein, 14 aa, Borrelia garinii
SKEQGGGDGGTQVV

SEQ ID NO: 183873 - protein, 14 aa, Borrelia garinii
KEQGGGDGGTQVVD

SEQ ID NO: 183874 - protein, 14 aa, Borrelia garinii
EQGGGDGGTQVVDA

SEQ ID NO: 183875 - protein, 14 aa, Borrelia garinii
QGGGDGGTQVVDAA

SEQ ID NO: 183876 - protein, 14 aa, Borrelia garinii
GGGDGGTQVVDAAK

SEQ ID NO: 183877 - protein, 14 aa, Borrelia garinii
GGDGGTQVVDAAKK

SEQ ID NO: 183878 - protein, 14 aa, Borrelia garinii
GDGGTQVVDAAKKA

SEQ ID NO: 183879 - protein, 14 aa, Borrelia garinii
DGGTQVVDAAKKAG

SEQ ID NO: 183880 - protein, 14 aa, Borrelia garinii
GGTQVVDAAKKAGE

SEQ ID NO: 183881 - protein, 14 aa, Borrelia garinii
GTQVVDAAKKAGEW

SEQ ID NO: 183882 - protein, 14 aa, Borrelia garinii
TQVVDAAKKAGEWI

SEQ ID NO: 183883 - protein, 14 aa, Borrelia garinii
QVVDAAKKAGEWIK

SEQ ID NO: 183884 - protein, 14 aa, Borrelia garinii
VVDAAKKAGEWIKE

SEQ ID NO: 183885 - protein, 14 aa, Borrelia garinii
VDAAKKAGEWIKEM

SEQ ID NO: 183886 - protein, 14 aa, Borrelia garinii
DAAKKAGEWIKEMH

SEQ ID NO: 183887 - protein, 14 aa, Borrelia garinii
AAKKAGEWIKEMHK

SEQ ID NO: 183888 - protein, 14 aa, Borrelia garinii
AKKAGEWIKEMHKA

SEQ ID NO: 183889 - protein, 14 aa, Borrelia garinii
KKAGEWIKEMHKAV

SEQ ID NO: 183890 - protein, 14 aa, Borrelia garinii
KAGEWIKEMHKAVE

SEQ ID NO: 183891 - protein, 14 aa, Borrelia garinii
AGEWIKEMHKAVED

SEQ ID NO: 183892 - protein, 14 aa, Borrelia garinii
GEWIKEMHKAVEDT

SEQ ID NO: 183893 - protein, 14 aa, Borrelia garinii
EWIKEMHKAVEDTA

SEQ ID NO: 183894 - protein, 14 aa, Borrelia garinii
WIKEMHKAVEDTAK

SEQ ID NO: 183895 - protein, 14 aa, Borrelia garinii
IKEMHKAVEDTAKA

SEQ ID NO: 183896 - protein, 14 aa, Borrelia garinii
KEMHKAVEDTAKAG

SEQ ID NO: 183897 - protein, 14 aa, Borrelia garinii
EMHKAVEDTAKAGG

SEQ ID NO: 183898 - protein, 14 aa, Borrelia garinii
MHKAVEDTAKAGGE

SEQ ID NO: 183899 - protein, 14 aa, Borrelia garinii
HKAVEDTAKAGGEG

SEQ ID NO: 183900 - protein, 14 aa, Borrelia garinii
KAVEDTAKAGGEGG

SEQ ID NO: 183901 - protein, 14 aa, Borrelia garinii
AVEDTAKAGGEGGS

SEQ ID NO: 183902 - protein, 14 aa, Borrelia garinii
VEDTAKAGGEGGSE

SEQ ID NO: 183903 - protein, 14 aa, Borrelia garinii
EDTAKAGGEGGSES

SEQ ID NO: 183904 - protein, 14 aa, Borrelia garinii
DTAKAGGEGGSESI

SEQ ID NO: 183905 - protein, 14 aa, Borrelia garinii
TAKAGGEGGSESIA

SEQ ID NO: 183906 - protein, 14 aa, Borrelia garinii
AKAGGEGGSESIAN

SEQ ID NO: 183907 - protein, 14 aa, Borrelia garinii
KAGGEGGSESIANV

SEQ ID NO: 183908 - protein, 14 aa, Borrelia garinii
AGGEGGSESIANVA

SEQ ID NO: 183909 - protein, 14 aa, Borrelia garinii
GGEGGSESIANVAA

SEQ ID NO: 183910 - protein, 14 aa, Borrelia garinii
GEGGSESIANVAAG

SEQ ID NO: 183911 - protein, 14 aa, Borrelia garinii
EGGSESIANVAAGG

SEQ ID NO: 183912 - protein, 14 aa, Borrelia garinii
GGSESIANVAAGGG

SEQ ID NO: 183913 - protein, 14 aa, Borrelia garinii
GSESIANVAAGGGG

SEQ ID NO: 183914 - protein, 14 aa, Borrelia garinii
SESIANVAAGGGGN

SEQ ID NO: 183915 - protein, 14 aa, Borrelia garinii
ESIANVAAGGGGND

SEQ ID NO: 183916 - protein, 14 aa, Borrelia garinii
SIANVAAGGGGNDG

SEQ ID NO: 183917 - protein, 14 aa, Borrelia garinii
IANVAAGGGGNDGA

SEQ ID NO: 183918 - protein, 14 aa, Borrelia garinii
ANVAAGGGGNDGAG

SEQ ID NO: 183919 - protein, 14 aa, Borrelia garinii
NVAAGGGGNDGAGA

SEQ ID NO: 183920 - protein, 14 aa, Borrelia garinii
VAAGGGGNDGAGAK

SEQ ID NO: 183921 - protein, 14 aa, Borrelia garinii
AAGGGGNDGAGAKA

SEQ ID NO: 183922 - protein, 14 aa, Borrelia garinii
AGGGGNDGAGAKAD

SEQ ID NO: 183923 - protein, 14 aa, Borrelia garinii
GGGGNDGAGAKADV

SEQ ID NO: 183924 - protein, 14 aa, Borrelia garinii
GGGNDGAGAKADVN

SEQ ID NO: 183925 - protein, 14 aa, Borrelia garinii
GGNDGAGAKADVNS

SEQ ID NO: 183926 - protein, 14 aa, Borrelia garinii
GNDGAGAKADVNSV

SEQ ID NO: 183927 - protein, 14 aa, Borrelia garinii
NDGAGAKADVNSVT

SEQ ID NO: 183928 - protein, 14 aa, Borrelia garinii
DGAGAKADVNSVTG

SEQ ID NO: 183929 - protein, 14 aa, Borrelia garinii
GAGAKADVNSVTGI

SEQ ID NO: 183930 - protein, 14 aa, Borrelia garinii
AGAKADVNSVTGIA

SEQ ID NO: 183931 - protein, 14 aa, Borrelia garinii
GAKADVNSVTGIAK

SEQ ID NO: 183932 - protein, 14 aa, Borrelia garinii
AKADVNSVTGIAKG

SEQ ID NO: 183933 - protein, 14 aa, Borrelia garinii
KADVNSVTGIAKGM

SEQ ID NO: 183934 - protein, 14 aa, Borrelia garinii
ADVNSVTGIAKGMK

SEQ ID NO: 183935 - protein, 14 aa, Borrelia garinii
DVNSVTGIAKGMKA

SEQ ID NO: 183936 - protein, 14 aa, Borrelia garinii
VNSVTGIAKGMKAI

SEQ ID NO: 183937 - protein, 14 aa, Borrelia garinii
NSVTGIAKGMKAIV

SEQ ID NO: 183938 - protein, 14 aa, Borrelia garinii
SVTGIAKGMKAIVD

SEQ ID NO: 183939 - protein, 14 aa, Borrelia garinii
VTGIAKGMKAIVDA

SEQ ID NO: 183940 - protein, 14 aa, Borrelia garinii
TGIAKGMKAIVDAA

SEQ ID NO: 183941 - protein, 14 aa, Borrelia garinii
GIAKGMKAIVDAAG

SEQ ID NO: 183942 - protein, 14 aa, Borrelia garinii
IAKGMKAIVDAAGK

SEQ ID NO: 183943 - protein, 14 aa, Borrelia garinii
AKGMKAIVDAAGKA

SEQ ID NO: 183944 - protein, 14 aa, Borrelia garinii
KGMKAIVDAAGKAG

SEQ ID NO: 183945 - protein, 14 aa, Borrelia garinii
GMKAIVDAAGKAGV

SEQ ID NO: 183946 - protein, 14 aa, Borrelia garinii
MKAIVDAAGKAGVE

SEQ ID NO: 183947 - protein, 14 aa, Borrelia garinii
KAIVDAAGKAGVEL

SEQ ID NO: 183948 - protein, 14 aa, Borrelia garinii
AIVDAAGKAGVELK

SEQ ID NO: 183949 - protein, 14 aa, Borrelia garinii
IVDAAGKAGVELKP

SEQ ID NO: 183950 - protein, 14 aa, Borrelia garinii
VDAAGKAGVELKPA

SEQ ID NO: 183951 - protein, 14 aa, Borrelia garinii
DAAGKAGVELKPAA

SEQ ID NO: 183952 - protein, 14 aa, Borrelia garinii
AAGKAGVELKPAAA

SEQ ID NO: 183953 - protein, 14 aa, Borrelia garinii
AGKAGVELKPAAAG

SEQ ID NO: 183954 - protein, 14 aa, Borrelia garinii
GKAGVELKPAAAGG

SEQ ID NO: 183955 - protein, 14 aa, Borrelia garinii
KAGVELKPAAAGGA

SEQ ID NO: 183956 - protein, 14 aa, Borrelia garinii
AGVELKPAAAGGAA

SEQ ID NO: 183957 - protein, 14 aa, Borrelia garinii
GVELKPAAAGGAAA

SEQ ID NO: 183958 - protein, 14 aa, Borrelia garinii
VELKPAAAGGAAAN

SEQ ID NO: 183959 - protein, 14 aa, Borrelia garinii
ELKPAAAGGAAAND

SEQ ID NO: 183960 - protein, 14 aa, Borrelia garinii
LKPAAAGGAAANDA

SEQ ID NO: 183961 - protein, 14 aa, Borrelia garinii
KPAAAGGAAANDAG

SEQ ID NO: 183962 - protein, 14 aa, Borrelia garinii
PAAAGGAAANDAGK

SEQ ID NO: 183963 - protein, 14 aa, Borrelia garinii
AAAGGAAANDAGKL

SEQ ID NO: 183964 - protein, 14 aa, Borrelia garinii
AAGGAAANDAGKLF

SEQ ID NO: 183965 - protein, 14 aa, Borrelia garinii
AGGAAANDAGKLFA

SEQ ID NO: 183966 - protein, 14 aa, Borrelia garinii
GGAAANDAGKLFAS

SEQ ID NO: 183967 - protein, 14 aa, Borrelia garinii
GAAANDAGKLFASG

SEQ ID NO: 183968 - protein, 14 aa, Borrelia garinii
AAANDAGKLFASGA

SEQ ID NO: 183969 - protein, 14 aa, Borrelia garinii
AANDAGKLFASGAN

SEQ ID NO: 183970 - protein, 14 aa, Borrelia garinii
ANDAGKLFASGANA

SEQ ID NO: 183971 - protein, 14 aa, Borrelia garinii
NDAGKLFASGANAN

SEQ ID NO: 183972 - protein, 14 aa, Borrelia garinii
DAGKLFASGANANA

SEQ ID NO: 183973 - protein, 14 aa, Borrelia garinii
AGKLFASGANANAA

SEQ ID NO: 183974 - protein, 14 aa, Borrelia garinii
GKLFASGANANAAA

SEQ ID NO: 183975 - protein, 14 aa, Borrelia garinii
KLFASGANANAAAN

SEQ ID NO: 183976 - protein, 14 aa, Borrelia garinii
LFASGANANAAANA

SEQ ID NO: 183977 - protein, 14 aa, Borrelia garinii
FASGANANAAANAD

SEQ ID NO: 183978 - protein, 14 aa, Borrelia garinii
ASGANANAAANADD

SEQ ID NO: 183979 - protein, 14 aa, Borrelia garinii
SGANANAAANADDA

SEQ ID NO: 183980 - protein, 14 aa, Borrelia garinii
GANANAAANADDAE

SEQ ID NO: 183981 - protein, 14 aa, Borrelia garinii
ANANAAANADDAEG

SEQ ID NO: 183982 - protein, 14 aa, Borrelia garinii
NANAAANADDAEGA

SEQ ID NO: 183983 - protein, 14 aa, Borrelia garinii
ANAAANADDAEGAA

SEQ ID NO: 183984 - protein, 14 aa, Borrelia garinii
NAAANADDAEGAAE

SEQ ID NO: 183985 - protein, 14 aa, Borrelia garinii
AAANADDAEGAAEA

SEQ ID NO: 183986 - protein, 14 aa, Borrelia garinii
AANADDAEGAAEAA

SEQ ID NO: 183987 - protein, 14 aa, Borrelia garinii
ANADDAEGAAEAAG

SEQ ID NO: 183988 - protein, 14 aa, Borrelia garinii
NADDAEGAAEAAGK

SEQ ID NO: 183989 - protein, 14 aa, Borrelia garinii
ADDAEGAAEAAGKA

SEQ ID NO: 183990 - protein, 14 aa, Borrelia garinii
DDAEGAAEAAGKAV

SEQ ID NO: 183991 - protein, 14 aa, Borrelia garinii
DAEGAAEAAGKAVS

SEQ ID NO: 183992 - protein, 14 aa, Borrelia garinii
AEGAAEAAGKAVSA

SEQ ID NO: 183993 - protein, 14 aa, Borrelia garinii
EGAAEAAGKAVSAV

SEQ ID NO: 183994 - protein, 14 aa, Borrelia garinii
GAAEAAGKAVSAVS

SEQ ID NO: 183995 - protein, 14 aa, Borrelia garinii
AAEAAGKAVSAVSG

SEQ ID NO: 183996 - protein, 14 aa, Borrelia garinii
AEAAGKAVSAVSGD

SEQ ID NO: 183997 - protein, 14 aa, Borrelia garinii
EAAGKAVSAVSGDQ

SEQ ID NO: 183998 - protein, 14 aa, Borrelia garinii
AAGKAVSAVSGDQI

SEQ ID NO: 183999 - protein, 14 aa, Borrelia garinii
AGKAVSAVSGDQIL

SEQ ID NO: 184000 - protein, 14 aa, Borrelia garinii
GKAVSAVSGDQILK

SEQ ID NO: 184001 - protein, 14 aa, Borrelia garinii
KAVSAVSGDQILKA

SEQ ID NO: 184002 - protein, 14 aa, Borrelia garinii
AVSAVSGDQILKAI

SEQ ID NO: 184003 - protein, 14 aa, Borrelia garinii
VSAVSGDQILKAIV

SEQ ID NO: 184004 - protein, 14 aa, Borrelia garinii
SAVSGDQILKAIVD

SEQ ID NO: 184005 - protein, 14 aa, Borrelia garinii
AVSGDQILKAIVDA

SEQ ID NO: 184006 - protein, 14 aa, Borrelia garinii
VSGDQILKAIVDAA

SEQ ID NO: 184007 - protein, 14 aa, Borrelia garinii
SGDQILKAIVDAAG

SEQ ID NO: 184008 - protein, 14 aa, Borrelia garinii
GDQILKAIVDAAGA

SEQ ID NO: 184009 - protein, 14 aa, Borrelia garinii
DQILKAIVDAAGAT

SEQ ID NO: 184010 - protein, 14 aa, Borrelia garinii
QILKAIVDAAGATA

SEQ ID NO: 184011 - protein, 14 aa, Borrelia garinii
ILKAIVDAAGATAG

SEQ ID NO: 184012 - protein, 14 aa, Borrelia garinii
LKAIVDAAGATAGK

SEQ ID NO: 184013 - protein, 14 aa, Borrelia garinii
KAIVDAAGATAGKK

SEQ ID NO: 184014 - protein, 14 aa, Borrelia garinii
AIVDAAGATAGKKA

SEQ ID NO: 184015 - protein, 14 aa, Borrelia garinii
IVDAAGATAGKKAN

SEQ ID NO: 184016 - protein, 14 aa, Borrelia garinii
VDAAGATAGKKANE

SEQ ID NO: 184017 - protein, 14 aa, Borrelia garinii
DAAGATAGKKANEA

SEQ ID NO: 184018 - protein, 14 aa, Borrelia garinii
AAGATAGKKANEAT

SEQ ID NO: 184019 - protein, 14 aa, Borrelia garinii
AGATAGKKANEATN

SEQ ID NO: 184020 - protein, 14 aa, Borrelia garinii
GATAGKKANEATNA

SEQ ID NO: 184021 - protein, 14 aa, Borrelia garinii
ATAGKKANEATNAV

SEQ ID NO: 184022 - protein, 14 aa, Borrelia garinii
TAGKKANEATNAVE

SEQ ID NO: 184023 - protein, 14 aa, Borrelia garinii
AGKKANEATNAVEA

SEQ ID NO: 184024 - protein, 14 aa, Borrelia garinii
GKKANEATNAVEAA

SEQ ID NO: 184025 - protein, 14 aa, Borrelia garinii
KKANEATNAVEAAI

SEQ ID NO: 184026 - protein, 14 aa, Borrelia garinii
KANEATNAVEAAIG

SEQ ID NO: 184027 - protein, 14 aa, Borrelia garinii
ANEATNAVEAAIGD

SEQ ID NO: 184028 - protein, 14 aa, Borrelia garinii
NEATNAVEAAIGDD

SEQ ID NO: 184029 - protein, 14 aa, Borrelia garinii
EATNAVEAAIGDDN

SEQ ID NO: 184030 - protein, 14 aa, Borrelia garinii
ATNAVEAAIGDDNA

SEQ ID NO: 184031 - protein, 14 aa, Borrelia garinii
TNAVEAAIGDDNAG

SEQ ID NO: 184032 - protein, 14 aa, Borrelia garinii
NAVEAAIGDDNAGQ

SEQ ID NO: 184033 - protein, 14 aa, Borrelia garinii
AVEAAIGDDNAGQA

SEQ ID NO: 184034 - protein, 14 aa, Borrelia garinii
VEAAIGDDNAGQAG

SEQ ID NO: 184035 - protein, 14 aa, Borrelia garinii
EAAIGDDNAGQAGA

SEQ ID NO: 184036 - protein, 14 aa, Borrelia garinii
AAIGDDNAGQAGAA

SEQ ID NO: 184037 - protein, 14 aa, Borrelia garinii
AIGDDNAGQAGAAF

SEQ ID NO: 184038 - protein, 14 aa, Borrelia garinii
IGDDNAGQAGAAFA

SEQ ID NO: 184039 - protein, 14 aa, Borrelia garinii
GDDNAGQAGAAFAA

SEQ ID NO: 184040 - protein, 14 aa, Borrelia garinii
DDNAGQAGAAFAAG

SEQ ID NO: 184041 - protein, 14 aa, Borrelia garinii
DNAGQAGAAFAAGM

SEQ ID NO: 184042 - protein, 14 aa, Borrelia garinii
NAGQAGAAFAAGMQ

SEQ ID NO: 184043 - protein, 14 aa, Borrelia garinii
AGQAGAAFAAGMQN

SEQ ID NO: 184044 - protein, 14 aa, Borrelia garinii
GQAGAAFAAGMQNK

SEQ ID NO: 184045 - protein, 14 aa, Borrelia garinii
QAGAAFAAGMQNKN

SEQ ID NO: 184046 - protein, 14 aa, Borrelia garinii
AGAAFAAGMQNKND

SEQ ID NO: 184047 - protein, 14 aa, Borrelia garinii
GAAFAAGMQNKNDQ

SEQ ID NO: 184048 - protein, 14 aa, Borrelia garinii
AAFAAGMQNKNDQI

SEQ ID NO: 184049 - protein, 14 aa, Borrelia garinii
AFAAGMQNKNDQIA

SEQ ID NO: 184050 - protein, 14 aa, Borrelia garinii
FAAGMQNKNDQIAA

SEQ ID NO: 184051 - protein, 14 aa, Borrelia garinii
AAGMQNKNDQIAAA

SEQ ID NO: 184052 - protein, 14 aa, Borrelia garinii
AGMQNKNDQIAAAI

SEQ ID NO: 184053 - protein, 14 aa, Borrelia garinii
GMQNKNDQIAAAIV

SEQ ID NO: 184054 - protein, 14 aa, Borrelia garinii
MQNKNDQIAAAIVL

SEQ ID NO: 184055 - protein, 14 aa, Borrelia garinii
QNKNDQIAAAIVLR

SEQ ID NO: 184056 - protein, 14 aa, Borrelia garinii
NKNDQIAAAIVLRG

SEQ ID NO: 184057 - protein, 14 aa, Borrelia garinii
KNDQIAAAIVLRGL

SEQ ID NO: 184058 - protein, 14 aa, Borrelia garinii
NDQIAAAIVLRGLA

SEQ ID NO: 184059 - protein, 14 aa, Borrelia garinii
DQIAAAIVLRGLAK

SEQ ID NO: 184060 - protein, 14 aa, Borrelia garinii
QIAAAIVLRGLAKS

SEQ ID NO: 184061 - protein, 14 aa, Borrelia garinii
IAAAIVLRGLAKSG

SEQ ID NO: 184062 - protein, 14 aa, Borrelia garinii
AAAIVLRGLAKSGK

SEQ ID NO: 184063 - protein, 14 aa, Borrelia garinii
AAIVLRGLAKSGKF

SEQ ID NO: 184064 - protein, 14 aa, Borrelia garinii
AIVLRGLAKSGKFA

SEQ ID NO: 184065 - protein, 14 aa, Borrelia garinii
IVLRGLAKSGKFAN

SEQ ID NO: 184066 - protein, 14 aa, Borrelia garinii
VLRGLAKSGKFANE

SEQ ID NO: 184067 - protein, 15 aa, Borrelia garinii
MKKISSAIFLLAFFV

SEQ ID NO: 184068 - protein, 15 aa, Borrelia garinii
KKISSAIFLLAFFVF

SEQ ID NO: 184069 - protein, 15 aa, Borrelia garinii
KISSAIFLLAFFVFT

SEQ ID NO: 184070 - protein, 15 aa, Borrelia garinii
ISSAIFLLAFFVFTN

SEQ ID NO: 184071 - protein, 15 aa, Borrelia garinii
SSAIFLLAFFVFTNC

SEQ ID NO: 184072 - protein, 15 aa, Borrelia garinii
SAIFLLAFFVFTNCK

SEQ ID NO: 184073 - protein, 15 aa, Borrelia garinii
AIFLLAFFVFTNCKN

SEQ ID NO: 184074 - protein, 15 aa, Borrelia garinii
IFLLAFFVFTNCKNN

SEQ ID NO: 184075 - protein, 15 aa, Borrelia garinii
FLLAFFVFTNCKNNA

SEQ ID NO: 184076 - protein, 15 aa, Borrelia garinii
LLAFFVFTNCKNNAE

SEQ ID NO: 184077 - protein, 15 aa, Borrelia garinii
LAFFVFTNCKNNAEL

SEQ ID NO: 184078 - protein, 15 aa, Borrelia garinii
AFFVFTNCKNNAELA

SEQ ID NO: 184079 - protein, 15 aa, Borrelia garinii
FFVFTNCKNNAELAE

SEQ ID NO: 184080 - protein, 15 aa, Borrelia garinii
FVFTNCKNNAELAEA

SEQ ID NO: 184081 - protein, 15 aa, Borrelia garinii
VFTNCKNNAELAEAE

SEQ ID NO: 184082 - protein, 15 aa, Borrelia garinii
FTNCKNNAELAEAEA

SEQ ID NO: 184083 - protein, 15 aa, Borrelia garinii
TNCKNNAELAEAEAK

SEQ ID NO: 184084 - protein, 15 aa, Borrelia garinii
NCKNNAELAEAEAKN

SEQ ID NO: 184085 - protein, 15 aa, Borrelia garinii
CKNNAELAEAEAKNQ

SEQ ID NO: 184086 - protein, 15 aa, Borrelia garinii
KNNAELAEAEAKNQS

SEQ ID NO: 184087 - protein, 15 aa, Borrelia garinii
NNAELAEAEAKNQSA

SEQ ID NO: 184088 - protein, 15 aa, Borrelia garinii
NAELAEAEAKNQSAK

SEQ ID NO: 184089 - protein, 15 aa, Borrelia garinii
AELAEAEAKNQSAKD

SEQ ID NO: 184090 - protein, 15 aa, Borrelia garinii
ELAEAEAKNQSAKDF

SEQ ID NO: 184091 - protein, 15 aa, Borrelia garinii
LAEAEAKNQSAKDFY

SEQ ID NO: 184092 - protein, 15 aa, Borrelia garinii
AEAEAKNQSAKDFYH

SEQ ID NO: 184093 - protein, 15 aa, Borrelia garinii
EAEAKNQSAKDFYHA

SEQ ID NO: 184094 - protein, 15 aa, Borrelia garinii
AEAKNQSAKDFYHAI

SEQ ID NO: 184095 - protein, 15 aa, Borrelia garinii
EAKNQSAKDFYHAII

SEQ ID NO: 184096 - protein, 15 aa, Borrelia garinii
AKNQSAKDFYHAIIK

SEQ ID NO: 184097 - protein, 15 aa, Borrelia garinii
KNQSAKDFYHAIIKL

SEQ ID NO: 184098 - protein, 15 aa, Borrelia garinii
NQSAKDFYHAIIKLG

SEQ ID NO: 184099 - protein, 15 aa, Borrelia garinii
QSAKDFYHAIIKLGY

SEQ ID NO: 184100 - protein, 15 aa, Borrelia garinii
SAKDFYHAIIKLGYG

SEQ ID NO: 184101 - protein, 15 aa, Borrelia garinii
AKDFYHAIIKLGYGF

SEQ ID NO: 184102 - protein, 15 aa, Borrelia garinii
KDFYHAIIKLGYGFV

SEQ ID NO: 184103 - protein, 15 aa, Borrelia garinii
DFYHAIIKLGYGFVD

SEQ ID NO: 184104 - protein, 15 aa, Borrelia garinii
FYHAIIKLGYGFVDV

SEQ ID NO: 184105 - protein, 15 aa, Borrelia garinii
YHAIIKLGYGFVDVF

SEQ ID NO: 184106 - protein, 15 aa, Borrelia garinii
HAIIKLGYGFVDVFN

SEQ ID NO: 184107 - protein, 15 aa, Borrelia garinii
AIIKLGYGFVDVFNA

SEQ ID NO: 184108 - protein, 15 aa, Borrelia garinii
IIKLGYGFVDVFNAI

SEQ ID NO: 184109 - protein, 15 aa, Borrelia garinii
IKLGYGFVDVFNAIG

SEQ ID NO: 184110 - protein, 15 aa, Borrelia garinii
KLGYGFVDVFNAIGG

SEQ ID NO: 184111 - protein, 15 aa, Borrelia garinii
LGYGFVDVFNAIGGL

SEQ ID NO: 184112 - protein, 15 aa, Borrelia garinii
GYGFVDVFNAIGGLV

SEQ ID NO: 184113 - protein, 15 aa, Borrelia garinii
YGFVDVFNAIGGLVS

SEQ ID NO: 184114 - protein, 15 aa, Borrelia garinii
GFVDVFNAIGGLVSD

SEQ ID NO: 184115 - protein, 15 aa, Borrelia garinii
FVDVFNAIGGLVSDV

SEQ ID NO: 184116 - protein, 15 aa, Borrelia garinii
VDVFNAIGGLVSDVF

SEQ ID NO: 184117 - protein, 15 aa, Borrelia garinii
DVFNAIGGLVSDVFY

SEQ ID NO: 184118 - protein, 15 aa, Borrelia garinii
VFNAIGGLVSDVFYK

SEQ ID NO: 184119 - protein, 15 aa, Borrelia garinii
FNAIGGLVSDVFYKA

SEQ ID NO: 184120 - protein, 15 aa, Borrelia garinii
NAIGGLVSDVFYKAD

SEQ ID NO: 184121 - protein, 15 aa, Borrelia garinii
AIGGLVSDVFYKADP

SEQ ID NO: 184122 - protein, 15 aa, Borrelia garinii
IGGLVSDVFYKADPK

SEQ ID NO: 184123 - protein, 15 aa, Borrelia garinii
GGLVSDVFYKADPKK

SEQ ID NO: 184124 - protein, 15 aa, Borrelia garinii
GLVSDVFYKADPKKS

SEQ ID NO: 184125 - protein, 15 aa, Borrelia garinii
LVSDVFYKADPKKSD

SEQ ID NO: 184126 - protein, 15 aa, Borrelia garinii
VSDVFYKADPKKSDV

SEQ ID NO: 184127 - protein, 15 aa, Borrelia garinii
SDVFYKADPKKSDVK

SEQ ID NO: 184128 - protein, 15 aa, Borrelia garinii
DVFYKADPKKSDVKN

SEQ ID NO: 184129 - protein, 15 aa, Borrelia garinii
VFYKADPKKSDVKNY

SEQ ID NO: 184130 - protein, 15 aa, Borrelia garinii
FYKADPKKSDVKNYF

SEQ ID NO: 184131 - protein, 15 aa, Borrelia garinii
YKADPKKSDVKNYFD

SEQ ID NO: 184132 - protein, 15 aa, Borrelia garinii
KADPKKSDVKNYFDS

SEQ ID NO: 184133 - protein, 15 aa, Borrelia garinii
ADPKKSDVKNYFDSI

SEQ ID NO: 184134 - protein, 15 aa, Borrelia garinii
DPKKSDVKNYFDSIA

SEQ ID NO: 184135 - protein, 15 aa, Borrelia garinii
PKKSDVKNYFDSIAS

SEQ ID NO: 184136 - protein, 15 aa, Borrelia garinii
KKSDVKNYFDSIASI

SEQ ID NO: 184137 - protein, 15 aa, Borrelia garinii
KSDVKNYFDSIASIL

SEQ ID NO: 184138 - protein, 15 aa, Borrelia garinii
SDVKNYFDSIASILK

SEQ ID NO: 184139 - protein, 15 aa, Borrelia garinii
DVKNYFDSIASILKE

SEQ ID NO: 184140 - protein, 15 aa, Borrelia garinii
VKNYFDSIASILKET

SEQ ID NO: 184141 - protein, 15 aa, Borrelia garinii
KNYFDSIASILKETQ

SEQ ID NO: 184142 - protein, 15 aa, Borrelia garinii
NYFDSIASILKETQT

SEQ ID NO: 184143 - protein, 15 aa, Borrelia garinii
YFDSIASILKETQTK

SEQ ID NO: 184144 - protein, 15 aa, Borrelia garinii
FDSIASILKETQTKL

SEQ ID NO: 184145 - protein, 15 aa, Borrelia garinii
DSIASILKETQTKLD

SEQ ID NO: 184146 - protein, 15 aa, Borrelia garinii
SIASILKETQTKLDA

SEQ ID NO: 184147 - protein, 15 aa, Borrelia garinii
IASILKETQTKLDAL

SEQ ID NO: 184148 - protein, 15 aa, Borrelia garinii
ASILKETQTKLDALS

SEQ ID NO: 184149 - protein, 15 aa, Borrelia garinii
SILKETQTKLDALSK

SEQ ID NO: 184150 - protein, 15 aa, Borrelia garinii
ILKETQTKLDALSKE

SEQ ID NO: 184151 - protein, 15 aa, Borrelia garinii
LKETQTKLDALSKEQ

SEQ ID NO: 184152 - protein, 15 aa, Borrelia garinii
KETQTKLDALSKEQG

SEQ ID NO: 184153 - protein, 15 aa, Borrelia garinii
ETQTKLDALSKEQGG

SEQ ID NO: 184154 - protein, 15 aa, Borrelia garinii
TQTKLDALSKEQGGG

SEQ ID NO: 184155 - protein, 15 aa, Borrelia garinii
QTKLDALSKEQGGGD

SEQ ID NO: 184156 - protein, 15 aa, Borrelia garinii
TKLDALSKEQGGGDG

SEQ ID NO: 184157 - protein, 15 aa, Borrelia garinii
KLDALSKEQGGGDGG

SEQ ID NO: 184158 - protein, 15 aa, Borrelia garinii
LDALSKEQGGGDGGT

SEQ ID NO: 184159 - protein, 15 aa, Borrelia garinii
DALSKEQGGGDGGTQ

SEQ ID NO: 184160 - protein, 15 aa, Borrelia garinii
ALSKEQGGGDGGTQV

SEQ ID NO: 184161 - protein, 15 aa, Borrelia garinii
LSKEQGGGDGGTQVV

SEQ ID NO: 184162 - protein, 15 aa, Borrelia garinii
SKEQGGGDGGTQVVD

SEQ ID NO: 184163 - protein, 15 aa, Borrelia garinii
KEQGGGDGGTQVVDA

SEQ ID NO: 184164 - protein, 15 aa, Borrelia garinii
EQGGGDGGTQVVDAA

SEQ ID NO: 184165 - protein, 15 aa, Borrelia garinii
QGGGDGGTQVVDAAK

SEQ ID NO: 184166 - protein, 15 aa, Borrelia garinii
GGGDGGTQVVDAAKK

SEQ ID NO: 184167 - protein, 15 aa, Borrelia garinii
GGDGGTQVVDAAKKA

SEQ ID NO: 184168 - protein, 15 aa, Borrelia garinii
GDGGTQVVDAAKKAG

SEQ ID NO: 184169 - protein, 15 aa, Borrelia garinii
DGGTQVVDAAKKAGE

SEQ ID NO: 184170 - protein, 15 aa, Borrelia garinii
GGTQVVDAAKKAGEW

SEQ ID NO: 184171 - protein, 15 aa, Borrelia garinii
GTQVVDAAKKAGEWI

SEQ ID NO: 184172 - protein, 15 aa, Borrelia garinii
TQVVDAAKKAGEWIK

SEQ ID NO: 184173 - protein, 15 aa, Borrelia garinii
QVVDAAKKAGEWIKE

SEQ ID NO: 184174 - protein, 15 aa, Borrelia garinii
VVDAAKKAGEWIKEM

SEQ ID NO: 184175 - protein, 15 aa, Borrelia garinii
VDAAKKAGEWIKEMH

SEQ ID NO: 184176 - protein, 15 aa, Borrelia garinii
DAAKKAGEWIKEMHK

SEQ ID NO: 184177 - protein, 15 aa, Borrelia garinii
AAKKAGEWIKEMHKA

SEQ ID NO: 184178 - protein, 15 aa, Borrelia garinii
AKKAGEWIKEMHKAV

SEQ ID NO: 184179 - protein, 15 aa, Borrelia garinii
KKAGEWIKEMHKAVE

SEQ ID NO: 184180 - protein, 15 aa, Borrelia garinii
KAGEWIKEMHKAVED

SEQ ID NO: 184181 - protein, 15 aa, Borrelia garinii
AGEWIKEMHKAVEDT

SEQ ID NO: 184182 - protein, 15 aa, Borrelia garinii
GEWIKEMHKAVEDTA

SEQ ID NO: 184183 - protein, 15 aa, Borrelia garinii
EWIKEMHKAVEDTAK

SEQ ID NO: 184184 - protein, 15 aa, Borrelia garinii
WIKEMHKAVEDTAKA

SEQ ID NO: 184185 - protein, 15 aa, Borrelia garinii
IKEMHKAVEDTAKAG

SEQ ID NO: 184186 - protein, 15 aa, Borrelia garinii
KEMHKAVEDTAKAGG

SEQ ID NO: 184187 - protein, 15 aa, Borrelia garinii
EMHKAVEDTAKAGGE

SEQ ID NO: 184188 - protein, 15 aa, Borrelia garinii
MHKAVEDTAKAGGEG

SEQ ID NO: 184189 - protein, 15 aa, Borrelia garinii
HKAVEDTAKAGGEGG

SEQ ID NO: 184190 - protein, 15 aa, Borrelia garinii
KAVEDTAKAGGEGGS

SEQ ID NO: 184191 - protein, 15 aa, Borrelia garinii
AVEDTAKAGGEGGSE

SEQ ID NO: 184192 - protein, 15 aa, Borrelia garinii
VEDTAKAGGEGGSES

SEQ ID NO: 184193 - protein, 15 aa, Borrelia garinii
EDTAKAGGEGGSESI

SEQ ID NO: 184194 - protein, 15 aa, Borrelia garinii
DTAKAGGEGGSESIA

SEQ ID NO: 184195 - protein, 15 aa, Borrelia garinii
TAKAGGEGGSESIAN

SEQ ID NO: 184196 - protein, 15 aa, Borrelia garinii
AKAGGEGGSESIANV

SEQ ID NO: 184197 - protein, 15 aa, Borrelia garinii
KAGGEGGSESIANVA

SEQ ID NO: 184198 - protein, 15 aa, Borrelia garinii
AGGEGGSESIANVAA

SEQ ID NO: 184199 - protein, 15 aa, Borrelia garinii
GGEGGSESIANVAAG

SEQ ID NO: 184200 - protein, 15 aa, Borrelia garinii
GEGGSESIANVAAGG

SEQ ID NO: 184201 - protein, 15 aa, Borrelia garinii
EGGSESIANVAAGGG

SEQ ID NO: 184202 - protein, 15 aa, Borrelia garinii
GGSESIANVAAGGGG

SEQ ID NO: 184203 - protein, 15 aa, Borrelia garinii
GSESIANVAAGGGGN

SEQ ID NO: 184204 - protein, 15 aa, Borrelia garinii
SESIANVAAGGGGND

SEQ ID NO: 184205 - protein, 15 aa, Borrelia garinii
ESIANVAAGGGGNDG

SEQ ID NO: 184206 - protein, 15 aa, Borrelia garinii
SIANVAAGGGGNDGA

SEQ ID NO: 184207 - protein, 15 aa, Borrelia garinii
IANVAAGGGGNDGAG

SEQ ID NO: 184208 - protein, 15 aa, Borrelia garinii
ANVAAGGGGNDGAGA

SEQ ID NO: 184209 - protein, 15 aa, Borrelia garinii
NVAAGGGGNDGAGAK

SEQ ID NO: 184210 - protein, 15 aa, Borrelia garinii
VAAGGGGNDGAGAKA

SEQ ID NO: 184211 - protein, 15 aa, Borrelia garinii
AAGGGGNDGAGAKAD

SEQ ID NO: 184212 - protein, 15 aa, Borrelia garinii
AGGGGNDGAGAKADV

SEQ ID NO: 184213 - protein, 15 aa, Borrelia garinii
GGGGNDGAGAKADVN

SEQ ID NO: 184214 - protein, 15 aa, Borrelia garinii
GGGNDGAGAKADVNS

SEQ ID NO: 184215 - protein, 15 aa, Borrelia garinii
GGNDGAGAKADVNSV

SEQ ID NO: 184216 - protein, 15 aa, Borrelia garinii
GNDGAGAKADVNSVT

SEQ ID NO: 184217 - protein, 15 aa, Borrelia garinii
NDGAGAKADVNSVTG

SEQ ID NO: 184218 - protein, 15 aa, Borrelia garinii
DGAGAKADVNSVTGI

SEQ ID NO: 184219 - protein, 15 aa, Borrelia garinii
GAGAKADVNSVTGIA

SEQ ID NO: 184220 - protein, 15 aa, Borrelia garinii
AGAKADVNSVTGIAK

SEQ ID NO: 184221 - protein, 15 aa, Borrelia garinii
GAKADVNSVTGIAKG

SEQ ID NO: 184222 - protein, 15 aa, Borrelia garinii
AKADVNSVTGIAKGM

SEQ ID NO: 184223 - protein, 15 aa, Borrelia garinii
KADVNSVTGIAKGMK

SEQ ID NO: 184224 - protein, 15 aa, Borrelia garinii
ADVNSVTGIAKGMKA

SEQ ID NO: 184225 - protein, 15 aa, Borrelia garinii
DVNSVTGIAKGMKAI

SEQ ID NO: 184226 - protein, 15 aa, Borrelia garinii
VNSVTGIAKGMKAIV

SEQ ID NO: 184227 - protein, 15 aa, Borrelia garinii
NSVTGIAKGMKAIVD

SEQ ID NO: 184228 - protein, 15 aa, Borrelia garinii
SVTGIAKGMKAIVDA

SEQ ID NO: 184229 - protein, 15 aa, Borrelia garinii
VTGIAKGMKAIVDAA

SEQ ID NO: 184230 - protein, 15 aa, Borrelia garinii
TGIAKGMKAIVDAAG

SEQ ID NO: 184231 - protein, 15 aa, Borrelia garinii
GIAKGMKAIVDAAGK

SEQ ID NO: 184232 - protein, 15 aa, Borrelia garinii
IAKGMKAIVDAAGKA

SEQ ID NO: 184233 - protein, 15 aa, Borrelia garinii
AKGMKAIVDAAGKAG

SEQ ID NO: 184234 - protein, 15 aa, Borrelia garinii
KGMKAIVDAAGKAGV

SEQ ID NO: 184235 - protein, 15 aa, Borrelia garinii
GMKAIVDAAGKAGVE

SEQ ID NO: 184236 - protein, 15 aa, Borrelia garinii
MKAIVDAAGKAGVEL

SEQ ID NO: 184237 - protein, 15 aa, Borrelia garinii
KAIVDAAGKAGVELK

SEQ ID NO: 184238 - protein, 15 aa, Borrelia garinii
AIVDAAGKAGVELKP

SEQ ID NO: 184239 - protein, 15 aa, Borrelia garinii
IVDAAGKAGVELKPA

SEQ ID NO: 184240 - protein, 15 aa, Borrelia garinii
VDAAGKAGVELKPAA

SEQ ID NO: 184241 - protein, 15 aa, Borrelia garinii
DAAGKAGVELKPAAA

SEQ ID NO: 184242 - protein, 15 aa, Borrelia garinii
AAGKAGVELKPAAAG

SEQ ID NO: 184243 - protein, 15 aa, Borrelia garinii
AGKAGVELKPAAAGG

SEQ ID NO: 184244 - protein, 15 aa, Borrelia garinii
GKAGVELKPAAAGGA

SEQ ID NO: 184245 - protein, 15 aa, Borrelia garinii
KAGVELKPAAAGGAA

SEQ ID NO: 184246 - protein, 15 aa, Borrelia garinii
AGVELKPAAAGGAAA

SEQ ID NO: 184247 - protein, 15 aa, Borrelia garinii
GVELKPAAAGGAAAN

SEQ ID NO: 184248 - protein, 15 aa, Borrelia garinii
VELKPAAAGGAAAND

SEQ ID NO: 184249 - protein, 15 aa, Borrelia garinii
ELKPAAAGGAAANDA

SEQ ID NO: 184250 - protein, 15 aa, Borrelia garinii
LKPAAAGGAAANDAG

SEQ ID NO: 184251 - protein, 15 aa, Borrelia garinii
KPAAAGGAAANDAGK

SEQ ID NO: 184252 - protein, 15 aa, Borrelia garinii
PAAAGGAAANDAGKL

SEQ ID NO: 184253 - protein, 15 aa, Borrelia garinii
AAAGGAAANDAGKLF

SEQ ID NO: 184254 - protein, 15 aa, Borrelia garinii
AAGGAAANDAGKLFA

SEQ ID NO: 184255 - protein, 15 aa, Borrelia garinii
AGGAAANDAGKLFAS

SEQ ID NO: 184256 - protein, 15 aa, Borrelia garinii
GGAAANDAGKLFASG

SEQ ID NO: 184257 - protein, 15 aa, Borrelia garinii
GAAANDAGKLFASGA

SEQ ID NO: 184258 - protein, 15 aa, Borrelia garinii
AAANDAGKLFASGAN

SEQ ID NO: 184259 - protein, 15 aa, Borrelia garinii
AANDAGKLFASGANA

SEQ ID NO: 184260 - protein, 15 aa, Borrelia garinii
ANDAGKLFASGANAN

SEQ ID NO: 184261 - protein, 15 aa, Borrelia garinii
NDAGKLFASGANANA

SEQ ID NO: 184262 - protein, 15 aa, Borrelia garinii
DAGKLFASGANANAA

SEQ ID NO: 184263 - protein, 15 aa, Borrelia garinii
AGKLFASGANANAAA

SEQ ID NO: 184264 - protein, 15 aa, Borrelia garinii
GKLFASGANANAAAN

SEQ ID NO: 184265 - protein, 15 aa, Borrelia garinii
KLFASGANANAAANA

SEQ ID NO: 184266 - protein, 15 aa, Borrelia garinii
LFASGANANAAANAD

SEQ ID NO: 184267 - protein, 15 aa, Borrelia garinii
FASGANANAAANADD

SEQ ID NO: 184268 - protein, 15 aa, Borrelia garinii
ASGANANAAANADDA

SEQ ID NO: 184269 - protein, 15 aa, Borrelia garinii
SGANANAAANADDAE

SEQ ID NO: 184270 - protein, 15 aa, Borrelia garinii
GANANAAANADDAEG

SEQ ID NO: 184271 - protein, 15 aa, Borrelia garinii
ANANAAANADDAEGA

SEQ ID NO: 184272 - protein, 15 aa, Borrelia garinii
NANAAANADDAEGAA

SEQ ID NO: 184273 - protein, 15 aa, Borrelia garinii
ANAAANADDAEGAAE

SEQ ID NO: 184274 - protein, 15 aa, Borrelia garinii
NAAANADDAEGAAEA

SEQ ID NO: 184275 - protein, 15 aa, Borrelia garinii
AAANADDAEGAAEAA

SEQ ID NO: 184276 - protein, 15 aa, Borrelia garinii
AANADDAEGAAEAAG

SEQ ID NO: 184277 - protein, 15 aa, Borrelia garinii
ANADDAEGAAEAAGK

SEQ ID NO: 184278 - protein, 15 aa, Borrelia garinii
NADDAEGAAEAAGKA

SEQ ID NO: 184279 - protein, 15 aa, Borrelia garinii
ADDAEGAAEAAGKAV

SEQ ID NO: 184280 - protein, 15 aa, Borrelia garinii
DDAEGAAEAAGKAVS

SEQ ID NO: 184281 - protein, 15 aa, Borrelia garinii
DAEGAAEAAGKAVSA

SEQ ID NO: 184282 - protein, 15 aa, Borrelia garinii
AEGAAEAAGKAVSAV

SEQ ID NO: 184283 - protein, 15 aa, Borrelia garinii
EGAAEAAGKAVSAVS

SEQ ID NO: 184284 - protein, 15 aa, Borrelia garinii
GAAEAAGKAVSAVSG

SEQ ID NO: 184285 - protein, 15 aa, Borrelia garinii
AAEAAGKAVSAVSGD

SEQ ID NO: 184286 - protein, 15 aa, Borrelia garinii
AEAAGKAVSAVSGDQ

SEQ ID NO: 184287 - protein, 15 aa, Borrelia garinii
EAAGKAVSAVSGDQI

SEQ ID NO: 184288 - protein, 15 aa, Borrelia garinii
AAGKAVSAVSGDQIL

SEQ ID NO: 184289 - protein, 15 aa, Borrelia garinii
AGKAVSAVSGDQILK

SEQ ID NO: 184290 - protein, 15 aa, Borrelia garinii
GKAVSAVSGDQILKA

SEQ ID NO: 184291 - protein, 15 aa, Borrelia garinii
KAVSAVSGDQILKAI

SEQ ID NO: 184292 - protein, 15 aa, Borrelia garinii
AVSAVSGDQILKAIV

SEQ ID NO: 184293 - protein, 15 aa, Borrelia garinii
VSAVSGDQILKAIVD

SEQ ID NO: 184294 - protein, 15 aa, Borrelia garinii
SAVSGDQILKAIVDA

SEQ ID NO: 184295 - protein, 15 aa, Borrelia garinii
AVSGDQILKAIVDAA

SEQ ID NO: 184296 - protein, 15 aa, Borrelia garinii
VSGDQILKAIVDAAG

SEQ ID NO: 184297 - protein, 15 aa, Borrelia garinii
SGDQILKAIVDAAGA

SEQ ID NO: 184298 - protein, 15 aa, Borrelia garinii
GDQILKAIVDAAGAT

SEQ ID NO: 184299 - protein, 15 aa, Borrelia garinii
DQILKAIVDAAGATA

SEQ ID NO: 184300 - protein, 15 aa, Borrelia garinii
QILKAIVDAAGATAG

SEQ ID NO: 184301 - protein, 15 aa, Borrelia garinii
ILKAIVDAAGATAGK

SEQ ID NO: 184302 - protein, 15 aa, Borrelia garinii
LKAIVDAAGATAGKK

SEQ ID NO: 184303 - protein, 15 aa, Borrelia garinii
KAIVDAAGATAGKKA

SEQ ID NO: 184304 - protein, 15 aa, Borrelia garinii
AIVDAAGATAGKKAN

SEQ ID NO: 184305 - protein, 15 aa, Borrelia garinii
IVDAAGATAGKKANE

SEQ ID NO: 184306 - protein, 15 aa, Borrelia garinii
VDAAGATAGKKANEA

SEQ ID NO: 184307 - protein, 15 aa, Borrelia garinii
DAAGATAGKKANEAT

SEQ ID NO: 184308 - protein, 15 aa, Borrelia garinii
AAGATAGKKANEATN

SEQ ID NO: 184309 - protein, 15 aa, Borrelia garinii
AGATAGKKANEATNA

SEQ ID NO: 184310 - protein, 15 aa, Borrelia garinii
GATAGKKANEATNAV

SEQ ID NO: 184311 - protein, 15 aa, Borrelia garinii
ATAGKKANEATNAVE

SEQ ID NO: 184312 - protein, 15 aa, Borrelia garinii
TAGKKANEATNAVEA

SEQ ID NO: 184313 - protein, 15 aa, Borrelia garinii
AGKKANEATNAVEAA

SEQ ID NO: 184314 - protein, 15 aa, Borrelia garinii
GKKANEATNAVEAAI

SEQ ID NO: 184315 - protein, 15 aa, Borrelia garinii
KKANEATNAVEAAIG

SEQ ID NO: 184316 - protein, 15 aa, Borrelia garinii
KANEATNAVEAAIGD

SEQ ID NO: 184317 - protein, 15 aa, Borrelia garinii
ANEATNAVEAAIGDD

SEQ ID NO: 184318 - protein, 15 aa, Borrelia garinii
NEATNAVEAAIGDDN

SEQ ID NO: 184319 - protein, 15 aa, Borrelia garinii
EATNAVEAAIGDDNA

SEQ ID NO: 184320 - protein, 15 aa, Borrelia garinii
ATNAVEAAIGDDNAG

SEQ ID NO: 184321 - protein, 15 aa, Borrelia garinii
TNAVEAAIGDDNAGQ

SEQ ID NO: 184322 - protein, 15 aa, Borrelia garinii
NAVEAAIGDDNAGQA

SEQ ID NO: 184323 - protein, 15 aa, Borrelia garinii
AVEAAIGDDNAGQAG

SEQ ID NO: 184324 - protein, 15 aa, Borrelia garinii
VEAAIGDDNAGQAGA

SEQ ID NO: 184325 - protein, 15 aa, Borrelia garinii
EAAIGDDNAGQAGAA

SEQ ID NO: 184326 - protein, 15 aa, Borrelia garinii
AAIGDDNAGQAGAAF

SEQ ID NO: 184327 - protein, 15 aa, Borrelia garinii
AIGDDNAGQAGAAFA

SEQ ID NO: 184328 - protein, 15 aa, Borrelia garinii
IGDDNAGQAGAAFAA

SEQ ID NO: 184329 - protein, 15 aa, Borrelia garinii
GDDNAGQAGAAFAAG

SEQ ID NO: 184330 - protein, 15 aa, Borrelia garinii
DDNAGQAGAAFAAGM

SEQ ID NO: 184331 - protein, 15 aa, Borrelia garinii
DNAGQAGAAFAAGMQ

SEQ ID NO: 184332 - protein, 15 aa, Borrelia garinii
NAGQAGAAFAAGMQN

SEQ ID NO: 184333 - protein, 15 aa, Borrelia garinii
AGQAGAAFAAGMQNK

SEQ ID NO: 184334 - protein, 15 aa, Borrelia garinii
GQAGAAFAAGMQNKN

SEQ ID NO: 184335 - protein, 15 aa, Borrelia garinii
QAGAAFAAGMQNKND

SEQ ID NO: 184336 - protein, 15 aa, Borrelia garinii
AGAAFAAGMQNKNDQ

SEQ ID NO: 184337 - protein, 15 aa, Borrelia garinii
GAAFAAGMQNKNDQI

SEQ ID NO: 184338 - protein, 15 aa, Borrelia garinii
AAFAAGMQNKNDQIA

SEQ ID NO: 184339 - protein, 15 aa, Borrelia garinii
AFAAGMQNKNDQIAA

SEQ ID NO: 184340 - protein, 15 aa, Borrelia garinii
FAAGMQNKNDQIAAA

SEQ ID NO: 184341 - protein, 15 aa, Borrelia garinii
AAGMQNKNDQIAAAI

SEQ ID NO: 184342 - protein, 15 aa, Borrelia garinii
AGMQNKNDQIAAAIV

SEQ ID NO: 184343 - protein, 15 aa, Borrelia garinii
GMQNKNDQIAAAIVL

SEQ ID NO: 184344 - protein, 15 aa, Borrelia garinii
MQNKNDQIAAAIVLR

SEQ ID NO: 184345 - protein, 15 aa, Borrelia garinii
QNKNDQIAAAIVLRG

SEQ ID NO: 184346 - protein, 15 aa, Borrelia garinii
NKNDQIAAAIVLRGL

SEQ ID NO: 184347 - protein, 15 aa, Borrelia garinii
KNDQIAAAIVLRGLA

SEQ ID NO: 184348 - protein, 15 aa, Borrelia garinii
NDQIAAAIVLRGLAK

SEQ ID NO: 184349 - protein, 15 aa, Borrelia garinii
DQIAAAIVLRGLAKS

SEQ ID NO: 184350 - protein, 15 aa, Borrelia garinii
QIAAAIVLRGLAKSG

SEQ ID NO: 184351 - protein, 15 aa, Borrelia garinii
IAAAIVLRGLAKSGK

SEQ ID NO: 184352 - protein, 15 aa, Borrelia garinii
AAAIVLRGLAKSGKF

SEQ ID NO: 184353 - protein, 15 aa, Borrelia garinii
AAIVLRGLAKSGKFA

SEQ ID NO: 184354 - protein, 15 aa, Borrelia garinii
AIVLRGLAKSGKFAN

SEQ ID NO: 184355 - protein, 15 aa, Borrelia garinii
IVLRGLAKSGKFANE

SEQ ID NO: 184356 - protein, 16 aa, Borrelia garinii
MKKISSAIFLLAFFVF

SEQ ID NO: 184357 - protein, 16 aa, Borrelia garinii
KKISSAIFLLAFFVFT

SEQ ID NO: 184358 - protein, 16 aa, Borrelia garinii
KISSAIFLLAFFVFTN

SEQ ID NO: 184359 - protein, 16 aa, Borrelia garinii
ISSAIFLLAFFVFTNC

SEQ ID NO: 184360 - protein, 16 aa, Borrelia garinii
SSAIFLLAFFVFTNCK

SEQ ID NO: 184361 - protein, 16 aa, Borrelia garinii
SAIFLLAFFVFTNCKN

SEQ ID NO: 184362 - protein, 16 aa, Borrelia garinii
AIFLLAFFVFTNCKNN

SEQ ID NO: 184363 - protein, 16 aa, Borrelia garinii
IFLLAFFVFTNCKNNA

SEQ ID NO: 184364 - protein, 16 aa, Borrelia garinii
FLLAFFVFTNCKNNAE

SEQ ID NO: 184365 - protein, 16 aa, Borrelia garinii
LLAFFVFTNCKNNAEL

SEQ ID NO: 184366 - protein, 16 aa, Borrelia garinii
LAFFVFTNCKNNAELA

SEQ ID NO: 184367 - protein, 16 aa, Borrelia garinii
AFFVFTNCKNNAELAE

SEQ ID NO: 184368 - protein, 16 aa, Borrelia garinii
FFVFTNCKNNAELAEA

SEQ ID NO: 184369 - protein, 16 aa, Borrelia garinii
FVFTNCKNNAELAEAE

SEQ ID NO: 184370 - protein, 16 aa, Borrelia garinii
VFTNCKNNAELAEAEA

SEQ ID NO: 184371 - protein, 16 aa, Borrelia garinii
FTNCKNNAELAEAEAK

SEQ ID NO: 184372 - protein, 16 aa, Borrelia garinii
TNCKNNAELAEAEAKN

SEQ ID NO: 184373 - protein, 16 aa, Borrelia garinii
NCKNNAELAEAEAKNQ

SEQ ID NO: 184374 - protein, 16 aa, Borrelia garinii
CKNNAELAEAEAKNQS

SEQ ID NO: 184375 - protein, 16 aa, Borrelia garinii
KNNAELAEAEAKNQSA

SEQ ID NO: 184376 - protein, 16 aa, Borrelia garinii
NNAELAEAEAKNQSAK

SEQ ID NO: 184377 - protein, 16 aa, Borrelia garinii
NAELAEAEAKNQSAKD

SEQ ID NO: 184378 - protein, 16 aa, Borrelia garinii
AELAEAEAKNQSAKDF

SEQ ID NO: 184379 - protein, 16 aa, Borrelia garinii
ELAEAEAKNQSAKDFY

SEQ ID NO: 184380 - protein, 16 aa, Borrelia garinii
LAEAEAKNQSAKDFYH

SEQ ID NO: 184381 - protein, 16 aa, Borrelia garinii
AEAEAKNQSAKDFYHA

SEQ ID NO: 184382 - protein, 16 aa, Borrelia garinii
EAEAKNQSAKDFYHAI

SEQ ID NO: 184383 - protein, 16 aa, Borrelia garinii
AEAKNQSAKDFYHAII

SEQ ID NO: 184384 - protein, 16 aa, Borrelia garinii
EAKNQSAKDFYHAIIK

SEQ ID NO: 184385 - protein, 16 aa, Borrelia garinii
AKNQSAKDFYHAIIKL

SEQ ID NO: 184386 - protein, 16 aa, Borrelia garinii
KNQSAKDFYHAIIKLG

SEQ ID NO: 184387 - protein, 16 aa, Borrelia garinii
NQSAKDFYHAIIKLGY

SEQ ID NO: 184388 - protein, 16 aa, Borrelia garinii
QSAKDFYHAIIKLGYG

SEQ ID NO: 184389 - protein, 16 aa, Borrelia garinii
SAKDFYHAIIKLGYGF

SEQ ID NO: 184390 - protein, 16 aa, Borrelia garinii
AKDFYHAIIKLGYGFV

SEQ ID NO: 184391 - protein, 16 aa, Borrelia garinii
KDFYHAIIKLGYGFVD

SEQ ID NO: 184392 - protein, 16 aa, Borrelia garinii
DFYHAIIKLGYGFVDV

SEQ ID NO: 184393 - protein, 16 aa, Borrelia garinii
FYHAIIKLGYGFVDVF

SEQ ID NO: 184394 - protein, 16 aa, Borrelia garinii
YHAIIKLGYGFVDVFN

SEQ ID NO: 184395 - protein, 16 aa, Borrelia garinii
HAIIKLGYGFVDVFNA

SEQ ID NO: 184396 - protein, 16 aa, Borrelia garinii
AIIKLGYGFVDVFNAI

SEQ ID NO: 184397 - protein, 16 aa, Borrelia garinii
IIKLGYGFVDVFNAIG

SEQ ID NO: 184398 - protein, 16 aa, Borrelia garinii
IKLGYGFVDVFNAIGG

SEQ ID NO: 184399 - protein, 16 aa, Borrelia garinii
KLGYGFVDVFNAIGGL

SEQ ID NO: 184400 - protein, 16 aa, Borrelia garinii
LGYGFVDVFNAIGGLV

SEQ ID NO: 184401 - protein, 16 aa, Borrelia garinii
GYGFVDVFNAIGGLVS

SEQ ID NO: 184402 - protein, 16 aa, Borrelia garinii
YGFVDVFNAIGGLVSD

SEQ ID NO: 184403 - protein, 16 aa, Borrelia garinii
GFVDVFNAIGGLVSDV

SEQ ID NO: 184404 - protein, 16 aa, Borrelia garinii
FVDVFNAIGGLVSDVF

SEQ ID NO: 184405 - protein, 16 aa, Borrelia garinii
VDVFNAIGGLVSDVFY

SEQ ID NO: 184406 - protein, 16 aa, Borrelia garinii
DVFNAIGGLVSDVFYK

SEQ ID NO: 184407 - protein, 16 aa, Borrelia garinii
VFNAIGGLVSDVFYKA

SEQ ID NO: 184408 - protein, 16 aa, Borrelia garinii
FNAIGGLVSDVFYKAD

SEQ ID NO: 184409 - protein, 16 aa, Borrelia garinii
NAIGGLVSDVFYKADP

SEQ ID NO: 184410 - protein, 16 aa, Borrelia garinii
AIGGLVSDVFYKADPK

SEQ ID NO: 184411 - protein, 16 aa, Borrelia garinii
IGGLVSDVFYKADPKK

SEQ ID NO: 184412 - protein, 16 aa, Borrelia garinii
GGLVSDVFYKADPKKS

SEQ ID NO: 184413 - protein, 16 aa, Borrelia garinii
GLVSDVFYKADPKKSD

SEQ ID NO: 184414 - protein, 16 aa, Borrelia garinii
LVSDVFYKADPKKSDV

SEQ ID NO: 184415 - protein, 16 aa, Borrelia garinii
VSDVFYKADPKKSDVK

SEQ ID NO: 184416 - protein, 16 aa, Borrelia garinii
SDVFYKADPKKSDVKN

SEQ ID NO: 184417 - protein, 16 aa, Borrelia garinii
DVFYKADPKKSDVKNY

SEQ ID NO: 184418 - protein, 16 aa, Borrelia garinii
VFYKADPKKSDVKNYF

SEQ ID NO: 184419 - protein, 16 aa, Borrelia garinii
FYKADPKKSDVKNYFD

SEQ ID NO: 184420 - protein, 16 aa, Borrelia garinii
YKADPKKSDVKNYFDS

SEQ ID NO: 184421 - protein, 16 aa, Borrelia garinii
KADPKKSDVKNYFDSI

SEQ ID NO: 184422 - protein, 16 aa, Borrelia garinii
ADPKKSDVKNYFDSIA

SEQ ID NO: 184423 - protein, 16 aa, Borrelia garinii
DPKKSDVKNYFDSIAS

SEQ ID NO: 184424 - protein, 16 aa, Borrelia garinii
PKKSDVKNYFDSIASI

SEQ ID NO: 184425 - protein, 16 aa, Borrelia garinii
KKSDVKNYFDSIASIL

SEQ ID NO: 184426 - protein, 16 aa, Borrelia garinii
KSDVKNYFDSIASILK

SEQ ID NO: 184427 - protein, 16 aa, Borrelia garinii
SDVKNYFDSIASILKE

SEQ ID NO: 184428 - protein, 16 aa, Borrelia garinii
DVKNYFDSIASILKET

SEQ ID NO: 184429 - protein, 16 aa, Borrelia garinii
VKNYFDSIASILKETQ

SEQ ID NO: 184430 - protein, 16 aa, Borrelia garinii
KNYFDSIASILKETQT

SEQ ID NO: 184431 - protein, 16 aa, Borrelia garinii
NYFDSIASILKETQTK

SEQ ID NO: 184432 - protein, 16 aa, Borrelia garinii
YFDSIASILKETQTKL

SEQ ID NO: 184433 - protein, 16 aa, Borrelia garinii
FDSIASILKETQTKLD

SEQ ID NO: 184434 - protein, 16 aa, Borrelia garinii
DSIASILKETQTKLDA

SEQ ID NO: 184435 - protein, 16 aa, Borrelia garinii
SIASILKETQTKLDAL

SEQ ID NO: 184436 - protein, 16 aa, Borrelia garinii
IASILKETQTKLDALS

SEQ ID NO: 184437 - protein, 16 aa, Borrelia garinii
ASILKETQTKLDALSK

SEQ ID NO: 184438 - protein, 16 aa, Borrelia garinii
SILKETQTKLDALSKE

SEQ ID NO: 184439 - protein, 16 aa, Borrelia garinii
ILKETQTKLDALSKEQ

SEQ ID NO: 184440 - protein, 16 aa, Borrelia garinii
LKETQTKLDALSKEQG

SEQ ID NO: 184441 - protein, 16 aa, Borrelia garinii
KETQTKLDALSKEQGG

SEQ ID NO: 184442 - protein, 16 aa, Borrelia garinii
ETQTKLDALSKEQGGG

SEQ ID NO: 184443 - protein, 16 aa, Borrelia garinii
TQTKLDALSKEQGGGD

SEQ ID NO: 184444 - protein, 16 aa, Borrelia garinii
QTKLDALSKEQGGGDG

SEQ ID NO: 184445 - protein, 16 aa, Borrelia garinii
TKLDALSKEQGGGDGG

SEQ ID NO: 184446 - protein, 16 aa, Borrelia garinii
KLDALSKEQGGGDGGT

SEQ ID NO: 184447 - protein, 16 aa, Borrelia garinii
LDALSKEQGGGDGGTQ

SEQ ID NO: 184448 - protein, 16 aa, Borrelia garinii
DALSKEQGGGDGGTQV

SEQ ID NO: 184449 - protein, 16 aa, Borrelia garinii
ALSKEQGGGDGGTQVV

SEQ ID NO: 184450 - protein, 16 aa, Borrelia garinii
LSKEQGGGDGGTQVVD

SEQ ID NO: 184451 - protein, 16 aa, Borrelia garinii
SKEQGGGDGGTQVVDA

SEQ ID NO: 184452 - protein, 16 aa, Borrelia garinii
KEQGGGDGGTQVVDAA

SEQ ID NO: 184453 - protein, 16 aa, Borrelia garinii
EQGGGDGGTQVVDAAK

SEQ ID NO: 184454 - protein, 16 aa, Borrelia garinii
QGGGDGGTQVVDAAKK

SEQ ID NO: 184455 - protein, 16 aa, Borrelia garinii
GGGDGGTQVVDAAKKA

SEQ ID NO: 184456 - protein, 16 aa, Borrelia garinii
GGDGGTQVVDAAKKAG

SEQ ID NO: 184457 - protein, 16 aa, Borrelia garinii
GDGGTQVVDAAKKAGE

SEQ ID NO: 184458 - protein, 16 aa, Borrelia garinii
DGGTQVVDAAKKAGEW

SEQ ID NO: 184459 - protein, 16 aa, Borrelia garinii
GGTQVVDAAKKAGEWI

SEQ ID NO: 184460 - protein, 16 aa, Borrelia garinii
GTQVVDAAKKAGEWIK

SEQ ID NO: 184461 - protein, 16 aa, Borrelia garinii
TQVVDAAKKAGEWIKE

SEQ ID NO: 184462 - protein, 16 aa, Borrelia garinii
QVVDAAKKAGEWIKEM

SEQ ID NO: 184463 - protein, 16 aa, Borrelia garinii
VVDAAKKAGEWIKEMH

SEQ ID NO: 184464 - protein, 16 aa, Borrelia garinii
VDAAKKAGEWIKEMHK

SEQ ID NO: 184465 - protein, 16 aa, Borrelia garinii
DAAKKAGEWIKEMHKA

SEQ ID NO: 184466 - protein, 16 aa, Borrelia garinii
AAKKAGEWIKEMHKAV

SEQ ID NO: 184467 - protein, 16 aa, Borrelia garinii
AKKAGEWIKEMHKAVE

SEQ ID NO: 184468 - protein, 16 aa, Borrelia garinii
KKAGEWIKEMHKAVED

SEQ ID NO: 184469 - protein, 16 aa, Borrelia garinii
KAGEWIKEMHKAVEDT

SEQ ID NO: 184470 - protein, 16 aa, Borrelia garinii
AGEWIKEMHKAVEDTA

SEQ ID NO: 184471 - protein, 16 aa, Borrelia garinii
GEWIKEMHKAVEDTAK

SEQ ID NO: 184472 - protein, 16 aa, Borrelia garinii
EWIKEMHKAVEDTAKA

SEQ ID NO: 184473 - protein, 16 aa, Borrelia garinii
WIKEMHKAVEDTAKAG

SEQ ID NO: 184474 - protein, 16 aa, Borrelia garinii
IKEMHKAVEDTAKAGG

SEQ ID NO: 184475 - protein, 16 aa, Borrelia garinii
KEMHKAVEDTAKAGGE

SEQ ID NO: 184476 - protein, 16 aa, Borrelia garinii
EMHKAVEDTAKAGGEG

SEQ ID NO: 184477 - protein, 16 aa, Borrelia garinii
MHKAVEDTAKAGGEGG

SEQ ID NO: 184478 - protein, 16 aa, Borrelia garinii
HKAVEDTAKAGGEGGS

SEQ ID NO: 184479 - protein, 16 aa, Borrelia garinii
KAVEDTAKAGGEGGSE

SEQ ID NO: 184480 - protein, 16 aa, Borrelia garinii
AVEDTAKAGGEGGSES

SEQ ID NO: 184481 - protein, 16 aa, Borrelia garinii
VEDTAKAGGEGGSESI

SEQ ID NO: 184482 - protein, 16 aa, Borrelia garinii
EDTAKAGGEGGSESIA

SEQ ID NO: 184483 - protein, 16 aa, Borrelia garinii
DTAKAGGEGGSESIAN

SEQ ID NO: 184484 - protein, 16 aa, Borrelia garinii
TAKAGGEGGSESIANV

SEQ ID NO: 184485 - protein, 16 aa, Borrelia garinii
AKAGGEGGSESIANVA

SEQ ID NO: 184486 - protein, 16 aa, Borrelia garinii
KAGGEGGSESIANVAA

SEQ ID NO: 184487 - protein, 16 aa, Borrelia garinii
AGGEGGSESIANVAAG

SEQ ID NO: 184488 - protein, 16 aa, Borrelia garinii
GGEGGSESIANVAAGG

SEQ ID NO: 184489 - protein, 16 aa, Borrelia garinii
GEGGSESIANVAAGGG

SEQ ID NO: 184490 - protein, 16 aa, Borrelia garinii
EGGSESIANVAAGGGG

SEQ ID NO: 184491 - protein, 16 aa, Borrelia garinii
GGSESIANVAAGGGGN

SEQ ID NO: 184492 - protein, 16 aa, Borrelia garinii
GSESIANVAAGGGGND

SEQ ID NO: 184493 - protein, 16 aa, Borrelia garinii
SESIANVAAGGGGNDG

SEQ ID NO: 184494 - protein, 16 aa, Borrelia garinii
ESIANVAAGGGGNDGA

SEQ ID NO: 184495 - protein, 16 aa, Borrelia garinii
SIANVAAGGGGNDGAG

SEQ ID NO: 184496 - protein, 16 aa, Borrelia garinii
IANVAAGGGGNDGAGA

SEQ ID NO: 184497 - protein, 16 aa, Borrelia garinii
ANVAAGGGGNDGAGAK

SEQ ID NO: 184498 - protein, 16 aa, Borrelia garinii
NVAAGGGGNDGAGAKA

SEQ ID NO: 184499 - protein, 16 aa, Borrelia garinii
VAAGGGGNDGAGAKAD

SEQ ID NO: 184500 - protein, 16 aa, Borrelia garinii
AAGGGGNDGAGAKADV

SEQ ID NO: 184501 - protein, 16 aa, Borrelia garinii
AGGGGNDGAGAKADVN

SEQ ID NO: 184502 - protein, 16 aa, Borrelia garinii
GGGGNDGAGAKADVNS

SEQ ID NO: 184503 - protein, 16 aa, Borrelia garinii
GGGNDGAGAKADVNSV

SEQ ID NO: 184504 - protein, 16 aa, Borrelia garinii
GGNDGAGAKADVNSVT

SEQ ID NO: 184505 - protein, 16 aa, Borrelia garinii
GNDGAGAKADVNSVTG

SEQ ID NO: 184506 - protein, 16 aa, Borrelia garinii
NDGAGAKADVNSVTGI

SEQ ID NO: 184507 - protein, 16 aa, Borrelia garinii
DGAGAKADVNSVTGIA

SEQ ID NO: 184508 - protein, 16 aa, Borrelia garinii
GAGAKADVNSVTGIAK

SEQ ID NO: 184509 - protein, 16 aa, Borrelia garinii
AGAKADVNSVTGIAKG

SEQ ID NO: 184510 - protein, 16 aa, Borrelia garinii
GAKADVNSVTGIAKGM

SEQ ID NO: 184511 - protein, 16 aa, Borrelia garinii
AKADVNSVTGIAKGMK

SEQ ID NO: 184512 - protein, 16 aa, Borrelia garinii
KADVNSVTGIAKGMKA

SEQ ID NO: 184513 - protein, 16 aa, Borrelia garinii
ADVNSVTGIAKGMKAI

SEQ ID NO: 184514 - protein, 16 aa, Borrelia garinii
DVNSVTGIAKGMKAIV

SEQ ID NO: 184515 - protein, 16 aa, Borrelia garinii
VNSVTGIAKGMKAIVD

SEQ ID NO: 184516 - protein, 16 aa, Borrelia garinii
NSVTGIAKGMKAIVDA

SEQ ID NO: 184517 - protein, 16 aa, Borrelia garinii
SVTGIAKGMKAIVDAA

SEQ ID NO: 184518 - protein, 16 aa, Borrelia garinii
VTGIAKGMKAIVDAAG

SEQ ID NO: 184519 - protein, 16 aa, Borrelia garinii
TGIAKGMKAIVDAAGK

SEQ ID NO: 184520 - protein, 16 aa, Borrelia garinii
GIAKGMKAIVDAAGKA

SEQ ID NO: 184521 - protein, 16 aa, Borrelia garinii
IAKGMKAIVDAAGKAG

SEQ ID NO: 184522 - protein, 16 aa, Borrelia garinii
AKGMKAIVDAAGKAGV

SEQ ID NO: 184523 - protein, 16 aa, Borrelia garinii
KGMKAIVDAAGKAGVE

SEQ ID NO: 184524 - protein, 16 aa, Borrelia garinii
GMKAIVDAAGKAGVEL

SEQ ID NO: 184525 - protein, 16 aa, Borrelia garinii
MKAIVDAAGKAGVELK

SEQ ID NO: 184526 - protein, 16 aa, Borrelia garinii
KAIVDAAGKAGVELKP

SEQ ID NO: 184527 - protein, 16 aa, Borrelia garinii
AIVDAAGKAGVELKPA

SEQ ID NO: 184528 - protein, 16 aa, Borrelia garinii
IVDAAGKAGVELKPAA

SEQ ID NO: 184529 - protein, 16 aa, Borrelia garinii
VDAAGKAGVELKPAAA

SEQ ID NO: 184530 - protein, 16 aa, Borrelia garinii
DAAGKAGVELKPAAAG

SEQ ID NO: 184531 - protein, 16 aa, Borrelia garinii
AAGKAGVELKPAAAGG

SEQ ID NO: 184532 - protein, 16 aa, Borrelia garinii
AGKAGVELKPAAAGGA

SEQ ID NO: 184533 - protein, 16 aa, Borrelia garinii
GKAGVELKPAAAGGAA

SEQ ID NO: 184534 - protein, 16 aa, Borrelia garinii
KAGVELKPAAAGGAAA

SEQ ID NO: 184535 - protein, 16 aa, Borrelia garinii
AGVELKPAAAGGAAAN

SEQ ID NO: 184536 - protein, 16 aa, Borrelia garinii
GVELKPAAAGGAAAND

SEQ ID NO: 184537 - protein, 16 aa, Borrelia garinii
VELKPAAAGGAAANDA

SEQ ID NO: 184538 - protein, 16 aa, Borrelia garinii
ELKPAAAGGAAANDAG

SEQ ID NO: 184539 - protein, 16 aa, Borrelia garinii
LKPAAAGGAAANDAGK

SEQ ID NO: 184540 - protein, 16 aa, Borrelia garinii
KPAAAGGAAANDAGKL

SEQ ID NO: 184541 - protein, 16 aa, Borrelia garinii
PAAAGGAAANDAGKLF

SEQ ID NO: 184542 - protein, 16 aa, Borrelia garinii
AAAGGAAANDAGKLFA

SEQ ID NO: 184543 - protein, 16 aa, Borrelia garinii
AAGGAAANDAGKLFAS

SEQ ID NO: 184544 - protein, 16 aa, Borrelia garinii
AGGAAANDAGKLFASG

SEQ ID NO: 184545 - protein, 16 aa, Borrelia garinii
GGAAANDAGKLFASGA

SEQ ID NO: 184546 - protein, 16 aa, Borrelia garinii
GAAANDAGKLFASGAN

SEQ ID NO: 184547 - protein, 16 aa, Borrelia garinii
AAANDAGKLFASGANA

SEQ ID NO: 184548 - protein, 16 aa, Borrelia garinii
AANDAGKLFASGANAN

SEQ ID NO: 184549 - protein, 16 aa, Borrelia garinii
ANDAGKLFASGANANA

SEQ ID NO: 184550 - protein, 16 aa, Borrelia garinii
NDAGKLFASGANANAA

SEQ ID NO: 184551 - protein, 16 aa, Borrelia garinii
DAGKLFASGANANAAA

SEQ ID NO: 184552 - protein, 16 aa, Borrelia garinii
AGKLFASGANANAAAN

SEQ ID NO: 184553 - protein, 16 aa, Borrelia garinii
GKLFASGANANAAANA

SEQ ID NO: 184554 - protein, 16 aa, Borrelia garinii
KLFASGANANAAANAD

SEQ ID NO: 184555 - protein, 16 aa, Borrelia garinii
LFASGANANAAANADD

SEQ ID NO: 184556 - protein, 16 aa, Borrelia garinii
FASGANANAAANADDA

SEQ ID NO: 184557 - protein, 16 aa, Borrelia garinii
ASGANANAAANADDAE

SEQ ID NO: 184558 - protein, 16 aa, Borrelia garinii
SGANANAAANADDAEG

SEQ ID NO: 184559 - protein, 16 aa, Borrelia garinii
GANANAAANADDAEGA

SEQ ID NO: 184560 - protein, 16 aa, Borrelia garinii
ANANAAANADDAEGAA

SEQ ID NO: 184561 - protein, 16 aa, Borrelia garinii
NANAAANADDAEGAAE

SEQ ID NO: 184562 - protein, 16 aa, Borrelia garinii
ANAAANADDAEGAAEA

SEQ ID NO: 184563 - protein, 16 aa, Borrelia garinii
NAAANADDAEGAAEAA

SEQ ID NO: 184564 - protein, 16 aa, Borrelia garinii
AAANADDAEGAAEAAG

SEQ ID NO: 184565 - protein, 16 aa, Borrelia garinii
AANADDAEGAAEAAGK

SEQ ID NO: 184566 - protein, 16 aa, Borrelia garinii
ANADDAEGAAEAAGKA

SEQ ID NO: 184567 - protein, 16 aa, Borrelia garinii
NADDAEGAAEAAGKAV

SEQ ID NO: 184568 - protein, 16 aa, Borrelia garinii
ADDAEGAAEAAGKAVS

SEQ ID NO: 184569 - protein, 16 aa, Borrelia garinii
DDAEGAAEAAGKAVSA

SEQ ID NO: 184570 - protein, 16 aa, Borrelia garinii
DAEGAAEAAGKAVSAV

SEQ ID NO: 184571 - protein, 16 aa, Borrelia garinii
AEGAAEAAGKAVSAVS

SEQ ID NO: 184572 - protein, 16 aa, Borrelia garinii
EGAAEAAGKAVSAVSG

SEQ ID NO: 184573 - protein, 16 aa, Borrelia garinii
GAAEAAGKAVSAVSGD

SEQ ID NO: 184574 - protein, 16 aa, Borrelia garinii
AAEAAGKAVSAVSGDQ

SEQ ID NO: 184575 - protein, 16 aa, Borrelia garinii
AEAAGKAVSAVSGDQI

SEQ ID NO: 184576 - protein, 16 aa, Borrelia garinii
EAAGKAVSAVSGDQIL

SEQ ID NO: 184577 - protein, 16 aa, Borrelia garinii
AAGKAVSAVSGDQILK

SEQ ID NO: 184578 - protein, 16 aa, Borrelia garinii
AGKAVSAVSGDQILKA

SEQ ID NO: 184579 - protein, 16 aa, Borrelia garinii
GKAVSAVSGDQILKAI

SEQ ID NO: 184580 - protein, 16 aa, Borrelia garinii
KAVSAVSGDQILKAIV

SEQ ID NO: 184581 - protein, 16 aa, Borrelia garinii
AVSAVSGDQILKAIVD

SEQ ID NO: 184582 - protein, 16 aa, Borrelia garinii
VSAVSGDQILKAIVDA

SEQ ID NO: 184583 - protein, 16 aa, Borrelia garinii
SAVSGDQILKAIVDAA

SEQ ID NO: 184584 - protein, 16 aa, Borrelia garinii
AVSGDQILKAIVDAAG

SEQ ID NO: 184585 - protein, 16 aa, Borrelia garinii
VSGDQILKAIVDAAGA

SEQ ID NO: 184586 - protein, 16 aa, Borrelia garinii
SGDQILKAIVDAAGAT

SEQ ID NO: 184587 - protein, 16 aa, Borrelia garinii
GDQILKAIVDAAGATA

SEQ ID NO: 184588 - protein, 16 aa, Borrelia garinii
DQILKAIVDAAGATAG

SEQ ID NO: 184589 - protein, 16 aa, Borrelia garinii
QILKAIVDAAGATAGK

SEQ ID NO: 184590 - protein, 16 aa, Borrelia garinii
ILKAIVDAAGATAGKK

SEQ ID NO: 184591 - protein, 16 aa, Borrelia garinii
LKAIVDAAGATAGKKA

SEQ ID NO: 184592 - protein, 16 aa, Borrelia garinii
KAIVDAAGATAGKKAN

SEQ ID NO: 184593 - protein, 16 aa, Borrelia garinii
AIVDAAGATAGKKANE

SEQ ID NO: 184594 - protein, 16 aa, Borrelia garinii
IVDAAGATAGKKANEA

SEQ ID NO: 184595 - protein, 16 aa, Borrelia garinii
VDAAGATAGKKANEAT

SEQ ID NO: 184596 - protein, 16 aa, Borrelia garinii
DAAGATAGKKANEATN

SEQ ID NO: 184597 - protein, 16 aa, Borrelia garinii
AAGATAGKKANEATNA

SEQ ID NO: 184598 - protein, 16 aa, Borrelia garinii
AGATAGKKANEATNAV

SEQ ID NO: 184599 - protein, 16 aa, Borrelia garinii
GATAGKKANEATNAVE

SEQ ID NO: 184600 - protein, 16 aa, Borrelia garinii
ATAGKKANEATNAVEA

SEQ ID NO: 184601 - protein, 16 aa, Borrelia garinii
TAGKKANEATNAVEAA

SEQ ID NO: 184602 - protein, 16 aa, Borrelia garinii
AGKKANEATNAVEAAI

SEQ ID NO: 184603 - protein, 16 aa, Borrelia garinii
GKKANEATNAVEAAIG

SEQ ID NO: 184604 - protein, 16 aa, Borrelia garinii
KKANEATNAVEAAIGD

SEQ ID NO: 184605 - protein, 16 aa, Borrelia garinii
KANEATNAVEAAIGDD

SEQ ID NO: 184606 - protein, 16 aa, Borrelia garinii
ANEATNAVEAAIGDDN

SEQ ID NO: 184607 - protein, 16 aa, Borrelia garinii
NEATNAVEAAIGDDNA

SEQ ID NO: 184608 - protein, 16 aa, Borrelia garinii
EATNAVEAAIGDDNAG

SEQ ID NO: 184609 - protein, 16 aa, Borrelia garinii
ATNAVEAAIGDDNAGQ

SEQ ID NO: 184610 - protein, 16 aa, Borrelia garinii
TNAVEAAIGDDNAGQA

SEQ ID NO: 184611 - protein, 16 aa, Borrelia garinii
NAVEAAIGDDNAGQAG

SEQ ID NO: 184612 - protein, 16 aa, Borrelia garinii
AVEAAIGDDNAGQAGA

SEQ ID NO: 184613 - protein, 16 aa, Borrelia garinii
VEAAIGDDNAGQAGAA

SEQ ID NO: 184614 - protein, 16 aa, Borrelia garinii
EAAIGDDNAGQAGAAF

SEQ ID NO: 184615 - protein, 16 aa, Borrelia garinii
AAIGDDNAGQAGAAFA

SEQ ID NO: 184616 - protein, 16 aa, Borrelia garinii
AIGDDNAGQAGAAFAA

SEQ ID NO: 184617 - protein, 16 aa, Borrelia garinii
IGDDNAGQAGAAFAAG

SEQ ID NO: 184618 - protein, 16 aa, Borrelia garinii
GDDNAGQAGAAFAAGM

SEQ ID NO: 184619 - protein, 16 aa, Borrelia garinii
DDNAGQAGAAFAAGMQ

SEQ ID NO: 184620 - protein, 16 aa, Borrelia garinii
DNAGQAGAAFAAGMQN

SEQ ID NO: 184621 - protein, 16 aa, Borrelia garinii
NAGQAGAAFAAGMQNK

SEQ ID NO: 184622 - protein, 16 aa, Borrelia garinii
AGQAGAAFAAGMQNKN

SEQ ID NO: 184623 - protein, 16 aa, Borrelia garinii
GQAGAAFAAGMQNKND

SEQ ID NO: 184624 - protein, 16 aa, Borrelia garinii
QAGAAFAAGMQNKNDQ

SEQ ID NO: 184625 - protein, 16 aa, Borrelia garinii
AGAAFAAGMQNKNDQI

SEQ ID NO: 184626 - protein, 16 aa, Borrelia garinii
GAAFAAGMQNKNDQIA

SEQ ID NO: 184627 - protein, 16 aa, Borrelia garinii
AAFAAGMQNKNDQIAA

SEQ ID NO: 184628 - protein, 16 aa, Borrelia garinii
AFAAGMQNKNDQIAAA

SEQ ID NO: 184629 - protein, 16 aa, Borrelia garinii
FAAGMQNKNDQIAAAI

SEQ ID NO: 184630 - protein, 16 aa, Borrelia garinii
AAGMQNKNDQIAAAIV

SEQ ID NO: 184631 - protein, 16 aa, Borrelia garinii
AGMQNKNDQIAAAIVL

SEQ ID NO: 184632 - protein, 16 aa, Borrelia garinii
GMQNKNDQIAAAIVLR

SEQ ID NO: 184633 - protein, 16 aa, Borrelia garinii
MQNKNDQIAAAIVLRG

SEQ ID NO: 184634 - protein, 16 aa, Borrelia garinii
QNKNDQIAAAIVLRGL

SEQ ID NO: 184635 - protein, 16 aa, Borrelia garinii
NKNDQIAAAIVLRGLA

SEQ ID NO: 184636 - protein, 16 aa, Borrelia garinii
KNDQIAAAIVLRGLAK

SEQ ID NO: 184637 - protein, 16 aa, Borrelia garinii
NDQIAAAIVLRGLAKS

SEQ ID NO: 184638 - protein, 16 aa, Borrelia garinii
DQIAAAIVLRGLAKSG

SEQ ID NO: 184639 - protein, 16 aa, Borrelia garinii
QIAAAIVLRGLAKSGK

SEQ ID NO: 184640 - protein, 16 aa, Borrelia garinii
IAAAIVLRGLAKSGKF

SEQ ID NO: 184641 - protein, 16 aa, Borrelia garinii
AAAIVLRGLAKSGKFA

SEQ ID NO: 184642 - protein, 16 aa, Borrelia garinii
AAIVLRGLAKSGKFAN

SEQ ID NO: 184643 - protein, 16 aa, Borrelia garinii
AIVLRGLAKSGKFANE

SEQ ID NO: 184644 - protein, 341 aa, Borrelia afzelii
MRIAIFIFGILLTSCFSKNGIESGSSKIKISMLVDGVLDDKSFNSSANEALLRLKKDFPENIEKVFSSAVSGVYSSYVSDLDNLKMNGSGLIWLVGYMLADVSLSVSLENPEINYGIIDPIYGDDVQIPKNLIGVVFRIEQGAFLAGYIAAKKSVSSKIGFIGGVKGDIVDAFRYGYEAGAKYANKGIEIVSEYSNSFSDIDIARVMANKMYSKGIDIIHFAAGLAGVGVIEAAKELGDGYYVIGADQDQSHLAPKNFITSVIKNVGDALYLITSESLKNDNVWEGGKIVQMGLRDGVVGLSNANEFEYIKDLERKIINKEIIVPCNQEGYEIFIKQILKL

SEQ ID NO: 184645 - protein, 8 aa, Borrelia afzelii
MRIAIFIF

SEQ ID NO: 184646 - protein, 8 aa, Borrelia afzelii
RIAIFIFG

SEQ ID NO: 184647 - protein, 8 aa, Borrelia afzelii
IAIFIFGI

SEQ ID NO: 184648 - protein, 8 aa, Borrelia afzelii
AIFIFGIL

SEQ ID NO: 184649 - protein, 8 aa, Borrelia afzelii
IFIFGILL

SEQ ID NO: 184650 - protein, 8 aa, Borrelia afzelii
FIFGILLT

SEQ ID NO: 184651 - protein, 8 aa, Borrelia afzelii
IFGILLTS

SEQ ID NO: 184652 - protein, 8 aa, Borrelia afzelii
FGILLTSC

SEQ ID NO: 184653 - protein, 8 aa, Borrelia afzelii
GILLTSCF

SEQ ID NO: 184654 - protein, 8 aa, Borrelia afzelii
ILLTSCFS

SEQ ID NO: 184655 - protein, 8 aa, Borrelia afzelii
LLTSCFSK

SEQ ID NO: 184656 - protein, 8 aa, Borrelia afzelii
LTSCFSKN

SEQ ID NO: 184657 - protein, 8 aa, Borrelia afzelii
TSCFSKNG

SEQ ID NO: 184658 - protein, 8 aa, Borrelia afzelii
SCFSKNGI

SEQ ID NO: 184659 - protein, 8 aa, Borrelia afzelii
CFSKNGIE

SEQ ID NO: 184660 - protein, 8 aa, Borrelia afzelii
FSKNGIES

SEQ ID NO: 184661 - protein, 8 aa, Borrelia afzelii
SKNGIESG

SEQ ID NO: 184662 - protein, 8 aa, Borrelia afzelii
KNGIESGS

SEQ ID NO: 184663 - protein, 8 aa, Borrelia afzelii
NGIESGSS

SEQ ID NO: 184664 - protein, 8 aa, Borrelia afzelii
GIESGSSK

SEQ ID NO: 184665 - protein, 8 aa, Borrelia afzelii
IESGSSKI

SEQ ID NO: 184666 - protein, 8 aa, Borrelia afzelii
ESGSSKIK

SEQ ID NO: 184667 - protein, 8 aa, Borrelia afzelii
SGSSKIKI

SEQ ID NO: 184668 - protein, 8 aa, Borrelia afzelii
GSSKIKIS

SEQ ID NO: 184669 - protein, 8 aa, Borrelia afzelii
SSKIKISM

SEQ ID NO: 184670 - protein, 8 aa, Borrelia afzelii
SKIKISML

SEQ ID NO: 184671 - protein, 8 aa, Borrelia afzelii
KIKISMLV

SEQ ID NO: 184672 - protein, 8 aa, Borrelia afzelii
IKISMLVD

SEQ ID NO: 184673 - protein, 8 aa, Borrelia afzelii
KISMLVDG

SEQ ID NO: 184674 - protein, 8 aa, Borrelia afzelii
ISMLVDGV

SEQ ID NO: 184675 - protein, 8 aa, Borrelia afzelii
SMLVDGVL

SEQ ID NO: 184676 - protein, 8 aa, Borrelia afzelii
MLVDGVLD

SEQ ID NO: 184677 - protein, 8 aa, Borrelia afzelii
LVDGVLDD

SEQ ID NO: 184678 - protein, 8 aa, Borrelia afzelii
VDGVLDDK

SEQ ID NO: 184679 - protein, 8 aa, Borrelia afzelii
DGVLDDKS

SEQ ID NO: 184680 - protein, 8 aa, Borrelia afzelii
GVLDDKSF

SEQ ID NO: 184681 - protein, 8 aa, Borrelia afzelii
VLDDKSFN

SEQ ID NO: 184682 - protein, 8 aa, Borrelia afzelii
LDDKSFNS

SEQ ID NO: 184683 - protein, 8 aa, Borrelia afzelii
DDKSFNSS

SEQ ID NO: 184684 - protein, 8 aa, Borrelia afzelii
DKSFNSSA

SEQ ID NO: 184685 - protein, 8 aa, Borrelia afzelii
KSFNSSAN

SEQ ID NO: 184686 - protein, 8 aa, Borrelia afzelii
SFNSSANE

SEQ ID NO: 184687 - protein, 8 aa, Borrelia afzelii
FNSSANEA

SEQ ID NO: 184688 - protein, 8 aa, Borrelia afzelii
NSSANEAL

SEQ ID NO: 184689 - protein, 8 aa, Borrelia afzelii
SSANEALL

SEQ ID NO: 184690 - protein, 8 aa, Borrelia afzelii
SANEALLR

SEQ ID NO: 184691 - protein, 8 aa, Borrelia afzelii
ANEALLRL

SEQ ID NO: 184692 - protein, 8 aa, Borrelia afzelii
NEALLRLK

SEQ ID NO: 184693 - protein, 8 aa, Borrelia afzelii
EALLRLKK

SEQ ID NO: 184694 - protein, 8 aa, Borrelia afzelii
ALLRLKKD

SEQ ID NO: 184695 - protein, 8 aa, Borrelia afzelii
LLRLKKDF

SEQ ID NO: 184696 - protein, 8 aa, Borrelia afzelii
LRLKKDFP

SEQ ID NO: 184697 - protein, 8 aa, Borrelia afzelii
RLKKDFPE

SEQ ID NO: 184698 - protein, 8 aa, Borrelia afzelii
LKKDFPEN

SEQ ID NO: 184699 - protein, 8 aa, Borrelia afzelii
KKDFPENI

SEQ ID NO: 184700 - protein, 8 aa, Borrelia afzelii
KDFPENIE

SEQ ID NO: 184701 - protein, 8 aa, Borrelia afzelii
DFPENIEK

SEQ ID NO: 184702 - protein, 8 aa, Borrelia afzelii
FPENIEKV

SEQ ID NO: 184703 - protein, 8 aa, Borrelia afzelii
PENIEKVF

SEQ ID NO: 184704 - protein, 8 aa, Borrelia afzelii
ENIEKVFS

SEQ ID NO: 184705 - protein, 8 aa, Borrelia afzelii
NIEKVFSS

SEQ ID NO: 184706 - protein, 8 aa, Borrelia afzelii
IEKVFSSA

SEQ ID NO: 184707 - protein, 8 aa, Borrelia afzelii
EKVFSSAV

SEQ ID NO: 184708 - protein, 8 aa, Borrelia afzelii
KVFSSAVS

SEQ ID NO: 184709 - protein, 8 aa, Borrelia afzelii
VFSSAVSG

SEQ ID NO: 184710 - protein, 8 aa, Borrelia afzelii
FSSAVSGV

SEQ ID NO: 184711 - protein, 8 aa, Borrelia afzelii
SSAVSGVY

SEQ ID NO: 184712 - protein, 8 aa, Borrelia afzelii
SAVSGVYS

SEQ ID NO: 184713 - protein, 8 aa, Borrelia afzelii
AVSGVYSS

SEQ ID NO: 184714 - protein, 8 aa, Borrelia afzelii
VSGVYSSY

SEQ ID NO: 184715 - protein, 8 aa, Borrelia afzelii
SGVYSSYV

SEQ ID NO: 184716 - protein, 8 aa, Borrelia afzelii
GVYSSYVS

SEQ ID NO: 184717 - protein, 8 aa, Borrelia afzelii
VYSSYVSD

SEQ ID NO: 184718 - protein, 8 aa, Borrelia afzelii
YSSYVSDL

SEQ ID NO: 184719 - protein, 8 aa, Borrelia afzelii
SSYVSDLD

SEQ ID NO: 184720 - protein, 8 aa, Borrelia afzelii
SYVSDLDN

SEQ ID NO: 184721 - protein, 8 aa, Borrelia afzelii
YVSDLDNL

SEQ ID NO: 184722 - protein, 8 aa, Borrelia afzelii
VSDLDNLK

SEQ ID NO: 184723 - protein, 8 aa, Borrelia afzelii
SDLDNLKM

SEQ ID NO: 184724 - protein, 8 aa, Borrelia afzelii
DLDNLKMN

SEQ ID NO: 184725 - protein, 8 aa, Borrelia afzelii
LDNLKMNG

SEQ ID NO: 184726 - protein, 8 aa, Borrelia afzelii
DNLKMNGS

SEQ ID NO: 184727 - protein, 8 aa, Borrelia afzelii
NLKMNGSG

SEQ ID NO: 184728 - protein, 8 aa, Borrelia afzelii
LKMNGSGL

SEQ ID NO: 184729 - protein, 8 aa, Borrelia afzelii
KMNGSGLI

SEQ ID NO: 184730 - protein, 8 aa, Borrelia afzelii
MNGSGLIW

SEQ ID NO: 184731 - protein, 8 aa, Borrelia afzelii
NGSGLIWL

SEQ ID NO: 184732 - protein, 8 aa, Borrelia afzelii
GSGLIWLV

SEQ ID NO: 184733 - protein, 8 aa, Borrelia afzelii
SGLIWLVG

SEQ ID NO: 184734 - protein, 8 aa, Borrelia afzelii
GLIWLVGY

SEQ ID NO: 184735 - protein, 8 aa, Borrelia afzelii
LIWLVGYM

SEQ ID NO: 184736 - protein, 8 aa, Borrelia afzelii
IWLVGYML

SEQ ID NO: 184737 - protein, 8 aa, Borrelia afzelii
WLVGYMLA

SEQ ID NO: 184738 - protein, 8 aa, Borrelia afzelii
LVGYMLAD

SEQ ID NO: 184739 - protein, 8 aa, Borrelia afzelii
VGYMLADV

SEQ ID NO: 184740 - protein, 8 aa, Borrelia afzelii
GYMLADVS

SEQ ID NO: 184741 - protein, 8 aa, Borrelia afzelii
YMLADVSL

SEQ ID NO: 184742 - protein, 8 aa, Borrelia afzelii
MLADVSLS

SEQ ID NO: 184743 - protein, 8 aa, Borrelia afzelii
LADVSLSV

SEQ ID NO: 184744 - protein, 8 aa, Borrelia afzelii
ADVSLSVS

SEQ ID NO: 184745 - protein, 8 aa, Borrelia afzelii
DVSLSVSL

SEQ ID NO: 184746 - protein, 8 aa, Borrelia afzelii
VSLSVSLE

SEQ ID NO: 184747 - protein, 8 aa, Borrelia afzelii
SLSVSLEN

SEQ ID NO: 184748 - protein, 8 aa, Borrelia afzelii
LSVSLENP

SEQ ID NO: 184749 - protein, 8 aa, Borrelia afzelii
SVSLENPE

SEQ ID NO: 184750 - protein, 8 aa, Borrelia afzelii
VSLENPEI

SEQ ID NO: 184751 - protein, 8 aa, Borrelia afzelii
SLENPEIN

SEQ ID NO: 184752 - protein, 8 aa, Borrelia afzelii
LENPEINY

SEQ ID NO: 184753 - protein, 8 aa, Borrelia afzelii
ENPEINYG

SEQ ID NO: 184754 - protein, 8 aa, Borrelia afzelii
NPEINYGI

SEQ ID NO: 184755 - protein, 8 aa, Borrelia afzelii
PEINYGII

SEQ ID NO: 184756 - protein, 8 aa, Borrelia afzelii
EINYGIID

SEQ ID NO: 184757 - protein, 8 aa, Borrelia afzelii
INYGIIDP

SEQ ID NO: 184758 - protein, 8 aa, Borrelia afzelii
NYGIIDPI

SEQ ID NO: 184759 - protein, 8 aa, Borrelia afzelii
YGIIDPIY

SEQ ID NO: 184760 - protein, 8 aa, Borrelia afzelii
GIIDPIYG

SEQ ID NO: 184761 - protein, 8 aa, Borrelia afzelii
IIDPIYGD

SEQ ID NO: 184762 - protein, 8 aa, Borrelia afzelii
IDPIYGDD

SEQ ID NO: 184763 - protein, 8 aa, Borrelia afzelii
DPIYGDDV

SEQ ID NO: 184764 - protein, 8 aa, Borrelia afzelii
PIYGDDVQ

SEQ ID NO: 184765 - protein, 8 aa, Borrelia afzelii
IYGDDVQI

SEQ ID NO: 184766 - protein, 8 aa, Borrelia afzelii
YGDDVQIP

SEQ ID NO: 184767 - protein, 8 aa, Borrelia afzelii
GDDVQIPK

SEQ ID NO: 184768 - protein, 8 aa, Borrelia afzelii
DDVQIPKN

SEQ ID NO: 184769 - protein, 8 aa, Borrelia afzelii
DVQIPKNL

SEQ ID NO: 184770 - protein, 8 aa, Borrelia afzelii
VQIPKNLI

SEQ ID NO: 184771 - protein, 8 aa, Borrelia afzelii
QIPKNLIG

SEQ ID NO: 184772 - protein, 8 aa, Borrelia afzelii
IPKNLIGV

SEQ ID NO: 184773 - protein, 8 aa, Borrelia afzelii
PKNLIGVV

SEQ ID NO: 184774 - protein, 8 aa, Borrelia afzelii
KNLIGVVF

SEQ ID NO: 184775 - protein, 8 aa, Borrelia afzelii
NLIGVVFR

SEQ ID NO: 184776 - protein, 8 aa, Borrelia afzelii
LIGVVFRI

SEQ ID NO: 184777 - protein, 8 aa, Borrelia afzelii
IGVVFRIE

SEQ ID NO: 184778 - protein, 8 aa, Borrelia afzelii
GVVFRIEQ

SEQ ID NO: 184779 - protein, 8 aa, Borrelia afzelii
VVFRIEQG

SEQ ID NO: 184780 - protein, 8 aa, Borrelia afzelii
VFRIEQGA

SEQ ID NO: 184781 - protein, 8 aa, Borrelia afzelii
FRIEQGAF

SEQ ID NO: 184782 - protein, 8 aa, Borrelia afzelii
RIEQGAFL

SEQ ID NO: 184783 - protein, 8 aa, Borrelia afzelii
IEQGAFLA

SEQ ID NO: 184784 - protein, 8 aa, Borrelia afzelii
EQGAFLAG

SEQ ID NO: 184785 - protein, 8 aa, Borrelia afzelii
QGAFLAGY

SEQ ID NO: 184786 - protein, 8 aa, Borrelia afzelii
GAFLAGYI

SEQ ID NO: 184787 - protein, 8 aa, Borrelia afzelii
AFLAGYIA

SEQ ID NO: 184788 - protein, 8 aa, Borrelia afzelii
FLAGYIAA

SEQ ID NO: 184789 - protein, 8 aa, Borrelia afzelii
LAGYIAAK

SEQ ID NO: 184790 - protein, 8 aa, Borrelia afzelii
AGYIAAKK

SEQ ID NO: 184791 - protein, 8 aa, Borrelia afzelii
GYIAAKKS

SEQ ID NO: 184792 - protein, 8 aa, Borrelia afzelii
YIAAKKSV

SEQ ID NO: 184793 - protein, 8 aa, Borrelia afzelii
IAAKKSVS

SEQ ID NO: 184794 - protein, 8 aa, Borrelia afzelii
AAKKSVSS

SEQ ID NO: 184795 - protein, 8 aa, Borrelia afzelii
AKKSVSSK

SEQ ID NO: 184796 - protein, 8 aa, Borrelia afzelii
KKSVSSKI

SEQ ID NO: 184797 - protein, 8 aa, Borrelia afzelii
KSVSSKIG

SEQ ID NO: 184798 - protein, 8 aa, Borrelia afzelii
SVSSKIGF

SEQ ID NO: 184799 - protein, 8 aa, Borrelia afzelii
VSSKIGFI

SEQ ID NO: 184800 - protein, 8 aa, Borrelia afzelii
SSKIGFIG

SEQ ID NO: 184801 - protein, 8 aa, Borrelia afzelii
SKIGFIGG

SEQ ID NO: 184802 - protein, 8 aa, Borrelia afzelii
KIGFIGGV

SEQ ID NO: 184803 - protein, 8 aa, Borrelia afzelii
IGFIGGVK

SEQ ID NO: 184804 - protein, 8 aa, Borrelia afzelii
GFIGGVKG

SEQ ID NO: 184805 - protein, 8 aa, Borrelia afzelii
FIGGVKGD

SEQ ID NO: 184806 - protein, 8 aa, Borrelia afzelii
IGGVKGDI

SEQ ID NO: 184807 - protein, 8 aa, Borrelia afzelii
GGVKGDIV

SEQ ID NO: 184808 - protein, 8 aa, Borrelia afzelii
GVKGDIVD

SEQ ID NO: 184809 - protein, 8 aa, Borrelia afzelii
VKGDIVDA

SEQ ID NO: 184810 - protein, 8 aa, Borrelia afzelii
KGDIVDAF

SEQ ID NO: 184811 - protein, 8 aa, Borrelia afzelii
GDIVDAFR

SEQ ID NO: 184812 - protein, 8 aa, Borrelia afzelii
DIVDAFRY

SEQ ID NO: 184813 - protein, 8 aa, Borrelia afzelii
IVDAFRYG

SEQ ID NO: 184814 - protein, 8 aa, Borrelia afzelii
VDAFRYGY

SEQ ID NO: 184815 - protein, 8 aa, Borrelia afzelii
DAFRYGYE

SEQ ID NO: 184816 - protein, 8 aa, Borrelia afzelii
AFRYGYEA

SEQ ID NO: 184817 - protein, 8 aa, Borrelia afzelii
FRYGYEAG

SEQ ID NO: 184818 - protein, 8 aa, Borrelia afzelii
RYGYEAGA

SEQ ID NO: 184819 - protein, 8 aa, Borrelia afzelii
YGYEAGAK

SEQ ID NO: 184820 - protein, 8 aa, Borrelia afzelii
GYEAGAKY

SEQ ID NO: 184821 - protein, 8 aa, Borrelia afzelii
YEAGAKYA

SEQ ID NO: 184822 - protein, 8 aa, Borrelia afzelii
EAGAKYAN

SEQ ID NO: 184823 - protein, 8 aa, Borrelia afzelii
AGAKYANK

SEQ ID NO: 184824 - protein, 8 aa, Borrelia afzelii
GAKYANKG

SEQ ID NO: 184825 - protein, 8 aa, Borrelia afzelii
AKYANKGI

SEQ ID NO: 184826 - protein, 8 aa, Borrelia afzelii
KYANKGIE

SEQ ID NO: 184827 - protein, 8 aa, Borrelia afzelii
YANKGIEI

SEQ ID NO: 184828 - protein, 8 aa, Borrelia afzelii
ANKGIEIV

SEQ ID NO: 184829 - protein, 8 aa, Borrelia afzelii
NKGIEIVS

SEQ ID NO: 184830 - protein, 8 aa, Borrelia afzelii
KGIEIVSE

SEQ ID NO: 184831 - protein, 8 aa, Borrelia afzelii
GIEIVSEY

SEQ ID NO: 184832 - protein, 8 aa, Borrelia afzelii
IEIVSEYS

SEQ ID NO: 184833 - protein, 8 aa, Borrelia afzelii
EIVSEYSN

SEQ ID NO: 184834 - protein, 8 aa, Borrelia afzelii
IVSEYSNS

SEQ ID NO: 184835 - protein, 8 aa, Borrelia afzelii
VSEYSNSF

SEQ ID NO: 184836 - protein, 8 aa, Borrelia afzelii
SEYSNSFS

SEQ ID NO: 184837 - protein, 8 aa, Borrelia afzelii
EYSNSFSD

SEQ ID NO: 184838 - protein, 8 aa, Borrelia afzelii
YSNSFSDI

SEQ ID NO: 184839 - protein, 8 aa, Borrelia afzelii
SNSFSDID

SEQ ID NO: 184840 - protein, 8 aa, Borrelia afzelii
NSFSDIDI

SEQ ID NO: 184841 - protein, 8 aa, Borrelia afzelii
SFSDIDIA

SEQ ID NO: 184842 - protein, 8 aa, Borrelia afzelii
FSDIDIAR

SEQ ID NO: 184843 - protein, 8 aa, Borrelia afzelii
SDIDIARV

SEQ ID NO: 184844 - protein, 8 aa, Borrelia afzelii
DIDIARVM

SEQ ID NO: 184845 - protein, 8 aa, Borrelia afzelii
IDIARVMA

SEQ ID NO: 184846 - protein, 8 aa, Borrelia afzelii
DIARVMAN

SEQ ID NO: 184847 - protein, 8 aa, Borrelia afzelii
IARVMANK

SEQ ID NO: 184848 - protein, 8 aa, Borrelia afzelii
ARVMANKM

SEQ ID NO: 184849 - protein, 8 aa, Borrelia afzelii
RVMANKMY

SEQ ID NO: 184850 - protein, 8 aa, Borrelia afzelii
VMANKMYS

SEQ ID NO: 184851 - protein, 8 aa, Borrelia afzelii
MANKMYSK

SEQ ID NO: 184852 - protein, 8 aa, Borrelia afzelii
ANKMYSKG

SEQ ID NO: 184853 - protein, 8 aa, Borrelia afzelii
NKMYSKGI

SEQ ID NO: 184854 - protein, 8 aa, Borrelia afzelii
KMYSKGID

SEQ ID NO: 184855 - protein, 8 aa, Borrelia afzelii
MYSKGIDI

SEQ ID NO: 184856 - protein, 8 aa, Borrelia afzelii
YSKGIDII

SEQ ID NO: 184857 - protein, 8 aa, Borrelia afzelii
SKGIDIIH

SEQ ID NO: 184858 - protein, 8 aa, Borrelia afzelii
KGIDIIHF

SEQ ID NO: 184859 - protein, 8 aa, Borrelia afzelii
GIDIIHFA

SEQ ID NO: 184860 - protein, 8 aa, Borrelia afzelii
IDIIHFAA

SEQ ID NO: 184861 - protein, 8 aa, Borrelia afzelii
DIIHFAAG

SEQ ID NO: 184862 - protein, 8 aa, Borrelia afzelii
IIHFAAGL

SEQ ID NO: 184863 - protein, 8 aa, Borrelia afzelii
IHFAAGLA

SEQ ID NO: 184864 - protein, 8 aa, Borrelia afzelii
HFAAGLAG

SEQ ID NO: 184865 - protein, 8 aa, Borrelia afzelii
FAAGLAGV

SEQ ID NO: 184866 - protein, 8 aa, Borrelia afzelii
AAGLAGVG

SEQ ID NO: 184867 - protein, 8 aa, Borrelia afzelii
AGLAGVGV

SEQ ID NO: 184868 - protein, 8 aa, Borrelia afzelii
GLAGVGVI

SEQ ID NO: 184869 - protein, 8 aa, Borrelia afzelii
LAGVGVIE

SEQ ID NO: 184870 - protein, 8 aa, Borrelia afzelii
AGVGVIEA

SEQ ID NO: 184871 - protein, 8 aa, Borrelia afzelii
GVGVIEAA

SEQ ID NO: 184872 - protein, 8 aa, Borrelia afzelii
VGVIEAAK

SEQ ID NO: 184873 - protein, 8 aa, Borrelia afzelii
GVIEAAKE

SEQ ID NO: 184874 - protein, 8 aa, Borrelia afzelii
VIEAAKEL

SEQ ID NO: 184875 - protein, 8 aa, Borrelia afzelii
IEAAKELG

SEQ ID NO: 184876 - protein, 8 aa, Borrelia afzelii
EAAKELGD

SEQ ID NO: 184877 - protein, 8 aa, Borrelia afzelii
AAKELGDG

SEQ ID NO: 184878 - protein, 8 aa, Borrelia afzelii
AKELGDGY

SEQ ID NO: 184879 - protein, 8 aa, Borrelia afzelii
KELGDGYY

SEQ ID NO: 184880 - protein, 8 aa, Borrelia afzelii
ELGDGYYV

SEQ ID NO: 184881 - protein, 8 aa, Borrelia afzelii
LGDGYYVI

SEQ ID NO: 184882 - protein, 8 aa, Borrelia afzelii
GDGYYVIG

SEQ ID NO: 184883 - protein, 8 aa, Borrelia afzelii
DGYYVIGA

SEQ ID NO: 184884 - protein, 8 aa, Borrelia afzelii
GYYVIGAD

SEQ ID NO: 184885 - protein, 8 aa, Borrelia afzelii
YYVIGADQ

SEQ ID NO: 184886 - protein, 8 aa, Borrelia afzelii
YVIGADQD

SEQ ID NO: 184887 - protein, 8 aa, Borrelia afzelii
VIGADQDQ

SEQ ID NO: 184888 - protein, 8 aa, Borrelia afzelii
IGADQDQS

SEQ ID NO: 184889 - protein, 8 aa, Borrelia afzelii
GADQDQSH

SEQ ID NO: 184890 - protein, 8 aa, Borrelia afzelii
ADQDQSHL

SEQ ID NO: 184891 - protein, 8 aa, Borrelia afzelii
DQDQSHLA

SEQ ID NO: 184892 - protein, 8 aa, Borrelia afzelii
QDQSHLAP

SEQ ID NO: 184893 - protein, 8 aa, Borrelia afzelii
DQSHLAPK

SEQ ID NO: 184894 - protein, 8 aa, Borrelia afzelii
QSHLAPKN

SEQ ID NO: 184895 - protein, 8 aa, Borrelia afzelii
SHLAPKNF

SEQ ID NO: 184896 - protein, 8 aa, Borrelia afzelii
HLAPKNFI

SEQ ID NO: 184897 - protein, 8 aa, Borrelia afzelii
LAPKNFIT

SEQ ID NO: 184898 - protein, 8 aa, Borrelia afzelii
APKNFITS

SEQ ID NO: 184899 - protein, 8 aa, Borrelia afzelii
PKNFITSV

SEQ ID NO: 184900 - protein, 8 aa, Borrelia afzelii
KNFITSVI

SEQ ID NO: 184901 - protein, 8 aa, Borrelia afzelii
NFITSVIK

SEQ ID NO: 184902 - protein, 8 aa, Borrelia afzelii
FITSVIKN

SEQ ID NO: 184903 - protein, 8 aa, Borrelia afzelii
ITSVIKNV

SEQ ID NO: 184904 - protein, 8 aa, Borrelia afzelii
TSVIKNVG

SEQ ID NO: 184905 - protein, 8 aa, Borrelia afzelii
SVIKNVGD

SEQ ID NO: 184906 - protein, 8 aa, Borrelia afzelii
VIKNVGDA

SEQ ID NO: 184907 - protein, 8 aa, Borrelia afzelii
IKNVGDAL

SEQ ID NO: 184908 - protein, 8 aa, Borrelia afzelii
KNVGDALY

SEQ ID NO: 184909 - protein, 8 aa, Borrelia afzelii
NVGDALYL

SEQ ID NO: 184910 - protein, 8 aa, Borrelia afzelii
VGDALYLI

SEQ ID NO: 184911 - protein, 8 aa, Borrelia afzelii
GDALYLIT

SEQ ID NO: 184912 - protein, 8 aa, Borrelia afzelii
DALYLITS

SEQ ID NO: 184913 - protein, 8 aa, Borrelia afzelii
ALYLITSE

SEQ ID NO: 184914 - protein, 8 aa, Borrelia afzelii
LYLITSES

SEQ ID NO: 184915 - protein, 8 aa, Borrelia afzelii
YLITSESL

SEQ ID NO: 184916 - protein, 8 aa, Borrelia afzelii
LITSESLK

SEQ ID NO: 184917 - protein, 8 aa, Borrelia afzelii
ITSESLKN

SEQ ID NO: 184918 - protein, 8 aa, Borrelia afzelii
TSESLKND

SEQ ID NO: 184919 - protein, 8 aa, Borrelia afzelii
SESLKNDN

SEQ ID NO: 184920 - protein, 8 aa, Borrelia afzelii
ESLKNDNV

SEQ ID NO: 184921 - protein, 8 aa, Borrelia afzelii
SLKNDNVW

SEQ ID NO: 184922 - protein, 8 aa, Borrelia afzelii
LKNDNVWE

SEQ ID NO: 184923 - protein, 8 aa, Borrelia afzelii
KNDNVWEG

SEQ ID NO: 184924 - protein, 8 aa, Borrelia afzelii
NDNVWEGG

SEQ ID NO: 184925 - protein, 8 aa, Borrelia afzelii
DNVWEGGK

SEQ ID NO: 184926 - protein, 8 aa, Borrelia afzelii
NVWEGGKI

SEQ ID NO: 184927 - protein, 8 aa, Borrelia afzelii
VWEGGKIV

SEQ ID NO: 184928 - protein, 8 aa, Borrelia afzelii
WEGGKIVQ

SEQ ID NO: 184929 - protein, 8 aa, Borrelia afzelii
EGGKIVQM

SEQ ID NO: 184930 - protein, 8 aa, Borrelia afzelii
GGKIVQMG

SEQ ID NO: 184931 - protein, 8 aa, Borrelia afzelii
GKIVQMGL

SEQ ID NO: 184932 - protein, 8 aa, Borrelia afzelii
KIVQMGLR

SEQ ID NO: 184933 - protein, 8 aa, Borrelia afzelii
IVQMGLRD

SEQ ID NO: 184934 - protein, 8 aa, Borrelia afzelii
VQMGLRDG

SEQ ID NO: 184935 - protein, 8 aa, Borrelia afzelii
QMGLRDGV

SEQ ID NO: 184936 - protein, 8 aa, Borrelia afzelii
MGLRDGVV

SEQ ID NO: 184937 - protein, 8 aa, Borrelia afzelii
GLRDGVVG

SEQ ID NO: 184938 - protein, 8 aa, Borrelia afzelii
LRDGVVGL

SEQ ID NO: 184939 - protein, 8 aa, Borrelia afzelii
RDGVVGLS

SEQ ID NO: 184940 - protein, 8 aa, Borrelia afzelii
DGVVGLSN

SEQ ID NO: 184941 - protein, 8 aa, Borrelia afzelii
GVVGLSNA

SEQ ID NO: 184942 - protein, 8 aa, Borrelia afzelii
VVGLSNAN

SEQ ID NO: 184943 - protein, 8 aa, Borrelia afzelii
VGLSNANE

SEQ ID NO: 184944 - protein, 8 aa, Borrelia afzelii
GLSNANEF

SEQ ID NO: 184945 - protein, 8 aa, Borrelia afzelii
LSNANEFE

SEQ ID NO: 184946 - protein, 8 aa, Borrelia afzelii
SNANEFEY

SEQ ID NO: 184947 - protein, 8 aa, Borrelia afzelii
NANEFEYI

SEQ ID NO: 184948 - protein, 8 aa, Borrelia afzelii
ANEFEYIK

SEQ ID NO: 184949 - protein, 8 aa, Borrelia afzelii
NEFEYIKD

SEQ ID NO: 184950 - protein, 8 aa, Borrelia afzelii
EFEYIKDL

SEQ ID NO: 184951 - protein, 8 aa, Borrelia afzelii
FEYIKDLE

SEQ ID NO: 184952 - protein, 8 aa, Borrelia afzelii
EYIKDLER

SEQ ID NO: 184953 - protein, 8 aa, Borrelia afzelii
YIKDLERK

SEQ ID NO: 184954 - protein, 8 aa, Borrelia afzelii
IKDLERKI

SEQ ID NO: 184955 - protein, 8 aa, Borrelia afzelii
KDLERKII

SEQ ID NO: 184956 - protein, 8 aa, Borrelia afzelii
DLERKIIN

SEQ ID NO: 184957 - protein, 8 aa, Borrelia afzelii
LERKIINK

SEQ ID NO: 184958 - protein, 8 aa, Borrelia afzelii
ERKIINKE

SEQ ID NO: 184959 - protein, 8 aa, Borrelia afzelii
RKIINKEI

SEQ ID NO: 184960 - protein, 8 aa, Borrelia afzelii
KIINKEII

SEQ ID NO: 184961 - protein, 8 aa, Borrelia afzelii
IINKEIIV

SEQ ID NO: 184962 - protein, 8 aa, Borrelia afzelii
INKEIIVP

SEQ ID NO: 184963 - protein, 8 aa, Borrelia afzelii
NKEIIVPC

SEQ ID NO: 184964 - protein, 8 aa, Borrelia afzelii
KEIIVPCN

SEQ ID NO: 184965 - protein, 8 aa, Borrelia afzelii
EIIVPCNQ

SEQ ID NO: 184966 - protein, 8 aa, Borrelia afzelii
IIVPCNQE

SEQ ID NO: 184967 - protein, 8 aa, Borrelia afzelii
IVPCNQEG

SEQ ID NO: 184968 - protein, 8 aa, Borrelia afzelii
VPCNQEGY

SEQ ID NO: 184969 - protein, 8 aa, Borrelia afzelii
PCNQEGYE

SEQ ID NO: 184970 - protein, 8 aa, Borrelia afzelii
CNQEGYEI

SEQ ID NO: 184971 - protein, 8 aa, Borrelia afzelii
NQEGYEIF

SEQ ID NO: 184972 - protein, 8 aa, Borrelia afzelii
QEGYEIFI

SEQ ID NO: 184973 - protein, 8 aa, Borrelia afzelii
EGYEIFIK

SEQ ID NO: 184974 - protein, 8 aa, Borrelia afzelii
GYEIFIKQ

SEQ ID NO: 184975 - protein, 8 aa, Borrelia afzelii
YEIFIKQI

SEQ ID NO: 184976 - protein, 8 aa, Borrelia afzelii
EIFIKQIL

SEQ ID NO: 184977 - protein, 8 aa, Borrelia afzelii
IFIKQILK

SEQ ID NO: 184978 - protein, 8 aa, Borrelia afzelii
FIKQILKL

SEQ ID NO: 184979 - protein, 9 aa, Borrelia afzelii
MRIAIFIFG

SEQ ID NO: 184980 - protein, 9 aa, Borrelia afzelii
RIAIFIFGI

SEQ ID NO: 184981 - protein, 9 aa, Borrelia afzelii
IAIFIFGIL

SEQ ID NO: 184982 - protein, 9 aa, Borrelia afzelii
AIFIFGILL

SEQ ID NO: 184983 - protein, 9 aa, Borrelia afzelii
IFIFGILLT

SEQ ID NO: 184984 - protein, 9 aa, Borrelia afzelii
FIFGILLTS

SEQ ID NO: 184985 - protein, 9 aa, Borrelia afzelii
IFGILLTSC

SEQ ID NO: 184986 - protein, 9 aa, Borrelia afzelii
FGILLTSCF

SEQ ID NO: 184987 - protein, 9 aa, Borrelia afzelii
GILLTSCFS

SEQ ID NO: 184988 - protein, 9 aa, Borrelia afzelii
ILLTSCFSK

SEQ ID NO: 184989 - protein, 9 aa, Borrelia afzelii
LLTSCFSKN

SEQ ID NO: 184990 - protein, 9 aa, Borrelia afzelii
LTSCFSKNG

SEQ ID NO: 184991 - protein, 9 aa, Borrelia afzelii
TSCFSKNGI

SEQ ID NO: 184992 - protein, 9 aa, Borrelia afzelii
SCFSKNGIE

SEQ ID NO: 184993 - protein, 9 aa, Borrelia afzelii
CFSKNGIES

SEQ ID NO: 184994 - protein, 9 aa, Borrelia afzelii
FSKNGIESG

SEQ ID NO: 184995 - protein, 9 aa, Borrelia afzelii
SKNGIESGS

SEQ ID NO: 184996 - protein, 9 aa, Borrelia afzelii
KNGIESGSS

SEQ ID NO: 184997 - protein, 9 aa, Borrelia afzelii
NGIESGSSK

SEQ ID NO: 184998 - protein, 9 aa, Borrelia afzelii
GIESGSSKI

SEQ ID NO: 184999 - protein, 9 aa, Borrelia afzelii
IESGSSKIK

SEQ ID NO: 185000 - protein, 9 aa, Borrelia afzelii
ESGSSKIKI

SEQ ID NO: 185001 - protein, 9 aa, Borrelia afzelii
SGSSKIKIS

SEQ ID NO: 185002 - protein, 9 aa, Borrelia afzelii
GSSKIKISM

SEQ ID NO: 185003 - protein, 9 aa, Borrelia afzelii
SSKIKISML

SEQ ID NO: 185004 - protein, 9 aa, Borrelia afzelii
SKIKISMLV

SEQ ID NO: 185005 - protein, 9 aa, Borrelia afzelii
KIKISMLVD

SEQ ID NO: 185006 - protein, 9 aa, Borrelia afzelii
IKISMLVDG

SEQ ID NO: 185007 - protein, 9 aa, Borrelia afzelii
KISMLVDGV

SEQ ID NO: 185008 - protein, 9 aa, Borrelia afzelii
ISMLVDGVL

SEQ ID NO: 185009 - protein, 9 aa, Borrelia afzelii
SMLVDGVLD

SEQ ID NO: 185010 - protein, 9 aa, Borrelia afzelii
MLVDGVLDD

SEQ ID NO: 185011 - protein, 9 aa, Borrelia afzelii
LVDGVLDDK

SEQ ID NO: 185012 - protein, 9 aa, Borrelia afzelii
VDGVLDDKS

SEQ ID NO: 185013 - protein, 9 aa, Borrelia afzelii
DGVLDDKSF

SEQ ID NO: 185014 - protein, 9 aa, Borrelia afzelii
GVLDDKSFN

SEQ ID NO: 185015 - protein, 9 aa, Borrelia afzelii
VLDDKSFNS

SEQ ID NO: 185016 - protein, 9 aa, Borrelia afzelii
LDDKSFNSS

SEQ ID NO: 185017 - protein, 9 aa, Borrelia afzelii
DDKSFNSSA

SEQ ID NO: 185018 - protein, 9 aa, Borrelia afzelii
DKSFNSSAN

SEQ ID NO: 185019 - protein, 9 aa, Borrelia afzelii
KSFNSSANE

SEQ ID NO: 185020 - protein, 9 aa, Borrelia afzelii
SFNSSANEA

SEQ ID NO: 185021 - protein, 9 aa, Borrelia afzelii
FNSSANEAL

SEQ ID NO: 185022 - protein, 9 aa, Borrelia afzelii
NSSANEALL

SEQ ID NO: 185023 - protein, 9 aa, Borrelia afzelii
SSANEALLR

SEQ ID NO: 185024 - protein, 9 aa, Borrelia afzelii
SANEALLRL

SEQ ID NO: 185025 - protein, 9 aa, Borrelia afzelii
ANEALLRLK

SEQ ID NO: 185026 - protein, 9 aa, Borrelia afzelii
NEALLRLKK

SEQ ID NO: 185027 - protein, 9 aa, Borrelia afzelii
EALLRLKKD

SEQ ID NO: 185028 - protein, 9 aa, Borrelia afzelii
ALLRLKKDF

SEQ ID NO: 185029 - protein, 9 aa, Borrelia afzelii
LLRLKKDFP

SEQ ID NO: 185030 - protein, 9 aa, Borrelia afzelii
LRLKKDFPE

SEQ ID NO: 185031 - protein, 9 aa, Borrelia afzelii
RLKKDFPEN

SEQ ID NO: 185032 - protein, 9 aa, Borrelia afzelii
LKKDFPENI

SEQ ID NO: 185033 - protein, 9 aa, Borrelia afzelii
KKDFPENIE

SEQ ID NO: 185034 - protein, 9 aa, Borrelia afzelii
KDFPENIEK

SEQ ID NO: 185035 - protein, 9 aa, Borrelia afzelii
DFPENIEKV

SEQ ID NO: 185036 - protein, 9 aa, Borrelia afzelii
FPENIEKVF

SEQ ID NO: 185037 - protein, 9 aa, Borrelia afzelii
PENIEKVFS

SEQ ID NO: 185038 - protein, 9 aa, Borrelia afzelii
ENIEKVFSS

SEQ ID NO: 185039 - protein, 9 aa, Borrelia afzelii
NIEKVFSSA

SEQ ID NO: 185040 - protein, 9 aa, Borrelia afzelii
IEKVFSSAV

SEQ ID NO: 185041 - protein, 9 aa, Borrelia afzelii
EKVFSSAVS

SEQ ID NO: 185042 - protein, 9 aa, Borrelia afzelii
KVFSSAVSG

SEQ ID NO: 185043 - protein, 9 aa, Borrelia afzelii
VFSSAVSGV

SEQ ID NO: 185044 - protein, 9 aa, Borrelia afzelii
FSSAVSGVY

SEQ ID NO: 185045 - protein, 9 aa, Borrelia afzelii
SSAVSGVYS

SEQ ID NO: 185046 - protein, 9 aa, Borrelia afzelii
SAVSGVYSS

SEQ ID NO: 185047 - protein, 9 aa, Borrelia afzelii
AVSGVYSSY

SEQ ID NO: 185048 - protein, 9 aa, Borrelia afzelii
VSGVYSSYV

SEQ ID NO: 185049 - protein, 9 aa, Borrelia afzelii
SGVYSSYVS

SEQ ID NO: 185050 - protein, 9 aa, Borrelia afzelii
GVYSSYVSD

SEQ ID NO: 185051 - protein, 9 aa, Borrelia afzelii
VYSSYVSDL

SEQ ID NO: 185052 - protein, 9 aa, Borrelia afzelii
YSSYVSDLD

SEQ ID NO: 185053 - protein, 9 aa, Borrelia afzelii
SSYVSDLDN

SEQ ID NO: 185054 - protein, 9 aa, Borrelia afzelii
SYVSDLDNL

SEQ ID NO: 185055 - protein, 9 aa, Borrelia afzelii
YVSDLDNLK

SEQ ID NO: 185056 - protein, 9 aa, Borrelia afzelii
VSDLDNLKM

SEQ ID NO: 185057 - protein, 9 aa, Borrelia afzelii
SDLDNLKMN

SEQ ID NO: 185058 - protein, 9 aa, Borrelia afzelii
DLDNLKMNG

SEQ ID NO: 185059 - protein, 9 aa, Borrelia afzelii
LDNLKMNGS

SEQ ID NO: 185060 - protein, 9 aa, Borrelia afzelii
DNLKMNGSG

SEQ ID NO: 185061 - protein, 9 aa, Borrelia afzelii
NLKMNGSGL

SEQ ID NO: 185062 - protein, 9 aa, Borrelia afzelii
LKMNGSGLI

SEQ ID NO: 185063 - protein, 9 aa, Borrelia afzelii
KMNGSGLIW

SEQ ID NO: 185064 - protein, 9 aa, Borrelia afzelii
MNGSGLIWL

SEQ ID NO: 185065 - protein, 9 aa, Borrelia afzelii
NGSGLIWLV

SEQ ID NO: 185066 - protein, 9 aa, Borrelia afzelii
GSGLIWLVG

SEQ ID NO: 185067 - protein, 9 aa, Borrelia afzelii
SGLIWLVGY

SEQ ID NO: 185068 - protein, 9 aa, Borrelia afzelii
GLIWLVGYM

SEQ ID NO: 185069 - protein, 9 aa, Borrelia afzelii
LIWLVGYML

SEQ ID NO: 185070 - protein, 9 aa, Borrelia afzelii
IWLVGYMLA

SEQ ID NO: 185071 - protein, 9 aa, Borrelia afzelii
WLVGYMLAD

SEQ ID NO: 185072 - protein, 9 aa, Borrelia afzelii
LVGYMLADV

SEQ ID NO: 185073 - protein, 9 aa, Borrelia afzelii
VGYMLADVS

SEQ ID NO: 185074 - protein, 9 aa, Borrelia afzelii
GYMLADVSL

SEQ ID NO: 185075 - protein, 9 aa, Borrelia afzelii
YMLADVSLS

SEQ ID NO: 185076 - protein, 9 aa, Borrelia afzelii
MLADVSLSV

SEQ ID NO: 185077 - protein, 9 aa, Borrelia afzelii
LADVSLSVS

SEQ ID NO: 185078 - protein, 9 aa, Borrelia afzelii
ADVSLSVSL

SEQ ID NO: 185079 - protein, 9 aa, Borrelia afzelii
DVSLSVSLE

SEQ ID NO: 185080 - protein, 9 aa, Borrelia afzelii
VSLSVSLEN

SEQ ID NO: 185081 - protein, 9 aa, Borrelia afzelii
SLSVSLENP

SEQ ID NO: 185082 - protein, 9 aa, Borrelia afzelii
LSVSLENPE

SEQ ID NO: 185083 - protein, 9 aa, Borrelia afzelii
SVSLENPEI

SEQ ID NO: 185084 - protein, 9 aa, Borrelia afzelii
VSLENPEIN

SEQ ID NO: 185085 - protein, 9 aa, Borrelia afzelii
SLENPEINY

SEQ ID NO: 185086 - protein, 9 aa, Borrelia afzelii
LENPEINYG

SEQ ID NO: 185087 - protein, 9 aa, Borrelia afzelii
ENPEINYGI

SEQ ID NO: 185088 - protein, 9 aa, Borrelia afzelii
NPEINYGII

SEQ ID NO: 185089 - protein, 9 aa, Borrelia afzelii
PEINYGIID

SEQ ID NO: 185090 - protein, 9 aa, Borrelia afzelii
EINYGIIDP

SEQ ID NO: 185091 - protein, 9 aa, Borrelia afzelii
INYGIIDPI

SEQ ID NO: 185092 - protein, 9 aa, Borrelia afzelii
NYGIIDPIY

SEQ ID NO: 185093 - protein, 9 aa, Borrelia afzelii
YGIIDPIYG

SEQ ID NO: 185094 - protein, 9 aa, Borrelia afzelii
GIIDPIYGD

SEQ ID NO: 185095 - protein, 9 aa, Borrelia afzelii
IIDPIYGDD

SEQ ID NO: 185096 - protein, 9 aa, Borrelia afzelii
IDPIYGDDV

SEQ ID NO: 185097 - protein, 9 aa, Borrelia afzelii
DPIYGDDVQ

SEQ ID NO: 185098 - protein, 9 aa, Borrelia afzelii
PIYGDDVQI

SEQ ID NO: 185099 - protein, 9 aa, Borrelia afzelii
IYGDDVQIP

SEQ ID NO: 185100 - protein, 9 aa, Borrelia afzelii
YGDDVQIPK

SEQ ID NO: 185101 - protein, 9 aa, Borrelia afzelii
GDDVQIPKN

SEQ ID NO: 185102 - protein, 9 aa, Borrelia afzelii
DDVQIPKNL

SEQ ID NO: 185103 - protein, 9 aa, Borrelia afzelii
DVQIPKNLI

SEQ ID NO: 185104 - protein, 9 aa, Borrelia afzelii
VQIPKNLIG

SEQ ID NO: 185105 - protein, 9 aa, Borrelia afzelii
QIPKNLIGV

SEQ ID NO: 185106 - protein, 9 aa, Borrelia afzelii
IPKNLIGVV

SEQ ID NO: 185107 - protein, 9 aa, Borrelia afzelii
PKNLIGVVF

SEQ ID NO: 185108 - protein, 9 aa, Borrelia afzelii
KNLIGVVFR

SEQ ID NO: 185109 - protein, 9 aa, Borrelia afzelii
NLIGVVFRI

SEQ ID NO: 185110 - protein, 9 aa, Borrelia afzelii
LIGVVFRIE

SEQ ID NO: 185111 - protein, 9 aa, Borrelia afzelii
IGVVFRIEQ

SEQ ID NO: 185112 - protein, 9 aa, Borrelia afzelii
GVVFRIEQG

SEQ ID NO: 185113 - protein, 9 aa, Borrelia afzelii
VVFRIEQGA

SEQ ID NO: 185114 - protein, 9 aa, Borrelia afzelii
VFRIEQGAF

SEQ ID NO: 185115 - protein, 9 aa, Borrelia afzelii
FRIEQGAFL

SEQ ID NO: 185116 - protein, 9 aa, Borrelia afzelii
RIEQGAFLA

SEQ ID NO: 185117 - protein, 9 aa, Borrelia afzelii
IEQGAFLAG

SEQ ID NO: 185118 - protein, 9 aa, Borrelia afzelii
EQGAFLAGY

SEQ ID NO: 185119 - protein, 9 aa, Borrelia afzelii
QGAFLAGYI

SEQ ID NO: 185120 - protein, 9 aa, Borrelia afzelii
GAFLAGYIA

SEQ ID NO: 185121 - protein, 9 aa, Borrelia afzelii
AFLAGYIAA

SEQ ID NO: 185122 - protein, 9 aa, Borrelia afzelii
FLAGYIAAK

SEQ ID NO: 185123 - protein, 9 aa, Borrelia afzelii
LAGYIAAKK

SEQ ID NO: 185124 - protein, 9 aa, Borrelia afzelii
AGYIAAKKS

SEQ ID NO: 185125 - protein, 9 aa, Borrelia afzelii
GYIAAKKSV

SEQ ID NO: 185126 - protein, 9 aa, Borrelia afzelii
YIAAKKSVS

SEQ ID NO: 185127 - protein, 9 aa, Borrelia afzelii
IAAKKSVSS

SEQ ID NO: 185128 - protein, 9 aa, Borrelia afzelii
AAKKSVSSK

SEQ ID NO: 185129 - protein, 9 aa, Borrelia afzelii
AKKSVSSKI

SEQ ID NO: 185130 - protein, 9 aa, Borrelia afzelii
KKSVSSKIG

SEQ ID NO: 185131 - protein, 9 aa, Borrelia afzelii
KSVSSKIGF

SEQ ID NO: 185132 - protein, 9 aa, Borrelia afzelii
SVSSKIGFI

SEQ ID NO: 185133 - protein, 9 aa, Borrelia afzelii
VSSKIGFIG

SEQ ID NO: 185134 - protein, 9 aa, Borrelia afzelii
SSKIGFIGG

SEQ ID NO: 185135 - protein, 9 aa, Borrelia afzelii
SKIGFIGGV

SEQ ID NO: 185136 - protein, 9 aa, Borrelia afzelii
KIGFIGGVK

SEQ ID NO: 185137 - protein, 9 aa, Borrelia afzelii
IGFIGGVKG

SEQ ID NO: 185138 - protein, 9 aa, Borrelia afzelii
GFIGGVKGD

SEQ ID NO: 185139 - protein, 9 aa, Borrelia afzelii
FIGGVKGDI

SEQ ID NO: 185140 - protein, 9 aa, Borrelia afzelii
IGGVKGDIV

SEQ ID NO: 185141 - protein, 9 aa, Borrelia afzelii
GGVKGDIVD

SEQ ID NO: 185142 - protein, 9 aa, Borrelia afzelii
GVKGDIVDA

SEQ ID NO: 185143 - protein, 9 aa, Borrelia afzelii
VKGDIVDAF

SEQ ID NO: 185144 - protein, 9 aa, Borrelia afzelii
KGDIVDAFR

SEQ ID NO: 185145 - protein, 9 aa, Borrelia afzelii
GDIVDAFRY

SEQ ID NO: 185146 - protein, 9 aa, Borrelia afzelii
DIVDAFRYG

SEQ ID NO: 185147 - protein, 9 aa, Borrelia afzelii
IVDAFRYGY

SEQ ID NO: 185148 - protein, 9 aa, Borrelia afzelii
VDAFRYGYE

SEQ ID NO: 185149 - protein, 9 aa, Borrelia afzelii
DAFRYGYEA

SEQ ID NO: 185150 - protein, 9 aa, Borrelia afzelii
AFRYGYEAG

SEQ ID NO: 185151 - protein, 9 aa, Borrelia afzelii
FRYGYEAGA

SEQ ID NO: 185152 - protein, 9 aa, Borrelia afzelii
RYGYEAGAK

SEQ ID NO: 185153 - protein, 9 aa, Borrelia afzelii
YGYEAGAKY

SEQ ID NO: 185154 - protein, 9 aa, Borrelia afzelii
GYEAGAKYA

SEQ ID NO: 185155 - protein, 9 aa, Borrelia afzelii
YEAGAKYAN

SEQ ID NO: 185156 - protein, 9 aa, Borrelia afzelii
EAGAKYANK

SEQ ID NO: 185157 - protein, 9 aa, Borrelia afzelii
AGAKYANKG

SEQ ID NO: 185158 - protein, 9 aa, Borrelia afzelii
GAKYANKGI

SEQ ID NO: 185159 - protein, 9 aa, Borrelia afzelii
AKYANKGIE

SEQ ID NO: 185160 - protein, 9 aa, Borrelia afzelii
KYANKGIEI

SEQ ID NO: 185161 - protein, 9 aa, Borrelia afzelii
YANKGIEIV

SEQ ID NO: 185162 - protein, 9 aa, Borrelia afzelii
ANKGIEIVS

SEQ ID NO: 185163 - protein, 9 aa, Borrelia afzelii
NKGIEIVSE

SEQ ID NO: 185164 - protein, 9 aa, Borrelia afzelii
KGIEIVSEY

SEQ ID NO: 185165 - protein, 9 aa, Borrelia afzelii
GIEIVSEYS

SEQ ID NO: 185166 - protein, 9 aa, Borrelia afzelii
IEIVSEYSN

SEQ ID NO: 185167 - protein, 9 aa, Borrelia afzelii
EIVSEYSNS

SEQ ID NO: 185168 - protein, 9 aa, Borrelia afzelii
IVSEYSNSF

SEQ ID NO: 185169 - protein, 9 aa, Borrelia afzelii
VSEYSNSFS

SEQ ID NO: 185170 - protein, 9 aa, Borrelia afzelii
SEYSNSFSD

SEQ ID NO: 185171 - protein, 9 aa, Borrelia afzelii
EYSNSFSDI

SEQ ID NO: 185172 - protein, 9 aa, Borrelia afzelii
YSNSFSDID

SEQ ID NO: 185173 - protein, 9 aa, Borrelia afzelii
SNSFSDIDI

SEQ ID NO: 185174 - protein, 9 aa, Borrelia afzelii
NSFSDIDIA

SEQ ID NO: 185175 - protein, 9 aa, Borrelia afzelii
SFSDIDIAR

SEQ ID NO: 185176 - protein, 9 aa, Borrelia afzelii
FSDIDIARV

SEQ ID NO: 185177 - protein, 9 aa, Borrelia afzelii
SDIDIARVM

SEQ ID NO: 185178 - protein, 9 aa, Borrelia afzelii
DIDIARVMA

SEQ ID NO: 185179 - protein, 9 aa, Borrelia afzelii
IDIARVMAN

SEQ ID NO: 185180 - protein, 9 aa, Borrelia afzelii
DIARVMANK

SEQ ID NO: 185181 - protein, 9 aa, Borrelia afzelii
IARVMANKM

SEQ ID NO: 185182 - protein, 9 aa, Borrelia afzelii
ARVMANKMY

SEQ ID NO: 185183 - protein, 9 aa, Borrelia afzelii
RVMANKMYS

SEQ ID NO: 185184 - protein, 9 aa, Borrelia afzelii
VMANKMYSK

SEQ ID NO: 185185 - protein, 9 aa, Borrelia afzelii
MANKMYSKG

SEQ ID NO: 185186 - protein, 9 aa, Borrelia afzelii
ANKMYSKGI

SEQ ID NO: 185187 - protein, 9 aa, Borrelia afzelii
NKMYSKGID

SEQ ID NO: 185188 - protein, 9 aa, Borrelia afzelii
KMYSKGIDI

SEQ ID NO: 185189 - protein, 9 aa, Borrelia afzelii
MYSKGIDII

SEQ ID NO: 185190 - protein, 9 aa, Borrelia afzelii
YSKGIDIIH

SEQ ID NO: 185191 - protein, 9 aa, Borrelia afzelii
SKGIDIIHF

SEQ ID NO: 185192 - protein, 9 aa, Borrelia afzelii
KGIDIIHFA

SEQ ID NO: 185193 - protein, 9 aa, Borrelia afzelii
GIDIIHFAA

SEQ ID NO: 185194 - protein, 9 aa, Borrelia afzelii
IDIIHFAAG

SEQ ID NO: 185195 - protein, 9 aa, Borrelia afzelii
DIIHFAAGL

SEQ ID NO: 185196 - protein, 9 aa, Borrelia afzelii
IIHFAAGLA

SEQ ID NO: 185197 - protein, 9 aa, Borrelia afzelii
IHFAAGLAG

SEQ ID NO: 185198 - protein, 9 aa, Borrelia afzelii
HFAAGLAGV

SEQ ID NO: 185199 - protein, 9 aa, Borrelia afzelii
FAAGLAGVG

SEQ ID NO: 185200 - protein, 9 aa, Borrelia afzelii
AAGLAGVGV

SEQ ID NO: 185201 - protein, 9 aa, Borrelia afzelii
AGLAGVGVI

SEQ ID NO: 185202 - protein, 9 aa, Borrelia afzelii
GLAGVGVIE

SEQ ID NO: 185203 - protein, 9 aa, Borrelia afzelii
LAGVGVIEA

SEQ ID NO: 185204 - protein, 9 aa, Borrelia afzelii
AGVGVIEAA

SEQ ID NO: 185205 - protein, 9 aa, Borrelia afzelii
GVGVIEAAK

SEQ ID NO: 185206 - protein, 9 aa, Borrelia afzelii
VGVIEAAKE

SEQ ID NO: 185207 - protein, 9 aa, Borrelia afzelii
GVIEAAKEL

SEQ ID NO: 185208 - protein, 9 aa, Borrelia afzelii
VIEAAKELG

SEQ ID NO: 185209 - protein, 9 aa, Borrelia afzelii
IEAAKELGD

SEQ ID NO: 185210 - protein, 9 aa, Borrelia afzelii
EAAKELGDG

SEQ ID NO: 185211 - protein, 9 aa, Borrelia afzelii
AAKELGDGY

SEQ ID NO: 185212 - protein, 9 aa, Borrelia afzelii
AKELGDGYY

SEQ ID NO: 185213 - protein, 9 aa, Borrelia afzelii
KELGDGYYV

SEQ ID NO: 185214 - protein, 9 aa, Borrelia afzelii
ELGDGYYVI

SEQ ID NO: 185215 - protein, 9 aa, Borrelia afzelii
LGDGYYVIG

SEQ ID NO: 185216 - protein, 9 aa, Borrelia afzelii
GDGYYVIGA

SEQ ID NO: 185217 - protein, 9 aa, Borrelia afzelii
DGYYVIGAD

SEQ ID NO: 185218 - protein, 9 aa, Borrelia afzelii
GYYVIGADQ

SEQ ID NO: 185219 - protein, 9 aa, Borrelia afzelii
YYVIGADQD

SEQ ID NO: 185220 - protein, 9 aa, Borrelia afzelii
YVIGADQDQ

SEQ ID NO: 185221 - protein, 9 aa, Borrelia afzelii
VIGADQDQS

SEQ ID NO: 185222 - protein, 9 aa, Borrelia afzelii
IGADQDQSH

SEQ ID NO: 185223 - protein, 9 aa, Borrelia afzelii
GADQDQSHL

SEQ ID NO: 185224 - protein, 9 aa, Borrelia afzelii
ADQDQSHLA

SEQ ID NO: 185225 - protein, 9 aa, Borrelia afzelii
DQDQSHLAP

SEQ ID NO: 185226 - protein, 9 aa, Borrelia afzelii
QDQSHLAPK

SEQ ID NO: 185227 - protein, 9 aa, Borrelia afzelii
DQSHLAPKN

SEQ ID NO: 185228 - protein, 9 aa, Borrelia afzelii
QSHLAPKNF

SEQ ID NO: 185229 - protein, 9 aa, Borrelia afzelii
SHLAPKNFI

SEQ ID NO: 185230 - protein, 9 aa, Borrelia afzelii
HLAPKNFIT

SEQ ID NO: 185231 - protein, 9 aa, Borrelia afzelii
LAPKNFITS

SEQ ID NO: 185232 - protein, 9 aa, Borrelia afzelii
APKNFITSV

SEQ ID NO: 185233 - protein, 9 aa, Borrelia afzelii
PKNFITSVI

SEQ ID NO: 185234 - protein, 9 aa, Borrelia afzelii
KNFITSVIK

SEQ ID NO: 185235 - protein, 9 aa, Borrelia afzelii
NFITSVIKN

SEQ ID NO: 185236 - protein, 9 aa, Borrelia afzelii
FITSVIKNV

SEQ ID NO: 185237 - protein, 9 aa, Borrelia afzelii
ITSVIKNVG

SEQ ID NO: 185238 - protein, 9 aa, Borrelia afzelii
TSVIKNVGD

SEQ ID NO: 185239 - protein, 9 aa, Borrelia afzelii
SVIKNVGDA

SEQ ID NO: 185240 - protein, 9 aa, Borrelia afzelii
VIKNVGDAL

SEQ ID NO: 185241 - protein, 9 aa, Borrelia afzelii
IKNVGDALY

SEQ ID NO: 185242 - protein, 9 aa, Borrelia afzelii
KNVGDALYL

SEQ ID NO: 185243 - protein, 9 aa, Borrelia afzelii
NVGDALYLI

SEQ ID NO: 185244 - protein, 9 aa, Borrelia afzelii
VGDALYLIT

SEQ ID NO: 185245 - protein, 9 aa, Borrelia afzelii
GDALYLITS

SEQ ID NO: 185246 - protein, 9 aa, Borrelia afzelii
DALYLITSE

SEQ ID NO: 185247 - protein, 9 aa, Borrelia afzelii
ALYLITSES

SEQ ID NO: 185248 - protein, 9 aa, Borrelia afzelii
LYLITSESL

SEQ ID NO: 185249 - protein, 9 aa, Borrelia afzelii
YLITSESLK

SEQ ID NO: 185250 - protein, 9 aa, Borrelia afzelii
LITSESLKN

SEQ ID NO: 185251 - protein, 9 aa, Borrelia afzelii
ITSESLKND

SEQ ID NO: 185252 - protein, 9 aa, Borrelia afzelii
TSESLKNDN

SEQ ID NO: 185253 - protein, 9 aa, Borrelia afzelii
SESLKNDNV

SEQ ID NO: 185254 - protein, 9 aa, Borrelia afzelii
ESLKNDNVW

SEQ ID NO: 185255 - protein, 9 aa, Borrelia afzelii
SLKNDNVWE

SEQ ID NO: 185256 - protein, 9 aa, Borrelia afzelii
LKNDNVWEG

SEQ ID NO: 185257 - protein, 9 aa, Borrelia afzelii
KNDNVWEGG

SEQ ID NO: 185258 - protein, 9 aa, Borrelia afzelii
NDNVWEGGK

SEQ ID NO: 185259 - protein, 9 aa, Borrelia afzelii
DNVWEGGKI

SEQ ID NO: 185260 - protein, 9 aa, Borrelia afzelii
NVWEGGKIV

SEQ ID NO: 185261 - protein, 9 aa, Borrelia afzelii
VWEGGKIVQ

SEQ ID NO: 185262 - protein, 9 aa, Borrelia afzelii
WEGGKIVQM

SEQ ID NO: 185263 - protein, 9 aa, Borrelia afzelii
EGGKIVQMG

SEQ ID NO: 185264 - protein, 9 aa, Borrelia afzelii
GGKIVQMGL

SEQ ID NO: 185265 - protein, 9 aa, Borrelia afzelii
GKIVQMGLR

SEQ ID NO: 185266 - protein, 9 aa, Borrelia afzelii
KIVQMGLRD

SEQ ID NO: 185267 - protein, 9 aa, Borrelia afzelii
IVQMGLRDG

SEQ ID NO: 185268 - protein, 9 aa, Borrelia afzelii
VQMGLRDGV

SEQ ID NO: 185269 - protein, 9 aa, Borrelia afzelii
QMGLRDGVV

SEQ ID NO: 185270 - protein, 9 aa, Borrelia afzelii
MGLRDGVVG

SEQ ID NO: 185271 - protein, 9 aa, Borrelia afzelii
GLRDGVVGL

SEQ ID NO: 185272 - protein, 9 aa, Borrelia afzelii
LRDGVVGLS

SEQ ID NO: 185273 - protein, 9 aa, Borrelia afzelii
RDGVVGLSN

SEQ ID NO: 185274 - protein, 9 aa, Borrelia afzelii
DGVVGLSNA

SEQ ID NO: 185275 - protein, 9 aa, Borrelia afzelii
GVVGLSNAN

SEQ ID NO: 185276 - protein, 9 aa, Borrelia afzelii
VVGLSNANE

SEQ ID NO: 185277 - protein, 9 aa, Borrelia afzelii
VGLSNANEF

SEQ ID NO: 185278 - protein, 9 aa, Borrelia afzelii
GLSNANEFE

SEQ ID NO: 185279 - protein, 9 aa, Borrelia afzelii
LSNANEFEY

SEQ ID NO: 185280 - protein, 9 aa, Borrelia afzelii
SNANEFEYI

SEQ ID NO: 185281 - protein, 9 aa, Borrelia afzelii
NANEFEYIK

SEQ ID NO: 185282 - protein, 9 aa, Borrelia afzelii
ANEFEYIKD

SEQ ID NO: 185283 - protein, 9 aa, Borrelia afzelii
NEFEYIKDL

SEQ ID NO: 185284 - protein, 9 aa, Borrelia afzelii
EFEYIKDLE

SEQ ID NO: 185285 - protein, 9 aa, Borrelia afzelii
FEYIKDLER

SEQ ID NO: 185286 - protein, 9 aa, Borrelia afzelii
EYIKDLERK

SEQ ID NO: 185287 - protein, 9 aa, Borrelia afzelii
YIKDLERKI

SEQ ID NO: 185288 - protein, 9 aa, Borrelia afzelii
IKDLERKII

SEQ ID NO: 185289 - protein, 9 aa, Borrelia afzelii
KDLERKIIN

SEQ ID NO: 185290 - protein, 9 aa, Borrelia afzelii
DLERKIINK

SEQ ID NO: 185291 - protein, 9 aa, Borrelia afzelii
LERKIINKE

SEQ ID NO: 185292 - protein, 9 aa, Borrelia afzelii
ERKIINKEI

SEQ ID NO: 185293 - protein, 9 aa, Borrelia afzelii
RKIINKEII

SEQ ID NO: 185294 - protein, 9 aa, Borrelia afzelii
KIINKEIIV

SEQ ID NO: 185295 - protein, 9 aa, Borrelia afzelii
IINKEIIVP

SEQ ID NO: 185296 - protein, 9 aa, Borrelia afzelii
INKEIIVPC

SEQ ID NO: 185297 - protein, 9 aa, Borrelia afzelii
NKEIIVPCN

SEQ ID NO: 185298 - protein, 9 aa, Borrelia afzelii
KEIIVPCNQ

SEQ ID NO: 185299 - protein, 9 aa, Borrelia afzelii
EIIVPCNQE

SEQ ID NO: 185300 - protein, 9 aa, Borrelia afzelii
IIVPCNQEG

SEQ ID NO: 185301 - protein, 9 aa, Borrelia afzelii
IVPCNQEGY

SEQ ID NO: 185302 - protein, 9 aa, Borrelia afzelii
VPCNQEGYE

SEQ ID NO: 185303 - protein, 9 aa, Borrelia afzelii
PCNQEGYEI

SEQ ID NO: 185304 - protein, 9 aa, Borrelia afzelii
CNQEGYEIF

SEQ ID NO: 185305 - protein, 9 aa, Borrelia afzelii
NQEGYEIFI

SEQ ID NO: 185306 - protein, 9 aa, Borrelia afzelii
QEGYEIFIK

SEQ ID NO: 185307 - protein, 9 aa, Borrelia afzelii
EGYEIFIKQ

SEQ ID NO: 185308 - protein, 9 aa, Borrelia afzelii
GYEIFIKQI

SEQ ID NO: 185309 - protein, 9 aa, Borrelia afzelii
YEIFIKQIL

SEQ ID NO: 185310 - protein, 9 aa, Borrelia afzelii
EIFIKQILK

SEQ ID NO: 185311 - protein, 9 aa, Borrelia afzelii
IFIKQILKL

SEQ ID NO: 185312 - protein, 10 aa, Borrelia afzelii
MRIAIFIFGI

SEQ ID NO: 185313 - protein, 10 aa, Borrelia afzelii
RIAIFIFGIL

SEQ ID NO: 185314 - protein, 10 aa, Borrelia afzelii
IAIFIFGILL

SEQ ID NO: 185315 - protein, 10 aa, Borrelia afzelii
AIFIFGILLT

SEQ ID NO: 185316 - protein, 10 aa, Borrelia afzelii
IFIFGILLTS

SEQ ID NO: 185317 - protein, 10 aa, Borrelia afzelii
FIFGILLTSC

SEQ ID NO: 185318 - protein, 10 aa, Borrelia afzelii
IFGILLTSCF

SEQ ID NO: 185319 - protein, 10 aa, Borrelia afzelii
FGILLTSCFS

SEQ ID NO: 185320 - protein, 10 aa, Borrelia afzelii
GILLTSCFSK

SEQ ID NO: 185321 - protein, 10 aa, Borrelia afzelii
ILLTSCFSKN

SEQ ID NO: 185322 - protein, 10 aa, Borrelia afzelii
LLTSCFSKNG

SEQ ID NO: 185323 - protein, 10 aa, Borrelia afzelii
LTSCFSKNGI

SEQ ID NO: 185324 - protein, 10 aa, Borrelia afzelii
TSCFSKNGIE

SEQ ID NO: 185325 - protein, 10 aa, Borrelia afzelii
SCFSKNGIES

SEQ ID NO: 185326 - protein, 10 aa, Borrelia afzelii
CFSKNGIESG

SEQ ID NO: 185327 - protein, 10 aa, Borrelia afzelii
FSKNGIESGS

SEQ ID NO: 185328 - protein, 10 aa, Borrelia afzelii
SKNGIESGSS

SEQ ID NO: 185329 - protein, 10 aa, Borrelia afzelii
KNGIESGSSK

SEQ ID NO: 185330 - protein, 10 aa, Borrelia afzelii
NGIESGSSKI

SEQ ID NO: 185331 - protein, 10 aa, Borrelia afzelii
GIESGSSKIK

SEQ ID NO: 185332 - protein, 10 aa, Borrelia afzelii
IESGSSKIKI

SEQ ID NO: 185333 - protein, 10 aa, Borrelia afzelii
ESGSSKIKIS

SEQ ID NO: 185334 - protein, 10 aa, Borrelia afzelii
SGSSKIKISM

SEQ ID NO: 185335 - protein, 10 aa, Borrelia afzelii
GSSKIKISML

SEQ ID NO: 185336 - protein, 10 aa, Borrelia afzelii
SSKIKISMLV

SEQ ID NO: 185337 - protein, 10 aa, Borrelia afzelii
SKIKISMLVD

SEQ ID NO: 185338 - protein, 10 aa, Borrelia afzelii
KIKISMLVDG

SEQ ID NO: 185339 - protein, 10 aa, Borrelia afzelii
IKISMLVDGV

SEQ ID NO: 185340 - protein, 10 aa, Borrelia afzelii
KISMLVDGVL

SEQ ID NO: 185341 - protein, 10 aa, Borrelia afzelii
ISMLVDGVLD

SEQ ID NO: 185342 - protein, 10 aa, Borrelia afzelii
SMLVDGVLDD

SEQ ID NO: 185343 - protein, 10 aa, Borrelia afzelii
MLVDGVLDDK

SEQ ID NO: 185344 - protein, 10 aa, Borrelia afzelii
LVDGVLDDKS

SEQ ID NO: 185345 - protein, 10 aa, Borrelia afzelii
VDGVLDDKSF

SEQ ID NO: 185346 - protein, 10 aa, Borrelia afzelii
DGVLDDKSFN

SEQ ID NO: 185347 - protein, 10 aa, Borrelia afzelii
GVLDDKSFNS

SEQ ID NO: 185348 - protein, 10 aa, Borrelia afzelii
VLDDKSFNSS

SEQ ID NO: 185349 - protein, 10 aa, Borrelia afzelii
LDDKSFNSSA

SEQ ID NO: 185350 - protein, 10 aa, Borrelia afzelii
DDKSFNSSAN

SEQ ID NO: 185351 - protein, 10 aa, Borrelia afzelii
DKSFNSSANE

SEQ ID NO: 185352 - protein, 10 aa, Borrelia afzelii
KSFNSSANEA

SEQ ID NO: 185353 - protein, 10 aa, Borrelia afzelii
SFNSSANEAL

SEQ ID NO: 185354 - protein, 10 aa, Borrelia afzelii
FNSSANEALL

SEQ ID NO: 185355 - protein, 10 aa, Borrelia afzelii
NSSANEALLR

SEQ ID NO: 185356 - protein, 10 aa, Borrelia afzelii
SSANEALLRL

SEQ ID NO: 185357 - protein, 10 aa, Borrelia afzelii
SANEALLRLK

SEQ ID NO: 185358 - protein, 10 aa, Borrelia afzelii
ANEALLRLKK

SEQ ID NO: 185359 - protein, 10 aa, Borrelia afzelii
NEALLRLKKD

SEQ ID NO: 185360 - protein, 10 aa, Borrelia afzelii
EALLRLKKDF

SEQ ID NO: 185361 - protein, 10 aa, Borrelia afzelii
ALLRLKKDFP

SEQ ID NO: 185362 - protein, 10 aa, Borrelia afzelii
LLRLKKDFPE

SEQ ID NO: 185363 - protein, 10 aa, Borrelia afzelii
LRLKKDFPEN

SEQ ID NO: 185364 - protein, 10 aa, Borrelia afzelii
RLKKDFPENI

SEQ ID NO: 185365 - protein, 10 aa, Borrelia afzelii
LKKDFPENIE

SEQ ID NO: 185366 - protein, 10 aa, Borrelia afzelii
KKDFPENIEK

SEQ ID NO: 185367 - protein, 10 aa, Borrelia afzelii
KDFPENIEKV

SEQ ID NO: 185368 - protein, 10 aa, Borrelia afzelii
DFPENIEKVF

SEQ ID NO: 185369 - protein, 10 aa, Borrelia afzelii
FPENIEKVFS

SEQ ID NO: 185370 - protein, 10 aa, Borrelia afzelii
PENIEKVFSS

SEQ ID NO: 185371 - protein, 10 aa, Borrelia afzelii
ENIEKVFSSA

SEQ ID NO: 185372 - protein, 10 aa, Borrelia afzelii
NIEKVFSSAV

SEQ ID NO: 185373 - protein, 10 aa, Borrelia afzelii
IEKVFSSAVS

SEQ ID NO: 185374 - protein, 10 aa, Borrelia afzelii
EKVFSSAVSG

SEQ ID NO: 185375 - protein, 10 aa, Borrelia afzelii
KVFSSAVSGV

SEQ ID NO: 185376 - protein, 10 aa, Borrelia afzelii
VFSSAVSGVY

SEQ ID NO: 185377 - protein, 10 aa, Borrelia afzelii
FSSAVSGVYS

SEQ ID NO: 185378 - protein, 10 aa, Borrelia afzelii
SSAVSGVYSS

SEQ ID NO: 185379 - protein, 10 aa, Borrelia afzelii
SAVSGVYSSY

SEQ ID NO: 185380 - protein, 10 aa, Borrelia afzelii
AVSGVYSSYV

SEQ ID NO: 185381 - protein, 10 aa, Borrelia afzelii
VSGVYSSYVS

SEQ ID NO: 185382 - protein, 10 aa, Borrelia afzelii
SGVYSSYVSD

SEQ ID NO: 185383 - protein, 10 aa, Borrelia afzelii
GVYSSYVSDL

SEQ ID NO: 185384 - protein, 10 aa, Borrelia afzelii
VYSSYVSDLD

SEQ ID NO: 185385 - protein, 10 aa, Borrelia afzelii
YSSYVSDLDN

SEQ ID NO: 185386 - protein, 10 aa, Borrelia afzelii
SSYVSDLDNL

SEQ ID NO: 185387 - protein, 10 aa, Borrelia afzelii
SYVSDLDNLK

SEQ ID NO: 185388 - protein, 10 aa, Borrelia afzelii
YVSDLDNLKM

SEQ ID NO: 185389 - protein, 10 aa, Borrelia afzelii
VSDLDNLKMN

SEQ ID NO: 185390 - protein, 10 aa, Borrelia afzelii
SDLDNLKMNG

SEQ ID NO: 185391 - protein, 10 aa, Borrelia afzelii
DLDNLKMNGS

SEQ ID NO: 185392 - protein, 10 aa, Borrelia afzelii
LDNLKMNGSG

SEQ ID NO: 185393 - protein, 10 aa, Borrelia afzelii
DNLKMNGSGL

SEQ ID NO: 185394 - protein, 10 aa, Borrelia afzelii
NLKMNGSGLI

SEQ ID NO: 185395 - protein, 10 aa, Borrelia afzelii
LKMNGSGLIW

SEQ ID NO: 185396 - protein, 10 aa, Borrelia afzelii
KMNGSGLIWL

SEQ ID NO: 185397 - protein, 10 aa, Borrelia afzelii
MNGSGLIWLV

SEQ ID NO: 185398 - protein, 10 aa, Borrelia afzelii
NGSGLIWLVG

SEQ ID NO: 185399 - protein, 10 aa, Borrelia afzelii
GSGLIWLVGY

SEQ ID NO: 185400 - protein, 10 aa, Borrelia afzelii
SGLIWLVGYM

SEQ ID NO: 185401 - protein, 10 aa, Borrelia afzelii
GLIWLVGYML

SEQ ID NO: 185402 - protein, 10 aa, Borrelia afzelii
LIWLVGYMLA

SEQ ID NO: 185403 - protein, 10 aa, Borrelia afzelii
IWLVGYMLAD

SEQ ID NO: 185404 - protein, 10 aa, Borrelia afzelii
WLVGYMLADV

SEQ ID NO: 185405 - protein, 10 aa, Borrelia afzelii
LVGYMLADVS

SEQ ID NO: 185406 - protein, 10 aa, Borrelia afzelii
VGYMLADVSL

SEQ ID NO: 185407 - protein, 10 aa, Borrelia afzelii
GYMLADVSLS

SEQ ID NO: 185408 - protein, 10 aa, Borrelia afzelii
YMLADVSLSV

SEQ ID NO: 185409 - protein, 10 aa, Borrelia afzelii
MLADVSLSVS

SEQ ID NO: 185410 - protein, 10 aa, Borrelia afzelii
LADVSLSVSL

SEQ ID NO: 185411 - protein, 10 aa, Borrelia afzelii
ADVSLSVSLE

SEQ ID NO: 185412 - protein, 10 aa, Borrelia afzelii
DVSLSVSLEN

SEQ ID NO: 185413 - protein, 10 aa, Borrelia afzelii
VSLSVSLENP

SEQ ID NO: 185414 - protein, 10 aa, Borrelia afzelii
SLSVSLENPE

SEQ ID NO: 185415 - protein, 10 aa, Borrelia afzelii
LSVSLENPEI

SEQ ID NO: 185416 - protein, 10 aa, Borrelia afzelii
SVSLENPEIN

SEQ ID NO: 185417 - protein, 10 aa, Borrelia afzelii
VSLENPEINY

SEQ ID NO: 185418 - protein, 10 aa, Borrelia afzelii
SLENPEINYG

SEQ ID NO: 185419 - protein, 10 aa, Borrelia afzelii
LENPEINYGI

SEQ ID NO: 185420 - protein, 10 aa, Borrelia afzelii
ENPEINYGII

SEQ ID NO: 185421 - protein, 10 aa, Borrelia afzelii
NPEINYGIID

SEQ ID NO: 185422 - protein, 10 aa, Borrelia afzelii
PEINYGIIDP

SEQ ID NO: 185423 - protein, 10 aa, Borrelia afzelii
EINYGIIDPI

SEQ ID NO: 185424 - protein, 10 aa, Borrelia afzelii
INYGIIDPIY

SEQ ID NO: 185425 - protein, 10 aa, Borrelia afzelii
NYGIIDPIYG

SEQ ID NO: 185426 - protein, 10 aa, Borrelia afzelii
YGIIDPIYGD

SEQ ID NO: 185427 - protein, 10 aa, Borrelia afzelii
GIIDPIYGDD

SEQ ID NO: 185428 - protein, 10 aa, Borrelia afzelii
IIDPIYGDDV

SEQ ID NO: 185429 - protein, 10 aa, Borrelia afzelii
IDPIYGDDVQ

SEQ ID NO: 185430 - protein, 10 aa, Borrelia afzelii
DPIYGDDVQI

SEQ ID NO: 185431 - protein, 10 aa, Borrelia afzelii
PIYGDDVQIP

SEQ ID NO: 185432 - protein, 10 aa, Borrelia afzelii
IYGDDVQIPK

SEQ ID NO: 185433 - protein, 10 aa, Borrelia afzelii
YGDDVQIPKN

SEQ ID NO: 185434 - protein, 10 aa, Borrelia afzelii
GDDVQIPKNL

SEQ ID NO: 185435 - protein, 10 aa, Borrelia afzelii
DDVQIPKNLI

SEQ ID NO: 185436 - protein, 10 aa, Borrelia afzelii
DVQIPKNLIG

SEQ ID NO: 185437 - protein, 10 aa, Borrelia afzelii
VQIPKNLIGV

SEQ ID NO: 185438 - protein, 10 aa, Borrelia afzelii
QIPKNLIGVV

SEQ ID NO: 185439 - protein, 10 aa, Borrelia afzelii
IPKNLIGVVF

SEQ ID NO: 185440 - protein, 10 aa, Borrelia afzelii
PKNLIGVVFR

SEQ ID NO: 185441 - protein, 10 aa, Borrelia afzelii
KNLIGVVFRI

SEQ ID NO: 185442 - protein, 10 aa, Borrelia afzelii
NLIGVVFRIE

SEQ ID NO: 185443 - protein, 10 aa, Borrelia afzelii
LIGVVFRIEQ

SEQ ID NO: 185444 - protein, 10 aa, Borrelia afzelii
IGVVFRIEQG

SEQ ID NO: 185445 - protein, 10 aa, Borrelia afzelii
GVVFRIEQGA

SEQ ID NO: 185446 - protein, 10 aa, Borrelia afzelii
VVFRIEQGAF

SEQ ID NO: 185447 - protein, 10 aa, Borrelia afzelii
VFRIEQGAFL

SEQ ID NO: 185448 - protein, 10 aa, Borrelia afzelii
FRIEQGAFLA

SEQ ID NO: 185449 - protein, 10 aa, Borrelia afzelii
RIEQGAFLAG

SEQ ID NO: 185450 - protein, 10 aa, Borrelia afzelii
IEQGAFLAGY

SEQ ID NO: 185451 - protein, 10 aa, Borrelia afzelii
EQGAFLAGYI

SEQ ID NO: 185452 - protein, 10 aa, Borrelia afzelii
QGAFLAGYIA

SEQ ID NO: 185453 - protein, 10 aa, Borrelia afzelii
GAFLAGYIAA

SEQ ID NO: 185454 - protein, 10 aa, Borrelia afzelii
AFLAGYIAAK

SEQ ID NO: 185455 - protein, 10 aa, Borrelia afzelii
FLAGYIAAKK

SEQ ID NO: 185456 - protein, 10 aa, Borrelia afzelii
LAGYIAAKKS

SEQ ID NO: 185457 - protein, 10 aa, Borrelia afzelii
AGYIAAKKSV

SEQ ID NO: 185458 - protein, 10 aa, Borrelia afzelii
GYIAAKKSVS

SEQ ID NO: 185459 - protein, 10 aa, Borrelia afzelii
YIAAKKSVSS

SEQ ID NO: 185460 - protein, 10 aa, Borrelia afzelii
IAAKKSVSSK

SEQ ID NO: 185461 - protein, 10 aa, Borrelia afzelii
AAKKSVSSKI

SEQ ID NO: 185462 - protein, 10 aa, Borrelia afzelii
AKKSVSSKIG

SEQ ID NO: 185463 - protein, 10 aa, Borrelia afzelii
KKSVSSKIGF

SEQ ID NO: 185464 - protein, 10 aa, Borrelia afzelii
KSVSSKIGFI

SEQ ID NO: 185465 - protein, 10 aa, Borrelia afzelii
SVSSKIGFIG

SEQ ID NO: 185466 - protein, 10 aa, Borrelia afzelii
VSSKIGFIGG

SEQ ID NO: 185467 - protein, 10 aa, Borrelia afzelii
SSKIGFIGGV

SEQ ID NO: 185468 - protein, 10 aa, Borrelia afzelii
SKIGFIGGVK

SEQ ID NO: 185469 - protein, 10 aa, Borrelia afzelii
KIGFIGGVKG

SEQ ID NO: 185470 - protein, 10 aa, Borrelia afzelii
IGFIGGVKGD

SEQ ID NO: 185471 - protein, 10 aa, Borrelia afzelii
GFIGGVKGDI

SEQ ID NO: 185472 - protein, 10 aa, Borrelia afzelii
FIGGVKGDIV

SEQ ID NO: 185473 - protein, 10 aa, Borrelia afzelii
IGGVKGDIVD

SEQ ID NO: 185474 - protein, 10 aa, Borrelia afzelii
GGVKGDIVDA

SEQ ID NO: 185475 - protein, 10 aa, Borrelia afzelii
GVKGDIVDAF

SEQ ID NO: 185476 - protein, 10 aa, Borrelia afzelii
VKGDIVDAFR

SEQ ID NO: 185477 - protein, 10 aa, Borrelia afzelii
KGDIVDAFRY

SEQ ID NO: 185478 - protein, 10 aa, Borrelia afzelii
GDIVDAFRYG

SEQ ID NO: 185479 - protein, 10 aa, Borrelia afzelii
DIVDAFRYGY

SEQ ID NO: 185480 - protein, 10 aa, Borrelia afzelii
IVDAFRYGYE

SEQ ID NO: 185481 - protein, 10 aa, Borrelia afzelii
VDAFRYGYEA

SEQ ID NO: 185482 - protein, 10 aa, Borrelia afzelii
DAFRYGYEAG

SEQ ID NO: 185483 - protein, 10 aa, Borrelia afzelii
AFRYGYEAGA

SEQ ID NO: 185484 - protein, 10 aa, Borrelia afzelii
FRYGYEAGAK

SEQ ID NO: 185485 - protein, 10 aa, Borrelia afzelii
RYGYEAGAKY

SEQ ID NO: 185486 - protein, 10 aa, Borrelia afzelii
YGYEAGAKYA

SEQ ID NO: 185487 - protein, 10 aa, Borrelia afzelii
GYEAGAKYAN

SEQ ID NO: 185488 - protein, 10 aa, Borrelia afzelii
YEAGAKYANK

SEQ ID NO: 185489 - protein, 10 aa, Borrelia afzelii
EAGAKYANKG

SEQ ID NO: 185490 - protein, 10 aa, Borrelia afzelii
AGAKYANKGI

SEQ ID NO: 185491 - protein, 10 aa, Borrelia afzelii
GAKYANKGIE

SEQ ID NO: 185492 - protein, 10 aa, Borrelia afzelii
AKYANKGIEI

SEQ ID NO: 185493 - protein, 10 aa, Borrelia afzelii
KYANKGIEIV

SEQ ID NO: 185494 - protein, 10 aa, Borrelia afzelii
YANKGIEIVS

SEQ ID NO: 185495 - protein, 10 aa, Borrelia afzelii
ANKGIEIVSE

SEQ ID NO: 185496 - protein, 10 aa, Borrelia afzelii
NKGIEIVSEY

SEQ ID NO: 185497 - protein, 10 aa, Borrelia afzelii
KGIEIVSEYS

SEQ ID NO: 185498 - protein, 10 aa, Borrelia afzelii
GIEIVSEYSN

SEQ ID NO: 185499 - protein, 10 aa, Borrelia afzelii
IEIVSEYSNS

SEQ ID NO: 185500 - protein, 10 aa, Borrelia afzelii
EIVSEYSNSF

SEQ ID NO: 185501 - protein, 10 aa, Borrelia afzelii
IVSEYSNSFS

SEQ ID NO: 185502 - protein, 10 aa, Borrelia afzelii
VSEYSNSFSD

SEQ ID NO: 185503 - protein, 10 aa, Borrelia afzelii
SEYSNSFSDI

SEQ ID NO: 185504 - protein, 10 aa, Borrelia afzelii
EYSNSFSDID

SEQ ID NO: 185505 - protein, 10 aa, Borrelia afzelii
YSNSFSDIDI

SEQ ID NO: 185506 - protein, 10 aa, Borrelia afzelii
SNSFSDIDIA

SEQ ID NO: 185507 - protein, 10 aa, Borrelia afzelii
NSFSDIDIAR

SEQ ID NO: 185508 - protein, 10 aa, Borrelia afzelii
SFSDIDIARV

SEQ ID NO: 185509 - protein, 10 aa, Borrelia afzelii
FSDIDIARVM

SEQ ID NO: 185510 - protein, 10 aa, Borrelia afzelii
SDIDIARVMA

SEQ ID NO: 185511 - protein, 10 aa, Borrelia afzelii
DIDIARVMAN

SEQ ID NO: 185512 - protein, 10 aa, Borrelia afzelii
IDIARVMANK

SEQ ID NO: 185513 - protein, 10 aa, Borrelia afzelii
DIARVMANKM

SEQ ID NO: 185514 - protein, 10 aa, Borrelia afzelii
IARVMANKMY

SEQ ID NO: 185515 - protein, 10 aa, Borrelia afzelii
ARVMANKMYS

SEQ ID NO: 185516 - protein, 10 aa, Borrelia afzelii
RVMANKMYSK

SEQ ID NO: 185517 - protein, 10 aa, Borrelia afzelii
VMANKMYSKG

SEQ ID NO: 185518 - protein, 10 aa, Borrelia afzelii
MANKMYSKGI

SEQ ID NO: 185519 - protein, 10 aa, Borrelia afzelii
ANKMYSKGID

SEQ ID NO: 185520 - protein, 10 aa, Borrelia afzelii
NKMYSKGIDI

SEQ ID NO: 185521 - protein, 10 aa, Borrelia afzelii
KMYSKGIDII

SEQ ID NO: 185522 - protein, 10 aa, Borrelia afzelii
MYSKGIDIIH

SEQ ID NO: 185523 - protein, 10 aa, Borrelia afzelii
YSKGIDIIHF

SEQ ID NO: 185524 - protein, 10 aa, Borrelia afzelii
SKGIDIIHFA

SEQ ID NO: 185525 - protein, 10 aa, Borrelia afzelii
KGIDIIHFAA

SEQ ID NO: 185526 - protein, 10 aa, Borrelia afzelii
GIDIIHFAAG

SEQ ID NO: 185527 - protein, 10 aa, Borrelia afzelii
IDIIHFAAGL

SEQ ID NO: 185528 - protein, 10 aa, Borrelia afzelii
DIIHFAAGLA

SEQ ID NO: 185529 - protein, 10 aa, Borrelia afzelii
IIHFAAGLAG

SEQ ID NO: 185530 - protein, 10 aa, Borrelia afzelii
IHFAAGLAGV

SEQ ID NO: 185531 - protein, 10 aa, Borrelia afzelii
HFAAGLAGVG

SEQ ID NO: 185532 - protein, 10 aa, Borrelia afzelii
FAAGLAGVGV

SEQ ID NO: 185533 - protein, 10 aa, Borrelia afzelii
AAGLAGVGVI

SEQ ID NO: 185534 - protein, 10 aa, Borrelia afzelii
AGLAGVGVIE

SEQ ID NO: 185535 - protein, 10 aa, Borrelia afzelii
GLAGVGVIEA

SEQ ID NO: 185536 - protein, 10 aa, Borrelia afzelii
LAGVGVIEAA

SEQ ID NO: 185537 - protein, 10 aa, Borrelia afzelii
AGVGVIEAAK

SEQ ID NO: 185538 - protein, 10 aa, Borrelia afzelii
GVGVIEAAKE

SEQ ID NO: 185539 - protein, 10 aa, Borrelia afzelii
VGVIEAAKEL

SEQ ID NO: 185540 - protein, 10 aa, Borrelia afzelii
GVIEAAKELG

SEQ ID NO: 185541 - protein, 10 aa, Borrelia afzelii
VIEAAKELGD

SEQ ID NO: 185542 - protein, 10 aa, Borrelia afzelii
IEAAKELGDG

SEQ ID NO: 185543 - protein, 10 aa, Borrelia afzelii
EAAKELGDGY

SEQ ID NO: 185544 - protein, 10 aa, Borrelia afzelii
AAKELGDGYY

SEQ ID NO: 185545 - protein, 10 aa, Borrelia afzelii
AKELGDGYYV

SEQ ID NO: 185546 - protein, 10 aa, Borrelia afzelii
KELGDGYYVI

SEQ ID NO: 185547 - protein, 10 aa, Borrelia afzelii
ELGDGYYVIG

SEQ ID NO: 185548 - protein, 10 aa, Borrelia afzelii
LGDGYYVIGA

SEQ ID NO: 185549 - protein, 10 aa, Borrelia afzelii
GDGYYVIGAD

SEQ ID NO: 185550 - protein, 10 aa, Borrelia afzelii
DGYYVIGADQ

SEQ ID NO: 185551 - protein, 10 aa, Borrelia afzelii
GYYVIGADQD

SEQ ID NO: 185552 - protein, 10 aa, Borrelia afzelii
YYVIGADQDQ

SEQ ID NO: 185553 - protein, 10 aa, Borrelia afzelii
YVIGADQDQS

SEQ ID NO: 185554 - protein, 10 aa, Borrelia afzelii
VIGADQDQSH

SEQ ID NO: 185555 - protein, 10 aa, Borrelia afzelii
IGADQDQSHL

SEQ ID NO: 185556 - protein, 10 aa, Borrelia afzelii
GADQDQSHLA

SEQ ID NO: 185557 - protein, 10 aa, Borrelia afzelii
ADQDQSHLAP

SEQ ID NO: 185558 - protein, 10 aa, Borrelia afzelii
DQDQSHLAPK

SEQ ID NO: 185559 - protein, 10 aa, Borrelia afzelii
QDQSHLAPKN

SEQ ID NO: 185560 - protein, 10 aa, Borrelia afzelii
DQSHLAPKNF

SEQ ID NO: 185561 - protein, 10 aa, Borrelia afzelii
QSHLAPKNFI

SEQ ID NO: 185562 - protein, 10 aa, Borrelia afzelii
SHLAPKNFIT

SEQ ID NO: 185563 - protein, 10 aa, Borrelia afzelii
HLAPKNFITS

SEQ ID NO: 185564 - protein, 10 aa, Borrelia afzelii
LAPKNFITSV

SEQ ID NO: 185565 - protein, 10 aa, Borrelia afzelii
APKNFITSVI

SEQ ID NO: 185566 - protein, 10 aa, Borrelia afzelii
PKNFITSVIK

SEQ ID NO: 185567 - protein, 10 aa, Borrelia afzelii
KNFITSVIKN

SEQ ID NO: 185568 - protein, 10 aa, Borrelia afzelii
NFITSVIKNV

SEQ ID NO: 185569 - protein, 10 aa, Borrelia afzelii
FITSVIKNVG

SEQ ID NO: 185570 - protein, 10 aa, Borrelia afzelii
ITSVIKNVGD

SEQ ID NO: 185571 - protein, 10 aa, Borrelia afzelii
TSVIKNVGDA

SEQ ID NO: 185572 - protein, 10 aa, Borrelia afzelii
SVIKNVGDAL

SEQ ID NO: 185573 - protein, 10 aa, Borrelia afzelii
VIKNVGDALY

SEQ ID NO: 185574 - protein, 10 aa, Borrelia afzelii
IKNVGDALYL

SEQ ID NO: 185575 - protein, 10 aa, Borrelia afzelii
KNVGDALYLI

SEQ ID NO: 185576 - protein, 10 aa, Borrelia afzelii
NVGDALYLIT

SEQ ID NO: 185577 - protein, 10 aa, Borrelia afzelii
VGDALYLITS

SEQ ID NO: 185578 - protein, 10 aa, Borrelia afzelii
GDALYLITSE

SEQ ID NO: 185579 - protein, 10 aa, Borrelia afzelii
DALYLITSES

SEQ ID NO: 185580 - protein, 10 aa, Borrelia afzelii
ALYLITSESL

SEQ ID NO: 185581 - protein, 10 aa, Borrelia afzelii
LYLITSESLK

SEQ ID NO: 185582 - protein, 10 aa, Borrelia afzelii
YLITSESLKN

SEQ ID NO: 185583 - protein, 10 aa, Borrelia afzelii
LITSESLKND

SEQ ID NO: 185584 - protein, 10 aa, Borrelia afzelii
ITSESLKNDN

SEQ ID NO: 185585 - protein, 10 aa, Borrelia afzelii
TSESLKNDNV

SEQ ID NO: 185586 - protein, 10 aa, Borrelia afzelii
SESLKNDNVW

SEQ ID NO: 185587 - protein, 10 aa, Borrelia afzelii
ESLKNDNVWE

SEQ ID NO: 185588 - protein, 10 aa, Borrelia afzelii
SLKNDNVWEG

SEQ ID NO: 185589 - protein, 10 aa, Borrelia afzelii
LKNDNVWEGG

SEQ ID NO: 185590 - protein, 10 aa, Borrelia afzelii
KNDNVWEGGK

SEQ ID NO: 185591 - protein, 10 aa, Borrelia afzelii
NDNVWEGGKI

SEQ ID NO: 185592 - protein, 10 aa, Borrelia afzelii
DNVWEGGKIV

SEQ ID NO: 185593 - protein, 10 aa, Borrelia afzelii
NVWEGGKIVQ

SEQ ID NO: 185594 - protein, 10 aa, Borrelia afzelii
VWEGGKIVQM

SEQ ID NO: 185595 - protein, 10 aa, Borrelia afzelii
WEGGKIVQMG

SEQ ID NO: 185596 - protein, 10 aa, Borrelia afzelii
EGGKIVQMGL

SEQ ID NO: 185597 - protein, 10 aa, Borrelia afzelii
GGKIVQMGLR

SEQ ID NO: 185598 - protein, 10 aa, Borrelia afzelii
GKIVQMGLRD

SEQ ID NO: 185599 - protein, 10 aa, Borrelia afzelii
KIVQMGLRDG

SEQ ID NO: 185600 - protein, 10 aa, Borrelia afzelii
IVQMGLRDGV

SEQ ID NO: 185601 - protein, 10 aa, Borrelia afzelii
VQMGLRDGVV

SEQ ID NO: 185602 - protein, 10 aa, Borrelia afzelii
QMGLRDGVVG

SEQ ID NO: 185603 - protein, 10 aa, Borrelia afzelii
MGLRDGVVGL

SEQ ID NO: 185604 - protein, 10 aa, Borrelia afzelii
GLRDGVVGLS

SEQ ID NO: 185605 - protein, 10 aa, Borrelia afzelii
LRDGVVGLSN

SEQ ID NO: 185606 - protein, 10 aa, Borrelia afzelii
RDGVVGLSNA

SEQ ID NO: 185607 - protein, 10 aa, Borrelia afzelii
DGVVGLSNAN

SEQ ID NO: 185608 - protein, 10 aa, Borrelia afzelii
GVVGLSNANE

SEQ ID NO: 185609 - protein, 10 aa, Borrelia afzelii
VVGLSNANEF

SEQ ID NO: 185610 - protein, 10 aa, Borrelia afzelii
VGLSNANEFE

SEQ ID NO: 185611 - protein, 10 aa, Borrelia afzelii
GLSNANEFEY

SEQ ID NO: 185612 - protein, 10 aa, Borrelia afzelii
LSNANEFEYI

SEQ ID NO: 185613 - protein, 10 aa, Borrelia afzelii
SNANEFEYIK

SEQ ID NO: 185614 - protein, 10 aa, Borrelia afzelii
NANEFEYIKD

SEQ ID NO: 185615 - protein, 10 aa, Borrelia afzelii
ANEFEYIKDL

SEQ ID NO: 185616 - protein, 10 aa, Borrelia afzelii
NEFEYIKDLE

SEQ ID NO: 185617 - protein, 10 aa, Borrelia afzelii
EFEYIKDLER

SEQ ID NO: 185618 - protein, 10 aa, Borrelia afzelii
FEYIKDLERK

SEQ ID NO: 185619 - protein, 10 aa, Borrelia afzelii
EYIKDLERKI

SEQ ID NO: 185620 - protein, 10 aa, Borrelia afzelii
YIKDLERKII

SEQ ID NO: 185621 - protein, 10 aa, Borrelia afzelii
IKDLERKIIN

SEQ ID NO: 185622 - protein, 10 aa, Borrelia afzelii
KDLERKIINK

SEQ ID NO: 185623 - protein, 10 aa, Borrelia afzelii
DLERKIINKE

SEQ ID NO: 185624 - protein, 10 aa, Borrelia afzelii
LERKIINKEI

SEQ ID NO: 185625 - protein, 10 aa, Borrelia afzelii
ERKIINKEII

SEQ ID NO: 185626 - protein, 10 aa, Borrelia afzelii
RKIINKEIIV

SEQ ID NO: 185627 - protein, 10 aa, Borrelia afzelii
KIINKEIIVP

SEQ ID NO: 185628 - protein, 10 aa, Borrelia afzelii
IINKEIIVPC

SEQ ID NO: 185629 - protein, 10 aa, Borrelia afzelii
INKEIIVPCN

SEQ ID NO: 185630 - protein, 10 aa, Borrelia afzelii
NKEIIVPCNQ

SEQ ID NO: 185631 - protein, 10 aa, Borrelia afzelii
KEIIVPCNQE

SEQ ID NO: 185632 - protein, 10 aa, Borrelia afzelii
EIIVPCNQEG

SEQ ID NO: 185633 - protein, 10 aa, Borrelia afzelii
IIVPCNQEGY

SEQ ID NO: 185634 - protein, 10 aa, Borrelia afzelii
IVPCNQEGYE

SEQ ID NO: 185635 - protein, 10 aa, Borrelia afzelii
VPCNQEGYEI

SEQ ID NO: 185636 - protein, 10 aa, Borrelia afzelii
PCNQEGYEIF

SEQ ID NO: 185637 - protein, 10 aa, Borrelia afzelii
CNQEGYEIFI

SEQ ID NO: 185638 - protein, 10 aa, Borrelia afzelii
NQEGYEIFIK

SEQ ID NO: 185639 - protein, 10 aa, Borrelia afzelii
QEGYEIFIKQ

SEQ ID NO: 185640 - protein, 10 aa, Borrelia afzelii
EGYEIFIKQI

SEQ ID NO: 185641 - protein, 10 aa, Borrelia afzelii
GYEIFIKQIL

SEQ ID NO: 185642 - protein, 10 aa, Borrelia afzelii
YEIFIKQILK

SEQ ID NO: 185643 - protein, 10 aa, Borrelia afzelii
EIFIKQILKL

SEQ ID NO: 185644 - protein, 11 aa, Borrelia afzelii
MRIAIFIFGIL

SEQ ID NO: 185645 - protein, 11 aa, Borrelia afzelii
RIAIFIFGILL

SEQ ID NO: 185646 - protein, 11 aa, Borrelia afzelii
IAIFIFGILLT

SEQ ID NO: 185647 - protein, 11 aa, Borrelia afzelii
AIFIFGILLTS

SEQ ID NO: 185648 - protein, 11 aa, Borrelia afzelii
IFIFGILLTSC

SEQ ID NO: 185649 - protein, 11 aa, Borrelia afzelii
FIFGILLTSCF

SEQ ID NO: 185650 - protein, 11 aa, Borrelia afzelii
IFGILLTSCFS

SEQ ID NO: 185651 - protein, 11 aa, Borrelia afzelii
FGILLTSCFSK

SEQ ID NO: 185652 - protein, 11 aa, Borrelia afzelii
GILLTSCFSKN

SEQ ID NO: 185653 - protein, 11 aa, Borrelia afzelii
ILLTSCFSKNG

SEQ ID NO: 185654 - protein, 11 aa, Borrelia afzelii
LLTSCFSKNGI

SEQ ID NO: 185655 - protein, 11 aa, Borrelia afzelii
LTSCFSKNGIE

SEQ ID NO: 185656 - protein, 11 aa, Borrelia afzelii
TSCFSKNGIES

SEQ ID NO: 185657 - protein, 11 aa, Borrelia afzelii
SCFSKNGIESG

SEQ ID NO: 185658 - protein, 11 aa, Borrelia afzelii
CFSKNGIESGS

SEQ ID NO: 185659 - protein, 11 aa, Borrelia afzelii
FSKNGIESGSS

SEQ ID NO: 185660 - protein, 11 aa, Borrelia afzelii
SKNGIESGSSK

SEQ ID NO: 185661 - protein, 11 aa, Borrelia afzelii
KNGIESGSSKI

SEQ ID NO: 185662 - protein, 11 aa, Borrelia afzelii
NGIESGSSKIK

SEQ ID NO: 185663 - protein, 11 aa, Borrelia afzelii
GIESGSSKIKI

SEQ ID NO: 185664 - protein, 11 aa, Borrelia afzelii
IESGSSKIKIS

SEQ ID NO: 185665 - protein, 11 aa, Borrelia afzelii
ESGSSKIKISM

SEQ ID NO: 185666 - protein, 11 aa, Borrelia afzelii
SGSSKIKISML

SEQ ID NO: 185667 - protein, 11 aa, Borrelia afzelii
GSSKIKISMLV

SEQ ID NO: 185668 - protein, 11 aa, Borrelia afzelii
SSKIKISMLVD

SEQ ID NO: 185669 - protein, 11 aa, Borrelia afzelii
SKIKISMLVDG

SEQ ID NO: 185670 - protein, 11 aa, Borrelia afzelii
KIKISMLVDGV

SEQ ID NO: 185671 - protein, 11 aa, Borrelia afzelii
IKISMLVDGVL

SEQ ID NO: 185672 - protein, 11 aa, Borrelia afzelii
KISMLVDGVLD

SEQ ID NO: 185673 - protein, 11 aa, Borrelia afzelii
ISMLVDGVLDD

SEQ ID NO: 185674 - protein, 11 aa, Borrelia afzelii
SMLVDGVLDDK

SEQ ID NO: 185675 - protein, 11 aa, Borrelia afzelii
MLVDGVLDDKS

SEQ ID NO: 185676 - protein, 11 aa, Borrelia afzelii
LVDGVLDDKSF

SEQ ID NO: 185677 - protein, 11 aa, Borrelia afzelii
VDGVLDDKSFN

SEQ ID NO: 185678 - protein, 11 aa, Borrelia afzelii
DGVLDDKSFNS

SEQ ID NO: 185679 - protein, 11 aa, Borrelia afzelii
GVLDDKSFNSS

SEQ ID NO: 185680 - protein, 11 aa, Borrelia afzelii
VLDDKSFNSSA

SEQ ID NO: 185681 - protein, 11 aa, Borrelia afzelii
LDDKSFNSSAN

SEQ ID NO: 185682 - protein, 11 aa, Borrelia afzelii
DDKSFNSSANE

SEQ ID NO: 185683 - protein, 11 aa, Borrelia afzelii
DKSFNSSANEA

SEQ ID NO: 185684 - protein, 11 aa, Borrelia afzelii
KSFNSSANEAL

SEQ ID NO: 185685 - protein, 11 aa, Borrelia afzelii
SFNSSANEALL

SEQ ID NO: 185686 - protein, 11 aa, Borrelia afzelii
FNSSANEALLR

SEQ ID NO: 185687 - protein, 11 aa, Borrelia afzelii
NSSANEALLRL

SEQ ID NO: 185688 - protein, 11 aa, Borrelia afzelii
SSANEALLRLK

SEQ ID NO: 185689 - protein, 11 aa, Borrelia afzelii
SANEALLRLKK

SEQ ID NO: 185690 - protein, 11 aa, Borrelia afzelii
ANEALLRLKKD

SEQ ID NO: 185691 - protein, 11 aa, Borrelia afzelii
NEALLRLKKDF

SEQ ID NO: 185692 - protein, 11 aa, Borrelia afzelii
EALLRLKKDFP

SEQ ID NO: 185693 - protein, 11 aa, Borrelia afzelii
ALLRLKKDFPE

SEQ ID NO: 185694 - protein, 11 aa, Borrelia afzelii
LLRLKKDFPEN

SEQ ID NO: 185695 - protein, 11 aa, Borrelia afzelii
LRLKKDFPENI

SEQ ID NO: 185696 - protein, 11 aa, Borrelia afzelii
RLKKDFPENIE

SEQ ID NO: 185697 - protein, 11 aa, Borrelia afzelii
LKKDFPENIEK

SEQ ID NO: 185698 - protein, 11 aa, Borrelia afzelii
KKDFPENIEKV

SEQ ID NO: 185699 - protein, 11 aa, Borrelia afzelii
KDFPENIEKVF

SEQ ID NO: 185700 - protein, 11 aa, Borrelia afzelii
DFPENIEKVFS

SEQ ID NO: 185701 - protein, 11 aa, Borrelia afzelii
FPENIEKVFSS

SEQ ID NO: 185702 - protein, 11 aa, Borrelia afzelii
PENIEKVFSSA

SEQ ID NO: 185703 - protein, 11 aa, Borrelia afzelii
ENIEKVFSSAV

SEQ ID NO: 185704 - protein, 11 aa, Borrelia afzelii
NIEKVFSSAVS

SEQ ID NO: 185705 - protein, 11 aa, Borrelia afzelii
IEKVFSSAVSG

SEQ ID NO: 185706 - protein, 11 aa, Borrelia afzelii
EKVFSSAVSGV

SEQ ID NO: 185707 - protein, 11 aa, Borrelia afzelii
KVFSSAVSGVY

SEQ ID NO: 185708 - protein, 11 aa, Borrelia afzelii
VFSSAVSGVYS

SEQ ID NO: 185709 - protein, 11 aa, Borrelia afzelii
FSSAVSGVYSS

SEQ ID NO: 185710 - protein, 11 aa, Borrelia afzelii
SSAVSGVYSSY

SEQ ID NO: 185711 - protein, 11 aa, Borrelia afzelii
SAVSGVYSSYV

SEQ ID NO: 185712 - protein, 11 aa, Borrelia afzelii
AVSGVYSSYVS

SEQ ID NO: 185713 - protein, 11 aa, Borrelia afzelii
VSGVYSSYVSD

SEQ ID NO: 185714 - protein, 11 aa, Borrelia afzelii
SGVYSSYVSDL

SEQ ID NO: 185715 - protein, 11 aa, Borrelia afzelii
GVYSSYVSDLD

SEQ ID NO: 185716 - protein, 11 aa, Borrelia afzelii
VYSSYVSDLDN

SEQ ID NO: 185717 - protein, 11 aa, Borrelia afzelii
YSSYVSDLDNL

SEQ ID NO: 185718 - protein, 11 aa, Borrelia afzelii
SSYVSDLDNLK

SEQ ID NO: 185719 - protein, 11 aa, Borrelia afzelii
SYVSDLDNLKM

SEQ ID NO: 185720 - protein, 11 aa, Borrelia afzelii
YVSDLDNLKMN

SEQ ID NO: 185721 - protein, 11 aa, Borrelia afzelii
VSDLDNLKMNG

SEQ ID NO: 185722 - protein, 11 aa, Borrelia afzelii
SDLDNLKMNGS

SEQ ID NO: 185723 - protein, 11 aa, Borrelia afzelii
DLDNLKMNGSG

SEQ ID NO: 185724 - protein, 11 aa, Borrelia afzelii
LDNLKMNGSGL

SEQ ID NO: 185725 - protein, 11 aa, Borrelia afzelii
DNLKMNGSGLI

SEQ ID NO: 185726 - protein, 11 aa, Borrelia afzelii
NLKMNGSGLIW

SEQ ID NO: 185727 - protein, 11 aa, Borrelia afzelii
LKMNGSGLIWL

SEQ ID NO: 185728 - protein, 11 aa, Borrelia afzelii
KMNGSGLIWLV

SEQ ID NO: 185729 - protein, 11 aa, Borrelia afzelii
MNGSGLIWLVG

SEQ ID NO: 185730 - protein, 11 aa, Borrelia afzelii
NGSGLIWLVGY

SEQ ID NO: 185731 - protein, 11 aa, Borrelia afzelii
GSGLIWLVGYM

SEQ ID NO: 185732 - protein, 11 aa, Borrelia afzelii
SGLIWLVGYML

SEQ ID NO: 185733 - protein, 11 aa, Borrelia afzelii
GLIWLVGYMLA

SEQ ID NO: 185734 - protein, 11 aa, Borrelia afzelii
LIWLVGYMLAD

SEQ ID NO: 185735 - protein, 11 aa, Borrelia afzelii
IWLVGYMLADV

SEQ ID NO: 185736 - protein, 11 aa, Borrelia afzelii
WLVGYMLADVS

SEQ ID NO: 185737 - protein, 11 aa, Borrelia afzelii
LVGYMLADVSL

SEQ ID NO: 185738 - protein, 11 aa, Borrelia afzelii
VGYMLADVSLS

SEQ ID NO: 185739 - protein, 11 aa, Borrelia afzelii
GYMLADVSLSV

SEQ ID NO: 185740 - protein, 11 aa, Borrelia afzelii
YMLADVSLSVS

SEQ ID NO: 185741 - protein, 11 aa, Borrelia afzelii
MLADVSLSVSL

SEQ ID NO: 185742 - protein, 11 aa, Borrelia afzelii
LADVSLSVSLE

SEQ ID NO: 185743 - protein, 11 aa, Borrelia afzelii
ADVSLSVSLEN

SEQ ID NO: 185744 - protein, 11 aa, Borrelia afzelii
DVSLSVSLENP

SEQ ID NO: 185745 - protein, 11 aa, Borrelia afzelii
VSLSVSLENPE

SEQ ID NO: 185746 - protein, 11 aa, Borrelia afzelii
SLSVSLENPEI

SEQ ID NO: 185747 - protein, 11 aa, Borrelia afzelii
LSVSLENPEIN

SEQ ID NO: 185748 - protein, 11 aa, Borrelia afzelii
SVSLENPEINY

SEQ ID NO: 185749 - protein, 11 aa, Borrelia afzelii
VSLENPEINYG

SEQ ID NO: 185750 - protein, 11 aa, Borrelia afzelii
SLENPEINYGI

SEQ ID NO: 185751 - protein, 11 aa, Borrelia afzelii
LENPEINYGII

SEQ ID NO: 185752 - protein, 11 aa, Borrelia afzelii
ENPEINYGIID

SEQ ID NO: 185753 - protein, 11 aa, Borrelia afzelii
NPEINYGIIDP

SEQ ID NO: 185754 - protein, 11 aa, Borrelia afzelii
PEINYGIIDPI

SEQ ID NO: 185755 - protein, 11 aa, Borrelia afzelii
EINYGIIDPIY

SEQ ID NO: 185756 - protein, 11 aa, Borrelia afzelii
INYGIIDPIYG

SEQ ID NO: 185757 - protein, 11 aa, Borrelia afzelii
NYGIIDPIYGD

SEQ ID NO: 185758 - protein, 11 aa, Borrelia afzelii
YGIIDPIYGDD

SEQ ID NO: 185759 - protein, 11 aa, Borrelia afzelii
GIIDPIYGDDV

SEQ ID NO: 185760 - protein, 11 aa, Borrelia afzelii
IIDPIYGDDVQ

SEQ ID NO: 185761 - protein, 11 aa, Borrelia afzelii
IDPIYGDDVQI

SEQ ID NO: 185762 - protein, 11 aa, Borrelia afzelii
DPIYGDDVQIP

SEQ ID NO: 185763 - protein, 11 aa, Borrelia afzelii
PIYGDDVQIPK

SEQ ID NO: 185764 - protein, 11 aa, Borrelia afzelii
IYGDDVQIPKN

SEQ ID NO: 185765 - protein, 11 aa, Borrelia afzelii
YGDDVQIPKNL

SEQ ID NO: 185766 - protein, 11 aa, Borrelia afzelii
GDDVQIPKNLI

SEQ ID NO: 185767 - protein, 11 aa, Borrelia afzelii
DDVQIPKNLIG

SEQ ID NO: 185768 - protein, 11 aa, Borrelia afzelii
DVQIPKNLIGV

SEQ ID NO: 185769 - protein, 11 aa, Borrelia afzelii
VQIPKNLIGVV

SEQ ID NO: 185770 - protein, 11 aa, Borrelia afzelii
QIPKNLIGVVF

SEQ ID NO: 185771 - protein, 11 aa, Borrelia afzelii
IPKNLIGVVFR

SEQ ID NO: 185772 - protein, 11 aa, Borrelia afzelii
PKNLIGVVFRI

SEQ ID NO: 185773 - protein, 11 aa, Borrelia afzelii
KNLIGVVFRIE

SEQ ID NO: 185774 - protein, 11 aa, Borrelia afzelii
NLIGVVFRIEQ

SEQ ID NO: 185775 - protein, 11 aa, Borrelia afzelii
LIGVVFRIEQG

SEQ ID NO: 185776 - protein, 11 aa, Borrelia afzelii
IGVVFRIEQGA

SEQ ID NO: 185777 - protein, 11 aa, Borrelia afzelii
GVVFRIEQGAF

SEQ ID NO: 185778 - protein, 11 aa, Borrelia afzelii
VVFRIEQGAFL

SEQ ID NO: 185779 - protein, 11 aa, Borrelia afzelii
VFRIEQGAFLA

SEQ ID NO: 185780 - protein, 11 aa, Borrelia afzelii
FRIEQGAFLAG

SEQ ID NO: 185781 - protein, 11 aa, Borrelia afzelii
RIEQGAFLAGY

SEQ ID NO: 185782 - protein, 11 aa, Borrelia afzelii
IEQGAFLAGYI

SEQ ID NO: 185783 - protein, 11 aa, Borrelia afzelii
EQGAFLAGYIA

SEQ ID NO: 185784 - protein, 11 aa, Borrelia afzelii
QGAFLAGYIAA

SEQ ID NO: 185785 - protein, 11 aa, Borrelia afzelii
GAFLAGYIAAK

SEQ ID NO: 185786 - protein, 11 aa, Borrelia afzelii
AFLAGYIAAKK

SEQ ID NO: 185787 - protein, 11 aa, Borrelia afzelii
FLAGYIAAKKS

SEQ ID NO: 185788 - protein, 11 aa, Borrelia afzelii
LAGYIAAKKSV

SEQ ID NO: 185789 - protein, 11 aa, Borrelia afzelii
AGYIAAKKSVS

SEQ ID NO: 185790 - protein, 11 aa, Borrelia afzelii
GYIAAKKSVSS

SEQ ID NO: 185791 - protein, 11 aa, Borrelia afzelii
YIAAKKSVSSK

SEQ ID NO: 185792 - protein, 11 aa, Borrelia afzelii
IAAKKSVSSKI

SEQ ID NO: 185793 - protein, 11 aa, Borrelia afzelii
AAKKSVSSKIG

SEQ ID NO: 185794 - protein, 11 aa, Borrelia afzelii
AKKSVSSKIGF

SEQ ID NO: 185795 - protein, 11 aa, Borrelia afzelii
KKSVSSKIGFI

SEQ ID NO: 185796 - protein, 11 aa, Borrelia afzelii
KSVSSKIGFIG

SEQ ID NO: 185797 - protein, 11 aa, Borrelia afzelii
SVSSKIGFIGG

SEQ ID NO: 185798 - protein, 11 aa, Borrelia afzelii
VSSKIGFIGGV

SEQ ID NO: 185799 - protein, 11 aa, Borrelia afzelii
SSKIGFIGGVK

SEQ ID NO: 185800 - protein, 11 aa, Borrelia afzelii
SKIGFIGGVKG

SEQ ID NO: 185801 - protein, 11 aa, Borrelia afzelii
KIGFIGGVKGD

SEQ ID NO: 185802 - protein, 11 aa, Borrelia afzelii
IGFIGGVKGDI

SEQ ID NO: 185803 - protein, 11 aa, Borrelia afzelii
GFIGGVKGDIV

SEQ ID NO: 185804 - protein, 11 aa, Borrelia afzelii
FIGGVKGDIVD

SEQ ID NO: 185805 - protein, 11 aa, Borrelia afzelii
IGGVKGDIVDA

SEQ ID NO: 185806 - protein, 11 aa, Borrelia afzelii
GGVKGDIVDAF

SEQ ID NO: 185807 - protein, 11 aa, Borrelia afzelii
GVKGDIVDAFR

SEQ ID NO: 185808 - protein, 11 aa, Borrelia afzelii
VKGDIVDAFRY

SEQ ID NO: 185809 - protein, 11 aa, Borrelia afzelii
KGDIVDAFRYG

SEQ ID NO: 185810 - protein, 11 aa, Borrelia afzelii
GDIVDAFRYGY

SEQ ID NO: 185811 - protein, 11 aa, Borrelia afzelii
DIVDAFRYGYE

SEQ ID NO: 185812 - protein, 11 aa, Borrelia afzelii
IVDAFRYGYEA

SEQ ID NO: 185813 - protein, 11 aa, Borrelia afzelii
VDAFRYGYEAG

SEQ ID NO: 185814 - protein, 11 aa, Borrelia afzelii
DAFRYGYEAGA

SEQ ID NO: 185815 - protein, 11 aa, Borrelia afzelii
AFRYGYEAGAK

SEQ ID NO: 185816 - protein, 11 aa, Borrelia afzelii
FRYGYEAGAKY

SEQ ID NO: 185817 - protein, 11 aa, Borrelia afzelii
RYGYEAGAKYA

SEQ ID NO: 185818 - protein, 11 aa, Borrelia afzelii
YGYEAGAKYAN

SEQ ID NO: 185819 - protein, 11 aa, Borrelia afzelii
GYEAGAKYANK

SEQ ID NO: 185820 - protein, 11 aa, Borrelia afzelii
YEAGAKYANKG

SEQ ID NO: 185821 - protein, 11 aa, Borrelia afzelii
EAGAKYANKGI

SEQ ID NO: 185822 - protein, 11 aa, Borrelia afzelii
AGAKYANKGIE

SEQ ID NO: 185823 - protein, 11 aa, Borrelia afzelii
GAKYANKGIEI

SEQ ID NO: 185824 - protein, 11 aa, Borrelia afzelii
AKYANKGIEIV

SEQ ID NO: 185825 - protein, 11 aa, Borrelia afzelii
KYANKGIEIVS

SEQ ID NO: 185826 - protein, 11 aa, Borrelia afzelii
YANKGIEIVSE

SEQ ID NO: 185827 - protein, 11 aa, Borrelia afzelii
ANKGIEIVSEY

SEQ ID NO: 185828 - protein, 11 aa, Borrelia afzelii
NKGIEIVSEYS

SEQ ID NO: 185829 - protein, 11 aa, Borrelia afzelii
KGIEIVSEYSN

SEQ ID NO: 185830 - protein, 11 aa, Borrelia afzelii
GIEIVSEYSNS

SEQ ID NO: 185831 - protein, 11 aa, Borrelia afzelii
IEIVSEYSNSF

SEQ ID NO: 185832 - protein, 11 aa, Borrelia afzelii
EIVSEYSNSFS

SEQ ID NO: 185833 - protein, 11 aa, Borrelia afzelii
IVSEYSNSFSD

SEQ ID NO: 185834 - protein, 11 aa, Borrelia afzelii
VSEYSNSFSDI

SEQ ID NO: 185835 - protein, 11 aa, Borrelia afzelii
SEYSNSFSDID

SEQ ID NO: 185836 - protein, 11 aa, Borrelia afzelii
EYSNSFSDIDI

SEQ ID NO: 185837 - protein, 11 aa, Borrelia afzelii
YSNSFSDIDIA

SEQ ID NO: 185838 - protein, 11 aa, Borrelia afzelii
SNSFSDIDIAR

SEQ ID NO: 185839 - protein, 11 aa, Borrelia afzelii
NSFSDIDIARV

SEQ ID NO: 185840 - protein, 11 aa, Borrelia afzelii
SFSDIDIARVM

SEQ ID NO: 185841 - protein, 11 aa, Borrelia afzelii
FSDIDIARVMA

SEQ ID NO: 185842 - protein, 11 aa, Borrelia afzelii
SDIDIARVMAN

SEQ ID NO: 185843 - protein, 11 aa, Borrelia afzelii
DIDIARVMANK

SEQ ID NO: 185844 - protein, 11 aa, Borrelia afzelii
IDIARVMANKM

SEQ ID NO: 185845 - protein, 11 aa, Borrelia afzelii
DIARVMANKMY

SEQ ID NO: 185846 - protein, 11 aa, Borrelia afzelii
IARVMANKMYS

SEQ ID NO: 185847 - protein, 11 aa, Borrelia afzelii
ARVMANKMYSK

SEQ ID NO: 185848 - protein, 11 aa, Borrelia afzelii
RVMANKMYSKG

SEQ ID NO: 185849 - protein, 11 aa, Borrelia afzelii
VMANKMYSKGI

SEQ ID NO: 185850 - protein, 11 aa, Borrelia afzelii
MANKMYSKGID

SEQ ID NO: 185851 - protein, 11 aa, Borrelia afzelii
ANKMYSKGIDI

SEQ ID NO: 185852 - protein, 11 aa, Borrelia afzelii
NKMYSKGIDII

SEQ ID NO: 185853 - protein, 11 aa, Borrelia afzelii
KMYSKGIDIIH

SEQ ID NO: 185854 - protein, 11 aa, Borrelia afzelii
MYSKGIDIIHF

SEQ ID NO: 185855 - protein, 11 aa, Borrelia afzelii
YSKGIDIIHFA

SEQ ID NO: 185856 - protein, 11 aa, Borrelia afzelii
SKGIDIIHFAA

SEQ ID NO: 185857 - protein, 11 aa, Borrelia afzelii
KGIDIIHFAAG

SEQ ID NO: 185858 - protein, 11 aa, Borrelia afzelii
GIDIIHFAAGL

SEQ ID NO: 185859 - protein, 11 aa, Borrelia afzelii
IDIIHFAAGLA

SEQ ID NO: 185860 - protein, 11 aa, Borrelia afzelii
DIIHFAAGLAG

SEQ ID NO: 185861 - protein, 11 aa, Borrelia afzelii
IIHFAAGLAGV

SEQ ID NO: 185862 - protein, 11 aa, Borrelia afzelii
IHFAAGLAGVG

SEQ ID NO: 185863 - protein, 11 aa, Borrelia afzelii
HFAAGLAGVGV

SEQ ID NO: 185864 - protein, 11 aa, Borrelia afzelii
FAAGLAGVGVI

SEQ ID NO: 185865 - protein, 11 aa, Borrelia afzelii
AAGLAGVGVIE

SEQ ID NO: 185866 - protein, 11 aa, Borrelia afzelii
AGLAGVGVIEA

SEQ ID NO: 185867 - protein, 11 aa, Borrelia afzelii
GLAGVGVIEAA

SEQ ID NO: 185868 - protein, 11 aa, Borrelia afzelii
LAGVGVIEAAK

SEQ ID NO: 185869 - protein, 11 aa, Borrelia afzelii
AGVGVIEAAKE

SEQ ID NO: 185870 - protein, 11 aa, Borrelia afzelii
GVGVIEAAKEL

SEQ ID NO: 185871 - protein, 11 aa, Borrelia afzelii
VGVIEAAKELG

SEQ ID NO: 185872 - protein, 11 aa, Borrelia afzelii
GVIEAAKELGD

SEQ ID NO: 185873 - protein, 11 aa, Borrelia afzelii
VIEAAKELGDG

SEQ ID NO: 185874 - protein, 11 aa, Borrelia afzelii
IEAAKELGDGY

SEQ ID NO: 185875 - protein, 11 aa, Borrelia afzelii
EAAKELGDGYY

SEQ ID NO: 185876 - protein, 11 aa, Borrelia afzelii
AAKELGDGYYV

SEQ ID NO: 185877 - protein, 11 aa, Borrelia afzelii
AKELGDGYYVI

SEQ ID NO: 185878 - protein, 11 aa, Borrelia afzelii
KELGDGYYVIG

SEQ ID NO: 185879 - protein, 11 aa, Borrelia afzelii
ELGDGYYVIGA

SEQ ID NO: 185880 - protein, 11 aa, Borrelia afzelii
LGDGYYVIGAD

SEQ ID NO: 185881 - protein, 11 aa, Borrelia afzelii
GDGYYVIGADQ

SEQ ID NO: 185882 - protein, 11 aa, Borrelia afzelii
DGYYVIGADQD

SEQ ID NO: 185883 - protein, 11 aa, Borrelia afzelii
GYYVIGADQDQ

SEQ ID NO: 185884 - protein, 11 aa, Borrelia afzelii
YYVIGADQDQS

SEQ ID NO: 185885 - protein, 11 aa, Borrelia afzelii
YVIGADQDQSH

SEQ ID NO: 185886 - protein, 11 aa, Borrelia afzelii
VIGADQDQSHL

SEQ ID NO: 185887 - protein, 11 aa, Borrelia afzelii
IGADQDQSHLA

SEQ ID NO: 185888 - protein, 11 aa, Borrelia afzelii
GADQDQSHLAP

SEQ ID NO: 185889 - protein, 11 aa, Borrelia afzelii
ADQDQSHLAPK

SEQ ID NO: 185890 - protein, 11 aa, Borrelia afzelii
DQDQSHLAPKN

SEQ ID NO: 185891 - protein, 11 aa, Borrelia afzelii
QDQSHLAPKNF

SEQ ID NO: 185892 - protein, 11 aa, Borrelia afzelii
DQSHLAPKNFI

SEQ ID NO: 185893 - protein, 11 aa, Borrelia afzelii
QSHLAPKNFIT

SEQ ID NO: 185894 - protein, 11 aa, Borrelia afzelii
SHLAPKNFITS

SEQ ID NO: 185895 - protein, 11 aa, Borrelia afzelii
HLAPKNFITSV

SEQ ID NO: 185896 - protein, 11 aa, Borrelia afzelii
LAPKNFITSVI

SEQ ID NO: 185897 - protein, 11 aa, Borrelia afzelii
APKNFITSVIK

SEQ ID NO: 185898 - protein, 11 aa, Borrelia afzelii
PKNFITSVIKN

SEQ ID NO: 185899 - protein, 11 aa, Borrelia afzelii
KNFITSVIKNV

SEQ ID NO: 185900 - protein, 11 aa, Borrelia afzelii
NFITSVIKNVG

SEQ ID NO: 185901 - protein, 11 aa, Borrelia afzelii
FITSVIKNVGD

SEQ ID NO: 185902 - protein, 11 aa, Borrelia afzelii
ITSVIKNVGDA

SEQ ID NO: 185903 - protein, 11 aa, Borrelia afzelii
TSVIKNVGDAL

SEQ ID NO: 185904 - protein, 11 aa, Borrelia afzelii
SVIKNVGDALY

SEQ ID NO: 185905 - protein, 11 aa, Borrelia afzelii
VIKNVGDALYL

SEQ ID NO: 185906 - protein, 11 aa, Borrelia afzelii
IKNVGDALYLI

SEQ ID NO: 185907 - protein, 11 aa, Borrelia afzelii
KNVGDALYLIT

SEQ ID NO: 185908 - protein, 11 aa, Borrelia afzelii
NVGDALYLITS

SEQ ID NO: 185909 - protein, 11 aa, Borrelia afzelii
VGDALYLITSE

SEQ ID NO: 185910 - protein, 11 aa, Borrelia afzelii
GDALYLITSES

SEQ ID NO: 185911 - protein, 11 aa, Borrelia afzelii
DALYLITSESL

SEQ ID NO: 185912 - protein, 11 aa, Borrelia afzelii
ALYLITSESLK

SEQ ID NO: 185913 - protein, 11 aa, Borrelia afzelii
LYLITSESLKN

SEQ ID NO: 185914 - protein, 11 aa, Borrelia afzelii
YLITSESLKND

SEQ ID NO: 185915 - protein, 11 aa, Borrelia afzelii
LITSESLKNDN

SEQ ID NO: 185916 - protein, 11 aa, Borrelia afzelii
ITSESLKNDNV

SEQ ID NO: 185917 - protein, 11 aa, Borrelia afzelii
TSESLKNDNVW

SEQ ID NO: 185918 - protein, 11 aa, Borrelia afzelii
SESLKNDNVWE

SEQ ID NO: 185919 - protein, 11 aa, Borrelia afzelii
ESLKNDNVWEG

SEQ ID NO: 185920 - protein, 11 aa, Borrelia afzelii
SLKNDNVWEGG

SEQ ID NO: 185921 - protein, 11 aa, Borrelia afzelii
LKNDNVWEGGK

SEQ ID NO: 185922 - protein, 11 aa, Borrelia afzelii
KNDNVWEGGKI

SEQ ID NO: 185923 - protein, 11 aa, Borrelia afzelii
NDNVWEGGKIV

SEQ ID NO: 185924 - protein, 11 aa, Borrelia afzelii
DNVWEGGKIVQ

SEQ ID NO: 185925 - protein, 11 aa, Borrelia afzelii
NVWEGGKIVQM

SEQ ID NO: 185926 - protein, 11 aa, Borrelia afzelii
VWEGGKIVQMG

SEQ ID NO: 185927 - protein, 11 aa, Borrelia afzelii
WEGGKIVQMGL

SEQ ID NO: 185928 - protein, 11 aa, Borrelia afzelii
EGGKIVQMGLR

SEQ ID NO: 185929 - protein, 11 aa, Borrelia afzelii
GGKIVQMGLRD

SEQ ID NO: 185930 - protein, 11 aa, Borrelia afzelii
GKIVQMGLRDG

SEQ ID NO: 185931 - protein, 11 aa, Borrelia afzelii
KIVQMGLRDGV

SEQ ID NO: 185932 - protein, 11 aa, Borrelia afzelii
IVQMGLRDGVV

SEQ ID NO: 185933 - protein, 11 aa, Borrelia afzelii
VQMGLRDGVVG

SEQ ID NO: 185934 - protein, 11 aa, Borrelia afzelii
QMGLRDGVVGL

SEQ ID NO: 185935 - protein, 11 aa, Borrelia afzelii
MGLRDGVVGLS

SEQ ID NO: 185936 - protein, 11 aa, Borrelia afzelii
GLRDGVVGLSN

SEQ ID NO: 185937 - protein, 11 aa, Borrelia afzelii
LRDGVVGLSNA

SEQ ID NO: 185938 - protein, 11 aa, Borrelia afzelii
RDGVVGLSNAN

SEQ ID NO: 185939 - protein, 11 aa, Borrelia afzelii
DGVVGLSNANE

SEQ ID NO: 185940 - protein, 11 aa, Borrelia afzelii
GVVGLSNANEF

SEQ ID NO: 185941 - protein, 11 aa, Borrelia afzelii
VVGLSNANEFE

SEQ ID NO: 185942 - protein, 11 aa, Borrelia afzelii
VGLSNANEFEY

SEQ ID NO: 185943 - protein, 11 aa, Borrelia afzelii
GLSNANEFEYI

SEQ ID NO: 185944 - protein, 11 aa, Borrelia afzelii
LSNANEFEYIK

SEQ ID NO: 185945 - protein, 11 aa, Borrelia afzelii
SNANEFEYIKD

SEQ ID NO: 185946 - protein, 11 aa, Borrelia afzelii
NANEFEYIKDL

SEQ ID NO: 185947 - protein, 11 aa, Borrelia afzelii
ANEFEYIKDLE

SEQ ID NO: 185948 - protein, 11 aa, Borrelia afzelii
NEFEYIKDLER

SEQ ID NO: 185949 - protein, 11 aa, Borrelia afzelii
EFEYIKDLERK

SEQ ID NO: 185950 - protein, 11 aa, Borrelia afzelii
FEYIKDLERKI

SEQ ID NO: 185951 - protein, 11 aa, Borrelia afzelii
EYIKDLERKII

SEQ ID NO: 185952 - protein, 11 aa, Borrelia afzelii
YIKDLERKIIN

SEQ ID NO: 185953 - protein, 11 aa, Borrelia afzelii
IKDLERKIINK

SEQ ID NO: 185954 - protein, 11 aa, Borrelia afzelii
KDLERKIINKE

SEQ ID NO: 185955 - protein, 11 aa, Borrelia afzelii
DLERKIINKEI

SEQ ID NO: 185956 - protein, 11 aa, Borrelia afzelii
LERKIINKEII

SEQ ID NO: 185957 - protein, 11 aa, Borrelia afzelii
ERKIINKEIIV

SEQ ID NO: 185958 - protein, 11 aa, Borrelia afzelii
RKIINKEIIVP

SEQ ID NO: 185959 - protein, 11 aa, Borrelia afzelii
KIINKEIIVPC

SEQ ID NO: 185960 - protein, 11 aa, Borrelia afzelii
IINKEIIVPCN

SEQ ID NO: 185961 - protein, 11 aa, Borrelia afzelii
INKEIIVPCNQ

SEQ ID NO: 185962 - protein, 11 aa, Borrelia afzelii
NKEIIVPCNQE

SEQ ID NO: 185963 - protein, 11 aa, Borrelia afzelii
KEIIVPCNQEG

SEQ ID NO: 185964 - protein, 11 aa, Borrelia afzelii
EIIVPCNQEGY

SEQ ID NO: 185965 - protein, 11 aa, Borrelia afzelii
IIVPCNQEGYE

SEQ ID NO: 185966 - protein, 11 aa, Borrelia afzelii
IVPCNQEGYEI

SEQ ID NO: 185967 - protein, 11 aa, Borrelia afzelii
VPCNQEGYEIF

SEQ ID NO: 185968 - protein, 11 aa, Borrelia afzelii
PCNQEGYEIFI

SEQ ID NO: 185969 - protein, 11 aa, Borrelia afzelii
CNQEGYEIFIK

SEQ ID NO: 185970 - protein, 11 aa, Borrelia afzelii
NQEGYEIFIKQ

SEQ ID NO: 185971 - protein, 11 aa, Borrelia afzelii
QEGYEIFIKQI

SEQ ID NO: 185972 - protein, 11 aa, Borrelia afzelii
EGYEIFIKQIL

SEQ ID NO: 185973 - protein, 11 aa, Borrelia afzelii
GYEIFIKQILK

SEQ ID NO: 185974 - protein, 11 aa, Borrelia afzelii
YEIFIKQILKL

SEQ ID NO: 185975 - protein, 13 aa, Borrelia afzelii
MRIAIFIFGILLT

SEQ ID NO: 185976 - protein, 13 aa, Borrelia afzelii
RIAIFIFGILLTS

SEQ ID NO: 185977 - protein, 13 aa, Borrelia afzelii
IAIFIFGILLTSC

SEQ ID NO: 185978 - protein, 13 aa, Borrelia afzelii
AIFIFGILLTSCF

SEQ ID NO: 185979 - protein, 13 aa, Borrelia afzelii
IFIFGILLTSCFS

SEQ ID NO: 185980 - protein, 13 aa, Borrelia afzelii
FIFGILLTSCFSK

SEQ ID NO: 185981 - protein, 13 aa, Borrelia afzelii
IFGILLTSCFSKN

SEQ ID NO: 185982 - protein, 13 aa, Borrelia afzelii
FGILLTSCFSKNG

SEQ ID NO: 185983 - protein, 13 aa, Borrelia afzelii
GILLTSCFSKNGI

SEQ ID NO: 185984 - protein, 13 aa, Borrelia afzelii
ILLTSCFSKNGIE

SEQ ID NO: 185985 - protein, 13 aa, Borrelia afzelii
LLTSCFSKNGIES

SEQ ID NO: 185986 - protein, 13 aa, Borrelia afzelii
LTSCFSKNGIESG

SEQ ID NO: 185987 - protein, 13 aa, Borrelia afzelii
TSCFSKNGIESGS

SEQ ID NO: 185988 - protein, 13 aa, Borrelia afzelii
SCFSKNGIESGSS

SEQ ID NO: 185989 - protein, 13 aa, Borrelia afzelii
CFSKNGIESGSSK

SEQ ID NO: 185990 - protein, 13 aa, Borrelia afzelii
FSKNGIESGSSKI

SEQ ID NO: 185991 - protein, 13 aa, Borrelia afzelii
SKNGIESGSSKIK

SEQ ID NO: 185992 - protein, 13 aa, Borrelia afzelii
KNGIESGSSKIKI

SEQ ID NO: 185993 - protein, 13 aa, Borrelia afzelii
NGIESGSSKIKIS

SEQ ID NO: 185994 - protein, 13 aa, Borrelia afzelii
GIESGSSKIKISM

SEQ ID NO: 185995 - protein, 13 aa, Borrelia afzelii
IESGSSKIKISML

SEQ ID NO: 185996 - protein, 13 aa, Borrelia afzelii
ESGSSKIKISMLV

SEQ ID NO: 185997 - protein, 13 aa, Borrelia afzelii
SGSSKIKISMLVD

SEQ ID NO: 185998 - protein, 13 aa, Borrelia afzelii
GSSKIKISMLVDG

SEQ ID NO: 185999 - protein, 13 aa, Borrelia afzelii
SSKIKISMLVDGV

SEQ ID NO: 186000 - protein, 13 aa, Borrelia afzelii
SKIKISMLVDGVL

SEQ ID NO: 186001 - protein, 13 aa, Borrelia afzelii
KIKISMLVDGVLD

SEQ ID NO: 186002 - protein, 13 aa, Borrelia afzelii
IKISMLVDGVLDD

SEQ ID NO: 186003 - protein, 13 aa, Borrelia afzelii
KISMLVDGVLDDK

SEQ ID NO: 186004 - protein, 13 aa, Borrelia afzelii
ISMLVDGVLDDKS

SEQ ID NO: 186005 - protein, 13 aa, Borrelia afzelii
SMLVDGVLDDKSF

SEQ ID NO: 186006 - protein, 13 aa, Borrelia afzelii
MLVDGVLDDKSFN

SEQ ID NO: 186007 - protein, 13 aa, Borrelia afzelii
LVDGVLDDKSFNS

SEQ ID NO: 186008 - protein, 13 aa, Borrelia afzelii
VDGVLDDKSFNSS

SEQ ID NO: 186009 - protein, 13 aa, Borrelia afzelii
DGVLDDKSFNSSA

SEQ ID NO: 186010 - protein, 13 aa, Borrelia afzelii
GVLDDKSFNSSAN

SEQ ID NO: 186011 - protein, 13 aa, Borrelia afzelii
VLDDKSFNSSANE

SEQ ID NO: 186012 - protein, 13 aa, Borrelia afzelii
LDDKSFNSSANEA

SEQ ID NO: 186013 - protein, 13 aa, Borrelia afzelii
DDKSFNSSANEAL

SEQ ID NO: 186014 - protein, 13 aa, Borrelia afzelii
DKSFNSSANEALL

SEQ ID NO: 186015 - protein, 13 aa, Borrelia afzelii
KSFNSSANEALLR

SEQ ID NO: 186016 - protein, 13 aa, Borrelia afzelii
SFNSSANEALLRL

SEQ ID NO: 186017 - protein, 13 aa, Borrelia afzelii
FNSSANEALLRLK

SEQ ID NO: 186018 - protein, 13 aa, Borrelia afzelii
NSSANEALLRLKK

SEQ ID NO: 186019 - protein, 13 aa, Borrelia afzelii
SSANEALLRLKKD

SEQ ID NO: 186020 - protein, 13 aa, Borrelia afzelii
SANEALLRLKKDF

SEQ ID NO: 186021 - protein, 13 aa, Borrelia afzelii
ANEALLRLKKDFP

SEQ ID NO: 186022 - protein, 13 aa, Borrelia afzelii
NEALLRLKKDFPE

SEQ ID NO: 186023 - protein, 13 aa, Borrelia afzelii
EALLRLKKDFPEN

SEQ ID NO: 186024 - protein, 13 aa, Borrelia afzelii
ALLRLKKDFPENI

SEQ ID NO: 186025 - protein, 13 aa, Borrelia afzelii
LLRLKKDFPENIE

SEQ ID NO: 186026 - protein, 13 aa, Borrelia afzelii
LRLKKDFPENIEK

SEQ ID NO: 186027 - protein, 13 aa, Borrelia afzelii
RLKKDFPENIEKV

SEQ ID NO: 186028 - protein, 13 aa, Borrelia afzelii
LKKDFPENIEKVF

SEQ ID NO: 186029 - protein, 13 aa, Borrelia afzelii
KKDFPENIEKVFS

SEQ ID NO: 186030 - protein, 13 aa, Borrelia afzelii
KDFPENIEKVFSS

SEQ ID NO: 186031 - protein, 13 aa, Borrelia afzelii
DFPENIEKVFSSA

SEQ ID NO: 186032 - protein, 13 aa, Borrelia afzelii
FPENIEKVFSSAV

SEQ ID NO: 186033 - protein, 13 aa, Borrelia afzelii
PENIEKVFSSAVS

SEQ ID NO: 186034 - protein, 13 aa, Borrelia afzelii
ENIEKVFSSAVSG

SEQ ID NO: 186035 - protein, 13 aa, Borrelia afzelii
NIEKVFSSAVSGV

SEQ ID NO: 186036 - protein, 13 aa, Borrelia afzelii
IEKVFSSAVSGVY

SEQ ID NO: 186037 - protein, 13 aa, Borrelia afzelii
EKVFSSAVSGVYS

SEQ ID NO: 186038 - protein, 13 aa, Borrelia afzelii
KVFSSAVSGVYSS

SEQ ID NO: 186039 - protein, 13 aa, Borrelia afzelii
VFSSAVSGVYSSY

SEQ ID NO: 186040 - protein, 13 aa, Borrelia afzelii
FSSAVSGVYSSYV

SEQ ID NO: 186041 - protein, 13 aa, Borrelia afzelii
SSAVSGVYSSYVS

SEQ ID NO: 186042 - protein, 13 aa, Borrelia afzelii
SAVSGVYSSYVSD

SEQ ID NO: 186043 - protein, 13 aa, Borrelia afzelii
AVSGVYSSYVSDL

SEQ ID NO: 186044 - protein, 13 aa, Borrelia afzelii
VSGVYSSYVSDLD

SEQ ID NO: 186045 - protein, 13 aa, Borrelia afzelii
SGVYSSYVSDLDN

SEQ ID NO: 186046 - protein, 13 aa, Borrelia afzelii
GVYSSYVSDLDNL

SEQ ID NO: 186047 - protein, 13 aa, Borrelia afzelii
VYSSYVSDLDNLK

SEQ ID NO: 186048 - protein, 13 aa, Borrelia afzelii
YSSYVSDLDNLKM

SEQ ID NO: 186049 - protein, 13 aa, Borrelia afzelii
SSYVSDLDNLKMN

SEQ ID NO: 186050 - protein, 13 aa, Borrelia afzelii
SYVSDLDNLKMNG

SEQ ID NO: 186051 - protein, 13 aa, Borrelia afzelii
YVSDLDNLKMNGS

SEQ ID NO: 186052 - protein, 13 aa, Borrelia afzelii
VSDLDNLKMNGSG

SEQ ID NO: 186053 - protein, 13 aa, Borrelia afzelii
SDLDNLKMNGSGL

SEQ ID NO: 186054 - protein, 13 aa, Borrelia afzelii
DLDNLKMNGSGLI

SEQ ID NO: 186055 - protein, 13 aa, Borrelia afzelii
LDNLKMNGSGLIW

SEQ ID NO: 186056 - protein, 13 aa, Borrelia afzelii
DNLKMNGSGLIWL

SEQ ID NO: 186057 - protein, 13 aa, Borrelia afzelii
NLKMNGSGLIWLV

SEQ ID NO: 186058 - protein, 13 aa, Borrelia afzelii
LKMNGSGLIWLVG

SEQ ID NO: 186059 - protein, 13 aa, Borrelia afzelii
KMNGSGLIWLVGY

SEQ ID NO: 186060 - protein, 13 aa, Borrelia afzelii
MNGSGLIWLVGYM

SEQ ID NO: 186061 - protein, 13 aa, Borrelia afzelii
NGSGLIWLVGYML

SEQ ID NO: 186062 - protein, 13 aa, Borrelia afzelii
GSGLIWLVGYMLA

SEQ ID NO: 186063 - protein, 13 aa, Borrelia afzelii
SGLIWLVGYMLAD

SEQ ID NO: 186064 - protein, 13 aa, Borrelia afzelii
GLIWLVGYMLADV

SEQ ID NO: 186065 - protein, 13 aa, Borrelia afzelii
LIWLVGYMLADVS

SEQ ID NO: 186066 - protein, 13 aa, Borrelia afzelii
IWLVGYMLADVSL

SEQ ID NO: 186067 - protein, 13 aa, Borrelia afzelii
WLVGYMLADVSLS

SEQ ID NO: 186068 - protein, 13 aa, Borrelia afzelii
LVGYMLADVSLSV

SEQ ID NO: 186069 - protein, 13 aa, Borrelia afzelii
VGYMLADVSLSVS

SEQ ID NO: 186070 - protein, 13 aa, Borrelia afzelii
GYMLADVSLSVSL

SEQ ID NO: 186071 - protein, 13 aa, Borrelia afzelii
YMLADVSLSVSLE

SEQ ID NO: 186072 - protein, 13 aa, Borrelia afzelii
MLADVSLSVSLEN

SEQ ID NO: 186073 - protein, 13 aa, Borrelia afzelii
LADVSLSVSLENP

SEQ ID NO: 186074 - protein, 13 aa, Borrelia afzelii
ADVSLSVSLENPE

SEQ ID NO: 186075 - protein, 13 aa, Borrelia afzelii
DVSLSVSLENPEI

SEQ ID NO: 186076 - protein, 13 aa, Borrelia afzelii
VSLSVSLENPEIN

SEQ ID NO: 186077 - protein, 13 aa, Borrelia afzelii
SLSVSLENPEINY

SEQ ID NO: 186078 - protein, 13 aa, Borrelia afzelii
LSVSLENPEINYG

SEQ ID NO: 186079 - protein, 13 aa, Borrelia afzelii
SVSLENPEINYGI

SEQ ID NO: 186080 - protein, 13 aa, Borrelia afzelii
VSLENPEINYGII

SEQ ID NO: 186081 - protein, 13 aa, Borrelia afzelii
SLENPEINYGIID

SEQ ID NO: 186082 - protein, 13 aa, Borrelia afzelii
LENPEINYGIIDP

SEQ ID NO: 186083 - protein, 13 aa, Borrelia afzelii
ENPEINYGIIDPI

SEQ ID NO: 186084 - protein, 13 aa, Borrelia afzelii
NPEINYGIIDPIY

SEQ ID NO: 186085 - protein, 13 aa, Borrelia afzelii
PEINYGIIDPIYG

SEQ ID NO: 186086 - protein, 13 aa, Borrelia afzelii
EINYGIIDPIYGD

SEQ ID NO: 186087 - protein, 13 aa, Borrelia afzelii
INYGIIDPIYGDD

SEQ ID NO: 186088 - protein, 13 aa, Borrelia afzelii
NYGIIDPIYGDDV

SEQ ID NO: 186089 - protein, 13 aa, Borrelia afzelii
YGIIDPIYGDDVQ

SEQ ID NO: 186090 - protein, 13 aa, Borrelia afzelii
GIIDPIYGDDVQI

SEQ ID NO: 186091 - protein, 13 aa, Borrelia afzelii
IIDPIYGDDVQIP

SEQ ID NO: 186092 - protein, 13 aa, Borrelia afzelii
IDPIYGDDVQIPK

SEQ ID NO: 186093 - protein, 13 aa, Borrelia afzelii
DPIYGDDVQIPKN

SEQ ID NO: 186094 - protein, 13 aa, Borrelia afzelii
PIYGDDVQIPKNL

SEQ ID NO: 186095 - protein, 13 aa, Borrelia afzelii
IYGDDVQIPKNLI

SEQ ID NO: 186096 - protein, 13 aa, Borrelia afzelii
YGDDVQIPKNLIG

SEQ ID NO: 186097 - protein, 13 aa, Borrelia afzelii
GDDVQIPKNLIGV

SEQ ID NO: 186098 - protein, 13 aa, Borrelia afzelii
DDVQIPKNLIGVV

SEQ ID NO: 186099 - protein, 13 aa, Borrelia afzelii
DVQIPKNLIGVVF

SEQ ID NO: 186100 - protein, 13 aa, Borrelia afzelii
VQIPKNLIGVVFR

SEQ ID NO: 186101 - protein, 13 aa, Borrelia afzelii
QIPKNLIGVVFRI

SEQ ID NO: 186102 - protein, 13 aa, Borrelia afzelii
IPKNLIGVVFRIE

SEQ ID NO: 186103 - protein, 13 aa, Borrelia afzelii
PKNLIGVVFRIEQ

SEQ ID NO: 186104 - protein, 13 aa, Borrelia afzelii
KNLIGVVFRIEQG

SEQ ID NO: 186105 - protein, 13 aa, Borrelia afzelii
NLIGVVFRIEQGA

SEQ ID NO: 186106 - protein, 13 aa, Borrelia afzelii
LIGVVFRIEQGAF

SEQ ID NO: 186107 - protein, 13 aa, Borrelia afzelii
IGVVFRIEQGAFL

SEQ ID NO: 186108 - protein, 13 aa, Borrelia afzelii
GVVFRIEQGAFLA

SEQ ID NO: 186109 - protein, 13 aa, Borrelia afzelii
VVFRIEQGAFLAG

SEQ ID NO: 186110 - protein, 13 aa, Borrelia afzelii
VFRIEQGAFLAGY

SEQ ID NO: 186111 - protein, 13 aa, Borrelia afzelii
FRIEQGAFLAGYI

SEQ ID NO: 186112 - protein, 13 aa, Borrelia afzelii
RIEQGAFLAGYIA

SEQ ID NO: 186113 - protein, 13 aa, Borrelia afzelii
IEQGAFLAGYIAA

SEQ ID NO: 186114 - protein, 13 aa, Borrelia afzelii
EQGAFLAGYIAAK

SEQ ID NO: 186115 - protein, 13 aa, Borrelia afzelii
QGAFLAGYIAAKK

SEQ ID NO: 186116 - protein, 13 aa, Borrelia afzelii
GAFLAGYIAAKKS

SEQ ID NO: 186117 - protein, 13 aa, Borrelia afzelii
AFLAGYIAAKKSV

SEQ ID NO: 186118 - protein, 13 aa, Borrelia afzelii
FLAGYIAAKKSVS

SEQ ID NO: 186119 - protein, 13 aa, Borrelia afzelii
LAGYIAAKKSVSS

SEQ ID NO: 186120 - protein, 13 aa, Borrelia afzelii
AGYIAAKKSVSSK

SEQ ID NO: 186121 - protein, 13 aa, Borrelia afzelii
GYIAAKKSVSSKI

SEQ ID NO: 186122 - protein, 13 aa, Borrelia afzelii
YIAAKKSVSSKIG

SEQ ID NO: 186123 - protein, 13 aa, Borrelia afzelii
IAAKKSVSSKIGF

SEQ ID NO: 186124 - protein, 13 aa, Borrelia afzelii
AAKKSVSSKIGFI

SEQ ID NO: 186125 - protein, 13 aa, Borrelia afzelii
AKKSVSSKIGFIG

SEQ ID NO: 186126 - protein, 13 aa, Borrelia afzelii
KKSVSSKIGFIGG

SEQ ID NO: 186127 - protein, 13 aa, Borrelia afzelii
KSVSSKIGFIGGV

SEQ ID NO: 186128 - protein, 13 aa, Borrelia afzelii
SVSSKIGFIGGVK

SEQ ID NO: 186129 - protein, 13 aa, Borrelia afzelii
VSSKIGFIGGVKG

SEQ ID NO: 186130 - protein, 13 aa, Borrelia afzelii
SSKIGFIGGVKGD

SEQ ID NO: 186131 - protein, 13 aa, Borrelia afzelii
SKIGFIGGVKGDI

SEQ ID NO: 186132 - protein, 13 aa, Borrelia afzelii
KIGFIGGVKGDIV

SEQ ID NO: 186133 - protein, 13 aa, Borrelia afzelii
IGFIGGVKGDIVD

SEQ ID NO: 186134 - protein, 13 aa, Borrelia afzelii
GFIGGVKGDIVDA

SEQ ID NO: 186135 - protein, 13 aa, Borrelia afzelii
FIGGVKGDIVDAF

SEQ ID NO: 186136 - protein, 13 aa, Borrelia afzelii
IGGVKGDIVDAFR

SEQ ID NO: 186137 - protein, 13 aa, Borrelia afzelii
GGVKGDIVDAFRY

SEQ ID NO: 186138 - protein, 13 aa, Borrelia afzelii
GVKGDIVDAFRYG

SEQ ID NO: 186139 - protein, 13 aa, Borrelia afzelii
VKGDIVDAFRYGY

SEQ ID NO: 186140 - protein, 13 aa, Borrelia afzelii
KGDIVDAFRYGYE

SEQ ID NO: 186141 - protein, 13 aa, Borrelia afzelii
GDIVDAFRYGYEA

SEQ ID NO: 186142 - protein, 13 aa, Borrelia afzelii
DIVDAFRYGYEAG

SEQ ID NO: 186143 - protein, 13 aa, Borrelia afzelii
IVDAFRYGYEAGA

SEQ ID NO: 186144 - protein, 13 aa, Borrelia afzelii
VDAFRYGYEAGAK

SEQ ID NO: 186145 - protein, 13 aa, Borrelia afzelii
DAFRYGYEAGAKY

SEQ ID NO: 186146 - protein, 13 aa, Borrelia afzelii
AFRYGYEAGAKYA

SEQ ID NO: 186147 - protein, 13 aa, Borrelia afzelii
FRYGYEAGAKYAN

SEQ ID NO: 186148 - protein, 13 aa, Borrelia afzelii
RYGYEAGAKYANK

SEQ ID NO: 186149 - protein, 13 aa, Borrelia afzelii
YGYEAGAKYANKG

SEQ ID NO: 186150 - protein, 13 aa, Borrelia afzelii
GYEAGAKYANKGI

SEQ ID NO: 186151 - protein, 13 aa, Borrelia afzelii
YEAGAKYANKGIE

SEQ ID NO: 186152 - protein, 13 aa, Borrelia afzelii
EAGAKYANKGIEI

SEQ ID NO: 186153 - protein, 13 aa, Borrelia afzelii
AGAKYANKGIEIV

SEQ ID NO: 186154 - protein, 13 aa, Borrelia afzelii
GAKYANKGIEIVS

SEQ ID NO: 186155 - protein, 13 aa, Borrelia afzelii
AKYANKGIEIVSE

SEQ ID NO: 186156 - protein, 13 aa, Borrelia afzelii
KYANKGIEIVSEY

SEQ ID NO: 186157 - protein, 13 aa, Borrelia afzelii
YANKGIEIVSEYS

SEQ ID NO: 186158 - protein, 13 aa, Borrelia afzelii
ANKGIEIVSEYSN

SEQ ID NO: 186159 - protein, 13 aa, Borrelia afzelii
NKGIEIVSEYSNS

SEQ ID NO: 186160 - protein, 13 aa, Borrelia afzelii
KGIEIVSEYSNSF

SEQ ID NO: 186161 - protein, 13 aa, Borrelia afzelii
GIEIVSEYSNSFS

SEQ ID NO: 186162 - protein, 13 aa, Borrelia afzelii
IEIVSEYSNSFSD

SEQ ID NO: 186163 - protein, 13 aa, Borrelia afzelii
EIVSEYSNSFSDI

SEQ ID NO: 186164 - protein, 13 aa, Borrelia afzelii
IVSEYSNSFSDID

SEQ ID NO: 186165 - protein, 13 aa, Borrelia afzelii
VSEYSNSFSDIDI

SEQ ID NO: 186166 - protein, 13 aa, Borrelia afzelii
SEYSNSFSDIDIA

SEQ ID NO: 186167 - protein, 13 aa, Borrelia afzelii
EYSNSFSDIDIAR

SEQ ID NO: 186168 - protein, 13 aa, Borrelia afzelii
YSNSFSDIDIARV

SEQ ID NO: 186169 - protein, 13 aa, Borrelia afzelii
SNSFSDIDIARVM

SEQ ID NO: 186170 - protein, 13 aa, Borrelia afzelii
NSFSDIDIARVMA

SEQ ID NO: 186171 - protein, 13 aa, Borrelia afzelii
SFSDIDIARVMAN

SEQ ID NO: 186172 - protein, 13 aa, Borrelia afzelii
FSDIDIARVMANK

SEQ ID NO: 186173 - protein, 13 aa, Borrelia afzelii
SDIDIARVMANKM

SEQ ID NO: 186174 - protein, 13 aa, Borrelia afzelii
DIDIARVMANKMY

SEQ ID NO: 186175 - protein, 13 aa, Borrelia afzelii
IDIARVMANKMYS

SEQ ID NO: 186176 - protein, 13 aa, Borrelia afzelii
DIARVMANKMYSK

SEQ ID NO: 186177 - protein, 13 aa, Borrelia afzelii
IARVMANKMYSKG

SEQ ID NO: 186178 - protein, 13 aa, Borrelia afzelii
ARVMANKMYSKGI

SEQ ID NO: 186179 - protein, 13 aa, Borrelia afzelii
RVMANKMYSKGID

SEQ ID NO: 186180 - protein, 13 aa, Borrelia afzelii
VMANKMYSKGIDI

SEQ ID NO: 186181 - protein, 13 aa, Borrelia afzelii
MANKMYSKGIDII

SEQ ID NO: 186182 - protein, 13 aa, Borrelia afzelii
ANKMYSKGIDIIH

SEQ ID NO: 186183 - protein, 13 aa, Borrelia afzelii
NKMYSKGIDIIHF

SEQ ID NO: 186184 - protein, 13 aa, Borrelia afzelii
KMYSKGIDIIHFA

SEQ ID NO: 186185 - protein, 13 aa, Borrelia afzelii
MYSKGIDIIHFAA

SEQ ID NO: 186186 - protein, 13 aa, Borrelia afzelii
YSKGIDIIHFAAG

SEQ ID NO: 186187 - protein, 13 aa, Borrelia afzelii
SKGIDIIHFAAGL

SEQ ID NO: 186188 - protein, 13 aa, Borrelia afzelii
KGIDIIHFAAGLA

SEQ ID NO: 186189 - protein, 13 aa, Borrelia afzelii
GIDIIHFAAGLAG

SEQ ID NO: 186190 - protein, 13 aa, Borrelia afzelii
IDIIHFAAGLAGV

SEQ ID NO: 186191 - protein, 13 aa, Borrelia afzelii
DIIHFAAGLAGVG

SEQ ID NO: 186192 - protein, 13 aa, Borrelia afzelii
IIHFAAGLAGVGV

SEQ ID NO: 186193 - protein, 13 aa, Borrelia afzelii
IHFAAGLAGVGVI

SEQ ID NO: 186194 - protein, 13 aa, Borrelia afzelii
HFAAGLAGVGVIE

SEQ ID NO: 186195 - protein, 13 aa, Borrelia afzelii
FAAGLAGVGVIEA

SEQ ID NO: 186196 - protein, 13 aa, Borrelia afzelii
AAGLAGVGVIEAA

SEQ ID NO: 186197 - protein, 13 aa, Borrelia afzelii
AGLAGVGVIEAAK

SEQ ID NO: 186198 - protein, 13 aa, Borrelia afzelii
GLAGVGVIEAAKE

SEQ ID NO: 186199 - protein, 13 aa, Borrelia afzelii
LAGVGVIEAAKEL

SEQ ID NO: 186200 - protein, 13 aa, Borrelia afzelii
AGVGVIEAAKELG

SEQ ID NO: 186201 - protein, 13 aa, Borrelia afzelii
GVGVIEAAKELGD

SEQ ID NO: 186202 - protein, 13 aa, Borrelia afzelii
VGVIEAAKELGDG

SEQ ID NO: 186203 - protein, 13 aa, Borrelia afzelii
GVIEAAKELGDGY

SEQ ID NO: 186204 - protein, 13 aa, Borrelia afzelii
VIEAAKELGDGYY

SEQ ID NO: 186205 - protein, 13 aa, Borrelia afzelii
IEAAKELGDGYYV

SEQ ID NO: 186206 - protein, 13 aa, Borrelia afzelii
EAAKELGDGYYVI

SEQ ID NO: 186207 - protein, 13 aa, Borrelia afzelii
AAKELGDGYYVIG

SEQ ID NO: 186208 - protein, 13 aa, Borrelia afzelii
AKELGDGYYVIGA

SEQ ID NO: 186209 - protein, 13 aa, Borrelia afzelii
KELGDGYYVIGAD

SEQ ID NO: 186210 - protein, 13 aa, Borrelia afzelii
ELGDGYYVIGADQ

SEQ ID NO: 186211 - protein, 13 aa, Borrelia afzelii
LGDGYYVIGADQD

SEQ ID NO: 186212 - protein, 13 aa, Borrelia afzelii
GDGYYVIGADQDQ

SEQ ID NO: 186213 - protein, 13 aa, Borrelia afzelii
DGYYVIGADQDQS

SEQ ID NO: 186214 - protein, 13 aa, Borrelia afzelii
GYYVIGADQDQSH

SEQ ID NO: 186215 - protein, 13 aa, Borrelia afzelii
YYVIGADQDQSHL

SEQ ID NO: 186216 - protein, 13 aa, Borrelia afzelii
YVIGADQDQSHLA

SEQ ID NO: 186217 - protein, 13 aa, Borrelia afzelii
VIGADQDQSHLAP

SEQ ID NO: 186218 - protein, 13 aa, Borrelia afzelii
IGADQDQSHLAPK

SEQ ID NO: 186219 - protein, 13 aa, Borrelia afzelii
GADQDQSHLAPKN

SEQ ID NO: 186220 - protein, 13 aa, Borrelia afzelii
ADQDQSHLAPKNF

SEQ ID NO: 186221 - protein, 13 aa, Borrelia afzelii
DQDQSHLAPKNFI

SEQ ID NO: 186222 - protein, 13 aa, Borrelia afzelii
QDQSHLAPKNFIT

SEQ ID NO: 186223 - protein, 13 aa, Borrelia afzelii
DQSHLAPKNFITS

SEQ ID NO: 186224 - protein, 13 aa, Borrelia afzelii
QSHLAPKNFITSV

SEQ ID NO: 186225 - protein, 13 aa, Borrelia afzelii
SHLAPKNFITSVI

SEQ ID NO: 186226 - protein, 13 aa, Borrelia afzelii
HLAPKNFITSVIK

SEQ ID NO: 186227 - protein, 13 aa, Borrelia afzelii
LAPKNFITSVIKN

SEQ ID NO: 186228 - protein, 13 aa, Borrelia afzelii
APKNFITSVIKNV

SEQ ID NO: 186229 - protein, 13 aa, Borrelia afzelii
PKNFITSVIKNVG

SEQ ID NO: 186230 - protein, 13 aa, Borrelia afzelii
KNFITSVIKNVGD

SEQ ID NO: 186231 - protein, 13 aa, Borrelia afzelii
NFITSVIKNVGDA

SEQ ID NO: 186232 - protein, 13 aa, Borrelia afzelii
FITSVIKNVGDAL

SEQ ID NO: 186233 - protein, 13 aa, Borrelia afzelii
ITSVIKNVGDALY

SEQ ID NO: 186234 - protein, 13 aa, Borrelia afzelii
TSVIKNVGDALYL

SEQ ID NO: 186235 - protein, 13 aa, Borrelia afzelii
SVIKNVGDALYLI

SEQ ID NO: 186236 - protein, 13 aa, Borrelia afzelii
VIKNVGDALYLIT

SEQ ID NO: 186237 - protein, 13 aa, Borrelia afzelii
IKNVGDALYLITS

SEQ ID NO: 186238 - protein, 13 aa, Borrelia afzelii
KNVGDALYLITSE

SEQ ID NO: 186239 - protein, 13 aa, Borrelia afzelii
NVGDALYLITSES

SEQ ID NO: 186240 - protein, 13 aa, Borrelia afzelii
VGDALYLITSESL

SEQ ID NO: 186241 - protein, 13 aa, Borrelia afzelii
GDALYLITSESLK

SEQ ID NO: 186242 - protein, 13 aa, Borrelia afzelii
DALYLITSESLKN

SEQ ID NO: 186243 - protein, 13 aa, Borrelia afzelii
ALYLITSESLKND

SEQ ID NO: 186244 - protein, 13 aa, Borrelia afzelii
LYLITSESLKNDN

SEQ ID NO: 186245 - protein, 13 aa, Borrelia afzelii
YLITSESLKNDNV

SEQ ID NO: 186246 - protein, 13 aa, Borrelia afzelii
LITSESLKNDNVW

SEQ ID NO: 186247 - protein, 13 aa, Borrelia afzelii
ITSESLKNDNVWE

SEQ ID NO: 186248 - protein, 13 aa, Borrelia afzelii
TSESLKNDNVWEG

SEQ ID NO: 186249 - protein, 13 aa, Borrelia afzelii
SESLKNDNVWEGG

SEQ ID NO: 186250 - protein, 13 aa, Borrelia afzelii
ESLKNDNVWEGGK

SEQ ID NO: 186251 - protein, 13 aa, Borrelia afzelii
SLKNDNVWEGGKI

SEQ ID NO: 186252 - protein, 13 aa, Borrelia afzelii
LKNDNVWEGGKIV

SEQ ID NO: 186253 - protein, 13 aa, Borrelia afzelii
KNDNVWEGGKIVQ

SEQ ID NO: 186254 - protein, 13 aa, Borrelia afzelii
NDNVWEGGKIVQM

SEQ ID NO: 186255 - protein, 13 aa, Borrelia afzelii
DNVWEGGKIVQMG

SEQ ID NO: 186256 - protein, 13 aa, Borrelia afzelii
NVWEGGKIVQMGL

SEQ ID NO: 186257 - protein, 13 aa, Borrelia afzelii
VWEGGKIVQMGLR

SEQ ID NO: 186258 - protein, 13 aa, Borrelia afzelii
WEGGKIVQMGLRD

SEQ ID NO: 186259 - protein, 13 aa, Borrelia afzelii
EGGKIVQMGLRDG

SEQ ID NO: 186260 - protein, 13 aa, Borrelia afzelii
GGKIVQMGLRDGV

SEQ ID NO: 186261 - protein, 13 aa, Borrelia afzelii
GKIVQMGLRDGVV

SEQ ID NO: 186262 - protein, 13 aa, Borrelia afzelii
KIVQMGLRDGVVG

SEQ ID NO: 186263 - protein, 13 aa, Borrelia afzelii
IVQMGLRDGVVGL

SEQ ID NO: 186264 - protein, 13 aa, Borrelia afzelii
VQMGLRDGVVGLS

SEQ ID NO: 186265 - protein, 13 aa, Borrelia afzelii
QMGLRDGVVGLSN

SEQ ID NO: 186266 - protein, 13 aa, Borrelia afzelii
MGLRDGVVGLSNA

SEQ ID NO: 186267 - protein, 13 aa, Borrelia afzelii
GLRDGVVGLSNAN

SEQ ID NO: 186268 - protein, 13 aa, Borrelia afzelii
LRDGVVGLSNANE

SEQ ID NO: 186269 - protein, 13 aa, Borrelia afzelii
RDGVVGLSNANEF

SEQ ID NO: 186270 - protein, 13 aa, Borrelia afzelii
DGVVGLSNANEFE

SEQ ID NO: 186271 - protein, 13 aa, Borrelia afzelii
GVVGLSNANEFEY

SEQ ID NO: 186272 - protein, 13 aa, Borrelia afzelii
VVGLSNANEFEYI

SEQ ID NO: 186273 - protein, 13 aa, Borrelia afzelii
VGLSNANEFEYIK

SEQ ID NO: 186274 - protein, 13 aa, Borrelia afzelii
GLSNANEFEYIKD

SEQ ID NO: 186275 - protein, 13 aa, Borrelia afzelii
LSNANEFEYIKDL

SEQ ID NO: 186276 - protein, 13 aa, Borrelia afzelii
SNANEFEYIKDLE

SEQ ID NO: 186277 - protein, 13 aa, Borrelia afzelii
NANEFEYIKDLER

SEQ ID NO: 186278 - protein, 13 aa, Borrelia afzelii
ANEFEYIKDLERK

SEQ ID NO: 186279 - protein, 13 aa, Borrelia afzelii
NEFEYIKDLERKI

SEQ ID NO: 186280 - protein, 13 aa, Borrelia afzelii
EFEYIKDLERKII

SEQ ID NO: 186281 - protein, 13 aa, Borrelia afzelii
FEYIKDLERKIIN

SEQ ID NO: 186282 - protein, 13 aa, Borrelia afzelii
EYIKDLERKIINK

SEQ ID NO: 186283 - protein, 13 aa, Borrelia afzelii
YIKDLERKIINKE

SEQ ID NO: 186284 - protein, 13 aa, Borrelia afzelii
IKDLERKIINKEI

SEQ ID NO: 186285 - protein, 13 aa, Borrelia afzelii
KDLERKIINKEII

SEQ ID NO: 186286 - protein, 13 aa, Borrelia afzelii
DLERKIINKEIIV

SEQ ID NO: 186287 - protein, 13 aa, Borrelia afzelii
LERKIINKEIIVP

SEQ ID NO: 186288 - protein, 13 aa, Borrelia afzelii
ERKIINKEIIVPC

SEQ ID NO: 186289 - protein, 13 aa, Borrelia afzelii
RKIINKEIIVPCN

SEQ ID NO: 186290 - protein, 13 aa, Borrelia afzelii
KIINKEIIVPCNQ

SEQ ID NO: 186291 - protein, 13 aa, Borrelia afzelii
IINKEIIVPCNQE

SEQ ID NO: 186292 - protein, 13 aa, Borrelia afzelii
INKEIIVPCNQEG

SEQ ID NO: 186293 - protein, 13 aa, Borrelia afzelii
NKEIIVPCNQEGY

SEQ ID NO: 186294 - protein, 13 aa, Borrelia afzelii
KEIIVPCNQEGYE

SEQ ID NO: 186295 - protein, 13 aa, Borrelia afzelii
EIIVPCNQEGYEI

SEQ ID NO: 186296 - protein, 13 aa, Borrelia afzelii
IIVPCNQEGYEIF

SEQ ID NO: 186297 - protein, 13 aa, Borrelia afzelii
IVPCNQEGYEIFI

SEQ ID NO: 186298 - protein, 13 aa, Borrelia afzelii
VPCNQEGYEIFIK

SEQ ID NO: 186299 - protein, 13 aa, Borrelia afzelii
PCNQEGYEIFIKQ

SEQ ID NO: 186300 - protein, 13 aa, Borrelia afzelii
CNQEGYEIFIKQI

SEQ ID NO: 186301 - protein, 13 aa, Borrelia afzelii
NQEGYEIFIKQIL

SEQ ID NO: 186302 - protein, 13 aa, Borrelia afzelii
QEGYEIFIKQILK

SEQ ID NO: 186303 - protein, 13 aa, Borrelia afzelii
EGYEIFIKQILKL

SEQ ID NO: 186304 - protein, 14 aa, Borrelia afzelii
MRIAIFIFGILLTS

SEQ ID NO: 186305 - protein, 14 aa, Borrelia afzelii
RIAIFIFGILLTSC

SEQ ID NO: 186306 - protein, 14 aa, Borrelia afzelii
IAIFIFGILLTSCF

SEQ ID NO: 186307 - protein, 14 aa, Borrelia afzelii
AIFIFGILLTSCFS

SEQ ID NO: 186308 - protein, 14 aa, Borrelia afzelii
IFIFGILLTSCFSK

SEQ ID NO: 186309 - protein, 14 aa, Borrelia afzelii
FIFGILLTSCFSKN

SEQ ID NO: 186310 - protein, 14 aa, Borrelia afzelii
IFGILLTSCFSKNG

SEQ ID NO: 186311 - protein, 14 aa, Borrelia afzelii
FGILLTSCFSKNGI

SEQ ID NO: 186312 - protein, 14 aa, Borrelia afzelii
GILLTSCFSKNGIE

SEQ ID NO: 186313 - protein, 14 aa, Borrelia afzelii
ILLTSCFSKNGIES

SEQ ID NO: 186314 - protein, 14 aa, Borrelia afzelii
LLTSCFSKNGIESG

SEQ ID NO: 186315 - protein, 14 aa, Borrelia afzelii
LTSCFSKNGIESGS

SEQ ID NO: 186316 - protein, 14 aa, Borrelia afzelii
TSCFSKNGIESGSS

SEQ ID NO: 186317 - protein, 14 aa, Borrelia afzelii
SCFSKNGIESGSSK

SEQ ID NO: 186318 - protein, 14 aa, Borrelia afzelii
CFSKNGIESGSSKI

SEQ ID NO: 186319 - protein, 14 aa, Borrelia afzelii
FSKNGIESGSSKIK

SEQ ID NO: 186320 - protein, 14 aa, Borrelia afzelii
SKNGIESGSSKIKI

SEQ ID NO: 186321 - protein, 14 aa, Borrelia afzelii
KNGIESGSSKIKIS

SEQ ID NO: 186322 - protein, 14 aa, Borrelia afzelii
NGIESGSSKIKISM

SEQ ID NO: 186323 - protein, 14 aa, Borrelia afzelii
GIESGSSKIKISML

SEQ ID NO: 186324 - protein, 14 aa, Borrelia afzelii
IESGSSKIKISMLV

SEQ ID NO: 186325 - protein, 14 aa, Borrelia afzelii
ESGSSKIKISMLVD

SEQ ID NO: 186326 - protein, 14 aa, Borrelia afzelii
SGSSKIKISMLVDG

SEQ ID NO: 186327 - protein, 14 aa, Borrelia afzelii
GSSKIKISMLVDGV

SEQ ID NO: 186328 - protein, 14 aa, Borrelia afzelii
SSKIKISMLVDGVL

SEQ ID NO: 186329 - protein, 14 aa, Borrelia afzelii
SKIKISMLVDGVLD

SEQ ID NO: 186330 - protein, 14 aa, Borrelia afzelii
KIKISMLVDGVLDD

SEQ ID NO: 186331 - protein, 14 aa, Borrelia afzelii
IKISMLVDGVLDDK

SEQ ID NO: 186332 - protein, 14 aa, Borrelia afzelii
KISMLVDGVLDDKS

SEQ ID NO: 186333 - protein, 14 aa, Borrelia afzelii
ISMLVDGVLDDKSF

SEQ ID NO: 186334 - protein, 14 aa, Borrelia afzelii
SMLVDGVLDDKSFN

SEQ ID NO: 186335 - protein, 14 aa, Borrelia afzelii
MLVDGVLDDKSFNS

SEQ ID NO: 186336 - protein, 14 aa, Borrelia afzelii
LVDGVLDDKSFNSS

SEQ ID NO: 186337 - protein, 14 aa, Borrelia afzelii
VDGVLDDKSFNSSA

SEQ ID NO: 186338 - protein, 14 aa, Borrelia afzelii
DGVLDDKSFNSSAN

SEQ ID NO: 186339 - protein, 14 aa, Borrelia afzelii
GVLDDKSFNSSANE

SEQ ID NO: 186340 - protein, 14 aa, Borrelia afzelii
VLDDKSFNSSANEA

SEQ ID NO: 186341 - protein, 14 aa, Borrelia afzelii
LDDKSFNSSANEAL

SEQ ID NO: 186342 - protein, 14 aa, Borrelia afzelii
DDKSFNSSANEALL

SEQ ID NO: 186343 - protein, 14 aa, Borrelia afzelii
DKSFNSSANEALLR

SEQ ID NO: 186344 - protein, 14 aa, Borrelia afzelii
KSFNSSANEALLRL

SEQ ID NO: 186345 - protein, 14 aa, Borrelia afzelii
SFNSSANEALLRLK

SEQ ID NO: 186346 - protein, 14 aa, Borrelia afzelii
FNSSANEALLRLKK

SEQ ID NO: 186347 - protein, 14 aa, Borrelia afzelii
NSSANEALLRLKKD

SEQ ID NO: 186348 - protein, 14 aa, Borrelia afzelii
SSANEALLRLKKDF

SEQ ID NO: 186349 - protein, 14 aa, Borrelia afzelii
SANEALLRLKKDFP

SEQ ID NO: 186350 - protein, 14 aa, Borrelia afzelii
ANEALLRLKKDFPE

SEQ ID NO: 186351 - protein, 14 aa, Borrelia afzelii
NEALLRLKKDFPEN

SEQ ID NO: 186352 - protein, 14 aa, Borrelia afzelii
EALLRLKKDFPENI

SEQ ID NO: 186353 - protein, 14 aa, Borrelia afzelii
ALLRLKKDFPENIE

SEQ ID NO: 186354 - protein, 14 aa, Borrelia afzelii
LLRLKKDFPENIEK

SEQ ID NO: 186355 - protein, 14 aa, Borrelia afzelii
LRLKKDFPENIEKV

SEQ ID NO: 186356 - protein, 14 aa, Borrelia afzelii
RLKKDFPENIEKVF

SEQ ID NO: 186357 - protein, 14 aa, Borrelia afzelii
LKKDFPENIEKVFS

SEQ ID NO: 186358 - protein, 14 aa, Borrelia afzelii
KKDFPENIEKVFSS

SEQ ID NO: 186359 - protein, 14 aa, Borrelia afzelii
KDFPENIEKVFSSA

SEQ ID NO: 186360 - protein, 14 aa, Borrelia afzelii
DFPENIEKVFSSAV

SEQ ID NO: 186361 - protein, 14 aa, Borrelia afzelii
FPENIEKVFSSAVS

SEQ ID NO: 186362 - protein, 14 aa, Borrelia afzelii
PENIEKVFSSAVSG

SEQ ID NO: 186363 - protein, 14 aa, Borrelia afzelii
ENIEKVFSSAVSGV

SEQ ID NO: 186364 - protein, 14 aa, Borrelia afzelii
NIEKVFSSAVSGVY

SEQ ID NO: 186365 - protein, 14 aa, Borrelia afzelii
IEKVFSSAVSGVYS

SEQ ID NO: 186366 - protein, 14 aa, Borrelia afzelii
EKVFSSAVSGVYSS

SEQ ID NO: 186367 - protein, 14 aa, Borrelia afzelii
KVFSSAVSGVYSSY

SEQ ID NO: 186368 - protein, 14 aa, Borrelia afzelii
VFSSAVSGVYSSYV

SEQ ID NO: 186369 - protein, 14 aa, Borrelia afzelii
FSSAVSGVYSSYVS

SEQ ID NO: 186370 - protein, 14 aa, Borrelia afzelii
SSAVSGVYSSYVSD

SEQ ID NO: 186371 - protein, 14 aa, Borrelia afzelii
SAVSGVYSSYVSDL

SEQ ID NO: 186372 - protein, 14 aa, Borrelia afzelii
AVSGVYSSYVSDLD

SEQ ID NO: 186373 - protein, 14 aa, Borrelia afzelii
VSGVYSSYVSDLDN

SEQ ID NO: 186374 - protein, 14 aa, Borrelia afzelii
SGVYSSYVSDLDNL

SEQ ID NO: 186375 - protein, 14 aa, Borrelia afzelii
GVYSSYVSDLDNLK

SEQ ID NO: 186376 - protein, 14 aa, Borrelia afzelii
VYSSYVSDLDNLKM

SEQ ID NO: 186377 - protein, 14 aa, Borrelia afzelii
YSSYVSDLDNLKMN

SEQ ID NO: 186378 - protein, 14 aa, Borrelia afzelii
SSYVSDLDNLKMNG

SEQ ID NO: 186379 - protein, 14 aa, Borrelia afzelii
SYVSDLDNLKMNGS

SEQ ID NO: 186380 - protein, 14 aa, Borrelia afzelii
YVSDLDNLKMNGSG

SEQ ID NO: 186381 - protein, 14 aa, Borrelia afzelii
VSDLDNLKMNGSGL

SEQ ID NO: 186382 - protein, 14 aa, Borrelia afzelii
SDLDNLKMNGSGLI

SEQ ID NO: 186383 - protein, 14 aa, Borrelia afzelii
DLDNLKMNGSGLIW

SEQ ID NO: 186384 - protein, 14 aa, Borrelia afzelii
LDNLKMNGSGLIWL

SEQ ID NO: 186385 - protein, 14 aa, Borrelia afzelii
DNLKMNGSGLIWLV

SEQ ID NO: 186386 - protein, 14 aa, Borrelia afzelii
NLKMNGSGLIWLVG

SEQ ID NO: 186387 - protein, 14 aa, Borrelia afzelii
LKMNGSGLIWLVGY

SEQ ID NO: 186388 - protein, 14 aa, Borrelia afzelii
KMNGSGLIWLVGYM

SEQ ID NO: 186389 - protein, 14 aa, Borrelia afzelii
MNGSGLIWLVGYML

SEQ ID NO: 186390 - protein, 14 aa, Borrelia afzelii
NGSGLIWLVGYMLA

SEQ ID NO: 186391 - protein, 14 aa, Borrelia afzelii
GSGLIWLVGYMLAD

SEQ ID NO: 186392 - protein, 14 aa, Borrelia afzelii
SGLIWLVGYMLADV

SEQ ID NO: 186393 - protein, 14 aa, Borrelia afzelii
GLIWLVGYMLADVS

SEQ ID NO: 186394 - protein, 14 aa, Borrelia afzelii
LIWLVGYMLADVSL

SEQ ID NO: 186395 - protein, 14 aa, Borrelia afzelii
IWLVGYMLADVSLS

SEQ ID NO: 186396 - protein, 14 aa, Borrelia afzelii
WLVGYMLADVSLSV

SEQ ID NO: 186397 - protein, 14 aa, Borrelia afzelii
LVGYMLADVSLSVS

SEQ ID NO: 186398 - protein, 14 aa, Borrelia afzelii
VGYMLADVSLSVSL

SEQ ID NO: 186399 - protein, 14 aa, Borrelia afzelii
GYMLADVSLSVSLE

SEQ ID NO: 186400 - protein, 14 aa, Borrelia afzelii
YMLADVSLSVSLEN

SEQ ID NO: 186401 - protein, 14 aa, Borrelia afzelii
MLADVSLSVSLENP

SEQ ID NO: 186402 - protein, 14 aa, Borrelia afzelii
LADVSLSVSLENPE

SEQ ID NO: 186403 - protein, 14 aa, Borrelia afzelii
ADVSLSVSLENPEI

SEQ ID NO: 186404 - protein, 14 aa, Borrelia afzelii
DVSLSVSLENPEIN

SEQ ID NO: 186405 - protein, 14 aa, Borrelia afzelii
VSLSVSLENPEINY

SEQ ID NO: 186406 - protein, 14 aa, Borrelia afzelii
SLSVSLENPEINYG

SEQ ID NO: 186407 - protein, 14 aa, Borrelia afzelii
LSVSLENPEINYGI

SEQ ID NO: 186408 - protein, 14 aa, Borrelia afzelii
SVSLENPEINYGII

SEQ ID NO: 186409 - protein, 14 aa, Borrelia afzelii
VSLENPEINYGIID

SEQ ID NO: 186410 - protein, 14 aa, Borrelia afzelii
SLENPEINYGIIDP

SEQ ID NO: 186411 - protein, 14 aa, Borrelia afzelii
LENPEINYGIIDPI

SEQ ID NO: 186412 - protein, 14 aa, Borrelia afzelii
ENPEINYGIIDPIY

SEQ ID NO: 186413 - protein, 14 aa, Borrelia afzelii
NPEINYGIIDPIYG

SEQ ID NO: 186414 - protein, 14 aa, Borrelia afzelii
PEINYGIIDPIYGD

SEQ ID NO: 186415 - protein, 14 aa, Borrelia afzelii
EINYGIIDPIYGDD

SEQ ID NO: 186416 - protein, 14 aa, Borrelia afzelii
INYGIIDPIYGDDV

SEQ ID NO: 186417 - protein, 14 aa, Borrelia afzelii
NYGIIDPIYGDDVQ

SEQ ID NO: 186418 - protein, 14 aa, Borrelia afzelii
YGIIDPIYGDDVQI

SEQ ID NO: 186419 - protein, 14 aa, Borrelia afzelii
GIIDPIYGDDVQIP

SEQ ID NO: 186420 - protein, 14 aa, Borrelia afzelii
IIDPIYGDDVQIPK

SEQ ID NO: 186421 - protein, 14 aa, Borrelia afzelii
IDPIYGDDVQIPKN

SEQ ID NO: 186422 - protein, 14 aa, Borrelia afzelii
DPIYGDDVQIPKNL

SEQ ID NO: 186423 - protein, 14 aa, Borrelia afzelii
PIYGDDVQIPKNLI

SEQ ID NO: 186424 - protein, 14 aa, Borrelia afzelii
IYGDDVQIPKNLIG

SEQ ID NO: 186425 - protein, 14 aa, Borrelia afzelii
YGDDVQIPKNLIGV

SEQ ID NO: 186426 - protein, 14 aa, Borrelia afzelii
GDDVQIPKNLIGVV

SEQ ID NO: 186427 - protein, 14 aa, Borrelia afzelii
DDVQIPKNLIGVVF

SEQ ID NO: 186428 - protein, 14 aa, Borrelia afzelii
DVQIPKNLIGVVFR

SEQ ID NO: 186429 - protein, 14 aa, Borrelia afzelii
VQIPKNLIGVVFRI

SEQ ID NO: 186430 - protein, 14 aa, Borrelia afzelii
QIPKNLIGVVFRIE

SEQ ID NO: 186431 - protein, 14 aa, Borrelia afzelii
IPKNLIGVVFRIEQ

SEQ ID NO: 186432 - protein, 14 aa, Borrelia afzelii
PKNLIGVVFRIEQG

SEQ ID NO: 186433 - protein, 14 aa, Borrelia afzelii
KNLIGVVFRIEQGA

SEQ ID NO: 186434 - protein, 14 aa, Borrelia afzelii
NLIGVVFRIEQGAF

SEQ ID NO: 186435 - protein, 14 aa, Borrelia afzelii
LIGVVFRIEQGAFL

SEQ ID NO: 186436 - protein, 14 aa, Borrelia afzelii
IGVVFRIEQGAFLA

SEQ ID NO: 186437 - protein, 14 aa, Borrelia afzelii
GVVFRIEQGAFLAG

SEQ ID NO: 186438 - protein, 14 aa, Borrelia afzelii
VVFRIEQGAFLAGY

SEQ ID NO: 186439 - protein, 14 aa, Borrelia afzelii
VFRIEQGAFLAGYI

SEQ ID NO: 186440 - protein, 14 aa, Borrelia afzelii
FRIEQGAFLAGYIA

SEQ ID NO: 186441 - protein, 14 aa, Borrelia afzelii
RIEQGAFLAGYIAA

SEQ ID NO: 186442 - protein, 14 aa, Borrelia afzelii
IEQGAFLAGYIAAK

SEQ ID NO: 186443 - protein, 14 aa, Borrelia afzelii
EQGAFLAGYIAAKK

SEQ ID NO: 186444 - protein, 14 aa, Borrelia afzelii
QGAFLAGYIAAKKS

SEQ ID NO: 186445 - protein, 14 aa, Borrelia afzelii
GAFLAGYIAAKKSV

SEQ ID NO: 186446 - protein, 14 aa, Borrelia afzelii
AFLAGYIAAKKSVS

SEQ ID NO: 186447 - protein, 14 aa, Borrelia afzelii
FLAGYIAAKKSVSS

SEQ ID NO: 186448 - protein, 14 aa, Borrelia afzelii
LAGYIAAKKSVSSK

SEQ ID NO: 186449 - protein, 14 aa, Borrelia afzelii
AGYIAAKKSVSSKI

SEQ ID NO: 186450 - protein, 14 aa, Borrelia afzelii
GYIAAKKSVSSKIG

SEQ ID NO: 186451 - protein, 14 aa, Borrelia afzelii
YIAAKKSVSSKIGF

SEQ ID NO: 186452 - protein, 14 aa, Borrelia afzelii
IAAKKSVSSKIGFI

SEQ ID NO: 186453 - protein, 14 aa, Borrelia afzelii
AAKKSVSSKIGFIG

SEQ ID NO: 186454 - protein, 14 aa, Borrelia afzelii
AKKSVSSKIGFIGG

SEQ ID NO: 186455 - protein, 14 aa, Borrelia afzelii
KKSVSSKIGFIGGV

SEQ ID NO: 186456 - protein, 14 aa, Borrelia afzelii
KSVSSKIGFIGGVK

SEQ ID NO: 186457 - protein, 14 aa, Borrelia afzelii
SVSSKIGFIGGVKG

SEQ ID NO: 186458 - protein, 14 aa, Borrelia afzelii
VSSKIGFIGGVKGD

SEQ ID NO: 186459 - protein, 14 aa, Borrelia afzelii
SSKIGFIGGVKGDI

SEQ ID NO: 186460 - protein, 14 aa, Borrelia afzelii
SKIGFIGGVKGDIV

SEQ ID NO: 186461 - protein, 14 aa, Borrelia afzelii
KIGFIGGVKGDIVD

SEQ ID NO: 186462 - protein, 14 aa, Borrelia afzelii
IGFIGGVKGDIVDA

SEQ ID NO: 186463 - protein, 14 aa, Borrelia afzelii
GFIGGVKGDIVDAF

SEQ ID NO: 186464 - protein, 14 aa, Borrelia afzelii
FIGGVKGDIVDAFR

SEQ ID NO: 186465 - protein, 14 aa, Borrelia afzelii
IGGVKGDIVDAFRY

SEQ ID NO: 186466 - protein, 14 aa, Borrelia afzelii
GGVKGDIVDAFRYG

SEQ ID NO: 186467 - protein, 14 aa, Borrelia afzelii
GVKGDIVDAFRYGY

SEQ ID NO: 186468 - protein, 14 aa, Borrelia afzelii
VKGDIVDAFRYGYE

SEQ ID NO: 186469 - protein, 14 aa, Borrelia afzelii
KGDIVDAFRYGYEA

SEQ ID NO: 186470 - protein, 14 aa, Borrelia afzelii
GDIVDAFRYGYEAG

SEQ ID NO: 186471 - protein, 14 aa, Borrelia afzelii
DIVDAFRYGYEAGA

SEQ ID NO: 186472 - protein, 14 aa, Borrelia afzelii
IVDAFRYGYEAGAK

SEQ ID NO: 186473 - protein, 14 aa, Borrelia afzelii
VDAFRYGYEAGAKY

SEQ ID NO: 186474 - protein, 14 aa, Borrelia afzelii
DAFRYGYEAGAKYA

SEQ ID NO: 186475 - protein, 14 aa, Borrelia afzelii
AFRYGYEAGAKYAN

SEQ ID NO: 186476 - protein, 14 aa, Borrelia afzelii
FRYGYEAGAKYANK

SEQ ID NO: 186477 - protein, 14 aa, Borrelia afzelii
RYGYEAGAKYANKG

SEQ ID NO: 186478 - protein, 14 aa, Borrelia afzelii
YGYEAGAKYANKGI

SEQ ID NO: 186479 - protein, 14 aa, Borrelia afzelii
GYEAGAKYANKGIE

SEQ ID NO: 186480 - protein, 14 aa, Borrelia afzelii
YEAGAKYANKGIEI

SEQ ID NO: 186481 - protein, 14 aa, Borrelia afzelii
EAGAKYANKGIEIV

SEQ ID NO: 186482 - protein, 14 aa, Borrelia afzelii
AGAKYANKGIEIVS

SEQ ID NO: 186483 - protein, 14 aa, Borrelia afzelii
GAKYANKGIEIVSE

SEQ ID NO: 186484 - protein, 14 aa, Borrelia afzelii
AKYANKGIEIVSEY

SEQ ID NO: 186485 - protein, 14 aa, Borrelia afzelii
KYANKGIEIVSEYS

SEQ ID NO: 186486 - protein, 14 aa, Borrelia afzelii
YANKGIEIVSEYSN

SEQ ID NO: 186487 - protein, 14 aa, Borrelia afzelii
ANKGIEIVSEYSNS

SEQ ID NO: 186488 - protein, 14 aa, Borrelia afzelii
NKGIEIVSEYSNSF

SEQ ID NO: 186489 - protein, 14 aa, Borrelia afzelii
KGIEIVSEYSNSFS

SEQ ID NO: 186490 - protein, 14 aa, Borrelia afzelii
GIEIVSEYSNSFSD

SEQ ID NO: 186491 - protein, 14 aa, Borrelia afzelii
IEIVSEYSNSFSDI

SEQ ID NO: 186492 - protein, 14 aa, Borrelia afzelii
EIVSEYSNSFSDID

SEQ ID NO: 186493 - protein, 14 aa, Borrelia afzelii
IVSEYSNSFSDIDI

SEQ ID NO: 186494 - protein, 14 aa, Borrelia afzelii
VSEYSNSFSDIDIA

SEQ ID NO: 186495 - protein, 14 aa, Borrelia afzelii
SEYSNSFSDIDIAR

SEQ ID NO: 186496 - protein, 14 aa, Borrelia afzelii
EYSNSFSDIDIARV

SEQ ID NO: 186497 - protein, 14 aa, Borrelia afzelii
YSNSFSDIDIARVM

SEQ ID NO: 186498 - protein, 14 aa, Borrelia afzelii
SNSFSDIDIARVMA

SEQ ID NO: 186499 - protein, 14 aa, Borrelia afzelii
NSFSDIDIARVMAN

SEQ ID NO: 186500 - protein, 14 aa, Borrelia afzelii
SFSDIDIARVMANK

SEQ ID NO: 186501 - protein, 14 aa, Borrelia afzelii
FSDIDIARVMANKM

SEQ ID NO: 186502 - protein, 14 aa, Borrelia afzelii
SDIDIARVMANKMY

SEQ ID NO: 186503 - protein, 14 aa, Borrelia afzelii
DIDIARVMANKMYS

SEQ ID NO: 186504 - protein, 14 aa, Borrelia afzelii
IDIARVMANKMYSK

SEQ ID NO: 186505 - protein, 14 aa, Borrelia afzelii
DIARVMANKMYSKG

SEQ ID NO: 186506 - protein, 14 aa, Borrelia afzelii
IARVMANKMYSKGI

SEQ ID NO: 186507 - protein, 14 aa, Borrelia afzelii
ARVMANKMYSKGID

SEQ ID NO: 186508 - protein, 14 aa, Borrelia afzelii
RVMANKMYSKGIDI

SEQ ID NO: 186509 - protein, 14 aa, Borrelia afzelii
VMANKMYSKGIDII

SEQ ID NO: 186510 - protein, 14 aa, Borrelia afzelii
MANKMYSKGIDIIH

SEQ ID NO: 186511 - protein, 14 aa, Borrelia afzelii
ANKMYSKGIDIIHF

SEQ ID NO: 186512 - protein, 14 aa, Borrelia afzelii
NKMYSKGIDIIHFA

SEQ ID NO: 186513 - protein, 14 aa, Borrelia afzelii
KMYSKGIDIIHFAA

SEQ ID NO: 186514 - protein, 14 aa, Borrelia afzelii
MYSKGIDIIHFAAG

SEQ ID NO: 186515 - protein, 14 aa, Borrelia afzelii
YSKGIDIIHFAAGL

SEQ ID NO: 186516 - protein, 14 aa, Borrelia afzelii
SKGIDIIHFAAGLA

SEQ ID NO: 186517 - protein, 14 aa, Borrelia afzelii
KGIDIIHFAAGLAG

SEQ ID NO: 186518 - protein, 14 aa, Borrelia afzelii
GIDIIHFAAGLAGV

SEQ ID NO: 186519 - protein, 14 aa, Borrelia afzelii
IDIIHFAAGLAGVG

SEQ ID NO: 186520 - protein, 14 aa, Borrelia afzelii
DIIHFAAGLAGVGV

SEQ ID NO: 186521 - protein, 14 aa, Borrelia afzelii
IIHFAAGLAGVGVI

SEQ ID NO: 186522 - protein, 14 aa, Borrelia afzelii
IHFAAGLAGVGVIE

SEQ ID NO: 186523 - protein, 14 aa, Borrelia afzelii
HFAAGLAGVGVIEA

SEQ ID NO: 186524 - protein, 14 aa, Borrelia afzelii
FAAGLAGVGVIEAA

SEQ ID NO: 186525 - protein, 14 aa, Borrelia afzelii
AAGLAGVGVIEAAK

SEQ ID NO: 186526 - protein, 14 aa, Borrelia afzelii
AGLAGVGVIEAAKE

SEQ ID NO: 186527 - protein, 14 aa, Borrelia afzelii
GLAGVGVIEAAKEL

SEQ ID NO: 186528 - protein, 14 aa, Borrelia afzelii
LAGVGVIEAAKELG

SEQ ID NO: 186529 - protein, 14 aa, Borrelia afzelii
AGVGVIEAAKELGD

SEQ ID NO: 186530 - protein, 14 aa, Borrelia afzelii
GVGVIEAAKELGDG

SEQ ID NO: 186531 - protein, 14 aa, Borrelia afzelii
VGVIEAAKELGDGY

SEQ ID NO: 186532 - protein, 14 aa, Borrelia afzelii
GVIEAAKELGDGYY

SEQ ID NO: 186533 - protein, 14 aa, Borrelia afzelii
VIEAAKELGDGYYV

SEQ ID NO: 186534 - protein, 14 aa, Borrelia afzelii
IEAAKELGDGYYVI

SEQ ID NO: 186535 - protein, 14 aa, Borrelia afzelii
EAAKELGDGYYVIG

SEQ ID NO: 186536 - protein, 14 aa, Borrelia afzelii
AAKELGDGYYVIGA

SEQ ID NO: 186537 - protein, 14 aa, Borrelia afzelii
AKELGDGYYVIGAD

SEQ ID NO: 186538 - protein, 14 aa, Borrelia afzelii
KELGDGYYVIGADQ

SEQ ID NO: 186539 - protein, 14 aa, Borrelia afzelii
ELGDGYYVIGADQD

SEQ ID NO: 186540 - protein, 14 aa, Borrelia afzelii
LGDGYYVIGADQDQ

SEQ ID NO: 186541 - protein, 14 aa, Borrelia afzelii
GDGYYVIGADQDQS

SEQ ID NO: 186542 - protein, 14 aa, Borrelia afzelii
DGYYVIGADQDQSH

SEQ ID NO: 186543 - protein, 14 aa, Borrelia afzelii
GYYVIGADQDQSHL

SEQ ID NO: 186544 - protein, 14 aa, Borrelia afzelii
YYVIGADQDQSHLA

SEQ ID NO: 186545 - protein, 14 aa, Borrelia afzelii
YVIGADQDQSHLAP

SEQ ID NO: 186546 - protein, 14 aa, Borrelia afzelii
VIGADQDQSHLAPK

SEQ ID NO: 186547 - protein, 14 aa, Borrelia afzelii
IGADQDQSHLAPKN

SEQ ID NO: 186548 - protein, 14 aa, Borrelia afzelii
GADQDQSHLAPKNF

SEQ ID NO: 186549 - protein, 14 aa, Borrelia afzelii
ADQDQSHLAPKNFI

SEQ ID NO: 186550 - protein, 14 aa, Borrelia afzelii
DQDQSHLAPKNFIT

SEQ ID NO: 186551 - protein, 14 aa, Borrelia afzelii
QDQSHLAPKNFITS

SEQ ID NO: 186552 - protein, 14 aa, Borrelia afzelii
DQSHLAPKNFITSV

SEQ ID NO: 186553 - protein, 14 aa, Borrelia afzelii
QSHLAPKNFITSVI

SEQ ID NO: 186554 - protein, 14 aa, Borrelia afzelii
SHLAPKNFITSVIK

SEQ ID NO: 186555 - protein, 14 aa, Borrelia afzelii
HLAPKNFITSVIKN

SEQ ID NO: 186556 - protein, 14 aa, Borrelia afzelii
LAPKNFITSVIKNV

SEQ ID NO: 186557 - protein, 14 aa, Borrelia afzelii
APKNFITSVIKNVG

SEQ ID NO: 186558 - protein, 14 aa, Borrelia afzelii
PKNFITSVIKNVGD

SEQ ID NO: 186559 - protein, 14 aa, Borrelia afzelii
KNFITSVIKNVGDA

SEQ ID NO: 186560 - protein, 14 aa, Borrelia afzelii
NFITSVIKNVGDAL

SEQ ID NO: 186561 - protein, 14 aa, Borrelia afzelii
FITSVIKNVGDALY

SEQ ID NO: 186562 - protein, 14 aa, Borrelia afzelii
ITSVIKNVGDALYL

SEQ ID NO: 186563 - protein, 14 aa, Borrelia afzelii
TSVIKNVGDALYLI

SEQ ID NO: 186564 - protein, 14 aa, Borrelia afzelii
SVIKNVGDALYLIT

SEQ ID NO: 186565 - protein, 14 aa, Borrelia afzelii
VIKNVGDALYLITS

SEQ ID NO: 186566 - protein, 14 aa, Borrelia afzelii
IKNVGDALYLITSE

SEQ ID NO: 186567 - protein, 14 aa, Borrelia afzelii
KNVGDALYLITSES

SEQ ID NO: 186568 - protein, 14 aa, Borrelia afzelii
NVGDALYLITSESL

SEQ ID NO: 186569 - protein, 14 aa, Borrelia afzelii
VGDALYLITSESLK

SEQ ID NO: 186570 - protein, 14 aa, Borrelia afzelii
GDALYLITSESLKN

SEQ ID NO: 186571 - protein, 14 aa, Borrelia afzelii
DALYLITSESLKND

SEQ ID NO: 186572 - protein, 14 aa, Borrelia afzelii
ALYLITSESLKNDN

SEQ ID NO: 186573 - protein, 14 aa, Borrelia afzelii
LYLITSESLKNDNV

SEQ ID NO: 186574 - protein, 14 aa, Borrelia afzelii
YLITSESLKNDNVW

SEQ ID NO: 186575 - protein, 14 aa, Borrelia afzelii
LITSESLKNDNVWE

SEQ ID NO: 186576 - protein, 14 aa, Borrelia afzelii
ITSESLKNDNVWEG

SEQ ID NO: 186577 - protein, 14 aa, Borrelia afzelii
TSESLKNDNVWEGG

SEQ ID NO: 186578 - protein, 14 aa, Borrelia afzelii
SESLKNDNVWEGGK

SEQ ID NO: 186579 - protein, 14 aa, Borrelia afzelii
ESLKNDNVWEGGKI

SEQ ID NO: 186580 - protein, 14 aa, Borrelia afzelii
SLKNDNVWEGGKIV

SEQ ID NO: 186581 - protein, 14 aa, Borrelia afzelii
LKNDNVWEGGKIVQ

SEQ ID NO: 186582 - protein, 14 aa, Borrelia afzelii
KNDNVWEGGKIVQM

SEQ ID NO: 186583 - protein, 14 aa, Borrelia afzelii
NDNVWEGGKIVQMG

SEQ ID NO: 186584 - protein, 14 aa, Borrelia afzelii
DNVWEGGKIVQMGL

SEQ ID NO: 186585 - protein, 14 aa, Borrelia afzelii
NVWEGGKIVQMGLR

SEQ ID NO: 186586 - protein, 14 aa, Borrelia afzelii
VWEGGKIVQMGLRD

SEQ ID NO: 186587 - protein, 14 aa, Borrelia afzelii
WEGGKIVQMGLRDG

SEQ ID NO: 186588 - protein, 14 aa, Borrelia afzelii
EGGKIVQMGLRDGV

SEQ ID NO: 186589 - protein, 14 aa, Borrelia afzelii
GGKIVQMGLRDGVV

SEQ ID NO: 186590 - protein, 14 aa, Borrelia afzelii
GKIVQMGLRDGVVG

SEQ ID NO: 186591 - protein, 14 aa, Borrelia afzelii
KIVQMGLRDGVVGL

SEQ ID NO: 186592 - protein, 14 aa, Borrelia afzelii
IVQMGLRDGVVGLS

SEQ ID NO: 186593 - protein, 14 aa, Borrelia afzelii
VQMGLRDGVVGLSN

SEQ ID NO: 186594 - protein, 14 aa, Borrelia afzelii
QMGLRDGVVGLSNA

SEQ ID NO: 186595 - protein, 14 aa, Borrelia afzelii
MGLRDGVVGLSNAN

SEQ ID NO: 186596 - protein, 14 aa, Borrelia afzelii
GLRDGVVGLSNANE

SEQ ID NO: 186597 - protein, 14 aa, Borrelia afzelii
LRDGVVGLSNANEF

SEQ ID NO: 186598 - protein, 14 aa, Borrelia afzelii
RDGVVGLSNANEFE

SEQ ID NO: 186599 - protein, 14 aa, Borrelia afzelii
DGVVGLSNANEFEY

SEQ ID NO: 186600 - protein, 14 aa, Borrelia afzelii
GVVGLSNANEFEYI

SEQ ID NO: 186601 - protein, 14 aa, Borrelia afzelii
VVGLSNANEFEYIK

SEQ ID NO: 186602 - protein, 14 aa, Borrelia afzelii
VGLSNANEFEYIKD

SEQ ID NO: 186603 - protein, 14 aa, Borrelia afzelii
GLSNANEFEYIKDL

SEQ ID NO: 186604 - protein, 14 aa, Borrelia afzelii
LSNANEFEYIKDLE

SEQ ID NO: 186605 - protein, 14 aa, Borrelia afzelii
SNANEFEYIKDLER

SEQ ID NO: 186606 - protein, 14 aa, Borrelia afzelii
NANEFEYIKDLERK

SEQ ID NO: 186607 - protein, 14 aa, Borrelia afzelii
ANEFEYIKDLERKI

SEQ ID NO: 186608 - protein, 14 aa, Borrelia afzelii
NEFEYIKDLERKII

SEQ ID NO: 186609 - protein, 14 aa, Borrelia afzelii
EFEYIKDLERKIIN

SEQ ID NO: 186610 - protein, 14 aa, Borrelia afzelii
FEYIKDLERKIINK

SEQ ID NO: 186611 - protein, 14 aa, Borrelia afzelii
EYIKDLERKIINKE

SEQ ID NO: 186612 - protein, 14 aa, Borrelia afzelii
YIKDLERKIINKEI

SEQ ID NO: 186613 - protein, 14 aa, Borrelia afzelii
IKDLERKIINKEII

SEQ ID NO: 186614 - protein, 14 aa, Borrelia afzelii
KDLERKIINKEIIV

SEQ ID NO: 186615 - protein, 14 aa, Borrelia afzelii
DLERKIINKEIIVP

SEQ ID NO: 186616 - protein, 14 aa, Borrelia afzelii
LERKIINKEIIVPC

SEQ ID NO: 186617 - protein, 14 aa, Borrelia afzelii
ERKIINKEIIVPCN

SEQ ID NO: 186618 - protein, 14 aa, Borrelia afzelii
RKIINKEIIVPCNQ

SEQ ID NO: 186619 - protein, 14 aa, Borrelia afzelii
KIINKEIIVPCNQE

SEQ ID NO: 186620 - protein, 14 aa, Borrelia afzelii
IINKEIIVPCNQEG

SEQ ID NO: 186621 - protein, 14 aa, Borrelia afzelii
INKEIIVPCNQEGY

SEQ ID NO: 186622 - protein, 14 aa, Borrelia afzelii
NKEIIVPCNQEGYE

SEQ ID NO: 186623 - protein, 14 aa, Borrelia afzelii
KEIIVPCNQEGYEI

SEQ ID NO: 186624 - protein, 14 aa, Borrelia afzelii
EIIVPCNQEGYEIF

SEQ ID NO: 186625 - protein, 14 aa, Borrelia afzelii
IIVPCNQEGYEIFI

SEQ ID NO: 186626 - protein, 14 aa, Borrelia afzelii
IVPCNQEGYEIFIK

SEQ ID NO: 186627 - protein, 14 aa, Borrelia afzelii
VPCNQEGYEIFIKQ

SEQ ID NO: 186628 - protein, 14 aa, Borrelia afzelii
PCNQEGYEIFIKQI

SEQ ID NO: 186629 - protein, 14 aa, Borrelia afzelii
CNQEGYEIFIKQIL

SEQ ID NO: 186630 - protein, 14 aa, Borrelia afzelii
NQEGYEIFIKQILK

SEQ ID NO: 186631 - protein, 14 aa, Borrelia afzelii
QEGYEIFIKQILKL

SEQ ID NO: 186632 - protein, 15 aa, Borrelia afzelii
MRIAIFIFGILLTSC

SEQ ID NO: 186633 - protein, 15 aa, Borrelia afzelii
RIAIFIFGILLTSCF

SEQ ID NO: 186634 - protein, 15 aa, Borrelia afzelii
IAIFIFGILLTSCFS

SEQ ID NO: 186635 - protein, 15 aa, Borrelia afzelii
AIFIFGILLTSCFSK

SEQ ID NO: 186636 - protein, 15 aa, Borrelia afzelii
IFIFGILLTSCFSKN

SEQ ID NO: 186637 - protein, 15 aa, Borrelia afzelii
FIFGILLTSCFSKNG

SEQ ID NO: 186638 - protein, 15 aa, Borrelia afzelii
IFGILLTSCFSKNGI

SEQ ID NO: 186639 - protein, 15 aa, Borrelia afzelii
FGILLTSCFSKNGIE

SEQ ID NO: 186640 - protein, 15 aa, Borrelia afzelii
GILLTSCFSKNGIES

SEQ ID NO: 186641 - protein, 15 aa, Borrelia afzelii
ILLTSCFSKNGIESG

SEQ ID NO: 186642 - protein, 15 aa, Borrelia afzelii
LLTSCFSKNGIESGS

SEQ ID NO: 186643 - protein, 15 aa, Borrelia afzelii
LTSCFSKNGIESGSS

SEQ ID NO: 186644 - protein, 15 aa, Borrelia afzelii
TSCFSKNGIESGSSK

SEQ ID NO: 186645 - protein, 15 aa, Borrelia afzelii
SCFSKNGIESGSSKI

SEQ ID NO: 186646 - protein, 15 aa, Borrelia afzelii
CFSKNGIESGSSKIK

SEQ ID NO: 186647 - protein, 15 aa, Borrelia afzelii
FSKNGIESGSSKIKI

SEQ ID NO: 186648 - protein, 15 aa, Borrelia afzelii
SKNGIESGSSKIKIS

SEQ ID NO: 186649 - protein, 15 aa, Borrelia afzelii
KNGIESGSSKIKISM

SEQ ID NO: 186650 - protein, 15 aa, Borrelia afzelii
NGIESGSSKIKISML

SEQ ID NO: 186651 - protein, 15 aa, Borrelia afzelii
GIESGSSKIKISMLV

SEQ ID NO: 186652 - protein, 15 aa, Borrelia afzelii
IESGSSKIKISMLVD

SEQ ID NO: 186653 - protein, 15 aa, Borrelia afzelii
ESGSSKIKISMLVDG

SEQ ID NO: 186654 - protein, 15 aa, Borrelia afzelii
SGSSKIKISMLVDGV

SEQ ID NO: 186655 - protein, 15 aa, Borrelia afzelii
GSSKIKISMLVDGVL

SEQ ID NO: 186656 - protein, 15 aa, Borrelia afzelii
SSKIKISMLVDGVLD

SEQ ID NO: 186657 - protein, 15 aa, Borrelia afzelii
SKIKISMLVDGVLDD

SEQ ID NO: 186658 - protein, 15 aa, Borrelia afzelii
KIKISMLVDGVLDDK

SEQ ID NO: 186659 - protein, 15 aa, Borrelia afzelii
IKISMLVDGVLDDKS

SEQ ID NO: 186660 - protein, 15 aa, Borrelia afzelii
KISMLVDGVLDDKSF

SEQ ID NO: 186661 - protein, 15 aa, Borrelia afzelii
ISMLVDGVLDDKSFN

SEQ ID NO: 186662 - protein, 15 aa, Borrelia afzelii
SMLVDGVLDDKSFNS

SEQ ID NO: 186663 - protein, 15 aa, Borrelia afzelii
MLVDGVLDDKSFNSS

SEQ ID NO: 186664 - protein, 15 aa, Borrelia afzelii
LVDGVLDDKSFNSSA

SEQ ID NO: 186665 - protein, 15 aa, Borrelia afzelii
VDGVLDDKSFNSSAN

SEQ ID NO: 186666 - protein, 15 aa, Borrelia afzelii
DGVLDDKSFNSSANE

SEQ ID NO: 186667 - protein, 15 aa, Borrelia afzelii
GVLDDKSFNSSANEA

SEQ ID NO: 186668 - protein, 15 aa, Borrelia afzelii
VLDDKSFNSSANEAL

SEQ ID NO: 186669 - protein, 15 aa, Borrelia afzelii
LDDKSFNSSANEALL

SEQ ID NO: 186670 - protein, 15 aa, Borrelia afzelii
DDKSFNSSANEALLR

SEQ ID NO: 186671 - protein, 15 aa, Borrelia afzelii
DKSFNSSANEALLRL

SEQ ID NO: 186672 - protein, 15 aa, Borrelia afzelii
KSFNSSANEALLRLK

SEQ ID NO: 186673 - protein, 15 aa, Borrelia afzelii
SFNSSANEALLRLKK

SEQ ID NO: 186674 - protein, 15 aa, Borrelia afzelii
FNSSANEALLRLKKD

SEQ ID NO: 186675 - protein, 15 aa, Borrelia afzelii
NSSANEALLRLKKDF

SEQ ID NO: 186676 - protein, 15 aa, Borrelia afzelii
SSANEALLRLKKDFP

SEQ ID NO: 186677 - protein, 15 aa, Borrelia afzelii
SANEALLRLKKDFPE

SEQ ID NO: 186678 - protein, 15 aa, Borrelia afzelii
ANEALLRLKKDFPEN

SEQ ID NO: 186679 - protein, 15 aa, Borrelia afzelii
NEALLRLKKDFPENI

SEQ ID NO: 186680 - protein, 15 aa, Borrelia afzelii
EALLRLKKDFPENIE

SEQ ID NO: 186681 - protein, 15 aa, Borrelia afzelii
ALLRLKKDFPENIEK

SEQ ID NO: 186682 - protein, 15 aa, Borrelia afzelii
LLRLKKDFPENIEKV

SEQ ID NO: 186683 - protein, 15 aa, Borrelia afzelii
LRLKKDFPENIEKVF

SEQ ID NO: 186684 - protein, 15 aa, Borrelia afzelii
RLKKDFPENIEKVFS

SEQ ID NO: 186685 - protein, 15 aa, Borrelia afzelii
LKKDFPENIEKVFSS

SEQ ID NO: 186686 - protein, 15 aa, Borrelia afzelii
KKDFPENIEKVFSSA

SEQ ID NO: 186687 - protein, 15 aa, Borrelia afzelii
KDFPENIEKVFSSAV

SEQ ID NO: 186688 - protein, 15 aa, Borrelia afzelii
DFPENIEKVFSSAVS

SEQ ID NO: 186689 - protein, 15 aa, Borrelia afzelii
FPENIEKVFSSAVSG

SEQ ID NO: 186690 - protein, 15 aa, Borrelia afzelii
PENIEKVFSSAVSGV

SEQ ID NO: 186691 - protein, 15 aa, Borrelia afzelii
ENIEKVFSSAVSGVY

SEQ ID NO: 186692 - protein, 15 aa, Borrelia afzelii
NIEKVFSSAVSGVYS

SEQ ID NO: 186693 - protein, 15 aa, Borrelia afzelii
IEKVFSSAVSGVYSS

SEQ ID NO: 186694 - protein, 15 aa, Borrelia afzelii
EKVFSSAVSGVYSSY

SEQ ID NO: 186695 - protein, 15 aa, Borrelia afzelii
KVFSSAVSGVYSSYV

SEQ ID NO: 186696 - protein, 15 aa, Borrelia afzelii
VFSSAVSGVYSSYVS

SEQ ID NO: 186697 - protein, 15 aa, Borrelia afzelii
FSSAVSGVYSSYVSD

SEQ ID NO: 186698 - protein, 15 aa, Borrelia afzelii
SSAVSGVYSSYVSDL

SEQ ID NO: 186699 - protein, 15 aa, Borrelia afzelii
SAVSGVYSSYVSDLD

SEQ ID NO: 186700 - protein, 15 aa, Borrelia afzelii
AVSGVYSSYVSDLDN

SEQ ID NO: 186701 - protein, 15 aa, Borrelia afzelii
VSGVYSSYVSDLDNL

SEQ ID NO: 186702 - protein, 15 aa, Borrelia afzelii
SGVYSSYVSDLDNLK

SEQ ID NO: 186703 - protein, 15 aa, Borrelia afzelii
GVYSSYVSDLDNLKM

SEQ ID NO: 186704 - protein, 15 aa, Borrelia afzelii
VYSSYVSDLDNLKMN

SEQ ID NO: 186705 - protein, 15 aa, Borrelia afzelii
YSSYVSDLDNLKMNG

SEQ ID NO: 186706 - protein, 15 aa, Borrelia afzelii
SSYVSDLDNLKMNGS

SEQ ID NO: 186707 - protein, 15 aa, Borrelia afzelii
SYVSDLDNLKMNGSG

SEQ ID NO: 186708 - protein, 15 aa, Borrelia afzelii
YVSDLDNLKMNGSGL

SEQ ID NO: 186709 - protein, 15 aa, Borrelia afzelii
VSDLDNLKMNGSGLI

SEQ ID NO: 186710 - protein, 15 aa, Borrelia afzelii
SDLDNLKMNGSGLIW

SEQ ID NO: 186711 - protein, 15 aa, Borrelia afzelii
DLDNLKMNGSGLIWL

SEQ ID NO: 186712 - protein, 15 aa, Borrelia afzelii
LDNLKMNGSGLIWLV

SEQ ID NO: 186713 - protein, 15 aa, Borrelia afzelii
DNLKMNGSGLIWLVG

SEQ ID NO: 186714 - protein, 15 aa, Borrelia afzelii
NLKMNGSGLIWLVGY

SEQ ID NO: 186715 - protein, 15 aa, Borrelia afzelii
LKMNGSGLIWLVGYM

SEQ ID NO: 186716 - protein, 15 aa, Borrelia afzelii
KMNGSGLIWLVGYML

SEQ ID NO: 186717 - protein, 15 aa, Borrelia afzelii
MNGSGLIWLVGYMLA

SEQ ID NO: 186718 - protein, 15 aa, Borrelia afzelii
NGSGLIWLVGYMLAD

SEQ ID NO: 186719 - protein, 15 aa, Borrelia afzelii
GSGLIWLVGYMLADV

SEQ ID NO: 186720 - protein, 15 aa, Borrelia afzelii
SGLIWLVGYMLADVS

SEQ ID NO: 186721 - protein, 15 aa, Borrelia afzelii
GLIWLVGYMLADVSL

SEQ ID NO: 186722 - protein, 15 aa, Borrelia afzelii
LIWLVGYMLADVSLS

SEQ ID NO: 186723 - protein, 15 aa, Borrelia afzelii
IWLVGYMLADVSLSV

SEQ ID NO: 186724 - protein, 15 aa, Borrelia afzelii
WLVGYMLADVSLSVS

SEQ ID NO: 186725 - protein, 15 aa, Borrelia afzelii
LVGYMLADVSLSVSL

SEQ ID NO: 186726 - protein, 15 aa, Borrelia afzelii
VGYMLADVSLSVSLE

SEQ ID NO: 186727 - protein, 15 aa, Borrelia afzelii
GYMLADVSLSVSLEN

SEQ ID NO: 186728 - protein, 15 aa, Borrelia afzelii
YMLADVSLSVSLENP

SEQ ID NO: 186729 - protein, 15 aa, Borrelia afzelii
MLADVSLSVSLENPE

SEQ ID NO: 186730 - protein, 15 aa, Borrelia afzelii
LADVSLSVSLENPEI

SEQ ID NO: 186731 - protein, 15 aa, Borrelia afzelii
ADVSLSVSLENPEIN

SEQ ID NO: 186732 - protein, 15 aa, Borrelia afzelii
DVSLSVSLENPEINY

SEQ ID NO: 186733 - protein, 15 aa, Borrelia afzelii
VSLSVSLENPEINYG

SEQ ID NO: 186734 - protein, 15 aa, Borrelia afzelii
SLSVSLENPEINYGI

SEQ ID NO: 186735 - protein, 15 aa, Borrelia afzelii
LSVSLENPEINYGII

SEQ ID NO: 186736 - protein, 15 aa, Borrelia afzelii
SVSLENPEINYGIID

SEQ ID NO: 186737 - protein, 15 aa, Borrelia afzelii
VSLENPEINYGIIDP

SEQ ID NO: 186738 - protein, 15 aa, Borrelia afzelii
SLENPEINYGIIDPI

SEQ ID NO: 186739 - protein, 15 aa, Borrelia afzelii
LENPEINYGIIDPIY

SEQ ID NO: 186740 - protein, 15 aa, Borrelia afzelii
ENPEINYGIIDPIYG

SEQ ID NO: 186741 - protein, 15 aa, Borrelia afzelii
NPEINYGIIDPIYGD

SEQ ID NO: 186742 - protein, 15 aa, Borrelia afzelii
PEINYGIIDPIYGDD

SEQ ID NO: 186743 - protein, 15 aa, Borrelia afzelii
EINYGIIDPIYGDDV

SEQ ID NO: 186744 - protein, 15 aa, Borrelia afzelii
INYGIIDPIYGDDVQ

SEQ ID NO: 186745 - protein, 15 aa, Borrelia afzelii
NYGIIDPIYGDDVQI

SEQ ID NO: 186746 - protein, 15 aa, Borrelia afzelii
YGIIDPIYGDDVQIP

SEQ ID NO: 186747 - protein, 15 aa, Borrelia afzelii
GIIDPIYGDDVQIPK

SEQ ID NO: 186748 - protein, 15 aa, Borrelia afzelii
IIDPIYGDDVQIPKN

SEQ ID NO: 186749 - protein, 15 aa, Borrelia afzelii
IDPIYGDDVQIPKNL

SEQ ID NO: 186750 - protein, 15 aa, Borrelia afzelii
DPIYGDDVQIPKNLI

SEQ ID NO: 186751 - protein, 15 aa, Borrelia afzelii
PIYGDDVQIPKNLIG

SEQ ID NO: 186752 - protein, 15 aa, Borrelia afzelii
IYGDDVQIPKNLIGV

SEQ ID NO: 186753 - protein, 15 aa, Borrelia afzelii
YGDDVQIPKNLIGVV

SEQ ID NO: 186754 - protein, 15 aa, Borrelia afzelii
GDDVQIPKNLIGVVF

SEQ ID NO: 186755 - protein, 15 aa, Borrelia afzelii
DDVQIPKNLIGVVFR

SEQ ID NO: 186756 - protein, 15 aa, Borrelia afzelii
DVQIPKNLIGVVFRI

SEQ ID NO: 186757 - protein, 15 aa, Borrelia afzelii
VQIPKNLIGVVFRIE

SEQ ID NO: 186758 - protein, 15 aa, Borrelia afzelii
QIPKNLIGVVFRIEQ

SEQ ID NO: 186759 - protein, 15 aa, Borrelia afzelii
IPKNLIGVVFRIEQG

SEQ ID NO: 186760 - protein, 15 aa, Borrelia afzelii
PKNLIGVVFRIEQGA

SEQ ID NO: 186761 - protein, 15 aa, Borrelia afzelii
KNLIGVVFRIEQGAF

SEQ ID NO: 186762 - protein, 15 aa, Borrelia afzelii
NLIGVVFRIEQGAFL

SEQ ID NO: 186763 - protein, 15 aa, Borrelia afzelii
LIGVVFRIEQGAFLA

SEQ ID NO: 186764 - protein, 15 aa, Borrelia afzelii
IGVVFRIEQGAFLAG

SEQ ID NO: 186765 - protein, 15 aa, Borrelia afzelii
GVVFRIEQGAFLAGY

SEQ ID NO: 186766 - protein, 15 aa, Borrelia afzelii
VVFRIEQGAFLAGYI

SEQ ID NO: 186767 - protein, 15 aa, Borrelia afzelii
VFRIEQGAFLAGYIA

SEQ ID NO: 186768 - protein, 15 aa, Borrelia afzelii
FRIEQGAFLAGYIAA

SEQ ID NO: 186769 - protein, 15 aa, Borrelia afzelii
RIEQGAFLAGYIAAK

SEQ ID NO: 186770 - protein, 15 aa, Borrelia afzelii
IEQGAFLAGYIAAKK

SEQ ID NO: 186771 - protein, 15 aa, Borrelia afzelii
EQGAFLAGYIAAKKS

SEQ ID NO: 186772 - protein, 15 aa, Borrelia afzelii
QGAFLAGYIAAKKSV

SEQ ID NO: 186773 - protein, 15 aa, Borrelia afzelii
GAFLAGYIAAKKSVS

SEQ ID NO: 186774 - protein, 15 aa, Borrelia afzelii
AFLAGYIAAKKSVSS

SEQ ID NO: 186775 - protein, 15 aa, Borrelia afzelii
FLAGYIAAKKSVSSK

SEQ ID NO: 186776 - protein, 15 aa, Borrelia afzelii
LAGYIAAKKSVSSKI

SEQ ID NO: 186777 - protein, 15 aa, Borrelia afzelii
AGYIAAKKSVSSKIG

SEQ ID NO: 186778 - protein, 15 aa, Borrelia afzelii
GYIAAKKSVSSKIGF

SEQ ID NO: 186779 - protein, 15 aa, Borrelia afzelii
YIAAKKSVSSKIGFI

SEQ ID NO: 186780 - protein, 15 aa, Borrelia afzelii
IAAKKSVSSKIGFIG

SEQ ID NO: 186781 - protein, 15 aa, Borrelia afzelii
AAKKSVSSKIGFIGG

SEQ ID NO: 186782 - protein, 15 aa, Borrelia afzelii
AKKSVSSKIGFIGGV

SEQ ID NO: 186783 - protein, 15 aa, Borrelia afzelii
KKSVSSKIGFIGGVK

SEQ ID NO: 186784 - protein, 15 aa, Borrelia afzelii
KSVSSKIGFIGGVKG

SEQ ID NO: 186785 - protein, 15 aa, Borrelia afzelii
SVSSKIGFIGGVKGD

SEQ ID NO: 186786 - protein, 15 aa, Borrelia afzelii
VSSKIGFIGGVKGDI

SEQ ID NO: 186787 - protein, 15 aa, Borrelia afzelii
SSKIGFIGGVKGDIV

SEQ ID NO: 186788 - protein, 15 aa, Borrelia afzelii
SKIGFIGGVKGDIVD

SEQ ID NO: 186789 - protein, 15 aa, Borrelia afzelii
KIGFIGGVKGDIVDA

SEQ ID NO: 186790 - protein, 15 aa, Borrelia afzelii
IGFIGGVKGDIVDAF

SEQ ID NO: 186791 - protein, 15 aa, Borrelia afzelii
GFIGGVKGDIVDAFR

SEQ ID NO: 186792 - protein, 15 aa, Borrelia afzelii
FIGGVKGDIVDAFRY

SEQ ID NO: 186793 - protein, 15 aa, Borrelia afzelii
IGGVKGDIVDAFRYG

SEQ ID NO: 186794 - protein, 15 aa, Borrelia afzelii
GGVKGDIVDAFRYGY

SEQ ID NO: 186795 - protein, 15 aa, Borrelia afzelii
GVKGDIVDAFRYGYE

SEQ ID NO: 186796 - protein, 15 aa, Borrelia afzelii
VKGDIVDAFRYGYEA

SEQ ID NO: 186797 - protein, 15 aa, Borrelia afzelii
KGDIVDAFRYGYEAG

SEQ ID NO: 186798 - protein, 15 aa, Borrelia afzelii
GDIVDAFRYGYEAGA

SEQ ID NO: 186799 - protein, 15 aa, Borrelia afzelii
DIVDAFRYGYEAGAK

SEQ ID NO: 186800 - protein, 15 aa, Borrelia afzelii
IVDAFRYGYEAGAKY

SEQ ID NO: 186801 - protein, 15 aa, Borrelia afzelii
VDAFRYGYEAGAKYA

SEQ ID NO: 186802 - protein, 15 aa, Borrelia afzelii
DAFRYGYEAGAKYAN

SEQ ID NO: 186803 - protein, 15 aa, Borrelia afzelii
AFRYGYEAGAKYANK

SEQ ID NO: 186804 - protein, 15 aa, Borrelia afzelii
FRYGYEAGAKYANKG

SEQ ID NO: 186805 - protein, 15 aa, Borrelia afzelii
RYGYEAGAKYANKGI

SEQ ID NO: 186806 - protein, 15 aa, Borrelia afzelii
YGYEAGAKYANKGIE

SEQ ID NO: 186807 - protein, 15 aa, Borrelia afzelii
GYEAGAKYANKGIEI

SEQ ID NO: 186808 - protein, 15 aa, Borrelia afzelii
YEAGAKYANKGIEIV

SEQ ID NO: 186809 - protein, 15 aa, Borrelia afzelii
EAGAKYANKGIEIVS

SEQ ID NO: 186810 - protein, 15 aa, Borrelia afzelii
AGAKYANKGIEIVSE

SEQ ID NO: 186811 - protein, 15 aa, Borrelia afzelii
GAKYANKGIEIVSEY

SEQ ID NO: 186812 - protein, 15 aa, Borrelia afzelii
AKYANKGIEIVSEYS

SEQ ID NO: 186813 - protein, 15 aa, Borrelia afzelii
KYANKGIEIVSEYSN

SEQ ID NO: 186814 - protein, 15 aa, Borrelia afzelii
YANKGIEIVSEYSNS

SEQ ID NO: 186815 - protein, 15 aa, Borrelia afzelii
ANKGIEIVSEYSNSF

SEQ ID NO: 186816 - protein, 15 aa, Borrelia afzelii
NKGIEIVSEYSNSFS

SEQ ID NO: 186817 - protein, 15 aa, Borrelia afzelii
KGIEIVSEYSNSFSD

SEQ ID NO: 186818 - protein, 15 aa, Borrelia afzelii
GIEIVSEYSNSFSDI

SEQ ID NO: 186819 - protein, 15 aa, Borrelia afzelii
IEIVSEYSNSFSDID

SEQ ID NO: 186820 - protein, 15 aa, Borrelia afzelii
EIVSEYSNSFSDIDI

SEQ ID NO: 186821 - protein, 15 aa, Borrelia afzelii
IVSEYSNSFSDIDIA

SEQ ID NO: 186822 - protein, 15 aa, Borrelia afzelii
VSEYSNSFSDIDIAR

SEQ ID NO: 186823 - protein, 15 aa, Borrelia afzelii
SEYSNSFSDIDIARV

SEQ ID NO: 186824 - protein, 15 aa, Borrelia afzelii
EYSNSFSDIDIARVM

SEQ ID NO: 186825 - protein, 15 aa, Borrelia afzelii
YSNSFSDIDIARVMA

SEQ ID NO: 186826 - protein, 15 aa, Borrelia afzelii
SNSFSDIDIARVMAN

SEQ ID NO: 186827 - protein, 15 aa, Borrelia afzelii
NSFSDIDIARVMANK

SEQ ID NO: 186828 - protein, 15 aa, Borrelia afzelii
SFSDIDIARVMANKM

SEQ ID NO: 186829 - protein, 15 aa, Borrelia afzelii
FSDIDIARVMANKMY

SEQ ID NO: 186830 - protein, 15 aa, Borrelia afzelii
SDIDIARVMANKMYS

SEQ ID NO: 186831 - protein, 15 aa, Borrelia afzelii
DIDIARVMANKMYSK

SEQ ID NO: 186832 - protein, 15 aa, Borrelia afzelii
IDIARVMANKMYSKG

SEQ ID NO: 186833 - protein, 15 aa, Borrelia afzelii
DIARVMANKMYSKGI

SEQ ID NO: 186834 - protein, 15 aa, Borrelia afzelii
IARVMANKMYSKGID

SEQ ID NO: 186835 - protein, 15 aa, Borrelia afzelii
ARVMANKMYSKGIDI

SEQ ID NO: 186836 - protein, 15 aa, Borrelia afzelii
RVMANKMYSKGIDII

SEQ ID NO: 186837 - protein, 15 aa, Borrelia afzelii
VMANKMYSKGIDIIH

SEQ ID NO: 186838 - protein, 15 aa, Borrelia afzelii
MANKMYSKGIDIIHF

SEQ ID NO: 186839 - protein, 15 aa, Borrelia afzelii
ANKMYSKGIDIIHFA

SEQ ID NO: 186840 - protein, 15 aa, Borrelia afzelii
NKMYSKGIDIIHFAA

SEQ ID NO: 186841 - protein, 15 aa, Borrelia afzelii
KMYSKGIDIIHFAAG

SEQ ID NO: 186842 - protein, 15 aa, Borrelia afzelii
MYSKGIDIIHFAAGL

SEQ ID NO: 186843 - protein, 15 aa, Borrelia afzelii
YSKGIDIIHFAAGLA

SEQ ID NO: 186844 - protein, 15 aa, Borrelia afzelii
SKGIDIIHFAAGLAG

SEQ ID NO: 186845 - protein, 15 aa, Borrelia afzelii
KGIDIIHFAAGLAGV

SEQ ID NO: 186846 - protein, 15 aa, Borrelia afzelii
GIDIIHFAAGLAGVG

SEQ ID NO: 186847 - protein, 15 aa, Borrelia afzelii
IDIIHFAAGLAGVGV

SEQ ID NO: 186848 - protein, 15 aa, Borrelia afzelii
DIIHFAAGLAGVGVI

SEQ ID NO: 186849 - protein, 15 aa, Borrelia afzelii
IIHFAAGLAGVGVIE

SEQ ID NO: 186850 - protein, 15 aa, Borrelia afzelii
IHFAAGLAGVGVIEA

SEQ ID NO: 186851 - protein, 15 aa, Borrelia afzelii
HFAAGLAGVGVIEAA

SEQ ID NO: 186852 - protein, 15 aa, Borrelia afzelii
FAAGLAGVGVIEAAK

SEQ ID NO: 186853 - protein, 15 aa, Borrelia afzelii
AAGLAGVGVIEAAKE

SEQ ID NO: 186854 - protein, 15 aa, Borrelia afzelii
AGLAGVGVIEAAKEL

SEQ ID NO: 186855 - protein, 15 aa, Borrelia afzelii
GLAGVGVIEAAKELG

SEQ ID NO: 186856 - protein, 15 aa, Borrelia afzelii
LAGVGVIEAAKELGD

SEQ ID NO: 186857 - protein, 15 aa, Borrelia afzelii
AGVGVIEAAKELGDG

SEQ ID NO: 186858 - protein, 15 aa, Borrelia afzelii
GVGVIEAAKELGDGY

SEQ ID NO: 186859 - protein, 15 aa, Borrelia afzelii
VGVIEAAKELGDGYY

SEQ ID NO: 186860 - protein, 15 aa, Borrelia afzelii
GVIEAAKELGDGYYV

SEQ ID NO: 186861 - protein, 15 aa, Borrelia afzelii
VIEAAKELGDGYYVI

SEQ ID NO: 186862 - protein, 15 aa, Borrelia afzelii
IEAAKELGDGYYVIG

SEQ ID NO: 186863 - protein, 15 aa, Borrelia afzelii
EAAKELGDGYYVIGA

SEQ ID NO: 186864 - protein, 15 aa, Borrelia afzelii
AAKELGDGYYVIGAD

SEQ ID NO: 186865 - protein, 15 aa, Borrelia afzelii
AKELGDGYYVIGADQ

SEQ ID NO: 186866 - protein, 15 aa, Borrelia afzelii
KELGDGYYVIGADQD

SEQ ID NO: 186867 - protein, 15 aa, Borrelia afzelii
ELGDGYYVIGADQDQ

SEQ ID NO: 186868 - protein, 15 aa, Borrelia afzelii
LGDGYYVIGADQDQS

SEQ ID NO: 186869 - protein, 15 aa, Borrelia afzelii
GDGYYVIGADQDQSH

SEQ ID NO: 186870 - protein, 15 aa, Borrelia afzelii
DGYYVIGADQDQSHL

SEQ ID NO: 186871 - protein, 15 aa, Borrelia afzelii
GYYVIGADQDQSHLA

SEQ ID NO: 186872 - protein, 15 aa, Borrelia afzelii
YYVIGADQDQSHLAP

SEQ ID NO: 186873 - protein, 15 aa, Borrelia afzelii
YVIGADQDQSHLAPK

SEQ ID NO: 186874 - protein, 15 aa, Borrelia afzelii
VIGADQDQSHLAPKN

SEQ ID NO: 186875 - protein, 15 aa, Borrelia afzelii
IGADQDQSHLAPKNF

SEQ ID NO: 186876 - protein, 15 aa, Borrelia afzelii
GADQDQSHLAPKNFI

SEQ ID NO: 186877 - protein, 15 aa, Borrelia afzelii
ADQDQSHLAPKNFIT

SEQ ID NO: 186878 - protein, 15 aa, Borrelia afzelii
DQDQSHLAPKNFITS

SEQ ID NO: 186879 - protein, 15 aa, Borrelia afzelii
QDQSHLAPKNFITSV

SEQ ID NO: 186880 - protein, 15 aa, Borrelia afzelii
DQSHLAPKNFITSVI

SEQ ID NO: 186881 - protein, 15 aa, Borrelia afzelii
QSHLAPKNFITSVIK

SEQ ID NO: 186882 - protein, 15 aa, Borrelia afzelii
SHLAPKNFITSVIKN

SEQ ID NO: 186883 - protein, 15 aa, Borrelia afzelii
HLAPKNFITSVIKNV

SEQ ID NO: 186884 - protein, 15 aa, Borrelia afzelii
LAPKNFITSVIKNVG

SEQ ID NO: 186885 - protein, 15 aa, Borrelia afzelii
APKNFITSVIKNVGD

SEQ ID NO: 186886 - protein, 15 aa, Borrelia afzelii
PKNFITSVIKNVGDA

SEQ ID NO: 186887 - protein, 15 aa, Borrelia afzelii
KNFITSVIKNVGDAL

SEQ ID NO: 186888 - protein, 15 aa, Borrelia afzelii
NFITSVIKNVGDALY

SEQ ID NO: 186889 - protein, 15 aa, Borrelia afzelii
FITSVIKNVGDALYL

SEQ ID NO: 186890 - protein, 15 aa, Borrelia afzelii
ITSVIKNVGDALYLI

SEQ ID NO: 186891 - protein, 15 aa, Borrelia afzelii
TSVIKNVGDALYLIT

SEQ ID NO: 186892 - protein, 15 aa, Borrelia afzelii
SVIKNVGDALYLITS

SEQ ID NO: 186893 - protein, 15 aa, Borrelia afzelii
VIKNVGDALYLITSE

SEQ ID NO: 186894 - protein, 15 aa, Borrelia afzelii
IKNVGDALYLITSES

SEQ ID NO: 186895 - protein, 15 aa, Borrelia afzelii
KNVGDALYLITSESL

SEQ ID NO: 186896 - protein, 15 aa, Borrelia afzelii
NVGDALYLITSESLK

SEQ ID NO: 186897 - protein, 15 aa, Borrelia afzelii
VGDALYLITSESLKN

SEQ ID NO: 186898 - protein, 15 aa, Borrelia afzelii
GDALYLITSESLKND

SEQ ID NO: 186899 - protein, 15 aa, Borrelia afzelii
DALYLITSESLKNDN

SEQ ID NO: 186900 - protein, 15 aa, Borrelia afzelii
ALYLITSESLKNDNV

SEQ ID NO: 186901 - protein, 15 aa, Borrelia afzelii
LYLITSESLKNDNVW

SEQ ID NO: 186902 - protein, 15 aa, Borrelia afzelii
YLITSESLKNDNVWE

SEQ ID NO: 186903 - protein, 15 aa, Borrelia afzelii
LITSESLKNDNVWEG

SEQ ID NO: 186904 - protein, 15 aa, Borrelia afzelii
ITSESLKNDNVWEGG

SEQ ID NO: 186905 - protein, 15 aa, Borrelia afzelii
TSESLKNDNVWEGGK

SEQ ID NO: 186906 - protein, 15 aa, Borrelia afzelii
SESLKNDNVWEGGKI

SEQ ID NO: 186907 - protein, 15 aa, Borrelia afzelii
ESLKNDNVWEGGKIV

SEQ ID NO: 186908 - protein, 15 aa, Borrelia afzelii
SLKNDNVWEGGKIVQ

SEQ ID NO: 186909 - protein, 15 aa, Borrelia afzelii
LKNDNVWEGGKIVQM

SEQ ID NO: 186910 - protein, 15 aa, Borrelia afzelii
KNDNVWEGGKIVQMG

SEQ ID NO: 186911 - protein, 15 aa, Borrelia afzelii
NDNVWEGGKIVQMGL

SEQ ID NO: 186912 - protein, 15 aa, Borrelia afzelii
DNVWEGGKIVQMGLR

SEQ ID NO: 186913 - protein, 15 aa, Borrelia afzelii
NVWEGGKIVQMGLRD

SEQ ID NO: 186914 - protein, 15 aa, Borrelia afzelii
VWEGGKIVQMGLRDG

SEQ ID NO: 186915 - protein, 15 aa, Borrelia afzelii
WEGGKIVQMGLRDGV

SEQ ID NO: 186916 - protein, 15 aa, Borrelia afzelii
EGGKIVQMGLRDGVV

SEQ ID NO: 186917 - protein, 15 aa, Borrelia afzelii
GGKIVQMGLRDGVVG

SEQ ID NO: 186918 - protein, 15 aa, Borrelia afzelii
GKIVQMGLRDGVVGL

SEQ ID NO: 186919 - protein, 15 aa, Borrelia afzelii
KIVQMGLRDGVVGLS

SEQ ID NO: 186920 - protein, 15 aa, Borrelia afzelii
IVQMGLRDGVVGLSN

SEQ ID NO: 186921 - protein, 15 aa, Borrelia afzelii
VQMGLRDGVVGLSNA

SEQ ID NO: 186922 - protein, 15 aa, Borrelia afzelii
QMGLRDGVVGLSNAN

SEQ ID NO: 186923 - protein, 15 aa, Borrelia afzelii
MGLRDGVVGLSNANE

SEQ ID NO: 186924 - protein, 15 aa, Borrelia afzelii
GLRDGVVGLSNANEF

SEQ ID NO: 186925 - protein, 15 aa, Borrelia afzelii
LRDGVVGLSNANEFE

SEQ ID NO: 186926 - protein, 15 aa, Borrelia afzelii
RDGVVGLSNANEFEY

SEQ ID NO: 186927 - protein, 15 aa, Borrelia afzelii
DGVVGLSNANEFEYI

SEQ ID NO: 186928 - protein, 15 aa, Borrelia afzelii
GVVGLSNANEFEYIK

SEQ ID NO: 186929 - protein, 15 aa, Borrelia afzelii
VVGLSNANEFEYIKD

SEQ ID NO: 186930 - protein, 15 aa, Borrelia afzelii
VGLSNANEFEYIKDL

SEQ ID NO: 186931 - protein, 15 aa, Borrelia afzelii
GLSNANEFEYIKDLE

SEQ ID NO: 186932 - protein, 15 aa, Borrelia afzelii
LSNANEFEYIKDLER

SEQ ID NO: 186933 - protein, 15 aa, Borrelia afzelii
SNANEFEYIKDLERK

SEQ ID NO: 186934 - protein, 15 aa, Borrelia afzelii
NANEFEYIKDLERKI

SEQ ID NO: 186935 - protein, 15 aa, Borrelia afzelii
ANEFEYIKDLERKII

SEQ ID NO: 186936 - protein, 15 aa, Borrelia afzelii
NEFEYIKDLERKIIN

SEQ ID NO: 186937 - protein, 15 aa, Borrelia afzelii
EFEYIKDLERKIINK

SEQ ID NO: 186938 - protein, 15 aa, Borrelia afzelii
FEYIKDLERKIINKE

SEQ ID NO: 186939 - protein, 15 aa, Borrelia afzelii
EYIKDLERKIINKEI

SEQ ID NO: 186940 - protein, 15 aa, Borrelia afzelii
YIKDLERKIINKEII

SEQ ID NO: 186941 - protein, 15 aa, Borrelia afzelii
IKDLERKIINKEIIV

SEQ ID NO: 186942 - protein, 15 aa, Borrelia afzelii
KDLERKIINKEIIVP

SEQ ID NO: 186943 - protein, 15 aa, Borrelia afzelii
DLERKIINKEIIVPC

SEQ ID NO: 186944 - protein, 15 aa, Borrelia afzelii
LERKIINKEIIVPCN

SEQ ID NO: 186945 - protein, 15 aa, Borrelia afzelii
ERKIINKEIIVPCNQ

SEQ ID NO: 186946 - protein, 15 aa, Borrelia afzelii
RKIINKEIIVPCNQE

SEQ ID NO: 186947 - protein, 15 aa, Borrelia afzelii
KIINKEIIVPCNQEG

SEQ ID NO: 186948 - protein, 15 aa, Borrelia afzelii
IINKEIIVPCNQEGY

SEQ ID NO: 186949 - protein, 15 aa, Borrelia afzelii
INKEIIVPCNQEGYE

SEQ ID NO: 186950 - protein, 15 aa, Borrelia afzelii
NKEIIVPCNQEGYEI

SEQ ID NO: 186951 - protein, 15 aa, Borrelia afzelii
KEIIVPCNQEGYEIF

SEQ ID NO: 186952 - protein, 15 aa, Borrelia afzelii
EIIVPCNQEGYEIFI

SEQ ID NO: 186953 - protein, 15 aa, Borrelia afzelii
IIVPCNQEGYEIFIK

SEQ ID NO: 186954 - protein, 15 aa, Borrelia afzelii
IVPCNQEGYEIFIKQ

SEQ ID NO: 186955 - protein, 15 aa, Borrelia afzelii
VPCNQEGYEIFIKQI

SEQ ID NO: 186956 - protein, 15 aa, Borrelia afzelii
PCNQEGYEIFIKQIL

SEQ ID NO: 186957 - protein, 15 aa, Borrelia afzelii
CNQEGYEIFIKQILK

SEQ ID NO: 186958 - protein, 15 aa, Borrelia afzelii
NQEGYEIFIKQILKL

SEQ ID NO: 186959 - protein, 16 aa, Borrelia afzelii
MRIAIFIFGILLTSCF

SEQ ID NO: 186960 - protein, 16 aa, Borrelia afzelii
RIAIFIFGILLTSCFS

SEQ ID NO: 186961 - protein, 16 aa, Borrelia afzelii
IAIFIFGILLTSCFSK

SEQ ID NO: 186962 - protein, 16 aa, Borrelia afzelii
AIFIFGILLTSCFSKN

SEQ ID NO: 186963 - protein, 16 aa, Borrelia afzelii
IFIFGILLTSCFSKNG

SEQ ID NO: 186964 - protein, 16 aa, Borrelia afzelii
FIFGILLTSCFSKNGI

SEQ ID NO: 186965 - protein, 16 aa, Borrelia afzelii
IFGILLTSCFSKNGIE

SEQ ID NO: 186966 - protein, 16 aa, Borrelia afzelii
FGILLTSCFSKNGIES

SEQ ID NO: 186967 - protein, 16 aa, Borrelia afzelii
GILLTSCFSKNGIESG

SEQ ID NO: 186968 - protein, 16 aa, Borrelia afzelii
ILLTSCFSKNGIESGS

SEQ ID NO: 186969 - protein, 16 aa, Borrelia afzelii
LLTSCFSKNGIESGSS

SEQ ID NO: 186970 - protein, 16 aa, Borrelia afzelii
LTSCFSKNGIESGSSK

SEQ ID NO: 186971 - protein, 16 aa, Borrelia afzelii
TSCFSKNGIESGSSKI

SEQ ID NO: 186972 - protein, 16 aa, Borrelia afzelii
SCFSKNGIESGSSKIK

SEQ ID NO: 186973 - protein, 16 aa, Borrelia afzelii
CFSKNGIESGSSKIKI

SEQ ID NO: 186974 - protein, 16 aa, Borrelia afzelii
FSKNGIESGSSKIKIS

SEQ ID NO: 186975 - protein, 16 aa, Borrelia afzelii
SKNGIESGSSKIKISM

SEQ ID NO: 186976 - protein, 16 aa, Borrelia afzelii
KNGIESGSSKIKISML

SEQ ID NO: 186977 - protein, 16 aa, Borrelia afzelii
NGIESGSSKIKISMLV

SEQ ID NO: 186978 - protein, 16 aa, Borrelia afzelii
GIESGSSKIKISMLVD

SEQ ID NO: 186979 - protein, 16 aa, Borrelia afzelii
IESGSSKIKISMLVDG

SEQ ID NO: 186980 - protein, 16 aa, Borrelia afzelii
ESGSSKIKISMLVDGV

SEQ ID NO: 186981 - protein, 16 aa, Borrelia afzelii
SGSSKIKISMLVDGVL

SEQ ID NO: 186982 - protein, 16 aa, Borrelia afzelii
GSSKIKISMLVDGVLD

SEQ ID NO: 186983 - protein, 16 aa, Borrelia afzelii
SSKIKISMLVDGVLDD

SEQ ID NO: 186984 - protein, 16 aa, Borrelia afzelii
SKIKISMLVDGVLDDK

SEQ ID NO: 186985 - protein, 16 aa, Borrelia afzelii
KIKISMLVDGVLDDKS

SEQ ID NO: 186986 - protein, 16 aa, Borrelia afzelii
IKISMLVDGVLDDKSF

SEQ ID NO: 186987 - protein, 16 aa, Borrelia afzelii
KISMLVDGVLDDKSFN

SEQ ID NO: 186988 - protein, 16 aa, Borrelia afzelii
ISMLVDGVLDDKSFNS

SEQ ID NO: 186989 - protein, 16 aa, Borrelia afzelii
SMLVDGVLDDKSFNSS

SEQ ID NO: 186990 - protein, 16 aa, Borrelia afzelii
MLVDGVLDDKSFNSSA

SEQ ID NO: 186991 - protein, 16 aa, Borrelia afzelii
LVDGVLDDKSFNSSAN

SEQ ID NO: 186992 - protein, 16 aa, Borrelia afzelii
VDGVLDDKSFNSSANE

SEQ ID NO: 186993 - protein, 16 aa, Borrelia afzelii
DGVLDDKSFNSSANEA

SEQ ID NO: 186994 - protein, 16 aa, Borrelia afzelii
GVLDDKSFNSSANEAL

SEQ ID NO: 186995 - protein, 16 aa, Borrelia afzelii
VLDDKSFNSSANEALL

SEQ ID NO: 186996 - protein, 16 aa, Borrelia afzelii
LDDKSFNSSANEALLR

SEQ ID NO: 186997 - protein, 16 aa, Borrelia afzelii
DDKSFNSSANEALLRL

SEQ ID NO: 186998 - protein, 16 aa, Borrelia afzelii
DKSFNSSANEALLRLK

SEQ ID NO: 186999 - protein, 16 aa, Borrelia afzelii
KSFNSSANEALLRLKK

SEQ ID NO: 187000 - protein, 16 aa, Borrelia afzelii
SFNSSANEALLRLKKD

SEQ ID NO: 187001 - protein, 16 aa, Borrelia afzelii
FNSSANEALLRLKKDF

SEQ ID NO: 187002 - protein, 16 aa, Borrelia afzelii
NSSANEALLRLKKDFP

SEQ ID NO: 187003 - protein, 16 aa, Borrelia afzelii
SSANEALLRLKKDFPE

SEQ ID NO: 187004 - protein, 16 aa, Borrelia afzelii
SANEALLRLKKDFPEN

SEQ ID NO: 187005 - protein, 16 aa, Borrelia afzelii
ANEALLRLKKDFPENI

SEQ ID NO: 187006 - protein, 16 aa, Borrelia afzelii
NEALLRLKKDFPENIE

SEQ ID NO: 187007 - protein, 16 aa, Borrelia afzelii
EALLRLKKDFPENIEK

SEQ ID NO: 187008 - protein, 16 aa, Borrelia afzelii
ALLRLKKDFPENIEKV

SEQ ID NO: 187009 - protein, 16 aa, Borrelia afzelii
LLRLKKDFPENIEKVF

SEQ ID NO: 187010 - protein, 16 aa, Borrelia afzelii
LRLKKDFPENIEKVFS

SEQ ID NO: 187011 - protein, 16 aa, Borrelia afzelii
RLKKDFPENIEKVFSS

SEQ ID NO: 187012 - protein, 16 aa, Borrelia afzelii
LKKDFPENIEKVFSSA

SEQ ID NO: 187013 - protein, 16 aa, Borrelia afzelii
KKDFPENIEKVFSSAV

SEQ ID NO: 187014 - protein, 16 aa, Borrelia afzelii
KDFPENIEKVFSSAVS

SEQ ID NO: 187015 - protein, 16 aa, Borrelia afzelii
DFPENIEKVFSSAVSG

SEQ ID NO: 187016 - protein, 16 aa, Borrelia afzelii
FPENIEKVFSSAVSGV

SEQ ID NO: 187017 - protein, 16 aa, Borrelia afzelii
PENIEKVFSSAVSGVY

SEQ ID NO: 187018 - protein, 16 aa, Borrelia afzelii
ENIEKVFSSAVSGVYS

SEQ ID NO: 187019 - protein, 16 aa, Borrelia afzelii
NIEKVFSSAVSGVYSS

SEQ ID NO: 187020 - protein, 16 aa, Borrelia afzelii
IEKVFSSAVSGVYSSY

SEQ ID NO: 187021 - protein, 16 aa, Borrelia afzelii
EKVFSSAVSGVYSSYV

SEQ ID NO: 187022 - protein, 16 aa, Borrelia afzelii
KVFSSAVSGVYSSYVS

SEQ ID NO: 187023 - protein, 16 aa, Borrelia afzelii
VFSSAVSGVYSSYVSD

SEQ ID NO: 187024 - protein, 16 aa, Borrelia afzelii
FSSAVSGVYSSYVSDL

SEQ ID NO: 187025 - protein, 16 aa, Borrelia afzelii
SSAVSGVYSSYVSDLD

SEQ ID NO: 187026 - protein, 16 aa, Borrelia afzelii
SAVSGVYSSYVSDLDN

SEQ ID NO: 187027 - protein, 16 aa, Borrelia afzelii
AVSGVYSSYVSDLDNL

SEQ ID NO: 187028 - protein, 16 aa, Borrelia afzelii
VSGVYSSYVSDLDNLK

SEQ ID NO: 187029 - protein, 16 aa, Borrelia afzelii
SGVYSSYVSDLDNLKM

SEQ ID NO: 187030 - protein, 16 aa, Borrelia afzelii
GVYSSYVSDLDNLKMN

SEQ ID NO: 187031 - protein, 16 aa, Borrelia afzelii
VYSSYVSDLDNLKMNG

SEQ ID NO: 187032 - protein, 16 aa, Borrelia afzelii
YSSYVSDLDNLKMNGS

SEQ ID NO: 187033 - protein, 16 aa, Borrelia afzelii
SSYVSDLDNLKMNGSG

SEQ ID NO: 187034 - protein, 16 aa, Borrelia afzelii
SYVSDLDNLKMNGSGL

SEQ ID NO: 187035 - protein, 16 aa, Borrelia afzelii
YVSDLDNLKMNGSGLI

SEQ ID NO: 187036 - protein, 16 aa, Borrelia afzelii
VSDLDNLKMNGSGLIW

SEQ ID NO: 187037 - protein, 16 aa, Borrelia afzelii
SDLDNLKMNGSGLIWL

SEQ ID NO: 187038 - protein, 16 aa, Borrelia afzelii
DLDNLKMNGSGLIWLV

SEQ ID NO: 187039 - protein, 16 aa, Borrelia afzelii
LDNLKMNGSGLIWLVG

SEQ ID NO: 187040 - protein, 16 aa, Borrelia afzelii
DNLKMNGSGLIWLVGY

SEQ ID NO: 187041 - protein, 16 aa, Borrelia afzelii
NLKMNGSGLIWLVGYM

SEQ ID NO: 187042 - protein, 16 aa, Borrelia afzelii
LKMNGSGLIWLVGYML

SEQ ID NO: 187043 - protein, 16 aa, Borrelia afzelii
KMNGSGLIWLVGYMLA

SEQ ID NO: 187044 - protein, 16 aa, Borrelia afzelii
MNGSGLIWLVGYMLAD

SEQ ID NO: 187045 - protein, 16 aa, Borrelia afzelii
NGSGLIWLVGYMLADV

SEQ ID NO: 187046 - protein, 16 aa, Borrelia afzelii
GSGLIWLVGYMLADVS

SEQ ID NO: 187047 - protein, 16 aa, Borrelia afzelii
SGLIWLVGYMLADVSL

SEQ ID NO: 187048 - protein, 16 aa, Borrelia afzelii
GLIWLVGYMLADVSLS

SEQ ID NO: 187049 - protein, 16 aa, Borrelia afzelii
LIWLVGYMLADVSLSV

SEQ ID NO: 187050 - protein, 16 aa, Borrelia afzelii
IWLVGYMLADVSLSVS

SEQ ID NO: 187051 - protein, 16 aa, Borrelia afzelii
WLVGYMLADVSLSVSL

SEQ ID NO: 187052 - protein, 16 aa, Borrelia afzelii
LVGYMLADVSLSVSLE

SEQ ID NO: 187053 - protein, 16 aa, Borrelia afzelii
VGYMLADVSLSVSLEN

SEQ ID NO: 187054 - protein, 16 aa, Borrelia afzelii
GYMLADVSLSVSLENP

SEQ ID NO: 187055 - protein, 16 aa, Borrelia afzelii
YMLADVSLSVSLENPE

SEQ ID NO: 187056 - protein, 16 aa, Borrelia afzelii
MLADVSLSVSLENPEI

SEQ ID NO: 187057 - protein, 16 aa, Borrelia afzelii
LADVSLSVSLENPEIN

SEQ ID NO: 187058 - protein, 16 aa, Borrelia afzelii
ADVSLSVSLENPEINY

SEQ ID NO: 187059 - protein, 16 aa, Borrelia afzelii
DVSLSVSLENPEINYG

SEQ ID NO: 187060 - protein, 16 aa, Borrelia afzelii
VSLSVSLENPEINYGI

SEQ ID NO: 187061 - protein, 16 aa, Borrelia afzelii
SLSVSLENPEINYGII

SEQ ID NO: 187062 - protein, 16 aa, Borrelia afzelii
LSVSLENPEINYGIID

SEQ ID NO: 187063 - protein, 16 aa, Borrelia afzelii
SVSLENPEINYGIIDP

SEQ ID NO: 187064 - protein, 16 aa, Borrelia afzelii
VSLENPEINYGIIDPI

SEQ ID NO: 187065 - protein, 16 aa, Borrelia afzelii
SLENPEINYGIIDPIY

SEQ ID NO: 187066 - protein, 16 aa, Borrelia afzelii
LENPEINYGIIDPIYG

SEQ ID NO: 187067 - protein, 16 aa, Borrelia afzelii
ENPEINYGIIDPIYGD

SEQ ID NO: 187068 - protein, 16 aa, Borrelia afzelii
NPEINYGIIDPIYGDD

SEQ ID NO: 187069 - protein, 16 aa, Borrelia afzelii
PEINYGIIDPIYGDDV

SEQ ID NO: 187070 - protein, 16 aa, Borrelia afzelii
EINYGIIDPIYGDDVQ

SEQ ID NO: 187071 - protein, 16 aa, Borrelia afzelii
INYGIIDPIYGDDVQI

SEQ ID NO: 187072 - protein, 16 aa, Borrelia afzelii
NYGIIDPIYGDDVQIP

SEQ ID NO: 187073 - protein, 16 aa, Borrelia afzelii
YGIIDPIYGDDVQIPK

SEQ ID NO: 187074 - protein, 16 aa, Borrelia afzelii
GIIDPIYGDDVQIPKN

SEQ ID NO: 187075 - protein, 16 aa, Borrelia afzelii
IIDPIYGDDVQIPKNL

SEQ ID NO: 187076 - protein, 16 aa, Borrelia afzelii
IDPIYGDDVQIPKNLI

SEQ ID NO: 187077 - protein, 16 aa, Borrelia afzelii
DPIYGDDVQIPKNLIG

SEQ ID NO: 187078 - protein, 16 aa, Borrelia afzelii
PIYGDDVQIPKNLIGV

SEQ ID NO: 187079 - protein, 16 aa, Borrelia afzelii
IYGDDVQIPKNLIGVV

SEQ ID NO: 187080 - protein, 16 aa, Borrelia afzelii
YGDDVQIPKNLIGVVF

SEQ ID NO: 187081 - protein, 16 aa, Borrelia afzelii
GDDVQIPKNLIGVVFR

SEQ ID NO: 187082 - protein, 16 aa, Borrelia afzelii
DDVQIPKNLIGVVFRI

SEQ ID NO: 187083 - protein, 16 aa, Borrelia afzelii
DVQIPKNLIGVVFRIE

SEQ ID NO: 187084 - protein, 16 aa, Borrelia afzelii
VQIPKNLIGVVFRIEQ

SEQ ID NO: 187085 - protein, 16 aa, Borrelia afzelii
QIPKNLIGVVFRIEQG

SEQ ID NO: 187086 - protein, 16 aa, Borrelia afzelii
IPKNLIGVVFRIEQGA

SEQ ID NO: 187087 - protein, 16 aa, Borrelia afzelii
PKNLIGVVFRIEQGAF

SEQ ID NO: 187088 - protein, 16 aa, Borrelia afzelii
KNLIGVVFRIEQGAFL

SEQ ID NO: 187089 - protein, 16 aa, Borrelia afzelii
NLIGVVFRIEQGAFLA

SEQ ID NO: 187090 - protein, 16 aa, Borrelia afzelii
LIGVVFRIEQGAFLAG

SEQ ID NO: 187091 - protein, 16 aa, Borrelia afzelii
IGVVFRIEQGAFLAGY

SEQ ID NO: 187092 - protein, 16 aa, Borrelia afzelii
GVVFRIEQGAFLAGYI

SEQ ID NO: 187093 - protein, 16 aa, Borrelia afzelii
VVFRIEQGAFLAGYIA

SEQ ID NO: 187094 - protein, 16 aa, Borrelia afzelii
VFRIEQGAFLAGYIAA

SEQ ID NO: 187095 - protein, 16 aa, Borrelia afzelii
FRIEQGAFLAGYIAAK

SEQ ID NO: 187096 - protein, 16 aa, Borrelia afzelii
RIEQGAFLAGYIAAKK

SEQ ID NO: 187097 - protein, 16 aa, Borrelia afzelii
IEQGAFLAGYIAAKKS

SEQ ID NO: 187098 - protein, 16 aa, Borrelia afzelii
EQGAFLAGYIAAKKSV

SEQ ID NO: 187099 - protein, 16 aa, Borrelia afzelii
QGAFLAGYIAAKKSVS

SEQ ID NO: 187100 - protein, 16 aa, Borrelia afzelii
GAFLAGYIAAKKSVSS

SEQ ID NO: 187101 - protein, 16 aa, Borrelia afzelii
AFLAGYIAAKKSVSSK

SEQ ID NO: 187102 - protein, 16 aa, Borrelia afzelii
FLAGYIAAKKSVSSKI

SEQ ID NO: 187103 - protein, 16 aa, Borrelia afzelii
LAGYIAAKKSVSSKIG

SEQ ID NO: 187104 - protein, 16 aa, Borrelia afzelii
AGYIAAKKSVSSKIGF

SEQ ID NO: 187105 - protein, 16 aa, Borrelia afzelii
GYIAAKKSVSSKIGFI

SEQ ID NO: 187106 - protein, 16 aa, Borrelia afzelii
YIAAKKSVSSKIGFIG

SEQ ID NO: 187107 - protein, 16 aa, Borrelia afzelii
IAAKKSVSSKIGFIGG

SEQ ID NO: 187108 - protein, 16 aa, Borrelia afzelii
AAKKSVSSKIGFIGGV

SEQ ID NO: 187109 - protein, 16 aa, Borrelia afzelii
AKKSVSSKIGFIGGVK

SEQ ID NO: 187110 - protein, 16 aa, Borrelia afzelii
KKSVSSKIGFIGGVKG

SEQ ID NO: 187111 - protein, 16 aa, Borrelia afzelii
KSVSSKIGFIGGVKGD

SEQ ID NO: 187112 - protein, 16 aa, Borrelia afzelii
SVSSKIGFIGGVKGDI

SEQ ID NO: 187113 - protein, 16 aa, Borrelia afzelii
VSSKIGFIGGVKGDIV

SEQ ID NO: 187114 - protein, 16 aa, Borrelia afzelii
SSKIGFIGGVKGDIVD

SEQ ID NO: 187115 - protein, 16 aa, Borrelia afzelii
SKIGFIGGVKGDIVDA

SEQ ID NO: 187116 - protein, 16 aa, Borrelia afzelii
KIGFIGGVKGDIVDAF

SEQ ID NO: 187117 - protein, 16 aa, Borrelia afzelii
IGFIGGVKGDIVDAFR

SEQ ID NO: 187118 - protein, 16 aa, Borrelia afzelii
GFIGGVKGDIVDAFRY

SEQ ID NO: 187119 - protein, 16 aa, Borrelia afzelii
FIGGVKGDIVDAFRYG

SEQ ID NO: 187120 - protein, 16 aa, Borrelia afzelii
IGGVKGDIVDAFRYGY

SEQ ID NO: 187121 - protein, 16 aa, Borrelia afzelii
GGVKGDIVDAFRYGYE

SEQ ID NO: 187122 - protein, 16 aa, Borrelia afzelii
GVKGDIVDAFRYGYEA

SEQ ID NO: 187123 - protein, 16 aa, Borrelia afzelii
VKGDIVDAFRYGYEAG

SEQ ID NO: 187124 - protein, 16 aa, Borrelia afzelii
KGDIVDAFRYGYEAGA

SEQ ID NO: 187125 - protein, 16 aa, Borrelia afzelii
GDIVDAFRYGYEAGAK

SEQ ID NO: 187126 - protein, 16 aa, Borrelia afzelii
DIVDAFRYGYEAGAKY

SEQ ID NO: 187127 - protein, 16 aa, Borrelia afzelii
IVDAFRYGYEAGAKYA

SEQ ID NO: 187128 - protein, 16 aa, Borrelia afzelii
VDAFRYGYEAGAKYAN

SEQ ID NO: 187129 - protein, 16 aa, Borrelia afzelii
DAFRYGYEAGAKYANK

SEQ ID NO: 187130 - protein, 16 aa, Borrelia afzelii
AFRYGYEAGAKYANKG

SEQ ID NO: 187131 - protein, 16 aa, Borrelia afzelii
FRYGYEAGAKYANKGI

SEQ ID NO: 187132 - protein, 16 aa, Borrelia afzelii
RYGYEAGAKYANKGIE

SEQ ID NO: 187133 - protein, 16 aa, Borrelia afzelii
YGYEAGAKYANKGIEI

SEQ ID NO: 187134 - protein, 16 aa, Borrelia afzelii
GYEAGAKYANKGIEIV

SEQ ID NO: 187135 - protein, 16 aa, Borrelia afzelii
YEAGAKYANKGIEIVS

SEQ ID NO: 187136 - protein, 16 aa, Borrelia afzelii
EAGAKYANKGIEIVSE

SEQ ID NO: 187137 - protein, 16 aa, Borrelia afzelii
AGAKYANKGIEIVSEY

SEQ ID NO: 187138 - protein, 16 aa, Borrelia afzelii
GAKYANKGIEIVSEYS

SEQ ID NO: 187139 - protein, 16 aa, Borrelia afzelii
AKYANKGIEIVSEYSN

SEQ ID NO: 187140 - protein, 16 aa, Borrelia afzelii
KYANKGIEIVSEYSNS

SEQ ID NO: 187141 - protein, 16 aa, Borrelia afzelii
YANKGIEIVSEYSNSF

SEQ ID NO: 187142 - protein, 16 aa, Borrelia afzelii
ANKGIEIVSEYSNSFS

SEQ ID NO: 187143 - protein, 16 aa, Borrelia afzelii
NKGIEIVSEYSNSFSD

SEQ ID NO: 187144 - protein, 16 aa, Borrelia afzelii
KGIEIVSEYSNSFSDI

SEQ ID NO: 187145 - protein, 16 aa, Borrelia afzelii
GIEIVSEYSNSFSDID

SEQ ID NO: 187146 - protein, 16 aa, Borrelia afzelii
IEIVSEYSNSFSDIDI

SEQ ID NO: 187147 - protein, 16 aa, Borrelia afzelii
EIVSEYSNSFSDIDIA

SEQ ID NO: 187148 - protein, 16 aa, Borrelia afzelii
IVSEYSNSFSDIDIAR

SEQ ID NO: 187149 - protein, 16 aa, Borrelia afzelii
VSEYSNSFSDIDIARV

SEQ ID NO: 187150 - protein, 16 aa, Borrelia afzelii
SEYSNSFSDIDIARVM

SEQ ID NO: 187151 - protein, 16 aa, Borrelia afzelii
EYSNSFSDIDIARVMA

SEQ ID NO: 187152 - protein, 16 aa, Borrelia afzelii
YSNSFSDIDIARVMAN

SEQ ID NO: 187153 - protein, 16 aa, Borrelia afzelii
SNSFSDIDIARVMANK

SEQ ID NO: 187154 - protein, 16 aa, Borrelia afzelii
NSFSDIDIARVMANKM

SEQ ID NO: 187155 - protein, 16 aa, Borrelia afzelii
SFSDIDIARVMANKMY

SEQ ID NO: 187156 - protein, 16 aa, Borrelia afzelii
FSDIDIARVMANKMYS

SEQ ID NO: 187157 - protein, 16 aa, Borrelia afzelii
SDIDIARVMANKMYSK

SEQ ID NO: 187158 - protein, 16 aa, Borrelia afzelii
DIDIARVMANKMYSKG

SEQ ID NO: 187159 - protein, 16 aa, Borrelia afzelii
IDIARVMANKMYSKGI

SEQ ID NO: 187160 - protein, 16 aa, Borrelia afzelii
DIARVMANKMYSKGID

SEQ ID NO: 187161 - protein, 16 aa, Borrelia afzelii
IARVMANKMYSKGIDI

SEQ ID NO: 187162 - protein, 16 aa, Borrelia afzelii
ARVMANKMYSKGIDII

SEQ ID NO: 187163 - protein, 16 aa, Borrelia afzelii
RVMANKMYSKGIDIIH

SEQ ID NO: 187164 - protein, 16 aa, Borrelia afzelii
VMANKMYSKGIDIIHF

SEQ ID NO: 187165 - protein, 16 aa, Borrelia afzelii
MANKMYSKGIDIIHFA

SEQ ID NO: 187166 - protein, 16 aa, Borrelia afzelii
ANKMYSKGIDIIHFAA

SEQ ID NO: 187167 - protein, 16 aa, Borrelia afzelii
NKMYSKGIDIIHFAAG

SEQ ID NO: 187168 - protein, 16 aa, Borrelia afzelii
KMYSKGIDIIHFAAGL

SEQ ID NO: 187169 - protein, 16 aa, Borrelia afzelii
MYSKGIDIIHFAAGLA

SEQ ID NO: 187170 - protein, 16 aa, Borrelia afzelii
YSKGIDIIHFAAGLAG

SEQ ID NO: 187171 - protein, 16 aa, Borrelia afzelii
SKGIDIIHFAAGLAGV

SEQ ID NO: 187172 - protein, 16 aa, Borrelia afzelii
KGIDIIHFAAGLAGVG

SEQ ID NO: 187173 - protein, 16 aa, Borrelia afzelii
GIDIIHFAAGLAGVGV

SEQ ID NO: 187174 - protein, 16 aa, Borrelia afzelii
IDIIHFAAGLAGVGVI

SEQ ID NO: 187175 - protein, 16 aa, Borrelia afzelii
DIIHFAAGLAGVGVIE

SEQ ID NO: 187176 - protein, 16 aa, Borrelia afzelii
IIHFAAGLAGVGVIEA

SEQ ID NO: 187177 - protein, 16 aa, Borrelia afzelii
IHFAAGLAGVGVIEAA

SEQ ID NO: 187178 - protein, 16 aa, Borrelia afzelii
HFAAGLAGVGVIEAAK

SEQ ID NO: 187179 - protein, 16 aa, Borrelia afzelii
FAAGLAGVGVIEAAKE

SEQ ID NO: 187180 - protein, 16 aa, Borrelia afzelii
AAGLAGVGVIEAAKEL

SEQ ID NO: 187181 - protein, 16 aa, Borrelia afzelii
AGLAGVGVIEAAKELG

SEQ ID NO: 187182 - protein, 16 aa, Borrelia afzelii
GLAGVGVIEAAKELGD

SEQ ID NO: 187183 - protein, 16 aa, Borrelia afzelii
LAGVGVIEAAKELGDG

SEQ ID NO: 187184 - protein, 16 aa, Borrelia afzelii
AGVGVIEAAKELGDGY

SEQ ID NO: 187185 - protein, 16 aa, Borrelia afzelii
GVGVIEAAKELGDGYY

SEQ ID NO: 187186 - protein, 16 aa, Borrelia afzelii
VGVIEAAKELGDGYYV

SEQ ID NO: 187187 - protein, 16 aa, Borrelia afzelii
GVIEAAKELGDGYYVI

SEQ ID NO: 187188 - protein, 16 aa, Borrelia afzelii
VIEAAKELGDGYYVIG

SEQ ID NO: 187189 - protein, 16 aa, Borrelia afzelii
IEAAKELGDGYYVIGA

SEQ ID NO: 187190 - protein, 16 aa, Borrelia afzelii
EAAKELGDGYYVIGAD

SEQ ID NO: 187191 - protein, 16 aa, Borrelia afzelii
AAKELGDGYYVIGADQ

SEQ ID NO: 187192 - protein, 16 aa, Borrelia afzelii
AKELGDGYYVIGADQD

SEQ ID NO: 187193 - protein, 16 aa, Borrelia afzelii
KELGDGYYVIGADQDQ

SEQ ID NO: 187194 - protein, 16 aa, Borrelia afzelii
ELGDGYYVIGADQDQS

SEQ ID NO: 187195 - protein, 16 aa, Borrelia afzelii
LGDGYYVIGADQDQSH

SEQ ID NO: 187196 - protein, 16 aa, Borrelia afzelii
GDGYYVIGADQDQSHL

SEQ ID NO: 187197 - protein, 16 aa, Borrelia afzelii
DGYYVIGADQDQSHLA

SEQ ID NO: 187198 - protein, 16 aa, Borrelia afzelii
GYYVIGADQDQSHLAP

SEQ ID NO: 187199 - protein, 16 aa, Borrelia afzelii
YYVIGADQDQSHLAPK

SEQ ID NO: 187200 - protein, 16 aa, Borrelia afzelii
YVIGADQDQSHLAPKN

SEQ ID NO: 187201 - protein, 16 aa, Borrelia afzelii
VIGADQDQSHLAPKNF

SEQ ID NO: 187202 - protein, 16 aa, Borrelia afzelii
IGADQDQSHLAPKNFI

SEQ ID NO: 187203 - protein, 16 aa, Borrelia afzelii
GADQDQSHLAPKNFIT

SEQ ID NO: 187204 - protein, 16 aa, Borrelia afzelii
ADQDQSHLAPKNFITS

SEQ ID NO: 187205 - protein, 16 aa, Borrelia afzelii
DQDQSHLAPKNFITSV

SEQ ID NO: 187206 - protein, 16 aa, Borrelia afzelii
QDQSHLAPKNFITSVI

SEQ ID NO: 187207 - protein, 16 aa, Borrelia afzelii
DQSHLAPKNFITSVIK

SEQ ID NO: 187208 - protein, 16 aa, Borrelia afzelii
QSHLAPKNFITSVIKN

SEQ ID NO: 187209 - protein, 16 aa, Borrelia afzelii
SHLAPKNFITSVIKNV

SEQ ID NO: 187210 - protein, 16 aa, Borrelia afzelii
HLAPKNFITSVIKNVG

SEQ ID NO: 187211 - protein, 16 aa, Borrelia afzelii
LAPKNFITSVIKNVGD

SEQ ID NO: 187212 - protein, 16 aa, Borrelia afzelii
APKNFITSVIKNVGDA

SEQ ID NO: 187213 - protein, 16 aa, Borrelia afzelii
PKNFITSVIKNVGDAL

SEQ ID NO: 187214 - protein, 16 aa, Borrelia afzelii
KNFITSVIKNVGDALY

SEQ ID NO: 187215 - protein, 16 aa, Borrelia afzelii
NFITSVIKNVGDALYL

SEQ ID NO: 187216 - protein, 16 aa, Borrelia afzelii
FITSVIKNVGDALYLI

SEQ ID NO: 187217 - protein, 16 aa, Borrelia afzelii
ITSVIKNVGDALYLIT

SEQ ID NO: 187218 - protein, 16 aa, Borrelia afzelii
TSVIKNVGDALYLITS

SEQ ID NO: 187219 - protein, 16 aa, Borrelia afzelii
SVIKNVGDALYLITSE

SEQ ID NO: 187220 - protein, 16 aa, Borrelia afzelii
VIKNVGDALYLITSES

SEQ ID NO: 187221 - protein, 16 aa, Borrelia afzelii
IKNVGDALYLITSESL

SEQ ID NO: 187222 - protein, 16 aa, Borrelia afzelii
KNVGDALYLITSESLK

SEQ ID NO: 187223 - protein, 16 aa, Borrelia afzelii
NVGDALYLITSESLKN

SEQ ID NO: 187224 - protein, 16 aa, Borrelia afzelii
VGDALYLITSESLKND

SEQ ID NO: 187225 - protein, 16 aa, Borrelia afzelii
GDALYLITSESLKNDN

SEQ ID NO: 187226 - protein, 16 aa, Borrelia afzelii
DALYLITSESLKNDNV

SEQ ID NO: 187227 - protein, 16 aa, Borrelia afzelii
ALYLITSESLKNDNVW

SEQ ID NO: 187228 - protein, 16 aa, Borrelia afzelii
LYLITSESLKNDNVWE

SEQ ID NO: 187229 - protein, 16 aa, Borrelia afzelii
YLITSESLKNDNVWEG

SEQ ID NO: 187230 - protein, 16 aa, Borrelia afzelii
LITSESLKNDNVWEGG

SEQ ID NO: 187231 - protein, 16 aa, Borrelia afzelii
ITSESLKNDNVWEGGK

SEQ ID NO: 187232 - protein, 16 aa, Borrelia afzelii
TSESLKNDNVWEGGKI

SEQ ID NO: 187233 - protein, 16 aa, Borrelia afzelii
SESLKNDNVWEGGKIV

SEQ ID NO: 187234 - protein, 16 aa, Borrelia afzelii
ESLKNDNVWEGGKIVQ

SEQ ID NO: 187235 - protein, 16 aa, Borrelia afzelii
SLKNDNVWEGGKIVQM

SEQ ID NO: 187236 - protein, 16 aa, Borrelia afzelii
LKNDNVWEGGKIVQMG

SEQ ID NO: 187237 - protein, 16 aa, Borrelia afzelii
KNDNVWEGGKIVQMGL

SEQ ID NO: 187238 - protein, 16 aa, Borrelia afzelii
NDNVWEGGKIVQMGLR

SEQ ID NO: 187239 - protein, 16 aa, Borrelia afzelii
DNVWEGGKIVQMGLRD

SEQ ID NO: 187240 - protein, 16 aa, Borrelia afzelii
NVWEGGKIVQMGLRDG

SEQ ID NO: 187241 - protein, 16 aa, Borrelia afzelii
VWEGGKIVQMGLRDGV

SEQ ID NO: 187242 - protein, 16 aa, Borrelia afzelii
WEGGKIVQMGLRDGVV

SEQ ID NO: 187243 - protein, 16 aa, Borrelia afzelii
EGGKIVQMGLRDGVVG

SEQ ID NO: 187244 - protein, 16 aa, Borrelia afzelii
GGKIVQMGLRDGVVGL

SEQ ID NO: 187245 - protein, 16 aa, Borrelia afzelii
GKIVQMGLRDGVVGLS

SEQ ID NO: 187246 - protein, 16 aa, Borrelia afzelii
KIVQMGLRDGVVGLSN

SEQ ID NO: 187247 - protein, 16 aa, Borrelia afzelii
IVQMGLRDGVVGLSNA

SEQ ID NO: 187248 - protein, 16 aa, Borrelia afzelii
VQMGLRDGVVGLSNAN

SEQ ID NO: 187249 - protein, 16 aa, Borrelia afzelii
QMGLRDGVVGLSNANE

SEQ ID NO: 187250 - protein, 16 aa, Borrelia afzelii
MGLRDGVVGLSNANEF

SEQ ID NO: 187251 - protein, 16 aa, Borrelia afzelii
GLRDGVVGLSNANEFE

SEQ ID NO: 187252 - protein, 16 aa, Borrelia afzelii
LRDGVVGLSNANEFEY

SEQ ID NO: 187253 - protein, 16 aa, Borrelia afzelii
RDGVVGLSNANEFEYI

SEQ ID NO: 187254 - protein, 16 aa, Borrelia afzelii
DGVVGLSNANEFEYIK

SEQ ID NO: 187255 - protein, 16 aa, Borrelia afzelii
GVVGLSNANEFEYIKD

SEQ ID NO: 187256 - protein, 16 aa, Borrelia afzelii
VVGLSNANEFEYIKDL

SEQ ID NO: 187257 - protein, 16 aa, Borrelia afzelii
VGLSNANEFEYIKDLE

SEQ ID NO: 187258 - protein, 16 aa, Borrelia afzelii
GLSNANEFEYIKDLER

SEQ ID NO: 187259 - protein, 16 aa, Borrelia afzelii
LSNANEFEYIKDLERK

SEQ ID NO: 187260 - protein, 16 aa, Borrelia afzelii
SNANEFEYIKDLERKI

SEQ ID NO: 187261 - protein, 16 aa, Borrelia afzelii
NANEFEYIKDLERKII

SEQ ID NO: 187262 - protein, 16 aa, Borrelia afzelii
ANEFEYIKDLERKIIN

SEQ ID NO: 187263 - protein, 16 aa, Borrelia afzelii
NEFEYIKDLERKIINK

SEQ ID NO: 187264 - protein, 16 aa, Borrelia afzelii
EFEYIKDLERKIINKE

SEQ ID NO: 187265 - protein, 16 aa, Borrelia afzelii
FEYIKDLERKIINKEI

SEQ ID NO: 187266 - protein, 16 aa, Borrelia afzelii
EYIKDLERKIINKEII

SEQ ID NO: 187267 - protein, 16 aa, Borrelia afzelii
YIKDLERKIINKEIIV

SEQ ID NO: 187268 - protein, 16 aa, Borrelia afzelii
IKDLERKIINKEIIVP

SEQ ID NO: 187269 - protein, 16 aa, Borrelia afzelii
KDLERKIINKEIIVPC

SEQ ID NO: 187270 - protein, 16 aa, Borrelia afzelii
DLERKIINKEIIVPCN

SEQ ID NO: 187271 - protein, 16 aa, Borrelia afzelii
LERKIINKEIIVPCNQ

SEQ ID NO: 187272 - protein, 16 aa, Borrelia afzelii
ERKIINKEIIVPCNQE

SEQ ID NO: 187273 - protein, 16 aa, Borrelia afzelii
RKIINKEIIVPCNQEG

SEQ ID NO: 187274 - protein, 16 aa, Borrelia afzelii
KIINKEIIVPCNQEGY

SEQ ID NO: 187275 - protein, 16 aa, Borrelia afzelii
IINKEIIVPCNQEGYE

SEQ ID NO: 187276 - protein, 16 aa, Borrelia afzelii
INKEIIVPCNQEGYEI

SEQ ID NO: 187277 - protein, 16 aa, Borrelia afzelii
NKEIIVPCNQEGYEIF

SEQ ID NO: 187278 - protein, 16 aa, Borrelia afzelii
KEIIVPCNQEGYEIFI

SEQ ID NO: 187279 - protein, 16 aa, Borrelia afzelii
EIIVPCNQEGYEIFIK

SEQ ID NO: 187280 - protein, 16 aa, Borrelia afzelii
IIVPCNQEGYEIFIKQ

SEQ ID NO: 187281 - protein, 16 aa, Borrelia afzelii
IVPCNQEGYEIFIKQI

SEQ ID NO: 187282 - protein, 16 aa, Borrelia afzelii
VPCNQEGYEIFIKQIL

SEQ ID NO: 187283 - protein, 16 aa, Borrelia afzelii
PCNQEGYEIFIKQILK

SEQ ID NO: 187284 - protein, 16 aa, Borrelia afzelii
CNQEGYEIFIKQILKL

SEQ ID NO: 187285 - protein, 341 aa, Borrelia garinii
MLNKVYCFIVFLFIIACSGSDDVKLESKTVSLIVDGAFDDKGFNESSSKAIRKLKTDFNINIIEKASTGNSHLGDIATLEDGNSNLIWGIGFRLSDVLLQRASENISINYAIMEGVYNEIQMPKNLLNISFRSEEVAFLAGYFASKTSKTGKIGFIGGVKGKVLESFMYGYEAGAKYANSTIKVISQYVGTFGDFGLGRSTASNMYRDGVDIVFAAAGLSGIGVIEAAKELGPDHYIIGVDQDQSYLAPNNVLVSAVKKVDSLMYSLTKKYLETGIWDGGKNIFFGLKEDGLGLVLNENLKSNYSEIYNKSLEIGQSIMEGIIKVPYDKASYDNFVLQIAN

SEQ ID NO: 187286 - protein, 8 aa, Borrelia garinii
MLNKVYCF

SEQ ID NO: 187287 - protein, 8 aa, Borrelia garinii
LNKVYCFI

SEQ ID NO: 187288 - protein, 8 aa, Borrelia garinii
NKVYCFIV

SEQ ID NO: 187289 - protein, 8 aa, Borrelia garinii
KVYCFIVF

SEQ ID NO: 187290 - protein, 8 aa, Borrelia garinii
VYCFIVFL

SEQ ID NO: 187291 - protein, 8 aa, Borrelia garinii
YCFIVFLF

SEQ ID NO: 187292 - protein, 8 aa, Borrelia garinii
CFIVFLFI

SEQ ID NO: 187293 - protein, 8 aa, Borrelia garinii
FIVFLFII

SEQ ID NO: 187294 - protein, 8 aa, Borrelia garinii
IVFLFIIA

SEQ ID NO: 187295 - protein, 8 aa, Borrelia garinii
VFLFIIAC

SEQ ID NO: 187296 - protein, 8 aa, Borrelia garinii
FLFIIACS

SEQ ID NO: 187297 - protein, 8 aa, Borrelia garinii
LFIIACSG

SEQ ID NO: 187298 - protein, 8 aa, Borrelia garinii
FIIACSGS

SEQ ID NO: 187299 - protein, 8 aa, Borrelia garinii
IIACSGSD

SEQ ID NO: 187300 - protein, 8 aa, Borrelia garinii
IACSGSDD

SEQ ID NO: 187301 - protein, 8 aa, Borrelia garinii
ACSGSDDV

SEQ ID NO: 187302 - protein, 8 aa, Borrelia garinii
CSGSDDVK

SEQ ID NO: 187303 - protein, 8 aa, Borrelia garinii
SGSDDVKL

SEQ ID NO: 187304 - protein, 8 aa, Borrelia garinii
GSDDVKLE

SEQ ID NO: 187305 - protein, 8 aa, Borrelia garinii
SDDVKLES

SEQ ID NO: 187306 - protein, 8 aa, Borrelia garinii
DDVKLESK

SEQ ID NO: 187307 - protein, 8 aa, Borrelia garinii
DVKLESKT

SEQ ID NO: 187308 - protein, 8 aa, Borrelia garinii
VKLESKTV

SEQ ID NO: 187309 - protein, 8 aa, Borrelia garinii
KLESKTVS

SEQ ID NO: 187310 - protein, 8 aa, Borrelia garinii
LESKTVSL

SEQ ID NO: 187311 - protein, 8 aa, Borrelia garinii
ESKTVSLI

SEQ ID NO: 187312 - protein, 8 aa, Borrelia garinii
SKTVSLIV

SEQ ID NO: 187313 - protein, 8 aa, Borrelia garinii
KTVSLIVD

SEQ ID NO: 187314 - protein, 8 aa, Borrelia garinii
TVSLIVDG

SEQ ID NO: 187315 - protein, 8 aa, Borrelia garinii
VSLIVDGA

SEQ ID NO: 187316 - protein, 8 aa, Borrelia garinii
SLIVDGAF

SEQ ID NO: 187317 - protein, 8 aa, Borrelia garinii
LIVDGAFD

SEQ ID NO: 187318 - protein, 8 aa, Borrelia garinii
IVDGAFDD

SEQ ID NO: 187319 - protein, 8 aa, Borrelia garinii
VDGAFDDK

SEQ ID NO: 187320 - protein, 8 aa, Borrelia garinii
DGAFDDKG

SEQ ID NO: 187321 - protein, 8 aa, Borrelia garinii
GAFDDKGF

SEQ ID NO: 187322 - protein, 8 aa, Borrelia garinii
AFDDKGFN

SEQ ID NO: 187323 - protein, 8 aa, Borrelia garinii
FDDKGFNE

SEQ ID NO: 187324 - protein, 8 aa, Borrelia garinii
DDKGFNES

SEQ ID NO: 187325 - protein, 8 aa, Borrelia garinii
DKGFNESS

SEQ ID NO: 187326 - protein, 8 aa, Borrelia garinii
KGFNESSS

SEQ ID NO: 187327 - protein, 8 aa, Borrelia garinii
GFNESSSK

SEQ ID NO: 187328 - protein, 8 aa, Borrelia garinii
FNESSSKA

SEQ ID NO: 187329 - protein, 8 aa, Borrelia garinii
NESSSKAI

SEQ ID NO: 187330 - protein, 8 aa, Borrelia garinii
ESSSKAIR

SEQ ID NO: 187331 - protein, 8 aa, Borrelia garinii
SSSKAIRK

SEQ ID NO: 187332 - protein, 8 aa, Borrelia garinii
SSKAIRKL

SEQ ID NO: 187333 - protein, 8 aa, Borrelia garinii
SKAIRKLK

SEQ ID NO: 187334 - protein, 8 aa, Borrelia garinii
KAIRKLKT

SEQ ID NO: 187335 - protein, 8 aa, Borrelia garinii
AIRKLKTD

SEQ ID NO: 187336 - protein, 8 aa, Borrelia garinii
IRKLKTDF

SEQ ID NO: 187337 - protein, 8 aa, Borrelia garinii
RKLKTDFN

SEQ ID NO: 187338 - protein, 8 aa, Borrelia garinii
KLKTDFNI

SEQ ID NO: 187339 - protein, 8 aa, Borrelia garinii
LKTDFNIN

SEQ ID NO: 187340 - protein, 8 aa, Borrelia garinii
KTDFNINI

SEQ ID NO: 187341 - protein, 8 aa, Borrelia garinii
TDFNINII

SEQ ID NO: 187342 - protein, 8 aa, Borrelia garinii
DFNINIIE

SEQ ID NO: 187343 - protein, 8 aa, Borrelia garinii
FNINIIEK

SEQ ID NO: 187344 - protein, 8 aa, Borrelia garinii
NINIIEKA

SEQ ID NO: 187345 - protein, 8 aa, Borrelia garinii
INIIEKAS

SEQ ID NO: 187346 - protein, 8 aa, Borrelia garinii
NIIEKAST

SEQ ID NO: 187347 - protein, 8 aa, Borrelia garinii
IIEKASTG

SEQ ID NO: 187348 - protein, 8 aa, Borrelia garinii
IEKASTGN

SEQ ID NO: 187349 - protein, 8 aa, Borrelia garinii
EKASTGNS

SEQ ID NO: 187350 - protein, 8 aa, Borrelia garinii
KASTGNSH

SEQ ID NO: 187351 - protein, 8 aa, Borrelia garinii
ASTGNSHL

SEQ ID NO: 187352 - protein, 8 aa, Borrelia garinii
STGNSHLG

SEQ ID NO: 187353 - protein, 8 aa, Borrelia garinii
TGNSHLGD

SEQ ID NO: 187354 - protein, 8 aa, Borrelia garinii
GNSHLGDI

SEQ ID NO: 187355 - protein, 8 aa, Borrelia garinii
NSHLGDIA

SEQ ID NO: 187356 - protein, 8 aa, Borrelia garinii
SHLGDIAT

SEQ ID NO: 187357 - protein, 8 aa, Borrelia garinii
HLGDIATL

SEQ ID NO: 187358 - protein, 8 aa, Borrelia garinii
LGDIATLE

SEQ ID NO: 187359 - protein, 8 aa, Borrelia garinii
GDIATLED

SEQ ID NO: 187360 - protein, 8 aa, Borrelia garinii
DIATLEDG

SEQ ID NO: 187361 - protein, 8 aa, Borrelia garinii
IATLEDGN

SEQ ID NO: 187362 - protein, 8 aa, Borrelia garinii
ATLEDGNS

SEQ ID NO: 187363 - protein, 8 aa, Borrelia garinii
TLEDGNSN

SEQ ID NO: 187364 - protein, 8 aa, Borrelia garinii
LEDGNSNL

SEQ ID NO: 187365 - protein, 8 aa, Borrelia garinii
EDGNSNLI

SEQ ID NO: 187366 - protein, 8 aa, Borrelia garinii
DGNSNLIW

SEQ ID NO: 187367 - protein, 8 aa, Borrelia garinii
GNSNLIWG

SEQ ID NO: 187368 - protein, 8 aa, Borrelia garinii
NSNLIWGI

SEQ ID NO: 187369 - protein, 8 aa, Borrelia garinii
SNLIWGIG

SEQ ID NO: 187370 - protein, 8 aa, Borrelia garinii
NLIWGIGF

SEQ ID NO: 187371 - protein, 8 aa, Borrelia garinii
LIWGIGFR

SEQ ID NO: 187372 - protein, 8 aa, Borrelia garinii
IWGIGFRL

SEQ ID NO: 187373 - protein, 8 aa, Borrelia garinii
WGIGFRLS

SEQ ID NO: 187374 - protein, 8 aa, Borrelia garinii
GIGFRLSD

SEQ ID NO: 187375 - protein, 8 aa, Borrelia garinii
IGFRLSDV

SEQ ID NO: 187376 - protein, 8 aa, Borrelia garinii
GFRLSDVL

SEQ ID NO: 187377 - protein, 8 aa, Borrelia garinii
FRLSDVLL

SEQ ID NO: 187378 - protein, 8 aa, Borrelia garinii
RLSDVLLQ

SEQ ID NO: 187379 - protein, 8 aa, Borrelia garinii
LSDVLLQR

SEQ ID NO: 187380 - protein, 8 aa, Borrelia garinii
SDVLLQRA

SEQ ID NO: 187381 - protein, 8 aa, Borrelia garinii
DVLLQRAS

SEQ ID NO: 187382 - protein, 8 aa, Borrelia garinii
VLLQRASE

SEQ ID NO: 187383 - protein, 8 aa, Borrelia garinii
LLQRASEN

SEQ ID NO: 187384 - protein, 8 aa, Borrelia garinii
LQRASENI

SEQ ID NO: 187385 - protein, 8 aa, Borrelia garinii
QRASENIS

SEQ ID NO: 187386 - protein, 8 aa, Borrelia garinii
RASENISI

SEQ ID NO: 187387 - protein, 8 aa, Borrelia garinii
ASENISIN

SEQ ID NO: 187388 - protein, 8 aa, Borrelia garinii
SENISINY

SEQ ID NO: 187389 - protein, 8 aa, Borrelia garinii
ENISINYA

SEQ ID NO: 187390 - protein, 8 aa, Borrelia garinii
NISINYAI

SEQ ID NO: 187391 - protein, 8 aa, Borrelia garinii
ISINYAIM

SEQ ID NO: 187392 - protein, 8 aa, Borrelia garinii
SINYAIME

SEQ ID NO: 187393 - protein, 8 aa, Borrelia garinii
INYAIMEG

SEQ ID NO: 187394 - protein, 8 aa, Borrelia garinii
NYAIMEGV

SEQ ID NO: 187395 - protein, 8 aa, Borrelia garinii
YAIMEGVY

SEQ ID NO: 187396 - protein, 8 aa, Borrelia garinii
AIMEGVYN

SEQ ID NO: 187397 - protein, 8 aa, Borrelia garinii
IMEGVYNE

SEQ ID NO: 187398 - protein, 8 aa, Borrelia garinii
MEGVYNEI

SEQ ID NO: 187399 - protein, 8 aa, Borrelia garinii
EGVYNEIQ

SEQ ID NO: 187400 - protein, 8 aa, Borrelia garinii
GVYNEIQM

SEQ ID NO: 187401 - protein, 8 aa, Borrelia garinii
VYNEIQMP

SEQ ID NO: 187402 - protein, 8 aa, Borrelia garinii
YNEIQMPK

SEQ ID NO: 187403 - protein, 8 aa, Borrelia garinii
NEIQMPKN

SEQ ID NO: 187404 - protein, 8 aa, Borrelia garinii
EIQMPKNL

SEQ ID NO: 187405 - protein, 8 aa, Borrelia garinii
IQMPKNLL

SEQ ID NO: 187406 - protein, 8 aa, Borrelia garinii
QMPKNLLN

SEQ ID NO: 187407 - protein, 8 aa, Borrelia garinii
MPKNLLNI

SEQ ID NO: 187408 - protein, 8 aa, Borrelia garinii
PKNLLNIS

SEQ ID NO: 187409 - protein, 8 aa, Borrelia garinii
KNLLNISF

SEQ ID NO: 187410 - protein, 8 aa, Borrelia garinii
NLLNISFR

SEQ ID NO: 187411 - protein, 8 aa, Borrelia garinii
LLNISFRS

SEQ ID NO: 187412 - protein, 8 aa, Borrelia garinii
LNISFRSE

SEQ ID NO: 187413 - protein, 8 aa, Borrelia garinii
NISFRSEE

SEQ ID NO: 187414 - protein, 8 aa, Borrelia garinii
ISFRSEEV

SEQ ID NO: 187415 - protein, 8 aa, Borrelia garinii
SFRSEEVA

SEQ ID NO: 187416 - protein, 8 aa, Borrelia garinii
FRSEEVAF

SEQ ID NO: 187417 - protein, 8 aa, Borrelia garinii
RSEEVAFL

SEQ ID NO: 187418 - protein, 8 aa, Borrelia garinii
SEEVAFLA

SEQ ID NO: 187419 - protein, 8 aa, Borrelia garinii
EEVAFLAG

SEQ ID NO: 187420 - protein, 8 aa, Borrelia garinii
EVAFLAGY

SEQ ID NO: 187421 - protein, 8 aa, Borrelia garinii
VAFLAGYF

SEQ ID NO: 187422 - protein, 8 aa, Borrelia garinii
AFLAGYFA

SEQ ID NO: 187423 - protein, 8 aa, Borrelia garinii
FLAGYFAS

SEQ ID NO: 187424 - protein, 8 aa, Borrelia garinii
LAGYFASK

SEQ ID NO: 187425 - protein, 8 aa, Borrelia garinii
AGYFASKT

SEQ ID NO: 187426 - protein, 8 aa, Borrelia garinii
GYFASKTS

SEQ ID NO: 187427 - protein, 8 aa, Borrelia garinii
YFASKTSK

SEQ ID NO: 187428 - protein, 8 aa, Borrelia garinii
FASKTSKT

SEQ ID NO: 187429 - protein, 8 aa, Borrelia garinii
ASKTSKTG

SEQ ID NO: 187430 - protein, 8 aa, Borrelia garinii
SKTSKTGK

SEQ ID NO: 187431 - protein, 8 aa, Borrelia garinii
KTSKTGKI

SEQ ID NO: 187432 - protein, 8 aa, Borrelia garinii
TSKTGKIG

SEQ ID NO: 187433 - protein, 8 aa, Borrelia garinii
SKTGKIGF

SEQ ID NO: 187434 - protein, 8 aa, Borrelia garinii
KTGKIGFI

SEQ ID NO: 187435 - protein, 8 aa, Borrelia garinii
TGKIGFIG

SEQ ID NO: 187436 - protein, 8 aa, Borrelia garinii
GKIGFIGG

SEQ ID NO: 187437 - protein, 8 aa, Borrelia garinii
KIGFIGGV

SEQ ID NO: 187438 - protein, 8 aa, Borrelia garinii
IGFIGGVK

SEQ ID NO: 187439 - protein, 8 aa, Borrelia garinii
GFIGGVKG

SEQ ID NO: 187440 - protein, 8 aa, Borrelia garinii
FIGGVKGK

SEQ ID NO: 187441 - protein, 8 aa, Borrelia garinii
IGGVKGKV

SEQ ID NO: 187442 - protein, 8 aa, Borrelia garinii
GGVKGKVL

SEQ ID NO: 187443 - protein, 8 aa, Borrelia garinii
GVKGKVLE

SEQ ID NO: 187444 - protein, 8 aa, Borrelia garinii
VKGKVLES

SEQ ID NO: 187445 - protein, 8 aa, Borrelia garinii
KGKVLESF

SEQ ID NO: 187446 - protein, 8 aa, Borrelia garinii
GKVLESFM

SEQ ID NO: 187447 - protein, 8 aa, Borrelia garinii
KVLESFMY

SEQ ID NO: 187448 - protein, 8 aa, Borrelia garinii
VLESFMYG

SEQ ID NO: 187449 - protein, 8 aa, Borrelia garinii
LESFMYGY

SEQ ID NO: 187450 - protein, 8 aa, Borrelia garinii
ESFMYGYE

SEQ ID NO: 187451 - protein, 8 aa, Borrelia garinii
SFMYGYEA

SEQ ID NO: 187452 - protein, 8 aa, Borrelia garinii
FMYGYEAG

SEQ ID NO: 187453 - protein, 8 aa, Borrelia garinii
MYGYEAGA

SEQ ID NO: 187454 - protein, 8 aa, Borrelia garinii
YGYEAGAK

SEQ ID NO: 187455 - protein, 8 aa, Borrelia garinii
GYEAGAKY

SEQ ID NO: 187456 - protein, 8 aa, Borrelia garinii
YEAGAKYA

SEQ ID NO: 187457 - protein, 8 aa, Borrelia garinii
EAGAKYAN

SEQ ID NO: 187458 - protein, 8 aa, Borrelia garinii
AGAKYANS

SEQ ID NO: 187459 - protein, 8 aa, Borrelia garinii
GAKYANST

SEQ ID NO: 187460 - protein, 8 aa, Borrelia garinii
AKYANSTI

SEQ ID NO: 187461 - protein, 8 aa, Borrelia garinii
KYANSTIK

SEQ ID NO: 187462 - protein, 8 aa, Borrelia garinii
YANSTIKV

SEQ ID NO: 187463 - protein, 8 aa, Borrelia garinii
ANSTIKVI

SEQ ID NO: 187464 - protein, 8 aa, Borrelia garinii
NSTIKVIS

SEQ ID NO: 187465 - protein, 8 aa, Borrelia garinii
STIKVISQ

SEQ ID NO: 187466 - protein, 8 aa, Borrelia garinii
TIKVISQY

SEQ ID NO: 187467 - protein, 8 aa, Borrelia garinii
IKVISQYV

SEQ ID NO: 187468 - protein, 8 aa, Borrelia garinii
KVISQYVG

SEQ ID NO: 187469 - protein, 8 aa, Borrelia garinii
VISQYVGT

SEQ ID NO: 187470 - protein, 8 aa, Borrelia garinii
ISQYVGTF

SEQ ID NO: 187471 - protein, 8 aa, Borrelia garinii
SQYVGTFG

SEQ ID NO: 187472 - protein, 8 aa, Borrelia garinii
QYVGTFGD

SEQ ID NO: 187473 - protein, 8 aa, Borrelia garinii
YVGTFGDF

SEQ ID NO: 187474 - protein, 8 aa, Borrelia garinii
VGTFGDFG

SEQ ID NO: 187475 - protein, 8 aa, Borrelia garinii
GTFGDFGL

SEQ ID NO: 187476 - protein, 8 aa, Borrelia garinii
TFGDFGLG

SEQ ID NO: 187477 - protein, 8 aa, Borrelia garinii
FGDFGLGR

SEQ ID NO: 187478 - protein, 8 aa, Borrelia garinii
GDFGLGRS

SEQ ID NO: 187479 - protein, 8 aa, Borrelia garinii
DFGLGRST

SEQ ID NO: 187480 - protein, 8 aa, Borrelia garinii
FGLGRSTA

SEQ ID NO: 187481 - protein, 8 aa, Borrelia garinii
GLGRSTAS

SEQ ID NO: 187482 - protein, 8 aa, Borrelia garinii
LGRSTASN

SEQ ID NO: 187483 - protein, 8 aa, Borrelia garinii
GRSTASNM

SEQ ID NO: 187484 - protein, 8 aa, Borrelia garinii
RSTASNMY

SEQ ID NO: 187485 - protein, 8 aa, Borrelia garinii
STASNMYR

SEQ ID NO: 187486 - protein, 8 aa, Borrelia garinii
TASNMYRD

SEQ ID NO: 187487 - protein, 8 aa, Borrelia garinii
ASNMYRDG

SEQ ID NO: 187488 - protein, 8 aa, Borrelia garinii
SNMYRDGV

SEQ ID NO: 187489 - protein, 8 aa, Borrelia garinii
NMYRDGVD

SEQ ID NO: 187490 - protein, 8 aa, Borrelia garinii
MYRDGVDI

SEQ ID NO: 187491 - protein, 8 aa, Borrelia garinii
YRDGVDIV

SEQ ID NO: 187492 - protein, 8 aa, Borrelia garinii
RDGVDIVF

SEQ ID NO: 187493 - protein, 8 aa, Borrelia garinii
DGVDIVFA

SEQ ID NO: 187494 - protein, 8 aa, Borrelia garinii
GVDIVFAA

SEQ ID NO: 187495 - protein, 8 aa, Borrelia garinii
VDIVFAAA

SEQ ID NO: 187496 - protein, 8 aa, Borrelia garinii
DIVFAAAG

SEQ ID NO: 187497 - protein, 8 aa, Borrelia garinii
IVFAAAGL

SEQ ID NO: 187498 - protein, 8 aa, Borrelia garinii
VFAAAGLS

SEQ ID NO: 187499 - protein, 8 aa, Borrelia garinii
FAAAGLSG

SEQ ID NO: 187500 - protein, 8 aa, Borrelia garinii
AAAGLSGI

SEQ ID NO: 187501 - protein, 8 aa, Borrelia garinii
AAGLSGIG

SEQ ID NO: 187502 - protein, 8 aa, Borrelia garinii
AGLSGIGV

SEQ ID NO: 187503 - protein, 8 aa, Borrelia garinii
GLSGIGVI

SEQ ID NO: 187504 - protein, 8 aa, Borrelia garinii
LSGIGVIE

SEQ ID NO: 187505 - protein, 8 aa, Borrelia garinii
SGIGVIEA

SEQ ID NO: 187506 - protein, 8 aa, Borrelia garinii
GIGVIEAA

SEQ ID NO: 187507 - protein, 8 aa, Borrelia garinii
IGVIEAAK

SEQ ID NO: 187508 - protein, 8 aa, Borrelia garinii
GVIEAAKE

SEQ ID NO: 187509 - protein, 8 aa, Borrelia garinii
VIEAAKEL

SEQ ID NO: 187510 - protein, 8 aa, Borrelia garinii
IEAAKELG

SEQ ID NO: 187511 - protein, 8 aa, Borrelia garinii
EAAKELGP

SEQ ID NO: 187512 - protein, 8 aa, Borrelia garinii
AAKELGPD

SEQ ID NO: 187513 - protein, 8 aa, Borrelia garinii
AKELGPDH

SEQ ID NO: 187514 - protein, 8 aa, Borrelia garinii
KELGPDHY

SEQ ID NO: 187515 - protein, 8 aa, Borrelia garinii
ELGPDHYI

SEQ ID NO: 187516 - protein, 8 aa, Borrelia garinii
LGPDHYII

SEQ ID NO: 187517 - protein, 8 aa, Borrelia garinii
GPDHYIIG

SEQ ID NO: 187518 - protein, 8 aa, Borrelia garinii
PDHYIIGV

SEQ ID NO: 187519 - protein, 8 aa, Borrelia garinii
DHYIIGVD

SEQ ID NO: 187520 - protein, 8 aa, Borrelia garinii
HYIIGVDQ

SEQ ID NO: 187521 - protein, 8 aa, Borrelia garinii
YIIGVDQD

SEQ ID NO: 187522 - protein, 8 aa, Borrelia garinii
IIGVDQDQ

SEQ ID NO: 187523 - protein, 8 aa, Borrelia garinii
IGVDQDQS

SEQ ID NO: 187524 - protein, 8 aa, Borrelia garinii
GVDQDQSY

SEQ ID NO: 187525 - protein, 8 aa, Borrelia garinii
VDQDQSYL

SEQ ID NO: 187526 - protein, 8 aa, Borrelia garinii
DQDQSYLA

SEQ ID NO: 187527 - protein, 8 aa, Borrelia garinii
QDQSYLAP

SEQ ID NO: 187528 - protein, 8 aa, Borrelia garinii
DQSYLAPN

SEQ ID NO: 187529 - protein, 8 aa, Borrelia garinii
QSYLAPNN

SEQ ID NO: 187530 - protein, 8 aa, Borrelia garinii
SYLAPNNV

SEQ ID NO: 187531 - protein, 8 aa, Borrelia garinii
YLAPNNVL

SEQ ID NO: 187532 - protein, 8 aa, Borrelia garinii
LAPNNVLV

SEQ ID NO: 187533 - protein, 8 aa, Borrelia garinii
APNNVLVS

SEQ ID NO: 187534 - protein, 8 aa, Borrelia garinii
PNNVLVSA

SEQ ID NO: 187535 - protein, 8 aa, Borrelia garinii
NNVLVSAV

SEQ ID NO: 187536 - protein, 8 aa, Borrelia garinii
NVLVSAVK

SEQ ID NO: 187537 - protein, 8 aa, Borrelia garinii
VLVSAVKK

SEQ ID NO: 187538 - protein, 8 aa, Borrelia garinii
LVSAVKKV

SEQ ID NO: 187539 - protein, 8 aa, Borrelia garinii
VSAVKKVD

SEQ ID NO: 187540 - protein, 8 aa, Borrelia garinii
SAVKKVDS

SEQ ID NO: 187541 - protein, 8 aa, Borrelia garinii
AVKKVDSL

SEQ ID NO: 187542 - protein, 8 aa, Borrelia garinii
VKKVDSLM

SEQ ID NO: 187543 - protein, 8 aa, Borrelia garinii
KKVDSLMY

SEQ ID NO: 187544 - protein, 8 aa, Borrelia garinii
KVDSLMYS

SEQ ID NO: 187545 - protein, 8 aa, Borrelia garinii
VDSLMYSL

SEQ ID NO: 187546 - protein, 8 aa, Borrelia garinii
DSLMYSLT

SEQ ID NO: 187547 - protein, 8 aa, Borrelia garinii
SLMYSLTK

SEQ ID NO: 187548 - protein, 8 aa, Borrelia garinii
LMYSLTKK

SEQ ID NO: 187549 - protein, 8 aa, Borrelia garinii
MYSLTKKY

SEQ ID NO: 187550 - protein, 8 aa, Borrelia garinii
YSLTKKYL

SEQ ID NO: 187551 - protein, 8 aa, Borrelia garinii
SLTKKYLE

SEQ ID NO: 187552 - protein, 8 aa, Borrelia garinii
LTKKYLET

SEQ ID NO: 187553 - protein, 8 aa, Borrelia garinii
TKKYLETG

SEQ ID NO: 187554 - protein, 8 aa, Borrelia garinii
KKYLETGI

SEQ ID NO: 187555 - protein, 8 aa, Borrelia garinii
KYLETGIW

SEQ ID NO: 187556 - protein, 8 aa, Borrelia garinii
YLETGIWD

SEQ ID NO: 187557 - protein, 8 aa, Borrelia garinii
LETGIWDG

SEQ ID NO: 187558 - protein, 8 aa, Borrelia garinii
ETGIWDGG

SEQ ID NO: 187559 - protein, 8 aa, Borrelia garinii
TGIWDGGK

SEQ ID NO: 187560 - protein, 8 aa, Borrelia garinii
GIWDGGKN

SEQ ID NO: 187561 - protein, 8 aa, Borrelia garinii
IWDGGKNI

SEQ ID NO: 187562 - protein, 8 aa, Borrelia garinii
WDGGKNIF

SEQ ID NO: 187563 - protein, 8 aa, Borrelia garinii
DGGKNIFF

SEQ ID NO: 187564 - protein, 8 aa, Borrelia garinii
GGKNIFFG

SEQ ID NO: 187565 - protein, 8 aa, Borrelia garinii
GKNIFFGL

SEQ ID NO: 187566 - protein, 8 aa, Borrelia garinii
KNIFFGLK

SEQ ID NO: 187567 - protein, 8 aa, Borrelia garinii
NIFFGLKE

SEQ ID NO: 187568 - protein, 8 aa, Borrelia garinii
IFFGLKED

SEQ ID NO: 187569 - protein, 8 aa, Borrelia garinii
FFGLKEDG

SEQ ID NO: 187570 - protein, 8 aa, Borrelia garinii
FGLKEDGL

SEQ ID NO: 187571 - protein, 8 aa, Borrelia garinii
GLKEDGLG

SEQ ID NO: 187572 - protein, 8 aa, Borrelia garinii
LKEDGLGL

SEQ ID NO: 187573 - protein, 8 aa, Borrelia garinii
KEDGLGLV

SEQ ID NO: 187574 - protein, 8 aa, Borrelia garinii
EDGLGLVL

SEQ ID NO: 187575 - protein, 8 aa, Borrelia garinii
DGLGLVLN

SEQ ID NO: 187576 - protein, 8 aa, Borrelia garinii
GLGLVLNE

SEQ ID NO: 187577 - protein, 8 aa, Borrelia garinii
LGLVLNEN

SEQ ID NO: 187578 - protein, 8 aa, Borrelia garinii
GLVLNENL

SEQ ID NO: 187579 - protein, 8 aa, Borrelia garinii
LVLNENLK

SEQ ID NO: 187580 - protein, 8 aa, Borrelia garinii
VLNENLKS

SEQ ID NO: 187581 - protein, 8 aa, Borrelia garinii
LNENLKSN

SEQ ID NO: 187582 - protein, 8 aa, Borrelia garinii
NENLKSNY

SEQ ID NO: 187583 - protein, 8 aa, Borrelia garinii
ENLKSNYS

SEQ ID NO: 187584 - protein, 8 aa, Borrelia garinii
NLKSNYSE

SEQ ID NO: 187585 - protein, 8 aa, Borrelia garinii
LKSNYSEI

SEQ ID NO: 187586 - protein, 8 aa, Borrelia garinii
KSNYSEIY

SEQ ID NO: 187587 - protein, 8 aa, Borrelia garinii
SNYSEIYN

SEQ ID NO: 187588 - protein, 8 aa, Borrelia garinii
NYSEIYNK

SEQ ID NO: 187589 - protein, 8 aa, Borrelia garinii
YSEIYNKS

SEQ ID NO: 187590 - protein, 8 aa, Borrelia garinii
SEIYNKSL

SEQ ID NO: 187591 - protein, 8 aa, Borrelia garinii
EIYNKSLE

SEQ ID NO: 187592 - protein, 8 aa, Borrelia garinii
IYNKSLEI

SEQ ID NO: 187593 - protein, 8 aa, Borrelia garinii
YNKSLEIG

SEQ ID NO: 187594 - protein, 8 aa, Borrelia garinii
NKSLEIGQ

SEQ ID NO: 187595 - protein, 8 aa, Borrelia garinii
KSLEIGQS

SEQ ID NO: 187596 - protein, 8 aa, Borrelia garinii
SLEIGQSI

SEQ ID NO: 187597 - protein, 8 aa, Borrelia garinii
LEIGQSIM

SEQ ID NO: 187598 - protein, 8 aa, Borrelia garinii
EIGQSIME

SEQ ID NO: 187599 - protein, 8 aa, Borrelia garinii
IGQSIMEG

SEQ ID NO: 187600 - protein, 8 aa, Borrelia garinii
GQSIMEGI

SEQ ID NO: 187601 - protein, 8 aa, Borrelia garinii
QSIMEGII

SEQ ID NO: 187602 - protein, 8 aa, Borrelia garinii
SIMEGIIK

SEQ ID NO: 187603 - protein, 8 aa, Borrelia garinii
IMEGIIKV

SEQ ID NO: 187604 - protein, 8 aa, Borrelia garinii
MEGIIKVP

SEQ ID NO: 187605 - protein, 8 aa, Borrelia garinii
EGIIKVPY

SEQ ID NO: 187606 - protein, 8 aa, Borrelia garinii
GIIKVPYD

SEQ ID NO: 187607 - protein, 8 aa, Borrelia garinii
IIKVPYDK

SEQ ID NO: 187608 - protein, 8 aa, Borrelia garinii
IKVPYDKA

SEQ ID NO: 187609 - protein, 8 aa, Borrelia garinii
KVPYDKAS

SEQ ID NO: 187610 - protein, 8 aa, Borrelia garinii
VPYDKASY

SEQ ID NO: 187611 - protein, 8 aa, Borrelia garinii
PYDKASYD

SEQ ID NO: 187612 - protein, 8 aa, Borrelia garinii
YDKASYDN

SEQ ID NO: 187613 - protein, 8 aa, Borrelia garinii
DKASYDNF

SEQ ID NO: 187614 - protein, 8 aa, Borrelia garinii
KASYDNFV

SEQ ID NO: 187615 - protein, 8 aa, Borrelia garinii
ASYDNFVL

SEQ ID NO: 187616 - protein, 8 aa, Borrelia garinii
SYDNFVLQ

SEQ ID NO: 187617 - protein, 8 aa, Borrelia garinii
YDNFVLQI

SEQ ID NO: 187618 - protein, 8 aa, Borrelia garinii
DNFVLQIA

SEQ ID NO: 187619 - protein, 8 aa, Borrelia garinii
NFVLQIAN

SEQ ID NO: 187620 - protein, 9 aa, Borrelia garinii
MLNKVYCFI

SEQ ID NO: 187621 - protein, 9 aa, Borrelia garinii
LNKVYCFIV

SEQ ID NO: 187622 - protein, 9 aa, Borrelia garinii
NKVYCFIVF

SEQ ID NO: 187623 - protein, 9 aa, Borrelia garinii
KVYCFIVFL

SEQ ID NO: 187624 - protein, 9 aa, Borrelia garinii
VYCFIVFLF

SEQ ID NO: 187625 - protein, 9 aa, Borrelia garinii
YCFIVFLFI

SEQ ID NO: 187626 - protein, 9 aa, Borrelia garinii
CFIVFLFII

SEQ ID NO: 187627 - protein, 9 aa, Borrelia garinii
FIVFLFIIA

SEQ ID NO: 187628 - protein, 9 aa, Borrelia garinii
IVFLFIIAC

SEQ ID NO: 187629 - protein, 9 aa, Borrelia garinii
VFLFIIACS

SEQ ID NO: 187630 - protein, 9 aa, Borrelia garinii
FLFIIACSG

SEQ ID NO: 187631 - protein, 9 aa, Borrelia garinii
LFIIACSGS

SEQ ID NO: 187632 - protein, 9 aa, Borrelia garinii
FIIACSGSD

SEQ ID NO: 187633 - protein, 9 aa, Borrelia garinii
IIACSGSDD

SEQ ID NO: 187634 - protein, 9 aa, Borrelia garinii
IACSGSDDV

SEQ ID NO: 187635 - protein, 9 aa, Borrelia garinii
ACSGSDDVK

SEQ ID NO: 187636 - protein, 9 aa, Borrelia garinii
CSGSDDVKL

SEQ ID NO: 187637 - protein, 9 aa, Borrelia garinii
SGSDDVKLE

SEQ ID NO: 187638 - protein, 9 aa, Borrelia garinii
GSDDVKLES

SEQ ID NO: 187639 - protein, 9 aa, Borrelia garinii
SDDVKLESK

SEQ ID NO: 187640 - protein, 9 aa, Borrelia garinii
DDVKLESKT

SEQ ID NO: 187641 - protein, 9 aa, Borrelia garinii
DVKLESKTV

SEQ ID NO: 187642 - protein, 9 aa, Borrelia garinii
VKLESKTVS

SEQ ID NO: 187643 - protein, 9 aa, Borrelia garinii
KLESKTVSL

SEQ ID NO: 187644 - protein, 9 aa, Borrelia garinii
LESKTVSLI

SEQ ID NO: 187645 - protein, 9 aa, Borrelia garinii
ESKTVSLIV

SEQ ID NO: 187646 - protein, 9 aa, Borrelia garinii
SKTVSLIVD

SEQ ID NO: 187647 - protein, 9 aa, Borrelia garinii
KTVSLIVDG

SEQ ID NO: 187648 - protein, 9 aa, Borrelia garinii
TVSLIVDGA

SEQ ID NO: 187649 - protein, 9 aa, Borrelia garinii
VSLIVDGAF

SEQ ID NO: 187650 - protein, 9 aa, Borrelia garinii
SLIVDGAFD

SEQ ID NO: 187651 - protein, 9 aa, Borrelia garinii
LIVDGAFDD

SEQ ID NO: 187652 - protein, 9 aa, Borrelia garinii
IVDGAFDDK

SEQ ID NO: 187653 - protein, 9 aa, Borrelia garinii
VDGAFDDKG

SEQ ID NO: 187654 - protein, 9 aa, Borrelia garinii
DGAFDDKGF

SEQ ID NO: 187655 - protein, 9 aa, Borrelia garinii
GAFDDKGFN

SEQ ID NO: 187656 - protein, 9 aa, Borrelia garinii
AFDDKGFNE

SEQ ID NO: 187657 - protein, 9 aa, Borrelia garinii
FDDKGFNES

SEQ ID NO: 187658 - protein, 9 aa, Borrelia garinii
DDKGFNESS

SEQ ID NO: 187659 - protein, 9 aa, Borrelia garinii
DKGFNESSS

SEQ ID NO: 187660 - protein, 9 aa, Borrelia garinii
KGFNESSSK

SEQ ID NO: 187661 - protein, 9 aa, Borrelia garinii
GFNESSSKA

SEQ ID NO: 187662 - protein, 9 aa, Borrelia garinii
FNESSSKAI

SEQ ID NO: 187663 - protein, 9 aa, Borrelia garinii
NESSSKAIR

SEQ ID NO: 187664 - protein, 9 aa, Borrelia garinii
ESSSKAIRK

SEQ ID NO: 187665 - protein, 9 aa, Borrelia garinii
SSSKAIRKL

SEQ ID NO: 187666 - protein, 9 aa, Borrelia garinii
SSKAIRKLK

SEQ ID NO: 187667 - protein, 9 aa, Borrelia garinii
SKAIRKLKT

SEQ ID NO: 187668 - protein, 9 aa, Borrelia garinii
KAIRKLKTD

SEQ ID NO: 187669 - protein, 9 aa, Borrelia garinii
AIRKLKTDF

SEQ ID NO: 187670 - protein, 9 aa, Borrelia garinii
IRKLKTDFN

SEQ ID NO: 187671 - protein, 9 aa, Borrelia garinii
RKLKTDFNI

SEQ ID NO: 187672 - protein, 9 aa, Borrelia garinii
KLKTDFNIN

SEQ ID NO: 187673 - protein, 9 aa, Borrelia garinii
LKTDFNINI

SEQ ID NO: 187674 - protein, 9 aa, Borrelia garinii
KTDFNINII

SEQ ID NO: 187675 - protein, 9 aa, Borrelia garinii
TDFNINIIE

SEQ ID NO: 187676 - protein, 9 aa, Borrelia garinii
DFNINIIEK

SEQ ID NO: 187677 - protein, 9 aa, Borrelia garinii
FNINIIEKA

SEQ ID NO: 187678 - protein, 9 aa, Borrelia garinii
NINIIEKAS

SEQ ID NO: 187679 - protein, 9 aa, Borrelia garinii
INIIEKAST

SEQ ID NO: 187680 - protein, 9 aa, Borrelia garinii
NIIEKASTG

SEQ ID NO: 187681 - protein, 9 aa, Borrelia garinii
IIEKASTGN

SEQ ID NO: 187682 - protein, 9 aa, Borrelia garinii
IEKASTGNS

SEQ ID NO: 187683 - protein, 9 aa, Borrelia garinii
EKASTGNSH

SEQ ID NO: 187684 - protein, 9 aa, Borrelia garinii
KASTGNSHL

SEQ ID NO: 187685 - protein, 9 aa, Borrelia garinii
ASTGNSHLG

SEQ ID NO: 187686 - protein, 9 aa, Borrelia garinii
STGNSHLGD

SEQ ID NO: 187687 - protein, 9 aa, Borrelia garinii
TGNSHLGDI

SEQ ID NO: 187688 - protein, 9 aa, Borrelia garinii
GNSHLGDIA

SEQ ID NO: 187689 - protein, 9 aa, Borrelia garinii
NSHLGDIAT

SEQ ID NO: 187690 - protein, 9 aa, Borrelia garinii
SHLGDIATL

SEQ ID NO: 187691 - protein, 9 aa, Borrelia garinii
HLGDIATLE

SEQ ID NO: 187692 - protein, 9 aa, Borrelia garinii
LGDIATLED

SEQ ID NO: 187693 - protein, 9 aa, Borrelia garinii
GDIATLEDG

SEQ ID NO: 187694 - protein, 9 aa, Borrelia garinii
DIATLEDGN

SEQ ID NO: 187695 - protein, 9 aa, Borrelia garinii
IATLEDGNS

SEQ ID NO: 187696 - protein, 9 aa, Borrelia garinii
ATLEDGNSN

SEQ ID NO: 187697 - protein, 9 aa, Borrelia garinii
TLEDGNSNL

SEQ ID NO: 187698 - protein, 9 aa, Borrelia garinii
LEDGNSNLI

SEQ ID NO: 187699 - protein, 9 aa, Borrelia garinii
EDGNSNLIW

SEQ ID NO: 187700 - protein, 9 aa, Borrelia garinii
DGNSNLIWG

SEQ ID NO: 187701 - protein, 9 aa, Borrelia garinii
GNSNLIWGI

SEQ ID NO: 187702 - protein, 9 aa, Borrelia garinii
NSNLIWGIG

SEQ ID NO: 187703 - protein, 9 aa, Borrelia garinii
SNLIWGIGF

SEQ ID NO: 187704 - protein, 9 aa, Borrelia garinii
NLIWGIGFR

SEQ ID NO: 187705 - protein, 9 aa, Borrelia garinii
LIWGIGFRL

SEQ ID NO: 187706 - protein, 9 aa, Borrelia garinii
IWGIGFRLS

SEQ ID NO: 187707 - protein, 9 aa, Borrelia garinii
WGIGFRLSD

SEQ ID NO: 187708 - protein, 9 aa, Borrelia garinii
GIGFRLSDV

SEQ ID NO: 187709 - protein, 9 aa, Borrelia garinii
IGFRLSDVL

SEQ ID NO: 187710 - protein, 9 aa, Borrelia garinii
GFRLSDVLL

SEQ ID NO: 187711 - protein, 9 aa, Borrelia garinii
FRLSDVLLQ

SEQ ID NO: 187712 - protein, 9 aa, Borrelia garinii
RLSDVLLQR

SEQ ID NO: 187713 - protein, 9 aa, Borrelia garinii
LSDVLLQRA

SEQ ID NO: 187714 - protein, 9 aa, Borrelia garinii
SDVLLQRAS

SEQ ID NO: 187715 - protein, 9 aa, Borrelia garinii
DVLLQRASE

SEQ ID NO: 187716 - protein, 9 aa, Borrelia garinii
VLLQRASEN

SEQ ID NO: 187717 - protein, 9 aa, Borrelia garinii
LLQRASENI

SEQ ID NO: 187718 - protein, 9 aa, Borrelia garinii
LQRASENIS

SEQ ID NO: 187719 - protein, 9 aa, Borrelia garinii
QRASENISI

SEQ ID NO: 187720 - protein, 9 aa, Borrelia garinii
RASENISIN

SEQ ID NO: 187721 - protein, 9 aa, Borrelia garinii
ASENISINY

SEQ ID NO: 187722 - protein, 9 aa, Borrelia garinii
SENISINYA

SEQ ID NO: 187723 - protein, 9 aa, Borrelia garinii
ENISINYAI

SEQ ID NO: 187724 - protein, 9 aa, Borrelia garinii
NISINYAIM

SEQ ID NO: 187725 - protein, 9 aa, Borrelia garinii
ISINYAIME

SEQ ID NO: 187726 - protein, 9 aa, Borrelia garinii
SINYAIMEG

SEQ ID NO: 187727 - protein, 9 aa, Borrelia garinii
INYAIMEGV

SEQ ID NO: 187728 - protein, 9 aa, Borrelia garinii
NYAIMEGVY

SEQ ID NO: 187729 - protein, 9 aa, Borrelia garinii
YAIMEGVYN

SEQ ID NO: 187730 - protein, 9 aa, Borrelia garinii
AIMEGVYNE

SEQ ID NO: 187731 - protein, 9 aa, Borrelia garinii
IMEGVYNEI

SEQ ID NO: 187732 - protein, 9 aa, Borrelia garinii
MEGVYNEIQ

SEQ ID NO: 187733 - protein, 9 aa, Borrelia garinii
EGVYNEIQM

SEQ ID NO: 187734 - protein, 9 aa, Borrelia garinii
GVYNEIQMP

SEQ ID NO: 187735 - protein, 9 aa, Borrelia garinii
VYNEIQMPK

SEQ ID NO: 187736 - protein, 9 aa, Borrelia garinii
YNEIQMPKN

SEQ ID NO: 187737 - protein, 9 aa, Borrelia garinii
NEIQMPKNL

SEQ ID NO: 187738 - protein, 9 aa, Borrelia garinii
EIQMPKNLL

SEQ ID NO: 187739 - protein, 9 aa, Borrelia garinii
IQMPKNLLN

SEQ ID NO: 187740 - protein, 9 aa, Borrelia garinii
QMPKNLLNI

SEQ ID NO: 187741 - protein, 9 aa, Borrelia garinii
MPKNLLNIS

SEQ ID NO: 187742 - protein, 9 aa, Borrelia garinii
PKNLLNISF

SEQ ID NO: 187743 - protein, 9 aa, Borrelia garinii
KNLLNISFR

SEQ ID NO: 187744 - protein, 9 aa, Borrelia garinii
NLLNISFRS

SEQ ID NO: 187745 - protein, 9 aa, Borrelia garinii
LLNISFRSE

SEQ ID NO: 187746 - protein, 9 aa, Borrelia garinii
LNISFRSEE

SEQ ID NO: 187747 - protein, 9 aa, Borrelia garinii
NISFRSEEV

SEQ ID NO: 187748 - protein, 9 aa, Borrelia garinii
ISFRSEEVA

SEQ ID NO: 187749 - protein, 9 aa, Borrelia garinii
SFRSEEVAF

SEQ ID NO: 187750 - protein, 9 aa, Borrelia garinii
FRSEEVAFL

SEQ ID NO: 187751 - protein, 9 aa, Borrelia garinii
RSEEVAFLA

SEQ ID NO: 187752 - protein, 9 aa, Borrelia garinii
SEEVAFLAG

SEQ ID NO: 187753 - protein, 9 aa, Borrelia garinii
EEVAFLAGY

SEQ ID NO: 187754 - protein, 9 aa, Borrelia garinii
EVAFLAGYF

SEQ ID NO: 187755 - protein, 9 aa, Borrelia garinii
VAFLAGYFA

SEQ ID NO: 187756 - protein, 9 aa, Borrelia garinii
AFLAGYFAS

SEQ ID NO: 187757 - protein, 9 aa, Borrelia garinii
FLAGYFASK

SEQ ID NO: 187758 - protein, 9 aa, Borrelia garinii
LAGYFASKT

SEQ ID NO: 187759 - protein, 9 aa, Borrelia garinii
AGYFASKTS

SEQ ID NO: 187760 - protein, 9 aa, Borrelia garinii
GYFASKTSK

SEQ ID NO: 187761 - protein, 9 aa, Borrelia garinii
YFASKTSKT

SEQ ID NO: 187762 - protein, 9 aa, Borrelia garinii
FASKTSKTG

SEQ ID NO: 187763 - protein, 9 aa, Borrelia garinii
ASKTSKTGK

SEQ ID NO: 187764 - protein, 9 aa, Borrelia garinii
SKTSKTGKI

SEQ ID NO: 187765 - protein, 9 aa, Borrelia garinii
KTSKTGKIG

SEQ ID NO: 187766 - protein, 9 aa, Borrelia garinii
TSKTGKIGF

SEQ ID NO: 187767 - protein, 9 aa, Borrelia garinii
SKTGKIGFI

SEQ ID NO: 187768 - protein, 9 aa, Borrelia garinii
KTGKIGFIG

SEQ ID NO: 187769 - protein, 9 aa, Borrelia garinii
TGKIGFIGG

SEQ ID NO: 187770 - protein, 9 aa, Borrelia garinii
GKIGFIGGV

SEQ ID NO: 187771 - protein, 9 aa, Borrelia garinii
KIGFIGGVK

SEQ ID NO: 187772 - protein, 9 aa, Borrelia garinii
IGFIGGVKG

SEQ ID NO: 187773 - protein, 9 aa, Borrelia garinii
GFIGGVKGK

SEQ ID NO: 187774 - protein, 9 aa, Borrelia garinii
FIGGVKGKV

SEQ ID NO: 187775 - protein, 9 aa, Borrelia garinii
IGGVKGKVL

SEQ ID NO: 187776 - protein, 9 aa, Borrelia garinii
GGVKGKVLE

SEQ ID NO: 187777 - protein, 9 aa, Borrelia garinii
GVKGKVLES

SEQ ID NO: 187778 - protein, 9 aa, Borrelia garinii
VKGKVLESF

SEQ ID NO: 187779 - protein, 9 aa, Borrelia garinii
KGKVLESFM

SEQ ID NO: 187780 - protein, 9 aa, Borrelia garinii
GKVLESFMY

SEQ ID NO: 187781 - protein, 9 aa, Borrelia garinii
KVLESFMYG

SEQ ID NO: 187782 - protein, 9 aa, Borrelia garinii
VLESFMYGY

SEQ ID NO: 187783 - protein, 9 aa, Borrelia garinii
LESFMYGYE

SEQ ID NO: 187784 - protein, 9 aa, Borrelia garinii
ESFMYGYEA

SEQ ID NO: 187785 - protein, 9 aa, Borrelia garinii
SFMYGYEAG

SEQ ID NO: 187786 - protein, 9 aa, Borrelia garinii
FMYGYEAGA

SEQ ID NO: 187787 - protein, 9 aa, Borrelia garinii
MYGYEAGAK

SEQ ID NO: 187788 - protein, 9 aa, Borrelia garinii
YGYEAGAKY

SEQ ID NO: 187789 - protein, 9 aa, Borrelia garinii
GYEAGAKYA

SEQ ID NO: 187790 - protein, 9 aa, Borrelia garinii
YEAGAKYAN

SEQ ID NO: 187791 - protein, 9 aa, Borrelia garinii
EAGAKYANS

SEQ ID NO: 187792 - protein, 9 aa, Borrelia garinii
AGAKYANST

SEQ ID NO: 187793 - protein, 9 aa, Borrelia garinii
GAKYANSTI

SEQ ID NO: 187794 - protein, 9 aa, Borrelia garinii
AKYANSTIK

SEQ ID NO: 187795 - protein, 9 aa, Borrelia garinii
KYANSTIKV

SEQ ID NO: 187796 - protein, 9 aa, Borrelia garinii
YANSTIKVI

SEQ ID NO: 187797 - protein, 9 aa, Borrelia garinii
ANSTIKVIS

SEQ ID NO: 187798 - protein, 9 aa, Borrelia garinii
NSTIKVISQ

SEQ ID NO: 187799 - protein, 9 aa, Borrelia garinii
STIKVISQY

SEQ ID NO: 187800 - protein, 9 aa, Borrelia garinii
TIKVISQYV

SEQ ID NO: 187801 - protein, 9 aa, Borrelia garinii
IKVISQYVG

SEQ ID NO: 187802 - protein, 9 aa, Borrelia garinii
KVISQYVGT

SEQ ID NO: 187803 - protein, 9 aa, Borrelia garinii
VISQYVGTF

SEQ ID NO: 187804 - protein, 9 aa, Borrelia garinii
ISQYVGTFG

SEQ ID NO: 187805 - protein, 9 aa, Borrelia garinii
SQYVGTFGD

SEQ ID NO: 187806 - protein, 9 aa, Borrelia garinii
QYVGTFGDF

SEQ ID NO: 187807 - protein, 9 aa, Borrelia garinii
YVGTFGDFG

SEQ ID NO: 187808 - protein, 9 aa, Borrelia garinii
VGTFGDFGL

SEQ ID NO: 187809 - protein, 9 aa, Borrelia garinii
GTFGDFGLG

SEQ ID NO: 187810 - protein, 9 aa, Borrelia garinii
TFGDFGLGR

SEQ ID NO: 187811 - protein, 9 aa, Borrelia garinii
FGDFGLGRS

SEQ ID NO: 187812 - protein, 9 aa, Borrelia garinii
GDFGLGRST

SEQ ID NO: 187813 - protein, 9 aa, Borrelia garinii
DFGLGRSTA

SEQ ID NO: 187814 - protein, 9 aa, Borrelia garinii
FGLGRSTAS

SEQ ID NO: 187815 - protein, 9 aa, Borrelia garinii
GLGRSTASN

SEQ ID NO: 187816 - protein, 9 aa, Borrelia garinii
LGRSTASNM

SEQ ID NO: 187817 - protein, 9 aa, Borrelia garinii
GRSTASNMY

SEQ ID NO: 187818 - protein, 9 aa, Borrelia garinii
RSTASNMYR

SEQ ID NO: 187819 - protein, 9 aa, Borrelia garinii
STASNMYRD

SEQ ID NO: 187820 - protein, 9 aa, Borrelia garinii
TASNMYRDG

SEQ ID NO: 187821 - protein, 9 aa, Borrelia garinii
ASNMYRDGV

SEQ ID NO: 187822 - protein, 9 aa, Borrelia garinii
SNMYRDGVD

SEQ ID NO: 187823 - protein, 9 aa, Borrelia garinii
NMYRDGVDI

SEQ ID NO: 187824 - protein, 9 aa, Borrelia garinii
MYRDGVDIV

SEQ ID NO: 187825 - protein, 9 aa, Borrelia garinii
YRDGVDIVF

SEQ ID NO: 187826 - protein, 9 aa, Borrelia garinii
RDGVDIVFA

SEQ ID NO: 187827 - protein, 9 aa, Borrelia garinii
DGVDIVFAA

SEQ ID NO: 187828 - protein, 9 aa, Borrelia garinii
GVDIVFAAA

SEQ ID NO: 187829 - protein, 9 aa, Borrelia garinii
VDIVFAAAG

SEQ ID NO: 187830 - protein, 9 aa, Borrelia garinii
DIVFAAAGL

SEQ ID NO: 187831 - protein, 9 aa, Borrelia garinii
IVFAAAGLS

SEQ ID NO: 187832 - protein, 9 aa, Borrelia garinii
VFAAAGLSG

SEQ ID NO: 187833 - protein, 9 aa, Borrelia garinii
FAAAGLSGI

SEQ ID NO: 187834 - protein, 9 aa, Borrelia garinii
AAAGLSGIG

SEQ ID NO: 187835 - protein, 9 aa, Borrelia garinii
AAGLSGIGV

SEQ ID NO: 187836 - protein, 9 aa, Borrelia garinii
AGLSGIGVI

SEQ ID NO: 187837 - protein, 9 aa, Borrelia garinii
GLSGIGVIE

SEQ ID NO: 187838 - protein, 9 aa, Borrelia garinii
LSGIGVIEA

SEQ ID NO: 187839 - protein, 9 aa, Borrelia garinii
SGIGVIEAA

SEQ ID NO: 187840 - protein, 9 aa, Borrelia garinii
GIGVIEAAK

SEQ ID NO: 187841 - protein, 9 aa, Borrelia garinii
IGVIEAAKE

SEQ ID NO: 187842 - protein, 9 aa, Borrelia garinii
GVIEAAKEL

SEQ ID NO: 187843 - protein, 9 aa, Borrelia garinii
VIEAAKELG

SEQ ID NO: 187844 - protein, 9 aa, Borrelia garinii
IEAAKELGP

SEQ ID NO: 187845 - protein, 9 aa, Borrelia garinii
EAAKELGPD

SEQ ID NO: 187846 - protein, 9 aa, Borrelia garinii
AAKELGPDH

SEQ ID NO: 187847 - protein, 9 aa, Borrelia garinii
AKELGPDHY

SEQ ID NO: 187848 - protein, 9 aa, Borrelia garinii
KELGPDHYI

SEQ ID NO: 187849 - protein, 9 aa, Borrelia garinii
ELGPDHYII

SEQ ID NO: 187850 - protein, 9 aa, Borrelia garinii
LGPDHYIIG

SEQ ID NO: 187851 - protein, 9 aa, Borrelia garinii
GPDHYIIGV

SEQ ID NO: 187852 - protein, 9 aa, Borrelia garinii
PDHYIIGVD

SEQ ID NO: 187853 - protein, 9 aa, Borrelia garinii
DHYIIGVDQ

SEQ ID NO: 187854 - protein, 9 aa, Borrelia garinii
HYIIGVDQD

SEQ ID NO: 187855 - protein, 9 aa, Borrelia garinii
YIIGVDQDQ

SEQ ID NO: 187856 - protein, 9 aa, Borrelia garinii
IIGVDQDQS

SEQ ID NO: 187857 - protein, 9 aa, Borrelia garinii
IGVDQDQSY

SEQ ID NO: 187858 - protein, 9 aa, Borrelia garinii
GVDQDQSYL

SEQ ID NO: 187859 - protein, 9 aa, Borrelia garinii
VDQDQSYLA

SEQ ID NO: 187860 - protein, 9 aa, Borrelia garinii
DQDQSYLAP

SEQ ID NO: 187861 - protein, 9 aa, Borrelia garinii
QDQSYLAPN

SEQ ID NO: 187862 - protein, 9 aa, Borrelia garinii
DQSYLAPNN

SEQ ID NO: 187863 - protein, 9 aa, Borrelia garinii
QSYLAPNNV

SEQ ID NO: 187864 - protein, 9 aa, Borrelia garinii
SYLAPNNVL

SEQ ID NO: 187865 - protein, 9 aa, Borrelia garinii
YLAPNNVLV

SEQ ID NO: 187866 - protein, 9 aa, Borrelia garinii
LAPNNVLVS

SEQ ID NO: 187867 - protein, 9 aa, Borrelia garinii
APNNVLVSA

SEQ ID NO: 187868 - protein, 9 aa, Borrelia garinii
PNNVLVSAV

SEQ ID NO: 187869 - protein, 9 aa, Borrelia garinii
NNVLVSAVK

SEQ ID NO: 187870 - protein, 9 aa, Borrelia garinii
NVLVSAVKK

SEQ ID NO: 187871 - protein, 9 aa, Borrelia garinii
VLVSAVKKV

SEQ ID NO: 187872 - protein, 9 aa, Borrelia garinii
LVSAVKKVD

SEQ ID NO: 187873 - protein, 9 aa, Borrelia garinii
VSAVKKVDS

SEQ ID NO: 187874 - protein, 9 aa, Borrelia garinii
SAVKKVDSL

SEQ ID NO: 187875 - protein, 9 aa, Borrelia garinii
AVKKVDSLM

SEQ ID NO: 187876 - protein, 9 aa, Borrelia garinii
VKKVDSLMY

SEQ ID NO: 187877 - protein, 9 aa, Borrelia garinii
KKVDSLMYS

SEQ ID NO: 187878 - protein, 9 aa, Borrelia garinii
KVDSLMYSL

SEQ ID NO: 187879 - protein, 9 aa, Borrelia garinii
VDSLMYSLT

SEQ ID NO: 187880 - protein, 9 aa, Borrelia garinii
DSLMYSLTK

SEQ ID NO: 187881 - protein, 9 aa, Borrelia garinii
SLMYSLTKK

SEQ ID NO: 187882 - protein, 9 aa, Borrelia garinii
LMYSLTKKY

SEQ ID NO: 187883 - protein, 9 aa, Borrelia garinii
MYSLTKKYL

SEQ ID NO: 187884 - protein, 9 aa, Borrelia garinii
YSLTKKYLE

SEQ ID NO: 187885 - protein, 9 aa, Borrelia garinii
SLTKKYLET

SEQ ID NO: 187886 - protein, 9 aa, Borrelia garinii
LTKKYLETG

SEQ ID NO: 187887 - protein, 9 aa, Borrelia garinii
TKKYLETGI

SEQ ID NO: 187888 - protein, 9 aa, Borrelia garinii
KKYLETGIW

SEQ ID NO: 187889 - protein, 9 aa, Borrelia garinii
KYLETGIWD

SEQ ID NO: 187890 - protein, 9 aa, Borrelia garinii
YLETGIWDG

SEQ ID NO: 187891 - protein, 9 aa, Borrelia garinii
LETGIWDGG

SEQ ID NO: 187892 - protein, 9 aa, Borrelia garinii
ETGIWDGGK

SEQ ID NO: 187893 - protein, 9 aa, Borrelia garinii
TGIWDGGKN

SEQ ID NO: 187894 - protein, 9 aa, Borrelia garinii
GIWDGGKNI

SEQ ID NO: 187895 - protein, 9 aa, Borrelia garinii
IWDGGKNIF

SEQ ID NO: 187896 - protein, 9 aa, Borrelia garinii
WDGGKNIFF

SEQ ID NO: 187897 - protein, 9 aa, Borrelia garinii
DGGKNIFFG

SEQ ID NO: 187898 - protein, 9 aa, Borrelia garinii
GGKNIFFGL

SEQ ID NO: 187899 - protein, 9 aa, Borrelia garinii
GKNIFFGLK

SEQ ID NO: 187900 - protein, 9 aa, Borrelia garinii
KNIFFGLKE

SEQ ID NO: 187901 - protein, 9 aa, Borrelia garinii
NIFFGLKED

SEQ ID NO: 187902 - protein, 9 aa, Borrelia garinii
IFFGLKEDG

SEQ ID NO: 187903 - protein, 9 aa, Borrelia garinii
FFGLKEDGL

SEQ ID NO: 187904 - protein, 9 aa, Borrelia garinii
FGLKEDGLG

SEQ ID NO: 187905 - protein, 9 aa, Borrelia garinii
GLKEDGLGL

SEQ ID NO: 187906 - protein, 9 aa, Borrelia garinii
LKEDGLGLV

SEQ ID NO: 187907 - protein, 9 aa, Borrelia garinii
KEDGLGLVL

SEQ ID NO: 187908 - protein, 9 aa, Borrelia garinii
EDGLGLVLN

SEQ ID NO: 187909 - protein, 9 aa, Borrelia garinii
DGLGLVLNE

SEQ ID NO: 187910 - protein, 9 aa, Borrelia garinii
GLGLVLNEN

SEQ ID NO: 187911 - protein, 9 aa, Borrelia garinii
LGLVLNENL

SEQ ID NO: 187912 - protein, 9 aa, Borrelia garinii
GLVLNENLK

SEQ ID NO: 187913 - protein, 9 aa, Borrelia garinii
LVLNENLKS

SEQ ID NO: 187914 - protein, 9 aa, Borrelia garinii
VLNENLKSN

SEQ ID NO: 187915 - protein, 9 aa, Borrelia garinii
LNENLKSNY

SEQ ID NO: 187916 - protein, 9 aa, Borrelia garinii
NENLKSNYS

SEQ ID NO: 187917 - protein, 9 aa, Borrelia garinii
ENLKSNYSE

SEQ ID NO: 187918 - protein, 9 aa, Borrelia garinii
NLKSNYSEI

SEQ ID NO: 187919 - protein, 9 aa, Borrelia garinii
LKSNYSEIY

SEQ ID NO: 187920 - protein, 9 aa, Borrelia garinii
KSNYSEIYN

SEQ ID NO: 187921 - protein, 9 aa, Borrelia garinii
SNYSEIYNK

SEQ ID NO: 187922 - protein, 9 aa, Borrelia garinii
NYSEIYNKS

SEQ ID NO: 187923 - protein, 9 aa, Borrelia garinii
YSEIYNKSL

SEQ ID NO: 187924 - protein, 9 aa, Borrelia garinii
SEIYNKSLE

SEQ ID NO: 187925 - protein, 9 aa, Borrelia garinii
EIYNKSLEI

SEQ ID NO: 187926 - protein, 9 aa, Borrelia garinii
IYNKSLEIG

SEQ ID NO: 187927 - protein, 9 aa, Borrelia garinii
YNKSLEIGQ

SEQ ID NO: 187928 - protein, 9 aa, Borrelia garinii
NKSLEIGQS

SEQ ID NO: 187929 - protein, 9 aa, Borrelia garinii
KSLEIGQSI

SEQ ID NO: 187930 - protein, 9 aa, Borrelia garinii
SLEIGQSIM

SEQ ID NO: 187931 - protein, 9 aa, Borrelia garinii
LEIGQSIME

SEQ ID NO: 187932 - protein, 9 aa, Borrelia garinii
EIGQSIMEG

SEQ ID NO: 187933 - protein, 9 aa, Borrelia garinii
IGQSIMEGI

SEQ ID NO: 187934 - protein, 9 aa, Borrelia garinii
GQSIMEGII

SEQ ID NO: 187935 - protein, 9 aa, Borrelia garinii
QSIMEGIIK

SEQ ID NO: 187936 - protein, 9 aa, Borrelia garinii
SIMEGIIKV

SEQ ID NO: 187937 - protein, 9 aa, Borrelia garinii
IMEGIIKVP

SEQ ID NO: 187938 - protein, 9 aa, Borrelia garinii
MEGIIKVPY

SEQ ID NO: 187939 - protein, 9 aa, Borrelia garinii
EGIIKVPYD

SEQ ID NO: 187940 - protein, 9 aa, Borrelia garinii
GIIKVPYDK

SEQ ID NO: 187941 - protein, 9 aa, Borrelia garinii
IIKVPYDKA

SEQ ID NO: 187942 - protein, 9 aa, Borrelia garinii
IKVPYDKAS

SEQ ID NO: 187943 - protein, 9 aa, Borrelia garinii
KVPYDKASY

SEQ ID NO: 187944 - protein, 9 aa, Borrelia garinii
VPYDKASYD

SEQ ID NO: 187945 - protein, 9 aa, Borrelia garinii
PYDKASYDN

SEQ ID NO: 187946 - protein, 9 aa, Borrelia garinii
YDKASYDNF

SEQ ID NO: 187947 - protein, 9 aa, Borrelia garinii
DKASYDNFV

SEQ ID NO: 187948 - protein, 9 aa, Borrelia garinii
KASYDNFVL

SEQ ID NO: 187949 - protein, 9 aa, Borrelia garinii
ASYDNFVLQ

SEQ ID NO: 187950 - protein, 9 aa, Borrelia garinii
SYDNFVLQI

SEQ ID NO: 187951 - protein, 9 aa, Borrelia garinii
YDNFVLQIA

SEQ ID NO: 187952 - protein, 9 aa, Borrelia garinii
DNFVLQIAN

SEQ ID NO: 187953 - protein, 10 aa, Borrelia garinii
MLNKVYCFIV

SEQ ID NO: 187954 - protein, 10 aa, Borrelia garinii
LNKVYCFIVF

SEQ ID NO: 187955 - protein, 10 aa, Borrelia garinii
NKVYCFIVFL

SEQ ID NO: 187956 - protein, 10 aa, Borrelia garinii
KVYCFIVFLF

SEQ ID NO: 187957 - protein, 10 aa, Borrelia garinii
VYCFIVFLFI

SEQ ID NO: 187958 - protein, 10 aa, Borrelia garinii
YCFIVFLFII

SEQ ID NO: 187959 - protein, 10 aa, Borrelia garinii
CFIVFLFIIA

SEQ ID NO: 187960 - protein, 10 aa, Borrelia garinii
FIVFLFIIAC

SEQ ID NO: 187961 - protein, 10 aa, Borrelia garinii
IVFLFIIACS

SEQ ID NO: 187962 - protein, 10 aa, Borrelia garinii
VFLFIIACSG

SEQ ID NO: 187963 - protein, 10 aa, Borrelia garinii
FLFIIACSGS

SEQ ID NO: 187964 - protein, 10 aa, Borrelia garinii
LFIIACSGSD

SEQ ID NO: 187965 - protein, 10 aa, Borrelia garinii
FIIACSGSDD

SEQ ID NO: 187966 - protein, 10 aa, Borrelia garinii
IIACSGSDDV

SEQ ID NO: 187967 - protein, 10 aa, Borrelia garinii
IACSGSDDVK

SEQ ID NO: 187968 - protein, 10 aa, Borrelia garinii
ACSGSDDVKL

SEQ ID NO: 187969 - protein, 10 aa, Borrelia garinii
CSGSDDVKLE

SEQ ID NO: 187970 - protein, 10 aa, Borrelia garinii
SGSDDVKLES

SEQ ID NO: 187971 - protein, 10 aa, Borrelia garinii
GSDDVKLESK

SEQ ID NO: 187972 - protein, 10 aa, Borrelia garinii
SDDVKLESKT

SEQ ID NO: 187973 - protein, 10 aa, Borrelia garinii
DDVKLESKTV

SEQ ID NO: 187974 - protein, 10 aa, Borrelia garinii
DVKLESKTVS

SEQ ID NO: 187975 - protein, 10 aa, Borrelia garinii
VKLESKTVSL

SEQ ID NO: 187976 - protein, 10 aa, Borrelia garinii
KLESKTVSLI

SEQ ID NO: 187977 - protein, 10 aa, Borrelia garinii
LESKTVSLIV

SEQ ID NO: 187978 - protein, 10 aa, Borrelia garinii
ESKTVSLIVD

SEQ ID NO: 187979 - protein, 10 aa, Borrelia garinii
SKTVSLIVDG

SEQ ID NO: 187980 - protein, 10 aa, Borrelia garinii
KTVSLIVDGA

SEQ ID NO: 187981 - protein, 10 aa, Borrelia garinii
TVSLIVDGAF

SEQ ID NO: 187982 - protein, 10 aa, Borrelia garinii
VSLIVDGAFD

SEQ ID NO: 187983 - protein, 10 aa, Borrelia garinii
SLIVDGAFDD

SEQ ID NO: 187984 - protein, 10 aa, Borrelia garinii
LIVDGAFDDK

SEQ ID NO: 187985 - protein, 10 aa, Borrelia garinii
IVDGAFDDKG

SEQ ID NO: 187986 - protein, 10 aa, Borrelia garinii
VDGAFDDKGF

SEQ ID NO: 187987 - protein, 10 aa, Borrelia garinii
DGAFDDKGFN

SEQ ID NO: 187988 - protein, 10 aa, Borrelia garinii
GAFDDKGFNE

SEQ ID NO: 187989 - protein, 10 aa, Borrelia garinii
AFDDKGFNES

SEQ ID NO: 187990 - protein, 10 aa, Borrelia garinii
FDDKGFNESS

SEQ ID NO: 187991 - protein, 10 aa, Borrelia garinii
DDKGFNESSS

SEQ ID NO: 187992 - protein, 10 aa, Borrelia garinii
DKGFNESSSK

SEQ ID NO: 187993 - protein, 10 aa, Borrelia garinii
KGFNESSSKA

SEQ ID NO: 187994 - protein, 10 aa, Borrelia garinii
GFNESSSKAI

SEQ ID NO: 187995 - protein, 10 aa, Borrelia garinii
FNESSSKAIR

SEQ ID NO: 187996 - protein, 10 aa, Borrelia garinii
NESSSKAIRK

SEQ ID NO: 187997 - protein, 10 aa, Borrelia garinii
ESSSKAIRKL

SEQ ID NO: 187998 - protein, 10 aa, Borrelia garinii
SSSKAIRKLK

SEQ ID NO: 187999 - protein, 10 aa, Borrelia garinii
SSKAIRKLKT

SEQ ID NO: 188000 - protein, 10 aa, Borrelia garinii
SKAIRKLKTD

SEQ ID NO: 188001 - protein, 10 aa, Borrelia garinii
KAIRKLKTDF

SEQ ID NO: 188002 - protein, 10 aa, Borrelia garinii
AIRKLKTDFN

SEQ ID NO: 188003 - protein, 10 aa, Borrelia garinii
IRKLKTDFNI

SEQ ID NO: 188004 - protein, 10 aa, Borrelia garinii
RKLKTDFNIN

SEQ ID NO: 188005 - protein, 10 aa, Borrelia garinii
KLKTDFNINI

SEQ ID NO: 188006 - protein, 10 aa, Borrelia garinii
LKTDFNINII

SEQ ID NO: 188007 - protein, 10 aa, Borrelia garinii
KTDFNINIIE

SEQ ID NO: 188008 - protein, 10 aa, Borrelia garinii
TDFNINIIEK

SEQ ID NO: 188009 - protein, 10 aa, Borrelia garinii
DFNINIIEKA

SEQ ID NO: 188010 - protein, 10 aa, Borrelia garinii
FNINIIEKAS

SEQ ID NO: 188011 - protein, 10 aa, Borrelia garinii
NINIIEKAST

SEQ ID NO: 188012 - protein, 10 aa, Borrelia garinii
INIIEKASTG

SEQ ID NO: 188013 - protein, 10 aa, Borrelia garinii
NIIEKASTGN

SEQ ID NO: 188014 - protein, 10 aa, Borrelia garinii
IIEKASTGNS

SEQ ID NO: 188015 - protein, 10 aa, Borrelia garinii
IEKASTGNSH

SEQ ID NO: 188016 - protein, 10 aa, Borrelia garinii
EKASTGNSHL

SEQ ID NO: 188017 - protein, 10 aa, Borrelia garinii
KASTGNSHLG

SEQ ID NO: 188018 - protein, 10 aa, Borrelia garinii
ASTGNSHLGD

SEQ ID NO: 188019 - protein, 10 aa, Borrelia garinii
STGNSHLGDI

SEQ ID NO: 188020 - protein, 10 aa, Borrelia garinii
TGNSHLGDIA

SEQ ID NO: 188021 - protein, 10 aa, Borrelia garinii
GNSHLGDIAT

SEQ ID NO: 188022 - protein, 10 aa, Borrelia garinii
NSHLGDIATL

SEQ ID NO: 188023 - protein, 10 aa, Borrelia garinii
SHLGDIATLE

SEQ ID NO: 188024 - protein, 10 aa, Borrelia garinii
HLGDIATLED

SEQ ID NO: 188025 - protein, 10 aa, Borrelia garinii
LGDIATLEDG

SEQ ID NO: 188026 - protein, 10 aa, Borrelia garinii
GDIATLEDGN

SEQ ID NO: 188027 - protein, 10 aa, Borrelia garinii
DIATLEDGNS

SEQ ID NO: 188028 - protein, 10 aa, Borrelia garinii
IATLEDGNSN

SEQ ID NO: 188029 - protein, 10 aa, Borrelia garinii
ATLEDGNSNL

SEQ ID NO: 188030 - protein, 10 aa, Borrelia garinii
TLEDGNSNLI

SEQ ID NO: 188031 - protein, 10 aa, Borrelia garinii
LEDGNSNLIW

SEQ ID NO: 188032 - protein, 10 aa, Borrelia garinii
EDGNSNLIWG

SEQ ID NO: 188033 - protein, 10 aa, Borrelia garinii
DGNSNLIWGI

SEQ ID NO: 188034 - protein, 10 aa, Borrelia garinii
GNSNLIWGIG

SEQ ID NO: 188035 - protein, 10 aa, Borrelia garinii
NSNLIWGIGF

SEQ ID NO: 188036 - protein, 10 aa, Borrelia garinii
SNLIWGIGFR

SEQ ID NO: 188037 - protein, 10 aa, Borrelia garinii
NLIWGIGFRL

SEQ ID NO: 188038 - protein, 10 aa, Borrelia garinii
LIWGIGFRLS

SEQ ID NO: 188039 - protein, 10 aa, Borrelia garinii
IWGIGFRLSD

SEQ ID NO: 188040 - protein, 10 aa, Borrelia garinii
WGIGFRLSDV

SEQ ID NO: 188041 - protein, 10 aa, Borrelia garinii
GIGFRLSDVL

SEQ ID NO: 188042 - protein, 10 aa, Borrelia garinii
IGFRLSDVLL

SEQ ID NO: 188043 - protein, 10 aa, Borrelia garinii
GFRLSDVLLQ

SEQ ID NO: 188044 - protein, 10 aa, Borrelia garinii
FRLSDVLLQR

SEQ ID NO: 188045 - protein, 10 aa, Borrelia garinii
RLSDVLLQRA

SEQ ID NO: 188046 - protein, 10 aa, Borrelia garinii
LSDVLLQRAS

SEQ ID NO: 188047 - protein, 10 aa, Borrelia garinii
SDVLLQRASE

SEQ ID NO: 188048 - protein, 10 aa, Borrelia garinii
DVLLQRASEN

SEQ ID NO: 188049 - protein, 10 aa, Borrelia garinii
VLLQRASENI

SEQ ID NO: 188050 - protein, 10 aa, Borrelia garinii
LLQRASENIS

SEQ ID NO: 188051 - protein, 10 aa, Borrelia garinii
LQRASENISI

SEQ ID NO: 188052 - protein, 10 aa, Borrelia garinii
QRASENISIN

SEQ ID NO: 188053 - protein, 10 aa, Borrelia garinii
RASENISINY

SEQ ID NO: 188054 - protein, 10 aa, Borrelia garinii
ASENISINYA

SEQ ID NO: 188055 - protein, 10 aa, Borrelia garinii
SENISINYAI

SEQ ID NO: 188056 - protein, 10 aa, Borrelia garinii
ENISINYAIM

SEQ ID NO: 188057 - protein, 10 aa, Borrelia garinii
NISINYAIME

SEQ ID NO: 188058 - protein, 10 aa, Borrelia garinii
ISINYAIMEG

SEQ ID NO: 188059 - protein, 10 aa, Borrelia garinii
SINYAIMEGV

SEQ ID NO: 188060 - protein, 10 aa, Borrelia garinii
INYAIMEGVY

SEQ ID NO: 188061 - protein, 10 aa, Borrelia garinii
NYAIMEGVYN

SEQ ID NO: 188062 - protein, 10 aa, Borrelia garinii
YAIMEGVYNE

SEQ ID NO: 188063 - protein, 10 aa, Borrelia garinii
AIMEGVYNEI

SEQ ID NO: 188064 - protein, 10 aa, Borrelia garinii
IMEGVYNEIQ

SEQ ID NO: 188065 - protein, 10 aa, Borrelia garinii
MEGVYNEIQM

SEQ ID NO: 188066 - protein, 10 aa, Borrelia garinii
EGVYNEIQMP

SEQ ID NO: 188067 - protein, 10 aa, Borrelia garinii
GVYNEIQMPK

SEQ ID NO: 188068 - protein, 10 aa, Borrelia garinii
VYNEIQMPKN

SEQ ID NO: 188069 - protein, 10 aa, Borrelia garinii
YNEIQMPKNL

SEQ ID NO: 188070 - protein, 10 aa, Borrelia garinii
NEIQMPKNLL

SEQ ID NO: 188071 - protein, 10 aa, Borrelia garinii
EIQMPKNLLN

SEQ ID NO: 188072 - protein, 10 aa, Borrelia garinii
IQMPKNLLNI

SEQ ID NO: 188073 - protein, 10 aa, Borrelia garinii
QMPKNLLNIS

SEQ ID NO: 188074 - protein, 10 aa, Borrelia garinii
MPKNLLNISF

SEQ ID NO: 188075 - protein, 10 aa, Borrelia garinii
PKNLLNISFR

SEQ ID NO: 188076 - protein, 10 aa, Borrelia garinii
KNLLNISFRS

SEQ ID NO: 188077 - protein, 10 aa, Borrelia garinii
NLLNISFRSE

SEQ ID NO: 188078 - protein, 10 aa, Borrelia garinii
LLNISFRSEE

SEQ ID NO: 188079 - protein, 10 aa, Borrelia garinii
LNISFRSEEV

SEQ ID NO: 188080 - protein, 10 aa, Borrelia garinii
NISFRSEEVA

SEQ ID NO: 188081 - protein, 10 aa, Borrelia garinii
ISFRSEEVAF

SEQ ID NO: 188082 - protein, 10 aa, Borrelia garinii
SFRSEEVAFL

SEQ ID NO: 188083 - protein, 10 aa, Borrelia garinii
FRSEEVAFLA

SEQ ID NO: 188084 - protein, 10 aa, Borrelia garinii
RSEEVAFLAG

SEQ ID NO: 188085 - protein, 10 aa, Borrelia garinii
SEEVAFLAGY

SEQ ID NO: 188086 - protein, 10 aa, Borrelia garinii
EEVAFLAGYF

SEQ ID NO: 188087 - protein, 10 aa, Borrelia garinii
EVAFLAGYFA

SEQ ID NO: 188088 - protein, 10 aa, Borrelia garinii
VAFLAGYFAS

SEQ ID NO: 188089 - protein, 10 aa, Borrelia garinii
AFLAGYFASK

SEQ ID NO: 188090 - protein, 10 aa, Borrelia garinii
FLAGYFASKT

SEQ ID NO: 188091 - protein, 10 aa, Borrelia garinii
LAGYFASKTS

SEQ ID NO: 188092 - protein, 10 aa, Borrelia garinii
AGYFASKTSK

SEQ ID NO: 188093 - protein, 10 aa, Borrelia garinii
GYFASKTSKT

SEQ ID NO: 188094 - protein, 10 aa, Borrelia garinii
YFASKTSKTG

SEQ ID NO: 188095 - protein, 10 aa, Borrelia garinii
FASKTSKTGK

SEQ ID NO: 188096 - protein, 10 aa, Borrelia garinii
ASKTSKTGKI

SEQ ID NO: 188097 - protein, 10 aa, Borrelia garinii
SKTSKTGKIG

SEQ ID NO: 188098 - protein, 10 aa, Borrelia garinii
KTSKTGKIGF

SEQ ID NO: 188099 - protein, 10 aa, Borrelia garinii
TSKTGKIGFI

SEQ ID NO: 188100 - protein, 10 aa, Borrelia garinii
SKTGKIGFIG

SEQ ID NO: 188101 - protein, 10 aa, Borrelia garinii
KTGKIGFIGG

SEQ ID NO: 188102 - protein, 10 aa, Borrelia garinii
TGKIGFIGGV

SEQ ID NO: 188103 - protein, 10 aa, Borrelia garinii
GKIGFIGGVK

SEQ ID NO: 188104 - protein, 10 aa, Borrelia garinii
KIGFIGGVKG

SEQ ID NO: 188105 - protein, 10 aa, Borrelia garinii
IGFIGGVKGK

SEQ ID NO: 188106 - protein, 10 aa, Borrelia garinii
GFIGGVKGKV

SEQ ID NO: 188107 - protein, 10 aa, Borrelia garinii
FIGGVKGKVL

SEQ ID NO: 188108 - protein, 10 aa, Borrelia garinii
IGGVKGKVLE

SEQ ID NO: 188109 - protein, 10 aa, Borrelia garinii
GGVKGKVLES

SEQ ID NO: 188110 - protein, 10 aa, Borrelia garinii
GVKGKVLESF

SEQ ID NO: 188111 - protein, 10 aa, Borrelia garinii
VKGKVLESFM

SEQ ID NO: 188112 - protein, 10 aa, Borrelia garinii
KGKVLESFMY

SEQ ID NO: 188113 - protein, 10 aa, Borrelia garinii
GKVLESFMYG

SEQ ID NO: 188114 - protein, 10 aa, Borrelia garinii
KVLESFMYGY

SEQ ID NO: 188115 - protein, 10 aa, Borrelia garinii
VLESFMYGYE

SEQ ID NO: 188116 - protein, 10 aa, Borrelia garinii
LESFMYGYEA

SEQ ID NO: 188117 - protein, 10 aa, Borrelia garinii
ESFMYGYEAG

SEQ ID NO: 188118 - protein, 10 aa, Borrelia garinii
SFMYGYEAGA

SEQ ID NO: 188119 - protein, 10 aa, Borrelia garinii
FMYGYEAGAK

SEQ ID NO: 188120 - protein, 10 aa, Borrelia garinii
MYGYEAGAKY

SEQ ID NO: 188121 - protein, 10 aa, Borrelia garinii
YGYEAGAKYA

SEQ ID NO: 188122 - protein, 10 aa, Borrelia garinii
GYEAGAKYAN

SEQ ID NO: 188123 - protein, 10 aa, Borrelia garinii
YEAGAKYANS

SEQ ID NO: 188124 - protein, 10 aa, Borrelia garinii
EAGAKYANST

SEQ ID NO: 188125 - protein, 10 aa, Borrelia garinii
AGAKYANSTI

SEQ ID NO: 188126 - protein, 10 aa, Borrelia garinii
GAKYANSTIK

SEQ ID NO: 188127 - protein, 10 aa, Borrelia garinii
AKYANSTIKV

SEQ ID NO: 188128 - protein, 10 aa, Borrelia garinii
KYANSTIKVI

SEQ ID NO: 188129 - protein, 10 aa, Borrelia garinii
YANSTIKVIS

SEQ ID NO: 188130 - protein, 10 aa, Borrelia garinii
ANSTIKVISQ

SEQ ID NO: 188131 - protein, 10 aa, Borrelia garinii
NSTIKVISQY

SEQ ID NO: 188132 - protein, 10 aa, Borrelia garinii
STIKVISQYV

SEQ ID NO: 188133 - protein, 10 aa, Borrelia garinii
TIKVISQYVG

SEQ ID NO: 188134 - protein, 10 aa, Borrelia garinii
IKVISQYVGT

SEQ ID NO: 188135 - protein, 10 aa, Borrelia garinii
KVISQYVGTF

SEQ ID NO: 188136 - protein, 10 aa, Borrelia garinii
VISQYVGTFG

SEQ ID NO: 188137 - protein, 10 aa, Borrelia garinii
ISQYVGTFGD

SEQ ID NO: 188138 - protein, 10 aa, Borrelia garinii
SQYVGTFGDF

SEQ ID NO: 188139 - protein, 10 aa, Borrelia garinii
QYVGTFGDFG

SEQ ID NO: 188140 - protein, 10 aa, Borrelia garinii
YVGTFGDFGL

SEQ ID NO: 188141 - protein, 10 aa, Borrelia garinii
VGTFGDFGLG

SEQ ID NO: 188142 - protein, 10 aa, Borrelia garinii
GTFGDFGLGR

SEQ ID NO: 188143 - protein, 10 aa, Borrelia garinii
TFGDFGLGRS

SEQ ID NO: 188144 - protein, 10 aa, Borrelia garinii
FGDFGLGRST

SEQ ID NO: 188145 - protein, 10 aa, Borrelia garinii
GDFGLGRSTA

SEQ ID NO: 188146 - protein, 10 aa, Borrelia garinii
DFGLGRSTAS

SEQ ID NO: 188147 - protein, 10 aa, Borrelia garinii
FGLGRSTASN

SEQ ID NO: 188148 - protein, 10 aa, Borrelia garinii
GLGRSTASNM

SEQ ID NO: 188149 - protein, 10 aa, Borrelia garinii
LGRSTASNMY

SEQ ID NO: 188150 - protein, 10 aa, Borrelia garinii
GRSTASNMYR

SEQ ID NO: 188151 - protein, 10 aa, Borrelia garinii
RSTASNMYRD

SEQ ID NO: 188152 - protein, 10 aa, Borrelia garinii
STASNMYRDG

SEQ ID NO: 188153 - protein, 10 aa, Borrelia garinii
TASNMYRDGV

SEQ ID NO: 188154 - protein, 10 aa, Borrelia garinii
ASNMYRDGVD

SEQ ID NO: 188155 - protein, 10 aa, Borrelia garinii
SNMYRDGVDI

SEQ ID NO: 188156 - protein, 10 aa, Borrelia garinii
NMYRDGVDIV

SEQ ID NO: 188157 - protein, 10 aa, Borrelia garinii
MYRDGVDIVF

SEQ ID NO: 188158 - protein, 10 aa, Borrelia garinii
YRDGVDIVFA

SEQ ID NO: 188159 - protein, 10 aa, Borrelia garinii
RDGVDIVFAA

SEQ ID NO: 188160 - protein, 10 aa, Borrelia garinii
DGVDIVFAAA

SEQ ID NO: 188161 - protein, 10 aa, Borrelia garinii
GVDIVFAAAG

SEQ ID NO: 188162 - protein, 10 aa, Borrelia garinii
VDIVFAAAGL

SEQ ID NO: 188163 - protein, 10 aa, Borrelia garinii
DIVFAAAGLS

SEQ ID NO: 188164 - protein, 10 aa, Borrelia garinii
IVFAAAGLSG

SEQ ID NO: 188165 - protein, 10 aa, Borrelia garinii
VFAAAGLSGI

SEQ ID NO: 188166 - protein, 10 aa, Borrelia garinii
FAAAGLSGIG

SEQ ID NO: 188167 - protein, 10 aa, Borrelia garinii
AAAGLSGIGV

SEQ ID NO: 188168 - protein, 10 aa, Borrelia garinii
AAGLSGIGVI

SEQ ID NO: 188169 - protein, 10 aa, Borrelia garinii
AGLSGIGVIE

SEQ ID NO: 188170 - protein, 10 aa, Borrelia garinii
GLSGIGVIEA

SEQ ID NO: 188171 - protein, 10 aa, Borrelia garinii
LSGIGVIEAA

SEQ ID NO: 188172 - protein, 10 aa, Borrelia garinii
SGIGVIEAAK

SEQ ID NO: 188173 - protein, 10 aa, Borrelia garinii
GIGVIEAAKE

SEQ ID NO: 188174 - protein, 10 aa, Borrelia garinii
IGVIEAAKEL

SEQ ID NO: 188175 - protein, 10 aa, Borrelia garinii
GVIEAAKELG

SEQ ID NO: 188176 - protein, 10 aa, Borrelia garinii
VIEAAKELGP

SEQ ID NO: 188177 - protein, 10 aa, Borrelia garinii
IEAAKELGPD

SEQ ID NO: 188178 - protein, 10 aa, Borrelia garinii
EAAKELGPDH

SEQ ID NO: 188179 - protein, 10 aa, Borrelia garinii
AAKELGPDHY

SEQ ID NO: 188180 - protein, 10 aa, Borrelia garinii
AKELGPDHYI

SEQ ID NO: 188181 - protein, 10 aa, Borrelia garinii
KELGPDHYII

SEQ ID NO: 188182 - protein, 10 aa, Borrelia garinii
ELGPDHYIIG

SEQ ID NO: 188183 - protein, 10 aa, Borrelia garinii
LGPDHYIIGV

SEQ ID NO: 188184 - protein, 10 aa, Borrelia garinii
GPDHYIIGVD

SEQ ID NO: 188185 - protein, 10 aa, Borrelia garinii
PDHYIIGVDQ

SEQ ID NO: 188186 - protein, 10 aa, Borrelia garinii
DHYIIGVDQD

SEQ ID NO: 188187 - protein, 10 aa, Borrelia garinii
HYIIGVDQDQ

SEQ ID NO: 188188 - protein, 10 aa, Borrelia garinii
YIIGVDQDQS

SEQ ID NO: 188189 - protein, 10 aa, Borrelia garinii
IIGVDQDQSY

SEQ ID NO: 188190 - protein, 10 aa, Borrelia garinii
IGVDQDQSYL

SEQ ID NO: 188191 - protein, 10 aa, Borrelia garinii
GVDQDQSYLA

SEQ ID NO: 188192 - protein, 10 aa, Borrelia garinii
VDQDQSYLAP

SEQ ID NO: 188193 - protein, 10 aa, Borrelia garinii
DQDQSYLAPN

SEQ ID NO: 188194 - protein, 10 aa, Borrelia garinii
QDQSYLAPNN

SEQ ID NO: 188195 - protein, 10 aa, Borrelia garinii
DQSYLAPNNV

SEQ ID NO: 188196 - protein, 10 aa, Borrelia garinii
QSYLAPNNVL

SEQ ID NO: 188197 - protein, 10 aa, Borrelia garinii
SYLAPNNVLV

SEQ ID NO: 188198 - protein, 10 aa, Borrelia garinii
YLAPNNVLVS

SEQ ID NO: 188199 - protein, 10 aa, Borrelia garinii
LAPNNVLVSA

SEQ ID NO: 188200 - protein, 10 aa, Borrelia garinii
APNNVLVSAV

SEQ ID NO: 188201 - protein, 10 aa, Borrelia garinii
PNNVLVSAVK

SEQ ID NO: 188202 - protein, 10 aa, Borrelia garinii
NNVLVSAVKK

SEQ ID NO: 188203 - protein, 10 aa, Borrelia garinii
NVLVSAVKKV

SEQ ID NO: 188204 - protein, 10 aa, Borrelia garinii
VLVSAVKKVD

SEQ ID NO: 188205 - protein, 10 aa, Borrelia garinii
LVSAVKKVDS

SEQ ID NO: 188206 - protein, 10 aa, Borrelia garinii
VSAVKKVDSL

SEQ ID NO: 188207 - protein, 10 aa, Borrelia garinii
SAVKKVDSLM

SEQ ID NO: 188208 - protein, 10 aa, Borrelia garinii
AVKKVDSLMY

SEQ ID NO: 188209 - protein, 10 aa, Borrelia garinii
VKKVDSLMYS

SEQ ID NO: 188210 - protein, 10 aa, Borrelia garinii
KKVDSLMYSL

SEQ ID NO: 188211 - protein, 10 aa, Borrelia garinii
KVDSLMYSLT

SEQ ID NO: 188212 - protein, 10 aa, Borrelia garinii
VDSLMYSLTK

SEQ ID NO: 188213 - protein, 10 aa, Borrelia garinii
DSLMYSLTKK

SEQ ID NO: 188214 - protein, 10 aa, Borrelia garinii
SLMYSLTKKY

SEQ ID NO: 188215 - protein, 10 aa, Borrelia garinii
LMYSLTKKYL

SEQ ID NO: 188216 - protein, 10 aa, Borrelia garinii
MYSLTKKYLE

SEQ ID NO: 188217 - protein, 10 aa, Borrelia garinii
YSLTKKYLET

SEQ ID NO: 188218 - protein, 10 aa, Borrelia garinii
SLTKKYLETG

SEQ ID NO: 188219 - protein, 10 aa, Borrelia garinii
LTKKYLETGI

SEQ ID NO: 188220 - protein, 10 aa, Borrelia garinii
TKKYLETGIW

SEQ ID NO: 188221 - protein, 10 aa, Borrelia garinii
KKYLETGIWD

SEQ ID NO: 188222 - protein, 10 aa, Borrelia garinii
KYLETGIWDG

SEQ ID NO: 188223 - protein, 10 aa, Borrelia garinii
YLETGIWDGG

SEQ ID NO: 188224 - protein, 10 aa, Borrelia garinii
LETGIWDGGK

SEQ ID NO: 188225 - protein, 10 aa, Borrelia garinii
ETGIWDGGKN

SEQ ID NO: 188226 - protein, 10 aa, Borrelia garinii
TGIWDGGKNI

SEQ ID NO: 188227 - protein, 10 aa, Borrelia garinii
GIWDGGKNIF

SEQ ID NO: 188228 - protein, 10 aa, Borrelia garinii
IWDGGKNIFF

SEQ ID NO: 188229 - protein, 10 aa, Borrelia garinii
WDGGKNIFFG

SEQ ID NO: 188230 - protein, 10 aa, Borrelia garinii
DGGKNIFFGL

SEQ ID NO: 188231 - protein, 10 aa, Borrelia garinii
GGKNIFFGLK

SEQ ID NO: 188232 - protein, 10 aa, Borrelia garinii
GKNIFFGLKE

SEQ ID NO: 188233 - protein, 10 aa, Borrelia garinii
KNIFFGLKED

SEQ ID NO: 188234 - protein, 10 aa, Borrelia garinii
NIFFGLKEDG

SEQ ID NO: 188235 - protein, 10 aa, Borrelia garinii
IFFGLKEDGL

SEQ ID NO: 188236 - protein, 10 aa, Borrelia garinii
FFGLKEDGLG

SEQ ID NO: 188237 - protein, 10 aa, Borrelia garinii
FGLKEDGLGL

SEQ ID NO: 188238 - protein, 10 aa, Borrelia garinii
GLKEDGLGLV

SEQ ID NO: 188239 - protein, 10 aa, Borrelia garinii
LKEDGLGLVL

SEQ ID NO: 188240 - protein, 10 aa, Borrelia garinii
KEDGLGLVLN

SEQ ID NO: 188241 - protein, 10 aa, Borrelia garinii
EDGLGLVLNE

SEQ ID NO: 188242 - protein, 10 aa, Borrelia garinii
DGLGLVLNEN

SEQ ID NO: 188243 - protein, 10 aa, Borrelia garinii
GLGLVLNENL

SEQ ID NO: 188244 - protein, 10 aa, Borrelia garinii
LGLVLNENLK

SEQ ID NO: 188245 - protein, 10 aa, Borrelia garinii
GLVLNENLKS

SEQ ID NO: 188246 - protein, 10 aa, Borrelia garinii
LVLNENLKSN

SEQ ID NO: 188247 - protein, 10 aa, Borrelia garinii
VLNENLKSNY

SEQ ID NO: 188248 - protein, 10 aa, Borrelia garinii
LNENLKSNYS

SEQ ID NO: 188249 - protein, 10 aa, Borrelia garinii
NENLKSNYSE

SEQ ID NO: 188250 - protein, 10 aa, Borrelia garinii
ENLKSNYSEI

SEQ ID NO: 188251 - protein, 10 aa, Borrelia garinii
NLKSNYSEIY

SEQ ID NO: 188252 - protein, 10 aa, Borrelia garinii
LKSNYSEIYN

SEQ ID NO: 188253 - protein, 10 aa, Borrelia garinii
KSNYSEIYNK

SEQ ID NO: 188254 - protein, 10 aa, Borrelia garinii
SNYSEIYNKS

SEQ ID NO: 188255 - protein, 10 aa, Borrelia garinii
NYSEIYNKSL

SEQ ID NO: 188256 - protein, 10 aa, Borrelia garinii
YSEIYNKSLE

SEQ ID NO: 188257 - protein, 10 aa, Borrelia garinii
SEIYNKSLEI

SEQ ID NO: 188258 - protein, 10 aa, Borrelia garinii
EIYNKSLEIG

SEQ ID NO: 188259 - protein, 10 aa, Borrelia garinii
IYNKSLEIGQ

SEQ ID NO: 188260 - protein, 10 aa, Borrelia garinii
YNKSLEIGQS

SEQ ID NO: 188261 - protein, 10 aa, Borrelia garinii
NKSLEIGQSI

SEQ ID NO: 188262 - protein, 10 aa, Borrelia garinii
KSLEIGQSIM

SEQ ID NO: 188263 - protein, 10 aa, Borrelia garinii
SLEIGQSIME

SEQ ID NO: 188264 - protein, 10 aa, Borrelia garinii
LEIGQSIMEG

SEQ ID NO: 188265 - protein, 10 aa, Borrelia garinii
EIGQSIMEGI

SEQ ID NO: 188266 - protein, 10 aa, Borrelia garinii
IGQSIMEGII

SEQ ID NO: 188267 - protein, 10 aa, Borrelia garinii
GQSIMEGIIK

SEQ ID NO: 188268 - protein, 10 aa, Borrelia garinii
QSIMEGIIKV

SEQ ID NO: 188269 - protein, 10 aa, Borrelia garinii
SIMEGIIKVP

SEQ ID NO: 188270 - protein, 10 aa, Borrelia garinii
IMEGIIKVPY

SEQ ID NO: 188271 - protein, 10 aa, Borrelia garinii
MEGIIKVPYD

SEQ ID NO: 188272 - protein, 10 aa, Borrelia garinii
EGIIKVPYDK

SEQ ID NO: 188273 - protein, 10 aa, Borrelia garinii
GIIKVPYDKA

SEQ ID NO: 188274 - protein, 10 aa, Borrelia garinii
IIKVPYDKAS

SEQ ID NO: 188275 - protein, 10 aa, Borrelia garinii
IKVPYDKASY

SEQ ID NO: 188276 - protein, 10 aa, Borrelia garinii
KVPYDKASYD

SEQ ID NO: 188277 - protein, 10 aa, Borrelia garinii
VPYDKASYDN

SEQ ID NO: 188278 - protein, 10 aa, Borrelia garinii
PYDKASYDNF

SEQ ID NO: 188279 - protein, 10 aa, Borrelia garinii
YDKASYDNFV

SEQ ID NO: 188280 - protein, 10 aa, Borrelia garinii
DKASYDNFVL

SEQ ID NO: 188281 - protein, 10 aa, Borrelia garinii
KASYDNFVLQ

SEQ ID NO: 188282 - protein, 10 aa, Borrelia garinii
ASYDNFVLQI

SEQ ID NO: 188283 - protein, 10 aa, Borrelia garinii
SYDNFVLQIA

SEQ ID NO: 188284 - protein, 10 aa, Borrelia garinii
YDNFVLQIAN

SEQ ID NO: 188285 - protein, 11 aa, Borrelia garinii
MLNKVYCFIVF

SEQ ID NO: 188286 - protein, 11 aa, Borrelia garinii
LNKVYCFIVFL

SEQ ID NO: 188287 - protein, 11 aa, Borrelia garinii
NKVYCFIVFLF

SEQ ID NO: 188288 - protein, 11 aa, Borrelia garinii
KVYCFIVFLFI

SEQ ID NO: 188289 - protein, 11 aa, Borrelia garinii
VYCFIVFLFII

SEQ ID NO: 188290 - protein, 11 aa, Borrelia garinii
YCFIVFLFIIA

SEQ ID NO: 188291 - protein, 11 aa, Borrelia garinii
CFIVFLFIIAC

SEQ ID NO: 188292 - protein, 11 aa, Borrelia garinii
FIVFLFIIACS

SEQ ID NO: 188293 - protein, 11 aa, Borrelia garinii
IVFLFIIACSG

SEQ ID NO: 188294 - protein, 11 aa, Borrelia garinii
VFLFIIACSGS

SEQ ID NO: 188295 - protein, 11 aa, Borrelia garinii
FLFIIACSGSD

SEQ ID NO: 188296 - protein, 11 aa, Borrelia garinii
LFIIACSGSDD

SEQ ID NO: 188297 - protein, 11 aa, Borrelia garinii
FIIACSGSDDV

SEQ ID NO: 188298 - protein, 11 aa, Borrelia garinii
IIACSGSDDVK

SEQ ID NO: 188299 - protein, 11 aa, Borrelia garinii
IACSGSDDVKL

SEQ ID NO: 188300 - protein, 11 aa, Borrelia garinii
ACSGSDDVKLE

SEQ ID NO: 188301 - protein, 11 aa, Borrelia garinii
CSGSDDVKLES

SEQ ID NO: 188302 - protein, 11 aa, Borrelia garinii
SGSDDVKLESK

SEQ ID NO: 188303 - protein, 11 aa, Borrelia garinii
GSDDVKLESKT

SEQ ID NO: 188304 - protein, 11 aa, Borrelia garinii
SDDVKLESKTV

SEQ ID NO: 188305 - protein, 11 aa, Borrelia garinii
DDVKLESKTVS

SEQ ID NO: 188306 - protein, 11 aa, Borrelia garinii
DVKLESKTVSL

SEQ ID NO: 188307 - protein, 11 aa, Borrelia garinii
VKLESKTVSLI

SEQ ID NO: 188308 - protein, 11 aa, Borrelia garinii
KLESKTVSLIV

SEQ ID NO: 188309 - protein, 11 aa, Borrelia garinii
LESKTVSLIVD

SEQ ID NO: 188310 - protein, 11 aa, Borrelia garinii
ESKTVSLIVDG

SEQ ID NO: 188311 - protein, 11 aa, Borrelia garinii
SKTVSLIVDGA

SEQ ID NO: 188312 - protein, 11 aa, Borrelia garinii
KTVSLIVDGAF

SEQ ID NO: 188313 - protein, 11 aa, Borrelia garinii
TVSLIVDGAFD

SEQ ID NO: 188314 - protein, 11 aa, Borrelia garinii
VSLIVDGAFDD

SEQ ID NO: 188315 - protein, 11 aa, Borrelia garinii
SLIVDGAFDDK

SEQ ID NO: 188316 - protein, 11 aa, Borrelia garinii
LIVDGAFDDKG

SEQ ID NO: 188317 - protein, 11 aa, Borrelia garinii
IVDGAFDDKGF

SEQ ID NO: 188318 - protein, 11 aa, Borrelia garinii
VDGAFDDKGFN

SEQ ID NO: 188319 - protein, 11 aa, Borrelia garinii
DGAFDDKGFNE

SEQ ID NO: 188320 - protein, 11 aa, Borrelia garinii
GAFDDKGFNES

SEQ ID NO: 188321 - protein, 11 aa, Borrelia garinii
AFDDKGFNESS

SEQ ID NO: 188322 - protein, 11 aa, Borrelia garinii
FDDKGFNESSS

SEQ ID NO: 188323 - protein, 11 aa, Borrelia garinii
DDKGFNESSSK

SEQ ID NO: 188324 - protein, 11 aa, Borrelia garinii
DKGFNESSSKA

SEQ ID NO: 188325 - protein, 11 aa, Borrelia garinii
KGFNESSSKAI

SEQ ID NO: 188326 - protein, 11 aa, Borrelia garinii
GFNESSSKAIR

SEQ ID NO: 188327 - protein, 11 aa, Borrelia garinii
FNESSSKAIRK

SEQ ID NO: 188328 - protein, 11 aa, Borrelia garinii
NESSSKAIRKL

SEQ ID NO: 188329 - protein, 11 aa, Borrelia garinii
ESSSKAIRKLK

SEQ ID NO: 188330 - protein, 11 aa, Borrelia garinii
SSSKAIRKLKT

SEQ ID NO: 188331 - protein, 11 aa, Borrelia garinii
SSKAIRKLKTD

SEQ ID NO: 188332 - protein, 11 aa, Borrelia garinii
SKAIRKLKTDF

SEQ ID NO: 188333 - protein, 11 aa, Borrelia garinii
KAIRKLKTDFN

SEQ ID NO: 188334 - protein, 11 aa, Borrelia garinii
AIRKLKTDFNI

SEQ ID NO: 188335 - protein, 11 aa, Borrelia garinii
IRKLKTDFNIN

SEQ ID NO: 188336 - protein, 11 aa, Borrelia garinii
RKLKTDFNINI

SEQ ID NO: 188337 - protein, 11 aa, Borrelia garinii
KLKTDFNINII

SEQ ID NO: 188338 - protein, 11 aa, Borrelia garinii
LKTDFNINIIE

SEQ ID NO: 188339 - protein, 11 aa, Borrelia garinii
KTDFNINIIEK

SEQ ID NO: 188340 - protein, 11 aa, Borrelia garinii
TDFNINIIEKA

SEQ ID NO: 188341 - protein, 11 aa, Borrelia garinii
DFNINIIEKAS

SEQ ID NO: 188342 - protein, 11 aa, Borrelia garinii
FNINIIEKAST

SEQ ID NO: 188343 - protein, 11 aa, Borrelia garinii
NINIIEKASTG

SEQ ID NO: 188344 - protein, 11 aa, Borrelia garinii
INIIEKASTGN

SEQ ID NO: 188345 - protein, 11 aa, Borrelia garinii
NIIEKASTGNS

SEQ ID NO: 188346 - protein, 11 aa, Borrelia garinii
IIEKASTGNSH

SEQ ID NO: 188347 - protein, 11 aa, Borrelia garinii
IEKASTGNSHL

SEQ ID NO: 188348 - protein, 11 aa, Borrelia garinii
EKASTGNSHLG

SEQ ID NO: 188349 - protein, 11 aa, Borrelia garinii
KASTGNSHLGD

SEQ ID NO: 188350 - protein, 11 aa, Borrelia garinii
ASTGNSHLGDI

SEQ ID NO: 188351 - protein, 11 aa, Borrelia garinii
STGNSHLGDIA

SEQ ID NO: 188352 - protein, 11 aa, Borrelia garinii
TGNSHLGDIAT

SEQ ID NO: 188353 - protein, 11 aa, Borrelia garinii
GNSHLGDIATL

SEQ ID NO: 188354 - protein, 11 aa, Borrelia garinii
NSHLGDIATLE

SEQ ID NO: 188355 - protein, 11 aa, Borrelia garinii
SHLGDIATLED

SEQ ID NO: 188356 - protein, 11 aa, Borrelia garinii
HLGDIATLEDG

SEQ ID NO: 188357 - protein, 11 aa, Borrelia garinii
LGDIATLEDGN

SEQ ID NO: 188358 - protein, 11 aa, Borrelia garinii
GDIATLEDGNS

SEQ ID NO: 188359 - protein, 11 aa, Borrelia garinii
DIATLEDGNSN

SEQ ID NO: 188360 - protein, 11 aa, Borrelia garinii
IATLEDGNSNL

SEQ ID NO: 188361 - protein, 11 aa, Borrelia garinii
ATLEDGNSNLI

SEQ ID NO: 188362 - protein, 11 aa, Borrelia garinii
TLEDGNSNLIW

SEQ ID NO: 188363 - protein, 11 aa, Borrelia garinii
LEDGNSNLIWG

SEQ ID NO: 188364 - protein, 11 aa, Borrelia garinii
EDGNSNLIWGI

SEQ ID NO: 188365 - protein, 11 aa, Borrelia garinii
DGNSNLIWGIG

SEQ ID NO: 188366 - protein, 11 aa, Borrelia garinii
GNSNLIWGIGF

SEQ ID NO: 188367 - protein, 11 aa, Borrelia garinii
NSNLIWGIGFR

SEQ ID NO: 188368 - protein, 11 aa, Borrelia garinii
SNLIWGIGFRL

SEQ ID NO: 188369 - protein, 11 aa, Borrelia garinii
NLIWGIGFRLS

SEQ ID NO: 188370 - protein, 11 aa, Borrelia garinii
LIWGIGFRLSD

SEQ ID NO: 188371 - protein, 11 aa, Borrelia garinii
IWGIGFRLSDV

SEQ ID NO: 188372 - protein, 11 aa, Borrelia garinii
WGIGFRLSDVL

SEQ ID NO: 188373 - protein, 11 aa, Borrelia garinii
GIGFRLSDVLL

SEQ ID NO: 188374 - protein, 11 aa, Borrelia garinii
IGFRLSDVLLQ

SEQ ID NO: 188375 - protein, 11 aa, Borrelia garinii
GFRLSDVLLQR

SEQ ID NO: 188376 - protein, 11 aa, Borrelia garinii
FRLSDVLLQRA

SEQ ID NO: 188377 - protein, 11 aa, Borrelia garinii
RLSDVLLQRAS

SEQ ID NO: 188378 - protein, 11 aa, Borrelia garinii
LSDVLLQRASE

SEQ ID NO: 188379 - protein, 11 aa, Borrelia garinii
SDVLLQRASEN

SEQ ID NO: 188380 - protein, 11 aa, Borrelia garinii
DVLLQRASENI

SEQ ID NO: 188381 - protein, 11 aa, Borrelia garinii
VLLQRASENIS

SEQ ID NO: 188382 - protein, 11 aa, Borrelia garinii
LLQRASENISI

SEQ ID NO: 188383 - protein, 11 aa, Borrelia garinii
LQRASENISIN

SEQ ID NO: 188384 - protein, 11 aa, Borrelia garinii
QRASENISINY

SEQ ID NO: 188385 - protein, 11 aa, Borrelia garinii
RASENISINYA

SEQ ID NO: 188386 - protein, 11 aa, Borrelia garinii
ASENISINYAI

SEQ ID NO: 188387 - protein, 11 aa, Borrelia garinii
SENISINYAIM

SEQ ID NO: 188388 - protein, 11 aa, Borrelia garinii
ENISINYAIME

SEQ ID NO: 188389 - protein, 11 aa, Borrelia garinii
NISINYAIMEG

SEQ ID NO: 188390 - protein, 11 aa, Borrelia garinii
ISINYAIMEGV

SEQ ID NO: 188391 - protein, 11 aa, Borrelia garinii
SINYAIMEGVY

SEQ ID NO: 188392 - protein, 11 aa, Borrelia garinii
INYAIMEGVYN

SEQ ID NO: 188393 - protein, 11 aa, Borrelia garinii
NYAIMEGVYNE

SEQ ID NO: 188394 - protein, 11 aa, Borrelia garinii
YAIMEGVYNEI

SEQ ID NO: 188395 - protein, 11 aa, Borrelia garinii
AIMEGVYNEIQ

SEQ ID NO: 188396 - protein, 11 aa, Borrelia garinii
IMEGVYNEIQM

SEQ ID NO: 188397 - protein, 11 aa, Borrelia garinii
MEGVYNEIQMP

SEQ ID NO: 188398 - protein, 11 aa, Borrelia garinii
EGVYNEIQMPK

SEQ ID NO: 188399 - protein, 11 aa, Borrelia garinii
GVYNEIQMPKN

SEQ ID NO: 188400 - protein, 11 aa, Borrelia garinii
VYNEIQMPKNL

SEQ ID NO: 188401 - protein, 11 aa, Borrelia garinii
YNEIQMPKNLL

SEQ ID NO: 188402 - protein, 11 aa, Borrelia garinii
NEIQMPKNLLN

SEQ ID NO: 188403 - protein, 11 aa, Borrelia garinii
EIQMPKNLLNI

SEQ ID NO: 188404 - protein, 11 aa, Borrelia garinii
IQMPKNLLNIS

SEQ ID NO: 188405 - protein, 11 aa, Borrelia garinii
QMPKNLLNISF

SEQ ID NO: 188406 - protein, 11 aa, Borrelia garinii
MPKNLLNISFR

SEQ ID NO: 188407 - protein, 11 aa, Borrelia garinii
PKNLLNISFRS

SEQ ID NO: 188408 - protein, 11 aa, Borrelia garinii
KNLLNISFRSE

SEQ ID NO: 188409 - protein, 11 aa, Borrelia garinii
NLLNISFRSEE

SEQ ID NO: 188410 - protein, 11 aa, Borrelia garinii
LLNISFRSEEV

SEQ ID NO: 188411 - protein, 11 aa, Borrelia garinii
LNISFRSEEVA

SEQ ID NO: 188412 - protein, 11 aa, Borrelia garinii
NISFRSEEVAF

SEQ ID NO: 188413 - protein, 11 aa, Borrelia garinii
ISFRSEEVAFL

SEQ ID NO: 188414 - protein, 11 aa, Borrelia garinii
SFRSEEVAFLA

SEQ ID NO: 188415 - protein, 11 aa, Borrelia garinii
FRSEEVAFLAG

SEQ ID NO: 188416 - protein, 11 aa, Borrelia garinii
RSEEVAFLAGY

SEQ ID NO: 188417 - protein, 11 aa, Borrelia garinii
SEEVAFLAGYF

SEQ ID NO: 188418 - protein, 11 aa, Borrelia garinii
EEVAFLAGYFA

SEQ ID NO: 188419 - protein, 11 aa, Borrelia garinii
EVAFLAGYFAS

SEQ ID NO: 188420 - protein, 11 aa, Borrelia garinii
VAFLAGYFASK

SEQ ID NO: 188421 - protein, 11 aa, Borrelia garinii
AFLAGYFASKT

SEQ ID NO: 188422 - protein, 11 aa, Borrelia garinii
FLAGYFASKTS

SEQ ID NO: 188423 - protein, 11 aa, Borrelia garinii
LAGYFASKTSK

SEQ ID NO: 188424 - protein, 11 aa, Borrelia garinii
AGYFASKTSKT

SEQ ID NO: 188425 - protein, 11 aa, Borrelia garinii
GYFASKTSKTG

SEQ ID NO: 188426 - protein, 11 aa, Borrelia garinii
YFASKTSKTGK

SEQ ID NO: 188427 - protein, 11 aa, Borrelia garinii
FASKTSKTGKI

SEQ ID NO: 188428 - protein, 11 aa, Borrelia garinii
ASKTSKTGKIG

SEQ ID NO: 188429 - protein, 11 aa, Borrelia garinii
SKTSKTGKIGF

SEQ ID NO: 188430 - protein, 11 aa, Borrelia garinii
KTSKTGKIGFI

SEQ ID NO: 188431 - protein, 11 aa, Borrelia garinii
TSKTGKIGFIG

SEQ ID NO: 188432 - protein, 11 aa, Borrelia garinii
SKTGKIGFIGG

SEQ ID NO: 188433 - protein, 11 aa, Borrelia garinii
KTGKIGFIGGV

SEQ ID NO: 188434 - protein, 11 aa, Borrelia garinii
TGKIGFIGGVK

SEQ ID NO: 188435 - protein, 11 aa, Borrelia garinii
GKIGFIGGVKG

SEQ ID NO: 188436 - protein, 11 aa, Borrelia garinii
KIGFIGGVKGK

SEQ ID NO: 188437 - protein, 11 aa, Borrelia garinii
IGFIGGVKGKV

SEQ ID NO: 188438 - protein, 11 aa, Borrelia garinii
GFIGGVKGKVL

SEQ ID NO: 188439 - protein, 11 aa, Borrelia garinii
FIGGVKGKVLE

SEQ ID NO: 188440 - protein, 11 aa, Borrelia garinii
IGGVKGKVLES

SEQ ID NO: 188441 - protein, 11 aa, Borrelia garinii
GGVKGKVLESF

SEQ ID NO: 188442 - protein, 11 aa, Borrelia garinii
GVKGKVLESFM

SEQ ID NO: 188443 - protein, 11 aa, Borrelia garinii
VKGKVLESFMY

SEQ ID NO: 188444 - protein, 11 aa, Borrelia garinii
KGKVLESFMYG

SEQ ID NO: 188445 - protein, 11 aa, Borrelia garinii
GKVLESFMYGY

SEQ ID NO: 188446 - protein, 11 aa, Borrelia garinii
KVLESFMYGYE

SEQ ID NO: 188447 - protein, 11 aa, Borrelia garinii
VLESFMYGYEA

SEQ ID NO: 188448 - protein, 11 aa, Borrelia garinii
LESFMYGYEAG

SEQ ID NO: 188449 - protein, 11 aa, Borrelia garinii
ESFMYGYEAGA

SEQ ID NO: 188450 - protein, 11 aa, Borrelia garinii
SFMYGYEAGAK

SEQ ID NO: 188451 - protein, 11 aa, Borrelia garinii
FMYGYEAGAKY

SEQ ID NO: 188452 - protein, 11 aa, Borrelia garinii
MYGYEAGAKYA

SEQ ID NO: 188453 - protein, 11 aa, Borrelia garinii
YGYEAGAKYAN

SEQ ID NO: 188454 - protein, 11 aa, Borrelia garinii
GYEAGAKYANS

SEQ ID NO: 188455 - protein, 11 aa, Borrelia garinii
YEAGAKYANST

SEQ ID NO: 188456 - protein, 11 aa, Borrelia garinii
EAGAKYANSTI

SEQ ID NO: 188457 - protein, 11 aa, Borrelia garinii
AGAKYANSTIK

SEQ ID NO: 188458 - protein, 11 aa, Borrelia garinii
GAKYANSTIKV

SEQ ID NO: 188459 - protein, 11 aa, Borrelia garinii
AKYANSTIKVI

SEQ ID NO: 188460 - protein, 11 aa, Borrelia garinii
KYANSTIKVIS

SEQ ID NO: 188461 - protein, 11 aa, Borrelia garinii
YANSTIKVISQ

SEQ ID NO: 188462 - protein, 11 aa, Borrelia garinii
ANSTIKVISQY

SEQ ID NO: 188463 - protein, 11 aa, Borrelia garinii
NSTIKVISQYV

SEQ ID NO: 188464 - protein, 11 aa, Borrelia garinii
STIKVISQYVG

SEQ ID NO: 188465 - protein, 11 aa, Borrelia garinii
TIKVISQYVGT

SEQ ID NO: 188466 - protein, 11 aa, Borrelia garinii
IKVISQYVGTF

SEQ ID NO: 188467 - protein, 11 aa, Borrelia garinii
KVISQYVGTFG

SEQ ID NO: 188468 - protein, 11 aa, Borrelia garinii
VISQYVGTFGD

SEQ ID NO: 188469 - protein, 11 aa, Borrelia garinii
ISQYVGTFGDF

SEQ ID NO: 188470 - protein, 11 aa, Borrelia garinii
SQYVGTFGDFG

SEQ ID NO: 188471 - protein, 11 aa, Borrelia garinii
QYVGTFGDFGL

SEQ ID NO: 188472 - protein, 11 aa, Borrelia garinii
YVGTFGDFGLG

SEQ ID NO: 188473 - protein, 11 aa, Borrelia garinii
VGTFGDFGLGR

SEQ ID NO: 188474 - protein, 11 aa, Borrelia garinii
GTFGDFGLGRS

SEQ ID NO: 188475 - protein, 11 aa, Borrelia garinii
TFGDFGLGRST

SEQ ID NO: 188476 - protein, 11 aa, Borrelia garinii
FGDFGLGRSTA

SEQ ID NO: 188477 - protein, 11 aa, Borrelia garinii
GDFGLGRSTAS

SEQ ID NO: 188478 - protein, 11 aa, Borrelia garinii
DFGLGRSTASN

SEQ ID NO: 188479 - protein, 11 aa, Borrelia garinii
FGLGRSTASNM

SEQ ID NO: 188480 - protein, 11 aa, Borrelia garinii
GLGRSTASNMY

SEQ ID NO: 188481 - protein, 11 aa, Borrelia garinii
LGRSTASNMYR

SEQ ID NO: 188482 - protein, 11 aa, Borrelia garinii
GRSTASNMYRD

SEQ ID NO: 188483 - protein, 11 aa, Borrelia garinii
RSTASNMYRDG

SEQ ID NO: 188484 - protein, 11 aa, Borrelia garinii
STASNMYRDGV

SEQ ID NO: 188485 - protein, 11 aa, Borrelia garinii
TASNMYRDGVD

SEQ ID NO: 188486 - protein, 11 aa, Borrelia garinii
ASNMYRDGVDI

SEQ ID NO: 188487 - protein, 11 aa, Borrelia garinii
SNMYRDGVDIV

SEQ ID NO: 188488 - protein, 11 aa, Borrelia garinii
NMYRDGVDIVF

SEQ ID NO: 188489 - protein, 11 aa, Borrelia garinii
MYRDGVDIVFA

SEQ ID NO: 188490 - protein, 11 aa, Borrelia garinii
YRDGVDIVFAA

SEQ ID NO: 188491 - protein, 11 aa, Borrelia garinii
RDGVDIVFAAA

SEQ ID NO: 188492 - protein, 11 aa, Borrelia garinii
DGVDIVFAAAG

SEQ ID NO: 188493 - protein, 11 aa, Borrelia garinii
GVDIVFAAAGL

SEQ ID NO: 188494 - protein, 11 aa, Borrelia garinii
VDIVFAAAGLS

SEQ ID NO: 188495 - protein, 11 aa, Borrelia garinii
DIVFAAAGLSG

SEQ ID NO: 188496 - protein, 11 aa, Borrelia garinii
IVFAAAGLSGI

SEQ ID NO: 188497 - protein, 11 aa, Borrelia garinii
VFAAAGLSGIG

SEQ ID NO: 188498 - protein, 11 aa, Borrelia garinii
FAAAGLSGIGV

SEQ ID NO: 188499 - protein, 11 aa, Borrelia garinii
AAAGLSGIGVI

SEQ ID NO: 188500 - protein, 11 aa, Borrelia garinii
AAGLSGIGVIE

SEQ ID NO: 188501 - protein, 11 aa, Borrelia garinii
AGLSGIGVIEA

SEQ ID NO: 188502 - protein, 11 aa, Borrelia garinii
GLSGIGVIEAA

SEQ ID NO: 188503 - protein, 11 aa, Borrelia garinii
LSGIGVIEAAK

SEQ ID NO: 188504 - protein, 11 aa, Borrelia garinii
SGIGVIEAAKE

SEQ ID NO: 188505 - protein, 11 aa, Borrelia garinii
GIGVIEAAKEL

SEQ ID NO: 188506 - protein, 11 aa, Borrelia garinii
IGVIEAAKELG

SEQ ID NO: 188507 - protein, 11 aa, Borrelia garinii
GVIEAAKELGP

SEQ ID NO: 188508 - protein, 11 aa, Borrelia garinii
VIEAAKELGPD

SEQ ID NO: 188509 - protein, 11 aa, Borrelia garinii
IEAAKELGPDH

SEQ ID NO: 188510 - protein, 11 aa, Borrelia garinii
EAAKELGPDHY

SEQ ID NO: 188511 - protein, 11 aa, Borrelia garinii
AAKELGPDHYI

SEQ ID NO: 188512 - protein, 11 aa, Borrelia garinii
AKELGPDHYII

SEQ ID NO: 188513 - protein, 11 aa, Borrelia garinii
KELGPDHYIIG

SEQ ID NO: 188514 - protein, 11 aa, Borrelia garinii
ELGPDHYIIGV

SEQ ID NO: 188515 - protein, 11 aa, Borrelia garinii
LGPDHYIIGVD

SEQ ID NO: 188516 - protein, 11 aa, Borrelia garinii
GPDHYIIGVDQ

SEQ ID NO: 188517 - protein, 11 aa, Borrelia garinii
PDHYIIGVDQD

SEQ ID NO: 188518 - protein, 11 aa, Borrelia garinii
DHYIIGVDQDQ

SEQ ID NO: 188519 - protein, 11 aa, Borrelia garinii
HYIIGVDQDQS

SEQ ID NO: 188520 - protein, 11 aa, Borrelia garinii
YIIGVDQDQSY

SEQ ID NO: 188521 - protein, 11 aa, Borrelia garinii
IIGVDQDQSYL

SEQ ID NO: 188522 - protein, 11 aa, Borrelia garinii
IGVDQDQSYLA

SEQ ID NO: 188523 - protein, 11 aa, Borrelia garinii
GVDQDQSYLAP

SEQ ID NO: 188524 - protein, 11 aa, Borrelia garinii
VDQDQSYLAPN

SEQ ID NO: 188525 - protein, 11 aa, Borrelia garinii
DQDQSYLAPNN

SEQ ID NO: 188526 - protein, 11 aa, Borrelia garinii
QDQSYLAPNNV

SEQ ID NO: 188527 - protein, 11 aa, Borrelia garinii
DQSYLAPNNVL

SEQ ID NO: 188528 - protein, 11 aa, Borrelia garinii
QSYLAPNNVLV

SEQ ID NO: 188529 - protein, 11 aa, Borrelia garinii
SYLAPNNVLVS

SEQ ID NO: 188530 - protein, 11 aa, Borrelia garinii
YLAPNNVLVSA

SEQ ID NO: 188531 - protein, 11 aa, Borrelia garinii
LAPNNVLVSAV

SEQ ID NO: 188532 - protein, 11 aa, Borrelia garinii
APNNVLVSAVK

SEQ ID NO: 188533 - protein, 11 aa, Borrelia garinii
PNNVLVSAVKK

SEQ ID NO: 188534 - protein, 11 aa, Borrelia garinii
NNVLVSAVKKV

SEQ ID NO: 188535 - protein, 11 aa, Borrelia garinii
NVLVSAVKKVD

SEQ ID NO: 188536 - protein, 11 aa, Borrelia garinii
VLVSAVKKVDS

SEQ ID NO: 188537 - protein, 11 aa, Borrelia garinii
LVSAVKKVDSL

SEQ ID NO: 188538 - protein, 11 aa, Borrelia garinii
VSAVKKVDSLM

SEQ ID NO: 188539 - protein, 11 aa, Borrelia garinii
SAVKKVDSLMY

SEQ ID NO: 188540 - protein, 11 aa, Borrelia garinii
AVKKVDSLMYS

SEQ ID NO: 188541 - protein, 11 aa, Borrelia garinii
VKKVDSLMYSL

SEQ ID NO: 188542 - protein, 11 aa, Borrelia garinii
KKVDSLMYSLT

SEQ ID NO: 188543 - protein, 11 aa, Borrelia garinii
KVDSLMYSLTK

SEQ ID NO: 188544 - protein, 11 aa, Borrelia garinii
VDSLMYSLTKK

SEQ ID NO: 188545 - protein, 11 aa, Borrelia garinii
DSLMYSLTKKY

SEQ ID NO: 188546 - protein, 11 aa, Borrelia garinii
SLMYSLTKKYL

SEQ ID NO: 188547 - protein, 11 aa, Borrelia garinii
LMYSLTKKYLE

SEQ ID NO: 188548 - protein, 11 aa, Borrelia garinii
MYSLTKKYLET

SEQ ID NO: 188549 - protein, 11 aa, Borrelia garinii
YSLTKKYLETG

SEQ ID NO: 188550 - protein, 11 aa, Borrelia garinii
SLTKKYLETGI

SEQ ID NO: 188551 - protein, 11 aa, Borrelia garinii
LTKKYLETGIW

SEQ ID NO: 188552 - protein, 11 aa, Borrelia garinii
TKKYLETGIWD

SEQ ID NO: 188553 - protein, 11 aa, Borrelia garinii
KKYLETGIWDG

SEQ ID NO: 188554 - protein, 11 aa, Borrelia garinii
KYLETGIWDGG

SEQ ID NO: 188555 - protein, 11 aa, Borrelia garinii
YLETGIWDGGK

SEQ ID NO: 188556 - protein, 11 aa, Borrelia garinii
LETGIWDGGKN

SEQ ID NO: 188557 - protein, 11 aa, Borrelia garinii
ETGIWDGGKNI

SEQ ID NO: 188558 - protein, 11 aa, Borrelia garinii
TGIWDGGKNIF

SEQ ID NO: 188559 - protein, 11 aa, Borrelia garinii
GIWDGGKNIFF

SEQ ID NO: 188560 - protein, 11 aa, Borrelia garinii
IWDGGKNIFFG

SEQ ID NO: 188561 - protein, 11 aa, Borrelia garinii
WDGGKNIFFGL

SEQ ID NO: 188562 - protein, 11 aa, Borrelia garinii
DGGKNIFFGLK

SEQ ID NO: 188563 - protein, 11 aa, Borrelia garinii
GGKNIFFGLKE

SEQ ID NO: 188564 - protein, 11 aa, Borrelia garinii
GKNIFFGLKED

SEQ ID NO: 188565 - protein, 11 aa, Borrelia garinii
KNIFFGLKEDG

SEQ ID NO: 188566 - protein, 11 aa, Borrelia garinii
NIFFGLKEDGL

SEQ ID NO: 188567 - protein, 11 aa, Borrelia garinii
IFFGLKEDGLG

SEQ ID NO: 188568 - protein, 11 aa, Borrelia garinii
FFGLKEDGLGL

SEQ ID NO: 188569 - protein, 11 aa, Borrelia garinii
FGLKEDGLGLV

SEQ ID NO: 188570 - protein, 11 aa, Borrelia garinii
GLKEDGLGLVL

SEQ ID NO: 188571 - protein, 11 aa, Borrelia garinii
LKEDGLGLVLN

SEQ ID NO: 188572 - protein, 11 aa, Borrelia garinii
KEDGLGLVLNE

SEQ ID NO: 188573 - protein, 11 aa, Borrelia garinii
EDGLGLVLNEN

SEQ ID NO: 188574 - protein, 11 aa, Borrelia garinii
DGLGLVLNENL

SEQ ID NO: 188575 - protein, 11 aa, Borrelia garinii
GLGLVLNENLK

SEQ ID NO: 188576 - protein, 11 aa, Borrelia garinii
LGLVLNENLKS

SEQ ID NO: 188577 - protein, 11 aa, Borrelia garinii
GLVLNENLKSN

SEQ ID NO: 188578 - protein, 11 aa, Borrelia garinii
LVLNENLKSNY

SEQ ID NO: 188579 - protein, 11 aa, Borrelia garinii
VLNENLKSNYS

SEQ ID NO: 188580 - protein, 11 aa, Borrelia garinii
LNENLKSNYSE

SEQ ID NO: 188581 - protein, 11 aa, Borrelia garinii
NENLKSNYSEI

SEQ ID NO: 188582 - protein, 11 aa, Borrelia garinii
ENLKSNYSEIY

SEQ ID NO: 188583 - protein, 11 aa, Borrelia garinii
NLKSNYSEIYN

SEQ ID NO: 188584 - protein, 11 aa, Borrelia garinii
LKSNYSEIYNK

SEQ ID NO: 188585 - protein, 11 aa, Borrelia garinii
KSNYSEIYNKS

SEQ ID NO: 188586 - protein, 11 aa, Borrelia garinii
SNYSEIYNKSL

SEQ ID NO: 188587 - protein, 11 aa, Borrelia garinii
NYSEIYNKSLE

SEQ ID NO: 188588 - protein, 11 aa, Borrelia garinii
YSEIYNKSLEI

SEQ ID NO: 188589 - protein, 11 aa, Borrelia garinii
SEIYNKSLEIG

SEQ ID NO: 188590 - protein, 11 aa, Borrelia garinii
EIYNKSLEIGQ

SEQ ID NO: 188591 - protein, 11 aa, Borrelia garinii
IYNKSLEIGQS

SEQ ID NO: 188592 - protein, 11 aa, Borrelia garinii
YNKSLEIGQSI

SEQ ID NO: 188593 - protein, 11 aa, Borrelia garinii
NKSLEIGQSIM

SEQ ID NO: 188594 - protein, 11 aa, Borrelia garinii
KSLEIGQSIME

SEQ ID NO: 188595 - protein, 11 aa, Borrelia garinii
SLEIGQSIMEG

SEQ ID NO: 188596 - protein, 11 aa, Borrelia garinii
LEIGQSIMEGI

SEQ ID NO: 188597 - protein, 11 aa, Borrelia garinii
EIGQSIMEGII

SEQ ID NO: 188598 - protein, 11 aa, Borrelia garinii
IGQSIMEGIIK

SEQ ID NO: 188599 - protein, 11 aa, Borrelia garinii
GQSIMEGIIKV

SEQ ID NO: 188600 - protein, 11 aa, Borrelia garinii
QSIMEGIIKVP

SEQ ID NO: 188601 - protein, 11 aa, Borrelia garinii
SIMEGIIKVPY

SEQ ID NO: 188602 - protein, 11 aa, Borrelia garinii
IMEGIIKVPYD

SEQ ID NO: 188603 - protein, 11 aa, Borrelia garinii
MEGIIKVPYDK

SEQ ID NO: 188604 - protein, 11 aa, Borrelia garinii
EGIIKVPYDKA

SEQ ID NO: 188605 - protein, 11 aa, Borrelia garinii
GIIKVPYDKAS

SEQ ID NO: 188606 - protein, 11 aa, Borrelia garinii
IIKVPYDKASY

SEQ ID NO: 188607 - protein, 11 aa, Borrelia garinii
IKVPYDKASYD

SEQ ID NO: 188608 - protein, 11 aa, Borrelia garinii
KVPYDKASYDN

SEQ ID NO: 188609 - protein, 11 aa, Borrelia garinii
VPYDKASYDNF

SEQ ID NO: 188610 - protein, 11 aa, Borrelia garinii
PYDKASYDNFV

SEQ ID NO: 188611 - protein, 11 aa, Borrelia garinii
YDKASYDNFVL

SEQ ID NO: 188612 - protein, 11 aa, Borrelia garinii
DKASYDNFVLQ

SEQ ID NO: 188613 - protein, 11 aa, Borrelia garinii
KASYDNFVLQI

SEQ ID NO: 188614 - protein, 11 aa, Borrelia garinii
ASYDNFVLQIA

SEQ ID NO: 188615 - protein, 11 aa, Borrelia garinii
SYDNFVLQIAN

SEQ ID NO: 188616 - protein, 13 aa, Borrelia garinii
MLNKVYCFIVFLF

SEQ ID NO: 188617 - protein, 13 aa, Borrelia garinii
LNKVYCFIVFLFI

SEQ ID NO: 188618 - protein, 13 aa, Borrelia garinii
NKVYCFIVFLFII

SEQ ID NO: 188619 - protein, 13 aa, Borrelia garinii
KVYCFIVFLFIIA

SEQ ID NO: 188620 - protein, 13 aa, Borrelia garinii
VYCFIVFLFIIAC

SEQ ID NO: 188621 - protein, 13 aa, Borrelia garinii
YCFIVFLFIIACS

SEQ ID NO: 188622 - protein, 13 aa, Borrelia garinii
CFIVFLFIIACSG

SEQ ID NO: 188623 - protein, 13 aa, Borrelia garinii
FIVFLFIIACSGS

SEQ ID NO: 188624 - protein, 13 aa, Borrelia garinii
IVFLFIIACSGSD

SEQ ID NO: 188625 - protein, 13 aa, Borrelia garinii
VFLFIIACSGSDD

SEQ ID NO: 188626 - protein, 13 aa, Borrelia garinii
FLFIIACSGSDDV

SEQ ID NO: 188627 - protein, 13 aa, Borrelia garinii
LFIIACSGSDDVK

SEQ ID NO: 188628 - protein, 13 aa, Borrelia garinii
FIIACSGSDDVKL

SEQ ID NO: 188629 - protein, 13 aa, Borrelia garinii
IIACSGSDDVKLE

SEQ ID NO: 188630 - protein, 13 aa, Borrelia garinii
IACSGSDDVKLES

SEQ ID NO: 188631 - protein, 13 aa, Borrelia garinii
ACSGSDDVKLESK

SEQ ID NO: 188632 - protein, 13 aa, Borrelia garinii
CSGSDDVKLESKT

SEQ ID NO: 188633 - protein, 13 aa, Borrelia garinii
SGSDDVKLESKTV

SEQ ID NO: 188634 - protein, 13 aa, Borrelia garinii
GSDDVKLESKTVS

SEQ ID NO: 188635 - protein, 13 aa, Borrelia garinii
SDDVKLESKTVSL

SEQ ID NO: 188636 - protein, 13 aa, Borrelia garinii
DDVKLESKTVSLI

SEQ ID NO: 188637 - protein, 13 aa, Borrelia garinii
DVKLESKTVSLIV

SEQ ID NO: 188638 - protein, 13 aa, Borrelia garinii
VKLESKTVSLIVD

SEQ ID NO: 188639 - protein, 13 aa, Borrelia garinii
KLESKTVSLIVDG

SEQ ID NO: 188640 - protein, 13 aa, Borrelia garinii
LESKTVSLIVDGA

SEQ ID NO: 188641 - protein, 13 aa, Borrelia garinii
ESKTVSLIVDGAF

SEQ ID NO: 188642 - protein, 13 aa, Borrelia garinii
SKTVSLIVDGAFD

SEQ ID NO: 188643 - protein, 13 aa, Borrelia garinii
KTVSLIVDGAFDD

SEQ ID NO: 188644 - protein, 13 aa, Borrelia garinii
TVSLIVDGAFDDK

SEQ ID NO: 188645 - protein, 13 aa, Borrelia garinii
VSLIVDGAFDDKG

SEQ ID NO: 188646 - protein, 13 aa, Borrelia garinii
SLIVDGAFDDKGF

SEQ ID NO: 188647 - protein, 13 aa, Borrelia garinii
LIVDGAFDDKGFN

SEQ ID NO: 188648 - protein, 13 aa, Borrelia garinii
IVDGAFDDKGFNE

SEQ ID NO: 188649 - protein, 13 aa, Borrelia garinii
VDGAFDDKGFNES

SEQ ID NO: 188650 - protein, 13 aa, Borrelia garinii
DGAFDDKGFNESS

SEQ ID NO: 188651 - protein, 13 aa, Borrelia garinii
GAFDDKGFNESSS

SEQ ID NO: 188652 - protein, 13 aa, Borrelia garinii
AFDDKGFNESSSK

SEQ ID NO: 188653 - protein, 13 aa, Borrelia garinii
FDDKGFNESSSKA

SEQ ID NO: 188654 - protein, 13 aa, Borrelia garinii
DDKGFNESSSKAI

SEQ ID NO: 188655 - protein, 13 aa, Borrelia garinii
DKGFNESSSKAIR

SEQ ID NO: 188656 - protein, 13 aa, Borrelia garinii
KGFNESSSKAIRK

SEQ ID NO: 188657 - protein, 13 aa, Borrelia garinii
GFNESSSKAIRKL

SEQ ID NO: 188658 - protein, 13 aa, Borrelia garinii
FNESSSKAIRKLK

SEQ ID NO: 188659 - protein, 13 aa, Borrelia garinii
NESSSKAIRKLKT

SEQ ID NO: 188660 - protein, 13 aa, Borrelia garinii
ESSSKAIRKLKTD

SEQ ID NO: 188661 - protein, 13 aa, Borrelia garinii
SSSKAIRKLKTDF

SEQ ID NO: 188662 - protein, 13 aa, Borrelia garinii
SSKAIRKLKTDFN

SEQ ID NO: 188663 - protein, 13 aa, Borrelia garinii
SKAIRKLKTDFNI

SEQ ID NO: 188664 - protein, 13 aa, Borrelia garinii
KAIRKLKTDFNIN

SEQ ID NO: 188665 - protein, 13 aa, Borrelia garinii
AIRKLKTDFNINI

SEQ ID NO: 188666 - protein, 13 aa, Borrelia garinii
IRKLKTDFNINII

SEQ ID NO: 188667 - protein, 13 aa, Borrelia garinii
RKLKTDFNINIIE

SEQ ID NO: 188668 - protein, 13 aa, Borrelia garinii
KLKTDFNINIIEK

SEQ ID NO: 188669 - protein, 13 aa, Borrelia garinii
LKTDFNINIIEKA

SEQ ID NO: 188670 - protein, 13 aa, Borrelia garinii
KTDFNINIIEKAS

SEQ ID NO: 188671 - protein, 13 aa, Borrelia garinii
TDFNINIIEKAST

SEQ ID NO: 188672 - protein, 13 aa, Borrelia garinii
DFNINIIEKASTG

SEQ ID NO: 188673 - protein, 13 aa, Borrelia garinii
FNINIIEKASTGN

SEQ ID NO: 188674 - protein, 13 aa, Borrelia garinii
NINIIEKASTGNS

SEQ ID NO: 188675 - protein, 13 aa, Borrelia garinii
INIIEKASTGNSH

SEQ ID NO: 188676 - protein, 13 aa, Borrelia garinii
NIIEKASTGNSHL

SEQ ID NO: 188677 - protein, 13 aa, Borrelia garinii
IIEKASTGNSHLG

SEQ ID NO: 188678 - protein, 13 aa, Borrelia garinii
IEKASTGNSHLGD

SEQ ID NO: 188679 - protein, 13 aa, Borrelia garinii
EKASTGNSHLGDI

SEQ ID NO: 188680 - protein, 13 aa, Borrelia garinii
KASTGNSHLGDIA

SEQ ID NO: 188681 - protein, 13 aa, Borrelia garinii
ASTGNSHLGDIAT

SEQ ID NO: 188682 - protein, 13 aa, Borrelia garinii
STGNSHLGDIATL

SEQ ID NO: 188683 - protein, 13 aa, Borrelia garinii
TGNSHLGDIATLE

SEQ ID NO: 188684 - protein, 13 aa, Borrelia garinii
GNSHLGDIATLED

SEQ ID NO: 188685 - protein, 13 aa, Borrelia garinii
NSHLGDIATLEDG

SEQ ID NO: 188686 - protein, 13 aa, Borrelia garinii
SHLGDIATLEDGN

SEQ ID NO: 188687 - protein, 13 aa, Borrelia garinii
HLGDIATLEDGNS

SEQ ID NO: 188688 - protein, 13 aa, Borrelia garinii
LGDIATLEDGNSN

SEQ ID NO: 188689 - protein, 13 aa, Borrelia garinii
GDIATLEDGNSNL

SEQ ID NO: 188690 - protein, 13 aa, Borrelia garinii
DIATLEDGNSNLI

SEQ ID NO: 188691 - protein, 13 aa, Borrelia garinii
IATLEDGNSNLIW

SEQ ID NO: 188692 - protein, 13 aa, Borrelia garinii
ATLEDGNSNLIWG

SEQ ID NO: 188693 - protein, 13 aa, Borrelia garinii
TLEDGNSNLIWGI

SEQ ID NO: 188694 - protein, 13 aa, Borrelia garinii
LEDGNSNLIWGIG

SEQ ID NO: 188695 - protein, 13 aa, Borrelia garinii
EDGNSNLIWGIGF

SEQ ID NO: 188696 - protein, 13 aa, Borrelia garinii
DGNSNLIWGIGFR

SEQ ID NO: 188697 - protein, 13 aa, Borrelia garinii
GNSNLIWGIGFRL

SEQ ID NO: 188698 - protein, 13 aa, Borrelia garinii
NSNLIWGIGFRLS

SEQ ID NO: 188699 - protein, 13 aa, Borrelia garinii
SNLIWGIGFRLSD

SEQ ID NO: 188700 - protein, 13 aa, Borrelia garinii
NLIWGIGFRLSDV

SEQ ID NO: 188701 - protein, 13 aa, Borrelia garinii
LIWGIGFRLSDVL

SEQ ID NO: 188702 - protein, 13 aa, Borrelia garinii
IWGIGFRLSDVLL

SEQ ID NO: 188703 - protein, 13 aa, Borrelia garinii
WGIGFRLSDVLLQ

SEQ ID NO: 188704 - protein, 13 aa, Borrelia garinii
GIGFRLSDVLLQR

SEQ ID NO: 188705 - protein, 13 aa, Borrelia garinii
IGFRLSDVLLQRA

SEQ ID NO: 188706 - protein, 13 aa, Borrelia garinii
GFRLSDVLLQRAS

SEQ ID NO: 188707 - protein, 13 aa, Borrelia garinii
FRLSDVLLQRASE

SEQ ID NO: 188708 - protein, 13 aa, Borrelia garinii
RLSDVLLQRASEN

SEQ ID NO: 188709 - protein, 13 aa, Borrelia garinii
LSDVLLQRASENI

SEQ ID NO: 188710 - protein, 13 aa, Borrelia garinii
SDVLLQRASENIS

SEQ ID NO: 188711 - protein, 13 aa, Borrelia garinii
DVLLQRASENISI

SEQ ID NO: 188712 - protein, 13 aa, Borrelia garinii
VLLQRASENISIN

SEQ ID NO: 188713 - protein, 13 aa, Borrelia garinii
LLQRASENISINY

SEQ ID NO: 188714 - protein, 13 aa, Borrelia garinii
LQRASENISINYA

SEQ ID NO: 188715 - protein, 13 aa, Borrelia garinii
QRASENISINYAI

SEQ ID NO: 188716 - protein, 13 aa, Borrelia garinii
RASENISINYAIM

SEQ ID NO: 188717 - protein, 13 aa, Borrelia garinii
ASENISINYAIME

SEQ ID NO: 188718 - protein, 13 aa, Borrelia garinii
SENISINYAIMEG

SEQ ID NO: 188719 - protein, 13 aa, Borrelia garinii
ENISINYAIMEGV

SEQ ID NO: 188720 - protein, 13 aa, Borrelia garinii
NISINYAIMEGVY

SEQ ID NO: 188721 - protein, 13 aa, Borrelia garinii
ISINYAIMEGVYN

SEQ ID NO: 188722 - protein, 13 aa, Borrelia garinii
SINYAIMEGVYNE

SEQ ID NO: 188723 - protein, 13 aa, Borrelia garinii
INYAIMEGVYNEI

SEQ ID NO: 188724 - protein, 13 aa, Borrelia garinii
NYAIMEGVYNEIQ

SEQ ID NO: 188725 - protein, 13 aa, Borrelia garinii
YAIMEGVYNEIQM

SEQ ID NO: 188726 - protein, 13 aa, Borrelia garinii
AIMEGVYNEIQMP

SEQ ID NO: 188727 - protein, 13 aa, Borrelia garinii
IMEGVYNEIQMPK

SEQ ID NO: 188728 - protein, 13 aa, Borrelia garinii
MEGVYNEIQMPKN

SEQ ID NO: 188729 - protein, 13 aa, Borrelia garinii
EGVYNEIQMPKNL

SEQ ID NO: 188730 - protein, 13 aa, Borrelia garinii
GVYNEIQMPKNLL

SEQ ID NO: 188731 - protein, 13 aa, Borrelia garinii
VYNEIQMPKNLLN

SEQ ID NO: 188732 - protein, 13 aa, Borrelia garinii
YNEIQMPKNLLNI

SEQ ID NO: 188733 - protein, 13 aa, Borrelia garinii
NEIQMPKNLLNIS

SEQ ID NO: 188734 - protein, 13 aa, Borrelia garinii
EIQMPKNLLNISF

SEQ ID NO: 188735 - protein, 13 aa, Borrelia garinii
IQMPKNLLNISFR

SEQ ID NO: 188736 - protein, 13 aa, Borrelia garinii
QMPKNLLNISFRS

SEQ ID NO: 188737 - protein, 13 aa, Borrelia garinii
MPKNLLNISFRSE

SEQ ID NO: 188738 - protein, 13 aa, Borrelia garinii
PKNLLNISFRSEE

SEQ ID NO: 188739 - protein, 13 aa, Borrelia garinii
KNLLNISFRSEEV

SEQ ID NO: 188740 - protein, 13 aa, Borrelia garinii
NLLNISFRSEEVA

SEQ ID NO: 188741 - protein, 13 aa, Borrelia garinii
LLNISFRSEEVAF

SEQ ID NO: 188742 - protein, 13 aa, Borrelia garinii
LNISFRSEEVAFL

SEQ ID NO: 188743 - protein, 13 aa, Borrelia garinii
NISFRSEEVAFLA

SEQ ID NO: 188744 - protein, 13 aa, Borrelia garinii
ISFRSEEVAFLAG

SEQ ID NO: 188745 - protein, 13 aa, Borrelia garinii
SFRSEEVAFLAGY

SEQ ID NO: 188746 - protein, 13 aa, Borrelia garinii
FRSEEVAFLAGYF

SEQ ID NO: 188747 - protein, 13 aa, Borrelia garinii
RSEEVAFLAGYFA

SEQ ID NO: 188748 - protein, 13 aa, Borrelia garinii
SEEVAFLAGYFAS

SEQ ID NO: 188749 - protein, 13 aa, Borrelia garinii
EEVAFLAGYFASK

SEQ ID NO: 188750 - protein, 13 aa, Borrelia garinii
EVAFLAGYFASKT

SEQ ID NO: 188751 - protein, 13 aa, Borrelia garinii
VAFLAGYFASKTS

SEQ ID NO: 188752 - protein, 13 aa, Borrelia garinii
AFLAGYFASKTSK

SEQ ID NO: 188753 - protein, 13 aa, Borrelia garinii
FLAGYFASKTSKT

SEQ ID NO: 188754 - protein, 13 aa, Borrelia garinii
LAGYFASKTSKTG

SEQ ID NO: 188755 - protein, 13 aa, Borrelia garinii
AGYFASKTSKTGK

SEQ ID NO: 188756 - protein, 13 aa, Borrelia garinii
GYFASKTSKTGKI

SEQ ID NO: 188757 - protein, 13 aa, Borrelia garinii
YFASKTSKTGKIG

SEQ ID NO: 188758 - protein, 13 aa, Borrelia garinii
FASKTSKTGKIGF

SEQ ID NO: 188759 - protein, 13 aa, Borrelia garinii
ASKTSKTGKIGFI

SEQ ID NO: 188760 - protein, 13 aa, Borrelia garinii
SKTSKTGKIGFIG

SEQ ID NO: 188761 - protein, 13 aa, Borrelia garinii
KTSKTGKIGFIGG

SEQ ID NO: 188762 - protein, 13 aa, Borrelia garinii
TSKTGKIGFIGGV

SEQ ID NO: 188763 - protein, 13 aa, Borrelia garinii
SKTGKIGFIGGVK

SEQ ID NO: 188764 - protein, 13 aa, Borrelia garinii
KTGKIGFIGGVKG

SEQ ID NO: 188765 - protein, 13 aa, Borrelia garinii
TGKIGFIGGVKGK

SEQ ID NO: 188766 - protein, 13 aa, Borrelia garinii
GKIGFIGGVKGKV

SEQ ID NO: 188767 - protein, 13 aa, Borrelia garinii
KIGFIGGVKGKVL

SEQ ID NO: 188768 - protein, 13 aa, Borrelia garinii
IGFIGGVKGKVLE

SEQ ID NO: 188769 - protein, 13 aa, Borrelia garinii
GFIGGVKGKVLES

SEQ ID NO: 188770 - protein, 13 aa, Borrelia garinii
FIGGVKGKVLESF

SEQ ID NO: 188771 - protein, 13 aa, Borrelia garinii
IGGVKGKVLESFM

SEQ ID NO: 188772 - protein, 13 aa, Borrelia garinii
GGVKGKVLESFMY

SEQ ID NO: 188773 - protein, 13 aa, Borrelia garinii
GVKGKVLESFMYG

SEQ ID NO: 188774 - protein, 13 aa, Borrelia garinii
VKGKVLESFMYGY

SEQ ID NO: 188775 - protein, 13 aa, Borrelia garinii
KGKVLESFMYGYE

SEQ ID NO: 188776 - protein, 13 aa, Borrelia garinii
GKVLESFMYGYEA

SEQ ID NO: 188777 - protein, 13 aa, Borrelia garinii
KVLESFMYGYEAG

SEQ ID NO: 188778 - protein, 13 aa, Borrelia garinii
VLESFMYGYEAGA

SEQ ID NO: 188779 - protein, 13 aa, Borrelia garinii
LESFMYGYEAGAK

SEQ ID NO: 188780 - protein, 13 aa, Borrelia garinii
ESFMYGYEAGAKY

SEQ ID NO: 188781 - protein, 13 aa, Borrelia garinii
SFMYGYEAGAKYA

SEQ ID NO: 188782 - protein, 13 aa, Borrelia garinii
FMYGYEAGAKYAN

SEQ ID NO: 188783 - protein, 13 aa, Borrelia garinii
MYGYEAGAKYANS

SEQ ID NO: 188784 - protein, 13 aa, Borrelia garinii
YGYEAGAKYANST

SEQ ID NO: 188785 - protein, 13 aa, Borrelia garinii
GYEAGAKYANSTI

SEQ ID NO: 188786 - protein, 13 aa, Borrelia garinii
YEAGAKYANSTIK

SEQ ID NO: 188787 - protein, 13 aa, Borrelia garinii
EAGAKYANSTIKV

SEQ ID NO: 188788 - protein, 13 aa, Borrelia garinii
AGAKYANSTIKVI

SEQ ID NO: 188789 - protein, 13 aa, Borrelia garinii
GAKYANSTIKVIS

SEQ ID NO: 188790 - protein, 13 aa, Borrelia garinii
AKYANSTIKVISQ

SEQ ID NO: 188791 - protein, 13 aa, Borrelia garinii
KYANSTIKVISQY

SEQ ID NO: 188792 - protein, 13 aa, Borrelia garinii
YANSTIKVISQYV

SEQ ID NO: 188793 - protein, 13 aa, Borrelia garinii
ANSTIKVISQYVG

SEQ ID NO: 188794 - protein, 13 aa, Borrelia garinii
NSTIKVISQYVGT

SEQ ID NO: 188795 - protein, 13 aa, Borrelia garinii
STIKVISQYVGTF

SEQ ID NO: 188796 - protein, 13 aa, Borrelia garinii
TIKVISQYVGTFG

SEQ ID NO: 188797 - protein, 13 aa, Borrelia garinii
IKVISQYVGTFGD

SEQ ID NO: 188798 - protein, 13 aa, Borrelia garinii
KVISQYVGTFGDF

SEQ ID NO: 188799 - protein, 13 aa, Borrelia garinii
VISQYVGTFGDFG

SEQ ID NO: 188800 - protein, 13 aa, Borrelia garinii
ISQYVGTFGDFGL

SEQ ID NO: 188801 - protein, 13 aa, Borrelia garinii
SQYVGTFGDFGLG

SEQ ID NO: 188802 - protein, 13 aa, Borrelia garinii
QYVGTFGDFGLGR

SEQ ID NO: 188803 - protein, 13 aa, Borrelia garinii
YVGTFGDFGLGRS

SEQ ID NO: 188804 - protein, 13 aa, Borrelia garinii
VGTFGDFGLGRST

SEQ ID NO: 188805 - protein, 13 aa, Borrelia garinii
GTFGDFGLGRSTA

SEQ ID NO: 188806 - protein, 13 aa, Borrelia garinii
TFGDFGLGRSTAS

SEQ ID NO: 188807 - protein, 13 aa, Borrelia garinii
FGDFGLGRSTASN

SEQ ID NO: 188808 - protein, 13 aa, Borrelia garinii
GDFGLGRSTASNM

SEQ ID NO: 188809 - protein, 13 aa, Borrelia garinii
DFGLGRSTASNMY

SEQ ID NO: 188810 - protein, 13 aa, Borrelia garinii
FGLGRSTASNMYR

SEQ ID NO: 188811 - protein, 13 aa, Borrelia garinii
GLGRSTASNMYRD

SEQ ID NO: 188812 - protein, 13 aa, Borrelia garinii
LGRSTASNMYRDG

SEQ ID NO: 188813 - protein, 13 aa, Borrelia garinii
GRSTASNMYRDGV

SEQ ID NO: 188814 - protein, 13 aa, Borrelia garinii
RSTASNMYRDGVD

SEQ ID NO: 188815 - protein, 13 aa, Borrelia garinii
STASNMYRDGVDI

SEQ ID NO: 188816 - protein, 13 aa, Borrelia garinii
TASNMYRDGVDIV

SEQ ID NO: 188817 - protein, 13 aa, Borrelia garinii
ASNMYRDGVDIVF

SEQ ID NO: 188818 - protein, 13 aa, Borrelia garinii
SNMYRDGVDIVFA

SEQ ID NO: 188819 - protein, 13 aa, Borrelia garinii
NMYRDGVDIVFAA

SEQ ID NO: 188820 - protein, 13 aa, Borrelia garinii
MYRDGVDIVFAAA

SEQ ID NO: 188821 - protein, 13 aa, Borrelia garinii
YRDGVDIVFAAAG

SEQ ID NO: 188822 - protein, 13 aa, Borrelia garinii
RDGVDIVFAAAGL

SEQ ID NO: 188823 - protein, 13 aa, Borrelia garinii
DGVDIVFAAAGLS

SEQ ID NO: 188824 - protein, 13 aa, Borrelia garinii
GVDIVFAAAGLSG

SEQ ID NO: 188825 - protein, 13 aa, Borrelia garinii
VDIVFAAAGLSGI

SEQ ID NO: 188826 - protein, 13 aa, Borrelia garinii
DIVFAAAGLSGIG

SEQ ID NO: 188827 - protein, 13 aa, Borrelia garinii
IVFAAAGLSGIGV

SEQ ID NO: 188828 - protein, 13 aa, Borrelia garinii
VFAAAGLSGIGVI

SEQ ID NO: 188829 - protein, 13 aa, Borrelia garinii
FAAAGLSGIGVIE

SEQ ID NO: 188830 - protein, 13 aa, Borrelia garinii
AAAGLSGIGVIEA

SEQ ID NO: 188831 - protein, 13 aa, Borrelia garinii
AAGLSGIGVIEAA

SEQ ID NO: 188832 - protein, 13 aa, Borrelia garinii
AGLSGIGVIEAAK

SEQ ID NO: 188833 - protein, 13 aa, Borrelia garinii
GLSGIGVIEAAKE

SEQ ID NO: 188834 - protein, 13 aa, Borrelia garinii
LSGIGVIEAAKEL

SEQ ID NO: 188835 - protein, 13 aa, Borrelia garinii
SGIGVIEAAKELG

SEQ ID NO: 188836 - protein, 13 aa, Borrelia garinii
GIGVIEAAKELGP

SEQ ID NO: 188837 - protein, 13 aa, Borrelia garinii
IGVIEAAKELGPD

SEQ ID NO: 188838 - protein, 13 aa, Borrelia garinii
GVIEAAKELGPDH

SEQ ID NO: 188839 - protein, 13 aa, Borrelia garinii
VIEAAKELGPDHY

SEQ ID NO: 188840 - protein, 13 aa, Borrelia garinii
IEAAKELGPDHYI

SEQ ID NO: 188841 - protein, 13 aa, Borrelia garinii
EAAKELGPDHYII

SEQ ID NO: 188842 - protein, 13 aa, Borrelia garinii
AAKELGPDHYIIG

SEQ ID NO: 188843 - protein, 13 aa, Borrelia garinii
AKELGPDHYIIGV

SEQ ID NO: 188844 - protein, 13 aa, Borrelia garinii
KELGPDHYIIGVD

SEQ ID NO: 188845 - protein, 13 aa, Borrelia garinii
ELGPDHYIIGVDQ

SEQ ID NO: 188846 - protein, 13 aa, Borrelia garinii
LGPDHYIIGVDQD

SEQ ID NO: 188847 - protein, 13 aa, Borrelia garinii
GPDHYIIGVDQDQ

SEQ ID NO: 188848 - protein, 13 aa, Borrelia garinii
PDHYIIGVDQDQS

SEQ ID NO: 188849 - protein, 13 aa, Borrelia garinii
DHYIIGVDQDQSY

SEQ ID NO: 188850 - protein, 13 aa, Borrelia garinii
HYIIGVDQDQSYL

SEQ ID NO: 188851 - protein, 13 aa, Borrelia garinii
YIIGVDQDQSYLA

SEQ ID NO: 188852 - protein, 13 aa, Borrelia garinii
IIGVDQDQSYLAP

SEQ ID NO: 188853 - protein, 13 aa, Borrelia garinii
IGVDQDQSYLAPN

SEQ ID NO: 188854 - protein, 13 aa, Borrelia garinii
GVDQDQSYLAPNN

SEQ ID NO: 188855 - protein, 13 aa, Borrelia garinii
VDQDQSYLAPNNV

SEQ ID NO: 188856 - protein, 13 aa, Borrelia garinii
DQDQSYLAPNNVL

SEQ ID NO: 188857 - protein, 13 aa, Borrelia garinii
QDQSYLAPNNVLV

SEQ ID NO: 188858 - protein, 13 aa, Borrelia garinii
DQSYLAPNNVLVS

SEQ ID NO: 188859 - protein, 13 aa, Borrelia garinii
QSYLAPNNVLVSA

SEQ ID NO: 188860 - protein, 13 aa, Borrelia garinii
SYLAPNNVLVSAV

SEQ ID NO: 188861 - protein, 13 aa, Borrelia garinii
YLAPNNVLVSAVK

SEQ ID NO: 188862 - protein, 13 aa, Borrelia garinii
LAPNNVLVSAVKK

SEQ ID NO: 188863 - protein, 13 aa, Borrelia garinii
APNNVLVSAVKKV

SEQ ID NO: 188864 - protein, 13 aa, Borrelia garinii
PNNVLVSAVKKVD

SEQ ID NO: 188865 - protein, 13 aa, Borrelia garinii
NNVLVSAVKKVDS

SEQ ID NO: 188866 - protein, 13 aa, Borrelia garinii
NVLVSAVKKVDSL

SEQ ID NO: 188867 - protein, 13 aa, Borrelia garinii
VLVSAVKKVDSLM

SEQ ID NO: 188868 - protein, 13 aa, Borrelia garinii
LVSAVKKVDSLMY

SEQ ID NO: 188869 - protein, 13 aa, Borrelia garinii
VSAVKKVDSLMYS

SEQ ID NO: 188870 - protein, 13 aa, Borrelia garinii
SAVKKVDSLMYSL

SEQ ID NO: 188871 - protein, 13 aa, Borrelia garinii
AVKKVDSLMYSLT

SEQ ID NO: 188872 - protein, 13 aa, Borrelia garinii
VKKVDSLMYSLTK

SEQ ID NO: 188873 - protein, 13 aa, Borrelia garinii
KKVDSLMYSLTKK

SEQ ID NO: 188874 - protein, 13 aa, Borrelia garinii
KVDSLMYSLTKKY

SEQ ID NO: 188875 - protein, 13 aa, Borrelia garinii
VDSLMYSLTKKYL

SEQ ID NO: 188876 - protein, 13 aa, Borrelia garinii
DSLMYSLTKKYLE

SEQ ID NO: 188877 - protein, 13 aa, Borrelia garinii
SLMYSLTKKYLET

SEQ ID NO: 188878 - protein, 13 aa, Borrelia garinii
LMYSLTKKYLETG

SEQ ID NO: 188879 - protein, 13 aa, Borrelia garinii
MYSLTKKYLETGI

SEQ ID NO: 188880 - protein, 13 aa, Borrelia garinii
YSLTKKYLETGIW

SEQ ID NO: 188881 - protein, 13 aa, Borrelia garinii
SLTKKYLETGIWD

SEQ ID NO: 188882 - protein, 13 aa, Borrelia garinii
LTKKYLETGIWDG

SEQ ID NO: 188883 - protein, 13 aa, Borrelia garinii
TKKYLETGIWDGG

SEQ ID NO: 188884 - protein, 13 aa, Borrelia garinii
KKYLETGIWDGGK

SEQ ID NO: 188885 - protein, 13 aa, Borrelia garinii
KYLETGIWDGGKN

SEQ ID NO: 188886 - protein, 13 aa, Borrelia garinii
YLETGIWDGGKNI

SEQ ID NO: 188887 - protein, 13 aa, Borrelia garinii
LETGIWDGGKNIF

SEQ ID NO: 188888 - protein, 13 aa, Borrelia garinii
ETGIWDGGKNIFF

SEQ ID NO: 188889 - protein, 13 aa, Borrelia garinii
TGIWDGGKNIFFG

SEQ ID NO: 188890 - protein, 13 aa, Borrelia garinii
GIWDGGKNIFFGL

SEQ ID NO: 188891 - protein, 13 aa, Borrelia garinii
IWDGGKNIFFGLK

SEQ ID NO: 188892 - protein, 13 aa, Borrelia garinii
WDGGKNIFFGLKE

SEQ ID NO: 188893 - protein, 13 aa, Borrelia garinii
DGGKNIFFGLKED

SEQ ID NO: 188894 - protein, 13 aa, Borrelia garinii
GGKNIFFGLKEDG

SEQ ID NO: 188895 - protein, 13 aa, Borrelia garinii
GKNIFFGLKEDGL

SEQ ID NO: 188896 - protein, 13 aa, Borrelia garinii
KNIFFGLKEDGLG

SEQ ID NO: 188897 - protein, 13 aa, Borrelia garinii
NIFFGLKEDGLGL

SEQ ID NO: 188898 - protein, 13 aa, Borrelia garinii
IFFGLKEDGLGLV

SEQ ID NO: 188899 - protein, 13 aa, Borrelia garinii
FFGLKEDGLGLVL

SEQ ID NO: 188900 - protein, 13 aa, Borrelia garinii
FGLKEDGLGLVLN

SEQ ID NO: 188901 - protein, 13 aa, Borrelia garinii
GLKEDGLGLVLNE

SEQ ID NO: 188902 - protein, 13 aa, Borrelia garinii
LKEDGLGLVLNEN

SEQ ID NO: 188903 - protein, 13 aa, Borrelia garinii
KEDGLGLVLNENL

SEQ ID NO: 188904 - protein, 13 aa, Borrelia garinii
EDGLGLVLNENLK

SEQ ID NO: 188905 - protein, 13 aa, Borrelia garinii
DGLGLVLNENLKS

SEQ ID NO: 188906 - protein, 13 aa, Borrelia garinii
GLGLVLNENLKSN

SEQ ID NO: 188907 - protein, 13 aa, Borrelia garinii
LGLVLNENLKSNY

SEQ ID NO: 188908 - protein, 13 aa, Borrelia garinii
GLVLNENLKSNYS

SEQ ID NO: 188909 - protein, 13 aa, Borrelia garinii
LVLNENLKSNYSE

SEQ ID NO: 188910 - protein, 13 aa, Borrelia garinii
VLNENLKSNYSEI

SEQ ID NO: 188911 - protein, 13 aa, Borrelia garinii
LNENLKSNYSEIY

SEQ ID NO: 188912 - protein, 13 aa, Borrelia garinii
NENLKSNYSEIYN

SEQ ID NO: 188913 - protein, 13 aa, Borrelia garinii
ENLKSNYSEIYNK

SEQ ID NO: 188914 - protein, 13 aa, Borrelia garinii
NLKSNYSEIYNKS

SEQ ID NO: 188915 - protein, 13 aa, Borrelia garinii
LKSNYSEIYNKSL

SEQ ID NO: 188916 - protein, 13 aa, Borrelia garinii
KSNYSEIYNKSLE

SEQ ID NO: 188917 - protein, 13 aa, Borrelia garinii
SNYSEIYNKSLEI

SEQ ID NO: 188918 - protein, 13 aa, Borrelia garinii
NYSEIYNKSLEIG

SEQ ID NO: 188919 - protein, 13 aa, Borrelia garinii
YSEIYNKSLEIGQ

SEQ ID NO: 188920 - protein, 13 aa, Borrelia garinii
SEIYNKSLEIGQS

SEQ ID NO: 188921 - protein, 13 aa, Borrelia garinii
EIYNKSLEIGQSI

SEQ ID NO: 188922 - protein, 13 aa, Borrelia garinii
IYNKSLEIGQSIM

SEQ ID NO: 188923 - protein, 13 aa, Borrelia garinii
YNKSLEIGQSIME

SEQ ID NO: 188924 - protein, 13 aa, Borrelia garinii
NKSLEIGQSIMEG

SEQ ID NO: 188925 - protein, 13 aa, Borrelia garinii
KSLEIGQSIMEGI

SEQ ID NO: 188926 - protein, 13 aa, Borrelia garinii
SLEIGQSIMEGII

SEQ ID NO: 188927 - protein, 13 aa, Borrelia garinii
LEIGQSIMEGIIK

SEQ ID NO: 188928 - protein, 13 aa, Borrelia garinii
EIGQSIMEGIIKV

SEQ ID NO: 188929 - protein, 13 aa, Borrelia garinii
IGQSIMEGIIKVP

SEQ ID NO: 188930 - protein, 13 aa, Borrelia garinii
GQSIMEGIIKVPY

SEQ ID NO: 188931 - protein, 13 aa, Borrelia garinii
QSIMEGIIKVPYD

SEQ ID NO: 188932 - protein, 13 aa, Borrelia garinii
SIMEGIIKVPYDK

SEQ ID NO: 188933 - protein, 13 aa, Borrelia garinii
IMEGIIKVPYDKA

SEQ ID NO: 188934 - protein, 13 aa, Borrelia garinii
MEGIIKVPYDKAS

SEQ ID NO: 188935 - protein, 13 aa, Borrelia garinii
EGIIKVPYDKASY

SEQ ID NO: 188936 - protein, 13 aa, Borrelia garinii
GIIKVPYDKASYD

SEQ ID NO: 188937 - protein, 13 aa, Borrelia garinii
IIKVPYDKASYDN

SEQ ID NO: 188938 - protein, 13 aa, Borrelia garinii
IKVPYDKASYDNF

SEQ ID NO: 188939 - protein, 13 aa, Borrelia garinii
KVPYDKASYDNFV

SEQ ID NO: 188940 - protein, 13 aa, Borrelia garinii
VPYDKASYDNFVL

SEQ ID NO: 188941 - protein, 13 aa, Borrelia garinii
PYDKASYDNFVLQ

SEQ ID NO: 188942 - protein, 13 aa, Borrelia garinii
YDKASYDNFVLQI

SEQ ID NO: 188943 - protein, 13 aa, Borrelia garinii
DKASYDNFVLQIA

SEQ ID NO: 188944 - protein, 13 aa, Borrelia garinii
KASYDNFVLQIAN

SEQ ID NO: 188945 - protein, 14 aa, Borrelia garinii
MLNKVYCFIVFLFI

SEQ ID NO: 188946 - protein, 14 aa, Borrelia garinii
LNKVYCFIVFLFII

SEQ ID NO: 188947 - protein, 14 aa, Borrelia garinii
NKVYCFIVFLFIIA

SEQ ID NO: 188948 - protein, 14 aa, Borrelia garinii
KVYCFIVFLFIIAC

SEQ ID NO: 188949 - protein, 14 aa, Borrelia garinii
VYCFIVFLFIIACS

SEQ ID NO: 188950 - protein, 14 aa, Borrelia garinii
YCFIVFLFIIACSG

SEQ ID NO: 188951 - protein, 14 aa, Borrelia garinii
CFIVFLFIIACSGS

SEQ ID NO: 188952 - protein, 14 aa, Borrelia garinii
FIVFLFIIACSGSD

SEQ ID NO: 188953 - protein, 14 aa, Borrelia garinii
IVFLFIIACSGSDD

SEQ ID NO: 188954 - protein, 14 aa, Borrelia garinii
VFLFIIACSGSDDV

SEQ ID NO: 188955 - protein, 14 aa, Borrelia garinii
FLFIIACSGSDDVK

SEQ ID NO: 188956 - protein, 14 aa, Borrelia garinii
LFIIACSGSDDVKL

SEQ ID NO: 188957 - protein, 14 aa, Borrelia garinii
FIIACSGSDDVKLE

SEQ ID NO: 188958 - protein, 14 aa, Borrelia garinii
IIACSGSDDVKLES

SEQ ID NO: 188959 - protein, 14 aa, Borrelia garinii
IACSGSDDVKLESK

SEQ ID NO: 188960 - protein, 14 aa, Borrelia garinii
ACSGSDDVKLESKT

SEQ ID NO: 188961 - protein, 14 aa, Borrelia garinii
CSGSDDVKLESKTV

SEQ ID NO: 188962 - protein, 14 aa, Borrelia garinii
SGSDDVKLESKTVS

SEQ ID NO: 188963 - protein, 14 aa, Borrelia garinii
GSDDVKLESKTVSL

SEQ ID NO: 188964 - protein, 14 aa, Borrelia garinii
SDDVKLESKTVSLI

SEQ ID NO: 188965 - protein, 14 aa, Borrelia garinii
DDVKLESKTVSLIV

SEQ ID NO: 188966 - protein, 14 aa, Borrelia garinii
DVKLESKTVSLIVD

SEQ ID NO: 188967 - protein, 14 aa, Borrelia garinii
VKLESKTVSLIVDG

SEQ ID NO: 188968 - protein, 14 aa, Borrelia garinii
KLESKTVSLIVDGA

SEQ ID NO: 188969 - protein, 14 aa, Borrelia garinii
LESKTVSLIVDGAF

SEQ ID NO: 188970 - protein, 14 aa, Borrelia garinii
ESKTVSLIVDGAFD

SEQ ID NO: 188971 - protein, 14 aa, Borrelia garinii
SKTVSLIVDGAFDD

SEQ ID NO: 188972 - protein, 14 aa, Borrelia garinii
KTVSLIVDGAFDDK

SEQ ID NO: 188973 - protein, 14 aa, Borrelia garinii
TVSLIVDGAFDDKG

SEQ ID NO: 188974 - protein, 14 aa, Borrelia garinii
VSLIVDGAFDDKGF

SEQ ID NO: 188975 - protein, 14 aa, Borrelia garinii
SLIVDGAFDDKGFN

SEQ ID NO: 188976 - protein, 14 aa, Borrelia garinii
LIVDGAFDDKGFNE

SEQ ID NO: 188977 - protein, 14 aa, Borrelia garinii
IVDGAFDDKGFNES

SEQ ID NO: 188978 - protein, 14 aa, Borrelia garinii
VDGAFDDKGFNESS

SEQ ID NO: 188979 - protein, 14 aa, Borrelia garinii
DGAFDDKGFNESSS

SEQ ID NO: 188980 - protein, 14 aa, Borrelia garinii
GAFDDKGFNESSSK

SEQ ID NO: 188981 - protein, 14 aa, Borrelia garinii
AFDDKGFNESSSKA

SEQ ID NO: 188982 - protein, 14 aa, Borrelia garinii
FDDKGFNESSSKAI

SEQ ID NO: 188983 - protein, 14 aa, Borrelia garinii
DDKGFNESSSKAIR

SEQ ID NO: 188984 - protein, 14 aa, Borrelia garinii
DKGFNESSSKAIRK

SEQ ID NO: 188985 - protein, 14 aa, Borrelia garinii
KGFNESSSKAIRKL

SEQ ID NO: 188986 - protein, 14 aa, Borrelia garinii
GFNESSSKAIRKLK

SEQ ID NO: 188987 - protein, 14 aa, Borrelia garinii
FNESSSKAIRKLKT

SEQ ID NO: 188988 - protein, 14 aa, Borrelia garinii
NESSSKAIRKLKTD

SEQ ID NO: 188989 - protein, 14 aa, Borrelia garinii
ESSSKAIRKLKTDF

SEQ ID NO: 188990 - protein, 14 aa, Borrelia garinii
SSSKAIRKLKTDFN

SEQ ID NO: 188991 - protein, 14 aa, Borrelia garinii
SSKAIRKLKTDFNI

SEQ ID NO: 188992 - protein, 14 aa, Borrelia garinii
SKAIRKLKTDFNIN

SEQ ID NO: 188993 - protein, 14 aa, Borrelia garinii
KAIRKLKTDFNINI

SEQ ID NO: 188994 - protein, 14 aa, Borrelia garinii
AIRKLKTDFNINII

SEQ ID NO: 188995 - protein, 14 aa, Borrelia garinii
IRKLKTDFNINIIE

SEQ ID NO: 188996 - protein, 14 aa, Borrelia garinii
RKLKTDFNINIIEK

SEQ ID NO: 188997 - protein, 14 aa, Borrelia garinii
KLKTDFNINIIEKA

SEQ ID NO: 188998 - protein, 14 aa, Borrelia garinii
LKTDFNINIIEKAS

SEQ ID NO: 188999 - protein, 14 aa, Borrelia garinii
KTDFNINIIEKAST

SEQ ID NO: 189000 - protein, 14 aa, Borrelia garinii
TDFNINIIEKASTG

SEQ ID NO: 189001 - protein, 14 aa, Borrelia garinii
DFNINIIEKASTGN

SEQ ID NO: 189002 - protein, 14 aa, Borrelia garinii
FNINIIEKASTGNS

SEQ ID NO: 189003 - protein, 14 aa, Borrelia garinii
NINIIEKASTGNSH

SEQ ID NO: 189004 - protein, 14 aa, Borrelia garinii
INIIEKASTGNSHL

SEQ ID NO: 189005 - protein, 14 aa, Borrelia garinii
NIIEKASTGNSHLG

SEQ ID NO: 189006 - protein, 14 aa, Borrelia garinii
IIEKASTGNSHLGD

SEQ ID NO: 189007 - protein, 14 aa, Borrelia garinii
IEKASTGNSHLGDI

SEQ ID NO: 189008 - protein, 14 aa, Borrelia garinii
EKASTGNSHLGDIA

SEQ ID NO: 189009 - protein, 14 aa, Borrelia garinii
KASTGNSHLGDIAT

SEQ ID NO: 189010 - protein, 14 aa, Borrelia garinii
ASTGNSHLGDIATL

SEQ ID NO: 189011 - protein, 14 aa, Borrelia garinii
STGNSHLGDIATLE

SEQ ID NO: 189012 - protein, 14 aa, Borrelia garinii
TGNSHLGDIATLED

SEQ ID NO: 189013 - protein, 14 aa, Borrelia garinii
GNSHLGDIATLEDG

SEQ ID NO: 189014 - protein, 14 aa, Borrelia garinii
NSHLGDIATLEDGN

SEQ ID NO: 189015 - protein, 14 aa, Borrelia garinii
SHLGDIATLEDGNS

SEQ ID NO: 189016 - protein, 14 aa, Borrelia garinii
HLGDIATLEDGNSN

SEQ ID NO: 189017 - protein, 14 aa, Borrelia garinii
LGDIATLEDGNSNL

SEQ ID NO: 189018 - protein, 14 aa, Borrelia garinii
GDIATLEDGNSNLI

SEQ ID NO: 189019 - protein, 14 aa, Borrelia garinii
DIATLEDGNSNLIW

SEQ ID NO: 189020 - protein, 14 aa, Borrelia garinii
IATLEDGNSNLIWG

SEQ ID NO: 189021 - protein, 14 aa, Borrelia garinii
ATLEDGNSNLIWGI

SEQ ID NO: 189022 - protein, 14 aa, Borrelia garinii
TLEDGNSNLIWGIG

SEQ ID NO: 189023 - protein, 14 aa, Borrelia garinii
LEDGNSNLIWGIGF

SEQ ID NO: 189024 - protein, 14 aa, Borrelia garinii
EDGNSNLIWGIGFR

SEQ ID NO: 189025 - protein, 14 aa, Borrelia garinii
DGNSNLIWGIGFRL

SEQ ID NO: 189026 - protein, 14 aa, Borrelia garinii
GNSNLIWGIGFRLS

SEQ ID NO: 189027 - protein, 14 aa, Borrelia garinii
NSNLIWGIGFRLSD

SEQ ID NO: 189028 - protein, 14 aa, Borrelia garinii
SNLIWGIGFRLSDV

SEQ ID NO: 189029 - protein, 14 aa, Borrelia garinii
NLIWGIGFRLSDVL

SEQ ID NO: 189030 - protein, 14 aa, Borrelia garinii
LIWGIGFRLSDVLL

SEQ ID NO: 189031 - protein, 14 aa, Borrelia garinii
IWGIGFRLSDVLLQ

SEQ ID NO: 189032 - protein, 14 aa, Borrelia garinii
WGIGFRLSDVLLQR

SEQ ID NO: 189033 - protein, 14 aa, Borrelia garinii
GIGFRLSDVLLQRA

SEQ ID NO: 189034 - protein, 14 aa, Borrelia garinii
IGFRLSDVLLQRAS

SEQ ID NO: 189035 - protein, 14 aa, Borrelia garinii
GFRLSDVLLQRASE

SEQ ID NO: 189036 - protein, 14 aa, Borrelia garinii
FRLSDVLLQRASEN

SEQ ID NO: 189037 - protein, 14 aa, Borrelia garinii
RLSDVLLQRASENI

SEQ ID NO: 189038 - protein, 14 aa, Borrelia garinii
LSDVLLQRASENIS

SEQ ID NO: 189039 - protein, 14 aa, Borrelia garinii
SDVLLQRASENISI

SEQ ID NO: 189040 - protein, 14 aa, Borrelia garinii
DVLLQRASENISIN

SEQ ID NO: 189041 - protein, 14 aa, Borrelia garinii
VLLQRASENISINY

SEQ ID NO: 189042 - protein, 14 aa, Borrelia garinii
LLQRASENISINYA

SEQ ID NO: 189043 - protein, 14 aa, Borrelia garinii
LQRASENISINYAI

SEQ ID NO: 189044 - protein, 14 aa, Borrelia garinii
QRASENISINYAIM

SEQ ID NO: 189045 - protein, 14 aa, Borrelia garinii
RASENISINYAIME

SEQ ID NO: 189046 - protein, 14 aa, Borrelia garinii
ASENISINYAIMEG

SEQ ID NO: 189047 - protein, 14 aa, Borrelia garinii
SENISINYAIMEGV

SEQ ID NO: 189048 - protein, 14 aa, Borrelia garinii
ENISINYAIMEGVY

SEQ ID NO: 189049 - protein, 14 aa, Borrelia garinii
NISINYAIMEGVYN

SEQ ID NO: 189050 - protein, 14 aa, Borrelia garinii
ISINYAIMEGVYNE

SEQ ID NO: 189051 - protein, 14 aa, Borrelia garinii
SINYAIMEGVYNEI

SEQ ID NO: 189052 - protein, 14 aa, Borrelia garinii
INYAIMEGVYNEIQ

SEQ ID NO: 189053 - protein, 14 aa, Borrelia garinii
NYAIMEGVYNEIQM

SEQ ID NO: 189054 - protein, 14 aa, Borrelia garinii
YAIMEGVYNEIQMP

SEQ ID NO: 189055 - protein, 14 aa, Borrelia garinii
AIMEGVYNEIQMPK

SEQ ID NO: 189056 - protein, 14 aa, Borrelia garinii
IMEGVYNEIQMPKN

SEQ ID NO: 189057 - protein, 14 aa, Borrelia garinii
MEGVYNEIQMPKNL

SEQ ID NO: 189058 - protein, 14 aa, Borrelia garinii
EGVYNEIQMPKNLL

SEQ ID NO: 189059 - protein, 14 aa, Borrelia garinii
GVYNEIQMPKNLLN

SEQ ID NO: 189060 - protein, 14 aa, Borrelia garinii
VYNEIQMPKNLLNI

SEQ ID NO: 189061 - protein, 14 aa, Borrelia garinii
YNEIQMPKNLLNIS

SEQ ID NO: 189062 - protein, 14 aa, Borrelia garinii
NEIQMPKNLLNISF

SEQ ID NO: 189063 - protein, 14 aa, Borrelia garinii
EIQMPKNLLNISFR

SEQ ID NO: 189064 - protein, 14 aa, Borrelia garinii
IQMPKNLLNISFRS

SEQ ID NO: 189065 - protein, 14 aa, Borrelia garinii
QMPKNLLNISFRSE

SEQ ID NO: 189066 - protein, 14 aa, Borrelia garinii
MPKNLLNISFRSEE

SEQ ID NO: 189067 - protein, 14 aa, Borrelia garinii
PKNLLNISFRSEEV

SEQ ID NO: 189068 - protein, 14 aa, Borrelia garinii
KNLLNISFRSEEVA

SEQ ID NO: 189069 - protein, 14 aa, Borrelia garinii
NLLNISFRSEEVAF

SEQ ID NO: 189070 - protein, 14 aa, Borrelia garinii
LLNISFRSEEVAFL

SEQ ID NO: 189071 - protein, 14 aa, Borrelia garinii
LNISFRSEEVAFLA

SEQ ID NO: 189072 - protein, 14 aa, Borrelia garinii
NISFRSEEVAFLAG

SEQ ID NO: 189073 - protein, 14 aa, Borrelia garinii
ISFRSEEVAFLAGY

SEQ ID NO: 189074 - protein, 14 aa, Borrelia garinii
SFRSEEVAFLAGYF

SEQ ID NO: 189075 - protein, 14 aa, Borrelia garinii
FRSEEVAFLAGYFA

SEQ ID NO: 189076 - protein, 14 aa, Borrelia garinii
RSEEVAFLAGYFAS

SEQ ID NO: 189077 - protein, 14 aa, Borrelia garinii
SEEVAFLAGYFASK

SEQ ID NO: 189078 - protein, 14 aa, Borrelia garinii
EEVAFLAGYFASKT

SEQ ID NO: 189079 - protein, 14 aa, Borrelia garinii
EVAFLAGYFASKTS

SEQ ID NO: 189080 - protein, 14 aa, Borrelia garinii
VAFLAGYFASKTSK

SEQ ID NO: 189081 - protein, 14 aa, Borrelia garinii
AFLAGYFASKTSKT

SEQ ID NO: 189082 - protein, 14 aa, Borrelia garinii
FLAGYFASKTSKTG

SEQ ID NO: 189083 - protein, 14 aa, Borrelia garinii
LAGYFASKTSKTGK

SEQ ID NO: 189084 - protein, 14 aa, Borrelia garinii
AGYFASKTSKTGKI

SEQ ID NO: 189085 - protein, 14 aa, Borrelia garinii
GYFASKTSKTGKIG

SEQ ID NO: 189086 - protein, 14 aa, Borrelia garinii
YFASKTSKTGKIGF

SEQ ID NO: 189087 - protein, 14 aa, Borrelia garinii
FASKTSKTGKIGFI

SEQ ID NO: 189088 - protein, 14 aa, Borrelia garinii
ASKTSKTGKIGFIG

SEQ ID NO: 189089 - protein, 14 aa, Borrelia garinii
SKTSKTGKIGFIGG

SEQ ID NO: 189090 - protein, 14 aa, Borrelia garinii
KTSKTGKIGFIGGV

SEQ ID NO: 189091 - protein, 14 aa, Borrelia garinii
TSKTGKIGFIGGVK

SEQ ID NO: 189092 - protein, 14 aa, Borrelia garinii
SKTGKIGFIGGVKG

SEQ ID NO: 189093 - protein, 14 aa, Borrelia garinii
KTGKIGFIGGVKGK

SEQ ID NO: 189094 - protein, 14 aa, Borrelia garinii
TGKIGFIGGVKGKV

SEQ ID NO: 189095 - protein, 14 aa, Borrelia garinii
GKIGFIGGVKGKVL

SEQ ID NO: 189096 - protein, 14 aa, Borrelia garinii
KIGFIGGVKGKVLE

SEQ ID NO: 189097 - protein, 14 aa, Borrelia garinii
IGFIGGVKGKVLES

SEQ ID NO: 189098 - protein, 14 aa, Borrelia garinii
GFIGGVKGKVLESF

SEQ ID NO: 189099 - protein, 14 aa, Borrelia garinii
FIGGVKGKVLESFM

SEQ ID NO: 189100 - protein, 14 aa, Borrelia garinii
IGGVKGKVLESFMY

SEQ ID NO: 189101 - protein, 14 aa, Borrelia garinii
GGVKGKVLESFMYG

SEQ ID NO: 189102 - protein, 14 aa, Borrelia garinii
GVKGKVLESFMYGY

SEQ ID NO: 189103 - protein, 14 aa, Borrelia garinii
VKGKVLESFMYGYE

SEQ ID NO: 189104 - protein, 14 aa, Borrelia garinii
KGKVLESFMYGYEA

SEQ ID NO: 189105 - protein, 14 aa, Borrelia garinii
GKVLESFMYGYEAG

SEQ ID NO: 189106 - protein, 14 aa, Borrelia garinii
KVLESFMYGYEAGA

SEQ ID NO: 189107 - protein, 14 aa, Borrelia garinii
VLESFMYGYEAGAK

SEQ ID NO: 189108 - protein, 14 aa, Borrelia garinii
LESFMYGYEAGAKY

SEQ ID NO: 189109 - protein, 14 aa, Borrelia garinii
ESFMYGYEAGAKYA

SEQ ID NO: 189110 - protein, 14 aa, Borrelia garinii
SFMYGYEAGAKYAN

SEQ ID NO: 189111 - protein, 14 aa, Borrelia garinii
FMYGYEAGAKYANS

SEQ ID NO: 189112 - protein, 14 aa, Borrelia garinii
MYGYEAGAKYANST

SEQ ID NO: 189113 - protein, 14 aa, Borrelia garinii
YGYEAGAKYANSTI

SEQ ID NO: 189114 - protein, 14 aa, Borrelia garinii
GYEAGAKYANSTIK

SEQ ID NO: 189115 - protein, 14 aa, Borrelia garinii
YEAGAKYANSTIKV

SEQ ID NO: 189116 - protein, 14 aa, Borrelia garinii
EAGAKYANSTIKVI

SEQ ID NO: 189117 - protein, 14 aa, Borrelia garinii
AGAKYANSTIKVIS

SEQ ID NO: 189118 - protein, 14 aa, Borrelia garinii
GAKYANSTIKVISQ

SEQ ID NO: 189119 - protein, 14 aa, Borrelia garinii
AKYANSTIKVISQY

SEQ ID NO: 189120 - protein, 14 aa, Borrelia garinii
KYANSTIKVISQYV

SEQ ID NO: 189121 - protein, 14 aa, Borrelia garinii
YANSTIKVISQYVG

SEQ ID NO: 189122 - protein, 14 aa, Borrelia garinii
ANSTIKVISQYVGT

SEQ ID NO: 189123 - protein, 14 aa, Borrelia garinii
NSTIKVISQYVGTF

SEQ ID NO: 189124 - protein, 14 aa, Borrelia garinii
STIKVISQYVGTFG

SEQ ID NO: 189125 - protein, 14 aa, Borrelia garinii
TIKVISQYVGTFGD

SEQ ID NO: 189126 - protein, 14 aa, Borrelia garinii
IKVISQYVGTFGDF

SEQ ID NO: 189127 - protein, 14 aa, Borrelia garinii
KVISQYVGTFGDFG

SEQ ID NO: 189128 - protein, 14 aa, Borrelia garinii
VISQYVGTFGDFGL

SEQ ID NO: 189129 - protein, 14 aa, Borrelia garinii
ISQYVGTFGDFGLG

SEQ ID NO: 189130 - protein, 14 aa, Borrelia garinii
SQYVGTFGDFGLGR

SEQ ID NO: 189131 - protein, 14 aa, Borrelia garinii
QYVGTFGDFGLGRS

SEQ ID NO: 189132 - protein, 14 aa, Borrelia garinii
YVGTFGDFGLGRST

SEQ ID NO: 189133 - protein, 14 aa, Borrelia garinii
VGTFGDFGLGRSTA

SEQ ID NO: 189134 - protein, 14 aa, Borrelia garinii
GTFGDFGLGRSTAS

SEQ ID NO: 189135 - protein, 14 aa, Borrelia garinii
TFGDFGLGRSTASN

SEQ ID NO: 189136 - protein, 14 aa, Borrelia garinii
FGDFGLGRSTASNM

SEQ ID NO: 189137 - protein, 14 aa, Borrelia garinii
GDFGLGRSTASNMY

SEQ ID NO: 189138 - protein, 14 aa, Borrelia garinii
DFGLGRSTASNMYR

SEQ ID NO: 189139 - protein, 14 aa, Borrelia garinii
FGLGRSTASNMYRD

SEQ ID NO: 189140 - protein, 14 aa, Borrelia garinii
GLGRSTASNMYRDG

SEQ ID NO: 189141 - protein, 14 aa, Borrelia garinii
LGRSTASNMYRDGV

SEQ ID NO: 189142 - protein, 14 aa, Borrelia garinii
GRSTASNMYRDGVD

SEQ ID NO: 189143 - protein, 14 aa, Borrelia garinii
RSTASNMYRDGVDI

SEQ ID NO: 189144 - protein, 14 aa, Borrelia garinii
STASNMYRDGVDIV

SEQ ID NO: 189145 - protein, 14 aa, Borrelia garinii
TASNMYRDGVDIVF

SEQ ID NO: 189146 - protein, 14 aa, Borrelia garinii
ASNMYRDGVDIVFA

SEQ ID NO: 189147 - protein, 14 aa, Borrelia garinii
SNMYRDGVDIVFAA

SEQ ID NO: 189148 - protein, 14 aa, Borrelia garinii
NMYRDGVDIVFAAA

SEQ ID NO: 189149 - protein, 14 aa, Borrelia garinii
MYRDGVDIVFAAAG

SEQ ID NO: 189150 - protein, 14 aa, Borrelia garinii
YRDGVDIVFAAAGL

SEQ ID NO: 189151 - protein, 14 aa, Borrelia garinii
RDGVDIVFAAAGLS

SEQ ID NO: 189152 - protein, 14 aa, Borrelia garinii
DGVDIVFAAAGLSG

SEQ ID NO: 189153 - protein, 14 aa, Borrelia garinii
GVDIVFAAAGLSGI

SEQ ID NO: 189154 - protein, 14 aa, Borrelia garinii
VDIVFAAAGLSGIG

SEQ ID NO: 189155 - protein, 14 aa, Borrelia garinii
DIVFAAAGLSGIGV

SEQ ID NO: 189156 - protein, 14 aa, Borrelia garinii
IVFAAAGLSGIGVI

SEQ ID NO: 189157 - protein, 14 aa, Borrelia garinii
VFAAAGLSGIGVIE

SEQ ID NO: 189158 - protein, 14 aa, Borrelia garinii
FAAAGLSGIGVIEA

SEQ ID NO: 189159 - protein, 14 aa, Borrelia garinii
AAAGLSGIGVIEAA

SEQ ID NO: 189160 - protein, 14 aa, Borrelia garinii
AAGLSGIGVIEAAK

SEQ ID NO: 189161 - protein, 14 aa, Borrelia garinii
AGLSGIGVIEAAKE

SEQ ID NO: 189162 - protein, 14 aa, Borrelia garinii
GLSGIGVIEAAKEL

SEQ ID NO: 189163 - protein, 14 aa, Borrelia garinii
LSGIGVIEAAKELG

SEQ ID NO: 189164 - protein, 14 aa, Borrelia garinii
SGIGVIEAAKELGP

SEQ ID NO: 189165 - protein, 14 aa, Borrelia garinii
GIGVIEAAKELGPD

SEQ ID NO: 189166 - protein, 14 aa, Borrelia garinii
IGVIEAAKELGPDH

SEQ ID NO: 189167 - protein, 14 aa, Borrelia garinii
GVIEAAKELGPDHY

SEQ ID NO: 189168 - protein, 14 aa, Borrelia garinii
VIEAAKELGPDHYI

SEQ ID NO: 189169 - protein, 14 aa, Borrelia garinii
IEAAKELGPDHYII

SEQ ID NO: 189170 - protein, 14 aa, Borrelia garinii
EAAKELGPDHYIIG

SEQ ID NO: 189171 - protein, 14 aa, Borrelia garinii
AAKELGPDHYIIGV

SEQ ID NO: 189172 - protein, 14 aa, Borrelia garinii
AKELGPDHYIIGVD

SEQ ID NO: 189173 - protein, 14 aa, Borrelia garinii
KELGPDHYIIGVDQ

SEQ ID NO: 189174 - protein, 14 aa, Borrelia garinii
ELGPDHYIIGVDQD

SEQ ID NO: 189175 - protein, 14 aa, Borrelia garinii
LGPDHYIIGVDQDQ

SEQ ID NO: 189176 - protein, 14 aa, Borrelia garinii
GPDHYIIGVDQDQS

SEQ ID NO: 189177 - protein, 14 aa, Borrelia garinii
PDHYIIGVDQDQSY

SEQ ID NO: 189178 - protein, 14 aa, Borrelia garinii
DHYIIGVDQDQSYL

SEQ ID NO: 189179 - protein, 14 aa, Borrelia garinii
HYIIGVDQDQSYLA

SEQ ID NO: 189180 - protein, 14 aa, Borrelia garinii
YIIGVDQDQSYLAP

SEQ ID NO: 189181 - protein, 14 aa, Borrelia garinii
IIGVDQDQSYLAPN

SEQ ID NO: 189182 - protein, 14 aa, Borrelia garinii
IGVDQDQSYLAPNN

SEQ ID NO: 189183 - protein, 14 aa, Borrelia garinii
GVDQDQSYLAPNNV

SEQ ID NO: 189184 - protein, 14 aa, Borrelia garinii
VDQDQSYLAPNNVL

SEQ ID NO: 189185 - protein, 14 aa, Borrelia garinii
DQDQSYLAPNNVLV

SEQ ID NO: 189186 - protein, 14 aa, Borrelia garinii
QDQSYLAPNNVLVS

SEQ ID NO: 189187 - protein, 14 aa, Borrelia garinii
DQSYLAPNNVLVSA

SEQ ID NO: 189188 - protein, 14 aa, Borrelia garinii
QSYLAPNNVLVSAV

SEQ ID NO: 189189 - protein, 14 aa, Borrelia garinii
SYLAPNNVLVSAVK

SEQ ID NO: 189190 - protein, 14 aa, Borrelia garinii
YLAPNNVLVSAVKK

SEQ ID NO: 189191 - protein, 14 aa, Borrelia garinii
LAPNNVLVSAVKKV

SEQ ID NO: 189192 - protein, 14 aa, Borrelia garinii
APNNVLVSAVKKVD

SEQ ID NO: 189193 - protein, 14 aa, Borrelia garinii
PNNVLVSAVKKVDS

SEQ ID NO: 189194 - protein, 14 aa, Borrelia garinii
NNVLVSAVKKVDSL

SEQ ID NO: 189195 - protein, 14 aa, Borrelia garinii
NVLVSAVKKVDSLM

SEQ ID NO: 189196 - protein, 14 aa, Borrelia garinii
VLVSAVKKVDSLMY

SEQ ID NO: 189197 - protein, 14 aa, Borrelia garinii
LVSAVKKVDSLMYS

SEQ ID NO: 189198 - protein, 14 aa, Borrelia garinii
VSAVKKVDSLMYSL

SEQ ID NO: 189199 - protein, 14 aa, Borrelia garinii
SAVKKVDSLMYSLT

SEQ ID NO: 189200 - protein, 14 aa, Borrelia garinii
AVKKVDSLMYSLTK

SEQ ID NO: 189201 - protein, 14 aa, Borrelia garinii
VKKVDSLMYSLTKK

SEQ ID NO: 189202 - protein, 14 aa, Borrelia garinii
KKVDSLMYSLTKKY

SEQ ID NO: 189203 - protein, 14 aa, Borrelia garinii
KVDSLMYSLTKKYL

SEQ ID NO: 189204 - protein, 14 aa, Borrelia garinii
VDSLMYSLTKKYLE

SEQ ID NO: 189205 - protein, 14 aa, Borrelia garinii
DSLMYSLTKKYLET

SEQ ID NO: 189206 - protein, 14 aa, Borrelia garinii
SLMYSLTKKYLETG

SEQ ID NO: 189207 - protein, 14 aa, Borrelia garinii
LMYSLTKKYLETGI

SEQ ID NO: 189208 - protein, 14 aa, Borrelia garinii
MYSLTKKYLETGIW

SEQ ID NO: 189209 - protein, 14 aa, Borrelia garinii
YSLTKKYLETGIWD

SEQ ID NO: 189210 - protein, 14 aa, Borrelia garinii
SLTKKYLETGIWDG

SEQ ID NO: 189211 - protein, 14 aa, Borrelia garinii
LTKKYLETGIWDGG

SEQ ID NO: 189212 - protein, 14 aa, Borrelia garinii
TKKYLETGIWDGGK

SEQ ID NO: 189213 - protein, 14 aa, Borrelia garinii
KKYLETGIWDGGKN

SEQ ID NO: 189214 - protein, 14 aa, Borrelia garinii
KYLETGIWDGGKNI

SEQ ID NO: 189215 - protein, 14 aa, Borrelia garinii
YLETGIWDGGKNIF

SEQ ID NO: 189216 - protein, 14 aa, Borrelia garinii
LETGIWDGGKNIFF

SEQ ID NO: 189217 - protein, 14 aa, Borrelia garinii
ETGIWDGGKNIFFG

SEQ ID NO: 189218 - protein, 14 aa, Borrelia garinii
TGIWDGGKNIFFGL

SEQ ID NO: 189219 - protein, 14 aa, Borrelia garinii
GIWDGGKNIFFGLK

SEQ ID NO: 189220 - protein, 14 aa, Borrelia garinii
IWDGGKNIFFGLKE

SEQ ID NO: 189221 - protein, 14 aa, Borrelia garinii
WDGGKNIFFGLKED

SEQ ID NO: 189222 - protein, 14 aa, Borrelia garinii
DGGKNIFFGLKEDG

SEQ ID NO: 189223 - protein, 14 aa, Borrelia garinii
GGKNIFFGLKEDGL

SEQ ID NO: 189224 - protein, 14 aa, Borrelia garinii
GKNIFFGLKEDGLG

SEQ ID NO: 189225 - protein, 14 aa, Borrelia garinii
KNIFFGLKEDGLGL

SEQ ID NO: 189226 - protein, 14 aa, Borrelia garinii
NIFFGLKEDGLGLV

SEQ ID NO: 189227 - protein, 14 aa, Borrelia garinii
IFFGLKEDGLGLVL

SEQ ID NO: 189228 - protein, 14 aa, Borrelia garinii
FFGLKEDGLGLVLN

SEQ ID NO: 189229 - protein, 14 aa, Borrelia garinii
FGLKEDGLGLVLNE

SEQ ID NO: 189230 - protein, 14 aa, Borrelia garinii
GLKEDGLGLVLNEN

SEQ ID NO: 189231 - protein, 14 aa, Borrelia garinii
LKEDGLGLVLNENL

SEQ ID NO: 189232 - protein, 14 aa, Borrelia garinii
KEDGLGLVLNENLK

SEQ ID NO: 189233 - protein, 14 aa, Borrelia garinii
EDGLGLVLNENLKS

SEQ ID NO: 189234 - protein, 14 aa, Borrelia garinii
DGLGLVLNENLKSN

SEQ ID NO: 189235 - protein, 14 aa, Borrelia garinii
GLGLVLNENLKSNY

SEQ ID NO: 189236 - protein, 14 aa, Borrelia garinii
LGLVLNENLKSNYS

SEQ ID NO: 189237 - protein, 14 aa, Borrelia garinii
GLVLNENLKSNYSE

SEQ ID NO: 189238 - protein, 14 aa, Borrelia garinii
LVLNENLKSNYSEI

SEQ ID NO: 189239 - protein, 14 aa, Borrelia garinii
VLNENLKSNYSEIY

SEQ ID NO: 189240 - protein, 14 aa, Borrelia garinii
LNENLKSNYSEIYN

SEQ ID NO: 189241 - protein, 14 aa, Borrelia garinii
NENLKSNYSEIYNK

SEQ ID NO: 189242 - protein, 14 aa, Borrelia garinii
ENLKSNYSEIYNKS

SEQ ID NO: 189243 - protein, 14 aa, Borrelia garinii
NLKSNYSEIYNKSL

SEQ ID NO: 189244 - protein, 14 aa, Borrelia garinii
LKSNYSEIYNKSLE

SEQ ID NO: 189245 - protein, 14 aa, Borrelia garinii
KSNYSEIYNKSLEI

SEQ ID NO: 189246 - protein, 14 aa, Borrelia garinii
SNYSEIYNKSLEIG

SEQ ID NO: 189247 - protein, 14 aa, Borrelia garinii
NYSEIYNKSLEIGQ

SEQ ID NO: 189248 - protein, 14 aa, Borrelia garinii
YSEIYNKSLEIGQS

SEQ ID NO: 189249 - protein, 14 aa, Borrelia garinii
SEIYNKSLEIGQSI

SEQ ID NO: 189250 - protein, 14 aa, Borrelia garinii
EIYNKSLEIGQSIM

SEQ ID NO: 189251 - protein, 14 aa, Borrelia garinii
IYNKSLEIGQSIME

SEQ ID NO: 189252 - protein, 14 aa, Borrelia garinii
YNKSLEIGQSIMEG

SEQ ID NO: 189253 - protein, 14 aa, Borrelia garinii
NKSLEIGQSIMEGI

SEQ ID NO: 189254 - protein, 14 aa, Borrelia garinii
KSLEIGQSIMEGII

SEQ ID NO: 189255 - protein, 14 aa, Borrelia garinii
SLEIGQSIMEGIIK

SEQ ID NO: 189256 - protein, 14 aa, Borrelia garinii
LEIGQSIMEGIIKV

SEQ ID NO: 189257 - protein, 14 aa, Borrelia garinii
EIGQSIMEGIIKVP

SEQ ID NO: 189258 - protein, 14 aa, Borrelia garinii
IGQSIMEGIIKVPY

SEQ ID NO: 189259 - protein, 14 aa, Borrelia garinii
GQSIMEGIIKVPYD

SEQ ID NO: 189260 - protein, 14 aa, Borrelia garinii
QSIMEGIIKVPYDK

SEQ ID NO: 189261 - protein, 14 aa, Borrelia garinii
SIMEGIIKVPYDKA

SEQ ID NO: 189262 - protein, 14 aa, Borrelia garinii
IMEGIIKVPYDKAS

SEQ ID NO: 189263 - protein, 14 aa, Borrelia garinii
MEGIIKVPYDKASY

SEQ ID NO: 189264 - protein, 14 aa, Borrelia garinii
EGIIKVPYDKASYD

SEQ ID NO: 189265 - protein, 14 aa, Borrelia garinii
GIIKVPYDKASYDN

SEQ ID NO: 189266 - protein, 14 aa, Borrelia garinii
IIKVPYDKASYDNF

SEQ ID NO: 189267 - protein, 14 aa, Borrelia garinii
IKVPYDKASYDNFV

SEQ ID NO: 189268 - protein, 14 aa, Borrelia garinii
KVPYDKASYDNFVL

SEQ ID NO: 189269 - protein, 14 aa, Borrelia garinii
VPYDKASYDNFVLQ

SEQ ID NO: 189270 - protein, 14 aa, Borrelia garinii
PYDKASYDNFVLQI

SEQ ID NO: 189271 - protein, 14 aa, Borrelia garinii
YDKASYDNFVLQIA

SEQ ID NO: 189272 - protein, 14 aa, Borrelia garinii
DKASYDNFVLQIAN

SEQ ID NO: 189273 - protein, 15 aa, Borrelia garinii
MLNKVYCFIVFLFII

SEQ ID NO: 189274 - protein, 15 aa, Borrelia garinii
LNKVYCFIVFLFIIA

SEQ ID NO: 189275 - protein, 15 aa, Borrelia garinii
NKVYCFIVFLFIIAC

SEQ ID NO: 189276 - protein, 15 aa, Borrelia garinii
KVYCFIVFLFIIACS

SEQ ID NO: 189277 - protein, 15 aa, Borrelia garinii
VYCFIVFLFIIACSG

SEQ ID NO: 189278 - protein, 15 aa, Borrelia garinii
YCFIVFLFIIACSGS

SEQ ID NO: 189279 - protein, 15 aa, Borrelia garinii
CFIVFLFIIACSGSD

SEQ ID NO: 189280 - protein, 15 aa, Borrelia garinii
FIVFLFIIACSGSDD

SEQ ID NO: 189281 - protein, 15 aa, Borrelia garinii
IVFLFIIACSGSDDV

SEQ ID NO: 189282 - protein, 15 aa, Borrelia garinii
VFLFIIACSGSDDVK

SEQ ID NO: 189283 - protein, 15 aa, Borrelia garinii
FLFIIACSGSDDVKL

SEQ ID NO: 189284 - protein, 15 aa, Borrelia garinii
LFIIACSGSDDVKLE

SEQ ID NO: 189285 - protein, 15 aa, Borrelia garinii
FIIACSGSDDVKLES

SEQ ID NO: 189286 - protein, 15 aa, Borrelia garinii
IIACSGSDDVKLESK

SEQ ID NO: 189287 - protein, 15 aa, Borrelia garinii
IACSGSDDVKLESKT

SEQ ID NO: 189288 - protein, 15 aa, Borrelia garinii
ACSGSDDVKLESKTV

SEQ ID NO: 189289 - protein, 15 aa, Borrelia garinii
CSGSDDVKLESKTVS

SEQ ID NO: 189290 - protein, 15 aa, Borrelia garinii
SGSDDVKLESKTVSL

SEQ ID NO: 189291 - protein, 15 aa, Borrelia garinii
GSDDVKLESKTVSLI

SEQ ID NO: 189292 - protein, 15 aa, Borrelia garinii
SDDVKLESKTVSLIV

SEQ ID NO: 189293 - protein, 15 aa, Borrelia garinii
DDVKLESKTVSLIVD

SEQ ID NO: 189294 - protein, 15 aa, Borrelia garinii
DVKLESKTVSLIVDG

SEQ ID NO: 189295 - protein, 15 aa, Borrelia garinii
VKLESKTVSLIVDGA

SEQ ID NO: 189296 - protein, 15 aa, Borrelia garinii
KLESKTVSLIVDGAF

SEQ ID NO: 189297 - protein, 15 aa, Borrelia garinii
LESKTVSLIVDGAFD

SEQ ID NO: 189298 - protein, 15 aa, Borrelia garinii
ESKTVSLIVDGAFDD

SEQ ID NO: 189299 - protein, 15 aa, Borrelia garinii
SKTVSLIVDGAFDDK

SEQ ID NO: 189300 - protein, 15 aa, Borrelia garinii
KTVSLIVDGAFDDKG

SEQ ID NO: 189301 - protein, 15 aa, Borrelia garinii
TVSLIVDGAFDDKGF

SEQ ID NO: 189302 - protein, 15 aa, Borrelia garinii
VSLIVDGAFDDKGFN

SEQ ID NO: 189303 - protein, 15 aa, Borrelia garinii
SLIVDGAFDDKGFNE

SEQ ID NO: 189304 - protein, 15 aa, Borrelia garinii
LIVDGAFDDKGFNES

SEQ ID NO: 189305 - protein, 15 aa, Borrelia garinii
IVDGAFDDKGFNESS

SEQ ID NO: 189306 - protein, 15 aa, Borrelia garinii
VDGAFDDKGFNESSS

SEQ ID NO: 189307 - protein, 15 aa, Borrelia garinii
DGAFDDKGFNESSSK

SEQ ID NO: 189308 - protein, 15 aa, Borrelia garinii
GAFDDKGFNESSSKA

SEQ ID NO: 189309 - protein, 15 aa, Borrelia garinii
AFDDKGFNESSSKAI

SEQ ID NO: 189310 - protein, 15 aa, Borrelia garinii
FDDKGFNESSSKAIR

SEQ ID NO: 189311 - protein, 15 aa, Borrelia garinii
DDKGFNESSSKAIRK

SEQ ID NO: 189312 - protein, 15 aa, Borrelia garinii
DKGFNESSSKAIRKL

SEQ ID NO: 189313 - protein, 15 aa, Borrelia garinii
KGFNESSSKAIRKLK

SEQ ID NO: 189314 - protein, 15 aa, Borrelia garinii
GFNESSSKAIRKLKT

SEQ ID NO: 189315 - protein, 15 aa, Borrelia garinii
FNESSSKAIRKLKTD

SEQ ID NO: 189316 - protein, 15 aa, Borrelia garinii
NESSSKAIRKLKTDF

SEQ ID NO: 189317 - protein, 15 aa, Borrelia garinii
ESSSKAIRKLKTDFN

SEQ ID NO: 189318 - protein, 15 aa, Borrelia garinii
SSSKAIRKLKTDFNI

SEQ ID NO: 189319 - protein, 15 aa, Borrelia garinii
SSKAIRKLKTDFNIN

SEQ ID NO: 189320 - protein, 15 aa, Borrelia garinii
SKAIRKLKTDFNINI

SEQ ID NO: 189321 - protein, 15 aa, Borrelia garinii
KAIRKLKTDFNINII

SEQ ID NO: 189322 - protein, 15 aa, Borrelia garinii
AIRKLKTDFNINIIE

SEQ ID NO: 189323 - protein, 15 aa, Borrelia garinii
IRKLKTDFNINIIEK

SEQ ID NO: 189324 - protein, 15 aa, Borrelia garinii
RKLKTDFNINIIEKA

SEQ ID NO: 189325 - protein, 15 aa, Borrelia garinii
KLKTDFNINIIEKAS

SEQ ID NO: 189326 - protein, 15 aa, Borrelia garinii
LKTDFNINIIEKAST

SEQ ID NO: 189327 - protein, 15 aa, Borrelia garinii
KTDFNINIIEKASTG

SEQ ID NO: 189328 - protein, 15 aa, Borrelia garinii
TDFNINIIEKASTGN

SEQ ID NO: 189329 - protein, 15 aa, Borrelia garinii
DFNINIIEKASTGNS

SEQ ID NO: 189330 - protein, 15 aa, Borrelia garinii
FNINIIEKASTGNSH

SEQ ID NO: 189331 - protein, 15 aa, Borrelia garinii
NINIIEKASTGNSHL

SEQ ID NO: 189332 - protein, 15 aa, Borrelia garinii
INIIEKASTGNSHLG

SEQ ID NO: 189333 - protein, 15 aa, Borrelia garinii
NIIEKASTGNSHLGD

SEQ ID NO: 189334 - protein, 15 aa, Borrelia garinii
IIEKASTGNSHLGDI

SEQ ID NO: 189335 - protein, 15 aa, Borrelia garinii
IEKASTGNSHLGDIA

SEQ ID NO: 189336 - protein, 15 aa, Borrelia garinii
EKASTGNSHLGDIAT

SEQ ID NO: 189337 - protein, 15 aa, Borrelia garinii
KASTGNSHLGDIATL

SEQ ID NO: 189338 - protein, 15 aa, Borrelia garinii
ASTGNSHLGDIATLE

SEQ ID NO: 189339 - protein, 15 aa, Borrelia garinii
STGNSHLGDIATLED

SEQ ID NO: 189340 - protein, 15 aa, Borrelia garinii
TGNSHLGDIATLEDG

SEQ ID NO: 189341 - protein, 15 aa, Borrelia garinii
GNSHLGDIATLEDGN

SEQ ID NO: 189342 - protein, 15 aa, Borrelia garinii
NSHLGDIATLEDGNS

SEQ ID NO: 189343 - protein, 15 aa, Borrelia garinii
SHLGDIATLEDGNSN

SEQ ID NO: 189344 - protein, 15 aa, Borrelia garinii
HLGDIATLEDGNSNL

SEQ ID NO: 189345 - protein, 15 aa, Borrelia garinii
LGDIATLEDGNSNLI

SEQ ID NO: 189346 - protein, 15 aa, Borrelia garinii
GDIATLEDGNSNLIW

SEQ ID NO: 189347 - protein, 15 aa, Borrelia garinii
DIATLEDGNSNLIWG

SEQ ID NO: 189348 - protein, 15 aa, Borrelia garinii
IATLEDGNSNLIWGI

SEQ ID NO: 189349 - protein, 15 aa, Borrelia garinii
ATLEDGNSNLIWGIG

SEQ ID NO: 189350 - protein, 15 aa, Borrelia garinii
TLEDGNSNLIWGIGF

SEQ ID NO: 189351 - protein, 15 aa, Borrelia garinii
LEDGNSNLIWGIGFR

SEQ ID NO: 189352 - protein, 15 aa, Borrelia garinii
EDGNSNLIWGIGFRL

SEQ ID NO: 189353 - protein, 15 aa, Borrelia garinii
DGNSNLIWGIGFRLS

SEQ ID NO: 189354 - protein, 15 aa, Borrelia garinii
GNSNLIWGIGFRLSD

SEQ ID NO: 189355 - protein, 15 aa, Borrelia garinii
NSNLIWGIGFRLSDV

SEQ ID NO: 189356 - protein, 15 aa, Borrelia garinii
SNLIWGIGFRLSDVL

SEQ ID NO: 189357 - protein, 15 aa, Borrelia garinii
NLIWGIGFRLSDVLL

SEQ ID NO: 189358 - protein, 15 aa, Borrelia garinii
LIWGIGFRLSDVLLQ

SEQ ID NO: 189359 - protein, 15 aa, Borrelia garinii
IWGIGFRLSDVLLQR

SEQ ID NO: 189360 - protein, 15 aa, Borrelia garinii
WGIGFRLSDVLLQRA

SEQ ID NO: 189361 - protein, 15 aa, Borrelia garinii
GIGFRLSDVLLQRAS

SEQ ID NO: 189362 - protein, 15 aa, Borrelia garinii
IGFRLSDVLLQRASE

SEQ ID NO: 189363 - protein, 15 aa, Borrelia garinii
GFRLSDVLLQRASEN

SEQ ID NO: 189364 - protein, 15 aa, Borrelia garinii
FRLSDVLLQRASENI

SEQ ID NO: 189365 - protein, 15 aa, Borrelia garinii
RLSDVLLQRASENIS

SEQ ID NO: 189366 - protein, 15 aa, Borrelia garinii
LSDVLLQRASENISI

SEQ ID NO: 189367 - protein, 15 aa, Borrelia garinii
SDVLLQRASENISIN

SEQ ID NO: 189368 - protein, 15 aa, Borrelia garinii
DVLLQRASENISINY

SEQ ID NO: 189369 - protein, 15 aa, Borrelia garinii
VLLQRASENISINYA

SEQ ID NO: 189370 - protein, 15 aa, Borrelia garinii
LLQRASENISINYAI

SEQ ID NO: 189371 - protein, 15 aa, Borrelia garinii
LQRASENISINYAIM

SEQ ID NO: 189372 - protein, 15 aa, Borrelia garinii
QRASENISINYAIME

SEQ ID NO: 189373 - protein, 15 aa, Borrelia garinii
RASENISINYAIMEG

SEQ ID NO: 189374 - protein, 15 aa, Borrelia garinii
ASENISINYAIMEGV

SEQ ID NO: 189375 - protein, 15 aa, Borrelia garinii
SENISINYAIMEGVY

SEQ ID NO: 189376 - protein, 15 aa, Borrelia garinii
ENISINYAIMEGVYN

SEQ ID NO: 189377 - protein, 15 aa, Borrelia garinii
NISINYAIMEGVYNE

SEQ ID NO: 189378 - protein, 15 aa, Borrelia garinii
ISINYAIMEGVYNEI

SEQ ID NO: 189379 - protein, 15 aa, Borrelia garinii
SINYAIMEGVYNEIQ

SEQ ID NO: 189380 - protein, 15 aa, Borrelia garinii
INYAIMEGVYNEIQM

SEQ ID NO: 189381 - protein, 15 aa, Borrelia garinii
NYAIMEGVYNEIQMP

SEQ ID NO: 189382 - protein, 15 aa, Borrelia garinii
YAIMEGVYNEIQMPK

SEQ ID NO: 189383 - protein, 15 aa, Borrelia garinii
AIMEGVYNEIQMPKN

SEQ ID NO: 189384 - protein, 15 aa, Borrelia garinii
IMEGVYNEIQMPKNL

SEQ ID NO: 189385 - protein, 15 aa, Borrelia garinii
MEGVYNEIQMPKNLL

SEQ ID NO: 189386 - protein, 15 aa, Borrelia garinii
EGVYNEIQMPKNLLN

SEQ ID NO: 189387 - protein, 15 aa, Borrelia garinii
GVYNEIQMPKNLLNI

SEQ ID NO: 189388 - protein, 15 aa, Borrelia garinii
VYNEIQMPKNLLNIS

SEQ ID NO: 189389 - protein, 15 aa, Borrelia garinii
YNEIQMPKNLLNISF

SEQ ID NO: 189390 - protein, 15 aa, Borrelia garinii
NEIQMPKNLLNISFR

SEQ ID NO: 189391 - protein, 15 aa, Borrelia garinii
EIQMPKNLLNISFRS

SEQ ID NO: 189392 - protein, 15 aa, Borrelia garinii
IQMPKNLLNISFRSE

SEQ ID NO: 189393 - protein, 15 aa, Borrelia garinii
QMPKNLLNISFRSEE

SEQ ID NO: 189394 - protein, 15 aa, Borrelia garinii
MPKNLLNISFRSEEV

SEQ ID NO: 189395 - protein, 15 aa, Borrelia garinii
PKNLLNISFRSEEVA

SEQ ID NO: 189396 - protein, 15 aa, Borrelia garinii
KNLLNISFRSEEVAF

SEQ ID NO: 189397 - protein, 15 aa, Borrelia garinii
NLLNISFRSEEVAFL

SEQ ID NO: 189398 - protein, 15 aa, Borrelia garinii
LLNISFRSEEVAFLA

SEQ ID NO: 189399 - protein, 15 aa, Borrelia garinii
LNISFRSEEVAFLAG

SEQ ID NO: 189400 - protein, 15 aa, Borrelia garinii
NISFRSEEVAFLAGY

SEQ ID NO: 189401 - protein, 15 aa, Borrelia garinii
ISFRSEEVAFLAGYF

SEQ ID NO: 189402 - protein, 15 aa, Borrelia garinii
SFRSEEVAFLAGYFA

SEQ ID NO: 189403 - protein, 15 aa, Borrelia garinii
FRSEEVAFLAGYFAS

SEQ ID NO: 189404 - protein, 15 aa, Borrelia garinii
RSEEVAFLAGYFASK

SEQ ID NO: 189405 - protein, 15 aa, Borrelia garinii
SEEVAFLAGYFASKT

SEQ ID NO: 189406 - protein, 15 aa, Borrelia garinii
EEVAFLAGYFASKTS

SEQ ID NO: 189407 - protein, 15 aa, Borrelia garinii
EVAFLAGYFASKTSK

SEQ ID NO: 189408 - protein, 15 aa, Borrelia garinii
VAFLAGYFASKTSKT

SEQ ID NO: 189409 - protein, 15 aa, Borrelia garinii
AFLAGYFASKTSKTG

SEQ ID NO: 189410 - protein, 15 aa, Borrelia garinii
FLAGYFASKTSKTGK

SEQ ID NO: 189411 - protein, 15 aa, Borrelia garinii
LAGYFASKTSKTGKI

SEQ ID NO: 189412 - protein, 15 aa, Borrelia garinii
AGYFASKTSKTGKIG

SEQ ID NO: 189413 - protein, 15 aa, Borrelia garinii
GYFASKTSKTGKIGF

SEQ ID NO: 189414 - protein, 15 aa, Borrelia garinii
YFASKTSKTGKIGFI

SEQ ID NO: 189415 - protein, 15 aa, Borrelia garinii
FASKTSKTGKIGFIG

SEQ ID NO: 189416 - protein, 15 aa, Borrelia garinii
ASKTSKTGKIGFIGG

SEQ ID NO: 189417 - protein, 15 aa, Borrelia garinii
SKTSKTGKIGFIGGV

SEQ ID NO: 189418 - protein, 15 aa, Borrelia garinii
KTSKTGKIGFIGGVK

SEQ ID NO: 189419 - protein, 15 aa, Borrelia garinii
TSKTGKIGFIGGVKG

SEQ ID NO: 189420 - protein, 15 aa, Borrelia garinii
SKTGKIGFIGGVKGK

SEQ ID NO: 189421 - protein, 15 aa, Borrelia garinii
KTGKIGFIGGVKGKV

SEQ ID NO: 189422 - protein, 15 aa, Borrelia garinii
TGKIGFIGGVKGKVL

SEQ ID NO: 189423 - protein, 15 aa, Borrelia garinii
GKIGFIGGVKGKVLE

SEQ ID NO: 189424 - protein, 15 aa, Borrelia garinii
KIGFIGGVKGKVLES

SEQ ID NO: 189425 - protein, 15 aa, Borrelia garinii
IGFIGGVKGKVLESF

SEQ ID NO: 189426 - protein, 15 aa, Borrelia garinii
GFIGGVKGKVLESFM

SEQ ID NO: 189427 - protein, 15 aa, Borrelia garinii
FIGGVKGKVLESFMY

SEQ ID NO: 189428 - protein, 15 aa, Borrelia garinii
IGGVKGKVLESFMYG

SEQ ID NO: 189429 - protein, 15 aa, Borrelia garinii
GGVKGKVLESFMYGY

SEQ ID NO: 189430 - protein, 15 aa, Borrelia garinii
GVKGKVLESFMYGYE

SEQ ID NO: 189431 - protein, 15 aa, Borrelia garinii
VKGKVLESFMYGYEA

SEQ ID NO: 189432 - protein, 15 aa, Borrelia garinii
KGKVLESFMYGYEAG

SEQ ID NO: 189433 - protein, 15 aa, Borrelia garinii
GKVLESFMYGYEAGA

SEQ ID NO: 189434 - protein, 15 aa, Borrelia garinii
KVLESFMYGYEAGAK

SEQ ID NO: 189435 - protein, 15 aa, Borrelia garinii
VLESFMYGYEAGAKY

SEQ ID NO: 189436 - protein, 15 aa, Borrelia garinii
LESFMYGYEAGAKYA

SEQ ID NO: 189437 - protein, 15 aa, Borrelia garinii
ESFMYGYEAGAKYAN

SEQ ID NO: 189438 - protein, 15 aa, Borrelia garinii
SFMYGYEAGAKYANS

SEQ ID NO: 189439 - protein, 15 aa, Borrelia garinii
FMYGYEAGAKYANST

SEQ ID NO: 189440 - protein, 15 aa, Borrelia garinii
MYGYEAGAKYANSTI

SEQ ID NO: 189441 - protein, 15 aa, Borrelia garinii
YGYEAGAKYANSTIK

SEQ ID NO: 189442 - protein, 15 aa, Borrelia garinii
GYEAGAKYANSTIKV

SEQ ID NO: 189443 - protein, 15 aa, Borrelia garinii
YEAGAKYANSTIKVI

SEQ ID NO: 189444 - protein, 15 aa, Borrelia garinii
EAGAKYANSTIKVIS

SEQ ID NO: 189445 - protein, 15 aa, Borrelia garinii
AGAKYANSTIKVISQ

SEQ ID NO: 189446 - protein, 15 aa, Borrelia garinii
GAKYANSTIKVISQY

SEQ ID NO: 189447 - protein, 15 aa, Borrelia garinii
AKYANSTIKVISQYV

SEQ ID NO: 189448 - protein, 15 aa, Borrelia garinii
KYANSTIKVISQYVG

SEQ ID NO: 189449 - protein, 15 aa, Borrelia garinii
YANSTIKVISQYVGT

SEQ ID NO: 189450 - protein, 15 aa, Borrelia garinii
ANSTIKVISQYVGTF

SEQ ID NO: 189451 - protein, 15 aa, Borrelia garinii
NSTIKVISQYVGTFG

SEQ ID NO: 189452 - protein, 15 aa, Borrelia garinii
STIKVISQYVGTFGD

SEQ ID NO: 189453 - protein, 15 aa, Borrelia garinii
TIKVISQYVGTFGDF

SEQ ID NO: 189454 - protein, 15 aa, Borrelia garinii
IKVISQYVGTFGDFG

SEQ ID NO: 189455 - protein, 15 aa, Borrelia garinii
KVISQYVGTFGDFGL

SEQ ID NO: 189456 - protein, 15 aa, Borrelia garinii
VISQYVGTFGDFGLG

SEQ ID NO: 189457 - protein, 15 aa, Borrelia garinii
ISQYVGTFGDFGLGR

SEQ ID NO: 189458 - protein, 15 aa, Borrelia garinii
SQYVGTFGDFGLGRS

SEQ ID NO: 189459 - protein, 15 aa, Borrelia garinii
QYVGTFGDFGLGRST

SEQ ID NO: 189460 - protein, 15 aa, Borrelia garinii
YVGTFGDFGLGRSTA

SEQ ID NO: 189461 - protein, 15 aa, Borrelia garinii
VGTFGDFGLGRSTAS

SEQ ID NO: 189462 - protein, 15 aa, Borrelia garinii
GTFGDFGLGRSTASN

SEQ ID NO: 189463 - protein, 15 aa, Borrelia garinii
TFGDFGLGRSTASNM

SEQ ID NO: 189464 - protein, 15 aa, Borrelia garinii
FGDFGLGRSTASNMY

SEQ ID NO: 189465 - protein, 15 aa, Borrelia garinii
GDFGLGRSTASNMYR

SEQ ID NO: 189466 - protein, 15 aa, Borrelia garinii
DFGLGRSTASNMYRD

SEQ ID NO: 189467 - protein, 15 aa, Borrelia garinii
FGLGRSTASNMYRDG

SEQ ID NO: 189468 - protein, 15 aa, Borrelia garinii
GLGRSTASNMYRDGV

SEQ ID NO: 189469 - protein, 15 aa, Borrelia garinii
LGRSTASNMYRDGVD

SEQ ID NO: 189470 - protein, 15 aa, Borrelia garinii
GRSTASNMYRDGVDI

SEQ ID NO: 189471 - protein, 15 aa, Borrelia garinii
RSTASNMYRDGVDIV

SEQ ID NO: 189472 - protein, 15 aa, Borrelia garinii
STASNMYRDGVDIVF

SEQ ID NO: 189473 - protein, 15 aa, Borrelia garinii
TASNMYRDGVDIVFA

SEQ ID NO: 189474 - protein, 15 aa, Borrelia garinii
ASNMYRDGVDIVFAA

SEQ ID NO: 189475 - protein, 15 aa, Borrelia garinii
SNMYRDGVDIVFAAA

SEQ ID NO: 189476 - protein, 15 aa, Borrelia garinii
NMYRDGVDIVFAAAG

SEQ ID NO: 189477 - protein, 15 aa, Borrelia garinii
MYRDGVDIVFAAAGL

SEQ ID NO: 189478 - protein, 15 aa, Borrelia garinii
YRDGVDIVFAAAGLS

SEQ ID NO: 189479 - protein, 15 aa, Borrelia garinii
RDGVDIVFAAAGLSG

SEQ ID NO: 189480 - protein, 15 aa, Borrelia garinii
DGVDIVFAAAGLSGI

SEQ ID NO: 189481 - protein, 15 aa, Borrelia garinii
GVDIVFAAAGLSGIG

SEQ ID NO: 189482 - protein, 15 aa, Borrelia garinii
VDIVFAAAGLSGIGV

SEQ ID NO: 189483 - protein, 15 aa, Borrelia garinii
DIVFAAAGLSGIGVI

SEQ ID NO: 189484 - protein, 15 aa, Borrelia garinii
IVFAAAGLSGIGVIE

SEQ ID NO: 189485 - protein, 15 aa, Borrelia garinii
VFAAAGLSGIGVIEA

SEQ ID NO: 189486 - protein, 15 aa, Borrelia garinii
FAAAGLSGIGVIEAA

SEQ ID NO: 189487 - protein, 15 aa, Borrelia garinii
AAAGLSGIGVIEAAK

SEQ ID NO: 189488 - protein, 15 aa, Borrelia garinii
AAGLSGIGVIEAAKE

SEQ ID NO: 189489 - protein, 15 aa, Borrelia garinii
AGLSGIGVIEAAKEL

SEQ ID NO: 189490 - protein, 15 aa, Borrelia garinii
GLSGIGVIEAAKELG

SEQ ID NO: 189491 - protein, 15 aa, Borrelia garinii
LSGIGVIEAAKELGP

SEQ ID NO: 189492 - protein, 15 aa, Borrelia garinii
SGIGVIEAAKELGPD

SEQ ID NO: 189493 - protein, 15 aa, Borrelia garinii
GIGVIEAAKELGPDH

SEQ ID NO: 189494 - protein, 15 aa, Borrelia garinii
IGVIEAAKELGPDHY

SEQ ID NO: 189495 - protein, 15 aa, Borrelia garinii
GVIEAAKELGPDHYI

SEQ ID NO: 189496 - protein, 15 aa, Borrelia garinii
VIEAAKELGPDHYII

SEQ ID NO: 189497 - protein, 15 aa, Borrelia garinii
IEAAKELGPDHYIIG

SEQ ID NO: 189498 - protein, 15 aa, Borrelia garinii
EAAKELGPDHYIIGV

SEQ ID NO: 189499 - protein, 15 aa, Borrelia garinii
AAKELGPDHYIIGVD

SEQ ID NO: 189500 - protein, 15 aa, Borrelia garinii
AKELGPDHYIIGVDQ

SEQ ID NO: 189501 - protein, 15 aa, Borrelia garinii
KELGPDHYIIGVDQD

SEQ ID NO: 189502 - protein, 15 aa, Borrelia garinii
ELGPDHYIIGVDQDQ

SEQ ID NO: 189503 - protein, 15 aa, Borrelia garinii
LGPDHYIIGVDQDQS

SEQ ID NO: 189504 - protein, 15 aa, Borrelia garinii
GPDHYIIGVDQDQSY

SEQ ID NO: 189505 - protein, 15 aa, Borrelia garinii
PDHYIIGVDQDQSYL

SEQ ID NO: 189506 - protein, 15 aa, Borrelia garinii
DHYIIGVDQDQSYLA

SEQ ID NO: 189507 - protein, 15 aa, Borrelia garinii
HYIIGVDQDQSYLAP

SEQ ID NO: 189508 - protein, 15 aa, Borrelia garinii
YIIGVDQDQSYLAPN

SEQ ID NO: 189509 - protein, 15 aa, Borrelia garinii
IIGVDQDQSYLAPNN

SEQ ID NO: 189510 - protein, 15 aa, Borrelia garinii
IGVDQDQSYLAPNNV

SEQ ID NO: 189511 - protein, 15 aa, Borrelia garinii
GVDQDQSYLAPNNVL

SEQ ID NO: 189512 - protein, 15 aa, Borrelia garinii
VDQDQSYLAPNNVLV

SEQ ID NO: 189513 - protein, 15 aa, Borrelia garinii
DQDQSYLAPNNVLVS

SEQ ID NO: 189514 - protein, 15 aa, Borrelia garinii
QDQSYLAPNNVLVSA

SEQ ID NO: 189515 - protein, 15 aa, Borrelia garinii
DQSYLAPNNVLVSAV

SEQ ID NO: 189516 - protein, 15 aa, Borrelia garinii
QSYLAPNNVLVSAVK

SEQ ID NO: 189517 - protein, 15 aa, Borrelia garinii
SYLAPNNVLVSAVKK

SEQ ID NO: 189518 - protein, 15 aa, Borrelia garinii
YLAPNNVLVSAVKKV

SEQ ID NO: 189519 - protein, 15 aa, Borrelia garinii
LAPNNVLVSAVKKVD

SEQ ID NO: 189520 - protein, 15 aa, Borrelia garinii
APNNVLVSAVKKVDS

SEQ ID NO: 189521 - protein, 15 aa, Borrelia garinii
PNNVLVSAVKKVDSL

SEQ ID NO: 189522 - protein, 15 aa, Borrelia garinii
NNVLVSAVKKVDSLM

SEQ ID NO: 189523 - protein, 15 aa, Borrelia garinii
NVLVSAVKKVDSLMY

SEQ ID NO: 189524 - protein, 15 aa, Borrelia garinii
VLVSAVKKVDSLMYS

SEQ ID NO: 189525 - protein, 15 aa, Borrelia garinii
LVSAVKKVDSLMYSL

SEQ ID NO: 189526 - protein, 15 aa, Borrelia garinii
VSAVKKVDSLMYSLT

SEQ ID NO: 189527 - protein, 15 aa, Borrelia garinii
SAVKKVDSLMYSLTK

SEQ ID NO: 189528 - protein, 15 aa, Borrelia garinii
AVKKVDSLMYSLTKK

SEQ ID NO: 189529 - protein, 15 aa, Borrelia garinii
VKKVDSLMYSLTKKY

SEQ ID NO: 189530 - protein, 15 aa, Borrelia garinii
KKVDSLMYSLTKKYL

SEQ ID NO: 189531 - protein, 15 aa, Borrelia garinii
KVDSLMYSLTKKYLE

SEQ ID NO: 189532 - protein, 15 aa, Borrelia garinii
VDSLMYSLTKKYLET

SEQ ID NO: 189533 - protein, 15 aa, Borrelia garinii
DSLMYSLTKKYLETG

SEQ ID NO: 189534 - protein, 15 aa, Borrelia garinii
SLMYSLTKKYLETGI

SEQ ID NO: 189535 - protein, 15 aa, Borrelia garinii
LMYSLTKKYLETGIW

SEQ ID NO: 189536 - protein, 15 aa, Borrelia garinii
MYSLTKKYLETGIWD

SEQ ID NO: 189537 - protein, 15 aa, Borrelia garinii
YSLTKKYLETGIWDG

SEQ ID NO: 189538 - protein, 15 aa, Borrelia garinii
SLTKKYLETGIWDGG

SEQ ID NO: 189539 - protein, 15 aa, Borrelia garinii
LTKKYLETGIWDGGK

SEQ ID NO: 189540 - protein, 15 aa, Borrelia garinii
TKKYLETGIWDGGKN

SEQ ID NO: 189541 - protein, 15 aa, Borrelia garinii
KKYLETGIWDGGKNI

SEQ ID NO: 189542 - protein, 15 aa, Borrelia garinii
KYLETGIWDGGKNIF

SEQ ID NO: 189543 - protein, 15 aa, Borrelia garinii
YLETGIWDGGKNIFF

SEQ ID NO: 189544 - protein, 15 aa, Borrelia garinii
LETGIWDGGKNIFFG

SEQ ID NO: 189545 - protein, 15 aa, Borrelia garinii
ETGIWDGGKNIFFGL

SEQ ID NO: 189546 - protein, 15 aa, Borrelia garinii
TGIWDGGKNIFFGLK

SEQ ID NO: 189547 - protein, 15 aa, Borrelia garinii
GIWDGGKNIFFGLKE

SEQ ID NO: 189548 - protein, 15 aa, Borrelia garinii
IWDGGKNIFFGLKED

SEQ ID NO: 189549 - protein, 15 aa, Borrelia garinii
WDGGKNIFFGLKEDG

SEQ ID NO: 189550 - protein, 15 aa, Borrelia garinii
DGGKNIFFGLKEDGL

SEQ ID NO: 189551 - protein, 15 aa, Borrelia garinii
GGKNIFFGLKEDGLG

SEQ ID NO: 189552 - protein, 15 aa, Borrelia garinii
GKNIFFGLKEDGLGL

SEQ ID NO: 189553 - protein, 15 aa, Borrelia garinii
KNIFFGLKEDGLGLV

SEQ ID NO: 189554 - protein, 15 aa, Borrelia garinii
NIFFGLKEDGLGLVL

SEQ ID NO: 189555 - protein, 15 aa, Borrelia garinii
IFFGLKEDGLGLVLN

SEQ ID NO: 189556 - protein, 15 aa, Borrelia garinii
FFGLKEDGLGLVLNE

SEQ ID NO: 189557 - protein, 15 aa, Borrelia garinii
FGLKEDGLGLVLNEN

SEQ ID NO: 189558 - protein, 15 aa, Borrelia garinii
GLKEDGLGLVLNENL

SEQ ID NO: 189559 - protein, 15 aa, Borrelia garinii
LKEDGLGLVLNENLK

SEQ ID NO: 189560 - protein, 15 aa, Borrelia garinii
KEDGLGLVLNENLKS

SEQ ID NO: 189561 - protein, 15 aa, Borrelia garinii
EDGLGLVLNENLKSN

SEQ ID NO: 189562 - protein, 15 aa, Borrelia garinii
DGLGLVLNENLKSNY

SEQ ID NO: 189563 - protein, 15 aa, Borrelia garinii
GLGLVLNENLKSNYS

SEQ ID NO: 189564 - protein, 15 aa, Borrelia garinii
LGLVLNENLKSNYSE

SEQ ID NO: 189565 - protein, 15 aa, Borrelia garinii
GLVLNENLKSNYSEI

SEQ ID NO: 189566 - protein, 15 aa, Borrelia garinii
LVLNENLKSNYSEIY

SEQ ID NO: 189567 - protein, 15 aa, Borrelia garinii
VLNENLKSNYSEIYN

SEQ ID NO: 189568 - protein, 15 aa, Borrelia garinii
LNENLKSNYSEIYNK

SEQ ID NO: 189569 - protein, 15 aa, Borrelia garinii
NENLKSNYSEIYNKS

SEQ ID NO: 189570 - protein, 15 aa, Borrelia garinii
ENLKSNYSEIYNKSL

SEQ ID NO: 189571 - protein, 15 aa, Borrelia garinii
NLKSNYSEIYNKSLE

SEQ ID NO: 189572 - protein, 15 aa, Borrelia garinii
LKSNYSEIYNKSLEI

SEQ ID NO: 189573 - protein, 15 aa, Borrelia garinii
KSNYSEIYNKSLEIG

SEQ ID NO: 189574 - protein, 15 aa, Borrelia garinii
SNYSEIYNKSLEIGQ

SEQ ID NO: 189575 - protein, 15 aa, Borrelia garinii
NYSEIYNKSLEIGQS

SEQ ID NO: 189576 - protein, 15 aa, Borrelia garinii
YSEIYNKSLEIGQSI

SEQ ID NO: 189577 - protein, 15 aa, Borrelia garinii
SEIYNKSLEIGQSIM

SEQ ID NO: 189578 - protein, 15 aa, Borrelia garinii
EIYNKSLEIGQSIME

SEQ ID NO: 189579 - protein, 15 aa, Borrelia garinii
IYNKSLEIGQSIMEG

SEQ ID NO: 189580 - protein, 15 aa, Borrelia garinii
YNKSLEIGQSIMEGI

SEQ ID NO: 189581 - protein, 15 aa, Borrelia garinii
NKSLEIGQSIMEGII

SEQ ID NO: 189582 - protein, 15 aa, Borrelia garinii
KSLEIGQSIMEGIIK

SEQ ID NO: 189583 - protein, 15 aa, Borrelia garinii
SLEIGQSIMEGIIKV

SEQ ID NO: 189584 - protein, 15 aa, Borrelia garinii
LEIGQSIMEGIIKVP

SEQ ID NO: 189585 - protein, 15 aa, Borrelia garinii
EIGQSIMEGIIKVPY

SEQ ID NO: 189586 - protein, 15 aa, Borrelia garinii
IGQSIMEGIIKVPYD

SEQ ID NO: 189587 - protein, 15 aa, Borrelia garinii
GQSIMEGIIKVPYDK

SEQ ID NO: 189588 - protein, 15 aa, Borrelia garinii
QSIMEGIIKVPYDKA

SEQ ID NO: 189589 - protein, 15 aa, Borrelia garinii
SIMEGIIKVPYDKAS

SEQ ID NO: 189590 - protein, 15 aa, Borrelia garinii
IMEGIIKVPYDKASY

SEQ ID NO: 189591 - protein, 15 aa, Borrelia garinii
MEGIIKVPYDKASYD

SEQ ID NO: 189592 - protein, 15 aa, Borrelia garinii
EGIIKVPYDKASYDN

SEQ ID NO: 189593 - protein, 15 aa, Borrelia garinii
GIIKVPYDKASYDNF

SEQ ID NO: 189594 - protein, 15 aa, Borrelia garinii
IIKVPYDKASYDNFV

SEQ ID NO: 189595 - protein, 15 aa, Borrelia garinii
IKVPYDKASYDNFVL

SEQ ID NO: 189596 - protein, 15 aa, Borrelia garinii
KVPYDKASYDNFVLQ

SEQ ID NO: 189597 - protein, 15 aa, Borrelia garinii
VPYDKASYDNFVLQI

SEQ ID NO: 189598 - protein, 15 aa, Borrelia garinii
PYDKASYDNFVLQIA

SEQ ID NO: 189599 - protein, 15 aa, Borrelia garinii
YDKASYDNFVLQIAN

SEQ ID NO: 189600 - protein, 16 aa, Borrelia garinii
MLNKVYCFIVFLFIIA

SEQ ID NO: 189601 - protein, 16 aa, Borrelia garinii
LNKVYCFIVFLFIIAC

SEQ ID NO: 189602 - protein, 16 aa, Borrelia garinii
NKVYCFIVFLFIIACS

SEQ ID NO: 189603 - protein, 16 aa, Borrelia garinii
KVYCFIVFLFIIACSG

SEQ ID NO: 189604 - protein, 16 aa, Borrelia garinii
VYCFIVFLFIIACSGS

SEQ ID NO: 189605 - protein, 16 aa, Borrelia garinii
YCFIVFLFIIACSGSD

SEQ ID NO: 189606 - protein, 16 aa, Borrelia garinii
CFIVFLFIIACSGSDD

SEQ ID NO: 189607 - protein, 16 aa, Borrelia garinii
FIVFLFIIACSGSDDV

SEQ ID NO: 189608 - protein, 16 aa, Borrelia garinii
IVFLFIIACSGSDDVK

SEQ ID NO: 189609 - protein, 16 aa, Borrelia garinii
VFLFIIACSGSDDVKL

SEQ ID NO: 189610 - protein, 16 aa, Borrelia garinii
FLFIIACSGSDDVKLE

SEQ ID NO: 189611 - protein, 16 aa, Borrelia garinii
LFIIACSGSDDVKLES

SEQ ID NO: 189612 - protein, 16 aa, Borrelia garinii
FIIACSGSDDVKLESK

SEQ ID NO: 189613 - protein, 16 aa, Borrelia garinii
IIACSGSDDVKLESKT

SEQ ID NO: 189614 - protein, 16 aa, Borrelia garinii
IACSGSDDVKLESKTV

SEQ ID NO: 189615 - protein, 16 aa, Borrelia garinii
ACSGSDDVKLESKTVS

SEQ ID NO: 189616 - protein, 16 aa, Borrelia garinii
CSGSDDVKLESKTVSL

SEQ ID NO: 189617 - protein, 16 aa, Borrelia garinii
SGSDDVKLESKTVSLI

SEQ ID NO: 189618 - protein, 16 aa, Borrelia garinii
GSDDVKLESKTVSLIV

SEQ ID NO: 189619 - protein, 16 aa, Borrelia garinii
SDDVKLESKTVSLIVD

SEQ ID NO: 189620 - protein, 16 aa, Borrelia garinii
DDVKLESKTVSLIVDG

SEQ ID NO: 189621 - protein, 16 aa, Borrelia garinii
DVKLESKTVSLIVDGA

SEQ ID NO: 189622 - protein, 16 aa, Borrelia garinii
VKLESKTVSLIVDGAF

SEQ ID NO: 189623 - protein, 16 aa, Borrelia garinii
KLESKTVSLIVDGAFD

SEQ ID NO: 189624 - protein, 16 aa, Borrelia garinii
LESKTVSLIVDGAFDD

SEQ ID NO: 189625 - protein, 16 aa, Borrelia garinii
ESKTVSLIVDGAFDDK

SEQ ID NO: 189626 - protein, 16 aa, Borrelia garinii
SKTVSLIVDGAFDDKG

SEQ ID NO: 189627 - protein, 16 aa, Borrelia garinii
KTVSLIVDGAFDDKGF

SEQ ID NO: 189628 - protein, 16 aa, Borrelia garinii
TVSLIVDGAFDDKGFN

SEQ ID NO: 189629 - protein, 16 aa, Borrelia garinii
VSLIVDGAFDDKGFNE

SEQ ID NO: 189630 - protein, 16 aa, Borrelia garinii
SLIVDGAFDDKGFNES

SEQ ID NO: 189631 - protein, 16 aa, Borrelia garinii
LIVDGAFDDKGFNESS

SEQ ID NO: 189632 - protein, 16 aa, Borrelia garinii
IVDGAFDDKGFNESSS

SEQ ID NO: 189633 - protein, 16 aa, Borrelia garinii
VDGAFDDKGFNESSSK

SEQ ID NO: 189634 - protein, 16 aa, Borrelia garinii
DGAFDDKGFNESSSKA

SEQ ID NO: 189635 - protein, 16 aa, Borrelia garinii
GAFDDKGFNESSSKAI

SEQ ID NO: 189636 - protein, 16 aa, Borrelia garinii
AFDDKGFNESSSKAIR

SEQ ID NO: 189637 - protein, 16 aa, Borrelia garinii
FDDKGFNESSSKAIRK

SEQ ID NO: 189638 - protein, 16 aa, Borrelia garinii
DDKGFNESSSKAIRKL

SEQ ID NO: 189639 - protein, 16 aa, Borrelia garinii
DKGFNESSSKAIRKLK

SEQ ID NO: 189640 - protein, 16 aa, Borrelia garinii
KGFNESSSKAIRKLKT

SEQ ID NO: 189641 - protein, 16 aa, Borrelia garinii
GFNESSSKAIRKLKTD

SEQ ID NO: 189642 - protein, 16 aa, Borrelia garinii
FNESSSKAIRKLKTDF

SEQ ID NO: 189643 - protein, 16 aa, Borrelia garinii
NESSSKAIRKLKTDFN

SEQ ID NO: 189644 - protein, 16 aa, Borrelia garinii
ESSSKAIRKLKTDFNI

SEQ ID NO: 189645 - protein, 16 aa, Borrelia garinii
SSSKAIRKLKTDFNIN

SEQ ID NO: 189646 - protein, 16 aa, Borrelia garinii
SSKAIRKLKTDFNINI

SEQ ID NO: 189647 - protein, 16 aa, Borrelia garinii
SKAIRKLKTDFNINII

SEQ ID NO: 189648 - protein, 16 aa, Borrelia garinii
KAIRKLKTDFNINIIE

SEQ ID NO: 189649 - protein, 16 aa, Borrelia garinii
AIRKLKTDFNINIIEK

SEQ ID NO: 189650 - protein, 16 aa, Borrelia garinii
IRKLKTDFNINIIEKA

SEQ ID NO: 189651 - protein, 16 aa, Borrelia garinii
RKLKTDFNINIIEKAS

SEQ ID NO: 189652 - protein, 16 aa, Borrelia garinii
KLKTDFNINIIEKAST

SEQ ID NO: 189653 - protein, 16 aa, Borrelia garinii
LKTDFNINIIEKASTG

SEQ ID NO: 189654 - protein, 16 aa, Borrelia garinii
KTDFNINIIEKASTGN

SEQ ID NO: 189655 - protein, 16 aa, Borrelia garinii
TDFNINIIEKASTGNS

SEQ ID NO: 189656 - protein, 16 aa, Borrelia garinii
DFNINIIEKASTGNSH

SEQ ID NO: 189657 - protein, 16 aa, Borrelia garinii
FNINIIEKASTGNSHL

SEQ ID NO: 189658 - protein, 16 aa, Borrelia garinii
NINIIEKASTGNSHLG

SEQ ID NO: 189659 - protein, 16 aa, Borrelia garinii
INIIEKASTGNSHLGD

SEQ ID NO: 189660 - protein, 16 aa, Borrelia garinii
NIIEKASTGNSHLGDI

SEQ ID NO: 189661 - protein, 16 aa, Borrelia garinii
IIEKASTGNSHLGDIA

SEQ ID NO: 189662 - protein, 16 aa, Borrelia garinii
IEKASTGNSHLGDIAT

SEQ ID NO: 189663 - protein, 16 aa, Borrelia garinii
EKASTGNSHLGDIATL

SEQ ID NO: 189664 - protein, 16 aa, Borrelia garinii
KASTGNSHLGDIATLE

SEQ ID NO: 189665 - protein, 16 aa, Borrelia garinii
ASTGNSHLGDIATLED

SEQ ID NO: 189666 - protein, 16 aa, Borrelia garinii
STGNSHLGDIATLEDG

SEQ ID NO: 189667 - protein, 16 aa, Borrelia garinii
TGNSHLGDIATLEDGN

SEQ ID NO: 189668 - protein, 16 aa, Borrelia garinii
GNSHLGDIATLEDGNS

SEQ ID NO: 189669 - protein, 16 aa, Borrelia garinii
NSHLGDIATLEDGNSN

SEQ ID NO: 189670 - protein, 16 aa, Borrelia garinii
SHLGDIATLEDGNSNL

SEQ ID NO: 189671 - protein, 16 aa, Borrelia garinii
HLGDIATLEDGNSNLI

SEQ ID NO: 189672 - protein, 16 aa, Borrelia garinii
LGDIATLEDGNSNLIW

SEQ ID NO: 189673 - protein, 16 aa, Borrelia garinii
GDIATLEDGNSNLIWG

SEQ ID NO: 189674 - protein, 16 aa, Borrelia garinii
DIATLEDGNSNLIWGI

SEQ ID NO: 189675 - protein, 16 aa, Borrelia garinii
IATLEDGNSNLIWGIG

SEQ ID NO: 189676 - protein, 16 aa, Borrelia garinii
ATLEDGNSNLIWGIGF

SEQ ID NO: 189677 - protein, 16 aa, Borrelia garinii
TLEDGNSNLIWGIGFR

SEQ ID NO: 189678 - protein, 16 aa, Borrelia garinii
LEDGNSNLIWGIGFRL

SEQ ID NO: 189679 - protein, 16 aa, Borrelia garinii
EDGNSNLIWGIGFRLS

SEQ ID NO: 189680 - protein, 16 aa, Borrelia garinii
DGNSNLIWGIGFRLSD

SEQ ID NO: 189681 - protein, 16 aa, Borrelia garinii
GNSNLIWGIGFRLSDV

SEQ ID NO: 189682 - protein, 16 aa, Borrelia garinii
NSNLIWGIGFRLSDVL

SEQ ID NO: 189683 - protein, 16 aa, Borrelia garinii
SNLIWGIGFRLSDVLL

SEQ ID NO: 189684 - protein, 16 aa, Borrelia garinii
NLIWGIGFRLSDVLLQ

SEQ ID NO: 189685 - protein, 16 aa, Borrelia garinii
LIWGIGFRLSDVLLQR

SEQ ID NO: 189686 - protein, 16 aa, Borrelia garinii
IWGIGFRLSDVLLQRA

SEQ ID NO: 189687 - protein, 16 aa, Borrelia garinii
WGIGFRLSDVLLQRAS

SEQ ID NO: 189688 - protein, 16 aa, Borrelia garinii
GIGFRLSDVLLQRASE

SEQ ID NO: 189689 - protein, 16 aa, Borrelia garinii
IGFRLSDVLLQRASEN

SEQ ID NO: 189690 - protein, 16 aa, Borrelia garinii
GFRLSDVLLQRASENI

SEQ ID NO: 189691 - protein, 16 aa, Borrelia garinii
FRLSDVLLQRASENIS

SEQ ID NO: 189692 - protein, 16 aa, Borrelia garinii
RLSDVLLQRASENISI

SEQ ID NO: 189693 - protein, 16 aa, Borrelia garinii
LSDVLLQRASENISIN

SEQ ID NO: 189694 - protein, 16 aa, Borrelia garinii
SDVLLQRASENISINY

SEQ ID NO: 189695 - protein, 16 aa, Borrelia garinii
DVLLQRASENISINYA

SEQ ID NO: 189696 - protein, 16 aa, Borrelia garinii
VLLQRASENISINYAI

SEQ ID NO: 189697 - protein, 16 aa, Borrelia garinii
LLQRASENISINYAIM

SEQ ID NO: 189698 - protein, 16 aa, Borrelia garinii
LQRASENISINYAIME

SEQ ID NO: 189699 - protein, 16 aa, Borrelia garinii
QRASENISINYAIMEG

SEQ ID NO: 189700 - protein, 16 aa, Borrelia garinii
RASENISINYAIMEGV

SEQ ID NO: 189701 - protein, 16 aa, Borrelia garinii
ASENISINYAIMEGVY

SEQ ID NO: 189702 - protein, 16 aa, Borrelia garinii
SENISINYAIMEGVYN

SEQ ID NO: 189703 - protein, 16 aa, Borrelia garinii
ENISINYAIMEGVYNE

SEQ ID NO: 189704 - protein, 16 aa, Borrelia garinii
NISINYAIMEGVYNEI

SEQ ID NO: 189705 - protein, 16 aa, Borrelia garinii
ISINYAIMEGVYNEIQ

SEQ ID NO: 189706 - protein, 16 aa, Borrelia garinii
SINYAIMEGVYNEIQM

SEQ ID NO: 189707 - protein, 16 aa, Borrelia garinii
INYAIMEGVYNEIQMP

SEQ ID NO: 189708 - protein, 16 aa, Borrelia garinii
NYAIMEGVYNEIQMPK

SEQ ID NO: 189709 - protein, 16 aa, Borrelia garinii
YAIMEGVYNEIQMPKN

SEQ ID NO: 189710 - protein, 16 aa, Borrelia garinii
AIMEGVYNEIQMPKNL

SEQ ID NO: 189711 - protein, 16 aa, Borrelia garinii
IMEGVYNEIQMPKNLL

SEQ ID NO: 189712 - protein, 16 aa, Borrelia garinii
MEGVYNEIQMPKNLLN

SEQ ID NO: 189713 - protein, 16 aa, Borrelia garinii
EGVYNEIQMPKNLLNI

SEQ ID NO: 189714 - protein, 16 aa, Borrelia garinii
GVYNEIQMPKNLLNIS

SEQ ID NO: 189715 - protein, 16 aa, Borrelia garinii
VYNEIQMPKNLLNISF

SEQ ID NO: 189716 - protein, 16 aa, Borrelia garinii
YNEIQMPKNLLNISFR

SEQ ID NO: 189717 - protein, 16 aa, Borrelia garinii
NEIQMPKNLLNISFRS

SEQ ID NO: 189718 - protein, 16 aa, Borrelia garinii
EIQMPKNLLNISFRSE

SEQ ID NO: 189719 - protein, 16 aa, Borrelia garinii
IQMPKNLLNISFRSEE

SEQ ID NO: 189720 - protein, 16 aa, Borrelia garinii
QMPKNLLNISFRSEEV

SEQ ID NO: 189721 - protein, 16 aa, Borrelia garinii
MPKNLLNISFRSEEVA

SEQ ID NO: 189722 - protein, 16 aa, Borrelia garinii
PKNLLNISFRSEEVAF

SEQ ID NO: 189723 - protein, 16 aa, Borrelia garinii
KNLLNISFRSEEVAFL

SEQ ID NO: 189724 - protein, 16 aa, Borrelia garinii
NLLNISFRSEEVAFLA

SEQ ID NO: 189725 - protein, 16 aa, Borrelia garinii
LLNISFRSEEVAFLAG

SEQ ID NO: 189726 - protein, 16 aa, Borrelia garinii
LNISFRSEEVAFLAGY

SEQ ID NO: 189727 - protein, 16 aa, Borrelia garinii
NISFRSEEVAFLAGYF

SEQ ID NO: 189728 - protein, 16 aa, Borrelia garinii
ISFRSEEVAFLAGYFA

SEQ ID NO: 189729 - protein, 16 aa, Borrelia garinii
SFRSEEVAFLAGYFAS

SEQ ID NO: 189730 - protein, 16 aa, Borrelia garinii
FRSEEVAFLAGYFASK

SEQ ID NO: 189731 - protein, 16 aa, Borrelia garinii
RSEEVAFLAGYFASKT

SEQ ID NO: 189732 - protein, 16 aa, Borrelia garinii
SEEVAFLAGYFASKTS

SEQ ID NO: 189733 - protein, 16 aa, Borrelia garinii
EEVAFLAGYFASKTSK

SEQ ID NO: 189734 - protein, 16 aa, Borrelia garinii
EVAFLAGYFASKTSKT

SEQ ID NO: 189735 - protein, 16 aa, Borrelia garinii
VAFLAGYFASKTSKTG

SEQ ID NO: 189736 - protein, 16 aa, Borrelia garinii
AFLAGYFASKTSKTGK

SEQ ID NO: 189737 - protein, 16 aa, Borrelia garinii
FLAGYFASKTSKTGKI

SEQ ID NO: 189738 - protein, 16 aa, Borrelia garinii
LAGYFASKTSKTGKIG

SEQ ID NO: 189739 - protein, 16 aa, Borrelia garinii
AGYFASKTSKTGKIGF

SEQ ID NO: 189740 - protein, 16 aa, Borrelia garinii
GYFASKTSKTGKIGFI

SEQ ID NO: 189741 - protein, 16 aa, Borrelia garinii
YFASKTSKTGKIGFIG

SEQ ID NO: 189742 - protein, 16 aa, Borrelia garinii
FASKTSKTGKIGFIGG

SEQ ID NO: 189743 - protein, 16 aa, Borrelia garinii
ASKTSKTGKIGFIGGV

SEQ ID NO: 189744 - protein, 16 aa, Borrelia garinii
SKTSKTGKIGFIGGVK

SEQ ID NO: 189745 - protein, 16 aa, Borrelia garinii
KTSKTGKIGFIGGVKG

SEQ ID NO: 189746 - protein, 16 aa, Borrelia garinii
TSKTGKIGFIGGVKGK

SEQ ID NO: 189747 - protein, 16 aa, Borrelia garinii
SKTGKIGFIGGVKGKV

SEQ ID NO: 189748 - protein, 16 aa, Borrelia garinii
KTGKIGFIGGVKGKVL

SEQ ID NO: 189749 - protein, 16 aa, Borrelia garinii
TGKIGFIGGVKGKVLE

SEQ ID NO: 189750 - protein, 16 aa, Borrelia garinii
GKIGFIGGVKGKVLES

SEQ ID NO: 189751 - protein, 16 aa, Borrelia garinii
KIGFIGGVKGKVLESF

SEQ ID NO: 189752 - protein, 16 aa, Borrelia garinii
IGFIGGVKGKVLESFM

SEQ ID NO: 189753 - protein, 16 aa, Borrelia garinii
GFIGGVKGKVLESFMY

SEQ ID NO: 189754 - protein, 16 aa, Borrelia garinii
FIGGVKGKVLESFMYG

SEQ ID NO: 189755 - protein, 16 aa, Borrelia garinii
IGGVKGKVLESFMYGY

SEQ ID NO: 189756 - protein, 16 aa, Borrelia garinii
GGVKGKVLESFMYGYE

SEQ ID NO: 189757 - protein, 16 aa, Borrelia garinii
GVKGKVLESFMYGYEA

SEQ ID NO: 189758 - protein, 16 aa, Borrelia garinii
VKGKVLESFMYGYEAG

SEQ ID NO: 189759 - protein, 16 aa, Borrelia garinii
KGKVLESFMYGYEAGA

SEQ ID NO: 189760 - protein, 16 aa, Borrelia garinii
GKVLESFMYGYEAGAK

SEQ ID NO: 189761 - protein, 16 aa, Borrelia garinii
KVLESFMYGYEAGAKY

SEQ ID NO: 189762 - protein, 16 aa, Borrelia garinii
VLESFMYGYEAGAKYA

SEQ ID NO: 189763 - protein, 16 aa, Borrelia garinii
LESFMYGYEAGAKYAN

SEQ ID NO: 189764 - protein, 16 aa, Borrelia garinii
ESFMYGYEAGAKYANS

SEQ ID NO: 189765 - protein, 16 aa, Borrelia garinii
SFMYGYEAGAKYANST

SEQ ID NO: 189766 - protein, 16 aa, Borrelia garinii
FMYGYEAGAKYANSTI

SEQ ID NO: 189767 - protein, 16 aa, Borrelia garinii
MYGYEAGAKYANSTIK

SEQ ID NO: 189768 - protein, 16 aa, Borrelia garinii
YGYEAGAKYANSTIKV

SEQ ID NO: 189769 - protein, 16 aa, Borrelia garinii
GYEAGAKYANSTIKVI

SEQ ID NO: 189770 - protein, 16 aa, Borrelia garinii
YEAGAKYANSTIKVIS

SEQ ID NO: 189771 - protein, 16 aa, Borrelia garinii
EAGAKYANSTIKVISQ

SEQ ID NO: 189772 - protein, 16 aa, Borrelia garinii
AGAKYANSTIKVISQY

SEQ ID NO: 189773 - protein, 16 aa, Borrelia garinii
GAKYANSTIKVISQYV

SEQ ID NO: 189774 - protein, 16 aa, Borrelia garinii
AKYANSTIKVISQYVG

SEQ ID NO: 189775 - protein, 16 aa, Borrelia garinii
KYANSTIKVISQYVGT

SEQ ID NO: 189776 - protein, 16 aa, Borrelia garinii
YANSTIKVISQYVGTF

SEQ ID NO: 189777 - protein, 16 aa, Borrelia garinii
ANSTIKVISQYVGTFG

SEQ ID NO: 189778 - protein, 16 aa, Borrelia garinii
NSTIKVISQYVGTFGD

SEQ ID NO: 189779 - protein, 16 aa, Borrelia garinii
STIKVISQYVGTFGDF

SEQ ID NO: 189780 - protein, 16 aa, Borrelia garinii
TIKVISQYVGTFGDFG

SEQ ID NO: 189781 - protein, 16 aa, Borrelia garinii
IKVISQYVGTFGDFGL

SEQ ID NO: 189782 - protein, 16 aa, Borrelia garinii
KVISQYVGTFGDFGLG

SEQ ID NO: 189783 - protein, 16 aa, Borrelia garinii
VISQYVGTFGDFGLGR

SEQ ID NO: 189784 - protein, 16 aa, Borrelia garinii
ISQYVGTFGDFGLGRS

SEQ ID NO: 189785 - protein, 16 aa, Borrelia garinii
SQYVGTFGDFGLGRST

SEQ ID NO: 189786 - protein, 16 aa, Borrelia garinii
QYVGTFGDFGLGRSTA

SEQ ID NO: 189787 - protein, 16 aa, Borrelia garinii
YVGTFGDFGLGRSTAS

SEQ ID NO: 189788 - protein, 16 aa, Borrelia garinii
VGTFGDFGLGRSTASN

SEQ ID NO: 189789 - protein, 16 aa, Borrelia garinii
GTFGDFGLGRSTASNM

SEQ ID NO: 189790 - protein, 16 aa, Borrelia garinii
TFGDFGLGRSTASNMY

SEQ ID NO: 189791 - protein, 16 aa, Borrelia garinii
FGDFGLGRSTASNMYR

SEQ ID NO: 189792 - protein, 16 aa, Borrelia garinii
GDFGLGRSTASNMYRD

SEQ ID NO: 189793 - protein, 16 aa, Borrelia garinii
DFGLGRSTASNMYRDG

SEQ ID NO: 189794 - protein, 16 aa, Borrelia garinii
FGLGRSTASNMYRDGV

SEQ ID NO: 189795 - protein, 16 aa, Borrelia garinii
GLGRSTASNMYRDGVD

SEQ ID NO: 189796 - protein, 16 aa, Borrelia garinii
LGRSTASNMYRDGVDI

SEQ ID NO: 189797 - protein, 16 aa, Borrelia garinii
GRSTASNMYRDGVDIV

SEQ ID NO: 189798 - protein, 16 aa, Borrelia garinii
RSTASNMYRDGVDIVF

SEQ ID NO: 189799 - protein, 16 aa, Borrelia garinii
STASNMYRDGVDIVFA

SEQ ID NO: 189800 - protein, 16 aa, Borrelia garinii
TASNMYRDGVDIVFAA

SEQ ID NO: 189801 - protein, 16 aa, Borrelia garinii
ASNMYRDGVDIVFAAA

SEQ ID NO: 189802 - protein, 16 aa, Borrelia garinii
SNMYRDGVDIVFAAAG

SEQ ID NO: 189803 - protein, 16 aa, Borrelia garinii
NMYRDGVDIVFAAAGL

SEQ ID NO: 189804 - protein, 16 aa, Borrelia garinii
MYRDGVDIVFAAAGLS

SEQ ID NO: 189805 - protein, 16 aa, Borrelia garinii
YRDGVDIVFAAAGLSG

SEQ ID NO: 189806 - protein, 16 aa, Borrelia garinii
RDGVDIVFAAAGLSGI

SEQ ID NO: 189807 - protein, 16 aa, Borrelia garinii
DGVDIVFAAAGLSGIG

SEQ ID NO: 189808 - protein, 16 aa, Borrelia garinii
GVDIVFAAAGLSGIGV

SEQ ID NO: 189809 - protein, 16 aa, Borrelia garinii
VDIVFAAAGLSGIGVI

SEQ ID NO: 189810 - protein, 16 aa, Borrelia garinii
DIVFAAAGLSGIGVIE

SEQ ID NO: 189811 - protein, 16 aa, Borrelia garinii
IVFAAAGLSGIGVIEA

SEQ ID NO: 189812 - protein, 16 aa, Borrelia garinii
VFAAAGLSGIGVIEAA

SEQ ID NO: 189813 - protein, 16 aa, Borrelia garinii
FAAAGLSGIGVIEAAK

SEQ ID NO: 189814 - protein, 16 aa, Borrelia garinii
AAAGLSGIGVIEAAKE

SEQ ID NO: 189815 - protein, 16 aa, Borrelia garinii
AAGLSGIGVIEAAKEL

SEQ ID NO: 189816 - protein, 16 aa, Borrelia garinii
AGLSGIGVIEAAKELG

SEQ ID NO: 189817 - protein, 16 aa, Borrelia garinii
GLSGIGVIEAAKELGP

SEQ ID NO: 189818 - protein, 16 aa, Borrelia garinii
LSGIGVIEAAKELGPD

SEQ ID NO: 189819 - protein, 16 aa, Borrelia garinii
SGIGVIEAAKELGPDH

SEQ ID NO: 189820 - protein, 16 aa, Borrelia garinii
GIGVIEAAKELGPDHY

SEQ ID NO: 189821 - protein, 16 aa, Borrelia garinii
IGVIEAAKELGPDHYI

SEQ ID NO: 189822 - protein, 16 aa, Borrelia garinii
GVIEAAKELGPDHYII

SEQ ID NO: 189823 - protein, 16 aa, Borrelia garinii
VIEAAKELGPDHYIIG

SEQ ID NO: 189824 - protein, 16 aa, Borrelia garinii
IEAAKELGPDHYIIGV

SEQ ID NO: 189825 - protein, 16 aa, Borrelia garinii
EAAKELGPDHYIIGVD

SEQ ID NO: 189826 - protein, 16 aa, Borrelia garinii
AAKELGPDHYIIGVDQ

SEQ ID NO: 189827 - protein, 16 aa, Borrelia garinii
AKELGPDHYIIGVDQD

SEQ ID NO: 189828 - protein, 16 aa, Borrelia garinii
KELGPDHYIIGVDQDQ

SEQ ID NO: 189829 - protein, 16 aa, Borrelia garinii
ELGPDHYIIGVDQDQS

SEQ ID NO: 189830 - protein, 16 aa, Borrelia garinii
LGPDHYIIGVDQDQSY

SEQ ID NO: 189831 - protein, 16 aa, Borrelia garinii
GPDHYIIGVDQDQSYL

SEQ ID NO: 189832 - protein, 16 aa, Borrelia garinii
PDHYIIGVDQDQSYLA

SEQ ID NO: 189833 - protein, 16 aa, Borrelia garinii
DHYIIGVDQDQSYLAP

SEQ ID NO: 189834 - protein, 16 aa, Borrelia garinii
HYIIGVDQDQSYLAPN

SEQ ID NO: 189835 - protein, 16 aa, Borrelia garinii
YIIGVDQDQSYLAPNN

SEQ ID NO: 189836 - protein, 16 aa, Borrelia garinii
IIGVDQDQSYLAPNNV

SEQ ID NO: 189837 - protein, 16 aa, Borrelia garinii
IGVDQDQSYLAPNNVL

SEQ ID NO: 189838 - protein, 16 aa, Borrelia garinii
GVDQDQSYLAPNNVLV

SEQ ID NO: 189839 - protein, 16 aa, Borrelia garinii
VDQDQSYLAPNNVLVS

SEQ ID NO: 189840 - protein, 16 aa, Borrelia garinii
DQDQSYLAPNNVLVSA

SEQ ID NO: 189841 - protein, 16 aa, Borrelia garinii
QDQSYLAPNNVLVSAV

SEQ ID NO: 189842 - protein, 16 aa, Borrelia garinii
DQSYLAPNNVLVSAVK

SEQ ID NO: 189843 - protein, 16 aa, Borrelia garinii
QSYLAPNNVLVSAVKK

SEQ ID NO: 189844 - protein, 16 aa, Borrelia garinii
SYLAPNNVLVSAVKKV

SEQ ID NO: 189845 - protein, 16 aa, Borrelia garinii
YLAPNNVLVSAVKKVD

SEQ ID NO: 189846 - protein, 16 aa, Borrelia garinii
LAPNNVLVSAVKKVDS

SEQ ID NO: 189847 - protein, 16 aa, Borrelia garinii
APNNVLVSAVKKVDSL

SEQ ID NO: 189848 - protein, 16 aa, Borrelia garinii
PNNVLVSAVKKVDSLM

SEQ ID NO: 189849 - protein, 16 aa, Borrelia garinii
NNVLVSAVKKVDSLMY

SEQ ID NO: 189850 - protein, 16 aa, Borrelia garinii
NVLVSAVKKVDSLMYS

SEQ ID NO: 189851 - protein, 16 aa, Borrelia garinii
VLVSAVKKVDSLMYSL

SEQ ID NO: 189852 - protein, 16 aa, Borrelia garinii
LVSAVKKVDSLMYSLT

SEQ ID NO: 189853 - protein, 16 aa, Borrelia garinii
VSAVKKVDSLMYSLTK

SEQ ID NO: 189854 - protein, 16 aa, Borrelia garinii
SAVKKVDSLMYSLTKK

SEQ ID NO: 189855 - protein, 16 aa, Borrelia garinii
AVKKVDSLMYSLTKKY

SEQ ID NO: 189856 - protein, 16 aa, Borrelia garinii
VKKVDSLMYSLTKKYL

SEQ ID NO: 189857 - protein, 16 aa, Borrelia garinii
KKVDSLMYSLTKKYLE

SEQ ID NO: 189858 - protein, 16 aa, Borrelia garinii
KVDSLMYSLTKKYLET

SEQ ID NO: 189859 - protein, 16 aa, Borrelia garinii
VDSLMYSLTKKYLETG

SEQ ID NO: 189860 - protein, 16 aa, Borrelia garinii
DSLMYSLTKKYLETGI

SEQ ID NO: 189861 - protein, 16 aa, Borrelia garinii
SLMYSLTKKYLETGIW

SEQ ID NO: 189862 - protein, 16 aa, Borrelia garinii
LMYSLTKKYLETGIWD

SEQ ID NO: 189863 - protein, 16 aa, Borrelia garinii
MYSLTKKYLETGIWDG

SEQ ID NO: 189864 - protein, 16 aa, Borrelia garinii
YSLTKKYLETGIWDGG

SEQ ID NO: 189865 - protein, 16 aa, Borrelia garinii
SLTKKYLETGIWDGGK

SEQ ID NO: 189866 - protein, 16 aa, Borrelia garinii
LTKKYLETGIWDGGKN

SEQ ID NO: 189867 - protein, 16 aa, Borrelia garinii
TKKYLETGIWDGGKNI

SEQ ID NO: 189868 - protein, 16 aa, Borrelia garinii
KKYLETGIWDGGKNIF

SEQ ID NO: 189869 - protein, 16 aa, Borrelia garinii
KYLETGIWDGGKNIFF

SEQ ID NO: 189870 - protein, 16 aa, Borrelia garinii
YLETGIWDGGKNIFFG

SEQ ID NO: 189871 - protein, 16 aa, Borrelia garinii
LETGIWDGGKNIFFGL

SEQ ID NO: 189872 - protein, 16 aa, Borrelia garinii
ETGIWDGGKNIFFGLK

SEQ ID NO: 189873 - protein, 16 aa, Borrelia garinii
TGIWDGGKNIFFGLKE

SEQ ID NO: 189874 - protein, 16 aa, Borrelia garinii
GIWDGGKNIFFGLKED

SEQ ID NO: 189875 - protein, 16 aa, Borrelia garinii
IWDGGKNIFFGLKEDG

SEQ ID NO: 189876 - protein, 16 aa, Borrelia garinii
WDGGKNIFFGLKEDGL

SEQ ID NO: 189877 - protein, 16 aa, Borrelia garinii
DGGKNIFFGLKEDGLG

SEQ ID NO: 189878 - protein, 16 aa, Borrelia garinii
GGKNIFFGLKEDGLGL

SEQ ID NO: 189879 - protein, 16 aa, Borrelia garinii
GKNIFFGLKEDGLGLV

SEQ ID NO: 189880 - protein, 16 aa, Borrelia garinii
KNIFFGLKEDGLGLVL

SEQ ID NO: 189881 - protein, 16 aa, Borrelia garinii
NIFFGLKEDGLGLVLN

SEQ ID NO: 189882 - protein, 16 aa, Borrelia garinii
IFFGLKEDGLGLVLNE

SEQ ID NO: 189883 - protein, 16 aa, Borrelia garinii
FFGLKEDGLGLVLNEN

SEQ ID NO: 189884 - protein, 16 aa, Borrelia garinii
FGLKEDGLGLVLNENL

SEQ ID NO: 189885 - protein, 16 aa, Borrelia garinii
GLKEDGLGLVLNENLK

SEQ ID NO: 189886 - protein, 16 aa, Borrelia garinii
LKEDGLGLVLNENLKS

SEQ ID NO: 189887 - protein, 16 aa, Borrelia garinii
KEDGLGLVLNENLKSN

SEQ ID NO: 189888 - protein, 16 aa, Borrelia garinii
EDGLGLVLNENLKSNY

SEQ ID NO: 189889 - protein, 16 aa, Borrelia garinii
DGLGLVLNENLKSNYS

SEQ ID NO: 189890 - protein, 16 aa, Borrelia garinii
GLGLVLNENLKSNYSE

SEQ ID NO: 189891 - protein, 16 aa, Borrelia garinii
LGLVLNENLKSNYSEI

SEQ ID NO: 189892 - protein, 16 aa, Borrelia garinii
GLVLNENLKSNYSEIY

SEQ ID NO: 189893 - protein, 16 aa, Borrelia garinii
LVLNENLKSNYSEIYN

SEQ ID NO: 189894 - protein, 16 aa, Borrelia garinii
VLNENLKSNYSEIYNK

SEQ ID NO: 189895 - protein, 16 aa, Borrelia garinii
LNENLKSNYSEIYNKS

SEQ ID NO: 189896 - protein, 16 aa, Borrelia garinii
NENLKSNYSEIYNKSL

SEQ ID NO: 189897 - protein, 16 aa, Borrelia garinii
ENLKSNYSEIYNKSLE

SEQ ID NO: 189898 - protein, 16 aa, Borrelia garinii
NLKSNYSEIYNKSLEI

SEQ ID NO: 189899 - protein, 16 aa, Borrelia garinii
LKSNYSEIYNKSLEIG

SEQ ID NO: 189900 - protein, 16 aa, Borrelia garinii
KSNYSEIYNKSLEIGQ

SEQ ID NO: 189901 - protein, 16 aa, Borrelia garinii
SNYSEIYNKSLEIGQS

SEQ ID NO: 189902 - protein, 16 aa, Borrelia garinii
NYSEIYNKSLEIGQSI

SEQ ID NO: 189903 - protein, 16 aa, Borrelia garinii
YSEIYNKSLEIGQSIM

SEQ ID NO: 189904 - protein, 16 aa, Borrelia garinii
SEIYNKSLEIGQSIME

SEQ ID NO: 189905 - protein, 16 aa, Borrelia garinii
EIYNKSLEIGQSIMEG

SEQ ID NO: 189906 - protein, 16 aa, Borrelia garinii
IYNKSLEIGQSIMEGI

SEQ ID NO: 189907 - protein, 16 aa, Borrelia garinii
YNKSLEIGQSIMEGII

SEQ ID NO: 189908 - protein, 16 aa, Borrelia garinii
NKSLEIGQSIMEGIIK

SEQ ID NO: 189909 - protein, 16 aa, Borrelia garinii
KSLEIGQSIMEGIIKV

SEQ ID NO: 189910 - protein, 16 aa, Borrelia garinii
SLEIGQSIMEGIIKVP

SEQ ID NO: 189911 - protein, 16 aa, Borrelia garinii
LEIGQSIMEGIIKVPY

SEQ ID NO: 189912 - protein, 16 aa, Borrelia garinii
EIGQSIMEGIIKVPYD

SEQ ID NO: 189913 - protein, 16 aa, Borrelia garinii
IGQSIMEGIIKVPYDK

SEQ ID NO: 189914 - protein, 16 aa, Borrelia garinii
GQSIMEGIIKVPYDKA

SEQ ID NO: 189915 - protein, 16 aa, Borrelia garinii
QSIMEGIIKVPYDKAS

SEQ ID NO: 189916 - protein, 16 aa, Borrelia garinii
SIMEGIIKVPYDKASY

SEQ ID NO: 189917 - protein, 16 aa, Borrelia garinii
IMEGIIKVPYDKASYD

SEQ ID NO: 189918 - protein, 16 aa, Borrelia garinii
MEGIIKVPYDKASYDN

SEQ ID NO: 189919 - protein, 16 aa, Borrelia garinii
EGIIKVPYDKASYDNF

SEQ ID NO: 189920 - protein, 16 aa, Borrelia garinii
GIIKVPYDKASYDNFV

SEQ ID NO: 189921 - protein, 16 aa, Borrelia garinii
IIKVPYDKASYDNFVL

SEQ ID NO: 189922 - protein, 16 aa, Borrelia garinii
IKVPYDKASYDNFVLQ

SEQ ID NO: 189923 - protein, 16 aa, Borrelia garinii
KVPYDKASYDNFVLQI

SEQ ID NO: 189924 - protein, 16 aa, Borrelia garinii
VPYDKASYDNFVLQIA

SEQ ID NO: 189925 - protein, 16 aa, Borrelia garinii
PYDKASYDNFVLQIAN

SEQ ID NO: 189926 - protein, 169 aa, Borrelia afzelii
MKKINLLIFLFLFILSLSANIEENYTETKRAFSEEDFNLINKRLDNYDFKNEYEKSHVFSDAPRIRRDLRKIGIKEKSVFLDALDIIEYLIKIKISADSIFLSEDMIRLIGGYPDLIFNYLIQLNSDKIDYAEKYGDNARNNFKEDYSKDKTNTVKQILKQILADLPKD

SEQ ID NO: 189927 - protein, 8 aa, Borrelia afzelii
MKKINLLI

SEQ ID NO: 189928 - protein, 8 aa, Borrelia afzelii
KKINLLIF

SEQ ID NO: 189929 - protein, 8 aa, Borrelia afzelii
KINLLIFL

SEQ ID NO: 189930 - protein, 8 aa, Borrelia afzelii
INLLIFLF

SEQ ID NO: 189931 - protein, 8 aa, Borrelia afzelii
NLLIFLFL

SEQ ID NO: 189932 - protein, 8 aa, Borrelia afzelii
LLIFLFLF

SEQ ID NO: 189933 - protein, 8 aa, Borrelia afzelii
LIFLFLFI

SEQ ID NO: 189934 - protein, 8 aa, Borrelia afzelii
IFLFLFIL

SEQ ID NO: 189935 - protein, 8 aa, Borrelia afzelii
FLFLFILS

SEQ ID NO: 189936 - protein, 8 aa, Borrelia afzelii
LFLFILSL

SEQ ID NO: 189937 - protein, 8 aa, Borrelia afzelii
FLFILSLS

SEQ ID NO: 189938 - protein, 8 aa, Borrelia afzelii
LFILSLSA

SEQ ID NO: 189939 - protein, 8 aa, Borrelia afzelii
FILSLSAN

SEQ ID NO: 189940 - protein, 8 aa, Borrelia afzelii
ILSLSANI

SEQ ID NO: 189941 - protein, 8 aa, Borrelia afzelii
LSLSANIE

SEQ ID NO: 189942 - protein, 8 aa, Borrelia afzelii
SLSANIEE

SEQ ID NO: 189943 - protein, 8 aa, Borrelia afzelii
LSANIEEN

SEQ ID NO: 189944 - protein, 8 aa, Borrelia afzelii
SANIEENY

SEQ ID NO: 189945 - protein, 8 aa, Borrelia afzelii
ANIEENYT

SEQ ID NO: 189946 - protein, 8 aa, Borrelia afzelii
NIEENYTE

SEQ ID NO: 189947 - protein, 8 aa, Borrelia afzelii
IEENYTET

SEQ ID NO: 189948 - protein, 8 aa, Borrelia afzelii
EENYTETK

SEQ ID NO: 189949 - protein, 8 aa, Borrelia afzelii
ENYTETKR

SEQ ID NO: 189950 - protein, 8 aa, Borrelia afzelii
NYTETKRA

SEQ ID NO: 189951 - protein, 8 aa, Borrelia afzelii
YTETKRAF

SEQ ID NO: 189952 - protein, 8 aa, Borrelia afzelii
TETKRAFS

SEQ ID NO: 189953 - protein, 8 aa, Borrelia afzelii
ETKRAFSE

SEQ ID NO: 189954 - protein, 8 aa, Borrelia afzelii
TKRAFSEE

SEQ ID NO: 189955 - protein, 8 aa, Borrelia afzelii
KRAFSEED

SEQ ID NO: 189956 - protein, 8 aa, Borrelia afzelii
RAFSEEDF

SEQ ID NO: 189957 - protein, 8 aa, Borrelia afzelii
AFSEEDFN

SEQ ID NO: 189958 - protein, 8 aa, Borrelia afzelii
FSEEDFNL

SEQ ID NO: 189959 - protein, 8 aa, Borrelia afzelii
SEEDFNLI

SEQ ID NO: 189960 - protein, 8 aa, Borrelia afzelii
EEDFNLIN

SEQ ID NO: 189961 - protein, 8 aa, Borrelia afzelii
EDFNLINK

SEQ ID NO: 189962 - protein, 8 aa, Borrelia afzelii
DFNLINKR

SEQ ID NO: 189963 - protein, 8 aa, Borrelia afzelii
FNLINKRL

SEQ ID NO: 189964 - protein, 8 aa, Borrelia afzelii
NLINKRLD

SEQ ID NO: 189965 - protein, 8 aa, Borrelia afzelii
LINKRLDN

SEQ ID NO: 189966 - protein, 8 aa, Borrelia afzelii
INKRLDNY

SEQ ID NO: 189967 - protein, 8 aa, Borrelia afzelii
NKRLDNYD

SEQ ID NO: 189968 - protein, 8 aa, Borrelia afzelii
KRLDNYDF

SEQ ID NO: 189969 - protein, 8 aa, Borrelia afzelii
RLDNYDFK

SEQ ID NO: 189970 - protein, 8 aa, Borrelia afzelii
LDNYDFKN

SEQ ID NO: 189971 - protein, 8 aa, Borrelia afzelii
DNYDFKNE

SEQ ID NO: 189972 - protein, 8 aa, Borrelia afzelii
NYDFKNEY

SEQ ID NO: 189973 - protein, 8 aa, Borrelia afzelii
YDFKNEYE

SEQ ID NO: 189974 - protein, 8 aa, Borrelia afzelii
DFKNEYEK

SEQ ID NO: 189975 - protein, 8 aa, Borrelia afzelii
FKNEYEKS

SEQ ID NO: 189976 - protein, 8 aa, Borrelia afzelii
KNEYEKSH

SEQ ID NO: 189977 - protein, 8 aa, Borrelia afzelii
NEYEKSHV

SEQ ID NO: 189978 - protein, 8 aa, Borrelia afzelii
EYEKSHVF

SEQ ID NO: 189979 - protein, 8 aa, Borrelia afzelii
YEKSHVFS

SEQ ID NO: 189980 - protein, 8 aa, Borrelia afzelii
EKSHVFSD

SEQ ID NO: 189981 - protein, 8 aa, Borrelia afzelii
KSHVFSDA

SEQ ID NO: 189982 - protein, 8 aa, Borrelia afzelii
SHVFSDAP

SEQ ID NO: 189983 - protein, 8 aa, Borrelia afzelii
HVFSDAPR

SEQ ID NO: 189984 - protein, 8 aa, Borrelia afzelii
VFSDAPRI

SEQ ID NO: 189985 - protein, 8 aa, Borrelia afzelii
FSDAPRIR

SEQ ID NO: 189986 - protein, 8 aa, Borrelia afzelii
SDAPRIRR

SEQ ID NO: 189987 - protein, 8 aa, Borrelia afzelii
DAPRIRRD

SEQ ID NO: 189988 - protein, 8 aa, Borrelia afzelii
APRIRRDL

SEQ ID NO: 189989 - protein, 8 aa, Borrelia afzelii
PRIRRDLR

SEQ ID NO: 189990 - protein, 8 aa, Borrelia afzelii
RIRRDLRK

SEQ ID NO: 189991 - protein, 8 aa, Borrelia afzelii
IRRDLRKI

SEQ ID NO: 189992 - protein, 8 aa, Borrelia afzelii
RRDLRKIG

SEQ ID NO: 189993 - protein, 8 aa, Borrelia afzelii
RDLRKIGI

SEQ ID NO: 189994 - protein, 8 aa, Borrelia afzelii
DLRKIGIK

SEQ ID NO: 189995 - protein, 8 aa, Borrelia afzelii
LRKIGIKE

SEQ ID NO: 189996 - protein, 8 aa, Borrelia afzelii
RKIGIKEK

SEQ ID NO: 189997 - protein, 8 aa, Borrelia afzelii
KIGIKEKS

SEQ ID NO: 189998 - protein, 8 aa, Borrelia afzelii
IGIKEKSV

SEQ ID NO: 189999 - protein, 8 aa, Borrelia afzelii
GIKEKSVF

SEQ ID NO: 190000 - protein, 8 aa, Borrelia afzelii
IKEKSVFL

SEQ ID NO: 190001 - protein, 8 aa, Borrelia afzelii
KEKSVFLD

SEQ ID NO: 190002 - protein, 8 aa, Borrelia afzelii
EKSVFLDA

SEQ ID NO: 190003 - protein, 8 aa, Borrelia afzelii
KSVFLDAL

SEQ ID NO: 190004 - protein, 8 aa, Borrelia afzelii
SVFLDALD

SEQ ID NO: 190005 - protein, 8 aa, Borrelia afzelii
VFLDALDI

SEQ ID NO: 190006 - protein, 8 aa, Borrelia afzelii
FLDALDII

SEQ ID NO: 190007 - protein, 8 aa, Borrelia afzelii
LDALDIIE

SEQ ID NO: 190008 - protein, 8 aa, Borrelia afzelii
DALDIIEY

SEQ ID NO: 190009 - protein, 8 aa, Borrelia afzelii
ALDIIEYL

SEQ ID NO: 190010 - protein, 8 aa, Borrelia afzelii
LDIIEYLI

SEQ ID NO: 190011 - protein, 8 aa, Borrelia afzelii
DIIEYLIK

SEQ ID NO: 190012 - protein, 8 aa, Borrelia afzelii
IIEYLIKI

SEQ ID NO: 190013 - protein, 8 aa, Borrelia afzelii
IEYLIKIK

SEQ ID NO: 190014 - protein, 8 aa, Borrelia afzelii
EYLIKIKI

SEQ ID NO: 190015 - protein, 8 aa, Borrelia afzelii
YLIKIKIS

SEQ ID NO: 190016 - protein, 8 aa, Borrelia afzelii
LIKIKISA

SEQ ID NO: 190017 - protein, 8 aa, Borrelia afzelii
IKIKISAD

SEQ ID NO: 190018 - protein, 8 aa, Borrelia afzelii
KIKISADS

SEQ ID NO: 190019 - protein, 8 aa, Borrelia afzelii
IKISADSI

SEQ ID NO: 190020 - protein, 8 aa, Borrelia afzelii
KISADSIF

SEQ ID NO: 190021 - protein, 8 aa, Borrelia afzelii
ISADSIFL

SEQ ID NO: 190022 - protein, 8 aa, Borrelia afzelii
SADSIFLS

SEQ ID NO: 190023 - protein, 8 aa, Borrelia afzelii
ADSIFLSE

SEQ ID NO: 190024 - protein, 8 aa, Borrelia afzelii
DSIFLSED

SEQ ID NO: 190025 - protein, 8 aa, Borrelia afzelii
SIFLSEDM

SEQ ID NO: 190026 - protein, 8 aa, Borrelia afzelii
IFLSEDMI

SEQ ID NO: 190027 - protein, 8 aa, Borrelia afzelii
FLSEDMIR

SEQ ID NO: 190028 - protein, 8 aa, Borrelia afzelii
LSEDMIRL

SEQ ID NO: 190029 - protein, 8 aa, Borrelia afzelii
SEDMIRLI

SEQ ID NO: 190030 - protein, 8 aa, Borrelia afzelii
EDMIRLIG

SEQ ID NO: 190031 - protein, 8 aa, Borrelia afzelii
DMIRLIGG

SEQ ID NO: 190032 - protein, 8 aa, Borrelia afzelii
MIRLIGGY

SEQ ID NO: 190033 - protein, 8 aa, Borrelia afzelii
IRLIGGYP

SEQ ID NO: 190034 - protein, 8 aa, Borrelia afzelii
RLIGGYPD

SEQ ID NO: 190035 - protein, 8 aa, Borrelia afzelii
LIGGYPDL

SEQ ID NO: 190036 - protein, 8 aa, Borrelia afzelii
IGGYPDLI

SEQ ID NO: 190037 - protein, 8 aa, Borrelia afzelii
GGYPDLIF

SEQ ID NO: 190038 - protein, 8 aa, Borrelia afzelii
GYPDLIFN

SEQ ID NO: 190039 - protein, 8 aa, Borrelia afzelii
YPDLIFNY

SEQ ID NO: 190040 - protein, 8 aa, Borrelia afzelii
PDLIFNYL

SEQ ID NO: 190041 - protein, 8 aa, Borrelia afzelii
DLIFNYLI

SEQ ID NO: 190042 - protein, 8 aa, Borrelia afzelii
LIFNYLIQ

SEQ ID NO: 190043 - protein, 8 aa, Borrelia afzelii
IFNYLIQL

SEQ ID NO: 190044 - protein, 8 aa, Borrelia afzelii
FNYLIQLN

SEQ ID NO: 190045 - protein, 8 aa, Borrelia afzelii
NYLIQLNS

SEQ ID NO: 190046 - protein, 8 aa, Borrelia afzelii
YLIQLNSD

SEQ ID NO: 190047 - protein, 8 aa, Borrelia afzelii
LIQLNSDK

SEQ ID NO: 190048 - protein, 8 aa, Borrelia afzelii
IQLNSDKI

SEQ ID NO: 190049 - protein, 8 aa, Borrelia afzelii
QLNSDKID

SEQ ID NO: 190050 - protein, 8 aa, Borrelia afzelii
LNSDKIDY

SEQ ID NO: 190051 - protein, 8 aa, Borrelia afzelii
NSDKIDYA

SEQ ID NO: 190052 - protein, 8 aa, Borrelia afzelii
SDKIDYAE

SEQ ID NO: 190053 - protein, 8 aa, Borrelia afzelii
DKIDYAEK

SEQ ID NO: 190054 - protein, 8 aa, Borrelia afzelii
KIDYAEKY

SEQ ID NO: 190055 - protein, 8 aa, Borrelia afzelii
IDYAEKYG

SEQ ID NO: 190056 - protein, 8 aa, Borrelia afzelii
DYAEKYGD

SEQ ID NO: 190057 - protein, 8 aa, Borrelia afzelii
YAEKYGDN

SEQ ID NO: 190058 - protein, 8 aa, Borrelia afzelii
AEKYGDNA

SEQ ID NO: 190059 - protein, 8 aa, Borrelia afzelii
EKYGDNAR

SEQ ID NO: 190060 - protein, 8 aa, Borrelia afzelii
KYGDNARN

SEQ ID NO: 190061 - protein, 8 aa, Borrelia afzelii
YGDNARNN

SEQ ID NO: 190062 - protein, 8 aa, Borrelia afzelii
GDNARNNF

SEQ ID NO: 190063 - protein, 8 aa, Borrelia afzelii
DNARNNFK

SEQ ID NO: 190064 - protein, 8 aa, Borrelia afzelii
NARNNFKE

SEQ ID NO: 190065 - protein, 8 aa, Borrelia afzelii
ARNNFKED

SEQ ID NO: 190066 - protein, 8 aa, Borrelia afzelii
RNNFKEDY

SEQ ID NO: 190067 - protein, 8 aa, Borrelia afzelii
NNFKEDYS

SEQ ID NO: 190068 - protein, 8 aa, Borrelia afzelii
NFKEDYSK

SEQ ID NO: 190069 - protein, 8 aa, Borrelia afzelii
FKEDYSKD

SEQ ID NO: 190070 - protein, 8 aa, Borrelia afzelii
KEDYSKDK

SEQ ID NO: 190071 - protein, 8 aa, Borrelia afzelii
EDYSKDKT

SEQ ID NO: 190072 - protein, 8 aa, Borrelia afzelii
DYSKDKTN

SEQ ID NO: 190073 - protein, 8 aa, Borrelia afzelii
YSKDKTNT

SEQ ID NO: 190074 - protein, 8 aa, Borrelia afzelii
SKDKTNTV

SEQ ID NO: 190075 - protein, 8 aa, Borrelia afzelii
KDKTNTVK

SEQ ID NO: 190076 - protein, 8 aa, Borrelia afzelii
DKTNTVKQ

SEQ ID NO: 190077 - protein, 8 aa, Borrelia afzelii
KTNTVKQI

SEQ ID NO: 190078 - protein, 8 aa, Borrelia afzelii
TNTVKQIL

SEQ ID NO: 190079 - protein, 8 aa, Borrelia afzelii
NTVKQILK

SEQ ID NO: 190080 - protein, 8 aa, Borrelia afzelii
TVKQILKQ

SEQ ID NO: 190081 - protein, 8 aa, Borrelia afzelii
VKQILKQI

SEQ ID NO: 190082 - protein, 8 aa, Borrelia afzelii
KQILKQIL

SEQ ID NO: 190083 - protein, 8 aa, Borrelia afzelii
QILKQILA

SEQ ID NO: 190084 - protein, 8 aa, Borrelia afzelii
ILKQILAD

SEQ ID NO: 190085 - protein, 8 aa, Borrelia afzelii
LKQILADL

SEQ ID NO: 190086 - protein, 8 aa, Borrelia afzelii
KQILADLP

SEQ ID NO: 190087 - protein, 8 aa, Borrelia afzelii
QILADLPK

SEQ ID NO: 190088 - protein, 8 aa, Borrelia afzelii
ILADLPKD

SEQ ID NO: 190089 - protein, 9 aa, Borrelia afzelii
MKKINLLIF

SEQ ID NO: 190090 - protein, 9 aa, Borrelia afzelii
KKINLLIFL

SEQ ID NO: 190091 - protein, 9 aa, Borrelia afzelii
KINLLIFLF

SEQ ID NO: 190092 - protein, 9 aa, Borrelia afzelii
INLLIFLFL

SEQ ID NO: 190093 - protein, 9 aa, Borrelia afzelii
NLLIFLFLF

SEQ ID NO: 190094 - protein, 9 aa, Borrelia afzelii
LLIFLFLFI

SEQ ID NO: 190095 - protein, 9 aa, Borrelia afzelii
LIFLFLFIL

SEQ ID NO: 190096 - protein, 9 aa, Borrelia afzelii
IFLFLFILS

SEQ ID NO: 190097 - protein, 9 aa, Borrelia afzelii
FLFLFILSL

SEQ ID NO: 190098 - protein, 9 aa, Borrelia afzelii
LFLFILSLS

SEQ ID NO: 190099 - protein, 9 aa, Borrelia afzelii
FLFILSLSA

SEQ ID NO: 190100 - protein, 9 aa, Borrelia afzelii
LFILSLSAN

SEQ ID NO: 190101 - protein, 9 aa, Borrelia afzelii
FILSLSANI

SEQ ID NO: 190102 - protein, 9 aa, Borrelia afzelii
ILSLSANIE

SEQ ID NO: 190103 - protein, 9 aa, Borrelia afzelii
LSLSANIEE

SEQ ID NO: 190104 - protein, 9 aa, Borrelia afzelii
SLSANIEEN

SEQ ID NO: 190105 - protein, 9 aa, Borrelia afzelii
LSANIEENY

SEQ ID NO: 190106 - protein, 9 aa, Borrelia afzelii
SANIEENYT

SEQ ID NO: 190107 - protein, 9 aa, Borrelia afzelii
ANIEENYTE

SEQ ID NO: 190108 - protein, 9 aa, Borrelia afzelii
NIEENYTET

SEQ ID NO: 190109 - protein, 9 aa, Borrelia afzelii
IEENYTETK

SEQ ID NO: 190110 - protein, 9 aa, Borrelia afzelii
EENYTETKR

SEQ ID NO: 190111 - protein, 9 aa, Borrelia afzelii
ENYTETKRA

SEQ ID NO: 190112 - protein, 9 aa, Borrelia afzelii
NYTETKRAF

SEQ ID NO: 190113 - protein, 9 aa, Borrelia afzelii
YTETKRAFS

SEQ ID NO: 190114 - protein, 9 aa, Borrelia afzelii
TETKRAFSE

SEQ ID NO: 190115 - protein, 9 aa, Borrelia afzelii
ETKRAFSEE

SEQ ID NO: 190116 - protein, 9 aa, Borrelia afzelii
TKRAFSEED

SEQ ID NO: 190117 - protein, 9 aa, Borrelia afzelii
KRAFSEEDF

SEQ ID NO: 190118 - protein, 9 aa, Borrelia afzelii
RAFSEEDFN

SEQ ID NO: 190119 - protein, 9 aa, Borrelia afzelii
AFSEEDFNL

SEQ ID NO: 190120 - protein, 9 aa, Borrelia afzelii
FSEEDFNLI

SEQ ID NO: 190121 - protein, 9 aa, Borrelia afzelii
SEEDFNLIN

SEQ ID NO: 190122 - protein, 9 aa, Borrelia afzelii
EEDFNLINK

SEQ ID NO: 190123 - protein, 9 aa, Borrelia afzelii
EDFNLINKR

SEQ ID NO: 190124 - protein, 9 aa, Borrelia afzelii
DFNLINKRL

SEQ ID NO: 190125 - protein, 9 aa, Borrelia afzelii
FNLINKRLD

SEQ ID NO: 190126 - protein, 9 aa, Borrelia afzelii
NLINKRLDN

SEQ ID NO: 190127 - protein, 9 aa, Borrelia afzelii
LINKRLDNY

SEQ ID NO: 190128 - protein, 9 aa, Borrelia afzelii
INKRLDNYD

SEQ ID NO: 190129 - protein, 9 aa, Borrelia afzelii
NKRLDNYDF

SEQ ID NO: 190130 - protein, 9 aa, Borrelia afzelii
KRLDNYDFK

SEQ ID NO: 190131 - protein, 9 aa, Borrelia afzelii
RLDNYDFKN

SEQ ID NO: 190132 - protein, 9 aa, Borrelia afzelii
LDNYDFKNE

SEQ ID NO: 190133 - protein, 9 aa, Borrelia afzelii
DNYDFKNEY

SEQ ID NO: 190134 - protein, 9 aa, Borrelia afzelii
NYDFKNEYE

SEQ ID NO: 190135 - protein, 9 aa, Borrelia afzelii
YDFKNEYEK

SEQ ID NO: 190136 - protein, 9 aa, Borrelia afzelii
DFKNEYEKS

SEQ ID NO: 190137 - protein, 9 aa, Borrelia afzelii
FKNEYEKSH

SEQ ID NO: 190138 - protein, 9 aa, Borrelia afzelii
KNEYEKSHV

SEQ ID NO: 190139 - protein, 9 aa, Borrelia afzelii
NEYEKSHVF

SEQ ID NO: 190140 - protein, 9 aa, Borrelia afzelii
EYEKSHVFS

SEQ ID NO: 190141 - protein, 9 aa, Borrelia afzelii
YEKSHVFSD

SEQ ID NO: 190142 - protein, 9 aa, Borrelia afzelii
EKSHVFSDA

SEQ ID NO: 190143 - protein, 9 aa, Borrelia afzelii
KSHVFSDAP

SEQ ID NO: 190144 - protein, 9 aa, Borrelia afzelii
SHVFSDAPR

SEQ ID NO: 190145 - protein, 9 aa, Borrelia afzelii
HVFSDAPRI

SEQ ID NO: 190146 - protein, 9 aa, Borrelia afzelii
VFSDAPRIR

SEQ ID NO: 190147 - protein, 9 aa, Borrelia afzelii
FSDAPRIRR

SEQ ID NO: 190148 - protein, 9 aa, Borrelia afzelii
SDAPRIRRD

SEQ ID NO: 190149 - protein, 9 aa, Borrelia afzelii
DAPRIRRDL

SEQ ID NO: 190150 - protein, 9 aa, Borrelia afzelii
APRIRRDLR

SEQ ID NO: 190151 - protein, 9 aa, Borrelia afzelii
PRIRRDLRK

SEQ ID NO: 190152 - protein, 9 aa, Borrelia afzelii
RIRRDLRKI

SEQ ID NO: 190153 - protein, 9 aa, Borrelia afzelii
IRRDLRKIG

SEQ ID NO: 190154 - protein, 9 aa, Borrelia afzelii
RRDLRKIGI

SEQ ID NO: 190155 - protein, 9 aa, Borrelia afzelii
RDLRKIGIK

SEQ ID NO: 190156 - protein, 9 aa, Borrelia afzelii
DLRKIGIKE

SEQ ID NO: 190157 - protein, 9 aa, Borrelia afzelii
LRKIGIKEK

SEQ ID NO: 190158 - protein, 9 aa, Borrelia afzelii
RKIGIKEKS

SEQ ID NO: 190159 - protein, 9 aa, Borrelia afzelii
KIGIKEKSV

SEQ ID NO: 190160 - protein, 9 aa, Borrelia afzelii
IGIKEKSVF

SEQ ID NO: 190161 - protein, 9 aa, Borrelia afzelii
GIKEKSVFL

SEQ ID NO: 190162 - protein, 9 aa, Borrelia afzelii
IKEKSVFLD

SEQ ID NO: 190163 - protein, 9 aa, Borrelia afzelii
KEKSVFLDA

SEQ ID NO: 190164 - protein, 9 aa, Borrelia afzelii
EKSVFLDAL

SEQ ID NO: 190165 - protein, 9 aa, Borrelia afzelii
KSVFLDALD

SEQ ID NO: 190166 - protein, 9 aa, Borrelia afzelii
SVFLDALDI

SEQ ID NO: 190167 - protein, 9 aa, Borrelia afzelii
VFLDALDII

SEQ ID NO: 190168 - protein, 9 aa, Borrelia afzelii
FLDALDIIE

SEQ ID NO: 190169 - protein, 9 aa, Borrelia afzelii
LDALDIIEY

SEQ ID NO: 190170 - protein, 9 aa, Borrelia afzelii
DALDIIEYL

SEQ ID NO: 190171 - protein, 9 aa, Borrelia afzelii
ALDIIEYLI

SEQ ID NO: 190172 - protein, 9 aa, Borrelia afzelii
LDIIEYLIK

SEQ ID NO: 190173 - protein, 9 aa, Borrelia afzelii
DIIEYLIKI

SEQ ID NO: 190174 - protein, 9 aa, Borrelia afzelii
IIEYLIKIK

SEQ ID NO: 190175 - protein, 9 aa, Borrelia afzelii
IEYLIKIKI

SEQ ID NO: 190176 - protein, 9 aa, Borrelia afzelii
EYLIKIKIS

SEQ ID NO: 190177 - protein, 9 aa, Borrelia afzelii
YLIKIKISA

SEQ ID NO: 190178 - protein, 9 aa, Borrelia afzelii
LIKIKISAD

SEQ ID NO: 190179 - protein, 9 aa, Borrelia afzelii
IKIKISADS

SEQ ID NO: 190180 - protein, 9 aa, Borrelia afzelii
KIKISADSI

SEQ ID NO: 190181 - protein, 9 aa, Borrelia afzelii
IKISADSIF

SEQ ID NO: 190182 - protein, 9 aa, Borrelia afzelii
KISADSIFL

SEQ ID NO: 190183 - protein, 9 aa, Borrelia afzelii
ISADSIFLS

SEQ ID NO: 190184 - protein, 9 aa, Borrelia afzelii
SADSIFLSE

SEQ ID NO: 190185 - protein, 9 aa, Borrelia afzelii
ADSIFLSED

SEQ ID NO: 190186 - protein, 9 aa, Borrelia afzelii
DSIFLSEDM

SEQ ID NO: 190187 - protein, 9 aa, Borrelia afzelii
SIFLSEDMI

SEQ ID NO: 190188 - protein, 9 aa, Borrelia afzelii
IFLSEDMIR

SEQ ID NO: 190189 - protein, 9 aa, Borrelia afzelii
FLSEDMIRL

SEQ ID NO: 190190 - protein, 9 aa, Borrelia afzelii
LSEDMIRLI

SEQ ID NO: 190191 - protein, 9 aa, Borrelia afzelii
SEDMIRLIG

SEQ ID NO: 190192 - protein, 9 aa, Borrelia afzelii
EDMIRLIGG

SEQ ID NO: 190193 - protein, 9 aa, Borrelia afzelii
DMIRLIGGY

SEQ ID NO: 190194 - protein, 9 aa, Borrelia afzelii
MIRLIGGYP

SEQ ID NO: 190195 - protein, 9 aa, Borrelia afzelii
IRLIGGYPD

SEQ ID NO: 190196 - protein, 9 aa, Borrelia afzelii
RLIGGYPDL

SEQ ID NO: 190197 - protein, 9 aa, Borrelia afzelii
LIGGYPDLI

SEQ ID NO: 190198 - protein, 9 aa, Borrelia afzelii
IGGYPDLIF

SEQ ID NO: 190199 - protein, 9 aa, Borrelia afzelii
GGYPDLIFN

SEQ ID NO: 190200 - protein, 9 aa, Borrelia afzelii
GYPDLIFNY

SEQ ID NO: 190201 - protein, 9 aa, Borrelia afzelii
YPDLIFNYL

SEQ ID NO: 190202 - protein, 9 aa, Borrelia afzelii
PDLIFNYLI

SEQ ID NO: 190203 - protein, 9 aa, Borrelia afzelii
DLIFNYLIQ

SEQ ID NO: 190204 - protein, 9 aa, Borrelia afzelii
LIFNYLIQL

SEQ ID NO: 190205 - protein, 9 aa, Borrelia afzelii
IFNYLIQLN

SEQ ID NO: 190206 - protein, 9 aa, Borrelia afzelii
FNYLIQLNS

SEQ ID NO: 190207 - protein, 9 aa, Borrelia afzelii
NYLIQLNSD

SEQ ID NO: 190208 - protein, 9 aa, Borrelia afzelii
YLIQLNSDK

SEQ ID NO: 190209 - protein, 9 aa, Borrelia afzelii
LIQLNSDKI

SEQ ID NO: 190210 - protein, 9 aa, Borrelia afzelii
IQLNSDKID

SEQ ID NO: 190211 - protein, 9 aa, Borrelia afzelii
QLNSDKIDY

SEQ ID NO: 190212 - protein, 9 aa, Borrelia afzelii
LNSDKIDYA

SEQ ID NO: 190213 - protein, 9 aa, Borrelia afzelii
NSDKIDYAE

SEQ ID NO: 190214 - protein, 9 aa, Borrelia afzelii
SDKIDYAEK

SEQ ID NO: 190215 - protein, 9 aa, Borrelia afzelii
DKIDYAEKY

SEQ ID NO: 190216 - protein, 9 aa, Borrelia afzelii
KIDYAEKYG

SEQ ID NO: 190217 - protein, 9 aa, Borrelia afzelii
IDYAEKYGD

SEQ ID NO: 190218 - protein, 9 aa, Borrelia afzelii
DYAEKYGDN

SEQ ID NO: 190219 - protein, 9 aa, Borrelia afzelii
YAEKYGDNA

SEQ ID NO: 190220 - protein, 9 aa, Borrelia afzelii
AEKYGDNAR

SEQ ID NO: 190221 - protein, 9 aa, Borrelia afzelii
EKYGDNARN

SEQ ID NO: 190222 - protein, 9 aa, Borrelia afzelii
KYGDNARNN

SEQ ID NO: 190223 - protein, 9 aa, Borrelia afzelii
YGDNARNNF

SEQ ID NO: 190224 - protein, 9 aa, Borrelia afzelii
GDNARNNFK

SEQ ID NO: 190225 - protein, 9 aa, Borrelia afzelii
DNARNNFKE

SEQ ID NO: 190226 - protein, 9 aa, Borrelia afzelii
NARNNFKED

SEQ ID NO: 190227 - protein, 9 aa, Borrelia afzelii
ARNNFKEDY

SEQ ID NO: 190228 - protein, 9 aa, Borrelia afzelii
RNNFKEDYS

SEQ ID NO: 190229 - protein, 9 aa, Borrelia afzelii
NNFKEDYSK

SEQ ID NO: 190230 - protein, 9 aa, Borrelia afzelii
NFKEDYSKD

SEQ ID NO: 190231 - protein, 9 aa, Borrelia afzelii
FKEDYSKDK

SEQ ID NO: 190232 - protein, 9 aa, Borrelia afzelii
KEDYSKDKT

SEQ ID NO: 190233 - protein, 9 aa, Borrelia afzelii
EDYSKDKTN

SEQ ID NO: 190234 - protein, 9 aa, Borrelia afzelii
DYSKDKTNT

SEQ ID NO: 190235 - protein, 9 aa, Borrelia afzelii
YSKDKTNTV

SEQ ID NO: 190236 - protein, 9 aa, Borrelia afzelii
SKDKTNTVK

SEQ ID NO: 190237 - protein, 9 aa, Borrelia afzelii
KDKTNTVKQ

SEQ ID NO: 190238 - protein, 9 aa, Borrelia afzelii
DKTNTVKQI

SEQ ID NO: 190239 - protein, 9 aa, Borrelia afzelii
KTNTVKQIL

SEQ ID NO: 190240 - protein, 9 aa, Borrelia afzelii
TNTVKQILK

SEQ ID NO: 190241 - protein, 9 aa, Borrelia afzelii
NTVKQILKQ

SEQ ID NO: 190242 - protein, 9 aa, Borrelia afzelii
TVKQILKQI

SEQ ID NO: 190243 - protein, 9 aa, Borrelia afzelii
VKQILKQIL

SEQ ID NO: 190244 - protein, 9 aa, Borrelia afzelii
KQILKQILA

SEQ ID NO: 190245 - protein, 9 aa, Borrelia afzelii
QILKQILAD

SEQ ID NO: 190246 - protein, 9 aa, Borrelia afzelii
ILKQILADL

SEQ ID NO: 190247 - protein, 9 aa, Borrelia afzelii
LKQILADLP

SEQ ID NO: 190248 - protein, 9 aa, Borrelia afzelii
KQILADLPK

SEQ ID NO: 190249 - protein, 9 aa, Borrelia afzelii
QILADLPKD

SEQ ID NO: 190250 - protein, 10 aa, Borrelia afzelii
MKKINLLIFL

SEQ ID NO: 190251 - protein, 10 aa, Borrelia afzelii
KKINLLIFLF

SEQ ID NO: 190252 - protein, 10 aa, Borrelia afzelii
KINLLIFLFL

SEQ ID NO: 190253 - protein, 10 aa, Borrelia afzelii
INLLIFLFLF

SEQ ID NO: 190254 - protein, 10 aa, Borrelia afzelii
NLLIFLFLFI

SEQ ID NO: 190255 - protein, 10 aa, Borrelia afzelii
LLIFLFLFIL

SEQ ID NO: 190256 - protein, 10 aa, Borrelia afzelii
LIFLFLFILS

SEQ ID NO: 190257 - protein, 10 aa, Borrelia afzelii
IFLFLFILSL

SEQ ID NO: 190258 - protein, 10 aa, Borrelia afzelii
FLFLFILSLS

SEQ ID NO: 190259 - protein, 10 aa, Borrelia afzelii
LFLFILSLSA

SEQ ID NO: 190260 - protein, 10 aa, Borrelia afzelii
FLFILSLSAN

SEQ ID NO: 190261 - protein, 10 aa, Borrelia afzelii
LFILSLSANI

SEQ ID NO: 190262 - protein, 10 aa, Borrelia afzelii
FILSLSANIE

SEQ ID NO: 190263 - protein, 10 aa, Borrelia afzelii
ILSLSANIEE

SEQ ID NO: 190264 - protein, 10 aa, Borrelia afzelii
LSLSANIEEN

SEQ ID NO: 190265 - protein, 10 aa, Borrelia afzelii
SLSANIEENY

SEQ ID NO: 190266 - protein, 10 aa, Borrelia afzelii
LSANIEENYT

SEQ ID NO: 190267 - protein, 10 aa, Borrelia afzelii
SANIEENYTE

SEQ ID NO: 190268 - protein, 10 aa, Borrelia afzelii
ANIEENYTET

SEQ ID NO: 190269 - protein, 10 aa, Borrelia afzelii
NIEENYTETK

SEQ ID NO: 190270 - protein, 10 aa, Borrelia afzelii
IEENYTETKR

SEQ ID NO: 190271 - protein, 10 aa, Borrelia afzelii
EENYTETKRA

SEQ ID NO: 190272 - protein, 10 aa, Borrelia afzelii
ENYTETKRAF

SEQ ID NO: 190273 - protein, 10 aa, Borrelia afzelii
NYTETKRAFS

SEQ ID NO: 190274 - protein, 10 aa, Borrelia afzelii
YTETKRAFSE

SEQ ID NO: 190275 - protein, 10 aa, Borrelia afzelii
TETKRAFSEE

SEQ ID NO: 190276 - protein, 10 aa, Borrelia afzelii
ETKRAFSEED

SEQ ID NO: 190277 - protein, 10 aa, Borrelia afzelii
TKRAFSEEDF

SEQ ID NO: 190278 - protein, 10 aa, Borrelia afzelii
KRAFSEEDFN

SEQ ID NO: 190279 - protein, 10 aa, Borrelia afzelii
RAFSEEDFNL

SEQ ID NO: 190280 - protein, 10 aa, Borrelia afzelii
AFSEEDFNLI

SEQ ID NO: 190281 - protein, 10 aa, Borrelia afzelii
FSEEDFNLIN

SEQ ID NO: 190282 - protein, 10 aa, Borrelia afzelii
SEEDFNLINK

SEQ ID NO: 190283 - protein, 10 aa, Borrelia afzelii
EEDFNLINKR

SEQ ID NO: 190284 - protein, 10 aa, Borrelia afzelii
EDFNLINKRL

SEQ ID NO: 190285 - protein, 10 aa, Borrelia afzelii
DFNLINKRLD

SEQ ID NO: 190286 - protein, 10 aa, Borrelia afzelii
FNLINKRLDN

SEQ ID NO: 190287 - protein, 10 aa, Borrelia afzelii
NLINKRLDNY

SEQ ID NO: 190288 - protein, 10 aa, Borrelia afzelii
LINKRLDNYD

SEQ ID NO: 190289 - protein, 10 aa, Borrelia afzelii
INKRLDNYDF

SEQ ID NO: 190290 - protein, 10 aa, Borrelia afzelii
NKRLDNYDFK

SEQ ID NO: 190291 - protein, 10 aa, Borrelia afzelii
KRLDNYDFKN

SEQ ID NO: 190292 - protein, 10 aa, Borrelia afzelii
RLDNYDFKNE

SEQ ID NO: 190293 - protein, 10 aa, Borrelia afzelii
LDNYDFKNEY

SEQ ID NO: 190294 - protein, 10 aa, Borrelia afzelii
DNYDFKNEYE

SEQ ID NO: 190295 - protein, 10 aa, Borrelia afzelii
NYDFKNEYEK

SEQ ID NO: 190296 - protein, 10 aa, Borrelia afzelii
YDFKNEYEKS

SEQ ID NO: 190297 - protein, 10 aa, Borrelia afzelii
DFKNEYEKSH

SEQ ID NO: 190298 - protein, 10 aa, Borrelia afzelii
FKNEYEKSHV

SEQ ID NO: 190299 - protein, 10 aa, Borrelia afzelii
KNEYEKSHVF

SEQ ID NO: 190300 - protein, 10 aa, Borrelia afzelii
NEYEKSHVFS

SEQ ID NO: 190301 - protein, 10 aa, Borrelia afzelii
EYEKSHVFSD

SEQ ID NO: 190302 - protein, 10 aa, Borrelia afzelii
YEKSHVFSDA

SEQ ID NO: 190303 - protein, 10 aa, Borrelia afzelii
EKSHVFSDAP

SEQ ID NO: 190304 - protein, 10 aa, Borrelia afzelii
KSHVFSDAPR

SEQ ID NO: 190305 - protein, 10 aa, Borrelia afzelii
SHVFSDAPRI

SEQ ID NO: 190306 - protein, 10 aa, Borrelia afzelii
HVFSDAPRIR

SEQ ID NO: 190307 - protein, 10 aa, Borrelia afzelii
VFSDAPRIRR

SEQ ID NO: 190308 - protein, 10 aa, Borrelia afzelii
FSDAPRIRRD

SEQ ID NO: 190309 - protein, 10 aa, Borrelia afzelii
SDAPRIRRDL

SEQ ID NO: 190310 - protein, 10 aa, Borrelia afzelii
DAPRIRRDLR

SEQ ID NO: 190311 - protein, 10 aa, Borrelia afzelii
APRIRRDLRK

SEQ ID NO: 190312 - protein, 10 aa, Borrelia afzelii
PRIRRDLRKI

SEQ ID NO: 190313 - protein, 10 aa, Borrelia afzelii
RIRRDLRKIG

SEQ ID NO: 190314 - protein, 10 aa, Borrelia afzelii
IRRDLRKIGI

SEQ ID NO: 190315 - protein, 10 aa, Borrelia afzelii
RRDLRKIGIK

SEQ ID NO: 190316 - protein, 10 aa, Borrelia afzelii
RDLRKIGIKE

SEQ ID NO: 190317 - protein, 10 aa, Borrelia afzelii
DLRKIGIKEK

SEQ ID NO: 190318 - protein, 10 aa, Borrelia afzelii
LRKIGIKEKS

SEQ ID NO: 190319 - protein, 10 aa, Borrelia afzelii
RKIGIKEKSV

SEQ ID NO: 190320 - protein, 10 aa, Borrelia afzelii
KIGIKEKSVF

SEQ ID NO: 190321 - protein, 10 aa, Borrelia afzelii
IGIKEKSVFL

SEQ ID NO: 190322 - protein, 10 aa, Borrelia afzelii
GIKEKSVFLD

SEQ ID NO: 190323 - protein, 10 aa, Borrelia afzelii
IKEKSVFLDA

SEQ ID NO: 190324 - protein, 10 aa, Borrelia afzelii
KEKSVFLDAL

SEQ ID NO: 190325 - protein, 10 aa, Borrelia afzelii
EKSVFLDALD

SEQ ID NO: 190326 - protein, 10 aa, Borrelia afzelii
KSVFLDALDI

SEQ ID NO: 190327 - protein, 10 aa, Borrelia afzelii
SVFLDALDII

SEQ ID NO: 190328 - protein, 10 aa, Borrelia afzelii
VFLDALDIIE

SEQ ID NO: 190329 - protein, 10 aa, Borrelia afzelii
FLDALDIIEY

SEQ ID NO: 190330 - protein, 10 aa, Borrelia afzelii
LDALDIIEYL

SEQ ID NO: 190331 - protein, 10 aa, Borrelia afzelii
DALDIIEYLI

SEQ ID NO: 190332 - protein, 10 aa, Borrelia afzelii
ALDIIEYLIK

SEQ ID NO: 190333 - protein, 10 aa, Borrelia afzelii
LDIIEYLIKI

SEQ ID NO: 190334 - protein, 10 aa, Borrelia afzelii
DIIEYLIKIK

SEQ ID NO: 190335 - protein, 10 aa, Borrelia afzelii
IIEYLIKIKI

SEQ ID NO: 190336 - protein, 10 aa, Borrelia afzelii
IEYLIKIKIS

SEQ ID NO: 190337 - protein, 10 aa, Borrelia afzelii
EYLIKIKISA

SEQ ID NO: 190338 - protein, 10 aa, Borrelia afzelii
YLIKIKISAD

SEQ ID NO: 190339 - protein, 10 aa, Borrelia afzelii
LIKIKISADS

SEQ ID NO: 190340 - protein, 10 aa, Borrelia afzelii
IKIKISADSI

SEQ ID NO: 190341 - protein, 10 aa, Borrelia afzelii
KIKISADSIF

SEQ ID NO: 190342 - protein, 10 aa, Borrelia afzelii
IKISADSIFL

SEQ ID NO: 190343 - protein, 10 aa, Borrelia afzelii
KISADSIFLS

SEQ ID NO: 190344 - protein, 10 aa, Borrelia afzelii
ISADSIFLSE

SEQ ID NO: 190345 - protein, 10 aa, Borrelia afzelii
SADSIFLSED

SEQ ID NO: 190346 - protein, 10 aa, Borrelia afzelii
ADSIFLSEDM

SEQ ID NO: 190347 - protein, 10 aa, Borrelia afzelii
DSIFLSEDMI

SEQ ID NO: 190348 - protein, 10 aa, Borrelia afzelii
SIFLSEDMIR

SEQ ID NO: 190349 - protein, 10 aa, Borrelia afzelii
IFLSEDMIRL

SEQ ID NO: 190350 - protein, 10 aa, Borrelia afzelii
FLSEDMIRLI

SEQ ID NO: 190351 - protein, 10 aa, Borrelia afzelii
LSEDMIRLIG

SEQ ID NO: 190352 - protein, 10 aa, Borrelia afzelii
SEDMIRLIGG

SEQ ID NO: 190353 - protein, 10 aa, Borrelia afzelii
EDMIRLIGGY

SEQ ID NO: 190354 - protein, 10 aa, Borrelia afzelii
DMIRLIGGYP

SEQ ID NO: 190355 - protein, 10 aa, Borrelia afzelii
MIRLIGGYPD

SEQ ID NO: 190356 - protein, 10 aa, Borrelia afzelii
IRLIGGYPDL

SEQ ID NO: 190357 - protein, 10 aa, Borrelia afzelii
RLIGGYPDLI

SEQ ID NO: 190358 - protein, 10 aa, Borrelia afzelii
LIGGYPDLIF

SEQ ID NO: 190359 - protein, 10 aa, Borrelia afzelii
IGGYPDLIFN

SEQ ID NO: 190360 - protein, 10 aa, Borrelia afzelii
GGYPDLIFNY

SEQ ID NO: 190361 - protein, 10 aa, Borrelia afzelii
GYPDLIFNYL

SEQ ID NO: 190362 - protein, 10 aa, Borrelia afzelii
YPDLIFNYLI

SEQ ID NO: 190363 - protein, 10 aa, Borrelia afzelii
PDLIFNYLIQ

SEQ ID NO: 190364 - protein, 10 aa, Borrelia afzelii
DLIFNYLIQL

SEQ ID NO: 190365 - protein, 10 aa, Borrelia afzelii
LIFNYLIQLN

SEQ ID NO: 190366 - protein, 10 aa, Borrelia afzelii
IFNYLIQLNS

SEQ ID NO: 190367 - protein, 10 aa, Borrelia afzelii
FNYLIQLNSD

SEQ ID NO: 190368 - protein, 10 aa, Borrelia afzelii
NYLIQLNSDK

SEQ ID NO: 190369 - protein, 10 aa, Borrelia afzelii
YLIQLNSDKI

SEQ ID NO: 190370 - protein, 10 aa, Borrelia afzelii
LIQLNSDKID

SEQ ID NO: 190371 - protein, 10 aa, Borrelia afzelii
IQLNSDKIDY

SEQ ID NO: 190372 - protein, 10 aa, Borrelia afzelii
QLNSDKIDYA

SEQ ID NO: 190373 - protein, 10 aa, Borrelia afzelii
LNSDKIDYAE

SEQ ID NO: 190374 - protein, 10 aa, Borrelia afzelii
NSDKIDYAEK

SEQ ID NO: 190375 - protein, 10 aa, Borrelia afzelii
SDKIDYAEKY

SEQ ID NO: 190376 - protein, 10 aa, Borrelia afzelii
DKIDYAEKYG

SEQ ID NO: 190377 - protein, 10 aa, Borrelia afzelii
KIDYAEKYGD

SEQ ID NO: 190378 - protein, 10 aa, Borrelia afzelii
IDYAEKYGDN

SEQ ID NO: 190379 - protein, 10 aa, Borrelia afzelii
DYAEKYGDNA

SEQ ID NO: 190380 - protein, 10 aa, Borrelia afzelii
YAEKYGDNAR

SEQ ID NO: 190381 - protein, 10 aa, Borrelia afzelii
AEKYGDNARN

SEQ ID NO: 190382 - protein, 10 aa, Borrelia afzelii
EKYGDNARNN

SEQ ID NO: 190383 - protein, 10 aa, Borrelia afzelii
KYGDNARNNF

SEQ ID NO: 190384 - protein, 10 aa, Borrelia afzelii
YGDNARNNFK

SEQ ID NO: 190385 - protein, 10 aa, Borrelia afzelii
GDNARNNFKE

SEQ ID NO: 190386 - protein, 10 aa, Borrelia afzelii
DNARNNFKED

SEQ ID NO: 190387 - protein, 10 aa, Borrelia afzelii
NARNNFKEDY

SEQ ID NO: 190388 - protein, 10 aa, Borrelia afzelii
ARNNFKEDYS

SEQ ID NO: 190389 - protein, 10 aa, Borrelia afzelii
RNNFKEDYSK

SEQ ID NO: 190390 - protein, 10 aa, Borrelia afzelii
NNFKEDYSKD

SEQ ID NO: 190391 - protein, 10 aa, Borrelia afzelii
NFKEDYSKDK

SEQ ID NO: 190392 - protein, 10 aa, Borrelia afzelii
FKEDYSKDKT

SEQ ID NO: 190393 - protein, 10 aa, Borrelia afzelii
KEDYSKDKTN

SEQ ID NO: 190394 - protein, 10 aa, Borrelia afzelii
EDYSKDKTNT

SEQ ID NO: 190395 - protein, 10 aa, Borrelia afzelii
DYSKDKTNTV

SEQ ID NO: 190396 - protein, 10 aa, Borrelia afzelii
YSKDKTNTVK

SEQ ID NO: 190397 - protein, 10 aa, Borrelia afzelii
SKDKTNTVKQ

SEQ ID NO: 190398 - protein, 10 aa, Borrelia afzelii
KDKTNTVKQI

SEQ ID NO: 190399 - protein, 10 aa, Borrelia afzelii
DKTNTVKQIL

SEQ ID NO: 190400 - protein, 10 aa, Borrelia afzelii
KTNTVKQILK

SEQ ID NO: 190401 - protein, 10 aa, Borrelia afzelii
TNTVKQILKQ

SEQ ID NO: 190402 - protein, 10 aa, Borrelia afzelii
NTVKQILKQI

SEQ ID NO: 190403 - protein, 10 aa, Borrelia afzelii
TVKQILKQIL

SEQ ID NO: 190404 - protein, 10 aa, Borrelia afzelii
VKQILKQILA

SEQ ID NO: 190405 - protein, 10 aa, Borrelia afzelii
KQILKQILAD

SEQ ID NO: 190406 - protein, 10 aa, Borrelia afzelii
QILKQILADL

SEQ ID NO: 190407 - protein, 10 aa, Borrelia afzelii
ILKQILADLP

SEQ ID NO: 190408 - protein, 10 aa, Borrelia afzelii
LKQILADLPK

SEQ ID NO: 190409 - protein, 10 aa, Borrelia afzelii
KQILADLPKD

SEQ ID NO: 190410 - protein, 11 aa, Borrelia afzelii
MKKINLLIFLF

SEQ ID NO: 190411 - protein, 11 aa, Borrelia afzelii
KKINLLIFLFL

SEQ ID NO: 190412 - protein, 11 aa, Borrelia afzelii
KINLLIFLFLF

SEQ ID NO: 190413 - protein, 11 aa, Borrelia afzelii
INLLIFLFLFI

SEQ ID NO: 190414 - protein, 11 aa, Borrelia afzelii
NLLIFLFLFIL

SEQ ID NO: 190415 - protein, 11 aa, Borrelia afzelii
LLIFLFLFILS

SEQ ID NO: 190416 - protein, 11 aa, Borrelia afzelii
LIFLFLFILSL

SEQ ID NO: 190417 - protein, 11 aa, Borrelia afzelii
IFLFLFILSLS

SEQ ID NO: 190418 - protein, 11 aa, Borrelia afzelii
FLFLFILSLSA

SEQ ID NO: 190419 - protein, 11 aa, Borrelia afzelii
LFLFILSLSAN

SEQ ID NO: 190420 - protein, 11 aa, Borrelia afzelii
FLFILSLSANI

SEQ ID NO: 190421 - protein, 11 aa, Borrelia afzelii
LFILSLSANIE

SEQ ID NO: 190422 - protein, 11 aa, Borrelia afzelii
FILSLSANIEE

SEQ ID NO: 190423 - protein, 11 aa, Borrelia afzelii
ILSLSANIEEN

SEQ ID NO: 190424 - protein, 11 aa, Borrelia afzelii
LSLSANIEENY

SEQ ID NO: 190425 - protein, 11 aa, Borrelia afzelii
SLSANIEENYT

SEQ ID NO: 190426 - protein, 11 aa, Borrelia afzelii
LSANIEENYTE

SEQ ID NO: 190427 - protein, 11 aa, Borrelia afzelii
SANIEENYTET

SEQ ID NO: 190428 - protein, 11 aa, Borrelia afzelii
ANIEENYTETK

SEQ ID NO: 190429 - protein, 11 aa, Borrelia afzelii
NIEENYTETKR

SEQ ID NO: 190430 - protein, 11 aa, Borrelia afzelii
IEENYTETKRA

SEQ ID NO: 190431 - protein, 11 aa, Borrelia afzelii
EENYTETKRAF

SEQ ID NO: 190432 - protein, 11 aa, Borrelia afzelii
ENYTETKRAFS

SEQ ID NO: 190433 - protein, 11 aa, Borrelia afzelii
NYTETKRAFSE

SEQ ID NO: 190434 - protein, 11 aa, Borrelia afzelii
YTETKRAFSEE

SEQ ID NO: 190435 - protein, 11 aa, Borrelia afzelii
TETKRAFSEED

SEQ ID NO: 190436 - protein, 11 aa, Borrelia afzelii
ETKRAFSEEDF

SEQ ID NO: 190437 - protein, 11 aa, Borrelia afzelii
TKRAFSEEDFN

SEQ ID NO: 190438 - protein, 11 aa, Borrelia afzelii
KRAFSEEDFNL

SEQ ID NO: 190439 - protein, 11 aa, Borrelia afzelii
RAFSEEDFNLI

SEQ ID NO: 190440 - protein, 11 aa, Borrelia afzelii
AFSEEDFNLIN

SEQ ID NO: 190441 - protein, 11 aa, Borrelia afzelii
FSEEDFNLINK

SEQ ID NO: 190442 - protein, 11 aa, Borrelia afzelii
SEEDFNLINKR

SEQ ID NO: 190443 - protein, 11 aa, Borrelia afzelii
EEDFNLINKRL

SEQ ID NO: 190444 - protein, 11 aa, Borrelia afzelii
EDFNLINKRLD

SEQ ID NO: 190445 - protein, 11 aa, Borrelia afzelii
DFNLINKRLDN

SEQ ID NO: 190446 - protein, 11 aa, Borrelia afzelii
FNLINKRLDNY

SEQ ID NO: 190447 - protein, 11 aa, Borrelia afzelii
NLINKRLDNYD

SEQ ID NO: 190448 - protein, 11 aa, Borrelia afzelii
LINKRLDNYDF

SEQ ID NO: 190449 - protein, 11 aa, Borrelia afzelii
INKRLDNYDFK

SEQ ID NO: 190450 - protein, 11 aa, Borrelia afzelii
NKRLDNYDFKN

SEQ ID NO: 190451 - protein, 11 aa, Borrelia afzelii
KRLDNYDFKNE

SEQ ID NO: 190452 - protein, 11 aa, Borrelia afzelii
RLDNYDFKNEY

SEQ ID NO: 190453 - protein, 11 aa, Borrelia afzelii
LDNYDFKNEYE

SEQ ID NO: 190454 - protein, 11 aa, Borrelia afzelii
DNYDFKNEYEK

SEQ ID NO: 190455 - protein, 11 aa, Borrelia afzelii
NYDFKNEYEKS

SEQ ID NO: 190456 - protein, 11 aa, Borrelia afzelii
YDFKNEYEKSH

SEQ ID NO: 190457 - protein, 11 aa, Borrelia afzelii
DFKNEYEKSHV

SEQ ID NO: 190458 - protein, 11 aa, Borrelia afzelii
FKNEYEKSHVF

SEQ ID NO: 190459 - protein, 11 aa, Borrelia afzelii
KNEYEKSHVFS

SEQ ID NO: 190460 - protein, 11 aa, Borrelia afzelii
NEYEKSHVFSD

SEQ ID NO: 190461 - protein, 11 aa, Borrelia afzelii
EYEKSHVFSDA

SEQ ID NO: 190462 - protein, 11 aa, Borrelia afzelii
YEKSHVFSDAP

SEQ ID NO: 190463 - protein, 11 aa, Borrelia afzelii
EKSHVFSDAPR

SEQ ID NO: 190464 - protein, 11 aa, Borrelia afzelii
KSHVFSDAPRI

SEQ ID NO: 190465 - protein, 11 aa, Borrelia afzelii
SHVFSDAPRIR

SEQ ID NO: 190466 - protein, 11 aa, Borrelia afzelii
HVFSDAPRIRR

SEQ ID NO: 190467 - protein, 11 aa, Borrelia afzelii
VFSDAPRIRRD

SEQ ID NO: 190468 - protein, 11 aa, Borrelia afzelii
FSDAPRIRRDL

SEQ ID NO: 190469 - protein, 11 aa, Borrelia afzelii
SDAPRIRRDLR

SEQ ID NO: 190470 - protein, 11 aa, Borrelia afzelii
DAPRIRRDLRK

SEQ ID NO: 190471 - protein, 11 aa, Borrelia afzelii
APRIRRDLRKI

SEQ ID NO: 190472 - protein, 11 aa, Borrelia afzelii
PRIRRDLRKIG

SEQ ID NO: 190473 - protein, 11 aa, Borrelia afzelii
RIRRDLRKIGI

SEQ ID NO: 190474 - protein, 11 aa, Borrelia afzelii
IRRDLRKIGIK

SEQ ID NO: 190475 - protein, 11 aa, Borrelia afzelii
RRDLRKIGIKE

SEQ ID NO: 190476 - protein, 11 aa, Borrelia afzelii
RDLRKIGIKEK

SEQ ID NO: 190477 - protein, 11 aa, Borrelia afzelii
DLRKIGIKEKS

SEQ ID NO: 190478 - protein, 11 aa, Borrelia afzelii
LRKIGIKEKSV

SEQ ID NO: 190479 - protein, 11 aa, Borrelia afzelii
RKIGIKEKSVF

SEQ ID NO: 190480 - protein, 11 aa, Borrelia afzelii
KIGIKEKSVFL

SEQ ID NO: 190481 - protein, 11 aa, Borrelia afzelii
IGIKEKSVFLD

SEQ ID NO: 190482 - protein, 11 aa, Borrelia afzelii
GIKEKSVFLDA

SEQ ID NO: 190483 - protein, 11 aa, Borrelia afzelii
IKEKSVFLDAL

SEQ ID NO: 190484 - protein, 11 aa, Borrelia afzelii
KEKSVFLDALD

SEQ ID NO: 190485 - protein, 11 aa, Borrelia afzelii
EKSVFLDALDI

SEQ ID NO: 190486 - protein, 11 aa, Borrelia afzelii
KSVFLDALDII

SEQ ID NO: 190487 - protein, 11 aa, Borrelia afzelii
SVFLDALDIIE

SEQ ID NO: 190488 - protein, 11 aa, Borrelia afzelii
VFLDALDIIEY

SEQ ID NO: 190489 - protein, 11 aa, Borrelia afzelii
FLDALDIIEYL

SEQ ID NO: 190490 - protein, 11 aa, Borrelia afzelii
LDALDIIEYLI

SEQ ID NO: 190491 - protein, 11 aa, Borrelia afzelii
DALDIIEYLIK

SEQ ID NO: 190492 - protein, 11 aa, Borrelia afzelii
ALDIIEYLIKI

SEQ ID NO: 190493 - protein, 11 aa, Borrelia afzelii
LDIIEYLIKIK

SEQ ID NO: 190494 - protein, 11 aa, Borrelia afzelii
DIIEYLIKIKI

SEQ ID NO: 190495 - protein, 11 aa, Borrelia afzelii
IIEYLIKIKIS

SEQ ID NO: 190496 - protein, 11 aa, Borrelia afzelii
IEYLIKIKISA

SEQ ID NO: 190497 - protein, 11 aa, Borrelia afzelii
EYLIKIKISAD

SEQ ID NO: 190498 - protein, 11 aa, Borrelia afzelii
YLIKIKISADS

SEQ ID NO: 190499 - protein, 11 aa, Borrelia afzelii
LIKIKISADSI

SEQ ID NO: 190500 - protein, 11 aa, Borrelia afzelii
IKIKISADSIF

SEQ ID NO: 190501 - protein, 11 aa, Borrelia afzelii
KIKISADSIFL

SEQ ID NO: 190502 - protein, 11 aa, Borrelia afzelii
IKISADSIFLS

SEQ ID NO: 190503 - protein, 11 aa, Borrelia afzelii
KISADSIFLSE

SEQ ID NO: 190504 - protein, 11 aa, Borrelia afzelii
ISADSIFLSED

SEQ ID NO: 190505 - protein, 11 aa, Borrelia afzelii
SADSIFLSEDM

SEQ ID NO: 190506 - protein, 11 aa, Borrelia afzelii
ADSIFLSEDMI

SEQ ID NO: 190507 - protein, 11 aa, Borrelia afzelii
DSIFLSEDMIR

SEQ ID NO: 190508 - protein, 11 aa, Borrelia afzelii
SIFLSEDMIRL

SEQ ID NO: 190509 - protein, 11 aa, Borrelia afzelii
IFLSEDMIRLI

SEQ ID NO: 190510 - protein, 11 aa, Borrelia afzelii
FLSEDMIRLIG

SEQ ID NO: 190511 - protein, 11 aa, Borrelia afzelii
LSEDMIRLIGG

SEQ ID NO: 190512 - protein, 11 aa, Borrelia afzelii
SEDMIRLIGGY

SEQ ID NO: 190513 - protein, 11 aa, Borrelia afzelii
EDMIRLIGGYP

SEQ ID NO: 190514 - protein, 11 aa, Borrelia afzelii
DMIRLIGGYPD

SEQ ID NO: 190515 - protein, 11 aa, Borrelia afzelii
MIRLIGGYPDL

SEQ ID NO: 190516 - protein, 11 aa, Borrelia afzelii
IRLIGGYPDLI

SEQ ID NO: 190517 - protein, 11 aa, Borrelia afzelii
RLIGGYPDLIF

SEQ ID NO: 190518 - protein, 11 aa, Borrelia afzelii
LIGGYPDLIFN

SEQ ID NO: 190519 - protein, 11 aa, Borrelia afzelii
IGGYPDLIFNY

SEQ ID NO: 190520 - protein, 11 aa, Borrelia afzelii
GGYPDLIFNYL

SEQ ID NO: 190521 - protein, 11 aa, Borrelia afzelii
GYPDLIFNYLI

SEQ ID NO: 190522 - protein, 11 aa, Borrelia afzelii
YPDLIFNYLIQ

SEQ ID NO: 190523 - protein, 11 aa, Borrelia afzelii
PDLIFNYLIQL

SEQ ID NO: 190524 - protein, 11 aa, Borrelia afzelii
DLIFNYLIQLN

SEQ ID NO: 190525 - protein, 11 aa, Borrelia afzelii
LIFNYLIQLNS

SEQ ID NO: 190526 - protein, 11 aa, Borrelia afzelii
IFNYLIQLNSD

SEQ ID NO: 190527 - protein, 11 aa, Borrelia afzelii
FNYLIQLNSDK

SEQ ID NO: 190528 - protein, 11 aa, Borrelia afzelii
NYLIQLNSDKI

SEQ ID NO: 190529 - protein, 11 aa, Borrelia afzelii
YLIQLNSDKID

SEQ ID NO: 190530 - protein, 11 aa, Borrelia afzelii
LIQLNSDKIDY

SEQ ID NO: 190531 - protein, 11 aa, Borrelia afzelii
IQLNSDKIDYA

SEQ ID NO: 190532 - protein, 11 aa, Borrelia afzelii
QLNSDKIDYAE

SEQ ID NO: 190533 - protein, 11 aa, Borrelia afzelii
LNSDKIDYAEK

SEQ ID NO: 190534 - protein, 11 aa, Borrelia afzelii
NSDKIDYAEKY

SEQ ID NO: 190535 - protein, 11 aa, Borrelia afzelii
SDKIDYAEKYG

SEQ ID NO: 190536 - protein, 11 aa, Borrelia afzelii
DKIDYAEKYGD

SEQ ID NO: 190537 - protein, 11 aa, Borrelia afzelii
KIDYAEKYGDN

SEQ ID NO: 190538 - protein, 11 aa, Borrelia afzelii
IDYAEKYGDNA

SEQ ID NO: 190539 - protein, 11 aa, Borrelia afzelii
DYAEKYGDNAR

SEQ ID NO: 190540 - protein, 11 aa, Borrelia afzelii
YAEKYGDNARN

SEQ ID NO: 190541 - protein, 11 aa, Borrelia afzelii
AEKYGDNARNN

SEQ ID NO: 190542 - protein, 11 aa, Borrelia afzelii
EKYGDNARNNF

SEQ ID NO: 190543 - protein, 11 aa, Borrelia afzelii
KYGDNARNNFK

SEQ ID NO: 190544 - protein, 11 aa, Borrelia afzelii
YGDNARNNFKE

SEQ ID NO: 190545 - protein, 11 aa, Borrelia afzelii
GDNARNNFKED

SEQ ID NO: 190546 - protein, 11 aa, Borrelia afzelii
DNARNNFKEDY

SEQ ID NO: 190547 - protein, 11 aa, Borrelia afzelii
NARNNFKEDYS

SEQ ID NO: 190548 - protein, 11 aa, Borrelia afzelii
ARNNFKEDYSK

SEQ ID NO: 190549 - protein, 11 aa, Borrelia afzelii
RNNFKEDYSKD

SEQ ID NO: 190550 - protein, 11 aa, Borrelia afzelii
NNFKEDYSKDK

SEQ ID NO: 190551 - protein, 11 aa, Borrelia afzelii
NFKEDYSKDKT

SEQ ID NO: 190552 - protein, 11 aa, Borrelia afzelii
FKEDYSKDKTN

SEQ ID NO: 190553 - protein, 11 aa, Borrelia afzelii
KEDYSKDKTNT

SEQ ID NO: 190554 - protein, 11 aa, Borrelia afzelii
EDYSKDKTNTV

SEQ ID NO: 190555 - protein, 11 aa, Borrelia afzelii
DYSKDKTNTVK

SEQ ID NO: 190556 - protein, 11 aa, Borrelia afzelii
YSKDKTNTVKQ

SEQ ID NO: 190557 - protein, 11 aa, Borrelia afzelii
SKDKTNTVKQI

SEQ ID NO: 190558 - protein, 11 aa, Borrelia afzelii
KDKTNTVKQIL

SEQ ID NO: 190559 - protein, 11 aa, Borrelia afzelii
DKTNTVKQILK

SEQ ID NO: 190560 - protein, 11 aa, Borrelia afzelii
KTNTVKQILKQ

SEQ ID NO: 190561 - protein, 11 aa, Borrelia afzelii
TNTVKQILKQI

SEQ ID NO: 190562 - protein, 11 aa, Borrelia afzelii
NTVKQILKQIL

SEQ ID NO: 190563 - protein, 11 aa, Borrelia afzelii
TVKQILKQILA

SEQ ID NO: 190564 - protein, 11 aa, Borrelia afzelii
VKQILKQILAD

SEQ ID NO: 190565 - protein, 11 aa, Borrelia afzelii
KQILKQILADL

SEQ ID NO: 190566 - protein, 11 aa, Borrelia afzelii
QILKQILADLP

SEQ ID NO: 190567 - protein, 11 aa, Borrelia afzelii
ILKQILADLPK

SEQ ID NO: 190568 - protein, 11 aa, Borrelia afzelii
LKQILADLPKD

SEQ ID NO: 190569 - protein, 13 aa, Borrelia afzelii
MKKINLLIFLFLF

SEQ ID NO: 190570 - protein, 13 aa, Borrelia afzelii
KKINLLIFLFLFI

SEQ ID NO: 190571 - protein, 13 aa, Borrelia afzelii
KINLLIFLFLFIL

SEQ ID NO: 190572 - protein, 13 aa, Borrelia afzelii
INLLIFLFLFILS

SEQ ID NO: 190573 - protein, 13 aa, Borrelia afzelii
NLLIFLFLFILSL

SEQ ID NO: 190574 - protein, 13 aa, Borrelia afzelii
LLIFLFLFILSLS

SEQ ID NO: 190575 - protein, 13 aa, Borrelia afzelii
LIFLFLFILSLSA

SEQ ID NO: 190576 - protein, 13 aa, Borrelia afzelii
IFLFLFILSLSAN

SEQ ID NO: 190577 - protein, 13 aa, Borrelia afzelii
FLFLFILSLSANI

SEQ ID NO: 190578 - protein, 13 aa, Borrelia afzelii
LFLFILSLSANIE

SEQ ID NO: 190579 - protein, 13 aa, Borrelia afzelii
FLFILSLSANIEE

SEQ ID NO: 190580 - protein, 13 aa, Borrelia afzelii
LFILSLSANIEEN

SEQ ID NO: 190581 - protein, 13 aa, Borrelia afzelii
FILSLSANIEENY

SEQ ID NO: 190582 - protein, 13 aa, Borrelia afzelii
ILSLSANIEENYT

SEQ ID NO: 190583 - protein, 13 aa, Borrelia afzelii
LSLSANIEENYTE

SEQ ID NO: 190584 - protein, 13 aa, Borrelia afzelii
SLSANIEENYTET

SEQ ID NO: 190585 - protein, 13 aa, Borrelia afzelii
LSANIEENYTETK

SEQ ID NO: 190586 - protein, 13 aa, Borrelia afzelii
SANIEENYTETKR

SEQ ID NO: 190587 - protein, 13 aa, Borrelia afzelii
ANIEENYTETKRA

SEQ ID NO: 190588 - protein, 13 aa, Borrelia afzelii
NIEENYTETKRAF

SEQ ID NO: 190589 - protein, 13 aa, Borrelia afzelii
IEENYTETKRAFS

SEQ ID NO: 190590 - protein, 13 aa, Borrelia afzelii
EENYTETKRAFSE

SEQ ID NO: 190591 - protein, 13 aa, Borrelia afzelii
ENYTETKRAFSEE

SEQ ID NO: 190592 - protein, 13 aa, Borrelia afzelii
NYTETKRAFSEED

SEQ ID NO: 190593 - protein, 13 aa, Borrelia afzelii
YTETKRAFSEEDF

SEQ ID NO: 190594 - protein, 13 aa, Borrelia afzelii
TETKRAFSEEDFN

SEQ ID NO: 190595 - protein, 13 aa, Borrelia afzelii
ETKRAFSEEDFNL

SEQ ID NO: 190596 - protein, 13 aa, Borrelia afzelii
TKRAFSEEDFNLI

SEQ ID NO: 190597 - protein, 13 aa, Borrelia afzelii
KRAFSEEDFNLIN

SEQ ID NO: 190598 - protein, 13 aa, Borrelia afzelii
RAFSEEDFNLINK

SEQ ID NO: 190599 - protein, 13 aa, Borrelia afzelii
AFSEEDFNLINKR

SEQ ID NO: 190600 - protein, 13 aa, Borrelia afzelii
FSEEDFNLINKRL

SEQ ID NO: 190601 - protein, 13 aa, Borrelia afzelii
SEEDFNLINKRLD

SEQ ID NO: 190602 - protein, 13 aa, Borrelia afzelii
EEDFNLINKRLDN

SEQ ID NO: 190603 - protein, 13 aa, Borrelia afzelii
EDFNLINKRLDNY

SEQ ID NO: 190604 - protein, 13 aa, Borrelia afzelii
DFNLINKRLDNYD

SEQ ID NO: 190605 - protein, 13 aa, Borrelia afzelii
FNLINKRLDNYDF

SEQ ID NO: 190606 - protein, 13 aa, Borrelia afzelii
NLINKRLDNYDFK

SEQ ID NO: 190607 - protein, 13 aa, Borrelia afzelii
LINKRLDNYDFKN

SEQ ID NO: 190608 - protein, 13 aa, Borrelia afzelii
INKRLDNYDFKNE

SEQ ID NO: 190609 - protein, 13 aa, Borrelia afzelii
NKRLDNYDFKNEY

SEQ ID NO: 190610 - protein, 13 aa, Borrelia afzelii
KRLDNYDFKNEYE

SEQ ID NO: 190611 - protein, 13 aa, Borrelia afzelii
RLDNYDFKNEYEK

SEQ ID NO: 190612 - protein, 13 aa, Borrelia afzelii
LDNYDFKNEYEKS

SEQ ID NO: 190613 - protein, 13 aa, Borrelia afzelii
DNYDFKNEYEKSH

SEQ ID NO: 190614 - protein, 13 aa, Borrelia afzelii
NYDFKNEYEKSHV

SEQ ID NO: 190615 - protein, 13 aa, Borrelia afzelii
YDFKNEYEKSHVF

SEQ ID NO: 190616 - protein, 13 aa, Borrelia afzelii
DFKNEYEKSHVFS

SEQ ID NO: 190617 - protein, 13 aa, Borrelia afzelii
FKNEYEKSHVFSD

SEQ ID NO: 190618 - protein, 13 aa, Borrelia afzelii
KNEYEKSHVFSDA

SEQ ID NO: 190619 - protein, 13 aa, Borrelia afzelii
NEYEKSHVFSDAP

SEQ ID NO: 190620 - protein, 13 aa, Borrelia afzelii
EYEKSHVFSDAPR

SEQ ID NO: 190621 - protein, 13 aa, Borrelia afzelii
YEKSHVFSDAPRI

SEQ ID NO: 190622 - protein, 13 aa, Borrelia afzelii
EKSHVFSDAPRIR

SEQ ID NO: 190623 - protein, 13 aa, Borrelia afzelii
KSHVFSDAPRIRR

SEQ ID NO: 190624 - protein, 13 aa, Borrelia afzelii
SHVFSDAPRIRRD

SEQ ID NO: 190625 - protein, 13 aa, Borrelia afzelii
HVFSDAPRIRRDL

SEQ ID NO: 190626 - protein, 13 aa, Borrelia afzelii
VFSDAPRIRRDLR

SEQ ID NO: 190627 - protein, 13 aa, Borrelia afzelii
FSDAPRIRRDLRK

SEQ ID NO: 190628 - protein, 13 aa, Borrelia afzelii
SDAPRIRRDLRKI

SEQ ID NO: 190629 - protein, 13 aa, Borrelia afzelii
DAPRIRRDLRKIG

SEQ ID NO: 190630 - protein, 13 aa, Borrelia afzelii
APRIRRDLRKIGI

SEQ ID NO: 190631 - protein, 13 aa, Borrelia afzelii
PRIRRDLRKIGIK

SEQ ID NO: 190632 - protein, 13 aa, Borrelia afzelii
RIRRDLRKIGIKE

SEQ ID NO: 190633 - protein, 13 aa, Borrelia afzelii
IRRDLRKIGIKEK

SEQ ID NO: 190634 - protein, 13 aa, Borrelia afzelii
RRDLRKIGIKEKS

SEQ ID NO: 190635 - protein, 13 aa, Borrelia afzelii
RDLRKIGIKEKSV

SEQ ID NO: 190636 - protein, 13 aa, Borrelia afzelii
DLRKIGIKEKSVF

SEQ ID NO: 190637 - protein, 13 aa, Borrelia afzelii
LRKIGIKEKSVFL

SEQ ID NO: 190638 - protein, 13 aa, Borrelia afzelii
RKIGIKEKSVFLD

SEQ ID NO: 190639 - protein, 13 aa, Borrelia afzelii
KIGIKEKSVFLDA

SEQ ID NO: 190640 - protein, 13 aa, Borrelia afzelii
IGIKEKSVFLDAL

SEQ ID NO: 190641 - protein, 13 aa, Borrelia afzelii
GIKEKSVFLDALD

SEQ ID NO: 190642 - protein, 13 aa, Borrelia afzelii
IKEKSVFLDALDI

SEQ ID NO: 190643 - protein, 13 aa, Borrelia afzelii
KEKSVFLDALDII

SEQ ID NO: 190644 - protein, 13 aa, Borrelia afzelii
EKSVFLDALDIIE

SEQ ID NO: 190645 - protein, 13 aa, Borrelia afzelii
KSVFLDALDIIEY

SEQ ID NO: 190646 - protein, 13 aa, Borrelia afzelii
SVFLDALDIIEYL

SEQ ID NO: 190647 - protein, 13 aa, Borrelia afzelii
VFLDALDIIEYLI

SEQ ID NO: 190648 - protein, 13 aa, Borrelia afzelii
FLDALDIIEYLIK

SEQ ID NO: 190649 - protein, 13 aa, Borrelia afzelii
LDALDIIEYLIKI

SEQ ID NO: 190650 - protein, 13 aa, Borrelia afzelii
DALDIIEYLIKIK

SEQ ID NO: 190651 - protein, 13 aa, Borrelia afzelii
ALDIIEYLIKIKI

SEQ ID NO: 190652 - protein, 13 aa, Borrelia afzelii
LDIIEYLIKIKIS

SEQ ID NO: 190653 - protein, 13 aa, Borrelia afzelii
DIIEYLIKIKISA

SEQ ID NO: 190654 - protein, 13 aa, Borrelia afzelii
IIEYLIKIKISAD

SEQ ID NO: 190655 - protein, 13 aa, Borrelia afzelii
IEYLIKIKISADS

SEQ ID NO: 190656 - protein, 13 aa, Borrelia afzelii
EYLIKIKISADSI

SEQ ID NO: 190657 - protein, 13 aa, Borrelia afzelii
YLIKIKISADSIF

SEQ ID NO: 190658 - protein, 13 aa, Borrelia afzelii
LIKIKISADSIFL

SEQ ID NO: 190659 - protein, 13 aa, Borrelia afzelii
IKIKISADSIFLS

SEQ ID NO: 190660 - protein, 13 aa, Borrelia afzelii
KIKISADSIFLSE

SEQ ID NO: 190661 - protein, 13 aa, Borrelia afzelii
IKISADSIFLSED

SEQ ID NO: 190662 - protein, 13 aa, Borrelia afzelii
KISADSIFLSEDM

SEQ ID NO: 190663 - protein, 13 aa, Borrelia afzelii
ISADSIFLSEDMI

SEQ ID NO: 190664 - protein, 13 aa, Borrelia afzelii
SADSIFLSEDMIR

SEQ ID NO: 190665 - protein, 13 aa, Borrelia afzelii
ADSIFLSEDMIRL

SEQ ID NO: 190666 - protein, 13 aa, Borrelia afzelii
DSIFLSEDMIRLI

SEQ ID NO: 190667 - protein, 13 aa, Borrelia afzelii
SIFLSEDMIRLIG

SEQ ID NO: 190668 - protein, 13 aa, Borrelia afzelii
IFLSEDMIRLIGG

SEQ ID NO: 190669 - protein, 13 aa, Borrelia afzelii
FLSEDMIRLIGGY

SEQ ID NO: 190670 - protein, 13 aa, Borrelia afzelii
LSEDMIRLIGGYP

SEQ ID NO: 190671 - protein, 13 aa, Borrelia afzelii
SEDMIRLIGGYPD

SEQ ID NO: 190672 - protein, 13 aa, Borrelia afzelii
EDMIRLIGGYPDL

SEQ ID NO: 190673 - protein, 13 aa, Borrelia afzelii
DMIRLIGGYPDLI

SEQ ID NO: 190674 - protein, 13 aa, Borrelia afzelii
MIRLIGGYPDLIF

SEQ ID NO: 190675 - protein, 13 aa, Borrelia afzelii
IRLIGGYPDLIFN

SEQ ID NO: 190676 - protein, 13 aa, Borrelia afzelii
RLIGGYPDLIFNY

SEQ ID NO: 190677 - protein, 13 aa, Borrelia afzelii
LIGGYPDLIFNYL

SEQ ID NO: 190678 - protein, 13 aa, Borrelia afzelii
IGGYPDLIFNYLI

SEQ ID NO: 190679 - protein, 13 aa, Borrelia afzelii
GGYPDLIFNYLIQ

SEQ ID NO: 190680 - protein, 13 aa, Borrelia afzelii
GYPDLIFNYLIQL

SEQ ID NO: 190681 - protein, 13 aa, Borrelia afzelii
YPDLIFNYLIQLN

SEQ ID NO: 190682 - protein, 13 aa, Borrelia afzelii
PDLIFNYLIQLNS

SEQ ID NO: 190683 - protein, 13 aa, Borrelia afzelii
DLIFNYLIQLNSD

SEQ ID NO: 190684 - protein, 13 aa, Borrelia afzelii
LIFNYLIQLNSDK

SEQ ID NO: 190685 - protein, 13 aa, Borrelia afzelii
IFNYLIQLNSDKI

SEQ ID NO: 190686 - protein, 13 aa, Borrelia afzelii
FNYLIQLNSDKID

SEQ ID NO: 190687 - protein, 13 aa, Borrelia afzelii
NYLIQLNSDKIDY

SEQ ID NO: 190688 - protein, 13 aa, Borrelia afzelii
YLIQLNSDKIDYA

SEQ ID NO: 190689 - protein, 13 aa, Borrelia afzelii
LIQLNSDKIDYAE

SEQ ID NO: 190690 - protein, 13 aa, Borrelia afzelii
IQLNSDKIDYAEK

SEQ ID NO: 190691 - protein, 13 aa, Borrelia afzelii
QLNSDKIDYAEKY

SEQ ID NO: 190692 - protein, 13 aa, Borrelia afzelii
LNSDKIDYAEKYG

SEQ ID NO: 190693 - protein, 13 aa, Borrelia afzelii
NSDKIDYAEKYGD

SEQ ID NO: 190694 - protein, 13 aa, Borrelia afzelii
SDKIDYAEKYGDN

SEQ ID NO: 190695 - protein, 13 aa, Borrelia afzelii
DKIDYAEKYGDNA

SEQ ID NO: 190696 - protein, 13 aa, Borrelia afzelii
KIDYAEKYGDNAR

SEQ ID NO: 190697 - protein, 13 aa, Borrelia afzelii
IDYAEKYGDNARN

SEQ ID NO: 190698 - protein, 13 aa, Borrelia afzelii
DYAEKYGDNARNN

SEQ ID NO: 190699 - protein, 13 aa, Borrelia afzelii
YAEKYGDNARNNF

SEQ ID NO: 190700 - protein, 13 aa, Borrelia afzelii
AEKYGDNARNNFK

SEQ ID NO: 190701 - protein, 13 aa, Borrelia afzelii
EKYGDNARNNFKE

SEQ ID NO: 190702 - protein, 13 aa, Borrelia afzelii
KYGDNARNNFKED

SEQ ID NO: 190703 - protein, 13 aa, Borrelia afzelii
YGDNARNNFKEDY

SEQ ID NO: 190704 - protein, 13 aa, Borrelia afzelii
GDNARNNFKEDYS

SEQ ID NO: 190705 - protein, 13 aa, Borrelia afzelii
DNARNNFKEDYSK

SEQ ID NO: 190706 - protein, 13 aa, Borrelia afzelii
NARNNFKEDYSKD

SEQ ID NO: 190707 - protein, 13 aa, Borrelia afzelii
ARNNFKEDYSKDK

SEQ ID NO: 190708 - protein, 13 aa, Borrelia afzelii
RNNFKEDYSKDKT

SEQ ID NO: 190709 - protein, 13 aa, Borrelia afzelii
NNFKEDYSKDKTN

SEQ ID NO: 190710 - protein, 13 aa, Borrelia afzelii
NFKEDYSKDKTNT

SEQ ID NO: 190711 - protein, 13 aa, Borrelia afzelii
FKEDYSKDKTNTV

SEQ ID NO: 190712 - protein, 13 aa, Borrelia afzelii
KEDYSKDKTNTVK

SEQ ID NO: 190713 - protein, 13 aa, Borrelia afzelii
EDYSKDKTNTVKQ

SEQ ID NO: 190714 - protein, 13 aa, Borrelia afzelii
DYSKDKTNTVKQI

SEQ ID NO: 190715 - protein, 13 aa, Borrelia afzelii
YSKDKTNTVKQIL

SEQ ID NO: 190716 - protein, 13 aa, Borrelia afzelii
SKDKTNTVKQILK

SEQ ID NO: 190717 - protein, 13 aa, Borrelia afzelii
KDKTNTVKQILKQ

SEQ ID NO: 190718 - protein, 13 aa, Borrelia afzelii
DKTNTVKQILKQI

SEQ ID NO: 190719 - protein, 13 aa, Borrelia afzelii
KTNTVKQILKQIL

SEQ ID NO: 190720 - protein, 13 aa, Borrelia afzelii
TNTVKQILKQILA

SEQ ID NO: 190721 - protein, 13 aa, Borrelia afzelii
NTVKQILKQILAD

SEQ ID NO: 190722 - protein, 13 aa, Borrelia afzelii
TVKQILKQILADL

SEQ ID NO: 190723 - protein, 13 aa, Borrelia afzelii
VKQILKQILADLP

SEQ ID NO: 190724 - protein, 13 aa, Borrelia afzelii
KQILKQILADLPK

SEQ ID NO: 190725 - protein, 13 aa, Borrelia afzelii
QILKQILADLPKD

SEQ ID NO: 190726 - protein, 14 aa, Borrelia afzelii
MKKINLLIFLFLFI

SEQ ID NO: 190727 - protein, 14 aa, Borrelia afzelii
KKINLLIFLFLFIL

SEQ ID NO: 190728 - protein, 14 aa, Borrelia afzelii
KINLLIFLFLFILS

SEQ ID NO: 190729 - protein, 14 aa, Borrelia afzelii
INLLIFLFLFILSL

SEQ ID NO: 190730 - protein, 14 aa, Borrelia afzelii
NLLIFLFLFILSLS

SEQ ID NO: 190731 - protein, 14 aa, Borrelia afzelii
LLIFLFLFILSLSA

SEQ ID NO: 190732 - protein, 14 aa, Borrelia afzelii
LIFLFLFILSLSAN

SEQ ID NO: 190733 - protein, 14 aa, Borrelia afzelii
IFLFLFILSLSANI

SEQ ID NO: 190734 - protein, 14 aa, Borrelia afzelii
FLFLFILSLSANIE

SEQ ID NO: 190735 - protein, 14 aa, Borrelia afzelii
LFLFILSLSANIEE

SEQ ID NO: 190736 - protein, 14 aa, Borrelia afzelii
FLFILSLSANIEEN

SEQ ID NO: 190737 - protein, 14 aa, Borrelia afzelii
LFILSLSANIEENY

SEQ ID NO: 190738 - protein, 14 aa, Borrelia afzelii
FILSLSANIEENYT

SEQ ID NO: 190739 - protein, 14 aa, Borrelia afzelii
ILSLSANIEENYTE

SEQ ID NO: 190740 - protein, 14 aa, Borrelia afzelii
LSLSANIEENYTET

SEQ ID NO: 190741 - protein, 14 aa, Borrelia afzelii
SLSANIEENYTETK

SEQ ID NO: 190742 - protein, 14 aa, Borrelia afzelii
LSANIEENYTETKR

SEQ ID NO: 190743 - protein, 14 aa, Borrelia afzelii
SANIEENYTETKRA

SEQ ID NO: 190744 - protein, 14 aa, Borrelia afzelii
ANIEENYTETKRAF

SEQ ID NO: 190745 - protein, 14 aa, Borrelia afzelii
NIEENYTETKRAFS

SEQ ID NO: 190746 - protein, 14 aa, Borrelia afzelii
IEENYTETKRAFSE

SEQ ID NO: 190747 - protein, 14 aa, Borrelia afzelii
EENYTETKRAFSEE

SEQ ID NO: 190748 - protein, 14 aa, Borrelia afzelii
ENYTETKRAFSEED

SEQ ID NO: 190749 - protein, 14 aa, Borrelia afzelii
NYTETKRAFSEEDF

SEQ ID NO: 190750 - protein, 14 aa, Borrelia afzelii
YTETKRAFSEEDFN

SEQ ID NO: 190751 - protein, 14 aa, Borrelia afzelii
TETKRAFSEEDFNL

SEQ ID NO: 190752 - protein, 14 aa, Borrelia afzelii
ETKRAFSEEDFNLI

SEQ ID NO: 190753 - protein, 14 aa, Borrelia afzelii
TKRAFSEEDFNLIN

SEQ ID NO: 190754 - protein, 14 aa, Borrelia afzelii
KRAFSEEDFNLINK

SEQ ID NO: 190755 - protein, 14 aa, Borrelia afzelii
RAFSEEDFNLINKR

SEQ ID NO: 190756 - protein, 14 aa, Borrelia afzelii
AFSEEDFNLINKRL

SEQ ID NO: 190757 - protein, 14 aa, Borrelia afzelii
FSEEDFNLINKRLD

SEQ ID NO: 190758 - protein, 14 aa, Borrelia afzelii
SEEDFNLINKRLDN

SEQ ID NO: 190759 - protein, 14 aa, Borrelia afzelii
EEDFNLINKRLDNY

SEQ ID NO: 190760 - protein, 14 aa, Borrelia afzelii
EDFNLINKRLDNYD

SEQ ID NO: 190761 - protein, 14 aa, Borrelia afzelii
DFNLINKRLDNYDF

SEQ ID NO: 190762 - protein, 14 aa, Borrelia afzelii
FNLINKRLDNYDFK

SEQ ID NO: 190763 - protein, 14 aa, Borrelia afzelii
NLINKRLDNYDFKN

SEQ ID NO: 190764 - protein, 14 aa, Borrelia afzelii
LINKRLDNYDFKNE

SEQ ID NO: 190765 - protein, 14 aa, Borrelia afzelii
INKRLDNYDFKNEY

SEQ ID NO: 190766 - protein, 14 aa, Borrelia afzelii
NKRLDNYDFKNEYE

SEQ ID NO: 190767 - protein, 14 aa, Borrelia afzelii
KRLDNYDFKNEYEK

SEQ ID NO: 190768 - protein, 14 aa, Borrelia afzelii
RLDNYDFKNEYEKS

SEQ ID NO: 190769 - protein, 14 aa, Borrelia afzelii
LDNYDFKNEYEKSH

SEQ ID NO: 190770 - protein, 14 aa, Borrelia afzelii
DNYDFKNEYEKSHV

SEQ ID NO: 190771 - protein, 14 aa, Borrelia afzelii
NYDFKNEYEKSHVF

SEQ ID NO: 190772 - protein, 14 aa, Borrelia afzelii
YDFKNEYEKSHVFS

SEQ ID NO: 190773 - protein, 14 aa, Borrelia afzelii
DFKNEYEKSHVFSD

SEQ ID NO: 190774 - protein, 14 aa, Borrelia afzelii
FKNEYEKSHVFSDA

SEQ ID NO: 190775 - protein, 14 aa, Borrelia afzelii
KNEYEKSHVFSDAP

SEQ ID NO: 190776 - protein, 14 aa, Borrelia afzelii
NEYEKSHVFSDAPR

SEQ ID NO: 190777 - protein, 14 aa, Borrelia afzelii
EYEKSHVFSDAPRI

SEQ ID NO: 190778 - protein, 14 aa, Borrelia afzelii
YEKSHVFSDAPRIR

SEQ ID NO: 190779 - protein, 14 aa, Borrelia afzelii
EKSHVFSDAPRIRR

SEQ ID NO: 190780 - protein, 14 aa, Borrelia afzelii
KSHVFSDAPRIRRD

SEQ ID NO: 190781 - protein, 14 aa, Borrelia afzelii
SHVFSDAPRIRRDL

SEQ ID NO: 190782 - protein, 14 aa, Borrelia afzelii
HVFSDAPRIRRDLR

SEQ ID NO: 190783 - protein, 14 aa, Borrelia afzelii
VFSDAPRIRRDLRK

SEQ ID NO: 190784 - protein, 14 aa, Borrelia afzelii
FSDAPRIRRDLRKI

SEQ ID NO: 190785 - protein, 14 aa, Borrelia afzelii
SDAPRIRRDLRKIG

SEQ ID NO: 190786 - protein, 14 aa, Borrelia afzelii
DAPRIRRDLRKIGI

SEQ ID NO: 190787 - protein, 14 aa, Borrelia afzelii
APRIRRDLRKIGIK

SEQ ID NO: 190788 - protein, 14 aa, Borrelia afzelii
PRIRRDLRKIGIKE

SEQ ID NO: 190789 - protein, 14 aa, Borrelia afzelii
RIRRDLRKIGIKEK

SEQ ID NO: 190790 - protein, 14 aa, Borrelia afzelii
IRRDLRKIGIKEKS

SEQ ID NO: 190791 - protein, 14 aa, Borrelia afzelii
RRDLRKIGIKEKSV

SEQ ID NO: 190792 - protein, 14 aa, Borrelia afzelii
RDLRKIGIKEKSVF

SEQ ID NO: 190793 - protein, 14 aa, Borrelia afzelii
DLRKIGIKEKSVFL

SEQ ID NO: 190794 - protein, 14 aa, Borrelia afzelii
LRKIGIKEKSVFLD

SEQ ID NO: 190795 - protein, 14 aa, Borrelia afzelii
RKIGIKEKSVFLDA

SEQ ID NO: 190796 - protein, 14 aa, Borrelia afzelii
KIGIKEKSVFLDAL

SEQ ID NO: 190797 - protein, 14 aa, Borrelia afzelii
IGIKEKSVFLDALD

SEQ ID NO: 190798 - protein, 14 aa, Borrelia afzelii
GIKEKSVFLDALDI

SEQ ID NO: 190799 - protein, 14 aa, Borrelia afzelii
IKEKSVFLDALDII

SEQ ID NO: 190800 - protein, 14 aa, Borrelia afzelii
KEKSVFLDALDIIE

SEQ ID NO: 190801 - protein, 14 aa, Borrelia afzelii
EKSVFLDALDIIEY

SEQ ID NO: 190802 - protein, 14 aa, Borrelia afzelii
KSVFLDALDIIEYL

SEQ ID NO: 190803 - protein, 14 aa, Borrelia afzelii
SVFLDALDIIEYLI

SEQ ID NO: 190804 - protein, 14 aa, Borrelia afzelii
VFLDALDIIEYLIK

SEQ ID NO: 190805 - protein, 14 aa, Borrelia afzelii
FLDALDIIEYLIKI

SEQ ID NO: 190806 - protein, 14 aa, Borrelia afzelii
LDALDIIEYLIKIK

SEQ ID NO: 190807 - protein, 14 aa, Borrelia afzelii
DALDIIEYLIKIKI

SEQ ID NO: 190808 - protein, 14 aa, Borrelia afzelii
ALDIIEYLIKIKIS

SEQ ID NO: 190809 - protein, 14 aa, Borrelia afzelii
LDIIEYLIKIKISA

SEQ ID NO: 190810 - protein, 14 aa, Borrelia afzelii
DIIEYLIKIKISAD

SEQ ID NO: 190811 - protein, 14 aa, Borrelia afzelii
IIEYLIKIKISADS

SEQ ID NO: 190812 - protein, 14 aa, Borrelia afzelii
IEYLIKIKISADSI

SEQ ID NO: 190813 - protein, 14 aa, Borrelia afzelii
EYLIKIKISADSIF

SEQ ID NO: 190814 - protein, 14 aa, Borrelia afzelii
YLIKIKISADSIFL

SEQ ID NO: 190815 - protein, 14 aa, Borrelia afzelii
LIKIKISADSIFLS

SEQ ID NO: 190816 - protein, 14 aa, Borrelia afzelii
IKIKISADSIFLSE

SEQ ID NO: 190817 - protein, 14 aa, Borrelia afzelii
KIKISADSIFLSED

SEQ ID NO: 190818 - protein, 14 aa, Borrelia afzelii
IKISADSIFLSEDM

SEQ ID NO: 190819 - protein, 14 aa, Borrelia afzelii
KISADSIFLSEDMI

SEQ ID NO: 190820 - protein, 14 aa, Borrelia afzelii
ISADSIFLSEDMIR

SEQ ID NO: 190821 - protein, 14 aa, Borrelia afzelii
SADSIFLSEDMIRL

SEQ ID NO: 190822 - protein, 14 aa, Borrelia afzelii
ADSIFLSEDMIRLI

SEQ ID NO: 190823 - protein, 14 aa, Borrelia afzelii
DSIFLSEDMIRLIG

SEQ ID NO: 190824 - protein, 14 aa, Borrelia afzelii
SIFLSEDMIRLIGG

SEQ ID NO: 190825 - protein, 14 aa, Borrelia afzelii
IFLSEDMIRLIGGY

SEQ ID NO: 190826 - protein, 14 aa, Borrelia afzelii
FLSEDMIRLIGGYP

SEQ ID NO: 190827 - protein, 14 aa, Borrelia afzelii
LSEDMIRLIGGYPD

SEQ ID NO: 190828 - protein, 14 aa, Borrelia afzelii
SEDMIRLIGGYPDL

SEQ ID NO: 190829 - protein, 14 aa, Borrelia afzelii
EDMIRLIGGYPDLI

SEQ ID NO: 190830 - protein, 14 aa, Borrelia afzelii
DMIRLIGGYPDLIF

SEQ ID NO: 190831 - protein, 14 aa, Borrelia afzelii
MIRLIGGYPDLIFN

SEQ ID NO: 190832 - protein, 14 aa, Borrelia afzelii
IRLIGGYPDLIFNY

SEQ ID NO: 190833 - protein, 14 aa, Borrelia afzelii
RLIGGYPDLIFNYL

SEQ ID NO: 190834 - protein, 14 aa, Borrelia afzelii
LIGGYPDLIFNYLI

SEQ ID NO: 190835 - protein, 14 aa, Borrelia afzelii
IGGYPDLIFNYLIQ

SEQ ID NO: 190836 - protein, 14 aa, Borrelia afzelii
GGYPDLIFNYLIQL

SEQ ID NO: 190837 - protein, 14 aa, Borrelia afzelii
GYPDLIFNYLIQLN

SEQ ID NO: 190838 - protein, 14 aa, Borrelia afzelii
YPDLIFNYLIQLNS

SEQ ID NO: 190839 - protein, 14 aa, Borrelia afzelii
PDLIFNYLIQLNSD

SEQ ID NO: 190840 - protein, 14 aa, Borrelia afzelii
DLIFNYLIQLNSDK

SEQ ID NO: 190841 - protein, 14 aa, Borrelia afzelii
LIFNYLIQLNSDKI

SEQ ID NO: 190842 - protein, 14 aa, Borrelia afzelii
IFNYLIQLNSDKID

SEQ ID NO: 190843 - protein, 14 aa, Borrelia afzelii
FNYLIQLNSDKIDY

SEQ ID NO: 190844 - protein, 14 aa, Borrelia afzelii
NYLIQLNSDKIDYA

SEQ ID NO: 190845 - protein, 14 aa, Borrelia afzelii
YLIQLNSDKIDYAE

SEQ ID NO: 190846 - protein, 14 aa, Borrelia afzelii
LIQLNSDKIDYAEK

SEQ ID NO: 190847 - protein, 14 aa, Borrelia afzelii
IQLNSDKIDYAEKY

SEQ ID NO: 190848 - protein, 14 aa, Borrelia afzelii
QLNSDKIDYAEKYG

SEQ ID NO: 190849 - protein, 14 aa, Borrelia afzelii
LNSDKIDYAEKYGD

SEQ ID NO: 190850 - protein, 14 aa, Borrelia afzelii
NSDKIDYAEKYGDN

SEQ ID NO: 190851 - protein, 14 aa, Borrelia afzelii
SDKIDYAEKYGDNA

SEQ ID NO: 190852 - protein, 14 aa, Borrelia afzelii
DKIDYAEKYGDNAR

SEQ ID NO: 190853 - protein, 14 aa, Borrelia afzelii
KIDYAEKYGDNARN

SEQ ID NO: 190854 - protein, 14 aa, Borrelia afzelii
IDYAEKYGDNARNN

SEQ ID NO: 190855 - protein, 14 aa, Borrelia afzelii
DYAEKYGDNARNNF

SEQ ID NO: 190856 - protein, 14 aa, Borrelia afzelii
YAEKYGDNARNNFK

SEQ ID NO: 190857 - protein, 14 aa, Borrelia afzelii
AEKYGDNARNNFKE

SEQ ID NO: 190858 - protein, 14 aa, Borrelia afzelii
EKYGDNARNNFKED

SEQ ID NO: 190859 - protein, 14 aa, Borrelia afzelii
KYGDNARNNFKEDY

SEQ ID NO: 190860 - protein, 14 aa, Borrelia afzelii
YGDNARNNFKEDYS

SEQ ID NO: 190861 - protein, 14 aa, Borrelia afzelii
GDNARNNFKEDYSK

SEQ ID NO: 190862 - protein, 14 aa, Borrelia afzelii
DNARNNFKEDYSKD

SEQ ID NO: 190863 - protein, 14 aa, Borrelia afzelii
NARNNFKEDYSKDK

SEQ ID NO: 190864 - protein, 14 aa, Borrelia afzelii
ARNNFKEDYSKDKT

SEQ ID NO: 190865 - protein, 14 aa, Borrelia afzelii
RNNFKEDYSKDKTN

SEQ ID NO: 190866 - protein, 14 aa, Borrelia afzelii
NNFKEDYSKDKTNT

SEQ ID NO: 190867 - protein, 14 aa, Borrelia afzelii
NFKEDYSKDKTNTV

SEQ ID NO: 190868 - protein, 14 aa, Borrelia afzelii
FKEDYSKDKTNTVK

SEQ ID NO: 190869 - protein, 14 aa, Borrelia afzelii
KEDYSKDKTNTVKQ

SEQ ID NO: 190870 - protein, 14 aa, Borrelia afzelii
EDYSKDKTNTVKQI

SEQ ID NO: 190871 - protein, 14 aa, Borrelia afzelii
DYSKDKTNTVKQIL

SEQ ID NO: 190872 - protein, 14 aa, Borrelia afzelii
YSKDKTNTVKQILK

SEQ ID NO: 190873 - protein, 14 aa, Borrelia afzelii
SKDKTNTVKQILKQ

SEQ ID NO: 190874 - protein, 14 aa, Borrelia afzelii
KDKTNTVKQILKQI

SEQ ID NO: 190875 - protein, 14 aa, Borrelia afzelii
DKTNTVKQILKQIL

SEQ ID NO: 190876 - protein, 14 aa, Borrelia afzelii
KTNTVKQILKQILA

SEQ ID NO: 190877 - protein, 14 aa, Borrelia afzelii
TNTVKQILKQILAD

SEQ ID NO: 190878 - protein, 14 aa, Borrelia afzelii
NTVKQILKQILADL

SEQ ID NO: 190879 - protein, 14 aa, Borrelia afzelii
TVKQILKQILADLP

SEQ ID NO: 190880 - protein, 14 aa, Borrelia afzelii
VKQILKQILADLPK

SEQ ID NO: 190881 - protein, 14 aa, Borrelia afzelii
KQILKQILADLPKD

SEQ ID NO: 190882 - protein, 15 aa, Borrelia afzelii
MKKINLLIFLFLFIL

SEQ ID NO: 190883 - protein, 15 aa, Borrelia afzelii
KKINLLIFLFLFILS

SEQ ID NO: 190884 - protein, 15 aa, Borrelia afzelii
KINLLIFLFLFILSL

SEQ ID NO: 190885 - protein, 15 aa, Borrelia afzelii
INLLIFLFLFILSLS

SEQ ID NO: 190886 - protein, 15 aa, Borrelia afzelii
NLLIFLFLFILSLSA

SEQ ID NO: 190887 - protein, 15 aa, Borrelia afzelii
LLIFLFLFILSLSAN

SEQ ID NO: 190888 - protein, 15 aa, Borrelia afzelii
LIFLFLFILSLSANI

SEQ ID NO: 190889 - protein, 15 aa, Borrelia afzelii
IFLFLFILSLSANIE

SEQ ID NO: 190890 - protein, 15 aa, Borrelia afzelii
FLFLFILSLSANIEE

SEQ ID NO: 190891 - protein, 15 aa, Borrelia afzelii
LFLFILSLSANIEEN

SEQ ID NO: 190892 - protein, 15 aa, Borrelia afzelii
FLFILSLSANIEENY

SEQ ID NO: 190893 - protein, 15 aa, Borrelia afzelii
LFILSLSANIEENYT

SEQ ID NO: 190894 - protein, 15 aa, Borrelia afzelii
FILSLSANIEENYTE

SEQ ID NO: 190895 - protein, 15 aa, Borrelia afzelii
ILSLSANIEENYTET

SEQ ID NO: 190896 - protein, 15 aa, Borrelia afzelii
LSLSANIEENYTETK

SEQ ID NO: 190897 - protein, 15 aa, Borrelia afzelii
SLSANIEENYTETKR

SEQ ID NO: 190898 - protein, 15 aa, Borrelia afzelii
LSANIEENYTETKRA

SEQ ID NO: 190899 - protein, 15 aa, Borrelia afzelii
SANIEENYTETKRAF

SEQ ID NO: 190900 - protein, 15 aa, Borrelia afzelii
ANIEENYTETKRAFS

SEQ ID NO: 190901 - protein, 15 aa, Borrelia afzelii
NIEENYTETKRAFSE

SEQ ID NO: 190902 - protein, 15 aa, Borrelia afzelii
IEENYTETKRAFSEE

SEQ ID NO: 190903 - protein, 15 aa, Borrelia afzelii
EENYTETKRAFSEED

SEQ ID NO: 190904 - protein, 15 aa, Borrelia afzelii
ENYTETKRAFSEEDF

SEQ ID NO: 190905 - protein, 15 aa, Borrelia afzelii
NYTETKRAFSEEDFN

SEQ ID NO: 190906 - protein, 15 aa, Borrelia afzelii
YTETKRAFSEEDFNL

SEQ ID NO: 190907 - protein, 15 aa, Borrelia afzelii
TETKRAFSEEDFNLI

SEQ ID NO: 190908 - protein, 15 aa, Borrelia afzelii
ETKRAFSEEDFNLIN

SEQ ID NO: 190909 - protein, 15 aa, Borrelia afzelii
TKRAFSEEDFNLINK

SEQ ID NO: 190910 - protein, 15 aa, Borrelia afzelii
KRAFSEEDFNLINKR

SEQ ID NO: 190911 - protein, 15 aa, Borrelia afzelii
RAFSEEDFNLINKRL

SEQ ID NO: 190912 - protein, 15 aa, Borrelia afzelii
AFSEEDFNLINKRLD

SEQ ID NO: 190913 - protein, 15 aa, Borrelia afzelii
FSEEDFNLINKRLDN

SEQ ID NO: 190914 - protein, 15 aa, Borrelia afzelii
SEEDFNLINKRLDNY

SEQ ID NO: 190915 - protein, 15 aa, Borrelia afzelii
EEDFNLINKRLDNYD

SEQ ID NO: 190916 - protein, 15 aa, Borrelia afzelii
EDFNLINKRLDNYDF

SEQ ID NO: 190917 - protein, 15 aa, Borrelia afzelii
DFNLINKRLDNYDFK

SEQ ID NO: 190918 - protein, 15 aa, Borrelia afzelii
FNLINKRLDNYDFKN

SEQ ID NO: 190919 - protein, 15 aa, Borrelia afzelii
NLINKRLDNYDFKNE

SEQ ID NO: 190920 - protein, 15 aa, Borrelia afzelii
LINKRLDNYDFKNEY

SEQ ID NO: 190921 - protein, 15 aa, Borrelia afzelii
INKRLDNYDFKNEYE

SEQ ID NO: 190922 - protein, 15 aa, Borrelia afzelii
NKRLDNYDFKNEYEK

SEQ ID NO: 190923 - protein, 15 aa, Borrelia afzelii
KRLDNYDFKNEYEKS

SEQ ID NO: 190924 - protein, 15 aa, Borrelia afzelii
RLDNYDFKNEYEKSH

SEQ ID NO: 190925 - protein, 15 aa, Borrelia afzelii
LDNYDFKNEYEKSHV

SEQ ID NO: 190926 - protein, 15 aa, Borrelia afzelii
DNYDFKNEYEKSHVF

SEQ ID NO: 190927 - protein, 15 aa, Borrelia afzelii
NYDFKNEYEKSHVFS

SEQ ID NO: 190928 - protein, 15 aa, Borrelia afzelii
YDFKNEYEKSHVFSD

SEQ ID NO: 190929 - protein, 15 aa, Borrelia afzelii
DFKNEYEKSHVFSDA

SEQ ID NO: 190930 - protein, 15 aa, Borrelia afzelii
FKNEYEKSHVFSDAP

SEQ ID NO: 190931 - protein, 15 aa, Borrelia afzelii
KNEYEKSHVFSDAPR

SEQ ID NO: 190932 - protein, 15 aa, Borrelia afzelii
NEYEKSHVFSDAPRI

SEQ ID NO: 190933 - protein, 15 aa, Borrelia afzelii
EYEKSHVFSDAPRIR

SEQ ID NO: 190934 - protein, 15 aa, Borrelia afzelii
YEKSHVFSDAPRIRR

SEQ ID NO: 190935 - protein, 15 aa, Borrelia afzelii
EKSHVFSDAPRIRRD

SEQ ID NO: 190936 - protein, 15 aa, Borrelia afzelii
KSHVFSDAPRIRRDL

SEQ ID NO: 190937 - protein, 15 aa, Borrelia afzelii
SHVFSDAPRIRRDLR

SEQ ID NO: 190938 - protein, 15 aa, Borrelia afzelii
HVFSDAPRIRRDLRK

SEQ ID NO: 190939 - protein, 15 aa, Borrelia afzelii
VFSDAPRIRRDLRKI

SEQ ID NO: 190940 - protein, 15 aa, Borrelia afzelii
FSDAPRIRRDLRKIG

SEQ ID NO: 190941 - protein, 15 aa, Borrelia afzelii
SDAPRIRRDLRKIGI

SEQ ID NO: 190942 - protein, 15 aa, Borrelia afzelii
DAPRIRRDLRKIGIK

SEQ ID NO: 190943 - protein, 15 aa, Borrelia afzelii
APRIRRDLRKIGIKE

SEQ ID NO: 190944 - protein, 15 aa, Borrelia afzelii
PRIRRDLRKIGIKEK

SEQ ID NO: 190945 - protein, 15 aa, Borrelia afzelii
RIRRDLRKIGIKEKS

SEQ ID NO: 190946 - protein, 15 aa, Borrelia afzelii
IRRDLRKIGIKEKSV

SEQ ID NO: 190947 - protein, 15 aa, Borrelia afzelii
RRDLRKIGIKEKSVF

SEQ ID NO: 190948 - protein, 15 aa, Borrelia afzelii
RDLRKIGIKEKSVFL

SEQ ID NO: 190949 - protein, 15 aa, Borrelia afzelii
DLRKIGIKEKSVFLD

SEQ ID NO: 190950 - protein, 15 aa, Borrelia afzelii
LRKIGIKEKSVFLDA

SEQ ID NO: 190951 - protein, 15 aa, Borrelia afzelii
RKIGIKEKSVFLDAL

SEQ ID NO: 190952 - protein, 15 aa, Borrelia afzelii
KIGIKEKSVFLDALD

SEQ ID NO: 190953 - protein, 15 aa, Borrelia afzelii
IGIKEKSVFLDALDI

SEQ ID NO: 190954 - protein, 15 aa, Borrelia afzelii
GIKEKSVFLDALDII

SEQ ID NO: 190955 - protein, 15 aa, Borrelia afzelii
IKEKSVFLDALDIIE

SEQ ID NO: 190956 - protein, 15 aa, Borrelia afzelii
KEKSVFLDALDIIEY

SEQ ID NO: 190957 - protein, 15 aa, Borrelia afzelii
EKSVFLDALDIIEYL

SEQ ID NO: 190958 - protein, 15 aa, Borrelia afzelii
KSVFLDALDIIEYLI

SEQ ID NO: 190959 - protein, 15 aa, Borrelia afzelii
SVFLDALDIIEYLIK

SEQ ID NO: 190960 - protein, 15 aa, Borrelia afzelii
VFLDALDIIEYLIKI

SEQ ID NO: 190961 - protein, 15 aa, Borrelia afzelii
FLDALDIIEYLIKIK

SEQ ID NO: 190962 - protein, 15 aa, Borrelia afzelii
LDALDIIEYLIKIKI

SEQ ID NO: 190963 - protein, 15 aa, Borrelia afzelii
DALDIIEYLIKIKIS

SEQ ID NO: 190964 - protein, 15 aa, Borrelia afzelii
ALDIIEYLIKIKISA

SEQ ID NO: 190965 - protein, 15 aa, Borrelia afzelii
LDIIEYLIKIKISAD

SEQ ID NO: 190966 - protein, 15 aa, Borrelia afzelii
DIIEYLIKIKISADS

SEQ ID NO: 190967 - protein, 15 aa, Borrelia afzelii
IIEYLIKIKISADSI

SEQ ID NO: 190968 - protein, 15 aa, Borrelia afzelii
IEYLIKIKISADSIF

SEQ ID NO: 190969 - protein, 15 aa, Borrelia afzelii
EYLIKIKISADSIFL

SEQ ID NO: 190970 - protein, 15 aa, Borrelia afzelii
YLIKIKISADSIFLS

SEQ ID NO: 190971 - protein, 15 aa, Borrelia afzelii
LIKIKISADSIFLSE

SEQ ID NO: 190972 - protein, 15 aa, Borrelia afzelii
IKIKISADSIFLSED

SEQ ID NO: 190973 - protein, 15 aa, Borrelia afzelii
KIKISADSIFLSEDM

SEQ ID NO: 190974 - protein, 15 aa, Borrelia afzelii
IKISADSIFLSEDMI

SEQ ID NO: 190975 - protein, 15 aa, Borrelia afzelii
KISADSIFLSEDMIR

SEQ ID NO: 190976 - protein, 15 aa, Borrelia afzelii
ISADSIFLSEDMIRL

SEQ ID NO: 190977 - protein, 15 aa, Borrelia afzelii
SADSIFLSEDMIRLI

SEQ ID NO: 190978 - protein, 15 aa, Borrelia afzelii
ADSIFLSEDMIRLIG

SEQ ID NO: 190979 - protein, 15 aa, Borrelia afzelii
DSIFLSEDMIRLIGG

SEQ ID NO: 190980 - protein, 15 aa, Borrelia afzelii
SIFLSEDMIRLIGGY

SEQ ID NO: 190981 - protein, 15 aa, Borrelia afzelii
IFLSEDMIRLIGGYP

SEQ ID NO: 190982 - protein, 15 aa, Borrelia afzelii
FLSEDMIRLIGGYPD

SEQ ID NO: 190983 - protein, 15 aa, Borrelia afzelii
LSEDMIRLIGGYPDL

SEQ ID NO: 190984 - protein, 15 aa, Borrelia afzelii
SEDMIRLIGGYPDLI

SEQ ID NO: 190985 - protein, 15 aa, Borrelia afzelii
EDMIRLIGGYPDLIF

SEQ ID NO: 190986 - protein, 15 aa, Borrelia afzelii
DMIRLIGGYPDLIFN

SEQ ID NO: 190987 - protein, 15 aa, Borrelia afzelii
MIRLIGGYPDLIFNY

SEQ ID NO: 190988 - protein, 15 aa, Borrelia afzelii
IRLIGGYPDLIFNYL

SEQ ID NO: 190989 - protein, 15 aa, Borrelia afzelii
RLIGGYPDLIFNYLI

SEQ ID NO: 190990 - protein, 15 aa, Borrelia afzelii
LIGGYPDLIFNYLIQ

SEQ ID NO: 190991 - protein, 15 aa, Borrelia afzelii
IGGYPDLIFNYLIQL

SEQ ID NO: 190992 - protein, 15 aa, Borrelia afzelii
GGYPDLIFNYLIQLN

SEQ ID NO: 190993 - protein, 15 aa, Borrelia afzelii
GYPDLIFNYLIQLNS

SEQ ID NO: 190994 - protein, 15 aa, Borrelia afzelii
YPDLIFNYLIQLNSD

SEQ ID NO: 190995 - protein, 15 aa, Borrelia afzelii
PDLIFNYLIQLNSDK

SEQ ID NO: 190996 - protein, 15 aa, Borrelia afzelii
DLIFNYLIQLNSDKI

SEQ ID NO: 190997 - protein, 15 aa, Borrelia afzelii
LIFNYLIQLNSDKID

SEQ ID NO: 190998 - protein, 15 aa, Borrelia afzelii
IFNYLIQLNSDKIDY

SEQ ID NO: 190999 - protein, 15 aa, Borrelia afzelii
FNYLIQLNSDKIDYA

SEQ ID NO: 191000 - protein, 15 aa, Borrelia afzelii
NYLIQLNSDKIDYAE

SEQ ID NO: 191001 - protein, 15 aa, Borrelia afzelii
YLIQLNSDKIDYAEK

SEQ ID NO: 191002 - protein, 15 aa, Borrelia afzelii
LIQLNSDKIDYAEKY

SEQ ID NO: 191003 - protein, 15 aa, Borrelia afzelii
IQLNSDKIDYAEKYG

SEQ ID NO: 191004 - protein, 15 aa, Borrelia afzelii
QLNSDKIDYAEKYGD

SEQ ID NO: 191005 - protein, 15 aa, Borrelia afzelii
LNSDKIDYAEKYGDN

SEQ ID NO: 191006 - protein, 15 aa, Borrelia afzelii
NSDKIDYAEKYGDNA

SEQ ID NO: 191007 - protein, 15 aa, Borrelia afzelii
SDKIDYAEKYGDNAR

SEQ ID NO: 191008 - protein, 15 aa, Borrelia afzelii
DKIDYAEKYGDNARN

SEQ ID NO: 191009 - protein, 15 aa, Borrelia afzelii
KIDYAEKYGDNARNN

SEQ ID NO: 191010 - protein, 15 aa, Borrelia afzelii
IDYAEKYGDNARNNF

SEQ ID NO: 191011 - protein, 15 aa, Borrelia afzelii
DYAEKYGDNARNNFK

SEQ ID NO: 191012 - protein, 15 aa, Borrelia afzelii
YAEKYGDNARNNFKE

SEQ ID NO: 191013 - protein, 15 aa, Borrelia afzelii
AEKYGDNARNNFKED

SEQ ID NO: 191014 - protein, 15 aa, Borrelia afzelii
EKYGDNARNNFKEDY

SEQ ID NO: 191015 - protein, 15 aa, Borrelia afzelii
KYGDNARNNFKEDYS

SEQ ID NO: 191016 - protein, 15 aa, Borrelia afzelii
YGDNARNNFKEDYSK

SEQ ID NO: 191017 - protein, 15 aa, Borrelia afzelii
GDNARNNFKEDYSKD

SEQ ID NO: 191018 - protein, 15 aa, Borrelia afzelii
DNARNNFKEDYSKDK

SEQ ID NO: 191019 - protein, 15 aa, Borrelia afzelii
NARNNFKEDYSKDKT

SEQ ID NO: 191020 - protein, 15 aa, Borrelia afzelii
ARNNFKEDYSKDKTN

SEQ ID NO: 191021 - protein, 15 aa, Borrelia afzelii
RNNFKEDYSKDKTNT

SEQ ID NO: 191022 - protein, 15 aa, Borrelia afzelii
NNFKEDYSKDKTNTV

SEQ ID NO: 191023 - protein, 15 aa, Borrelia afzelii
NFKEDYSKDKTNTVK

SEQ ID NO: 191024 - protein, 15 aa, Borrelia afzelii
FKEDYSKDKTNTVKQ

SEQ ID NO: 191025 - protein, 15 aa, Borrelia afzelii
KEDYSKDKTNTVKQI

SEQ ID NO: 191026 - protein, 15 aa, Borrelia afzelii
EDYSKDKTNTVKQIL

SEQ ID NO: 191027 - protein, 15 aa, Borrelia afzelii
DYSKDKTNTVKQILK

SEQ ID NO: 191028 - protein, 15 aa, Borrelia afzelii
YSKDKTNTVKQILKQ

SEQ ID NO: 191029 - protein, 15 aa, Borrelia afzelii
SKDKTNTVKQILKQI

SEQ ID NO: 191030 - protein, 15 aa, Borrelia afzelii
KDKTNTVKQILKQIL

SEQ ID NO: 191031 - protein, 15 aa, Borrelia afzelii
DKTNTVKQILKQILA

SEQ ID NO: 191032 - protein, 15 aa, Borrelia afzelii
KTNTVKQILKQILAD

SEQ ID NO: 191033 - protein, 15 aa, Borrelia afzelii
TNTVKQILKQILADL

SEQ ID NO: 191034 - protein, 15 aa, Borrelia afzelii
NTVKQILKQILADLP

SEQ ID NO: 191035 - protein, 15 aa, Borrelia afzelii
TVKQILKQILADLPK

SEQ ID NO: 191036 - protein, 15 aa, Borrelia afzelii
VKQILKQILADLPKD

SEQ ID NO: 191037 - protein, 16 aa, Borrelia afzelii
MKKINLLIFLFLFILS

SEQ ID NO: 191038 - protein, 16 aa, Borrelia afzelii
KKINLLIFLFLFILSL

SEQ ID NO: 191039 - protein, 16 aa, Borrelia afzelii
KINLLIFLFLFILSLS

SEQ ID NO: 191040 - protein, 16 aa, Borrelia afzelii
INLLIFLFLFILSLSA

SEQ ID NO: 191041 - protein, 16 aa, Borrelia afzelii
NLLIFLFLFILSLSAN

SEQ ID NO: 191042 - protein, 16 aa, Borrelia afzelii
LLIFLFLFILSLSANI

SEQ ID NO: 191043 - protein, 16 aa, Borrelia afzelii
LIFLFLFILSLSANIE

SEQ ID NO: 191044 - protein, 16 aa, Borrelia afzelii
IFLFLFILSLSANIEE

SEQ ID NO: 191045 - protein, 16 aa, Borrelia afzelii
FLFLFILSLSANIEEN

SEQ ID NO: 191046 - protein, 16 aa, Borrelia afzelii
LFLFILSLSANIEENY

SEQ ID NO: 191047 - protein, 16 aa, Borrelia afzelii
FLFILSLSANIEENYT

SEQ ID NO: 191048 - protein, 16 aa, Borrelia afzelii
LFILSLSANIEENYTE

SEQ ID NO: 191049 - protein, 16 aa, Borrelia afzelii
FILSLSANIEENYTET

SEQ ID NO: 191050 - protein, 16 aa, Borrelia afzelii
ILSLSANIEENYTETK

SEQ ID NO: 191051 - protein, 16 aa, Borrelia afzelii
LSLSANIEENYTETKR

SEQ ID NO: 191052 - protein, 16 aa, Borrelia afzelii
SLSANIEENYTETKRA

SEQ ID NO: 191053 - protein, 16 aa, Borrelia afzelii
LSANIEENYTETKRAF

SEQ ID NO: 191054 - protein, 16 aa, Borrelia afzelii
SANIEENYTETKRAFS

SEQ ID NO: 191055 - protein, 16 aa, Borrelia afzelii
ANIEENYTETKRAFSE

SEQ ID NO: 191056 - protein, 16 aa, Borrelia afzelii
NIEENYTETKRAFSEE

SEQ ID NO: 191057 - protein, 16 aa, Borrelia afzelii
IEENYTETKRAFSEED

SEQ ID NO: 191058 - protein, 16 aa, Borrelia afzelii
EENYTETKRAFSEEDF

SEQ ID NO: 191059 - protein, 16 aa, Borrelia afzelii
ENYTETKRAFSEEDFN

SEQ ID NO: 191060 - protein, 16 aa, Borrelia afzelii
NYTETKRAFSEEDFNL

SEQ ID NO: 191061 - protein, 16 aa, Borrelia afzelii
YTETKRAFSEEDFNLI

SEQ ID NO: 191062 - protein, 16 aa, Borrelia afzelii
TETKRAFSEEDFNLIN

SEQ ID NO: 191063 - protein, 16 aa, Borrelia afzelii
ETKRAFSEEDFNLINK

SEQ ID NO: 191064 - protein, 16 aa, Borrelia afzelii
TKRAFSEEDFNLINKR

SEQ ID NO: 191065 - protein, 16 aa, Borrelia afzelii
KRAFSEEDFNLINKRL

SEQ ID NO: 191066 - protein, 16 aa, Borrelia afzelii
RAFSEEDFNLINKRLD

SEQ ID NO: 191067 - protein, 16 aa, Borrelia afzelii
AFSEEDFNLINKRLDN

SEQ ID NO: 191068 - protein, 16 aa, Borrelia afzelii
FSEEDFNLINKRLDNY

SEQ ID NO: 191069 - protein, 16 aa, Borrelia afzelii
SEEDFNLINKRLDNYD

SEQ ID NO: 191070 - protein, 16 aa, Borrelia afzelii
EEDFNLINKRLDNYDF

SEQ ID NO: 191071 - protein, 16 aa, Borrelia afzelii
EDFNLINKRLDNYDFK

SEQ ID NO: 191072 - protein, 16 aa, Borrelia afzelii
DFNLINKRLDNYDFKN

SEQ ID NO: 191073 - protein, 16 aa, Borrelia afzelii
FNLINKRLDNYDFKNE

SEQ ID NO: 191074 - protein, 16 aa, Borrelia afzelii
NLINKRLDNYDFKNEY

SEQ ID NO: 191075 - protein, 16 aa, Borrelia afzelii
LINKRLDNYDFKNEYE

SEQ ID NO: 191076 - protein, 16 aa, Borrelia afzelii
INKRLDNYDFKNEYEK

SEQ ID NO: 191077 - protein, 16 aa, Borrelia afzelii
NKRLDNYDFKNEYEKS

SEQ ID NO: 191078 - protein, 16 aa, Borrelia afzelii
KRLDNYDFKNEYEKSH

SEQ ID NO: 191079 - protein, 16 aa, Borrelia afzelii
RLDNYDFKNEYEKSHV

SEQ ID NO: 191080 - protein, 16 aa, Borrelia afzelii
LDNYDFKNEYEKSHVF

SEQ ID NO: 191081 - protein, 16 aa, Borrelia afzelii
DNYDFKNEYEKSHVFS

SEQ ID NO: 191082 - protein, 16 aa, Borrelia afzelii
NYDFKNEYEKSHVFSD

SEQ ID NO: 191083 - protein, 16 aa, Borrelia afzelii
YDFKNEYEKSHVFSDA

SEQ ID NO: 191084 - protein, 16 aa, Borrelia afzelii
DFKNEYEKSHVFSDAP

SEQ ID NO: 191085 - protein, 16 aa, Borrelia afzelii
FKNEYEKSHVFSDAPR

SEQ ID NO: 191086 - protein, 16 aa, Borrelia afzelii
KNEYEKSHVFSDAPRI

SEQ ID NO: 191087 - protein, 16 aa, Borrelia afzelii
NEYEKSHVFSDAPRIR

SEQ ID NO: 191088 - protein, 16 aa, Borrelia afzelii
EYEKSHVFSDAPRIRR

SEQ ID NO: 191089 - protein, 16 aa, Borrelia afzelii
YEKSHVFSDAPRIRRD

SEQ ID NO: 191090 - protein, 16 aa, Borrelia afzelii
EKSHVFSDAPRIRRDL

SEQ ID NO: 191091 - protein, 16 aa, Borrelia afzelii
KSHVFSDAPRIRRDLR

SEQ ID NO: 191092 - protein, 16 aa, Borrelia afzelii
SHVFSDAPRIRRDLRK

SEQ ID NO: 191093 - protein, 16 aa, Borrelia afzelii
HVFSDAPRIRRDLRKI

SEQ ID NO: 191094 - protein, 16 aa, Borrelia afzelii
VFSDAPRIRRDLRKIG

SEQ ID NO: 191095 - protein, 16 aa, Borrelia afzelii
FSDAPRIRRDLRKIGI

SEQ ID NO: 191096 - protein, 16 aa, Borrelia afzelii
SDAPRIRRDLRKIGIK

SEQ ID NO: 191097 - protein, 16 aa, Borrelia afzelii
DAPRIRRDLRKIGIKE

SEQ ID NO: 191098 - protein, 16 aa, Borrelia afzelii
APRIRRDLRKIGIKEK

SEQ ID NO: 191099 - protein, 16 aa, Borrelia afzelii
PRIRRDLRKIGIKEKS

SEQ ID NO: 191100 - protein, 16 aa, Borrelia afzelii
RIRRDLRKIGIKEKSV

SEQ ID NO: 191101 - protein, 16 aa, Borrelia afzelii
IRRDLRKIGIKEKSVF

SEQ ID NO: 191102 - protein, 16 aa, Borrelia afzelii
RRDLRKIGIKEKSVFL

SEQ ID NO: 191103 - protein, 16 aa, Borrelia afzelii
RDLRKIGIKEKSVFLD

SEQ ID NO: 191104 - protein, 16 aa, Borrelia afzelii
DLRKIGIKEKSVFLDA

SEQ ID NO: 191105 - protein, 16 aa, Borrelia afzelii
LRKIGIKEKSVFLDAL

SEQ ID NO: 191106 - protein, 16 aa, Borrelia afzelii
RKIGIKEKSVFLDALD

SEQ ID NO: 191107 - protein, 16 aa, Borrelia afzelii
KIGIKEKSVFLDALDI

SEQ ID NO: 191108 - protein, 16 aa, Borrelia afzelii
IGIKEKSVFLDALDII

SEQ ID NO: 191109 - protein, 16 aa, Borrelia afzelii
GIKEKSVFLDALDIIE

SEQ ID NO: 191110 - protein, 16 aa, Borrelia afzelii
IKEKSVFLDALDIIEY

SEQ ID NO: 191111 - protein, 16 aa, Borrelia afzelii
KEKSVFLDALDIIEYL

SEQ ID NO: 191112 - protein, 16 aa, Borrelia afzelii
EKSVFLDALDIIEYLI

SEQ ID NO: 191113 - protein, 16 aa, Borrelia afzelii
KSVFLDALDIIEYLIK

SEQ ID NO: 191114 - protein, 16 aa, Borrelia afzelii
SVFLDALDIIEYLIKI

SEQ ID NO: 191115 - protein, 16 aa, Borrelia afzelii
VFLDALDIIEYLIKIK

SEQ ID NO: 191116 - protein, 16 aa, Borrelia afzelii
FLDALDIIEYLIKIKI

SEQ ID NO: 191117 - protein, 16 aa, Borrelia afzelii
LDALDIIEYLIKIKIS

SEQ ID NO: 191118 - protein, 16 aa, Borrelia afzelii
DALDIIEYLIKIKISA

SEQ ID NO: 191119 - protein, 16 aa, Borrelia afzelii
ALDIIEYLIKIKISAD

SEQ ID NO: 191120 - protein, 16 aa, Borrelia afzelii
LDIIEYLIKIKISADS

SEQ ID NO: 191121 - protein, 16 aa, Borrelia afzelii
DIIEYLIKIKISADSI

SEQ ID NO: 191122 - protein, 16 aa, Borrelia afzelii
IIEYLIKIKISADSIF

SEQ ID NO: 191123 - protein, 16 aa, Borrelia afzelii
IEYLIKIKISADSIFL

SEQ ID NO: 191124 - protein, 16 aa, Borrelia afzelii
EYLIKIKISADSIFLS

SEQ ID NO: 191125 - protein, 16 aa, Borrelia afzelii
YLIKIKISADSIFLSE

SEQ ID NO: 191126 - protein, 16 aa, Borrelia afzelii
LIKIKISADSIFLSED

SEQ ID NO: 191127 - protein, 16 aa, Borrelia afzelii
IKIKISADSIFLSEDM

SEQ ID NO: 191128 - protein, 16 aa, Borrelia afzelii
KIKISADSIFLSEDMI

SEQ ID NO: 191129 - protein, 16 aa, Borrelia afzelii
IKISADSIFLSEDMIR

SEQ ID NO: 191130 - protein, 16 aa, Borrelia afzelii
KISADSIFLSEDMIRL

SEQ ID NO: 191131 - protein, 16 aa, Borrelia afzelii
ISADSIFLSEDMIRLI

SEQ ID NO: 191132 - protein, 16 aa, Borrelia afzelii
SADSIFLSEDMIRLIG

SEQ ID NO: 191133 - protein, 16 aa, Borrelia afzelii
ADSIFLSEDMIRLIGG

SEQ ID NO: 191134 - protein, 16 aa, Borrelia afzelii
DSIFLSEDMIRLIGGY

SEQ ID NO: 191135 - protein, 16 aa, Borrelia afzelii
SIFLSEDMIRLIGGYP

SEQ ID NO: 191136 - protein, 16 aa, Borrelia afzelii
IFLSEDMIRLIGGYPD

SEQ ID NO: 191137 - protein, 16 aa, Borrelia afzelii
FLSEDMIRLIGGYPDL

SEQ ID NO: 191138 - protein, 16 aa, Borrelia afzelii
LSEDMIRLIGGYPDLI

SEQ ID NO: 191139 - protein, 16 aa, Borrelia afzelii
SEDMIRLIGGYPDLIF

SEQ ID NO: 191140 - protein, 16 aa, Borrelia afzelii
EDMIRLIGGYPDLIFN

SEQ ID NO: 191141 - protein, 16 aa, Borrelia afzelii
DMIRLIGGYPDLIFNY

SEQ ID NO: 191142 - protein, 16 aa, Borrelia afzelii
MIRLIGGYPDLIFNYL

SEQ ID NO: 191143 - protein, 16 aa, Borrelia afzelii
IRLIGGYPDLIFNYLI

SEQ ID NO: 191144 - protein, 16 aa, Borrelia afzelii
RLIGGYPDLIFNYLIQ

SEQ ID NO: 191145 - protein, 16 aa, Borrelia afzelii
LIGGYPDLIFNYLIQL

SEQ ID NO: 191146 - protein, 16 aa, Borrelia afzelii
IGGYPDLIFNYLIQLN

SEQ ID NO: 191147 - protein, 16 aa, Borrelia afzelii
GGYPDLIFNYLIQLNS

SEQ ID NO: 191148 - protein, 16 aa, Borrelia afzelii
GYPDLIFNYLIQLNSD

SEQ ID NO: 191149 - protein, 16 aa, Borrelia afzelii
YPDLIFNYLIQLNSDK

SEQ ID NO: 191150 - protein, 16 aa, Borrelia afzelii
PDLIFNYLIQLNSDKI

SEQ ID NO: 191151 - protein, 16 aa, Borrelia afzelii
DLIFNYLIQLNSDKID

SEQ ID NO: 191152 - protein, 16 aa, Borrelia afzelii
LIFNYLIQLNSDKIDY

SEQ ID NO: 191153 - protein, 16 aa, Borrelia afzelii
IFNYLIQLNSDKIDYA

SEQ ID NO: 191154 - protein, 16 aa, Borrelia afzelii
FNYLIQLNSDKIDYAE

SEQ ID NO: 191155 - protein, 16 aa, Borrelia afzelii
NYLIQLNSDKIDYAEK

SEQ ID NO: 191156 - protein, 16 aa, Borrelia afzelii
YLIQLNSDKIDYAEKY

SEQ ID NO: 191157 - protein, 16 aa, Borrelia afzelii
LIQLNSDKIDYAEKYG

SEQ ID NO: 191158 - protein, 16 aa, Borrelia afzelii
IQLNSDKIDYAEKYGD

SEQ ID NO: 191159 - protein, 16 aa, Borrelia afzelii
QLNSDKIDYAEKYGDN

SEQ ID NO: 191160 - protein, 16 aa, Borrelia afzelii
LNSDKIDYAEKYGDNA

SEQ ID NO: 191161 - protein, 16 aa, Borrelia afzelii
NSDKIDYAEKYGDNAR

SEQ ID NO: 191162 - protein, 16 aa, Borrelia afzelii
SDKIDYAEKYGDNARN

SEQ ID NO: 191163 - protein, 16 aa, Borrelia afzelii
DKIDYAEKYGDNARNN

SEQ ID NO: 191164 - protein, 16 aa, Borrelia afzelii
KIDYAEKYGDNARNNF

SEQ ID NO: 191165 - protein, 16 aa, Borrelia afzelii
IDYAEKYGDNARNNFK

SEQ ID NO: 191166 - protein, 16 aa, Borrelia afzelii
DYAEKYGDNARNNFKE

SEQ ID NO: 191167 - protein, 16 aa, Borrelia afzelii
YAEKYGDNARNNFKED

SEQ ID NO: 191168 - protein, 16 aa, Borrelia afzelii
AEKYGDNARNNFKEDY

SEQ ID NO: 191169 - protein, 16 aa, Borrelia afzelii
EKYGDNARNNFKEDYS

SEQ ID NO: 191170 - protein, 16 aa, Borrelia afzelii
KYGDNARNNFKEDYSK

SEQ ID NO: 191171 - protein, 16 aa, Borrelia afzelii
YGDNARNNFKEDYSKD

SEQ ID NO: 191172 - protein, 16 aa, Borrelia afzelii
GDNARNNFKEDYSKDK

SEQ ID NO: 191173 - protein, 16 aa, Borrelia afzelii
DNARNNFKEDYSKDKT

SEQ ID NO: 191174 - protein, 16 aa, Borrelia afzelii
NARNNFKEDYSKDKTN

SEQ ID NO: 191175 - protein, 16 aa, Borrelia afzelii
ARNNFKEDYSKDKTNT

SEQ ID NO: 191176 - protein, 16 aa, Borrelia afzelii
RNNFKEDYSKDKTNTV

SEQ ID NO: 191177 - protein, 16 aa, Borrelia afzelii
NNFKEDYSKDKTNTVK

SEQ ID NO: 191178 - protein, 16 aa, Borrelia afzelii
NFKEDYSKDKTNTVKQ

SEQ ID NO: 191179 - protein, 16 aa, Borrelia afzelii
FKEDYSKDKTNTVKQI

SEQ ID NO: 191180 - protein, 16 aa, Borrelia afzelii
KEDYSKDKTNTVKQIL

SEQ ID NO: 191181 - protein, 16 aa, Borrelia afzelii
EDYSKDKTNTVKQILK

SEQ ID NO: 191182 - protein, 16 aa, Borrelia afzelii
DYSKDKTNTVKQILKQ

SEQ ID NO: 191183 - protein, 16 aa, Borrelia afzelii
YSKDKTNTVKQILKQI

SEQ ID NO: 191184 - protein, 16 aa, Borrelia afzelii
SKDKTNTVKQILKQIL

SEQ ID NO: 191185 - protein, 16 aa, Borrelia afzelii
KDKTNTVKQILKQILA

SEQ ID NO: 191186 - protein, 16 aa, Borrelia afzelii
DKTNTVKQILKQILAD

SEQ ID NO: 191187 - protein, 16 aa, Borrelia afzelii
KTNTVKQILKQILADL

SEQ ID NO: 191188 - protein, 16 aa, Borrelia afzelii
TNTVKQILKQILADLP

SEQ ID NO: 191189 - protein, 16 aa, Borrelia afzelii
NTVKQILKQILADLPK

SEQ ID NO: 191190 - protein, 16 aa, Borrelia afzelii
TVKQILKQILADLPKD

SEQ ID NO: 191191 - protein, 13 aa, Borrelia afzelii
MKKINLLIFLFLF

SEQ ID NO: 191192 - protein, 13 aa, Borrelia afzelii
KKINLLIFLFLFI

SEQ ID NO: 191193 - protein, 13 aa, Borrelia afzelii
KINLLIFLFLFIL

SEQ ID NO: 191194 - protein, 13 aa, Borrelia afzelii
INLLIFLFLFILS

SEQ ID NO: 191195 - protein, 13 aa, Borrelia afzelii
NLLIFLFLFILSL

SEQ ID NO: 191196 - protein, 13 aa, Borrelia afzelii
LLIFLFLFILSLS

SEQ ID NO: 191197 - protein, 13 aa, Borrelia afzelii
LIFLFLFILSLSA

SEQ ID NO: 191198 - protein, 13 aa, Borrelia afzelii
IFLFLFILSLSAN

SEQ ID NO: 191199 - protein, 13 aa, Borrelia afzelii
FLFLFILSLSANI

SEQ ID NO: 191200 - protein, 13 aa, Borrelia afzelii
LFLFILSLSANIE

SEQ ID NO: 191201 - protein, 13 aa, Borrelia afzelii
FLFILSLSANIEE

SEQ ID NO: 191202 - protein, 13 aa, Borrelia afzelii
LFILSLSANIEEN

SEQ ID NO: 191203 - protein, 13 aa, Borrelia afzelii
FILSLSANIEENY

SEQ ID NO: 191204 - protein, 13 aa, Borrelia afzelii
ILSLSANIEENYT

SEQ ID NO: 191205 - protein, 13 aa, Borrelia afzelii
LSLSANIEENYTE

SEQ ID NO: 191206 - protein, 13 aa, Borrelia afzelii
SLSANIEENYTET

SEQ ID NO: 191207 - protein, 13 aa, Borrelia afzelii
LSANIEENYTETK

SEQ ID NO: 191208 - protein, 13 aa, Borrelia afzelii
SANIEENYTETKR

SEQ ID NO: 191209 - protein, 13 aa, Borrelia afzelii
ANIEENYTETKRA

SEQ ID NO: 191210 - protein, 13 aa, Borrelia afzelii
NIEENYTETKRAF

SEQ ID NO: 191211 - protein, 13 aa, Borrelia afzelii
IEENYTETKRAFS

SEQ ID NO: 191212 - protein, 13 aa, Borrelia afzelii
EENYTETKRAFSE

SEQ ID NO: 191213 - protein, 13 aa, Borrelia afzelii
ENYTETKRAFSEE

SEQ ID NO: 191214 - protein, 13 aa, Borrelia afzelii
NYTETKRAFSEED

SEQ ID NO: 191215 - protein, 13 aa, Borrelia afzelii
YTETKRAFSEEDF

SEQ ID NO: 191216 - protein, 13 aa, Borrelia afzelii
TETKRAFSEEDFN

SEQ ID NO: 191217 - protein, 13 aa, Borrelia afzelii
ETKRAFSEEDFNL

SEQ ID NO: 191218 - protein, 13 aa, Borrelia afzelii
TKRAFSEEDFNLI

SEQ ID NO: 191219 - protein, 13 aa, Borrelia afzelii
KRAFSEEDFNLIN

SEQ ID NO: 191220 - protein, 13 aa, Borrelia afzelii
RAFSEEDFNLINK

SEQ ID NO: 191221 - protein, 13 aa, Borrelia afzelii
AFSEEDFNLINKR

SEQ ID NO: 191222 - protein, 13 aa, Borrelia afzelii
FSEEDFNLINKRL

SEQ ID NO: 191223 - protein, 13 aa, Borrelia afzelii
SEEDFNLINKRLD

SEQ ID NO: 191224 - protein, 13 aa, Borrelia afzelii
EEDFNLINKRLDN

SEQ ID NO: 191225 - protein, 13 aa, Borrelia afzelii
EDFNLINKRLDNY

SEQ ID NO: 191226 - protein, 13 aa, Borrelia afzelii
DFNLINKRLDNYD

SEQ ID NO: 191227 - protein, 13 aa, Borrelia afzelii
FNLINKRLDNYDF

SEQ ID NO: 191228 - protein, 13 aa, Borrelia afzelii
NLINKRLDNYDFK

SEQ ID NO: 191229 - protein, 13 aa, Borrelia afzelii
LINKRLDNYDFKN

SEQ ID NO: 191230 - protein, 13 aa, Borrelia afzelii
INKRLDNYDFKNE

SEQ ID NO: 191231 - protein, 13 aa, Borrelia afzelii
NKRLDNYDFKNEY

SEQ ID NO: 191232 - protein, 13 aa, Borrelia afzelii
KRLDNYDFKNEYE

SEQ ID NO: 191233 - protein, 13 aa, Borrelia afzelii
RLDNYDFKNEYEK

SEQ ID NO: 191234 - protein, 13 aa, Borrelia afzelii
LDNYDFKNEYEKS

SEQ ID NO: 191235 - protein, 13 aa, Borrelia afzelii
DNYDFKNEYEKSH

SEQ ID NO: 191236 - protein, 13 aa, Borrelia afzelii
NYDFKNEYEKSHV

SEQ ID NO: 191237 - protein, 13 aa, Borrelia afzelii
YDFKNEYEKSHVF

SEQ ID NO: 191238 - protein, 13 aa, Borrelia afzelii
DFKNEYEKSHVFS

SEQ ID NO: 191239 - protein, 13 aa, Borrelia afzelii
FKNEYEKSHVFSD

SEQ ID NO: 191240 - protein, 13 aa, Borrelia afzelii
KNEYEKSHVFSDA

SEQ ID NO: 191241 - protein, 13 aa, Borrelia afzelii
NEYEKSHVFSDAP

SEQ ID NO: 191242 - protein, 13 aa, Borrelia afzelii
EYEKSHVFSDAPR

SEQ ID NO: 191243 - protein, 13 aa, Borrelia afzelii
YEKSHVFSDAPRI

SEQ ID NO: 191244 - protein, 13 aa, Borrelia afzelii
EKSHVFSDAPRIR

SEQ ID NO: 191245 - protein, 13 aa, Borrelia afzelii
KSHVFSDAPRIRR

SEQ ID NO: 191246 - protein, 13 aa, Borrelia afzelii
SHVFSDAPRIRRD

SEQ ID NO: 191247 - protein, 13 aa, Borrelia afzelii
HVFSDAPRIRRDL

SEQ ID NO: 191248 - protein, 13 aa, Borrelia afzelii
VFSDAPRIRRDLR

SEQ ID NO: 191249 - protein, 13 aa, Borrelia afzelii
FSDAPRIRRDLRK

SEQ ID NO: 191250 - protein, 13 aa, Borrelia afzelii
SDAPRIRRDLRKI

SEQ ID NO: 191251 - protein, 13 aa, Borrelia afzelii
DAPRIRRDLRKIG

SEQ ID NO: 191252 - protein, 13 aa, Borrelia afzelii
APRIRRDLRKIGI

SEQ ID NO: 191253 - protein, 13 aa, Borrelia afzelii
PRIRRDLRKIGIK

SEQ ID NO: 191254 - protein, 13 aa, Borrelia afzelii
RIRRDLRKIGIKE

SEQ ID NO: 191255 - protein, 13 aa, Borrelia afzelii
IRRDLRKIGIKEK

SEQ ID NO: 191256 - protein, 13 aa, Borrelia afzelii
RRDLRKIGIKEKS

SEQ ID NO: 191257 - protein, 13 aa, Borrelia afzelii
RDLRKIGIKEKSV

SEQ ID NO: 191258 - protein, 13 aa, Borrelia afzelii
DLRKIGIKEKSVF

SEQ ID NO: 191259 - protein, 13 aa, Borrelia afzelii
LRKIGIKEKSVFL

SEQ ID NO: 191260 - protein, 13 aa, Borrelia afzelii
RKIGIKEKSVFLD

SEQ ID NO: 191261 - protein, 13 aa, Borrelia afzelii
KIGIKEKSVFLDA

SEQ ID NO: 191262 - protein, 13 aa, Borrelia afzelii
IGIKEKSVFLDAL

SEQ ID NO: 191263 - protein, 13 aa, Borrelia afzelii
GIKEKSVFLDALD

SEQ ID NO: 191264 - protein, 13 aa, Borrelia afzelii
IKEKSVFLDALDI

SEQ ID NO: 191265 - protein, 13 aa, Borrelia afzelii
KEKSVFLDALDII

SEQ ID NO: 191266 - protein, 13 aa, Borrelia afzelii
EKSVFLDALDIIE

SEQ ID NO: 191267 - protein, 13 aa, Borrelia afzelii
KSVFLDALDIIEY

SEQ ID NO: 191268 - protein, 13 aa, Borrelia afzelii
SVFLDALDIIEYL

SEQ ID NO: 191269 - protein, 13 aa, Borrelia afzelii
VFLDALDIIEYLI

SEQ ID NO: 191270 - protein, 13 aa, Borrelia afzelii
FLDALDIIEYLIK

SEQ ID NO: 191271 - protein, 13 aa, Borrelia afzelii
LDALDIIEYLIKI

SEQ ID NO: 191272 - protein, 13 aa, Borrelia afzelii
DALDIIEYLIKIK

SEQ ID NO: 191273 - protein, 13 aa, Borrelia afzelii
ALDIIEYLIKIKI

SEQ ID NO: 191274 - protein, 13 aa, Borrelia afzelii
LDIIEYLIKIKIS

SEQ ID NO: 191275 - protein, 13 aa, Borrelia afzelii
DIIEYLIKIKISA

SEQ ID NO: 191276 - protein, 13 aa, Borrelia afzelii
IIEYLIKIKISAD

SEQ ID NO: 191277 - protein, 13 aa, Borrelia afzelii
IEYLIKIKISADS

SEQ ID NO: 191278 - protein, 13 aa, Borrelia afzelii
EYLIKIKISADSI

SEQ ID NO: 191279 - protein, 13 aa, Borrelia afzelii
YLIKIKISADSIF

SEQ ID NO: 191280 - protein, 13 aa, Borrelia afzelii
LIKIKISADSIFL

SEQ ID NO: 191281 - protein, 13 aa, Borrelia afzelii
IKIKISADSIFLS

SEQ ID NO: 191282 - protein, 13 aa, Borrelia afzelii
KIKISADSIFLSE

SEQ ID NO: 191283 - protein, 13 aa, Borrelia afzelii
IKISADSIFLSED

SEQ ID NO: 191284 - protein, 13 aa, Borrelia afzelii
KISADSIFLSEDM

SEQ ID NO: 191285 - protein, 13 aa, Borrelia afzelii
ISADSIFLSEDMI

SEQ ID NO: 191286 - protein, 13 aa, Borrelia afzelii
SADSIFLSEDMIR

SEQ ID NO: 191287 - protein, 13 aa, Borrelia afzelii
ADSIFLSEDMIRL

SEQ ID NO: 191288 - protein, 13 aa, Borrelia afzelii
DSIFLSEDMIRLI

SEQ ID NO: 191289 - protein, 13 aa, Borrelia afzelii
SIFLSEDMIRLIG

SEQ ID NO: 191290 - protein, 13 aa, Borrelia afzelii
IFLSEDMIRLIGG

SEQ ID NO: 191291 - protein, 13 aa, Borrelia afzelii
FLSEDMIRLIGGY

SEQ ID NO: 191292 - protein, 13 aa, Borrelia afzelii
LSEDMIRLIGGYP

SEQ ID NO: 191293 - protein, 13 aa, Borrelia afzelii
SEDMIRLIGGYPD

SEQ ID NO: 191294 - protein, 13 aa, Borrelia afzelii
EDMIRLIGGYPDL

SEQ ID NO: 191295 - protein, 13 aa, Borrelia afzelii
DMIRLIGGYPDLI

SEQ ID NO: 191296 - protein, 13 aa, Borrelia afzelii
MIRLIGGYPDLIF

SEQ ID NO: 191297 - protein, 13 aa, Borrelia afzelii
IRLIGGYPDLIFN

SEQ ID NO: 191298 - protein, 13 aa, Borrelia afzelii
RLIGGYPDLIFNY

SEQ ID NO: 191299 - protein, 13 aa, Borrelia afzelii
LIGGYPDLIFNYL

SEQ ID NO: 191300 - protein, 13 aa, Borrelia afzelii
IGGYPDLIFNYLI

SEQ ID NO: 191301 - protein, 13 aa, Borrelia afzelii
GGYPDLIFNYLIQ

SEQ ID NO: 191302 - protein, 13 aa, Borrelia afzelii
GYPDLIFNYLIQL

SEQ ID NO: 191303 - protein, 13 aa, Borrelia afzelii
YPDLIFNYLIQLN

SEQ ID NO: 191304 - protein, 13 aa, Borrelia afzelii
PDLIFNYLIQLNS

SEQ ID NO: 191305 - protein, 13 aa, Borrelia afzelii
DLIFNYLIQLNSD

SEQ ID NO: 191306 - protein, 13 aa, Borrelia afzelii
LIFNYLIQLNSDK

SEQ ID NO: 191307 - protein, 13 aa, Borrelia afzelii
IFNYLIQLNSDKI

SEQ ID NO: 191308 - protein, 13 aa, Borrelia afzelii
FNYLIQLNSDKID

SEQ ID NO: 191309 - protein, 13 aa, Borrelia afzelii
NYLIQLNSDKIDY

SEQ ID NO: 191310 - protein, 13 aa, Borrelia afzelii
YLIQLNSDKIDYA

SEQ ID NO: 191311 - protein, 13 aa, Borrelia afzelii
LIQLNSDKIDYAE

SEQ ID NO: 191312 - protein, 13 aa, Borrelia afzelii
IQLNSDKIDYAEK

SEQ ID NO: 191313 - protein, 13 aa, Borrelia afzelii
QLNSDKIDYAEKY

SEQ ID NO: 191314 - protein, 13 aa, Borrelia afzelii
LNSDKIDYAEKYG

SEQ ID NO: 191315 - protein, 13 aa, Borrelia afzelii
NSDKIDYAEKYGD

SEQ ID NO: 191316 - protein, 13 aa, Borrelia afzelii
SDKIDYAEKYGDN

SEQ ID NO: 191317 - protein, 13 aa, Borrelia afzelii
DKIDYAEKYGDNA

SEQ ID NO: 191318 - protein, 13 aa, Borrelia afzelii
KIDYAEKYGDNAR

SEQ ID NO: 191319 - protein, 13 aa, Borrelia afzelii
IDYAEKYGDNARN

SEQ ID NO: 191320 - protein, 13 aa, Borrelia afzelii
DYAEKYGDNARNN

SEQ ID NO: 191321 - protein, 13 aa, Borrelia afzelii
YAEKYGDNARNNF

SEQ ID NO: 191322 - protein, 13 aa, Borrelia afzelii
AEKYGDNARNNFK

SEQ ID NO: 191323 - protein, 13 aa, Borrelia afzelii
EKYGDNARNNFKE

SEQ ID NO: 191324 - protein, 13 aa, Borrelia afzelii
KYGDNARNNFKED

SEQ ID NO: 191325 - protein, 13 aa, Borrelia afzelii
YGDNARNNFKEDY

SEQ ID NO: 191326 - protein, 13 aa, Borrelia afzelii
GDNARNNFKEDYS

SEQ ID NO: 191327 - protein, 13 aa, Borrelia afzelii
DNARNNFKEDYSK

SEQ ID NO: 191328 - protein, 13 aa, Borrelia afzelii
NARNNFKEDYSKD

SEQ ID NO: 191329 - protein, 13 aa, Borrelia afzelii
ARNNFKEDYSKDK

SEQ ID NO: 191330 - protein, 13 aa, Borrelia afzelii
RNNFKEDYSKDKT

SEQ ID NO: 191331 - protein, 13 aa, Borrelia afzelii
NNFKEDYSKDKTN

SEQ ID NO: 191332 - protein, 13 aa, Borrelia afzelii
NFKEDYSKDKTNT

SEQ ID NO: 191333 - protein, 13 aa, Borrelia afzelii
FKEDYSKDKTNTV

SEQ ID NO: 191334 - protein, 13 aa, Borrelia afzelii
KEDYSKDKTNTVK

SEQ ID NO: 191335 - protein, 13 aa, Borrelia afzelii
EDYSKDKTNTVKQ

SEQ ID NO: 191336 - protein, 13 aa, Borrelia afzelii
DYSKDKTNTVKQI

SEQ ID NO: 191337 - protein, 13 aa, Borrelia afzelii
YSKDKTNTVKQIL

SEQ ID NO: 191338 - protein, 13 aa, Borrelia afzelii
SKDKTNTVKQILK

SEQ ID NO: 191339 - protein, 13 aa, Borrelia afzelii
KDKTNTVKQILKQ

SEQ ID NO: 191340 - protein, 13 aa, Borrelia afzelii
DKTNTVKQILKQI

SEQ ID NO: 191341 - protein, 13 aa, Borrelia afzelii
KTNTVKQILKQIL

SEQ ID NO: 191342 - protein, 13 aa, Borrelia afzelii
TNTVKQILKQILA

SEQ ID NO: 191343 - protein, 13 aa, Borrelia afzelii
NTVKQILKQILAD

SEQ ID NO: 191344 - protein, 13 aa, Borrelia afzelii
TVKQILKQILADL

SEQ ID NO: 191345 - protein, 13 aa, Borrelia afzelii
VKQILKQILADLP

SEQ ID NO: 191346 - protein, 13 aa, Borrelia afzelii
KQILKQILADLPK

SEQ ID NO: 191347 - protein, 13 aa, Borrelia afzelii
QILKQILADLPKD

SEQ ID NO: 191348 - protein, 14 aa, Borrelia afzelii
MKKINLLIFLFLFI

SEQ ID NO: 191349 - protein, 14 aa, Borrelia afzelii
KKINLLIFLFLFIL

SEQ ID NO: 191350 - protein, 14 aa, Borrelia afzelii
KINLLIFLFLFILS

SEQ ID NO: 191351 - protein, 14 aa, Borrelia afzelii
INLLIFLFLFILSL

SEQ ID NO: 191352 - protein, 14 aa, Borrelia afzelii
NLLIFLFLFILSLS

SEQ ID NO: 191353 - protein, 14 aa, Borrelia afzelii
LLIFLFLFILSLSA

SEQ ID NO: 191354 - protein, 14 aa, Borrelia afzelii
LIFLFLFILSLSAN

SEQ ID NO: 191355 - protein, 14 aa, Borrelia afzelii
IFLFLFILSLSANI

SEQ ID NO: 191356 - protein, 14 aa, Borrelia afzelii
FLFLFILSLSANIE

SEQ ID NO: 191357 - protein, 14 aa, Borrelia afzelii
LFLFILSLSANIEE

SEQ ID NO: 191358 - protein, 14 aa, Borrelia afzelii
FLFILSLSANIEEN

SEQ ID NO: 191359 - protein, 14 aa, Borrelia afzelii
LFILSLSANIEENY

SEQ ID NO: 191360 - protein, 14 aa, Borrelia afzelii
FILSLSANIEENYT

SEQ ID NO: 191361 - protein, 14 aa, Borrelia afzelii
ILSLSANIEENYTE

SEQ ID NO: 191362 - protein, 14 aa, Borrelia afzelii
LSLSANIEENYTET

SEQ ID NO: 191363 - protein, 14 aa, Borrelia afzelii
SLSANIEENYTETK

SEQ ID NO: 191364 - protein, 14 aa, Borrelia afzelii
LSANIEENYTETKR

SEQ ID NO: 191365 - protein, 14 aa, Borrelia afzelii
SANIEENYTETKRA

SEQ ID NO: 191366 - protein, 14 aa, Borrelia afzelii
ANIEENYTETKRAF

SEQ ID NO: 191367 - protein, 14 aa, Borrelia afzelii
NIEENYTETKRAFS

SEQ ID NO: 191368 - protein, 14 aa, Borrelia afzelii
IEENYTETKRAFSE

SEQ ID NO: 191369 - protein, 14 aa, Borrelia afzelii
EENYTETKRAFSEE

SEQ ID NO: 191370 - protein, 14 aa, Borrelia afzelii
ENYTETKRAFSEED

SEQ ID NO: 191371 - protein, 14 aa, Borrelia afzelii
NYTETKRAFSEEDF

SEQ ID NO: 191372 - protein, 14 aa, Borrelia afzelii
YTETKRAFSEEDFN

SEQ ID NO: 191373 - protein, 14 aa, Borrelia afzelii
TETKRAFSEEDFNL

SEQ ID NO: 191374 - protein, 14 aa, Borrelia afzelii
ETKRAFSEEDFNLI

SEQ ID NO: 191375 - protein, 14 aa, Borrelia afzelii
TKRAFSEEDFNLIN

SEQ ID NO: 191376 - protein, 14 aa, Borrelia afzelii
KRAFSEEDFNLINK

SEQ ID NO: 191377 - protein, 14 aa, Borrelia afzelii
RAFSEEDFNLINKR

SEQ ID NO: 191378 - protein, 14 aa, Borrelia afzelii
AFSEEDFNLINKRL

SEQ ID NO: 191379 - protein, 14 aa, Borrelia afzelii
FSEEDFNLINKRLD

SEQ ID NO: 191380 - protein, 14 aa, Borrelia afzelii
SEEDFNLINKRLDN

SEQ ID NO: 191381 - protein, 14 aa, Borrelia afzelii
EEDFNLINKRLDNY

SEQ ID NO: 191382 - protein, 14 aa, Borrelia afzelii
EDFNLINKRLDNYD

SEQ ID NO: 191383 - protein, 14 aa, Borrelia afzelii
DFNLINKRLDNYDF

SEQ ID NO: 191384 - protein, 14 aa, Borrelia afzelii
FNLINKRLDNYDFK

SEQ ID NO: 191385 - protein, 14 aa, Borrelia afzelii
NLINKRLDNYDFKN

SEQ ID NO: 191386 - protein, 14 aa, Borrelia afzelii
LINKRLDNYDFKNE

SEQ ID NO: 191387 - protein, 14 aa, Borrelia afzelii
INKRLDNYDFKNEY

SEQ ID NO: 191388 - protein, 14 aa, Borrelia afzelii
NKRLDNYDFKNEYE

SEQ ID NO: 191389 - protein, 14 aa, Borrelia afzelii
KRLDNYDFKNEYEK

SEQ ID NO: 191390 - protein, 14 aa, Borrelia afzelii
RLDNYDFKNEYEKS

SEQ ID NO: 191391 - protein, 14 aa, Borrelia afzelii
LDNYDFKNEYEKSH

SEQ ID NO: 191392 - protein, 14 aa, Borrelia afzelii
DNYDFKNEYEKSHV

SEQ ID NO: 191393 - protein, 14 aa, Borrelia afzelii
NYDFKNEYEKSHVF

SEQ ID NO: 191394 - protein, 14 aa, Borrelia afzelii
YDFKNEYEKSHVFS

SEQ ID NO: 191395 - protein, 14 aa, Borrelia afzelii
DFKNEYEKSHVFSD

SEQ ID NO: 191396 - protein, 14 aa, Borrelia afzelii
FKNEYEKSHVFSDA

SEQ ID NO: 191397 - protein, 14 aa, Borrelia afzelii
KNEYEKSHVFSDAP

SEQ ID NO: 191398 - protein, 14 aa, Borrelia afzelii
NEYEKSHVFSDAPR

SEQ ID NO: 191399 - protein, 14 aa, Borrelia afzelii
EYEKSHVFSDAPRI

SEQ ID NO: 191400 - protein, 14 aa, Borrelia afzelii
YEKSHVFSDAPRIR

SEQ ID NO: 191401 - protein, 14 aa, Borrelia afzelii
EKSHVFSDAPRIRR

SEQ ID NO: 191402 - protein, 14 aa, Borrelia afzelii
KSHVFSDAPRIRRD

SEQ ID NO: 191403 - protein, 14 aa, Borrelia afzelii
SHVFSDAPRIRRDL

SEQ ID NO: 191404 - protein, 14 aa, Borrelia afzelii
HVFSDAPRIRRDLR

SEQ ID NO: 191405 - protein, 14 aa, Borrelia afzelii
VFSDAPRIRRDLRK

SEQ ID NO: 191406 - protein, 14 aa, Borrelia afzelii
FSDAPRIRRDLRKI

SEQ ID NO: 191407 - protein, 14 aa, Borrelia afzelii
SDAPRIRRDLRKIG

SEQ ID NO: 191408 - protein, 14 aa, Borrelia afzelii
DAPRIRRDLRKIGI

SEQ ID NO: 191409 - protein, 14 aa, Borrelia afzelii
APRIRRDLRKIGIK

SEQ ID NO: 191410 - protein, 14 aa, Borrelia afzelii
PRIRRDLRKIGIKE

SEQ ID NO: 191411 - protein, 14 aa, Borrelia afzelii
RIRRDLRKIGIKEK

SEQ ID NO: 191412 - protein, 14 aa, Borrelia afzelii
IRRDLRKIGIKEKS

SEQ ID NO: 191413 - protein, 14 aa, Borrelia afzelii
RRDLRKIGIKEKSV

SEQ ID NO: 191414 - protein, 14 aa, Borrelia afzelii
RDLRKIGIKEKSVF

SEQ ID NO: 191415 - protein, 14 aa, Borrelia afzelii
DLRKIGIKEKSVFL

SEQ ID NO: 191416 - protein, 14 aa, Borrelia afzelii
LRKIGIKEKSVFLD

SEQ ID NO: 191417 - protein, 14 aa, Borrelia afzelii
RKIGIKEKSVFLDA

SEQ ID NO: 191418 - protein, 14 aa, Borrelia afzelii
KIGIKEKSVFLDAL

SEQ ID NO: 191419 - protein, 14 aa, Borrelia afzelii
IGIKEKSVFLDALD

SEQ ID NO: 191420 - protein, 14 aa, Borrelia afzelii
GIKEKSVFLDALDI

SEQ ID NO: 191421 - protein, 14 aa, Borrelia afzelii
IKEKSVFLDALDII

SEQ ID NO: 191422 - protein, 14 aa, Borrelia afzelii
KEKSVFLDALDIIE

SEQ ID NO: 191423 - protein, 14 aa, Borrelia afzelii
EKSVFLDALDIIEY

SEQ ID NO: 191424 - protein, 14 aa, Borrelia afzelii
KSVFLDALDIIEYL

SEQ ID NO: 191425 - protein, 14 aa, Borrelia afzelii
SVFLDALDIIEYLI

SEQ ID NO: 191426 - protein, 14 aa, Borrelia afzelii
VFLDALDIIEYLIK

SEQ ID NO: 191427 - protein, 14 aa, Borrelia afzelii
FLDALDIIEYLIKI

SEQ ID NO: 191428 - protein, 14 aa, Borrelia afzelii
LDALDIIEYLIKIK

SEQ ID NO: 191429 - protein, 14 aa, Borrelia afzelii
DALDIIEYLIKIKI

SEQ ID NO: 191430 - protein, 14 aa, Borrelia afzelii
ALDIIEYLIKIKIS

SEQ ID NO: 191431 - protein, 14 aa, Borrelia afzelii
LDIIEYLIKIKISA

SEQ ID NO: 191432 - protein, 14 aa, Borrelia afzelii
DIIEYLIKIKISAD

SEQ ID NO: 191433 - protein, 14 aa, Borrelia afzelii
IIEYLIKIKISADS

SEQ ID NO: 191434 - protein, 14 aa, Borrelia afzelii
IEYLIKIKISADSI

SEQ ID NO: 191435 - protein, 14 aa, Borrelia afzelii
EYLIKIKISADSIF

SEQ ID NO: 191436 - protein, 14 aa, Borrelia afzelii
YLIKIKISADSIFL

SEQ ID NO: 191437 - protein, 14 aa, Borrelia afzelii
LIKIKISADSIFLS

SEQ ID NO: 191438 - protein, 14 aa, Borrelia afzelii
IKIKISADSIFLSE

SEQ ID NO: 191439 - protein, 14 aa, Borrelia afzelii
KIKISADSIFLSED

SEQ ID NO: 191440 - protein, 14 aa, Borrelia afzelii
IKISADSIFLSEDM

SEQ ID NO: 191441 - protein, 14 aa, Borrelia afzelii
KISADSIFLSEDMI

SEQ ID NO: 191442 - protein, 14 aa, Borrelia afzelii
ISADSIFLSEDMIR

SEQ ID NO: 191443 - protein, 14 aa, Borrelia afzelii
SADSIFLSEDMIRL

SEQ ID NO: 191444 - protein, 14 aa, Borrelia afzelii
ADSIFLSEDMIRLI

SEQ ID NO: 191445 - protein, 14 aa, Borrelia afzelii
DSIFLSEDMIRLIG

SEQ ID NO: 191446 - protein, 14 aa, Borrelia afzelii
SIFLSEDMIRLIGG

SEQ ID NO: 191447 - protein, 14 aa, Borrelia afzelii
IFLSEDMIRLIGGY

SEQ ID NO: 191448 - protein, 14 aa, Borrelia afzelii
FLSEDMIRLIGGYP

SEQ ID NO: 191449 - protein, 14 aa, Borrelia afzelii
LSEDMIRLIGGYPD

SEQ ID NO: 191450 - protein, 14 aa, Borrelia afzelii
SEDMIRLIGGYPDL

SEQ ID NO: 191451 - protein, 14 aa, Borrelia afzelii
EDMIRLIGGYPDLI

SEQ ID NO: 191452 - protein, 14 aa, Borrelia afzelii
DMIRLIGGYPDLIF

SEQ ID NO: 191453 - protein, 14 aa, Borrelia afzelii
MIRLIGGYPDLIFN

SEQ ID NO: 191454 - protein, 14 aa, Borrelia afzelii
IRLIGGYPDLIFNY

SEQ ID NO: 191455 - protein, 14 aa, Borrelia afzelii
RLIGGYPDLIFNYL

SEQ ID NO: 191456 - protein, 14 aa, Borrelia afzelii
LIGGYPDLIFNYLI

SEQ ID NO: 191457 - protein, 14 aa, Borrelia afzelii
IGGYPDLIFNYLIQ

SEQ ID NO: 191458 - protein, 14 aa, Borrelia afzelii
GGYPDLIFNYLIQL

SEQ ID NO: 191459 - protein, 14 aa, Borrelia afzelii
GYPDLIFNYLIQLN

SEQ ID NO: 191460 - protein, 14 aa, Borrelia afzelii
YPDLIFNYLIQLNS

SEQ ID NO: 191461 - protein, 14 aa, Borrelia afzelii
PDLIFNYLIQLNSD

SEQ ID NO: 191462 - protein, 14 aa, Borrelia afzelii
DLIFNYLIQLNSDK

SEQ ID NO: 191463 - protein, 14 aa, Borrelia afzelii
LIFNYLIQLNSDKI

SEQ ID NO: 191464 - protein, 14 aa, Borrelia afzelii
IFNYLIQLNSDKID

SEQ ID NO: 191465 - protein, 14 aa, Borrelia afzelii
FNYLIQLNSDKIDY

SEQ ID NO: 191466 - protein, 14 aa, Borrelia afzelii
NYLIQLNSDKIDYA

SEQ ID NO: 191467 - protein, 14 aa, Borrelia afzelii
YLIQLNSDKIDYAE

SEQ ID NO: 191468 - protein, 14 aa, Borrelia afzelii
LIQLNSDKIDYAEK

SEQ ID NO: 191469 - protein, 14 aa, Borrelia afzelii
IQLNSDKIDYAEKY

SEQ ID NO: 191470 - protein, 14 aa, Borrelia afzelii
QLNSDKIDYAEKYG

SEQ ID NO: 191471 - protein, 14 aa, Borrelia afzelii
LNSDKIDYAEKYGD

SEQ ID NO: 191472 - protein, 14 aa, Borrelia afzelii
NSDKIDYAEKYGDN

SEQ ID NO: 191473 - protein, 14 aa, Borrelia afzelii
SDKIDYAEKYGDNA

SEQ ID NO: 191474 - protein, 14 aa, Borrelia afzelii
DKIDYAEKYGDNAR

SEQ ID NO: 191475 - protein, 14 aa, Borrelia afzelii
KIDYAEKYGDNARN

SEQ ID NO: 191476 - protein, 14 aa, Borrelia afzelii
IDYAEKYGDNARNN

SEQ ID NO: 191477 - protein, 14 aa, Borrelia afzelii
DYAEKYGDNARNNF

SEQ ID NO: 191478 - protein, 14 aa, Borrelia afzelii
YAEKYGDNARNNFK

SEQ ID NO: 191479 - protein, 14 aa, Borrelia afzelii
AEKYGDNARNNFKE

SEQ ID NO: 191480 - protein, 14 aa, Borrelia afzelii
EKYGDNARNNFKED

SEQ ID NO: 191481 - protein, 14 aa, Borrelia afzelii
KYGDNARNNFKEDY

SEQ ID NO: 191482 - protein, 14 aa, Borrelia afzelii
YGDNARNNFKEDYS

SEQ ID NO: 191483 - protein, 14 aa, Borrelia afzelii
GDNARNNFKEDYSK

SEQ ID NO: 191484 - protein, 14 aa, Borrelia afzelii
DNARNNFKEDYSKD

SEQ ID NO: 191485 - protein, 14 aa, Borrelia afzelii
NARNNFKEDYSKDK

SEQ ID NO: 191486 - protein, 14 aa, Borrelia afzelii
ARNNFKEDYSKDKT

SEQ ID NO: 191487 - protein, 14 aa, Borrelia afzelii
RNNFKEDYSKDKTN

SEQ ID NO: 191488 - protein, 14 aa, Borrelia afzelii
NNFKEDYSKDKTNT

SEQ ID NO: 191489 - protein, 14 aa, Borrelia afzelii
NFKEDYSKDKTNTV

SEQ ID NO: 191490 - protein, 14 aa, Borrelia afzelii
FKEDYSKDKTNTVK

SEQ ID NO: 191491 - protein, 14 aa, Borrelia afzelii
KEDYSKDKTNTVKQ

SEQ ID NO: 191492 - protein, 14 aa, Borrelia afzelii
EDYSKDKTNTVKQI

SEQ ID NO: 191493 - protein, 14 aa, Borrelia afzelii
DYSKDKTNTVKQIL

SEQ ID NO: 191494 - protein, 14 aa, Borrelia afzelii
YSKDKTNTVKQILK

SEQ ID NO: 191495 - protein, 14 aa, Borrelia afzelii
SKDKTNTVKQILKQ

SEQ ID NO: 191496 - protein, 14 aa, Borrelia afzelii
KDKTNTVKQILKQI

SEQ ID NO: 191497 - protein, 14 aa, Borrelia afzelii
DKTNTVKQILKQIL

SEQ ID NO: 191498 - protein, 14 aa, Borrelia afzelii
KTNTVKQILKQILA

SEQ ID NO: 191499 - protein, 14 aa, Borrelia afzelii
TNTVKQILKQILAD

SEQ ID NO: 191500 - protein, 14 aa, Borrelia afzelii
NTVKQILKQILADL

SEQ ID NO: 191501 - protein, 14 aa, Borrelia afzelii
TVKQILKQILADLP

SEQ ID NO: 191502 - protein, 14 aa, Borrelia afzelii
VKQILKQILADLPK

SEQ ID NO: 191503 - protein, 14 aa, Borrelia afzelii
KQILKQILADLPKD

SEQ ID NO: 191504 - protein, 15 aa, Borrelia afzelii
MKKINLLIFLFLFIL

SEQ ID NO: 191505 - protein, 15 aa, Borrelia afzelii
KKINLLIFLFLFILS

SEQ ID NO: 191506 - protein, 15 aa, Borrelia afzelii
KINLLIFLFLFILSL

SEQ ID NO: 191507 - protein, 15 aa, Borrelia afzelii
INLLIFLFLFILSLS

SEQ ID NO: 191508 - protein, 15 aa, Borrelia afzelii
NLLIFLFLFILSLSA

SEQ ID NO: 191509 - protein, 15 aa, Borrelia afzelii
LLIFLFLFILSLSAN

SEQ ID NO: 191510 - protein, 15 aa, Borrelia afzelii
LIFLFLFILSLSANI

SEQ ID NO: 191511 - protein, 15 aa, Borrelia afzelii
IFLFLFILSLSANIE

SEQ ID NO: 191512 - protein, 15 aa, Borrelia afzelii
FLFLFILSLSANIEE

SEQ ID NO: 191513 - protein, 15 aa, Borrelia afzelii
LFLFILSLSANIEEN

SEQ ID NO: 191514 - protein, 15 aa, Borrelia afzelii
FLFILSLSANIEENY

SEQ ID NO: 191515 - protein, 15 aa, Borrelia afzelii
LFILSLSANIEENYT

SEQ ID NO: 191516 - protein, 15 aa, Borrelia afzelii
FILSLSANIEENYTE

SEQ ID NO: 191517 - protein, 15 aa, Borrelia afzelii
ILSLSANIEENYTET

SEQ ID NO: 191518 - protein, 15 aa, Borrelia afzelii
LSLSANIEENYTETK

SEQ ID NO: 191519 - protein, 15 aa, Borrelia afzelii
SLSANIEENYTETKR

SEQ ID NO: 191520 - protein, 15 aa, Borrelia afzelii
LSANIEENYTETKRA

SEQ ID NO: 191521 - protein, 15 aa, Borrelia afzelii
SANIEENYTETKRAF

SEQ ID NO: 191522 - protein, 15 aa, Borrelia afzelii
ANIEENYTETKRAFS

SEQ ID NO: 191523 - protein, 15 aa, Borrelia afzelii
NIEENYTETKRAFSE

SEQ ID NO: 191524 - protein, 15 aa, Borrelia afzelii
IEENYTETKRAFSEE

SEQ ID NO: 191525 - protein, 15 aa, Borrelia afzelii
EENYTETKRAFSEED

SEQ ID NO: 191526 - protein, 15 aa, Borrelia afzelii
ENYTETKRAFSEEDF

SEQ ID NO: 191527 - protein, 15 aa, Borrelia afzelii
NYTETKRAFSEEDFN

SEQ ID NO: 191528 - protein, 15 aa, Borrelia afzelii
YTETKRAFSEEDFNL

SEQ ID NO: 191529 - protein, 15 aa, Borrelia afzelii
TETKRAFSEEDFNLI

SEQ ID NO: 191530 - protein, 15 aa, Borrelia afzelii
ETKRAFSEEDFNLIN

SEQ ID NO: 191531 - protein, 15 aa, Borrelia afzelii
TKRAFSEEDFNLINK

SEQ ID NO: 191532 - protein, 15 aa, Borrelia afzelii
KRAFSEEDFNLINKR

SEQ ID NO: 191533 - protein, 15 aa, Borrelia afzelii
RAFSEEDFNLINKRL

SEQ ID NO: 191534 - protein, 15 aa, Borrelia afzelii
AFSEEDFNLINKRLD

SEQ ID NO: 191535 - protein, 15 aa, Borrelia afzelii
FSEEDFNLINKRLDN

SEQ ID NO: 191536 - protein, 15 aa, Borrelia afzelii
SEEDFNLINKRLDNY

SEQ ID NO: 191537 - protein, 15 aa, Borrelia afzelii
EEDFNLINKRLDNYD

SEQ ID NO: 191538 - protein, 15 aa, Borrelia afzelii
EDFNLINKRLDNYDF

SEQ ID NO: 191539 - protein, 15 aa, Borrelia afzelii
DFNLINKRLDNYDFK

SEQ ID NO: 191540 - protein, 15 aa, Borrelia afzelii
FNLINKRLDNYDFKN

SEQ ID NO: 191541 - protein, 15 aa, Borrelia afzelii
NLINKRLDNYDFKNE

SEQ ID NO: 191542 - protein, 15 aa, Borrelia afzelii
LINKRLDNYDFKNEY

SEQ ID NO: 191543 - protein, 15 aa, Borrelia afzelii
INKRLDNYDFKNEYE

SEQ ID NO: 191544 - protein, 15 aa, Borrelia afzelii
NKRLDNYDFKNEYEK

SEQ ID NO: 191545 - protein, 15 aa, Borrelia afzelii
KRLDNYDFKNEYEKS

SEQ ID NO: 191546 - protein, 15 aa, Borrelia afzelii
RLDNYDFKNEYEKSH

SEQ ID NO: 191547 - protein, 15 aa, Borrelia afzelii
LDNYDFKNEYEKSHV

SEQ ID NO: 191548 - protein, 15 aa, Borrelia afzelii
DNYDFKNEYEKSHVF

SEQ ID NO: 191549 - protein, 15 aa, Borrelia afzelii
NYDFKNEYEKSHVFS

SEQ ID NO: 191550 - protein, 15 aa, Borrelia afzelii
YDFKNEYEKSHVFSD

SEQ ID NO: 191551 - protein, 15 aa, Borrelia afzelii
DFKNEYEKSHVFSDA

SEQ ID NO: 191552 - protein, 15 aa, Borrelia afzelii
FKNEYEKSHVFSDAP

SEQ ID NO: 191553 - protein, 15 aa, Borrelia afzelii
KNEYEKSHVFSDAPR

SEQ ID NO: 191554 - protein, 15 aa, Borrelia afzelii
NEYEKSHVFSDAPRI

SEQ ID NO: 191555 - protein, 15 aa, Borrelia afzelii
EYEKSHVFSDAPRIR

SEQ ID NO: 191556 - protein, 15 aa, Borrelia afzelii
YEKSHVFSDAPRIRR

SEQ ID NO: 191557 - protein, 15 aa, Borrelia afzelii
EKSHVFSDAPRIRRD

SEQ ID NO: 191558 - protein, 15 aa, Borrelia afzelii
KSHVFSDAPRIRRDL

SEQ ID NO: 191559 - protein, 15 aa, Borrelia afzelii
SHVFSDAPRIRRDLR

SEQ ID NO: 191560 - protein, 15 aa, Borrelia afzelii
HVFSDAPRIRRDLRK

SEQ ID NO: 191561 - protein, 15 aa, Borrelia afzelii
VFSDAPRIRRDLRKI

SEQ ID NO: 191562 - protein, 15 aa, Borrelia afzelii
FSDAPRIRRDLRKIG

SEQ ID NO: 191563 - protein, 15 aa, Borrelia afzelii
SDAPRIRRDLRKIGI

SEQ ID NO: 191564 - protein, 15 aa, Borrelia afzelii
DAPRIRRDLRKIGIK

SEQ ID NO: 191565 - protein, 15 aa, Borrelia afzelii
APRIRRDLRKIGIKE

SEQ ID NO: 191566 - protein, 15 aa, Borrelia afzelii
PRIRRDLRKIGIKEK

SEQ ID NO: 191567 - protein, 15 aa, Borrelia afzelii
RIRRDLRKIGIKEKS

SEQ ID NO: 191568 - protein, 15 aa, Borrelia afzelii
IRRDLRKIGIKEKSV

SEQ ID NO: 191569 - protein, 15 aa, Borrelia afzelii
RRDLRKIGIKEKSVF

SEQ ID NO: 191570 - protein, 15 aa, Borrelia afzelii
RDLRKIGIKEKSVFL

SEQ ID NO: 191571 - protein, 15 aa, Borrelia afzelii
DLRKIGIKEKSVFLD

SEQ ID NO: 191572 - protein, 15 aa, Borrelia afzelii
LRKIGIKEKSVFLDA

SEQ ID NO: 191573 - protein, 15 aa, Borrelia afzelii
RKIGIKEKSVFLDAL

SEQ ID NO: 191574 - protein, 15 aa, Borrelia afzelii
KIGIKEKSVFLDALD

SEQ ID NO: 191575 - protein, 15 aa, Borrelia afzelii
IGIKEKSVFLDALDI

SEQ ID NO: 191576 - protein, 15 aa, Borrelia afzelii
GIKEKSVFLDALDII

SEQ ID NO: 191577 - protein, 15 aa, Borrelia afzelii
IKEKSVFLDALDIIE

SEQ ID NO: 191578 - protein, 15 aa, Borrelia afzelii
KEKSVFLDALDIIEY

SEQ ID NO: 191579 - protein, 15 aa, Borrelia afzelii
EKSVFLDALDIIEYL

SEQ ID NO: 191580 - protein, 15 aa, Borrelia afzelii
KSVFLDALDIIEYLI

SEQ ID NO: 191581 - protein, 15 aa, Borrelia afzelii
SVFLDALDIIEYLIK

SEQ ID NO: 191582 - protein, 15 aa, Borrelia afzelii
VFLDALDIIEYLIKI

SEQ ID NO: 191583 - protein, 15 aa, Borrelia afzelii
FLDALDIIEYLIKIK

SEQ ID NO: 191584 - protein, 15 aa, Borrelia afzelii
LDALDIIEYLIKIKI

SEQ ID NO: 191585 - protein, 15 aa, Borrelia afzelii
DALDIIEYLIKIKIS

SEQ ID NO: 191586 - protein, 15 aa, Borrelia afzelii
ALDIIEYLIKIKISA

SEQ ID NO: 191587 - protein, 15 aa, Borrelia afzelii
LDIIEYLIKIKISAD

SEQ ID NO: 191588 - protein, 15 aa, Borrelia afzelii
DIIEYLIKIKISADS

SEQ ID NO: 191589 - protein, 15 aa, Borrelia afzelii
IIEYLIKIKISADSI

SEQ ID NO: 191590 - protein, 15 aa, Borrelia afzelii
IEYLIKIKISADSIF

SEQ ID NO: 191591 - protein, 15 aa, Borrelia afzelii
EYLIKIKISADSIFL

SEQ ID NO: 191592 - protein, 15 aa, Borrelia afzelii
YLIKIKISADSIFLS

SEQ ID NO: 191593 - protein, 15 aa, Borrelia afzelii
LIKIKISADSIFLSE

SEQ ID NO: 191594 - protein, 15 aa, Borrelia afzelii
IKIKISADSIFLSED

SEQ ID NO: 191595 - protein, 15 aa, Borrelia afzelii
KIKISADSIFLSEDM

SEQ ID NO: 191596 - protein, 15 aa, Borrelia afzelii
IKISADSIFLSEDMI

SEQ ID NO: 191597 - protein, 15 aa, Borrelia afzelii
KISADSIFLSEDMIR

SEQ ID NO: 191598 - protein, 15 aa, Borrelia afzelii
ISADSIFLSEDMIRL

SEQ ID NO: 191599 - protein, 15 aa, Borrelia afzelii
SADSIFLSEDMIRLI

SEQ ID NO: 191600 - protein, 15 aa, Borrelia afzelii
ADSIFLSEDMIRLIG

SEQ ID NO: 191601 - protein, 15 aa, Borrelia afzelii
DSIFLSEDMIRLIGG

SEQ ID NO: 191602 - protein, 15 aa, Borrelia afzelii
SIFLSEDMIRLIGGY

SEQ ID NO: 191603 - protein, 15 aa, Borrelia afzelii
IFLSEDMIRLIGGYP

SEQ ID NO: 191604 - protein, 15 aa, Borrelia afzelii
FLSEDMIRLIGGYPD

SEQ ID NO: 191605 - protein, 15 aa, Borrelia afzelii
LSEDMIRLIGGYPDL

SEQ ID NO: 191606 - protein, 15 aa, Borrelia afzelii
SEDMIRLIGGYPDLI

SEQ ID NO: 191607 - protein, 15 aa, Borrelia afzelii
EDMIRLIGGYPDLIF

SEQ ID NO: 191608 - protein, 15 aa, Borrelia afzelii
DMIRLIGGYPDLIFN

SEQ ID NO: 191609 - protein, 15 aa, Borrelia afzelii
MIRLIGGYPDLIFNY

SEQ ID NO: 191610 - protein, 15 aa, Borrelia afzelii
IRLIGGYPDLIFNYL

SEQ ID NO: 191611 - protein, 15 aa, Borrelia afzelii
RLIGGYPDLIFNYLI

SEQ ID NO: 191612 - protein, 15 aa, Borrelia afzelii
LIGGYPDLIFNYLIQ

SEQ ID NO: 191613 - protein, 15 aa, Borrelia afzelii
IGGYPDLIFNYLIQL

SEQ ID NO: 191614 - protein, 15 aa, Borrelia afzelii
GGYPDLIFNYLIQLN

SEQ ID NO: 191615 - protein, 15 aa, Borrelia afzelii
GYPDLIFNYLIQLNS

SEQ ID NO: 191616 - protein, 15 aa, Borrelia afzelii
YPDLIFNYLIQLNSD

SEQ ID NO: 191617 - protein, 15 aa, Borrelia afzelii
PDLIFNYLIQLNSDK

SEQ ID NO: 191618 - protein, 15 aa, Borrelia afzelii
DLIFNYLIQLNSDKI

SEQ ID NO: 191619 - protein, 15 aa, Borrelia afzelii
LIFNYLIQLNSDKID

SEQ ID NO: 191620 - protein, 15 aa, Borrelia afzelii
IFNYLIQLNSDKIDY

SEQ ID NO: 191621 - protein, 15 aa, Borrelia afzelii
FNYLIQLNSDKIDYA

SEQ ID NO: 191622 - protein, 15 aa, Borrelia afzelii
NYLIQLNSDKIDYAE

SEQ ID NO: 191623 - protein, 15 aa, Borrelia afzelii
YLIQLNSDKIDYAEK

SEQ ID NO: 191624 - protein, 15 aa, Borrelia afzelii
LIQLNSDKIDYAEKY

SEQ ID NO: 191625 - protein, 15 aa, Borrelia afzelii
IQLNSDKIDYAEKYG

SEQ ID NO: 191626 - protein, 15 aa, Borrelia afzelii
QLNSDKIDYAEKYGD

SEQ ID NO: 191627 - protein, 15 aa, Borrelia afzelii
LNSDKIDYAEKYGDN

SEQ ID NO: 191628 - protein, 15 aa, Borrelia afzelii
NSDKIDYAEKYGDNA

SEQ ID NO: 191629 - protein, 15 aa, Borrelia afzelii
SDKIDYAEKYGDNAR

SEQ ID NO: 191630 - protein, 15 aa, Borrelia afzelii
DKIDYAEKYGDNARN

SEQ ID NO: 191631 - protein, 15 aa, Borrelia afzelii
KIDYAEKYGDNARNN

SEQ ID NO: 191632 - protein, 15 aa, Borrelia afzelii
IDYAEKYGDNARNNF

SEQ ID NO: 191633 - protein, 15 aa, Borrelia afzelii
DYAEKYGDNARNNFK

SEQ ID NO: 191634 - protein, 15 aa, Borrelia afzelii
YAEKYGDNARNNFKE

SEQ ID NO: 191635 - protein, 15 aa, Borrelia afzelii
AEKYGDNARNNFKED

SEQ ID NO: 191636 - protein, 15 aa, Borrelia afzelii
EKYGDNARNNFKEDY

SEQ ID NO: 191637 - protein, 15 aa, Borrelia afzelii
KYGDNARNNFKEDYS

SEQ ID NO: 191638 - protein, 15 aa, Borrelia afzelii
YGDNARNNFKEDYSK

SEQ ID NO: 191639 - protein, 15 aa, Borrelia afzelii
GDNARNNFKEDYSKD

SEQ ID NO: 191640 - protein, 15 aa, Borrelia afzelii
DNARNNFKEDYSKDK

SEQ ID NO: 191641 - protein, 15 aa, Borrelia afzelii
NARNNFKEDYSKDKT

SEQ ID NO: 191642 - protein, 15 aa, Borrelia afzelii
ARNNFKEDYSKDKTN

SEQ ID NO: 191643 - protein, 15 aa, Borrelia afzelii
RNNFKEDYSKDKTNT

SEQ ID NO: 191644 - protein, 15 aa, Borrelia afzelii
NNFKEDYSKDKTNTV

SEQ ID NO: 191645 - protein, 15 aa, Borrelia afzelii
NFKEDYSKDKTNTVK

SEQ ID NO: 191646 - protein, 15 aa, Borrelia afzelii
FKEDYSKDKTNTVKQ

SEQ ID NO: 191647 - protein, 15 aa, Borrelia afzelii
KEDYSKDKTNTVKQI

SEQ ID NO: 191648 - protein, 15 aa, Borrelia afzelii
EDYSKDKTNTVKQIL

SEQ ID NO: 191649 - protein, 15 aa, Borrelia afzelii
DYSKDKTNTVKQILK

SEQ ID NO: 191650 - protein, 15 aa, Borrelia afzelii
YSKDKTNTVKQILKQ

SEQ ID NO: 191651 - protein, 15 aa, Borrelia afzelii
SKDKTNTVKQILKQI

SEQ ID NO: 191652 - protein, 15 aa, Borrelia afzelii
KDKTNTVKQILKQIL

SEQ ID NO: 191653 - protein, 15 aa, Borrelia afzelii
DKTNTVKQILKQILA

SEQ ID NO: 191654 - protein, 15 aa, Borrelia afzelii
KTNTVKQILKQILAD

SEQ ID NO: 191655 - protein, 15 aa, Borrelia afzelii
TNTVKQILKQILADL

SEQ ID NO: 191656 - protein, 15 aa, Borrelia afzelii
NTVKQILKQILADLP

SEQ ID NO: 191657 - protein, 15 aa, Borrelia afzelii
TVKQILKQILADLPK

SEQ ID NO: 191658 - protein, 15 aa, Borrelia afzelii
VKQILKQILADLPKD

SEQ ID NO: 191659 - protein, 16 aa, Borrelia afzelii
MKKINLLIFLFLFILS

SEQ ID NO: 191660 - protein, 16 aa, Borrelia afzelii
KKINLLIFLFLFILSL

SEQ ID NO: 191661 - protein, 16 aa, Borrelia afzelii
KINLLIFLFLFILSLS

SEQ ID NO: 191662 - protein, 16 aa, Borrelia afzelii
INLLIFLFLFILSLSA

SEQ ID NO: 191663 - protein, 16 aa, Borrelia afzelii
NLLIFLFLFILSLSAN

SEQ ID NO: 191664 - protein, 16 aa, Borrelia afzelii
LLIFLFLFILSLSANI

SEQ ID NO: 191665 - protein, 16 aa, Borrelia afzelii
LIFLFLFILSLSANIE

SEQ ID NO: 191666 - protein, 16 aa, Borrelia afzelii
IFLFLFILSLSANIEE

SEQ ID NO: 191667 - protein, 16 aa, Borrelia afzelii
FLFLFILSLSANIEEN

SEQ ID NO: 191668 - protein, 16 aa, Borrelia afzelii
LFLFILSLSANIEENY

SEQ ID NO: 191669 - protein, 16 aa, Borrelia afzelii
FLFILSLSANIEENYT

SEQ ID NO: 191670 - protein, 16 aa, Borrelia afzelii
LFILSLSANIEENYTE

SEQ ID NO: 191671 - protein, 16 aa, Borrelia afzelii
FILSLSANIEENYTET

SEQ ID NO: 191672 - protein, 16 aa, Borrelia afzelii
ILSLSANIEENYTETK

SEQ ID NO: 191673 - protein, 16 aa, Borrelia afzelii
LSLSANIEENYTETKR

SEQ ID NO: 191674 - protein, 16 aa, Borrelia afzelii
SLSANIEENYTETKRA

SEQ ID NO: 191675 - protein, 16 aa, Borrelia afzelii
LSANIEENYTETKRAF

SEQ ID NO: 191676 - protein, 16 aa, Borrelia afzelii
SANIEENYTETKRAFS

SEQ ID NO: 191677 - protein, 16 aa, Borrelia afzelii
ANIEENYTETKRAFSE

SEQ ID NO: 191678 - protein, 16 aa, Borrelia afzelii
NIEENYTETKRAFSEE

SEQ ID NO: 191679 - protein, 16 aa, Borrelia afzelii
IEENYTETKRAFSEED

SEQ ID NO: 191680 - protein, 16 aa, Borrelia afzelii
EENYTETKRAFSEEDF

SEQ ID NO: 191681 - protein, 16 aa, Borrelia afzelii
ENYTETKRAFSEEDFN

SEQ ID NO: 191682 - protein, 16 aa, Borrelia afzelii
NYTETKRAFSEEDFNL

SEQ ID NO: 191683 - protein, 16 aa, Borrelia afzelii
YTETKRAFSEEDFNLI

SEQ ID NO: 191684 - protein, 16 aa, Borrelia afzelii
TETKRAFSEEDFNLIN

SEQ ID NO: 191685 - protein, 16 aa, Borrelia afzelii
ETKRAFSEEDFNLINK

SEQ ID NO: 191686 - protein, 16 aa, Borrelia afzelii
TKRAFSEEDFNLINKR

SEQ ID NO: 191687 - protein, 16 aa, Borrelia afzelii
KRAFSEEDFNLINKRL

SEQ ID NO: 191688 - protein, 16 aa, Borrelia afzelii
RAFSEEDFNLINKRLD

SEQ ID NO: 191689 - protein, 16 aa, Borrelia afzelii
AFSEEDFNLINKRLDN

SEQ ID NO: 191690 - protein, 16 aa, Borrelia afzelii
FSEEDFNLINKRLDNY

SEQ ID NO: 191691 - protein, 16 aa, Borrelia afzelii
SEEDFNLINKRLDNYD

SEQ ID NO: 191692 - protein, 16 aa, Borrelia afzelii
EEDFNLINKRLDNYDF

SEQ ID NO: 191693 - protein, 16 aa, Borrelia afzelii
EDFNLINKRLDNYDFK

SEQ ID NO: 191694 - protein, 16 aa, Borrelia afzelii
DFNLINKRLDNYDFKN

SEQ ID NO: 191695 - protein, 16 aa, Borrelia afzelii
FNLINKRLDNYDFKNE

SEQ ID NO: 191696 - protein, 16 aa, Borrelia afzelii
NLINKRLDNYDFKNEY

SEQ ID NO: 191697 - protein, 16 aa, Borrelia afzelii
LINKRLDNYDFKNEYE

SEQ ID NO: 191698 - protein, 16 aa, Borrelia afzelii
INKRLDNYDFKNEYEK

SEQ ID NO: 191699 - protein, 16 aa, Borrelia afzelii
NKRLDNYDFKNEYEKS

SEQ ID NO: 191700 - protein, 16 aa, Borrelia afzelii
KRLDNYDFKNEYEKSH

SEQ ID NO: 191701 - protein, 16 aa, Borrelia afzelii
RLDNYDFKNEYEKSHV

SEQ ID NO: 191702 - protein, 16 aa, Borrelia afzelii
LDNYDFKNEYEKSHVF

SEQ ID NO: 191703 - protein, 16 aa, Borrelia afzelii
DNYDFKNEYEKSHVFS

SEQ ID NO: 191704 - protein, 16 aa, Borrelia afzelii
NYDFKNEYEKSHVFSD

SEQ ID NO: 191705 - protein, 16 aa, Borrelia afzelii
YDFKNEYEKSHVFSDA

SEQ ID NO: 191706 - protein, 16 aa, Borrelia afzelii
DFKNEYEKSHVFSDAP

SEQ ID NO: 191707 - protein, 16 aa, Borrelia afzelii
FKNEYEKSHVFSDAPR

SEQ ID NO: 191708 - protein, 16 aa, Borrelia afzelii
KNEYEKSHVFSDAPRI

SEQ ID NO: 191709 - protein, 16 aa, Borrelia afzelii
NEYEKSHVFSDAPRIR

SEQ ID NO: 191710 - protein, 16 aa, Borrelia afzelii
EYEKSHVFSDAPRIRR

SEQ ID NO: 191711 - protein, 16 aa, Borrelia afzelii
YEKSHVFSDAPRIRRD

SEQ ID NO: 191712 - protein, 16 aa, Borrelia afzelii
EKSHVFSDAPRIRRDL

SEQ ID NO: 191713 - protein, 16 aa, Borrelia afzelii
KSHVFSDAPRIRRDLR

SEQ ID NO: 191714 - protein, 16 aa, Borrelia afzelii
SHVFSDAPRIRRDLRK

SEQ ID NO: 191715 - protein, 16 aa, Borrelia afzelii
HVFSDAPRIRRDLRKI

SEQ ID NO: 191716 - protein, 16 aa, Borrelia afzelii
VFSDAPRIRRDLRKIG

SEQ ID NO: 191717 - protein, 16 aa, Borrelia afzelii
FSDAPRIRRDLRKIGI

SEQ ID NO: 191718 - protein, 16 aa, Borrelia afzelii
SDAPRIRRDLRKIGIK

SEQ ID NO: 191719 - protein, 16 aa, Borrelia afzelii
DAPRIRRDLRKIGIKE

SEQ ID NO: 191720 - protein, 16 aa, Borrelia afzelii
APRIRRDLRKIGIKEK

SEQ ID NO: 191721 - protein, 16 aa, Borrelia afzelii
PRIRRDLRKIGIKEKS

SEQ ID NO: 191722 - protein, 16 aa, Borrelia afzelii
RIRRDLRKIGIKEKSV

SEQ ID NO: 191723 - protein, 16 aa, Borrelia afzelii
IRRDLRKIGIKEKSVF

SEQ ID NO: 191724 - protein, 16 aa, Borrelia afzelii
RRDLRKIGIKEKSVFL

SEQ ID NO: 191725 - protein, 16 aa, Borrelia afzelii
RDLRKIGIKEKSVFLD

SEQ ID NO: 191726 - protein, 16 aa, Borrelia afzelii
DLRKIGIKEKSVFLDA

SEQ ID NO: 191727 - protein, 16 aa, Borrelia afzelii
LRKIGIKEKSVFLDAL

SEQ ID NO: 191728 - protein, 16 aa, Borrelia afzelii
RKIGIKEKSVFLDALD

SEQ ID NO: 191729 - protein, 16 aa, Borrelia afzelii
KIGIKEKSVFLDALDI

SEQ ID NO: 191730 - protein, 16 aa, Borrelia afzelii
IGIKEKSVFLDALDII

SEQ ID NO: 191731 - protein, 16 aa, Borrelia afzelii
GIKEKSVFLDALDIIE

SEQ ID NO: 191732 - protein, 16 aa, Borrelia afzelii
IKEKSVFLDALDIIEY

SEQ ID NO: 191733 - protein, 16 aa, Borrelia afzelii
KEKSVFLDALDIIEYL

SEQ ID NO: 191734 - protein, 16 aa, Borrelia afzelii
EKSVFLDALDIIEYLI

SEQ ID NO: 191735 - protein, 16 aa, Borrelia afzelii
KSVFLDALDIIEYLIK

SEQ ID NO: 191736 - protein, 16 aa, Borrelia afzelii
SVFLDALDIIEYLIKI

SEQ ID NO: 191737 - protein, 16 aa, Borrelia afzelii
VFLDALDIIEYLIKIK

SEQ ID NO: 191738 - protein, 16 aa, Borrelia afzelii
FLDALDIIEYLIKIKI

SEQ ID NO: 191739 - protein, 16 aa, Borrelia afzelii
LDALDIIEYLIKIKIS

SEQ ID NO: 191740 - protein, 16 aa, Borrelia afzelii
DALDIIEYLIKIKISA

SEQ ID NO: 191741 - protein, 16 aa, Borrelia afzelii
ALDIIEYLIKIKISAD

SEQ ID NO: 191742 - protein, 16 aa, Borrelia afzelii
LDIIEYLIKIKISADS

SEQ ID NO: 191743 - protein, 16 aa, Borrelia afzelii
DIIEYLIKIKISADSI

SEQ ID NO: 191744 - protein, 16 aa, Borrelia afzelii
IIEYLIKIKISADSIF

SEQ ID NO: 191745 - protein, 16 aa, Borrelia afzelii
IEYLIKIKISADSIFL

SEQ ID NO: 191746 - protein, 16 aa, Borrelia afzelii
EYLIKIKISADSIFLS

SEQ ID NO: 191747 - protein, 16 aa, Borrelia afzelii
YLIKIKISADSIFLSE

SEQ ID NO: 191748 - protein, 16 aa, Borrelia afzelii
LIKIKISADSIFLSED

SEQ ID NO: 191749 - protein, 16 aa, Borrelia afzelii
IKIKISADSIFLSEDM

SEQ ID NO: 191750 - protein, 16 aa, Borrelia afzelii
KIKISADSIFLSEDMI

SEQ ID NO: 191751 - protein, 16 aa, Borrelia afzelii
IKISADSIFLSEDMIR

SEQ ID NO: 191752 - protein, 16 aa, Borrelia afzelii
KISADSIFLSEDMIRL

SEQ ID NO: 191753 - protein, 16 aa, Borrelia afzelii
ISADSIFLSEDMIRLI

SEQ ID NO: 191754 - protein, 16 aa, Borrelia afzelii
SADSIFLSEDMIRLIG

SEQ ID NO: 191755 - protein, 16 aa, Borrelia afzelii
ADSIFLSEDMIRLIGG

SEQ ID NO: 191756 - protein, 16 aa, Borrelia afzelii
DSIFLSEDMIRLIGGY

SEQ ID NO: 191757 - protein, 16 aa, Borrelia afzelii
SIFLSEDMIRLIGGYP

SEQ ID NO: 191758 - protein, 16 aa, Borrelia afzelii
IFLSEDMIRLIGGYPD

SEQ ID NO: 191759 - protein, 16 aa, Borrelia afzelii
FLSEDMIRLIGGYPDL

SEQ ID NO: 191760 - protein, 16 aa, Borrelia afzelii
LSEDMIRLIGGYPDLI

SEQ ID NO: 191761 - protein, 16 aa, Borrelia afzelii
SEDMIRLIGGYPDLIF

SEQ ID NO: 191762 - protein, 16 aa, Borrelia afzelii
EDMIRLIGGYPDLIFN

SEQ ID NO: 191763 - protein, 16 aa, Borrelia afzelii
DMIRLIGGYPDLIFNY

SEQ ID NO: 191764 - protein, 16 aa, Borrelia afzelii
MIRLIGGYPDLIFNYL

SEQ ID NO: 191765 - protein, 16 aa, Borrelia afzelii
IRLIGGYPDLIFNYLI

SEQ ID NO: 191766 - protein, 16 aa, Borrelia afzelii
RLIGGYPDLIFNYLIQ

SEQ ID NO: 191767 - protein, 16 aa, Borrelia afzelii
LIGGYPDLIFNYLIQL

SEQ ID NO: 191768 - protein, 16 aa, Borrelia afzelii
IGGYPDLIFNYLIQLN

SEQ ID NO: 191769 - protein, 16 aa, Borrelia afzelii
GGYPDLIFNYLIQLNS

SEQ ID NO: 191770 - protein, 16 aa, Borrelia afzelii
GYPDLIFNYLIQLNSD

SEQ ID NO: 191771 - protein, 16 aa, Borrelia afzelii
YPDLIFNYLIQLNSDK

SEQ ID NO: 191772 - protein, 16 aa, Borrelia afzelii
PDLIFNYLIQLNSDKI

SEQ ID NO: 191773 - protein, 16 aa, Borrelia afzelii
DLIFNYLIQLNSDKID

SEQ ID NO: 191774 - protein, 16 aa, Borrelia afzelii
LIFNYLIQLNSDKIDY

SEQ ID NO: 191775 - protein, 16 aa, Borrelia afzelii
IFNYLIQLNSDKIDYA

SEQ ID NO: 191776 - protein, 16 aa, Borrelia afzelii
FNYLIQLNSDKIDYAE

SEQ ID NO: 191777 - protein, 16 aa, Borrelia afzelii
NYLIQLNSDKIDYAEK

SEQ ID NO: 191778 - protein, 16 aa, Borrelia afzelii
YLIQLNSDKIDYAEKY

SEQ ID NO: 191779 - protein, 16 aa, Borrelia afzelii
LIQLNSDKIDYAEKYG

SEQ ID NO: 191780 - protein, 16 aa, Borrelia afzelii
IQLNSDKIDYAEKYGD

SEQ ID NO: 191781 - protein, 16 aa, Borrelia afzelii
QLNSDKIDYAEKYGDN

SEQ ID NO: 191782 - protein, 16 aa, Borrelia afzelii
LNSDKIDYAEKYGDNA

SEQ ID NO: 191783 - protein, 16 aa, Borrelia afzelii
NSDKIDYAEKYGDNAR

SEQ ID NO: 191784 - protein, 16 aa, Borrelia afzelii
SDKIDYAEKYGDNARN

SEQ ID NO: 191785 - protein, 16 aa, Borrelia afzelii
DKIDYAEKYGDNARNN

SEQ ID NO: 191786 - protein, 16 aa, Borrelia afzelii
KIDYAEKYGDNARNNF

SEQ ID NO: 191787 - protein, 16 aa, Borrelia afzelii
IDYAEKYGDNARNNFK

SEQ ID NO: 191788 - protein, 16 aa, Borrelia afzelii
DYAEKYGDNARNNFKE

SEQ ID NO: 191789 - protein, 16 aa, Borrelia afzelii
YAEKYGDNARNNFKED

SEQ ID NO: 191790 - protein, 16 aa, Borrelia afzelii
AEKYGDNARNNFKEDY

SEQ ID NO: 191791 - protein, 16 aa, Borrelia afzelii
EKYGDNARNNFKEDYS

SEQ ID NO: 191792 - protein, 16 aa, Borrelia afzelii
KYGDNARNNFKEDYSK

SEQ ID NO: 191793 - protein, 16 aa, Borrelia afzelii
YGDNARNNFKEDYSKD

SEQ ID NO: 191794 - protein, 16 aa, Borrelia afzelii
GDNARNNFKEDYSKDK

SEQ ID NO: 191795 - protein, 16 aa, Borrelia afzelii
DNARNNFKEDYSKDKT

SEQ ID NO: 191796 - protein, 16 aa, Borrelia afzelii
NARNNFKEDYSKDKTN

SEQ ID NO: 191797 - protein, 16 aa, Borrelia afzelii
ARNNFKEDYSKDKTNT

SEQ ID NO: 191798 - protein, 16 aa, Borrelia afzelii
RNNFKEDYSKDKTNTV

SEQ ID NO: 191799 - protein, 16 aa, Borrelia afzelii
NNFKEDYSKDKTNTVK

SEQ ID NO: 191800 - protein, 16 aa, Borrelia afzelii
NFKEDYSKDKTNTVKQ

SEQ ID NO: 191801 - protein, 16 aa, Borrelia afzelii
FKEDYSKDKTNTVKQI

SEQ ID NO: 191802 - protein, 16 aa, Borrelia afzelii
KEDYSKDKTNTVKQIL

SEQ ID NO: 191803 - protein, 16 aa, Borrelia afzelii
EDYSKDKTNTVKQILK

SEQ ID NO: 191804 - protein, 16 aa, Borrelia afzelii
DYSKDKTNTVKQILKQ

SEQ ID NO: 191805 - protein, 16 aa, Borrelia afzelii
YSKDKTNTVKQILKQI

SEQ ID NO: 191806 - protein, 16 aa, Borrelia afzelii
SKDKTNTVKQILKQIL

SEQ ID NO: 191807 - protein, 16 aa, Borrelia afzelii
KDKTNTVKQILKQILA

SEQ ID NO: 191808 - protein, 16 aa, Borrelia afzelii
DKTNTVKQILKQILAD

SEQ ID NO: 191809 - protein, 16 aa, Borrelia afzelii
KTNTVKQILKQILADL

SEQ ID NO: 191810 - protein, 16 aa, Borrelia afzelii
TNTVKQILKQILADLP

SEQ ID NO: 191811 - protein, 16 aa, Borrelia afzelii
NTVKQILKQILADLPK

SEQ ID NO: 191812 - protein, 16 aa, Borrelia afzelii
TVKQILKQILADLPKD

SEQ ID NO: 191813 - protein, 274 aa, Borrelia garinii
MKKYLLGIGLILALIACKQNVSSLDEKNSVSVDLPGGMKVLVSKEKDKDGKYSLMATVEKLELKGTSDKSNGSGVLEGEKADKSKAKLTISQDLNQTTFEIFKEDGKTLVSRKVNSKDKSSTEEKFNDKGKLSEKVVTRANGTRLEYTEIKNDGSGKAKEVLKGFALEGTLTDGGETKLTVTEGTVTLSKNISKSGEITVALNDTETTPADKKTGEWKSDTSTLTISKNSQKPKQLVFTKENTITVQNYNRAGNALEGSPAEIKDLAELKAALK

SEQ ID NO: 191814 - protein, 8 aa, Borrelia garinii
MKKYLLGI

SEQ ID NO: 191815 - protein, 8 aa, Borrelia garinii
KKYLLGIG

SEQ ID NO: 191816 - protein, 8 aa, Borrelia garinii
KYLLGIGL

SEQ ID NO: 191817 - protein, 8 aa, Borrelia garinii
YLLGIGLI

SEQ ID NO: 191818 - protein, 8 aa, Borrelia garinii
LLGIGLIL

SEQ ID NO: 191819 - protein, 8 aa, Borrelia garinii
LGIGLILA

SEQ ID NO: 191820 - protein, 8 aa, Borrelia garinii
GIGLILAL

SEQ ID NO: 191821 - protein, 8 aa, Borrelia garinii
IGLILALI

SEQ ID NO: 191822 - protein, 8 aa, Borrelia garinii
GLILALIA

SEQ ID NO: 191823 - protein, 8 aa, Borrelia garinii
LILALIAC

SEQ ID NO: 191824 - protein, 8 aa, Borrelia garinii
ILALIACK

SEQ ID NO: 191825 - protein, 8 aa, Borrelia garinii
LALIACKQ

SEQ ID NO: 191826 - protein, 8 aa, Borrelia garinii
ALIACKQN

SEQ ID NO: 191827 - protein, 8 aa, Borrelia garinii
LIACKQNV

SEQ ID NO: 191828 - protein, 8 aa, Borrelia garinii
IACKQNVS

SEQ ID NO: 191829 - protein, 8 aa, Borrelia garinii
ACKQNVSS

SEQ ID NO: 191830 - protein, 8 aa, Borrelia garinii
CKQNVSSL

SEQ ID NO: 191831 - protein, 8 aa, Borrelia garinii
KQNVSSLD

SEQ ID NO: 191832 - protein, 8 aa, Borrelia garinii
QNVSSLDE

SEQ ID NO: 191833 - protein, 8 aa, Borrelia garinii
NVSSLDEK

SEQ ID NO: 191834 - protein, 8 aa, Borrelia garinii
VSSLDEKN

SEQ ID NO: 191835 - protein, 8 aa, Borrelia garinii
SSLDEKNS

SEQ ID NO: 191836 - protein, 8 aa, Borrelia garinii
SLDEKNSV

SEQ ID NO: 191837 - protein, 8 aa, Borrelia garinii
LDEKNSVS

SEQ ID NO: 191838 - protein, 8 aa, Borrelia garinii
DEKNSVSV

SEQ ID NO: 191839 - protein, 8 aa, Borrelia garinii
EKNSVSVD

SEQ ID NO: 191840 - protein, 8 aa, Borrelia garinii
KNSVSVDL

SEQ ID NO: 191841 - protein, 8 aa, Borrelia garinii
NSVSVDLP

SEQ ID NO: 191842 - protein, 8 aa, Borrelia garinii
SVSVDLPG

SEQ ID NO: 191843 - protein, 8 aa, Borrelia garinii
VSVDLPGG

SEQ ID NO: 191844 - protein, 8 aa, Borrelia garinii
SVDLPGGM

SEQ ID NO: 191845 - protein, 8 aa, Borrelia garinii
VDLPGGMK

SEQ ID NO: 191846 - protein, 8 aa, Borrelia garinii
DLPGGMKV

SEQ ID NO: 191847 - protein, 8 aa, Borrelia garinii
LPGGMKVL

SEQ ID NO: 191848 - protein, 8 aa, Borrelia garinii
PGGMKVLV

SEQ ID NO: 191849 - protein, 8 aa, Borrelia garinii
GGMKVLVS

SEQ ID NO: 191850 - protein, 8 aa, Borrelia garinii
GMKVLVSK

SEQ ID NO: 191851 - protein, 8 aa, Borrelia garinii
MKVLVSKE

SEQ ID NO: 191852 - protein, 8 aa, Borrelia garinii
KVLVSKEK

SEQ ID NO: 191853 - protein, 8 aa, Borrelia garinii
VLVSKEKD

SEQ ID NO: 191854 - protein, 8 aa, Borrelia garinii
LVSKEKDK

SEQ ID NO: 191855 - protein, 8 aa, Borrelia garinii
VSKEKDKD

SEQ ID NO: 191856 - protein, 8 aa, Borrelia garinii
SKEKDKDG

SEQ ID NO: 191857 - protein, 8 aa, Borrelia garinii
KEKDKDGK

SEQ ID NO: 191858 - protein, 8 aa, Borrelia garinii
EKDKDGKY

SEQ ID NO: 191859 - protein, 8 aa, Borrelia garinii
KDKDGKYS

SEQ ID NO: 191860 - protein, 8 aa, Borrelia garinii
DKDGKYSL

SEQ ID NO: 191861 - protein, 8 aa, Borrelia garinii
KDGKYSLM

SEQ ID NO: 191862 - protein, 8 aa, Borrelia garinii
DGKYSLMA

SEQ ID NO: 191863 - protein, 8 aa, Borrelia garinii
GKYSLMAT

SEQ ID NO: 191864 - protein, 8 aa, Borrelia garinii
KYSLMATV

SEQ ID NO: 191865 - protein, 8 aa, Borrelia garinii
YSLMATVE

SEQ ID NO: 191866 - protein, 8 aa, Borrelia garinii
SLMATVEK

SEQ ID NO: 191867 - protein, 8 aa, Borrelia garinii
LMATVEKL

SEQ ID NO: 191868 - protein, 8 aa, Borrelia garinii
MATVEKLE

SEQ ID NO: 191869 - protein, 8 aa, Borrelia garinii
ATVEKLEL

SEQ ID NO: 191870 - protein, 8 aa, Borrelia garinii
TVEKLELK

SEQ ID NO: 191871 - protein, 8 aa, Borrelia garinii
VEKLELKG

SEQ ID NO: 191872 - protein, 8 aa, Borrelia garinii
EKLELKGT

SEQ ID NO: 191873 - protein, 8 aa, Borrelia garinii
KLELKGTS

SEQ ID NO: 191874 - protein, 8 aa, Borrelia garinii
LELKGTSD

SEQ ID NO: 191875 - protein, 8 aa, Borrelia garinii
ELKGTSDK

SEQ ID NO: 191876 - protein, 8 aa, Borrelia garinii
LKGTSDKS

SEQ ID NO: 191877 - protein, 8 aa, Borrelia garinii
KGTSDKSN

SEQ ID NO: 191878 - protein, 8 aa, Borrelia garinii
GTSDKSNG

SEQ ID NO: 191879 - protein, 8 aa, Borrelia garinii
TSDKSNGS

SEQ ID NO: 191880 - protein, 8 aa, Borrelia garinii
SDKSNGSG

SEQ ID NO: 191881 - protein, 8 aa, Borrelia garinii
DKSNGSGV

SEQ ID NO: 191882 - protein, 8 aa, Borrelia garinii
KSNGSGVL

SEQ ID NO: 191883 - protein, 8 aa, Borrelia garinii
SNGSGVLE

SEQ ID NO: 191884 - protein, 8 aa, Borrelia garinii
NGSGVLEG

SEQ ID NO: 191885 - protein, 8 aa, Borrelia garinii
GSGVLEGE

SEQ ID NO: 191886 - protein, 8 aa, Borrelia garinii
SGVLEGEK

SEQ ID NO: 191887 - protein, 8 aa, Borrelia garinii
GVLEGEKA

SEQ ID NO: 191888 - protein, 8 aa, Borrelia garinii
VLEGEKAD

SEQ ID NO: 191889 - protein, 8 aa, Borrelia garinii
LEGEKADK

SEQ ID NO: 191890 - protein, 8 aa, Borrelia garinii
EGEKADKS

SEQ ID NO: 191891 - protein, 8 aa, Borrelia garinii
GEKADKSK

SEQ ID NO: 191892 - protein, 8 aa, Borrelia garinii
EKADKSKA

SEQ ID NO: 191893 - protein, 8 aa, Borrelia garinii
KADKSKAK

SEQ ID NO: 191894 - protein, 8 aa, Borrelia garinii
ADKSKAKL

SEQ ID NO: 191895 - protein, 8 aa, Borrelia garinii
DKSKAKLT

SEQ ID NO: 191896 - protein, 8 aa, Borrelia garinii
KSKAKLTI

SEQ ID NO: 191897 - protein, 8 aa, Borrelia garinii
SKAKLTIS

SEQ ID NO: 191898 - protein, 8 aa, Borrelia garinii
KAKLTISQ

SEQ ID NO: 191899 - protein, 8 aa, Borrelia garinii
AKLTISQD

SEQ ID NO: 191900 - protein, 8 aa, Borrelia garinii
KLTISQDL

SEQ ID NO: 191901 - protein, 8 aa, Borrelia garinii
LTISQDLN

SEQ ID NO: 191902 - protein, 8 aa, Borrelia garinii
TISQDLNQ

SEQ ID NO: 191903 - protein, 8 aa, Borrelia garinii
ISQDLNQT

SEQ ID NO: 191904 - protein, 8 aa, Borrelia garinii
SQDLNQTT

SEQ ID NO: 191905 - protein, 8 aa, Borrelia garinii
QDLNQTTF

SEQ ID NO: 191906 - protein, 8 aa, Borrelia garinii
DLNQTTFE

SEQ ID NO: 191907 - protein, 8 aa, Borrelia garinii
LNQTTFEI

SEQ ID NO: 191908 - protein, 8 aa, Borrelia garinii
NQTTFEIF

SEQ ID NO: 191909 - protein, 8 aa, Borrelia garinii
QTTFEIFK

SEQ ID NO: 191910 - protein, 8 aa, Borrelia garinii
TTFEIFKE

SEQ ID NO: 191911 - protein, 8 aa, Borrelia garinii
TFEIFKED

SEQ ID NO: 191912 - protein, 8 aa, Borrelia garinii
FEIFKEDG

SEQ ID NO: 191913 - protein, 8 aa, Borrelia garinii
EIFKEDGK

SEQ ID NO: 191914 - protein, 8 aa, Borrelia garinii
IFKEDGKT

SEQ ID NO: 191915 - protein, 8 aa, Borrelia garinii
FKEDGKTL

SEQ ID NO: 191916 - protein, 8 aa, Borrelia garinii
KEDGKTLV

SEQ ID NO: 191917 - protein, 8 aa, Borrelia garinii
EDGKTLVS

SEQ ID NO: 191918 - protein, 8 aa, Borrelia garinii
DGKTLVSR

SEQ ID NO: 191919 - protein, 8 aa, Borrelia garinii
GKTLVSRK

SEQ ID NO: 191920 - protein, 8 aa, Borrelia garinii
KTLVSRKV

SEQ ID NO: 191921 - protein, 8 aa, Borrelia garinii
TLVSRKVN

SEQ ID NO: 191922 - protein, 8 aa, Borrelia garinii
LVSRKVNS

SEQ ID NO: 191923 - protein, 8 aa, Borrelia garinii
VSRKVNSK

SEQ ID NO: 191924 - protein, 8 aa, Borrelia garinii
SRKVNSKD

SEQ ID NO: 191925 - protein, 8 aa, Borrelia garinii
RKVNSKDK

SEQ ID NO: 191926 - protein, 8 aa, Borrelia garinii
KVNSKDKS

SEQ ID NO: 191927 - protein, 8 aa, Borrelia garinii
VNSKDKSS

SEQ ID NO: 191928 - protein, 8 aa, Borrelia garinii
NSKDKSST

SEQ ID NO: 191929 - protein, 8 aa, Borrelia garinii
SKDKSSTE

SEQ ID NO: 191930 - protein, 8 aa, Borrelia garinii
KDKSSTEE

SEQ ID NO: 191931 - protein, 8 aa, Borrelia garinii
DKSSTEEK

SEQ ID NO: 191932 - protein, 8 aa, Borrelia garinii
KSSTEEKF

SEQ ID NO: 191933 - protein, 8 aa, Borrelia garinii
SSTEEKFN

SEQ ID NO: 191934 - protein, 8 aa, Borrelia garinii
STEEKFND

SEQ ID NO: 191935 - protein, 8 aa, Borrelia garinii
TEEKFNDK

SEQ ID NO: 191936 - protein, 8 aa, Borrelia garinii
EEKFNDKG

SEQ ID NO: 191937 - protein, 8 aa, Borrelia garinii
EKFNDKGK

SEQ ID NO: 191938 - protein, 8 aa, Borrelia garinii
KFNDKGKL

SEQ ID NO: 191939 - protein, 8 aa, Borrelia garinii
FNDKGKLS

SEQ ID NO: 191940 - protein, 8 aa, Borrelia garinii
NDKGKLSE

SEQ ID NO: 191941 - protein, 8 aa, Borrelia garinii
DKGKLSEK

SEQ ID NO: 191942 - protein, 8 aa, Borrelia garinii
KGKLSEKV

SEQ ID NO: 191943 - protein, 8 aa, Borrelia garinii
GKLSEKVV

SEQ ID NO: 191944 - protein, 8 aa, Borrelia garinii
KLSEKVVT

SEQ ID NO: 191945 - protein, 8 aa, Borrelia garinii
LSEKVVTR

SEQ ID NO: 191946 - protein, 8 aa, Borrelia garinii
SEKVVTRA

SEQ ID NO: 191947 - protein, 8 aa, Borrelia garinii
EKVVTRAN

SEQ ID NO: 191948 - protein, 8 aa, Borrelia garinii
KVVTRANG

SEQ ID NO: 191949 - protein, 8 aa, Borrelia garinii
VVTRANGT

SEQ ID NO: 191950 - protein, 8 aa, Borrelia garinii
VTRANGTR

SEQ ID NO: 191951 - protein, 8 aa, Borrelia garinii
TRANGTRL

SEQ ID NO: 191952 - protein, 8 aa, Borrelia garinii
RANGTRLE

SEQ ID NO: 191953 - protein, 8 aa, Borrelia garinii
ANGTRLEY

SEQ ID NO: 191954 - protein, 8 aa, Borrelia garinii
NGTRLEYT

SEQ ID NO: 191955 - protein, 8 aa, Borrelia garinii
GTRLEYTE

SEQ ID NO: 191956 - protein, 8 aa, Borrelia garinii
TRLEYTEI

SEQ ID NO: 191957 - protein, 8 aa, Borrelia garinii
RLEYTEIK

SEQ ID NO: 191958 - protein, 8 aa, Borrelia garinii
LEYTEIKN

SEQ ID NO: 191959 - protein, 8 aa, Borrelia garinii
EYTEIKND

SEQ ID NO: 191960 - protein, 8 aa, Borrelia garinii
YTEIKNDG

SEQ ID NO: 191961 - protein, 8 aa, Borrelia garinii
TEIKNDGS

SEQ ID NO: 191962 - protein, 8 aa, Borrelia garinii
EIKNDGSG

SEQ ID NO: 191963 - protein, 8 aa, Borrelia garinii
IKNDGSGK

SEQ ID NO: 191964 - protein, 8 aa, Borrelia garinii
KNDGSGKA

SEQ ID NO: 191965 - protein, 8 aa, Borrelia garinii
NDGSGKAK

SEQ ID NO: 191966 - protein, 8 aa, Borrelia garinii
DGSGKAKE

SEQ ID NO: 191967 - protein, 8 aa, Borrelia garinii
GSGKAKEV

SEQ ID NO: 191968 - protein, 8 aa, Borrelia garinii
SGKAKEVL

SEQ ID NO: 191969 - protein, 8 aa, Borrelia garinii
GKAKEVLK

SEQ ID NO: 191970 - protein, 8 aa, Borrelia garinii
KAKEVLKG

SEQ ID NO: 191971 - protein, 8 aa, Borrelia garinii
AKEVLKGF

SEQ ID NO: 191972 - protein, 8 aa, Borrelia garinii
KEVLKGFA

SEQ ID NO: 191973 - protein, 8 aa, Borrelia garinii
EVLKGFAL

SEQ ID NO: 191974 - protein, 8 aa, Borrelia garinii
VLKGFALE

SEQ ID NO: 191975 - protein, 8 aa, Borrelia garinii
LKGFALEG

SEQ ID NO: 191976 - protein, 8 aa, Borrelia garinii
KGFALEGT

SEQ ID NO: 191977 - protein, 8 aa, Borrelia garinii
GFALEGTL

SEQ ID NO: 191978 - protein, 8 aa, Borrelia garinii
FALEGTLT

SEQ ID NO: 191979 - protein, 8 aa, Borrelia garinii
ALEGTLTD

SEQ ID NO: 191980 - protein, 8 aa, Borrelia garinii
LEGTLTDG

SEQ ID NO: 191981 - protein, 8 aa, Borrelia garinii
EGTLTDGG

SEQ ID NO: 191982 - protein, 8 aa, Borrelia garinii
GTLTDGGE

SEQ ID NO: 191983 - protein, 8 aa, Borrelia garinii
TLTDGGET

SEQ ID NO: 191984 - protein, 8 aa, Borrelia garinii
LTDGGETK

SEQ ID NO: 191985 - protein, 8 aa, Borrelia garinii
TDGGETKL

SEQ ID NO: 191986 - protein, 8 aa, Borrelia garinii
DGGETKLT

SEQ ID NO: 191987 - protein, 8 aa, Borrelia garinii
GGETKLTV

SEQ ID NO: 191988 - protein, 8 aa, Borrelia garinii
GETKLTVT

SEQ ID NO: 191989 - protein, 8 aa, Borrelia garinii
ETKLTVTE

SEQ ID NO: 191990 - protein, 8 aa, Borrelia garinii
TKLTVTEG

SEQ ID NO: 191991 - protein, 8 aa, Borrelia garinii
KLTVTEGT

SEQ ID NO: 191992 - protein, 8 aa, Borrelia garinii
LTVTEGTV

SEQ ID NO: 191993 - protein, 8 aa, Borrelia garinii
TVTEGTVT

SEQ ID NO: 191994 - protein, 8 aa, Borrelia garinii
VTEGTVTL

SEQ ID NO: 191995 - protein, 8 aa, Borrelia garinii
TEGTVTLS

SEQ ID NO: 191996 - protein, 8 aa, Borrelia garinii
EGTVTLSK

SEQ ID NO: 191997 - protein, 8 aa, Borrelia garinii
GTVTLSKN

SEQ ID NO: 191998 - protein, 8 aa, Borrelia garinii
TVTLSKNI

SEQ ID NO: 191999 - protein, 8 aa, Borrelia garinii
VTLSKNIS

SEQ ID NO: 192000 - protein, 8 aa, Borrelia garinii
TLSKNISK

SEQ ID NO: 192001 - protein, 8 aa, Borrelia garinii
LSKNISKS

SEQ ID NO: 192002 - protein, 8 aa, Borrelia garinii
SKNISKSG

SEQ ID NO: 192003 - protein, 8 aa, Borrelia garinii
KNISKSGE

SEQ ID NO: 192004 - protein, 8 aa, Borrelia garinii
NISKSGEI

SEQ ID NO: 192005 - protein, 8 aa, Borrelia garinii
ISKSGEIT

SEQ ID NO: 192006 - protein, 8 aa, Borrelia garinii
SKSGEITV

SEQ ID NO: 192007 - protein, 8 aa, Borrelia garinii
KSGEITVA

SEQ ID NO: 192008 - protein, 8 aa, Borrelia garinii
SGEITVAL

SEQ ID NO: 192009 - protein, 8 aa, Borrelia garinii
GEITVALN

SEQ ID NO: 192010 - protein, 8 aa, Borrelia garinii
EITVALND

SEQ ID NO: 192011 - protein, 8 aa, Borrelia garinii
ITVALNDT

SEQ ID NO: 192012 - protein, 8 aa, Borrelia garinii
TVALNDTE

SEQ ID NO: 192013 - protein, 8 aa, Borrelia garinii
VALNDTET

SEQ ID NO: 192014 - protein, 8 aa, Borrelia garinii
ALNDTETT

SEQ ID NO: 192015 - protein, 8 aa, Borrelia garinii
LNDTETTP

SEQ ID NO: 192016 - protein, 8 aa, Borrelia garinii
NDTETTPA

SEQ ID NO: 192017 - protein, 8 aa, Borrelia garinii
DTETTPAD

SEQ ID NO: 192018 - protein, 8 aa, Borrelia garinii
TETTPADK

SEQ ID NO: 192019 - protein, 8 aa, Borrelia garinii
ETTPADKK

SEQ ID NO: 192020 - protein, 8 aa, Borrelia garinii
TTPADKKT

SEQ ID NO: 192021 - protein, 8 aa, Borrelia garinii
TPADKKTG

SEQ ID NO: 192022 - protein, 8 aa, Borrelia garinii
PADKKTGE

SEQ ID NO: 192023 - protein, 8 aa, Borrelia garinii
ADKKTGEW

SEQ ID NO: 192024 - protein, 8 aa, Borrelia garinii
DKKTGEWK

SEQ ID NO: 192025 - protein, 8 aa, Borrelia garinii
KKTGEWKS

SEQ ID NO: 192026 - protein, 8 aa, Borrelia garinii
KTGEWKSD

SEQ ID NO: 192027 - protein, 8 aa, Borrelia garinii
TGEWKSDT

SEQ ID NO: 192028 - protein, 8 aa, Borrelia garinii
GEWKSDTS

SEQ ID NO: 192029 - protein, 8 aa, Borrelia garinii
EWKSDTST

SEQ ID NO: 192030 - protein, 8 aa, Borrelia garinii
WKSDTSTL

SEQ ID NO: 192031 - protein, 8 aa, Borrelia garinii
KSDTSTLT

SEQ ID NO: 192032 - protein, 8 aa, Borrelia garinii
SDTSTLTI

SEQ ID NO: 192033 - protein, 8 aa, Borrelia garinii
DTSTLTIS

SEQ ID NO: 192034 - protein, 8 aa, Borrelia garinii
TSTLTISK

SEQ ID NO: 192035 - protein, 8 aa, Borrelia garinii
STLTISKN

SEQ ID NO: 192036 - protein, 8 aa, Borrelia garinii
TLTISKNS

SEQ ID NO: 192037 - protein, 8 aa, Borrelia garinii
LTISKNSQ

SEQ ID NO: 192038 - protein, 8 aa, Borrelia garinii
TISKNSQK

SEQ ID NO: 192039 - protein, 8 aa, Borrelia garinii
ISKNSQKP

SEQ ID NO: 192040 - protein, 8 aa, Borrelia garinii
SKNSQKPK

SEQ ID NO: 192041 - protein, 8 aa, Borrelia garinii
KNSQKPKQ

SEQ ID NO: 192042 - protein, 8 aa, Borrelia garinii
NSQKPKQL

SEQ ID NO: 192043 - protein, 8 aa, Borrelia garinii
SQKPKQLV

SEQ ID NO: 192044 - protein, 8 aa, Borrelia garinii
QKPKQLVF

SEQ ID NO: 192045 - protein, 8 aa, Borrelia garinii
KPKQLVFT

SEQ ID NO: 192046 - protein, 8 aa, Borrelia garinii
PKQLVFTK

SEQ ID NO: 192047 - protein, 8 aa, Borrelia garinii
KQLVFTKE

SEQ ID NO: 192048 - protein, 8 aa, Borrelia garinii
QLVFTKEN

SEQ ID NO: 192049 - protein, 8 aa, Borrelia garinii
LVFTKENT

SEQ ID NO: 192050 - protein, 8 aa, Borrelia garinii
VFTKENTI

SEQ ID NO: 192051 - protein, 8 aa, Borrelia garinii
FTKENTIT

SEQ ID NO: 192052 - protein, 8 aa, Borrelia garinii
TKENTITV

SEQ ID NO: 192053 - protein, 8 aa, Borrelia garinii
KENTITVQ

SEQ ID NO: 192054 - protein, 8 aa, Borrelia garinii
ENTITVQN

SEQ ID NO: 192055 - protein, 8 aa, Borrelia garinii
NTITVQNY

SEQ ID NO: 192056 - protein, 8 aa, Borrelia garinii
TITVQNYN

SEQ ID NO: 192057 - protein, 8 aa, Borrelia garinii
ITVQNYNR

SEQ ID NO: 192058 - protein, 8 aa, Borrelia garinii
TVQNYNRA

SEQ ID NO: 192059 - protein, 8 aa, Borrelia garinii
VQNYNRAG

SEQ ID NO: 192060 - protein, 8 aa, Borrelia garinii
QNYNRAGN

SEQ ID NO: 192061 - protein, 8 aa, Borrelia garinii
NYNRAGNA

SEQ ID NO: 192062 - protein, 8 aa, Borrelia garinii
YNRAGNAL

SEQ ID NO: 192063 - protein, 8 aa, Borrelia garinii
NRAGNALE

SEQ ID NO: 192064 - protein, 8 aa, Borrelia garinii
RAGNALEG

SEQ ID NO: 192065 - protein, 8 aa, Borrelia garinii
AGNALEGS

SEQ ID NO: 192066 - protein, 8 aa, Borrelia garinii
GNALEGSP

SEQ ID NO: 192067 - protein, 8 aa, Borrelia garinii
NALEGSPA

SEQ ID NO: 192068 - protein, 8 aa, Borrelia garinii
ALEGSPAE

SEQ ID NO: 192069 - protein, 8 aa, Borrelia garinii
LEGSPAEI

SEQ ID NO: 192070 - protein, 8 aa, Borrelia garinii
EGSPAEIK

SEQ ID NO: 192071 - protein, 8 aa, Borrelia garinii
GSPAEIKD

SEQ ID NO: 192072 - protein, 8 aa, Borrelia garinii
SPAEIKDL

SEQ ID NO: 192073 - protein, 8 aa, Borrelia garinii
PAEIKDLA

SEQ ID NO: 192074 - protein, 8 aa, Borrelia garinii
AEIKDLAE

SEQ ID NO: 192075 - protein, 8 aa, Borrelia garinii
EIKDLAEL

SEQ ID NO: 192076 - protein, 8 aa, Borrelia garinii
IKDLAELK

SEQ ID NO: 192077 - protein, 8 aa, Borrelia garinii
KDLAELKA

SEQ ID NO: 192078 - protein, 8 aa, Borrelia garinii
DLAELKAA

SEQ ID NO: 192079 - protein, 8 aa, Borrelia garinii
LAELKAAL

SEQ ID NO: 192080 - protein, 8 aa, Borrelia garinii
AELKAALK

SEQ ID NO: 192081 - protein, 9 aa, Borrelia garinii
MKKYLLGIG

SEQ ID NO: 192082 - protein, 9 aa, Borrelia garinii
KKYLLGIGL

SEQ ID NO: 192083 - protein, 9 aa, Borrelia garinii
KYLLGIGLI

SEQ ID NO: 192084 - protein, 9 aa, Borrelia garinii
YLLGIGLIL

SEQ ID NO: 192085 - protein, 9 aa, Borrelia garinii
LLGIGLILA

SEQ ID NO: 192086 - protein, 9 aa, Borrelia garinii
LGIGLILAL

SEQ ID NO: 192087 - protein, 9 aa, Borrelia garinii
GIGLILALI

SEQ ID NO: 192088 - protein, 9 aa, Borrelia garinii
IGLILALIA

SEQ ID NO: 192089 - protein, 9 aa, Borrelia garinii
GLILALIAC

SEQ ID NO: 192090 - protein, 9 aa, Borrelia garinii
LILALIACK

SEQ ID NO: 192091 - protein, 9 aa, Borrelia garinii
ILALIACKQ

SEQ ID NO: 192092 - protein, 9 aa, Borrelia garinii
LALIACKQN

SEQ ID NO: 192093 - protein, 9 aa, Borrelia garinii
ALIACKQNV

SEQ ID NO: 192094 - protein, 9 aa, Borrelia garinii
LIACKQNVS

SEQ ID NO: 192095 - protein, 9 aa, Borrelia garinii
IACKQNVSS

SEQ ID NO: 192096 - protein, 9 aa, Borrelia garinii
ACKQNVSSL

SEQ ID NO: 192097 - protein, 9 aa, Borrelia garinii
CKQNVSSLD

SEQ ID NO: 192098 - protein, 9 aa, Borrelia garinii
KQNVSSLDE

SEQ ID NO: 192099 - protein, 9 aa, Borrelia garinii
QNVSSLDEK

SEQ ID NO: 192100 - protein, 9 aa, Borrelia garinii
NVSSLDEKN

SEQ ID NO: 192101 - protein, 9 aa, Borrelia garinii
VSSLDEKNS

SEQ ID NO: 192102 - protein, 9 aa, Borrelia garinii
SSLDEKNSV

SEQ ID NO: 192103 - protein, 9 aa, Borrelia garinii
SLDEKNSVS

SEQ ID NO: 192104 - protein, 9 aa, Borrelia garinii
LDEKNSVSV

SEQ ID NO: 192105 - protein, 9 aa, Borrelia garinii
DEKNSVSVD

SEQ ID NO: 192106 - protein, 9 aa, Borrelia garinii
EKNSVSVDL

SEQ ID NO: 192107 - protein, 9 aa, Borrelia garinii
KNSVSVDLP

SEQ ID NO: 192108 - protein, 9 aa, Borrelia garinii
NSVSVDLPG

SEQ ID NO: 192109 - protein, 9 aa, Borrelia garinii
SVSVDLPGG

SEQ ID NO: 192110 - protein, 9 aa, Borrelia garinii
VSVDLPGGM

SEQ ID NO: 192111 - protein, 9 aa, Borrelia garinii
SVDLPGGMK

SEQ ID NO: 192112 - protein, 9 aa, Borrelia garinii
VDLPGGMKV

SEQ ID NO: 192113 - protein, 9 aa, Borrelia garinii
DLPGGMKVL

SEQ ID NO: 192114 - protein, 9 aa, Borrelia garinii
LPGGMKVLV

SEQ ID NO: 192115 - protein, 9 aa, Borrelia garinii
PGGMKVLVS

SEQ ID NO: 192116 - protein, 9 aa, Borrelia garinii
GGMKVLVSK

SEQ ID NO: 192117 - protein, 9 aa, Borrelia garinii
GMKVLVSKE

SEQ ID NO: 192118 - protein, 9 aa, Borrelia garinii
MKVLVSKEK

SEQ ID NO: 192119 - protein, 9 aa, Borrelia garinii
KVLVSKEKD

SEQ ID NO: 192120 - protein, 9 aa, Borrelia garinii
VLVSKEKDK

SEQ ID NO: 192121 - protein, 9 aa, Borrelia garinii
LVSKEKDKD

SEQ ID NO: 192122 - protein, 9 aa, Borrelia garinii
VSKEKDKDG

SEQ ID NO: 192123 - protein, 9 aa, Borrelia garinii
SKEKDKDGK

SEQ ID NO: 192124 - protein, 9 aa, Borrelia garinii
KEKDKDGKY

SEQ ID NO: 192125 - protein, 9 aa, Borrelia garinii
EKDKDGKYS

SEQ ID NO: 192126 - protein, 9 aa, Borrelia garinii
KDKDGKYSL

SEQ ID NO: 192127 - protein, 9 aa, Borrelia garinii
DKDGKYSLM

SEQ ID NO: 192128 - protein, 9 aa, Borrelia garinii
KDGKYSLMA

SEQ ID NO: 192129 - protein, 9 aa, Borrelia garinii
DGKYSLMAT

SEQ ID NO: 192130 - protein, 9 aa, Borrelia garinii
GKYSLMATV

SEQ ID NO: 192131 - protein, 9 aa, Borrelia garinii
KYSLMATVE

SEQ ID NO: 192132 - protein, 9 aa, Borrelia garinii
YSLMATVEK

SEQ ID NO: 192133 - protein, 9 aa, Borrelia garinii
SLMATVEKL

SEQ ID NO: 192134 - protein, 9 aa, Borrelia garinii
LMATVEKLE

SEQ ID NO: 192135 - protein, 9 aa, Borrelia garinii
MATVEKLEL

SEQ ID NO: 192136 - protein, 9 aa, Borrelia garinii
ATVEKLELK

SEQ ID NO: 192137 - protein, 9 aa, Borrelia garinii
TVEKLELKG

SEQ ID NO: 192138 - protein, 9 aa, Borrelia garinii
VEKLELKGT

SEQ ID NO: 192139 - protein, 9 aa, Borrelia garinii
EKLELKGTS

SEQ ID NO: 192140 - protein, 9 aa, Borrelia garinii
KLELKGTSD

SEQ ID NO: 192141 - protein, 9 aa, Borrelia garinii
LELKGTSDK

SEQ ID NO: 192142 - protein, 9 aa, Borrelia garinii
ELKGTSDKS

SEQ ID NO: 192143 - protein, 9 aa, Borrelia garinii
LKGTSDKSN

SEQ ID NO: 192144 - protein, 9 aa, Borrelia garinii
KGTSDKSNG

SEQ ID NO: 192145 - protein, 9 aa, Borrelia garinii
GTSDKSNGS

SEQ ID NO: 192146 - protein, 9 aa, Borrelia garinii
TSDKSNGSG

SEQ ID NO: 192147 - protein, 9 aa, Borrelia garinii
SDKSNGSGV

SEQ ID NO: 192148 - protein, 9 aa, Borrelia garinii
DKSNGSGVL

SEQ ID NO: 192149 - protein, 9 aa, Borrelia garinii
KSNGSGVLE

SEQ ID NO: 192150 - protein, 9 aa, Borrelia garinii
SNGSGVLEG

SEQ ID NO: 192151 - protein, 9 aa, Borrelia garinii
NGSGVLEGE

SEQ ID NO: 192152 - protein, 9 aa, Borrelia garinii
GSGVLEGEK

SEQ ID NO: 192153 - protein, 9 aa, Borrelia garinii
SGVLEGEKA

SEQ ID NO: 192154 - protein, 9 aa, Borrelia garinii
GVLEGEKAD

SEQ ID NO: 192155 - protein, 9 aa, Borrelia garinii
VLEGEKADK

SEQ ID NO: 192156 - protein, 9 aa, Borrelia garinii
LEGEKADKS

SEQ ID NO: 192157 - protein, 9 aa, Borrelia garinii
EGEKADKSK

SEQ ID NO: 192158 - protein, 9 aa, Borrelia garinii
GEKADKSKA

SEQ ID NO: 192159 - protein, 9 aa, Borrelia garinii
EKADKSKAK

SEQ ID NO: 192160 - protein, 9 aa, Borrelia garinii
KADKSKAKL

SEQ ID NO: 192161 - protein, 9 aa, Borrelia garinii
ADKSKAKLT

SEQ ID NO: 192162 - protein, 9 aa, Borrelia garinii
DKSKAKLTI

SEQ ID NO: 192163 - protein, 9 aa, Borrelia garinii
KSKAKLTIS

SEQ ID NO: 192164 - protein, 9 aa, Borrelia garinii
SKAKLTISQ

SEQ ID NO: 192165 - protein, 9 aa, Borrelia garinii
KAKLTISQD

SEQ ID NO: 192166 - protein, 9 aa, Borrelia garinii
AKLTISQDL

SEQ ID NO: 192167 - protein, 9 aa, Borrelia garinii
KLTISQDLN

SEQ ID NO: 192168 - protein, 9 aa, Borrelia garinii
LTISQDLNQ

SEQ ID NO: 192169 - protein, 9 aa, Borrelia garinii
TISQDLNQT

SEQ ID NO: 192170 - protein, 9 aa, Borrelia garinii
ISQDLNQTT

SEQ ID NO: 192171 - protein, 9 aa, Borrelia garinii
SQDLNQTTF

SEQ ID NO: 192172 - protein, 9 aa, Borrelia garinii
QDLNQTTFE

SEQ ID NO: 192173 - protein, 9 aa, Borrelia garinii
DLNQTTFEI

SEQ ID NO: 192174 - protein, 9 aa, Borrelia garinii
LNQTTFEIF

SEQ ID NO: 192175 - protein, 9 aa, Borrelia garinii
NQTTFEIFK

SEQ ID NO: 192176 - protein, 9 aa, Borrelia garinii
QTTFEIFKE

SEQ ID NO: 192177 - protein, 9 aa, Borrelia garinii
TTFEIFKED

SEQ ID NO: 192178 - protein, 9 aa, Borrelia garinii
TFEIFKEDG

SEQ ID NO: 192179 - protein, 9 aa, Borrelia garinii
FEIFKEDGK

SEQ ID NO: 192180 - protein, 9 aa, Borrelia garinii
EIFKEDGKT

SEQ ID NO: 192181 - protein, 9 aa, Borrelia garinii
IFKEDGKTL

SEQ ID NO: 192182 - protein, 9 aa, Borrelia garinii
FKEDGKTLV

SEQ ID NO: 192183 - protein, 9 aa, Borrelia garinii
KEDGKTLVS

SEQ ID NO: 192184 - protein, 9 aa, Borrelia garinii
EDGKTLVSR

SEQ ID NO: 192185 - protein, 9 aa, Borrelia garinii
DGKTLVSRK

SEQ ID NO: 192186 - protein, 9 aa, Borrelia garinii
GKTLVSRKV

SEQ ID NO: 192187 - protein, 9 aa, Borrelia garinii
KTLVSRKVN

SEQ ID NO: 192188 - protein, 9 aa, Borrelia garinii
TLVSRKVNS

SEQ ID NO: 192189 - protein, 9 aa, Borrelia garinii
LVSRKVNSK

SEQ ID NO: 192190 - protein, 9 aa, Borrelia garinii
VSRKVNSKD

SEQ ID NO: 192191 - protein, 9 aa, Borrelia garinii
SRKVNSKDK

SEQ ID NO: 192192 - protein, 9 aa, Borrelia garinii
RKVNSKDKS

SEQ ID NO: 192193 - protein, 9 aa, Borrelia garinii
KVNSKDKSS

SEQ ID NO: 192194 - protein, 9 aa, Borrelia garinii
VNSKDKSST

SEQ ID NO: 192195 - protein, 9 aa, Borrelia garinii
NSKDKSSTE

SEQ ID NO: 192196 - protein, 9 aa, Borrelia garinii
SKDKSSTEE

SEQ ID NO: 192197 - protein, 9 aa, Borrelia garinii
KDKSSTEEK

SEQ ID NO: 192198 - protein, 9 aa, Borrelia garinii
DKSSTEEKF

SEQ ID NO: 192199 - protein, 9 aa, Borrelia garinii
KSSTEEKFN

SEQ ID NO: 192200 - protein, 9 aa, Borrelia garinii
SSTEEKFND

SEQ ID NO: 192201 - protein, 9 aa, Borrelia garinii
STEEKFNDK

SEQ ID NO: 192202 - protein, 9 aa, Borrelia garinii
TEEKFNDKG

SEQ ID NO: 192203 - protein, 9 aa, Borrelia garinii
EEKFNDKGK

SEQ ID NO: 192204 - protein, 9 aa, Borrelia garinii
EKFNDKGKL

SEQ ID NO: 192205 - protein, 9 aa, Borrelia garinii
KFNDKGKLS

SEQ ID NO: 192206 - protein, 9 aa, Borrelia garinii
FNDKGKLSE

SEQ ID NO: 192207 - protein, 9 aa, Borrelia garinii
NDKGKLSEK

SEQ ID NO: 192208 - protein, 9 aa, Borrelia garinii
DKGKLSEKV

SEQ ID NO: 192209 - protein, 9 aa, Borrelia garinii
KGKLSEKVV

SEQ ID NO: 192210 - protein, 9 aa, Borrelia garinii
GKLSEKVVT

SEQ ID NO: 192211 - protein, 9 aa, Borrelia garinii
KLSEKVVTR

SEQ ID NO: 192212 - protein, 9 aa, Borrelia garinii
LSEKVVTRA

SEQ ID NO: 192213 - protein, 9 aa, Borrelia garinii
SEKVVTRAN

SEQ ID NO: 192214 - protein, 9 aa, Borrelia garinii
EKVVTRANG

SEQ ID NO: 192215 - protein, 9 aa, Borrelia garinii
KVVTRANGT

SEQ ID NO: 192216 - protein, 9 aa, Borrelia garinii
VVTRANGTR

SEQ ID NO: 192217 - protein, 9 aa, Borrelia garinii
VTRANGTRL

SEQ ID NO: 192218 - protein, 9 aa, Borrelia garinii
TRANGTRLE

SEQ ID NO: 192219 - protein, 9 aa, Borrelia garinii
RANGTRLEY

SEQ ID NO: 192220 - protein, 9 aa, Borrelia garinii
ANGTRLEYT

SEQ ID NO: 192221 - protein, 9 aa, Borrelia garinii
NGTRLEYTE

SEQ ID NO: 192222 - protein, 9 aa, Borrelia garinii
GTRLEYTEI

SEQ ID NO: 192223 - protein, 9 aa, Borrelia garinii
TRLEYTEIK

SEQ ID NO: 192224 - protein, 9 aa, Borrelia garinii
RLEYTEIKN

SEQ ID NO: 192225 - protein, 9 aa, Borrelia garinii
LEYTEIKND

SEQ ID NO: 192226 - protein, 9 aa, Borrelia garinii
EYTEIKNDG

SEQ ID NO: 192227 - protein, 9 aa, Borrelia garinii
YTEIKNDGS

SEQ ID NO: 192228 - protein, 9 aa, Borrelia garinii
TEIKNDGSG

SEQ ID NO: 192229 - protein, 9 aa, Borrelia garinii
EIKNDGSGK

SEQ ID NO: 192230 - protein, 9 aa, Borrelia garinii
IKNDGSGKA

SEQ ID NO: 192231 - protein, 9 aa, Borrelia garinii
KNDGSGKAK

SEQ ID NO: 192232 - protein, 9 aa, Borrelia garinii
NDGSGKAKE

SEQ ID NO: 192233 - protein, 9 aa, Borrelia garinii
DGSGKAKEV

SEQ ID NO: 192234 - protein, 9 aa, Borrelia garinii
GSGKAKEVL

SEQ ID NO: 192235 - protein, 9 aa, Borrelia garinii
SGKAKEVLK

SEQ ID NO: 192236 - protein, 9 aa, Borrelia garinii
GKAKEVLKG

SEQ ID NO: 192237 - protein, 9 aa, Borrelia garinii
KAKEVLKGF

SEQ ID NO: 192238 - protein, 9 aa, Borrelia garinii
AKEVLKGFA

SEQ ID NO: 192239 - protein, 9 aa, Borrelia garinii
KEVLKGFAL

SEQ ID NO: 192240 - protein, 9 aa, Borrelia garinii
EVLKGFALE

SEQ ID NO: 192241 - protein, 9 aa, Borrelia garinii
VLKGFALEG

SEQ ID NO: 192242 - protein, 9 aa, Borrelia garinii
LKGFALEGT

SEQ ID NO: 192243 - protein, 9 aa, Borrelia garinii
KGFALEGTL

SEQ ID NO: 192244 - protein, 9 aa, Borrelia garinii
GFALEGTLT

SEQ ID NO: 192245 - protein, 9 aa, Borrelia garinii
FALEGTLTD

SEQ ID NO: 192246 - protein, 9 aa, Borrelia garinii
ALEGTLTDG

SEQ ID NO: 192247 - protein, 9 aa, Borrelia garinii
LEGTLTDGG

SEQ ID NO: 192248 - protein, 9 aa, Borrelia garinii
EGTLTDGGE

SEQ ID NO: 192249 - protein, 9 aa, Borrelia garinii
GTLTDGGET

SEQ ID NO: 192250 - protein, 9 aa, Borrelia garinii
TLTDGGETK

SEQ ID NO: 192251 - protein, 9 aa, Borrelia garinii
LTDGGETKL

SEQ ID NO: 192252 - protein, 9 aa, Borrelia garinii
TDGGETKLT

SEQ ID NO: 192253 - protein, 9 aa, Borrelia garinii
DGGETKLTV

SEQ ID NO: 192254 - protein, 9 aa, Borrelia garinii
GGETKLTVT

SEQ ID NO: 192255 - protein, 9 aa, Borrelia garinii
GETKLTVTE

SEQ ID NO: 192256 - protein, 9 aa, Borrelia garinii
ETKLTVTEG

SEQ ID NO: 192257 - protein, 9 aa, Borrelia garinii
TKLTVTEGT

SEQ ID NO: 192258 - protein, 9 aa, Borrelia garinii
KLTVTEGTV

SEQ ID NO: 192259 - protein, 9 aa, Borrelia garinii
LTVTEGTVT

SEQ ID NO: 192260 - protein, 9 aa, Borrelia garinii
TVTEGTVTL

SEQ ID NO: 192261 - protein, 9 aa, Borrelia garinii
VTEGTVTLS

SEQ ID NO: 192262 - protein, 9 aa, Borrelia garinii
TEGTVTLSK

SEQ ID NO: 192263 - protein, 9 aa, Borrelia garinii
EGTVTLSKN

SEQ ID NO: 192264 - protein, 9 aa, Borrelia garinii
GTVTLSKNI

SEQ ID NO: 192265 - protein, 9 aa, Borrelia garinii
TVTLSKNIS

SEQ ID NO: 192266 - protein, 9 aa, Borrelia garinii
VTLSKNISK

SEQ ID NO: 192267 - protein, 9 aa, Borrelia garinii
TLSKNISKS

SEQ ID NO: 192268 - protein, 9 aa, Borrelia garinii
LSKNISKSG

SEQ ID NO: 192269 - protein, 9 aa, Borrelia garinii
SKNISKSGE

SEQ ID NO: 192270 - protein, 9 aa, Borrelia garinii
KNISKSGEI

SEQ ID NO: 192271 - protein, 9 aa, Borrelia garinii
NISKSGEIT

SEQ ID NO: 192272 - protein, 9 aa, Borrelia garinii
ISKSGEITV

SEQ ID NO: 192273 - protein, 9 aa, Borrelia garinii
SKSGEITVA

SEQ ID NO: 192274 - protein, 9 aa, Borrelia garinii
KSGEITVAL

SEQ ID NO: 192275 - protein, 9 aa, Borrelia garinii
SGEITVALN

SEQ ID NO: 192276 - protein, 9 aa, Borrelia garinii
GEITVALND

SEQ ID NO: 192277 - protein, 9 aa, Borrelia garinii
EITVALNDT

SEQ ID NO: 192278 - protein, 9 aa, Borrelia garinii
ITVALNDTE

SEQ ID NO: 192279 - protein, 9 aa, Borrelia garinii
TVALNDTET

SEQ ID NO: 192280 - protein, 9 aa, Borrelia garinii
VALNDTETT

SEQ ID NO: 192281 - protein, 9 aa, Borrelia garinii
ALNDTETTP

SEQ ID NO: 192282 - protein, 9 aa, Borrelia garinii
LNDTETTPA

SEQ ID NO: 192283 - protein, 9 aa, Borrelia garinii
NDTETTPAD

SEQ ID NO: 192284 - protein, 9 aa, Borrelia garinii
DTETTPADK

SEQ ID NO: 192285 - protein, 9 aa, Borrelia garinii
TETTPADKK

SEQ ID NO: 192286 - protein, 9 aa, Borrelia garinii
ETTPADKKT

SEQ ID NO: 192287 - protein, 9 aa, Borrelia garinii
TTPADKKTG

SEQ ID NO: 192288 - protein, 9 aa, Borrelia garinii
TPADKKTGE

SEQ ID NO: 192289 - protein, 9 aa, Borrelia garinii
PADKKTGEW

SEQ ID NO: 192290 - protein, 9 aa, Borrelia garinii
ADKKTGEWK

SEQ ID NO: 192291 - protein, 9 aa, Borrelia garinii
DKKTGEWKS

SEQ ID NO: 192292 - protein, 9 aa, Borrelia garinii
KKTGEWKSD

SEQ ID NO: 192293 - protein, 9 aa, Borrelia garinii
KTGEWKSDT

SEQ ID NO: 192294 - protein, 9 aa, Borrelia garinii
TGEWKSDTS

SEQ ID NO: 192295 - protein, 9 aa, Borrelia garinii
GEWKSDTST

SEQ ID NO: 192296 - protein, 9 aa, Borrelia garinii
EWKSDTSTL

SEQ ID NO: 192297 - protein, 9 aa, Borrelia garinii
WKSDTSTLT

SEQ ID NO: 192298 - protein, 9 aa, Borrelia garinii
KSDTSTLTI

SEQ ID NO: 192299 - protein, 9 aa, Borrelia garinii
SDTSTLTIS

SEQ ID NO: 192300 - protein, 9 aa, Borrelia garinii
DTSTLTISK

SEQ ID NO: 192301 - protein, 9 aa, Borrelia garinii
TSTLTISKN

SEQ ID NO: 192302 - protein, 9 aa, Borrelia garinii
STLTISKNS

SEQ ID NO: 192303 - protein, 9 aa, Borrelia garinii
TLTISKNSQ

SEQ ID NO: 192304 - protein, 9 aa, Borrelia garinii
LTISKNSQK

SEQ ID NO: 192305 - protein, 9 aa, Borrelia garinii
TISKNSQKP

SEQ ID NO: 192306 - protein, 9 aa, Borrelia garinii
ISKNSQKPK

SEQ ID NO: 192307 - protein, 9 aa, Borrelia garinii
SKNSQKPKQ

SEQ ID NO: 192308 - protein, 9 aa, Borrelia garinii
KNSQKPKQL

SEQ ID NO: 192309 - protein, 9 aa, Borrelia garinii
NSQKPKQLV

SEQ ID NO: 192310 - protein, 9 aa, Borrelia garinii
SQKPKQLVF

SEQ ID NO: 192311 - protein, 9 aa, Borrelia garinii
QKPKQLVFT

SEQ ID NO: 192312 - protein, 9 aa, Borrelia garinii
KPKQLVFTK

SEQ ID NO: 192313 - protein, 9 aa, Borrelia garinii
PKQLVFTKE

SEQ ID NO: 192314 - protein, 9 aa, Borrelia garinii
KQLVFTKEN

SEQ ID NO: 192315 - protein, 9 aa, Borrelia garinii
QLVFTKENT

SEQ ID NO: 192316 - protein, 9 aa, Borrelia garinii
LVFTKENTI

SEQ ID NO: 192317 - protein, 9 aa, Borrelia garinii
VFTKENTIT

SEQ ID NO: 192318 - protein, 9 aa, Borrelia garinii
FTKENTITV

SEQ ID NO: 192319 - protein, 9 aa, Borrelia garinii
TKENTITVQ

SEQ ID NO: 192320 - protein, 9 aa, Borrelia garinii
KENTITVQN

SEQ ID NO: 192321 - protein, 9 aa, Borrelia garinii
ENTITVQNY

SEQ ID NO: 192322 - protein, 9 aa, Borrelia garinii
NTITVQNYN

SEQ ID NO: 192323 - protein, 9 aa, Borrelia garinii
TITVQNYNR

SEQ ID NO: 192324 - protein, 9 aa, Borrelia garinii
ITVQNYNRA

SEQ ID NO: 192325 - protein, 9 aa, Borrelia garinii
TVQNYNRAG

SEQ ID NO: 192326 - protein, 9 aa, Borrelia garinii
VQNYNRAGN

SEQ ID NO: 192327 - protein, 9 aa, Borrelia garinii
QNYNRAGNA

SEQ ID NO: 192328 - protein, 9 aa, Borrelia garinii
NYNRAGNAL

SEQ ID NO: 192329 - protein, 9 aa, Borrelia garinii
YNRAGNALE

SEQ ID NO: 192330 - protein, 9 aa, Borrelia garinii
NRAGNALEG

SEQ ID NO: 192331 - protein, 9 aa, Borrelia garinii
RAGNALEGS

SEQ ID NO: 192332 - protein, 9 aa, Borrelia garinii
AGNALEGSP

SEQ ID NO: 192333 - protein, 9 aa, Borrelia garinii
GNALEGSPA

SEQ ID NO: 192334 - protein, 9 aa, Borrelia garinii
NALEGSPAE

SEQ ID NO: 192335 - protein, 9 aa, Borrelia garinii
ALEGSPAEI

SEQ ID NO: 192336 - protein, 9 aa, Borrelia garinii
LEGSPAEIK

SEQ ID NO: 192337 - protein, 9 aa, Borrelia garinii
EGSPAEIKD

SEQ ID NO: 192338 - protein, 9 aa, Borrelia garinii
GSPAEIKDL

SEQ ID NO: 192339 - protein, 9 aa, Borrelia garinii
SPAEIKDLA

SEQ ID NO: 192340 - protein, 9 aa, Borrelia garinii
PAEIKDLAE

SEQ ID NO: 192341 - protein, 9 aa, Borrelia garinii
AEIKDLAEL

SEQ ID NO: 192342 - protein, 9 aa, Borrelia garinii
EIKDLAELK

SEQ ID NO: 192343 - protein, 9 aa, Borrelia garinii
IKDLAELKA

SEQ ID NO: 192344 - protein, 9 aa, Borrelia garinii
KDLAELKAA

SEQ ID NO: 192345 - protein, 9 aa, Borrelia garinii
DLAELKAAL

SEQ ID NO: 192346 - protein, 9 aa, Borrelia garinii
LAELKAALK

SEQ ID NO: 192347 - protein, 10 aa, Borrelia garinii
MKKYLLGIGL

SEQ ID NO: 192348 - protein, 10 aa, Borrelia garinii
KKYLLGIGLI

SEQ ID NO: 192349 - protein, 10 aa, Borrelia garinii
KYLLGIGLIL

SEQ ID NO: 192350 - protein, 10 aa, Borrelia garinii
YLLGIGLILA

SEQ ID NO: 192351 - protein, 10 aa, Borrelia garinii
LLGIGLILAL

SEQ ID NO: 192352 - protein, 10 aa, Borrelia garinii
LGIGLILALI

SEQ ID NO: 192353 - protein, 10 aa, Borrelia garinii
GIGLILALIA

SEQ ID NO: 192354 - protein, 10 aa, Borrelia garinii
IGLILALIAC

SEQ ID NO: 192355 - protein, 10 aa, Borrelia garinii
GLILALIACK

SEQ ID NO: 192356 - protein, 10 aa, Borrelia garinii
LILALIACKQ

SEQ ID NO: 192357 - protein, 10 aa, Borrelia garinii
ILALIACKQN

SEQ ID NO: 192358 - protein, 10 aa, Borrelia garinii
LALIACKQNV

SEQ ID NO: 192359 - protein, 10 aa, Borrelia garinii
ALIACKQNVS

SEQ ID NO: 192360 - protein, 10 aa, Borrelia garinii
LIACKQNVSS

SEQ ID NO: 192361 - protein, 10 aa, Borrelia garinii
IACKQNVSSL

SEQ ID NO: 192362 - protein, 10 aa, Borrelia garinii
ACKQNVSSLD

SEQ ID NO: 192363 - protein, 10 aa, Borrelia garinii
CKQNVSSLDE

SEQ ID NO: 192364 - protein, 10 aa, Borrelia garinii
KQNVSSLDEK

SEQ ID NO: 192365 - protein, 10 aa, Borrelia garinii
QNVSSLDEKN

SEQ ID NO: 192366 - protein, 10 aa, Borrelia garinii
NVSSLDEKNS

SEQ ID NO: 192367 - protein, 10 aa, Borrelia garinii
VSSLDEKNSV

SEQ ID NO: 192368 - protein, 10 aa, Borrelia garinii
SSLDEKNSVS

SEQ ID NO: 192369 - protein, 10 aa, Borrelia garinii
SLDEKNSVSV

SEQ ID NO: 192370 - protein, 10 aa, Borrelia garinii
LDEKNSVSVD

SEQ ID NO: 192371 - protein, 10 aa, Borrelia garinii
DEKNSVSVDL

SEQ ID NO: 192372 - protein, 10 aa, Borrelia garinii
EKNSVSVDLP

SEQ ID NO: 192373 - protein, 10 aa, Borrelia garinii
KNSVSVDLPG

SEQ ID NO: 192374 - protein, 10 aa, Borrelia garinii
NSVSVDLPGG

SEQ ID NO: 192375 - protein, 10 aa, Borrelia garinii
SVSVDLPGGM

SEQ ID NO: 192376 - protein, 10 aa, Borrelia garinii
VSVDLPGGMK

SEQ ID NO: 192377 - protein, 10 aa, Borrelia garinii
SVDLPGGMKV

SEQ ID NO: 192378 - protein, 10 aa, Borrelia garinii
VDLPGGMKVL

SEQ ID NO: 192379 - protein, 10 aa, Borrelia garinii
DLPGGMKVLV

SEQ ID NO: 192380 - protein, 10 aa, Borrelia garinii
LPGGMKVLVS

SEQ ID NO: 192381 - protein, 10 aa, Borrelia garinii
PGGMKVLVSK

SEQ ID NO: 192382 - protein, 10 aa, Borrelia garinii
GGMKVLVSKE

SEQ ID NO: 192383 - protein, 10 aa, Borrelia garinii
GMKVLVSKEK

SEQ ID NO: 192384 - protein, 10 aa, Borrelia garinii
MKVLVSKEKD

SEQ ID NO: 192385 - protein, 10 aa, Borrelia garinii
KVLVSKEKDK

SEQ ID NO: 192386 - protein, 10 aa, Borrelia garinii
VLVSKEKDKD

SEQ ID NO: 192387 - protein, 10 aa, Borrelia garinii
LVSKEKDKDG

SEQ ID NO: 192388 - protein, 10 aa, Borrelia garinii
VSKEKDKDGK

SEQ ID NO: 192389 - protein, 10 aa, Borrelia garinii
SKEKDKDGKY

SEQ ID NO: 192390 - protein, 10 aa, Borrelia garinii
KEKDKDGKYS

SEQ ID NO: 192391 - protein, 10 aa, Borrelia garinii
EKDKDGKYSL

SEQ ID NO: 192392 - protein, 10 aa, Borrelia garinii
KDKDGKYSLM

SEQ ID NO: 192393 - protein, 10 aa, Borrelia garinii
DKDGKYSLMA

SEQ ID NO: 192394 - protein, 10 aa, Borrelia garinii
KDGKYSLMAT

SEQ ID NO: 192395 - protein, 10 aa, Borrelia garinii
DGKYSLMATV

SEQ ID NO: 192396 - protein, 10 aa, Borrelia garinii
GKYSLMATVE

SEQ ID NO: 192397 - protein, 10 aa, Borrelia garinii
KYSLMATVEK

SEQ ID NO: 192398 - protein, 10 aa, Borrelia garinii
YSLMATVEKL

SEQ ID NO: 192399 - protein, 10 aa, Borrelia garinii
SLMATVEKLE

SEQ ID NO: 192400 - protein, 10 aa, Borrelia garinii
LMATVEKLEL

SEQ ID NO: 192401 - protein, 10 aa, Borrelia garinii
MATVEKLELK

SEQ ID NO: 192402 - protein, 10 aa, Borrelia garinii
ATVEKLELKG

SEQ ID NO: 192403 - protein, 10 aa, Borrelia garinii
TVEKLELKGT

SEQ ID NO: 192404 - protein, 10 aa, Borrelia garinii
VEKLELKGTS

SEQ ID NO: 192405 - protein, 10 aa, Borrelia garinii
EKLELKGTSD

SEQ ID NO: 192406 - protein, 10 aa, Borrelia garinii
KLELKGTSDK

SEQ ID NO: 192407 - protein, 10 aa, Borrelia garinii
LELKGTSDKS

SEQ ID NO: 192408 - protein, 10 aa, Borrelia garinii
ELKGTSDKSN

SEQ ID NO: 192409 - protein, 10 aa, Borrelia garinii
LKGTSDKSNG

SEQ ID NO: 192410 - protein, 10 aa, Borrelia garinii
KGTSDKSNGS

SEQ ID NO: 192411 - protein, 10 aa, Borrelia garinii
GTSDKSNGSG

SEQ ID NO: 192412 - protein, 10 aa, Borrelia garinii
TSDKSNGSGV

SEQ ID NO: 192413 - protein, 10 aa, Borrelia garinii
SDKSNGSGVL

SEQ ID NO: 192414 - protein, 10 aa, Borrelia garinii
DKSNGSGVLE

SEQ ID NO: 192415 - protein, 10 aa, Borrelia garinii
KSNGSGVLEG

SEQ ID NO: 192416 - protein, 10 aa, Borrelia garinii
SNGSGVLEGE

SEQ ID NO: 192417 - protein, 10 aa, Borrelia garinii
NGSGVLEGEK

SEQ ID NO: 192418 - protein, 10 aa, Borrelia garinii
GSGVLEGEKA

SEQ ID NO: 192419 - protein, 10 aa, Borrelia garinii
SGVLEGEKAD

SEQ ID NO: 192420 - protein, 10 aa, Borrelia garinii
GVLEGEKADK

SEQ ID NO: 192421 - protein, 10 aa, Borrelia garinii
VLEGEKADKS

SEQ ID NO: 192422 - protein, 10 aa, Borrelia garinii
LEGEKADKSK

SEQ ID NO: 192423 - protein, 10 aa, Borrelia garinii
EGEKADKSKA

SEQ ID NO: 192424 - protein, 10 aa, Borrelia garinii
GEKADKSKAK

SEQ ID NO: 192425 - protein, 10 aa, Borrelia garinii
EKADKSKAKL

SEQ ID NO: 192426 - protein, 10 aa, Borrelia garinii
KADKSKAKLT

SEQ ID NO: 192427 - protein, 10 aa, Borrelia garinii
ADKSKAKLTI

SEQ ID NO: 192428 - protein, 10 aa, Borrelia garinii
DKSKAKLTIS

SEQ ID NO: 192429 - protein, 10 aa, Borrelia garinii
KSKAKLTISQ

SEQ ID NO: 192430 - protein, 10 aa, Borrelia garinii
SKAKLTISQD

SEQ ID NO: 192431 - protein, 10 aa, Borrelia garinii
KAKLTISQDL

SEQ ID NO: 192432 - protein, 10 aa, Borrelia garinii
AKLTISQDLN

SEQ ID NO: 192433 - protein, 10 aa, Borrelia garinii
KLTISQDLNQ

SEQ ID NO: 192434 - protein, 10 aa, Borrelia garinii
LTISQDLNQT

SEQ ID NO: 192435 - protein, 10 aa, Borrelia garinii
TISQDLNQTT

SEQ ID NO: 192436 - protein, 10 aa, Borrelia garinii
ISQDLNQTTF

SEQ ID NO: 192437 - protein, 10 aa, Borrelia garinii
SQDLNQTTFE

SEQ ID NO: 192438 - protein, 10 aa, Borrelia garinii
QDLNQTTFEI

SEQ ID NO: 192439 - protein, 10 aa, Borrelia garinii
DLNQTTFEIF

SEQ ID NO: 192440 - protein, 10 aa, Borrelia garinii
LNQTTFEIFK

SEQ ID NO: 192441 - protein, 10 aa, Borrelia garinii
NQTTFEIFKE

SEQ ID NO: 192442 - protein, 10 aa, Borrelia garinii
QTTFEIFKED

SEQ ID NO: 192443 - protein, 10 aa, Borrelia garinii
TTFEIFKEDG

SEQ ID NO: 192444 - protein, 10 aa, Borrelia garinii
TFEIFKEDGK

SEQ ID NO: 192445 - protein, 10 aa, Borrelia garinii
FEIFKEDGKT

SEQ ID NO: 192446 - protein, 10 aa, Borrelia garinii
EIFKEDGKTL

SEQ ID NO: 192447 - protein, 10 aa, Borrelia garinii
IFKEDGKTLV

SEQ ID NO: 192448 - protein, 10 aa, Borrelia garinii
FKEDGKTLVS

SEQ ID NO: 192449 - protein, 10 aa, Borrelia garinii
KEDGKTLVSR

SEQ ID NO: 192450 - protein, 10 aa, Borrelia garinii
EDGKTLVSRK

SEQ ID NO: 192451 - protein, 10 aa, Borrelia garinii
DGKTLVSRKV

SEQ ID NO: 192452 - protein, 10 aa, Borrelia garinii
GKTLVSRKVN

SEQ ID NO: 192453 - protein, 10 aa, Borrelia garinii
KTLVSRKVNS

SEQ ID NO: 192454 - protein, 10 aa, Borrelia garinii
TLVSRKVNSK

SEQ ID NO: 192455 - protein, 10 aa, Borrelia garinii
LVSRKVNSKD

SEQ ID NO: 192456 - protein, 10 aa, Borrelia garinii
VSRKVNSKDK

SEQ ID NO: 192457 - protein, 10 aa, Borrelia garinii
SRKVNSKDKS

SEQ ID NO: 192458 - protein, 10 aa, Borrelia garinii
RKVNSKDKSS

SEQ ID NO: 192459 - protein, 10 aa, Borrelia garinii
KVNSKDKSST

SEQ ID NO: 192460 - protein, 10 aa, Borrelia garinii
VNSKDKSSTE

SEQ ID NO: 192461 - protein, 10 aa, Borrelia garinii
NSKDKSSTEE

SEQ ID NO: 192462 - protein, 10 aa, Borrelia garinii
SKDKSSTEEK

SEQ ID NO: 192463 - protein, 10 aa, Borrelia garinii
KDKSSTEEKF

SEQ ID NO: 192464 - protein, 10 aa, Borrelia garinii
DKSSTEEKFN

SEQ ID NO: 192465 - protein, 10 aa, Borrelia garinii
KSSTEEKFND

SEQ ID NO: 192466 - protein, 10 aa, Borrelia garinii
SSTEEKFNDK

SEQ ID NO: 192467 - protein, 10 aa, Borrelia garinii
STEEKFNDKG

SEQ ID NO: 192468 - protein, 10 aa, Borrelia garinii
TEEKFNDKGK

SEQ ID NO: 192469 - protein, 10 aa, Borrelia garinii
EEKFNDKGKL

SEQ ID NO: 192470 - protein, 10 aa, Borrelia garinii
EKFNDKGKLS

SEQ ID NO: 192471 - protein, 10 aa, Borrelia garinii
KFNDKGKLSE

SEQ ID NO: 192472 - protein, 10 aa, Borrelia garinii
FNDKGKLSEK

SEQ ID NO: 192473 - protein, 10 aa, Borrelia garinii
NDKGKLSEKV

SEQ ID NO: 192474 - protein, 10 aa, Borrelia garinii
DKGKLSEKVV

SEQ ID NO: 192475 - protein, 10 aa, Borrelia garinii
KGKLSEKVVT

SEQ ID NO: 192476 - protein, 10 aa, Borrelia garinii
GKLSEKVVTR

SEQ ID NO: 192477 - protein, 10 aa, Borrelia garinii
KLSEKVVTRA

SEQ ID NO: 192478 - protein, 10 aa, Borrelia garinii
LSEKVVTRAN

SEQ ID NO: 192479 - protein, 10 aa, Borrelia garinii
SEKVVTRANG

SEQ ID NO: 192480 - protein, 10 aa, Borrelia garinii
EKVVTRANGT

SEQ ID NO: 192481 - protein, 10 aa, Borrelia garinii
KVVTRANGTR

SEQ ID NO: 192482 - protein, 10 aa, Borrelia garinii
VVTRANGTRL

SEQ ID NO: 192483 - protein, 10 aa, Borrelia garinii
VTRANGTRLE

SEQ ID NO: 192484 - protein, 10 aa, Borrelia garinii
TRANGTRLEY

SEQ ID NO: 192485 - protein, 10 aa, Borrelia garinii
RANGTRLEYT

SEQ ID NO: 192486 - protein, 10 aa, Borrelia garinii
ANGTRLEYTE

SEQ ID NO: 192487 - protein, 10 aa, Borrelia garinii
NGTRLEYTEI

SEQ ID NO: 192488 - protein, 10 aa, Borrelia garinii
GTRLEYTEIK

SEQ ID NO: 192489 - protein, 10 aa, Borrelia garinii
TRLEYTEIKN

SEQ ID NO: 192490 - protein, 10 aa, Borrelia garinii
RLEYTEIKND

SEQ ID NO: 192491 - protein, 10 aa, Borrelia garinii
LEYTEIKNDG

SEQ ID NO: 192492 - protein, 10 aa, Borrelia garinii
EYTEIKNDGS

SEQ ID NO: 192493 - protein, 10 aa, Borrelia garinii
YTEIKNDGSG

SEQ ID NO: 192494 - protein, 10 aa, Borrelia garinii
TEIKNDGSGK

SEQ ID NO: 192495 - protein, 10 aa, Borrelia garinii
EIKNDGSGKA

SEQ ID NO: 192496 - protein, 10 aa, Borrelia garinii
IKNDGSGKAK

SEQ ID NO: 192497 - protein, 10 aa, Borrelia garinii
KNDGSGKAKE

SEQ ID NO: 192498 - protein, 10 aa, Borrelia garinii
NDGSGKAKEV

SEQ ID NO: 192499 - protein, 10 aa, Borrelia garinii
DGSGKAKEVL

SEQ ID NO: 192500 - protein, 10 aa, Borrelia garinii
GSGKAKEVLK

SEQ ID NO: 192501 - protein, 10 aa, Borrelia garinii
SGKAKEVLKG

SEQ ID NO: 192502 - protein, 10 aa, Borrelia garinii
GKAKEVLKGF

SEQ ID NO: 192503 - protein, 10 aa, Borrelia garinii
KAKEVLKGFA

SEQ ID NO: 192504 - protein, 10 aa, Borrelia garinii
AKEVLKGFAL

SEQ ID NO: 192505 - protein, 10 aa, Borrelia garinii
KEVLKGFALE

SEQ ID NO: 192506 - protein, 10 aa, Borrelia garinii
EVLKGFALEG

SEQ ID NO: 192507 - protein, 10 aa, Borrelia garinii
VLKGFALEGT

SEQ ID NO: 192508 - protein, 10 aa, Borrelia garinii
LKGFALEGTL

SEQ ID NO: 192509 - protein, 10 aa, Borrelia garinii
KGFALEGTLT

SEQ ID NO: 192510 - protein, 10 aa, Borrelia garinii
GFALEGTLTD

SEQ ID NO: 192511 - protein, 10 aa, Borrelia garinii
FALEGTLTDG

SEQ ID NO: 192512 - protein, 10 aa, Borrelia garinii
ALEGTLTDGG

SEQ ID NO: 192513 - protein, 10 aa, Borrelia garinii
LEGTLTDGGE

SEQ ID NO: 192514 - protein, 10 aa, Borrelia garinii
EGTLTDGGET

SEQ ID NO: 192515 - protein, 10 aa, Borrelia garinii
GTLTDGGETK

SEQ ID NO: 192516 - protein, 10 aa, Borrelia garinii
TLTDGGETKL

SEQ ID NO: 192517 - protein, 10 aa, Borrelia garinii
LTDGGETKLT

SEQ ID NO: 192518 - protein, 10 aa, Borrelia garinii
TDGGETKLTV

SEQ ID NO: 192519 - protein, 10 aa, Borrelia garinii
DGGETKLTVT

SEQ ID NO: 192520 - protein, 10 aa, Borrelia garinii
GGETKLTVTE

SEQ ID NO: 192521 - protein, 10 aa, Borrelia garinii
GETKLTVTEG

SEQ ID NO: 192522 - protein, 10 aa, Borrelia garinii
ETKLTVTEGT

SEQ ID NO: 192523 - protein, 10 aa, Borrelia garinii
TKLTVTEGTV

SEQ ID NO: 192524 - protein, 10 aa, Borrelia garinii
KLTVTEGTVT

SEQ ID NO: 192525 - protein, 10 aa, Borrelia garinii
LTVTEGTVTL

SEQ ID NO: 192526 - protein, 10 aa, Borrelia garinii
TVTEGTVTLS

SEQ ID NO: 192527 - protein, 10 aa, Borrelia garinii
VTEGTVTLSK

SEQ ID NO: 192528 - protein, 10 aa, Borrelia garinii
TEGTVTLSKN

SEQ ID NO: 192529 - protein, 10 aa, Borrelia garinii
EGTVTLSKNI

SEQ ID NO: 192530 - protein, 10 aa, Borrelia garinii
GTVTLSKNIS

SEQ ID NO: 192531 - protein, 10 aa, Borrelia garinii
TVTLSKNISK

SEQ ID NO: 192532 - protein, 10 aa, Borrelia garinii
VTLSKNISKS

SEQ ID NO: 192533 - protein, 10 aa, Borrelia garinii
TLSKNISKSG

SEQ ID NO: 192534 - protein, 10 aa, Borrelia garinii
LSKNISKSGE

SEQ ID NO: 192535 - protein, 10 aa, Borrelia garinii
SKNISKSGEI

SEQ ID NO: 192536 - protein, 10 aa, Borrelia garinii
KNISKSGEIT

SEQ ID NO: 192537 - protein, 10 aa, Borrelia garinii
NISKSGEITV

SEQ ID NO: 192538 - protein, 10 aa, Borrelia garinii
ISKSGEITVA

SEQ ID NO: 192539 - protein, 10 aa, Borrelia garinii
SKSGEITVAL

SEQ ID NO: 192540 - protein, 10 aa, Borrelia garinii
KSGEITVALN

SEQ ID NO: 192541 - protein, 10 aa, Borrelia garinii
SGEITVALND

SEQ ID NO: 192542 - protein, 10 aa, Borrelia garinii
GEITVALNDT

SEQ ID NO: 192543 - protein, 10 aa, Borrelia garinii
EITVALNDTE

SEQ ID NO: 192544 - protein, 10 aa, Borrelia garinii
ITVALNDTET

SEQ ID NO: 192545 - protein, 10 aa, Borrelia garinii
TVALNDTETT

SEQ ID NO: 192546 - protein, 10 aa, Borrelia garinii
VALNDTETTP

SEQ ID NO: 192547 - protein, 10 aa, Borrelia garinii
ALNDTETTPA

SEQ ID NO: 192548 - protein, 10 aa, Borrelia garinii
LNDTETTPAD

SEQ ID NO: 192549 - protein, 10 aa, Borrelia garinii
NDTETTPADK

SEQ ID NO: 192550 - protein, 10 aa, Borrelia garinii
DTETTPADKK

SEQ ID NO: 192551 - protein, 10 aa, Borrelia garinii
TETTPADKKT

SEQ ID NO: 192552 - protein, 10 aa, Borrelia garinii
ETTPADKKTG

SEQ ID NO: 192553 - protein, 10 aa, Borrelia garinii
TTPADKKTGE

SEQ ID NO: 192554 - protein, 10 aa, Borrelia garinii
TPADKKTGEW

SEQ ID NO: 192555 - protein, 10 aa, Borrelia garinii
PADKKTGEWK

SEQ ID NO: 192556 - protein, 10 aa, Borrelia garinii
ADKKTGEWKS

SEQ ID NO: 192557 - protein, 10 aa, Borrelia garinii
DKKTGEWKSD

SEQ ID NO: 192558 - protein, 10 aa, Borrelia garinii
KKTGEWKSDT

SEQ ID NO: 192559 - protein, 10 aa, Borrelia garinii
KTGEWKSDTS

SEQ ID NO: 192560 - protein, 10 aa, Borrelia garinii
TGEWKSDTST

SEQ ID NO: 192561 - protein, 10 aa, Borrelia garinii
GEWKSDTSTL

SEQ ID NO: 192562 - protein, 10 aa, Borrelia garinii
EWKSDTSTLT

SEQ ID NO: 192563 - protein, 10 aa, Borrelia garinii
WKSDTSTLTI

SEQ ID NO: 192564 - protein, 10 aa, Borrelia garinii
KSDTSTLTIS

SEQ ID NO: 192565 - protein, 10 aa, Borrelia garinii
SDTSTLTISK

SEQ ID NO: 192566 - protein, 10 aa, Borrelia garinii
DTSTLTISKN

SEQ ID NO: 192567 - protein, 10 aa, Borrelia garinii
TSTLTISKNS

SEQ ID NO: 192568 - protein, 10 aa, Borrelia garinii
STLTISKNSQ

SEQ ID NO: 192569 - protein, 10 aa, Borrelia garinii
TLTISKNSQK

SEQ ID NO: 192570 - protein, 10 aa, Borrelia garinii
LTISKNSQKP

SEQ ID NO: 192571 - protein, 10 aa, Borrelia garinii
TISKNSQKPK

SEQ ID NO: 192572 - protein, 10 aa, Borrelia garinii
ISKNSQKPKQ

SEQ ID NO: 192573 - protein, 10 aa, Borrelia garinii
SKNSQKPKQL

SEQ ID NO: 192574 - protein, 10 aa, Borrelia garinii
KNSQKPKQLV

SEQ ID NO: 192575 - protein, 10 aa, Borrelia garinii
NSQKPKQLVF

SEQ ID NO: 192576 - protein, 10 aa, Borrelia garinii
SQKPKQLVFT

SEQ ID NO: 192577 - protein, 10 aa, Borrelia garinii
QKPKQLVFTK

SEQ ID NO: 192578 - protein, 10 aa, Borrelia garinii
KPKQLVFTKE

SEQ ID NO: 192579 - protein, 10 aa, Borrelia garinii
PKQLVFTKEN

SEQ ID NO: 192580 - protein, 10 aa, Borrelia garinii
KQLVFTKENT

SEQ ID NO: 192581 - protein, 10 aa, Borrelia garinii
QLVFTKENTI

SEQ ID NO: 192582 - protein, 10 aa, Borrelia garinii
LVFTKENTIT

SEQ ID NO: 192583 - protein, 10 aa, Borrelia garinii
VFTKENTITV

SEQ ID NO: 192584 - protein, 10 aa, Borrelia garinii
FTKENTITVQ

SEQ ID NO: 192585 - protein, 10 aa, Borrelia garinii
TKENTITVQN

SEQ ID NO: 192586 - protein, 10 aa, Borrelia garinii
KENTITVQNY

SEQ ID NO: 192587 - protein, 10 aa, Borrelia garinii
ENTITVQNYN

SEQ ID NO: 192588 - protein, 10 aa, Borrelia garinii
NTITVQNYNR

SEQ ID NO: 192589 - protein, 10 aa, Borrelia garinii
TITVQNYNRA

SEQ ID NO: 192590 - protein, 10 aa, Borrelia garinii
ITVQNYNRAG

SEQ ID NO: 192591 - protein, 10 aa, Borrelia garinii
TVQNYNRAGN

SEQ ID NO: 192592 - protein, 10 aa, Borrelia garinii
VQNYNRAGNA

SEQ ID NO: 192593 - protein, 10 aa, Borrelia garinii
QNYNRAGNAL

SEQ ID NO: 192594 - protein, 10 aa, Borrelia garinii
NYNRAGNALE

SEQ ID NO: 192595 - protein, 10 aa, Borrelia garinii
YNRAGNALEG

SEQ ID NO: 192596 - protein, 10 aa, Borrelia garinii
NRAGNALEGS

SEQ ID NO: 192597 - protein, 10 aa, Borrelia garinii
RAGNALEGSP

SEQ ID NO: 192598 - protein, 10 aa, Borrelia garinii
AGNALEGSPA

SEQ ID NO: 192599 - protein, 10 aa, Borrelia garinii
GNALEGSPAE

SEQ ID NO: 192600 - protein, 10 aa, Borrelia garinii
NALEGSPAEI

SEQ ID NO: 192601 - protein, 10 aa, Borrelia garinii
ALEGSPAEIK

SEQ ID NO: 192602 - protein, 10 aa, Borrelia garinii
LEGSPAEIKD

SEQ ID NO: 192603 - protein, 10 aa, Borrelia garinii
EGSPAEIKDL

SEQ ID NO: 192604 - protein, 10 aa, Borrelia garinii
GSPAEIKDLA

SEQ ID NO: 192605 - protein, 10 aa, Borrelia garinii
SPAEIKDLAE

SEQ ID NO: 192606 - protein, 10 aa, Borrelia garinii
PAEIKDLAEL

SEQ ID NO: 192607 - protein, 10 aa, Borrelia garinii
AEIKDLAELK

SEQ ID NO: 192608 - protein, 10 aa, Borrelia garinii
EIKDLAELKA

SEQ ID NO: 192609 - protein, 10 aa, Borrelia garinii
IKDLAELKAA

SEQ ID NO: 192610 - protein, 10 aa, Borrelia garinii
KDLAELKAAL

SEQ ID NO: 192611 - protein, 10 aa, Borrelia garinii
DLAELKAALK

SEQ ID NO: 192612 - protein, 11 aa, Borrelia garinii
MKKYLLGIGLI

SEQ ID NO: 192613 - protein, 11 aa, Borrelia garinii
KKYLLGIGLIL

SEQ ID NO: 192614 - protein, 11 aa, Borrelia garinii
KYLLGIGLILA

SEQ ID NO: 192615 - protein, 11 aa, Borrelia garinii
YLLGIGLILAL

SEQ ID NO: 192616 - protein, 11 aa, Borrelia garinii
LLGIGLILALI

SEQ ID NO: 192617 - protein, 11 aa, Borrelia garinii
LGIGLILALIA

SEQ ID NO: 192618 - protein, 11 aa, Borrelia garinii
GIGLILALIAC

SEQ ID NO: 192619 - protein, 11 aa, Borrelia garinii
IGLILALIACK

SEQ ID NO: 192620 - protein, 11 aa, Borrelia garinii
GLILALIACKQ

SEQ ID NO: 192621 - protein, 11 aa, Borrelia garinii
LILALIACKQN

SEQ ID NO: 192622 - protein, 11 aa, Borrelia garinii
ILALIACKQNV

SEQ ID NO: 192623 - protein, 11 aa, Borrelia garinii
LALIACKQNVS

SEQ ID NO: 192624 - protein, 11 aa, Borrelia garinii
ALIACKQNVSS

SEQ ID NO: 192625 - protein, 11 aa, Borrelia garinii
LIACKQNVSSL

SEQ ID NO: 192626 - protein, 11 aa, Borrelia garinii
IACKQNVSSLD

SEQ ID NO: 192627 - protein, 11 aa, Borrelia garinii
ACKQNVSSLDE

SEQ ID NO: 192628 - protein, 11 aa, Borrelia garinii
CKQNVSSLDEK

SEQ ID NO: 192629 - protein, 11 aa, Borrelia garinii
KQNVSSLDEKN

SEQ ID NO: 192630 - protein, 11 aa, Borrelia garinii
QNVSSLDEKNS

SEQ ID NO: 192631 - protein, 11 aa, Borrelia garinii
NVSSLDEKNSV

SEQ ID NO: 192632 - protein, 11 aa, Borrelia garinii
VSSLDEKNSVS

SEQ ID NO: 192633 - protein, 11 aa, Borrelia garinii
SSLDEKNSVSV

SEQ ID NO: 192634 - protein, 11 aa, Borrelia garinii
SLDEKNSVSVD

SEQ ID NO: 192635 - protein, 11 aa, Borrelia garinii
LDEKNSVSVDL

SEQ ID NO: 192636 - protein, 11 aa, Borrelia garinii
DEKNSVSVDLP

SEQ ID NO: 192637 - protein, 11 aa, Borrelia garinii
EKNSVSVDLPG

SEQ ID NO: 192638 - protein, 11 aa, Borrelia garinii
KNSVSVDLPGG

SEQ ID NO: 192639 - protein, 11 aa, Borrelia garinii
NSVSVDLPGGM

SEQ ID NO: 192640 - protein, 11 aa, Borrelia garinii
SVSVDLPGGMK

SEQ ID NO: 192641 - protein, 11 aa, Borrelia garinii
VSVDLPGGMKV

SEQ ID NO: 192642 - protein, 11 aa, Borrelia garinii
SVDLPGGMKVL

SEQ ID NO: 192643 - protein, 11 aa, Borrelia garinii
VDLPGGMKVLV

SEQ ID NO: 192644 - protein, 11 aa, Borrelia garinii
DLPGGMKVLVS

SEQ ID NO: 192645 - protein, 11 aa, Borrelia garinii
LPGGMKVLVSK

SEQ ID NO: 192646 - protein, 11 aa, Borrelia garinii
PGGMKVLVSKE

SEQ ID NO: 192647 - protein, 11 aa, Borrelia garinii
GGMKVLVSKEK

SEQ ID NO: 192648 - protein, 11 aa, Borrelia garinii
GMKVLVSKEKD

SEQ ID NO: 192649 - protein, 11 aa, Borrelia garinii
MKVLVSKEKDK

SEQ ID NO: 192650 - protein, 11 aa, Borrelia garinii
KVLVSKEKDKD

SEQ ID NO: 192651 - protein, 11 aa, Borrelia garinii
VLVSKEKDKDG

SEQ ID NO: 192652 - protein, 11 aa, Borrelia garinii
LVSKEKDKDGK

SEQ ID NO: 192653 - protein, 11 aa, Borrelia garinii
VSKEKDKDGKY

SEQ ID NO: 192654 - protein, 11 aa, Borrelia garinii
SKEKDKDGKYS

SEQ ID NO: 192655 - protein, 11 aa, Borrelia garinii
KEKDKDGKYSL

SEQ ID NO: 192656 - protein, 11 aa, Borrelia garinii
EKDKDGKYSLM

SEQ ID NO: 192657 - protein, 11 aa, Borrelia garinii
KDKDGKYSLMA

SEQ ID NO: 192658 - protein, 11 aa, Borrelia garinii
DKDGKYSLMAT

SEQ ID NO: 192659 - protein, 11 aa, Borrelia garinii
KDGKYSLMATV

SEQ ID NO: 192660 - protein, 11 aa, Borrelia garinii
DGKYSLMATVE

SEQ ID NO: 192661 - protein, 11 aa, Borrelia garinii
GKYSLMATVEK

SEQ ID NO: 192662 - protein, 11 aa, Borrelia garinii
KYSLMATVEKL

SEQ ID NO: 192663 - protein, 11 aa, Borrelia garinii
YSLMATVEKLE

SEQ ID NO: 192664 - protein, 11 aa, Borrelia garinii
SLMATVEKLEL

SEQ ID NO: 192665 - protein, 11 aa, Borrelia garinii
LMATVEKLELK

SEQ ID NO: 192666 - protein, 11 aa, Borrelia garinii
MATVEKLELKG

SEQ ID NO: 192667 - protein, 11 aa, Borrelia garinii
ATVEKLELKGT

SEQ ID NO: 192668 - protein, 11 aa, Borrelia garinii
TVEKLELKGTS

SEQ ID NO: 192669 - protein, 11 aa, Borrelia garinii
VEKLELKGTSD

SEQ ID NO: 192670 - protein, 11 aa, Borrelia garinii
EKLELKGTSDK

SEQ ID NO: 192671 - protein, 11 aa, Borrelia garinii
KLELKGTSDKS

SEQ ID NO: 192672 - protein, 11 aa, Borrelia garinii
LELKGTSDKSN

SEQ ID NO: 192673 - protein, 11 aa, Borrelia garinii
ELKGTSDKSNG

SEQ ID NO: 192674 - protein, 11 aa, Borrelia garinii
LKGTSDKSNGS

SEQ ID NO: 192675 - protein, 11 aa, Borrelia garinii
KGTSDKSNGSG

SEQ ID NO: 192676 - protein, 11 aa, Borrelia garinii
GTSDKSNGSGV

SEQ ID NO: 192677 - protein, 11 aa, Borrelia garinii
TSDKSNGSGVL

SEQ ID NO: 192678 - protein, 11 aa, Borrelia garinii
SDKSNGSGVLE

SEQ ID NO: 192679 - protein, 11 aa, Borrelia garinii
DKSNGSGVLEG

SEQ ID NO: 192680 - protein, 11 aa, Borrelia garinii
KSNGSGVLEGE

SEQ ID NO: 192681 - protein, 11 aa, Borrelia garinii
SNGSGVLEGEK

SEQ ID NO: 192682 - protein, 11 aa, Borrelia garinii
NGSGVLEGEKA

SEQ ID NO: 192683 - protein, 11 aa, Borrelia garinii
GSGVLEGEKAD

SEQ ID NO: 192684 - protein, 11 aa, Borrelia garinii
SGVLEGEKADK

SEQ ID NO: 192685 - protein, 11 aa, Borrelia garinii
GVLEGEKADKS

SEQ ID NO: 192686 - protein, 11 aa, Borrelia garinii
VLEGEKADKSK

SEQ ID NO: 192687 - protein, 11 aa, Borrelia garinii
LEGEKADKSKA

SEQ ID NO: 192688 - protein, 11 aa, Borrelia garinii
EGEKADKSKAK

SEQ ID NO: 192689 - protein, 11 aa, Borrelia garinii
GEKADKSKAKL

SEQ ID NO: 192690 - protein, 11 aa, Borrelia garinii
EKADKSKAKLT

SEQ ID NO: 192691 - protein, 11 aa, Borrelia garinii
KADKSKAKLTI

SEQ ID NO: 192692 - protein, 11 aa, Borrelia garinii
ADKSKAKLTIS

SEQ ID NO: 192693 - protein, 11 aa, Borrelia garinii
DKSKAKLTISQ

SEQ ID NO: 192694 - protein, 11 aa, Borrelia garinii
KSKAKLTISQD

SEQ ID NO: 192695 - protein, 11 aa, Borrelia garinii
SKAKLTISQDL

SEQ ID NO: 192696 - protein, 11 aa, Borrelia garinii
KAKLTISQDLN

SEQ ID NO: 192697 - protein, 11 aa, Borrelia garinii
AKLTISQDLNQ

SEQ ID NO: 192698 - protein, 11 aa, Borrelia garinii
KLTISQDLNQT

SEQ ID NO: 192699 - protein, 11 aa, Borrelia garinii
LTISQDLNQTT

SEQ ID NO: 192700 - protein, 11 aa, Borrelia garinii
TISQDLNQTTF

SEQ ID NO: 192701 - protein, 11 aa, Borrelia garinii
ISQDLNQTTFE

SEQ ID NO: 192702 - protein, 11 aa, Borrelia garinii
SQDLNQTTFEI

SEQ ID NO: 192703 - protein, 11 aa, Borrelia garinii
QDLNQTTFEIF

SEQ ID NO: 192704 - protein, 11 aa, Borrelia garinii
DLNQTTFEIFK

SEQ ID NO: 192705 - protein, 11 aa, Borrelia garinii
LNQTTFEIFKE

SEQ ID NO: 192706 - protein, 11 aa, Borrelia garinii
NQTTFEIFKED

SEQ ID NO: 192707 - protein, 11 aa, Borrelia garinii
QTTFEIFKEDG

SEQ ID NO: 192708 - protein, 11 aa, Borrelia garinii
TTFEIFKEDGK

SEQ ID NO: 192709 - protein, 11 aa, Borrelia garinii
TFEIFKEDGKT

SEQ ID NO: 192710 - protein, 11 aa, Borrelia garinii
FEIFKEDGKTL

SEQ ID NO: 192711 - protein, 11 aa, Borrelia garinii
EIFKEDGKTLV

SEQ ID NO: 192712 - protein, 11 aa, Borrelia garinii
IFKEDGKTLVS

SEQ ID NO: 192713 - protein, 11 aa, Borrelia garinii
FKEDGKTLVSR

SEQ ID NO: 192714 - protein, 11 aa, Borrelia garinii
KEDGKTLVSRK

SEQ ID NO: 192715 - protein, 11 aa, Borrelia garinii
EDGKTLVSRKV

SEQ ID NO: 192716 - protein, 11 aa, Borrelia garinii
DGKTLVSRKVN

SEQ ID NO: 192717 - protein, 11 aa, Borrelia garinii
GKTLVSRKVNS

SEQ ID NO: 192718 - protein, 11 aa, Borrelia garinii
KTLVSRKVNSK

SEQ ID NO: 192719 - protein, 11 aa, Borrelia garinii
TLVSRKVNSKD

SEQ ID NO: 192720 - protein, 11 aa, Borrelia garinii
LVSRKVNSKDK

SEQ ID NO: 192721 - protein, 11 aa, Borrelia garinii
VSRKVNSKDKS

SEQ ID NO: 192722 - protein, 11 aa, Borrelia garinii
SRKVNSKDKSS

SEQ ID NO: 192723 - protein, 11 aa, Borrelia garinii
RKVNSKDKSST

SEQ ID NO: 192724 - protein, 11 aa, Borrelia garinii
KVNSKDKSSTE

SEQ ID NO: 192725 - protein, 11 aa, Borrelia garinii
VNSKDKSSTEE

SEQ ID NO: 192726 - protein, 11 aa, Borrelia garinii
NSKDKSSTEEK

SEQ ID NO: 192727 - protein, 11 aa, Borrelia garinii
SKDKSSTEEKF

SEQ ID NO: 192728 - protein, 11 aa, Borrelia garinii
KDKSSTEEKFN

SEQ ID NO: 192729 - protein, 11 aa, Borrelia garinii
DKSSTEEKFND

SEQ ID NO: 192730 - protein, 11 aa, Borrelia garinii
KSSTEEKFNDK

SEQ ID NO: 192731 - protein, 11 aa, Borrelia garinii
SSTEEKFNDKG

SEQ ID NO: 192732 - protein, 11 aa, Borrelia garinii
STEEKFNDKGK

SEQ ID NO: 192733 - protein, 11 aa, Borrelia garinii
TEEKFNDKGKL

SEQ ID NO: 192734 - protein, 11 aa, Borrelia garinii
EEKFNDKGKLS

SEQ ID NO: 192735 - protein, 11 aa, Borrelia garinii
EKFNDKGKLSE

SEQ ID NO: 192736 - protein, 11 aa, Borrelia garinii
KFNDKGKLSEK

SEQ ID NO: 192737 - protein, 11 aa, Borrelia garinii
FNDKGKLSEKV

SEQ ID NO: 192738 - protein, 11 aa, Borrelia garinii
NDKGKLSEKVV

SEQ ID NO: 192739 - protein, 11 aa, Borrelia garinii
DKGKLSEKVVT

SEQ ID NO: 192740 - protein, 11 aa, Borrelia garinii
KGKLSEKVVTR

SEQ ID NO: 192741 - protein, 11 aa, Borrelia garinii
GKLSEKVVTRA

SEQ ID NO: 192742 - protein, 11 aa, Borrelia garinii
KLSEKVVTRAN

SEQ ID NO: 192743 - protein, 11 aa, Borrelia garinii
LSEKVVTRANG

SEQ ID NO: 192744 - protein, 11 aa, Borrelia garinii
SEKVVTRANGT

SEQ ID NO: 192745 - protein, 11 aa, Borrelia garinii
EKVVTRANGTR

SEQ ID NO: 192746 - protein, 11 aa, Borrelia garinii
KVVTRANGTRL

SEQ ID NO: 192747 - protein, 11 aa, Borrelia garinii
VVTRANGTRLE

SEQ ID NO: 192748 - protein, 11 aa, Borrelia garinii
VTRANGTRLEY

SEQ ID NO: 192749 - protein, 11 aa, Borrelia garinii
TRANGTRLEYT

SEQ ID NO: 192750 - protein, 11 aa, Borrelia garinii
RANGTRLEYTE

SEQ ID NO: 192751 - protein, 11 aa, Borrelia garinii
ANGTRLEYTEI

SEQ ID NO: 192752 - protein, 11 aa, Borrelia garinii
NGTRLEYTEIK

SEQ ID NO: 192753 - protein, 11 aa, Borrelia garinii
GTRLEYTEIKN

SEQ ID NO: 192754 - protein, 11 aa, Borrelia garinii
TRLEYTEIKND

SEQ ID NO: 192755 - protein, 11 aa, Borrelia garinii
RLEYTEIKNDG

SEQ ID NO: 192756 - protein, 11 aa, Borrelia garinii
LEYTEIKNDGS

SEQ ID NO: 192757 - protein, 11 aa, Borrelia garinii
EYTEIKNDGSG

SEQ ID NO: 192758 - protein, 11 aa, Borrelia garinii
YTEIKNDGSGK

SEQ ID NO: 192759 - protein, 11 aa, Borrelia garinii
TEIKNDGSGKA

SEQ ID NO: 192760 - protein, 11 aa, Borrelia garinii
EIKNDGSGKAK

SEQ ID NO: 192761 - protein, 11 aa, Borrelia garinii
IKNDGSGKAKE

SEQ ID NO: 192762 - protein, 11 aa, Borrelia garinii
KNDGSGKAKEV

SEQ ID NO: 192763 - protein, 11 aa, Borrelia garinii
NDGSGKAKEVL

SEQ ID NO: 192764 - protein, 11 aa, Borrelia garinii
DGSGKAKEVLK

SEQ ID NO: 192765 - protein, 11 aa, Borrelia garinii
GSGKAKEVLKG

SEQ ID NO: 192766 - protein, 11 aa, Borrelia garinii
SGKAKEVLKGF

SEQ ID NO: 192767 - protein, 11 aa, Borrelia garinii
GKAKEVLKGFA

SEQ ID NO: 192768 - protein, 11 aa, Borrelia garinii
KAKEVLKGFAL

SEQ ID NO: 192769 - protein, 11 aa, Borrelia garinii
AKEVLKGFALE

SEQ ID NO: 192770 - protein, 11 aa, Borrelia garinii
KEVLKGFALEG

SEQ ID NO: 192771 - protein, 11 aa, Borrelia garinii
EVLKGFALEGT

SEQ ID NO: 192772 - protein, 11 aa, Borrelia garinii
VLKGFALEGTL

SEQ ID NO: 192773 - protein, 11 aa, Borrelia garinii
LKGFALEGTLT

SEQ ID NO: 192774 - protein, 11 aa, Borrelia garinii
KGFALEGTLTD

SEQ ID NO: 192775 - protein, 11 aa, Borrelia garinii
GFALEGTLTDG

SEQ ID NO: 192776 - protein, 11 aa, Borrelia garinii
FALEGTLTDGG

SEQ ID NO: 192777 - protein, 11 aa, Borrelia garinii
ALEGTLTDGGE

SEQ ID NO: 192778 - protein, 11 aa, Borrelia garinii
LEGTLTDGGET

SEQ ID NO: 192779 - protein, 11 aa, Borrelia garinii
EGTLTDGGETK

SEQ ID NO: 192780 - protein, 11 aa, Borrelia garinii
GTLTDGGETKL

SEQ ID NO: 192781 - protein, 11 aa, Borrelia garinii
TLTDGGETKLT

SEQ ID NO: 192782 - protein, 11 aa, Borrelia garinii
LTDGGETKLTV

SEQ ID NO: 192783 - protein, 11 aa, Borrelia garinii
TDGGETKLTVT

SEQ ID NO: 192784 - protein, 11 aa, Borrelia garinii
DGGETKLTVTE

SEQ ID NO: 192785 - protein, 11 aa, Borrelia garinii
GGETKLTVTEG

SEQ ID NO: 192786 - protein, 11 aa, Borrelia garinii
GETKLTVTEGT

SEQ ID NO: 192787 - protein, 11 aa, Borrelia garinii
ETKLTVTEGTV

SEQ ID NO: 192788 - protein, 11 aa, Borrelia garinii
TKLTVTEGTVT

SEQ ID NO: 192789 - protein, 11 aa, Borrelia garinii
KLTVTEGTVTL

SEQ ID NO: 192790 - protein, 11 aa, Borrelia garinii
LTVTEGTVTLS

SEQ ID NO: 192791 - protein, 11 aa, Borrelia garinii
TVTEGTVTLSK

SEQ ID NO: 192792 - protein, 11 aa, Borrelia garinii
VTEGTVTLSKN

SEQ ID NO: 192793 - protein, 11 aa, Borrelia garinii
TEGTVTLSKNI

SEQ ID NO: 192794 - protein, 11 aa, Borrelia garinii
EGTVTLSKNIS

SEQ ID NO: 192795 - protein, 11 aa, Borrelia garinii
GTVTLSKNISK

SEQ ID NO: 192796 - protein, 11 aa, Borrelia garinii
TVTLSKNISKS

SEQ ID NO: 192797 - protein, 11 aa, Borrelia garinii
VTLSKNISKSG

SEQ ID NO: 192798 - protein, 11 aa, Borrelia garinii
TLSKNISKSGE

SEQ ID NO: 192799 - protein, 11 aa, Borrelia garinii
LSKNISKSGEI

SEQ ID NO: 192800 - protein, 11 aa, Borrelia garinii
SKNISKSGEIT

SEQ ID NO: 192801 - protein, 11 aa, Borrelia garinii
KNISKSGEITV

SEQ ID NO: 192802 - protein, 11 aa, Borrelia garinii
NISKSGEITVA

SEQ ID NO: 192803 - protein, 11 aa, Borrelia garinii
ISKSGEITVAL

SEQ ID NO: 192804 - protein, 11 aa, Borrelia garinii
SKSGEITVALN

SEQ ID NO: 192805 - protein, 11 aa, Borrelia garinii
KSGEITVALND

SEQ ID NO: 192806 - protein, 11 aa, Borrelia garinii
SGEITVALNDT

SEQ ID NO: 192807 - protein, 11 aa, Borrelia garinii
GEITVALNDTE

SEQ ID NO: 192808 - protein, 11 aa, Borrelia garinii
EITVALNDTET

SEQ ID NO: 192809 - protein, 11 aa, Borrelia garinii
ITVALNDTETT

SEQ ID NO: 192810 - protein, 11 aa, Borrelia garinii
TVALNDTETTP

SEQ ID NO: 192811 - protein, 11 aa, Borrelia garinii
VALNDTETTPA

SEQ ID NO: 192812 - protein, 11 aa, Borrelia garinii
ALNDTETTPAD

SEQ ID NO: 192813 - protein, 11 aa, Borrelia garinii
LNDTETTPADK

SEQ ID NO: 192814 - protein, 11 aa, Borrelia garinii
NDTETTPADKK

SEQ ID NO: 192815 - protein, 11 aa, Borrelia garinii
DTETTPADKKT

SEQ ID NO: 192816 - protein, 11 aa, Borrelia garinii
TETTPADKKTG

SEQ ID NO: 192817 - protein, 11 aa, Borrelia garinii
ETTPADKKTGE

SEQ ID NO: 192818 - protein, 11 aa, Borrelia garinii
TTPADKKTGEW

SEQ ID NO: 192819 - protein, 11 aa, Borrelia garinii
TPADKKTGEWK

SEQ ID NO: 192820 - protein, 11 aa, Borrelia garinii
PADKKTGEWKS

SEQ ID NO: 192821 - protein, 11 aa, Borrelia garinii
ADKKTGEWKSD

SEQ ID NO: 192822 - protein, 11 aa, Borrelia garinii
DKKTGEWKSDT

SEQ ID NO: 192823 - protein, 11 aa, Borrelia garinii
KKTGEWKSDTS

SEQ ID NO: 192824 - protein, 11 aa, Borrelia garinii
KTGEWKSDTST

SEQ ID NO: 192825 - protein, 11 aa, Borrelia garinii
TGEWKSDTSTL

SEQ ID NO: 192826 - protein, 11 aa, Borrelia garinii
GEWKSDTSTLT

SEQ ID NO: 192827 - protein, 11 aa, Borrelia garinii
EWKSDTSTLTI

SEQ ID NO: 192828 - protein, 11 aa, Borrelia garinii
WKSDTSTLTIS

SEQ ID NO: 192829 - protein, 11 aa, Borrelia garinii
KSDTSTLTISK

SEQ ID NO: 192830 - protein, 11 aa, Borrelia garinii
SDTSTLTISKN

SEQ ID NO: 192831 - protein, 11 aa, Borrelia garinii
DTSTLTISKNS

SEQ ID NO: 192832 - protein, 11 aa, Borrelia garinii
TSTLTISKNSQ

SEQ ID NO: 192833 - protein, 11 aa, Borrelia garinii
STLTISKNSQK

SEQ ID NO: 192834 - protein, 11 aa, Borrelia garinii
TLTISKNSQKP

SEQ ID NO: 192835 - protein, 11 aa, Borrelia garinii
LTISKNSQKPK

SEQ ID NO: 192836 - protein, 11 aa, Borrelia garinii
TISKNSQKPKQ

SEQ ID NO: 192837 - protein, 11 aa, Borrelia garinii
ISKNSQKPKQL

SEQ ID NO: 192838 - protein, 11 aa, Borrelia garinii
SKNSQKPKQLV

SEQ ID NO: 192839 - protein, 11 aa, Borrelia garinii
KNSQKPKQLVF

SEQ ID NO: 192840 - protein, 11 aa, Borrelia garinii
NSQKPKQLVFT

SEQ ID NO: 192841 - protein, 11 aa, Borrelia garinii
SQKPKQLVFTK

SEQ ID NO: 192842 - protein, 11 aa, Borrelia garinii
QKPKQLVFTKE

SEQ ID NO: 192843 - protein, 11 aa, Borrelia garinii
KPKQLVFTKEN

SEQ ID NO: 192844 - protein, 11 aa, Borrelia garinii
PKQLVFTKENT

SEQ ID NO: 192845 - protein, 11 aa, Borrelia garinii
KQLVFTKENTI

SEQ ID NO: 192846 - protein, 11 aa, Borrelia garinii
QLVFTKENTIT

SEQ ID NO: 192847 - protein, 11 aa, Borrelia garinii
LVFTKENTITV

SEQ ID NO: 192848 - protein, 11 aa, Borrelia garinii
VFTKENTITVQ

SEQ ID NO: 192849 - protein, 11 aa, Borrelia garinii
FTKENTITVQN

SEQ ID NO: 192850 - protein, 11 aa, Borrelia garinii
TKENTITVQNY

SEQ ID NO: 192851 - protein, 11 aa, Borrelia garinii
KENTITVQNYN

SEQ ID NO: 192852 - protein, 11 aa, Borrelia garinii
ENTITVQNYNR

SEQ ID NO: 192853 - protein, 11 aa, Borrelia garinii
NTITVQNYNRA

SEQ ID NO: 192854 - protein, 11 aa, Borrelia garinii
TITVQNYNRAG

SEQ ID NO: 192855 - protein, 11 aa, Borrelia garinii
ITVQNYNRAGN

SEQ ID NO: 192856 - protein, 11 aa, Borrelia garinii
TVQNYNRAGNA

SEQ ID NO: 192857 - protein, 11 aa, Borrelia garinii
VQNYNRAGNAL

SEQ ID NO: 192858 - protein, 11 aa, Borrelia garinii
QNYNRAGNALE

SEQ ID NO: 192859 - protein, 11 aa, Borrelia garinii
NYNRAGNALEG

SEQ ID NO: 192860 - protein, 11 aa, Borrelia garinii
YNRAGNALEGS

SEQ ID NO: 192861 - protein, 11 aa, Borrelia garinii
NRAGNALEGSP

SEQ ID NO: 192862 - protein, 11 aa, Borrelia garinii
RAGNALEGSPA

SEQ ID NO: 192863 - protein, 11 aa, Borrelia garinii
AGNALEGSPAE

SEQ ID NO: 192864 - protein, 11 aa, Borrelia garinii
GNALEGSPAEI

SEQ ID NO: 192865 - protein, 11 aa, Borrelia garinii
NALEGSPAEIK

SEQ ID NO: 192866 - protein, 11 aa, Borrelia garinii
ALEGSPAEIKD

SEQ ID NO: 192867 - protein, 11 aa, Borrelia garinii
LEGSPAEIKDL

SEQ ID NO: 192868 - protein, 11 aa, Borrelia garinii
EGSPAEIKDLA

SEQ ID NO: 192869 - protein, 11 aa, Borrelia garinii
GSPAEIKDLAE

SEQ ID NO: 192870 - protein, 11 aa, Borrelia garinii
SPAEIKDLAEL

SEQ ID NO: 192871 - protein, 11 aa, Borrelia garinii
PAEIKDLAELK

SEQ ID NO: 192872 - protein, 11 aa, Borrelia garinii
AEIKDLAELKA

SEQ ID NO: 192873 - protein, 11 aa, Borrelia garinii
EIKDLAELKAA

SEQ ID NO: 192874 - protein, 11 aa, Borrelia garinii
IKDLAELKAAL

SEQ ID NO: 192875 - protein, 11 aa, Borrelia garinii
KDLAELKAALK

SEQ ID NO: 192876 - protein, 13 aa, Borrelia garinii
MKKYLLGIGLILA

SEQ ID NO: 192877 - protein, 13 aa, Borrelia garinii
KKYLLGIGLILAL

SEQ ID NO: 192878 - protein, 13 aa, Borrelia garinii
KYLLGIGLILALI

SEQ ID NO: 192879 - protein, 13 aa, Borrelia garinii
YLLGIGLILALIA

SEQ ID NO: 192880 - protein, 13 aa, Borrelia garinii
LLGIGLILALIAC

SEQ ID NO: 192881 - protein, 13 aa, Borrelia garinii
LGIGLILALIACK

SEQ ID NO: 192882 - protein, 13 aa, Borrelia garinii
GIGLILALIACKQ

SEQ ID NO: 192883 - protein, 13 aa, Borrelia garinii
IGLILALIACKQN

SEQ ID NO: 192884 - protein, 13 aa, Borrelia garinii
GLILALIACKQNV

SEQ ID NO: 192885 - protein, 13 aa, Borrelia garinii
LILALIACKQNVS

SEQ ID NO: 192886 - protein, 13 aa, Borrelia garinii
ILALIACKQNVSS

SEQ ID NO: 192887 - protein, 13 aa, Borrelia garinii
LALIACKQNVSSL

SEQ ID NO: 192888 - protein, 13 aa, Borrelia garinii
ALIACKQNVSSLD

SEQ ID NO: 192889 - protein, 13 aa, Borrelia garinii
LIACKQNVSSLDE

SEQ ID NO: 192890 - protein, 13 aa, Borrelia garinii
IACKQNVSSLDEK

SEQ ID NO: 192891 - protein, 13 aa, Borrelia garinii
ACKQNVSSLDEKN

SEQ ID NO: 192892 - protein, 13 aa, Borrelia garinii
CKQNVSSLDEKNS

SEQ ID NO: 192893 - protein, 13 aa, Borrelia garinii
KQNVSSLDEKNSV

SEQ ID NO: 192894 - protein, 13 aa, Borrelia garinii
QNVSSLDEKNSVS

SEQ ID NO: 192895 - protein, 13 aa, Borrelia garinii
NVSSLDEKNSVSV

SEQ ID NO: 192896 - protein, 13 aa, Borrelia garinii
VSSLDEKNSVSVD

SEQ ID NO: 192897 - protein, 13 aa, Borrelia garinii
SSLDEKNSVSVDL

SEQ ID NO: 192898 - protein, 13 aa, Borrelia garinii
SLDEKNSVSVDLP

SEQ ID NO: 192899 - protein, 13 aa, Borrelia garinii
LDEKNSVSVDLPG

SEQ ID NO: 192900 - protein, 13 aa, Borrelia garinii
DEKNSVSVDLPGG

SEQ ID NO: 192901 - protein, 13 aa, Borrelia garinii
EKNSVSVDLPGGM

SEQ ID NO: 192902 - protein, 13 aa, Borrelia garinii
KNSVSVDLPGGMK

SEQ ID NO: 192903 - protein, 13 aa, Borrelia garinii
NSVSVDLPGGMKV

SEQ ID NO: 192904 - protein, 13 aa, Borrelia garinii
SVSVDLPGGMKVL

SEQ ID NO: 192905 - protein, 13 aa, Borrelia garinii
VSVDLPGGMKVLV

SEQ ID NO: 192906 - protein, 13 aa, Borrelia garinii
SVDLPGGMKVLVS

SEQ ID NO: 192907 - protein, 13 aa, Borrelia garinii
VDLPGGMKVLVSK

SEQ ID NO: 192908 - protein, 13 aa, Borrelia garinii
DLPGGMKVLVSKE

SEQ ID NO: 192909 - protein, 13 aa, Borrelia garinii
LPGGMKVLVSKEK

SEQ ID NO: 192910 - protein, 13 aa, Borrelia garinii
PGGMKVLVSKEKD

SEQ ID NO: 192911 - protein, 13 aa, Borrelia garinii
GGMKVLVSKEKDK

SEQ ID NO: 192912 - protein, 13 aa, Borrelia garinii
GMKVLVSKEKDKD

SEQ ID NO: 192913 - protein, 13 aa, Borrelia garinii
MKVLVSKEKDKDG

SEQ ID NO: 192914 - protein, 13 aa, Borrelia garinii
KVLVSKEKDKDGK

SEQ ID NO: 192915 - protein, 13 aa, Borrelia garinii
VLVSKEKDKDGKY

SEQ ID NO: 192916 - protein, 13 aa, Borrelia garinii
LVSKEKDKDGKYS

SEQ ID NO: 192917 - protein, 13 aa, Borrelia garinii
VSKEKDKDGKYSL

SEQ ID NO: 192918 - protein, 13 aa, Borrelia garinii
SKEKDKDGKYSLM

SEQ ID NO: 192919 - protein, 13 aa, Borrelia garinii
KEKDKDGKYSLMA

SEQ ID NO: 192920 - protein, 13 aa, Borrelia garinii
EKDKDGKYSLMAT

SEQ ID NO: 192921 - protein, 13 aa, Borrelia garinii
KDKDGKYSLMATV

SEQ ID NO: 192922 - protein, 13 aa, Borrelia garinii
DKDGKYSLMATVE

SEQ ID NO: 192923 - protein, 13 aa, Borrelia garinii
KDGKYSLMATVEK

SEQ ID NO: 192924 - protein, 13 aa, Borrelia garinii
DGKYSLMATVEKL

SEQ ID NO: 192925 - protein, 13 aa, Borrelia garinii
GKYSLMATVEKLE

SEQ ID NO: 192926 - protein, 13 aa, Borrelia garinii
KYSLMATVEKLEL

SEQ ID NO: 192927 - protein, 13 aa, Borrelia garinii
YSLMATVEKLELK

SEQ ID NO: 192928 - protein, 13 aa, Borrelia garinii
SLMATVEKLELKG

SEQ ID NO: 192929 - protein, 13 aa, Borrelia garinii
LMATVEKLELKGT

SEQ ID NO: 192930 - protein, 13 aa, Borrelia garinii
MATVEKLELKGTS

SEQ ID NO: 192931 - protein, 13 aa, Borrelia garinii
ATVEKLELKGTSD

SEQ ID NO: 192932 - protein, 13 aa, Borrelia garinii
TVEKLELKGTSDK

SEQ ID NO: 192933 - protein, 13 aa, Borrelia garinii
VEKLELKGTSDKS

SEQ ID NO: 192934 - protein, 13 aa, Borrelia garinii
EKLELKGTSDKSN

SEQ ID NO: 192935 - protein, 13 aa, Borrelia garinii
KLELKGTSDKSNG

SEQ ID NO: 192936 - protein, 13 aa, Borrelia garinii
LELKGTSDKSNGS

SEQ ID NO: 192937 - protein, 13 aa, Borrelia garinii
ELKGTSDKSNGSG

SEQ ID NO: 192938 - protein, 13 aa, Borrelia garinii
LKGTSDKSNGSGV

SEQ ID NO: 192939 - protein, 13 aa, Borrelia garinii
KGTSDKSNGSGVL

SEQ ID NO: 192940 - protein, 13 aa, Borrelia garinii
GTSDKSNGSGVLE

SEQ ID NO: 192941 - protein, 13 aa, Borrelia garinii
TSDKSNGSGVLEG

SEQ ID NO: 192942 - protein, 13 aa, Borrelia garinii
SDKSNGSGVLEGE

SEQ ID NO: 192943 - protein, 13 aa, Borrelia garinii
DKSNGSGVLEGEK

SEQ ID NO: 192944 - protein, 13 aa, Borrelia garinii
KSNGSGVLEGEKA

SEQ ID NO: 192945 - protein, 13 aa, Borrelia garinii
SNGSGVLEGEKAD

SEQ ID NO: 192946 - protein, 13 aa, Borrelia garinii
NGSGVLEGEKADK

SEQ ID NO: 192947 - protein, 13 aa, Borrelia garinii
GSGVLEGEKADKS

SEQ ID NO: 192948 - protein, 13 aa, Borrelia garinii
SGVLEGEKADKSK

SEQ ID NO: 192949 - protein, 13 aa, Borrelia garinii
GVLEGEKADKSKA

SEQ ID NO: 192950 - protein, 13 aa, Borrelia garinii
VLEGEKADKSKAK

SEQ ID NO: 192951 - protein, 13 aa, Borrelia garinii
LEGEKADKSKAKL

SEQ ID NO: 192952 - protein, 13 aa, Borrelia garinii
EGEKADKSKAKLT

SEQ ID NO: 192953 - protein, 13 aa, Borrelia garinii
GEKADKSKAKLTI

SEQ ID NO: 192954 - protein, 13 aa, Borrelia garinii
EKADKSKAKLTIS

SEQ ID NO: 192955 - protein, 13 aa, Borrelia garinii
KADKSKAKLTISQ

SEQ ID NO: 192956 - protein, 13 aa, Borrelia garinii
ADKSKAKLTISQD

SEQ ID NO: 192957 - protein, 13 aa, Borrelia garinii
DKSKAKLTISQDL

SEQ ID NO: 192958 - protein, 13 aa, Borrelia garinii
KSKAKLTISQDLN

SEQ ID NO: 192959 - protein, 13 aa, Borrelia garinii
SKAKLTISQDLNQ

SEQ ID NO: 192960 - protein, 13 aa, Borrelia garinii
KAKLTISQDLNQT

SEQ ID NO: 192961 - protein, 13 aa, Borrelia garinii
AKLTISQDLNQTT

SEQ ID NO: 192962 - protein, 13 aa, Borrelia garinii
KLTISQDLNQTTF

SEQ ID NO: 192963 - protein, 13 aa, Borrelia garinii
LTISQDLNQTTFE

SEQ ID NO: 192964 - protein, 13 aa, Borrelia garinii
TISQDLNQTTFEI

SEQ ID NO: 192965 - protein, 13 aa, Borrelia garinii
ISQDLNQTTFEIF

SEQ ID NO: 192966 - protein, 13 aa, Borrelia garinii
SQDLNQTTFEIFK

SEQ ID NO: 192967 - protein, 13 aa, Borrelia garinii
QDLNQTTFEIFKE

SEQ ID NO: 192968 - protein, 13 aa, Borrelia garinii
DLNQTTFEIFKED

SEQ ID NO: 192969 - protein, 13 aa, Borrelia garinii
LNQTTFEIFKEDG

SEQ ID NO: 192970 - protein, 13 aa, Borrelia garinii
NQTTFEIFKEDGK

SEQ ID NO: 192971 - protein, 13 aa, Borrelia garinii
QTTFEIFKEDGKT

SEQ ID NO: 192972 - protein, 13 aa, Borrelia garinii
TTFEIFKEDGKTL

SEQ ID NO: 192973 - protein, 13 aa, Borrelia garinii
TFEIFKEDGKTLV

SEQ ID NO: 192974 - protein, 13 aa, Borrelia garinii
FEIFKEDGKTLVS

SEQ ID NO: 192975 - protein, 13 aa, Borrelia garinii
EIFKEDGKTLVSR

SEQ ID NO: 192976 - protein, 13 aa, Borrelia garinii
IFKEDGKTLVSRK

SEQ ID NO: 192977 - protein, 13 aa, Borrelia garinii
FKEDGKTLVSRKV

SEQ ID NO: 192978 - protein, 13 aa, Borrelia garinii
KEDGKTLVSRKVN

SEQ ID NO: 192979 - protein, 13 aa, Borrelia garinii
EDGKTLVSRKVNS

SEQ ID NO: 192980 - protein, 13 aa, Borrelia garinii
DGKTLVSRKVNSK

SEQ ID NO: 192981 - protein, 13 aa, Borrelia garinii
GKTLVSRKVNSKD

SEQ ID NO: 192982 - protein, 13 aa, Borrelia garinii
KTLVSRKVNSKDK

SEQ ID NO: 192983 - protein, 13 aa, Borrelia garinii
TLVSRKVNSKDKS

SEQ ID NO: 192984 - protein, 13 aa, Borrelia garinii
LVSRKVNSKDKSS

SEQ ID NO: 192985 - protein, 13 aa, Borrelia garinii
VSRKVNSKDKSST

SEQ ID NO: 192986 - protein, 13 aa, Borrelia garinii
SRKVNSKDKSSTE

SEQ ID NO: 192987 - protein, 13 aa, Borrelia garinii
RKVNSKDKSSTEE

SEQ ID NO: 192988 - protein, 13 aa, Borrelia garinii
KVNSKDKSSTEEK

SEQ ID NO: 192989 - protein, 13 aa, Borrelia garinii
VNSKDKSSTEEKF

SEQ ID NO: 192990 - protein, 13 aa, Borrelia garinii
NSKDKSSTEEKFN

SEQ ID NO: 192991 - protein, 13 aa, Borrelia garinii
SKDKSSTEEKFND

SEQ ID NO: 192992 - protein, 13 aa, Borrelia garinii
KDKSSTEEKFNDK

SEQ ID NO: 192993 - protein, 13 aa, Borrelia garinii
DKSSTEEKFNDKG

SEQ ID NO: 192994 - protein, 13 aa, Borrelia garinii
KSSTEEKFNDKGK

SEQ ID NO: 192995 - protein, 13 aa, Borrelia garinii
SSTEEKFNDKGKL

SEQ ID NO: 192996 - protein, 13 aa, Borrelia garinii
STEEKFNDKGKLS

SEQ ID NO: 192997 - protein, 13 aa, Borrelia garinii
TEEKFNDKGKLSE

SEQ ID NO: 192998 - protein, 13 aa, Borrelia garinii
EEKFNDKGKLSEK

SEQ ID NO: 192999 - protein, 13 aa, Borrelia garinii
EKFNDKGKLSEKV

SEQ ID NO: 193000 - protein, 13 aa, Borrelia garinii
KFNDKGKLSEKVV

SEQ ID NO: 193001 - protein, 13 aa, Borrelia garinii
FNDKGKLSEKVVT

SEQ ID NO: 193002 - protein, 13 aa, Borrelia garinii
NDKGKLSEKVVTR

SEQ ID NO: 193003 - protein, 13 aa, Borrelia garinii
DKGKLSEKVVTRA

SEQ ID NO: 193004 - protein, 13 aa, Borrelia garinii
KGKLSEKVVTRAN

SEQ ID NO: 193005 - protein, 13 aa, Borrelia garinii
GKLSEKVVTRANG

SEQ ID NO: 193006 - protein, 13 aa, Borrelia garinii
KLSEKVVTRANGT

SEQ ID NO: 193007 - protein, 13 aa, Borrelia garinii
LSEKVVTRANGTR

SEQ ID NO: 193008 - protein, 13 aa, Borrelia garinii
SEKVVTRANGTRL

SEQ ID NO: 193009 - protein, 13 aa, Borrelia garinii
EKVVTRANGTRLE

SEQ ID NO: 193010 - protein, 13 aa, Borrelia garinii
KVVTRANGTRLEY

SEQ ID NO: 193011 - protein, 13 aa, Borrelia garinii
VVTRANGTRLEYT

SEQ ID NO: 193012 - protein, 13 aa, Borrelia garinii
VTRANGTRLEYTE

SEQ ID NO: 193013 - protein, 13 aa, Borrelia garinii
TRANGTRLEYTEI

SEQ ID NO: 193014 - protein, 13 aa, Borrelia garinii
RANGTRLEYTEIK

SEQ ID NO: 193015 - protein, 13 aa, Borrelia garinii
ANGTRLEYTEIKN

SEQ ID NO: 193016 - protein, 13 aa, Borrelia garinii
NGTRLEYTEIKND

SEQ ID NO: 193017 - protein, 13 aa, Borrelia garinii
GTRLEYTEIKNDG

SEQ ID NO: 193018 - protein, 13 aa, Borrelia garinii
TRLEYTEIKNDGS

SEQ ID NO: 193019 - protein, 13 aa, Borrelia garinii
RLEYTEIKNDGSG

SEQ ID NO: 193020 - protein, 13 aa, Borrelia garinii
LEYTEIKNDGSGK

SEQ ID NO: 193021 - protein, 13 aa, Borrelia garinii
EYTEIKNDGSGKA

SEQ ID NO: 193022 - protein, 13 aa, Borrelia garinii
YTEIKNDGSGKAK

SEQ ID NO: 193023 - protein, 13 aa, Borrelia garinii
TEIKNDGSGKAKE

SEQ ID NO: 193024 - protein, 13 aa, Borrelia garinii
EIKNDGSGKAKEV

SEQ ID NO: 193025 - protein, 13 aa, Borrelia garinii
IKNDGSGKAKEVL

SEQ ID NO: 193026 - protein, 13 aa, Borrelia garinii
KNDGSGKAKEVLK

SEQ ID NO: 193027 - protein, 13 aa, Borrelia garinii
NDGSGKAKEVLKG

SEQ ID NO: 193028 - protein, 13 aa, Borrelia garinii
DGSGKAKEVLKGF

SEQ ID NO: 193029 - protein, 13 aa, Borrelia garinii
GSGKAKEVLKGFA

SEQ ID NO: 193030 - protein, 13 aa, Borrelia garinii
SGKAKEVLKGFAL

SEQ ID NO: 193031 - protein, 13 aa, Borrelia garinii
GKAKEVLKGFALE

SEQ ID NO: 193032 - protein, 13 aa, Borrelia garinii
KAKEVLKGFALEG

SEQ ID NO: 193033 - protein, 13 aa, Borrelia garinii
AKEVLKGFALEGT

SEQ ID NO: 193034 - protein, 13 aa, Borrelia garinii
KEVLKGFALEGTL

SEQ ID NO: 193035 - protein, 13 aa, Borrelia garinii
EVLKGFALEGTLT

SEQ ID NO: 193036 - protein, 13 aa, Borrelia garinii
VLKGFALEGTLTD

SEQ ID NO: 193037 - protein, 13 aa, Borrelia garinii
LKGFALEGTLTDG

SEQ ID NO: 193038 - protein, 13 aa, Borrelia garinii
KGFALEGTLTDGG

SEQ ID NO: 193039 - protein, 13 aa, Borrelia garinii
GFALEGTLTDGGE

SEQ ID NO: 193040 - protein, 13 aa, Borrelia garinii
FALEGTLTDGGET

SEQ ID NO: 193041 - protein, 13 aa, Borrelia garinii
ALEGTLTDGGETK

SEQ ID NO: 193042 - protein, 13 aa, Borrelia garinii
LEGTLTDGGETKL

SEQ ID NO: 193043 - protein, 13 aa, Borrelia garinii
EGTLTDGGETKLT

SEQ ID NO: 193044 - protein, 13 aa, Borrelia garinii
GTLTDGGETKLTV

SEQ ID NO: 193045 - protein, 13 aa, Borrelia garinii
TLTDGGETKLTVT

SEQ ID NO: 193046 - protein, 13 aa, Borrelia garinii
LTDGGETKLTVTE

SEQ ID NO: 193047 - protein, 13 aa, Borrelia garinii
TDGGETKLTVTEG

SEQ ID NO: 193048 - protein, 13 aa, Borrelia garinii
DGGETKLTVTEGT

SEQ ID NO: 193049 - protein, 13 aa, Borrelia garinii
GGETKLTVTEGTV

SEQ ID NO: 193050 - protein, 13 aa, Borrelia garinii
GETKLTVTEGTVT

SEQ ID NO: 193051 - protein, 13 aa, Borrelia garinii
ETKLTVTEGTVTL

SEQ ID NO: 193052 - protein, 13 aa, Borrelia garinii
TKLTVTEGTVTLS

SEQ ID NO: 193053 - protein, 13 aa, Borrelia garinii
KLTVTEGTVTLSK

SEQ ID NO: 193054 - protein, 13 aa, Borrelia garinii
LTVTEGTVTLSKN

SEQ ID NO: 193055 - protein, 13 aa, Borrelia garinii
TVTEGTVTLSKNI

SEQ ID NO: 193056 - protein, 13 aa, Borrelia garinii
VTEGTVTLSKNIS

SEQ ID NO: 193057 - protein, 13 aa, Borrelia garinii
TEGTVTLSKNISK

SEQ ID NO: 193058 - protein, 13 aa, Borrelia garinii
EGTVTLSKNISKS

SEQ ID NO: 193059 - protein, 13 aa, Borrelia garinii
GTVTLSKNISKSG

SEQ ID NO: 193060 - protein, 13 aa, Borrelia garinii
TVTLSKNISKSGE

SEQ ID NO: 193061 - protein, 13 aa, Borrelia garinii
VTLSKNISKSGEI

SEQ ID NO: 193062 - protein, 13 aa, Borrelia garinii
TLSKNISKSGEIT

SEQ ID NO: 193063 - protein, 13 aa, Borrelia garinii
LSKNISKSGEITV

SEQ ID NO: 193064 - protein, 13 aa, Borrelia garinii
SKNISKSGEITVA

SEQ ID NO: 193065 - protein, 13 aa, Borrelia garinii
KNISKSGEITVAL

SEQ ID NO: 193066 - protein, 13 aa, Borrelia garinii
NISKSGEITVALN

SEQ ID NO: 193067 - protein, 13 aa, Borrelia garinii
ISKSGEITVALND

SEQ ID NO: 193068 - protein, 13 aa, Borrelia garinii
SKSGEITVALNDT

SEQ ID NO: 193069 - protein, 13 aa, Borrelia garinii
KSGEITVALNDTE

SEQ ID NO: 193070 - protein, 13 aa, Borrelia garinii
SGEITVALNDTET

SEQ ID NO: 193071 - protein, 13 aa, Borrelia garinii
GEITVALNDTETT

SEQ ID NO: 193072 - protein, 13 aa, Borrelia garinii
EITVALNDTETTP

SEQ ID NO: 193073 - protein, 13 aa, Borrelia garinii
ITVALNDTETTPA

SEQ ID NO: 193074 - protein, 13 aa, Borrelia garinii
TVALNDTETTPAD

SEQ ID NO: 193075 - protein, 13 aa, Borrelia garinii
VALNDTETTPADK

SEQ ID NO: 193076 - protein, 13 aa, Borrelia garinii
ALNDTETTPADKK

SEQ ID NO: 193077 - protein, 13 aa, Borrelia garinii
LNDTETTPADKKT

SEQ ID NO: 193078 - protein, 13 aa, Borrelia garinii
NDTETTPADKKTG

SEQ ID NO: 193079 - protein, 13 aa, Borrelia garinii
DTETTPADKKTGE

SEQ ID NO: 193080 - protein, 13 aa, Borrelia garinii
TETTPADKKTGEW

SEQ ID NO: 193081 - protein, 13 aa, Borrelia garinii
ETTPADKKTGEWK

SEQ ID NO: 193082 - protein, 13 aa, Borrelia garinii
TTPADKKTGEWKS

SEQ ID NO: 193083 - protein, 13 aa, Borrelia garinii
TPADKKTGEWKSD

SEQ ID NO: 193084 - protein, 13 aa, Borrelia garinii
PADKKTGEWKSDT

SEQ ID NO: 193085 - protein, 13 aa, Borrelia garinii
ADKKTGEWKSDTS

SEQ ID NO: 193086 - protein, 13 aa, Borrelia garinii
DKKTGEWKSDTST

SEQ ID NO: 193087 - protein, 13 aa, Borrelia garinii
KKTGEWKSDTSTL

SEQ ID NO: 193088 - protein, 13 aa, Borrelia garinii
KTGEWKSDTSTLT

SEQ ID NO: 193089 - protein, 13 aa, Borrelia garinii
TGEWKSDTSTLTI

SEQ ID NO: 193090 - protein, 13 aa, Borrelia garinii
GEWKSDTSTLTIS

SEQ ID NO: 193091 - protein, 13 aa, Borrelia garinii
EWKSDTSTLTISK

SEQ ID NO: 193092 - protein, 13 aa, Borrelia garinii
WKSDTSTLTISKN

SEQ ID NO: 193093 - protein, 13 aa, Borrelia garinii
KSDTSTLTISKNS

SEQ ID NO: 193094 - protein, 13 aa, Borrelia garinii
SDTSTLTISKNSQ

SEQ ID NO: 193095 - protein, 13 aa, Borrelia garinii
DTSTLTISKNSQK

SEQ ID NO: 193096 - protein, 13 aa, Borrelia garinii
TSTLTISKNSQKP

SEQ ID NO: 193097 - protein, 13 aa, Borrelia garinii
STLTISKNSQKPK

SEQ ID NO: 193098 - protein, 13 aa, Borrelia garinii
TLTISKNSQKPKQ

SEQ ID NO: 193099 - protein, 13 aa, Borrelia garinii
LTISKNSQKPKQL

SEQ ID NO: 193100 - protein, 13 aa, Borrelia garinii
TISKNSQKPKQLV

SEQ ID NO: 193101 - protein, 13 aa, Borrelia garinii
ISKNSQKPKQLVF

SEQ ID NO: 193102 - protein, 13 aa, Borrelia garinii
SKNSQKPKQLVFT

SEQ ID NO: 193103 - protein, 13 aa, Borrelia garinii
KNSQKPKQLVFTK

SEQ ID NO: 193104 - protein, 13 aa, Borrelia garinii
NSQKPKQLVFTKE

SEQ ID NO: 193105 - protein, 13 aa, Borrelia garinii
SQKPKQLVFTKEN

SEQ ID NO: 193106 - protein, 13 aa, Borrelia garinii
QKPKQLVFTKENT

SEQ ID NO: 193107 - protein, 13 aa, Borrelia garinii
KPKQLVFTKENTI

SEQ ID NO: 193108 - protein, 13 aa, Borrelia garinii
PKQLVFTKENTIT

SEQ ID NO: 193109 - protein, 13 aa, Borrelia garinii
KQLVFTKENTITV

SEQ ID NO: 193110 - protein, 13 aa, Borrelia garinii
QLVFTKENTITVQ

SEQ ID NO: 193111 - protein, 13 aa, Borrelia garinii
LVFTKENTITVQN

SEQ ID NO: 193112 - protein, 13 aa, Borrelia garinii
VFTKENTITVQNY

SEQ ID NO: 193113 - protein, 13 aa, Borrelia garinii
FTKENTITVQNYN

SEQ ID NO: 193114 - protein, 13 aa, Borrelia garinii
TKENTITVQNYNR

SEQ ID NO: 193115 - protein, 13 aa, Borrelia garinii
KENTITVQNYNRA

SEQ ID NO: 193116 - protein, 13 aa, Borrelia garinii
ENTITVQNYNRAG

SEQ ID NO: 193117 - protein, 13 aa, Borrelia garinii
NTITVQNYNRAGN

SEQ ID NO: 193118 - protein, 13 aa, Borrelia garinii
TITVQNYNRAGNA

SEQ ID NO: 193119 - protein, 13 aa, Borrelia garinii
ITVQNYNRAGNAL

SEQ ID NO: 193120 - protein, 13 aa, Borrelia garinii
TVQNYNRAGNALE

SEQ ID NO: 193121 - protein, 13 aa, Borrelia garinii
VQNYNRAGNALEG

SEQ ID NO: 193122 - protein, 13 aa, Borrelia garinii
QNYNRAGNALEGS

SEQ ID NO: 193123 - protein, 13 aa, Borrelia garinii
NYNRAGNALEGSP

SEQ ID NO: 193124 - protein, 13 aa, Borrelia garinii
YNRAGNALEGSPA

SEQ ID NO: 193125 - protein, 13 aa, Borrelia garinii
NRAGNALEGSPAE

SEQ ID NO: 193126 - protein, 13 aa, Borrelia garinii
RAGNALEGSPAEI

SEQ ID NO: 193127 - protein, 13 aa, Borrelia garinii
AGNALEGSPAEIK

SEQ ID NO: 193128 - protein, 13 aa, Borrelia garinii
GNALEGSPAEIKD

SEQ ID NO: 193129 - protein, 13 aa, Borrelia garinii
NALEGSPAEIKDL

SEQ ID NO: 193130 - protein, 13 aa, Borrelia garinii
ALEGSPAEIKDLA

SEQ ID NO: 193131 - protein, 13 aa, Borrelia garinii
LEGSPAEIKDLAE

SEQ ID NO: 193132 - protein, 13 aa, Borrelia garinii
EGSPAEIKDLAEL

SEQ ID NO: 193133 - protein, 13 aa, Borrelia garinii
GSPAEIKDLAELK

SEQ ID NO: 193134 - protein, 13 aa, Borrelia garinii
SPAEIKDLAELKA

SEQ ID NO: 193135 - protein, 13 aa, Borrelia garinii
PAEIKDLAELKAA

SEQ ID NO: 193136 - protein, 13 aa, Borrelia garinii
AEIKDLAELKAAL

SEQ ID NO: 193137 - protein, 13 aa, Borrelia garinii
EIKDLAELKAALK

SEQ ID NO: 193138 - protein, 14 aa, Borrelia garinii
MKKYLLGIGLILAL

SEQ ID NO: 193139 - protein, 14 aa, Borrelia garinii
KKYLLGIGLILALI

SEQ ID NO: 193140 - protein, 14 aa, Borrelia garinii
KYLLGIGLILALIA

SEQ ID NO: 193141 - protein, 14 aa, Borrelia garinii
YLLGIGLILALIAC

SEQ ID NO: 193142 - protein, 14 aa, Borrelia garinii
LLGIGLILALIACK

SEQ ID NO: 193143 - protein, 14 aa, Borrelia garinii
LGIGLILALIACKQ

SEQ ID NO: 193144 - protein, 14 aa, Borrelia garinii
GIGLILALIACKQN

SEQ ID NO: 193145 - protein, 14 aa, Borrelia garinii
IGLILALIACKQNV

SEQ ID NO: 193146 - protein, 14 aa, Borrelia garinii
GLILALIACKQNVS

SEQ ID NO: 193147 - protein, 14 aa, Borrelia garinii
LILALIACKQNVSS

SEQ ID NO: 193148 - protein, 14 aa, Borrelia garinii
ILALIACKQNVSSL

SEQ ID NO: 193149 - protein, 14 aa, Borrelia garinii
LALIACKQNVSSLD

SEQ ID NO: 193150 - protein, 14 aa, Borrelia garinii
ALIACKQNVSSLDE

SEQ ID NO: 193151 - protein, 14 aa, Borrelia garinii
LIACKQNVSSLDEK

SEQ ID NO: 193152 - protein, 14 aa, Borrelia garinii
IACKQNVSSLDEKN

SEQ ID NO: 193153 - protein, 14 aa, Borrelia garinii
ACKQNVSSLDEKNS

SEQ ID NO: 193154 - protein, 14 aa, Borrelia garinii
CKQNVSSLDEKNSV

SEQ ID NO: 193155 - protein, 14 aa, Borrelia garinii
KQNVSSLDEKNSVS

SEQ ID NO: 193156 - protein, 14 aa, Borrelia garinii
QNVSSLDEKNSVSV

SEQ ID NO: 193157 - protein, 14 aa, Borrelia garinii
NVSSLDEKNSVSVD

SEQ ID NO: 193158 - protein, 14 aa, Borrelia garinii
VSSLDEKNSVSVDL

SEQ ID NO: 193159 - protein, 14 aa, Borrelia garinii
SSLDEKNSVSVDLP

SEQ ID NO: 193160 - protein, 14 aa, Borrelia garinii
SLDEKNSVSVDLPG

SEQ ID NO: 193161 - protein, 14 aa, Borrelia garinii
LDEKNSVSVDLPGG

SEQ ID NO: 193162 - protein, 14 aa, Borrelia garinii
DEKNSVSVDLPGGM

SEQ ID NO: 193163 - protein, 14 aa, Borrelia garinii
EKNSVSVDLPGGMK

SEQ ID NO: 193164 - protein, 14 aa, Borrelia garinii
KNSVSVDLPGGMKV

SEQ ID NO: 193165 - protein, 14 aa, Borrelia garinii
NSVSVDLPGGMKVL

SEQ ID NO: 193166 - protein, 14 aa, Borrelia garinii
SVSVDLPGGMKVLV

SEQ ID NO: 193167 - protein, 14 aa, Borrelia garinii
VSVDLPGGMKVLVS

SEQ ID NO: 193168 - protein, 14 aa, Borrelia garinii
SVDLPGGMKVLVSK

SEQ ID NO: 193169 - protein, 14 aa, Borrelia garinii
VDLPGGMKVLVSKE

SEQ ID NO: 193170 - protein, 14 aa, Borrelia garinii
DLPGGMKVLVSKEK

SEQ ID NO: 193171 - protein, 14 aa, Borrelia garinii
LPGGMKVLVSKEKD

SEQ ID NO: 193172 - protein, 14 aa, Borrelia garinii
PGGMKVLVSKEKDK

SEQ ID NO: 193173 - protein, 14 aa, Borrelia garinii
GGMKVLVSKEKDKD

SEQ ID NO: 193174 - protein, 14 aa, Borrelia garinii
GMKVLVSKEKDKDG

SEQ ID NO: 193175 - protein, 14 aa, Borrelia garinii
MKVLVSKEKDKDGK

SEQ ID NO: 193176 - protein, 14 aa, Borrelia garinii
KVLVSKEKDKDGKY

SEQ ID NO: 193177 - protein, 14 aa, Borrelia garinii
VLVSKEKDKDGKYS

SEQ ID NO: 193178 - protein, 14 aa, Borrelia garinii
LVSKEKDKDGKYSL

SEQ ID NO: 193179 - protein, 14 aa, Borrelia garinii
VSKEKDKDGKYSLM

SEQ ID NO: 193180 - protein, 14 aa, Borrelia garinii
SKEKDKDGKYSLMA

SEQ ID NO: 193181 - protein, 14 aa, Borrelia garinii
KEKDKDGKYSLMAT

SEQ ID NO: 193182 - protein, 14 aa, Borrelia garinii
EKDKDGKYSLMATV

SEQ ID NO: 193183 - protein, 14 aa, Borrelia garinii
KDKDGKYSLMATVE

SEQ ID NO: 193184 - protein, 14 aa, Borrelia garinii
DKDGKYSLMATVEK

SEQ ID NO: 193185 - protein, 14 aa, Borrelia garinii
KDGKYSLMATVEKL

SEQ ID NO: 193186 - protein, 14 aa, Borrelia garinii
DGKYSLMATVEKLE

SEQ ID NO: 193187 - protein, 14 aa, Borrelia garinii
GKYSLMATVEKLEL

SEQ ID NO: 193188 - protein, 14 aa, Borrelia garinii
KYSLMATVEKLELK

SEQ ID NO: 193189 - protein, 14 aa, Borrelia garinii
YSLMATVEKLELKG

SEQ ID NO: 193190 - protein, 14 aa, Borrelia garinii
SLMATVEKLELKGT

SEQ ID NO: 193191 - protein, 14 aa, Borrelia garinii
LMATVEKLELKGTS

SEQ ID NO: 193192 - protein, 14 aa, Borrelia garinii
MATVEKLELKGTSD

SEQ ID NO: 193193 - protein, 14 aa, Borrelia garinii
ATVEKLELKGTSDK

SEQ ID NO: 193194 - protein, 14 aa, Borrelia garinii
TVEKLELKGTSDKS

SEQ ID NO: 193195 - protein, 14 aa, Borrelia garinii
VEKLELKGTSDKSN

SEQ ID NO: 193196 - protein, 14 aa, Borrelia garinii
EKLELKGTSDKSNG

SEQ ID NO: 193197 - protein, 14 aa, Borrelia garinii
KLELKGTSDKSNGS

SEQ ID NO: 193198 - protein, 14 aa, Borrelia garinii
LELKGTSDKSNGSG

SEQ ID NO: 193199 - protein, 14 aa, Borrelia garinii
ELKGTSDKSNGSGV

SEQ ID NO: 193200 - protein, 14 aa, Borrelia garinii
LKGTSDKSNGSGVL

SEQ ID NO: 193201 - protein, 14 aa, Borrelia garinii
KGTSDKSNGSGVLE

SEQ ID NO: 193202 - protein, 14 aa, Borrelia garinii
GTSDKSNGSGVLEG

SEQ ID NO: 193203 - protein, 14 aa, Borrelia garinii
TSDKSNGSGVLEGE

SEQ ID NO: 193204 - protein, 14 aa, Borrelia garinii
SDKSNGSGVLEGEK

SEQ ID NO: 193205 - protein, 14 aa, Borrelia garinii
DKSNGSGVLEGEKA

SEQ ID NO: 193206 - protein, 14 aa, Borrelia garinii
KSNGSGVLEGEKAD

SEQ ID NO: 193207 - protein, 14 aa, Borrelia garinii
SNGSGVLEGEKADK

SEQ ID NO: 193208 - protein, 14 aa, Borrelia garinii
NGSGVLEGEKADKS

SEQ ID NO: 193209 - protein, 14 aa, Borrelia garinii
GSGVLEGEKADKSK

SEQ ID NO: 193210 - protein, 14 aa, Borrelia garinii
SGVLEGEKADKSKA

SEQ ID NO: 193211 - protein, 14 aa, Borrelia garinii
GVLEGEKADKSKAK

SEQ ID NO: 193212 - protein, 14 aa, Borrelia garinii
VLEGEKADKSKAKL

SEQ ID NO: 193213 - protein, 14 aa, Borrelia garinii
LEGEKADKSKAKLT

SEQ ID NO: 193214 - protein, 14 aa, Borrelia garinii
EGEKADKSKAKLTI

SEQ ID NO: 193215 - protein, 14 aa, Borrelia garinii
GEKADKSKAKLTIS

SEQ ID NO: 193216 - protein, 14 aa, Borrelia garinii
EKADKSKAKLTISQ

SEQ ID NO: 193217 - protein, 14 aa, Borrelia garinii
KADKSKAKLTISQD

SEQ ID NO: 193218 - protein, 14 aa, Borrelia garinii
ADKSKAKLTISQDL

SEQ ID NO: 193219 - protein, 14 aa, Borrelia garinii
DKSKAKLTISQDLN

SEQ ID NO: 193220 - protein, 14 aa, Borrelia garinii
KSKAKLTISQDLNQ

SEQ ID NO: 193221 - protein, 14 aa, Borrelia garinii
SKAKLTISQDLNQT

SEQ ID NO: 193222 - protein, 14 aa, Borrelia garinii
KAKLTISQDLNQTT

SEQ ID NO: 193223 - protein, 14 aa, Borrelia garinii
AKLTISQDLNQTTF

SEQ ID NO: 193224 - protein, 14 aa, Borrelia garinii
KLTISQDLNQTTFE

SEQ ID NO: 193225 - protein, 14 aa, Borrelia garinii
LTISQDLNQTTFEI

SEQ ID NO: 193226 - protein, 14 aa, Borrelia garinii
TISQDLNQTTFEIF

SEQ ID NO: 193227 - protein, 14 aa, Borrelia garinii
ISQDLNQTTFEIFK

SEQ ID NO: 193228 - protein, 14 aa, Borrelia garinii
SQDLNQTTFEIFKE

SEQ ID NO: 193229 - protein, 14 aa, Borrelia garinii
QDLNQTTFEIFKED

SEQ ID NO: 193230 - protein, 14 aa, Borrelia garinii
DLNQTTFEIFKEDG

SEQ ID NO: 193231 - protein, 14 aa, Borrelia garinii
LNQTTFEIFKEDGK

SEQ ID NO: 193232 - protein, 14 aa, Borrelia garinii
NQTTFEIFKEDGKT

SEQ ID NO: 193233 - protein, 14 aa, Borrelia garinii
QTTFEIFKEDGKTL

SEQ ID NO: 193234 - protein, 14 aa, Borrelia garinii
TTFEIFKEDGKTLV

SEQ ID NO: 193235 - protein, 14 aa, Borrelia garinii
TFEIFKEDGKTLVS

SEQ ID NO: 193236 - protein, 14 aa, Borrelia garinii
FEIFKEDGKTLVSR

SEQ ID NO: 193237 - protein, 14 aa, Borrelia garinii
EIFKEDGKTLVSRK

SEQ ID NO: 193238 - protein, 14 aa, Borrelia garinii
IFKEDGKTLVSRKV

SEQ ID NO: 193239 - protein, 14 aa, Borrelia garinii
FKEDGKTLVSRKVN

SEQ ID NO: 193240 - protein, 14 aa, Borrelia garinii
KEDGKTLVSRKVNS

SEQ ID NO: 193241 - protein, 14 aa, Borrelia garinii
EDGKTLVSRKVNSK

SEQ ID NO: 193242 - protein, 14 aa, Borrelia garinii
DGKTLVSRKVNSKD

SEQ ID NO: 193243 - protein, 14 aa, Borrelia garinii
GKTLVSRKVNSKDK

SEQ ID NO: 193244 - protein, 14 aa, Borrelia garinii
KTLVSRKVNSKDKS

SEQ ID NO: 193245 - protein, 14 aa, Borrelia garinii
TLVSRKVNSKDKSS

SEQ ID NO: 193246 - protein, 14 aa, Borrelia garinii
LVSRKVNSKDKSST

SEQ ID NO: 193247 - protein, 14 aa, Borrelia garinii
VSRKVNSKDKSSTE

SEQ ID NO: 193248 - protein, 14 aa, Borrelia garinii
SRKVNSKDKSSTEE

SEQ ID NO: 193249 - protein, 14 aa, Borrelia garinii
RKVNSKDKSSTEEK

SEQ ID NO: 193250 - protein, 14 aa, Borrelia garinii
KVNSKDKSSTEEKF

SEQ ID NO: 193251 - protein, 14 aa, Borrelia garinii
VNSKDKSSTEEKFN

SEQ ID NO: 193252 - protein, 14 aa, Borrelia garinii
NSKDKSSTEEKFND

SEQ ID NO: 193253 - protein, 14 aa, Borrelia garinii
SKDKSSTEEKFNDK

SEQ ID NO: 193254 - protein, 14 aa, Borrelia garinii
KDKSSTEEKFNDKG

SEQ ID NO: 193255 - protein, 14 aa, Borrelia garinii
DKSSTEEKFNDKGK

SEQ ID NO: 193256 - protein, 14 aa, Borrelia garinii
KSSTEEKFNDKGKL

SEQ ID NO: 193257 - protein, 14 aa, Borrelia garinii
SSTEEKFNDKGKLS

SEQ ID NO: 193258 - protein, 14 aa, Borrelia garinii
STEEKFNDKGKLSE

SEQ ID NO: 193259 - protein, 14 aa, Borrelia garinii
TEEKFNDKGKLSEK

SEQ ID NO: 193260 - protein, 14 aa, Borrelia garinii
EEKFNDKGKLSEKV

SEQ ID NO: 193261 - protein, 14 aa, Borrelia garinii
EKFNDKGKLSEKVV

SEQ ID NO: 193262 - protein, 14 aa, Borrelia garinii
KFNDKGKLSEKVVT

SEQ ID NO: 193263 - protein, 14 aa, Borrelia garinii
FNDKGKLSEKVVTR

SEQ ID NO: 193264 - protein, 14 aa, Borrelia garinii
NDKGKLSEKVVTRA

SEQ ID NO: 193265 - protein, 14 aa, Borrelia garinii
DKGKLSEKVVTRAN

SEQ ID NO: 193266 - protein, 14 aa, Borrelia garinii
KGKLSEKVVTRANG

SEQ ID NO: 193267 - protein, 14 aa, Borrelia garinii
GKLSEKVVTRANGT

SEQ ID NO: 193268 - protein, 14 aa, Borrelia garinii
KLSEKVVTRANGTR

SEQ ID NO: 193269 - protein, 14 aa, Borrelia garinii
LSEKVVTRANGTRL

SEQ ID NO: 193270 - protein, 14 aa, Borrelia garinii
SEKVVTRANGTRLE

SEQ ID NO: 193271 - protein, 14 aa, Borrelia garinii
EKVVTRANGTRLEY

SEQ ID NO: 193272 - protein, 14 aa, Borrelia garinii
KVVTRANGTRLEYT

SEQ ID NO: 193273 - protein, 14 aa, Borrelia garinii
VVTRANGTRLEYTE

SEQ ID NO: 193274 - protein, 14 aa, Borrelia garinii
VTRANGTRLEYTEI

SEQ ID NO: 193275 - protein, 14 aa, Borrelia garinii
TRANGTRLEYTEIK

SEQ ID NO: 193276 - protein, 14 aa, Borrelia garinii
RANGTRLEYTEIKN

SEQ ID NO: 193277 - protein, 14 aa, Borrelia garinii
ANGTRLEYTEIKND

SEQ ID NO: 193278 - protein, 14 aa, Borrelia garinii
NGTRLEYTEIKNDG

SEQ ID NO: 193279 - protein, 14 aa, Borrelia garinii
GTRLEYTEIKNDGS

SEQ ID NO: 193280 - protein, 14 aa, Borrelia garinii
TRLEYTEIKNDGSG

SEQ ID NO: 193281 - protein, 14 aa, Borrelia garinii
RLEYTEIKNDGSGK

SEQ ID NO: 193282 - protein, 14 aa, Borrelia garinii
LEYTEIKNDGSGKA

SEQ ID NO: 193283 - protein, 14 aa, Borrelia garinii
EYTEIKNDGSGKAK

SEQ ID NO: 193284 - protein, 14 aa, Borrelia garinii
YTEIKNDGSGKAKE

SEQ ID NO: 193285 - protein, 14 aa, Borrelia garinii
TEIKNDGSGKAKEV

SEQ ID NO: 193286 - protein, 14 aa, Borrelia garinii
EIKNDGSGKAKEVL

SEQ ID NO: 193287 - protein, 14 aa, Borrelia garinii
IKNDGSGKAKEVLK

SEQ ID NO: 193288 - protein, 14 aa, Borrelia garinii
KNDGSGKAKEVLKG

SEQ ID NO: 193289 - protein, 14 aa, Borrelia garinii
NDGSGKAKEVLKGF

SEQ ID NO: 193290 - protein, 14 aa, Borrelia garinii
DGSGKAKEVLKGFA

SEQ ID NO: 193291 - protein, 14 aa, Borrelia garinii
GSGKAKEVLKGFAL

SEQ ID NO: 193292 - protein, 14 aa, Borrelia garinii
SGKAKEVLKGFALE

SEQ ID NO: 193293 - protein, 14 aa, Borrelia garinii
GKAKEVLKGFALEG

SEQ ID NO: 193294 - protein, 14 aa, Borrelia garinii
KAKEVLKGFALEGT

SEQ ID NO: 193295 - protein, 14 aa, Borrelia garinii
AKEVLKGFALEGTL

SEQ ID NO: 193296 - protein, 14 aa, Borrelia garinii
KEVLKGFALEGTLT

SEQ ID NO: 193297 - protein, 14 aa, Borrelia garinii
EVLKGFALEGTLTD

SEQ ID NO: 193298 - protein, 14 aa, Borrelia garinii
VLKGFALEGTLTDG

SEQ ID NO: 193299 - protein, 14 aa, Borrelia garinii
LKGFALEGTLTDGG

SEQ ID NO: 193300 - protein, 14 aa, Borrelia garinii
KGFALEGTLTDGGE

SEQ ID NO: 193301 - protein, 14 aa, Borrelia garinii
GFALEGTLTDGGET

SEQ ID NO: 193302 - protein, 14 aa, Borrelia garinii
FALEGTLTDGGETK

SEQ ID NO: 193303 - protein, 14 aa, Borrelia garinii
ALEGTLTDGGETKL

SEQ ID NO: 193304 - protein, 14 aa, Borrelia garinii
LEGTLTDGGETKLT

SEQ ID NO: 193305 - protein, 14 aa, Borrelia garinii
EGTLTDGGETKLTV

SEQ ID NO: 193306 - protein, 14 aa, Borrelia garinii
GTLTDGGETKLTVT

SEQ ID NO: 193307 - protein, 14 aa, Borrelia garinii
TLTDGGETKLTVTE

SEQ ID NO: 193308 - protein, 14 aa, Borrelia garinii
LTDGGETKLTVTEG

SEQ ID NO: 193309 - protein, 14 aa, Borrelia garinii
TDGGETKLTVTEGT

SEQ ID NO: 193310 - protein, 14 aa, Borrelia garinii
DGGETKLTVTEGTV

SEQ ID NO: 193311 - protein, 14 aa, Borrelia garinii
GGETKLTVTEGTVT

SEQ ID NO: 193312 - protein, 14 aa, Borrelia garinii
GETKLTVTEGTVTL

SEQ ID NO: 193313 - protein, 14 aa, Borrelia garinii
ETKLTVTEGTVTLS

SEQ ID NO: 193314 - protein, 14 aa, Borrelia garinii
TKLTVTEGTVTLSK

SEQ ID NO: 193315 - protein, 14 aa, Borrelia garinii
KLTVTEGTVTLSKN

SEQ ID NO: 193316 - protein, 14 aa, Borrelia garinii
LTVTEGTVTLSKNI

SEQ ID NO: 193317 - protein, 14 aa, Borrelia garinii
TVTEGTVTLSKNIS

SEQ ID NO: 193318 - protein, 14 aa, Borrelia garinii
VTEGTVTLSKNISK

SEQ ID NO: 193319 - protein, 14 aa, Borrelia garinii
TEGTVTLSKNISKS

SEQ ID NO: 193320 - protein, 14 aa, Borrelia garinii
EGTVTLSKNISKSG

SEQ ID NO: 193321 - protein, 14 aa, Borrelia garinii
GTVTLSKNISKSGE

SEQ ID NO: 193322 - protein, 14 aa, Borrelia garinii
TVTLSKNISKSGEI

SEQ ID NO: 193323 - protein, 14 aa, Borrelia garinii
VTLSKNISKSGEIT

SEQ ID NO: 193324 - protein, 14 aa, Borrelia garinii
TLSKNISKSGEITV

SEQ ID NO: 193325 - protein, 14 aa, Borrelia garinii
LSKNISKSGEITVA

SEQ ID NO: 193326 - protein, 14 aa, Borrelia garinii
SKNISKSGEITVAL

SEQ ID NO: 193327 - protein, 14 aa, Borrelia garinii
KNISKSGEITVALN

SEQ ID NO: 193328 - protein, 14 aa, Borrelia garinii
NISKSGEITVALND

SEQ ID NO: 193329 - protein, 14 aa, Borrelia garinii
ISKSGEITVALNDT

SEQ ID NO: 193330 - protein, 14 aa, Borrelia garinii
SKSGEITVALNDTE

SEQ ID NO: 193331 - protein, 14 aa, Borrelia garinii
KSGEITVALNDTET

SEQ ID NO: 193332 - protein, 14 aa, Borrelia garinii
SGEITVALNDTETT

SEQ ID NO: 193333 - protein, 14 aa, Borrelia garinii
GEITVALNDTETTP

SEQ ID NO: 193334 - protein, 14 aa, Borrelia garinii
EITVALNDTETTPA

SEQ ID NO: 193335 - protein, 14 aa, Borrelia garinii
ITVALNDTETTPAD

SEQ ID NO: 193336 - protein, 14 aa, Borrelia garinii
TVALNDTETTPADK

SEQ ID NO: 193337 - protein, 14 aa, Borrelia garinii
VALNDTETTPADKK

SEQ ID NO: 193338 - protein, 14 aa, Borrelia garinii
ALNDTETTPADKKT

SEQ ID NO: 193339 - protein, 14 aa, Borrelia garinii
LNDTETTPADKKTG

SEQ ID NO: 193340 - protein, 14 aa, Borrelia garinii
NDTETTPADKKTGE

SEQ ID NO: 193341 - protein, 14 aa, Borrelia garinii
DTETTPADKKTGEW

SEQ ID NO: 193342 - protein, 14 aa, Borrelia garinii
TETTPADKKTGEWK

SEQ ID NO: 193343 - protein, 14 aa, Borrelia garinii
ETTPADKKTGEWKS

SEQ ID NO: 193344 - protein, 14 aa, Borrelia garinii
TTPADKKTGEWKSD

SEQ ID NO: 193345 - protein, 14 aa, Borrelia garinii
TPADKKTGEWKSDT

SEQ ID NO: 193346 - protein, 14 aa, Borrelia garinii
PADKKTGEWKSDTS

SEQ ID NO: 193347 - protein, 14 aa, Borrelia garinii
ADKKTGEWKSDTST

SEQ ID NO: 193348 - protein, 14 aa, Borrelia garinii
DKKTGEWKSDTSTL

SEQ ID NO: 193349 - protein, 14 aa, Borrelia garinii
KKTGEWKSDTSTLT

SEQ ID NO: 193350 - protein, 14 aa, Borrelia garinii
KTGEWKSDTSTLTI

SEQ ID NO: 193351 - protein, 14 aa, Borrelia garinii
TGEWKSDTSTLTIS

SEQ ID NO: 193352 - protein, 14 aa, Borrelia garinii
GEWKSDTSTLTISK

SEQ ID NO: 193353 - protein, 14 aa, Borrelia garinii
EWKSDTSTLTISKN

SEQ ID NO: 193354 - protein, 14 aa, Borrelia garinii
WKSDTSTLTISKNS

SEQ ID NO: 193355 - protein, 14 aa, Borrelia garinii
KSDTSTLTISKNSQ

SEQ ID NO: 193356 - protein, 14 aa, Borrelia garinii
SDTSTLTISKNSQK

SEQ ID NO: 193357 - protein, 14 aa, Borrelia garinii
DTSTLTISKNSQKP

SEQ ID NO: 193358 - protein, 14 aa, Borrelia garinii
TSTLTISKNSQKPK

SEQ ID NO: 193359 - protein, 14 aa, Borrelia garinii
STLTISKNSQKPKQ

SEQ ID NO: 193360 - protein, 14 aa, Borrelia garinii
TLTISKNSQKPKQL

SEQ ID NO: 193361 - protein, 14 aa, Borrelia garinii
LTISKNSQKPKQLV

SEQ ID NO: 193362 - protein, 14 aa, Borrelia garinii
TISKNSQKPKQLVF

SEQ ID NO: 193363 - protein, 14 aa, Borrelia garinii
ISKNSQKPKQLVFT

SEQ ID NO: 193364 - protein, 14 aa, Borrelia garinii
SKNSQKPKQLVFTK

SEQ ID NO: 193365 - protein, 14 aa, Borrelia garinii
KNSQKPKQLVFTKE

SEQ ID NO: 193366 - protein, 14 aa, Borrelia garinii
NSQKPKQLVFTKEN

SEQ ID NO: 193367 - protein, 14 aa, Borrelia garinii
SQKPKQLVFTKENT

SEQ ID NO: 193368 - protein, 14 aa, Borrelia garinii
QKPKQLVFTKENTI

SEQ ID NO: 193369 - protein, 14 aa, Borrelia garinii
KPKQLVFTKENTIT

SEQ ID NO: 193370 - protein, 14 aa, Borrelia garinii
PKQLVFTKENTITV

SEQ ID NO: 193371 - protein, 14 aa, Borrelia garinii
KQLVFTKENTITVQ

SEQ ID NO: 193372 - protein, 14 aa, Borrelia garinii
QLVFTKENTITVQN

SEQ ID NO: 193373 - protein, 14 aa, Borrelia garinii
LVFTKENTITVQNY

SEQ ID NO: 193374 - protein, 14 aa, Borrelia garinii
VFTKENTITVQNYN

SEQ ID NO: 193375 - protein, 14 aa, Borrelia garinii
FTKENTITVQNYNR

SEQ ID NO: 193376 - protein, 14 aa, Borrelia garinii
TKENTITVQNYNRA

SEQ ID NO: 193377 - protein, 14 aa, Borrelia garinii
KENTITVQNYNRAG

SEQ ID NO: 193378 - protein, 14 aa, Borrelia garinii
ENTITVQNYNRAGN

SEQ ID NO: 193379 - protein, 14 aa, Borrelia garinii
NTITVQNYNRAGNA

SEQ ID NO: 193380 - protein, 14 aa, Borrelia garinii
TITVQNYNRAGNAL

SEQ ID NO: 193381 - protein, 14 aa, Borrelia garinii
ITVQNYNRAGNALE

SEQ ID NO: 193382 - protein, 14 aa, Borrelia garinii
TVQNYNRAGNALEG

SEQ ID NO: 193383 - protein, 14 aa, Borrelia garinii
VQNYNRAGNALEGS

SEQ ID NO: 193384 - protein, 14 aa, Borrelia garinii
QNYNRAGNALEGSP

SEQ ID NO: 193385 - protein, 14 aa, Borrelia garinii
NYNRAGNALEGSPA

SEQ ID NO: 193386 - protein, 14 aa, Borrelia garinii
YNRAGNALEGSPAE

SEQ ID NO: 193387 - protein, 14 aa, Borrelia garinii
NRAGNALEGSPAEI

SEQ ID NO: 193388 - protein, 14 aa, Borrelia garinii
RAGNALEGSPAEIK

SEQ ID NO: 193389 - protein, 14 aa, Borrelia garinii
AGNALEGSPAEIKD

SEQ ID NO: 193390 - protein, 14 aa, Borrelia garinii
GNALEGSPAEIKDL

SEQ ID NO: 193391 - protein, 14 aa, Borrelia garinii
NALEGSPAEIKDLA

SEQ ID NO: 193392 - protein, 14 aa, Borrelia garinii
ALEGSPAEIKDLAE

SEQ ID NO: 193393 - protein, 14 aa, Borrelia garinii
LEGSPAEIKDLAEL

SEQ ID NO: 193394 - protein, 14 aa, Borrelia garinii
EGSPAEIKDLAELK

SEQ ID NO: 193395 - protein, 14 aa, Borrelia garinii
GSPAEIKDLAELKA

SEQ ID NO: 193396 - protein, 14 aa, Borrelia garinii
SPAEIKDLAELKAA

SEQ ID NO: 193397 - protein, 14 aa, Borrelia garinii
PAEIKDLAELKAAL

SEQ ID NO: 193398 - protein, 14 aa, Borrelia garinii
AEIKDLAELKAALK

SEQ ID NO: 193399 - protein, 15 aa, Borrelia garinii
MKKYLLGIGLILALI

SEQ ID NO: 193400 - protein, 15 aa, Borrelia garinii
KKYLLGIGLILALIA

SEQ ID NO: 193401 - protein, 15 aa, Borrelia garinii
KYLLGIGLILALIAC

SEQ ID NO: 193402 - protein, 15 aa, Borrelia garinii
YLLGIGLILALIACK

SEQ ID NO: 193403 - protein, 15 aa, Borrelia garinii
LLGIGLILALIACKQ

SEQ ID NO: 193404 - protein, 15 aa, Borrelia garinii
LGIGLILALIACKQN

SEQ ID NO: 193405 - protein, 15 aa, Borrelia garinii
GIGLILALIACKQNV

SEQ ID NO: 193406 - protein, 15 aa, Borrelia garinii
IGLILALIACKQNVS

SEQ ID NO: 193407 - protein, 15 aa, Borrelia garinii
GLILALIACKQNVSS

SEQ ID NO: 193408 - protein, 15 aa, Borrelia garinii
LILALIACKQNVSSL

SEQ ID NO: 193409 - protein, 15 aa, Borrelia garinii
ILALIACKQNVSSLD

SEQ ID NO: 193410 - protein, 15 aa, Borrelia garinii
LALIACKQNVSSLDE

SEQ ID NO: 193411 - protein, 15 aa, Borrelia garinii
ALIACKQNVSSLDEK

SEQ ID NO: 193412 - protein, 15 aa, Borrelia garinii
LIACKQNVSSLDEKN

SEQ ID NO: 193413 - protein, 15 aa, Borrelia garinii
IACKQNVSSLDEKNS

SEQ ID NO: 193414 - protein, 15 aa, Borrelia garinii
ACKQNVSSLDEKNSV

SEQ ID NO: 193415 - protein, 15 aa, Borrelia garinii
CKQNVSSLDEKNSVS

SEQ ID NO: 193416 - protein, 15 aa, Borrelia garinii
KQNVSSLDEKNSVSV

SEQ ID NO: 193417 - protein, 15 aa, Borrelia garinii
QNVSSLDEKNSVSVD

SEQ ID NO: 193418 - protein, 15 aa, Borrelia garinii
NVSSLDEKNSVSVDL

SEQ ID NO: 193419 - protein, 15 aa, Borrelia garinii
VSSLDEKNSVSVDLP

SEQ ID NO: 193420 - protein, 15 aa, Borrelia garinii
SSLDEKNSVSVDLPG

SEQ ID NO: 193421 - protein, 15 aa, Borrelia garinii
SLDEKNSVSVDLPGG

SEQ ID NO: 193422 - protein, 15 aa, Borrelia garinii
LDEKNSVSVDLPGGM

SEQ ID NO: 193423 - protein, 15 aa, Borrelia garinii
DEKNSVSVDLPGGMK

SEQ ID NO: 193424 - protein, 15 aa, Borrelia garinii
EKNSVSVDLPGGMKV

SEQ ID NO: 193425 - protein, 15 aa, Borrelia garinii
KNSVSVDLPGGMKVL

SEQ ID NO: 193426 - protein, 15 aa, Borrelia garinii
NSVSVDLPGGMKVLV

SEQ ID NO: 193427 - protein, 15 aa, Borrelia garinii
SVSVDLPGGMKVLVS

SEQ ID NO: 193428 - protein, 15 aa, Borrelia garinii
VSVDLPGGMKVLVSK

SEQ ID NO: 193429 - protein, 15 aa, Borrelia garinii
SVDLPGGMKVLVSKE

SEQ ID NO: 193430 - protein, 15 aa, Borrelia garinii
VDLPGGMKVLVSKEK

SEQ ID NO: 193431 - protein, 15 aa, Borrelia garinii
DLPGGMKVLVSKEKD

SEQ ID NO: 193432 - protein, 15 aa, Borrelia garinii
LPGGMKVLVSKEKDK

SEQ ID NO: 193433 - protein, 15 aa, Borrelia garinii
PGGMKVLVSKEKDKD

SEQ ID NO: 193434 - protein, 15 aa, Borrelia garinii
GGMKVLVSKEKDKDG

SEQ ID NO: 193435 - protein, 15 aa, Borrelia garinii
GMKVLVSKEKDKDGK

SEQ ID NO: 193436 - protein, 15 aa, Borrelia garinii
MKVLVSKEKDKDGKY

SEQ ID NO: 193437 - protein, 15 aa, Borrelia garinii
KVLVSKEKDKDGKYS

SEQ ID NO: 193438 - protein, 15 aa, Borrelia garinii
VLVSKEKDKDGKYSL

SEQ ID NO: 193439 - protein, 15 aa, Borrelia garinii
LVSKEKDKDGKYSLM

SEQ ID NO: 193440 - protein, 15 aa, Borrelia garinii
VSKEKDKDGKYSLMA

SEQ ID NO: 193441 - protein, 15 aa, Borrelia garinii
SKEKDKDGKYSLMAT

SEQ ID NO: 193442 - protein, 15 aa, Borrelia garinii
KEKDKDGKYSLMATV

SEQ ID NO: 193443 - protein, 15 aa, Borrelia garinii
EKDKDGKYSLMATVE

SEQ ID NO: 193444 - protein, 15 aa, Borrelia garinii
KDKDGKYSLMATVEK

SEQ ID NO: 193445 - protein, 15 aa, Borrelia garinii
DKDGKYSLMATVEKL

SEQ ID NO: 193446 - protein, 15 aa, Borrelia garinii
KDGKYSLMATVEKLE

SEQ ID NO: 193447 - protein, 15 aa, Borrelia garinii
DGKYSLMATVEKLEL

SEQ ID NO: 193448 - protein, 15 aa, Borrelia garinii
GKYSLMATVEKLELK

SEQ ID NO: 193449 - protein, 15 aa, Borrelia garinii
KYSLMATVEKLELKG

SEQ ID NO: 193450 - protein, 15 aa, Borrelia garinii
YSLMATVEKLELKGT

SEQ ID NO: 193451 - protein, 15 aa, Borrelia garinii
SLMATVEKLELKGTS

SEQ ID NO: 193452 - protein, 15 aa, Borrelia garinii
LMATVEKLELKGTSD

SEQ ID NO: 193453 - protein, 15 aa, Borrelia garinii
MATVEKLELKGTSDK

SEQ ID NO: 193454 - protein, 15 aa, Borrelia garinii
ATVEKLELKGTSDKS

SEQ ID NO: 193455 - protein, 15 aa, Borrelia garinii
TVEKLELKGTSDKSN

SEQ ID NO: 193456 - protein, 15 aa, Borrelia garinii
VEKLELKGTSDKSNG

SEQ ID NO: 193457 - protein, 15 aa, Borrelia garinii
EKLELKGTSDKSNGS

SEQ ID NO: 193458 - protein, 15 aa, Borrelia garinii
KLELKGTSDKSNGSG

SEQ ID NO: 193459 - protein, 15 aa, Borrelia garinii
LELKGTSDKSNGSGV

SEQ ID NO: 193460 - protein, 15 aa, Borrelia garinii
ELKGTSDKSNGSGVL

SEQ ID NO: 193461 - protein, 15 aa, Borrelia garinii
LKGTSDKSNGSGVLE

SEQ ID NO: 193462 - protein, 15 aa, Borrelia garinii
KGTSDKSNGSGVLEG

SEQ ID NO: 193463 - protein, 15 aa, Borrelia garinii
GTSDKSNGSGVLEGE

SEQ ID NO: 193464 - protein, 15 aa, Borrelia garinii
TSDKSNGSGVLEGEK

SEQ ID NO: 193465 - protein, 15 aa, Borrelia garinii
SDKSNGSGVLEGEKA

SEQ ID NO: 193466 - protein, 15 aa, Borrelia garinii
DKSNGSGVLEGEKAD

SEQ ID NO: 193467 - protein, 15 aa, Borrelia garinii
KSNGSGVLEGEKADK

SEQ ID NO: 193468 - protein, 15 aa, Borrelia garinii
SNGSGVLEGEKADKS

SEQ ID NO: 193469 - protein, 15 aa, Borrelia garinii
NGSGVLEGEKADKSK

SEQ ID NO: 193470 - protein, 15 aa, Borrelia garinii
GSGVLEGEKADKSKA

SEQ ID NO: 193471 - protein, 15 aa, Borrelia garinii
SGVLEGEKADKSKAK

SEQ ID NO: 193472 - protein, 15 aa, Borrelia garinii
GVLEGEKADKSKAKL

SEQ ID NO: 193473 - protein, 15 aa, Borrelia garinii
VLEGEKADKSKAKLT

SEQ ID NO: 193474 - protein, 15 aa, Borrelia garinii
LEGEKADKSKAKLTI

SEQ ID NO: 193475 - protein, 15 aa, Borrelia garinii
EGEKADKSKAKLTIS

SEQ ID NO: 193476 - protein, 15 aa, Borrelia garinii
GEKADKSKAKLTISQ

SEQ ID NO: 193477 - protein, 15 aa, Borrelia garinii
EKADKSKAKLTISQD

SEQ ID NO: 193478 - protein, 15 aa, Borrelia garinii
KADKSKAKLTISQDL

SEQ ID NO: 193479 - protein, 15 aa, Borrelia garinii
ADKSKAKLTISQDLN

SEQ ID NO: 193480 - protein, 15 aa, Borrelia garinii
DKSKAKLTISQDLNQ

SEQ ID NO: 193481 - protein, 15 aa, Borrelia garinii
KSKAKLTISQDLNQT

SEQ ID NO: 193482 - protein, 15 aa, Borrelia garinii
SKAKLTISQDLNQTT

SEQ ID NO: 193483 - protein, 15 aa, Borrelia garinii
KAKLTISQDLNQTTF

SEQ ID NO: 193484 - protein, 15 aa, Borrelia garinii
AKLTISQDLNQTTFE

SEQ ID NO: 193485 - protein, 15 aa, Borrelia garinii
KLTISQDLNQTTFEI

SEQ ID NO: 193486 - protein, 15 aa, Borrelia garinii
LTISQDLNQTTFEIF

SEQ ID NO: 193487 - protein, 15 aa, Borrelia garinii
TISQDLNQTTFEIFK

SEQ ID NO: 193488 - protein, 15 aa, Borrelia garinii
ISQDLNQTTFEIFKE

SEQ ID NO: 193489 - protein, 15 aa, Borrelia garinii
SQDLNQTTFEIFKED

SEQ ID NO: 193490 - protein, 15 aa, Borrelia garinii
QDLNQTTFEIFKEDG

SEQ ID NO: 193491 - protein, 15 aa, Borrelia garinii
DLNQTTFEIFKEDGK

SEQ ID NO: 193492 - protein, 15 aa, Borrelia garinii
LNQTTFEIFKEDGKT

SEQ ID NO: 193493 - protein, 15 aa, Borrelia garinii
NQTTFEIFKEDGKTL

SEQ ID NO: 193494 - protein, 15 aa, Borrelia garinii
QTTFEIFKEDGKTLV

SEQ ID NO: 193495 - protein, 15 aa, Borrelia garinii
TTFEIFKEDGKTLVS

SEQ ID NO: 193496 - protein, 15 aa, Borrelia garinii
TFEIFKEDGKTLVSR

SEQ ID NO: 193497 - protein, 15 aa, Borrelia garinii
FEIFKEDGKTLVSRK

SEQ ID NO: 193498 - protein, 15 aa, Borrelia garinii
EIFKEDGKTLVSRKV

SEQ ID NO: 193499 - protein, 15 aa, Borrelia garinii
IFKEDGKTLVSRKVN

SEQ ID NO: 193500 - protein, 15 aa, Borrelia garinii
FKEDGKTLVSRKVNS

SEQ ID NO: 193501 - protein, 15 aa, Borrelia garinii
KEDGKTLVSRKVNSK

SEQ ID NO: 193502 - protein, 15 aa, Borrelia garinii
EDGKTLVSRKVNSKD

SEQ ID NO: 193503 - protein, 15 aa, Borrelia garinii
DGKTLVSRKVNSKDK

SEQ ID NO: 193504 - protein, 15 aa, Borrelia garinii
GKTLVSRKVNSKDKS

SEQ ID NO: 193505 - protein, 15 aa, Borrelia garinii
KTLVSRKVNSKDKSS

SEQ ID NO: 193506 - protein, 15 aa, Borrelia garinii
TLVSRKVNSKDKSST

SEQ ID NO: 193507 - protein, 15 aa, Borrelia garinii
LVSRKVNSKDKSSTE

SEQ ID NO: 193508 - protein, 15 aa, Borrelia garinii
VSRKVNSKDKSSTEE

SEQ ID NO: 193509 - protein, 15 aa, Borrelia garinii
SRKVNSKDKSSTEEK

SEQ ID NO: 193510 - protein, 15 aa, Borrelia garinii
RKVNSKDKSSTEEKF

SEQ ID NO: 193511 - protein, 15 aa, Borrelia garinii
KVNSKDKSSTEEKFN

SEQ ID NO: 193512 - protein, 15 aa, Borrelia garinii
VNSKDKSSTEEKFND

SEQ ID NO: 193513 - protein, 15 aa, Borrelia garinii
NSKDKSSTEEKFNDK

SEQ ID NO: 193514 - protein, 15 aa, Borrelia garinii
SKDKSSTEEKFNDKG

SEQ ID NO: 193515 - protein, 15 aa, Borrelia garinii
KDKSSTEEKFNDKGK

SEQ ID NO: 193516 - protein, 15 aa, Borrelia garinii
DKSSTEEKFNDKGKL

SEQ ID NO: 193517 - protein, 15 aa, Borrelia garinii
KSSTEEKFNDKGKLS

SEQ ID NO: 193518 - protein, 15 aa, Borrelia garinii
SSTEEKFNDKGKLSE

SEQ ID NO: 193519 - protein, 15 aa, Borrelia garinii
STEEKFNDKGKLSEK

SEQ ID NO: 193520 - protein, 15 aa, Borrelia garinii
TEEKFNDKGKLSEKV

SEQ ID NO: 193521 - protein, 15 aa, Borrelia garinii
EEKFNDKGKLSEKVV

SEQ ID NO: 193522 - protein, 15 aa, Borrelia garinii
EKFNDKGKLSEKVVT

SEQ ID NO: 193523 - protein, 15 aa, Borrelia garinii
KFNDKGKLSEKVVTR

SEQ ID NO: 193524 - protein, 15 aa, Borrelia garinii
FNDKGKLSEKVVTRA

SEQ ID NO: 193525 - protein, 15 aa, Borrelia garinii
NDKGKLSEKVVTRAN

SEQ ID NO: 193526 - protein, 15 aa, Borrelia garinii
DKGKLSEKVVTRANG

SEQ ID NO: 193527 - protein, 15 aa, Borrelia garinii
KGKLSEKVVTRANGT

SEQ ID NO: 193528 - protein, 15 aa, Borrelia garinii
GKLSEKVVTRANGTR

SEQ ID NO: 193529 - protein, 15 aa, Borrelia garinii
KLSEKVVTRANGTRL

SEQ ID NO: 193530 - protein, 15 aa, Borrelia garinii
LSEKVVTRANGTRLE

SEQ ID NO: 193531 - protein, 15 aa, Borrelia garinii
SEKVVTRANGTRLEY

SEQ ID NO: 193532 - protein, 15 aa, Borrelia garinii
EKVVTRANGTRLEYT

SEQ ID NO: 193533 - protein, 15 aa, Borrelia garinii
KVVTRANGTRLEYTE

SEQ ID NO: 193534 - protein, 15 aa, Borrelia garinii
VVTRANGTRLEYTEI

SEQ ID NO: 193535 - protein, 15 aa, Borrelia garinii
VTRANGTRLEYTEIK

SEQ ID NO: 193536 - protein, 15 aa, Borrelia garinii
TRANGTRLEYTEIKN

SEQ ID NO: 193537 - protein, 15 aa, Borrelia garinii
RANGTRLEYTEIKND

SEQ ID NO: 193538 - protein, 15 aa, Borrelia garinii
ANGTRLEYTEIKNDG

SEQ ID NO: 193539 - protein, 15 aa, Borrelia garinii
NGTRLEYTEIKNDGS

SEQ ID NO: 193540 - protein, 15 aa, Borrelia garinii
GTRLEYTEIKNDGSG

SEQ ID NO: 193541 - protein, 15 aa, Borrelia garinii
TRLEYTEIKNDGSGK

SEQ ID NO: 193542 - protein, 15 aa, Borrelia garinii
RLEYTEIKNDGSGKA

SEQ ID NO: 193543 - protein, 15 aa, Borrelia garinii
LEYTEIKNDGSGKAK

SEQ ID NO: 193544 - protein, 15 aa, Borrelia garinii
EYTEIKNDGSGKAKE

SEQ ID NO: 193545 - protein, 15 aa, Borrelia garinii
YTEIKNDGSGKAKEV

SEQ ID NO: 193546 - protein, 15 aa, Borrelia garinii
TEIKNDGSGKAKEVL

SEQ ID NO: 193547 - protein, 15 aa, Borrelia garinii
EIKNDGSGKAKEVLK

SEQ ID NO: 193548 - protein, 15 aa, Borrelia garinii
IKNDGSGKAKEVLKG

SEQ ID NO: 193549 - protein, 15 aa, Borrelia garinii
KNDGSGKAKEVLKGF

SEQ ID NO: 193550 - protein, 15 aa, Borrelia garinii
NDGSGKAKEVLKGFA

SEQ ID NO: 193551 - protein, 15 aa, Borrelia garinii
DGSGKAKEVLKGFAL

SEQ ID NO: 193552 - protein, 15 aa, Borrelia garinii
GSGKAKEVLKGFALE

SEQ ID NO: 193553 - protein, 15 aa, Borrelia garinii
SGKAKEVLKGFALEG

SEQ ID NO: 193554 - protein, 15 aa, Borrelia garinii
GKAKEVLKGFALEGT

SEQ ID NO: 193555 - protein, 15 aa, Borrelia garinii
KAKEVLKGFALEGTL

SEQ ID NO: 193556 - protein, 15 aa, Borrelia garinii
AKEVLKGFALEGTLT

SEQ ID NO: 193557 - protein, 15 aa, Borrelia garinii
KEVLKGFALEGTLTD

SEQ ID NO: 193558 - protein, 15 aa, Borrelia garinii
EVLKGFALEGTLTDG

SEQ ID NO: 193559 - protein, 15 aa, Borrelia garinii
VLKGFALEGTLTDGG

SEQ ID NO: 193560 - protein, 15 aa, Borrelia garinii
LKGFALEGTLTDGGE

SEQ ID NO: 193561 - protein, 15 aa, Borrelia garinii
KGFALEGTLTDGGET

SEQ ID NO: 193562 - protein, 15 aa, Borrelia garinii
GFALEGTLTDGGETK

SEQ ID NO: 193563 - protein, 15 aa, Borrelia garinii
FALEGTLTDGGETKL

SEQ ID NO: 193564 - protein, 15 aa, Borrelia garinii
ALEGTLTDGGETKLT

SEQ ID NO: 193565 - protein, 15 aa, Borrelia garinii
LEGTLTDGGETKLTV

SEQ ID NO: 193566 - protein, 15 aa, Borrelia garinii
EGTLTDGGETKLTVT

SEQ ID NO: 193567 - protein, 15 aa, Borrelia garinii
GTLTDGGETKLTVTE

SEQ ID NO: 193568 - protein, 15 aa, Borrelia garinii
TLTDGGETKLTVTEG

SEQ ID NO: 193569 - protein, 15 aa, Borrelia garinii
LTDGGETKLTVTEGT

SEQ ID NO: 193570 - protein, 15 aa, Borrelia garinii
TDGGETKLTVTEGTV

SEQ ID NO: 193571 - protein, 15 aa, Borrelia garinii
DGGETKLTVTEGTVT

SEQ ID NO: 193572 - protein, 15 aa, Borrelia garinii
GGETKLTVTEGTVTL

SEQ ID NO: 193573 - protein, 15 aa, Borrelia garinii
GETKLTVTEGTVTLS

SEQ ID NO: 193574 - protein, 15 aa, Borrelia garinii
ETKLTVTEGTVTLSK

SEQ ID NO: 193575 - protein, 15 aa, Borrelia garinii
TKLTVTEGTVTLSKN

SEQ ID NO: 193576 - protein, 15 aa, Borrelia garinii
KLTVTEGTVTLSKNI

SEQ ID NO: 193577 - protein, 15 aa, Borrelia garinii
LTVTEGTVTLSKNIS

SEQ ID NO: 193578 - protein, 15 aa, Borrelia garinii
TVTEGTVTLSKNISK

SEQ ID NO: 193579 - protein, 15 aa, Borrelia garinii
VTEGTVTLSKNISKS

SEQ ID NO: 193580 - protein, 15 aa, Borrelia garinii
TEGTVTLSKNISKSG

SEQ ID NO: 193581 - protein, 15 aa, Borrelia garinii
EGTVTLSKNISKSGE

SEQ ID NO: 193582 - protein, 15 aa, Borrelia garinii
GTVTLSKNISKSGEI

SEQ ID NO: 193583 - protein, 15 aa, Borrelia garinii
TVTLSKNISKSGEIT

SEQ ID NO: 193584 - protein, 15 aa, Borrelia garinii
VTLSKNISKSGEITV

SEQ ID NO: 193585 - protein, 15 aa, Borrelia garinii
TLSKNISKSGEITVA

SEQ ID NO: 193586 - protein, 15 aa, Borrelia garinii
LSKNISKSGEITVAL

SEQ ID NO: 193587 - protein, 15 aa, Borrelia garinii
SKNISKSGEITVALN

SEQ ID NO: 193588 - protein, 15 aa, Borrelia garinii
KNISKSGEITVALND

SEQ ID NO: 193589 - protein, 15 aa, Borrelia garinii
NISKSGEITVALNDT

SEQ ID NO: 193590 - protein, 15 aa, Borrelia garinii
ISKSGEITVALNDTE

SEQ ID NO: 193591 - protein, 15 aa, Borrelia garinii
SKSGEITVALNDTET

SEQ ID NO: 193592 - protein, 15 aa, Borrelia garinii
KSGEITVALNDTETT

SEQ ID NO: 193593 - protein, 15 aa, Borrelia garinii
SGEITVALNDTETTP

SEQ ID NO: 193594 - protein, 15 aa, Borrelia garinii
GEITVALNDTETTPA

SEQ ID NO: 193595 - protein, 15 aa, Borrelia garinii
EITVALNDTETTPAD

SEQ ID NO: 193596 - protein, 15 aa, Borrelia garinii
ITVALNDTETTPADK

SEQ ID NO: 193597 - protein, 15 aa, Borrelia garinii
TVALNDTETTPADKK

SEQ ID NO: 193598 - protein, 15 aa, Borrelia garinii
VALNDTETTPADKKT

SEQ ID NO: 193599 - protein, 15 aa, Borrelia garinii
ALNDTETTPADKKTG

SEQ ID NO: 193600 - protein, 15 aa, Borrelia garinii
LNDTETTPADKKTGE

SEQ ID NO: 193601 - protein, 15 aa, Borrelia garinii
NDTETTPADKKTGEW

SEQ ID NO: 193602 - protein, 15 aa, Borrelia garinii
DTETTPADKKTGEWK

SEQ ID NO: 193603 - protein, 15 aa, Borrelia garinii
TETTPADKKTGEWKS

SEQ ID NO: 193604 - protein, 15 aa, Borrelia garinii
ETTPADKKTGEWKSD

SEQ ID NO: 193605 - protein, 15 aa, Borrelia garinii
TTPADKKTGEWKSDT

SEQ ID NO: 193606 - protein, 15 aa, Borrelia garinii
TPADKKTGEWKSDTS

SEQ ID NO: 193607 - protein, 15 aa, Borrelia garinii
PADKKTGEWKSDTST

SEQ ID NO: 193608 - protein, 15 aa, Borrelia garinii
ADKKTGEWKSDTSTL

SEQ ID NO: 193609 - protein, 15 aa, Borrelia garinii
DKKTGEWKSDTSTLT

SEQ ID NO: 193610 - protein, 15 aa, Borrelia garinii
KKTGEWKSDTSTLTI

SEQ ID NO: 193611 - protein, 15 aa, Borrelia garinii
KTGEWKSDTSTLTIS

SEQ ID NO: 193612 - protein, 15 aa, Borrelia garinii
TGEWKSDTSTLTISK

SEQ ID NO: 193613 - protein, 15 aa, Borrelia garinii
GEWKSDTSTLTISKN

SEQ ID NO: 193614 - protein, 15 aa, Borrelia garinii
EWKSDTSTLTISKNS

SEQ ID NO: 193615 - protein, 15 aa, Borrelia garinii
WKSDTSTLTISKNSQ

SEQ ID NO: 193616 - protein, 15 aa, Borrelia garinii
KSDTSTLTISKNSQK

SEQ ID NO: 193617 - protein, 15 aa, Borrelia garinii
SDTSTLTISKNSQKP

SEQ ID NO: 193618 - protein, 15 aa, Borrelia garinii
DTSTLTISKNSQKPK

SEQ ID NO: 193619 - protein, 15 aa, Borrelia garinii
TSTLTISKNSQKPKQ

SEQ ID NO: 193620 - protein, 15 aa, Borrelia garinii
STLTISKNSQKPKQL

SEQ ID NO: 193621 - protein, 15 aa, Borrelia garinii
TLTISKNSQKPKQLV

SEQ ID NO: 193622 - protein, 15 aa, Borrelia garinii
LTISKNSQKPKQLVF

SEQ ID NO: 193623 - protein, 15 aa, Borrelia garinii
TISKNSQKPKQLVFT

SEQ ID NO: 193624 - protein, 15 aa, Borrelia garinii
ISKNSQKPKQLVFTK

SEQ ID NO: 193625 - protein, 15 aa, Borrelia garinii
SKNSQKPKQLVFTKE

SEQ ID NO: 193626 - protein, 15 aa, Borrelia garinii
KNSQKPKQLVFTKEN

SEQ ID NO: 193627 - protein, 15 aa, Borrelia garinii
NSQKPKQLVFTKENT

SEQ ID NO: 193628 - protein, 15 aa, Borrelia garinii
SQKPKQLVFTKENTI

SEQ ID NO: 193629 - protein, 15 aa, Borrelia garinii
QKPKQLVFTKENTIT

SEQ ID NO: 193630 - protein, 15 aa, Borrelia garinii
KPKQLVFTKENTITV

SEQ ID NO: 193631 - protein, 15 aa, Borrelia garinii
PKQLVFTKENTITVQ

SEQ ID NO: 193632 - protein, 15 aa, Borrelia garinii
KQLVFTKENTITVQN

SEQ ID NO: 193633 - protein, 15 aa, Borrelia garinii
QLVFTKENTITVQNY

SEQ ID NO: 193634 - protein, 15 aa, Borrelia garinii
LVFTKENTITVQNYN

SEQ ID NO: 193635 - protein, 15 aa, Borrelia garinii
VFTKENTITVQNYNR

SEQ ID NO: 193636 - protein, 15 aa, Borrelia garinii
FTKENTITVQNYNRA

SEQ ID NO: 193637 - protein, 15 aa, Borrelia garinii
TKENTITVQNYNRAG

SEQ ID NO: 193638 - protein, 15 aa, Borrelia garinii
KENTITVQNYNRAGN

SEQ ID NO: 193639 - protein, 15 aa, Borrelia garinii
ENTITVQNYNRAGNA

SEQ ID NO: 193640 - protein, 15 aa, Borrelia garinii
NTITVQNYNRAGNAL

SEQ ID NO: 193641 - protein, 15 aa, Borrelia garinii
TITVQNYNRAGNALE

SEQ ID NO: 193642 - protein, 15 aa, Borrelia garinii
ITVQNYNRAGNALEG

SEQ ID NO: 193643 - protein, 15 aa, Borrelia garinii
TVQNYNRAGNALEGS

SEQ ID NO: 193644 - protein, 15 aa, Borrelia garinii
VQNYNRAGNALEGSP

SEQ ID NO: 193645 - protein, 15 aa, Borrelia garinii
QNYNRAGNALEGSPA

SEQ ID NO: 193646 - protein, 15 aa, Borrelia garinii
NYNRAGNALEGSPAE

SEQ ID NO: 193647 - protein, 15 aa, Borrelia garinii
YNRAGNALEGSPAEI

SEQ ID NO: 193648 - protein, 15 aa, Borrelia garinii
NRAGNALEGSPAEIK

SEQ ID NO: 193649 - protein, 15 aa, Borrelia garinii
RAGNALEGSPAEIKD

SEQ ID NO: 193650 - protein, 15 aa, Borrelia garinii
AGNALEGSPAEIKDL

SEQ ID NO: 193651 - protein, 15 aa, Borrelia garinii
GNALEGSPAEIKDLA

SEQ ID NO: 193652 - protein, 15 aa, Borrelia garinii
NALEGSPAEIKDLAE

SEQ ID NO: 193653 - protein, 15 aa, Borrelia garinii
ALEGSPAEIKDLAEL

SEQ ID NO: 193654 - protein, 15 aa, Borrelia garinii
LEGSPAEIKDLAELK

SEQ ID NO: 193655 - protein, 15 aa, Borrelia garinii
EGSPAEIKDLAELKA

SEQ ID NO: 193656 - protein, 15 aa, Borrelia garinii
GSPAEIKDLAELKAA

SEQ ID NO: 193657 - protein, 15 aa, Borrelia garinii
SPAEIKDLAELKAAL

SEQ ID NO: 193658 - protein, 15 aa, Borrelia garinii
PAEIKDLAELKAALK

SEQ ID NO: 193659 - protein, 16 aa, Borrelia garinii
MKKYLLGIGLILALIA

SEQ ID NO: 193660 - protein, 16 aa, Borrelia garinii
KKYLLGIGLILALIAC

SEQ ID NO: 193661 - protein, 16 aa, Borrelia garinii
KYLLGIGLILALIACK

SEQ ID NO: 193662 - protein, 16 aa, Borrelia garinii
YLLGIGLILALIACKQ

SEQ ID NO: 193663 - protein, 16 aa, Borrelia garinii
LLGIGLILALIACKQN

SEQ ID NO: 193664 - protein, 16 aa, Borrelia garinii
LGIGLILALIACKQNV

SEQ ID NO: 193665 - protein, 16 aa, Borrelia garinii
GIGLILALIACKQNVS

SEQ ID NO: 193666 - protein, 16 aa, Borrelia garinii
IGLILALIACKQNVSS

SEQ ID NO: 193667 - protein, 16 aa, Borrelia garinii
GLILALIACKQNVSSL

SEQ ID NO: 193668 - protein, 16 aa, Borrelia garinii
LILALIACKQNVSSLD

SEQ ID NO: 193669 - protein, 16 aa, Borrelia garinii
ILALIACKQNVSSLDE

SEQ ID NO: 193670 - protein, 16 aa, Borrelia garinii
LALIACKQNVSSLDEK

SEQ ID NO: 193671 - protein, 16 aa, Borrelia garinii
ALIACKQNVSSLDEKN

SEQ ID NO: 193672 - protein, 16 aa, Borrelia garinii
LIACKQNVSSLDEKNS

SEQ ID NO: 193673 - protein, 16 aa, Borrelia garinii
IACKQNVSSLDEKNSV

SEQ ID NO: 193674 - protein, 16 aa, Borrelia garinii
ACKQNVSSLDEKNSVS

SEQ ID NO: 193675 - protein, 16 aa, Borrelia garinii
CKQNVSSLDEKNSVSV

SEQ ID NO: 193676 - protein, 16 aa, Borrelia garinii
KQNVSSLDEKNSVSVD

SEQ ID NO: 193677 - protein, 16 aa, Borrelia garinii
QNVSSLDEKNSVSVDL

SEQ ID NO: 193678 - protein, 16 aa, Borrelia garinii
NVSSLDEKNSVSVDLP

SEQ ID NO: 193679 - protein, 16 aa, Borrelia garinii
VSSLDEKNSVSVDLPG

SEQ ID NO: 193680 - protein, 16 aa, Borrelia garinii
SSLDEKNSVSVDLPGG

SEQ ID NO: 193681 - protein, 16 aa, Borrelia garinii
SLDEKNSVSVDLPGGM

SEQ ID NO: 193682 - protein, 16 aa, Borrelia garinii
LDEKNSVSVDLPGGMK

SEQ ID NO: 193683 - protein, 16 aa, Borrelia garinii
DEKNSVSVDLPGGMKV

SEQ ID NO: 193684 - protein, 16 aa, Borrelia garinii
EKNSVSVDLPGGMKVL

SEQ ID NO: 193685 - protein, 16 aa, Borrelia garinii
KNSVSVDLPGGMKVLV

SEQ ID NO: 193686 - protein, 16 aa, Borrelia garinii
NSVSVDLPGGMKVLVS

SEQ ID NO: 193687 - protein, 16 aa, Borrelia garinii
SVSVDLPGGMKVLVSK

SEQ ID NO: 193688 - protein, 16 aa, Borrelia garinii
VSVDLPGGMKVLVSKE

SEQ ID NO: 193689 - protein, 16 aa, Borrelia garinii
SVDLPGGMKVLVSKEK

SEQ ID NO: 193690 - protein, 16 aa, Borrelia garinii
VDLPGGMKVLVSKEKD

SEQ ID NO: 193691 - protein, 16 aa, Borrelia garinii
DLPGGMKVLVSKEKDK

SEQ ID NO: 193692 - protein, 16 aa, Borrelia garinii
LPGGMKVLVSKEKDKD

SEQ ID NO: 193693 - protein, 16 aa, Borrelia garinii
PGGMKVLVSKEKDKDG

SEQ ID NO: 193694 - protein, 16 aa, Borrelia garinii
GGMKVLVSKEKDKDGK

SEQ ID NO: 193695 - protein, 16 aa, Borrelia garinii
GMKVLVSKEKDKDGKY

SEQ ID NO: 193696 - protein, 16 aa, Borrelia garinii
MKVLVSKEKDKDGKYS

SEQ ID NO: 193697 - protein, 16 aa, Borrelia garinii
KVLVSKEKDKDGKYSL

SEQ ID NO: 193698 - protein, 16 aa, Borrelia garinii
VLVSKEKDKDGKYSLM

SEQ ID NO: 193699 - protein, 16 aa, Borrelia garinii
LVSKEKDKDGKYSLMA

SEQ ID NO: 193700 - protein, 16 aa, Borrelia garinii
VSKEKDKDGKYSLMAT

SEQ ID NO: 193701 - protein, 16 aa, Borrelia garinii
SKEKDKDGKYSLMATV

SEQ ID NO: 193702 - protein, 16 aa, Borrelia garinii
KEKDKDGKYSLMATVE

SEQ ID NO: 193703 - protein, 16 aa, Borrelia garinii
EKDKDGKYSLMATVEK

SEQ ID NO: 193704 - protein, 16 aa, Borrelia garinii
KDKDGKYSLMATVEKL

SEQ ID NO: 193705 - protein, 16 aa, Borrelia garinii
DKDGKYSLMATVEKLE

SEQ ID NO: 193706 - protein, 16 aa, Borrelia garinii
KDGKYSLMATVEKLEL

SEQ ID NO: 193707 - protein, 16 aa, Borrelia garinii
DGKYSLMATVEKLELK

SEQ ID NO: 193708 - protein, 16 aa, Borrelia garinii
GKYSLMATVEKLELKG

SEQ ID NO: 193709 - protein, 16 aa, Borrelia garinii
KYSLMATVEKLELKGT

SEQ ID NO: 193710 - protein, 16 aa, Borrelia garinii
YSLMATVEKLELKGTS

SEQ ID NO: 193711 - protein, 16 aa, Borrelia garinii
SLMATVEKLELKGTSD

SEQ ID NO: 193712 - protein, 16 aa, Borrelia garinii
LMATVEKLELKGTSDK

SEQ ID NO: 193713 - protein, 16 aa, Borrelia garinii
MATVEKLELKGTSDKS

SEQ ID NO: 193714 - protein, 16 aa, Borrelia garinii
ATVEKLELKGTSDKSN

SEQ ID NO: 193715 - protein, 16 aa, Borrelia garinii
TVEKLELKGTSDKSNG

SEQ ID NO: 193716 - protein, 16 aa, Borrelia garinii
VEKLELKGTSDKSNGS

SEQ ID NO: 193717 - protein, 16 aa, Borrelia garinii
EKLELKGTSDKSNGSG

SEQ ID NO: 193718 - protein, 16 aa, Borrelia garinii
KLELKGTSDKSNGSGV

SEQ ID NO: 193719 - protein, 16 aa, Borrelia garinii
LELKGTSDKSNGSGVL

SEQ ID NO: 193720 - protein, 16 aa, Borrelia garinii
ELKGTSDKSNGSGVLE

SEQ ID NO: 193721 - protein, 16 aa, Borrelia garinii
LKGTSDKSNGSGVLEG

SEQ ID NO: 193722 - protein, 16 aa, Borrelia garinii
KGTSDKSNGSGVLEGE

SEQ ID NO: 193723 - protein, 16 aa, Borrelia garinii
GTSDKSNGSGVLEGEK

SEQ ID NO: 193724 - protein, 16 aa, Borrelia garinii
TSDKSNGSGVLEGEKA

SEQ ID NO: 193725 - protein, 16 aa, Borrelia garinii
SDKSNGSGVLEGEKAD

SEQ ID NO: 193726 - protein, 16 aa, Borrelia garinii
DKSNGSGVLEGEKADK

SEQ ID NO: 193727 - protein, 16 aa, Borrelia garinii
KSNGSGVLEGEKADKS

SEQ ID NO: 193728 - protein, 16 aa, Borrelia garinii
SNGSGVLEGEKADKSK

SEQ ID NO: 193729 - protein, 16 aa, Borrelia garinii
NGSGVLEGEKADKSKA

SEQ ID NO: 193730 - protein, 16 aa, Borrelia garinii
GSGVLEGEKADKSKAK

SEQ ID NO: 193731 - protein, 16 aa, Borrelia garinii
SGVLEGEKADKSKAKL

SEQ ID NO: 193732 - protein, 16 aa, Borrelia garinii
GVLEGEKADKSKAKLT

SEQ ID NO: 193733 - protein, 16 aa, Borrelia garinii
VLEGEKADKSKAKLTI

SEQ ID NO: 193734 - protein, 16 aa, Borrelia garinii
LEGEKADKSKAKLTIS

SEQ ID NO: 193735 - protein, 16 aa, Borrelia garinii
EGEKADKSKAKLTISQ

SEQ ID NO: 193736 - protein, 16 aa, Borrelia garinii
GEKADKSKAKLTISQD

SEQ ID NO: 193737 - protein, 16 aa, Borrelia garinii
EKADKSKAKLTISQDL

SEQ ID NO: 193738 - protein, 16 aa, Borrelia garinii
KADKSKAKLTISQDLN

SEQ ID NO: 193739 - protein, 16 aa, Borrelia garinii
ADKSKAKLTISQDLNQ

SEQ ID NO: 193740 - protein, 16 aa, Borrelia garinii
DKSKAKLTISQDLNQT

SEQ ID NO: 193741 - protein, 16 aa, Borrelia garinii
KSKAKLTISQDLNQTT

SEQ ID NO: 193742 - protein, 16 aa, Borrelia garinii
SKAKLTISQDLNQTTF

SEQ ID NO: 193743 - protein, 16 aa, Borrelia garinii
KAKLTISQDLNQTTFE

SEQ ID NO: 193744 - protein, 16 aa, Borrelia garinii
AKLTISQDLNQTTFEI

SEQ ID NO: 193745 - protein, 16 aa, Borrelia garinii
KLTISQDLNQTTFEIF

SEQ ID NO: 193746 - protein, 16 aa, Borrelia garinii
LTISQDLNQTTFEIFK

SEQ ID NO: 193747 - protein, 16 aa, Borrelia garinii
TISQDLNQTTFEIFKE

SEQ ID NO: 193748 - protein, 16 aa, Borrelia garinii
ISQDLNQTTFEIFKED

SEQ ID NO: 193749 - protein, 16 aa, Borrelia garinii
SQDLNQTTFEIFKEDG

SEQ ID NO: 193750 - protein, 16 aa, Borrelia garinii
QDLNQTTFEIFKEDGK

SEQ ID NO: 193751 - protein, 16 aa, Borrelia garinii
DLNQTTFEIFKEDGKT

SEQ ID NO: 193752 - protein, 16 aa, Borrelia garinii
LNQTTFEIFKEDGKTL

SEQ ID NO: 193753 - protein, 16 aa, Borrelia garinii
NQTTFEIFKEDGKTLV

SEQ ID NO: 193754 - protein, 16 aa, Borrelia garinii
QTTFEIFKEDGKTLVS

SEQ ID NO: 193755 - protein, 16 aa, Borrelia garinii
TTFEIFKEDGKTLVSR

SEQ ID NO: 193756 - protein, 16 aa, Borrelia garinii
TFEIFKEDGKTLVSRK

SEQ ID NO: 193757 - protein, 16 aa, Borrelia garinii
FEIFKEDGKTLVSRKV

SEQ ID NO: 193758 - protein, 16 aa, Borrelia garinii
EIFKEDGKTLVSRKVN

SEQ ID NO: 193759 - protein, 16 aa, Borrelia garinii
IFKEDGKTLVSRKVNS

SEQ ID NO: 193760 - protein, 16 aa, Borrelia garinii
FKEDGKTLVSRKVNSK

SEQ ID NO: 193761 - protein, 16 aa, Borrelia garinii
KEDGKTLVSRKVNSKD

SEQ ID NO: 193762 - protein, 16 aa, Borrelia garinii
EDGKTLVSRKVNSKDK

SEQ ID NO: 193763 - protein, 16 aa, Borrelia garinii
DGKTLVSRKVNSKDKS

SEQ ID NO: 193764 - protein, 16 aa, Borrelia garinii
GKTLVSRKVNSKDKSS

SEQ ID NO: 193765 - protein, 16 aa, Borrelia garinii
KTLVSRKVNSKDKSST

SEQ ID NO: 193766 - protein, 16 aa, Borrelia garinii
TLVSRKVNSKDKSSTE

SEQ ID NO: 193767 - protein, 16 aa, Borrelia garinii
LVSRKVNSKDKSSTEE

SEQ ID NO: 193768 - protein, 16 aa, Borrelia garinii
VSRKVNSKDKSSTEEK

SEQ ID NO: 193769 - protein, 16 aa, Borrelia garinii
SRKVNSKDKSSTEEKF

SEQ ID NO: 193770 - protein, 16 aa, Borrelia garinii
RKVNSKDKSSTEEKFN

SEQ ID NO: 193771 - protein, 16 aa, Borrelia garinii
KVNSKDKSSTEEKFND

SEQ ID NO: 193772 - protein, 16 aa, Borrelia garinii
VNSKDKSSTEEKFNDK

SEQ ID NO: 193773 - protein, 16 aa, Borrelia garinii
NSKDKSSTEEKFNDKG

SEQ ID NO: 193774 - protein, 16 aa, Borrelia garinii
SKDKSSTEEKFNDKGK

SEQ ID NO: 193775 - protein, 16 aa, Borrelia garinii
KDKSSTEEKFNDKGKL

SEQ ID NO: 193776 - protein, 16 aa, Borrelia garinii
DKSSTEEKFNDKGKLS

SEQ ID NO: 193777 - protein, 16 aa, Borrelia garinii
KSSTEEKFNDKGKLSE

SEQ ID NO: 193778 - protein, 16 aa, Borrelia garinii
SSTEEKFNDKGKLSEK

SEQ ID NO: 193779 - protein, 16 aa, Borrelia garinii
STEEKFNDKGKLSEKV

SEQ ID NO: 193780 - protein, 16 aa, Borrelia garinii
TEEKFNDKGKLSEKVV

SEQ ID NO: 193781 - protein, 16 aa, Borrelia garinii
EEKFNDKGKLSEKVVT

SEQ ID NO: 193782 - protein, 16 aa, Borrelia garinii
EKFNDKGKLSEKVVTR

SEQ ID NO: 193783 - protein, 16 aa, Borrelia garinii
KFNDKGKLSEKVVTRA

SEQ ID NO: 193784 - protein, 16 aa, Borrelia garinii
FNDKGKLSEKVVTRAN

SEQ ID NO: 193785 - protein, 16 aa, Borrelia garinii
NDKGKLSEKVVTRANG

SEQ ID NO: 193786 - protein, 16 aa, Borrelia garinii
DKGKLSEKVVTRANGT

SEQ ID NO: 193787 - protein, 16 aa, Borrelia garinii
KGKLSEKVVTRANGTR

SEQ ID NO: 193788 - protein, 16 aa, Borrelia garinii
GKLSEKVVTRANGTRL

SEQ ID NO: 193789 - protein, 16 aa, Borrelia garinii
KLSEKVVTRANGTRLE

SEQ ID NO: 193790 - protein, 16 aa, Borrelia garinii
LSEKVVTRANGTRLEY

SEQ ID NO: 193791 - protein, 16 aa, Borrelia garinii
SEKVVTRANGTRLEYT

SEQ ID NO: 193792 - protein, 16 aa, Borrelia garinii
EKVVTRANGTRLEYTE

SEQ ID NO: 193793 - protein, 16 aa, Borrelia garinii
KVVTRANGTRLEYTEI

SEQ ID NO: 193794 - protein, 16 aa, Borrelia garinii
VVTRANGTRLEYTEIK

SEQ ID NO: 193795 - protein, 16 aa, Borrelia garinii
VTRANGTRLEYTEIKN

SEQ ID NO: 193796 - protein, 16 aa, Borrelia garinii
TRANGTRLEYTEIKND

SEQ ID NO: 193797 - protein, 16 aa, Borrelia garinii
RANGTRLEYTEIKNDG

SEQ ID NO: 193798 - protein, 16 aa, Borrelia garinii
ANGTRLEYTEIKNDGS

SEQ ID NO: 193799 - protein, 16 aa, Borrelia garinii
NGTRLEYTEIKNDGSG

SEQ ID NO: 193800 - protein, 16 aa, Borrelia garinii
GTRLEYTEIKNDGSGK

SEQ ID NO: 193801 - protein, 16 aa, Borrelia garinii
TRLEYTEIKNDGSGKA

SEQ ID NO: 193802 - protein, 16 aa, Borrelia garinii
RLEYTEIKNDGSGKAK

SEQ ID NO: 193803 - protein, 16 aa, Borrelia garinii
LEYTEIKNDGSGKAKE

SEQ ID NO: 193804 - protein, 16 aa, Borrelia garinii
EYTEIKNDGSGKAKEV

SEQ ID NO: 193805 - protein, 16 aa, Borrelia garinii
YTEIKNDGSGKAKEVL

SEQ ID NO: 193806 - protein, 16 aa, Borrelia garinii
TEIKNDGSGKAKEVLK

SEQ ID NO: 193807 - protein, 16 aa, Borrelia garinii
EIKNDGSGKAKEVLKG

SEQ ID NO: 193808 - protein, 16 aa, Borrelia garinii
IKNDGSGKAKEVLKGF

SEQ ID NO: 193809 - protein, 16 aa, Borrelia garinii
KNDGSGKAKEVLKGFA

SEQ ID NO: 193810 - protein, 16 aa, Borrelia garinii
NDGSGKAKEVLKGFAL

SEQ ID NO: 193811 - protein, 16 aa, Borrelia garinii
DGSGKAKEVLKGFALE

SEQ ID NO: 193812 - protein, 16 aa, Borrelia garinii
GSGKAKEVLKGFALEG

SEQ ID NO: 193813 - protein, 16 aa, Borrelia garinii
SGKAKEVLKGFALEGT

SEQ ID NO: 193814 - protein, 16 aa, Borrelia garinii
GKAKEVLKGFALEGTL

SEQ ID NO: 193815 - protein, 16 aa, Borrelia garinii
KAKEVLKGFALEGTLT

SEQ ID NO: 193816 - protein, 16 aa, Borrelia garinii
AKEVLKGFALEGTLTD

SEQ ID NO: 193817 - protein, 16 aa, Borrelia garinii
KEVLKGFALEGTLTDG

SEQ ID NO: 193818 - protein, 16 aa, Borrelia garinii
EVLKGFALEGTLTDGG

SEQ ID NO: 193819 - protein, 16 aa, Borrelia garinii
VLKGFALEGTLTDGGE

SEQ ID NO: 193820 - protein, 16 aa, Borrelia garinii
LKGFALEGTLTDGGET

SEQ ID NO: 193821 - protein, 16 aa, Borrelia garinii
KGFALEGTLTDGGETK

SEQ ID NO: 193822 - protein, 16 aa, Borrelia garinii
GFALEGTLTDGGETKL

SEQ ID NO: 193823 - protein, 16 aa, Borrelia garinii
FALEGTLTDGGETKLT

SEQ ID NO: 193824 - protein, 16 aa, Borrelia garinii
ALEGTLTDGGETKLTV

SEQ ID NO: 193825 - protein, 16 aa, Borrelia garinii
LEGTLTDGGETKLTVT

SEQ ID NO: 193826 - protein, 16 aa, Borrelia garinii
EGTLTDGGETKLTVTE

SEQ ID NO: 193827 - protein, 16 aa, Borrelia garinii
GTLTDGGETKLTVTEG

SEQ ID NO: 193828 - protein, 16 aa, Borrelia garinii
TLTDGGETKLTVTEGT

SEQ ID NO: 193829 - protein, 16 aa, Borrelia garinii
LTDGGETKLTVTEGTV

SEQ ID NO: 193830 - protein, 16 aa, Borrelia garinii
TDGGETKLTVTEGTVT

SEQ ID NO: 193831 - protein, 16 aa, Borrelia garinii
DGGETKLTVTEGTVTL

SEQ ID NO: 193832 - protein, 16 aa, Borrelia garinii
GGETKLTVTEGTVTLS

SEQ ID NO: 193833 - protein, 16 aa, Borrelia garinii
GETKLTVTEGTVTLSK

SEQ ID NO: 193834 - protein, 16 aa, Borrelia garinii
ETKLTVTEGTVTLSKN

SEQ ID NO: 193835 - protein, 16 aa, Borrelia garinii
TKLTVTEGTVTLSKNI

SEQ ID NO: 193836 - protein, 16 aa, Borrelia garinii
KLTVTEGTVTLSKNIS

SEQ ID NO: 193837 - protein, 16 aa, Borrelia garinii
LTVTEGTVTLSKNISK

SEQ ID NO: 193838 - protein, 16 aa, Borrelia garinii
TVTEGTVTLSKNISKS

SEQ ID NO: 193839 - protein, 16 aa, Borrelia garinii
VTEGTVTLSKNISKSG

SEQ ID NO: 193840 - protein, 16 aa, Borrelia garinii
TEGTVTLSKNISKSGE

SEQ ID NO: 193841 - protein, 16 aa, Borrelia garinii
EGTVTLSKNISKSGEI

SEQ ID NO: 193842 - protein, 16 aa, Borrelia garinii
GTVTLSKNISKSGEIT

SEQ ID NO: 193843 - protein, 16 aa, Borrelia garinii
TVTLSKNISKSGEITV

SEQ ID NO: 193844 - protein, 16 aa, Borrelia garinii
VTLSKNISKSGEITVA

SEQ ID NO: 193845 - protein, 16 aa, Borrelia garinii
TLSKNISKSGEITVAL

SEQ ID NO: 193846 - protein, 16 aa, Borrelia garinii
LSKNISKSGEITVALN

SEQ ID NO: 193847 - protein, 16 aa, Borrelia garinii
SKNISKSGEITVALND

SEQ ID NO: 193848 - protein, 16 aa, Borrelia garinii
KNISKSGEITVALNDT

SEQ ID NO: 193849 - protein, 16 aa, Borrelia garinii
NISKSGEITVALNDTE

SEQ ID NO: 193850 - protein, 16 aa, Borrelia garinii
ISKSGEITVALNDTET

SEQ ID NO: 193851 - protein, 16 aa, Borrelia garinii
SKSGEITVALNDTETT

SEQ ID NO: 193852 - protein, 16 aa, Borrelia garinii
KSGEITVALNDTETTP

SEQ ID NO: 193853 - protein, 16 aa, Borrelia garinii
SGEITVALNDTETTPA

SEQ ID NO: 193854 - protein, 16 aa, Borrelia garinii
GEITVALNDTETTPAD

SEQ ID NO: 193855 - protein, 16 aa, Borrelia garinii
EITVALNDTETTPADK

SEQ ID NO: 193856 - protein, 16 aa, Borrelia garinii
ITVALNDTETTPADKK

SEQ ID NO: 193857 - protein, 16 aa, Borrelia garinii
TVALNDTETTPADKKT

SEQ ID NO: 193858 - protein, 16 aa, Borrelia garinii
VALNDTETTPADKKTG

SEQ ID NO: 193859 - protein, 16 aa, Borrelia garinii
ALNDTETTPADKKTGE

SEQ ID NO: 193860 - protein, 16 aa, Borrelia garinii
LNDTETTPADKKTGEW

SEQ ID NO: 193861 - protein, 16 aa, Borrelia garinii
NDTETTPADKKTGEWK

SEQ ID NO: 193862 - protein, 16 aa, Borrelia garinii
DTETTPADKKTGEWKS

SEQ ID NO: 193863 - protein, 16 aa, Borrelia garinii
TETTPADKKTGEWKSD

SEQ ID NO: 193864 - protein, 16 aa, Borrelia garinii
ETTPADKKTGEWKSDT

SEQ ID NO: 193865 - protein, 16 aa, Borrelia garinii
TTPADKKTGEWKSDTS

SEQ ID NO: 193866 - protein, 16 aa, Borrelia garinii
TPADKKTGEWKSDTST

SEQ ID NO: 193867 - protein, 16 aa, Borrelia garinii
PADKKTGEWKSDTSTL

SEQ ID NO: 193868 - protein, 16 aa, Borrelia garinii
ADKKTGEWKSDTSTLT

SEQ ID NO: 193869 - protein, 16 aa, Borrelia garinii
DKKTGEWKSDTSTLTI

SEQ ID NO: 193870 - protein, 16 aa, Borrelia garinii
KKTGEWKSDTSTLTIS

SEQ ID NO: 193871 - protein, 16 aa, Borrelia garinii
KTGEWKSDTSTLTISK

SEQ ID NO: 193872 - protein, 16 aa, Borrelia garinii
TGEWKSDTSTLTISKN

SEQ ID NO: 193873 - protein, 16 aa, Borrelia garinii
GEWKSDTSTLTISKNS

SEQ ID NO: 193874 - protein, 16 aa, Borrelia garinii
EWKSDTSTLTISKNSQ

SEQ ID NO: 193875 - protein, 16 aa, Borrelia garinii
WKSDTSTLTISKNSQK

SEQ ID NO: 193876 - protein, 16 aa, Borrelia garinii
KSDTSTLTISKNSQKP

SEQ ID NO: 193877 - protein, 16 aa, Borrelia garinii
SDTSTLTISKNSQKPK

SEQ ID NO: 193878 - protein, 16 aa, Borrelia garinii
DTSTLTISKNSQKPKQ

SEQ ID NO: 193879 - protein, 16 aa, Borrelia garinii
TSTLTISKNSQKPKQL

SEQ ID NO: 193880 - protein, 16 aa, Borrelia garinii
STLTISKNSQKPKQLV

SEQ ID NO: 193881 - protein, 16 aa, Borrelia garinii
TLTISKNSQKPKQLVF

SEQ ID NO: 193882 - protein, 16 aa, Borrelia garinii
LTISKNSQKPKQLVFT

SEQ ID NO: 193883 - protein, 16 aa, Borrelia garinii
TISKNSQKPKQLVFTK

SEQ ID NO: 193884 - protein, 16 aa, Borrelia garinii
ISKNSQKPKQLVFTKE

SEQ ID NO: 193885 - protein, 16 aa, Borrelia garinii
SKNSQKPKQLVFTKEN

SEQ ID NO: 193886 - protein, 16 aa, Borrelia garinii
KNSQKPKQLVFTKENT

SEQ ID NO: 193887 - protein, 16 aa, Borrelia garinii
NSQKPKQLVFTKENTI

SEQ ID NO: 193888 - protein, 16 aa, Borrelia garinii
SQKPKQLVFTKENTIT

SEQ ID NO: 193889 - protein, 16 aa, Borrelia garinii
QKPKQLVFTKENTITV

SEQ ID NO: 193890 - protein, 16 aa, Borrelia garinii
KPKQLVFTKENTITVQ

SEQ ID NO: 193891 - protein, 16 aa, Borrelia garinii
PKQLVFTKENTITVQN

SEQ ID NO: 193892 - protein, 16 aa, Borrelia garinii
KQLVFTKENTITVQNY

SEQ ID NO: 193893 - protein, 16 aa, Borrelia garinii
QLVFTKENTITVQNYN

SEQ ID NO: 193894 - protein, 16 aa, Borrelia garinii
LVFTKENTITVQNYNR

SEQ ID NO: 193895 - protein, 16 aa, Borrelia garinii
VFTKENTITVQNYNRA

SEQ ID NO: 193896 - protein, 16 aa, Borrelia garinii
FTKENTITVQNYNRAG

SEQ ID NO: 193897 - protein, 16 aa, Borrelia garinii
TKENTITVQNYNRAGN

SEQ ID NO: 193898 - protein, 16 aa, Borrelia garinii
KENTITVQNYNRAGNA

SEQ ID NO: 193899 - protein, 16 aa, Borrelia garinii
ENTITVQNYNRAGNAL

SEQ ID NO: 193900 - protein, 16 aa, Borrelia garinii
NTITVQNYNRAGNALE

SEQ ID NO: 193901 - protein, 16 aa, Borrelia garinii
TITVQNYNRAGNALEG

SEQ ID NO: 193902 - protein, 16 aa, Borrelia garinii
ITVQNYNRAGNALEGS

SEQ ID NO: 193903 - protein, 16 aa, Borrelia garinii
TVQNYNRAGNALEGSP

SEQ ID NO: 193904 - protein, 16 aa, Borrelia garinii
VQNYNRAGNALEGSPA

SEQ ID NO: 193905 - protein, 16 aa, Borrelia garinii
QNYNRAGNALEGSPAE

SEQ ID NO: 193906 - protein, 16 aa, Borrelia garinii
NYNRAGNALEGSPAEI

SEQ ID NO: 193907 - protein, 16 aa, Borrelia garinii
YNRAGNALEGSPAEIK

SEQ ID NO: 193908 - protein, 16 aa, Borrelia garinii
NRAGNALEGSPAEIKD

SEQ ID NO: 193909 - protein, 16 aa, Borrelia garinii
RAGNALEGSPAEIKDL

SEQ ID NO: 193910 - protein, 16 aa, Borrelia garinii
AGNALEGSPAEIKDLA

SEQ ID NO: 193911 - protein, 16 aa, Borrelia garinii
GNALEGSPAEIKDLAE

SEQ ID NO: 193912 - protein, 16 aa, Borrelia garinii
NALEGSPAEIKDLAEL

SEQ ID NO: 193913 - protein, 16 aa, Borrelia garinii
ALEGSPAEIKDLAELK

SEQ ID NO: 193914 - protein, 16 aa, Borrelia garinii
LEGSPAEIKDLAELKA

SEQ ID NO: 193915 - protein, 16 aa, Borrelia garinii
EGSPAEIKDLAELKAA

SEQ ID NO: 193916 - protein, 16 aa, Borrelia garinii
GSPAEIKDLAELKAAL

SEQ ID NO: 193917 - protein, 16 aa, Borrelia garinii
SPAEIKDLAELKAALK

SEQ ID NO: 193918 - protein, 353 aa, Borrelia garinii
MFKRFVFIALSLLVLACFKSNKKSVKSDKVIIGVLANGSFYDKGYNQSVYDGVVKLKDDFGIKLITKSLRPYPIEGKRLLTVNEAMAEDAYEVQKNPLNLFWLAGYQFSSLSVKLSYERPDIYYGIIDAFDYGDIQVPKNSLAIKFRNEEAAFLAGYIAAKMSRKEKIGFLTGPESEYLNDFKFGFKAGIFYANPKLRLVSKKAPSLFDKEKGKEMARFMYKEDKVGVIFPIAGITGLGVYDAAKELGPKYYVIGLNQDQSYIAPQNVITSVLKDIGKVIYSVSSDYIKNGVFKGGVVIDRGLKEGVIEIVKDPDVLNNRLVNEVVELENKIISGEIIVPDSEYAFDLFKSKL

SEQ ID NO: 193919 - protein, 8 aa, Borrelia garinii
MFKRFVFI

SEQ ID NO: 193920 - protein, 8 aa, Borrelia garinii
FKRFVFIA

SEQ ID NO: 193921 - protein, 8 aa, Borrelia garinii
KRFVFIAL

SEQ ID NO: 193922 - protein, 8 aa, Borrelia garinii
RFVFIALS

SEQ ID NO: 193923 - protein, 8 aa, Borrelia garinii
FVFIALSL

SEQ ID NO: 193924 - protein, 8 aa, Borrelia garinii
VFIALSLL

SEQ ID NO: 193925 - protein, 8 aa, Borrelia garinii
FIALSLLV

SEQ ID NO: 193926 - protein, 8 aa, Borrelia garinii
IALSLLVL

SEQ ID NO: 193927 - protein, 8 aa, Borrelia garinii
ALSLLVLA

SEQ ID NO: 193928 - protein, 8 aa, Borrelia garinii
LSLLVLAC

SEQ ID NO: 193929 - protein, 8 aa, Borrelia garinii
SLLVLACF

SEQ ID NO: 193930 - protein, 8 aa, Borrelia garinii
LLVLACFK

SEQ ID NO: 193931 - protein, 8 aa, Borrelia garinii
LVLACFKS

SEQ ID NO: 193932 - protein, 8 aa, Borrelia garinii
VLACFKSN

SEQ ID NO: 193933 - protein, 8 aa, Borrelia garinii
LACFKSNK

SEQ ID NO: 193934 - protein, 8 aa, Borrelia garinii
ACFKSNKK

SEQ ID NO: 193935 - protein, 8 aa, Borrelia garinii
CFKSNKKS

SEQ ID NO: 193936 - protein, 8 aa, Borrelia garinii
FKSNKKSV

SEQ ID NO: 193937 - protein, 8 aa, Borrelia garinii
KSNKKSVK

SEQ ID NO: 193938 - protein, 8 aa, Borrelia garinii
SNKKSVKS

SEQ ID NO: 193939 - protein, 8 aa, Borrelia garinii
NKKSVKSD

SEQ ID NO: 193940 - protein, 8 aa, Borrelia garinii
KKSVKSDK

SEQ ID NO: 193941 - protein, 8 aa, Borrelia garinii
KSVKSDKV

SEQ ID NO: 193942 - protein, 8 aa, Borrelia garinii
SVKSDKVI

SEQ ID NO: 193943 - protein, 8 aa, Borrelia garinii
VKSDKVII

SEQ ID NO: 193944 - protein, 8 aa, Borrelia garinii
KSDKVIIG

SEQ ID NO: 193945 - protein, 8 aa, Borrelia garinii
SDKVIIGV

SEQ ID NO: 193946 - protein, 8 aa, Borrelia garinii
DKVIIGVL

SEQ ID NO: 193947 - protein, 8 aa, Borrelia garinii
KVIIGVLA

SEQ ID NO: 193948 - protein, 8 aa, Borrelia garinii
VIIGVLAN

SEQ ID NO: 193949 - protein, 8 aa, Borrelia garinii
IIGVLANG

SEQ ID NO: 193950 - protein, 8 aa, Borrelia garinii
IGVLANGS

SEQ ID NO: 193951 - protein, 8 aa, Borrelia garinii
GVLANGSF

SEQ ID NO: 193952 - protein, 8 aa, Borrelia garinii
VLANGSFY

SEQ ID NO: 193953 - protein, 8 aa, Borrelia garinii
LANGSFYD

SEQ ID NO: 193954 - protein, 8 aa, Borrelia garinii
ANGSFYDK

SEQ ID NO: 193955 - protein, 8 aa, Borrelia garinii
NGSFYDKG

SEQ ID NO: 193956 - protein, 8 aa, Borrelia garinii
GSFYDKGY

SEQ ID NO: 193957 - protein, 8 aa, Borrelia garinii
SFYDKGYN

SEQ ID NO: 193958 - protein, 8 aa, Borrelia garinii
FYDKGYNQ

SEQ ID NO: 193959 - protein, 8 aa, Borrelia garinii
YDKGYNQS

SEQ ID NO: 193960 - protein, 8 aa, Borrelia garinii
DKGYNQSV

SEQ ID NO: 193961 - protein, 8 aa, Borrelia garinii
KGYNQSVY

SEQ ID NO: 193962 - protein, 8 aa, Borrelia garinii
GYNQSVYD

SEQ ID NO: 193963 - protein, 8 aa, Borrelia garinii
YNQSVYDG

SEQ ID NO: 193964 - protein, 8 aa, Borrelia garinii
NQSVYDGV

SEQ ID NO: 193965 - protein, 8 aa, Borrelia garinii
QSVYDGVV

SEQ ID NO: 193966 - protein, 8 aa, Borrelia garinii
SVYDGVVK

SEQ ID NO: 193967 - protein, 8 aa, Borrelia garinii
VYDGVVKL

SEQ ID NO: 193968 - protein, 8 aa, Borrelia garinii
YDGVVKLK

SEQ ID NO: 193969 - protein, 8 aa, Borrelia garinii
DGVVKLKD

SEQ ID NO: 193970 - protein, 8 aa, Borrelia garinii
GVVKLKDD

SEQ ID NO: 193971 - protein, 8 aa, Borrelia garinii
VVKLKDDF

SEQ ID NO: 193972 - protein, 8 aa, Borrelia garinii
VKLKDDFG

SEQ ID NO: 193973 - protein, 8 aa, Borrelia garinii
KLKDDFGI

SEQ ID NO: 193974 - protein, 8 aa, Borrelia garinii
LKDDFGIK

SEQ ID NO: 193975 - protein, 8 aa, Borrelia garinii
KDDFGIKL

SEQ ID NO: 193976 - protein, 8 aa, Borrelia garinii
DDFGIKLI

SEQ ID NO: 193977 - protein, 8 aa, Borrelia garinii
DFGIKLIT

SEQ ID NO: 193978 - protein, 8 aa, Borrelia garinii
FGIKLITK

SEQ ID NO: 193979 - protein, 8 aa, Borrelia garinii
GIKLITKS

SEQ ID NO: 193980 - protein, 8 aa, Borrelia garinii
IKLITKSL

SEQ ID NO: 193981 - protein, 8 aa, Borrelia garinii
KLITKSLR

SEQ ID NO: 193982 - protein, 8 aa, Borrelia garinii
LITKSLRP

SEQ ID NO: 193983 - protein, 8 aa, Borrelia garinii
ITKSLRPY

SEQ ID NO: 193984 - protein, 8 aa, Borrelia garinii
TKSLRPYP

SEQ ID NO: 193985 - protein, 8 aa, Borrelia garinii
KSLRPYPI

SEQ ID NO: 193986 - protein, 8 aa, Borrelia garinii
SLRPYPIE

SEQ ID NO: 193987 - protein, 8 aa, Borrelia garinii
LRPYPIEG

SEQ ID NO: 193988 - protein, 8 aa, Borrelia garinii
RPYPIEGK

SEQ ID NO: 193989 - protein, 8 aa, Borrelia garinii
PYPIEGKR

SEQ ID NO: 193990 - protein, 8 aa, Borrelia garinii
YPIEGKRL

SEQ ID NO: 193991 - protein, 8 aa, Borrelia garinii
PIEGKRLL

SEQ ID NO: 193992 - protein, 8 aa, Borrelia garinii
IEGKRLLT

SEQ ID NO: 193993 - protein, 8 aa, Borrelia garinii
EGKRLLTV

SEQ ID NO: 193994 - protein, 8 aa, Borrelia garinii
GKRLLTVN

SEQ ID NO: 193995 - protein, 8 aa, Borrelia garinii
KRLLTVNE

SEQ ID NO: 193996 - protein, 8 aa, Borrelia garinii
RLLTVNEA

SEQ ID NO: 193997 - protein, 8 aa, Borrelia garinii
LLTVNEAM

SEQ ID NO: 193998 - protein, 8 aa, Borrelia garinii
LTVNEAMA

SEQ ID NO: 193999 - protein, 8 aa, Borrelia garinii
TVNEAMAE

SEQ ID NO: 194000 - protein, 8 aa, Borrelia garinii
VNEAMAED

SEQ ID NO: 194001 - protein, 8 aa, Borrelia garinii
NEAMAEDA

SEQ ID NO: 194002 - protein, 8 aa, Borrelia garinii
EAMAEDAY

SEQ ID NO: 194003 - protein, 8 aa, Borrelia garinii
AMAEDAYE

SEQ ID NO: 194004 - protein, 8 aa, Borrelia garinii
MAEDAYEV

SEQ ID NO: 194005 - protein, 8 aa, Borrelia garinii
AEDAYEVQ

SEQ ID NO: 194006 - protein, 8 aa, Borrelia garinii
EDAYEVQK

SEQ ID NO: 194007 - protein, 8 aa, Borrelia garinii
DAYEVQKN

SEQ ID NO: 194008 - protein, 8 aa, Borrelia garinii
AYEVQKNP

SEQ ID NO: 194009 - protein, 8 aa, Borrelia garinii
YEVQKNPL

SEQ ID NO: 194010 - protein, 8 aa, Borrelia garinii
EVQKNPLN

SEQ ID NO: 194011 - protein, 8 aa, Borrelia garinii
VQKNPLNL

SEQ ID NO: 194012 - protein, 8 aa, Borrelia garinii
QKNPLNLF

SEQ ID NO: 194013 - protein, 8 aa, Borrelia garinii
KNPLNLFW

SEQ ID NO: 194014 - protein, 8 aa, Borrelia garinii
NPLNLFWL

SEQ ID NO: 194015 - protein, 8 aa, Borrelia garinii
PLNLFWLA

SEQ ID NO: 194016 - protein, 8 aa, Borrelia garinii
LNLFWLAG

SEQ ID NO: 194017 - protein, 8 aa, Borrelia garinii
NLFWLAGY

SEQ ID NO: 194018 - protein, 8 aa, Borrelia garinii
LFWLAGYQ

SEQ ID NO: 194019 - protein, 8 aa, Borrelia garinii
FWLAGYQF

SEQ ID NO: 194020 - protein, 8 aa, Borrelia garinii
WLAGYQFS

SEQ ID NO: 194021 - protein, 8 aa, Borrelia garinii
LAGYQFSS

SEQ ID NO: 194022 - protein, 8 aa, Borrelia garinii
AGYQFSSL

SEQ ID NO: 194023 - protein, 8 aa, Borrelia garinii
GYQFSSLS

SEQ ID NO: 194024 - protein, 8 aa, Borrelia garinii
YQFSSLSV

SEQ ID NO: 194025 - protein, 8 aa, Borrelia garinii
QFSSLSVK

SEQ ID NO: 194026 - protein, 8 aa, Borrelia garinii
FSSLSVKL

SEQ ID NO: 194027 - protein, 8 aa, Borrelia garinii
SSLSVKLS

SEQ ID NO: 194028 - protein, 8 aa, Borrelia garinii
SLSVKLSY

SEQ ID NO: 194029 - protein, 8 aa, Borrelia garinii
LSVKLSYE

SEQ ID NO: 194030 - protein, 8 aa, Borrelia garinii
SVKLSYER

SEQ ID NO: 194031 - protein, 8 aa, Borrelia garinii
VKLSYERP

SEQ ID NO: 194032 - protein, 8 aa, Borrelia garinii
KLSYERPD

SEQ ID NO: 194033 - protein, 8 aa, Borrelia garinii
LSYERPDI

SEQ ID NO: 194034 - protein, 8 aa, Borrelia garinii
SYERPDIY

SEQ ID NO: 194035 - protein, 8 aa, Borrelia garinii
YERPDIYY

SEQ ID NO: 194036 - protein, 8 aa, Borrelia garinii
ERPDIYYG

SEQ ID NO: 194037 - protein, 8 aa, Borrelia garinii
RPDIYYGI

SEQ ID NO: 194038 - protein, 8 aa, Borrelia garinii
PDIYYGII

SEQ ID NO: 194039 - protein, 8 aa, Borrelia garinii
DIYYGIID

SEQ ID NO: 194040 - protein, 8 aa, Borrelia garinii
IYYGIIDA

SEQ ID NO: 194041 - protein, 8 aa, Borrelia garinii
YYGIIDAF

SEQ ID NO: 194042 - protein, 8 aa, Borrelia garinii
YGIIDAFD

SEQ ID NO: 194043 - protein, 8 aa, Borrelia garinii
GIIDAFDY

SEQ ID NO: 194044 - protein, 8 aa, Borrelia garinii
IIDAFDYG

SEQ ID NO: 194045 - protein, 8 aa, Borrelia garinii
IDAFDYGD

SEQ ID NO: 194046 - protein, 8 aa, Borrelia garinii
DAFDYGDI

SEQ ID NO: 194047 - protein, 8 aa, Borrelia garinii
AFDYGDIQ

SEQ ID NO: 194048 - protein, 8 aa, Borrelia garinii
FDYGDIQV

SEQ ID NO: 194049 - protein, 8 aa, Borrelia garinii
DYGDIQVP

SEQ ID NO: 194050 - protein, 8 aa, Borrelia garinii
YGDIQVPK

SEQ ID NO: 194051 - protein, 8 aa, Borrelia garinii
GDIQVPKN

SEQ ID NO: 194052 - protein, 8 aa, Borrelia garinii
DIQVPKNS

SEQ ID NO: 194053 - protein, 8 aa, Borrelia garinii
IQVPKNSL

SEQ ID NO: 194054 - protein, 8 aa, Borrelia garinii
QVPKNSLA

SEQ ID NO: 194055 - protein, 8 aa, Borrelia garinii
VPKNSLAI

SEQ ID NO: 194056 - protein, 8 aa, Borrelia garinii
PKNSLAIK

SEQ ID NO: 194057 - protein, 8 aa, Borrelia garinii
KNSLAIKF

SEQ ID NO: 194058 - protein, 8 aa, Borrelia garinii
NSLAIKFR

SEQ ID NO: 194059 - protein, 8 aa, Borrelia garinii
SLAIKFRN

SEQ ID NO: 194060 - protein, 8 aa, Borrelia garinii
LAIKFRNE

SEQ ID NO: 194061 - protein, 8 aa, Borrelia garinii
AIKFRNEE

SEQ ID NO: 194062 - protein, 8 aa, Borrelia garinii
IKFRNEEA

SEQ ID NO: 194063 - protein, 8 aa, Borrelia garinii
KFRNEEAA

SEQ ID NO: 194064 - protein, 8 aa, Borrelia garinii
FRNEEAAF

SEQ ID NO: 194065 - protein, 8 aa, Borrelia garinii
RNEEAAFL

SEQ ID NO: 194066 - protein, 8 aa, Borrelia garinii
NEEAAFLA

SEQ ID NO: 194067 - protein, 8 aa, Borrelia garinii
EEAAFLAG

SEQ ID NO: 194068 - protein, 8 aa, Borrelia garinii
EAAFLAGY

SEQ ID NO: 194069 - protein, 8 aa, Borrelia garinii
AAFLAGYI

SEQ ID NO: 194070 - protein, 8 aa, Borrelia garinii
AFLAGYIA

SEQ ID NO: 194071 - protein, 8 aa, Borrelia garinii
FLAGYIAA

SEQ ID NO: 194072 - protein, 8 aa, Borrelia garinii
LAGYIAAK

SEQ ID NO: 194073 - protein, 8 aa, Borrelia garinii
AGYIAAKM

SEQ ID NO: 194074 - protein, 8 aa, Borrelia garinii
GYIAAKMS

SEQ ID NO: 194075 - protein, 8 aa, Borrelia garinii
YIAAKMSR

SEQ ID NO: 194076 - protein, 8 aa, Borrelia garinii
IAAKMSRK

SEQ ID NO: 194077 - protein, 8 aa, Borrelia garinii
AAKMSRKE

SEQ ID NO: 194078 - protein, 8 aa, Borrelia garinii
AKMSRKEK

SEQ ID NO: 194079 - protein, 8 aa, Borrelia garinii
KMSRKEKI

SEQ ID NO: 194080 - protein, 8 aa, Borrelia garinii
MSRKEKIG

SEQ ID NO: 194081 - protein, 8 aa, Borrelia garinii
SRKEKIGF

SEQ ID NO: 194082 - protein, 8 aa, Borrelia garinii
RKEKIGFL

SEQ ID NO: 194083 - protein, 8 aa, Borrelia garinii
KEKIGFLT

SEQ ID NO: 194084 - protein, 8 aa, Borrelia garinii
EKIGFLTG

SEQ ID NO: 194085 - protein, 8 aa, Borrelia garinii
KIGFLTGP

SEQ ID NO: 194086 - protein, 8 aa, Borrelia garinii
IGFLTGPE

SEQ ID NO: 194087 - protein, 8 aa, Borrelia garinii
GFLTGPES

SEQ ID NO: 194088 - protein, 8 aa, Borrelia garinii
FLTGPESE

SEQ ID NO: 194089 - protein, 8 aa, Borrelia garinii
LTGPESEY

SEQ ID NO: 194090 - protein, 8 aa, Borrelia garinii
TGPESEYL

SEQ ID NO: 194091 - protein, 8 aa, Borrelia garinii
GPESEYLN

SEQ ID NO: 194092 - protein, 8 aa, Borrelia garinii
PESEYLND

SEQ ID NO: 194093 - protein, 8 aa, Borrelia garinii
ESEYLNDF

SEQ ID NO: 194094 - protein, 8 aa, Borrelia garinii
SEYLNDFK

SEQ ID NO: 194095 - protein, 8 aa, Borrelia garinii
EYLNDFKF

SEQ ID NO: 194096 - protein, 8 aa, Borrelia garinii
YLNDFKFG

SEQ ID NO: 194097 - protein, 8 aa, Borrelia garinii
LNDFKFGF

SEQ ID NO: 194098 - protein, 8 aa, Borrelia garinii
NDFKFGFK

SEQ ID NO: 194099 - protein, 8 aa, Borrelia garinii
DFKFGFKA

SEQ ID NO: 194100 - protein, 8 aa, Borrelia garinii
FKFGFKAG

SEQ ID NO: 194101 - protein, 8 aa, Borrelia garinii
KFGFKAGI

SEQ ID NO: 194102 - protein, 8 aa, Borrelia garinii
FGFKAGIF

SEQ ID NO: 194103 - protein, 8 aa, Borrelia garinii
GFKAGIFY

SEQ ID NO: 194104 - protein, 8 aa, Borrelia garinii
FKAGIFYA

SEQ ID NO: 194105 - protein, 8 aa, Borrelia garinii
KAGIFYAN

SEQ ID NO: 194106 - protein, 8 aa, Borrelia garinii
AGIFYANP

SEQ ID NO: 194107 - protein, 8 aa, Borrelia garinii
GIFYANPK

SEQ ID NO: 194108 - protein, 8 aa, Borrelia garinii
IFYANPKL

SEQ ID NO: 194109 - protein, 8 aa, Borrelia garinii
FYANPKLR

SEQ ID NO: 194110 - protein, 8 aa, Borrelia garinii
YANPKLRL

SEQ ID NO: 194111 - protein, 8 aa, Borrelia garinii
ANPKLRLV

SEQ ID NO: 194112 - protein, 8 aa, Borrelia garinii
NPKLRLVS

SEQ ID NO: 194113 - protein, 8 aa, Borrelia garinii
PKLRLVSK

SEQ ID NO: 194114 - protein, 8 aa, Borrelia garinii
KLRLVSKK

SEQ ID NO: 194115 - protein, 8 aa, Borrelia garinii
LRLVSKKA

SEQ ID NO: 194116 - protein, 8 aa, Borrelia garinii
RLVSKKAP

SEQ ID NO: 194117 - protein, 8 aa, Borrelia garinii
LVSKKAPS

SEQ ID NO: 194118 - protein, 8 aa, Borrelia garinii
VSKKAPSL

SEQ ID NO: 194119 - protein, 8 aa, Borrelia garinii
SKKAPSLF

SEQ ID NO: 194120 - protein, 8 aa, Borrelia garinii
KKAPSLFD

SEQ ID NO: 194121 - protein, 8 aa, Borrelia garinii
KAPSLFDK

SEQ ID NO: 194122 - protein, 8 aa, Borrelia garinii
APSLFDKE

SEQ ID NO: 194123 - protein, 8 aa, Borrelia garinii
PSLFDKEK

SEQ ID NO: 194124 - protein, 8 aa, Borrelia garinii
SLFDKEKG

SEQ ID NO: 194125 - protein, 8 aa, Borrelia garinii
LFDKEKGK

SEQ ID NO: 194126 - protein, 8 aa, Borrelia garinii
FDKEKGKE

SEQ ID NO: 194127 - protein, 8 aa, Borrelia garinii
DKEKGKEM

SEQ ID NO: 194128 - protein, 8 aa, Borrelia garinii
KEKGKEMA

SEQ ID NO: 194129 - protein, 8 aa, Borrelia garinii
EKGKEMAR

SEQ ID NO: 194130 - protein, 8 aa, Borrelia garinii
KGKEMARF

SEQ ID NO: 194131 - protein, 8 aa, Borrelia garinii
GKEMARFM

SEQ ID NO: 194132 - protein, 8 aa, Borrelia garinii
KEMARFMY

SEQ ID NO: 194133 - protein, 8 aa, Borrelia garinii
EMARFMYK

SEQ ID NO: 194134 - protein, 8 aa, Borrelia garinii
MARFMYKE

SEQ ID NO: 194135 - protein, 8 aa, Borrelia garinii
ARFMYKED

SEQ ID NO: 194136 - protein, 8 aa, Borrelia garinii
RFMYKEDK

SEQ ID NO: 194137 - protein, 8 aa, Borrelia garinii
FMYKEDKV

SEQ ID NO: 194138 - protein, 8 aa, Borrelia garinii
MYKEDKVG

SEQ ID NO: 194139 - protein, 8 aa, Borrelia garinii
YKEDKVGV

SEQ ID NO: 194140 - protein, 8 aa, Borrelia garinii
KEDKVGVI

SEQ ID NO: 194141 - protein, 8 aa, Borrelia garinii
EDKVGVIF

SEQ ID NO: 194142 - protein, 8 aa, Borrelia garinii
DKVGVIFP

SEQ ID NO: 194143 - protein, 8 aa, Borrelia garinii
KVGVIFPI

SEQ ID NO: 194144 - protein, 8 aa, Borrelia garinii
VGVIFPIA

SEQ ID NO: 194145 - protein, 8 aa, Borrelia garinii
GVIFPIAG

SEQ ID NO: 194146 - protein, 8 aa, Borrelia garinii
VIFPIAGI

SEQ ID NO: 194147 - protein, 8 aa, Borrelia garinii
IFPIAGIT

SEQ ID NO: 194148 - protein, 8 aa, Borrelia garinii
FPIAGITG

SEQ ID NO: 194149 - protein, 8 aa, Borrelia garinii
PIAGITGL

SEQ ID NO: 194150 - protein, 8 aa, Borrelia garinii
IAGITGLG

SEQ ID NO: 194151 - protein, 8 aa, Borrelia garinii
AGITGLGV

SEQ ID NO: 194152 - protein, 8 aa, Borrelia garinii
GITGLGVY

SEQ ID NO: 194153 - protein, 8 aa, Borrelia garinii
ITGLGVYD

SEQ ID NO: 194154 - protein, 8 aa, Borrelia garinii
TGLGVYDA

SEQ ID NO: 194155 - protein, 8 aa, Borrelia garinii
GLGVYDAA

SEQ ID NO: 194156 - protein, 8 aa, Borrelia garinii
LGVYDAAK

SEQ ID NO: 194157 - protein, 8 aa, Borrelia garinii
GVYDAAKE

SEQ ID NO: 194158 - protein, 8 aa, Borrelia garinii
VYDAAKEL

SEQ ID NO: 194159 - protein, 8 aa, Borrelia garinii
YDAAKELG

SEQ ID NO: 194160 - protein, 8 aa, Borrelia garinii
DAAKELGP

SEQ ID NO: 194161 - protein, 8 aa, Borrelia garinii
AAKELGPK

SEQ ID NO: 194162 - protein, 8 aa, Borrelia garinii
AKELGPKY

SEQ ID NO: 194163 - protein, 8 aa, Borrelia garinii
KELGPKYY

SEQ ID NO: 194164 - protein, 8 aa, Borrelia garinii
ELGPKYYV

SEQ ID NO: 194165 - protein, 8 aa, Borrelia garinii
LGPKYYVI

SEQ ID NO: 194166 - protein, 8 aa, Borrelia garinii
GPKYYVIG

SEQ ID NO: 194167 - protein, 8 aa, Borrelia garinii
PKYYVIGL

SEQ ID NO: 194168 - protein, 8 aa, Borrelia garinii
KYYVIGLN

SEQ ID NO: 194169 - protein, 8 aa, Borrelia garinii
YYVIGLNQ

SEQ ID NO: 194170 - protein, 8 aa, Borrelia garinii
YVIGLNQD

SEQ ID NO: 194171 - protein, 8 aa, Borrelia garinii
VIGLNQDQ

SEQ ID NO: 194172 - protein, 8 aa, Borrelia garinii
IGLNQDQS

SEQ ID NO: 194173 - protein, 8 aa, Borrelia garinii
GLNQDQSY

SEQ ID NO: 194174 - protein, 8 aa, Borrelia garinii
LNQDQSYI

SEQ ID NO: 194175 - protein, 8 aa, Borrelia garinii
NQDQSYIA

SEQ ID NO: 194176 - protein, 8 aa, Borrelia garinii
QDQSYIAP

SEQ ID NO: 194177 - protein, 8 aa, Borrelia garinii
DQSYIAPQ

SEQ ID NO: 194178 - protein, 8 aa, Borrelia garinii
QSYIAPQN

SEQ ID NO: 194179 - protein, 8 aa, Borrelia garinii
SYIAPQNV

SEQ ID NO: 194180 - protein, 8 aa, Borrelia garinii
YIAPQNVI

SEQ ID NO: 194181 - protein, 8 aa, Borrelia garinii
IAPQNVIT

SEQ ID NO: 194182 - protein, 8 aa, Borrelia garinii
APQNVITS

SEQ ID NO: 194183 - protein, 8 aa, Borrelia garinii
PQNVITSV

SEQ ID NO: 194184 - protein, 8 aa, Borrelia garinii
QNVITSVL

SEQ ID NO: 194185 - protein, 8 aa, Borrelia garinii
NVITSVLK

SEQ ID NO: 194186 - protein, 8 aa, Borrelia garinii
VITSVLKD

SEQ ID NO: 194187 - protein, 8 aa, Borrelia garinii
ITSVLKDI

SEQ ID NO: 194188 - protein, 8 aa, Borrelia garinii
TSVLKDIG

SEQ ID NO: 194189 - protein, 8 aa, Borrelia garinii
SVLKDIGK

SEQ ID NO: 194190 - protein, 8 aa, Borrelia garinii
VLKDIGKV

SEQ ID NO: 194191 - protein, 8 aa, Borrelia garinii
LKDIGKVI

SEQ ID NO: 194192 - protein, 8 aa, Borrelia garinii
KDIGKVIY

SEQ ID NO: 194193 - protein, 8 aa, Borrelia garinii
DIGKVIYS

SEQ ID NO: 194194 - protein, 8 aa, Borrelia garinii
IGKVIYSV

SEQ ID NO: 194195 - protein, 8 aa, Borrelia garinii
GKVIYSVS

SEQ ID NO: 194196 - protein, 8 aa, Borrelia garinii
KVIYSVSS

SEQ ID NO: 194197 - protein, 8 aa, Borrelia garinii
VIYSVSSD

SEQ ID NO: 194198 - protein, 8 aa, Borrelia garinii
IYSVSSDY

SEQ ID NO: 194199 - protein, 8 aa, Borrelia garinii
YSVSSDYI

SEQ ID NO: 194200 - protein, 8 aa, Borrelia garinii
SVSSDYIK

SEQ ID NO: 194201 - protein, 8 aa, Borrelia garinii
VSSDYIKN

SEQ ID NO: 194202 - protein, 8 aa, Borrelia garinii
SSDYIKNG

SEQ ID NO: 194203 - protein, 8 aa, Borrelia garinii
SDYIKNGV

SEQ ID NO: 194204 - protein, 8 aa, Borrelia garinii
DYIKNGVF

SEQ ID NO: 194205 - protein, 8 aa, Borrelia garinii
YIKNGVFK

SEQ ID NO: 194206 - protein, 8 aa, Borrelia garinii
IKNGVFKG

SEQ ID NO: 194207 - protein, 8 aa, Borrelia garinii
KNGVFKGG

SEQ ID NO: 194208 - protein, 8 aa, Borrelia garinii
NGVFKGGV

SEQ ID NO: 194209 - protein, 8 aa, Borrelia garinii
GVFKGGVV

SEQ ID NO: 194210 - protein, 8 aa, Borrelia garinii
VFKGGVVI

SEQ ID NO: 194211 - protein, 8 aa, Borrelia garinii
FKGGVVID

SEQ ID NO: 194212 - protein, 8 aa, Borrelia garinii
KGGVVIDR

SEQ ID NO: 194213 - protein, 8 aa, Borrelia garinii
GGVVIDRG

SEQ ID NO: 194214 - protein, 8 aa, Borrelia garinii
GVVIDRGL

SEQ ID NO: 194215 - protein, 8 aa, Borrelia garinii
VVIDRGLK

SEQ ID NO: 194216 - protein, 8 aa, Borrelia garinii
VIDRGLKE

SEQ ID NO: 194217 - protein, 8 aa, Borrelia garinii
IDRGLKEG

SEQ ID NO: 194218 - protein, 8 aa, Borrelia garinii
DRGLKEGV

SEQ ID NO: 194219 - protein, 8 aa, Borrelia garinii
RGLKEGVI

SEQ ID NO: 194220 - protein, 8 aa, Borrelia garinii
GLKEGVIE

SEQ ID NO: 194221 - protein, 8 aa, Borrelia garinii
LKEGVIEI

SEQ ID NO: 194222 - protein, 8 aa, Borrelia garinii
KEGVIEIV

SEQ ID NO: 194223 - protein, 8 aa, Borrelia garinii
EGVIEIVK

SEQ ID NO: 194224 - protein, 8 aa, Borrelia garinii
GVIEIVKD

SEQ ID NO: 194225 - protein, 8 aa, Borrelia garinii
VIEIVKDP

SEQ ID NO: 194226 - protein, 8 aa, Borrelia garinii
IEIVKDPD

SEQ ID NO: 194227 - protein, 8 aa, Borrelia garinii
EIVKDPDV

SEQ ID NO: 194228 - protein, 8 aa, Borrelia garinii
IVKDPDVL

SEQ ID NO: 194229 - protein, 8 aa, Borrelia garinii
VKDPDVLN

SEQ ID NO: 194230 - protein, 8 aa, Borrelia garinii
KDPDVLNN

SEQ ID NO: 194231 - protein, 8 aa, Borrelia garinii
DPDVLNNR

SEQ ID NO: 194232 - protein, 8 aa, Borrelia garinii
PDVLNNRL

SEQ ID NO: 194233 - protein, 8 aa, Borrelia garinii
DVLNNRLV

SEQ ID NO: 194234 - protein, 8 aa, Borrelia garinii
VLNNRLVN

SEQ ID NO: 194235 - protein, 8 aa, Borrelia garinii
LNNRLVNE

SEQ ID NO: 194236 - protein, 8 aa, Borrelia garinii
NNRLVNEV

SEQ ID NO: 194237 - protein, 8 aa, Borrelia garinii
NRLVNEVV

SEQ ID NO: 194238 - protein, 8 aa, Borrelia garinii
RLVNEVVE

SEQ ID NO: 194239 - protein, 8 aa, Borrelia garinii
LVNEVVEL

SEQ ID NO: 194240 - protein, 8 aa, Borrelia garinii
VNEVVELE

SEQ ID NO: 194241 - protein, 8 aa, Borrelia garinii
NEVVELEN

SEQ ID NO: 194242 - protein, 8 aa, Borrelia garinii
EVVELENK

SEQ ID NO: 194243 - protein, 8 aa, Borrelia garinii
VVELENKI

SEQ ID NO: 194244 - protein, 8 aa, Borrelia garinii
VELENKII

SEQ ID NO: 194245 - protein, 8 aa, Borrelia garinii
ELENKIIS

SEQ ID NO: 194246 - protein, 8 aa, Borrelia garinii
LENKIISG

SEQ ID NO: 194247 - protein, 8 aa, Borrelia garinii
ENKIISGE

SEQ ID NO: 194248 - protein, 8 aa, Borrelia garinii
NKIISGEI

SEQ ID NO: 194249 - protein, 8 aa, Borrelia garinii
KIISGEII

SEQ ID NO: 194250 - protein, 8 aa, Borrelia garinii
IISGEIIV

SEQ ID NO: 194251 - protein, 8 aa, Borrelia garinii
ISGEIIVP

SEQ ID NO: 194252 - protein, 8 aa, Borrelia garinii
SGEIIVPD

SEQ ID NO: 194253 - protein, 8 aa, Borrelia garinii
GEIIVPDS

SEQ ID NO: 194254 - protein, 8 aa, Borrelia garinii
EIIVPDSE

SEQ ID NO: 194255 - protein, 8 aa, Borrelia garinii
IIVPDSEY

SEQ ID NO: 194256 - protein, 8 aa, Borrelia garinii
IVPDSEYA

SEQ ID NO: 194257 - protein, 8 aa, Borrelia garinii
VPDSEYAF

SEQ ID NO: 194258 - protein, 8 aa, Borrelia garinii
PDSEYAFD

SEQ ID NO: 194259 - protein, 8 aa, Borrelia garinii
DSEYAFDL

SEQ ID NO: 194260 - protein, 8 aa, Borrelia garinii
SEYAFDLF

SEQ ID NO: 194261 - protein, 8 aa, Borrelia garinii
EYAFDLFK

SEQ ID NO: 194262 - protein, 8 aa, Borrelia garinii
YAFDLFKS

SEQ ID NO: 194263 - protein, 8 aa, Borrelia garinii
AFDLFKSK

SEQ ID NO: 194264 - protein, 8 aa, Borrelia garinii
FDLFKSKL

SEQ ID NO: 194265 - protein, 9 aa, Borrelia garinii
MFKRFVFIA

SEQ ID NO: 194266 - protein, 9 aa, Borrelia garinii
FKRFVFIAL

SEQ ID NO: 194267 - protein, 9 aa, Borrelia garinii
KRFVFIALS

SEQ ID NO: 194268 - protein, 9 aa, Borrelia garinii
RFVFIALSL

SEQ ID NO: 194269 - protein, 9 aa, Borrelia garinii
FVFIALSLL

SEQ ID NO: 194270 - protein, 9 aa, Borrelia garinii
VFIALSLLV

SEQ ID NO: 194271 - protein, 9 aa, Borrelia garinii
FIALSLLVL

SEQ ID NO: 194272 - protein, 9 aa, Borrelia garinii
IALSLLVLA

SEQ ID NO: 194273 - protein, 9 aa, Borrelia garinii
ALSLLVLAC

SEQ ID NO: 194274 - protein, 9 aa, Borrelia garinii
LSLLVLACF

SEQ ID NO: 194275 - protein, 9 aa, Borrelia garinii
SLLVLACFK

SEQ ID NO: 194276 - protein, 9 aa, Borrelia garinii
LLVLACFKS

SEQ ID NO: 194277 - protein, 9 aa, Borrelia garinii
LVLACFKSN

SEQ ID NO: 194278 - protein, 9 aa, Borrelia garinii
VLACFKSNK

SEQ ID NO: 194279 - protein, 9 aa, Borrelia garinii
LACFKSNKK

SEQ ID NO: 194280 - protein, 9 aa, Borrelia garinii
ACFKSNKKS

SEQ ID NO: 194281 - protein, 9 aa, Borrelia garinii
CFKSNKKSV

SEQ ID NO: 194282 - protein, 9 aa, Borrelia garinii
FKSNKKSVK

SEQ ID NO: 194283 - protein, 9 aa, Borrelia garinii
KSNKKSVKS

SEQ ID NO: 194284 - protein, 9 aa, Borrelia garinii
SNKKSVKSD

SEQ ID NO: 194285 - protein, 9 aa, Borrelia garinii
NKKSVKSDK

SEQ ID NO: 194286 - protein, 9 aa, Borrelia garinii
KKSVKSDKV

SEQ ID NO: 194287 - protein, 9 aa, Borrelia garinii
KSVKSDKVI

SEQ ID NO: 194288 - protein, 9 aa, Borrelia garinii
SVKSDKVII

SEQ ID NO: 194289 - protein, 9 aa, Borrelia garinii
VKSDKVIIG

SEQ ID NO: 194290 - protein, 9 aa, Borrelia garinii
KSDKVIIGV

SEQ ID NO: 194291 - protein, 9 aa, Borrelia garinii
SDKVIIGVL

SEQ ID NO: 194292 - protein, 9 aa, Borrelia garinii
DKVIIGVLA

SEQ ID NO: 194293 - protein, 9 aa, Borrelia garinii
KVIIGVLAN

SEQ ID NO: 194294 - protein, 9 aa, Borrelia garinii
VIIGVLANG

SEQ ID NO: 194295 - protein, 9 aa, Borrelia garinii
IIGVLANGS

SEQ ID NO: 194296 - protein, 9 aa, Borrelia garinii
IGVLANGSF

SEQ ID NO: 194297 - protein, 9 aa, Borrelia garinii
GVLANGSFY

SEQ ID NO: 194298 - protein, 9 aa, Borrelia garinii
VLANGSFYD

SEQ ID NO: 194299 - protein, 9 aa, Borrelia garinii
LANGSFYDK

SEQ ID NO: 194300 - protein, 9 aa, Borrelia garinii
ANGSFYDKG

SEQ ID NO: 194301 - protein, 9 aa, Borrelia garinii
NGSFYDKGY

SEQ ID NO: 194302 - protein, 9 aa, Borrelia garinii
GSFYDKGYN

SEQ ID NO: 194303 - protein, 9 aa, Borrelia garinii
SFYDKGYNQ

SEQ ID NO: 194304 - protein, 9 aa, Borrelia garinii
FYDKGYNQS

SEQ ID NO: 194305 - protein, 9 aa, Borrelia garinii
YDKGYNQSV

SEQ ID NO: 194306 - protein, 9 aa, Borrelia garinii
DKGYNQSVY

SEQ ID NO: 194307 - protein, 9 aa, Borrelia garinii
KGYNQSVYD

SEQ ID NO: 194308 - protein, 9 aa, Borrelia garinii
GYNQSVYDG

SEQ ID NO: 194309 - protein, 9 aa, Borrelia garinii
YNQSVYDGV

SEQ ID NO: 194310 - protein, 9 aa, Borrelia garinii
NQSVYDGVV

SEQ ID NO: 194311 - protein, 9 aa, Borrelia garinii
QSVYDGVVK

SEQ ID NO: 194312 - protein, 9 aa, Borrelia garinii
SVYDGVVKL

SEQ ID NO: 194313 - protein, 9 aa, Borrelia garinii
VYDGVVKLK

SEQ ID NO: 194314 - protein, 9 aa, Borrelia garinii
YDGVVKLKD

SEQ ID NO: 194315 - protein, 9 aa, Borrelia garinii
DGVVKLKDD

SEQ ID NO: 194316 - protein, 9 aa, Borrelia garinii
GVVKLKDDF

SEQ ID NO: 194317 - protein, 9 aa, Borrelia garinii
VVKLKDDFG

SEQ ID NO: 194318 - protein, 9 aa, Borrelia garinii
VKLKDDFGI

SEQ ID NO: 194319 - protein, 9 aa, Borrelia garinii
KLKDDFGIK

SEQ ID NO: 194320 - protein, 9 aa, Borrelia garinii
LKDDFGIKL

SEQ ID NO: 194321 - protein, 9 aa, Borrelia garinii
KDDFGIKLI

SEQ ID NO: 194322 - protein, 9 aa, Borrelia garinii
DDFGIKLIT

SEQ ID NO: 194323 - protein, 9 aa, Borrelia garinii
DFGIKLITK

SEQ ID NO: 194324 - protein, 9 aa, Borrelia garinii
FGIKLITKS

SEQ ID NO: 194325 - protein, 9 aa, Borrelia garinii
GIKLITKSL

SEQ ID NO: 194326 - protein, 9 aa, Borrelia garinii
IKLITKSLR

SEQ ID NO: 194327 - protein, 9 aa, Borrelia garinii
KLITKSLRP

SEQ ID NO: 194328 - protein, 9 aa, Borrelia garinii
LITKSLRPY

SEQ ID NO: 194329 - protein, 9 aa, Borrelia garinii
ITKSLRPYP

SEQ ID NO: 194330 - protein, 9 aa, Borrelia garinii
TKSLRPYPI

SEQ ID NO: 194331 - protein, 9 aa, Borrelia garinii
KSLRPYPIE

SEQ ID NO: 194332 - protein, 9 aa, Borrelia garinii
SLRPYPIEG

SEQ ID NO: 194333 - protein, 9 aa, Borrelia garinii
LRPYPIEGK

SEQ ID NO: 194334 - protein, 9 aa, Borrelia garinii
RPYPIEGKR

SEQ ID NO: 194335 - protein, 9 aa, Borrelia garinii
PYPIEGKRL

SEQ ID NO: 194336 - protein, 9 aa, Borrelia garinii
YPIEGKRLL

SEQ ID NO: 194337 - protein, 9 aa, Borrelia garinii
PIEGKRLLT

SEQ ID NO: 194338 - protein, 9 aa, Borrelia garinii
IEGKRLLTV

SEQ ID NO: 194339 - protein, 9 aa, Borrelia garinii
EGKRLLTVN

SEQ ID NO: 194340 - protein, 9 aa, Borrelia garinii
GKRLLTVNE

SEQ ID NO: 194341 - protein, 9 aa, Borrelia garinii
KRLLTVNEA

SEQ ID NO: 194342 - protein, 9 aa, Borrelia garinii
RLLTVNEAM

SEQ ID NO: 194343 - protein, 9 aa, Borrelia garinii
LLTVNEAMA

SEQ ID NO: 194344 - protein, 9 aa, Borrelia garinii
LTVNEAMAE

SEQ ID NO: 194345 - protein, 9 aa, Borrelia garinii
TVNEAMAED

SEQ ID NO: 194346 - protein, 9 aa, Borrelia garinii
VNEAMAEDA

SEQ ID NO: 194347 - protein, 9 aa, Borrelia garinii
NEAMAEDAY

SEQ ID NO: 194348 - protein, 9 aa, Borrelia garinii
EAMAEDAYE

SEQ ID NO: 194349 - protein, 9 aa, Borrelia garinii
AMAEDAYEV

SEQ ID NO: 194350 - protein, 9 aa, Borrelia garinii
MAEDAYEVQ

SEQ ID NO: 194351 - protein, 9 aa, Borrelia garinii
AEDAYEVQK

SEQ ID NO: 194352 - protein, 9 aa, Borrelia garinii
EDAYEVQKN

SEQ ID NO: 194353 - protein, 9 aa, Borrelia garinii
DAYEVQKNP

SEQ ID NO: 194354 - protein, 9 aa, Borrelia garinii
AYEVQKNPL

SEQ ID NO: 194355 - protein, 9 aa, Borrelia garinii
YEVQKNPLN

SEQ ID NO: 194356 - protein, 9 aa, Borrelia garinii
EVQKNPLNL

SEQ ID NO: 194357 - protein, 9 aa, Borrelia garinii
VQKNPLNLF

SEQ ID NO: 194358 - protein, 9 aa, Borrelia garinii
QKNPLNLFW

SEQ ID NO: 194359 - protein, 9 aa, Borrelia garinii
KNPLNLFWL

SEQ ID NO: 194360 - protein, 9 aa, Borrelia garinii
NPLNLFWLA

SEQ ID NO: 194361 - protein, 9 aa, Borrelia garinii
PLNLFWLAG

SEQ ID NO: 194362 - protein, 9 aa, Borrelia garinii
LNLFWLAGY

SEQ ID NO: 194363 - protein, 9 aa, Borrelia garinii
NLFWLAGYQ

SEQ ID NO: 194364 - protein, 9 aa, Borrelia garinii
LFWLAGYQF

SEQ ID NO: 194365 - protein, 9 aa, Borrelia garinii
FWLAGYQFS

SEQ ID NO: 194366 - protein, 9 aa, Borrelia garinii
WLAGYQFSS

SEQ ID NO: 194367 - protein, 9 aa, Borrelia garinii
LAGYQFSSL

SEQ ID NO: 194368 - protein, 9 aa, Borrelia garinii
AGYQFSSLS

SEQ ID NO: 194369 - protein, 9 aa, Borrelia garinii
GYQFSSLSV

SEQ ID NO: 194370 - protein, 9 aa, Borrelia garinii
YQFSSLSVK

SEQ ID NO: 194371 - protein, 9 aa, Borrelia garinii
QFSSLSVKL

SEQ ID NO: 194372 - protein, 9 aa, Borrelia garinii
FSSLSVKLS

SEQ ID NO: 194373 - protein, 9 aa, Borrelia garinii
SSLSVKLSY

SEQ ID NO: 194374 - protein, 9 aa, Borrelia garinii
SLSVKLSYE

SEQ ID NO: 194375 - protein, 9 aa, Borrelia garinii
LSVKLSYER

SEQ ID NO: 194376 - protein, 9 aa, Borrelia garinii
SVKLSYERP

SEQ ID NO: 194377 - protein, 9 aa, Borrelia garinii
VKLSYERPD

SEQ ID NO: 194378 - protein, 9 aa, Borrelia garinii
KLSYERPDI

SEQ ID NO: 194379 - protein, 9 aa, Borrelia garinii
LSYERPDIY

SEQ ID NO: 194380 - protein, 9 aa, Borrelia garinii
SYERPDIYY

SEQ ID NO: 194381 - protein, 9 aa, Borrelia garinii
YERPDIYYG

SEQ ID NO: 194382 - protein, 9 aa, Borrelia garinii
ERPDIYYGI

SEQ ID NO: 194383 - protein, 9 aa, Borrelia garinii
RPDIYYGII

SEQ ID NO: 194384 - protein, 9 aa, Borrelia garinii
PDIYYGIID

SEQ ID NO: 194385 - protein, 9 aa, Borrelia garinii
DIYYGIIDA

SEQ ID NO: 194386 - protein, 9 aa, Borrelia garinii
IYYGIIDAF

SEQ ID NO: 194387 - protein, 9 aa, Borrelia garinii
YYGIIDAFD

SEQ ID NO: 194388 - protein, 9 aa, Borrelia garinii
YGIIDAFDY

SEQ ID NO: 194389 - protein, 9 aa, Borrelia garinii
GIIDAFDYG

SEQ ID NO: 194390 - protein, 9 aa, Borrelia garinii
IIDAFDYGD

SEQ ID NO: 194391 - protein, 9 aa, Borrelia garinii
IDAFDYGDI

SEQ ID NO: 194392 - protein, 9 aa, Borrelia garinii
DAFDYGDIQ

SEQ ID NO: 194393 - protein, 9 aa, Borrelia garinii
AFDYGDIQV

SEQ ID NO: 194394 - protein, 9 aa, Borrelia garinii
FDYGDIQVP

SEQ ID NO: 194395 - protein, 9 aa, Borrelia garinii
DYGDIQVPK

SEQ ID NO: 194396 - protein, 9 aa, Borrelia garinii
YGDIQVPKN

SEQ ID NO: 194397 - protein, 9 aa, Borrelia garinii
GDIQVPKNS

SEQ ID NO: 194398 - protein, 9 aa, Borrelia garinii
DIQVPKNSL

SEQ ID NO: 194399 - protein, 9 aa, Borrelia garinii
IQVPKNSLA

SEQ ID NO: 194400 - protein, 9 aa, Borrelia garinii
QVPKNSLAI

SEQ ID NO: 194401 - protein, 9 aa, Borrelia garinii
VPKNSLAIK

SEQ ID NO: 194402 - protein, 9 aa, Borrelia garinii
PKNSLAIKF

SEQ ID NO: 194403 - protein, 9 aa, Borrelia garinii
KNSLAIKFR

SEQ ID NO: 194404 - protein, 9 aa, Borrelia garinii
NSLAIKFRN

SEQ ID NO: 194405 - protein, 9 aa, Borrelia garinii
SLAIKFRNE

SEQ ID NO: 194406 - protein, 9 aa, Borrelia garinii
LAIKFRNEE

SEQ ID NO: 194407 - protein, 9 aa, Borrelia garinii
AIKFRNEEA

SEQ ID NO: 194408 - protein, 9 aa, Borrelia garinii
IKFRNEEAA

SEQ ID NO: 194409 - protein, 9 aa, Borrelia garinii
KFRNEEAAF

SEQ ID NO: 194410 - protein, 9 aa, Borrelia garinii
FRNEEAAFL

SEQ ID NO: 194411 - protein, 9 aa, Borrelia garinii
RNEEAAFLA

SEQ ID NO: 194412 - protein, 9 aa, Borrelia garinii
NEEAAFLAG

SEQ ID NO: 194413 - protein, 9 aa, Borrelia garinii
EEAAFLAGY

SEQ ID NO: 194414 - protein, 9 aa, Borrelia garinii
EAAFLAGYI

SEQ ID NO: 194415 - protein, 9 aa, Borrelia garinii
AAFLAGYIA

SEQ ID NO: 194416 - protein, 9 aa, Borrelia garinii
AFLAGYIAA

SEQ ID NO: 194417 - protein, 9 aa, Borrelia garinii
FLAGYIAAK

SEQ ID NO: 194418 - protein, 9 aa, Borrelia garinii
LAGYIAAKM

SEQ ID NO: 194419 - protein, 9 aa, Borrelia garinii
AGYIAAKMS

SEQ ID NO: 194420 - protein, 9 aa, Borrelia garinii
GYIAAKMSR

SEQ ID NO: 194421 - protein, 9 aa, Borrelia garinii
YIAAKMSRK

SEQ ID NO: 194422 - protein, 9 aa, Borrelia garinii
IAAKMSRKE

SEQ ID NO: 194423 - protein, 9 aa, Borrelia garinii
AAKMSRKEK

SEQ ID NO: 194424 - protein, 9 aa, Borrelia garinii
AKMSRKEKI

SEQ ID NO: 194425 - protein, 9 aa, Borrelia garinii
KMSRKEKIG

SEQ ID NO: 194426 - protein, 9 aa, Borrelia garinii
MSRKEKIGF

SEQ ID NO: 194427 - protein, 9 aa, Borrelia garinii
SRKEKIGFL

SEQ ID NO: 194428 - protein, 9 aa, Borrelia garinii
RKEKIGFLT

SEQ ID NO: 194429 - protein, 9 aa, Borrelia garinii
KEKIGFLTG

SEQ ID NO: 194430 - protein, 9 aa, Borrelia garinii
EKIGFLTGP

SEQ ID NO: 194431 - protein, 9 aa, Borrelia garinii
KIGFLTGPE

SEQ ID NO: 194432 - protein, 9 aa, Borrelia garinii
IGFLTGPES

SEQ ID NO: 194433 - protein, 9 aa, Borrelia garinii
GFLTGPESE

SEQ ID NO: 194434 - protein, 9 aa, Borrelia garinii
FLTGPESEY

SEQ ID NO: 194435 - protein, 9 aa, Borrelia garinii
LTGPESEYL

SEQ ID NO: 194436 - protein, 9 aa, Borrelia garinii
TGPESEYLN

SEQ ID NO: 194437 - protein, 9 aa, Borrelia garinii
GPESEYLND

SEQ ID NO: 194438 - protein, 9 aa, Borrelia garinii
PESEYLNDF

SEQ ID NO: 194439 - protein, 9 aa, Borrelia garinii
ESEYLNDFK

SEQ ID NO: 194440 - protein, 9 aa, Borrelia garinii
SEYLNDFKF

SEQ ID NO: 194441 - protein, 9 aa, Borrelia garinii
EYLNDFKFG

SEQ ID NO: 194442 - protein, 9 aa, Borrelia garinii
YLNDFKFGF

SEQ ID NO: 194443 - protein, 9 aa, Borrelia garinii
LNDFKFGFK

SEQ ID NO: 194444 - protein, 9 aa, Borrelia garinii
NDFKFGFKA

SEQ ID NO: 194445 - protein, 9 aa, Borrelia garinii
DFKFGFKAG

SEQ ID NO: 194446 - protein, 9 aa, Borrelia garinii
FKFGFKAGI

SEQ ID NO: 194447 - protein, 9 aa, Borrelia garinii
KFGFKAGIF

SEQ ID NO: 194448 - protein, 9 aa, Borrelia garinii
FGFKAGIFY

SEQ ID NO: 194449 - protein, 9 aa, Borrelia garinii
GFKAGIFYA

SEQ ID NO: 194450 - protein, 9 aa, Borrelia garinii
FKAGIFYAN

SEQ ID NO: 194451 - protein, 9 aa, Borrelia garinii
KAGIFYANP

SEQ ID NO: 194452 - protein, 9 aa, Borrelia garinii
AGIFYANPK

SEQ ID NO: 194453 - protein, 9 aa, Borrelia garinii
GIFYANPKL

SEQ ID NO: 194454 - protein, 9 aa, Borrelia garinii
IFYANPKLR

SEQ ID NO: 194455 - protein, 9 aa, Borrelia garinii
FYANPKLRL

SEQ ID NO: 194456 - protein, 9 aa, Borrelia garinii
YANPKLRLV

SEQ ID NO: 194457 - protein, 9 aa, Borrelia garinii
ANPKLRLVS

SEQ ID NO: 194458 - protein, 9 aa, Borrelia garinii
NPKLRLVSK

SEQ ID NO: 194459 - protein, 9 aa, Borrelia garinii
PKLRLVSKK

SEQ ID NO: 194460 - protein, 9 aa, Borrelia garinii
KLRLVSKKA

SEQ ID NO: 194461 - protein, 9 aa, Borrelia garinii
LRLVSKKAP

SEQ ID NO: 194462 - protein, 9 aa, Borrelia garinii
RLVSKKAPS

SEQ ID NO: 194463 - protein, 9 aa, Borrelia garinii
LVSKKAPSL

SEQ ID NO: 194464 - protein, 9 aa, Borrelia garinii
VSKKAPSLF

SEQ ID NO: 194465 - protein, 9 aa, Borrelia garinii
SKKAPSLFD

SEQ ID NO: 194466 - protein, 9 aa, Borrelia garinii
KKAPSLFDK

SEQ ID NO: 194467 - protein, 9 aa, Borrelia garinii
KAPSLFDKE

SEQ ID NO: 194468 - protein, 9 aa, Borrelia garinii
APSLFDKEK

SEQ ID NO: 194469 - protein, 9 aa, Borrelia garinii
PSLFDKEKG

SEQ ID NO: 194470 - protein, 9 aa, Borrelia garinii
SLFDKEKGK

SEQ ID NO: 194471 - protein, 9 aa, Borrelia garinii
LFDKEKGKE

SEQ ID NO: 194472 - protein, 9 aa, Borrelia garinii
FDKEKGKEM

SEQ ID NO: 194473 - protein, 9 aa, Borrelia garinii
DKEKGKEMA

SEQ ID NO: 194474 - protein, 9 aa, Borrelia garinii
KEKGKEMAR

SEQ ID NO: 194475 - protein, 9 aa, Borrelia garinii
EKGKEMARF

SEQ ID NO: 194476 - protein, 9 aa, Borrelia garinii
KGKEMARFM

SEQ ID NO: 194477 - protein, 9 aa, Borrelia garinii
GKEMARFMY

SEQ ID NO: 194478 - protein, 9 aa, Borrelia garinii
KEMARFMYK

SEQ ID NO: 194479 - protein, 9 aa, Borrelia garinii
EMARFMYKE

SEQ ID NO: 194480 - protein, 9 aa, Borrelia garinii
MARFMYKED

SEQ ID NO: 194481 - protein, 9 aa, Borrelia garinii
ARFMYKEDK

SEQ ID NO: 194482 - protein, 9 aa, Borrelia garinii
RFMYKEDKV

SEQ ID NO: 194483 - protein, 9 aa, Borrelia garinii
FMYKEDKVG

SEQ ID NO: 194484 - protein, 9 aa, Borrelia garinii
MYKEDKVGV

SEQ ID NO: 194485 - protein, 9 aa, Borrelia garinii
YKEDKVGVI

SEQ ID NO: 194486 - protein, 9 aa, Borrelia garinii
KEDKVGVIF

SEQ ID NO: 194487 - protein, 9 aa, Borrelia garinii
EDKVGVIFP

SEQ ID NO: 194488 - protein, 9 aa, Borrelia garinii
DKVGVIFPI

SEQ ID NO: 194489 - protein, 9 aa, Borrelia garinii
KVGVIFPIA

SEQ ID NO: 194490 - protein, 9 aa, Borrelia garinii
VGVIFPIAG

SEQ ID NO: 194491 - protein, 9 aa, Borrelia garinii
GVIFPIAGI

SEQ ID NO: 194492 - protein, 9 aa, Borrelia garinii
VIFPIAGIT

SEQ ID NO: 194493 - protein, 9 aa, Borrelia garinii
IFPIAGITG

SEQ ID NO: 194494 - protein, 9 aa, Borrelia garinii
FPIAGITGL

SEQ ID NO: 194495 - protein, 9 aa, Borrelia garinii
PIAGITGLG

SEQ ID NO: 194496 - protein, 9 aa, Borrelia garinii
IAGITGLGV

SEQ ID NO: 194497 - protein, 9 aa, Borrelia garinii
AGITGLGVY

SEQ ID NO: 194498 - protein, 9 aa, Borrelia garinii
GITGLGVYD

SEQ ID NO: 194499 - protein, 9 aa, Borrelia garinii
ITGLGVYDA

SEQ ID NO: 194500 - protein, 9 aa, Borrelia garinii
TGLGVYDAA

SEQ ID NO: 194501 - protein, 9 aa, Borrelia garinii
GLGVYDAAK

SEQ ID NO: 194502 - protein, 9 aa, Borrelia garinii
LGVYDAAKE

SEQ ID NO: 194503 - protein, 9 aa, Borrelia garinii
GVYDAAKEL

SEQ ID NO: 194504 - protein, 9 aa, Borrelia garinii
VYDAAKELG

SEQ ID NO: 194505 - protein, 9 aa, Borrelia garinii
YDAAKELGP

SEQ ID NO: 194506 - protein, 9 aa, Borrelia garinii
DAAKELGPK

SEQ ID NO: 194507 - protein, 9 aa, Borrelia garinii
AAKELGPKY

SEQ ID NO: 194508 - protein, 9 aa, Borrelia garinii
AKELGPKYY

SEQ ID NO: 194509 - protein, 9 aa, Borrelia garinii
KELGPKYYV

SEQ ID NO: 194510 - protein, 9 aa, Borrelia garinii
ELGPKYYVI

SEQ ID NO: 194511 - protein, 9 aa, Borrelia garinii
LGPKYYVIG

SEQ ID NO: 194512 - protein, 9 aa, Borrelia garinii
GPKYYVIGL

SEQ ID NO: 194513 - protein, 9 aa, Borrelia garinii
PKYYVIGLN

SEQ ID NO: 194514 - protein, 9 aa, Borrelia garinii
KYYVIGLNQ

SEQ ID NO: 194515 - protein, 9 aa, Borrelia garinii
YYVIGLNQD

SEQ ID NO: 194516 - protein, 9 aa, Borrelia garinii
YVIGLNQDQ

SEQ ID NO: 194517 - protein, 9 aa, Borrelia garinii
VIGLNQDQS

SEQ ID NO: 194518 - protein, 9 aa, Borrelia garinii
IGLNQDQSY

SEQ ID NO: 194519 - protein, 9 aa, Borrelia garinii
GLNQDQSYI

SEQ ID NO: 194520 - protein, 9 aa, Borrelia garinii
LNQDQSYIA

SEQ ID NO: 194521 - protein, 9 aa, Borrelia garinii
NQDQSYIAP

SEQ ID NO: 194522 - protein, 9 aa, Borrelia garinii
QDQSYIAPQ

SEQ ID NO: 194523 - protein, 9 aa, Borrelia garinii
DQSYIAPQN

SEQ ID NO: 194524 - protein, 9 aa, Borrelia garinii
QSYIAPQNV

SEQ ID NO: 194525 - protein, 9 aa, Borrelia garinii
SYIAPQNVI

SEQ ID NO: 194526 - protein, 9 aa, Borrelia garinii
YIAPQNVIT

SEQ ID NO: 194527 - protein, 9 aa, Borrelia garinii
IAPQNVITS

SEQ ID NO: 194528 - protein, 9 aa, Borrelia garinii
APQNVITSV

SEQ ID NO: 194529 - protein, 9 aa, Borrelia garinii
PQNVITSVL

SEQ ID NO: 194530 - protein, 9 aa, Borrelia garinii
QNVITSVLK

SEQ ID NO: 194531 - protein, 9 aa, Borrelia garinii
NVITSVLKD

SEQ ID NO: 194532 - protein, 9 aa, Borrelia garinii
VITSVLKDI

SEQ ID NO: 194533 - protein, 9 aa, Borrelia garinii
ITSVLKDIG

SEQ ID NO: 194534 - protein, 9 aa, Borrelia garinii
TSVLKDIGK

SEQ ID NO: 194535 - protein, 9 aa, Borrelia garinii
SVLKDIGKV

SEQ ID NO: 194536 - protein, 9 aa, Borrelia garinii
VLKDIGKVI

SEQ ID NO: 194537 - protein, 9 aa, Borrelia garinii
LKDIGKVIY

SEQ ID NO: 194538 - protein, 9 aa, Borrelia garinii
KDIGKVIYS

SEQ ID NO: 194539 - protein, 9 aa, Borrelia garinii
DIGKVIYSV

SEQ ID NO: 194540 - protein, 9 aa, Borrelia garinii
IGKVIYSVS

SEQ ID NO: 194541 - protein, 9 aa, Borrelia garinii
GKVIYSVSS

SEQ ID NO: 194542 - protein, 9 aa, Borrelia garinii
KVIYSVSSD

SEQ ID NO: 194543 - protein, 9 aa, Borrelia garinii
VIYSVSSDY

SEQ ID NO: 194544 - protein, 9 aa, Borrelia garinii
IYSVSSDYI

SEQ ID NO: 194545 - protein, 9 aa, Borrelia garinii
YSVSSDYIK

SEQ ID NO: 194546 - protein, 9 aa, Borrelia garinii
SVSSDYIKN

SEQ ID NO: 194547 - protein, 9 aa, Borrelia garinii
VSSDYIKNG

SEQ ID NO: 194548 - protein, 9 aa, Borrelia garinii
SSDYIKNGV

SEQ ID NO: 194549 - protein, 9 aa, Borrelia garinii
SDYIKNGVF

SEQ ID NO: 194550 - protein, 9 aa, Borrelia garinii
DYIKNGVFK

SEQ ID NO: 194551 - protein, 9 aa, Borrelia garinii
YIKNGVFKG

SEQ ID NO: 194552 - protein, 9 aa, Borrelia garinii
IKNGVFKGG

SEQ ID NO: 194553 - protein, 9 aa, Borrelia garinii
KNGVFKGGV

SEQ ID NO: 194554 - protein, 9 aa, Borrelia garinii
NGVFKGGVV

SEQ ID NO: 194555 - protein, 9 aa, Borrelia garinii
GVFKGGVVI

SEQ ID NO: 194556 - protein, 9 aa, Borrelia garinii
VFKGGVVID

SEQ ID NO: 194557 - protein, 9 aa, Borrelia garinii
FKGGVVIDR

SEQ ID NO: 194558 - protein, 9 aa, Borrelia garinii
KGGVVIDRG

SEQ ID NO: 194559 - protein, 9 aa, Borrelia garinii
GGVVIDRGL

SEQ ID NO: 194560 - protein, 9 aa, Borrelia garinii
GVVIDRGLK

SEQ ID NO: 194561 - protein, 9 aa, Borrelia garinii
VVIDRGLKE

SEQ ID NO: 194562 - protein, 9 aa, Borrelia garinii
VIDRGLKEG

SEQ ID NO: 194563 - protein, 9 aa, Borrelia garinii
IDRGLKEGV

SEQ ID NO: 194564 - protein, 9 aa, Borrelia garinii
DRGLKEGVI

SEQ ID NO: 194565 - protein, 9 aa, Borrelia garinii
RGLKEGVIE

SEQ ID NO: 194566 - protein, 9 aa, Borrelia garinii
GLKEGVIEI

SEQ ID NO: 194567 - protein, 9 aa, Borrelia garinii
LKEGVIEIV

SEQ ID NO: 194568 - protein, 9 aa, Borrelia garinii
KEGVIEIVK

SEQ ID NO: 194569 - protein, 9 aa, Borrelia garinii
EGVIEIVKD

SEQ ID NO: 194570 - protein, 9 aa, Borrelia garinii
GVIEIVKDP

SEQ ID NO: 194571 - protein, 9 aa, Borrelia garinii
VIEIVKDPD

SEQ ID NO: 194572 - protein, 9 aa, Borrelia garinii
IEIVKDPDV

SEQ ID NO: 194573 - protein, 9 aa, Borrelia garinii
EIVKDPDVL

SEQ ID NO: 194574 - protein, 9 aa, Borrelia garinii
IVKDPDVLN

SEQ ID NO: 194575 - protein, 9 aa, Borrelia garinii
VKDPDVLNN

SEQ ID NO: 194576 - protein, 9 aa, Borrelia garinii
KDPDVLNNR

SEQ ID NO: 194577 - protein, 9 aa, Borrelia garinii
DPDVLNNRL

SEQ ID NO: 194578 - protein, 9 aa, Borrelia garinii
PDVLNNRLV

SEQ ID NO: 194579 - protein, 9 aa, Borrelia garinii
DVLNNRLVN

SEQ ID NO: 194580 - protein, 9 aa, Borrelia garinii
VLNNRLVNE

SEQ ID NO: 194581 - protein, 9 aa, Borrelia garinii
LNNRLVNEV

SEQ ID NO: 194582 - protein, 9 aa, Borrelia garinii
NNRLVNEVV

SEQ ID NO: 194583 - protein, 9 aa, Borrelia garinii
NRLVNEVVE

SEQ ID NO: 194584 - protein, 9 aa, Borrelia garinii
RLVNEVVEL

SEQ ID NO: 194585 - protein, 9 aa, Borrelia garinii
LVNEVVELE

SEQ ID NO: 194586 - protein, 9 aa, Borrelia garinii
VNEVVELEN

SEQ ID NO: 194587 - protein, 9 aa, Borrelia garinii
NEVVELENK

SEQ ID NO: 194588 - protein, 9 aa, Borrelia garinii
EVVELENKI

SEQ ID NO: 194589 - protein, 9 aa, Borrelia garinii
VVELENKII

SEQ ID NO: 194590 - protein, 9 aa, Borrelia garinii
VELENKIIS

SEQ ID NO: 194591 - protein, 9 aa, Borrelia garinii
ELENKIISG

SEQ ID NO: 194592 - protein, 9 aa, Borrelia garinii
LENKIISGE

SEQ ID NO: 194593 - protein, 9 aa, Borrelia garinii
ENKIISGEI

SEQ ID NO: 194594 - protein, 9 aa, Borrelia garinii
NKIISGEII

SEQ ID NO: 194595 - protein, 9 aa, Borrelia garinii
KIISGEIIV

SEQ ID NO: 194596 - protein, 9 aa, Borrelia garinii
IISGEIIVP

SEQ ID NO: 194597 - protein, 9 aa, Borrelia garinii
ISGEIIVPD

SEQ ID NO: 194598 - protein, 9 aa, Borrelia garinii
SGEIIVPDS

SEQ ID NO: 194599 - protein, 9 aa, Borrelia garinii
GEIIVPDSE

SEQ ID NO: 194600 - protein, 9 aa, Borrelia garinii
EIIVPDSEY

SEQ ID NO: 194601 - protein, 9 aa, Borrelia garinii
IIVPDSEYA

SEQ ID NO: 194602 - protein, 9 aa, Borrelia garinii
IVPDSEYAF

SEQ ID NO: 194603 - protein, 9 aa, Borrelia garinii
VPDSEYAFD

SEQ ID NO: 194604 - protein, 9 aa, Borrelia garinii
PDSEYAFDL

SEQ ID NO: 194605 - protein, 9 aa, Borrelia garinii
DSEYAFDLF

SEQ ID NO: 194606 - protein, 9 aa, Borrelia garinii
SEYAFDLFK

SEQ ID NO: 194607 - protein, 9 aa, Borrelia garinii
EYAFDLFKS

SEQ ID NO: 194608 - protein, 9 aa, Borrelia garinii
YAFDLFKSK

SEQ ID NO: 194609 - protein, 9 aa, Borrelia garinii
AFDLFKSKL

SEQ ID NO: 194610 - protein, 10 aa, Borrelia garinii
MFKRFVFIAL

SEQ ID NO: 194611 - protein, 10 aa, Borrelia garinii
FKRFVFIALS

SEQ ID NO: 194612 - protein, 10 aa, Borrelia garinii
KRFVFIALSL

SEQ ID NO: 194613 - protein, 10 aa, Borrelia garinii
RFVFIALSLL

SEQ ID NO: 194614 - protein, 10 aa, Borrelia garinii
FVFIALSLLV

SEQ ID NO: 194615 - protein, 10 aa, Borrelia garinii
VFIALSLLVL

SEQ ID NO: 194616 - protein, 10 aa, Borrelia garinii
FIALSLLVLA

SEQ ID NO: 194617 - protein, 10 aa, Borrelia garinii
IALSLLVLAC

SEQ ID NO: 194618 - protein, 10 aa, Borrelia garinii
ALSLLVLACF

SEQ ID NO: 194619 - protein, 10 aa, Borrelia garinii
LSLLVLACFK

SEQ ID NO: 194620 - protein, 10 aa, Borrelia garinii
SLLVLACFKS

SEQ ID NO: 194621 - protein, 10 aa, Borrelia garinii
LLVLACFKSN

SEQ ID NO: 194622 - protein, 10 aa, Borrelia garinii
LVLACFKSNK

SEQ ID NO: 194623 - protein, 10 aa, Borrelia garinii
VLACFKSNKK

SEQ ID NO: 194624 - protein, 10 aa, Borrelia garinii
LACFKSNKKS

SEQ ID NO: 194625 - protein, 10 aa, Borrelia garinii
ACFKSNKKSV

SEQ ID NO: 194626 - protein, 10 aa, Borrelia garinii
CFKSNKKSVK

SEQ ID NO: 194627 - protein, 10 aa, Borrelia garinii
FKSNKKSVKS

SEQ ID NO: 194628 - protein, 10 aa, Borrelia garinii
KSNKKSVKSD

SEQ ID NO: 194629 - protein, 10 aa, Borrelia garinii
SNKKSVKSDK

SEQ ID NO: 194630 - protein, 10 aa, Borrelia garinii
NKKSVKSDKV

SEQ ID NO: 194631 - protein, 10 aa, Borrelia garinii
KKSVKSDKVI

SEQ ID NO: 194632 - protein, 10 aa, Borrelia garinii
KSVKSDKVII

SEQ ID NO: 194633 - protein, 10 aa, Borrelia garinii
SVKSDKVIIG

SEQ ID NO: 194634 - protein, 10 aa, Borrelia garinii
VKSDKVIIGV

SEQ ID NO: 194635 - protein, 10 aa, Borrelia garinii
KSDKVIIGVL

SEQ ID NO: 194636 - protein, 10 aa, Borrelia garinii
SDKVIIGVLA

SEQ ID NO: 194637 - protein, 10 aa, Borrelia garinii
DKVIIGVLAN

SEQ ID NO: 194638 - protein, 10 aa, Borrelia garinii
KVIIGVLANG

SEQ ID NO: 194639 - protein, 10 aa, Borrelia garinii
VIIGVLANGS

SEQ ID NO: 194640 - protein, 10 aa, Borrelia garinii
IIGVLANGSF

SEQ ID NO: 194641 - protein, 10 aa, Borrelia garinii
IGVLANGSFY

SEQ ID NO: 194642 - protein, 10 aa, Borrelia garinii
GVLANGSFYD

SEQ ID NO: 194643 - protein, 10 aa, Borrelia garinii
VLANGSFYDK

SEQ ID NO: 194644 - protein, 10 aa, Borrelia garinii
LANGSFYDKG

SEQ ID NO: 194645 - protein, 10 aa, Borrelia garinii
ANGSFYDKGY

SEQ ID NO: 194646 - protein, 10 aa, Borrelia garinii
NGSFYDKGYN

SEQ ID NO: 194647 - protein, 10 aa, Borrelia garinii
GSFYDKGYNQ

SEQ ID NO: 194648 - protein, 10 aa, Borrelia garinii
SFYDKGYNQS

SEQ ID NO: 194649 - protein, 10 aa, Borrelia garinii
FYDKGYNQSV

SEQ ID NO: 194650 - protein, 10 aa, Borrelia garinii
YDKGYNQSVY

SEQ ID NO: 194651 - protein, 10 aa, Borrelia garinii
DKGYNQSVYD

SEQ ID NO: 194652 - protein, 10 aa, Borrelia garinii
KGYNQSVYDG

SEQ ID NO: 194653 - protein, 10 aa, Borrelia garinii
GYNQSVYDGV

SEQ ID NO: 194654 - protein, 10 aa, Borrelia garinii
YNQSVYDGVV

SEQ ID NO: 194655 - protein, 10 aa, Borrelia garinii
NQSVYDGVVK

SEQ ID NO: 194656 - protein, 10 aa, Borrelia garinii
QSVYDGVVKL

SEQ ID NO: 194657 - protein, 10 aa, Borrelia garinii
SVYDGVVKLK

SEQ ID NO: 194658 - protein, 10 aa, Borrelia garinii
VYDGVVKLKD

SEQ ID NO: 194659 - protein, 10 aa, Borrelia garinii
YDGVVKLKDD

SEQ ID NO: 194660 - protein, 10 aa, Borrelia garinii
DGVVKLKDDF

SEQ ID NO: 194661 - protein, 10 aa, Borrelia garinii
GVVKLKDDFG

SEQ ID NO: 194662 - protein, 10 aa, Borrelia garinii
VVKLKDDFGI

SEQ ID NO: 194663 - protein, 10 aa, Borrelia garinii
VKLKDDFGIK

SEQ ID NO: 194664 - protein, 10 aa, Borrelia garinii
KLKDDFGIKL

SEQ ID NO: 194665 - protein, 10 aa, Borrelia garinii
LKDDFGIKLI

SEQ ID NO: 194666 - protein, 10 aa, Borrelia garinii
KDDFGIKLIT

SEQ ID NO: 194667 - protein, 10 aa, Borrelia garinii
DDFGIKLITK

SEQ ID NO: 194668 - protein, 10 aa, Borrelia garinii
DFGIKLITKS

SEQ ID NO: 194669 - protein, 10 aa, Borrelia garinii
FGIKLITKSL

SEQ ID NO: 194670 - protein, 10 aa, Borrelia garinii
GIKLITKSLR

SEQ ID NO: 194671 - protein, 10 aa, Borrelia garinii
IKLITKSLRP

SEQ ID NO: 194672 - protein, 10 aa, Borrelia garinii
KLITKSLRPY

SEQ ID NO: 194673 - protein, 10 aa, Borrelia garinii
LITKSLRPYP

SEQ ID NO: 194674 - protein, 10 aa, Borrelia garinii
ITKSLRPYPI

SEQ ID NO: 194675 - protein, 10 aa, Borrelia garinii
TKSLRPYPIE

SEQ ID NO: 194676 - protein, 10 aa, Borrelia garinii
KSLRPYPIEG

SEQ ID NO: 194677 - protein, 10 aa, Borrelia garinii
SLRPYPIEGK

SEQ ID NO: 194678 - protein, 10 aa, Borrelia garinii
LRPYPIEGKR

SEQ ID NO: 194679 - protein, 10 aa, Borrelia garinii
RPYPIEGKRL

SEQ ID NO: 194680 - protein, 10 aa, Borrelia garinii
PYPIEGKRLL

SEQ ID NO: 194681 - protein, 10 aa, Borrelia garinii
YPIEGKRLLT

SEQ ID NO: 194682 - protein, 10 aa, Borrelia garinii
PIEGKRLLTV

SEQ ID NO: 194683 - protein, 10 aa, Borrelia garinii
IEGKRLLTVN

SEQ ID NO: 194684 - protein, 10 aa, Borrelia garinii
EGKRLLTVNE

SEQ ID NO: 194685 - protein, 10 aa, Borrelia garinii
GKRLLTVNEA

SEQ ID NO: 194686 - protein, 10 aa, Borrelia garinii
KRLLTVNEAM

SEQ ID NO: 194687 - protein, 10 aa, Borrelia garinii
RLLTVNEAMA

SEQ ID NO: 194688 - protein, 10 aa, Borrelia garinii
LLTVNEAMAE

SEQ ID NO: 194689 - protein, 10 aa, Borrelia garinii
LTVNEAMAED

SEQ ID NO: 194690 - protein, 10 aa, Borrelia garinii
TVNEAMAEDA

SEQ ID NO: 194691 - protein, 10 aa, Borrelia garinii
VNEAMAEDAY

SEQ ID NO: 194692 - protein, 10 aa, Borrelia garinii
NEAMAEDAYE

SEQ ID NO: 194693 - protein, 10 aa, Borrelia garinii
EAMAEDAYEV

SEQ ID NO: 194694 - protein, 10 aa, Borrelia garinii
AMAEDAYEVQ

SEQ ID NO: 194695 - protein, 10 aa, Borrelia garinii
MAEDAYEVQK

SEQ ID NO: 194696 - protein, 10 aa, Borrelia garinii
AEDAYEVQKN

SEQ ID NO: 194697 - protein, 10 aa, Borrelia garinii
EDAYEVQKNP

SEQ ID NO: 194698 - protein, 10 aa, Borrelia garinii
DAYEVQKNPL

SEQ ID NO: 194699 - protein, 10 aa, Borrelia garinii
AYEVQKNPLN

SEQ ID NO: 194700 - protein, 10 aa, Borrelia garinii
YEVQKNPLNL

SEQ ID NO: 194701 - protein, 10 aa, Borrelia garinii
EVQKNPLNLF

SEQ ID NO: 194702 - protein, 10 aa, Borrelia garinii
VQKNPLNLFW

SEQ ID NO: 194703 - protein, 10 aa, Borrelia garinii
QKNPLNLFWL

SEQ ID NO: 194704 - protein, 10 aa, Borrelia garinii
KNPLNLFWLA

SEQ ID NO: 194705 - protein, 10 aa, Borrelia garinii
NPLNLFWLAG

SEQ ID NO: 194706 - protein, 10 aa, Borrelia garinii
PLNLFWLAGY

SEQ ID NO: 194707 - protein, 10 aa, Borrelia garinii
LNLFWLAGYQ

SEQ ID NO: 194708 - protein, 10 aa, Borrelia garinii
NLFWLAGYQF

SEQ ID NO: 194709 - protein, 10 aa, Borrelia garinii
LFWLAGYQFS

SEQ ID NO: 194710 - protein, 10 aa, Borrelia garinii
FWLAGYQFSS

SEQ ID NO: 194711 - protein, 10 aa, Borrelia garinii
WLAGYQFSSL

SEQ ID NO: 194712 - protein, 10 aa, Borrelia garinii
LAGYQFSSLS

SEQ ID NO: 194713 - protein, 10 aa, Borrelia garinii
AGYQFSSLSV

SEQ ID NO: 194714 - protein, 10 aa, Borrelia garinii
GYQFSSLSVK

SEQ ID NO: 194715 - protein, 10 aa, Borrelia garinii
YQFSSLSVKL

SEQ ID NO: 194716 - protein, 10 aa, Borrelia garinii
QFSSLSVKLS

SEQ ID NO: 194717 - protein, 10 aa, Borrelia garinii
FSSLSVKLSY

SEQ ID NO: 194718 - protein, 10 aa, Borrelia garinii
SSLSVKLSYE

SEQ ID NO: 194719 - protein, 10 aa, Borrelia garinii
SLSVKLSYER

SEQ ID NO: 194720 - protein, 10 aa, Borrelia garinii
LSVKLSYERP

SEQ ID NO: 194721 - protein, 10 aa, Borrelia garinii
SVKLSYERPD

SEQ ID NO: 194722 - protein, 10 aa, Borrelia garinii
VKLSYERPDI

SEQ ID NO: 194723 - protein, 10 aa, Borrelia garinii
KLSYERPDIY

SEQ ID NO: 194724 - protein, 10 aa, Borrelia garinii
LSYERPDIYY

SEQ ID NO: 194725 - protein, 10 aa, Borrelia garinii
SYERPDIYYG

SEQ ID NO: 194726 - protein, 10 aa, Borrelia garinii
YERPDIYYGI

SEQ ID NO: 194727 - protein, 10 aa, Borrelia garinii
ERPDIYYGII

SEQ ID NO: 194728 - protein, 10 aa, Borrelia garinii
RPDIYYGIID

SEQ ID NO: 194729 - protein, 10 aa, Borrelia garinii
PDIYYGIIDA

SEQ ID NO: 194730 - protein, 10 aa, Borrelia garinii
DIYYGIIDAF

SEQ ID NO: 194731 - protein, 10 aa, Borrelia garinii
IYYGIIDAFD

SEQ ID NO: 194732 - protein, 10 aa, Borrelia garinii
YYGIIDAFDY

SEQ ID NO: 194733 - protein, 10 aa, Borrelia garinii
YGIIDAFDYG

SEQ ID NO: 194734 - protein, 10 aa, Borrelia garinii
GIIDAFDYGD

SEQ ID NO: 194735 - protein, 10 aa, Borrelia garinii
IIDAFDYGDI

SEQ ID NO: 194736 - protein, 10 aa, Borrelia garinii
IDAFDYGDIQ

SEQ ID NO: 194737 - protein, 10 aa, Borrelia garinii
DAFDYGDIQV

SEQ ID NO: 194738 - protein, 10 aa, Borrelia garinii
AFDYGDIQVP

SEQ ID NO: 194739 - protein, 10 aa, Borrelia garinii
FDYGDIQVPK

SEQ ID NO: 194740 - protein, 10 aa, Borrelia garinii
DYGDIQVPKN

SEQ ID NO: 194741 - protein, 10 aa, Borrelia garinii
YGDIQVPKNS

SEQ ID NO: 194742 - protein, 10 aa, Borrelia garinii
GDIQVPKNSL

SEQ ID NO: 194743 - protein, 10 aa, Borrelia garinii
DIQVPKNSLA

SEQ ID NO: 194744 - protein, 10 aa, Borrelia garinii
IQVPKNSLAI

SEQ ID NO: 194745 - protein, 10 aa, Borrelia garinii
QVPKNSLAIK

SEQ ID NO: 194746 - protein, 10 aa, Borrelia garinii
VPKNSLAIKF

SEQ ID NO: 194747 - protein, 10 aa, Borrelia garinii
PKNSLAIKFR

SEQ ID NO: 194748 - protein, 10 aa, Borrelia garinii
KNSLAIKFRN

SEQ ID NO: 194749 - protein, 10 aa, Borrelia garinii
NSLAIKFRNE

SEQ ID NO: 194750 - protein, 10 aa, Borrelia garinii
SLAIKFRNEE

SEQ ID NO: 194751 - protein, 10 aa, Borrelia garinii
LAIKFRNEEA

SEQ ID NO: 194752 - protein, 10 aa, Borrelia garinii
AIKFRNEEAA

SEQ ID NO: 194753 - protein, 10 aa, Borrelia garinii
IKFRNEEAAF

SEQ ID NO: 194754 - protein, 10 aa, Borrelia garinii
KFRNEEAAFL

SEQ ID NO: 194755 - protein, 10 aa, Borrelia garinii
FRNEEAAFLA

SEQ ID NO: 194756 - protein, 10 aa, Borrelia garinii
RNEEAAFLAG

SEQ ID NO: 194757 - protein, 10 aa, Borrelia garinii
NEEAAFLAGY

SEQ ID NO: 194758 - protein, 10 aa, Borrelia garinii
EEAAFLAGYI

SEQ ID NO: 194759 - protein, 10 aa, Borrelia garinii
EAAFLAGYIA

SEQ ID NO: 194760 - protein, 10 aa, Borrelia garinii
AAFLAGYIAA

SEQ ID NO: 194761 - protein, 10 aa, Borrelia garinii
AFLAGYIAAK

SEQ ID NO: 194762 - protein, 10 aa, Borrelia garinii
FLAGYIAAKM

SEQ ID NO: 194763 - protein, 10 aa, Borrelia garinii
LAGYIAAKMS

SEQ ID NO: 194764 - protein, 10 aa, Borrelia garinii
AGYIAAKMSR

SEQ ID NO: 194765 - protein, 10 aa, Borrelia garinii
GYIAAKMSRK

SEQ ID NO: 194766 - protein, 10 aa, Borrelia garinii
YIAAKMSRKE

SEQ ID NO: 194767 - protein, 10 aa, Borrelia garinii
IAAKMSRKEK

SEQ ID NO: 194768 - protein, 10 aa, Borrelia garinii
AAKMSRKEKI

SEQ ID NO: 194769 - protein, 10 aa, Borrelia garinii
AKMSRKEKIG

SEQ ID NO: 194770 - protein, 10 aa, Borrelia garinii
KMSRKEKIGF

SEQ ID NO: 194771 - protein, 10 aa, Borrelia garinii
MSRKEKIGFL

SEQ ID NO: 194772 - protein, 10 aa, Borrelia garinii
SRKEKIGFLT

SEQ ID NO: 194773 - protein, 10 aa, Borrelia garinii
RKEKIGFLTG

SEQ ID NO: 194774 - protein, 10 aa, Borrelia garinii
KEKIGFLTGP

SEQ ID NO: 194775 - protein, 10 aa, Borrelia garinii
EKIGFLTGPE

SEQ ID NO: 194776 - protein, 10 aa, Borrelia garinii
KIGFLTGPES

SEQ ID NO: 194777 - protein, 10 aa, Borrelia garinii
IGFLTGPESE

SEQ ID NO: 194778 - protein, 10 aa, Borrelia garinii
GFLTGPESEY

SEQ ID NO: 194779 - protein, 10 aa, Borrelia garinii
FLTGPESEYL

SEQ ID NO: 194780 - protein, 10 aa, Borrelia garinii
LTGPESEYLN

SEQ ID NO: 194781 - protein, 10 aa, Borrelia garinii
TGPESEYLND

SEQ ID NO: 194782 - protein, 10 aa, Borrelia garinii
GPESEYLNDF

SEQ ID NO: 194783 - protein, 10 aa, Borrelia garinii
PESEYLNDFK

SEQ ID NO: 194784 - protein, 10 aa, Borrelia garinii
ESEYLNDFKF

SEQ ID NO: 194785 - protein, 10 aa, Borrelia garinii
SEYLNDFKFG

SEQ ID NO: 194786 - protein, 10 aa, Borrelia garinii
EYLNDFKFGF

SEQ ID NO: 194787 - protein, 10 aa, Borrelia garinii
YLNDFKFGFK

SEQ ID NO: 194788 - protein, 10 aa, Borrelia garinii
LNDFKFGFKA

SEQ ID NO: 194789 - protein, 10 aa, Borrelia garinii
NDFKFGFKAG

SEQ ID NO: 194790 - protein, 10 aa, Borrelia garinii
DFKFGFKAGI

SEQ ID NO: 194791 - protein, 10 aa, Borrelia garinii
FKFGFKAGIF

SEQ ID NO: 194792 - protein, 10 aa, Borrelia garinii
KFGFKAGIFY

SEQ ID NO: 194793 - protein, 10 aa, Borrelia garinii
FGFKAGIFYA

SEQ ID NO: 194794 - protein, 10 aa, Borrelia garinii
GFKAGIFYAN

SEQ ID NO: 194795 - protein, 10 aa, Borrelia garinii
FKAGIFYANP

SEQ ID NO: 194796 - protein, 10 aa, Borrelia garinii
KAGIFYANPK

SEQ ID NO: 194797 - protein, 10 aa, Borrelia garinii
AGIFYANPKL

SEQ ID NO: 194798 - protein, 10 aa, Borrelia garinii
GIFYANPKLR

SEQ ID NO: 194799 - protein, 10 aa, Borrelia garinii
IFYANPKLRL

SEQ ID NO: 194800 - protein, 10 aa, Borrelia garinii
FYANPKLRLV

SEQ ID NO: 194801 - protein, 10 aa, Borrelia garinii
YANPKLRLVS

SEQ ID NO: 194802 - protein, 10 aa, Borrelia garinii
ANPKLRLVSK

SEQ ID NO: 194803 - protein, 10 aa, Borrelia garinii
NPKLRLVSKK

SEQ ID NO: 194804 - protein, 10 aa, Borrelia garinii
PKLRLVSKKA

SEQ ID NO: 194805 - protein, 10 aa, Borrelia garinii
KLRLVSKKAP

SEQ ID NO: 194806 - protein, 10 aa, Borrelia garinii
LRLVSKKAPS

SEQ ID NO: 194807 - protein, 10 aa, Borrelia garinii
RLVSKKAPSL

SEQ ID NO: 194808 - protein, 10 aa, Borrelia garinii
LVSKKAPSLF

SEQ ID NO: 194809 - protein, 10 aa, Borrelia garinii
VSKKAPSLFD

SEQ ID NO: 194810 - protein, 10 aa, Borrelia garinii
SKKAPSLFDK

SEQ ID NO: 194811 - protein, 10 aa, Borrelia garinii
KKAPSLFDKE

SEQ ID NO: 194812 - protein, 10 aa, Borrelia garinii
KAPSLFDKEK

SEQ ID NO: 194813 - protein, 10 aa, Borrelia garinii
APSLFDKEKG

SEQ ID NO: 194814 - protein, 10 aa, Borrelia garinii
PSLFDKEKGK

SEQ ID NO: 194815 - protein, 10 aa, Borrelia garinii
SLFDKEKGKE

SEQ ID NO: 194816 - protein, 10 aa, Borrelia garinii
LFDKEKGKEM

SEQ ID NO: 194817 - protein, 10 aa, Borrelia garinii
FDKEKGKEMA

SEQ ID NO: 194818 - protein, 10 aa, Borrelia garinii
DKEKGKEMAR

SEQ ID NO: 194819 - protein, 10 aa, Borrelia garinii
KEKGKEMARF

SEQ ID NO: 194820 - protein, 10 aa, Borrelia garinii
EKGKEMARFM

SEQ ID NO: 194821 - protein, 10 aa, Borrelia garinii
KGKEMARFMY

SEQ ID NO: 194822 - protein, 10 aa, Borrelia garinii
GKEMARFMYK

SEQ ID NO: 194823 - protein, 10 aa, Borrelia garinii
KEMARFMYKE

SEQ ID NO: 194824 - protein, 10 aa, Borrelia garinii
EMARFMYKED

SEQ ID NO: 194825 - protein, 10 aa, Borrelia garinii
MARFMYKEDK

SEQ ID NO: 194826 - protein, 10 aa, Borrelia garinii
ARFMYKEDKV

SEQ ID NO: 194827 - protein, 10 aa, Borrelia garinii
RFMYKEDKVG

SEQ ID NO: 194828 - protein, 10 aa, Borrelia garinii
FMYKEDKVGV

SEQ ID NO: 194829 - protein, 10 aa, Borrelia garinii
MYKEDKVGVI

SEQ ID NO: 194830 - protein, 10 aa, Borrelia garinii
YKEDKVGVIF

SEQ ID NO: 194831 - protein, 10 aa, Borrelia garinii
KEDKVGVIFP

SEQ ID NO: 194832 - protein, 10 aa, Borrelia garinii
EDKVGVIFPI

SEQ ID NO: 194833 - protein, 10 aa, Borrelia garinii
DKVGVIFPIA

SEQ ID NO: 194834 - protein, 10 aa, Borrelia garinii
KVGVIFPIAG

SEQ ID NO: 194835 - protein, 10 aa, Borrelia garinii
VGVIFPIAGI

SEQ ID NO: 194836 - protein, 10 aa, Borrelia garinii
GVIFPIAGIT

SEQ ID NO: 194837 - protein, 10 aa, Borrelia garinii
VIFPIAGITG

SEQ ID NO: 194838 - protein, 10 aa, Borrelia garinii
IFPIAGITGL

SEQ ID NO: 194839 - protein, 10 aa, Borrelia garinii
FPIAGITGLG

SEQ ID NO: 194840 - protein, 10 aa, Borrelia garinii
PIAGITGLGV

SEQ ID NO: 194841 - protein, 10 aa, Borrelia garinii
IAGITGLGVY

SEQ ID NO: 194842 - protein, 10 aa, Borrelia garinii
AGITGLGVYD

SEQ ID NO: 194843 - protein, 10 aa, Borrelia garinii
GITGLGVYDA

SEQ ID NO: 194844 - protein, 10 aa, Borrelia garinii
ITGLGVYDAA

SEQ ID NO: 194845 - protein, 10 aa, Borrelia garinii
TGLGVYDAAK

SEQ ID NO: 194846 - protein, 10 aa, Borrelia garinii
GLGVYDAAKE

SEQ ID NO: 194847 - protein, 10 aa, Borrelia garinii
LGVYDAAKEL

SEQ ID NO: 194848 - protein, 10 aa, Borrelia garinii
GVYDAAKELG

SEQ ID NO: 194849 - protein, 10 aa, Borrelia garinii
VYDAAKELGP

SEQ ID NO: 194850 - protein, 10 aa, Borrelia garinii
YDAAKELGPK

SEQ ID NO: 194851 - protein, 10 aa, Borrelia garinii
DAAKELGPKY

SEQ ID NO: 194852 - protein, 10 aa, Borrelia garinii
AAKELGPKYY

SEQ ID NO: 194853 - protein, 10 aa, Borrelia garinii
AKELGPKYYV

SEQ ID NO: 194854 - protein, 10 aa, Borrelia garinii
KELGPKYYVI

SEQ ID NO: 194855 - protein, 10 aa, Borrelia garinii
ELGPKYYVIG

SEQ ID NO: 194856 - protein, 10 aa, Borrelia garinii
LGPKYYVIGL

SEQ ID NO: 194857 - protein, 10 aa, Borrelia garinii
GPKYYVIGLN

SEQ ID NO: 194858 - protein, 10 aa, Borrelia garinii
PKYYVIGLNQ

SEQ ID NO: 194859 - protein, 10 aa, Borrelia garinii
KYYVIGLNQD

SEQ ID NO: 194860 - protein, 10 aa, Borrelia garinii
YYVIGLNQDQ

SEQ ID NO: 194861 - protein, 10 aa, Borrelia garinii
YVIGLNQDQS

SEQ ID NO: 194862 - protein, 10 aa, Borrelia garinii
VIGLNQDQSY

SEQ ID NO: 194863 - protein, 10 aa, Borrelia garinii
IGLNQDQSYI

SEQ ID NO: 194864 - protein, 10 aa, Borrelia garinii
GLNQDQSYIA

SEQ ID NO: 194865 - protein, 10 aa, Borrelia garinii
LNQDQSYIAP

SEQ ID NO: 194866 - protein, 10 aa, Borrelia garinii
NQDQSYIAPQ

SEQ ID NO: 194867 - protein, 10 aa, Borrelia garinii
QDQSYIAPQN

SEQ ID NO: 194868 - protein, 10 aa, Borrelia garinii
DQSYIAPQNV

SEQ ID NO: 194869 - protein, 10 aa, Borrelia garinii
QSYIAPQNVI

SEQ ID NO: 194870 - protein, 10 aa, Borrelia garinii
SYIAPQNVIT

SEQ ID NO: 194871 - protein, 10 aa, Borrelia garinii
YIAPQNVITS

SEQ ID NO: 194872 - protein, 10 aa, Borrelia garinii
IAPQNVITSV

SEQ ID NO: 194873 - protein, 10 aa, Borrelia garinii
APQNVITSVL

SEQ ID NO: 194874 - protein, 10 aa, Borrelia garinii
PQNVITSVLK

SEQ ID NO: 194875 - protein, 10 aa, Borrelia garinii
QNVITSVLKD

SEQ ID NO: 194876 - protein, 10 aa, Borrelia garinii
NVITSVLKDI

SEQ ID NO: 194877 - protein, 10 aa, Borrelia garinii
VITSVLKDIG

SEQ ID NO: 194878 - protein, 10 aa, Borrelia garinii
ITSVLKDIGK

SEQ ID NO: 194879 - protein, 10 aa, Borrelia garinii
TSVLKDIGKV

SEQ ID NO: 194880 - protein, 10 aa, Borrelia garinii
SVLKDIGKVI

SEQ ID NO: 194881 - protein, 10 aa, Borrelia garinii
VLKDIGKVIY

SEQ ID NO: 194882 - protein, 10 aa, Borrelia garinii
LKDIGKVIYS

SEQ ID NO: 194883 - protein, 10 aa, Borrelia garinii
KDIGKVIYSV

SEQ ID NO: 194884 - protein, 10 aa, Borrelia garinii
DIGKVIYSVS

SEQ ID NO: 194885 - protein, 10 aa, Borrelia garinii
IGKVIYSVSS

SEQ ID NO: 194886 - protein, 10 aa, Borrelia garinii
GKVIYSVSSD

SEQ ID NO: 194887 - protein, 10 aa, Borrelia garinii
KVIYSVSSDY

SEQ ID NO: 194888 - protein, 10 aa, Borrelia garinii
VIYSVSSDYI

SEQ ID NO: 194889 - protein, 10 aa, Borrelia garinii
IYSVSSDYIK

SEQ ID NO: 194890 - protein, 10 aa, Borrelia garinii
YSVSSDYIKN

SEQ ID NO: 194891 - protein, 10 aa, Borrelia garinii
SVSSDYIKNG

SEQ ID NO: 194892 - protein, 10 aa, Borrelia garinii
VSSDYIKNGV

SEQ ID NO: 194893 - protein, 10 aa, Borrelia garinii
SSDYIKNGVF

SEQ ID NO: 194894 - protein, 10 aa, Borrelia garinii
SDYIKNGVFK

SEQ ID NO: 194895 - protein, 10 aa, Borrelia garinii
DYIKNGVFKG

SEQ ID NO: 194896 - protein, 10 aa, Borrelia garinii
YIKNGVFKGG

SEQ ID NO: 194897 - protein, 10 aa, Borrelia garinii
IKNGVFKGGV

SEQ ID NO: 194898 - protein, 10 aa, Borrelia garinii
KNGVFKGGVV

SEQ ID NO: 194899 - protein, 10 aa, Borrelia garinii
NGVFKGGVVI

SEQ ID NO: 194900 - protein, 10 aa, Borrelia garinii
GVFKGGVVID

SEQ ID NO: 194901 - protein, 10 aa, Borrelia garinii
VFKGGVVIDR

SEQ ID NO: 194902 - protein, 10 aa, Borrelia garinii
FKGGVVIDRG

SEQ ID NO: 194903 - protein, 10 aa, Borrelia garinii
KGGVVIDRGL

SEQ ID NO: 194904 - protein, 10 aa, Borrelia garinii
GGVVIDRGLK

SEQ ID NO: 194905 - protein, 10 aa, Borrelia garinii
GVVIDRGLKE

SEQ ID NO: 194906 - protein, 10 aa, Borrelia garinii
VVIDRGLKEG

SEQ ID NO: 194907 - protein, 10 aa, Borrelia garinii
VIDRGLKEGV

SEQ ID NO: 194908 - protein, 10 aa, Borrelia garinii
IDRGLKEGVI

SEQ ID NO: 194909 - protein, 10 aa, Borrelia garinii
DRGLKEGVIE

SEQ ID NO: 194910 - protein, 10 aa, Borrelia garinii
RGLKEGVIEI

SEQ ID NO: 194911 - protein, 10 aa, Borrelia garinii
GLKEGVIEIV

SEQ ID NO: 194912 - protein, 10 aa, Borrelia garinii
LKEGVIEIVK

SEQ ID NO: 194913 - protein, 10 aa, Borrelia garinii
KEGVIEIVKD

SEQ ID NO: 194914 - protein, 10 aa, Borrelia garinii
EGVIEIVKDP

SEQ ID NO: 194915 - protein, 10 aa, Borrelia garinii
GVIEIVKDPD

SEQ ID NO: 194916 - protein, 10 aa, Borrelia garinii
VIEIVKDPDV

SEQ ID NO: 194917 - protein, 10 aa, Borrelia garinii
IEIVKDPDVL

SEQ ID NO: 194918 - protein, 10 aa, Borrelia garinii
EIVKDPDVLN

SEQ ID NO: 194919 - protein, 10 aa, Borrelia garinii
IVKDPDVLNN

SEQ ID NO: 194920 - protein, 10 aa, Borrelia garinii
VKDPDVLNNR

SEQ ID NO: 194921 - protein, 10 aa, Borrelia garinii
KDPDVLNNRL

SEQ ID NO: 194922 - protein, 10 aa, Borrelia garinii
DPDVLNNRLV

SEQ ID NO: 194923 - protein, 10 aa, Borrelia garinii
PDVLNNRLVN

SEQ ID NO: 194924 - protein, 10 aa, Borrelia garinii
DVLNNRLVNE

SEQ ID NO: 194925 - protein, 10 aa, Borrelia garinii
VLNNRLVNEV

SEQ ID NO: 194926 - protein, 10 aa, Borrelia garinii
LNNRLVNEVV

SEQ ID NO: 194927 - protein, 10 aa, Borrelia garinii
NNRLVNEVVE

SEQ ID NO: 194928 - protein, 10 aa, Borrelia garinii
NRLVNEVVEL

SEQ ID NO: 194929 - protein, 10 aa, Borrelia garinii
RLVNEVVELE

SEQ ID NO: 194930 - protein, 10 aa, Borrelia garinii
LVNEVVELEN

SEQ ID NO: 194931 - protein, 10 aa, Borrelia garinii
VNEVVELENK

SEQ ID NO: 194932 - protein, 10 aa, Borrelia garinii
NEVVELENKI

SEQ ID NO: 194933 - protein, 10 aa, Borrelia garinii
EVVELENKII

SEQ ID NO: 194934 - protein, 10 aa, Borrelia garinii
VVELENKIIS

SEQ ID NO: 194935 - protein, 10 aa, Borrelia garinii
VELENKIISG

SEQ ID NO: 194936 - protein, 10 aa, Borrelia garinii
ELENKIISGE

SEQ ID NO: 194937 - protein, 10 aa, Borrelia garinii
LENKIISGEI

SEQ ID NO: 194938 - protein, 10 aa, Borrelia garinii
ENKIISGEII

SEQ ID NO: 194939 - protein, 10 aa, Borrelia garinii
NKIISGEIIV

SEQ ID NO: 194940 - protein, 10 aa, Borrelia garinii
KIISGEIIVP

SEQ ID NO: 194941 - protein, 10 aa, Borrelia garinii
IISGEIIVPD

SEQ ID NO: 194942 - protein, 10 aa, Borrelia garinii
ISGEIIVPDS

SEQ ID NO: 194943 - protein, 10 aa, Borrelia garinii
SGEIIVPDSE

SEQ ID NO: 194944 - protein, 10 aa, Borrelia garinii
GEIIVPDSEY

SEQ ID NO: 194945 - protein, 10 aa, Borrelia garinii
EIIVPDSEYA

SEQ ID NO: 194946 - protein, 10 aa, Borrelia garinii
IIVPDSEYAF

SEQ ID NO: 194947 - protein, 10 aa, Borrelia garinii
IVPDSEYAFD

SEQ ID NO: 194948 - protein, 10 aa, Borrelia garinii
VPDSEYAFDL

SEQ ID NO: 194949 - protein, 10 aa, Borrelia garinii
PDSEYAFDLF

SEQ ID NO: 194950 - protein, 10 aa, Borrelia garinii
DSEYAFDLFK

SEQ ID NO: 194951 - protein, 10 aa, Borrelia garinii
SEYAFDLFKS

SEQ ID NO: 194952 - protein, 10 aa, Borrelia garinii
EYAFDLFKSK

SEQ ID NO: 194953 - protein, 10 aa, Borrelia garinii
YAFDLFKSKL

SEQ ID NO: 194954 - protein, 11 aa, Borrelia garinii
MFKRFVFIALS

SEQ ID NO: 194955 - protein, 11 aa, Borrelia garinii
FKRFVFIALSL

SEQ ID NO: 194956 - protein, 11 aa, Borrelia garinii
KRFVFIALSLL

SEQ ID NO: 194957 - protein, 11 aa, Borrelia garinii
RFVFIALSLLV

SEQ ID NO: 194958 - protein, 11 aa, Borrelia garinii
FVFIALSLLVL

SEQ ID NO: 194959 - protein, 11 aa, Borrelia garinii
VFIALSLLVLA

SEQ ID NO: 194960 - protein, 11 aa, Borrelia garinii
FIALSLLVLAC

SEQ ID NO: 194961 - protein, 11 aa, Borrelia garinii
IALSLLVLACF

SEQ ID NO: 194962 - protein, 11 aa, Borrelia garinii
ALSLLVLACFK

SEQ ID NO: 194963 - protein, 11 aa, Borrelia garinii
LSLLVLACFKS

SEQ ID NO: 194964 - protein, 11 aa, Borrelia garinii
SLLVLACFKSN

SEQ ID NO: 194965 - protein, 11 aa, Borrelia garinii
LLVLACFKSNK

SEQ ID NO: 194966 - protein, 11 aa, Borrelia garinii
LVLACFKSNKK

SEQ ID NO: 194967 - protein, 11 aa, Borrelia garinii
VLACFKSNKKS

SEQ ID NO: 194968 - protein, 11 aa, Borrelia garinii
LACFKSNKKSV

SEQ ID NO: 194969 - protein, 11 aa, Borrelia garinii
ACFKSNKKSVK

SEQ ID NO: 194970 - protein, 11 aa, Borrelia garinii
CFKSNKKSVKS

SEQ ID NO: 194971 - protein, 11 aa, Borrelia garinii
FKSNKKSVKSD

SEQ ID NO: 194972 - protein, 11 aa, Borrelia garinii
KSNKKSVKSDK

SEQ ID NO: 194973 - protein, 11 aa, Borrelia garinii
SNKKSVKSDKV

SEQ ID NO: 194974 - protein, 11 aa, Borrelia garinii
NKKSVKSDKVI

SEQ ID NO: 194975 - protein, 11 aa, Borrelia garinii
KKSVKSDKVII

SEQ ID NO: 194976 - protein, 11 aa, Borrelia garinii
KSVKSDKVIIG

SEQ ID NO: 194977 - protein, 11 aa, Borrelia garinii
SVKSDKVIIGV

SEQ ID NO: 194978 - protein, 11 aa, Borrelia garinii
VKSDKVIIGVL

SEQ ID NO: 194979 - protein, 11 aa, Borrelia garinii
KSDKVIIGVLA

SEQ ID NO: 194980 - protein, 11 aa, Borrelia garinii
SDKVIIGVLAN

SEQ ID NO: 194981 - protein, 11 aa, Borrelia garinii
DKVIIGVLANG

SEQ ID NO: 194982 - protein, 11 aa, Borrelia garinii
KVIIGVLANGS

SEQ ID NO: 194983 - protein, 11 aa, Borrelia garinii
VIIGVLANGSF

SEQ ID NO: 194984 - protein, 11 aa, Borrelia garinii
IIGVLANGSFY

SEQ ID NO: 194985 - protein, 11 aa, Borrelia garinii
IGVLANGSFYD

SEQ ID NO: 194986 - protein, 11 aa, Borrelia garinii
GVLANGSFYDK

SEQ ID NO: 194987 - protein, 11 aa, Borrelia garinii
VLANGSFYDKG

SEQ ID NO: 194988 - protein, 11 aa, Borrelia garinii
LANGSFYDKGY

SEQ ID NO: 194989 - protein, 11 aa, Borrelia garinii
ANGSFYDKGYN

SEQ ID NO: 194990 - protein, 11 aa, Borrelia garinii
NGSFYDKGYNQ

SEQ ID NO: 194991 - protein, 11 aa, Borrelia garinii
GSFYDKGYNQS

SEQ ID NO: 194992 - protein, 11 aa, Borrelia garinii
SFYDKGYNQSV

SEQ ID NO: 194993 - protein, 11 aa, Borrelia garinii
FYDKGYNQSVY

SEQ ID NO: 194994 - protein, 11 aa, Borrelia garinii
YDKGYNQSVYD

SEQ ID NO: 194995 - protein, 11 aa, Borrelia garinii
DKGYNQSVYDG

SEQ ID NO: 194996 - protein, 11 aa, Borrelia garinii
KGYNQSVYDGV

SEQ ID NO: 194997 - protein, 11 aa, Borrelia garinii
GYNQSVYDGVV

SEQ ID NO: 194998 - protein, 11 aa, Borrelia garinii
YNQSVYDGVVK

SEQ ID NO: 194999 - protein, 11 aa, Borrelia garinii
NQSVYDGVVKL

SEQ ID NO: 195000 - protein, 11 aa, Borrelia garinii
QSVYDGVVKLK

SEQ ID NO: 195001 - protein, 11 aa, Borrelia garinii
SVYDGVVKLKD

SEQ ID NO: 195002 - protein, 11 aa, Borrelia garinii
VYDGVVKLKDD

SEQ ID NO: 195003 - protein, 11 aa, Borrelia garinii
YDGVVKLKDDF

SEQ ID NO: 195004 - protein, 11 aa, Borrelia garinii
DGVVKLKDDFG

SEQ ID NO: 195005 - protein, 11 aa, Borrelia garinii
GVVKLKDDFGI

SEQ ID NO: 195006 - protein, 11 aa, Borrelia garinii
VVKLKDDFGIK

SEQ ID NO: 195007 - protein, 11 aa, Borrelia garinii
VKLKDDFGIKL

SEQ ID NO: 195008 - protein, 11 aa, Borrelia garinii
KLKDDFGIKLI

SEQ ID NO: 195009 - protein, 11 aa, Borrelia garinii
LKDDFGIKLIT

SEQ ID NO: 195010 - protein, 11 aa, Borrelia garinii
KDDFGIKLITK

SEQ ID NO: 195011 - protein, 11 aa, Borrelia garinii
DDFGIKLITKS

SEQ ID NO: 195012 - protein, 11 aa, Borrelia garinii
DFGIKLITKSL

SEQ ID NO: 195013 - protein, 11 aa, Borrelia garinii
FGIKLITKSLR

SEQ ID NO: 195014 - protein, 11 aa, Borrelia garinii
GIKLITKSLRP

SEQ ID NO: 195015 - protein, 11 aa, Borrelia garinii
IKLITKSLRPY

SEQ ID NO: 195016 - protein, 11 aa, Borrelia garinii
KLITKSLRPYP

SEQ ID NO: 195017 - protein, 11 aa, Borrelia garinii
LITKSLRPYPI

SEQ ID NO: 195018 - protein, 11 aa, Borrelia garinii
ITKSLRPYPIE

SEQ ID NO: 195019 - protein, 11 aa, Borrelia garinii
TKSLRPYPIEG

SEQ ID NO: 195020 - protein, 11 aa, Borrelia garinii
KSLRPYPIEGK

SEQ ID NO: 195021 - protein, 11 aa, Borrelia garinii
SLRPYPIEGKR

SEQ ID NO: 195022 - protein, 11 aa, Borrelia garinii
LRPYPIEGKRL

SEQ ID NO: 195023 - protein, 11 aa, Borrelia garinii
RPYPIEGKRLL

SEQ ID NO: 195024 - protein, 11 aa, Borrelia garinii
PYPIEGKRLLT

SEQ ID NO: 195025 - protein, 11 aa, Borrelia garinii
YPIEGKRLLTV

SEQ ID NO: 195026 - protein, 11 aa, Borrelia garinii
PIEGKRLLTVN

SEQ ID NO: 195027 - protein, 11 aa, Borrelia garinii
IEGKRLLTVNE

SEQ ID NO: 195028 - protein, 11 aa, Borrelia garinii
EGKRLLTVNEA

SEQ ID NO: 195029 - protein, 11 aa, Borrelia garinii
GKRLLTVNEAM

SEQ ID NO: 195030 - protein, 11 aa, Borrelia garinii
KRLLTVNEAMA

SEQ ID NO: 195031 - protein, 11 aa, Borrelia garinii
RLLTVNEAMAE

SEQ ID NO: 195032 - protein, 11 aa, Borrelia garinii
LLTVNEAMAED

SEQ ID NO: 195033 - protein, 11 aa, Borrelia garinii
LTVNEAMAEDA

SEQ ID NO: 195034 - protein, 11 aa, Borrelia garinii
TVNEAMAEDAY

SEQ ID NO: 195035 - protein, 11 aa, Borrelia garinii
VNEAMAEDAYE

SEQ ID NO: 195036 - protein, 11 aa, Borrelia garinii
NEAMAEDAYEV

SEQ ID NO: 195037 - protein, 11 aa, Borrelia garinii
EAMAEDAYEVQ

SEQ ID NO: 195038 - protein, 11 aa, Borrelia garinii
AMAEDAYEVQK

SEQ ID NO: 195039 - protein, 11 aa, Borrelia garinii
MAEDAYEVQKN

SEQ ID NO: 195040 - protein, 11 aa, Borrelia garinii
AEDAYEVQKNP

SEQ ID NO: 195041 - protein, 11 aa, Borrelia garinii
EDAYEVQKNPL

SEQ ID NO: 195042 - protein, 11 aa, Borrelia garinii
DAYEVQKNPLN

SEQ ID NO: 195043 - protein, 11 aa, Borrelia garinii
AYEVQKNPLNL

SEQ ID NO: 195044 - protein, 11 aa, Borrelia garinii
YEVQKNPLNLF

SEQ ID NO: 195045 - protein, 11 aa, Borrelia garinii
EVQKNPLNLFW

SEQ ID NO: 195046 - protein, 11 aa, Borrelia garinii
VQKNPLNLFWL

SEQ ID NO: 195047 - protein, 11 aa, Borrelia garinii
QKNPLNLFWLA

SEQ ID NO: 195048 - protein, 11 aa, Borrelia garinii
KNPLNLFWLAG

SEQ ID NO: 195049 - protein, 11 aa, Borrelia garinii
NPLNLFWLAGY

SEQ ID NO: 195050 - protein, 11 aa, Borrelia garinii
PLNLFWLAGYQ

SEQ ID NO: 195051 - protein, 11 aa, Borrelia garinii
LNLFWLAGYQF

SEQ ID NO: 195052 - protein, 11 aa, Borrelia garinii
NLFWLAGYQFS

SEQ ID NO: 195053 - protein, 11 aa, Borrelia garinii
LFWLAGYQFSS

SEQ ID NO: 195054 - protein, 11 aa, Borrelia garinii
FWLAGYQFSSL

SEQ ID NO: 195055 - protein, 11 aa, Borrelia garinii
WLAGYQFSSLS

SEQ ID NO: 195056 - protein, 11 aa, Borrelia garinii
LAGYQFSSLSV

SEQ ID NO: 195057 - protein, 11 aa, Borrelia garinii
AGYQFSSLSVK

SEQ ID NO: 195058 - protein, 11 aa, Borrelia garinii
GYQFSSLSVKL

SEQ ID NO: 195059 - protein, 11 aa, Borrelia garinii
YQFSSLSVKLS

SEQ ID NO: 195060 - protein, 11 aa, Borrelia garinii
QFSSLSVKLSY

SEQ ID NO: 195061 - protein, 11 aa, Borrelia garinii
FSSLSVKLSYE

SEQ ID NO: 195062 - protein, 11 aa, Borrelia garinii
SSLSVKLSYER

SEQ ID NO: 195063 - protein, 11 aa, Borrelia garinii
SLSVKLSYERP

SEQ ID NO: 195064 - protein, 11 aa, Borrelia garinii
LSVKLSYERPD

SEQ ID NO: 195065 - protein, 11 aa, Borrelia garinii
SVKLSYERPDI

SEQ ID NO: 195066 - protein, 11 aa, Borrelia garinii
VKLSYERPDIY

SEQ ID NO: 195067 - protein, 11 aa, Borrelia garinii
KLSYERPDIYY

SEQ ID NO: 195068 - protein, 11 aa, Borrelia garinii
LSYERPDIYYG

SEQ ID NO: 195069 - protein, 11 aa, Borrelia garinii
SYERPDIYYGI

SEQ ID NO: 195070 - protein, 11 aa, Borrelia garinii
YERPDIYYGII

SEQ ID NO: 195071 - protein, 11 aa, Borrelia garinii
ERPDIYYGIID

SEQ ID NO: 195072 - protein, 11 aa, Borrelia garinii
RPDIYYGIIDA

SEQ ID NO: 195073 - protein, 11 aa, Borrelia garinii
PDIYYGIIDAF

SEQ ID NO: 195074 - protein, 11 aa, Borrelia garinii
DIYYGIIDAFD

SEQ ID NO: 195075 - protein, 11 aa, Borrelia garinii
IYYGIIDAFDY

SEQ ID NO: 195076 - protein, 11 aa, Borrelia garinii
YYGIIDAFDYG

SEQ ID NO: 195077 - protein, 11 aa, Borrelia garinii
YGIIDAFDYGD

SEQ ID NO: 195078 - protein, 11 aa, Borrelia garinii
GIIDAFDYGDI

SEQ ID NO: 195079 - protein, 11 aa, Borrelia garinii
IIDAFDYGDIQ

SEQ ID NO: 195080 - protein, 11 aa, Borrelia garinii
IDAFDYGDIQV

SEQ ID NO: 195081 - protein, 11 aa, Borrelia garinii
DAFDYGDIQVP

SEQ ID NO: 195082 - protein, 11 aa, Borrelia garinii
AFDYGDIQVPK

SEQ ID NO: 195083 - protein, 11 aa, Borrelia garinii
FDYGDIQVPKN

SEQ ID NO: 195084 - protein, 11 aa, Borrelia garinii
DYGDIQVPKNS

SEQ ID NO: 195085 - protein, 11 aa, Borrelia garinii
YGDIQVPKNSL

SEQ ID NO: 195086 - protein, 11 aa, Borrelia garinii
GDIQVPKNSLA

SEQ ID NO: 195087 - protein, 11 aa, Borrelia garinii
DIQVPKNSLAI

SEQ ID NO: 195088 - protein, 11 aa, Borrelia garinii
IQVPKNSLAIK

SEQ ID NO: 195089 - protein, 11 aa, Borrelia garinii
QVPKNSLAIKF

SEQ ID NO: 195090 - protein, 11 aa, Borrelia garinii
VPKNSLAIKFR

SEQ ID NO: 195091 - protein, 11 aa, Borrelia garinii
PKNSLAIKFRN

SEQ ID NO: 195092 - protein, 11 aa, Borrelia garinii
KNSLAIKFRNE

SEQ ID NO: 195093 - protein, 11 aa, Borrelia garinii
NSLAIKFRNEE

SEQ ID NO: 195094 - protein, 11 aa, Borrelia garinii
SLAIKFRNEEA

SEQ ID NO: 195095 - protein, 11 aa, Borrelia garinii
LAIKFRNEEAA

SEQ ID NO: 195096 - protein, 11 aa, Borrelia garinii
AIKFRNEEAAF

SEQ ID NO: 195097 - protein, 11 aa, Borrelia garinii
IKFRNEEAAFL

SEQ ID NO: 195098 - protein, 11 aa, Borrelia garinii
KFRNEEAAFLA

SEQ ID NO: 195099 - protein, 11 aa, Borrelia garinii
FRNEEAAFLAG

SEQ ID NO: 195100 - protein, 11 aa, Borrelia garinii
RNEEAAFLAGY

SEQ ID NO: 195101 - protein, 11 aa, Borrelia garinii
NEEAAFLAGYI

SEQ ID NO: 195102 - protein, 11 aa, Borrelia garinii
EEAAFLAGYIA

SEQ ID NO: 195103 - protein, 11 aa, Borrelia garinii
EAAFLAGYIAA

SEQ ID NO: 195104 - protein, 11 aa, Borrelia garinii
AAFLAGYIAAK

SEQ ID NO: 195105 - protein, 11 aa, Borrelia garinii
AFLAGYIAAKM

SEQ ID NO: 195106 - protein, 11 aa, Borrelia garinii
FLAGYIAAKMS

SEQ ID NO: 195107 - protein, 11 aa, Borrelia garinii
LAGYIAAKMSR

SEQ ID NO: 195108 - protein, 11 aa, Borrelia garinii
AGYIAAKMSRK

SEQ ID NO: 195109 - protein, 11 aa, Borrelia garinii
GYIAAKMSRKE

SEQ ID NO: 195110 - protein, 11 aa, Borrelia garinii
YIAAKMSRKEK

SEQ ID NO: 195111 - protein, 11 aa, Borrelia garinii
IAAKMSRKEKI

SEQ ID NO: 195112 - protein, 11 aa, Borrelia garinii
AAKMSRKEKIG

SEQ ID NO: 195113 - protein, 11 aa, Borrelia garinii
AKMSRKEKIGF

SEQ ID NO: 195114 - protein, 11 aa, Borrelia garinii
KMSRKEKIGFL

SEQ ID NO: 195115 - protein, 11 aa, Borrelia garinii
MSRKEKIGFLT

SEQ ID NO: 195116 - protein, 11 aa, Borrelia garinii
SRKEKIGFLTG

SEQ ID NO: 195117 - protein, 11 aa, Borrelia garinii
RKEKIGFLTGP

SEQ ID NO: 195118 - protein, 11 aa, Borrelia garinii
KEKIGFLTGPE

SEQ ID NO: 195119 - protein, 11 aa, Borrelia garinii
EKIGFLTGPES

SEQ ID NO: 195120 - protein, 11 aa, Borrelia garinii
KIGFLTGPESE

SEQ ID NO: 195121 - protein, 11 aa, Borrelia garinii
IGFLTGPESEY

SEQ ID NO: 195122 - protein, 11 aa, Borrelia garinii
GFLTGPESEYL

SEQ ID NO: 195123 - protein, 11 aa, Borrelia garinii
FLTGPESEYLN

SEQ ID NO: 195124 - protein, 11 aa, Borrelia garinii
LTGPESEYLND

SEQ ID NO: 195125 - protein, 11 aa, Borrelia garinii
TGPESEYLNDF

SEQ ID NO: 195126 - protein, 11 aa, Borrelia garinii
GPESEYLNDFK

SEQ ID NO: 195127 - protein, 11 aa, Borrelia garinii
PESEYLNDFKF

SEQ ID NO: 195128 - protein, 11 aa, Borrelia garinii
ESEYLNDFKFG

SEQ ID NO: 195129 - protein, 11 aa, Borrelia garinii
SEYLNDFKFGF

SEQ ID NO: 195130 - protein, 11 aa, Borrelia garinii
EYLNDFKFGFK

SEQ ID NO: 195131 - protein, 11 aa, Borrelia garinii
YLNDFKFGFKA

SEQ ID NO: 195132 - protein, 11 aa, Borrelia garinii
LNDFKFGFKAG

SEQ ID NO: 195133 - protein, 11 aa, Borrelia garinii
NDFKFGFKAGI

SEQ ID NO: 195134 - protein, 11 aa, Borrelia garinii
DFKFGFKAGIF

SEQ ID NO: 195135 - protein, 11 aa, Borrelia garinii
FKFGFKAGIFY

SEQ ID NO: 195136 - protein, 11 aa, Borrelia garinii
KFGFKAGIFYA

SEQ ID NO: 195137 - protein, 11 aa, Borrelia garinii
FGFKAGIFYAN

SEQ ID NO: 195138 - protein, 11 aa, Borrelia garinii
GFKAGIFYANP

SEQ ID NO: 195139 - protein, 11 aa, Borrelia garinii
FKAGIFYANPK

SEQ ID NO: 195140 - protein, 11 aa, Borrelia garinii
KAGIFYANPKL

SEQ ID NO: 195141 - protein, 11 aa, Borrelia garinii
AGIFYANPKLR

SEQ ID NO: 195142 - protein, 11 aa, Borrelia garinii
GIFYANPKLRL

SEQ ID NO: 195143 - protein, 11 aa, Borrelia garinii
IFYANPKLRLV

SEQ ID NO: 195144 - protein, 11 aa, Borrelia garinii
FYANPKLRLVS

SEQ ID NO: 195145 - protein, 11 aa, Borrelia garinii
YANPKLRLVSK

SEQ ID NO: 195146 - protein, 11 aa, Borrelia garinii
ANPKLRLVSKK

SEQ ID NO: 195147 - protein, 11 aa, Borrelia garinii
NPKLRLVSKKA

SEQ ID NO: 195148 - protein, 11 aa, Borrelia garinii
PKLRLVSKKAP

SEQ ID NO: 195149 - protein, 11 aa, Borrelia garinii
KLRLVSKKAPS

SEQ ID NO: 195150 - protein, 11 aa, Borrelia garinii
LRLVSKKAPSL

SEQ ID NO: 195151 - protein, 11 aa, Borrelia garinii
RLVSKKAPSLF

SEQ ID NO: 195152 - protein, 11 aa, Borrelia garinii
LVSKKAPSLFD

SEQ ID NO: 195153 - protein, 11 aa, Borrelia garinii
VSKKAPSLFDK

SEQ ID NO: 195154 - protein, 11 aa, Borrelia garinii
SKKAPSLFDKE

SEQ ID NO: 195155 - protein, 11 aa, Borrelia garinii
KKAPSLFDKEK

SEQ ID NO: 195156 - protein, 11 aa, Borrelia garinii
KAPSLFDKEKG

SEQ ID NO: 195157 - protein, 11 aa, Borrelia garinii
APSLFDKEKGK

SEQ ID NO: 195158 - protein, 11 aa, Borrelia garinii
PSLFDKEKGKE

SEQ ID NO: 195159 - protein, 11 aa, Borrelia garinii
SLFDKEKGKEM

SEQ ID NO: 195160 - protein, 11 aa, Borrelia garinii
LFDKEKGKEMA

SEQ ID NO: 195161 - protein, 11 aa, Borrelia garinii
FDKEKGKEMAR

SEQ ID NO: 195162 - protein, 11 aa, Borrelia garinii
DKEKGKEMARF

SEQ ID NO: 195163 - protein, 11 aa, Borrelia garinii
KEKGKEMARFM

SEQ ID NO: 195164 - protein, 11 aa, Borrelia garinii
EKGKEMARFMY

SEQ ID NO: 195165 - protein, 11 aa, Borrelia garinii
KGKEMARFMYK

SEQ ID NO: 195166 - protein, 11 aa, Borrelia garinii
GKEMARFMYKE

SEQ ID NO: 195167 - protein, 11 aa, Borrelia garinii
KEMARFMYKED

SEQ ID NO: 195168 - protein, 11 aa, Borrelia garinii
EMARFMYKEDK

SEQ ID NO: 195169 - protein, 11 aa, Borrelia garinii
MARFMYKEDKV

SEQ ID NO: 195170 - protein, 11 aa, Borrelia garinii
ARFMYKEDKVG

SEQ ID NO: 195171 - protein, 11 aa, Borrelia garinii
RFMYKEDKVGV

SEQ ID NO: 195172 - protein, 11 aa, Borrelia garinii
FMYKEDKVGVI

SEQ ID NO: 195173 - protein, 11 aa, Borrelia garinii
MYKEDKVGVIF

SEQ ID NO: 195174 - protein, 11 aa, Borrelia garinii
YKEDKVGVIFP

SEQ ID NO: 195175 - protein, 11 aa, Borrelia garinii
KEDKVGVIFPI

SEQ ID NO: 195176 - protein, 11 aa, Borrelia garinii
EDKVGVIFPIA

SEQ ID NO: 195177 - protein, 11 aa, Borrelia garinii
DKVGVIFPIAG

SEQ ID NO: 195178 - protein, 11 aa, Borrelia garinii
KVGVIFPIAGI

SEQ ID NO: 195179 - protein, 11 aa, Borrelia garinii
VGVIFPIAGIT

SEQ ID NO: 195180 - protein, 11 aa, Borrelia garinii
GVIFPIAGITG

SEQ ID NO: 195181 - protein, 11 aa, Borrelia garinii
VIFPIAGITGL

SEQ ID NO: 195182 - protein, 11 aa, Borrelia garinii
IFPIAGITGLG

SEQ ID NO: 195183 - protein, 11 aa, Borrelia garinii
FPIAGITGLGV

SEQ ID NO: 195184 - protein, 11 aa, Borrelia garinii
PIAGITGLGVY

SEQ ID NO: 195185 - protein, 11 aa, Borrelia garinii
IAGITGLGVYD

SEQ ID NO: 195186 - protein, 11 aa, Borrelia garinii
AGITGLGVYDA

SEQ ID NO: 195187 - protein, 11 aa, Borrelia garinii
GITGLGVYDAA

SEQ ID NO: 195188 - protein, 11 aa, Borrelia garinii
ITGLGVYDAAK

SEQ ID NO: 195189 - protein, 11 aa, Borrelia garinii
TGLGVYDAAKE

SEQ ID NO: 195190 - protein, 11 aa, Borrelia garinii
GLGVYDAAKEL

SEQ ID NO: 195191 - protein, 11 aa, Borrelia garinii
LGVYDAAKELG

SEQ ID NO: 195192 - protein, 11 aa, Borrelia garinii
GVYDAAKELGP

SEQ ID NO: 195193 - protein, 11 aa, Borrelia garinii
VYDAAKELGPK

SEQ ID NO: 195194 - protein, 11 aa, Borrelia garinii
YDAAKELGPKY

SEQ ID NO: 195195 - protein, 11 aa, Borrelia garinii
DAAKELGPKYY

SEQ ID NO: 195196 - protein, 11 aa, Borrelia garinii
AAKELGPKYYV

SEQ ID NO: 195197 - protein, 11 aa, Borrelia garinii
AKELGPKYYVI

SEQ ID NO: 195198 - protein, 11 aa, Borrelia garinii
KELGPKYYVIG

SEQ ID NO: 195199 - protein, 11 aa, Borrelia garinii
ELGPKYYVIGL

SEQ ID NO: 195200 - protein, 11 aa, Borrelia garinii
LGPKYYVIGLN

SEQ ID NO: 195201 - protein, 11 aa, Borrelia garinii
GPKYYVIGLNQ

SEQ ID NO: 195202 - protein, 11 aa, Borrelia garinii
PKYYVIGLNQD

SEQ ID NO: 195203 - protein, 11 aa, Borrelia garinii
KYYVIGLNQDQ

SEQ ID NO: 195204 - protein, 11 aa, Borrelia garinii
YYVIGLNQDQS

SEQ ID NO: 195205 - protein, 11 aa, Borrelia garinii
YVIGLNQDQSY

SEQ ID NO: 195206 - protein, 11 aa, Borrelia garinii
VIGLNQDQSYI

SEQ ID NO: 195207 - protein, 11 aa, Borrelia garinii
IGLNQDQSYIA

SEQ ID NO: 195208 - protein, 11 aa, Borrelia garinii
GLNQDQSYIAP

SEQ ID NO: 195209 - protein, 11 aa, Borrelia garinii
LNQDQSYIAPQ

SEQ ID NO: 195210 - protein, 11 aa, Borrelia garinii
NQDQSYIAPQN

SEQ ID NO: 195211 - protein, 11 aa, Borrelia garinii
QDQSYIAPQNV

SEQ ID NO: 195212 - protein, 11 aa, Borrelia garinii
DQSYIAPQNVI

SEQ ID NO: 195213 - protein, 11 aa, Borrelia garinii
QSYIAPQNVIT

SEQ ID NO: 195214 - protein, 11 aa, Borrelia garinii
SYIAPQNVITS

SEQ ID NO: 195215 - protein, 11 aa, Borrelia garinii
YIAPQNVITSV

SEQ ID NO: 195216 - protein, 11 aa, Borrelia garinii
IAPQNVITSVL

SEQ ID NO: 195217 - protein, 11 aa, Borrelia garinii
APQNVITSVLK

SEQ ID NO: 195218 - protein, 11 aa, Borrelia garinii
PQNVITSVLKD

SEQ ID NO: 195219 - protein, 11 aa, Borrelia garinii
QNVITSVLKDI

SEQ ID NO: 195220 - protein, 11 aa, Borrelia garinii
NVITSVLKDIG

SEQ ID NO: 195221 - protein, 11 aa, Borrelia garinii
VITSVLKDIGK

SEQ ID NO: 195222 - protein, 11 aa, Borrelia garinii
ITSVLKDIGKV

SEQ ID NO: 195223 - protein, 11 aa, Borrelia garinii
TSVLKDIGKVI

SEQ ID NO: 195224 - protein, 11 aa, Borrelia garinii
SVLKDIGKVIY

SEQ ID NO: 195225 - protein, 11 aa, Borrelia garinii
VLKDIGKVIYS

SEQ ID NO: 195226 - protein, 11 aa, Borrelia garinii
LKDIGKVIYSV

SEQ ID NO: 195227 - protein, 11 aa, Borrelia garinii
KDIGKVIYSVS

SEQ ID NO: 195228 - protein, 11 aa, Borrelia garinii
DIGKVIYSVSS

SEQ ID NO: 195229 - protein, 11 aa, Borrelia garinii
IGKVIYSVSSD

SEQ ID NO: 195230 - protein, 11 aa, Borrelia garinii
GKVIYSVSSDY

SEQ ID NO: 195231 - protein, 11 aa, Borrelia garinii
KVIYSVSSDYI

SEQ ID NO: 195232 - protein, 11 aa, Borrelia garinii
VIYSVSSDYIK

SEQ ID NO: 195233 - protein, 11 aa, Borrelia garinii
IYSVSSDYIKN

SEQ ID NO: 195234 - protein, 11 aa, Borrelia garinii
YSVSSDYIKNG

SEQ ID NO: 195235 - protein, 11 aa, Borrelia garinii
SVSSDYIKNGV

SEQ ID NO: 195236 - protein, 11 aa, Borrelia garinii
VSSDYIKNGVF

SEQ ID NO: 195237 - protein, 11 aa, Borrelia garinii
SSDYIKNGVFK

SEQ ID NO: 195238 - protein, 11 aa, Borrelia garinii
SDYIKNGVFKG

SEQ ID NO: 195239 - protein, 11 aa, Borrelia garinii
DYIKNGVFKGG

SEQ ID NO: 195240 - protein, 11 aa, Borrelia garinii
YIKNGVFKGGV

SEQ ID NO: 195241 - protein, 11 aa, Borrelia garinii
IKNGVFKGGVV

SEQ ID NO: 195242 - protein, 11 aa, Borrelia garinii
KNGVFKGGVVI

SEQ ID NO: 195243 - protein, 11 aa, Borrelia garinii
NGVFKGGVVID

SEQ ID NO: 195244 - protein, 11 aa, Borrelia garinii
GVFKGGVVIDR

SEQ ID NO: 195245 - protein, 11 aa, Borrelia garinii
VFKGGVVIDRG

SEQ ID NO: 195246 - protein, 11 aa, Borrelia garinii
FKGGVVIDRGL

SEQ ID NO: 195247 - protein, 11 aa, Borrelia garinii
KGGVVIDRGLK

SEQ ID NO: 195248 - protein, 11 aa, Borrelia garinii
GGVVIDRGLKE

SEQ ID NO: 195249 - protein, 11 aa, Borrelia garinii
GVVIDRGLKEG

SEQ ID NO: 195250 - protein, 11 aa, Borrelia garinii
VVIDRGLKEGV

SEQ ID NO: 195251 - protein, 11 aa, Borrelia garinii
VIDRGLKEGVI

SEQ ID NO: 195252 - protein, 11 aa, Borrelia garinii
IDRGLKEGVIE

SEQ ID NO: 195253 - protein, 11 aa, Borrelia garinii
DRGLKEGVIEI

SEQ ID NO: 195254 - protein, 11 aa, Borrelia garinii
RGLKEGVIEIV

SEQ ID NO: 195255 - protein, 11 aa, Borrelia garinii
GLKEGVIEIVK

SEQ ID NO: 195256 - protein, 11 aa, Borrelia garinii
LKEGVIEIVKD

SEQ ID NO: 195257 - protein, 11 aa, Borrelia garinii
KEGVIEIVKDP

SEQ ID NO: 195258 - protein, 11 aa, Borrelia garinii
EGVIEIVKDPD

SEQ ID NO: 195259 - protein, 11 aa, Borrelia garinii
GVIEIVKDPDV

SEQ ID NO: 195260 - protein, 11 aa, Borrelia garinii
VIEIVKDPDVL

SEQ ID NO: 195261 - protein, 11 aa, Borrelia garinii
IEIVKDPDVLN

SEQ ID NO: 195262 - protein, 11 aa, Borrelia garinii
EIVKDPDVLNN

SEQ ID NO: 195263 - protein, 11 aa, Borrelia garinii
IVKDPDVLNNR

SEQ ID NO: 195264 - protein, 11 aa, Borrelia garinii
VKDPDVLNNRL

SEQ ID NO: 195265 - protein, 11 aa, Borrelia garinii
KDPDVLNNRLV

SEQ ID NO: 195266 - protein, 11 aa, Borrelia garinii
DPDVLNNRLVN

SEQ ID NO: 195267 - protein, 11 aa, Borrelia garinii
PDVLNNRLVNE

SEQ ID NO: 195268 - protein, 11 aa, Borrelia garinii
DVLNNRLVNEV

SEQ ID NO: 195269 - protein, 11 aa, Borrelia garinii
VLNNRLVNEVV

SEQ ID NO: 195270 - protein, 11 aa, Borrelia garinii
LNNRLVNEVVE

SEQ ID NO: 195271 - protein, 11 aa, Borrelia garinii
NNRLVNEVVEL

SEQ ID NO: 195272 - protein, 11 aa, Borrelia garinii
NRLVNEVVELE

SEQ ID NO: 195273 - protein, 11 aa, Borrelia garinii
RLVNEVVELEN

SEQ ID NO: 195274 - protein, 11 aa, Borrelia garinii
LVNEVVELENK

SEQ ID NO: 195275 - protein, 11 aa, Borrelia garinii
VNEVVELENKI

SEQ ID NO: 195276 - protein, 11 aa, Borrelia garinii
NEVVELENKII

SEQ ID NO: 195277 - protein, 11 aa, Borrelia garinii
EVVELENKIIS

SEQ ID NO: 195278 - protein, 11 aa, Borrelia garinii
VVELENKIISG

SEQ ID NO: 195279 - protein, 11 aa, Borrelia garinii
VELENKIISGE

SEQ ID NO: 195280 - protein, 11 aa, Borrelia garinii
ELENKIISGEI

SEQ ID NO: 195281 - protein, 11 aa, Borrelia garinii
LENKIISGEII

SEQ ID NO: 195282 - protein, 11 aa, Borrelia garinii
ENKIISGEIIV

SEQ ID NO: 195283 - protein, 11 aa, Borrelia garinii
NKIISGEIIVP

SEQ ID NO: 195284 - protein, 11 aa, Borrelia garinii
KIISGEIIVPD

SEQ ID NO: 195285 - protein, 11 aa, Borrelia garinii
IISGEIIVPDS

SEQ ID NO: 195286 - protein, 11 aa, Borrelia garinii
ISGEIIVPDSE

SEQ ID NO: 195287 - protein, 11 aa, Borrelia garinii
SGEIIVPDSEY

SEQ ID NO: 195288 - protein, 11 aa, Borrelia garinii
GEIIVPDSEYA

SEQ ID NO: 195289 - protein, 11 aa, Borrelia garinii
EIIVPDSEYAF

SEQ ID NO: 195290 - protein, 11 aa, Borrelia garinii
IIVPDSEYAFD

SEQ ID NO: 195291 - protein, 11 aa, Borrelia garinii
IVPDSEYAFDL

SEQ ID NO: 195292 - protein, 11 aa, Borrelia garinii
VPDSEYAFDLF

SEQ ID NO: 195293 - protein, 11 aa, Borrelia garinii
PDSEYAFDLFK

SEQ ID NO: 195294 - protein, 11 aa, Borrelia garinii
DSEYAFDLFKS

SEQ ID NO: 195295 - protein, 11 aa, Borrelia garinii
SEYAFDLFKSK

SEQ ID NO: 195296 - protein, 11 aa, Borrelia garinii
EYAFDLFKSKL

SEQ ID NO: 195297 - protein, 13 aa, Borrelia garinii
MFKRFVFIALSLL

SEQ ID NO: 195298 - protein, 13 aa, Borrelia garinii
FKRFVFIALSLLV

SEQ ID NO: 195299 - protein, 13 aa, Borrelia garinii
KRFVFIALSLLVL

SEQ ID NO: 195300 - protein, 13 aa, Borrelia garinii
RFVFIALSLLVLA

SEQ ID NO: 195301 - protein, 13 aa, Borrelia garinii
FVFIALSLLVLAC

SEQ ID NO: 195302 - protein, 13 aa, Borrelia garinii
VFIALSLLVLACF

SEQ ID NO: 195303 - protein, 13 aa, Borrelia garinii
FIALSLLVLACFK

SEQ ID NO: 195304 - protein, 13 aa, Borrelia garinii
IALSLLVLACFKS

SEQ ID NO: 195305 - protein, 13 aa, Borrelia garinii
ALSLLVLACFKSN

SEQ ID NO: 195306 - protein, 13 aa, Borrelia garinii
LSLLVLACFKSNK

SEQ ID NO: 195307 - protein, 13 aa, Borrelia garinii
SLLVLACFKSNKK

SEQ ID NO: 195308 - protein, 13 aa, Borrelia garinii
LLVLACFKSNKKS

SEQ ID NO: 195309 - protein, 13 aa, Borrelia garinii
LVLACFKSNKKSV

SEQ ID NO: 195310 - protein, 13 aa, Borrelia garinii
VLACFKSNKKSVK

SEQ ID NO: 195311 - protein, 13 aa, Borrelia garinii
LACFKSNKKSVKS

SEQ ID NO: 195312 - protein, 13 aa, Borrelia garinii
ACFKSNKKSVKSD

SEQ ID NO: 195313 - protein, 13 aa, Borrelia garinii
CFKSNKKSVKSDK

SEQ ID NO: 195314 - protein, 13 aa, Borrelia garinii
FKSNKKSVKSDKV

SEQ ID NO: 195315 - protein, 13 aa, Borrelia garinii
KSNKKSVKSDKVI

SEQ ID NO: 195316 - protein, 13 aa, Borrelia garinii
SNKKSVKSDKVII

SEQ ID NO: 195317 - protein, 13 aa, Borrelia garinii
NKKSVKSDKVIIG

SEQ ID NO: 195318 - protein, 13 aa, Borrelia garinii
KKSVKSDKVIIGV

SEQ ID NO: 195319 - protein, 13 aa, Borrelia garinii
KSVKSDKVIIGVL

SEQ ID NO: 195320 - protein, 13 aa, Borrelia garinii
SVKSDKVIIGVLA

SEQ ID NO: 195321 - protein, 13 aa, Borrelia garinii
VKSDKVIIGVLAN

SEQ ID NO: 195322 - protein, 13 aa, Borrelia garinii
KSDKVIIGVLANG

SEQ ID NO: 195323 - protein, 13 aa, Borrelia garinii
SDKVIIGVLANGS

SEQ ID NO: 195324 - protein, 13 aa, Borrelia garinii
DKVIIGVLANGSF

SEQ ID NO: 195325 - protein, 13 aa, Borrelia garinii
KVIIGVLANGSFY

SEQ ID NO: 195326 - protein, 13 aa, Borrelia garinii
VIIGVLANGSFYD

SEQ ID NO: 195327 - protein, 13 aa, Borrelia garinii
IIGVLANGSFYDK

SEQ ID NO: 195328 - protein, 13 aa, Borrelia garinii
IGVLANGSFYDKG

SEQ ID NO: 195329 - protein, 13 aa, Borrelia garinii
GVLANGSFYDKGY

SEQ ID NO: 195330 - protein, 13 aa, Borrelia garinii
VLANGSFYDKGYN

SEQ ID NO: 195331 - protein, 13 aa, Borrelia garinii
LANGSFYDKGYNQ

SEQ ID NO: 195332 - protein, 13 aa, Borrelia garinii
ANGSFYDKGYNQS

SEQ ID NO: 195333 - protein, 13 aa, Borrelia garinii
NGSFYDKGYNQSV

SEQ ID NO: 195334 - protein, 13 aa, Borrelia garinii
GSFYDKGYNQSVY

SEQ ID NO: 195335 - protein, 13 aa, Borrelia garinii
SFYDKGYNQSVYD

SEQ ID NO: 195336 - protein, 13 aa, Borrelia garinii
FYDKGYNQSVYDG

SEQ ID NO: 195337 - protein, 13 aa, Borrelia garinii
YDKGYNQSVYDGV

SEQ ID NO: 195338 - protein, 13 aa, Borrelia garinii
DKGYNQSVYDGVV

SEQ ID NO: 195339 - protein, 13 aa, Borrelia garinii
KGYNQSVYDGVVK

SEQ ID NO: 195340 - protein, 13 aa, Borrelia garinii
GYNQSVYDGVVKL

SEQ ID NO: 195341 - protein, 13 aa, Borrelia garinii
YNQSVYDGVVKLK

SEQ ID NO: 195342 - protein, 13 aa, Borrelia garinii
NQSVYDGVVKLKD

SEQ ID NO: 195343 - protein, 13 aa, Borrelia garinii
QSVYDGVVKLKDD

SEQ ID NO: 195344 - protein, 13 aa, Borrelia garinii
SVYDGVVKLKDDF

SEQ ID NO: 195345 - protein, 13 aa, Borrelia garinii
VYDGVVKLKDDFG

SEQ ID NO: 195346 - protein, 13 aa, Borrelia garinii
YDGVVKLKDDFGI

SEQ ID NO: 195347 - protein, 13 aa, Borrelia garinii
DGVVKLKDDFGIK

SEQ ID NO: 195348 - protein, 13 aa, Borrelia garinii
GVVKLKDDFGIKL

SEQ ID NO: 195349 - protein, 13 aa, Borrelia garinii
VVKLKDDFGIKLI

SEQ ID NO: 195350 - protein, 13 aa, Borrelia garinii
VKLKDDFGIKLIT

SEQ ID NO: 195351 - protein, 13 aa, Borrelia garinii
KLKDDFGIKLITK

SEQ ID NO: 195352 - protein, 13 aa, Borrelia garinii
LKDDFGIKLITKS

SEQ ID NO: 195353 - protein, 13 aa, Borrelia garinii
KDDFGIKLITKSL

SEQ ID NO: 195354 - protein, 13 aa, Borrelia garinii
DDFGIKLITKSLR

SEQ ID NO: 195355 - protein, 13 aa, Borrelia garinii
DFGIKLITKSLRP

SEQ ID NO: 195356 - protein, 13 aa, Borrelia garinii
FGIKLITKSLRPY

SEQ ID NO: 195357 - protein, 13 aa, Borrelia garinii
GIKLITKSLRPYP

SEQ ID NO: 195358 - protein, 13 aa, Borrelia garinii
IKLITKSLRPYPI

SEQ ID NO: 195359 - protein, 13 aa, Borrelia garinii
KLITKSLRPYPIE

SEQ ID NO: 195360 - protein, 13 aa, Borrelia garinii
LITKSLRPYPIEG

SEQ ID NO: 195361 - protein, 13 aa, Borrelia garinii
ITKSLRPYPIEGK

SEQ ID NO: 195362 - protein, 13 aa, Borrelia garinii
TKSLRPYPIEGKR

SEQ ID NO: 195363 - protein, 13 aa, Borrelia garinii
KSLRPYPIEGKRL

SEQ ID NO: 195364 - protein, 13 aa, Borrelia garinii
SLRPYPIEGKRLL

SEQ ID NO: 195365 - protein, 13 aa, Borrelia garinii
LRPYPIEGKRLLT

SEQ ID NO: 195366 - protein, 13 aa, Borrelia garinii
RPYPIEGKRLLTV

SEQ ID NO: 195367 - protein, 13 aa, Borrelia garinii
PYPIEGKRLLTVN

SEQ ID NO: 195368 - protein, 13 aa, Borrelia garinii
YPIEGKRLLTVNE

SEQ ID NO: 195369 - protein, 13 aa, Borrelia garinii
PIEGKRLLTVNEA

SEQ ID NO: 195370 - protein, 13 aa, Borrelia garinii
IEGKRLLTVNEAM

SEQ ID NO: 195371 - protein, 13 aa, Borrelia garinii
EGKRLLTVNEAMA

SEQ ID NO: 195372 - protein, 13 aa, Borrelia garinii
GKRLLTVNEAMAE

SEQ ID NO: 195373 - protein, 13 aa, Borrelia garinii
KRLLTVNEAMAED

SEQ ID NO: 195374 - protein, 13 aa, Borrelia garinii
RLLTVNEAMAEDA

SEQ ID NO: 195375 - protein, 13 aa, Borrelia garinii
LLTVNEAMAEDAY

SEQ ID NO: 195376 - protein, 13 aa, Borrelia garinii
LTVNEAMAEDAYE

SEQ ID NO: 195377 - protein, 13 aa, Borrelia garinii
TVNEAMAEDAYEV

SEQ ID NO: 195378 - protein, 13 aa, Borrelia garinii
VNEAMAEDAYEVQ

SEQ ID NO: 195379 - protein, 13 aa, Borrelia garinii
NEAMAEDAYEVQK

SEQ ID NO: 195380 - protein, 13 aa, Borrelia garinii
EAMAEDAYEVQKN

SEQ ID NO: 195381 - protein, 13 aa, Borrelia garinii
AMAEDAYEVQKNP

SEQ ID NO: 195382 - protein, 13 aa, Borrelia garinii
MAEDAYEVQKNPL

SEQ ID NO: 195383 - protein, 13 aa, Borrelia garinii
AEDAYEVQKNPLN

SEQ ID NO: 195384 - protein, 13 aa, Borrelia garinii
EDAYEVQKNPLNL

SEQ ID NO: 195385 - protein, 13 aa, Borrelia garinii
DAYEVQKNPLNLF

SEQ ID NO: 195386 - protein, 13 aa, Borrelia garinii
AYEVQKNPLNLFW

SEQ ID NO: 195387 - protein, 13 aa, Borrelia garinii
YEVQKNPLNLFWL

SEQ ID NO: 195388 - protein, 13 aa, Borrelia garinii
EVQKNPLNLFWLA

SEQ ID NO: 195389 - protein, 13 aa, Borrelia garinii
VQKNPLNLFWLAG

SEQ ID NO: 195390 - protein, 13 aa, Borrelia garinii
QKNPLNLFWLAGY

SEQ ID NO: 195391 - protein, 13 aa, Borrelia garinii
KNPLNLFWLAGYQ

SEQ ID NO: 195392 - protein, 13 aa, Borrelia garinii
NPLNLFWLAGYQF

SEQ ID NO: 195393 - protein, 13 aa, Borrelia garinii
PLNLFWLAGYQFS

SEQ ID NO: 195394 - protein, 13 aa, Borrelia garinii
LNLFWLAGYQFSS

SEQ ID NO: 195395 - protein, 13 aa, Borrelia garinii
NLFWLAGYQFSSL

SEQ ID NO: 195396 - protein, 13 aa, Borrelia garinii
LFWLAGYQFSSLS

SEQ ID NO: 195397 - protein, 13 aa, Borrelia garinii
FWLAGYQFSSLSV

SEQ ID NO: 195398 - protein, 13 aa, Borrelia garinii
WLAGYQFSSLSVK

SEQ ID NO: 195399 - protein, 13 aa, Borrelia garinii
LAGYQFSSLSVKL

SEQ ID NO: 195400 - protein, 13 aa, Borrelia garinii
AGYQFSSLSVKLS

SEQ ID NO: 195401 - protein, 13 aa, Borrelia garinii
GYQFSSLSVKLSY

SEQ ID NO: 195402 - protein, 13 aa, Borrelia garinii
YQFSSLSVKLSYE

SEQ ID NO: 195403 - protein, 13 aa, Borrelia garinii
QFSSLSVKLSYER

SEQ ID NO: 195404 - protein, 13 aa, Borrelia garinii
FSSLSVKLSYERP

SEQ ID NO: 195405 - protein, 13 aa, Borrelia garinii
SSLSVKLSYERPD

SEQ ID NO: 195406 - protein, 13 aa, Borrelia garinii
SLSVKLSYERPDI

SEQ ID NO: 195407 - protein, 13 aa, Borrelia garinii
LSVKLSYERPDIY

SEQ ID NO: 195408 - protein, 13 aa, Borrelia garinii
SVKLSYERPDIYY

SEQ ID NO: 195409 - protein, 13 aa, Borrelia garinii
VKLSYERPDIYYG

SEQ ID NO: 195410 - protein, 13 aa, Borrelia garinii
KLSYERPDIYYGI

SEQ ID NO: 195411 - protein, 13 aa, Borrelia garinii
LSYERPDIYYGII

SEQ ID NO: 195412 - protein, 13 aa, Borrelia garinii
SYERPDIYYGIID

SEQ ID NO: 195413 - protein, 13 aa, Borrelia garinii
YERPDIYYGIIDA

SEQ ID NO: 195414 - protein, 13 aa, Borrelia garinii
ERPDIYYGIIDAF

SEQ ID NO: 195415 - protein, 13 aa, Borrelia garinii
RPDIYYGIIDAFD

SEQ ID NO: 195416 - protein, 13 aa, Borrelia garinii
PDIYYGIIDAFDY

SEQ ID NO: 195417 - protein, 13 aa, Borrelia garinii
DIYYGIIDAFDYG

SEQ ID NO: 195418 - protein, 13 aa, Borrelia garinii
IYYGIIDAFDYGD

SEQ ID NO: 195419 - protein, 13 aa, Borrelia garinii
YYGIIDAFDYGDI

SEQ ID NO: 195420 - protein, 13 aa, Borrelia garinii
YGIIDAFDYGDIQ

SEQ ID NO: 195421 - protein, 13 aa, Borrelia garinii
GIIDAFDYGDIQV

SEQ ID NO: 195422 - protein, 13 aa, Borrelia garinii
IIDAFDYGDIQVP

SEQ ID NO: 195423 - protein, 13 aa, Borrelia garinii
IDAFDYGDIQVPK

SEQ ID NO: 195424 - protein, 13 aa, Borrelia garinii
DAFDYGDIQVPKN

SEQ ID NO: 195425 - protein, 13 aa, Borrelia garinii
AFDYGDIQVPKNS

SEQ ID NO: 195426 - protein, 13 aa, Borrelia garinii
FDYGDIQVPKNSL

SEQ ID NO: 195427 - protein, 13 aa, Borrelia garinii
DYGDIQVPKNSLA

SEQ ID NO: 195428 - protein, 13 aa, Borrelia garinii
YGDIQVPKNSLAI

SEQ ID NO: 195429 - protein, 13 aa, Borrelia garinii
GDIQVPKNSLAIK

SEQ ID NO: 195430 - protein, 13 aa, Borrelia garinii
DIQVPKNSLAIKF

SEQ ID NO: 195431 - protein, 13 aa, Borrelia garinii
IQVPKNSLAIKFR

SEQ ID NO: 195432 - protein, 13 aa, Borrelia garinii
QVPKNSLAIKFRN

SEQ ID NO: 195433 - protein, 13 aa, Borrelia garinii
VPKNSLAIKFRNE

SEQ ID NO: 195434 - protein, 13 aa, Borrelia garinii
PKNSLAIKFRNEE

SEQ ID NO: 195435 - protein, 13 aa, Borrelia garinii
KNSLAIKFRNEEA

SEQ ID NO: 195436 - protein, 13 aa, Borrelia garinii
NSLAIKFRNEEAA

SEQ ID NO: 195437 - protein, 13 aa, Borrelia garinii
SLAIKFRNEEAAF

SEQ ID NO: 195438 - protein, 13 aa, Borrelia garinii
LAIKFRNEEAAFL

SEQ ID NO: 195439 - protein, 13 aa, Borrelia garinii
AIKFRNEEAAFLA

SEQ ID NO: 195440 - protein, 13 aa, Borrelia garinii
IKFRNEEAAFLAG

SEQ ID NO: 195441 - protein, 13 aa, Borrelia garinii
KFRNEEAAFLAGY

SEQ ID NO: 195442 - protein, 13 aa, Borrelia garinii
FRNEEAAFLAGYI

SEQ ID NO: 195443 - protein, 13 aa, Borrelia garinii
RNEEAAFLAGYIA

SEQ ID NO: 195444 - protein, 13 aa, Borrelia garinii
NEEAAFLAGYIAA

SEQ ID NO: 195445 - protein, 13 aa, Borrelia garinii
EEAAFLAGYIAAK

SEQ ID NO: 195446 - protein, 13 aa, Borrelia garinii
EAAFLAGYIAAKM

SEQ ID NO: 195447 - protein, 13 aa, Borrelia garinii
AAFLAGYIAAKMS

SEQ ID NO: 195448 - protein, 13 aa, Borrelia garinii
AFLAGYIAAKMSR

SEQ ID NO: 195449 - protein, 13 aa, Borrelia garinii
FLAGYIAAKMSRK

SEQ ID NO: 195450 - protein, 13 aa, Borrelia garinii
LAGYIAAKMSRKE

SEQ ID NO: 195451 - protein, 13 aa, Borrelia garinii
AGYIAAKMSRKEK

SEQ ID NO: 195452 - protein, 13 aa, Borrelia garinii
GYIAAKMSRKEKI

SEQ ID NO: 195453 - protein, 13 aa, Borrelia garinii
YIAAKMSRKEKIG

SEQ ID NO: 195454 - protein, 13 aa, Borrelia garinii
IAAKMSRKEKIGF

SEQ ID NO: 195455 - protein, 13 aa, Borrelia garinii
AAKMSRKEKIGFL

SEQ ID NO: 195456 - protein, 13 aa, Borrelia garinii
AKMSRKEKIGFLT

SEQ ID NO: 195457 - protein, 13 aa, Borrelia garinii
KMSRKEKIGFLTG

SEQ ID NO: 195458 - protein, 13 aa, Borrelia garinii
MSRKEKIGFLTGP

SEQ ID NO: 195459 - protein, 13 aa, Borrelia garinii
SRKEKIGFLTGPE

SEQ ID NO: 195460 - protein, 13 aa, Borrelia garinii
RKEKIGFLTGPES

SEQ ID NO: 195461 - protein, 13 aa, Borrelia garinii
KEKIGFLTGPESE

SEQ ID NO: 195462 - protein, 13 aa, Borrelia garinii
EKIGFLTGPESEY

SEQ ID NO: 195463 - protein, 13 aa, Borrelia garinii
KIGFLTGPESEYL

SEQ ID NO: 195464 - protein, 13 aa, Borrelia garinii
IGFLTGPESEYLN

SEQ ID NO: 195465 - protein, 13 aa, Borrelia garinii
GFLTGPESEYLND

SEQ ID NO: 195466 - protein, 13 aa, Borrelia garinii
FLTGPESEYLNDF

SEQ ID NO: 195467 - protein, 13 aa, Borrelia garinii
LTGPESEYLNDFK

SEQ ID NO: 195468 - protein, 13 aa, Borrelia garinii
TGPESEYLNDFKF

SEQ ID NO: 195469 - protein, 13 aa, Borrelia garinii
GPESEYLNDFKFG

SEQ ID NO: 195470 - protein, 13 aa, Borrelia garinii
PESEYLNDFKFGF

SEQ ID NO: 195471 - protein, 13 aa, Borrelia garinii
ESEYLNDFKFGFK

SEQ ID NO: 195472 - protein, 13 aa, Borrelia garinii
SEYLNDFKFGFKA

SEQ ID NO: 195473 - protein, 13 aa, Borrelia garinii
EYLNDFKFGFKAG

SEQ ID NO: 195474 - protein, 13 aa, Borrelia garinii
YLNDFKFGFKAGI

SEQ ID NO: 195475 - protein, 13 aa, Borrelia garinii
LNDFKFGFKAGIF

SEQ ID NO: 195476 - protein, 13 aa, Borrelia garinii
NDFKFGFKAGIFY

SEQ ID NO: 195477 - protein, 13 aa, Borrelia garinii
DFKFGFKAGIFYA

SEQ ID NO: 195478 - protein, 13 aa, Borrelia garinii
FKFGFKAGIFYAN

SEQ ID NO: 195479 - protein, 13 aa, Borrelia garinii
KFGFKAGIFYANP

SEQ ID NO: 195480 - protein, 13 aa, Borrelia garinii
FGFKAGIFYANPK

SEQ ID NO: 195481 - protein, 13 aa, Borrelia garinii
GFKAGIFYANPKL

SEQ ID NO: 195482 - protein, 13 aa, Borrelia garinii
FKAGIFYANPKLR

SEQ ID NO: 195483 - protein, 13 aa, Borrelia garinii
KAGIFYANPKLRL

SEQ ID NO: 195484 - protein, 13 aa, Borrelia garinii
AGIFYANPKLRLV

SEQ ID NO: 195485 - protein, 13 aa, Borrelia garinii
GIFYANPKLRLVS

SEQ ID NO: 195486 - protein, 13 aa, Borrelia garinii
IFYANPKLRLVSK

SEQ ID NO: 195487 - protein, 13 aa, Borrelia garinii
FYANPKLRLVSKK

SEQ ID NO: 195488 - protein, 13 aa, Borrelia garinii
YANPKLRLVSKKA

SEQ ID NO: 195489 - protein, 13 aa, Borrelia garinii
ANPKLRLVSKKAP

SEQ ID NO: 195490 - protein, 13 aa, Borrelia garinii
NPKLRLVSKKAPS

SEQ ID NO: 195491 - protein, 13 aa, Borrelia garinii
PKLRLVSKKAPSL

SEQ ID NO: 195492 - protein, 13 aa, Borrelia garinii
KLRLVSKKAPSLF

SEQ ID NO: 195493 - protein, 13 aa, Borrelia garinii
LRLVSKKAPSLFD

SEQ ID NO: 195494 - protein, 13 aa, Borrelia garinii
RLVSKKAPSLFDK

SEQ ID NO: 195495 - protein, 13 aa, Borrelia garinii
LVSKKAPSLFDKE

SEQ ID NO: 195496 - protein, 13 aa, Borrelia garinii
VSKKAPSLFDKEK

SEQ ID NO: 195497 - protein, 13 aa, Borrelia garinii
SKKAPSLFDKEKG

SEQ ID NO: 195498 - protein, 13 aa, Borrelia garinii
KKAPSLFDKEKGK

SEQ ID NO: 195499 - protein, 13 aa, Borrelia garinii
KAPSLFDKEKGKE

SEQ ID NO: 195500 - protein, 13 aa, Borrelia garinii
APSLFDKEKGKEM

SEQ ID NO: 195501 - protein, 13 aa, Borrelia garinii
PSLFDKEKGKEMA

SEQ ID NO: 195502 - protein, 13 aa, Borrelia garinii
SLFDKEKGKEMAR

SEQ ID NO: 195503 - protein, 13 aa, Borrelia garinii
LFDKEKGKEMARF

SEQ ID NO: 195504 - protein, 13 aa, Borrelia garinii
FDKEKGKEMARFM

SEQ ID NO: 195505 - protein, 13 aa, Borrelia garinii
DKEKGKEMARFMY

SEQ ID NO: 195506 - protein, 13 aa, Borrelia garinii
KEKGKEMARFMYK

SEQ ID NO: 195507 - protein, 13 aa, Borrelia garinii
EKGKEMARFMYKE

SEQ ID NO: 195508 - protein, 13 aa, Borrelia garinii
KGKEMARFMYKED

SEQ ID NO: 195509 - protein, 13 aa, Borrelia garinii
GKEMARFMYKEDK

SEQ ID NO: 195510 - protein, 13 aa, Borrelia garinii
KEMARFMYKEDKV

SEQ ID NO: 195511 - protein, 13 aa, Borrelia garinii
EMARFMYKEDKVG

SEQ ID NO: 195512 - protein, 13 aa, Borrelia garinii
MARFMYKEDKVGV

SEQ ID NO: 195513 - protein, 13 aa, Borrelia garinii
ARFMYKEDKVGVI

SEQ ID NO: 195514 - protein, 13 aa, Borrelia garinii
RFMYKEDKVGVIF

SEQ ID NO: 195515 - protein, 13 aa, Borrelia garinii
FMYKEDKVGVIFP

SEQ ID NO: 195516 - protein, 13 aa, Borrelia garinii
MYKEDKVGVIFPI

SEQ ID NO: 195517 - protein, 13 aa, Borrelia garinii
YKEDKVGVIFPIA

SEQ ID NO: 195518 - protein, 13 aa, Borrelia garinii
KEDKVGVIFPIAG

SEQ ID NO: 195519 - protein, 13 aa, Borrelia garinii
EDKVGVIFPIAGI

SEQ ID NO: 195520 - protein, 13 aa, Borrelia garinii
DKVGVIFPIAGIT

SEQ ID NO: 195521 - protein, 13 aa, Borrelia garinii
KVGVIFPIAGITG

SEQ ID NO: 195522 - protein, 13 aa, Borrelia garinii
VGVIFPIAGITGL

SEQ ID NO: 195523 - protein, 13 aa, Borrelia garinii
GVIFPIAGITGLG

SEQ ID NO: 195524 - protein, 13 aa, Borrelia garinii
VIFPIAGITGLGV

SEQ ID NO: 195525 - protein, 13 aa, Borrelia garinii
IFPIAGITGLGVY

SEQ ID NO: 195526 - protein, 13 aa, Borrelia garinii
FPIAGITGLGVYD

SEQ ID NO: 195527 - protein, 13 aa, Borrelia garinii
PIAGITGLGVYDA

SEQ ID NO: 195528 - protein, 13 aa, Borrelia garinii
IAGITGLGVYDAA

SEQ ID NO: 195529 - protein, 13 aa, Borrelia garinii
AGITGLGVYDAAK

SEQ ID NO: 195530 - protein, 13 aa, Borrelia garinii
GITGLGVYDAAKE

SEQ ID NO: 195531 - protein, 13 aa, Borrelia garinii
ITGLGVYDAAKEL

SEQ ID NO: 195532 - protein, 13 aa, Borrelia garinii
TGLGVYDAAKELG

SEQ ID NO: 195533 - protein, 13 aa, Borrelia garinii
GLGVYDAAKELGP

SEQ ID NO: 195534 - protein, 13 aa, Borrelia garinii
LGVYDAAKELGPK

SEQ ID NO: 195535 - protein, 13 aa, Borrelia garinii
GVYDAAKELGPKY

SEQ ID NO: 195536 - protein, 13 aa, Borrelia garinii
VYDAAKELGPKYY

SEQ ID NO: 195537 - protein, 13 aa, Borrelia garinii
YDAAKELGPKYYV

SEQ ID NO: 195538 - protein, 13 aa, Borrelia garinii
DAAKELGPKYYVI

SEQ ID NO: 195539 - protein, 13 aa, Borrelia garinii
AAKELGPKYYVIG

SEQ ID NO: 195540 - protein, 13 aa, Borrelia garinii
AKELGPKYYVIGL

SEQ ID NO: 195541 - protein, 13 aa, Borrelia garinii
KELGPKYYVIGLN

SEQ ID NO: 195542 - protein, 13 aa, Borrelia garinii
ELGPKYYVIGLNQ

SEQ ID NO: 195543 - protein, 13 aa, Borrelia garinii
LGPKYYVIGLNQD

SEQ ID NO: 195544 - protein, 13 aa, Borrelia garinii
GPKYYVIGLNQDQ

SEQ ID NO: 195545 - protein, 13 aa, Borrelia garinii
PKYYVIGLNQDQS

SEQ ID NO: 195546 - protein, 13 aa, Borrelia garinii
KYYVIGLNQDQSY

SEQ ID NO: 195547 - protein, 13 aa, Borrelia garinii
YYVIGLNQDQSYI

SEQ ID NO: 195548 - protein, 13 aa, Borrelia garinii
YVIGLNQDQSYIA

SEQ ID NO: 195549 - protein, 13 aa, Borrelia garinii
VIGLNQDQSYIAP

SEQ ID NO: 195550 - protein, 13 aa, Borrelia garinii
IGLNQDQSYIAPQ

SEQ ID NO: 195551 - protein, 13 aa, Borrelia garinii
GLNQDQSYIAPQN

SEQ ID NO: 195552 - protein, 13 aa, Borrelia garinii
LNQDQSYIAPQNV

SEQ ID NO: 195553 - protein, 13 aa, Borrelia garinii
NQDQSYIAPQNVI

SEQ ID NO: 195554 - protein, 13 aa, Borrelia garinii
QDQSYIAPQNVIT

SEQ ID NO: 195555 - protein, 13 aa, Borrelia garinii
DQSYIAPQNVITS

SEQ ID NO: 195556 - protein, 13 aa, Borrelia garinii
QSYIAPQNVITSV

SEQ ID NO: 195557 - protein, 13 aa, Borrelia garinii
SYIAPQNVITSVL

SEQ ID NO: 195558 - protein, 13 aa, Borrelia garinii
YIAPQNVITSVLK

SEQ ID NO: 195559 - protein, 13 aa, Borrelia garinii
IAPQNVITSVLKD

SEQ ID NO: 195560 - protein, 13 aa, Borrelia garinii
APQNVITSVLKDI

SEQ ID NO: 195561 - protein, 13 aa, Borrelia garinii
PQNVITSVLKDIG

SEQ ID NO: 195562 - protein, 13 aa, Borrelia garinii
QNVITSVLKDIGK

SEQ ID NO: 195563 - protein, 13 aa, Borrelia garinii
NVITSVLKDIGKV

SEQ ID NO: 195564 - protein, 13 aa, Borrelia garinii
VITSVLKDIGKVI

SEQ ID NO: 195565 - protein, 13 aa, Borrelia garinii
ITSVLKDIGKVIY

SEQ ID NO: 195566 - protein, 13 aa, Borrelia garinii
TSVLKDIGKVIYS

SEQ ID NO: 195567 - protein, 13 aa, Borrelia garinii
SVLKDIGKVIYSV

SEQ ID NO: 195568 - protein, 13 aa, Borrelia garinii
VLKDIGKVIYSVS

SEQ ID NO: 195569 - protein, 13 aa, Borrelia garinii
LKDIGKVIYSVSS

SEQ ID NO: 195570 - protein, 13 aa, Borrelia garinii
KDIGKVIYSVSSD

SEQ ID NO: 195571 - protein, 13 aa, Borrelia garinii
DIGKVIYSVSSDY

SEQ ID NO: 195572 - protein, 13 aa, Borrelia garinii
IGKVIYSVSSDYI

SEQ ID NO: 195573 - protein, 13 aa, Borrelia garinii
GKVIYSVSSDYIK

SEQ ID NO: 195574 - protein, 13 aa, Borrelia garinii
KVIYSVSSDYIKN

SEQ ID NO: 195575 - protein, 13 aa, Borrelia garinii
VIYSVSSDYIKNG

SEQ ID NO: 195576 - protein, 13 aa, Borrelia garinii
IYSVSSDYIKNGV

SEQ ID NO: 195577 - protein, 13 aa, Borrelia garinii
YSVSSDYIKNGVF

SEQ ID NO: 195578 - protein, 13 aa, Borrelia garinii
SVSSDYIKNGVFK

SEQ ID NO: 195579 - protein, 13 aa, Borrelia garinii
VSSDYIKNGVFKG

SEQ ID NO: 195580 - protein, 13 aa, Borrelia garinii
SSDYIKNGVFKGG

SEQ ID NO: 195581 - protein, 13 aa, Borrelia garinii
SDYIKNGVFKGGV

SEQ ID NO: 195582 - protein, 13 aa, Borrelia garinii
DYIKNGVFKGGVV

SEQ ID NO: 195583 - protein, 13 aa, Borrelia garinii
YIKNGVFKGGVVI

SEQ ID NO: 195584 - protein, 13 aa, Borrelia garinii
IKNGVFKGGVVID

SEQ ID NO: 195585 - protein, 13 aa, Borrelia garinii
KNGVFKGGVVIDR

SEQ ID NO: 195586 - protein, 13 aa, Borrelia garinii
NGVFKGGVVIDRG

SEQ ID NO: 195587 - protein, 13 aa, Borrelia garinii
GVFKGGVVIDRGL

SEQ ID NO: 195588 - protein, 13 aa, Borrelia garinii
VFKGGVVIDRGLK

SEQ ID NO: 195589 - protein, 13 aa, Borrelia garinii
FKGGVVIDRGLKE

SEQ ID NO: 195590 - protein, 13 aa, Borrelia garinii
KGGVVIDRGLKEG

SEQ ID NO: 195591 - protein, 13 aa, Borrelia garinii
GGVVIDRGLKEGV

SEQ ID NO: 195592 - protein, 13 aa, Borrelia garinii
GVVIDRGLKEGVI

SEQ ID NO: 195593 - protein, 13 aa, Borrelia garinii
VVIDRGLKEGVIE

SEQ ID NO: 195594 - protein, 13 aa, Borrelia garinii
VIDRGLKEGVIEI

SEQ ID NO: 195595 - protein, 13 aa, Borrelia garinii
IDRGLKEGVIEIV

SEQ ID NO: 195596 - protein, 13 aa, Borrelia garinii
DRGLKEGVIEIVK

SEQ ID NO: 195597 - protein, 13 aa, Borrelia garinii
RGLKEGVIEIVKD

SEQ ID NO: 195598 - protein, 13 aa, Borrelia garinii
GLKEGVIEIVKDP

SEQ ID NO: 195599 - protein, 13 aa, Borrelia garinii
LKEGVIEIVKDPD

SEQ ID NO: 195600 - protein, 13 aa, Borrelia garinii
KEGVIEIVKDPDV

SEQ ID NO: 195601 - protein, 13 aa, Borrelia garinii
EGVIEIVKDPDVL

SEQ ID NO: 195602 - protein, 13 aa, Borrelia garinii
GVIEIVKDPDVLN

SEQ ID NO: 195603 - protein, 13 aa, Borrelia garinii
VIEIVKDPDVLNN

SEQ ID NO: 195604 - protein, 13 aa, Borrelia garinii
IEIVKDPDVLNNR

SEQ ID NO: 195605 - protein, 13 aa, Borrelia garinii
EIVKDPDVLNNRL

SEQ ID NO: 195606 - protein, 13 aa, Borrelia garinii
IVKDPDVLNNRLV

SEQ ID NO: 195607 - protein, 13 aa, Borrelia garinii
VKDPDVLNNRLVN

SEQ ID NO: 195608 - protein, 13 aa, Borrelia garinii
KDPDVLNNRLVNE

SEQ ID NO: 195609 - protein, 13 aa, Borrelia garinii
DPDVLNNRLVNEV

SEQ ID NO: 195610 - protein, 13 aa, Borrelia garinii
PDVLNNRLVNEVV

SEQ ID NO: 195611 - protein, 13 aa, Borrelia garinii
DVLNNRLVNEVVE

SEQ ID NO: 195612 - protein, 13 aa, Borrelia garinii
VLNNRLVNEVVEL

SEQ ID NO: 195613 - protein, 13 aa, Borrelia garinii
LNNRLVNEVVELE

SEQ ID NO: 195614 - protein, 13 aa, Borrelia garinii
NNRLVNEVVELEN

SEQ ID NO: 195615 - protein, 13 aa, Borrelia garinii
NRLVNEVVELENK

SEQ ID NO: 195616 - protein, 13 aa, Borrelia garinii
RLVNEVVELENKI

SEQ ID NO: 195617 - protein, 13 aa, Borrelia garinii
LVNEVVELENKII

SEQ ID NO: 195618 - protein, 13 aa, Borrelia garinii
VNEVVELENKIIS

SEQ ID NO: 195619 - protein, 13 aa, Borrelia garinii
NEVVELENKIISG

SEQ ID NO: 195620 - protein, 13 aa, Borrelia garinii
EVVELENKIISGE

SEQ ID NO: 195621 - protein, 13 aa, Borrelia garinii
VVELENKIISGEI

SEQ ID NO: 195622 - protein, 13 aa, Borrelia garinii
VELENKIISGEII

SEQ ID NO: 195623 - protein, 13 aa, Borrelia garinii
ELENKIISGEIIV

SEQ ID NO: 195624 - protein, 13 aa, Borrelia garinii
LENKIISGEIIVP

SEQ ID NO: 195625 - protein, 13 aa, Borrelia garinii
ENKIISGEIIVPD

SEQ ID NO: 195626 - protein, 13 aa, Borrelia garinii
NKIISGEIIVPDS

SEQ ID NO: 195627 - protein, 13 aa, Borrelia garinii
KIISGEIIVPDSE

SEQ ID NO: 195628 - protein, 13 aa, Borrelia garinii
IISGEIIVPDSEY

SEQ ID NO: 195629 - protein, 13 aa, Borrelia garinii
ISGEIIVPDSEYA

SEQ ID NO: 195630 - protein, 13 aa, Borrelia garinii
SGEIIVPDSEYAF

SEQ ID NO: 195631 - protein, 13 aa, Borrelia garinii
GEIIVPDSEYAFD

SEQ ID NO: 195632 - protein, 13 aa, Borrelia garinii
EIIVPDSEYAFDL

SEQ ID NO: 195633 - protein, 13 aa, Borrelia garinii
IIVPDSEYAFDLF

SEQ ID NO: 195634 - protein, 13 aa, Borrelia garinii
IVPDSEYAFDLFK

SEQ ID NO: 195635 - protein, 13 aa, Borrelia garinii
VPDSEYAFDLFKS

SEQ ID NO: 195636 - protein, 13 aa, Borrelia garinii
PDSEYAFDLFKSK

SEQ ID NO: 195637 - protein, 13 aa, Borrelia garinii
DSEYAFDLFKSKL

SEQ ID NO: 195638 - protein, 14 aa, Borrelia garinii
MFKRFVFIALSLLV

SEQ ID NO: 195639 - protein, 14 aa, Borrelia garinii
FKRFVFIALSLLVL

SEQ ID NO: 195640 - protein, 14 aa, Borrelia garinii
KRFVFIALSLLVLA

SEQ ID NO: 195641 - protein, 14 aa, Borrelia garinii
RFVFIALSLLVLAC

SEQ ID NO: 195642 - protein, 14 aa, Borrelia garinii
FVFIALSLLVLACF

SEQ ID NO: 195643 - protein, 14 aa, Borrelia garinii
VFIALSLLVLACFK

SEQ ID NO: 195644 - protein, 14 aa, Borrelia garinii
FIALSLLVLACFKS

SEQ ID NO: 195645 - protein, 14 aa, Borrelia garinii
IALSLLVLACFKSN

SEQ ID NO: 195646 - protein, 14 aa, Borrelia garinii
ALSLLVLACFKSNK

SEQ ID NO: 195647 - protein, 14 aa, Borrelia garinii
LSLLVLACFKSNKK

SEQ ID NO: 195648 - protein, 14 aa, Borrelia garinii
SLLVLACFKSNKKS

SEQ ID NO: 195649 - protein, 14 aa, Borrelia garinii
LLVLACFKSNKKSV

SEQ ID NO: 195650 - protein, 14 aa, Borrelia garinii
LVLACFKSNKKSVK

SEQ ID NO: 195651 - protein, 14 aa, Borrelia garinii
VLACFKSNKKSVKS

SEQ ID NO: 195652 - protein, 14 aa, Borrelia garinii
LACFKSNKKSVKSD

SEQ ID NO: 195653 - protein, 14 aa, Borrelia garinii
ACFKSNKKSVKSDK

SEQ ID NO: 195654 - protein, 14 aa, Borrelia garinii
CFKSNKKSVKSDKV

SEQ ID NO: 195655 - protein, 14 aa, Borrelia garinii
FKSNKKSVKSDKVI

SEQ ID NO: 195656 - protein, 14 aa, Borrelia garinii
KSNKKSVKSDKVII

SEQ ID NO: 195657 - protein, 14 aa, Borrelia garinii
SNKKSVKSDKVIIG

SEQ ID NO: 195658 - protein, 14 aa, Borrelia garinii
NKKSVKSDKVIIGV

SEQ ID NO: 195659 - protein, 14 aa, Borrelia garinii
KKSVKSDKVIIGVL

SEQ ID NO: 195660 - protein, 14 aa, Borrelia garinii
KSVKSDKVIIGVLA

SEQ ID NO: 195661 - protein, 14 aa, Borrelia garinii
SVKSDKVIIGVLAN

SEQ ID NO: 195662 - protein, 14 aa, Borrelia garinii
VKSDKVIIGVLANG

SEQ ID NO: 195663 - protein, 14 aa, Borrelia garinii
KSDKVIIGVLANGS

SEQ ID NO: 195664 - protein, 14 aa, Borrelia garinii
SDKVIIGVLANGSF

SEQ ID NO: 195665 - protein, 14 aa, Borrelia garinii
DKVIIGVLANGSFY

SEQ ID NO: 195666 - protein, 14 aa, Borrelia garinii
KVIIGVLANGSFYD

SEQ ID NO: 195667 - protein, 14 aa, Borrelia garinii
VIIGVLANGSFYDK

SEQ ID NO: 195668 - protein, 14 aa, Borrelia garinii
IIGVLANGSFYDKG

SEQ ID NO: 195669 - protein, 14 aa, Borrelia garinii
IGVLANGSFYDKGY

SEQ ID NO: 195670 - protein, 14 aa, Borrelia garinii
GVLANGSFYDKGYN

SEQ ID NO: 195671 - protein, 14 aa, Borrelia garinii
VLANGSFYDKGYNQ

SEQ ID NO: 195672 - protein, 14 aa, Borrelia garinii
LANGSFYDKGYNQS

SEQ ID NO: 195673 - protein, 14 aa, Borrelia garinii
ANGSFYDKGYNQSV

SEQ ID NO: 195674 - protein, 14 aa, Borrelia garinii
NGSFYDKGYNQSVY

SEQ ID NO: 195675 - protein, 14 aa, Borrelia garinii
GSFYDKGYNQSVYD

SEQ ID NO: 195676 - protein, 14 aa, Borrelia garinii
SFYDKGYNQSVYDG

SEQ ID NO: 195677 - protein, 14 aa, Borrelia garinii
FYDKGYNQSVYDGV

SEQ ID NO: 195678 - protein, 14 aa, Borrelia garinii
YDKGYNQSVYDGVV

SEQ ID NO: 195679 - protein, 14 aa, Borrelia garinii
DKGYNQSVYDGVVK

SEQ ID NO: 195680 - protein, 14 aa, Borrelia garinii
KGYNQSVYDGVVKL

SEQ ID NO: 195681 - protein, 14 aa, Borrelia garinii
GYNQSVYDGVVKLK

SEQ ID NO: 195682 - protein, 14 aa, Borrelia garinii
YNQSVYDGVVKLKD

SEQ ID NO: 195683 - protein, 14 aa, Borrelia garinii
NQSVYDGVVKLKDD

SEQ ID NO: 195684 - protein, 14 aa, Borrelia garinii
QSVYDGVVKLKDDF

SEQ ID NO: 195685 - protein, 14 aa, Borrelia garinii
SVYDGVVKLKDDFG

SEQ ID NO: 195686 - protein, 14 aa, Borrelia garinii
VYDGVVKLKDDFGI

SEQ ID NO: 195687 - protein, 14 aa, Borrelia garinii
YDGVVKLKDDFGIK

SEQ ID NO: 195688 - protein, 14 aa, Borrelia garinii
DGVVKLKDDFGIKL

SEQ ID NO: 195689 - protein, 14 aa, Borrelia garinii
GVVKLKDDFGIKLI

SEQ ID NO: 195690 - protein, 14 aa, Borrelia garinii
VVKLKDDFGIKLIT

SEQ ID NO: 195691 - protein, 14 aa, Borrelia garinii
VKLKDDFGIKLITK

SEQ ID NO: 195692 - protein, 14 aa, Borrelia garinii
KLKDDFGIKLITKS

SEQ ID NO: 195693 - protein, 14 aa, Borrelia garinii
LKDDFGIKLITKSL

SEQ ID NO: 195694 - protein, 14 aa, Borrelia garinii
KDDFGIKLITKSLR

SEQ ID NO: 195695 - protein, 14 aa, Borrelia garinii
DDFGIKLITKSLRP

SEQ ID NO: 195696 - protein, 14 aa, Borrelia garinii
DFGIKLITKSLRPY

SEQ ID NO: 195697 - protein, 14 aa, Borrelia garinii
FGIKLITKSLRPYP

SEQ ID NO: 195698 - protein, 14 aa, Borrelia garinii
GIKLITKSLRPYPI

SEQ ID NO: 195699 - protein, 14 aa, Borrelia garinii
IKLITKSLRPYPIE

SEQ ID NO: 195700 - protein, 14 aa, Borrelia garinii
KLITKSLRPYPIEG

SEQ ID NO: 195701 - protein, 14 aa, Borrelia garinii
LITKSLRPYPIEGK

SEQ ID NO: 195702 - protein, 14 aa, Borrelia garinii
ITKSLRPYPIEGKR

SEQ ID NO: 195703 - protein, 14 aa, Borrelia garinii
TKSLRPYPIEGKRL

SEQ ID NO: 195704 - protein, 14 aa, Borrelia garinii
KSLRPYPIEGKRLL

SEQ ID NO: 195705 - protein, 14 aa, Borrelia garinii
SLRPYPIEGKRLLT

SEQ ID NO: 195706 - protein, 14 aa, Borrelia garinii
LRPYPIEGKRLLTV

SEQ ID NO: 195707 - protein, 14 aa, Borrelia garinii
RPYPIEGKRLLTVN

SEQ ID NO: 195708 - protein, 14 aa, Borrelia garinii
PYPIEGKRLLTVNE

SEQ ID NO: 195709 - protein, 14 aa, Borrelia garinii
YPIEGKRLLTVNEA

SEQ ID NO: 195710 - protein, 14 aa, Borrelia garinii
PIEGKRLLTVNEAM

SEQ ID NO: 195711 - protein, 14 aa, Borrelia garinii
IEGKRLLTVNEAMA

SEQ ID NO: 195712 - protein, 14 aa, Borrelia garinii
EGKRLLTVNEAMAE

SEQ ID NO: 195713 - protein, 14 aa, Borrelia garinii
GKRLLTVNEAMAED

SEQ ID NO: 195714 - protein, 14 aa, Borrelia garinii
KRLLTVNEAMAEDA

SEQ ID NO: 195715 - protein, 14 aa, Borrelia garinii
RLLTVNEAMAEDAY

SEQ ID NO: 195716 - protein, 14 aa, Borrelia garinii
LLTVNEAMAEDAYE

SEQ ID NO: 195717 - protein, 14 aa, Borrelia garinii
LTVNEAMAEDAYEV

SEQ ID NO: 195718 - protein, 14 aa, Borrelia garinii
TVNEAMAEDAYEVQ

SEQ ID NO: 195719 - protein, 14 aa, Borrelia garinii
VNEAMAEDAYEVQK

SEQ ID NO: 195720 - protein, 14 aa, Borrelia garinii
NEAMAEDAYEVQKN

SEQ ID NO: 195721 - protein, 14 aa, Borrelia garinii
EAMAEDAYEVQKNP

SEQ ID NO: 195722 - protein, 14 aa, Borrelia garinii
AMAEDAYEVQKNPL

SEQ ID NO: 195723 - protein, 14 aa, Borrelia garinii
MAEDAYEVQKNPLN

SEQ ID NO: 195724 - protein, 14 aa, Borrelia garinii
AEDAYEVQKNPLNL

SEQ ID NO: 195725 - protein, 14 aa, Borrelia garinii
EDAYEVQKNPLNLF

SEQ ID NO: 195726 - protein, 14 aa, Borrelia garinii
DAYEVQKNPLNLFW

SEQ ID NO: 195727 - protein, 14 aa, Borrelia garinii
AYEVQKNPLNLFWL

SEQ ID NO: 195728 - protein, 14 aa, Borrelia garinii
YEVQKNPLNLFWLA

SEQ ID NO: 195729 - protein, 14 aa, Borrelia garinii
EVQKNPLNLFWLAG

SEQ ID NO: 195730 - protein, 14 aa, Borrelia garinii
VQKNPLNLFWLAGY

SEQ ID NO: 195731 - protein, 14 aa, Borrelia garinii
QKNPLNLFWLAGYQ

SEQ ID NO: 195732 - protein, 14 aa, Borrelia garinii
KNPLNLFWLAGYQF

SEQ ID NO: 195733 - protein, 14 aa, Borrelia garinii
NPLNLFWLAGYQFS

SEQ ID NO: 195734 - protein, 14 aa, Borrelia garinii
PLNLFWLAGYQFSS

SEQ ID NO: 195735 - protein, 14 aa, Borrelia garinii
LNLFWLAGYQFSSL

SEQ ID NO: 195736 - protein, 14 aa, Borrelia garinii
NLFWLAGYQFSSLS

SEQ ID NO: 195737 - protein, 14 aa, Borrelia garinii
LFWLAGYQFSSLSV

SEQ ID NO: 195738 - protein, 14 aa, Borrelia garinii
FWLAGYQFSSLSVK

SEQ ID NO: 195739 - protein, 14 aa, Borrelia garinii
WLAGYQFSSLSVKL

SEQ ID NO: 195740 - protein, 14 aa, Borrelia garinii
LAGYQFSSLSVKLS

SEQ ID NO: 195741 - protein, 14 aa, Borrelia garinii
AGYQFSSLSVKLSY

SEQ ID NO: 195742 - protein, 14 aa, Borrelia garinii
GYQFSSLSVKLSYE

SEQ ID NO: 195743 - protein, 14 aa, Borrelia garinii
YQFSSLSVKLSYER

SEQ ID NO: 195744 - protein, 14 aa, Borrelia garinii
QFSSLSVKLSYERP

SEQ ID NO: 195745 - protein, 14 aa, Borrelia garinii
FSSLSVKLSYERPD

SEQ ID NO: 195746 - protein, 14 aa, Borrelia garinii
SSLSVKLSYERPDI

SEQ ID NO: 195747 - protein, 14 aa, Borrelia garinii
SLSVKLSYERPDIY

SEQ ID NO: 195748 - protein, 14 aa, Borrelia garinii
LSVKLSYERPDIYY

SEQ ID NO: 195749 - protein, 14 aa, Borrelia garinii
SVKLSYERPDIYYG

SEQ ID NO: 195750 - protein, 14 aa, Borrelia garinii
VKLSYERPDIYYGI

SEQ ID NO: 195751 - protein, 14 aa, Borrelia garinii
KLSYERPDIYYGII

SEQ ID NO: 195752 - protein, 14 aa, Borrelia garinii
LSYERPDIYYGIID

SEQ ID NO: 195753 - protein, 14 aa, Borrelia garinii
SYERPDIYYGIIDA

SEQ ID NO: 195754 - protein, 14 aa, Borrelia garinii
YERPDIYYGIIDAF

SEQ ID NO: 195755 - protein, 14 aa, Borrelia garinii
ERPDIYYGIIDAFD

SEQ ID NO: 195756 - protein, 14 aa, Borrelia garinii
RPDIYYGIIDAFDY

SEQ ID NO: 195757 - protein, 14 aa, Borrelia garinii
PDIYYGIIDAFDYG

SEQ ID NO: 195758 - protein, 14 aa, Borrelia garinii
DIYYGIIDAFDYGD

SEQ ID NO: 195759 - protein, 14 aa, Borrelia garinii
IYYGIIDAFDYGDI

SEQ ID NO: 195760 - protein, 14 aa, Borrelia garinii
YYGIIDAFDYGDIQ

SEQ ID NO: 195761 - protein, 14 aa, Borrelia garinii
YGIIDAFDYGDIQV

SEQ ID NO: 195762 - protein, 14 aa, Borrelia garinii
GIIDAFDYGDIQVP

SEQ ID NO: 195763 - protein, 14 aa, Borrelia garinii
IIDAFDYGDIQVPK

SEQ ID NO: 195764 - protein, 14 aa, Borrelia garinii
IDAFDYGDIQVPKN

SEQ ID NO: 195765 - protein, 14 aa, Borrelia garinii
DAFDYGDIQVPKNS

SEQ ID NO: 195766 - protein, 14 aa, Borrelia garinii
AFDYGDIQVPKNSL

SEQ ID NO: 195767 - protein, 14 aa, Borrelia garinii
FDYGDIQVPKNSLA

SEQ ID NO: 195768 - protein, 14 aa, Borrelia garinii
DYGDIQVPKNSLAI

SEQ ID NO: 195769 - protein, 14 aa, Borrelia garinii
YGDIQVPKNSLAIK

SEQ ID NO: 195770 - protein, 14 aa, Borrelia garinii
GDIQVPKNSLAIKF

SEQ ID NO: 195771 - protein, 14 aa, Borrelia garinii
DIQVPKNSLAIKFR

SEQ ID NO: 195772 - protein, 14 aa, Borrelia garinii
IQVPKNSLAIKFRN

SEQ ID NO: 195773 - protein, 14 aa, Borrelia garinii
QVPKNSLAIKFRNE

SEQ ID NO: 195774 - protein, 14 aa, Borrelia garinii
VPKNSLAIKFRNEE

SEQ ID NO: 195775 - protein, 14 aa, Borrelia garinii
PKNSLAIKFRNEEA

SEQ ID NO: 195776 - protein, 14 aa, Borrelia garinii
KNSLAIKFRNEEAA

SEQ ID NO: 195777 - protein, 14 aa, Borrelia garinii
NSLAIKFRNEEAAF

SEQ ID NO: 195778 - protein, 14 aa, Borrelia garinii
SLAIKFRNEEAAFL

SEQ ID NO: 195779 - protein, 14 aa, Borrelia garinii
LAIKFRNEEAAFLA

SEQ ID NO: 195780 - protein, 14 aa, Borrelia garinii
AIKFRNEEAAFLAG

SEQ ID NO: 195781 - protein, 14 aa, Borrelia garinii
IKFRNEEAAFLAGY

SEQ ID NO: 195782 - protein, 14 aa, Borrelia garinii
KFRNEEAAFLAGYI

SEQ ID NO: 195783 - protein, 14 aa, Borrelia garinii
FRNEEAAFLAGYIA

SEQ ID NO: 195784 - protein, 14 aa, Borrelia garinii
RNEEAAFLAGYIAA

SEQ ID NO: 195785 - protein, 14 aa, Borrelia garinii
NEEAAFLAGYIAAK

SEQ ID NO: 195786 - protein, 14 aa, Borrelia garinii
EEAAFLAGYIAAKM

SEQ ID NO: 195787 - protein, 14 aa, Borrelia garinii
EAAFLAGYIAAKMS

SEQ ID NO: 195788 - protein, 14 aa, Borrelia garinii
AAFLAGYIAAKMSR

SEQ ID NO: 195789 - protein, 14 aa, Borrelia garinii
AFLAGYIAAKMSRK

SEQ ID NO: 195790 - protein, 14 aa, Borrelia garinii
FLAGYIAAKMSRKE

SEQ ID NO: 195791 - protein, 14 aa, Borrelia garinii
LAGYIAAKMSRKEK

SEQ ID NO: 195792 - protein, 14 aa, Borrelia garinii
AGYIAAKMSRKEKI

SEQ ID NO: 195793 - protein, 14 aa, Borrelia garinii
GYIAAKMSRKEKIG

SEQ ID NO: 195794 - protein, 14 aa, Borrelia garinii
YIAAKMSRKEKIGF

SEQ ID NO: 195795 - protein, 14 aa, Borrelia garinii
IAAKMSRKEKIGFL

SEQ ID NO: 195796 - protein, 14 aa, Borrelia garinii
AAKMSRKEKIGFLT

SEQ ID NO: 195797 - protein, 14 aa, Borrelia garinii
AKMSRKEKIGFLTG

SEQ ID NO: 195798 - protein, 14 aa, Borrelia garinii
KMSRKEKIGFLTGP

SEQ ID NO: 195799 - protein, 14 aa, Borrelia garinii
MSRKEKIGFLTGPE

SEQ ID NO: 195800 - protein, 14 aa, Borrelia garinii
SRKEKIGFLTGPES

SEQ ID NO: 195801 - protein, 14 aa, Borrelia garinii
RKEKIGFLTGPESE

SEQ ID NO: 195802 - protein, 14 aa, Borrelia garinii
KEKIGFLTGPESEY

SEQ ID NO: 195803 - protein, 14 aa, Borrelia garinii
EKIGFLTGPESEYL

SEQ ID NO: 195804 - protein, 14 aa, Borrelia garinii
KIGFLTGPESEYLN

SEQ ID NO: 195805 - protein, 14 aa, Borrelia garinii
IGFLTGPESEYLND

SEQ ID NO: 195806 - protein, 14 aa, Borrelia garinii
GFLTGPESEYLNDF

SEQ ID NO: 195807 - protein, 14 aa, Borrelia garinii
FLTGPESEYLNDFK

SEQ ID NO: 195808 - protein, 14 aa, Borrelia garinii
LTGPESEYLNDFKF

SEQ ID NO: 195809 - protein, 14 aa, Borrelia garinii
TGPESEYLNDFKFG

SEQ ID NO: 195810 - protein, 14 aa, Borrelia garinii
GPESEYLNDFKFGF

SEQ ID NO: 195811 - protein, 14 aa, Borrelia garinii
PESEYLNDFKFGFK

SEQ ID NO: 195812 - protein, 14 aa, Borrelia garinii
ESEYLNDFKFGFKA

SEQ ID NO: 195813 - protein, 14 aa, Borrelia garinii
SEYLNDFKFGFKAG

SEQ ID NO: 195814 - protein, 14 aa, Borrelia garinii
EYLNDFKFGFKAGI

SEQ ID NO: 195815 - protein, 14 aa, Borrelia garinii
YLNDFKFGFKAGIF

SEQ ID NO: 195816 - protein, 14 aa, Borrelia garinii
LNDFKFGFKAGIFY

SEQ ID NO: 195817 - protein, 14 aa, Borrelia garinii
NDFKFGFKAGIFYA

SEQ ID NO: 195818 - protein, 14 aa, Borrelia garinii
DFKFGFKAGIFYAN

SEQ ID NO: 195819 - protein, 14 aa, Borrelia garinii
FKFGFKAGIFYANP

SEQ ID NO: 195820 - protein, 14 aa, Borrelia garinii
KFGFKAGIFYANPK

SEQ ID NO: 195821 - protein, 14 aa, Borrelia garinii
FGFKAGIFYANPKL

SEQ ID NO: 195822 - protein, 14 aa, Borrelia garinii
GFKAGIFYANPKLR

SEQ ID NO: 195823 - protein, 14 aa, Borrelia garinii
FKAGIFYANPKLRL

SEQ ID NO: 195824 - protein, 14 aa, Borrelia garinii
KAGIFYANPKLRLV

SEQ ID NO: 195825 - protein, 14 aa, Borrelia garinii
AGIFYANPKLRLVS

SEQ ID NO: 195826 - protein, 14 aa, Borrelia garinii
GIFYANPKLRLVSK

SEQ ID NO: 195827 - protein, 14 aa, Borrelia garinii
IFYANPKLRLVSKK

SEQ ID NO: 195828 - protein, 14 aa, Borrelia garinii
FYANPKLRLVSKKA

SEQ ID NO: 195829 - protein, 14 aa, Borrelia garinii
YANPKLRLVSKKAP

SEQ ID NO: 195830 - protein, 14 aa, Borrelia garinii
ANPKLRLVSKKAPS

SEQ ID NO: 195831 - protein, 14 aa, Borrelia garinii
NPKLRLVSKKAPSL

SEQ ID NO: 195832 - protein, 14 aa, Borrelia garinii
PKLRLVSKKAPSLF

SEQ ID NO: 195833 - protein, 14 aa, Borrelia garinii
KLRLVSKKAPSLFD

SEQ ID NO: 195834 - protein, 14 aa, Borrelia garinii
LRLVSKKAPSLFDK

SEQ ID NO: 195835 - protein, 14 aa, Borrelia garinii
RLVSKKAPSLFDKE

SEQ ID NO: 195836 - protein, 14 aa, Borrelia garinii
LVSKKAPSLFDKEK

SEQ ID NO: 195837 - protein, 14 aa, Borrelia garinii
VSKKAPSLFDKEKG

SEQ ID NO: 195838 - protein, 14 aa, Borrelia garinii
SKKAPSLFDKEKGK

SEQ ID NO: 195839 - protein, 14 aa, Borrelia garinii
KKAPSLFDKEKGKE

SEQ ID NO: 195840 - protein, 14 aa, Borrelia garinii
KAPSLFDKEKGKEM

SEQ ID NO: 195841 - protein, 14 aa, Borrelia garinii
APSLFDKEKGKEMA

SEQ ID NO: 195842 - protein, 14 aa, Borrelia garinii
PSLFDKEKGKEMAR

SEQ ID NO: 195843 - protein, 14 aa, Borrelia garinii
SLFDKEKGKEMARF

SEQ ID NO: 195844 - protein, 14 aa, Borrelia garinii
LFDKEKGKEMARFM

SEQ ID NO: 195845 - protein, 14 aa, Borrelia garinii
FDKEKGKEMARFMY

SEQ ID NO: 195846 - protein, 14 aa, Borrelia garinii
DKEKGKEMARFMYK

SEQ ID NO: 195847 - protein, 14 aa, Borrelia garinii
KEKGKEMARFMYKE

SEQ ID NO: 195848 - protein, 14 aa, Borrelia garinii
EKGKEMARFMYKED

SEQ ID NO: 195849 - protein, 14 aa, Borrelia garinii
KGKEMARFMYKEDK

SEQ ID NO: 195850 - protein, 14 aa, Borrelia garinii
GKEMARFMYKEDKV

SEQ ID NO: 195851 - protein, 14 aa, Borrelia garinii
KEMARFMYKEDKVG

SEQ ID NO: 195852 - protein, 14 aa, Borrelia garinii
EMARFMYKEDKVGV

SEQ ID NO: 195853 - protein, 14 aa, Borrelia garinii
MARFMYKEDKVGVI

SEQ ID NO: 195854 - protein, 14 aa, Borrelia garinii
ARFMYKEDKVGVIF

SEQ ID NO: 195855 - protein, 14 aa, Borrelia garinii
RFMYKEDKVGVIFP

SEQ ID NO: 195856 - protein, 14 aa, Borrelia garinii
FMYKEDKVGVIFPI

SEQ ID NO: 195857 - protein, 14 aa, Borrelia garinii
MYKEDKVGVIFPIA

SEQ ID NO: 195858 - protein, 14 aa, Borrelia garinii
YKEDKVGVIFPIAG

SEQ ID NO: 195859 - protein, 14 aa, Borrelia garinii
KEDKVGVIFPIAGI

SEQ ID NO: 195860 - protein, 14 aa, Borrelia garinii
EDKVGVIFPIAGIT

SEQ ID NO: 195861 - protein, 14 aa, Borrelia garinii
DKVGVIFPIAGITG

SEQ ID NO: 195862 - protein, 14 aa, Borrelia garinii
KVGVIFPIAGITGL

SEQ ID NO: 195863 - protein, 14 aa, Borrelia garinii
VGVIFPIAGITGLG

SEQ ID NO: 195864 - protein, 14 aa, Borrelia garinii
GVIFPIAGITGLGV

SEQ ID NO: 195865 - protein, 14 aa, Borrelia garinii
VIFPIAGITGLGVY

SEQ ID NO: 195866 - protein, 14 aa, Borrelia garinii
IFPIAGITGLGVYD

SEQ ID NO: 195867 - protein, 14 aa, Borrelia garinii
FPIAGITGLGVYDA

SEQ ID NO: 195868 - protein, 14 aa, Borrelia garinii
PIAGITGLGVYDAA

SEQ ID NO: 195869 - protein, 14 aa, Borrelia garinii
IAGITGLGVYDAAK

SEQ ID NO: 195870 - protein, 14 aa, Borrelia garinii
AGITGLGVYDAAKE

SEQ ID NO: 195871 - protein, 14 aa, Borrelia garinii
GITGLGVYDAAKEL

SEQ ID NO: 195872 - protein, 14 aa, Borrelia garinii
ITGLGVYDAAKELG

SEQ ID NO: 195873 - protein, 14 aa, Borrelia garinii
TGLGVYDAAKELGP

SEQ ID NO: 195874 - protein, 14 aa, Borrelia garinii
GLGVYDAAKELGPK

SEQ ID NO: 195875 - protein, 14 aa, Borrelia garinii
LGVYDAAKELGPKY

SEQ ID NO: 195876 - protein, 14 aa, Borrelia garinii
GVYDAAKELGPKYY

SEQ ID NO: 195877 - protein, 14 aa, Borrelia garinii
VYDAAKELGPKYYV

SEQ ID NO: 195878 - protein, 14 aa, Borrelia garinii
YDAAKELGPKYYVI

SEQ ID NO: 195879 - protein, 14 aa, Borrelia garinii
DAAKELGPKYYVIG

SEQ ID NO: 195880 - protein, 14 aa, Borrelia garinii
AAKELGPKYYVIGL

SEQ ID NO: 195881 - protein, 14 aa, Borrelia garinii
AKELGPKYYVIGLN

SEQ ID NO: 195882 - protein, 14 aa, Borrelia garinii
KELGPKYYVIGLNQ

SEQ ID NO: 195883 - protein, 14 aa, Borrelia garinii
ELGPKYYVIGLNQD

SEQ ID NO: 195884 - protein, 14 aa, Borrelia garinii
LGPKYYVIGLNQDQ

SEQ ID NO: 195885 - protein, 14 aa, Borrelia garinii
GPKYYVIGLNQDQS

SEQ ID NO: 195886 - protein, 14 aa, Borrelia garinii
PKYYVIGLNQDQSY

SEQ ID NO: 195887 - protein, 14 aa, Borrelia garinii
KYYVIGLNQDQSYI

SEQ ID NO: 195888 - protein, 14 aa, Borrelia garinii
YYVIGLNQDQSYIA

SEQ ID NO: 195889 - protein, 14 aa, Borrelia garinii
YVIGLNQDQSYIAP

SEQ ID NO: 195890 - protein, 14 aa, Borrelia garinii
VIGLNQDQSYIAPQ

SEQ ID NO: 195891 - protein, 14 aa, Borrelia garinii
IGLNQDQSYIAPQN

SEQ ID NO: 195892 - protein, 14 aa, Borrelia garinii
GLNQDQSYIAPQNV

SEQ ID NO: 195893 - protein, 14 aa, Borrelia garinii
LNQDQSYIAPQNVI

SEQ ID NO: 195894 - protein, 14 aa, Borrelia garinii
NQDQSYIAPQNVIT

SEQ ID NO: 195895 - protein, 14 aa, Borrelia garinii
QDQSYIAPQNVITS

SEQ ID NO: 195896 - protein, 14 aa, Borrelia garinii
DQSYIAPQNVITSV

SEQ ID NO: 195897 - protein, 14 aa, Borrelia garinii
QSYIAPQNVITSVL

SEQ ID NO: 195898 - protein, 14 aa, Borrelia garinii
SYIAPQNVITSVLK

SEQ ID NO: 195899 - protein, 14 aa, Borrelia garinii
YIAPQNVITSVLKD

SEQ ID NO: 195900 - protein, 14 aa, Borrelia garinii
IAPQNVITSVLKDI

SEQ ID NO: 195901 - protein, 14 aa, Borrelia garinii
APQNVITSVLKDIG

SEQ ID NO: 195902 - protein, 14 aa, Borrelia garinii
PQNVITSVLKDIGK

SEQ ID NO: 195903 - protein, 14 aa, Borrelia garinii
QNVITSVLKDIGKV

SEQ ID NO: 195904 - protein, 14 aa, Borrelia garinii
NVITSVLKDIGKVI

SEQ ID NO: 195905 - protein, 14 aa, Borrelia garinii
VITSVLKDIGKVIY

SEQ ID NO: 195906 - protein, 14 aa, Borrelia garinii
ITSVLKDIGKVIYS

SEQ ID NO: 195907 - protein, 14 aa, Borrelia garinii
TSVLKDIGKVIYSV

SEQ ID NO: 195908 - protein, 14 aa, Borrelia garinii
SVLKDIGKVIYSVS

SEQ ID NO: 195909 - protein, 14 aa, Borrelia garinii
VLKDIGKVIYSVSS

SEQ ID NO: 195910 - protein, 14 aa, Borrelia garinii
LKDIGKVIYSVSSD

SEQ ID NO: 195911 - protein, 14 aa, Borrelia garinii
KDIGKVIYSVSSDY

SEQ ID NO: 195912 - protein, 14 aa, Borrelia garinii
DIGKVIYSVSSDYI

SEQ ID NO: 195913 - protein, 14 aa, Borrelia garinii
IGKVIYSVSSDYIK

SEQ ID NO: 195914 - protein, 14 aa, Borrelia garinii
GKVIYSVSSDYIKN

SEQ ID NO: 195915 - protein, 14 aa, Borrelia garinii
KVIYSVSSDYIKNG

SEQ ID NO: 195916 - protein, 14 aa, Borrelia garinii
VIYSVSSDYIKNGV

SEQ ID NO: 195917 - protein, 14 aa, Borrelia garinii
IYSVSSDYIKNGVF

SEQ ID NO: 195918 - protein, 14 aa, Borrelia garinii
YSVSSDYIKNGVFK

SEQ ID NO: 195919 - protein, 14 aa, Borrelia garinii
SVSSDYIKNGVFKG

SEQ ID NO: 195920 - protein, 14 aa, Borrelia garinii
VSSDYIKNGVFKGG

SEQ ID NO: 195921 - protein, 14 aa, Borrelia garinii
SSDYIKNGVFKGGV

SEQ ID NO: 195922 - protein, 14 aa, Borrelia garinii
SDYIKNGVFKGGVV

SEQ ID NO: 195923 - protein, 14 aa, Borrelia garinii
DYIKNGVFKGGVVI

SEQ ID NO: 195924 - protein, 14 aa, Borrelia garinii
YIKNGVFKGGVVID

SEQ ID NO: 195925 - protein, 14 aa, Borrelia garinii
IKNGVFKGGVVIDR

SEQ ID NO: 195926 - protein, 14 aa, Borrelia garinii
KNGVFKGGVVIDRG

SEQ ID NO: 195927 - protein, 14 aa, Borrelia garinii
NGVFKGGVVIDRGL

SEQ ID NO: 195928 - protein, 14 aa, Borrelia garinii
GVFKGGVVIDRGLK

SEQ ID NO: 195929 - protein, 14 aa, Borrelia garinii
VFKGGVVIDRGLKE

SEQ ID NO: 195930 - protein, 14 aa, Borrelia garinii
FKGGVVIDRGLKEG

SEQ ID NO: 195931 - protein, 14 aa, Borrelia garinii
KGGVVIDRGLKEGV

SEQ ID NO: 195932 - protein, 14 aa, Borrelia garinii
GGVVIDRGLKEGVI

SEQ ID NO: 195933 - protein, 14 aa, Borrelia garinii
GVVIDRGLKEGVIE

SEQ ID NO: 195934 - protein, 14 aa, Borrelia garinii
VVIDRGLKEGVIEI

SEQ ID NO: 195935 - protein, 14 aa, Borrelia garinii
VIDRGLKEGVIEIV

SEQ ID NO: 195936 - protein, 14 aa, Borrelia garinii
IDRGLKEGVIEIVK

SEQ ID NO: 195937 - protein, 14 aa, Borrelia garinii
DRGLKEGVIEIVKD

SEQ ID NO: 195938 - protein, 14 aa, Borrelia garinii
RGLKEGVIEIVKDP

SEQ ID NO: 195939 - protein, 14 aa, Borrelia garinii
GLKEGVIEIVKDPD

SEQ ID NO: 195940 - protein, 14 aa, Borrelia garinii
LKEGVIEIVKDPDV

SEQ ID NO: 195941 - protein, 14 aa, Borrelia garinii
KEGVIEIVKDPDVL

SEQ ID NO: 195942 - protein, 14 aa, Borrelia garinii
EGVIEIVKDPDVLN

SEQ ID NO: 195943 - protein, 14 aa, Borrelia garinii
GVIEIVKDPDVLNN

SEQ ID NO: 195944 - protein, 14 aa, Borrelia garinii
VIEIVKDPDVLNNR

SEQ ID NO: 195945 - protein, 14 aa, Borrelia garinii
IEIVKDPDVLNNRL

SEQ ID NO: 195946 - protein, 14 aa, Borrelia garinii
EIVKDPDVLNNRLV

SEQ ID NO: 195947 - protein, 14 aa, Borrelia garinii
IVKDPDVLNNRLVN

SEQ ID NO: 195948 - protein, 14 aa, Borrelia garinii
VKDPDVLNNRLVNE

SEQ ID NO: 195949 - protein, 14 aa, Borrelia garinii
KDPDVLNNRLVNEV

SEQ ID NO: 195950 - protein, 14 aa, Borrelia garinii
DPDVLNNRLVNEVV

SEQ ID NO: 195951 - protein, 14 aa, Borrelia garinii
PDVLNNRLVNEVVE

SEQ ID NO: 195952 - protein, 14 aa, Borrelia garinii
DVLNNRLVNEVVEL

SEQ ID NO: 195953 - protein, 14 aa, Borrelia garinii
VLNNRLVNEVVELE

SEQ ID NO: 195954 - protein, 14 aa, Borrelia garinii
LNNRLVNEVVELEN

SEQ ID NO: 195955 - protein, 14 aa, Borrelia garinii
NNRLVNEVVELENK

SEQ ID NO: 195956 - protein, 14 aa, Borrelia garinii
NRLVNEVVELENKI

SEQ ID NO: 195957 - protein, 14 aa, Borrelia garinii
RLVNEVVELENKII

SEQ ID NO: 195958 - protein, 14 aa, Borrelia garinii
LVNEVVELENKIIS

SEQ ID NO: 195959 - protein, 14 aa, Borrelia garinii
VNEVVELENKIISG

SEQ ID NO: 195960 - protein, 14 aa, Borrelia garinii
NEVVELENKIISGE

SEQ ID NO: 195961 - protein, 14 aa, Borrelia garinii
EVVELENKIISGEI

SEQ ID NO: 195962 - protein, 14 aa, Borrelia garinii
VVELENKIISGEII

SEQ ID NO: 195963 - protein, 14 aa, Borrelia garinii
VELENKIISGEIIV

SEQ ID NO: 195964 - protein, 14 aa, Borrelia garinii
ELENKIISGEIIVP

SEQ ID NO: 195965 - protein, 14 aa, Borrelia garinii
LENKIISGEIIVPD

SEQ ID NO: 195966 - protein, 14 aa, Borrelia garinii
ENKIISGEIIVPDS

SEQ ID NO: 195967 - protein, 14 aa, Borrelia garinii
NKIISGEIIVPDSE

SEQ ID NO: 195968 - protein, 14 aa, Borrelia garinii
KIISGEIIVPDSEY

SEQ ID NO: 195969 - protein, 14 aa, Borrelia garinii
IISGEIIVPDSEYA

SEQ ID NO: 195970 - protein, 14 aa, Borrelia garinii
ISGEIIVPDSEYAF

SEQ ID NO: 195971 - protein, 14 aa, Borrelia garinii
SGEIIVPDSEYAFD

SEQ ID NO: 195972 - protein, 14 aa, Borrelia garinii
GEIIVPDSEYAFDL

SEQ ID NO: 195973 - protein, 14 aa, Borrelia garinii
EIIVPDSEYAFDLF

SEQ ID NO: 195974 - protein, 14 aa, Borrelia garinii
IIVPDSEYAFDLFK

SEQ ID NO: 195975 - protein, 14 aa, Borrelia garinii
IVPDSEYAFDLFKS

SEQ ID NO: 195976 - protein, 14 aa, Borrelia garinii
VPDSEYAFDLFKSK

SEQ ID NO: 195977 - protein, 14 aa, Borrelia garinii
PDSEYAFDLFKSKL

SEQ ID NO: 195978 - protein, 15 aa, Borrelia garinii
MFKRFVFIALSLLVL

SEQ ID NO: 195979 - protein, 15 aa, Borrelia garinii
FKRFVFIALSLLVLA

SEQ ID NO: 195980 - protein, 15 aa, Borrelia garinii
KRFVFIALSLLVLAC

SEQ ID NO: 195981 - protein, 15 aa, Borrelia garinii
RFVFIALSLLVLACF

SEQ ID NO: 195982 - protein, 15 aa, Borrelia garinii
FVFIALSLLVLACFK

SEQ ID NO: 195983 - protein, 15 aa, Borrelia garinii
VFIALSLLVLACFKS

SEQ ID NO: 195984 - protein, 15 aa, Borrelia garinii
FIALSLLVLACFKSN

SEQ ID NO: 195985 - protein, 15 aa, Borrelia garinii
IALSLLVLACFKSNK

SEQ ID NO: 195986 - protein, 15 aa, Borrelia garinii
ALSLLVLACFKSNKK

SEQ ID NO: 195987 - protein, 15 aa, Borrelia garinii
LSLLVLACFKSNKKS

SEQ ID NO: 195988 - protein, 15 aa, Borrelia garinii
SLLVLACFKSNKKSV

SEQ ID NO: 195989 - protein, 15 aa, Borrelia garinii
LLVLACFKSNKKSVK

SEQ ID NO: 195990 - protein, 15 aa, Borrelia garinii
LVLACFKSNKKSVKS

SEQ ID NO: 195991 - protein, 15 aa, Borrelia garinii
VLACFKSNKKSVKSD

SEQ ID NO: 195992 - protein, 15 aa, Borrelia garinii
LACFKSNKKSVKSDK

SEQ ID NO: 195993 - protein, 15 aa, Borrelia garinii
ACFKSNKKSVKSDKV

SEQ ID NO: 195994 - protein, 15 aa, Borrelia garinii
CFKSNKKSVKSDKVI

SEQ ID NO: 195995 - protein, 15 aa, Borrelia garinii
FKSNKKSVKSDKVII

SEQ ID NO: 195996 - protein, 15 aa, Borrelia garinii
KSNKKSVKSDKVIIG

SEQ ID NO: 195997 - protein, 15 aa, Borrelia garinii
SNKKSVKSDKVIIGV

SEQ ID NO: 195998 - protein, 15 aa, Borrelia garinii
NKKSVKSDKVIIGVL

SEQ ID NO: 195999 - protein, 15 aa, Borrelia garinii
KKSVKSDKVIIGVLA

SEQ ID NO: 196000 - protein, 15 aa, Borrelia garinii
KSVKSDKVIIGVLAN

SEQ ID NO: 196001 - protein, 15 aa, Borrelia garinii
SVKSDKVIIGVLANG

SEQ ID NO: 196002 - protein, 15 aa, Borrelia garinii
VKSDKVIIGVLANGS

SEQ ID NO: 196003 - protein, 15 aa, Borrelia garinii
KSDKVIIGVLANGSF

SEQ ID NO: 196004 - protein, 15 aa, Borrelia garinii
SDKVIIGVLANGSFY

SEQ ID NO: 196005 - protein, 15 aa, Borrelia garinii
DKVIIGVLANGSFYD

SEQ ID NO: 196006 - protein, 15 aa, Borrelia garinii
KVIIGVLANGSFYDK

SEQ ID NO: 196007 - protein, 15 aa, Borrelia garinii
VIIGVLANGSFYDKG

SEQ ID NO: 196008 - protein, 15 aa, Borrelia garinii
IIGVLANGSFYDKGY

SEQ ID NO: 196009 - protein, 15 aa, Borrelia garinii
IGVLANGSFYDKGYN

SEQ ID NO: 196010 - protein, 15 aa, Borrelia garinii
GVLANGSFYDKGYNQ

SEQ ID NO: 196011 - protein, 15 aa, Borrelia garinii
VLANGSFYDKGYNQS

SEQ ID NO: 196012 - protein, 15 aa, Borrelia garinii
LANGSFYDKGYNQSV

SEQ ID NO: 196013 - protein, 15 aa, Borrelia garinii
ANGSFYDKGYNQSVY

SEQ ID NO: 196014 - protein, 15 aa, Borrelia garinii
NGSFYDKGYNQSVYD

SEQ ID NO: 196015 - protein, 15 aa, Borrelia garinii
GSFYDKGYNQSVYDG

SEQ ID NO: 196016 - protein, 15 aa, Borrelia garinii
SFYDKGYNQSVYDGV

SEQ ID NO: 196017 - protein, 15 aa, Borrelia garinii
FYDKGYNQSVYDGVV

SEQ ID NO: 196018 - protein, 15 aa, Borrelia garinii
YDKGYNQSVYDGVVK

SEQ ID NO: 196019 - protein, 15 aa, Borrelia garinii
DKGYNQSVYDGVVKL

SEQ ID NO: 196020 - protein, 15 aa, Borrelia garinii
KGYNQSVYDGVVKLK

SEQ ID NO: 196021 - protein, 15 aa, Borrelia garinii
GYNQSVYDGVVKLKD

SEQ ID NO: 196022 - protein, 15 aa, Borrelia garinii
YNQSVYDGVVKLKDD

SEQ ID NO: 196023 - protein, 15 aa, Borrelia garinii
NQSVYDGVVKLKDDF

SEQ ID NO: 196024 - protein, 15 aa, Borrelia garinii
QSVYDGVVKLKDDFG

SEQ ID NO: 196025 - protein, 15 aa, Borrelia garinii
SVYDGVVKLKDDFGI

SEQ ID NO: 196026 - protein, 15 aa, Borrelia garinii
VYDGVVKLKDDFGIK

SEQ ID NO: 196027 - protein, 15 aa, Borrelia garinii
YDGVVKLKDDFGIKL

SEQ ID NO: 196028 - protein, 15 aa, Borrelia garinii
DGVVKLKDDFGIKLI

SEQ ID NO: 196029 - protein, 15 aa, Borrelia garinii
GVVKLKDDFGIKLIT

SEQ ID NO: 196030 - protein, 15 aa, Borrelia garinii
VVKLKDDFGIKLITK

SEQ ID NO: 196031 - protein, 15 aa, Borrelia garinii
VKLKDDFGIKLITKS

SEQ ID NO: 196032 - protein, 15 aa, Borrelia garinii
KLKDDFGIKLITKSL

SEQ ID NO: 196033 - protein, 15 aa, Borrelia garinii
LKDDFGIKLITKSLR

SEQ ID NO: 196034 - protein, 15 aa, Borrelia garinii
KDDFGIKLITKSLRP

SEQ ID NO: 196035 - protein, 15 aa, Borrelia garinii
DDFGIKLITKSLRPY

SEQ ID NO: 196036 - protein, 15 aa, Borrelia garinii
DFGIKLITKSLRPYP

SEQ ID NO: 196037 - protein, 15 aa, Borrelia garinii
FGIKLITKSLRPYPI

SEQ ID NO: 196038 - protein, 15 aa, Borrelia garinii
GIKLITKSLRPYPIE

SEQ ID NO: 196039 - protein, 15 aa, Borrelia garinii
IKLITKSLRPYPIEG

SEQ ID NO: 196040 - protein, 15 aa, Borrelia garinii
KLITKSLRPYPIEGK

SEQ ID NO: 196041 - protein, 15 aa, Borrelia garinii
LITKSLRPYPIEGKR

SEQ ID NO: 196042 - protein, 15 aa, Borrelia garinii
ITKSLRPYPIEGKRL

SEQ ID NO: 196043 - protein, 15 aa, Borrelia garinii
TKSLRPYPIEGKRLL

SEQ ID NO: 196044 - protein, 15 aa, Borrelia garinii
KSLRPYPIEGKRLLT

SEQ ID NO: 196045 - protein, 15 aa, Borrelia garinii
SLRPYPIEGKRLLTV

SEQ ID NO: 196046 - protein, 15 aa, Borrelia garinii
LRPYPIEGKRLLTVN

SEQ ID NO: 196047 - protein, 15 aa, Borrelia garinii
RPYPIEGKRLLTVNE

SEQ ID NO: 196048 - protein, 15 aa, Borrelia garinii
PYPIEGKRLLTVNEA

SEQ ID NO: 196049 - protein, 15 aa, Borrelia garinii
YPIEGKRLLTVNEAM

SEQ ID NO: 196050 - protein, 15 aa, Borrelia garinii
PIEGKRLLTVNEAMA

SEQ ID NO: 196051 - protein, 15 aa, Borrelia garinii
IEGKRLLTVNEAMAE

SEQ ID NO: 196052 - protein, 15 aa, Borrelia garinii
EGKRLLTVNEAMAED

SEQ ID NO: 196053 - protein, 15 aa, Borrelia garinii
GKRLLTVNEAMAEDA

SEQ ID NO: 196054 - protein, 15 aa, Borrelia garinii
KRLLTVNEAMAEDAY

SEQ ID NO: 196055 - protein, 15 aa, Borrelia garinii
RLLTVNEAMAEDAYE

SEQ ID NO: 196056 - protein, 15 aa, Borrelia garinii
LLTVNEAMAEDAYEV

SEQ ID NO: 196057 - protein, 15 aa, Borrelia garinii
LTVNEAMAEDAYEVQ

SEQ ID NO: 196058 - protein, 15 aa, Borrelia garinii
TVNEAMAEDAYEVQK

SEQ ID NO: 196059 - protein, 15 aa, Borrelia garinii
VNEAMAEDAYEVQKN

SEQ ID NO: 196060 - protein, 15 aa, Borrelia garinii
NEAMAEDAYEVQKNP

SEQ ID NO: 196061 - protein, 15 aa, Borrelia garinii
EAMAEDAYEVQKNPL

SEQ ID NO: 196062 - protein, 15 aa, Borrelia garinii
AMAEDAYEVQKNPLN

SEQ ID NO: 196063 - protein, 15 aa, Borrelia garinii
MAEDAYEVQKNPLNL

SEQ ID NO: 196064 - protein, 15 aa, Borrelia garinii
AEDAYEVQKNPLNLF

SEQ ID NO: 196065 - protein, 15 aa, Borrelia garinii
EDAYEVQKNPLNLFW

SEQ ID NO: 196066 - protein, 15 aa, Borrelia garinii
DAYEVQKNPLNLFWL

SEQ ID NO: 196067 - protein, 15 aa, Borrelia garinii
AYEVQKNPLNLFWLA

SEQ ID NO: 196068 - protein, 15 aa, Borrelia garinii
YEVQKNPLNLFWLAG

SEQ ID NO: 196069 - protein, 15 aa, Borrelia garinii
EVQKNPLNLFWLAGY

SEQ ID NO: 196070 - protein, 15 aa, Borrelia garinii
VQKNPLNLFWLAGYQ

SEQ ID NO: 196071 - protein, 15 aa, Borrelia garinii
QKNPLNLFWLAGYQF

SEQ ID NO: 196072 - protein, 15 aa, Borrelia garinii
KNPLNLFWLAGYQFS

SEQ ID NO: 196073 - protein, 15 aa, Borrelia garinii
NPLNLFWLAGYQFSS

SEQ ID NO: 196074 - protein, 15 aa, Borrelia garinii
PLNLFWLAGYQFSSL

SEQ ID NO: 196075 - protein, 15 aa, Borrelia garinii
LNLFWLAGYQFSSLS

SEQ ID NO: 196076 - protein, 15 aa, Borrelia garinii
NLFWLAGYQFSSLSV

SEQ ID NO: 196077 - protein, 15 aa, Borrelia garinii
LFWLAGYQFSSLSVK

SEQ ID NO: 196078 - protein, 15 aa, Borrelia garinii
FWLAGYQFSSLSVKL

SEQ ID NO: 196079 - protein, 15 aa, Borrelia garinii
WLAGYQFSSLSVKLS

SEQ ID NO: 196080 - protein, 15 aa, Borrelia garinii
LAGYQFSSLSVKLSY

SEQ ID NO: 196081 - protein, 15 aa, Borrelia garinii
AGYQFSSLSVKLSYE

SEQ ID NO: 196082 - protein, 15 aa, Borrelia garinii
GYQFSSLSVKLSYER

SEQ ID NO: 196083 - protein, 15 aa, Borrelia garinii
YQFSSLSVKLSYERP

SEQ ID NO: 196084 - protein, 15 aa, Borrelia garinii
QFSSLSVKLSYERPD

SEQ ID NO: 196085 - protein, 15 aa, Borrelia garinii
FSSLSVKLSYERPDI

SEQ ID NO: 196086 - protein, 15 aa, Borrelia garinii
SSLSVKLSYERPDIY

SEQ ID NO: 196087 - protein, 15 aa, Borrelia garinii
SLSVKLSYERPDIYY

SEQ ID NO: 196088 - protein, 15 aa, Borrelia garinii
LSVKLSYERPDIYYG

SEQ ID NO: 196089 - protein, 15 aa, Borrelia garinii
SVKLSYERPDIYYGI

SEQ ID NO: 196090 - protein, 15 aa, Borrelia garinii
VKLSYERPDIYYGII

SEQ ID NO: 196091 - protein, 15 aa, Borrelia garinii
KLSYERPDIYYGIID

SEQ ID NO: 196092 - protein, 15 aa, Borrelia garinii
LSYERPDIYYGIIDA

SEQ ID NO: 196093 - protein, 15 aa, Borrelia garinii
SYERPDIYYGIIDAF

SEQ ID NO: 196094 - protein, 15 aa, Borrelia garinii
YERPDIYYGIIDAFD

SEQ ID NO: 196095 - protein, 15 aa, Borrelia garinii
ERPDIYYGIIDAFDY

SEQ ID NO: 196096 - protein, 15 aa, Borrelia garinii
RPDIYYGIIDAFDYG

SEQ ID NO: 196097 - protein, 15 aa, Borrelia garinii
PDIYYGIIDAFDYGD

SEQ ID NO: 196098 - protein, 15 aa, Borrelia garinii
DIYYGIIDAFDYGDI

SEQ ID NO: 196099 - protein, 15 aa, Borrelia garinii
IYYGIIDAFDYGDIQ

SEQ ID NO: 196100 - protein, 15 aa, Borrelia garinii
YYGIIDAFDYGDIQV

SEQ ID NO: 196101 - protein, 15 aa, Borrelia garinii
YGIIDAFDYGDIQVP

SEQ ID NO: 196102 - protein, 15 aa, Borrelia garinii
GIIDAFDYGDIQVPK

SEQ ID NO: 196103 - protein, 15 aa, Borrelia garinii
IIDAFDYGDIQVPKN

SEQ ID NO: 196104 - protein, 15 aa, Borrelia garinii
IDAFDYGDIQVPKNS

SEQ ID NO: 196105 - protein, 15 aa, Borrelia garinii
DAFDYGDIQVPKNSL

SEQ ID NO: 196106 - protein, 15 aa, Borrelia garinii
AFDYGDIQVPKNSLA

SEQ ID NO: 196107 - protein, 15 aa, Borrelia garinii
FDYGDIQVPKNSLAI

SEQ ID NO: 196108 - protein, 15 aa, Borrelia garinii
DYGDIQVPKNSLAIK

SEQ ID NO: 196109 - protein, 15 aa, Borrelia garinii
YGDIQVPKNSLAIKF

SEQ ID NO: 196110 - protein, 15 aa, Borrelia garinii
GDIQVPKNSLAIKFR

SEQ ID NO: 196111 - protein, 15 aa, Borrelia garinii
DIQVPKNSLAIKFRN

SEQ ID NO: 196112 - protein, 15 aa, Borrelia garinii
IQVPKNSLAIKFRNE

SEQ ID NO: 196113 - protein, 15 aa, Borrelia garinii
QVPKNSLAIKFRNEE

SEQ ID NO: 196114 - protein, 15 aa, Borrelia garinii
VPKNSLAIKFRNEEA

SEQ ID NO: 196115 - protein, 15 aa, Borrelia garinii
PKNSLAIKFRNEEAA

SEQ ID NO: 196116 - protein, 15 aa, Borrelia garinii
KNSLAIKFRNEEAAF

SEQ ID NO: 196117 - protein, 15 aa, Borrelia garinii
NSLAIKFRNEEAAFL

SEQ ID NO: 196118 - protein, 15 aa, Borrelia garinii
SLAIKFRNEEAAFLA

SEQ ID NO: 196119 - protein, 15 aa, Borrelia garinii
LAIKFRNEEAAFLAG

SEQ ID NO: 196120 - protein, 15 aa, Borrelia garinii
AIKFRNEEAAFLAGY

SEQ ID NO: 196121 - protein, 15 aa, Borrelia garinii
IKFRNEEAAFLAGYI

SEQ ID NO: 196122 - protein, 15 aa, Borrelia garinii
KFRNEEAAFLAGYIA

SEQ ID NO: 196123 - protein, 15 aa, Borrelia garinii
FRNEEAAFLAGYIAA

SEQ ID NO: 196124 - protein, 15 aa, Borrelia garinii
RNEEAAFLAGYIAAK

SEQ ID NO: 196125 - protein, 15 aa, Borrelia garinii
NEEAAFLAGYIAAKM

SEQ ID NO: 196126 - protein, 15 aa, Borrelia garinii
EEAAFLAGYIAAKMS

SEQ ID NO: 196127 - protein, 15 aa, Borrelia garinii
EAAFLAGYIAAKMSR

SEQ ID NO: 196128 - protein, 15 aa, Borrelia garinii
AAFLAGYIAAKMSRK

SEQ ID NO: 196129 - protein, 15 aa, Borrelia garinii
AFLAGYIAAKMSRKE

SEQ ID NO: 196130 - protein, 15 aa, Borrelia garinii
FLAGYIAAKMSRKEK

SEQ ID NO: 196131 - protein, 15 aa, Borrelia garinii
LAGYIAAKMSRKEKI

SEQ ID NO: 196132 - protein, 15 aa, Borrelia garinii
AGYIAAKMSRKEKIG

SEQ ID NO: 196133 - protein, 15 aa, Borrelia garinii
GYIAAKMSRKEKIGF

SEQ ID NO: 196134 - protein, 15 aa, Borrelia garinii
YIAAKMSRKEKIGFL

SEQ ID NO: 196135 - protein, 15 aa, Borrelia garinii
IAAKMSRKEKIGFLT

SEQ ID NO: 196136 - protein, 15 aa, Borrelia garinii
AAKMSRKEKIGFLTG

SEQ ID NO: 196137 - protein, 15 aa, Borrelia garinii
AKMSRKEKIGFLTGP

SEQ ID NO: 196138 - protein, 15 aa, Borrelia garinii
KMSRKEKIGFLTGPE

SEQ ID NO: 196139 - protein, 15 aa, Borrelia garinii
MSRKEKIGFLTGPES

SEQ ID NO: 196140 - protein, 15 aa, Borrelia garinii
SRKEKIGFLTGPESE

SEQ ID NO: 196141 - protein, 15 aa, Borrelia garinii
RKEKIGFLTGPESEY

SEQ ID NO: 196142 - protein, 15 aa, Borrelia garinii
KEKIGFLTGPESEYL

SEQ ID NO: 196143 - protein, 15 aa, Borrelia garinii
EKIGFLTGPESEYLN

SEQ ID NO: 196144 - protein, 15 aa, Borrelia garinii
KIGFLTGPESEYLND

SEQ ID NO: 196145 - protein, 15 aa, Borrelia garinii
IGFLTGPESEYLNDF

SEQ ID NO: 196146 - protein, 15 aa, Borrelia garinii
GFLTGPESEYLNDFK

SEQ ID NO: 196147 - protein, 15 aa, Borrelia garinii
FLTGPESEYLNDFKF

SEQ ID NO: 196148 - protein, 15 aa, Borrelia garinii
LTGPESEYLNDFKFG

SEQ ID NO: 196149 - protein, 15 aa, Borrelia garinii
TGPESEYLNDFKFGF

SEQ ID NO: 196150 - protein, 15 aa, Borrelia garinii
GPESEYLNDFKFGFK

SEQ ID NO: 196151 - protein, 15 aa, Borrelia garinii
PESEYLNDFKFGFKA

SEQ ID NO: 196152 - protein, 15 aa, Borrelia garinii
ESEYLNDFKFGFKAG

SEQ ID NO: 196153 - protein, 15 aa, Borrelia garinii
SEYLNDFKFGFKAGI

SEQ ID NO: 196154 - protein, 15 aa, Borrelia garinii
EYLNDFKFGFKAGIF

SEQ ID NO: 196155 - protein, 15 aa, Borrelia garinii
YLNDFKFGFKAGIFY

SEQ ID NO: 196156 - protein, 15 aa, Borrelia garinii
LNDFKFGFKAGIFYA

SEQ ID NO: 196157 - protein, 15 aa, Borrelia garinii
NDFKFGFKAGIFYAN

SEQ ID NO: 196158 - protein, 15 aa, Borrelia garinii
DFKFGFKAGIFYANP

SEQ ID NO: 196159 - protein, 15 aa, Borrelia garinii
FKFGFKAGIFYANPK

SEQ ID NO: 196160 - protein, 15 aa, Borrelia garinii
KFGFKAGIFYANPKL

SEQ ID NO: 196161 - protein, 15 aa, Borrelia garinii
FGFKAGIFYANPKLR

SEQ ID NO: 196162 - protein, 15 aa, Borrelia garinii
GFKAGIFYANPKLRL

SEQ ID NO: 196163 - protein, 15 aa, Borrelia garinii
FKAGIFYANPKLRLV

SEQ ID NO: 196164 - protein, 15 aa, Borrelia garinii
KAGIFYANPKLRLVS

SEQ ID NO: 196165 - protein, 15 aa, Borrelia garinii
AGIFYANPKLRLVSK

SEQ ID NO: 196166 - protein, 15 aa, Borrelia garinii
GIFYANPKLRLVSKK

SEQ ID NO: 196167 - protein, 15 aa, Borrelia garinii
IFYANPKLRLVSKKA

SEQ ID NO: 196168 - protein, 15 aa, Borrelia garinii
FYANPKLRLVSKKAP

SEQ ID NO: 196169 - protein, 15 aa, Borrelia garinii
YANPKLRLVSKKAPS

SEQ ID NO: 196170 - protein, 15 aa, Borrelia garinii
ANPKLRLVSKKAPSL

SEQ ID NO: 196171 - protein, 15 aa, Borrelia garinii
NPKLRLVSKKAPSLF

SEQ ID NO: 196172 - protein, 15 aa, Borrelia garinii
PKLRLVSKKAPSLFD

SEQ ID NO: 196173 - protein, 15 aa, Borrelia garinii
KLRLVSKKAPSLFDK

SEQ ID NO: 196174 - protein, 15 aa, Borrelia garinii
LRLVSKKAPSLFDKE

SEQ ID NO: 196175 - protein, 15 aa, Borrelia garinii
RLVSKKAPSLFDKEK

SEQ ID NO: 196176 - protein, 15 aa, Borrelia garinii
LVSKKAPSLFDKEKG

SEQ ID NO: 196177 - protein, 15 aa, Borrelia garinii
VSKKAPSLFDKEKGK

SEQ ID NO: 196178 - protein, 15 aa, Borrelia garinii
SKKAPSLFDKEKGKE

SEQ ID NO: 196179 - protein, 15 aa, Borrelia garinii
KKAPSLFDKEKGKEM

SEQ ID NO: 196180 - protein, 15 aa, Borrelia garinii
KAPSLFDKEKGKEMA

SEQ ID NO: 196181 - protein, 15 aa, Borrelia garinii
APSLFDKEKGKEMAR

SEQ ID NO: 196182 - protein, 15 aa, Borrelia garinii
PSLFDKEKGKEMARF

SEQ ID NO: 196183 - protein, 15 aa, Borrelia garinii
SLFDKEKGKEMARFM

SEQ ID NO: 196184 - protein, 15 aa, Borrelia garinii
LFDKEKGKEMARFMY

SEQ ID NO: 196185 - protein, 15 aa, Borrelia garinii
FDKEKGKEMARFMYK

SEQ ID NO: 196186 - protein, 15 aa, Borrelia garinii
DKEKGKEMARFMYKE

SEQ ID NO: 196187 - protein, 15 aa, Borrelia garinii
KEKGKEMARFMYKED

SEQ ID NO: 196188 - protein, 15 aa, Borrelia garinii
EKGKEMARFMYKEDK

SEQ ID NO: 196189 - protein, 15 aa, Borrelia garinii
KGKEMARFMYKEDKV

SEQ ID NO: 196190 - protein, 15 aa, Borrelia garinii
GKEMARFMYKEDKVG

SEQ ID NO: 196191 - protein, 15 aa, Borrelia garinii
KEMARFMYKEDKVGV

SEQ ID NO: 196192 - protein, 15 aa, Borrelia garinii
EMARFMYKEDKVGVI

SEQ ID NO: 196193 - protein, 15 aa, Borrelia garinii
MARFMYKEDKVGVIF

SEQ ID NO: 196194 - protein, 15 aa, Borrelia garinii
ARFMYKEDKVGVIFP

SEQ ID NO: 196195 - protein, 15 aa, Borrelia garinii
RFMYKEDKVGVIFPI

SEQ ID NO: 196196 - protein, 15 aa, Borrelia garinii
FMYKEDKVGVIFPIA

SEQ ID NO: 196197 - protein, 15 aa, Borrelia garinii
MYKEDKVGVIFPIAG

SEQ ID NO: 196198 - protein, 15 aa, Borrelia garinii
YKEDKVGVIFPIAGI

SEQ ID NO: 196199 - protein, 15 aa, Borrelia garinii
KEDKVGVIFPIAGIT

SEQ ID NO: 196200 - protein, 15 aa, Borrelia garinii
EDKVGVIFPIAGITG

SEQ ID NO: 196201 - protein, 15 aa, Borrelia garinii
DKVGVIFPIAGITGL

SEQ ID NO: 196202 - protein, 15 aa, Borrelia garinii
KVGVIFPIAGITGLG

SEQ ID NO: 196203 - protein, 15 aa, Borrelia garinii
VGVIFPIAGITGLGV

SEQ ID NO: 196204 - protein, 15 aa, Borrelia garinii
GVIFPIAGITGLGVY

SEQ ID NO: 196205 - protein, 15 aa, Borrelia garinii
VIFPIAGITGLGVYD

SEQ ID NO: 196206 - protein, 15 aa, Borrelia garinii
IFPIAGITGLGVYDA

SEQ ID NO: 196207 - protein, 15 aa, Borrelia garinii
FPIAGITGLGVYDAA

SEQ ID NO: 196208 - protein, 15 aa, Borrelia garinii
PIAGITGLGVYDAAK

SEQ ID NO: 196209 - protein, 15 aa, Borrelia garinii
IAGITGLGVYDAAKE

SEQ ID NO: 196210 - protein, 15 aa, Borrelia garinii
AGITGLGVYDAAKEL

SEQ ID NO: 196211 - protein, 15 aa, Borrelia garinii
GITGLGVYDAAKELG

SEQ ID NO: 196212 - protein, 15 aa, Borrelia garinii
ITGLGVYDAAKELGP

SEQ ID NO: 196213 - protein, 15 aa, Borrelia garinii
TGLGVYDAAKELGPK

SEQ ID NO: 196214 - protein, 15 aa, Borrelia garinii
GLGVYDAAKELGPKY

SEQ ID NO: 196215 - protein, 15 aa, Borrelia garinii
LGVYDAAKELGPKYY

SEQ ID NO: 196216 - protein, 15 aa, Borrelia garinii
GVYDAAKELGPKYYV

SEQ ID NO: 196217 - protein, 15 aa, Borrelia garinii
VYDAAKELGPKYYVI

SEQ ID NO: 196218 - protein, 15 aa, Borrelia garinii
YDAAKELGPKYYVIG

SEQ ID NO: 196219 - protein, 15 aa, Borrelia garinii
DAAKELGPKYYVIGL

SEQ ID NO: 196220 - protein, 15 aa, Borrelia garinii
AAKELGPKYYVIGLN

SEQ ID NO: 196221 - protein, 15 aa, Borrelia garinii
AKELGPKYYVIGLNQ

SEQ ID NO: 196222 - protein, 15 aa, Borrelia garinii
KELGPKYYVIGLNQD

SEQ ID NO: 196223 - protein, 15 aa, Borrelia garinii
ELGPKYYVIGLNQDQ

SEQ ID NO: 196224 - protein, 15 aa, Borrelia garinii
LGPKYYVIGLNQDQS

SEQ ID NO: 196225 - protein, 15 aa, Borrelia garinii
GPKYYVIGLNQDQSY

SEQ ID NO: 196226 - protein, 15 aa, Borrelia garinii
PKYYVIGLNQDQSYI

SEQ ID NO: 196227 - protein, 15 aa, Borrelia garinii
KYYVIGLNQDQSYIA

SEQ ID NO: 196228 - protein, 15 aa, Borrelia garinii
YYVIGLNQDQSYIAP

SEQ ID NO: 196229 - protein, 15 aa, Borrelia garinii
YVIGLNQDQSYIAPQ

SEQ ID NO: 196230 - protein, 15 aa, Borrelia garinii
VIGLNQDQSYIAPQN

SEQ ID NO: 196231 - protein, 15 aa, Borrelia garinii
IGLNQDQSYIAPQNV

SEQ ID NO: 196232 - protein, 15 aa, Borrelia garinii
GLNQDQSYIAPQNVI

SEQ ID NO: 196233 - protein, 15 aa, Borrelia garinii
LNQDQSYIAPQNVIT

SEQ ID NO: 196234 - protein, 15 aa, Borrelia garinii
NQDQSYIAPQNVITS

SEQ ID NO: 196235 - protein, 15 aa, Borrelia garinii
QDQSYIAPQNVITSV

SEQ ID NO: 196236 - protein, 15 aa, Borrelia garinii
DQSYIAPQNVITSVL

SEQ ID NO: 196237 - protein, 15 aa, Borrelia garinii
QSYIAPQNVITSVLK

SEQ ID NO: 196238 - protein, 15 aa, Borrelia garinii
SYIAPQNVITSVLKD

SEQ ID NO: 196239 - protein, 15 aa, Borrelia garinii
YIAPQNVITSVLKDI

SEQ ID NO: 196240 - protein, 15 aa, Borrelia garinii
IAPQNVITSVLKDIG

SEQ ID NO: 196241 - protein, 15 aa, Borrelia garinii
APQNVITSVLKDIGK

SEQ ID NO: 196242 - protein, 15 aa, Borrelia garinii
PQNVITSVLKDIGKV

SEQ ID NO: 196243 - protein, 15 aa, Borrelia garinii
QNVITSVLKDIGKVI

SEQ ID NO: 196244 - protein, 15 aa, Borrelia garinii
NVITSVLKDIGKVIY

SEQ ID NO: 196245 - protein, 15 aa, Borrelia garinii
VITSVLKDIGKVIYS

SEQ ID NO: 196246 - protein, 15 aa, Borrelia garinii
ITSVLKDIGKVIYSV

SEQ ID NO: 196247 - protein, 15 aa, Borrelia garinii
TSVLKDIGKVIYSVS

SEQ ID NO: 196248 - protein, 15 aa, Borrelia garinii
SVLKDIGKVIYSVSS

SEQ ID NO: 196249 - protein, 15 aa, Borrelia garinii
VLKDIGKVIYSVSSD

SEQ ID NO: 196250 - protein, 15 aa, Borrelia garinii
LKDIGKVIYSVSSDY

SEQ ID NO: 196251 - protein, 15 aa, Borrelia garinii
KDIGKVIYSVSSDYI

SEQ ID NO: 196252 - protein, 15 aa, Borrelia garinii
DIGKVIYSVSSDYIK

SEQ ID NO: 196253 - protein, 15 aa, Borrelia garinii
IGKVIYSVSSDYIKN

SEQ ID NO: 196254 - protein, 15 aa, Borrelia garinii
GKVIYSVSSDYIKNG

SEQ ID NO: 196255 - protein, 15 aa, Borrelia garinii
KVIYSVSSDYIKNGV

SEQ ID NO: 196256 - protein, 15 aa, Borrelia garinii
VIYSVSSDYIKNGVF

SEQ ID NO: 196257 - protein, 15 aa, Borrelia garinii
IYSVSSDYIKNGVFK

SEQ ID NO: 196258 - protein, 15 aa, Borrelia garinii
YSVSSDYIKNGVFKG

SEQ ID NO: 196259 - protein, 15 aa, Borrelia garinii
SVSSDYIKNGVFKGG

SEQ ID NO: 196260 - protein, 15 aa, Borrelia garinii
VSSDYIKNGVFKGGV

SEQ ID NO: 196261 - protein, 15 aa, Borrelia garinii
SSDYIKNGVFKGGVV

SEQ ID NO: 196262 - protein, 15 aa, Borrelia garinii
SDYIKNGVFKGGVVI

SEQ ID NO: 196263 - protein, 15 aa, Borrelia garinii
DYIKNGVFKGGVVID

SEQ ID NO: 196264 - protein, 15 aa, Borrelia garinii
YIKNGVFKGGVVIDR

SEQ ID NO: 196265 - protein, 15 aa, Borrelia garinii
IKNGVFKGGVVIDRG

SEQ ID NO: 196266 - protein, 15 aa, Borrelia garinii
KNGVFKGGVVIDRGL

SEQ ID NO: 196267 - protein, 15 aa, Borrelia garinii
NGVFKGGVVIDRGLK

SEQ ID NO: 196268 - protein, 15 aa, Borrelia garinii
GVFKGGVVIDRGLKE

SEQ ID NO: 196269 - protein, 15 aa, Borrelia garinii
VFKGGVVIDRGLKEG

SEQ ID NO: 196270 - protein, 15 aa, Borrelia garinii
FKGGVVIDRGLKEGV

SEQ ID NO: 196271 - protein, 15 aa, Borrelia garinii
KGGVVIDRGLKEGVI

SEQ ID NO: 196272 - protein, 15 aa, Borrelia garinii
GGVVIDRGLKEGVIE

SEQ ID NO: 196273 - protein, 15 aa, Borrelia garinii
GVVIDRGLKEGVIEI

SEQ ID NO: 196274 - protein, 15 aa, Borrelia garinii
VVIDRGLKEGVIEIV

SEQ ID NO: 196275 - protein, 15 aa, Borrelia garinii
VIDRGLKEGVIEIVK

SEQ ID NO: 196276 - protein, 15 aa, Borrelia garinii
IDRGLKEGVIEIVKD

SEQ ID NO: 196277 - protein, 15 aa, Borrelia garinii
DRGLKEGVIEIVKDP

SEQ ID NO: 196278 - protein, 15 aa, Borrelia garinii
RGLKEGVIEIVKDPD

SEQ ID NO: 196279 - protein, 15 aa, Borrelia garinii
GLKEGVIEIVKDPDV

SEQ ID NO: 196280 - protein, 15 aa, Borrelia garinii
LKEGVIEIVKDPDVL

SEQ ID NO: 196281 - protein, 15 aa, Borrelia garinii
KEGVIEIVKDPDVLN

SEQ ID NO: 196282 - protein, 15 aa, Borrelia garinii
EGVIEIVKDPDVLNN

SEQ ID NO: 196283 - protein, 15 aa, Borrelia garinii
GVIEIVKDPDVLNNR

SEQ ID NO: 196284 - protein, 15 aa, Borrelia garinii
VIEIVKDPDVLNNRL

SEQ ID NO: 196285 - protein, 15 aa, Borrelia garinii
IEIVKDPDVLNNRLV

SEQ ID NO: 196286 - protein, 15 aa, Borrelia garinii
EIVKDPDVLNNRLVN

SEQ ID NO: 196287 - protein, 15 aa, Borrelia garinii
IVKDPDVLNNRLVNE

SEQ ID NO: 196288 - protein, 15 aa, Borrelia garinii
VKDPDVLNNRLVNEV

SEQ ID NO: 196289 - protein, 15 aa, Borrelia garinii
KDPDVLNNRLVNEVV

SEQ ID NO: 196290 - protein, 15 aa, Borrelia garinii
DPDVLNNRLVNEVVE

SEQ ID NO: 196291 - protein, 15 aa, Borrelia garinii
PDVLNNRLVNEVVEL

SEQ ID NO: 196292 - protein, 15 aa, Borrelia garinii
DVLNNRLVNEVVELE

SEQ ID NO: 196293 - protein, 15 aa, Borrelia garinii
VLNNRLVNEVVELEN

SEQ ID NO: 196294 - protein, 15 aa, Borrelia garinii
LNNRLVNEVVELENK

SEQ ID NO: 196295 - protein, 15 aa, Borrelia garinii
NNRLVNEVVELENKI

SEQ ID NO: 196296 - protein, 15 aa, Borrelia garinii
NRLVNEVVELENKII

SEQ ID NO: 196297 - protein, 15 aa, Borrelia garinii
RLVNEVVELENKIIS

SEQ ID NO: 196298 - protein, 15 aa, Borrelia garinii
LVNEVVELENKIISG

SEQ ID NO: 196299 - protein, 15 aa, Borrelia garinii
VNEVVELENKIISGE

SEQ ID NO: 196300 - protein, 15 aa, Borrelia garinii
NEVVELENKIISGEI

SEQ ID NO: 196301 - protein, 15 aa, Borrelia garinii
EVVELENKIISGEII

SEQ ID NO: 196302 - protein, 15 aa, Borrelia garinii
VVELENKIISGEIIV

SEQ ID NO: 196303 - protein, 15 aa, Borrelia garinii
VELENKIISGEIIVP

SEQ ID NO: 196304 - protein, 15 aa, Borrelia garinii
ELENKIISGEIIVPD

SEQ ID NO: 196305 - protein, 15 aa, Borrelia garinii
LENKIISGEIIVPDS

SEQ ID NO: 196306 - protein, 15 aa, Borrelia garinii
ENKIISGEIIVPDSE

SEQ ID NO: 196307 - protein, 15 aa, Borrelia garinii
NKIISGEIIVPDSEY

SEQ ID NO: 196308 - protein, 15 aa, Borrelia garinii
KIISGEIIVPDSEYA

SEQ ID NO: 196309 - protein, 15 aa, Borrelia garinii
IISGEIIVPDSEYAF

SEQ ID NO: 196310 - protein, 15 aa, Borrelia garinii
ISGEIIVPDSEYAFD

SEQ ID NO: 196311 - protein, 15 aa, Borrelia garinii
SGEIIVPDSEYAFDL

SEQ ID NO: 196312 - protein, 15 aa, Borrelia garinii
GEIIVPDSEYAFDLF

SEQ ID NO: 196313 - protein, 15 aa, Borrelia garinii
EIIVPDSEYAFDLFK

SEQ ID NO: 196314 - protein, 15 aa, Borrelia garinii
IIVPDSEYAFDLFKS

SEQ ID NO: 196315 - protein, 15 aa, Borrelia garinii
IVPDSEYAFDLFKSK

SEQ ID NO: 196316 - protein, 15 aa, Borrelia garinii
VPDSEYAFDLFKSKL

SEQ ID NO: 196317 - protein, 16 aa, Borrelia garinii
MFKRFVFIALSLLVLA

SEQ ID NO: 196318 - protein, 16 aa, Borrelia garinii
FKRFVFIALSLLVLAC

SEQ ID NO: 196319 - protein, 16 aa, Borrelia garinii
KRFVFIALSLLVLACF

SEQ ID NO: 196320 - protein, 16 aa, Borrelia garinii
RFVFIALSLLVLACFK

SEQ ID NO: 196321 - protein, 16 aa, Borrelia garinii
FVFIALSLLVLACFKS

SEQ ID NO: 196322 - protein, 16 aa, Borrelia garinii
VFIALSLLVLACFKSN

SEQ ID NO: 196323 - protein, 16 aa, Borrelia garinii
FIALSLLVLACFKSNK

SEQ ID NO: 196324 - protein, 16 aa, Borrelia garinii
IALSLLVLACFKSNKK

SEQ ID NO: 196325 - protein, 16 aa, Borrelia garinii
ALSLLVLACFKSNKKS

SEQ ID NO: 196326 - protein, 16 aa, Borrelia garinii
LSLLVLACFKSNKKSV

SEQ ID NO: 196327 - protein, 16 aa, Borrelia garinii
SLLVLACFKSNKKSVK

SEQ ID NO: 196328 - protein, 16 aa, Borrelia garinii
LLVLACFKSNKKSVKS

SEQ ID NO: 196329 - protein, 16 aa, Borrelia garinii
LVLACFKSNKKSVKSD

SEQ ID NO: 196330 - protein, 16 aa, Borrelia garinii
VLACFKSNKKSVKSDK

SEQ ID NO: 196331 - protein, 16 aa, Borrelia garinii
LACFKSNKKSVKSDKV

SEQ ID NO: 196332 - protein, 16 aa, Borrelia garinii
ACFKSNKKSVKSDKVI

SEQ ID NO: 196333 - protein, 16 aa, Borrelia garinii
CFKSNKKSVKSDKVII

SEQ ID NO: 196334 - protein, 16 aa, Borrelia garinii
FKSNKKSVKSDKVIIG

SEQ ID NO: 196335 - protein, 16 aa, Borrelia garinii
KSNKKSVKSDKVIIGV

SEQ ID NO: 196336 - protein, 16 aa, Borrelia garinii
SNKKSVKSDKVIIGVL

SEQ ID NO: 196337 - protein, 16 aa, Borrelia garinii
NKKSVKSDKVIIGVLA

SEQ ID NO: 196338 - protein, 16 aa, Borrelia garinii
KKSVKSDKVIIGVLAN

SEQ ID NO: 196339 - protein, 16 aa, Borrelia garinii
KSVKSDKVIIGVLANG

SEQ ID NO: 196340 - protein, 16 aa, Borrelia garinii
SVKSDKVIIGVLANGS

SEQ ID NO: 196341 - protein, 16 aa, Borrelia garinii
VKSDKVIIGVLANGSF

SEQ ID NO: 196342 - protein, 16 aa, Borrelia garinii
KSDKVIIGVLANGSFY

SEQ ID NO: 196343 - protein, 16 aa, Borrelia garinii
SDKVIIGVLANGSFYD

SEQ ID NO: 196344 - protein, 16 aa, Borrelia garinii
DKVIIGVLANGSFYDK

SEQ ID NO: 196345 - protein, 16 aa, Borrelia garinii
KVIIGVLANGSFYDKG

SEQ ID NO: 196346 - protein, 16 aa, Borrelia garinii
VIIGVLANGSFYDKGY

SEQ ID NO: 196347 - protein, 16 aa, Borrelia garinii
IIGVLANGSFYDKGYN

SEQ ID NO: 196348 - protein, 16 aa, Borrelia garinii
IGVLANGSFYDKGYNQ

SEQ ID NO: 196349 - protein, 16 aa, Borrelia garinii
GVLANGSFYDKGYNQS

SEQ ID NO: 196350 - protein, 16 aa, Borrelia garinii
VLANGSFYDKGYNQSV

SEQ ID NO: 196351 - protein, 16 aa, Borrelia garinii
LANGSFYDKGYNQSVY

SEQ ID NO: 196352 - protein, 16 aa, Borrelia garinii
ANGSFYDKGYNQSVYD

SEQ ID NO: 196353 - protein, 16 aa, Borrelia garinii
NGSFYDKGYNQSVYDG

SEQ ID NO: 196354 - protein, 16 aa, Borrelia garinii
GSFYDKGYNQSVYDGV

SEQ ID NO: 196355 - protein, 16 aa, Borrelia garinii
SFYDKGYNQSVYDGVV

SEQ ID NO: 196356 - protein, 16 aa, Borrelia garinii
FYDKGYNQSVYDGVVK

SEQ ID NO: 196357 - protein, 16 aa, Borrelia garinii
YDKGYNQSVYDGVVKL

SEQ ID NO: 196358 - protein, 16 aa, Borrelia garinii
DKGYNQSVYDGVVKLK

SEQ ID NO: 196359 - protein, 16 aa, Borrelia garinii
KGYNQSVYDGVVKLKD

SEQ ID NO: 196360 - protein, 16 aa, Borrelia garinii
GYNQSVYDGVVKLKDD

SEQ ID NO: 196361 - protein, 16 aa, Borrelia garinii
YNQSVYDGVVKLKDDF

SEQ ID NO: 196362 - protein, 16 aa, Borrelia garinii
NQSVYDGVVKLKDDFG

SEQ ID NO: 196363 - protein, 16 aa, Borrelia garinii
QSVYDGVVKLKDDFGI

SEQ ID NO: 196364 - protein, 16 aa, Borrelia garinii
SVYDGVVKLKDDFGIK

SEQ ID NO: 196365 - protein, 16 aa, Borrelia garinii
VYDGVVKLKDDFGIKL

SEQ ID NO: 196366 - protein, 16 aa, Borrelia garinii
YDGVVKLKDDFGIKLI

SEQ ID NO: 196367 - protein, 16 aa, Borrelia garinii
DGVVKLKDDFGIKLIT

SEQ ID NO: 196368 - protein, 16 aa, Borrelia garinii
GVVKLKDDFGIKLITK

SEQ ID NO: 196369 - protein, 16 aa, Borrelia garinii
VVKLKDDFGIKLITKS

SEQ ID NO: 196370 - protein, 16 aa, Borrelia garinii
VKLKDDFGIKLITKSL

SEQ ID NO: 196371 - protein, 16 aa, Borrelia garinii
KLKDDFGIKLITKSLR

SEQ ID NO: 196372 - protein, 16 aa, Borrelia garinii
LKDDFGIKLITKSLRP

SEQ ID NO: 196373 - protein, 16 aa, Borrelia garinii
KDDFGIKLITKSLRPY

SEQ ID NO: 196374 - protein, 16 aa, Borrelia garinii
DDFGIKLITKSLRPYP

SEQ ID NO: 196375 - protein, 16 aa, Borrelia garinii
DFGIKLITKSLRPYPI

SEQ ID NO: 196376 - protein, 16 aa, Borrelia garinii
FGIKLITKSLRPYPIE

SEQ ID NO: 196377 - protein, 16 aa, Borrelia garinii
GIKLITKSLRPYPIEG

SEQ ID NO: 196378 - protein, 16 aa, Borrelia garinii
IKLITKSLRPYPIEGK

SEQ ID NO: 196379 - protein, 16 aa, Borrelia garinii
KLITKSLRPYPIEGKR

SEQ ID NO: 196380 - protein, 16 aa, Borrelia garinii
LITKSLRPYPIEGKRL

SEQ ID NO: 196381 - protein, 16 aa, Borrelia garinii
ITKSLRPYPIEGKRLL

SEQ ID NO: 196382 - protein, 16 aa, Borrelia garinii
TKSLRPYPIEGKRLLT

SEQ ID NO: 196383 - protein, 16 aa, Borrelia garinii
KSLRPYPIEGKRLLTV

SEQ ID NO: 196384 - protein, 16 aa, Borrelia garinii
SLRPYPIEGKRLLTVN

SEQ ID NO: 196385 - protein, 16 aa, Borrelia garinii
LRPYPIEGKRLLTVNE

SEQ ID NO: 196386 - protein, 16 aa, Borrelia garinii
RPYPIEGKRLLTVNEA

SEQ ID NO: 196387 - protein, 16 aa, Borrelia garinii
PYPIEGKRLLTVNEAM

SEQ ID NO: 196388 - protein, 16 aa, Borrelia garinii
YPIEGKRLLTVNEAMA

SEQ ID NO: 196389 - protein, 16 aa, Borrelia garinii
PIEGKRLLTVNEAMAE

SEQ ID NO: 196390 - protein, 16 aa, Borrelia garinii
IEGKRLLTVNEAMAED

SEQ ID NO: 196391 - protein, 16 aa, Borrelia garinii
EGKRLLTVNEAMAEDA

SEQ ID NO: 196392 - protein, 16 aa, Borrelia garinii
GKRLLTVNEAMAEDAY

SEQ ID NO: 196393 - protein, 16 aa, Borrelia garinii
KRLLTVNEAMAEDAYE

SEQ ID NO: 196394 - protein, 16 aa, Borrelia garinii
RLLTVNEAMAEDAYEV

SEQ ID NO: 196395 - protein, 16 aa, Borrelia garinii
LLTVNEAMAEDAYEVQ

SEQ ID NO: 196396 - protein, 16 aa, Borrelia garinii
LTVNEAMAEDAYEVQK

SEQ ID NO: 196397 - protein, 16 aa, Borrelia garinii
TVNEAMAEDAYEVQKN

SEQ ID NO: 196398 - protein, 16 aa, Borrelia garinii
VNEAMAEDAYEVQKNP

SEQ ID NO: 196399 - protein, 16 aa, Borrelia garinii
NEAMAEDAYEVQKNPL

SEQ ID NO: 196400 - protein, 16 aa, Borrelia garinii
EAMAEDAYEVQKNPLN

SEQ ID NO: 196401 - protein, 16 aa, Borrelia garinii
AMAEDAYEVQKNPLNL

SEQ ID NO: 196402 - protein, 16 aa, Borrelia garinii
MAEDAYEVQKNPLNLF

SEQ ID NO: 196403 - protein, 16 aa, Borrelia garinii
AEDAYEVQKNPLNLFW

SEQ ID NO: 196404 - protein, 16 aa, Borrelia garinii
EDAYEVQKNPLNLFWL

SEQ ID NO: 196405 - protein, 16 aa, Borrelia garinii
DAYEVQKNPLNLFWLA

SEQ ID NO: 196406 - protein, 16 aa, Borrelia garinii
AYEVQKNPLNLFWLAG

SEQ ID NO: 196407 - protein, 16 aa, Borrelia garinii
YEVQKNPLNLFWLAGY

SEQ ID NO: 196408 - protein, 16 aa, Borrelia garinii
EVQKNPLNLFWLAGYQ

SEQ ID NO: 196409 - protein, 16 aa, Borrelia garinii
VQKNPLNLFWLAGYQF

SEQ ID NO: 196410 - protein, 16 aa, Borrelia garinii
QKNPLNLFWLAGYQFS

SEQ ID NO: 196411 - protein, 16 aa, Borrelia garinii
KNPLNLFWLAGYQFSS

SEQ ID NO: 196412 - protein, 16 aa, Borrelia garinii
NPLNLFWLAGYQFSSL

SEQ ID NO: 196413 - protein, 16 aa, Borrelia garinii
PLNLFWLAGYQFSSLS

SEQ ID NO: 196414 - protein, 16 aa, Borrelia garinii
LNLFWLAGYQFSSLSV

SEQ ID NO: 196415 - protein, 16 aa, Borrelia garinii
NLFWLAGYQFSSLSVK

SEQ ID NO: 196416 - protein, 16 aa, Borrelia garinii
LFWLAGYQFSSLSVKL

SEQ ID NO: 196417 - protein, 16 aa, Borrelia garinii
FWLAGYQFSSLSVKLS

SEQ ID NO: 196418 - protein, 16 aa, Borrelia garinii
WLAGYQFSSLSVKLSY

SEQ ID NO: 196419 - protein, 16 aa, Borrelia garinii
LAGYQFSSLSVKLSYE

SEQ ID NO: 196420 - protein, 16 aa, Borrelia garinii
AGYQFSSLSVKLSYER

SEQ ID NO: 196421 - protein, 16 aa, Borrelia garinii
GYQFSSLSVKLSYERP

SEQ ID NO: 196422 - protein, 16 aa, Borrelia garinii
YQFSSLSVKLSYERPD

SEQ ID NO: 196423 - protein, 16 aa, Borrelia garinii
QFSSLSVKLSYERPDI

SEQ ID NO: 196424 - protein, 16 aa, Borrelia garinii
FSSLSVKLSYERPDIY

SEQ ID NO: 196425 - protein, 16 aa, Borrelia garinii
SSLSVKLSYERPDIYY

SEQ ID NO: 196426 - protein, 16 aa, Borrelia garinii
SLSVKLSYERPDIYYG

SEQ ID NO: 196427 - protein, 16 aa, Borrelia garinii
LSVKLSYERPDIYYGI

SEQ ID NO: 196428 - protein, 16 aa, Borrelia garinii
SVKLSYERPDIYYGII

SEQ ID NO: 196429 - protein, 16 aa, Borrelia garinii
VKLSYERPDIYYGIID

SEQ ID NO: 196430 - protein, 16 aa, Borrelia garinii
KLSYERPDIYYGIIDA

SEQ ID NO: 196431 - protein, 16 aa, Borrelia garinii
LSYERPDIYYGIIDAF

SEQ ID NO: 196432 - protein, 16 aa, Borrelia garinii
SYERPDIYYGIIDAFD

SEQ ID NO: 196433 - protein, 16 aa, Borrelia garinii
YERPDIYYGIIDAFDY

SEQ ID NO: 196434 - protein, 16 aa, Borrelia garinii
ERPDIYYGIIDAFDYG

SEQ ID NO: 196435 - protein, 16 aa, Borrelia garinii
RPDIYYGIIDAFDYGD

SEQ ID NO: 196436 - protein, 16 aa, Borrelia garinii
PDIYYGIIDAFDYGDI

SEQ ID NO: 196437 - protein, 16 aa, Borrelia garinii
DIYYGIIDAFDYGDIQ

SEQ ID NO: 196438 - protein, 16 aa, Borrelia garinii
IYYGIIDAFDYGDIQV

SEQ ID NO: 196439 - protein, 16 aa, Borrelia garinii
YYGIIDAFDYGDIQVP

SEQ ID NO: 196440 - protein, 16 aa, Borrelia garinii
YGIIDAFDYGDIQVPK

SEQ ID NO: 196441 - protein, 16 aa, Borrelia garinii
GIIDAFDYGDIQVPKN

SEQ ID NO: 196442 - protein, 16 aa, Borrelia garinii
IIDAFDYGDIQVPKNS

SEQ ID NO: 196443 - protein, 16 aa, Borrelia garinii
IDAFDYGDIQVPKNSL

SEQ ID NO: 196444 - protein, 16 aa, Borrelia garinii
DAFDYGDIQVPKNSLA

SEQ ID NO: 196445 - protein, 16 aa, Borrelia garinii
AFDYGDIQVPKNSLAI

SEQ ID NO: 196446 - protein, 16 aa, Borrelia garinii
FDYGDIQVPKNSLAIK

SEQ ID NO: 196447 - protein, 16 aa, Borrelia garinii
DYGDIQVPKNSLAIKF

SEQ ID NO: 196448 - protein, 16 aa, Borrelia garinii
YGDIQVPKNSLAIKFR

SEQ ID NO: 196449 - protein, 16 aa, Borrelia garinii
GDIQVPKNSLAIKFRN

SEQ ID NO: 196450 - protein, 16 aa, Borrelia garinii
DIQVPKNSLAIKFRNE

SEQ ID NO: 196451 - protein, 16 aa, Borrelia garinii
IQVPKNSLAIKFRNEE

SEQ ID NO: 196452 - protein, 16 aa, Borrelia garinii
QVPKNSLAIKFRNEEA

SEQ ID NO: 196453 - protein, 16 aa, Borrelia garinii
VPKNSLAIKFRNEEAA

SEQ ID NO: 196454 - protein, 16 aa, Borrelia garinii
PKNSLAIKFRNEEAAF

SEQ ID NO: 196455 - protein, 16 aa, Borrelia garinii
KNSLAIKFRNEEAAFL

SEQ ID NO: 196456 - protein, 16 aa, Borrelia garinii
NSLAIKFRNEEAAFLA

SEQ ID NO: 196457 - protein, 16 aa, Borrelia garinii
SLAIKFRNEEAAFLAG

SEQ ID NO: 196458 - protein, 16 aa, Borrelia garinii
LAIKFRNEEAAFLAGY

SEQ ID NO: 196459 - protein, 16 aa, Borrelia garinii
AIKFRNEEAAFLAGYI

SEQ ID NO: 196460 - protein, 16 aa, Borrelia garinii
IKFRNEEAAFLAGYIA

SEQ ID NO: 196461 - protein, 16 aa, Borrelia garinii
KFRNEEAAFLAGYIAA

SEQ ID NO: 196462 - protein, 16 aa, Borrelia garinii
FRNEEAAFLAGYIAAK

SEQ ID NO: 196463 - protein, 16 aa, Borrelia garinii
RNEEAAFLAGYIAAKM

SEQ ID NO: 196464 - protein, 16 aa, Borrelia garinii
NEEAAFLAGYIAAKMS

SEQ ID NO: 196465 - protein, 16 aa, Borrelia garinii
EEAAFLAGYIAAKMSR

SEQ ID NO: 196466 - protein, 16 aa, Borrelia garinii
EAAFLAGYIAAKMSRK

SEQ ID NO: 196467 - protein, 16 aa, Borrelia garinii
AAFLAGYIAAKMSRKE

SEQ ID NO: 196468 - protein, 16 aa, Borrelia garinii
AFLAGYIAAKMSRKEK

SEQ ID NO: 196469 - protein, 16 aa, Borrelia garinii
FLAGYIAAKMSRKEKI

SEQ ID NO: 196470 - protein, 16 aa, Borrelia garinii
LAGYIAAKMSRKEKIG

SEQ ID NO: 196471 - protein, 16 aa, Borrelia garinii
AGYIAAKMSRKEKIGF

SEQ ID NO: 196472 - protein, 16 aa, Borrelia garinii
GYIAAKMSRKEKIGFL

SEQ ID NO: 196473 - protein, 16 aa, Borrelia garinii
YIAAKMSRKEKIGFLT

SEQ ID NO: 196474 - protein, 16 aa, Borrelia garinii
IAAKMSRKEKIGFLTG

SEQ ID NO: 196475 - protein, 16 aa, Borrelia garinii
AAKMSRKEKIGFLTGP

SEQ ID NO: 196476 - protein, 16 aa, Borrelia garinii
AKMSRKEKIGFLTGPE

SEQ ID NO: 196477 - protein, 16 aa, Borrelia garinii
KMSRKEKIGFLTGPES

SEQ ID NO: 196478 - protein, 16 aa, Borrelia garinii
MSRKEKIGFLTGPESE

SEQ ID NO: 196479 - protein, 16 aa, Borrelia garinii
SRKEKIGFLTGPESEY

SEQ ID NO: 196480 - protein, 16 aa, Borrelia garinii
RKEKIGFLTGPESEYL

SEQ ID NO: 196481 - protein, 16 aa, Borrelia garinii
KEKIGFLTGPESEYLN

SEQ ID NO: 196482 - protein, 16 aa, Borrelia garinii
EKIGFLTGPESEYLND

SEQ ID NO: 196483 - protein, 16 aa, Borrelia garinii
KIGFLTGPESEYLNDF

SEQ ID NO: 196484 - protein, 16 aa, Borrelia garinii
IGFLTGPESEYLNDFK

SEQ ID NO: 196485 - protein, 16 aa, Borrelia garinii
GFLTGPESEYLNDFKF

SEQ ID NO: 196486 - protein, 16 aa, Borrelia garinii
FLTGPESEYLNDFKFG

SEQ ID NO: 196487 - protein, 16 aa, Borrelia garinii
LTGPESEYLNDFKFGF

SEQ ID NO: 196488 - protein, 16 aa, Borrelia garinii
TGPESEYLNDFKFGFK

SEQ ID NO: 196489 - protein, 16 aa, Borrelia garinii
GPESEYLNDFKFGFKA

SEQ ID NO: 196490 - protein, 16 aa, Borrelia garinii
PESEYLNDFKFGFKAG

SEQ ID NO: 196491 - protein, 16 aa, Borrelia garinii
ESEYLNDFKFGFKAGI

SEQ ID NO: 196492 - protein, 16 aa, Borrelia garinii
SEYLNDFKFGFKAGIF

SEQ ID NO: 196493 - protein, 16 aa, Borrelia garinii
EYLNDFKFGFKAGIFY

SEQ ID NO: 196494 - protein, 16 aa, Borrelia garinii
YLNDFKFGFKAGIFYA

SEQ ID NO: 196495 - protein, 16 aa, Borrelia garinii
LNDFKFGFKAGIFYAN

SEQ ID NO: 196496 - protein, 16 aa, Borrelia garinii
NDFKFGFKAGIFYANP

SEQ ID NO: 196497 - protein, 16 aa, Borrelia garinii
DFKFGFKAGIFYANPK

SEQ ID NO: 196498 - protein, 16 aa, Borrelia garinii
FKFGFKAGIFYANPKL

SEQ ID NO: 196499 - protein, 16 aa, Borrelia garinii
KFGFKAGIFYANPKLR

SEQ ID NO: 196500 - protein, 16 aa, Borrelia garinii
FGFKAGIFYANPKLRL

SEQ ID NO: 196501 - protein, 16 aa, Borrelia garinii
GFKAGIFYANPKLRLV

SEQ ID NO: 196502 - protein, 16 aa, Borrelia garinii
FKAGIFYANPKLRLVS

SEQ ID NO: 196503 - protein, 16 aa, Borrelia garinii
KAGIFYANPKLRLVSK

SEQ ID NO: 196504 - protein, 16 aa, Borrelia garinii
AGIFYANPKLRLVSKK

SEQ ID NO: 196505 - protein, 16 aa, Borrelia garinii
GIFYANPKLRLVSKKA

SEQ ID NO: 196506 - protein, 16 aa, Borrelia garinii
IFYANPKLRLVSKKAP

SEQ ID NO: 196507 - protein, 16 aa, Borrelia garinii
FYANPKLRLVSKKAPS

SEQ ID NO: 196508 - protein, 16 aa, Borrelia garinii
YANPKLRLVSKKAPSL

SEQ ID NO: 196509 - protein, 16 aa, Borrelia garinii
ANPKLRLVSKKAPSLF

SEQ ID NO: 196510 - protein, 16 aa, Borrelia garinii
NPKLRLVSKKAPSLFD

SEQ ID NO: 196511 - protein, 16 aa, Borrelia garinii
PKLRLVSKKAPSLFDK

SEQ ID NO: 196512 - protein, 16 aa, Borrelia garinii
KLRLVSKKAPSLFDKE

SEQ ID NO: 196513 - protein, 16 aa, Borrelia garinii
LRLVSKKAPSLFDKEK

SEQ ID NO: 196514 - protein, 16 aa, Borrelia garinii
RLVSKKAPSLFDKEKG

SEQ ID NO: 196515 - protein, 16 aa, Borrelia garinii
LVSKKAPSLFDKEKGK

SEQ ID NO: 196516 - protein, 16 aa, Borrelia garinii
VSKKAPSLFDKEKGKE

SEQ ID NO: 196517 - protein, 16 aa, Borrelia garinii
SKKAPSLFDKEKGKEM

SEQ ID NO: 196518 - protein, 16 aa, Borrelia garinii
KKAPSLFDKEKGKEMA

SEQ ID NO: 196519 - protein, 16 aa, Borrelia garinii
KAPSLFDKEKGKEMAR

SEQ ID NO: 196520 - protein, 16 aa, Borrelia garinii
APSLFDKEKGKEMARF

SEQ ID NO: 196521 - protein, 16 aa, Borrelia garinii
PSLFDKEKGKEMARFM

SEQ ID NO: 196522 - protein, 16 aa, Borrelia garinii
SLFDKEKGKEMARFMY

SEQ ID NO: 196523 - protein, 16 aa, Borrelia garinii
LFDKEKGKEMARFMYK

SEQ ID NO: 196524 - protein, 16 aa, Borrelia garinii
FDKEKGKEMARFMYKE

SEQ ID NO: 196525 - protein, 16 aa, Borrelia garinii
DKEKGKEMARFMYKED

SEQ ID NO: 196526 - protein, 16 aa, Borrelia garinii
KEKGKEMARFMYKEDK

SEQ ID NO: 196527 - protein, 16 aa, Borrelia garinii
EKGKEMARFMYKEDKV

SEQ ID NO: 196528 - protein, 16 aa, Borrelia garinii
KGKEMARFMYKEDKVG

SEQ ID NO: 196529 - protein, 16 aa, Borrelia garinii
GKEMARFMYKEDKVGV

SEQ ID NO: 196530 - protein, 16 aa, Borrelia garinii
KEMARFMYKEDKVGVI

SEQ ID NO: 196531 - protein, 16 aa, Borrelia garinii
EMARFMYKEDKVGVIF

SEQ ID NO: 196532 - protein, 16 aa, Borrelia garinii
MARFMYKEDKVGVIFP

SEQ ID NO: 196533 - protein, 16 aa, Borrelia garinii
ARFMYKEDKVGVIFPI

SEQ ID NO: 196534 - protein, 16 aa, Borrelia garinii
RFMYKEDKVGVIFPIA

SEQ ID NO: 196535 - protein, 16 aa, Borrelia garinii
FMYKEDKVGVIFPIAG

SEQ ID NO: 196536 - protein, 16 aa, Borrelia garinii
MYKEDKVGVIFPIAGI

SEQ ID NO: 196537 - protein, 16 aa, Borrelia garinii
YKEDKVGVIFPIAGIT

SEQ ID NO: 196538 - protein, 16 aa, Borrelia garinii
KEDKVGVIFPIAGITG

SEQ ID NO: 196539 - protein, 16 aa, Borrelia garinii
EDKVGVIFPIAGITGL

SEQ ID NO: 196540 - protein, 16 aa, Borrelia garinii
DKVGVIFPIAGITGLG

SEQ ID NO: 196541 - protein, 16 aa, Borrelia garinii
KVGVIFPIAGITGLGV

SEQ ID NO: 196542 - protein, 16 aa, Borrelia garinii
VGVIFPIAGITGLGVY

SEQ ID NO: 196543 - protein, 16 aa, Borrelia garinii
GVIFPIAGITGLGVYD

SEQ ID NO: 196544 - protein, 16 aa, Borrelia garinii
VIFPIAGITGLGVYDA

SEQ ID NO: 196545 - protein, 16 aa, Borrelia garinii
IFPIAGITGLGVYDAA

SEQ ID NO: 196546 - protein, 16 aa, Borrelia garinii
FPIAGITGLGVYDAAK

SEQ ID NO: 196547 - protein, 16 aa, Borrelia garinii
PIAGITGLGVYDAAKE

SEQ ID NO: 196548 - protein, 16 aa, Borrelia garinii
IAGITGLGVYDAAKEL

SEQ ID NO: 196549 - protein, 16 aa, Borrelia garinii
AGITGLGVYDAAKELG

SEQ ID NO: 196550 - protein, 16 aa, Borrelia garinii
GITGLGVYDAAKELGP

SEQ ID NO: 196551 - protein, 16 aa, Borrelia garinii
ITGLGVYDAAKELGPK

SEQ ID NO: 196552 - protein, 16 aa, Borrelia garinii
TGLGVYDAAKELGPKY

SEQ ID NO: 196553 - protein, 16 aa, Borrelia garinii
GLGVYDAAKELGPKYY

SEQ ID NO: 196554 - protein, 16 aa, Borrelia garinii
LGVYDAAKELGPKYYV

SEQ ID NO: 196555 - protein, 16 aa, Borrelia garinii
GVYDAAKELGPKYYVI

SEQ ID NO: 196556 - protein, 16 aa, Borrelia garinii
VYDAAKELGPKYYVIG

SEQ ID NO: 196557 - protein, 16 aa, Borrelia garinii
YDAAKELGPKYYVIGL

SEQ ID NO: 196558 - protein, 16 aa, Borrelia garinii
DAAKELGPKYYVIGLN

SEQ ID NO: 196559 - protein, 16 aa, Borrelia garinii
AAKELGPKYYVIGLNQ

SEQ ID NO: 196560 - protein, 16 aa, Borrelia garinii
AKELGPKYYVIGLNQD

SEQ ID NO: 196561 - protein, 16 aa, Borrelia garinii
KELGPKYYVIGLNQDQ

SEQ ID NO: 196562 - protein, 16 aa, Borrelia garinii
ELGPKYYVIGLNQDQS

SEQ ID NO: 196563 - protein, 16 aa, Borrelia garinii
LGPKYYVIGLNQDQSY

SEQ ID NO: 196564 - protein, 16 aa, Borrelia garinii
GPKYYVIGLNQDQSYI

SEQ ID NO: 196565 - protein, 16 aa, Borrelia garinii
PKYYVIGLNQDQSYIA

SEQ ID NO: 196566 - protein, 16 aa, Borrelia garinii
KYYVIGLNQDQSYIAP

SEQ ID NO: 196567 - protein, 16 aa, Borrelia garinii
YYVIGLNQDQSYIAPQ

SEQ ID NO: 196568 - protein, 16 aa, Borrelia garinii
YVIGLNQDQSYIAPQN

SEQ ID NO: 196569 - protein, 16 aa, Borrelia garinii
VIGLNQDQSYIAPQNV

SEQ ID NO: 196570 - protein, 16 aa, Borrelia garinii
IGLNQDQSYIAPQNVI

SEQ ID NO: 196571 - protein, 16 aa, Borrelia garinii
GLNQDQSYIAPQNVIT

SEQ ID NO: 196572 - protein, 16 aa, Borrelia garinii
LNQDQSYIAPQNVITS

SEQ ID NO: 196573 - protein, 16 aa, Borrelia garinii
NQDQSYIAPQNVITSV

SEQ ID NO: 196574 - protein, 16 aa, Borrelia garinii
QDQSYIAPQNVITSVL

SEQ ID NO: 196575 - protein, 16 aa, Borrelia garinii
DQSYIAPQNVITSVLK

SEQ ID NO: 196576 - protein, 16 aa, Borrelia garinii
QSYIAPQNVITSVLKD

SEQ ID NO: 196577 - protein, 16 aa, Borrelia garinii
SYIAPQNVITSVLKDI

SEQ ID NO: 196578 - protein, 16 aa, Borrelia garinii
YIAPQNVITSVLKDIG

SEQ ID NO: 196579 - protein, 16 aa, Borrelia garinii
IAPQNVITSVLKDIGK

SEQ ID NO: 196580 - protein, 16 aa, Borrelia garinii
APQNVITSVLKDIGKV

SEQ ID NO: 196581 - protein, 16 aa, Borrelia garinii
PQNVITSVLKDIGKVI

SEQ ID NO: 196582 - protein, 16 aa, Borrelia garinii
QNVITSVLKDIGKVIY

SEQ ID NO: 196583 - protein, 16 aa, Borrelia garinii
NVITSVLKDIGKVIYS

SEQ ID NO: 196584 - protein, 16 aa, Borrelia garinii
VITSVLKDIGKVIYSV

SEQ ID NO: 196585 - protein, 16 aa, Borrelia garinii
ITSVLKDIGKVIYSVS

SEQ ID NO: 196586 - protein, 16 aa, Borrelia garinii
TSVLKDIGKVIYSVSS

SEQ ID NO: 196587 - protein, 16 aa, Borrelia garinii
SVLKDIGKVIYSVSSD

SEQ ID NO: 196588 - protein, 16 aa, Borrelia garinii
VLKDIGKVIYSVSSDY

SEQ ID NO: 196589 - protein, 16 aa, Borrelia garinii
LKDIGKVIYSVSSDYI

SEQ ID NO: 196590 - protein, 16 aa, Borrelia garinii
KDIGKVIYSVSSDYIK

SEQ ID NO: 196591 - protein, 16 aa, Borrelia garinii
DIGKVIYSVSSDYIKN

SEQ ID NO: 196592 - protein, 16 aa, Borrelia garinii
IGKVIYSVSSDYIKNG

SEQ ID NO: 196593 - protein, 16 aa, Borrelia garinii
GKVIYSVSSDYIKNGV

SEQ ID NO: 196594 - protein, 16 aa, Borrelia garinii
KVIYSVSSDYIKNGVF

SEQ ID NO: 196595 - protein, 16 aa, Borrelia garinii
VIYSVSSDYIKNGVFK

SEQ ID NO: 196596 - protein, 16 aa, Borrelia garinii
IYSVSSDYIKNGVFKG

SEQ ID NO: 196597 - protein, 16 aa, Borrelia garinii
YSVSSDYIKNGVFKGG

SEQ ID NO: 196598 - protein, 16 aa, Borrelia garinii
SVSSDYIKNGVFKGGV

SEQ ID NO: 196599 - protein, 16 aa, Borrelia garinii
VSSDYIKNGVFKGGVV

SEQ ID NO: 196600 - protein, 16 aa, Borrelia garinii
SSDYIKNGVFKGGVVI

SEQ ID NO: 196601 - protein, 16 aa, Borrelia garinii
SDYIKNGVFKGGVVID

SEQ ID NO: 196602 - protein, 16 aa, Borrelia garinii
DYIKNGVFKGGVVIDR

SEQ ID NO: 196603 - protein, 16 aa, Borrelia garinii
YIKNGVFKGGVVIDRG

SEQ ID NO: 196604 - protein, 16 aa, Borrelia garinii
IKNGVFKGGVVIDRGL

SEQ ID NO: 196605 - protein, 16 aa, Borrelia garinii
KNGVFKGGVVIDRGLK

SEQ ID NO: 196606 - protein, 16 aa, Borrelia garinii
NGVFKGGVVIDRGLKE

SEQ ID NO: 196607 - protein, 16 aa, Borrelia garinii
GVFKGGVVIDRGLKEG

SEQ ID NO: 196608 - protein, 16 aa, Borrelia garinii
VFKGGVVIDRGLKEGV

SEQ ID NO: 196609 - protein, 16 aa, Borrelia garinii
FKGGVVIDRGLKEGVI

SEQ ID NO: 196610 - protein, 16 aa, Borrelia garinii
KGGVVIDRGLKEGVIE

SEQ ID NO: 196611 - protein, 16 aa, Borrelia garinii
GGVVIDRGLKEGVIEI

SEQ ID NO: 196612 - protein, 16 aa, Borrelia garinii
GVVIDRGLKEGVIEIV

SEQ ID NO: 196613 - protein, 16 aa, Borrelia garinii
VVIDRGLKEGVIEIVK

SEQ ID NO: 196614 - protein, 16 aa, Borrelia garinii
VIDRGLKEGVIEIVKD

SEQ ID NO: 196615 - protein, 16 aa, Borrelia garinii
IDRGLKEGVIEIVKDP

SEQ ID NO: 196616 - protein, 16 aa, Borrelia garinii
DRGLKEGVIEIVKDPD

SEQ ID NO: 196617 - protein, 16 aa, Borrelia garinii
RGLKEGVIEIVKDPDV

SEQ ID NO: 196618 - protein, 16 aa, Borrelia garinii
GLKEGVIEIVKDPDVL

SEQ ID NO: 196619 - protein, 16 aa, Borrelia garinii
LKEGVIEIVKDPDVLN

SEQ ID NO: 196620 - protein, 16 aa, Borrelia garinii
KEGVIEIVKDPDVLNN

SEQ ID NO: 196621 - protein, 16 aa, Borrelia garinii
EGVIEIVKDPDVLNNR

SEQ ID NO: 196622 - protein, 16 aa, Borrelia garinii
GVIEIVKDPDVLNNRL

SEQ ID NO: 196623 - protein, 16 aa, Borrelia garinii
VIEIVKDPDVLNNRLV

SEQ ID NO: 196624 - protein, 16 aa, Borrelia garinii
IEIVKDPDVLNNRLVN

SEQ ID NO: 196625 - protein, 16 aa, Borrelia garinii
EIVKDPDVLNNRLVNE

SEQ ID NO: 196626 - protein, 16 aa, Borrelia garinii
IVKDPDVLNNRLVNEV

SEQ ID NO: 196627 - protein, 16 aa, Borrelia garinii
VKDPDVLNNRLVNEVV

SEQ ID NO: 196628 - protein, 16 aa, Borrelia garinii
KDPDVLNNRLVNEVVE

SEQ ID NO: 196629 - protein, 16 aa, Borrelia garinii
DPDVLNNRLVNEVVEL

SEQ ID NO: 196630 - protein, 16 aa, Borrelia garinii
PDVLNNRLVNEVVELE

SEQ ID NO: 196631 - protein, 16 aa, Borrelia garinii
DVLNNRLVNEVVELEN

SEQ ID NO: 196632 - protein, 16 aa, Borrelia garinii
VLNNRLVNEVVELENK

SEQ ID NO: 196633 - protein, 16 aa, Borrelia garinii
LNNRLVNEVVELENKI

SEQ ID NO: 196634 - protein, 16 aa, Borrelia garinii
NNRLVNEVVELENKII

SEQ ID NO: 196635 - protein, 16 aa, Borrelia garinii
NRLVNEVVELENKIIS

SEQ ID NO: 196636 - protein, 16 aa, Borrelia garinii
RLVNEVVELENKIISG

SEQ ID NO: 196637 - protein, 16 aa, Borrelia garinii
LVNEVVELENKIISGE

SEQ ID NO: 196638 - protein, 16 aa, Borrelia garinii
VNEVVELENKIISGEI

SEQ ID NO: 196639 - protein, 16 aa, Borrelia garinii
NEVVELENKIISGEII

SEQ ID NO: 196640 - protein, 16 aa, Borrelia garinii
EVVELENKIISGEIIV

SEQ ID NO: 196641 - protein, 16 aa, Borrelia garinii
VVELENKIISGEIIVP

SEQ ID NO: 196642 - protein, 16 aa, Borrelia garinii
VELENKIISGEIIVPD

SEQ ID NO: 196643 - protein, 16 aa, Borrelia garinii
ELENKIISGEIIVPDS

SEQ ID NO: 196644 - protein, 16 aa, Borrelia garinii
LENKIISGEIIVPDSE

SEQ ID NO: 196645 - protein, 16 aa, Borrelia garinii
ENKIISGEIIVPDSEY

SEQ ID NO: 196646 - protein, 16 aa, Borrelia garinii
NKIISGEIIVPDSEYA

SEQ ID NO: 196647 - protein, 16 aa, Borrelia garinii
KIISGEIIVPDSEYAF

SEQ ID NO: 196648 - protein, 16 aa, Borrelia garinii
IISGEIIVPDSEYAFD

SEQ ID NO: 196649 - protein, 16 aa, Borrelia garinii
ISGEIIVPDSEYAFDL

SEQ ID NO: 196650 - protein, 16 aa, Borrelia garinii
SGEIIVPDSEYAFDLF

SEQ ID NO: 196651 - protein, 16 aa, Borrelia garinii
GEIIVPDSEYAFDLFK

SEQ ID NO: 196652 - protein, 16 aa, Borrelia garinii
EIIVPDSEYAFDLFKS

SEQ ID NO: 196653 - protein, 16 aa, Borrelia garinii
IIVPDSEYAFDLFKSK

SEQ ID NO: 196654 - protein, 16 aa, Borrelia garinii
IVPDSEYAFDLFKSKL

SEQ ID NO: 196655 - protein, 616 aa, Borrelia afzelii
MKKQFDTEVNDLLYLIIHSLYSHKEIFLRELISNASDAIDKLKFLSLTNEKFKNIALEPKIEITFDDKSILIKDNGIGMNEQELTNHLGVIAKSGTKEFINNLKQDEKKSANLIGQFGVGFYSAFIVSEKVEVTSKKALESDAYIWSSDGKTGYEIEKAKKEDPGTEIKLYLNKEGLEYANKWKIQEIVKKYSNHINYPIYIKYNEPIMKDGKQEGIEEKEEKLNETTALWTKNKSEIKTEEYNEFYKNTTFDYENPLMYIHTKAEGNLEYTNLFYIPSKAPYDLYYPNTKPGVKLFINRIFITDSEGSLLPNYLRFIKGIIDCQDLPLNVSREILQQNKILSKIKSSSVKKILSELEKLSKKNPEKFSEFSKEFGRCIKEGVYSDFENREKLISLIRFKSSSVDGFVSFKEYKERMNEGQKSIYYITGGKENILKENPIVTAYKEKGFEILIMDDELDEAILNLIPEYEGLKLKAINKNETSNELKDENFKKIEEEFKDTLTRVKEILKDQIKEVNLSATLIKEPSAIIVDSNDPTYQMQKIMLSMGQEVKEIKPILELNPNNKIVQNLKNLEPEKLEKISILLFEEALLTSGMPSKNPRKFINIINEFLEKDLL

SEQ ID NO: 196656 - protein, 8 aa, Borrelia afzelii
MKKQFDTE

SEQ ID NO: 196657 - protein, 8 aa, Borrelia afzelii
KKQFDTEV

SEQ ID NO: 196658 - protein, 8 aa, Borrelia afzelii
KQFDTEVN

SEQ ID NO: 196659 - protein, 8 aa, Borrelia afzelii
QFDTEVND

SEQ ID NO: 196660 - protein, 8 aa, Borrelia afzelii
FDTEVNDL

SEQ ID NO: 196661 - protein, 8 aa, Borrelia afzelii
DTEVNDLL

SEQ ID NO: 196662 - protein, 8 aa, Borrelia afzelii
TEVNDLLY

SEQ ID NO: 196663 - protein, 8 aa, Borrelia afzelii
EVNDLLYL

SEQ ID NO: 196664 - protein, 8 aa, Borrelia afzelii
VNDLLYLI

SEQ ID NO: 196665 - protein, 8 aa, Borrelia afzelii
NDLLYLII

SEQ ID NO: 196666 - protein, 8 aa, Borrelia afzelii
DLLYLIIH

SEQ ID NO: 196667 - protein, 8 aa, Borrelia afzelii
LLYLIIHS

SEQ ID NO: 196668 - protein, 8 aa, Borrelia afzelii
LYLIIHSL

SEQ ID NO: 196669 - protein, 8 aa, Borrelia afzelii
YLIIHSLY

SEQ ID NO: 196670 - protein, 8 aa, Borrelia afzelii
LIIHSLYS

SEQ ID NO: 196671 - protein, 8 aa, Borrelia afzelii
IIHSLYSH

SEQ ID NO: 196672 - protein, 8 aa, Borrelia afzelii
IHSLYSHK

SEQ ID NO: 196673 - protein, 8 aa, Borrelia afzelii
HSLYSHKE

SEQ ID NO: 196674 - protein, 8 aa, Borrelia afzelii
SLYSHKEI

SEQ ID NO: 196675 - protein, 8 aa, Borrelia afzelii
LYSHKEIF

SEQ ID NO: 196676 - protein, 8 aa, Borrelia afzelii
YSHKEIFL

SEQ ID NO: 196677 - protein, 8 aa, Borrelia afzelii
SHKEIFLR

SEQ ID NO: 196678 - protein, 8 aa, Borrelia afzelii
HKEIFLRE

SEQ ID NO: 196679 - protein, 8 aa, Borrelia afzelii
KEIFLREL

SEQ ID NO: 196680 - protein, 8 aa, Borrelia afzelii
EIFLRELI

SEQ ID NO: 196681 - protein, 8 aa, Borrelia afzelii
IFLRELIS

SEQ ID NO: 196682 - protein, 8 aa, Borrelia afzelii
FLRELISN

SEQ ID NO: 196683 - protein, 8 aa, Borrelia afzelii
LRELISNA

SEQ ID NO: 196684 - protein, 8 aa, Borrelia afzelii
RELISNAS

SEQ ID NO: 196685 - protein, 8 aa, Borrelia afzelii
ELISNASD

SEQ ID NO: 196686 - protein, 8 aa, Borrelia afzelii
LISNASDA

SEQ ID NO: 196687 - protein, 8 aa, Borrelia afzelii
ISNASDAI

SEQ ID NO: 196688 - protein, 8 aa, Borrelia afzelii
SNASDAID

SEQ ID NO: 196689 - protein, 8 aa, Borrelia afzelii
NASDAIDK

SEQ ID NO: 196690 - protein, 8 aa, Borrelia afzelii
ASDAIDKL

SEQ ID NO: 196691 - protein, 8 aa, Borrelia afzelii
SDAIDKLK

SEQ ID NO: 196692 - protein, 8 aa, Borrelia afzelii
DAIDKLKF

SEQ ID NO: 196693 - protein, 8 aa, Borrelia afzelii
AIDKLKFL

SEQ ID NO: 196694 - protein, 8 aa, Borrelia afzelii
IDKLKFLS

SEQ ID NO: 196695 - protein, 8 aa, Borrelia afzelii
DKLKFLSL

SEQ ID NO: 196696 - protein, 8 aa, Borrelia afzelii
KLKFLSLT

SEQ ID NO: 196697 - protein, 8 aa, Borrelia afzelii
LKFLSLTN

SEQ ID NO: 196698 - protein, 8 aa, Borrelia afzelii
KFLSLTNE

SEQ ID NO: 196699 - protein, 8 aa, Borrelia afzelii
FLSLTNEK

SEQ ID NO: 196700 - protein, 8 aa, Borrelia afzelii
LSLTNEKF

SEQ ID NO: 196701 - protein, 8 aa, Borrelia afzelii
SLTNEKFK

SEQ ID NO: 196702 - protein, 8 aa, Borrelia afzelii
LTNEKFKN

SEQ ID NO: 196703 - protein, 8 aa, Borrelia afzelii
TNEKFKNI

SEQ ID NO: 196704 - protein, 8 aa, Borrelia afzelii
NEKFKNIA

SEQ ID NO: 196705 - protein, 8 aa, Borrelia afzelii
EKFKNIAL

SEQ ID NO: 196706 - protein, 8 aa, Borrelia afzelii
KFKNIALE

SEQ ID NO: 196707 - protein, 8 aa, Borrelia afzelii
FKNIALEP

SEQ ID NO: 196708 - protein, 8 aa, Borrelia afzelii
KNIALEPK

SEQ ID NO: 196709 - protein, 8 aa, Borrelia afzelii
NIALEPKI

SEQ ID NO: 196710 - protein, 8 aa, Borrelia afzelii
IALEPKIE

SEQ ID NO: 196711 - protein, 8 aa, Borrelia afzelii
ALEPKIEI

SEQ ID NO: 196712 - protein, 8 aa, Borrelia afzelii
LEPKIEIT

SEQ ID NO: 196713 - protein, 8 aa, Borrelia afzelii
EPKIEITF

SEQ ID NO: 196714 - protein, 8 aa, Borrelia afzelii
PKIEITFD

SEQ ID NO: 196715 - protein, 8 aa, Borrelia afzelii
KIEITFDD

SEQ ID NO: 196716 - protein, 8 aa, Borrelia afzelii
IEITFDDK

SEQ ID NO: 196717 - protein, 8 aa, Borrelia afzelii
EITFDDKS

SEQ ID NO: 196718 - protein, 8 aa, Borrelia afzelii
ITFDDKSI

SEQ ID NO: 196719 - protein, 8 aa, Borrelia afzelii
TFDDKSIL

SEQ ID NO: 196720 - protein, 8 aa, Borrelia afzelii
FDDKSILI

SEQ ID NO: 196721 - protein, 8 aa, Borrelia afzelii
DDKSILIK

SEQ ID NO: 196722 - protein, 8 aa, Borrelia afzelii
DKSILIKD

SEQ ID NO: 196723 - protein, 8 aa, Borrelia afzelii
KSILIKDN

SEQ ID NO: 196724 - protein, 8 aa, Borrelia afzelii
SILIKDNG

SEQ ID NO: 196725 - protein, 8 aa, Borrelia afzelii
ILIKDNGI

SEQ ID NO: 196726 - protein, 8 aa, Borrelia afzelii
LIKDNGIG

SEQ ID NO: 196727 - protein, 8 aa, Borrelia afzelii
IKDNGIGM

SEQ ID NO: 196728 - protein, 8 aa, Borrelia afzelii
KDNGIGMN

SEQ ID NO: 196729 - protein, 8 aa, Borrelia afzelii
DNGIGMNE

SEQ ID NO: 196730 - protein, 8 aa, Borrelia afzelii
NGIGMNEQ

SEQ ID NO: 196731 - protein, 8 aa, Borrelia afzelii
GIGMNEQE

SEQ ID NO: 196732 - protein, 8 aa, Borrelia afzelii
IGMNEQEL

SEQ ID NO: 196733 - protein, 8 aa, Borrelia afzelii
GMNEQELT

SEQ ID NO: 196734 - protein, 8 aa, Borrelia afzelii
MNEQELTN

SEQ ID NO: 196735 - protein, 8 aa, Borrelia afzelii
NEQELTNH

SEQ ID NO: 196736 - protein, 8 aa, Borrelia afzelii
EQELTNHL

SEQ ID NO: 196737 - protein, 8 aa, Borrelia afzelii
QELTNHLG

SEQ ID NO: 196738 - protein, 8 aa, Borrelia afzelii
ELTNHLGV

SEQ ID NO: 196739 - protein, 8 aa, Borrelia afzelii
LTNHLGVI

SEQ ID NO: 196740 - protein, 8 aa, Borrelia afzelii
TNHLGVIA

SEQ ID NO: 196741 - protein, 8 aa, Borrelia afzelii
NHLGVIAK

SEQ ID NO: 196742 - protein, 8 aa, Borrelia afzelii
HLGVIAKS

SEQ ID NO: 196743 - protein, 8 aa, Borrelia afzelii
LGVIAKSG

SEQ ID NO: 196744 - protein, 8 aa, Borrelia afzelii
GVIAKSGT

SEQ ID NO: 196745 - protein, 8 aa, Borrelia afzelii
VIAKSGTK

SEQ ID NO: 196746 - protein, 8 aa, Borrelia afzelii
IAKSGTKE

SEQ ID NO: 196747 - protein, 8 aa, Borrelia afzelii
AKSGTKEF

SEQ ID NO: 196748 - protein, 8 aa, Borrelia afzelii
KSGTKEFI

SEQ ID NO: 196749 - protein, 8 aa, Borrelia afzelii
SGTKEFIN

SEQ ID NO: 196750 - protein, 8 aa, Borrelia afzelii
GTKEFINN

SEQ ID NO: 196751 - protein, 8 aa, Borrelia afzelii
TKEFINNL

SEQ ID NO: 196752 - protein, 8 aa, Borrelia afzelii
KEFINNLK

SEQ ID NO: 196753 - protein, 8 aa, Borrelia afzelii
EFINNLKQ

SEQ ID NO: 196754 - protein, 8 aa, Borrelia afzelii
FINNLKQD

SEQ ID NO: 196755 - protein, 8 aa, Borrelia afzelii
INNLKQDE

SEQ ID NO: 196756 - protein, 8 aa, Borrelia afzelii
NNLKQDEK

SEQ ID NO: 196757 - protein, 8 aa, Borrelia afzelii
NLKQDEKK

SEQ ID NO: 196758 - protein, 8 aa, Borrelia afzelii
LKQDEKKS

SEQ ID NO: 196759 - protein, 8 aa, Borrelia afzelii
KQDEKKSA

SEQ ID NO: 196760 - protein, 8 aa, Borrelia afzelii
QDEKKSAN

SEQ ID NO: 196761 - protein, 8 aa, Borrelia afzelii
DEKKSANL

SEQ ID NO: 196762 - protein, 8 aa, Borrelia afzelii
EKKSANLI

SEQ ID NO: 196763 - protein, 8 aa, Borrelia afzelii
KKSANLIG

SEQ ID NO: 196764 - protein, 8 aa, Borrelia afzelii
KSANLIGQ

SEQ ID NO: 196765 - protein, 8 aa, Borrelia afzelii
SANLIGQF

SEQ ID NO: 196766 - protein, 8 aa, Borrelia afzelii
ANLIGQFG

SEQ ID NO: 196767 - protein, 8 aa, Borrelia afzelii
NLIGQFGV

SEQ ID NO: 196768 - protein, 8 aa, Borrelia afzelii
LIGQFGVG

SEQ ID NO: 196769 - protein, 8 aa, Borrelia afzelii
IGQFGVGF

SEQ ID NO: 196770 - protein, 8 aa, Borrelia afzelii
GQFGVGFY

SEQ ID NO: 196771 - protein, 8 aa, Borrelia afzelii
QFGVGFYS

SEQ ID NO: 196772 - protein, 8 aa, Borrelia afzelii
FGVGFYSA

SEQ ID NO: 196773 - protein, 8 aa, Borrelia afzelii
GVGFYSAF

SEQ ID NO: 196774 - protein, 8 aa, Borrelia afzelii
VGFYSAFI

SEQ ID NO: 196775 - protein, 8 aa, Borrelia afzelii
GFYSAFIV

SEQ ID NO: 196776 - protein, 8 aa, Borrelia afzelii
FYSAFIVS

SEQ ID NO: 196777 - protein, 8 aa, Borrelia afzelii
YSAFIVSE

SEQ ID NO: 196778 - protein, 8 aa, Borrelia afzelii
SAFIVSEK

SEQ ID NO: 196779 - protein, 8 aa, Borrelia afzelii
AFIVSEKV

SEQ ID NO: 196780 - protein, 8 aa, Borrelia afzelii
FIVSEKVE

SEQ ID NO: 196781 - protein, 8 aa, Borrelia afzelii
IVSEKVEV

SEQ ID NO: 196782 - protein, 8 aa, Borrelia afzelii
VSEKVEVT

SEQ ID NO: 196783 - protein, 8 aa, Borrelia afzelii
SEKVEVTS

SEQ ID NO: 196784 - protein, 8 aa, Borrelia afzelii
EKVEVTSK

SEQ ID NO: 196785 - protein, 8 aa, Borrelia afzelii
KVEVTSKK

SEQ ID NO: 196786 - protein, 8 aa, Borrelia afzelii
VEVTSKKA

SEQ ID NO: 196787 - protein, 8 aa, Borrelia afzelii
EVTSKKAL

SEQ ID NO: 196788 - protein, 8 aa, Borrelia afzelii
VTSKKALE

SEQ ID NO: 196789 - protein, 8 aa, Borrelia afzelii
TSKKALES

SEQ ID NO: 196790 - protein, 8 aa, Borrelia afzelii
SKKALESD

SEQ ID NO: 196791 - protein, 8 aa, Borrelia afzelii
KKALESDA

SEQ ID NO: 196792 - protein, 8 aa, Borrelia afzelii
KALESDAY

SEQ ID NO: 196793 - protein, 8 aa, Borrelia afzelii
ALESDAYI

SEQ ID NO: 196794 - protein, 8 aa, Borrelia afzelii
LESDAYIW

SEQ ID NO: 196795 - protein, 8 aa, Borrelia afzelii
ESDAYIWS

SEQ ID NO: 196796 - protein, 8 aa, Borrelia afzelii
SDAYIWSS

SEQ ID NO: 196797 - protein, 8 aa, Borrelia afzelii
DAYIWSSD

SEQ ID NO: 196798 - protein, 8 aa, Borrelia afzelii
AYIWSSDG

SEQ ID NO: 196799 - protein, 8 aa, Borrelia afzelii
YIWSSDGK

SEQ ID NO: 196800 - protein, 8 aa, Borrelia afzelii
IWSSDGKT

SEQ ID NO: 196801 - protein, 8 aa, Borrelia afzelii
WSSDGKTG

SEQ ID NO: 196802 - protein, 8 aa, Borrelia afzelii
SSDGKTGY

SEQ ID NO: 196803 - protein, 8 aa, Borrelia afzelii
SDGKTGYE

SEQ ID NO: 196804 - protein, 8 aa, Borrelia afzelii
DGKTGYEI

SEQ ID NO: 196805 - protein, 8 aa, Borrelia afzelii
GKTGYEIE

SEQ ID NO: 196806 - protein, 8 aa, Borrelia afzelii
KTGYEIEK

SEQ ID NO: 196807 - protein, 8 aa, Borrelia afzelii
TGYEIEKA

SEQ ID NO: 196808 - protein, 8 aa, Borrelia afzelii
GYEIEKAK

SEQ ID NO: 196809 - protein, 8 aa, Borrelia afzelii
YEIEKAKK

SEQ ID NO: 196810 - protein, 8 aa, Borrelia afzelii
EIEKAKKE

SEQ ID NO: 196811 - protein, 8 aa, Borrelia afzelii
IEKAKKED

SEQ ID NO: 196812 - protein, 8 aa, Borrelia afzelii
EKAKKEDP

SEQ ID NO: 196813 - protein, 8 aa, Borrelia afzelii
KAKKEDPG

SEQ ID NO: 196814 - protein, 8 aa, Borrelia afzelii
AKKEDPGT

SEQ ID NO: 196815 - protein, 8 aa, Borrelia afzelii
KKEDPGTE

SEQ ID NO: 196816 - protein, 8 aa, Borrelia afzelii
KEDPGTEI

SEQ ID NO: 196817 - protein, 8 aa, Borrelia afzelii
EDPGTEIK

SEQ ID NO: 196818 - protein, 8 aa, Borrelia afzelii
DPGTEIKL

SEQ ID NO: 196819 - protein, 8 aa, Borrelia afzelii
PGTEIKLY

SEQ ID NO: 196820 - protein, 8 aa, Borrelia afzelii
GTEIKLYL

SEQ ID NO: 196821 - protein, 8 aa, Borrelia afzelii
TEIKLYLN

SEQ ID NO: 196822 - protein, 8 aa, Borrelia afzelii
EIKLYLNK

SEQ ID NO: 196823 - protein, 8 aa, Borrelia afzelii
IKLYLNKE

SEQ ID NO: 196824 - protein, 8 aa, Borrelia afzelii
KLYLNKEG

SEQ ID NO: 196825 - protein, 8 aa, Borrelia afzelii
LYLNKEGL

SEQ ID NO: 196826 - protein, 8 aa, Borrelia afzelii
YLNKEGLE

SEQ ID NO: 196827 - protein, 8 aa, Borrelia afzelii
LNKEGLEY

SEQ ID NO: 196828 - protein, 8 aa, Borrelia afzelii
NKEGLEYA

SEQ ID NO: 196829 - protein, 8 aa, Borrelia afzelii
KEGLEYAN

SEQ ID NO: 196830 - protein, 8 aa, Borrelia afzelii
EGLEYANK

SEQ ID NO: 196831 - protein, 8 aa, Borrelia afzelii
GLEYANKW

SEQ ID NO: 196832 - protein, 8 aa, Borrelia afzelii
LEYANKWK

SEQ ID NO: 196833 - protein, 8 aa, Borrelia afzelii
EYANKWKI

SEQ ID NO: 196834 - protein, 8 aa, Borrelia afzelii
YANKWKIQ

SEQ ID NO: 196835 - protein, 8 aa, Borrelia afzelii
ANKWKIQE

SEQ ID NO: 196836 - protein, 8 aa, Borrelia afzelii
NKWKIQEI

SEQ ID NO: 196837 - protein, 8 aa, Borrelia afzelii
KWKIQEIV

SEQ ID NO: 196838 - protein, 8 aa, Borrelia afzelii
WKIQEIVK

SEQ ID NO: 196839 - protein, 8 aa, Borrelia afzelii
KIQEIVKK

SEQ ID NO: 196840 - protein, 8 aa, Borrelia afzelii
IQEIVKKY

SEQ ID NO: 196841 - protein, 8 aa, Borrelia afzelii
QEIVKKYS

SEQ ID NO: 196842 - protein, 8 aa, Borrelia afzelii
EIVKKYSN

SEQ ID NO: 196843 - protein, 8 aa, Borrelia afzelii
IVKKYSNH

SEQ ID NO: 196844 - protein, 8 aa, Borrelia afzelii
VKKYSNHI

SEQ ID NO: 196845 - protein, 8 aa, Borrelia afzelii
KKYSNHIN

SEQ ID NO: 196846 - protein, 8 aa, Borrelia afzelii
KYSNHINY

SEQ ID NO: 196847 - protein, 8 aa, Borrelia afzelii
YSNHINYP

SEQ ID NO: 196848 - protein, 8 aa, Borrelia afzelii
SNHINYPI

SEQ ID NO: 196849 - protein, 8 aa, Borrelia afzelii
NHINYPIY

SEQ ID NO: 196850 - protein, 8 aa, Borrelia afzelii
HINYPIYI

SEQ ID NO: 196851 - protein, 8 aa, Borrelia afzelii
INYPIYIK

SEQ ID NO: 196852 - protein, 8 aa, Borrelia afzelii
NYPIYIKY

SEQ ID NO: 196853 - protein, 8 aa, Borrelia afzelii
YPIYIKYN

SEQ ID NO: 196854 - protein, 8 aa, Borrelia afzelii
PIYIKYNE

SEQ ID NO: 196855 - protein, 8 aa, Borrelia afzelii
IYIKYNEP

SEQ ID NO: 196856 - protein, 8 aa, Borrelia afzelii
YIKYNEPI

SEQ ID NO: 196857 - protein, 8 aa, Borrelia afzelii
IKYNEPIM

SEQ ID NO: 196858 - protein, 8 aa, Borrelia afzelii
KYNEPIMK

SEQ ID NO: 196859 - protein, 8 aa, Borrelia afzelii
YNEPIMKD

SEQ ID NO: 196860 - protein, 8 aa, Borrelia afzelii
NEPIMKDG

SEQ ID NO: 196861 - protein, 8 aa, Borrelia afzelii
EPIMKDGK

SEQ ID NO: 196862 - protein, 8 aa, Borrelia afzelii
PIMKDGKQ

SEQ ID NO: 196863 - protein, 8 aa, Borrelia afzelii
IMKDGKQE

SEQ ID NO: 196864 - protein, 8 aa, Borrelia afzelii
MKDGKQEG

SEQ ID NO: 196865 - protein, 8 aa, Borrelia afzelii
KDGKQEGI

SEQ ID NO: 196866 - protein, 8 aa, Borrelia afzelii
DGKQEGIE

SEQ ID NO: 196867 - protein, 8 aa, Borrelia afzelii
GKQEGIEE

SEQ ID NO: 196868 - protein, 8 aa, Borrelia afzelii
KQEGIEEK

SEQ ID NO: 196869 - protein, 8 aa, Borrelia afzelii
QEGIEEKE

SEQ ID NO: 196870 - protein, 8 aa, Borrelia afzelii
EGIEEKEE

SEQ ID NO: 196871 - protein, 8 aa, Borrelia afzelii
GIEEKEEK

SEQ ID NO: 196872 - protein, 8 aa, Borrelia afzelii
IEEKEEKL

SEQ ID NO: 196873 - protein, 8 aa, Borrelia afzelii
EEKEEKLN

SEQ ID NO: 196874 - protein, 8 aa, Borrelia afzelii
EKEEKLNE

SEQ ID NO: 196875 - protein, 8 aa, Borrelia afzelii
KEEKLNET

SEQ ID NO: 196876 - protein, 8 aa, Borrelia afzelii
EEKLNETT

SEQ ID NO: 196877 - protein, 8 aa, Borrelia afzelii
EKLNETTA

SEQ ID NO: 196878 - protein, 8 aa, Borrelia afzelii
KLNETTAL

SEQ ID NO: 196879 - protein, 8 aa, Borrelia afzelii
LNETTALW

SEQ ID NO: 196880 - protein, 8 aa, Borrelia afzelii
NETTALWT

SEQ ID NO: 196881 - protein, 8 aa, Borrelia afzelii
ETTALWTK

SEQ ID NO: 196882 - protein, 8 aa, Borrelia afzelii
TTALWTKN

SEQ ID NO: 196883 - protein, 8 aa, Borrelia afzelii
TALWTKNK

SEQ ID NO: 196884 - protein, 8 aa, Borrelia afzelii
ALWTKNKS

SEQ ID NO: 196885 - protein, 8 aa, Borrelia afzelii
LWTKNKSE

SEQ ID NO: 196886 - protein, 8 aa, Borrelia afzelii
WTKNKSEI

SEQ ID NO: 196887 - protein, 8 aa, Borrelia afzelii
TKNKSEIK

SEQ ID NO: 196888 - protein, 8 aa, Borrelia afzelii
KNKSEIKT

SEQ ID NO: 196889 - protein, 8 aa, Borrelia afzelii
NKSEIKTE

SEQ ID NO: 196890 - protein, 8 aa, Borrelia afzelii
KSEIKTEE

SEQ ID NO: 196891 - protein, 8 aa, Borrelia afzelii
SEIKTEEY

SEQ ID NO: 196892 - protein, 8 aa, Borrelia afzelii
EIKTEEYN

SEQ ID NO: 196893 - protein, 8 aa, Borrelia afzelii
IKTEEYNE

SEQ ID NO: 196894 - protein, 8 aa, Borrelia afzelii
KTEEYNEF

SEQ ID NO: 196895 - protein, 8 aa, Borrelia afzelii
TEEYNEFY

SEQ ID NO: 196896 - protein, 8 aa, Borrelia afzelii
EEYNEFYK

SEQ ID NO: 196897 - protein, 8 aa, Borrelia afzelii
EYNEFYKN

SEQ ID NO: 196898 - protein, 8 aa, Borrelia afzelii
YNEFYKNT

SEQ ID NO: 196899 - protein, 8 aa, Borrelia afzelii
NEFYKNTT

SEQ ID NO: 196900 - protein, 8 aa, Borrelia afzelii
EFYKNTTF

SEQ ID NO: 196901 - protein, 8 aa, Borrelia afzelii
FYKNTTFD

SEQ ID NO: 196902 - protein, 8 aa, Borrelia afzelii
YKNTTFDY

SEQ ID NO: 196903 - protein, 8 aa, Borrelia afzelii
KNTTFDYE

SEQ ID NO: 196904 - protein, 8 aa, Borrelia afzelii
NTTFDYEN

SEQ ID NO: 196905 - protein, 8 aa, Borrelia afzelii
TTFDYENP

SEQ ID NO: 196906 - protein, 8 aa, Borrelia afzelii
TFDYENPL

SEQ ID NO: 196907 - protein, 8 aa, Borrelia afzelii
FDYENPLM

SEQ ID NO: 196908 - protein, 8 aa, Borrelia afzelii
DYENPLMY

SEQ ID NO: 196909 - protein, 8 aa, Borrelia afzelii
YENPLMYI

SEQ ID NO: 196910 - protein, 8 aa, Borrelia afzelii
ENPLMYIH

SEQ ID NO: 196911 - protein, 8 aa, Borrelia afzelii
NPLMYIHT

SEQ ID NO: 196912 - protein, 8 aa, Borrelia afzelii
PLMYIHTK

SEQ ID NO: 196913 - protein, 8 aa, Borrelia afzelii
LMYIHTKA

SEQ ID NO: 196914 - protein, 8 aa, Borrelia afzelii
MYIHTKAE

SEQ ID NO: 196915 - protein, 8 aa, Borrelia afzelii
YIHTKAEG

SEQ ID NO: 196916 - protein, 8 aa, Borrelia afzelii
IHTKAEGN

SEQ ID NO: 196917 - protein, 8 aa, Borrelia afzelii
HTKAEGNL

SEQ ID NO: 196918 - protein, 8 aa, Borrelia afzelii
TKAEGNLE

SEQ ID NO: 196919 - protein, 8 aa, Borrelia afzelii
KAEGNLEY

SEQ ID NO: 196920 - protein, 8 aa, Borrelia afzelii
AEGNLEYT

SEQ ID NO: 196921 - protein, 8 aa, Borrelia afzelii
EGNLEYTN

SEQ ID NO: 196922 - protein, 8 aa, Borrelia afzelii
GNLEYTNL

SEQ ID NO: 196923 - protein, 8 aa, Borrelia afzelii
NLEYTNLF

SEQ ID NO: 196924 - protein, 8 aa, Borrelia afzelii
LEYTNLFY

SEQ ID NO: 196925 - protein, 8 aa, Borrelia afzelii
EYTNLFYI

SEQ ID NO: 196926 - protein, 8 aa, Borrelia afzelii
YTNLFYIP

SEQ ID NO: 196927 - protein, 8 aa, Borrelia afzelii
TNLFYIPS

SEQ ID NO: 196928 - protein, 8 aa, Borrelia afzelii
NLFYIPSK

SEQ ID NO: 196929 - protein, 8 aa, Borrelia afzelii
LFYIPSKA

SEQ ID NO: 196930 - protein, 8 aa, Borrelia afzelii
FYIPSKAP

SEQ ID NO: 196931 - protein, 8 aa, Borrelia afzelii
YIPSKAPY

SEQ ID NO: 196932 - protein, 8 aa, Borrelia afzelii
IPSKAPYD

SEQ ID NO: 196933 - protein, 8 aa, Borrelia afzelii
PSKAPYDL

SEQ ID NO: 196934 - protein, 8 aa, Borrelia afzelii
SKAPYDLY

SEQ ID NO: 196935 - protein, 8 aa, Borrelia afzelii
KAPYDLYY

SEQ ID NO: 196936 - protein, 8 aa, Borrelia afzelii
APYDLYYP

SEQ ID NO: 196937 - protein, 8 aa, Borrelia afzelii
PYDLYYPN

SEQ ID NO: 196938 - protein, 8 aa, Borrelia afzelii
YDLYYPNT

SEQ ID NO: 196939 - protein, 8 aa, Borrelia afzelii
DLYYPNTK

SEQ ID NO: 196940 - protein, 8 aa, Borrelia afzelii
LYYPNTKP

SEQ ID NO: 196941 - protein, 8 aa, Borrelia afzelii
YYPNTKPG

SEQ ID NO: 196942 - protein, 8 aa, Borrelia afzelii
YPNTKPGV

SEQ ID NO: 196943 - protein, 8 aa, Borrelia afzelii
PNTKPGVK

SEQ ID NO: 196944 - protein, 8 aa, Borrelia afzelii
NTKPGVKL

SEQ ID NO: 196945 - protein, 8 aa, Borrelia afzelii
TKPGVKLF

SEQ ID NO: 196946 - protein, 8 aa, Borrelia afzelii
KPGVKLFI

SEQ ID NO: 196947 - protein, 8 aa, Borrelia afzelii
PGVKLFIN

SEQ ID NO: 196948 - protein, 8 aa, Borrelia afzelii
GVKLFINR

SEQ ID NO: 196949 - protein, 8 aa, Borrelia afzelii
VKLFINRI

SEQ ID NO: 196950 - protein, 8 aa, Borrelia afzelii
KLFINRIF

SEQ ID NO: 196951 - protein, 8 aa, Borrelia afzelii
LFINRIFI

SEQ ID NO: 196952 - protein, 8 aa, Borrelia afzelii
FINRIFIT

SEQ ID NO: 196953 - protein, 8 aa, Borrelia afzelii
INRIFITD

SEQ ID NO: 196954 - protein, 8 aa, Borrelia afzelii
NRIFITDS

SEQ ID NO: 196955 - protein, 8 aa, Borrelia afzelii
RIFITDSE

SEQ ID NO: 196956 - protein, 8 aa, Borrelia afzelii
IFITDSEG

SEQ ID NO: 196957 - protein, 8 aa, Borrelia afzelii
FITDSEGS

SEQ ID NO: 196958 - protein, 8 aa, Borrelia afzelii
ITDSEGSL

SEQ ID NO: 196959 - protein, 8 aa, Borrelia afzelii
TDSEGSLL

SEQ ID NO: 196960 - protein, 8 aa, Borrelia afzelii
DSEGSLLP

SEQ ID NO: 196961 - protein, 8 aa, Borrelia afzelii
SEGSLLPN

SEQ ID NO: 196962 - protein, 8 aa, Borrelia afzelii
EGSLLPNY

SEQ ID NO: 196963 - protein, 8 aa, Borrelia afzelii
GSLLPNYL

SEQ ID NO: 196964 - protein, 8 aa, Borrelia afzelii
SLLPNYLR

SEQ ID NO: 196965 - protein, 8 aa, Borrelia afzelii
LLPNYLRF

SEQ ID NO: 196966 - protein, 8 aa, Borrelia afzelii
LPNYLRFI

SEQ ID NO: 196967 - protein, 8 aa, Borrelia afzelii
PNYLRFIK

SEQ ID NO: 196968 - protein, 8 aa, Borrelia afzelii
NYLRFIKG

SEQ ID NO: 196969 - protein, 8 aa, Borrelia afzelii
YLRFIKGI

SEQ ID NO: 196970 - protein, 8 aa, Borrelia afzelii
LRFIKGII

SEQ ID NO: 196971 - protein, 8 aa, Borrelia afzelii
RFIKGIID

SEQ ID NO: 196972 - protein, 8 aa, Borrelia afzelii
FIKGIIDC

SEQ ID NO: 196973 - protein, 8 aa, Borrelia afzelii
IKGIIDCQ

SEQ ID NO: 196974 - protein, 8 aa, Borrelia afzelii
KGIIDCQD

SEQ ID NO: 196975 - protein, 8 aa, Borrelia afzelii
GIIDCQDL

SEQ ID NO: 196976 - protein, 8 aa, Borrelia afzelii
IIDCQDLP

SEQ ID NO: 196977 - protein, 8 aa, Borrelia afzelii
IDCQDLPL

SEQ ID NO: 196978 - protein, 8 aa, Borrelia afzelii
DCQDLPLN

SEQ ID NO: 196979 - protein, 8 aa, Borrelia afzelii
CQDLPLNV

SEQ ID NO: 196980 - protein, 8 aa, Borrelia afzelii
QDLPLNVS

SEQ ID NO: 196981 - protein, 8 aa, Borrelia afzelii
DLPLNVSR

SEQ ID NO: 196982 - protein, 8 aa, Borrelia afzelii
LPLNVSRE

SEQ ID NO: 196983 - protein, 8 aa, Borrelia afzelii
PLNVSREI

SEQ ID NO: 196984 - protein, 8 aa, Borrelia afzelii
LNVSREIL

SEQ ID NO: 196985 - protein, 8 aa, Borrelia afzelii
NVSREILQ

SEQ ID NO: 196986 - protein, 8 aa, Borrelia afzelii
VSREILQQ

SEQ ID NO: 196987 - protein, 8 aa, Borrelia afzelii
SREILQQN

SEQ ID NO: 196988 - protein, 8 aa, Borrelia afzelii
REILQQNK

SEQ ID NO: 196989 - protein, 8 aa, Borrelia afzelii
EILQQNKI

SEQ ID NO: 196990 - protein, 8 aa, Borrelia afzelii
ILQQNKIL

SEQ ID NO: 196991 - protein, 8 aa, Borrelia afzelii
LQQNKILS

SEQ ID NO: 196992 - protein, 8 aa, Borrelia afzelii
QQNKILSK

SEQ ID NO: 196993 - protein, 8 aa, Borrelia afzelii
QNKILSKI

SEQ ID NO: 196994 - protein, 8 aa, Borrelia afzelii
NKILSKIK

SEQ ID NO: 196995 - protein, 8 aa, Borrelia afzelii
KILSKIKS

SEQ ID NO: 196996 - protein, 8 aa, Borrelia afzelii
ILSKIKSS

SEQ ID NO: 196997 - protein, 8 aa, Borrelia afzelii
LSKIKSSS

SEQ ID NO: 196998 - protein, 8 aa, Borrelia afzelii
SKIKSSSV

SEQ ID NO: 196999 - protein, 8 aa, Borrelia afzelii
KIKSSSVK

SEQ ID NO: 197000 - protein, 8 aa, Borrelia afzelii
IKSSSVKK

SEQ ID NO: 197001 - protein, 8 aa, Borrelia afzelii
KSSSVKKI

SEQ ID NO: 197002 - protein, 8 aa, Borrelia afzelii
SSSVKKIL

SEQ ID NO: 197003 - protein, 8 aa, Borrelia afzelii
SSVKKILS

SEQ ID NO: 197004 - protein, 8 aa, Borrelia afzelii
SVKKILSE

SEQ ID NO: 197005 - protein, 8 aa, Borrelia afzelii
VKKILSEL

SEQ ID NO: 197006 - protein, 8 aa, Borrelia afzelii
KKILSELE

SEQ ID NO: 197007 - protein, 8 aa, Borrelia afzelii
KILSELEK

SEQ ID NO: 197008 - protein, 8 aa, Borrelia afzelii
ILSELEKL

SEQ ID NO: 197009 - protein, 8 aa, Borrelia afzelii
LSELEKLS

SEQ ID NO: 197010 - protein, 8 aa, Borrelia afzelii
SELEKLSK

SEQ ID NO: 197011 - protein, 8 aa, Borrelia afzelii
ELEKLSKK

SEQ ID NO: 197012 - protein, 8 aa, Borrelia afzelii
LEKLSKKN

SEQ ID NO: 197013 - protein, 8 aa, Borrelia afzelii
EKLSKKNP

SEQ ID NO: 197014 - protein, 8 aa, Borrelia afzelii
KLSKKNPE

SEQ ID NO: 197015 - protein, 8 aa, Borrelia afzelii
LSKKNPEK

SEQ ID NO: 197016 - protein, 8 aa, Borrelia afzelii
SKKNPEKF

SEQ ID NO: 197017 - protein, 8 aa, Borrelia afzelii
KKNPEKFS

SEQ ID NO: 197018 - protein, 8 aa, Borrelia afzelii
KNPEKFSE

SEQ ID NO: 197019 - protein, 8 aa, Borrelia afzelii
NPEKFSEF

SEQ ID NO: 197020 - protein, 8 aa, Borrelia afzelii
PEKFSEFS

SEQ ID NO: 197021 - protein, 8 aa, Borrelia afzelii
EKFSEFSK

SEQ ID NO: 197022 - protein, 8 aa, Borrelia afzelii
KFSEFSKE

SEQ ID NO: 197023 - protein, 8 aa, Borrelia afzelii
FSEFSKEF

SEQ ID NO: 197024 - protein, 8 aa, Borrelia afzelii
SEFSKEFG

SEQ ID NO: 197025 - protein, 8 aa, Borrelia afzelii
EFSKEFGR

SEQ ID NO: 197026 - protein, 8 aa, Borrelia afzelii
FSKEFGRC

SEQ ID NO: 197027 - protein, 8 aa, Borrelia afzelii
SKEFGRCI

SEQ ID NO: 197028 - protein, 8 aa, Borrelia afzelii
KEFGRCIK

SEQ ID NO: 197029 - protein, 8 aa, Borrelia afzelii
EFGRCIKE

SEQ ID NO: 197030 - protein, 8 aa, Borrelia afzelii
FGRCIKEG

SEQ ID NO: 197031 - protein, 8 aa, Borrelia afzelii
GRCIKEGV

SEQ ID NO: 197032 - protein, 8 aa, Borrelia afzelii
RCIKEGVY

SEQ ID NO: 197033 - protein, 8 aa, Borrelia afzelii
CIKEGVYS

SEQ ID NO: 197034 - protein, 8 aa, Borrelia afzelii
IKEGVYSD

SEQ ID NO: 197035 - protein, 8 aa, Borrelia afzelii
KEGVYSDF

SEQ ID NO: 197036 - protein, 8 aa, Borrelia afzelii
EGVYSDFE

SEQ ID NO: 197037 - protein, 8 aa, Borrelia afzelii
GVYSDFEN

SEQ ID NO: 197038 - protein, 8 aa, Borrelia afzelii
VYSDFENR

SEQ ID NO: 197039 - protein, 8 aa, Borrelia afzelii
YSDFENRE

SEQ ID NO: 197040 - protein, 8 aa, Borrelia afzelii
SDFENREK

SEQ ID NO: 197041 - protein, 8 aa, Borrelia afzelii
DFENREKL

SEQ ID NO: 197042 - protein, 8 aa, Borrelia afzelii
FENREKLI

SEQ ID NO: 197043 - protein, 8 aa, Borrelia afzelii
ENREKLIS

SEQ ID NO: 197044 - protein, 8 aa, Borrelia afzelii
NREKLISL

SEQ ID NO: 197045 - protein, 8 aa, Borrelia afzelii
REKLISLI

SEQ ID NO: 197046 - protein, 8 aa, Borrelia afzelii
EKLISLIR

SEQ ID NO: 197047 - protein, 8 aa, Borrelia afzelii
KLISLIRF

SEQ ID NO: 197048 - protein, 8 aa, Borrelia afzelii
LISLIRFK

SEQ ID NO: 197049 - protein, 8 aa, Borrelia afzelii
ISLIRFKS

SEQ ID NO: 197050 - protein, 8 aa, Borrelia afzelii
SLIRFKSS

SEQ ID NO: 197051 - protein, 8 aa, Borrelia afzelii
LIRFKSSS

SEQ ID NO: 197052 - protein, 8 aa, Borrelia afzelii
IRFKSSSV

SEQ ID NO: 197053 - protein, 8 aa, Borrelia afzelii
RFKSSSVD

SEQ ID NO: 197054 - protein, 8 aa, Borrelia afzelii
FKSSSVDG

SEQ ID NO: 197055 - protein, 8 aa, Borrelia afzelii
KSSSVDGF

SEQ ID NO: 197056 - protein, 8 aa, Borrelia afzelii
SSSVDGFV

SEQ ID NO: 197057 - protein, 8 aa, Borrelia afzelii
SSVDGFVS

SEQ ID NO: 197058 - protein, 8 aa, Borrelia afzelii
SVDGFVSF

SEQ ID NO: 197059 - protein, 8 aa, Borrelia afzelii
VDGFVSFK

SEQ ID NO: 197060 - protein, 8 aa, Borrelia afzelii
DGFVSFKE

SEQ ID NO: 197061 - protein, 8 aa, Borrelia afzelii
GFVSFKEY

SEQ ID NO: 197062 - protein, 8 aa, Borrelia afzelii
FVSFKEYK

SEQ ID NO: 197063 - protein, 8 aa, Borrelia afzelii
VSFKEYKE

SEQ ID NO: 197064 - protein, 8 aa, Borrelia afzelii
SFKEYKER

SEQ ID NO: 197065 - protein, 8 aa, Borrelia afzelii
FKEYKERM

SEQ ID NO: 197066 - protein, 8 aa, Borrelia afzelii
KEYKERMN

SEQ ID NO: 197067 - protein, 8 aa, Borrelia afzelii
EYKERMNE

SEQ ID NO: 197068 - protein, 8 aa, Borrelia afzelii
YKERMNEG

SEQ ID NO: 197069 - protein, 8 aa, Borrelia afzelii
KERMNEGQ

SEQ ID NO: 197070 - protein, 8 aa, Borrelia afzelii
ERMNEGQK

SEQ ID NO: 197071 - protein, 8 aa, Borrelia afzelii
RMNEGQKS

SEQ ID NO: 197072 - protein, 8 aa, Borrelia afzelii
MNEGQKSI

SEQ ID NO: 197073 - protein, 8 aa, Borrelia afzelii
NEGQKSIY

SEQ ID NO: 197074 - protein, 8 aa, Borrelia afzelii
EGQKSIYY

SEQ ID NO: 197075 - protein, 8 aa, Borrelia afzelii
GQKSIYYI

SEQ ID NO: 197076 - protein, 8 aa, Borrelia afzelii
QKSIYYIT

SEQ ID NO: 197077 - protein, 8 aa, Borrelia afzelii
KSIYYITG

SEQ ID NO: 197078 - protein, 8 aa, Borrelia afzelii
SIYYITGG

SEQ ID NO: 197079 - protein, 8 aa, Borrelia afzelii
IYYITGGK

SEQ ID NO: 197080 - protein, 8 aa, Borrelia afzelii
YYITGGKE

SEQ ID NO: 197081 - protein, 8 aa, Borrelia afzelii
YITGGKEN

SEQ ID NO: 197082 - protein, 8 aa, Borrelia afzelii
ITGGKENI

SEQ ID NO: 197083 - protein, 8 aa, Borrelia afzelii
TGGKENIL

SEQ ID NO: 197084 - protein, 8 aa, Borrelia afzelii
GGKENILK

SEQ ID NO: 197085 - protein, 8 aa, Borrelia afzelii
GKENILKE

SEQ ID NO: 197086 - protein, 8 aa, Borrelia afzelii
KENILKEN

SEQ ID NO: 197087 - protein, 8 aa, Borrelia afzelii
ENILKENP

SEQ ID NO: 197088 - protein, 8 aa, Borrelia afzelii
NILKENPI

SEQ ID NO: 197089 - protein, 8 aa, Borrelia afzelii
ILKENPIV

SEQ ID NO: 197090 - protein, 8 aa, Borrelia afzelii
LKENPIVT

SEQ ID NO: 197091 - protein, 8 aa, Borrelia afzelii
KENPIVTA

SEQ ID NO: 197092 - protein, 8 aa, Borrelia afzelii
ENPIVTAY

SEQ ID NO: 197093 - protein, 8 aa, Borrelia afzelii
NPIVTAYK

SEQ ID NO: 197094 - protein, 8 aa, Borrelia afzelii
PIVTAYKE

SEQ ID NO: 197095 - protein, 8 aa, Borrelia afzelii
IVTAYKEK

SEQ ID NO: 197096 - protein, 8 aa, Borrelia afzelii
VTAYKEKG

SEQ ID NO: 197097 - protein, 8 aa, Borrelia afzelii
TAYKEKGF

SEQ ID NO: 197098 - protein, 8 aa, Borrelia afzelii
AYKEKGFE

SEQ ID NO: 197099 - protein, 8 aa, Borrelia afzelii
YKEKGFEI

SEQ ID NO: 197100 - protein, 8 aa, Borrelia afzelii
KEKGFEIL

SEQ ID NO: 197101 - protein, 8 aa, Borrelia afzelii
EKGFEILI

SEQ ID NO: 197102 - protein, 8 aa, Borrelia afzelii
KGFEILIM

SEQ ID NO: 197103 - protein, 8 aa, Borrelia afzelii
GFEILIMD

SEQ ID NO: 197104 - protein, 8 aa, Borrelia afzelii
FEILIMDD

SEQ ID NO: 197105 - protein, 8 aa, Borrelia afzelii
EILIMDDE

SEQ ID NO: 197106 - protein, 8 aa, Borrelia afzelii
ILIMDDEL

SEQ ID NO: 197107 - protein, 8 aa, Borrelia afzelii
LIMDDELD

SEQ ID NO: 197108 - protein, 8 aa, Borrelia afzelii
IMDDELDE

SEQ ID NO: 197109 - protein, 8 aa, Borrelia afzelii
MDDELDEA

SEQ ID NO: 197110 - protein, 8 aa, Borrelia afzelii
DDELDEAI

SEQ ID NO: 197111 - protein, 8 aa, Borrelia afzelii
DELDEAIL

SEQ ID NO: 197112 - protein, 8 aa, Borrelia afzelii
ELDEAILN

SEQ ID NO: 197113 - protein, 8 aa, Borrelia afzelii
LDEAILNL

SEQ ID NO: 197114 - protein, 8 aa, Borrelia afzelii
DEAILNLI

SEQ ID NO: 197115 - protein, 8 aa, Borrelia afzelii
EAILNLIP

SEQ ID NO: 197116 - protein, 8 aa, Borrelia afzelii
AILNLIPE

SEQ ID NO: 197117 - protein, 8 aa, Borrelia afzelii
ILNLIPEY

SEQ ID NO: 197118 - protein, 8 aa, Borrelia afzelii
LNLIPEYE

SEQ ID NO: 197119 - protein, 8 aa, Borrelia afzelii
NLIPEYEG

SEQ ID NO: 197120 - protein, 8 aa, Borrelia afzelii
LIPEYEGL

SEQ ID NO: 197121 - protein, 8 aa, Borrelia afzelii
IPEYEGLK

SEQ ID NO: 197122 - protein, 8 aa, Borrelia afzelii
PEYEGLKL

SEQ ID NO: 197123 - protein, 8 aa, Borrelia afzelii
EYEGLKLK

SEQ ID NO: 197124 - protein, 8 aa, Borrelia afzelii
YEGLKLKA

SEQ ID NO: 197125 - protein, 8 aa, Borrelia afzelii
EGLKLKAI

SEQ ID NO: 197126 - protein, 8 aa, Borrelia afzelii
GLKLKAIN

SEQ ID NO: 197127 - protein, 8 aa, Borrelia afzelii
LKLKAINK

SEQ ID NO: 197128 - protein, 8 aa, Borrelia afzelii
KLKAINKN

SEQ ID NO: 197129 - protein, 8 aa, Borrelia afzelii
LKAINKNE

SEQ ID NO: 197130 - protein, 8 aa, Borrelia afzelii
KAINKNET

SEQ ID NO: 197131 - protein, 8 aa, Borrelia afzelii
AINKNETS

SEQ ID NO: 197132 - protein, 8 aa, Borrelia afzelii
INKNETSN

SEQ ID NO: 197133 - protein, 8 aa, Borrelia afzelii
NKNETSNE

SEQ ID NO: 197134 - protein, 8 aa, Borrelia afzelii
KNETSNEL

SEQ ID NO: 197135 - protein, 8 aa, Borrelia afzelii
NETSNELK

SEQ ID NO: 197136 - protein, 8 aa, Borrelia afzelii
ETSNELKD

SEQ ID NO: 197137 - protein, 8 aa, Borrelia afzelii
TSNELKDE

SEQ ID NO: 197138 - protein, 8 aa, Borrelia afzelii
SNELKDEN

SEQ ID NO: 197139 - protein, 8 aa, Borrelia afzelii
NELKDENF

SEQ ID NO: 197140 - protein, 8 aa, Borrelia afzelii
ELKDENFK

SEQ ID NO: 197141 - protein, 8 aa, Borrelia afzelii
LKDENFKK

SEQ ID NO: 197142 - protein, 8 aa, Borrelia afzelii
KDENFKKI

SEQ ID NO: 197143 - protein, 8 aa, Borrelia afzelii
DENFKKIE

SEQ ID NO: 197144 - protein, 8 aa, Borrelia afzelii
ENFKKIEE

SEQ ID NO: 197145 - protein, 8 aa, Borrelia afzelii
NFKKIEEE

SEQ ID NO: 197146 - protein, 8 aa, Borrelia afzelii
FKKIEEEF

SEQ ID NO: 197147 - protein, 8 aa, Borrelia afzelii
KKIEEEFK

SEQ ID NO: 197148 - protein, 8 aa, Borrelia afzelii
KIEEEFKD

SEQ ID NO: 197149 - protein, 8 aa, Borrelia afzelii
IEEEFKDT

SEQ ID NO: 197150 - protein, 8 aa, Borrelia afzelii
EEEFKDTL

SEQ ID NO: 197151 - protein, 8 aa, Borrelia afzelii
EEFKDTLT

SEQ ID NO: 197152 - protein, 8 aa, Borrelia afzelii
EFKDTLTR

SEQ ID NO: 197153 - protein, 8 aa, Borrelia afzelii
FKDTLTRV

SEQ ID NO: 197154 - protein, 8 aa, Borrelia afzelii
KDTLTRVK

SEQ ID NO: 197155 - protein, 8 aa, Borrelia afzelii
DTLTRVKE

SEQ ID NO: 197156 - protein, 8 aa, Borrelia afzelii
TLTRVKEI

SEQ ID NO: 197157 - protein, 8 aa, Borrelia afzelii
LTRVKEIL

SEQ ID NO: 197158 - protein, 8 aa, Borrelia afzelii
TRVKEILK

SEQ ID NO: 197159 - protein, 8 aa, Borrelia afzelii
RVKEILKD

SEQ ID NO: 197160 - protein, 8 aa, Borrelia afzelii
VKEILKDQ

SEQ ID NO: 197161 - protein, 8 aa, Borrelia afzelii
KEILKDQI

SEQ ID NO: 197162 - protein, 8 aa, Borrelia afzelii
EILKDQIK

SEQ ID NO: 197163 - protein, 8 aa, Borrelia afzelii
ILKDQIKE

SEQ ID NO: 197164 - protein, 8 aa, Borrelia afzelii
LKDQIKEV

SEQ ID NO: 197165 - protein, 8 aa, Borrelia afzelii
KDQIKEVN

SEQ ID NO: 197166 - protein, 8 aa, Borrelia afzelii
DQIKEVNL

SEQ ID NO: 197167 - protein, 8 aa, Borrelia afzelii
QIKEVNLS

SEQ ID NO: 197168 - protein, 8 aa, Borrelia afzelii
IKEVNLSA

SEQ ID NO: 197169 - protein, 8 aa, Borrelia afzelii
KEVNLSAT

SEQ ID NO: 197170 - protein, 8 aa, Borrelia afzelii
EVNLSATL

SEQ ID NO: 197171 - protein, 8 aa, Borrelia afzelii
VNLSATLI

SEQ ID NO: 197172 - protein, 8 aa, Borrelia afzelii
NLSATLIK

SEQ ID NO: 197173 - protein, 8 aa, Borrelia afzelii
LSATLIKE

SEQ ID NO: 197174 - protein, 8 aa, Borrelia afzelii
SATLIKEP

SEQ ID NO: 197175 - protein, 8 aa, Borrelia afzelii
ATLIKEPS

SEQ ID NO: 197176 - protein, 8 aa, Borrelia afzelii
TLIKEPSA

SEQ ID NO: 197177 - protein, 8 aa, Borrelia afzelii
LIKEPSAI

SEQ ID NO: 197178 - protein, 8 aa, Borrelia afzelii
IKEPSAII

SEQ ID NO: 197179 - protein, 8 aa, Borrelia afzelii
KEPSAIIV

SEQ ID NO: 197180 - protein, 8 aa, Borrelia afzelii
EPSAIIVD

SEQ ID NO: 197181 - protein, 8 aa, Borrelia afzelii
PSAIIVDS

SEQ ID NO: 197182 - protein, 8 aa, Borrelia afzelii
SAIIVDSN

SEQ ID NO: 197183 - protein, 8 aa, Borrelia afzelii
AIIVDSND

SEQ ID NO: 197184 - protein, 8 aa, Borrelia afzelii
IIVDSNDP

SEQ ID NO: 197185 - protein, 8 aa, Borrelia afzelii
IVDSNDPT

SEQ ID NO: 197186 - protein, 8 aa, Borrelia afzelii
VDSNDPTY

SEQ ID NO: 197187 - protein, 8 aa, Borrelia afzelii
DSNDPTYQ

SEQ ID NO: 197188 - protein, 8 aa, Borrelia afzelii
SNDPTYQM

SEQ ID NO: 197189 - protein, 8 aa, Borrelia afzelii
NDPTYQMQ

SEQ ID NO: 197190 - protein, 8 aa, Borrelia afzelii
DPTYQMQK

SEQ ID NO: 197191 - protein, 8 aa, Borrelia afzelii
PTYQMQKI

SEQ ID NO: 197192 - protein, 8 aa, Borrelia afzelii
TYQMQKIM

SEQ ID NO: 197193 - protein, 8 aa, Borrelia afzelii
YQMQKIML

SEQ ID NO: 197194 - protein, 8 aa, Borrelia afzelii
QMQKIMLS

SEQ ID NO: 197195 - protein, 8 aa, Borrelia afzelii
MQKIMLSM

SEQ ID NO: 197196 - protein, 8 aa, Borrelia afzelii
QKIMLSMG

SEQ ID NO: 197197 - protein, 8 aa, Borrelia afzelii
KIMLSMGQ

SEQ ID NO: 197198 - protein, 8 aa, Borrelia afzelii
IMLSMGQE

SEQ ID NO: 197199 - protein, 8 aa, Borrelia afzelii
MLSMGQEV

SEQ ID NO: 197200 - protein, 8 aa, Borrelia afzelii
LSMGQEVK

SEQ ID NO: 197201 - protein, 8 aa, Borrelia afzelii
SMGQEVKE

SEQ ID NO: 197202 - protein, 8 aa, Borrelia afzelii
MGQEVKEI

SEQ ID NO: 197203 - protein, 8 aa, Borrelia afzelii
GQEVKEIK

SEQ ID NO: 197204 - protein, 8 aa, Borrelia afzelii
QEVKEIKP

SEQ ID NO: 197205 - protein, 8 aa, Borrelia afzelii
EVKEIKPI

SEQ ID NO: 197206 - protein, 8 aa, Borrelia afzelii
VKEIKPIL

SEQ ID NO: 197207 - protein, 8 aa, Borrelia afzelii
KEIKPILE

SEQ ID NO: 197208 - protein, 8 aa, Borrelia afzelii
EIKPILEL

SEQ ID NO: 197209 - protein, 8 aa, Borrelia afzelii
IKPILELN

SEQ ID NO: 197210 - protein, 8 aa, Borrelia afzelii
KPILELNP

SEQ ID NO: 197211 - protein, 8 aa, Borrelia afzelii
PILELNPN

SEQ ID NO: 197212 - protein, 8 aa, Borrelia afzelii
ILELNPNN

SEQ ID NO: 197213 - protein, 8 aa, Borrelia afzelii
LELNPNNK

SEQ ID NO: 197214 - protein, 8 aa, Borrelia afzelii
ELNPNNKI

SEQ ID NO: 197215 - protein, 8 aa, Borrelia afzelii
LNPNNKIV

SEQ ID NO: 197216 - protein, 8 aa, Borrelia afzelii
NPNNKIVQ

SEQ ID NO: 197217 - protein, 8 aa, Borrelia afzelii
PNNKIVQN

SEQ ID NO: 197218 - protein, 8 aa, Borrelia afzelii
NNKIVQNL

SEQ ID NO: 197219 - protein, 8 aa, Borrelia afzelii
NKIVQNLK

SEQ ID NO: 197220 - protein, 8 aa, Borrelia afzelii
KIVQNLKN

SEQ ID NO: 197221 - protein, 8 aa, Borrelia afzelii
IVQNLKNL

SEQ ID NO: 197222 - protein, 8 aa, Borrelia afzelii
VQNLKNLE

SEQ ID NO: 197223 - protein, 8 aa, Borrelia afzelii
QNLKNLEP

SEQ ID NO: 197224 - protein, 8 aa, Borrelia afzelii
NLKNLEPE

SEQ ID NO: 197225 - protein, 8 aa, Borrelia afzelii
LKNLEPEK

SEQ ID NO: 197226 - protein, 8 aa, Borrelia afzelii
KNLEPEKL

SEQ ID NO: 197227 - protein, 8 aa, Borrelia afzelii
NLEPEKLE

SEQ ID NO: 197228 - protein, 8 aa, Borrelia afzelii
LEPEKLEK

SEQ ID NO: 197229 - protein, 8 aa, Borrelia afzelii
EPEKLEKI

SEQ ID NO: 197230 - protein, 8 aa, Borrelia afzelii
PEKLEKIS

SEQ ID NO: 197231 - protein, 8 aa, Borrelia afzelii
EKLEKISI

SEQ ID NO: 197232 - protein, 8 aa, Borrelia afzelii
KLEKISIL

SEQ ID NO: 197233 - protein, 8 aa, Borrelia afzelii
LEKISILL

SEQ ID NO: 197234 - protein, 8 aa, Borrelia afzelii
EKISILLF

SEQ ID NO: 197235 - protein, 8 aa, Borrelia afzelii
KISILLFE

SEQ ID NO: 197236 - protein, 8 aa, Borrelia afzelii
ISILLFEE

SEQ ID NO: 197237 - protein, 8 aa, Borrelia afzelii
SILLFEEA

SEQ ID NO: 197238 - protein, 8 aa, Borrelia afzelii
ILLFEEAL

SEQ ID NO: 197239 - protein, 8 aa, Borrelia afzelii
LLFEEALL

SEQ ID NO: 197240 - protein, 8 aa, Borrelia afzelii
LFEEALLT

SEQ ID NO: 197241 - protein, 8 aa, Borrelia afzelii
FEEALLTS

SEQ ID NO: 197242 - protein, 8 aa, Borrelia afzelii
EEALLTSG

SEQ ID NO: 197243 - protein, 8 aa, Borrelia afzelii
EALLTSGM

SEQ ID NO: 197244 - protein, 8 aa, Borrelia afzelii
ALLTSGMP

SEQ ID NO: 197245 - protein, 8 aa, Borrelia afzelii
LLTSGMPS

SEQ ID NO: 197246 - protein, 8 aa, Borrelia afzelii
LTSGMPSK

SEQ ID NO: 197247 - protein, 8 aa, Borrelia afzelii
TSGMPSKN

SEQ ID NO: 197248 - protein, 8 aa, Borrelia afzelii
SGMPSKNP

SEQ ID NO: 197249 - protein, 8 aa, Borrelia afzelii
GMPSKNPR

SEQ ID NO: 197250 - protein, 8 aa, Borrelia afzelii
MPSKNPRK

SEQ ID NO: 197251 - protein, 8 aa, Borrelia afzelii
PSKNPRKF

SEQ ID NO: 197252 - protein, 8 aa, Borrelia afzelii
SKNPRKFI

SEQ ID NO: 197253 - protein, 8 aa, Borrelia afzelii
KNPRKFIN

SEQ ID NO: 197254 - protein, 8 aa, Borrelia afzelii
NPRKFINI

SEQ ID NO: 197255 - protein, 8 aa, Borrelia afzelii
PRKFINII

SEQ ID NO: 197256 - protein, 8 aa, Borrelia afzelii
RKFINIIN

SEQ ID NO: 197257 - protein, 8 aa, Borrelia afzelii
KFINIINE

SEQ ID NO: 197258 - protein, 8 aa, Borrelia afzelii
FINIINEF

SEQ ID NO: 197259 - protein, 8 aa, Borrelia afzelii
INIINEFL

SEQ ID NO: 197260 - protein, 8 aa, Borrelia afzelii
NIINEFLE

SEQ ID NO: 197261 - protein, 8 aa, Borrelia afzelii
IINEFLEK

SEQ ID NO: 197262 - protein, 8 aa, Borrelia afzelii
INEFLEKD

SEQ ID NO: 197263 - protein, 8 aa, Borrelia afzelii
NEFLEKDL

SEQ ID NO: 197264 - protein, 8 aa, Borrelia afzelii
EFLEKDLL

SEQ ID NO: 197265 - protein, 9 aa, Borrelia afzelii
MKKQFDTEV

SEQ ID NO: 197266 - protein, 9 aa, Borrelia afzelii
KKQFDTEVN

SEQ ID NO: 197267 - protein, 9 aa, Borrelia afzelii
KQFDTEVND

SEQ ID NO: 197268 - protein, 9 aa, Borrelia afzelii
QFDTEVNDL

SEQ ID NO: 197269 - protein, 9 aa, Borrelia afzelii
FDTEVNDLL

SEQ ID NO: 197270 - protein, 9 aa, Borrelia afzelii
DTEVNDLLY

SEQ ID NO: 197271 - protein, 9 aa, Borrelia afzelii
TEVNDLLYL

SEQ ID NO: 197272 - protein, 9 aa, Borrelia afzelii
EVNDLLYLI

SEQ ID NO: 197273 - protein, 9 aa, Borrelia afzelii
VNDLLYLII

SEQ ID NO: 197274 - protein, 9 aa, Borrelia afzelii
NDLLYLIIH

SEQ ID NO: 197275 - protein, 9 aa, Borrelia afzelii
DLLYLIIHS

SEQ ID NO: 197276 - protein, 9 aa, Borrelia afzelii
LLYLIIHSL

SEQ ID NO: 197277 - protein, 9 aa, Borrelia afzelii
LYLIIHSLY

SEQ ID NO: 197278 - protein, 9 aa, Borrelia afzelii
YLIIHSLYS

SEQ ID NO: 197279 - protein, 9 aa, Borrelia afzelii
LIIHSLYSH

SEQ ID NO: 197280 - protein, 9 aa, Borrelia afzelii
IIHSLYSHK

SEQ ID NO: 197281 - protein, 9 aa, Borrelia afzelii
IHSLYSHKE

SEQ ID NO: 197282 - protein, 9 aa, Borrelia afzelii
HSLYSHKEI

SEQ ID NO: 197283 - protein, 9 aa, Borrelia afzelii
SLYSHKEIF

SEQ ID NO: 197284 - protein, 9 aa, Borrelia afzelii
LYSHKEIFL

SEQ ID NO: 197285 - protein, 9 aa, Borrelia afzelii
YSHKEIFLR

SEQ ID NO: 197286 - protein, 9 aa, Borrelia afzelii
SHKEIFLRE

SEQ ID NO: 197287 - protein, 9 aa, Borrelia afzelii
HKEIFLREL

SEQ ID NO: 197288 - protein, 9 aa, Borrelia afzelii
KEIFLRELI

SEQ ID NO: 197289 - protein, 9 aa, Borrelia afzelii
EIFLRELIS

SEQ ID NO: 197290 - protein, 9 aa, Borrelia afzelii
IFLRELISN

SEQ ID NO: 197291 - protein, 9 aa, Borrelia afzelii
FLRELISNA

SEQ ID NO: 197292 - protein, 9 aa, Borrelia afzelii
LRELISNAS

SEQ ID NO: 197293 - protein, 9 aa, Borrelia afzelii
RELISNASD

SEQ ID NO: 197294 - protein, 9 aa, Borrelia afzelii
ELISNASDA

SEQ ID NO: 197295 - protein, 9 aa, Borrelia afzelii
LISNASDAI

SEQ ID NO: 197296 - protein, 9 aa, Borrelia afzelii
ISNASDAID

SEQ ID NO: 197297 - protein, 9 aa, Borrelia afzelii
SNASDAIDK

SEQ ID NO: 197298 - protein, 9 aa, Borrelia afzelii
NASDAIDKL

SEQ ID NO: 197299 - protein, 9 aa, Borrelia afzelii
ASDAIDKLK

SEQ ID NO: 197300 - protein, 9 aa, Borrelia afzelii
SDAIDKLKF

SEQ ID NO: 197301 - protein, 9 aa, Borrelia afzelii
DAIDKLKFL

SEQ ID NO: 197302 - protein, 9 aa, Borrelia afzelii
AIDKLKFLS

SEQ ID NO: 197303 - protein, 9 aa, Borrelia afzelii
IDKLKFLSL

SEQ ID NO: 197304 - protein, 9 aa, Borrelia afzelii
DKLKFLSLT

SEQ ID NO: 197305 - protein, 9 aa, Borrelia afzelii
KLKFLSLTN

SEQ ID NO: 197306 - protein, 9 aa, Borrelia afzelii
LKFLSLTNE

SEQ ID NO: 197307 - protein, 9 aa, Borrelia afzelii
KFLSLTNEK

SEQ ID NO: 197308 - protein, 9 aa, Borrelia afzelii
FLSLTNEKF

SEQ ID NO: 197309 - protein, 9 aa, Borrelia afzelii
LSLTNEKFK

SEQ ID NO: 197310 - protein, 9 aa, Borrelia afzelii
SLTNEKFKN

SEQ ID NO: 197311 - protein, 9 aa, Borrelia afzelii
LTNEKFKNI

SEQ ID NO: 197312 - protein, 9 aa, Borrelia afzelii
TNEKFKNIA

SEQ ID NO: 197313 - protein, 9 aa, Borrelia afzelii
NEKFKNIAL

SEQ ID NO: 197314 - protein, 9 aa, Borrelia afzelii
EKFKNIALE

SEQ ID NO: 197315 - protein, 9 aa, Borrelia afzelii
KFKNIALEP

SEQ ID NO: 197316 - protein, 9 aa, Borrelia afzelii
FKNIALEPK

SEQ ID NO: 197317 - protein, 9 aa, Borrelia afzelii
KNIALEPKI

SEQ ID NO: 197318 - protein, 9 aa, Borrelia afzelii
NIALEPKIE

SEQ ID NO: 197319 - protein, 9 aa, Borrelia afzelii
IALEPKIEI

SEQ ID NO: 197320 - protein, 9 aa, Borrelia afzelii
ALEPKIEIT

SEQ ID NO: 197321 - protein, 9 aa, Borrelia afzelii
LEPKIEITF

SEQ ID NO: 197322 - protein, 9 aa, Borrelia afzelii
EPKIEITFD

SEQ ID NO: 197323 - protein, 9 aa, Borrelia afzelii
PKIEITFDD

SEQ ID NO: 197324 - protein, 9 aa, Borrelia afzelii
KIEITFDDK

SEQ ID NO: 197325 - protein, 9 aa, Borrelia afzelii
IEITFDDKS

SEQ ID NO: 197326 - protein, 9 aa, Borrelia afzelii
EITFDDKSI

SEQ ID NO: 197327 - protein, 9 aa, Borrelia afzelii
ITFDDKSIL

SEQ ID NO: 197328 - protein, 9 aa, Borrelia afzelii
TFDDKSILI

SEQ ID NO: 197329 - protein, 9 aa, Borrelia afzelii
FDDKSILIK

SEQ ID NO: 197330 - protein, 9 aa, Borrelia afzelii
DDKSILIKD

SEQ ID NO: 197331 - protein, 9 aa, Borrelia afzelii
DKSILIKDN

SEQ ID NO: 197332 - protein, 9 aa, Borrelia afzelii
KSILIKDNG

SEQ ID NO: 197333 - protein, 9 aa, Borrelia afzelii
SILIKDNGI

SEQ ID NO: 197334 - protein, 9 aa, Borrelia afzelii
ILIKDNGIG

SEQ ID NO: 197335 - protein, 9 aa, Borrelia afzelii
LIKDNGIGM

SEQ ID NO: 197336 - protein, 9 aa, Borrelia afzelii
IKDNGIGMN

SEQ ID NO: 197337 - protein, 9 aa, Borrelia afzelii
KDNGIGMNE

SEQ ID NO: 197338 - protein, 9 aa, Borrelia afzelii
DNGIGMNEQ

SEQ ID NO: 197339 - protein, 9 aa, Borrelia afzelii
NGIGMNEQE

SEQ ID NO: 197340 - protein, 9 aa, Borrelia afzelii
GIGMNEQEL

SEQ ID NO: 197341 - protein, 9 aa, Borrelia afzelii
IGMNEQELT

SEQ ID NO: 197342 - protein, 9 aa, Borrelia afzelii
GMNEQELTN

SEQ ID NO: 197343 - protein, 9 aa, Borrelia afzelii
MNEQELTNH

SEQ ID NO: 197344 - protein, 9 aa, Borrelia afzelii
NEQELTNHL

SEQ ID NO: 197345 - protein, 9 aa, Borrelia afzelii
EQELTNHLG

SEQ ID NO: 197346 - protein, 9 aa, Borrelia afzelii
QELTNHLGV

SEQ ID NO: 197347 - protein, 9 aa, Borrelia afzelii
ELTNHLGVI

SEQ ID NO: 197348 - protein, 9 aa, Borrelia afzelii
LTNHLGVIA

SEQ ID NO: 197349 - protein, 9 aa, Borrelia afzelii
TNHLGVIAK

SEQ ID NO: 197350 - protein, 9 aa, Borrelia afzelii
NHLGVIAKS

SEQ ID NO: 197351 - protein, 9 aa, Borrelia afzelii
HLGVIAKSG

SEQ ID NO: 197352 - protein, 9 aa, Borrelia afzelii
LGVIAKSGT

SEQ ID NO: 197353 - protein, 9 aa, Borrelia afzelii
GVIAKSGTK

SEQ ID NO: 197354 - protein, 9 aa, Borrelia afzelii
VIAKSGTKE

SEQ ID NO: 197355 - protein, 9 aa, Borrelia afzelii
IAKSGTKEF

SEQ ID NO: 197356 - protein, 9 aa, Borrelia afzelii
AKSGTKEFI

SEQ ID NO: 197357 - protein, 9 aa, Borrelia afzelii
KSGTKEFIN

SEQ ID NO: 197358 - protein, 9 aa, Borrelia afzelii
SGTKEFINN

SEQ ID NO: 197359 - protein, 9 aa, Borrelia afzelii
GTKEFINNL

SEQ ID NO: 197360 - protein, 9 aa, Borrelia afzelii
TKEFINNLK

SEQ ID NO: 197361 - protein, 9 aa, Borrelia afzelii
KEFINNLKQ

SEQ ID NO: 197362 - protein, 9 aa, Borrelia afzelii
EFINNLKQD

SEQ ID NO: 197363 - protein, 9 aa, Borrelia afzelii
FINNLKQDE

SEQ ID NO: 197364 - protein, 9 aa, Borrelia afzelii
INNLKQDEK

SEQ ID NO: 197365 - protein, 9 aa, Borrelia afzelii
NNLKQDEKK

SEQ ID NO: 197366 - protein, 9 aa, Borrelia afzelii
NLKQDEKKS

SEQ ID NO: 197367 - protein, 9 aa, Borrelia afzelii
LKQDEKKSA

SEQ ID NO: 197368 - protein, 9 aa, Borrelia afzelii
KQDEKKSAN

SEQ ID NO: 197369 - protein, 9 aa, Borrelia afzelii
QDEKKSANL

SEQ ID NO: 197370 - protein, 9 aa, Borrelia afzelii
DEKKSANLI

SEQ ID NO: 197371 - protein, 9 aa, Borrelia afzelii
EKKSANLIG

SEQ ID NO: 197372 - protein, 9 aa, Borrelia afzelii
KKSANLIGQ

SEQ ID NO: 197373 - protein, 9 aa, Borrelia afzelii
KSANLIGQF

SEQ ID NO: 197374 - protein, 9 aa, Borrelia afzelii
SANLIGQFG

SEQ ID NO: 197375 - protein, 9 aa, Borrelia afzelii
ANLIGQFGV

SEQ ID NO: 197376 - protein, 9 aa, Borrelia afzelii
NLIGQFGVG

SEQ ID NO: 197377 - protein, 9 aa, Borrelia afzelii
LIGQFGVGF

SEQ ID NO: 197378 - protein, 9 aa, Borrelia afzelii
IGQFGVGFY

SEQ ID NO: 197379 - protein, 9 aa, Borrelia afzelii
GQFGVGFYS

SEQ ID NO: 197380 - protein, 9 aa, Borrelia afzelii
QFGVGFYSA

SEQ ID NO: 197381 - protein, 9 aa, Borrelia afzelii
FGVGFYSAF

SEQ ID NO: 197382 - protein, 9 aa, Borrelia afzelii
GVGFYSAFI

SEQ ID NO: 197383 - protein, 9 aa, Borrelia afzelii
VGFYSAFIV

SEQ ID NO: 197384 - protein, 9 aa, Borrelia afzelii
GFYSAFIVS

SEQ ID NO: 197385 - protein, 9 aa, Borrelia afzelii
FYSAFIVSE

SEQ ID NO: 197386 - protein, 9 aa, Borrelia afzelii
YSAFIVSEK

SEQ ID NO: 197387 - protein, 9 aa, Borrelia afzelii
SAFIVSEKV

SEQ ID NO: 197388 - protein, 9 aa, Borrelia afzelii
AFIVSEKVE

SEQ ID NO: 197389 - protein, 9 aa, Borrelia afzelii
FIVSEKVEV

SEQ ID NO: 197390 - protein, 9 aa, Borrelia afzelii
IVSEKVEVT

SEQ ID NO: 197391 - protein, 9 aa, Borrelia afzelii
VSEKVEVTS

SEQ ID NO: 197392 - protein, 9 aa, Borrelia afzelii
SEKVEVTSK

SEQ ID NO: 197393 - protein, 9 aa, Borrelia afzelii
EKVEVTSKK

SEQ ID NO: 197394 - protein, 9 aa, Borrelia afzelii
KVEVTSKKA

SEQ ID NO: 197395 - protein, 9 aa, Borrelia afzelii
VEVTSKKAL

SEQ ID NO: 197396 - protein, 9 aa, Borrelia afzelii
EVTSKKALE

SEQ ID NO: 197397 - protein, 9 aa, Borrelia afzelii
VTSKKALES

SEQ ID NO: 197398 - protein, 9 aa, Borrelia afzelii
TSKKALESD

SEQ ID NO: 197399 - protein, 9 aa, Borrelia afzelii
SKKALESDA

SEQ ID NO: 197400 - protein, 9 aa, Borrelia afzelii
KKALESDAY

SEQ ID NO: 197401 - protein, 9 aa, Borrelia afzelii
KALESDAYI

SEQ ID NO: 197402 - protein, 9 aa, Borrelia afzelii
ALESDAYIW

SEQ ID NO: 197403 - protein, 9 aa, Borrelia afzelii
LESDAYIWS

SEQ ID NO: 197404 - protein, 9 aa, Borrelia afzelii
ESDAYIWSS

SEQ ID NO: 197405 - protein, 9 aa, Borrelia afzelii
SDAYIWSSD

SEQ ID NO: 197406 - protein, 9 aa, Borrelia afzelii
DAYIWSSDG

SEQ ID NO: 197407 - protein, 9 aa, Borrelia afzelii
AYIWSSDGK

SEQ ID NO: 197408 - protein, 9 aa, Borrelia afzelii
YIWSSDGKT

SEQ ID NO: 197409 - protein, 9 aa, Borrelia afzelii
IWSSDGKTG

SEQ ID NO: 197410 - protein, 9 aa, Borrelia afzelii
WSSDGKTGY

SEQ ID NO: 197411 - protein, 9 aa, Borrelia afzelii
SSDGKTGYE

SEQ ID NO: 197412 - protein, 9 aa, Borrelia afzelii
SDGKTGYEI

SEQ ID NO: 197413 - protein, 9 aa, Borrelia afzelii
DGKTGYEIE

SEQ ID NO: 197414 - protein, 9 aa, Borrelia afzelii
GKTGYEIEK

SEQ ID NO: 197415 - protein, 9 aa, Borrelia afzelii
KTGYEIEKA

SEQ ID NO: 197416 - protein, 9 aa, Borrelia afzelii
TGYEIEKAK

SEQ ID NO: 197417 - protein, 9 aa, Borrelia afzelii
GYEIEKAKK

SEQ ID NO: 197418 - protein, 9 aa, Borrelia afzelii
YEIEKAKKE

SEQ ID NO: 197419 - protein, 9 aa, Borrelia afzelii
EIEKAKKED

SEQ ID NO: 197420 - protein, 9 aa, Borrelia afzelii
IEKAKKEDP

SEQ ID NO: 197421 - protein, 9 aa, Borrelia afzelii
EKAKKEDPG

SEQ ID NO: 197422 - protein, 9 aa, Borrelia afzelii
KAKKEDPGT

SEQ ID NO: 197423 - protein, 9 aa, Borrelia afzelii
AKKEDPGTE

SEQ ID NO: 197424 - protein, 9 aa, Borrelia afzelii
KKEDPGTEI

SEQ ID NO: 197425 - protein, 9 aa, Borrelia afzelii
KEDPGTEIK

SEQ ID NO: 197426 - protein, 9 aa, Borrelia afzelii
EDPGTEIKL

SEQ ID NO: 197427 - protein, 9 aa, Borrelia afzelii
DPGTEIKLY

SEQ ID NO: 197428 - protein, 9 aa, Borrelia afzelii
PGTEIKLYL

SEQ ID NO: 197429 - protein, 9 aa, Borrelia afzelii
GTEIKLYLN

SEQ ID NO: 197430 - protein, 9 aa, Borrelia afzelii
TEIKLYLNK

SEQ ID NO: 197431 - protein, 9 aa, Borrelia afzelii
EIKLYLNKE

SEQ ID NO: 197432 - protein, 9 aa, Borrelia afzelii
IKLYLNKEG

SEQ ID NO: 197433 - protein, 9 aa, Borrelia afzelii
KLYLNKEGL

SEQ ID NO: 197434 - protein, 9 aa, Borrelia afzelii
LYLNKEGLE

SEQ ID NO: 197435 - protein, 9 aa, Borrelia afzelii
YLNKEGLEY

SEQ ID NO: 197436 - protein, 9 aa, Borrelia afzelii
LNKEGLEYA

SEQ ID NO: 197437 - protein, 9 aa, Borrelia afzelii
NKEGLEYAN

SEQ ID NO: 197438 - protein, 9 aa, Borrelia afzelii
KEGLEYANK

SEQ ID NO: 197439 - protein, 9 aa, Borrelia afzelii
EGLEYANKW

SEQ ID NO: 197440 - protein, 9 aa, Borrelia afzelii
GLEYANKWK

SEQ ID NO: 197441 - protein, 9 aa, Borrelia afzelii
LEYANKWKI

SEQ ID NO: 197442 - protein, 9 aa, Borrelia afzelii
EYANKWKIQ

SEQ ID NO: 197443 - protein, 9 aa, Borrelia afzelii
YANKWKIQE

SEQ ID NO: 197444 - protein, 9 aa, Borrelia afzelii
ANKWKIQEI

SEQ ID NO: 197445 - protein, 9 aa, Borrelia afzelii
NKWKIQEIV

SEQ ID NO: 197446 - protein, 9 aa, Borrelia afzelii
KWKIQEIVK

SEQ ID NO: 197447 - protein, 9 aa, Borrelia afzelii
WKIQEIVKK

SEQ ID NO: 197448 - protein, 9 aa, Borrelia afzelii
KIQEIVKKY

SEQ ID NO: 197449 - protein, 9 aa, Borrelia afzelii
IQEIVKKYS

SEQ ID NO: 197450 - protein, 9 aa, Borrelia afzelii
QEIVKKYSN

SEQ ID NO: 197451 - protein, 9 aa, Borrelia afzelii
EIVKKYSNH

SEQ ID NO: 197452 - protein, 9 aa, Borrelia afzelii
IVKKYSNHI

SEQ ID NO: 197453 - protein, 9 aa, Borrelia afzelii
VKKYSNHIN

SEQ ID NO: 197454 - protein, 9 aa, Borrelia afzelii
KKYSNHINY

SEQ ID NO: 197455 - protein, 9 aa, Borrelia afzelii
KYSNHINYP

SEQ ID NO: 197456 - protein, 9 aa, Borrelia afzelii
YSNHINYPI

SEQ ID NO: 197457 - protein, 9 aa, Borrelia afzelii
SNHINYPIY

SEQ ID NO: 197458 - protein, 9 aa, Borrelia afzelii
NHINYPIYI

SEQ ID NO: 197459 - protein, 9 aa, Borrelia afzelii
HINYPIYIK

SEQ ID NO: 197460 - protein, 9 aa, Borrelia afzelii
INYPIYIKY

SEQ ID NO: 197461 - protein, 9 aa, Borrelia afzelii
NYPIYIKYN

SEQ ID NO: 197462 - protein, 9 aa, Borrelia afzelii
YPIYIKYNE

SEQ ID NO: 197463 - protein, 9 aa, Borrelia afzelii
PIYIKYNEP

SEQ ID NO: 197464 - protein, 9 aa, Borrelia afzelii
IYIKYNEPI

SEQ ID NO: 197465 - protein, 9 aa, Borrelia afzelii
YIKYNEPIM

SEQ ID NO: 197466 - protein, 9 aa, Borrelia afzelii
IKYNEPIMK

SEQ ID NO: 197467 - protein, 9 aa, Borrelia afzelii
KYNEPIMKD

SEQ ID NO: 197468 - protein, 9 aa, Borrelia afzelii
YNEPIMKDG

SEQ ID NO: 197469 - protein, 9 aa, Borrelia afzelii
NEPIMKDGK

SEQ ID NO: 197470 - protein, 9 aa, Borrelia afzelii
EPIMKDGKQ

SEQ ID NO: 197471 - protein, 9 aa, Borrelia afzelii
PIMKDGKQE

SEQ ID NO: 197472 - protein, 9 aa, Borrelia afzelii
IMKDGKQEG

SEQ ID NO: 197473 - protein, 9 aa, Borrelia afzelii
MKDGKQEGI

SEQ ID NO: 197474 - protein, 9 aa, Borrelia afzelii
KDGKQEGIE

SEQ ID NO: 197475 - protein, 9 aa, Borrelia afzelii
DGKQEGIEE

SEQ ID NO: 197476 - protein, 9 aa, Borrelia afzelii
GKQEGIEEK

SEQ ID NO: 197477 - protein, 9 aa, Borrelia afzelii
KQEGIEEKE

SEQ ID NO: 197478 - protein, 9 aa, Borrelia afzelii
QEGIEEKEE

SEQ ID NO: 197479 - protein, 9 aa, Borrelia afzelii
EGIEEKEEK

SEQ ID NO: 197480 - protein, 9 aa, Borrelia afzelii
GIEEKEEKL

SEQ ID NO: 197481 - protein, 9 aa, Borrelia afzelii
IEEKEEKLN

SEQ ID NO: 197482 - protein, 9 aa, Borrelia afzelii
EEKEEKLNE

SEQ ID NO: 197483 - protein, 9 aa, Borrelia afzelii
EKEEKLNET

SEQ ID NO: 197484 - protein, 9 aa, Borrelia afzelii
KEEKLNETT

SEQ ID NO: 197485 - protein, 9 aa, Borrelia afzelii
EEKLNETTA

SEQ ID NO: 197486 - protein, 9 aa, Borrelia afzelii
EKLNETTAL

SEQ ID NO: 197487 - protein, 9 aa, Borrelia afzelii
KLNETTALW

SEQ ID NO: 197488 - protein, 9 aa, Borrelia afzelii
LNETTALWT

SEQ ID NO: 197489 - protein, 9 aa, Borrelia afzelii
NETTALWTK

SEQ ID NO: 197490 - protein, 9 aa, Borrelia afzelii
ETTALWTKN

SEQ ID NO: 197491 - protein, 9 aa, Borrelia afzelii
TTALWTKNK

SEQ ID NO: 197492 - protein, 9 aa, Borrelia afzelii
TALWTKNKS

SEQ ID NO: 197493 - protein, 9 aa, Borrelia afzelii
ALWTKNKSE

SEQ ID NO: 197494 - protein, 9 aa, Borrelia afzelii
LWTKNKSEI

SEQ ID NO: 197495 - protein, 9 aa, Borrelia afzelii
WTKNKSEIK

SEQ ID NO: 197496 - protein, 9 aa, Borrelia afzelii
TKNKSEIKT

SEQ ID NO: 197497 - protein, 9 aa, Borrelia afzelii
KNKSEIKTE

SEQ ID NO: 197498 - protein, 9 aa, Borrelia afzelii
NKSEIKTEE

SEQ ID NO: 197499 - protein, 9 aa, Borrelia afzelii
KSEIKTEEY

SEQ ID NO: 197500 - protein, 9 aa, Borrelia afzelii
SEIKTEEYN

SEQ ID NO: 197501 - protein, 9 aa, Borrelia afzelii
EIKTEEYNE

SEQ ID NO: 197502 - protein, 9 aa, Borrelia afzelii
IKTEEYNEF

SEQ ID NO: 197503 - protein, 9 aa, Borrelia afzelii
KTEEYNEFY

SEQ ID NO: 197504 - protein, 9 aa, Borrelia afzelii
TEEYNEFYK

SEQ ID NO: 197505 - protein, 9 aa, Borrelia afzelii
EEYNEFYKN

SEQ ID NO: 197506 - protein, 9 aa, Borrelia afzelii
EYNEFYKNT

SEQ ID NO: 197507 - protein, 9 aa, Borrelia afzelii
YNEFYKNTT

SEQ ID NO: 197508 - protein, 9 aa, Borrelia afzelii
NEFYKNTTF

SEQ ID NO: 197509 - protein, 9 aa, Borrelia afzelii
EFYKNTTFD

SEQ ID NO: 197510 - protein, 9 aa, Borrelia afzelii
FYKNTTFDY

SEQ ID NO: 197511 - protein, 9 aa, Borrelia afzelii
YKNTTFDYE

SEQ ID NO: 197512 - protein, 9 aa, Borrelia afzelii
KNTTFDYEN

SEQ ID NO: 197513 - protein, 9 aa, Borrelia afzelii
NTTFDYENP

SEQ ID NO: 197514 - protein, 9 aa, Borrelia afzelii
TTFDYENPL

SEQ ID NO: 197515 - protein, 9 aa, Borrelia afzelii
TFDYENPLM

SEQ ID NO: 197516 - protein, 9 aa, Borrelia afzelii
FDYENPLMY

SEQ ID NO: 197517 - protein, 9 aa, Borrelia afzelii
DYENPLMYI

SEQ ID NO: 197518 - protein, 9 aa, Borrelia afzelii
YENPLMYIH

SEQ ID NO: 197519 - protein, 9 aa, Borrelia afzelii
ENPLMYIHT

SEQ ID NO: 197520 - protein, 9 aa, Borrelia afzelii
NPLMYIHTK

SEQ ID NO: 197521 - protein, 9 aa, Borrelia afzelii
PLMYIHTKA

SEQ ID NO: 197522 - protein, 9 aa, Borrelia afzelii
LMYIHTKAE

SEQ ID NO: 197523 - protein, 9 aa, Borrelia afzelii
MYIHTKAEG

SEQ ID NO: 197524 - protein, 9 aa, Borrelia afzelii
YIHTKAEGN

SEQ ID NO: 197525 - protein, 9 aa, Borrelia afzelii
IHTKAEGNL

SEQ ID NO: 197526 - protein, 9 aa, Borrelia afzelii
HTKAEGNLE

SEQ ID NO: 197527 - protein, 9 aa, Borrelia afzelii
TKAEGNLEY

SEQ ID NO: 197528 - protein, 9 aa, Borrelia afzelii
KAEGNLEYT

SEQ ID NO: 197529 - protein, 9 aa, Borrelia afzelii
AEGNLEYTN

SEQ ID NO: 197530 - protein, 9 aa, Borrelia afzelii
EGNLEYTNL

SEQ ID NO: 197531 - protein, 9 aa, Borrelia afzelii
GNLEYTNLF

SEQ ID NO: 197532 - protein, 9 aa, Borrelia afzelii
NLEYTNLFY

SEQ ID NO: 197533 - protein, 9 aa, Borrelia afzelii
LEYTNLFYI

SEQ ID NO: 197534 - protein, 9 aa, Borrelia afzelii
EYTNLFYIP

SEQ ID NO: 197535 - protein, 9 aa, Borrelia afzelii
YTNLFYIPS

SEQ ID NO: 197536 - protein, 9 aa, Borrelia afzelii
TNLFYIPSK

SEQ ID NO: 197537 - protein, 9 aa, Borrelia afzelii
NLFYIPSKA

SEQ ID NO: 197538 - protein, 9 aa, Borrelia afzelii
LFYIPSKAP

SEQ ID NO: 197539 - protein, 9 aa, Borrelia afzelii
FYIPSKAPY

SEQ ID NO: 197540 - protein, 9 aa, Borrelia afzelii
YIPSKAPYD

SEQ ID NO: 197541 - protein, 9 aa, Borrelia afzelii
IPSKAPYDL

SEQ ID NO: 197542 - protein, 9 aa, Borrelia afzelii
PSKAPYDLY

SEQ ID NO: 197543 - protein, 9 aa, Borrelia afzelii
SKAPYDLYY

SEQ ID NO: 197544 - protein, 9 aa, Borrelia afzelii
KAPYDLYYP

SEQ ID NO: 197545 - protein, 9 aa, Borrelia afzelii
APYDLYYPN

SEQ ID NO: 197546 - protein, 9 aa, Borrelia afzelii
PYDLYYPNT

SEQ ID NO: 197547 - protein, 9 aa, Borrelia afzelii
YDLYYPNTK

SEQ ID NO: 197548 - protein, 9 aa, Borrelia afzelii
DLYYPNTKP

SEQ ID NO: 197549 - protein, 9 aa, Borrelia afzelii
LYYPNTKPG

SEQ ID NO: 197550 - protein, 9 aa, Borrelia afzelii
YYPNTKPGV

SEQ ID NO: 197551 - protein, 9 aa, Borrelia afzelii
YPNTKPGVK

SEQ ID NO: 197552 - protein, 9 aa, Borrelia afzelii
PNTKPGVKL

SEQ ID NO: 197553 - protein, 9 aa, Borrelia afzelii
NTKPGVKLF

SEQ ID NO: 197554 - protein, 9 aa, Borrelia afzelii
TKPGVKLFI

SEQ ID NO: 197555 - protein, 9 aa, Borrelia afzelii
KPGVKLFIN

SEQ ID NO: 197556 - protein, 9 aa, Borrelia afzelii
PGVKLFINR

SEQ ID NO: 197557 - protein, 9 aa, Borrelia afzelii
GVKLFINRI

SEQ ID NO: 197558 - protein, 9 aa, Borrelia afzelii
VKLFINRIF

SEQ ID NO: 197559 - protein, 9 aa, Borrelia afzelii
KLFINRIFI

SEQ ID NO: 197560 - protein, 9 aa, Borrelia afzelii
LFINRIFIT

SEQ ID NO: 197561 - protein, 9 aa, Borrelia afzelii
FINRIFITD

SEQ ID NO: 197562 - protein, 9 aa, Borrelia afzelii
INRIFITDS

SEQ ID NO: 197563 - protein, 9 aa, Borrelia afzelii
NRIFITDSE

SEQ ID NO: 197564 - protein, 9 aa, Borrelia afzelii
RIFITDSEG

SEQ ID NO: 197565 - protein, 9 aa, Borrelia afzelii
IFITDSEGS

SEQ ID NO: 197566 - protein, 9 aa, Borrelia afzelii
FITDSEGSL

SEQ ID NO: 197567 - protein, 9 aa, Borrelia afzelii
ITDSEGSLL

SEQ ID NO: 197568 - protein, 9 aa, Borrelia afzelii
TDSEGSLLP

SEQ ID NO: 197569 - protein, 9 aa, Borrelia afzelii
DSEGSLLPN

SEQ ID NO: 197570 - protein, 9 aa, Borrelia afzelii
SEGSLLPNY

SEQ ID NO: 197571 - protein, 9 aa, Borrelia afzelii
EGSLLPNYL

SEQ ID NO: 197572 - protein, 9 aa, Borrelia afzelii
GSLLPNYLR

SEQ ID NO: 197573 - protein, 9 aa, Borrelia afzelii
SLLPNYLRF

SEQ ID NO: 197574 - protein, 9 aa, Borrelia afzelii
LLPNYLRFI

SEQ ID NO: 197575 - protein, 9 aa, Borrelia afzelii
LPNYLRFIK

SEQ ID NO: 197576 - protein, 9 aa, Borrelia afzelii
PNYLRFIKG

SEQ ID NO: 197577 - protein, 9 aa, Borrelia afzelii
NYLRFIKGI

SEQ ID NO: 197578 - protein, 9 aa, Borrelia afzelii
YLRFIKGII

SEQ ID NO: 197579 - protein, 9 aa, Borrelia afzelii
LRFIKGIID

SEQ ID NO: 197580 - protein, 9 aa, Borrelia afzelii
RFIKGIIDC

SEQ ID NO: 197581 - protein, 9 aa, Borrelia afzelii
FIKGIIDCQ

SEQ ID NO: 197582 - protein, 9 aa, Borrelia afzelii
IKGIIDCQD

SEQ ID NO: 197583 - protein, 9 aa, Borrelia afzelii
KGIIDCQDL

SEQ ID NO: 197584 - protein, 9 aa, Borrelia afzelii
GIIDCQDLP

SEQ ID NO: 197585 - protein, 9 aa, Borrelia afzelii
IIDCQDLPL

SEQ ID NO: 197586 - protein, 9 aa, Borrelia afzelii
IDCQDLPLN

SEQ ID NO: 197587 - protein, 9 aa, Borrelia afzelii
DCQDLPLNV

SEQ ID NO: 197588 - protein, 9 aa, Borrelia afzelii
CQDLPLNVS

SEQ ID NO: 197589 - protein, 9 aa, Borrelia afzelii
QDLPLNVSR

SEQ ID NO: 197590 - protein, 9 aa, Borrelia afzelii
DLPLNVSRE

SEQ ID NO: 197591 - protein, 9 aa, Borrelia afzelii
LPLNVSREI

SEQ ID NO: 197592 - protein, 9 aa, Borrelia afzelii
PLNVSREIL

SEQ ID NO: 197593 - protein, 9 aa, Borrelia afzelii
LNVSREILQ

SEQ ID NO: 197594 - protein, 9 aa, Borrelia afzelii
NVSREILQQ

SEQ ID NO: 197595 - protein, 9 aa, Borrelia afzelii
VSREILQQN

SEQ ID NO: 197596 - protein, 9 aa, Borrelia afzelii
SREILQQNK

SEQ ID NO: 197597 - protein, 9 aa, Borrelia afzelii
REILQQNKI

SEQ ID NO: 197598 - protein, 9 aa, Borrelia afzelii
EILQQNKIL

SEQ ID NO: 197599 - protein, 9 aa, Borrelia afzelii
ILQQNKILS

SEQ ID NO: 197600 - protein, 9 aa, Borrelia afzelii
LQQNKILSK

SEQ ID NO: 197601 - protein, 9 aa, Borrelia afzelii
QQNKILSKI

SEQ ID NO: 197602 - protein, 9 aa, Borrelia afzelii
QNKILSKIK

SEQ ID NO: 197603 - protein, 9 aa, Borrelia afzelii
NKILSKIKS

SEQ ID NO: 197604 - protein, 9 aa, Borrelia afzelii
KILSKIKSS

SEQ ID NO: 197605 - protein, 9 aa, Borrelia afzelii
ILSKIKSSS

SEQ ID NO: 197606 - protein, 9 aa, Borrelia afzelii
LSKIKSSSV

SEQ ID NO: 197607 - protein, 9 aa, Borrelia afzelii
SKIKSSSVK

SEQ ID NO: 197608 - protein, 9 aa, Borrelia afzelii
KIKSSSVKK

SEQ ID NO: 197609 - protein, 9 aa, Borrelia afzelii
IKSSSVKKI

SEQ ID NO: 197610 - protein, 9 aa, Borrelia afzelii
KSSSVKKIL

SEQ ID NO: 197611 - protein, 9 aa, Borrelia afzelii
SSSVKKILS

SEQ ID NO: 197612 - protein, 9 aa, Borrelia afzelii
SSVKKILSE

SEQ ID NO: 197613 - protein, 9 aa, Borrelia afzelii
SVKKILSEL

SEQ ID NO: 197614 - protein, 9 aa, Borrelia afzelii
VKKILSELE

SEQ ID NO: 197615 - protein, 9 aa, Borrelia afzelii
KKILSELEK

SEQ ID NO: 197616 - protein, 9 aa, Borrelia afzelii
KILSELEKL

SEQ ID NO: 197617 - protein, 9 aa, Borrelia afzelii
ILSELEKLS

SEQ ID NO: 197618 - protein, 9 aa, Borrelia afzelii
LSELEKLSK

SEQ ID NO: 197619 - protein, 9 aa, Borrelia afzelii
SELEKLSKK

SEQ ID NO: 197620 - protein, 9 aa, Borrelia afzelii
ELEKLSKKN

SEQ ID NO: 197621 - protein, 9 aa, Borrelia afzelii
LEKLSKKNP

SEQ ID NO: 197622 - protein, 9 aa, Borrelia afzelii
EKLSKKNPE

SEQ ID NO: 197623 - protein, 9 aa, Borrelia afzelii
KLSKKNPEK

SEQ ID NO: 197624 - protein, 9 aa, Borrelia afzelii
LSKKNPEKF

SEQ ID NO: 197625 - protein, 9 aa, Borrelia afzelii
SKKNPEKFS

SEQ ID NO: 197626 - protein, 9 aa, Borrelia afzelii
KKNPEKFSE

SEQ ID NO: 197627 - protein, 9 aa, Borrelia afzelii
KNPEKFSEF

SEQ ID NO: 197628 - protein, 9 aa, Borrelia afzelii
NPEKFSEFS

SEQ ID NO: 197629 - protein, 9 aa, Borrelia afzelii
PEKFSEFSK

SEQ ID NO: 197630 - protein, 9 aa, Borrelia afzelii
EKFSEFSKE

SEQ ID NO: 197631 - protein, 9 aa, Borrelia afzelii
KFSEFSKEF

SEQ ID NO: 197632 - protein, 9 aa, Borrelia afzelii
FSEFSKEFG

SEQ ID NO: 197633 - protein, 9 aa, Borrelia afzelii
SEFSKEFGR

SEQ ID NO: 197634 - protein, 9 aa, Borrelia afzelii
EFSKEFGRC

SEQ ID NO: 197635 - protein, 9 aa, Borrelia afzelii
FSKEFGRCI

SEQ ID NO: 197636 - protein, 9 aa, Borrelia afzelii
SKEFGRCIK

SEQ ID NO: 197637 - protein, 9 aa, Borrelia afzelii
KEFGRCIKE

SEQ ID NO: 197638 - protein, 9 aa, Borrelia afzelii
EFGRCIKEG

SEQ ID NO: 197639 - protein, 9 aa, Borrelia afzelii
FGRCIKEGV

SEQ ID NO: 197640 - protein, 9 aa, Borrelia afzelii
GRCIKEGVY

SEQ ID NO: 197641 - protein, 9 aa, Borrelia afzelii
RCIKEGVYS

SEQ ID NO: 197642 - protein, 9 aa, Borrelia afzelii
CIKEGVYSD

SEQ ID NO: 197643 - protein, 9 aa, Borrelia afzelii
IKEGVYSDF

SEQ ID NO: 197644 - protein, 9 aa, Borrelia afzelii
KEGVYSDFE

SEQ ID NO: 197645 - protein, 9 aa, Borrelia afzelii
EGVYSDFEN

SEQ ID NO: 197646 - protein, 9 aa, Borrelia afzelii
GVYSDFENR

SEQ ID NO: 197647 - protein, 9 aa, Borrelia afzelii
VYSDFENRE

SEQ ID NO: 197648 - protein, 9 aa, Borrelia afzelii
YSDFENREK

SEQ ID NO: 197649 - protein, 9 aa, Borrelia afzelii
SDFENREKL

SEQ ID NO: 197650 - protein, 9 aa, Borrelia afzelii
DFENREKLI

SEQ ID NO: 197651 - protein, 9 aa, Borrelia afzelii
FENREKLIS

SEQ ID NO: 197652 - protein, 9 aa, Borrelia afzelii
ENREKLISL

SEQ ID NO: 197653 - protein, 9 aa, Borrelia afzelii
NREKLISLI

SEQ ID NO: 197654 - protein, 9 aa, Borrelia afzelii
REKLISLIR

SEQ ID NO: 197655 - protein, 9 aa, Borrelia afzelii
EKLISLIRF

SEQ ID NO: 197656 - protein, 9 aa, Borrelia afzelii
KLISLIRFK

SEQ ID NO: 197657 - protein, 9 aa, Borrelia afzelii
LISLIRFKS

SEQ ID NO: 197658 - protein, 9 aa, Borrelia afzelii
ISLIRFKSS

SEQ ID NO: 197659 - protein, 9 aa, Borrelia afzelii
SLIRFKSSS

SEQ ID NO: 197660 - protein, 9 aa, Borrelia afzelii
LIRFKSSSV

SEQ ID NO: 197661 - protein, 9 aa, Borrelia afzelii
IRFKSSSVD

SEQ ID NO: 197662 - protein, 9 aa, Borrelia afzelii
RFKSSSVDG

SEQ ID NO: 197663 - protein, 9 aa, Borrelia afzelii
FKSSSVDGF

SEQ ID NO: 197664 - protein, 9 aa, Borrelia afzelii
KSSSVDGFV

SEQ ID NO: 197665 - protein, 9 aa, Borrelia afzelii
SSSVDGFVS

SEQ ID NO: 197666 - protein, 9 aa, Borrelia afzelii
SSVDGFVSF

SEQ ID NO: 197667 - protein, 9 aa, Borrelia afzelii
SVDGFVSFK

SEQ ID NO: 197668 - protein, 9 aa, Borrelia afzelii
VDGFVSFKE

SEQ ID NO: 197669 - protein, 9 aa, Borrelia afzelii
DGFVSFKEY

SEQ ID NO: 197670 - protein, 9 aa, Borrelia afzelii
GFVSFKEYK

SEQ ID NO: 197671 - protein, 9 aa, Borrelia afzelii
FVSFKEYKE

SEQ ID NO: 197672 - protein, 9 aa, Borrelia afzelii
VSFKEYKER

SEQ ID NO: 197673 - protein, 9 aa, Borrelia afzelii
SFKEYKERM

SEQ ID NO: 197674 - protein, 9 aa, Borrelia afzelii
FKEYKERMN

SEQ ID NO: 197675 - protein, 9 aa, Borrelia afzelii
KEYKERMNE

SEQ ID NO: 197676 - protein, 9 aa, Borrelia afzelii
EYKERMNEG

SEQ ID NO: 197677 - protein, 9 aa, Borrelia afzelii
YKERMNEGQ

SEQ ID NO: 197678 - protein, 9 aa, Borrelia afzelii
KERMNEGQK

SEQ ID NO: 197679 - protein, 9 aa, Borrelia afzelii
ERMNEGQKS

SEQ ID NO: 197680 - protein, 9 aa, Borrelia afzelii
RMNEGQKSI

SEQ ID NO: 197681 - protein, 9 aa, Borrelia afzelii
MNEGQKSIY

SEQ ID NO: 197682 - protein, 9 aa, Borrelia afzelii
NEGQKSIYY

SEQ ID NO: 197683 - protein, 9 aa, Borrelia afzelii
EGQKSIYYI

SEQ ID NO: 197684 - protein, 9 aa, Borrelia afzelii
GQKSIYYIT

SEQ ID NO: 197685 - protein, 9 aa, Borrelia afzelii
QKSIYYITG

SEQ ID NO: 197686 - protein, 9 aa, Borrelia afzelii
KSIYYITGG

SEQ ID NO: 197687 - protein, 9 aa, Borrelia afzelii
SIYYITGGK

SEQ ID NO: 197688 - protein, 9 aa, Borrelia afzelii
IYYITGGKE

SEQ ID NO: 197689 - protein, 9 aa, Borrelia afzelii
YYITGGKEN

SEQ ID NO: 197690 - protein, 9 aa, Borrelia afzelii
YITGGKENI

SEQ ID NO: 197691 - protein, 9 aa, Borrelia afzelii
ITGGKENIL

SEQ ID NO: 197692 - protein, 9 aa, Borrelia afzelii
TGGKENILK

SEQ ID NO: 197693 - protein, 9 aa, Borrelia afzelii
GGKENILKE

SEQ ID NO: 197694 - protein, 9 aa, Borrelia afzelii
GKENILKEN

SEQ ID NO: 197695 - protein, 9 aa, Borrelia afzelii
KENILKENP

SEQ ID NO: 197696 - protein, 9 aa, Borrelia afzelii
ENILKENPI

SEQ ID NO: 197697 - protein, 9 aa, Borrelia afzelii
NILKENPIV

SEQ ID NO: 197698 - protein, 9 aa, Borrelia afzelii
ILKENPIVT

SEQ ID NO: 197699 - protein, 9 aa, Borrelia afzelii
LKENPIVTA

SEQ ID NO: 197700 - protein, 9 aa, Borrelia afzelii
KENPIVTAY

SEQ ID NO: 197701 - protein, 9 aa, Borrelia afzelii
ENPIVTAYK

SEQ ID NO: 197702 - protein, 9 aa, Borrelia afzelii
NPIVTAYKE

SEQ ID NO: 197703 - protein, 9 aa, Borrelia afzelii
PIVTAYKEK

SEQ ID NO: 197704 - protein, 9 aa, Borrelia afzelii
IVTAYKEKG

SEQ ID NO: 197705 - protein, 9 aa, Borrelia afzelii
VTAYKEKGF

SEQ ID NO: 197706 - protein, 9 aa, Borrelia afzelii
TAYKEKGFE

SEQ ID NO: 197707 - protein, 9 aa, Borrelia afzelii
AYKEKGFEI

SEQ ID NO: 197708 - protein, 9 aa, Borrelia afzelii
YKEKGFEIL

SEQ ID NO: 197709 - protein, 9 aa, Borrelia afzelii
KEKGFEILI

SEQ ID NO: 197710 - protein, 9 aa, Borrelia afzelii
EKGFEILIM

SEQ ID NO: 197711 - protein, 9 aa, Borrelia afzelii
KGFEILIMD

SEQ ID NO: 197712 - protein, 9 aa, Borrelia afzelii
GFEILIMDD

SEQ ID NO: 197713 - protein, 9 aa, Borrelia afzelii
FEILIMDDE

SEQ ID NO: 197714 - protein, 9 aa, Borrelia afzelii
EILIMDDEL

SEQ ID NO: 197715 - protein, 9 aa, Borrelia afzelii
ILIMDDELD

SEQ ID NO: 197716 - protein, 9 aa, Borrelia afzelii
LIMDDELDE

SEQ ID NO: 197717 - protein, 9 aa, Borrelia afzelii
IMDDELDEA

SEQ ID NO: 197718 - protein, 9 aa, Borrelia afzelii
MDDELDEAI

SEQ ID NO: 197719 - protein, 9 aa, Borrelia afzelii
DDELDEAIL

SEQ ID NO: 197720 - protein, 9 aa, Borrelia afzelii
DELDEAILN

SEQ ID NO: 197721 - protein, 9 aa, Borrelia afzelii
ELDEAILNL

SEQ ID NO: 197722 - protein, 9 aa, Borrelia afzelii
LDEAILNLI

SEQ ID NO: 197723 - protein, 9 aa, Borrelia afzelii
DEAILNLIP

SEQ ID NO: 197724 - protein, 9 aa, Borrelia afzelii
EAILNLIPE

SEQ ID NO: 197725 - protein, 9 aa, Borrelia afzelii
AILNLIPEY

SEQ ID NO: 197726 - protein, 9 aa, Borrelia afzelii
ILNLIPEYE

SEQ ID NO: 197727 - protein, 9 aa, Borrelia afzelii
LNLIPEYEG

SEQ ID NO: 197728 - protein, 9 aa, Borrelia afzelii
NLIPEYEGL

SEQ ID NO: 197729 - protein, 9 aa, Borrelia afzelii
LIPEYEGLK

SEQ ID NO: 197730 - protein, 9 aa, Borrelia afzelii
IPEYEGLKL

SEQ ID NO: 197731 - protein, 9 aa, Borrelia afzelii
PEYEGLKLK

SEQ ID NO: 197732 - protein, 9 aa, Borrelia afzelii
EYEGLKLKA

SEQ ID NO: 197733 - protein, 9 aa, Borrelia afzelii
YEGLKLKAI

SEQ ID NO: 197734 - protein, 9 aa, Borrelia afzelii
EGLKLKAIN

SEQ ID NO: 197735 - protein, 9 aa, Borrelia afzelii
GLKLKAINK

SEQ ID NO: 197736 - protein, 9 aa, Borrelia afzelii
LKLKAINKN

SEQ ID NO: 197737 - protein, 9 aa, Borrelia afzelii
KLKAINKNE

SEQ ID NO: 197738 - protein, 9 aa, Borrelia afzelii
LKAINKNET

SEQ ID NO: 197739 - protein, 9 aa, Borrelia afzelii
KAINKNETS

SEQ ID NO: 197740 - protein, 9 aa, Borrelia afzelii
AINKNETSN

SEQ ID NO: 197741 - protein, 9 aa, Borrelia afzelii
INKNETSNE

SEQ ID NO: 197742 - protein, 9 aa, Borrelia afzelii
NKNETSNEL

SEQ ID NO: 197743 - protein, 9 aa, Borrelia afzelii
KNETSNELK

SEQ ID NO: 197744 - protein, 9 aa, Borrelia afzelii
NETSNELKD

SEQ ID NO: 197745 - protein, 9 aa, Borrelia afzelii
ETSNELKDE

SEQ ID NO: 197746 - protein, 9 aa, Borrelia afzelii
TSNELKDEN

SEQ ID NO: 197747 - protein, 9 aa, Borrelia afzelii
SNELKDENF

SEQ ID NO: 197748 - protein, 9 aa, Borrelia afzelii
NELKDENFK

SEQ ID NO: 197749 - protein, 9 aa, Borrelia afzelii
ELKDENFKK

SEQ ID NO: 197750 - protein, 9 aa, Borrelia afzelii
LKDENFKKI

SEQ ID NO: 197751 - protein, 9 aa, Borrelia afzelii
KDENFKKIE

SEQ ID NO: 197752 - protein, 9 aa, Borrelia afzelii
DENFKKIEE

SEQ ID NO: 197753 - protein, 9 aa, Borrelia afzelii
ENFKKIEEE

SEQ ID NO: 197754 - protein, 9 aa, Borrelia afzelii
NFKKIEEEF

SEQ ID NO: 197755 - protein, 9 aa, Borrelia afzelii
FKKIEEEFK

SEQ ID NO: 197756 - protein, 9 aa, Borrelia afzelii
KKIEEEFKD

SEQ ID NO: 197757 - protein, 9 aa, Borrelia afzelii
KIEEEFKDT

SEQ ID NO: 197758 - protein, 9 aa, Borrelia afzelii
IEEEFKDTL

SEQ ID NO: 197759 - protein, 9 aa, Borrelia afzelii
EEEFKDTLT

SEQ ID NO: 197760 - protein, 9 aa, Borrelia afzelii
EEFKDTLTR

SEQ ID NO: 197761 - protein, 9 aa, Borrelia afzelii
EFKDTLTRV

SEQ ID NO: 197762 - protein, 9 aa, Borrelia afzelii
FKDTLTRVK

SEQ ID NO: 197763 - protein, 9 aa, Borrelia afzelii
KDTLTRVKE

SEQ ID NO: 197764 - protein, 9 aa, Borrelia afzelii
DTLTRVKEI

SEQ ID NO: 197765 - protein, 9 aa, Borrelia afzelii
TLTRVKEIL

SEQ ID NO: 197766 - protein, 9 aa, Borrelia afzelii
LTRVKEILK

SEQ ID NO: 197767 - protein, 9 aa, Borrelia afzelii
TRVKEILKD

SEQ ID NO: 197768 - protein, 9 aa, Borrelia afzelii
RVKEILKDQ

SEQ ID NO: 197769 - protein, 9 aa, Borrelia afzelii
VKEILKDQI

SEQ ID NO: 197770 - protein, 9 aa, Borrelia afzelii
KEILKDQIK

SEQ ID NO: 197771 - protein, 9 aa, Borrelia afzelii
EILKDQIKE

SEQ ID NO: 197772 - protein, 9 aa, Borrelia afzelii
ILKDQIKEV

SEQ ID NO: 197773 - protein, 9 aa, Borrelia afzelii
LKDQIKEVN

SEQ ID NO: 197774 - protein, 9 aa, Borrelia afzelii
KDQIKEVNL

SEQ ID NO: 197775 - protein, 9 aa, Borrelia afzelii
DQIKEVNLS

SEQ ID NO: 197776 - protein, 9 aa, Borrelia afzelii
QIKEVNLSA

SEQ ID NO: 197777 - protein, 9 aa, Borrelia afzelii
IKEVNLSAT

SEQ ID NO: 197778 - protein, 9 aa, Borrelia afzelii
KEVNLSATL

SEQ ID NO: 197779 - protein, 9 aa, Borrelia afzelii
EVNLSATLI

SEQ ID NO: 197780 - protein, 9 aa, Borrelia afzelii
VNLSATLIK

SEQ ID NO: 197781 - protein, 9 aa, Borrelia afzelii
NLSATLIKE

SEQ ID NO: 197782 - protein, 9 aa, Borrelia afzelii
LSATLIKEP

SEQ ID NO: 197783 - protein, 9 aa, Borrelia afzelii
SATLIKEPS

SEQ ID NO: 197784 - protein, 9 aa, Borrelia afzelii
ATLIKEPSA

SEQ ID NO: 197785 - protein, 9 aa, Borrelia afzelii
TLIKEPSAI

SEQ ID NO: 197786 - protein, 9 aa, Borrelia afzelii
LIKEPSAII

SEQ ID NO: 197787 - protein, 9 aa, Borrelia afzelii
IKEPSAIIV

SEQ ID NO: 197788 - protein, 9 aa, Borrelia afzelii
KEPSAIIVD

SEQ ID NO: 197789 - protein, 9 aa, Borrelia afzelii
EPSAIIVDS

SEQ ID NO: 197790 - protein, 9 aa, Borrelia afzelii
PSAIIVDSN

SEQ ID NO: 197791 - protein, 9 aa, Borrelia afzelii
SAIIVDSND

SEQ ID NO: 197792 - protein, 9 aa, Borrelia afzelii
AIIVDSNDP

SEQ ID NO: 197793 - protein, 9 aa, Borrelia afzelii
IIVDSNDPT

SEQ ID NO: 197794 - protein, 9 aa, Borrelia afzelii
IVDSNDPTY

SEQ ID NO: 197795 - protein, 9 aa, Borrelia afzelii
VDSNDPTYQ

SEQ ID NO: 197796 - protein, 9 aa, Borrelia afzelii
DSNDPTYQM

SEQ ID NO: 197797 - protein, 9 aa, Borrelia afzelii
SNDPTYQMQ

SEQ ID NO: 197798 - protein, 9 aa, Borrelia afzelii
NDPTYQMQK

SEQ ID NO: 197799 - protein, 9 aa, Borrelia afzelii
DPTYQMQKI

SEQ ID NO: 197800 - protein, 9 aa, Borrelia afzelii
PTYQMQKIM

SEQ ID NO: 197801 - protein, 9 aa, Borrelia afzelii
TYQMQKIML

SEQ ID NO: 197802 - protein, 9 aa, Borrelia afzelii
YQMQKIMLS

SEQ ID NO: 197803 - protein, 9 aa, Borrelia afzelii
QMQKIMLSM

SEQ ID NO: 197804 - protein, 9 aa, Borrelia afzelii
MQKIMLSMG

SEQ ID NO: 197805 - protein, 9 aa, Borrelia afzelii
QKIMLSMGQ

SEQ ID NO: 197806 - protein, 9 aa, Borrelia afzelii
KIMLSMGQE

SEQ ID NO: 197807 - protein, 9 aa, Borrelia afzelii
IMLSMGQEV

SEQ ID NO: 197808 - protein, 9 aa, Borrelia afzelii
MLSMGQEVK

SEQ ID NO: 197809 - protein, 9 aa, Borrelia afzelii
LSMGQEVKE

SEQ ID NO: 197810 - protein, 9 aa, Borrelia afzelii
SMGQEVKEI

SEQ ID NO: 197811 - protein, 9 aa, Borrelia afzelii
MGQEVKEIK

SEQ ID NO: 197812 - protein, 9 aa, Borrelia afzelii
GQEVKEIKP

SEQ ID NO: 197813 - protein, 9 aa, Borrelia afzelii
QEVKEIKPI

SEQ ID NO: 197814 - protein, 9 aa, Borrelia afzelii
EVKEIKPIL

SEQ ID NO: 197815 - protein, 9 aa, Borrelia afzelii
VKEIKPILE

SEQ ID NO: 197816 - protein, 9 aa, Borrelia afzelii
KEIKPILEL

SEQ ID NO: 197817 - protein, 9 aa, Borrelia afzelii
EIKPILELN

SEQ ID NO: 197818 - protein, 9 aa, Borrelia afzelii
IKPILELNP

SEQ ID NO: 197819 - protein, 9 aa, Borrelia afzelii
KPILELNPN

SEQ ID NO: 197820 - protein, 9 aa, Borrelia afzelii
PILELNPNN

SEQ ID NO: 197821 - protein, 9 aa, Borrelia afzelii
ILELNPNNK

SEQ ID NO: 197822 - protein, 9 aa, Borrelia afzelii
LELNPNNKI

SEQ ID NO: 197823 - protein, 9 aa, Borrelia afzelii
ELNPNNKIV

SEQ ID NO: 197824 - protein, 9 aa, Borrelia afzelii
LNPNNKIVQ

SEQ ID NO: 197825 - protein, 9 aa, Borrelia afzelii
NPNNKIVQN

SEQ ID NO: 197826 - protein, 9 aa, Borrelia afzelii
PNNKIVQNL

SEQ ID NO: 197827 - protein, 9 aa, Borrelia afzelii
NNKIVQNLK

SEQ ID NO: 197828 - protein, 9 aa, Borrelia afzelii
NKIVQNLKN

SEQ ID NO: 197829 - protein, 9 aa, Borrelia afzelii
KIVQNLKNL

SEQ ID NO: 197830 - protein, 9 aa, Borrelia afzelii
IVQNLKNLE

SEQ ID NO: 197831 - protein, 9 aa, Borrelia afzelii
VQNLKNLEP

SEQ ID NO: 197832 - protein, 9 aa, Borrelia afzelii
QNLKNLEPE

SEQ ID NO: 197833 - protein, 9 aa, Borrelia afzelii
NLKNLEPEK

SEQ ID NO: 197834 - protein, 9 aa, Borrelia afzelii
LKNLEPEKL

SEQ ID NO: 197835 - protein, 9 aa, Borrelia afzelii
KNLEPEKLE

SEQ ID NO: 197836 - protein, 9 aa, Borrelia afzelii
NLEPEKLEK

SEQ ID NO: 197837 - protein, 9 aa, Borrelia afzelii
LEPEKLEKI

SEQ ID NO: 197838 - protein, 9 aa, Borrelia afzelii
EPEKLEKIS

SEQ ID NO: 197839 - protein, 9 aa, Borrelia afzelii
PEKLEKISI

SEQ ID NO: 197840 - protein, 9 aa, Borrelia afzelii
EKLEKISIL

SEQ ID NO: 197841 - protein, 9 aa, Borrelia afzelii
KLEKISILL

SEQ ID NO: 197842 - protein, 9 aa, Borrelia afzelii
LEKISILLF

SEQ ID NO: 197843 - protein, 9 aa, Borrelia afzelii
EKISILLFE

SEQ ID NO: 197844 - protein, 9 aa, Borrelia afzelii
KISILLFEE

SEQ ID NO: 197845 - protein, 9 aa, Borrelia afzelii
ISILLFEEA

SEQ ID NO: 197846 - protein, 9 aa, Borrelia afzelii
SILLFEEAL

SEQ ID NO: 197847 - protein, 9 aa, Borrelia afzelii
ILLFEEALL

SEQ ID NO: 197848 - protein, 9 aa, Borrelia afzelii
LLFEEALLT

SEQ ID NO: 197849 - protein, 9 aa, Borrelia afzelii
LFEEALLTS

SEQ ID NO: 197850 - protein, 9 aa, Borrelia afzelii
FEEALLTSG

SEQ ID NO: 197851 - protein, 9 aa, Borrelia afzelii
EEALLTSGM

SEQ ID NO: 197852 - protein, 9 aa, Borrelia afzelii
EALLTSGMP

SEQ ID NO: 197853 - protein, 9 aa, Borrelia afzelii
ALLTSGMPS

SEQ ID NO: 197854 - protein, 9 aa, Borrelia afzelii
LLTSGMPSK

SEQ ID NO: 197855 - protein, 9 aa, Borrelia afzelii
LTSGMPSKN

SEQ ID NO: 197856 - protein, 9 aa, Borrelia afzelii
TSGMPSKNP

SEQ ID NO: 197857 - protein, 9 aa, Borrelia afzelii
SGMPSKNPR

SEQ ID NO: 197858 - protein, 9 aa, Borrelia afzelii
GMPSKNPRK

SEQ ID NO: 197859 - protein, 9 aa, Borrelia afzelii
MPSKNPRKF

SEQ ID NO: 197860 - protein, 9 aa, Borrelia afzelii
PSKNPRKFI

SEQ ID NO: 197861 - protein, 9 aa, Borrelia afzelii
SKNPRKFIN

SEQ ID NO: 197862 - protein, 9 aa, Borrelia afzelii
KNPRKFINI

SEQ ID NO: 197863 - protein, 9 aa, Borrelia afzelii
NPRKFINII

SEQ ID NO: 197864 - protein, 9 aa, Borrelia afzelii
PRKFINIIN

SEQ ID NO: 197865 - protein, 9 aa, Borrelia afzelii
RKFINIINE

SEQ ID NO: 197866 - protein, 9 aa, Borrelia afzelii
KFINIINEF

SEQ ID NO: 197867 - protein, 9 aa, Borrelia afzelii
FINIINEFL

SEQ ID NO: 197868 - protein, 9 aa, Borrelia afzelii
INIINEFLE

SEQ ID NO: 197869 - protein, 9 aa, Borrelia afzelii
NIINEFLEK

SEQ ID NO: 197870 - protein, 9 aa, Borrelia afzelii
IINEFLEKD

SEQ ID NO: 197871 - protein, 9 aa, Borrelia afzelii
INEFLEKDL

SEQ ID NO: 197872 - protein, 9 aa, Borrelia afzelii
NEFLEKDLL

SEQ ID NO: 197873 - protein, 10 aa, Borrelia afzelii
MKKQFDTEVN

SEQ ID NO: 197874 - protein, 10 aa, Borrelia afzelii
KKQFDTEVND

SEQ ID NO: 197875 - protein, 10 aa, Borrelia afzelii
KQFDTEVNDL

SEQ ID NO: 197876 - protein, 10 aa, Borrelia afzelii
QFDTEVNDLL

SEQ ID NO: 197877 - protein, 10 aa, Borrelia afzelii
FDTEVNDLLY

SEQ ID NO: 197878 - protein, 10 aa, Borrelia afzelii
DTEVNDLLYL

SEQ ID NO: 197879 - protein, 10 aa, Borrelia afzelii
TEVNDLLYLI

SEQ ID NO: 197880 - protein, 10 aa, Borrelia afzelii
EVNDLLYLII

SEQ ID NO: 197881 - protein, 10 aa, Borrelia afzelii
VNDLLYLIIH

SEQ ID NO: 197882 - protein, 10 aa, Borrelia afzelii
NDLLYLIIHS

SEQ ID NO: 197883 - protein, 10 aa, Borrelia afzelii
DLLYLIIHSL

SEQ ID NO: 197884 - protein, 10 aa, Borrelia afzelii
LLYLIIHSLY

SEQ ID NO: 197885 - protein, 10 aa, Borrelia afzelii
LYLIIHSLYS

SEQ ID NO: 197886 - protein, 10 aa, Borrelia afzelii
YLIIHSLYSH

SEQ ID NO: 197887 - protein, 10 aa, Borrelia afzelii
LIIHSLYSHK

SEQ ID NO: 197888 - protein, 10 aa, Borrelia afzelii
IIHSLYSHKE

SEQ ID NO: 197889 - protein, 10 aa, Borrelia afzelii
IHSLYSHKEI

SEQ ID NO: 197890 - protein, 10 aa, Borrelia afzelii
HSLYSHKEIF

SEQ ID NO: 197891 - protein, 10 aa, Borrelia afzelii
SLYSHKEIFL

SEQ ID NO: 197892 - protein, 10 aa, Borrelia afzelii
LYSHKEIFLR

SEQ ID NO: 197893 - protein, 10 aa, Borrelia afzelii
YSHKEIFLRE

SEQ ID NO: 197894 - protein, 10 aa, Borrelia afzelii
SHKEIFLREL

SEQ ID NO: 197895 - protein, 10 aa, Borrelia afzelii
HKEIFLRELI

SEQ ID NO: 197896 - protein, 10 aa, Borrelia afzelii
KEIFLRELIS

SEQ ID NO: 197897 - protein, 10 aa, Borrelia afzelii
EIFLRELISN

SEQ ID NO: 197898 - protein, 10 aa, Borrelia afzelii
IFLRELISNA

SEQ ID NO: 197899 - protein, 10 aa, Borrelia afzelii
FLRELISNAS

SEQ ID NO: 197900 - protein, 10 aa, Borrelia afzelii
LRELISNASD

SEQ ID NO: 197901 - protein, 10 aa, Borrelia afzelii
RELISNASDA

SEQ ID NO: 197902 - protein, 10 aa, Borrelia afzelii
ELISNASDAI

SEQ ID NO: 197903 - protein, 10 aa, Borrelia afzelii
LISNASDAID

SEQ ID NO: 197904 - protein, 10 aa, Borrelia afzelii
ISNASDAIDK

SEQ ID NO: 197905 - protein, 10 aa, Borrelia afzelii
SNASDAIDKL

SEQ ID NO: 197906 - protein, 10 aa, Borrelia afzelii
NASDAIDKLK

SEQ ID NO: 197907 - protein, 10 aa, Borrelia afzelii
ASDAIDKLKF

SEQ ID NO: 197908 - protein, 10 aa, Borrelia afzelii
SDAIDKLKFL

SEQ ID NO: 197909 - protein, 10 aa, Borrelia afzelii
DAIDKLKFLS

SEQ ID NO: 197910 - protein, 10 aa, Borrelia afzelii
AIDKLKFLSL

SEQ ID NO: 197911 - protein, 10 aa, Borrelia afzelii
IDKLKFLSLT

SEQ ID NO: 197912 - protein, 10 aa, Borrelia afzelii
DKLKFLSLTN

SEQ ID NO: 197913 - protein, 10 aa, Borrelia afzelii
KLKFLSLTNE

SEQ ID NO: 197914 - protein, 10 aa, Borrelia afzelii
LKFLSLTNEK

SEQ ID NO: 197915 - protein, 10 aa, Borrelia afzelii
KFLSLTNEKF

SEQ ID NO: 197916 - protein, 10 aa, Borrelia afzelii
FLSLTNEKFK

SEQ ID NO: 197917 - protein, 10 aa, Borrelia afzelii
LSLTNEKFKN

SEQ ID NO: 197918 - protein, 10 aa, Borrelia afzelii
SLTNEKFKNI

SEQ ID NO: 197919 - protein, 10 aa, Borrelia afzelii
LTNEKFKNIA

SEQ ID NO: 197920 - protein, 10 aa, Borrelia afzelii
TNEKFKNIAL

SEQ ID NO: 197921 - protein, 10 aa, Borrelia afzelii
NEKFKNIALE

SEQ ID NO: 197922 - protein, 10 aa, Borrelia afzelii
EKFKNIALEP

SEQ ID NO: 197923 - protein, 10 aa, Borrelia afzelii
KFKNIALEPK

SEQ ID NO: 197924 - protein, 10 aa, Borrelia afzelii
FKNIALEPKI

SEQ ID NO: 197925 - protein, 10 aa, Borrelia afzelii
KNIALEPKIE

SEQ ID NO: 197926 - protein, 10 aa, Borrelia afzelii
NIALEPKIEI

SEQ ID NO: 197927 - protein, 10 aa, Borrelia afzelii
IALEPKIEIT

SEQ ID NO: 197928 - protein, 10 aa, Borrelia afzelii
ALEPKIEITF

SEQ ID NO: 197929 - protein, 10 aa, Borrelia afzelii
LEPKIEITFD

SEQ ID NO: 197930 - protein, 10 aa, Borrelia afzelii
EPKIEITFDD

SEQ ID NO: 197931 - protein, 10 aa, Borrelia afzelii
PKIEITFDDK

SEQ ID NO: 197932 - protein, 10 aa, Borrelia afzelii
KIEITFDDKS

SEQ ID NO: 197933 - protein, 10 aa, Borrelia afzelii
IEITFDDKSI

SEQ ID NO: 197934 - protein, 10 aa, Borrelia afzelii
EITFDDKSIL

SEQ ID NO: 197935 - protein, 10 aa, Borrelia afzelii
ITFDDKSILI

SEQ ID NO: 197936 - protein, 10 aa, Borrelia afzelii
TFDDKSILIK

SEQ ID NO: 197937 - protein, 10 aa, Borrelia afzelii
FDDKSILIKD

SEQ ID NO: 197938 - protein, 10 aa, Borrelia afzelii
DDKSILIKDN

SEQ ID NO: 197939 - protein, 10 aa, Borrelia afzelii
DKSILIKDNG

SEQ ID NO: 197940 - protein, 10 aa, Borrelia afzelii
KSILIKDNGI

SEQ ID NO: 197941 - protein, 10 aa, Borrelia afzelii
SILIKDNGIG

SEQ ID NO: 197942 - protein, 10 aa, Borrelia afzelii
ILIKDNGIGM

SEQ ID NO: 197943 - protein, 10 aa, Borrelia afzelii
LIKDNGIGMN

SEQ ID NO: 197944 - protein, 10 aa, Borrelia afzelii
IKDNGIGMNE

SEQ ID NO: 197945 - protein, 10 aa, Borrelia afzelii
KDNGIGMNEQ

SEQ ID NO: 197946 - protein, 10 aa, Borrelia afzelii
DNGIGMNEQE

SEQ ID NO: 197947 - protein, 10 aa, Borrelia afzelii
NGIGMNEQEL

SEQ ID NO: 197948 - protein, 10 aa, Borrelia afzelii
GIGMNEQELT

SEQ ID NO: 197949 - protein, 10 aa, Borrelia afzelii
IGMNEQELTN

SEQ ID NO: 197950 - protein, 10 aa, Borrelia afzelii
GMNEQELTNH

SEQ ID NO: 197951 - protein, 10 aa, Borrelia afzelii
MNEQELTNHL

SEQ ID NO: 197952 - protein, 10 aa, Borrelia afzelii
NEQELTNHLG

SEQ ID NO: 197953 - protein, 10 aa, Borrelia afzelii
EQELTNHLGV

SEQ ID NO: 197954 - protein, 10 aa, Borrelia afzelii
QELTNHLGVI

SEQ ID NO: 197955 - protein, 10 aa, Borrelia afzelii
ELTNHLGVIA

SEQ ID NO: 197956 - protein, 10 aa, Borrelia afzelii
LTNHLGVIAK

SEQ ID NO: 197957 - protein, 10 aa, Borrelia afzelii
TNHLGVIAKS

SEQ ID NO: 197958 - protein, 10 aa, Borrelia afzelii
NHLGVIAKSG

SEQ ID NO: 197959 - protein, 10 aa, Borrelia afzelii
HLGVIAKSGT

SEQ ID NO: 197960 - protein, 10 aa, Borrelia afzelii
LGVIAKSGTK

SEQ ID NO: 197961 - protein, 10 aa, Borrelia afzelii
GVIAKSGTKE

SEQ ID NO: 197962 - protein, 10 aa, Borrelia afzelii
VIAKSGTKEF

SEQ ID NO: 197963 - protein, 10 aa, Borrelia afzelii
IAKSGTKEFI

SEQ ID NO: 197964 - protein, 10 aa, Borrelia afzelii
AKSGTKEFIN

SEQ ID NO: 197965 - protein, 10 aa, Borrelia afzelii
KSGTKEFINN

SEQ ID NO: 197966 - protein, 10 aa, Borrelia afzelii
SGTKEFINNL

SEQ ID NO: 197967 - protein, 10 aa, Borrelia afzelii
GTKEFINNLK

SEQ ID NO: 197968 - protein, 10 aa, Borrelia afzelii
TKEFINNLKQ

SEQ ID NO: 197969 - protein, 10 aa, Borrelia afzelii
KEFINNLKQD

SEQ ID NO: 197970 - protein, 10 aa, Borrelia afzelii
EFINNLKQDE

SEQ ID NO: 197971 - protein, 10 aa, Borrelia afzelii
FINNLKQDEK

SEQ ID NO: 197972 - protein, 10 aa, Borrelia afzelii
INNLKQDEKK

SEQ ID NO: 197973 - protein, 10 aa, Borrelia afzelii
NNLKQDEKKS

SEQ ID NO: 197974 - protein, 10 aa, Borrelia afzelii
NLKQDEKKSA

SEQ ID NO: 197975 - protein, 10 aa, Borrelia afzelii
LKQDEKKSAN

SEQ ID NO: 197976 - protein, 10 aa, Borrelia afzelii
KQDEKKSANL

SEQ ID NO: 197977 - protein, 10 aa, Borrelia afzelii
QDEKKSANLI

SEQ ID NO: 197978 - protein, 10 aa, Borrelia afzelii
DEKKSANLIG

SEQ ID NO: 197979 - protein, 10 aa, Borrelia afzelii
EKKSANLIGQ

SEQ ID NO: 197980 - protein, 10 aa, Borrelia afzelii
KKSANLIGQF

SEQ ID NO: 197981 - protein, 10 aa, Borrelia afzelii
KSANLIGQFG

SEQ ID NO: 197982 - protein, 10 aa, Borrelia afzelii
SANLIGQFGV

SEQ ID NO: 197983 - protein, 10 aa, Borrelia afzelii
ANLIGQFGVG

SEQ ID NO: 197984 - protein, 10 aa, Borrelia afzelii
NLIGQFGVGF

SEQ ID NO: 197985 - protein, 10 aa, Borrelia afzelii
LIGQFGVGFY

SEQ ID NO: 197986 - protein, 10 aa, Borrelia afzelii
IGQFGVGFYS

SEQ ID NO: 197987 - protein, 10 aa, Borrelia afzelii
GQFGVGFYSA

SEQ ID NO: 197988 - protein, 10 aa, Borrelia afzelii
QFGVGFYSAF

SEQ ID NO: 197989 - protein, 10 aa, Borrelia afzelii
FGVGFYSAFI

SEQ ID NO: 197990 - protein, 10 aa, Borrelia afzelii
GVGFYSAFIV

SEQ ID NO: 197991 - protein, 10 aa, Borrelia afzelii
VGFYSAFIVS

SEQ ID NO: 197992 - protein, 10 aa, Borrelia afzelii
GFYSAFIVSE

SEQ ID NO: 197993 - protein, 10 aa, Borrelia afzelii
FYSAFIVSEK

SEQ ID NO: 197994 - protein, 10 aa, Borrelia afzelii
YSAFIVSEKV

SEQ ID NO: 197995 - protein, 10 aa, Borrelia afzelii
SAFIVSEKVE

SEQ ID NO: 197996 - protein, 10 aa, Borrelia afzelii
AFIVSEKVEV

SEQ ID NO: 197997 - protein, 10 aa, Borrelia afzelii
FIVSEKVEVT

SEQ ID NO: 197998 - protein, 10 aa, Borrelia afzelii
IVSEKVEVTS

SEQ ID NO: 197999 - protein, 10 aa, Borrelia afzelii
VSEKVEVTSK

SEQ ID NO: 198000 - protein, 10 aa, Borrelia afzelii
SEKVEVTSKK

SEQ ID NO: 198001 - protein, 10 aa, Borrelia afzelii
EKVEVTSKKA

SEQ ID NO: 198002 - protein, 10 aa, Borrelia afzelii
KVEVTSKKAL

SEQ ID NO: 198003 - protein, 10 aa, Borrelia afzelii
VEVTSKKALE

SEQ ID NO: 198004 - protein, 10 aa, Borrelia afzelii
EVTSKKALES

SEQ ID NO: 198005 - protein, 10 aa, Borrelia afzelii
VTSKKALESD

SEQ ID NO: 198006 - protein, 10 aa, Borrelia afzelii
TSKKALESDA

SEQ ID NO: 198007 - protein, 10 aa, Borrelia afzelii
SKKALESDAY

SEQ ID NO: 198008 - protein, 10 aa, Borrelia afzelii
KKALESDAYI

SEQ ID NO: 198009 - protein, 10 aa, Borrelia afzelii
KALESDAYIW

SEQ ID NO: 198010 - protein, 10 aa, Borrelia afzelii
ALESDAYIWS

SEQ ID NO: 198011 - protein, 10 aa, Borrelia afzelii
LESDAYIWSS

SEQ ID NO: 198012 - protein, 10 aa, Borrelia afzelii
ESDAYIWSSD

SEQ ID NO: 198013 - protein, 10 aa, Borrelia afzelii
SDAYIWSSDG

SEQ ID NO: 198014 - protein, 10 aa, Borrelia afzelii
DAYIWSSDGK

SEQ ID NO: 198015 - protein, 10 aa, Borrelia afzelii
AYIWSSDGKT

SEQ ID NO: 198016 - protein, 10 aa, Borrelia afzelii
YIWSSDGKTG

SEQ ID NO: 198017 - protein, 10 aa, Borrelia afzelii
IWSSDGKTGY

SEQ ID NO: 198018 - protein, 10 aa, Borrelia afzelii
WSSDGKTGYE

SEQ ID NO: 198019 - protein, 10 aa, Borrelia afzelii
SSDGKTGYEI

SEQ ID NO: 198020 - protein, 10 aa, Borrelia afzelii
SDGKTGYEIE

SEQ ID NO: 198021 - protein, 10 aa, Borrelia afzelii
DGKTGYEIEK

SEQ ID NO: 198022 - protein, 10 aa, Borrelia afzelii
GKTGYEIEKA

SEQ ID NO: 198023 - protein, 10 aa, Borrelia afzelii
KTGYEIEKAK

SEQ ID NO: 198024 - protein, 10 aa, Borrelia afzelii
TGYEIEKAKK

SEQ ID NO: 198025 - protein, 10 aa, Borrelia afzelii
GYEIEKAKKE

SEQ ID NO: 198026 - protein, 10 aa, Borrelia afzelii
YEIEKAKKED

SEQ ID NO: 198027 - protein, 10 aa, Borrelia afzelii
EIEKAKKEDP

SEQ ID NO: 198028 - protein, 10 aa, Borrelia afzelii
IEKAKKEDPG

SEQ ID NO: 198029 - protein, 10 aa, Borrelia afzelii
EKAKKEDPGT

SEQ ID NO: 198030 - protein, 10 aa, Borrelia afzelii
KAKKEDPGTE

SEQ ID NO: 198031 - protein, 10 aa, Borrelia afzelii
AKKEDPGTEI

SEQ ID NO: 198032 - protein, 10 aa, Borrelia afzelii
KKEDPGTEIK

SEQ ID NO: 198033 - protein, 10 aa, Borrelia afzelii
KEDPGTEIKL

SEQ ID NO: 198034 - protein, 10 aa, Borrelia afzelii
EDPGTEIKLY

SEQ ID NO: 198035 - protein, 10 aa, Borrelia afzelii
DPGTEIKLYL

SEQ ID NO: 198036 - protein, 10 aa, Borrelia afzelii
PGTEIKLYLN

SEQ ID NO: 198037 - protein, 10 aa, Borrelia afzelii
GTEIKLYLNK

SEQ ID NO: 198038 - protein, 10 aa, Borrelia afzelii
TEIKLYLNKE

SEQ ID NO: 198039 - protein, 10 aa, Borrelia afzelii
EIKLYLNKEG

SEQ ID NO: 198040 - protein, 10 aa, Borrelia afzelii
IKLYLNKEGL

SEQ ID NO: 198041 - protein, 10 aa, Borrelia afzelii
KLYLNKEGLE

SEQ ID NO: 198042 - protein, 10 aa, Borrelia afzelii
LYLNKEGLEY

SEQ ID NO: 198043 - protein, 10 aa, Borrelia afzelii
YLNKEGLEYA

SEQ ID NO: 198044 - protein, 10 aa, Borrelia afzelii
LNKEGLEYAN

SEQ ID NO: 198045 - protein, 10 aa, Borrelia afzelii
NKEGLEYANK

SEQ ID NO: 198046 - protein, 10 aa, Borrelia afzelii
KEGLEYANKW

SEQ ID NO: 198047 - protein, 10 aa, Borrelia afzelii
EGLEYANKWK

SEQ ID NO: 198048 - protein, 10 aa, Borrelia afzelii
GLEYANKWKI

SEQ ID NO: 198049 - protein, 10 aa, Borrelia afzelii
LEYANKWKIQ

SEQ ID NO: 198050 - protein, 10 aa, Borrelia afzelii
EYANKWKIQE

SEQ ID NO: 198051 - protein, 10 aa, Borrelia afzelii
YANKWKIQEI

SEQ ID NO: 198052 - protein, 10 aa, Borrelia afzelii
ANKWKIQEIV

SEQ ID NO: 198053 - protein, 10 aa, Borrelia afzelii
NKWKIQEIVK

SEQ ID NO: 198054 - protein, 10 aa, Borrelia afzelii
KWKIQEIVKK

SEQ ID NO: 198055 - protein, 10 aa, Borrelia afzelii
WKIQEIVKKY

SEQ ID NO: 198056 - protein, 10 aa, Borrelia afzelii
KIQEIVKKYS

SEQ ID NO: 198057 - protein, 10 aa, Borrelia afzelii
IQEIVKKYSN

SEQ ID NO: 198058 - protein, 10 aa, Borrelia afzelii
QEIVKKYSNH

SEQ ID NO: 198059 - protein, 10 aa, Borrelia afzelii
EIVKKYSNHI

SEQ ID NO: 198060 - protein, 10 aa, Borrelia afzelii
IVKKYSNHIN

SEQ ID NO: 198061 - protein, 10 aa, Borrelia afzelii
VKKYSNHINY

SEQ ID NO: 198062 - protein, 10 aa, Borrelia afzelii
KKYSNHINYP

SEQ ID NO: 198063 - protein, 10 aa, Borrelia afzelii
KYSNHINYPI

SEQ ID NO: 198064 - protein, 10 aa, Borrelia afzelii
YSNHINYPIY

SEQ ID NO: 198065 - protein, 10 aa, Borrelia afzelii
SNHINYPIYI

SEQ ID NO: 198066 - protein, 10 aa, Borrelia afzelii
NHINYPIYIK

SEQ ID NO: 198067 - protein, 10 aa, Borrelia afzelii
HINYPIYIKY

SEQ ID NO: 198068 - protein, 10 aa, Borrelia afzelii
INYPIYIKYN

SEQ ID NO: 198069 - protein, 10 aa, Borrelia afzelii
NYPIYIKYNE

SEQ ID NO: 198070 - protein, 10 aa, Borrelia afzelii
YPIYIKYNEP

SEQ ID NO: 198071 - protein, 10 aa, Borrelia afzelii
PIYIKYNEPI

SEQ ID NO: 198072 - protein, 10 aa, Borrelia afzelii
IYIKYNEPIM

SEQ ID NO: 198073 - protein, 10 aa, Borrelia afzelii
YIKYNEPIMK

SEQ ID NO: 198074 - protein, 10 aa, Borrelia afzelii
IKYNEPIMKD

SEQ ID NO: 198075 - protein, 10 aa, Borrelia afzelii
KYNEPIMKDG

SEQ ID NO: 198076 - protein, 10 aa, Borrelia afzelii
YNEPIMKDGK

SEQ ID NO: 198077 - protein, 10 aa, Borrelia afzelii
NEPIMKDGKQ

SEQ ID NO: 198078 - protein, 10 aa, Borrelia afzelii
EPIMKDGKQE

SEQ ID NO: 198079 - protein, 10 aa, Borrelia afzelii
PIMKDGKQEG

SEQ ID NO: 198080 - protein, 10 aa, Borrelia afzelii
IMKDGKQEGI

SEQ ID NO: 198081 - protein, 10 aa, Borrelia afzelii
MKDGKQEGIE

SEQ ID NO: 198082 - protein, 10 aa, Borrelia afzelii
KDGKQEGIEE

SEQ ID NO: 198083 - protein, 10 aa, Borrelia afzelii
DGKQEGIEEK

SEQ ID NO: 198084 - protein, 10 aa, Borrelia afzelii
GKQEGIEEKE

SEQ ID NO: 198085 - protein, 10 aa, Borrelia afzelii
KQEGIEEKEE

SEQ ID NO: 198086 - protein, 10 aa, Borrelia afzelii
QEGIEEKEEK

SEQ ID NO: 198087 - protein, 10 aa, Borrelia afzelii
EGIEEKEEKL

SEQ ID NO: 198088 - protein, 10 aa, Borrelia afzelii
GIEEKEEKLN

SEQ ID NO: 198089 - protein, 10 aa, Borrelia afzelii
IEEKEEKLNE

SEQ ID NO: 198090 - protein, 10 aa, Borrelia afzelii
EEKEEKLNET

SEQ ID NO: 198091 - protein, 10 aa, Borrelia afzelii
EKEEKLNETT

SEQ ID NO: 198092 - protein, 10 aa, Borrelia afzelii
KEEKLNETTA

SEQ ID NO: 198093 - protein, 10 aa, Borrelia afzelii
EEKLNETTAL

SEQ ID NO: 198094 - protein, 10 aa, Borrelia afzelii
EKLNETTALW

SEQ ID NO: 198095 - protein, 10 aa, Borrelia afzelii
KLNETTALWT

SEQ ID NO: 198096 - protein, 10 aa, Borrelia afzelii
LNETTALWTK

SEQ ID NO: 198097 - protein, 10 aa, Borrelia afzelii
NETTALWTKN

SEQ ID NO: 198098 - protein, 10 aa, Borrelia afzelii
ETTALWTKNK

SEQ ID NO: 198099 - protein, 10 aa, Borrelia afzelii
TTALWTKNKS

SEQ ID NO: 198100 - protein, 10 aa, Borrelia afzelii
TALWTKNKSE

SEQ ID NO: 198101 - protein, 10 aa, Borrelia afzelii
ALWTKNKSEI

SEQ ID NO: 198102 - protein, 10 aa, Borrelia afzelii
LWTKNKSEIK

SEQ ID NO: 198103 - protein, 10 aa, Borrelia afzelii
WTKNKSEIKT

SEQ ID NO: 198104 - protein, 10 aa, Borrelia afzelii
TKNKSEIKTE

SEQ ID NO: 198105 - protein, 10 aa, Borrelia afzelii
KNKSEIKTEE

SEQ ID NO: 198106 - protein, 10 aa, Borrelia afzelii
NKSEIKTEEY

SEQ ID NO: 198107 - protein, 10 aa, Borrelia afzelii
KSEIKTEEYN

SEQ ID NO: 198108 - protein, 10 aa, Borrelia afzelii
SEIKTEEYNE

SEQ ID NO: 198109 - protein, 10 aa, Borrelia afzelii
EIKTEEYNEF

SEQ ID NO: 198110 - protein, 10 aa, Borrelia afzelii
IKTEEYNEFY

SEQ ID NO: 198111 - protein, 10 aa, Borrelia afzelii
KTEEYNEFYK

SEQ ID NO: 198112 - protein, 10 aa, Borrelia afzelii
TEEYNEFYKN

SEQ ID NO: 198113 - protein, 10 aa, Borrelia afzelii
EEYNEFYKNT

SEQ ID NO: 198114 - protein, 10 aa, Borrelia afzelii
EYNEFYKNTT

SEQ ID NO: 198115 - protein, 10 aa, Borrelia afzelii
YNEFYKNTTF

SEQ ID NO: 198116 - protein, 10 aa, Borrelia afzelii
NEFYKNTTFD

SEQ ID NO: 198117 - protein, 10 aa, Borrelia afzelii
EFYKNTTFDY

SEQ ID NO: 198118 - protein, 10 aa, Borrelia afzelii
FYKNTTFDYE

SEQ ID NO: 198119 - protein, 10 aa, Borrelia afzelii
YKNTTFDYEN

SEQ ID NO: 198120 - protein, 10 aa, Borrelia afzelii
KNTTFDYENP

SEQ ID NO: 198121 - protein, 10 aa, Borrelia afzelii
NTTFDYENPL

SEQ ID NO: 198122 - protein, 10 aa, Borrelia afzelii
TTFDYENPLM

SEQ ID NO: 198123 - protein, 10 aa, Borrelia afzelii
TFDYENPLMY

SEQ ID NO: 198124 - protein, 10 aa, Borrelia afzelii
FDYENPLMYI

SEQ ID NO: 198125 - protein, 10 aa, Borrelia afzelii
DYENPLMYIH

SEQ ID NO: 198126 - protein, 10 aa, Borrelia afzelii
YENPLMYIHT

SEQ ID NO: 198127 - protein, 10 aa, Borrelia afzelii
ENPLMYIHTK

SEQ ID NO: 198128 - protein, 10 aa, Borrelia afzelii
NPLMYIHTKA

SEQ ID NO: 198129 - protein, 10 aa, Borrelia afzelii
PLMYIHTKAE

SEQ ID NO: 198130 - protein, 10 aa, Borrelia afzelii
LMYIHTKAEG

SEQ ID NO: 198131 - protein, 10 aa, Borrelia afzelii
MYIHTKAEGN

SEQ ID NO: 198132 - protein, 10 aa, Borrelia afzelii
YIHTKAEGNL

SEQ ID NO: 198133 - protein, 10 aa, Borrelia afzelii
IHTKAEGNLE

SEQ ID NO: 198134 - protein, 10 aa, Borrelia afzelii
HTKAEGNLEY

SEQ ID NO: 198135 - protein, 10 aa, Borrelia afzelii
TKAEGNLEYT

SEQ ID NO: 198136 - protein, 10 aa, Borrelia afzelii
KAEGNLEYTN

SEQ ID NO: 198137 - protein, 10 aa, Borrelia afzelii
AEGNLEYTNL

SEQ ID NO: 198138 - protein, 10 aa, Borrelia afzelii
EGNLEYTNLF

SEQ ID NO: 198139 - protein, 10 aa, Borrelia afzelii
GNLEYTNLFY

SEQ ID NO: 198140 - protein, 10 aa, Borrelia afzelii
NLEYTNLFYI

SEQ ID NO: 198141 - protein, 10 aa, Borrelia afzelii
LEYTNLFYIP

SEQ ID NO: 198142 - protein, 10 aa, Borrelia afzelii
EYTNLFYIPS

SEQ ID NO: 198143 - protein, 10 aa, Borrelia afzelii
YTNLFYIPSK

SEQ ID NO: 198144 - protein, 10 aa, Borrelia afzelii
TNLFYIPSKA

SEQ ID NO: 198145 - protein, 10 aa, Borrelia afzelii
NLFYIPSKAP

SEQ ID NO: 198146 - protein, 10 aa, Borrelia afzelii
LFYIPSKAPY

SEQ ID NO: 198147 - protein, 10 aa, Borrelia afzelii
FYIPSKAPYD

SEQ ID NO: 198148 - protein, 10 aa, Borrelia afzelii
YIPSKAPYDL

SEQ ID NO: 198149 - protein, 10 aa, Borrelia afzelii
IPSKAPYDLY

SEQ ID NO: 198150 - protein, 10 aa, Borrelia afzelii
PSKAPYDLYY

SEQ ID NO: 198151 - protein, 10 aa, Borrelia afzelii
SKAPYDLYYP

SEQ ID NO: 198152 - protein, 10 aa, Borrelia afzelii
KAPYDLYYPN

SEQ ID NO: 198153 - protein, 10 aa, Borrelia afzelii
APYDLYYPNT

SEQ ID NO: 198154 - protein, 10 aa, Borrelia afzelii
PYDLYYPNTK

SEQ ID NO: 198155 - protein, 10 aa, Borrelia afzelii
YDLYYPNTKP

SEQ ID NO: 198156 - protein, 10 aa, Borrelia afzelii
DLYYPNTKPG

SEQ ID NO: 198157 - protein, 10 aa, Borrelia afzelii
LYYPNTKPGV

SEQ ID NO: 198158 - protein, 10 aa, Borrelia afzelii
YYPNTKPGVK

SEQ ID NO: 198159 - protein, 10 aa, Borrelia afzelii
YPNTKPGVKL

SEQ ID NO: 198160 - protein, 10 aa, Borrelia afzelii
PNTKPGVKLF

SEQ ID NO: 198161 - protein, 10 aa, Borrelia afzelii
NTKPGVKLFI

SEQ ID NO: 198162 - protein, 10 aa, Borrelia afzelii
TKPGVKLFIN

SEQ ID NO: 198163 - protein, 10 aa, Borrelia afzelii
KPGVKLFINR

SEQ ID NO: 198164 - protein, 10 aa, Borrelia afzelii
PGVKLFINRI

SEQ ID NO: 198165 - protein, 10 aa, Borrelia afzelii
GVKLFINRIF

SEQ ID NO: 198166 - protein, 10 aa, Borrelia afzelii
VKLFINRIFI

SEQ ID NO: 198167 - protein, 10 aa, Borrelia afzelii
KLFINRIFIT

SEQ ID NO: 198168 - protein, 10 aa, Borrelia afzelii
LFINRIFITD

SEQ ID NO: 198169 - protein, 10 aa, Borrelia afzelii
FINRIFITDS

SEQ ID NO: 198170 - protein, 10 aa, Borrelia afzelii
INRIFITDSE

SEQ ID NO: 198171 - protein, 10 aa, Borrelia afzelii
NRIFITDSEG

SEQ ID NO: 198172 - protein, 10 aa, Borrelia afzelii
RIFITDSEGS

SEQ ID NO: 198173 - protein, 10 aa, Borrelia afzelii
IFITDSEGSL

SEQ ID NO: 198174 - protein, 10 aa, Borrelia afzelii
FITDSEGSLL

SEQ ID NO: 198175 - protein, 10 aa, Borrelia afzelii
ITDSEGSLLP

SEQ ID NO: 198176 - protein, 10 aa, Borrelia afzelii
TDSEGSLLPN

SEQ ID NO: 198177 - protein, 10 aa, Borrelia afzelii
DSEGSLLPNY

SEQ ID NO: 198178 - protein, 10 aa, Borrelia afzelii
SEGSLLPNYL

SEQ ID NO: 198179 - protein, 10 aa, Borrelia afzelii
EGSLLPNYLR

SEQ ID NO: 198180 - protein, 10 aa, Borrelia afzelii
GSLLPNYLRF

SEQ ID NO: 198181 - protein, 10 aa, Borrelia afzelii
SLLPNYLRFI

SEQ ID NO: 198182 - protein, 10 aa, Borrelia afzelii
LLPNYLRFIK

SEQ ID NO: 198183 - protein, 10 aa, Borrelia afzelii
LPNYLRFIKG

SEQ ID NO: 198184 - protein, 10 aa, Borrelia afzelii
PNYLRFIKGI

SEQ ID NO: 198185 - protein, 10 aa, Borrelia afzelii
NYLRFIKGII

SEQ ID NO: 198186 - protein, 10 aa, Borrelia afzelii
YLRFIKGIID

SEQ ID NO: 198187 - protein, 10 aa, Borrelia afzelii
LRFIKGIIDC

SEQ ID NO: 198188 - protein, 10 aa, Borrelia afzelii
RFIKGIIDCQ

SEQ ID NO: 198189 - protein, 10 aa, Borrelia afzelii
FIKGIIDCQD

SEQ ID NO: 198190 - protein, 10 aa, Borrelia afzelii
IKGIIDCQDL

SEQ ID NO: 198191 - protein, 10 aa, Borrelia afzelii
KGIIDCQDLP

SEQ ID NO: 198192 - protein, 10 aa, Borrelia afzelii
GIIDCQDLPL

SEQ ID NO: 198193 - protein, 10 aa, Borrelia afzelii
IIDCQDLPLN

SEQ ID NO: 198194 - protein, 10 aa, Borrelia afzelii
IDCQDLPLNV

SEQ ID NO: 198195 - protein, 10 aa, Borrelia afzelii
DCQDLPLNVS

SEQ ID NO: 198196 - protein, 10 aa, Borrelia afzelii
CQDLPLNVSR

SEQ ID NO: 198197 - protein, 10 aa, Borrelia afzelii
QDLPLNVSRE

SEQ ID NO: 198198 - protein, 10 aa, Borrelia afzelii
DLPLNVSREI

SEQ ID NO: 198199 - protein, 10 aa, Borrelia afzelii
LPLNVSREIL

SEQ ID NO: 198200 - protein, 10 aa, Borrelia afzelii
PLNVSREILQ

SEQ ID NO: 198201 - protein, 10 aa, Borrelia afzelii
LNVSREILQQ

SEQ ID NO: 198202 - protein, 10 aa, Borrelia afzelii
NVSREILQQN

SEQ ID NO: 198203 - protein, 10 aa, Borrelia afzelii
VSREILQQNK

SEQ ID NO: 198204 - protein, 10 aa, Borrelia afzelii
SREILQQNKI

SEQ ID NO: 198205 - protein, 10 aa, Borrelia afzelii
REILQQNKIL

SEQ ID NO: 198206 - protein, 10 aa, Borrelia afzelii
EILQQNKILS

SEQ ID NO: 198207 - protein, 10 aa, Borrelia afzelii
ILQQNKILSK

SEQ ID NO: 198208 - protein, 10 aa, Borrelia afzelii
LQQNKILSKI

SEQ ID NO: 198209 - protein, 10 aa, Borrelia afzelii
QQNKILSKIK

SEQ ID NO: 198210 - protein, 10 aa, Borrelia afzelii
QNKILSKIKS

SEQ ID NO: 198211 - protein, 10 aa, Borrelia afzelii
NKILSKIKSS

SEQ ID NO: 198212 - protein, 10 aa, Borrelia afzelii
KILSKIKSSS

SEQ ID NO: 198213 - protein, 10 aa, Borrelia afzelii
ILSKIKSSSV

SEQ ID NO: 198214 - protein, 10 aa, Borrelia afzelii
LSKIKSSSVK

SEQ ID NO: 198215 - protein, 10 aa, Borrelia afzelii
SKIKSSSVKK

SEQ ID NO: 198216 - protein, 10 aa, Borrelia afzelii
KIKSSSVKKI

SEQ ID NO: 198217 - protein, 10 aa, Borrelia afzelii
IKSSSVKKIL

SEQ ID NO: 198218 - protein, 10 aa, Borrelia afzelii
KSSSVKKILS

SEQ ID NO: 198219 - protein, 10 aa, Borrelia afzelii
SSSVKKILSE

SEQ ID NO: 198220 - protein, 10 aa, Borrelia afzelii
SSVKKILSEL

SEQ ID NO: 198221 - protein, 10 aa, Borrelia afzelii
SVKKILSELE

SEQ ID NO: 198222 - protein, 10 aa, Borrelia afzelii
VKKILSELEK

SEQ ID NO: 198223 - protein, 10 aa, Borrelia afzelii
KKILSELEKL

SEQ ID NO: 198224 - protein, 10 aa, Borrelia afzelii
KILSELEKLS

SEQ ID NO: 198225 - protein, 10 aa, Borrelia afzelii
ILSELEKLSK

SEQ ID NO: 198226 - protein, 10 aa, Borrelia afzelii
LSELEKLSKK

SEQ ID NO: 198227 - protein, 10 aa, Borrelia afzelii
SELEKLSKKN

SEQ ID NO: 198228 - protein, 10 aa, Borrelia afzelii
ELEKLSKKNP

SEQ ID NO: 198229 - protein, 10 aa, Borrelia afzelii
LEKLSKKNPE

SEQ ID NO: 198230 - protein, 10 aa, Borrelia afzelii
EKLSKKNPEK

SEQ ID NO: 198231 - protein, 10 aa, Borrelia afzelii
KLSKKNPEKF

SEQ ID NO: 198232 - protein, 10 aa, Borrelia afzelii
LSKKNPEKFS

SEQ ID NO: 198233 - protein, 10 aa, Borrelia afzelii
SKKNPEKFSE

SEQ ID NO: 198234 - protein, 10 aa, Borrelia afzelii
KKNPEKFSEF

SEQ ID NO: 198235 - protein, 10 aa, Borrelia afzelii
KNPEKFSEFS

SEQ ID NO: 198236 - protein, 10 aa, Borrelia afzelii
NPEKFSEFSK

SEQ ID NO: 198237 - protein, 10 aa, Borrelia afzelii
PEKFSEFSKE

SEQ ID NO: 198238 - protein, 10 aa, Borrelia afzelii
EKFSEFSKEF

SEQ ID NO: 198239 - protein, 10 aa, Borrelia afzelii
KFSEFSKEFG

SEQ ID NO: 198240 - protein, 10 aa, Borrelia afzelii
FSEFSKEFGR

SEQ ID NO: 198241 - protein, 10 aa, Borrelia afzelii
SEFSKEFGRC

SEQ ID NO: 198242 - protein, 10 aa, Borrelia afzelii
EFSKEFGRCI

SEQ ID NO: 198243 - protein, 10 aa, Borrelia afzelii
FSKEFGRCIK

SEQ ID NO: 198244 - protein, 10 aa, Borrelia afzelii
SKEFGRCIKE

SEQ ID NO: 198245 - protein, 10 aa, Borrelia afzelii
KEFGRCIKEG

SEQ ID NO: 198246 - protein, 10 aa, Borrelia afzelii
EFGRCIKEGV

SEQ ID NO: 198247 - protein, 10 aa, Borrelia afzelii
FGRCIKEGVY

SEQ ID NO: 198248 - protein, 10 aa, Borrelia afzelii
GRCIKEGVYS

SEQ ID NO: 198249 - protein, 10 aa, Borrelia afzelii
RCIKEGVYSD

SEQ ID NO: 198250 - protein, 10 aa, Borrelia afzelii
CIKEGVYSDF

SEQ ID NO: 198251 - protein, 10 aa, Borrelia afzelii
IKEGVYSDFE

SEQ ID NO: 198252 - protein, 10 aa, Borrelia afzelii
KEGVYSDFEN

SEQ ID NO: 198253 - protein, 10 aa, Borrelia afzelii
EGVYSDFENR

SEQ ID NO: 198254 - protein, 10 aa, Borrelia afzelii
GVYSDFENRE

SEQ ID NO: 198255 - protein, 10 aa, Borrelia afzelii
VYSDFENREK

SEQ ID NO: 198256 - protein, 10 aa, Borrelia afzelii
YSDFENREKL

SEQ ID NO: 198257 - protein, 10 aa, Borrelia afzelii
SDFENREKLI

SEQ ID NO: 198258 - protein, 10 aa, Borrelia afzelii
DFENREKLIS

SEQ ID NO: 198259 - protein, 10 aa, Borrelia afzelii
FENREKLISL

SEQ ID NO: 198260 - protein, 10 aa, Borrelia afzelii
ENREKLISLI

SEQ ID NO: 198261 - protein, 10 aa, Borrelia afzelii
NREKLISLIR

SEQ ID NO: 198262 - protein, 10 aa, Borrelia afzelii
REKLISLIRF

SEQ ID NO: 198263 - protein, 10 aa, Borrelia afzelii
EKLISLIRFK

SEQ ID NO: 198264 - protein, 10 aa, Borrelia afzelii
KLISLIRFKS

SEQ ID NO: 198265 - protein, 10 aa, Borrelia afzelii
LISLIRFKSS

SEQ ID NO: 198266 - protein, 10 aa, Borrelia afzelii
ISLIRFKSSS

SEQ ID NO: 198267 - protein, 10 aa, Borrelia afzelii
SLIRFKSSSV

SEQ ID NO: 198268 - protein, 10 aa, Borrelia afzelii
LIRFKSSSVD

SEQ ID NO: 198269 - protein, 10 aa, Borrelia afzelii
IRFKSSSVDG

SEQ ID NO: 198270 - protein, 10 aa, Borrelia afzelii
RFKSSSVDGF

SEQ ID NO: 198271 - protein, 10 aa, Borrelia afzelii
FKSSSVDGFV

SEQ ID NO: 198272 - protein, 10 aa, Borrelia afzelii
KSSSVDGFVS

SEQ ID NO: 198273 - protein, 10 aa, Borrelia afzelii
SSSVDGFVSF

SEQ ID NO: 198274 - protein, 10 aa, Borrelia afzelii
SSVDGFVSFK

SEQ ID NO: 198275 - protein, 10 aa, Borrelia afzelii
SVDGFVSFKE

SEQ ID NO: 198276 - protein, 10 aa, Borrelia afzelii
VDGFVSFKEY

SEQ ID NO: 198277 - protein, 10 aa, Borrelia afzelii
DGFVSFKEYK

SEQ ID NO: 198278 - protein, 10 aa, Borrelia afzelii
GFVSFKEYKE

SEQ ID NO: 198279 - protein, 10 aa, Borrelia afzelii
FVSFKEYKER

SEQ ID NO: 198280 - protein, 10 aa, Borrelia afzelii
VSFKEYKERM

SEQ ID NO: 198281 - protein, 10 aa, Borrelia afzelii
SFKEYKERMN

SEQ ID NO: 198282 - protein, 10 aa, Borrelia afzelii
FKEYKERMNE

SEQ ID NO: 198283 - protein, 10 aa, Borrelia afzelii
KEYKERMNEG

SEQ ID NO: 198284 - protein, 10 aa, Borrelia afzelii
EYKERMNEGQ

SEQ ID NO: 198285 - protein, 10 aa, Borrelia afzelii
YKERMNEGQK

SEQ ID NO: 198286 - protein, 10 aa, Borrelia afzelii
KERMNEGQKS

SEQ ID NO: 198287 - protein, 10 aa, Borrelia afzelii
ERMNEGQKSI

SEQ ID NO: 198288 - protein, 10 aa, Borrelia afzelii
RMNEGQKSIY

SEQ ID NO: 198289 - protein, 10 aa, Borrelia afzelii
MNEGQKSIYY

SEQ ID NO: 198290 - protein, 10 aa, Borrelia afzelii
NEGQKSIYYI

SEQ ID NO: 198291 - protein, 10 aa, Borrelia afzelii
EGQKSIYYIT

SEQ ID NO: 198292 - protein, 10 aa, Borrelia afzelii
GQKSIYYITG

SEQ ID NO: 198293 - protein, 10 aa, Borrelia afzelii
QKSIYYITGG

SEQ ID NO: 198294 - protein, 10 aa, Borrelia afzelii
KSIYYITGGK

SEQ ID NO: 198295 - protein, 10 aa, Borrelia afzelii
SIYYITGGKE

SEQ ID NO: 198296 - protein, 10 aa, Borrelia afzelii
IYYITGGKEN

SEQ ID NO: 198297 - protein, 10 aa, Borrelia afzelii
YYITGGKENI

SEQ ID NO: 198298 - protein, 10 aa, Borrelia afzelii
YITGGKENIL

SEQ ID NO: 198299 - protein, 10 aa, Borrelia afzelii
ITGGKENILK

SEQ ID NO: 198300 - protein, 10 aa, Borrelia afzelii
TGGKENILKE

SEQ ID NO: 198301 - protein, 10 aa, Borrelia afzelii
GGKENILKEN

SEQ ID NO: 198302 - protein, 10 aa, Borrelia afzelii
GKENILKENP

SEQ ID NO: 198303 - protein, 10 aa, Borrelia afzelii
KENILKENPI

SEQ ID NO: 198304 - protein, 10 aa, Borrelia afzelii
ENILKENPIV

SEQ ID NO: 198305 - protein, 10 aa, Borrelia afzelii
NILKENPIVT

SEQ ID NO: 198306 - protein, 10 aa, Borrelia afzelii
ILKENPIVTA

SEQ ID NO: 198307 - protein, 10 aa, Borrelia afzelii
LKENPIVTAY

SEQ ID NO: 198308 - protein, 10 aa, Borrelia afzelii
KENPIVTAYK

SEQ ID NO: 198309 - protein, 10 aa, Borrelia afzelii
ENPIVTAYKE

SEQ ID NO: 198310 - protein, 10 aa, Borrelia afzelii
NPIVTAYKEK

SEQ ID NO: 198311 - protein, 10 aa, Borrelia afzelii
PIVTAYKEKG

SEQ ID NO: 198312 - protein, 10 aa, Borrelia afzelii
IVTAYKEKGF

SEQ ID NO: 198313 - protein, 10 aa, Borrelia afzelii
VTAYKEKGFE

SEQ ID NO: 198314 - protein, 10 aa, Borrelia afzelii
TAYKEKGFEI

SEQ ID NO: 198315 - protein, 10 aa, Borrelia afzelii
AYKEKGFEIL

SEQ ID NO: 198316 - protein, 10 aa, Borrelia afzelii
YKEKGFEILI

SEQ ID NO: 198317 - protein, 10 aa, Borrelia afzelii
KEKGFEILIM

SEQ ID NO: 198318 - protein, 10 aa, Borrelia afzelii
EKGFEILIMD

SEQ ID NO: 198319 - protein, 10 aa, Borrelia afzelii
KGFEILIMDD

SEQ ID NO: 198320 - protein, 10 aa, Borrelia afzelii
GFEILIMDDE

SEQ ID NO: 198321 - protein, 10 aa, Borrelia afzelii
FEILIMDDEL

SEQ ID NO: 198322 - protein, 10 aa, Borrelia afzelii
EILIMDDELD

SEQ ID NO: 198323 - protein, 10 aa, Borrelia afzelii
ILIMDDELDE

SEQ ID NO: 198324 - protein, 10 aa, Borrelia afzelii
LIMDDELDEA

SEQ ID NO: 198325 - protein, 10 aa, Borrelia afzelii
IMDDELDEAI

SEQ ID NO: 198326 - protein, 10 aa, Borrelia afzelii
MDDELDEAIL

SEQ ID NO: 198327 - protein, 10 aa, Borrelia afzelii
DDELDEAILN

SEQ ID NO: 198328 - protein, 10 aa, Borrelia afzelii
DELDEAILNL

SEQ ID NO: 198329 - protein, 10 aa, Borrelia afzelii
ELDEAILNLI

SEQ ID NO: 198330 - protein, 10 aa, Borrelia afzelii
LDEAILNLIP

SEQ ID NO: 198331 - protein, 10 aa, Borrelia afzelii
DEAILNLIPE

SEQ ID NO: 198332 - protein, 10 aa, Borrelia afzelii
EAILNLIPEY

SEQ ID NO: 198333 - protein, 10 aa, Borrelia afzelii
AILNLIPEYE

SEQ ID NO: 198334 - protein, 10 aa, Borrelia afzelii
ILNLIPEYEG

SEQ ID NO: 198335 - protein, 10 aa, Borrelia afzelii
LNLIPEYEGL

SEQ ID NO: 198336 - protein, 10 aa, Borrelia afzelii
NLIPEYEGLK

SEQ ID NO: 198337 - protein, 10 aa, Borrelia afzelii
LIPEYEGLKL

SEQ ID NO: 198338 - protein, 10 aa, Borrelia afzelii
IPEYEGLKLK

SEQ ID NO: 198339 - protein, 10 aa, Borrelia afzelii
PEYEGLKLKA

SEQ ID NO: 198340 - protein, 10 aa, Borrelia afzelii
EYEGLKLKAI

SEQ ID NO: 198341 - protein, 10 aa, Borrelia afzelii
YEGLKLKAIN

SEQ ID NO: 198342 - protein, 10 aa, Borrelia afzelii
EGLKLKAINK

SEQ ID NO: 198343 - protein, 10 aa, Borrelia afzelii
GLKLKAINKN

SEQ ID NO: 198344 - protein, 10 aa, Borrelia afzelii
LKLKAINKNE

SEQ ID NO: 198345 - protein, 10 aa, Borrelia afzelii
KLKAINKNET

SEQ ID NO: 198346 - protein, 10 aa, Borrelia afzelii
LKAINKNETS

SEQ ID NO: 198347 - protein, 10 aa, Borrelia afzelii
KAINKNETSN

SEQ ID NO: 198348 - protein, 10 aa, Borrelia afzelii
AINKNETSNE

SEQ ID NO: 198349 - protein, 10 aa, Borrelia afzelii
INKNETSNEL

SEQ ID NO: 198350 - protein, 10 aa, Borrelia afzelii
NKNETSNELK

SEQ ID NO: 198351 - protein, 10 aa, Borrelia afzelii
KNETSNELKD

SEQ ID NO: 198352 - protein, 10 aa, Borrelia afzelii
NETSNELKDE

SEQ ID NO: 198353 - protein, 10 aa, Borrelia afzelii
ETSNELKDEN

SEQ ID NO: 198354 - protein, 10 aa, Borrelia afzelii
TSNELKDENF

SEQ ID NO: 198355 - protein, 10 aa, Borrelia afzelii
SNELKDENFK

SEQ ID NO: 198356 - protein, 10 aa, Borrelia afzelii
NELKDENFKK

SEQ ID NO: 198357 - protein, 10 aa, Borrelia afzelii
ELKDENFKKI

SEQ ID NO: 198358 - protein, 10 aa, Borrelia afzelii
LKDENFKKIE

SEQ ID NO: 198359 - protein, 10 aa, Borrelia afzelii
KDENFKKIEE

SEQ ID NO: 198360 - protein, 10 aa, Borrelia afzelii
DENFKKIEEE

SEQ ID NO: 198361 - protein, 10 aa, Borrelia afzelii
ENFKKIEEEF

SEQ ID NO: 198362 - protein, 10 aa, Borrelia afzelii
NFKKIEEEFK

SEQ ID NO: 198363 - protein, 10 aa, Borrelia afzelii
FKKIEEEFKD

SEQ ID NO: 198364 - protein, 10 aa, Borrelia afzelii
KKIEEEFKDT

SEQ ID NO: 198365 - protein, 10 aa, Borrelia afzelii
KIEEEFKDTL

SEQ ID NO: 198366 - protein, 10 aa, Borrelia afzelii
IEEEFKDTLT

SEQ ID NO: 198367 - protein, 10 aa, Borrelia afzelii
EEEFKDTLTR

SEQ ID NO: 198368 - protein, 10 aa, Borrelia afzelii
EEFKDTLTRV

SEQ ID NO: 198369 - protein, 10 aa, Borrelia afzelii
EFKDTLTRVK

SEQ ID NO: 198370 - protein, 10 aa, Borrelia afzelii
FKDTLTRVKE

SEQ ID NO: 198371 - protein, 10 aa, Borrelia afzelii
KDTLTRVKEI

SEQ ID NO: 198372 - protein, 10 aa, Borrelia afzelii
DTLTRVKEIL

SEQ ID NO: 198373 - protein, 10 aa, Borrelia afzelii
TLTRVKEILK

SEQ ID NO: 198374 - protein, 10 aa, Borrelia afzelii
LTRVKEILKD

SEQ ID NO: 198375 - protein, 10 aa, Borrelia afzelii
TRVKEILKDQ

SEQ ID NO: 198376 - protein, 10 aa, Borrelia afzelii
RVKEILKDQI

SEQ ID NO: 198377 - protein, 10 aa, Borrelia afzelii
VKEILKDQIK

SEQ ID NO: 198378 - protein, 10 aa, Borrelia afzelii
KEILKDQIKE

SEQ ID NO: 198379 - protein, 10 aa, Borrelia afzelii
EILKDQIKEV

SEQ ID NO: 198380 - protein, 10 aa, Borrelia afzelii
ILKDQIKEVN

SEQ ID NO: 198381 - protein, 10 aa, Borrelia afzelii
LKDQIKEVNL

SEQ ID NO: 198382 - protein, 10 aa, Borrelia afzelii
KDQIKEVNLS

SEQ ID NO: 198383 - protein, 10 aa, Borrelia afzelii
DQIKEVNLSA

SEQ ID NO: 198384 - protein, 10 aa, Borrelia afzelii
QIKEVNLSAT

SEQ ID NO: 198385 - protein, 10 aa, Borrelia afzelii
IKEVNLSATL

SEQ ID NO: 198386 - protein, 10 aa, Borrelia afzelii
KEVNLSATLI

SEQ ID NO: 198387 - protein, 10 aa, Borrelia afzelii
EVNLSATLIK

SEQ ID NO: 198388 - protein, 10 aa, Borrelia afzelii
VNLSATLIKE

SEQ ID NO: 198389 - protein, 10 aa, Borrelia afzelii
NLSATLIKEP

SEQ ID NO: 198390 - protein, 10 aa, Borrelia afzelii
LSATLIKEPS

SEQ ID NO: 198391 - protein, 10 aa, Borrelia afzelii
SATLIKEPSA

SEQ ID NO: 198392 - protein, 10 aa, Borrelia afzelii
ATLIKEPSAI

SEQ ID NO: 198393 - protein, 10 aa, Borrelia afzelii
TLIKEPSAII

SEQ ID NO: 198394 - protein, 10 aa, Borrelia afzelii
LIKEPSAIIV

SEQ ID NO: 198395 - protein, 10 aa, Borrelia afzelii
IKEPSAIIVD

SEQ ID NO: 198396 - protein, 10 aa, Borrelia afzelii
KEPSAIIVDS

SEQ ID NO: 198397 - protein, 10 aa, Borrelia afzelii
EPSAIIVDSN

SEQ ID NO: 198398 - protein, 10 aa, Borrelia afzelii
PSAIIVDSND

SEQ ID NO: 198399 - protein, 10 aa, Borrelia afzelii
SAIIVDSNDP

SEQ ID NO: 198400 - protein, 10 aa, Borrelia afzelii
AIIVDSNDPT

SEQ ID NO: 198401 - protein, 10 aa, Borrelia afzelii
IIVDSNDPTY

SEQ ID NO: 198402 - protein, 10 aa, Borrelia afzelii
IVDSNDPTYQ

SEQ ID NO: 198403 - protein, 10 aa, Borrelia afzelii
VDSNDPTYQM

SEQ ID NO: 198404 - protein, 10 aa, Borrelia afzelii
DSNDPTYQMQ

SEQ ID NO: 198405 - protein, 10 aa, Borrelia afzelii
SNDPTYQMQK

SEQ ID NO: 198406 - protein, 10 aa, Borrelia afzelii
NDPTYQMQKI

SEQ ID NO: 198407 - protein, 10 aa, Borrelia afzelii
DPTYQMQKIM

SEQ ID NO: 198408 - protein, 10 aa, Borrelia afzelii
PTYQMQKIML

SEQ ID NO: 198409 - protein, 10 aa, Borrelia afzelii
TYQMQKIMLS

SEQ ID NO: 198410 - protein, 10 aa, Borrelia afzelii
YQMQKIMLSM

SEQ ID NO: 198411 - protein, 10 aa, Borrelia afzelii
QMQKIMLSMG

SEQ ID NO: 198412 - protein, 10 aa, Borrelia afzelii
MQKIMLSMGQ

SEQ ID NO: 198413 - protein, 10 aa, Borrelia afzelii
QKIMLSMGQE

SEQ ID NO: 198414 - protein, 10 aa, Borrelia afzelii
KIMLSMGQEV

SEQ ID NO: 198415 - protein, 10 aa, Borrelia afzelii
IMLSMGQEVK

SEQ ID NO: 198416 - protein, 10 aa, Borrelia afzelii
MLSMGQEVKE

SEQ ID NO: 198417 - protein, 10 aa, Borrelia afzelii
LSMGQEVKEI

SEQ ID NO: 198418 - protein, 10 aa, Borrelia afzelii
SMGQEVKEIK

SEQ ID NO: 198419 - protein, 10 aa, Borrelia afzelii
MGQEVKEIKP

SEQ ID NO: 198420 - protein, 10 aa, Borrelia afzelii
GQEVKEIKPI

SEQ ID NO: 198421 - protein, 10 aa, Borrelia afzelii
QEVKEIKPIL

SEQ ID NO: 198422 - protein, 10 aa, Borrelia afzelii
EVKEIKPILE

SEQ ID NO: 198423 - protein, 10 aa, Borrelia afzelii
VKEIKPILEL

SEQ ID NO: 198424 - protein, 10 aa, Borrelia afzelii
KEIKPILELN

SEQ ID NO: 198425 - protein, 10 aa, Borrelia afzelii
EIKPILELNP

SEQ ID NO: 198426 - protein, 10 aa, Borrelia afzelii
IKPILELNPN

SEQ ID NO: 198427 - protein, 10 aa, Borrelia afzelii
KPILELNPNN

SEQ ID NO: 198428 - protein, 10 aa, Borrelia afzelii
PILELNPNNK

SEQ ID NO: 198429 - protein, 10 aa, Borrelia afzelii
ILELNPNNKI

SEQ ID NO: 198430 - protein, 10 aa, Borrelia afzelii
LELNPNNKIV

SEQ ID NO: 198431 - protein, 10 aa, Borrelia afzelii
ELNPNNKIVQ

SEQ ID NO: 198432 - protein, 10 aa, Borrelia afzelii
LNPNNKIVQN

SEQ ID NO: 198433 - protein, 10 aa, Borrelia afzelii
NPNNKIVQNL

SEQ ID NO: 198434 - protein, 10 aa, Borrelia afzelii
PNNKIVQNLK

SEQ ID NO: 198435 - protein, 10 aa, Borrelia afzelii
NNKIVQNLKN

SEQ ID NO: 198436 - protein, 10 aa, Borrelia afzelii
NKIVQNLKNL

SEQ ID NO: 198437 - protein, 10 aa, Borrelia afzelii
KIVQNLKNLE

SEQ ID NO: 198438 - protein, 10 aa, Borrelia afzelii
IVQNLKNLEP

SEQ ID NO: 198439 - protein, 10 aa, Borrelia afzelii
VQNLKNLEPE

SEQ ID NO: 198440 - protein, 10 aa, Borrelia afzelii
QNLKNLEPEK

SEQ ID NO: 198441 - protein, 10 aa, Borrelia afzelii
NLKNLEPEKL

SEQ ID NO: 198442 - protein, 10 aa, Borrelia afzelii
LKNLEPEKLE

SEQ ID NO: 198443 - protein, 10 aa, Borrelia afzelii
KNLEPEKLEK

SEQ ID NO: 198444 - protein, 10 aa, Borrelia afzelii
NLEPEKLEKI

SEQ ID NO: 198445 - protein, 10 aa, Borrelia afzelii
LEPEKLEKIS

SEQ ID NO: 198446 - protein, 10 aa, Borrelia afzelii
EPEKLEKISI

SEQ ID NO: 198447 - protein, 10 aa, Borrelia afzelii
PEKLEKISIL

SEQ ID NO: 198448 - protein, 10 aa, Borrelia afzelii
EKLEKISILL

SEQ ID NO: 198449 - protein, 10 aa, Borrelia afzelii
KLEKISILLF

SEQ ID NO: 198450 - protein, 10 aa, Borrelia afzelii
LEKISILLFE

SEQ ID NO: 198451 - protein, 10 aa, Borrelia afzelii
EKISILLFEE

SEQ ID NO: 198452 - protein, 10 aa, Borrelia afzelii
KISILLFEEA

SEQ ID NO: 198453 - protein, 10 aa, Borrelia afzelii
ISILLFEEAL

SEQ ID NO: 198454 - protein, 10 aa, Borrelia afzelii
SILLFEEALL

SEQ ID NO: 198455 - protein, 10 aa, Borrelia afzelii
ILLFEEALLT

SEQ ID NO: 198456 - protein, 10 aa, Borrelia afzelii
LLFEEALLTS

SEQ ID NO: 198457 - protein, 10 aa, Borrelia afzelii
LFEEALLTSG

SEQ ID NO: 198458 - protein, 10 aa, Borrelia afzelii
FEEALLTSGM

SEQ ID NO: 198459 - protein, 10 aa, Borrelia afzelii
EEALLTSGMP

SEQ ID NO: 198460 - protein, 10 aa, Borrelia afzelii
EALLTSGMPS

SEQ ID NO: 198461 - protein, 10 aa, Borrelia afzelii
ALLTSGMPSK

SEQ ID NO: 198462 - protein, 10 aa, Borrelia afzelii
LLTSGMPSKN

SEQ ID NO: 198463 - protein, 10 aa, Borrelia afzelii
LTSGMPSKNP

SEQ ID NO: 198464 - protein, 10 aa, Borrelia afzelii
TSGMPSKNPR

SEQ ID NO: 198465 - protein, 10 aa, Borrelia afzelii
SGMPSKNPRK

SEQ ID NO: 198466 - protein, 10 aa, Borrelia afzelii
GMPSKNPRKF

SEQ ID NO: 198467 - protein, 10 aa, Borrelia afzelii
MPSKNPRKFI

SEQ ID NO: 198468 - protein, 10 aa, Borrelia afzelii
PSKNPRKFIN

SEQ ID NO: 198469 - protein, 10 aa, Borrelia afzelii
SKNPRKFINI

SEQ ID NO: 198470 - protein, 10 aa, Borrelia afzelii
KNPRKFINII

SEQ ID NO: 198471 - protein, 10 aa, Borrelia afzelii
NPRKFINIIN

SEQ ID NO: 198472 - protein, 10 aa, Borrelia afzelii
PRKFINIINE

SEQ ID NO: 198473 - protein, 10 aa, Borrelia afzelii
RKFINIINEF

SEQ ID NO: 198474 - protein, 10 aa, Borrelia afzelii
KFINIINEFL

SEQ ID NO: 198475 - protein, 10 aa, Borrelia afzelii
FINIINEFLE

SEQ ID NO: 198476 - protein, 10 aa, Borrelia afzelii
INIINEFLEK

SEQ ID NO: 198477 - protein, 10 aa, Borrelia afzelii
NIINEFLEKD

SEQ ID NO: 198478 - protein, 10 aa, Borrelia afzelii
IINEFLEKDL

SEQ ID NO: 198479 - protein, 10 aa, Borrelia afzelii
INEFLEKDLL

SEQ ID NO: 198480 - protein, 11 aa, Borrelia afzelii
MKKQFDTEVND

SEQ ID NO: 198481 - protein, 11 aa, Borrelia afzelii
KKQFDTEVNDL

SEQ ID NO: 198482 - protein, 11 aa, Borrelia afzelii
KQFDTEVNDLL

SEQ ID NO: 198483 - protein, 11 aa, Borrelia afzelii
QFDTEVNDLLY

SEQ ID NO: 198484 - protein, 11 aa, Borrelia afzelii
FDTEVNDLLYL

SEQ ID NO: 198485 - protein, 11 aa, Borrelia afzelii
DTEVNDLLYLI

SEQ ID NO: 198486 - protein, 11 aa, Borrelia afzelii
TEVNDLLYLII

SEQ ID NO: 198487 - protein, 11 aa, Borrelia afzelii
EVNDLLYLIIH

SEQ ID NO: 198488 - protein, 11 aa, Borrelia afzelii
VNDLLYLIIHS

SEQ ID NO: 198489 - protein, 11 aa, Borrelia afzelii
NDLLYLIIHSL

SEQ ID NO: 198490 - protein, 11 aa, Borrelia afzelii
DLLYLIIHSLY

SEQ ID NO: 198491 - protein, 11 aa, Borrelia afzelii
LLYLIIHSLYS

SEQ ID NO: 198492 - protein, 11 aa, Borrelia afzelii
LYLIIHSLYSH

SEQ ID NO: 198493 - protein, 11 aa, Borrelia afzelii
YLIIHSLYSHK

SEQ ID NO: 198494 - protein, 11 aa, Borrelia afzelii
LIIHSLYSHKE

SEQ ID NO: 198495 - protein, 11 aa, Borrelia afzelii
IIHSLYSHKEI

SEQ ID NO: 198496 - protein, 11 aa, Borrelia afzelii
IHSLYSHKEIF

SEQ ID NO: 198497 - protein, 11 aa, Borrelia afzelii
HSLYSHKEIFL

SEQ ID NO: 198498 - protein, 11 aa, Borrelia afzelii
SLYSHKEIFLR

SEQ ID NO: 198499 - protein, 11 aa, Borrelia afzelii
LYSHKEIFLRE

SEQ ID NO: 198500 - protein, 11 aa, Borrelia afzelii
YSHKEIFLREL

SEQ ID NO: 198501 - protein, 11 aa, Borrelia afzelii
SHKEIFLRELI

SEQ ID NO: 198502 - protein, 11 aa, Borrelia afzelii
HKEIFLRELIS

SEQ ID NO: 198503 - protein, 11 aa, Borrelia afzelii
KEIFLRELISN

SEQ ID NO: 198504 - protein, 11 aa, Borrelia afzelii
EIFLRELISNA

SEQ ID NO: 198505 - protein, 11 aa, Borrelia afzelii
IFLRELISNAS

SEQ ID NO: 198506 - protein, 11 aa, Borrelia afzelii
FLRELISNASD

SEQ ID NO: 198507 - protein, 11 aa, Borrelia afzelii
LRELISNASDA

SEQ ID NO: 198508 - protein, 11 aa, Borrelia afzelii
RELISNASDAI

SEQ ID NO: 198509 - protein, 11 aa, Borrelia afzelii
ELISNASDAID

SEQ ID NO: 198510 - protein, 11 aa, Borrelia afzelii
LISNASDAIDK

SEQ ID NO: 198511 - protein, 11 aa, Borrelia afzelii
ISNASDAIDKL

SEQ ID NO: 198512 - protein, 11 aa, Borrelia afzelii
SNASDAIDKLK

SEQ ID NO: 198513 - protein, 11 aa, Borrelia afzelii
NASDAIDKLKF

SEQ ID NO: 198514 - protein, 11 aa, Borrelia afzelii
ASDAIDKLKFL

SEQ ID NO: 198515 - protein, 11 aa, Borrelia afzelii
SDAIDKLKFLS

SEQ ID NO: 198516 - protein, 11 aa, Borrelia afzelii
DAIDKLKFLSL

SEQ ID NO: 198517 - protein, 11 aa, Borrelia afzelii
AIDKLKFLSLT

SEQ ID NO: 198518 - protein, 11 aa, Borrelia afzelii
IDKLKFLSLTN

SEQ ID NO: 198519 - protein, 11 aa, Borrelia afzelii
DKLKFLSLTNE

SEQ ID NO: 198520 - protein, 11 aa, Borrelia afzelii
KLKFLSLTNEK

SEQ ID NO: 198521 - protein, 11 aa, Borrelia afzelii
LKFLSLTNEKF

SEQ ID NO: 198522 - protein, 11 aa, Borrelia afzelii
KFLSLTNEKFK

SEQ ID NO: 198523 - protein, 11 aa, Borrelia afzelii
FLSLTNEKFKN

SEQ ID NO: 198524 - protein, 11 aa, Borrelia afzelii
LSLTNEKFKNI

SEQ ID NO: 198525 - protein, 11 aa, Borrelia afzelii
SLTNEKFKNIA

SEQ ID NO: 198526 - protein, 11 aa, Borrelia afzelii
LTNEKFKNIAL

SEQ ID NO: 198527 - protein, 11 aa, Borrelia afzelii
TNEKFKNIALE

SEQ ID NO: 198528 - protein, 11 aa, Borrelia afzelii
NEKFKNIALEP

SEQ ID NO: 198529 - protein, 11 aa, Borrelia afzelii
EKFKNIALEPK

SEQ ID NO: 198530 - protein, 11 aa, Borrelia afzelii
KFKNIALEPKI

SEQ ID NO: 198531 - protein, 11 aa, Borrelia afzelii
FKNIALEPKIE

SEQ ID NO: 198532 - protein, 11 aa, Borrelia afzelii
KNIALEPKIEI

SEQ ID NO: 198533 - protein, 11 aa, Borrelia afzelii
NIALEPKIEIT

SEQ ID NO: 198534 - protein, 11 aa, Borrelia afzelii
IALEPKIEITF

SEQ ID NO: 198535 - protein, 11 aa, Borrelia afzelii
ALEPKIEITFD

SEQ ID NO: 198536 - protein, 11 aa, Borrelia afzelii
LEPKIEITFDD

SEQ ID NO: 198537 - protein, 11 aa, Borrelia afzelii
EPKIEITFDDK

SEQ ID NO: 198538 - protein, 11 aa, Borrelia afzelii
PKIEITFDDKS

SEQ ID NO: 198539 - protein, 11 aa, Borrelia afzelii
KIEITFDDKSI

SEQ ID NO: 198540 - protein, 11 aa, Borrelia afzelii
IEITFDDKSIL

SEQ ID NO: 198541 - protein, 11 aa, Borrelia afzelii
EITFDDKSILI

SEQ ID NO: 198542 - protein, 11 aa, Borrelia afzelii
ITFDDKSILIK

SEQ ID NO: 198543 - protein, 11 aa, Borrelia afzelii
TFDDKSILIKD

SEQ ID NO: 198544 - protein, 11 aa, Borrelia afzelii
FDDKSILIKDN

SEQ ID NO: 198545 - protein, 11 aa, Borrelia afzelii
DDKSILIKDNG

SEQ ID NO: 198546 - protein, 11 aa, Borrelia afzelii
DKSILIKDNGI

SEQ ID NO: 198547 - protein, 11 aa, Borrelia afzelii
KSILIKDNGIG

SEQ ID NO: 198548 - protein, 11 aa, Borrelia afzelii
SILIKDNGIGM

SEQ ID NO: 198549 - protein, 11 aa, Borrelia afzelii
ILIKDNGIGMN

SEQ ID NO: 198550 - protein, 11 aa, Borrelia afzelii
LIKDNGIGMNE

SEQ ID NO: 198551 - protein, 11 aa, Borrelia afzelii
IKDNGIGMNEQ

SEQ ID NO: 198552 - protein, 11 aa, Borrelia afzelii
KDNGIGMNEQE

SEQ ID NO: 198553 - protein, 11 aa, Borrelia afzelii
DNGIGMNEQEL

SEQ ID NO: 198554 - protein, 11 aa, Borrelia afzelii
NGIGMNEQELT

SEQ ID NO: 198555 - protein, 11 aa, Borrelia afzelii
GIGMNEQELTN

SEQ ID NO: 198556 - protein, 11 aa, Borrelia afzelii
IGMNEQELTNH

SEQ ID NO: 198557 - protein, 11 aa, Borrelia afzelii
GMNEQELTNHL

SEQ ID NO: 198558 - protein, 11 aa, Borrelia afzelii
MNEQELTNHLG

SEQ ID NO: 198559 - protein, 11 aa, Borrelia afzelii
NEQELTNHLGV

SEQ ID NO: 198560 - protein, 11 aa, Borrelia afzelii
EQELTNHLGVI

SEQ ID NO: 198561 - protein, 11 aa, Borrelia afzelii
QELTNHLGVIA

SEQ ID NO: 198562 - protein, 11 aa, Borrelia afzelii
ELTNHLGVIAK

SEQ ID NO: 198563 - protein, 11 aa, Borrelia afzelii
LTNHLGVIAKS

SEQ ID NO: 198564 - protein, 11 aa, Borrelia afzelii
TNHLGVIAKSG

SEQ ID NO: 198565 - protein, 11 aa, Borrelia afzelii
NHLGVIAKSGT

SEQ ID NO: 198566 - protein, 11 aa, Borrelia afzelii
HLGVIAKSGTK

SEQ ID NO: 198567 - protein, 11 aa, Borrelia afzelii
LGVIAKSGTKE

SEQ ID NO: 198568 - protein, 11 aa, Borrelia afzelii
GVIAKSGTKEF

SEQ ID NO: 198569 - protein, 11 aa, Borrelia afzelii
VIAKSGTKEFI

SEQ ID NO: 198570 - protein, 11 aa, Borrelia afzelii
IAKSGTKEFIN

SEQ ID NO: 198571 - protein, 11 aa, Borrelia afzelii
AKSGTKEFINN

SEQ ID NO: 198572 - protein, 11 aa, Borrelia afzelii
KSGTKEFINNL

SEQ ID NO: 198573 - protein, 11 aa, Borrelia afzelii
SGTKEFINNLK

SEQ ID NO: 198574 - protein, 11 aa, Borrelia afzelii
GTKEFINNLKQ

SEQ ID NO: 198575 - protein, 11 aa, Borrelia afzelii
TKEFINNLKQD

SEQ ID NO: 198576 - protein, 11 aa, Borrelia afzelii
KEFINNLKQDE

SEQ ID NO: 198577 - protein, 11 aa, Borrelia afzelii
EFINNLKQDEK

SEQ ID NO: 198578 - protein, 11 aa, Borrelia afzelii
FINNLKQDEKK

SEQ ID NO: 198579 - protein, 11 aa, Borrelia afzelii
INNLKQDEKKS

SEQ ID NO: 198580 - protein, 11 aa, Borrelia afzelii
NNLKQDEKKSA

SEQ ID NO: 198581 - protein, 11 aa, Borrelia afzelii
NLKQDEKKSAN

SEQ ID NO: 198582 - protein, 11 aa, Borrelia afzelii
LKQDEKKSANL

SEQ ID NO: 198583 - protein, 11 aa, Borrelia afzelii
KQDEKKSANLI

SEQ ID NO: 198584 - protein, 11 aa, Borrelia afzelii
QDEKKSANLIG

SEQ ID NO: 198585 - protein, 11 aa, Borrelia afzelii
DEKKSANLIGQ

SEQ ID NO: 198586 - protein, 11 aa, Borrelia afzelii
EKKSANLIGQF

SEQ ID NO: 198587 - protein, 11 aa, Borrelia afzelii
KKSANLIGQFG

SEQ ID NO: 198588 - protein, 11 aa, Borrelia afzelii
KSANLIGQFGV

SEQ ID NO: 198589 - protein, 11 aa, Borrelia afzelii
SANLIGQFGVG

SEQ ID NO: 198590 - protein, 11 aa, Borrelia afzelii
ANLIGQFGVGF

SEQ ID NO: 198591 - protein, 11 aa, Borrelia afzelii
NLIGQFGVGFY

SEQ ID NO: 198592 - protein, 11 aa, Borrelia afzelii
LIGQFGVGFYS

SEQ ID NO: 198593 - protein, 11 aa, Borrelia afzelii
IGQFGVGFYSA

SEQ ID NO: 198594 - protein, 11 aa, Borrelia afzelii
GQFGVGFYSAF

SEQ ID NO: 198595 - protein, 11 aa, Borrelia afzelii
QFGVGFYSAFI

SEQ ID NO: 198596 - protein, 11 aa, Borrelia afzelii
FGVGFYSAFIV

SEQ ID NO: 198597 - protein, 11 aa, Borrelia afzelii
GVGFYSAFIVS

SEQ ID NO: 198598 - protein, 11 aa, Borrelia afzelii
VGFYSAFIVSE

SEQ ID NO: 198599 - protein, 11 aa, Borrelia afzelii
GFYSAFIVSEK

SEQ ID NO: 198600 - protein, 11 aa, Borrelia afzelii
FYSAFIVSEKV

SEQ ID NO: 198601 - protein, 11 aa, Borrelia afzelii
YSAFIVSEKVE

SEQ ID NO: 198602 - protein, 11 aa, Borrelia afzelii
SAFIVSEKVEV

SEQ ID NO: 198603 - protein, 11 aa, Borrelia afzelii
AFIVSEKVEVT

SEQ ID NO: 198604 - protein, 11 aa, Borrelia afzelii
FIVSEKVEVTS

SEQ ID NO: 198605 - protein, 11 aa, Borrelia afzelii
IVSEKVEVTSK

SEQ ID NO: 198606 - protein, 11 aa, Borrelia afzelii
VSEKVEVTSKK

SEQ ID NO: 198607 - protein, 11 aa, Borrelia afzelii
SEKVEVTSKKA

SEQ ID NO: 198608 - protein, 11 aa, Borrelia afzelii
EKVEVTSKKAL

SEQ ID NO: 198609 - protein, 11 aa, Borrelia afzelii
KVEVTSKKALE

SEQ ID NO: 198610 - protein, 11 aa, Borrelia afzelii
VEVTSKKALES

SEQ ID NO: 198611 - protein, 11 aa, Borrelia afzelii
EVTSKKALESD

SEQ ID NO: 198612 - protein, 11 aa, Borrelia afzelii
VTSKKALESDA

SEQ ID NO: 198613 - protein, 11 aa, Borrelia afzelii
TSKKALESDAY

SEQ ID NO: 198614 - protein, 11 aa, Borrelia afzelii
SKKALESDAYI

SEQ ID NO: 198615 - protein, 11 aa, Borrelia afzelii
KKALESDAYIW

SEQ ID NO: 198616 - protein, 11 aa, Borrelia afzelii
KALESDAYIWS

SEQ ID NO: 198617 - protein, 11 aa, Borrelia afzelii
ALESDAYIWSS

SEQ ID NO: 198618 - protein, 11 aa, Borrelia afzelii
LESDAYIWSSD

SEQ ID NO: 198619 - protein, 11 aa, Borrelia afzelii
ESDAYIWSSDG

SEQ ID NO: 198620 - protein, 11 aa, Borrelia afzelii
SDAYIWSSDGK

SEQ ID NO: 198621 - protein, 11 aa, Borrelia afzelii
DAYIWSSDGKT

SEQ ID NO: 198622 - protein, 11 aa, Borrelia afzelii
AYIWSSDGKTG

SEQ ID NO: 198623 - protein, 11 aa, Borrelia afzelii
YIWSSDGKTGY

SEQ ID NO: 198624 - protein, 11 aa, Borrelia afzelii
IWSSDGKTGYE

SEQ ID NO: 198625 - protein, 11 aa, Borrelia afzelii
WSSDGKTGYEI

SEQ ID NO: 198626 - protein, 11 aa, Borrelia afzelii
SSDGKTGYEIE

SEQ ID NO: 198627 - protein, 11 aa, Borrelia afzelii
SDGKTGYEIEK

SEQ ID NO: 198628 - protein, 11 aa, Borrelia afzelii
DGKTGYEIEKA

SEQ ID NO: 198629 - protein, 11 aa, Borrelia afzelii
GKTGYEIEKAK

SEQ ID NO: 198630 - protein, 11 aa, Borrelia afzelii
KTGYEIEKAKK

SEQ ID NO: 198631 - protein, 11 aa, Borrelia afzelii
TGYEIEKAKKE

SEQ ID NO: 198632 - protein, 11 aa, Borrelia afzelii
GYEIEKAKKED

SEQ ID NO: 198633 - protein, 11 aa, Borrelia afzelii
YEIEKAKKEDP

SEQ ID NO: 198634 - protein, 11 aa, Borrelia afzelii
EIEKAKKEDPG

SEQ ID NO: 198635 - protein, 11 aa, Borrelia afzelii
IEKAKKEDPGT

SEQ ID NO: 198636 - protein, 11 aa, Borrelia afzelii
EKAKKEDPGTE

SEQ ID NO: 198637 - protein, 11 aa, Borrelia afzelii
KAKKEDPGTEI

SEQ ID NO: 198638 - protein, 11 aa, Borrelia afzelii
AKKEDPGTEIK

SEQ ID NO: 198639 - protein, 11 aa, Borrelia afzelii
KKEDPGTEIKL

SEQ ID NO: 198640 - protein, 11 aa, Borrelia afzelii
KEDPGTEIKLY

SEQ ID NO: 198641 - protein, 11 aa, Borrelia afzelii
EDPGTEIKLYL

SEQ ID NO: 198642 - protein, 11 aa, Borrelia afzelii
DPGTEIKLYLN

SEQ ID NO: 198643 - protein, 11 aa, Borrelia afzelii
PGTEIKLYLNK

SEQ ID NO: 198644 - protein, 11 aa, Borrelia afzelii
GTEIKLYLNKE

SEQ ID NO: 198645 - protein, 11 aa, Borrelia afzelii
TEIKLYLNKEG

SEQ ID NO: 198646 - protein, 11 aa, Borrelia afzelii
EIKLYLNKEGL

SEQ ID NO: 198647 - protein, 11 aa, Borrelia afzelii
IKLYLNKEGLE

SEQ ID NO: 198648 - protein, 11 aa, Borrelia afzelii
KLYLNKEGLEY

SEQ ID NO: 198649 - protein, 11 aa, Borrelia afzelii
LYLNKEGLEYA

SEQ ID NO: 198650 - protein, 11 aa, Borrelia afzelii
YLNKEGLEYAN

SEQ ID NO: 198651 - protein, 11 aa, Borrelia afzelii
LNKEGLEYANK

SEQ ID NO: 198652 - protein, 11 aa, Borrelia afzelii
NKEGLEYANKW

SEQ ID NO: 198653 - protein, 11 aa, Borrelia afzelii
KEGLEYANKWK

SEQ ID NO: 198654 - protein, 11 aa, Borrelia afzelii
EGLEYANKWKI

SEQ ID NO: 198655 - protein, 11 aa, Borrelia afzelii
GLEYANKWKIQ

SEQ ID NO: 198656 - protein, 11 aa, Borrelia afzelii
LEYANKWKIQE

SEQ ID NO: 198657 - protein, 11 aa, Borrelia afzelii
EYANKWKIQEI

SEQ ID NO: 198658 - protein, 11 aa, Borrelia afzelii
YANKWKIQEIV

SEQ ID NO: 198659 - protein, 11 aa, Borrelia afzelii
ANKWKIQEIVK

SEQ ID NO: 198660 - protein, 11 aa, Borrelia afzelii
NKWKIQEIVKK

SEQ ID NO: 198661 - protein, 11 aa, Borrelia afzelii
KWKIQEIVKKY

SEQ ID NO: 198662 - protein, 11 aa, Borrelia afzelii
WKIQEIVKKYS

SEQ ID NO: 198663 - protein, 11 aa, Borrelia afzelii
KIQEIVKKYSN

SEQ ID NO: 198664 - protein, 11 aa, Borrelia afzelii
IQEIVKKYSNH

SEQ ID NO: 198665 - protein, 11 aa, Borrelia afzelii
QEIVKKYSNHI

SEQ ID NO: 198666 - protein, 11 aa, Borrelia afzelii
EIVKKYSNHIN

SEQ ID NO: 198667 - protein, 11 aa, Borrelia afzelii
IVKKYSNHINY

SEQ ID NO: 198668 - protein, 11 aa, Borrelia afzelii
VKKYSNHINYP

SEQ ID NO: 198669 - protein, 11 aa, Borrelia afzelii
KKYSNHINYPI

SEQ ID NO: 198670 - protein, 11 aa, Borrelia afzelii
KYSNHINYPIY

SEQ ID NO: 198671 - protein, 11 aa, Borrelia afzelii
YSNHINYPIYI

SEQ ID NO: 198672 - protein, 11 aa, Borrelia afzelii
SNHINYPIYIK

SEQ ID NO: 198673 - protein, 11 aa, Borrelia afzelii
NHINYPIYIKY

SEQ ID NO: 198674 - protein, 11 aa, Borrelia afzelii
HINYPIYIKYN

SEQ ID NO: 198675 - protein, 11 aa, Borrelia afzelii
INYPIYIKYNE

SEQ ID NO: 198676 - protein, 11 aa, Borrelia afzelii
NYPIYIKYNEP

SEQ ID NO: 198677 - protein, 11 aa, Borrelia afzelii
YPIYIKYNEPI

SEQ ID NO: 198678 - protein, 11 aa, Borrelia afzelii
PIYIKYNEPIM

SEQ ID NO: 198679 - protein, 11 aa, Borrelia afzelii
IYIKYNEPIMK

SEQ ID NO: 198680 - protein, 11 aa, Borrelia afzelii
YIKYNEPIMKD

SEQ ID NO: 198681 - protein, 11 aa, Borrelia afzelii
IKYNEPIMKDG

SEQ ID NO: 198682 - protein, 11 aa, Borrelia afzelii
KYNEPIMKDGK

SEQ ID NO: 198683 - protein, 11 aa, Borrelia afzelii
YNEPIMKDGKQ

SEQ ID NO: 198684 - protein, 11 aa, Borrelia afzelii
NEPIMKDGKQE

SEQ ID NO: 198685 - protein, 11 aa, Borrelia afzelii
EPIMKDGKQEG

SEQ ID NO: 198686 - protein, 11 aa, Borrelia afzelii
PIMKDGKQEGI

SEQ ID NO: 198687 - protein, 11 aa, Borrelia afzelii
IMKDGKQEGIE

SEQ ID NO: 198688 - protein, 11 aa, Borrelia afzelii
MKDGKQEGIEE

SEQ ID NO: 198689 - protein, 11 aa, Borrelia afzelii
KDGKQEGIEEK

SEQ ID NO: 198690 - protein, 11 aa, Borrelia afzelii
DGKQEGIEEKE

SEQ ID NO: 198691 - protein, 11 aa, Borrelia afzelii
GKQEGIEEKEE

SEQ ID NO: 198692 - protein, 11 aa, Borrelia afzelii
KQEGIEEKEEK

SEQ ID NO: 198693 - protein, 11 aa, Borrelia afzelii
QEGIEEKEEKL

SEQ ID NO: 198694 - protein, 11 aa, Borrelia afzelii
EGIEEKEEKLN

SEQ ID NO: 198695 - protein, 11 aa, Borrelia afzelii
GIEEKEEKLNE

SEQ ID NO: 198696 - protein, 11 aa, Borrelia afzelii
IEEKEEKLNET

SEQ ID NO: 198697 - protein, 11 aa, Borrelia afzelii
EEKEEKLNETT

SEQ ID NO: 198698 - protein, 11 aa, Borrelia afzelii
EKEEKLNETTA

SEQ ID NO: 198699 - protein, 11 aa, Borrelia afzelii
KEEKLNETTAL

SEQ ID NO: 198700 - protein, 11 aa, Borrelia afzelii
EEKLNETTALW

SEQ ID NO: 198701 - protein, 11 aa, Borrelia afzelii
EKLNETTALWT

SEQ ID NO: 198702 - protein, 11 aa, Borrelia afzelii
KLNETTALWTK

SEQ ID NO: 198703 - protein, 11 aa, Borrelia afzelii
LNETTALWTKN

SEQ ID NO: 198704 - protein, 11 aa, Borrelia afzelii
NETTALWTKNK

SEQ ID NO: 198705 - protein, 11 aa, Borrelia afzelii
ETTALWTKNKS

SEQ ID NO: 198706 - protein, 11 aa, Borrelia afzelii
TTALWTKNKSE

SEQ ID NO: 198707 - protein, 11 aa, Borrelia afzelii
TALWTKNKSEI

SEQ ID NO: 198708 - protein, 11 aa, Borrelia afzelii
ALWTKNKSEIK

SEQ ID NO: 198709 - protein, 11 aa, Borrelia afzelii
LWTKNKSEIKT

SEQ ID NO: 198710 - protein, 11 aa, Borrelia afzelii
WTKNKSEIKTE

SEQ ID NO: 198711 - protein, 11 aa, Borrelia afzelii
TKNKSEIKTEE

SEQ ID NO: 198712 - protein, 11 aa, Borrelia afzelii
KNKSEIKTEEY

SEQ ID NO: 198713 - protein, 11 aa, Borrelia afzelii
NKSEIKTEEYN

SEQ ID NO: 198714 - protein, 11 aa, Borrelia afzelii
KSEIKTEEYNE

SEQ ID NO: 198715 - protein, 11 aa, Borrelia afzelii
SEIKTEEYNEF

SEQ ID NO: 198716 - protein, 11 aa, Borrelia afzelii
EIKTEEYNEFY

SEQ ID NO: 198717 - protein, 11 aa, Borrelia afzelii
IKTEEYNEFYK

SEQ ID NO: 198718 - protein, 11 aa, Borrelia afzelii
KTEEYNEFYKN

SEQ ID NO: 198719 - protein, 11 aa, Borrelia afzelii
TEEYNEFYKNT

SEQ ID NO: 198720 - protein, 11 aa, Borrelia afzelii
EEYNEFYKNTT

SEQ ID NO: 198721 - protein, 11 aa, Borrelia afzelii
EYNEFYKNTTF

SEQ ID NO: 198722 - protein, 11 aa, Borrelia afzelii
YNEFYKNTTFD

SEQ ID NO: 198723 - protein, 11 aa, Borrelia afzelii
NEFYKNTTFDY

SEQ ID NO: 198724 - protein, 11 aa, Borrelia afzelii
EFYKNTTFDYE

SEQ ID NO: 198725 - protein, 11 aa, Borrelia afzelii
FYKNTTFDYEN

SEQ ID NO: 198726 - protein, 11 aa, Borrelia afzelii
YKNTTFDYENP

SEQ ID NO: 198727 - protein, 11 aa, Borrelia afzelii
KNTTFDYENPL

SEQ ID NO: 198728 - protein, 11 aa, Borrelia afzelii
NTTFDYENPLM

SEQ ID NO: 198729 - protein, 11 aa, Borrelia afzelii
TTFDYENPLMY

SEQ ID NO: 198730 - protein, 11 aa, Borrelia afzelii
TFDYENPLMYI

SEQ ID NO: 198731 - protein, 11 aa, Borrelia afzelii
FDYENPLMYIH

SEQ ID NO: 198732 - protein, 11 aa, Borrelia afzelii
DYENPLMYIHT

SEQ ID NO: 198733 - protein, 11 aa, Borrelia afzelii
YENPLMYIHTK

SEQ ID NO: 198734 - protein, 11 aa, Borrelia afzelii
ENPLMYIHTKA

SEQ ID NO: 198735 - protein, 11 aa, Borrelia afzelii
NPLMYIHTKAE

SEQ ID NO: 198736 - protein, 11 aa, Borrelia afzelii
PLMYIHTKAEG

SEQ ID NO: 198737 - protein, 11 aa, Borrelia afzelii
LMYIHTKAEGN

SEQ ID NO: 198738 - protein, 11 aa, Borrelia afzelii
MYIHTKAEGNL

SEQ ID NO: 198739 - protein, 11 aa, Borrelia afzelii
YIHTKAEGNLE

SEQ ID NO: 198740 - protein, 11 aa, Borrelia afzelii
IHTKAEGNLEY

SEQ ID NO: 198741 - protein, 11 aa, Borrelia afzelii
HTKAEGNLEYT

SEQ ID NO: 198742 - protein, 11 aa, Borrelia afzelii
TKAEGNLEYTN

SEQ ID NO: 198743 - protein, 11 aa, Borrelia afzelii
KAEGNLEYTNL

SEQ ID NO: 198744 - protein, 11 aa, Borrelia afzelii
AEGNLEYTNLF

SEQ ID NO: 198745 - protein, 11 aa, Borrelia afzelii
EGNLEYTNLFY

SEQ ID NO: 198746 - protein, 11 aa, Borrelia afzelii
GNLEYTNLFYI

SEQ ID NO: 198747 - protein, 11 aa, Borrelia afzelii
NLEYTNLFYIP

SEQ ID NO: 198748 - protein, 11 aa, Borrelia afzelii
LEYTNLFYIPS

SEQ ID NO: 198749 - protein, 11 aa, Borrelia afzelii
EYTNLFYIPSK

SEQ ID NO: 198750 - protein, 11 aa, Borrelia afzelii
YTNLFYIPSKA

SEQ ID NO: 198751 - protein, 11 aa, Borrelia afzelii
TNLFYIPSKAP

SEQ ID NO: 198752 - protein, 11 aa, Borrelia afzelii
NLFYIPSKAPY

SEQ ID NO: 198753 - protein, 11 aa, Borrelia afzelii
LFYIPSKAPYD

SEQ ID NO: 198754 - protein, 11 aa, Borrelia afzelii
FYIPSKAPYDL

SEQ ID NO: 198755 - protein, 11 aa, Borrelia afzelii
YIPSKAPYDLY

SEQ ID NO: 198756 - protein, 11 aa, Borrelia afzelii
IPSKAPYDLYY

SEQ ID NO: 198757 - protein, 11 aa, Borrelia afzelii
PSKAPYDLYYP

SEQ ID NO: 198758 - protein, 11 aa, Borrelia afzelii
SKAPYDLYYPN

SEQ ID NO: 198759 - protein, 11 aa, Borrelia afzelii
KAPYDLYYPNT

SEQ ID NO: 198760 - protein, 11 aa, Borrelia afzelii
APYDLYYPNTK

SEQ ID NO: 198761 - protein, 11 aa, Borrelia afzelii
PYDLYYPNTKP

SEQ ID NO: 198762 - protein, 11 aa, Borrelia afzelii
YDLYYPNTKPG

SEQ ID NO: 198763 - protein, 11 aa, Borrelia afzelii
DLYYPNTKPGV

SEQ ID NO: 198764 - protein, 11 aa, Borrelia afzelii
LYYPNTKPGVK

SEQ ID NO: 198765 - protein, 11 aa, Borrelia afzelii
YYPNTKPGVKL

SEQ ID NO: 198766 - protein, 11 aa, Borrelia afzelii
YPNTKPGVKLF

SEQ ID NO: 198767 - protein, 11 aa, Borrelia afzelii
PNTKPGVKLFI

SEQ ID NO: 198768 - protein, 11 aa, Borrelia afzelii
NTKPGVKLFIN

SEQ ID NO: 198769 - protein, 11 aa, Borrelia afzelii
TKPGVKLFINR

SEQ ID NO: 198770 - protein, 11 aa, Borrelia afzelii
KPGVKLFINRI

SEQ ID NO: 198771 - protein, 11 aa, Borrelia afzelii
PGVKLFINRIF

SEQ ID NO: 198772 - protein, 11 aa, Borrelia afzelii
GVKLFINRIFI

SEQ ID NO: 198773 - protein, 11 aa, Borrelia afzelii
VKLFINRIFIT

SEQ ID NO: 198774 - protein, 11 aa, Borrelia afzelii
KLFINRIFITD

SEQ ID NO: 198775 - protein, 11 aa, Borrelia afzelii
LFINRIFITDS

SEQ ID NO: 198776 - protein, 11 aa, Borrelia afzelii
FINRIFITDSE

SEQ ID NO: 198777 - protein, 11 aa, Borrelia afzelii
INRIFITDSEG

SEQ ID NO: 198778 - protein, 11 aa, Borrelia afzelii
NRIFITDSEGS

SEQ ID NO: 198779 - protein, 11 aa, Borrelia afzelii
RIFITDSEGSL

SEQ ID NO: 198780 - protein, 11 aa, Borrelia afzelii
IFITDSEGSLL

SEQ ID NO: 198781 - protein, 11 aa, Borrelia afzelii
FITDSEGSLLP

SEQ ID NO: 198782 - protein, 11 aa, Borrelia afzelii
ITDSEGSLLPN

SEQ ID NO: 198783 - protein, 11 aa, Borrelia afzelii
TDSEGSLLPNY

SEQ ID NO: 198784 - protein, 11 aa, Borrelia afzelii
DSEGSLLPNYL

SEQ ID NO: 198785 - protein, 11 aa, Borrelia afzelii
SEGSLLPNYLR

SEQ ID NO: 198786 - protein, 11 aa, Borrelia afzelii
EGSLLPNYLRF

SEQ ID NO: 198787 - protein, 11 aa, Borrelia afzelii
GSLLPNYLRFI

SEQ ID NO: 198788 - protein, 11 aa, Borrelia afzelii
SLLPNYLRFIK

SEQ ID NO: 198789 - protein, 11 aa, Borrelia afzelii
LLPNYLRFIKG

SEQ ID NO: 198790 - protein, 11 aa, Borrelia afzelii
LPNYLRFIKGI

SEQ ID NO: 198791 - protein, 11 aa, Borrelia afzelii
PNYLRFIKGII

SEQ ID NO: 198792 - protein, 11 aa, Borrelia afzelii
NYLRFIKGIID

SEQ ID NO: 198793 - protein, 11 aa, Borrelia afzelii
YLRFIKGIIDC

SEQ ID NO: 198794 - protein, 11 aa, Borrelia afzelii
LRFIKGIIDCQ

SEQ ID NO: 198795 - protein, 11 aa, Borrelia afzelii
RFIKGIIDCQD

SEQ ID NO: 198796 - protein, 11 aa, Borrelia afzelii
FIKGIIDCQDL

SEQ ID NO: 198797 - protein, 11 aa, Borrelia afzelii
IKGIIDCQDLP

SEQ ID NO: 198798 - protein, 11 aa, Borrelia afzelii
KGIIDCQDLPL

SEQ ID NO: 198799 - protein, 11 aa, Borrelia afzelii
GIIDCQDLPLN

SEQ ID NO: 198800 - protein, 11 aa, Borrelia afzelii
IIDCQDLPLNV

SEQ ID NO: 198801 - protein, 11 aa, Borrelia afzelii
IDCQDLPLNVS

SEQ ID NO: 198802 - protein, 11 aa, Borrelia afzelii
DCQDLPLNVSR

SEQ ID NO: 198803 - protein, 11 aa, Borrelia afzelii
CQDLPLNVSRE

SEQ ID NO: 198804 - protein, 11 aa, Borrelia afzelii
QDLPLNVSREI

SEQ ID NO: 198805 - protein, 11 aa, Borrelia afzelii
DLPLNVSREIL

SEQ ID NO: 198806 - protein, 11 aa, Borrelia afzelii
LPLNVSREILQ

SEQ ID NO: 198807 - protein, 11 aa, Borrelia afzelii
PLNVSREILQQ

SEQ ID NO: 198808 - protein, 11 aa, Borrelia afzelii
LNVSREILQQN

SEQ ID NO: 198809 - protein, 11 aa, Borrelia afzelii
NVSREILQQNK

SEQ ID NO: 198810 - protein, 11 aa, Borrelia afzelii
VSREILQQNKI

SEQ ID NO: 198811 - protein, 11 aa, Borrelia afzelii
SREILQQNKIL

SEQ ID NO: 198812 - protein, 11 aa, Borrelia afzelii
REILQQNKILS

SEQ ID NO: 198813 - protein, 11 aa, Borrelia afzelii
EILQQNKILSK

SEQ ID NO: 198814 - protein, 11 aa, Borrelia afzelii
ILQQNKILSKI

SEQ ID NO: 198815 - protein, 11 aa, Borrelia afzelii
LQQNKILSKIK

SEQ ID NO: 198816 - protein, 11 aa, Borrelia afzelii
QQNKILSKIKS

SEQ ID NO: 198817 - protein, 11 aa, Borrelia afzelii
QNKILSKIKSS

SEQ ID NO: 198818 - protein, 11 aa, Borrelia afzelii
NKILSKIKSSS

SEQ ID NO: 198819 - protein, 11 aa, Borrelia afzelii
KILSKIKSSSV

SEQ ID NO: 198820 - protein, 11 aa, Borrelia afzelii
ILSKIKSSSVK

SEQ ID NO: 198821 - protein, 11 aa, Borrelia afzelii
LSKIKSSSVKK

SEQ ID NO: 198822 - protein, 11 aa, Borrelia afzelii
SKIKSSSVKKI

SEQ ID NO: 198823 - protein, 11 aa, Borrelia afzelii
KIKSSSVKKIL

SEQ ID NO: 198824 - protein, 11 aa, Borrelia afzelii
IKSSSVKKILS

SEQ ID NO: 198825 - protein, 11 aa, Borrelia afzelii
KSSSVKKILSE

SEQ ID NO: 198826 - protein, 11 aa, Borrelia afzelii
SSSVKKILSEL

SEQ ID NO: 198827 - protein, 11 aa, Borrelia afzelii
SSVKKILSELE

SEQ ID NO: 198828 - protein, 11 aa, Borrelia afzelii
SVKKILSELEK

SEQ ID NO: 198829 - protein, 11 aa, Borrelia afzelii
VKKILSELEKL

SEQ ID NO: 198830 - protein, 11 aa, Borrelia afzelii
KKILSELEKLS

SEQ ID NO: 198831 - protein, 11 aa, Borrelia afzelii
KILSELEKLSK

SEQ ID NO: 198832 - protein, 11 aa, Borrelia afzelii
ILSELEKLSKK

SEQ ID NO: 198833 - protein, 11 aa, Borrelia afzelii
LSELEKLSKKN

SEQ ID NO: 198834 - protein, 11 aa, Borrelia afzelii
SELEKLSKKNP

SEQ ID NO: 198835 - protein, 11 aa, Borrelia afzelii
ELEKLSKKNPE

SEQ ID NO: 198836 - protein, 11 aa, Borrelia afzelii
LEKLSKKNPEK

SEQ ID NO: 198837 - protein, 11 aa, Borrelia afzelii
EKLSKKNPEKF

SEQ ID NO: 198838 - protein, 11 aa, Borrelia afzelii
KLSKKNPEKFS

SEQ ID NO: 198839 - protein, 11 aa, Borrelia afzelii
LSKKNPEKFSE

SEQ ID NO: 198840 - protein, 11 aa, Borrelia afzelii
SKKNPEKFSEF

SEQ ID NO: 198841 - protein, 11 aa, Borrelia afzelii
KKNPEKFSEFS

SEQ ID NO: 198842 - protein, 11 aa, Borrelia afzelii
KNPEKFSEFSK

SEQ ID NO: 198843 - protein, 11 aa, Borrelia afzelii
NPEKFSEFSKE

SEQ ID NO: 198844 - protein, 11 aa, Borrelia afzelii
PEKFSEFSKEF

SEQ ID NO: 198845 - protein, 11 aa, Borrelia afzelii
EKFSEFSKEFG

SEQ ID NO: 198846 - protein, 11 aa, Borrelia afzelii
KFSEFSKEFGR

SEQ ID NO: 198847 - protein, 11 aa, Borrelia afzelii
FSEFSKEFGRC

SEQ ID NO: 198848 - protein, 11 aa, Borrelia afzelii
SEFSKEFGRCI

SEQ ID NO: 198849 - protein, 11 aa, Borrelia afzelii
EFSKEFGRCIK

SEQ ID NO: 198850 - protein, 11 aa, Borrelia afzelii
FSKEFGRCIKE

SEQ ID NO: 198851 - protein, 11 aa, Borrelia afzelii
SKEFGRCIKEG

SEQ ID NO: 198852 - protein, 11 aa, Borrelia afzelii
KEFGRCIKEGV

SEQ ID NO: 198853 - protein, 11 aa, Borrelia afzelii
EFGRCIKEGVY

SEQ ID NO: 198854 - protein, 11 aa, Borrelia afzelii
FGRCIKEGVYS

SEQ ID NO: 198855 - protein, 11 aa, Borrelia afzelii
GRCIKEGVYSD

SEQ ID NO: 198856 - protein, 11 aa, Borrelia afzelii
RCIKEGVYSDF

SEQ ID NO: 198857 - protein, 11 aa, Borrelia afzelii
CIKEGVYSDFE

SEQ ID NO: 198858 - protein, 11 aa, Borrelia afzelii
IKEGVYSDFEN

SEQ ID NO: 198859 - protein, 11 aa, Borrelia afzelii
KEGVYSDFENR

SEQ ID NO: 198860 - protein, 11 aa, Borrelia afzelii
EGVYSDFENRE

SEQ ID NO: 198861 - protein, 11 aa, Borrelia afzelii
GVYSDFENREK

SEQ ID NO: 198862 - protein, 11 aa, Borrelia afzelii
VYSDFENREKL

SEQ ID NO: 198863 - protein, 11 aa, Borrelia afzelii
YSDFENREKLI

SEQ ID NO: 198864 - protein, 11 aa, Borrelia afzelii
SDFENREKLIS

SEQ ID NO: 198865 - protein, 11 aa, Borrelia afzelii
DFENREKLISL

SEQ ID NO: 198866 - protein, 11 aa, Borrelia afzelii
FENREKLISLI

SEQ ID NO: 198867 - protein, 11 aa, Borrelia afzelii
ENREKLISLIR

SEQ ID NO: 198868 - protein, 11 aa, Borrelia afzelii
NREKLISLIRF

SEQ ID NO: 198869 - protein, 11 aa, Borrelia afzelii
REKLISLIRFK

SEQ ID NO: 198870 - protein, 11 aa, Borrelia afzelii
EKLISLIRFKS

SEQ ID NO: 198871 - protein, 11 aa, Borrelia afzelii
KLISLIRFKSS

SEQ ID NO: 198872 - protein, 11 aa, Borrelia afzelii
LISLIRFKSSS

SEQ ID NO: 198873 - protein, 11 aa, Borrelia afzelii
ISLIRFKSSSV

SEQ ID NO: 198874 - protein, 11 aa, Borrelia afzelii
SLIRFKSSSVD

SEQ ID NO: 198875 - protein, 11 aa, Borrelia afzelii
LIRFKSSSVDG

SEQ ID NO: 198876 - protein, 11 aa, Borrelia afzelii
IRFKSSSVDGF

SEQ ID NO: 198877 - protein, 11 aa, Borrelia afzelii
RFKSSSVDGFV

SEQ ID NO: 198878 - protein, 11 aa, Borrelia afzelii
FKSSSVDGFVS

SEQ ID NO: 198879 - protein, 11 aa, Borrelia afzelii
KSSSVDGFVSF

SEQ ID NO: 198880 - protein, 11 aa, Borrelia afzelii
SSSVDGFVSFK

SEQ ID NO: 198881 - protein, 11 aa, Borrelia afzelii
SSVDGFVSFKE

SEQ ID NO: 198882 - protein, 11 aa, Borrelia afzelii
SVDGFVSFKEY

SEQ ID NO: 198883 - protein, 11 aa, Borrelia afzelii
VDGFVSFKEYK

SEQ ID NO: 198884 - protein, 11 aa, Borrelia afzelii
DGFVSFKEYKE

SEQ ID NO: 198885 - protein, 11 aa, Borrelia afzelii
GFVSFKEYKER

SEQ ID NO: 198886 - protein, 11 aa, Borrelia afzelii
FVSFKEYKERM

SEQ ID NO: 198887 - protein, 11 aa, Borrelia afzelii
VSFKEYKERMN

SEQ ID NO: 198888 - protein, 11 aa, Borrelia afzelii
SFKEYKERMNE

SEQ ID NO: 198889 - protein, 11 aa, Borrelia afzelii
FKEYKERMNEG

SEQ ID NO: 198890 - protein, 11 aa, Borrelia afzelii
KEYKERMNEGQ

SEQ ID NO: 198891 - protein, 11 aa, Borrelia afzelii
EYKERMNEGQK

SEQ ID NO: 198892 - protein, 11 aa, Borrelia afzelii
YKERMNEGQKS

SEQ ID NO: 198893 - protein, 11 aa, Borrelia afzelii
KERMNEGQKSI

SEQ ID NO: 198894 - protein, 11 aa, Borrelia afzelii
ERMNEGQKSIY

SEQ ID NO: 198895 - protein, 11 aa, Borrelia afzelii
RMNEGQKSIYY

SEQ ID NO: 198896 - protein, 11 aa, Borrelia afzelii
MNEGQKSIYYI

SEQ ID NO: 198897 - protein, 11 aa, Borrelia afzelii
NEGQKSIYYIT

SEQ ID NO: 198898 - protein, 11 aa, Borrelia afzelii
EGQKSIYYITG

SEQ ID NO: 198899 - protein, 11 aa, Borrelia afzelii
GQKSIYYITGG

SEQ ID NO: 198900 - protein, 11 aa, Borrelia afzelii
QKSIYYITGGK

SEQ ID NO: 198901 - protein, 11 aa, Borrelia afzelii
KSIYYITGGKE

SEQ ID NO: 198902 - protein, 11 aa, Borrelia afzelii
SIYYITGGKEN

SEQ ID NO: 198903 - protein, 11 aa, Borrelia afzelii
IYYITGGKENI

SEQ ID NO: 198904 - protein, 11 aa, Borrelia afzelii
YYITGGKENIL

SEQ ID NO: 198905 - protein, 11 aa, Borrelia afzelii
YITGGKENILK

SEQ ID NO: 198906 - protein, 11 aa, Borrelia afzelii
ITGGKENILKE

SEQ ID NO: 198907 - protein, 11 aa, Borrelia afzelii
TGGKENILKEN

SEQ ID NO: 198908 - protein, 11 aa, Borrelia afzelii
GGKENILKENP

SEQ ID NO: 198909 - protein, 11 aa, Borrelia afzelii
GKENILKENPI

SEQ ID NO: 198910 - protein, 11 aa, Borrelia afzelii
KENILKENPIV

SEQ ID NO: 198911 - protein, 11 aa, Borrelia afzelii
ENILKENPIVT

SEQ ID NO: 198912 - protein, 11 aa, Borrelia afzelii
NILKENPIVTA

SEQ ID NO: 198913 - protein, 11 aa, Borrelia afzelii
ILKENPIVTAY

SEQ ID NO: 198914 - protein, 11 aa, Borrelia afzelii
LKENPIVTAYK

SEQ ID NO: 198915 - protein, 11 aa, Borrelia afzelii
KENPIVTAYKE

SEQ ID NO: 198916 - protein, 11 aa, Borrelia afzelii
ENPIVTAYKEK

SEQ ID NO: 198917 - protein, 11 aa, Borrelia afzelii
NPIVTAYKEKG

SEQ ID NO: 198918 - protein, 11 aa, Borrelia afzelii
PIVTAYKEKGF

SEQ ID NO: 198919 - protein, 11 aa, Borrelia afzelii
IVTAYKEKGFE

SEQ ID NO: 198920 - protein, 11 aa, Borrelia afzelii
VTAYKEKGFEI

SEQ ID NO: 198921 - protein, 11 aa, Borrelia afzelii
TAYKEKGFEIL

SEQ ID NO: 198922 - protein, 11 aa, Borrelia afzelii
AYKEKGFEILI

SEQ ID NO: 198923 - protein, 11 aa, Borrelia afzelii
YKEKGFEILIM

SEQ ID NO: 198924 - protein, 11 aa, Borrelia afzelii
KEKGFEILIMD

SEQ ID NO: 198925 - protein, 11 aa, Borrelia afzelii
EKGFEILIMDD

SEQ ID NO: 198926 - protein, 11 aa, Borrelia afzelii
KGFEILIMDDE

SEQ ID NO: 198927 - protein, 11 aa, Borrelia afzelii
GFEILIMDDEL

SEQ ID NO: 198928 - protein, 11 aa, Borrelia afzelii
FEILIMDDELD

SEQ ID NO: 198929 - protein, 11 aa, Borrelia afzelii
EILIMDDELDE

SEQ ID NO: 198930 - protein, 11 aa, Borrelia afzelii
ILIMDDELDEA

SEQ ID NO: 198931 - protein, 11 aa, Borrelia afzelii
LIMDDELDEAI

SEQ ID NO: 198932 - protein, 11 aa, Borrelia afzelii
IMDDELDEAIL

SEQ ID NO: 198933 - protein, 11 aa, Borrelia afzelii
MDDELDEAILN

SEQ ID NO: 198934 - protein, 11 aa, Borrelia afzelii
DDELDEAILNL

SEQ ID NO: 198935 - protein, 11 aa, Borrelia afzelii
DELDEAILNLI

SEQ ID NO: 198936 - protein, 11 aa, Borrelia afzelii
ELDEAILNLIP

SEQ ID NO: 198937 - protein, 11 aa, Borrelia afzelii
LDEAILNLIPE

SEQ ID NO: 198938 - protein, 11 aa, Borrelia afzelii
DEAILNLIPEY

SEQ ID NO: 198939 - protein, 11 aa, Borrelia afzelii
EAILNLIPEYE

SEQ ID NO: 198940 - protein, 11 aa, Borrelia afzelii
AILNLIPEYEG

SEQ ID NO: 198941 - protein, 11 aa, Borrelia afzelii
ILNLIPEYEGL

SEQ ID NO: 198942 - protein, 11 aa, Borrelia afzelii
LNLIPEYEGLK

SEQ ID NO: 198943 - protein, 11 aa, Borrelia afzelii
NLIPEYEGLKL

SEQ ID NO: 198944 - protein, 11 aa, Borrelia afzelii
LIPEYEGLKLK

SEQ ID NO: 198945 - protein, 11 aa, Borrelia afzelii
IPEYEGLKLKA

SEQ ID NO: 198946 - protein, 11 aa, Borrelia afzelii
PEYEGLKLKAI

SEQ ID NO: 198947 - protein, 11 aa, Borrelia afzelii
EYEGLKLKAIN

SEQ ID NO: 198948 - protein, 11 aa, Borrelia afzelii
YEGLKLKAINK

SEQ ID NO: 198949 - protein, 11 aa, Borrelia afzelii
EGLKLKAINKN

SEQ ID NO: 198950 - protein, 11 aa, Borrelia afzelii
GLKLKAINKNE

SEQ ID NO: 198951 - protein, 11 aa, Borrelia afzelii
LKLKAINKNET

SEQ ID NO: 198952 - protein, 11 aa, Borrelia afzelii
KLKAINKNETS

SEQ ID NO: 198953 - protein, 11 aa, Borrelia afzelii
LKAINKNETSN

SEQ ID NO: 198954 - protein, 11 aa, Borrelia afzelii
KAINKNETSNE

SEQ ID NO: 198955 - protein, 11 aa, Borrelia afzelii
AINKNETSNEL

SEQ ID NO: 198956 - protein, 11 aa, Borrelia afzelii
INKNETSNELK

SEQ ID NO: 198957 - protein, 11 aa, Borrelia afzelii
NKNETSNELKD

SEQ ID NO: 198958 - protein, 11 aa, Borrelia afzelii
KNETSNELKDE

SEQ ID NO: 198959 - protein, 11 aa, Borrelia afzelii
NETSNELKDEN

SEQ ID NO: 198960 - protein, 11 aa, Borrelia afzelii
ETSNELKDENF

SEQ ID NO: 198961 - protein, 11 aa, Borrelia afzelii
TSNELKDENFK

SEQ ID NO: 198962 - protein, 11 aa, Borrelia afzelii
SNELKDENFKK

SEQ ID NO: 198963 - protein, 11 aa, Borrelia afzelii
NELKDENFKKI

SEQ ID NO: 198964 - protein, 11 aa, Borrelia afzelii
ELKDENFKKIE

SEQ ID NO: 198965 - protein, 11 aa, Borrelia afzelii
LKDENFKKIEE

SEQ ID NO: 198966 - protein, 11 aa, Borrelia afzelii
KDENFKKIEEE

SEQ ID NO: 198967 - protein, 11 aa, Borrelia afzelii
DENFKKIEEEF

SEQ ID NO: 198968 - protein, 11 aa, Borrelia afzelii
ENFKKIEEEFK

SEQ ID NO: 198969 - protein, 11 aa, Borrelia afzelii
NFKKIEEEFKD

SEQ ID NO: 198970 - protein, 11 aa, Borrelia afzelii
FKKIEEEFKDT

SEQ ID NO: 198971 - protein, 11 aa, Borrelia afzelii
KKIEEEFKDTL

SEQ ID NO: 198972 - protein, 11 aa, Borrelia afzelii
KIEEEFKDTLT

SEQ ID NO: 198973 - protein, 11 aa, Borrelia afzelii
IEEEFKDTLTR

SEQ ID NO: 198974 - protein, 11 aa, Borrelia afzelii
EEEFKDTLTRV

SEQ ID NO: 198975 - protein, 11 aa, Borrelia afzelii
EEFKDTLTRVK

SEQ ID NO: 198976 - protein, 11 aa, Borrelia afzelii
EFKDTLTRVKE

SEQ ID NO: 198977 - protein, 11 aa, Borrelia afzelii
FKDTLTRVKEI

SEQ ID NO: 198978 - protein, 11 aa, Borrelia afzelii
KDTLTRVKEIL

SEQ ID NO: 198979 - protein, 11 aa, Borrelia afzelii
DTLTRVKEILK

SEQ ID NO: 198980 - protein, 11 aa, Borrelia afzelii
TLTRVKEILKD

SEQ ID NO: 198981 - protein, 11 aa, Borrelia afzelii
LTRVKEILKDQ

SEQ ID NO: 198982 - protein, 11 aa, Borrelia afzelii
TRVKEILKDQI

SEQ ID NO: 198983 - protein, 11 aa, Borrelia afzelii
RVKEILKDQIK

SEQ ID NO: 198984 - protein, 11 aa, Borrelia afzelii
VKEILKDQIKE

SEQ ID NO: 198985 - protein, 11 aa, Borrelia afzelii
KEILKDQIKEV

SEQ ID NO: 198986 - protein, 11 aa, Borrelia afzelii
EILKDQIKEVN

SEQ ID NO: 198987 - protein, 11 aa, Borrelia afzelii
ILKDQIKEVNL

SEQ ID NO: 198988 - protein, 11 aa, Borrelia afzelii
LKDQIKEVNLS

SEQ ID NO: 198989 - protein, 11 aa, Borrelia afzelii
KDQIKEVNLSA

SEQ ID NO: 198990 - protein, 11 aa, Borrelia afzelii
DQIKEVNLSAT

SEQ ID NO: 198991 - protein, 11 aa, Borrelia afzelii
QIKEVNLSATL

SEQ ID NO: 198992 - protein, 11 aa, Borrelia afzelii
IKEVNLSATLI

SEQ ID NO: 198993 - protein, 11 aa, Borrelia afzelii
KEVNLSATLIK

SEQ ID NO: 198994 - protein, 11 aa, Borrelia afzelii
EVNLSATLIKE

SEQ ID NO: 198995 - protein, 11 aa, Borrelia afzelii
VNLSATLIKEP

SEQ ID NO: 198996 - protein, 11 aa, Borrelia afzelii
NLSATLIKEPS

SEQ ID NO: 198997 - protein, 11 aa, Borrelia afzelii
LSATLIKEPSA

SEQ ID NO: 198998 - protein, 11 aa, Borrelia afzelii
SATLIKEPSAI

SEQ ID NO: 198999 - protein, 11 aa, Borrelia afzelii
ATLIKEPSAII

SEQ ID NO: 199000 - protein, 11 aa, Borrelia afzelii
TLIKEPSAIIV

SEQ ID NO: 199001 - protein, 11 aa, Borrelia afzelii
LIKEPSAIIVD

SEQ ID NO: 199002 - protein, 11 aa, Borrelia afzelii
IKEPSAIIVDS

SEQ ID NO: 199003 - protein, 11 aa, Borrelia afzelii
KEPSAIIVDSN

SEQ ID NO: 199004 - protein, 11 aa, Borrelia afzelii
EPSAIIVDSND

SEQ ID NO: 199005 - protein, 11 aa, Borrelia afzelii
PSAIIVDSNDP

SEQ ID NO: 199006 - protein, 11 aa, Borrelia afzelii
SAIIVDSNDPT

SEQ ID NO: 199007 - protein, 11 aa, Borrelia afzelii
AIIVDSNDPTY

SEQ ID NO: 199008 - protein, 11 aa, Borrelia afzelii
IIVDSNDPTYQ

SEQ ID NO: 199009 - protein, 11 aa, Borrelia afzelii
IVDSNDPTYQM

SEQ ID NO: 199010 - protein, 11 aa, Borrelia afzelii
VDSNDPTYQMQ

SEQ ID NO: 199011 - protein, 11 aa, Borrelia afzelii
DSNDPTYQMQK

SEQ ID NO: 199012 - protein, 11 aa, Borrelia afzelii
SNDPTYQMQKI

SEQ ID NO: 199013 - protein, 11 aa, Borrelia afzelii
NDPTYQMQKIM

SEQ ID NO: 199014 - protein, 11 aa, Borrelia afzelii
DPTYQMQKIML

SEQ ID NO: 199015 - protein, 11 aa, Borrelia afzelii
PTYQMQKIMLS

SEQ ID NO: 199016 - protein, 11 aa, Borrelia afzelii
TYQMQKIMLSM

SEQ ID NO: 199017 - protein, 11 aa, Borrelia afzelii
YQMQKIMLSMG

SEQ ID NO: 199018 - protein, 11 aa, Borrelia afzelii
QMQKIMLSMGQ

SEQ ID NO: 199019 - protein, 11 aa, Borrelia afzelii
MQKIMLSMGQE

SEQ ID NO: 199020 - protein, 11 aa, Borrelia afzelii
QKIMLSMGQEV

SEQ ID NO: 199021 - protein, 11 aa, Borrelia afzelii
KIMLSMGQEVK

SEQ ID NO: 199022 - protein, 11 aa, Borrelia afzelii
IMLSMGQEVKE

SEQ ID NO: 199023 - protein, 11 aa, Borrelia afzelii
MLSMGQEVKEI

SEQ ID NO: 199024 - protein, 11 aa, Borrelia afzelii
LSMGQEVKEIK

SEQ ID NO: 199025 - protein, 11 aa, Borrelia afzelii
SMGQEVKEIKP

SEQ ID NO: 199026 - protein, 11 aa, Borrelia afzelii
MGQEVKEIKPI

SEQ ID NO: 199027 - protein, 11 aa, Borrelia afzelii
GQEVKEIKPIL

SEQ ID NO: 199028 - protein, 11 aa, Borrelia afzelii
QEVKEIKPILE

SEQ ID NO: 199029 - protein, 11 aa, Borrelia afzelii
EVKEIKPILEL

SEQ ID NO: 199030 - protein, 11 aa, Borrelia afzelii
VKEIKPILELN

SEQ ID NO: 199031 - protein, 11 aa, Borrelia afzelii
KEIKPILELNP

SEQ ID NO: 199032 - protein, 11 aa, Borrelia afzelii
EIKPILELNPN

SEQ ID NO: 199033 - protein, 11 aa, Borrelia afzelii
IKPILELNPNN

SEQ ID NO: 199034 - protein, 11 aa, Borrelia afzelii
KPILELNPNNK

SEQ ID NO: 199035 - protein, 11 aa, Borrelia afzelii
PILELNPNNKI

SEQ ID NO: 199036 - protein, 11 aa, Borrelia afzelii
ILELNPNNKIV

SEQ ID NO: 199037 - protein, 11 aa, Borrelia afzelii
LELNPNNKIVQ

SEQ ID NO: 199038 - protein, 11 aa, Borrelia afzelii
ELNPNNKIVQN

SEQ ID NO: 199039 - protein, 11 aa, Borrelia afzelii
LNPNNKIVQNL

SEQ ID NO: 199040 - protein, 11 aa, Borrelia afzelii
NPNNKIVQNLK

SEQ ID NO: 199041 - protein, 11 aa, Borrelia afzelii
PNNKIVQNLKN

SEQ ID NO: 199042 - protein, 11 aa, Borrelia afzelii
NNKIVQNLKNL

SEQ ID NO: 199043 - protein, 11 aa, Borrelia afzelii
NKIVQNLKNLE

SEQ ID NO: 199044 - protein, 11 aa, Borrelia afzelii
KIVQNLKNLEP

SEQ ID NO: 199045 - protein, 11 aa, Borrelia afzelii
IVQNLKNLEPE

SEQ ID NO: 199046 - protein, 11 aa, Borrelia afzelii
VQNLKNLEPEK

SEQ ID NO: 199047 - protein, 11 aa, Borrelia afzelii
QNLKNLEPEKL

SEQ ID NO: 199048 - protein, 11 aa, Borrelia afzelii
NLKNLEPEKLE

SEQ ID NO: 199049 - protein, 11 aa, Borrelia afzelii
LKNLEPEKLEK

SEQ ID NO: 199050 - protein, 11 aa, Borrelia afzelii
KNLEPEKLEKI

SEQ ID NO: 199051 - protein, 11 aa, Borrelia afzelii
NLEPEKLEKIS

SEQ ID NO: 199052 - protein, 11 aa, Borrelia afzelii
LEPEKLEKISI

SEQ ID NO: 199053 - protein, 11 aa, Borrelia afzelii
EPEKLEKISIL

SEQ ID NO: 199054 - protein, 11 aa, Borrelia afzelii
PEKLEKISILL

SEQ ID NO: 199055 - protein, 11 aa, Borrelia afzelii
EKLEKISILLF

SEQ ID NO: 199056 - protein, 11 aa, Borrelia afzelii
KLEKISILLFE

SEQ ID NO: 199057 - protein, 11 aa, Borrelia afzelii
LEKISILLFEE

SEQ ID NO: 199058 - protein, 11 aa, Borrelia afzelii
EKISILLFEEA

SEQ ID NO: 199059 - protein, 11 aa, Borrelia afzelii
KISILLFEEAL

SEQ ID NO: 199060 - protein, 11 aa, Borrelia afzelii
ISILLFEEALL

SEQ ID NO: 199061 - protein, 11 aa, Borrelia afzelii
SILLFEEALLT

SEQ ID NO: 199062 - protein, 11 aa, Borrelia afzelii
ILLFEEALLTS

SEQ ID NO: 199063 - protein, 11 aa, Borrelia afzelii
LLFEEALLTSG

SEQ ID NO: 199064 - protein, 11 aa, Borrelia afzelii
LFEEALLTSGM

SEQ ID NO: 199065 - protein, 11 aa, Borrelia afzelii
FEEALLTSGMP

SEQ ID NO: 199066 - protein, 11 aa, Borrelia afzelii
EEALLTSGMPS

SEQ ID NO: 199067 - protein, 11 aa, Borrelia afzelii
EALLTSGMPSK

SEQ ID NO: 199068 - protein, 11 aa, Borrelia afzelii
ALLTSGMPSKN

SEQ ID NO: 199069 - protein, 11 aa, Borrelia afzelii
LLTSGMPSKNP

SEQ ID NO: 199070 - protein, 11 aa, Borrelia afzelii
LTSGMPSKNPR

SEQ ID NO: 199071 - protein, 11 aa, Borrelia afzelii
TSGMPSKNPRK

SEQ ID NO: 199072 - protein, 11 aa, Borrelia afzelii
SGMPSKNPRKF

SEQ ID NO: 199073 - protein, 11 aa, Borrelia afzelii
GMPSKNPRKFI

SEQ ID NO: 199074 - protein, 11 aa, Borrelia afzelii
MPSKNPRKFIN

SEQ ID NO: 199075 - protein, 11 aa, Borrelia afzelii
PSKNPRKFINI

SEQ ID NO: 199076 - protein, 11 aa, Borrelia afzelii
SKNPRKFINII

SEQ ID NO: 199077 - protein, 11 aa, Borrelia afzelii
KNPRKFINIIN

SEQ ID NO: 199078 - protein, 11 aa, Borrelia afzelii
NPRKFINIINE

SEQ ID NO: 199079 - protein, 11 aa, Borrelia afzelii
PRKFINIINEF

SEQ ID NO: 199080 - protein, 11 aa, Borrelia afzelii
RKFINIINEFL

SEQ ID NO: 199081 - protein, 11 aa, Borrelia afzelii
KFINIINEFLE

SEQ ID NO: 199082 - protein, 11 aa, Borrelia afzelii
FINIINEFLEK

SEQ ID NO: 199083 - protein, 11 aa, Borrelia afzelii
INIINEFLEKD

SEQ ID NO: 199084 - protein, 11 aa, Borrelia afzelii
NIINEFLEKDL

SEQ ID NO: 199085 - protein, 11 aa, Borrelia afzelii
IINEFLEKDLL

SEQ ID NO: 199086 - protein, 13 aa, Borrelia afzelii
MKKQFDTEVNDLL

SEQ ID NO: 199087 - protein, 13 aa, Borrelia afzelii
KKQFDTEVNDLLY

SEQ ID NO: 199088 - protein, 13 aa, Borrelia afzelii
KQFDTEVNDLLYL

SEQ ID NO: 199089 - protein, 13 aa, Borrelia afzelii
QFDTEVNDLLYLI

SEQ ID NO: 199090 - protein, 13 aa, Borrelia afzelii
FDTEVNDLLYLII

SEQ ID NO: 199091 - protein, 13 aa, Borrelia afzelii
DTEVNDLLYLIIH

SEQ ID NO: 199092 - protein, 13 aa, Borrelia afzelii
TEVNDLLYLIIHS

SEQ ID NO: 199093 - protein, 13 aa, Borrelia afzelii
EVNDLLYLIIHSL

SEQ ID NO: 199094 - protein, 13 aa, Borrelia afzelii
VNDLLYLIIHSLY

SEQ ID NO: 199095 - protein, 13 aa, Borrelia afzelii
NDLLYLIIHSLYS

SEQ ID NO: 199096 - protein, 13 aa, Borrelia afzelii
DLLYLIIHSLYSH

SEQ ID NO: 199097 - protein, 13 aa, Borrelia afzelii
LLYLIIHSLYSHK

SEQ ID NO: 199098 - protein, 13 aa, Borrelia afzelii
LYLIIHSLYSHKE

SEQ ID NO: 199099 - protein, 13 aa, Borrelia afzelii
YLIIHSLYSHKEI

SEQ ID NO: 199100 - protein, 13 aa, Borrelia afzelii
LIIHSLYSHKEIF

SEQ ID NO: 199101 - protein, 13 aa, Borrelia afzelii
IIHSLYSHKEIFL

SEQ ID NO: 199102 - protein, 13 aa, Borrelia afzelii
IHSLYSHKEIFLR

SEQ ID NO: 199103 - protein, 13 aa, Borrelia afzelii
HSLYSHKEIFLRE

SEQ ID NO: 199104 - protein, 13 aa, Borrelia afzelii
SLYSHKEIFLREL

SEQ ID NO: 199105 - protein, 13 aa, Borrelia afzelii
LYSHKEIFLRELI

SEQ ID NO: 199106 - protein, 13 aa, Borrelia afzelii
YSHKEIFLRELIS

SEQ ID NO: 199107 - protein, 13 aa, Borrelia afzelii
SHKEIFLRELISN

SEQ ID NO: 199108 - protein, 13 aa, Borrelia afzelii
HKEIFLRELISNA

SEQ ID NO: 199109 - protein, 13 aa, Borrelia afzelii
KEIFLRELISNAS

SEQ ID NO: 199110 - protein, 13 aa, Borrelia afzelii
EIFLRELISNASD

SEQ ID NO: 199111 - protein, 13 aa, Borrelia afzelii
IFLRELISNASDA

SEQ ID NO: 199112 - protein, 13 aa, Borrelia afzelii
FLRELISNASDAI

SEQ ID NO: 199113 - protein, 13 aa, Borrelia afzelii
LRELISNASDAID

SEQ ID NO: 199114 - protein, 13 aa, Borrelia afzelii
RELISNASDAIDK

SEQ ID NO: 199115 - protein, 13 aa, Borrelia afzelii
ELISNASDAIDKL

SEQ ID NO: 199116 - protein, 13 aa, Borrelia afzelii
LISNASDAIDKLK

SEQ ID NO: 199117 - protein, 13 aa, Borrelia afzelii
ISNASDAIDKLKF

SEQ ID NO: 199118 - protein, 13 aa, Borrelia afzelii
SNASDAIDKLKFL

SEQ ID NO: 199119 - protein, 13 aa, Borrelia afzelii
NASDAIDKLKFLS

SEQ ID NO: 199120 - protein, 13 aa, Borrelia afzelii
ASDAIDKLKFLSL

SEQ ID NO: 199121 - protein, 13 aa, Borrelia afzelii
SDAIDKLKFLSLT

SEQ ID NO: 199122 - protein, 13 aa, Borrelia afzelii
DAIDKLKFLSLTN

SEQ ID NO: 199123 - protein, 13 aa, Borrelia afzelii
AIDKLKFLSLTNE

SEQ ID NO: 199124 - protein, 13 aa, Borrelia afzelii
IDKLKFLSLTNEK

SEQ ID NO: 199125 - protein, 13 aa, Borrelia afzelii
DKLKFLSLTNEKF

SEQ ID NO: 199126 - protein, 13 aa, Borrelia afzelii
KLKFLSLTNEKFK

SEQ ID NO: 199127 - protein, 13 aa, Borrelia afzelii
LKFLSLTNEKFKN

SEQ ID NO: 199128 - protein, 13 aa, Borrelia afzelii
KFLSLTNEKFKNI

SEQ ID NO: 199129 - protein, 13 aa, Borrelia afzelii
FLSLTNEKFKNIA

SEQ ID NO: 199130 - protein, 13 aa, Borrelia afzelii
LSLTNEKFKNIAL

SEQ ID NO: 199131 - protein, 13 aa, Borrelia afzelii
SLTNEKFKNIALE

SEQ ID NO: 199132 - protein, 13 aa, Borrelia afzelii
LTNEKFKNIALEP

SEQ ID NO: 199133 - protein, 13 aa, Borrelia afzelii
TNEKFKNIALEPK

SEQ ID NO: 199134 - protein, 13 aa, Borrelia afzelii
NEKFKNIALEPKI

SEQ ID NO: 199135 - protein, 13 aa, Borrelia afzelii
EKFKNIALEPKIE

SEQ ID NO: 199136 - protein, 13 aa, Borrelia afzelii
KFKNIALEPKIEI

SEQ ID NO: 199137 - protein, 13 aa, Borrelia afzelii
FKNIALEPKIEIT

SEQ ID NO: 199138 - protein, 13 aa, Borrelia afzelii
KNIALEPKIEITF

SEQ ID NO: 199139 - protein, 13 aa, Borrelia afzelii
NIALEPKIEITFD

SEQ ID NO: 199140 - protein, 13 aa, Borrelia afzelii
IALEPKIEITFDD

SEQ ID NO: 199141 - protein, 13 aa, Borrelia afzelii
ALEPKIEITFDDK

SEQ ID NO: 199142 - protein, 13 aa, Borrelia afzelii
LEPKIEITFDDKS

SEQ ID NO: 199143 - protein, 13 aa, Borrelia afzelii
EPKIEITFDDKSI

SEQ ID NO: 199144 - protein, 13 aa, Borrelia afzelii
PKIEITFDDKSIL

SEQ ID NO: 199145 - protein, 13 aa, Borrelia afzelii
KIEITFDDKSILI

SEQ ID NO: 199146 - protein, 13 aa, Borrelia afzelii
IEITFDDKSILIK

SEQ ID NO: 199147 - protein, 13 aa, Borrelia afzelii
EITFDDKSILIKD

SEQ ID NO: 199148 - protein, 13 aa, Borrelia afzelii
ITFDDKSILIKDN

SEQ ID NO: 199149 - protein, 13 aa, Borrelia afzelii
TFDDKSILIKDNG

SEQ ID NO: 199150 - protein, 13 aa, Borrelia afzelii
FDDKSILIKDNGI

SEQ ID NO: 199151 - protein, 13 aa, Borrelia afzelii
DDKSILIKDNGIG

SEQ ID NO: 199152 - protein, 13 aa, Borrelia afzelii
DKSILIKDNGIGM

SEQ ID NO: 199153 - protein, 13 aa, Borrelia afzelii
KSILIKDNGIGMN

SEQ ID NO: 199154 - protein, 13 aa, Borrelia afzelii
SILIKDNGIGMNE

SEQ ID NO: 199155 - protein, 13 aa, Borrelia afzelii
ILIKDNGIGMNEQ

SEQ ID NO: 199156 - protein, 13 aa, Borrelia afzelii
LIKDNGIGMNEQE

SEQ ID NO: 199157 - protein, 13 aa, Borrelia afzelii
IKDNGIGMNEQEL

SEQ ID NO: 199158 - protein, 13 aa, Borrelia afzelii
KDNGIGMNEQELT

SEQ ID NO: 199159 - protein, 13 aa, Borrelia afzelii
DNGIGMNEQELTN

SEQ ID NO: 199160 - protein, 13 aa, Borrelia afzelii
NGIGMNEQELTNH

SEQ ID NO: 199161 - protein, 13 aa, Borrelia afzelii
GIGMNEQELTNHL

SEQ ID NO: 199162 - protein, 13 aa, Borrelia afzelii
IGMNEQELTNHLG

SEQ ID NO: 199163 - protein, 13 aa, Borrelia afzelii
GMNEQELTNHLGV

SEQ ID NO: 199164 - protein, 13 aa, Borrelia afzelii
MNEQELTNHLGVI

SEQ ID NO: 199165 - protein, 13 aa, Borrelia afzelii
NEQELTNHLGVIA

SEQ ID NO: 199166 - protein, 13 aa, Borrelia afzelii
EQELTNHLGVIAK

SEQ ID NO: 199167 - protein, 13 aa, Borrelia afzelii
QELTNHLGVIAKS

SEQ ID NO: 199168 - protein, 13 aa, Borrelia afzelii
ELTNHLGVIAKSG

SEQ ID NO: 199169 - protein, 13 aa, Borrelia afzelii
LTNHLGVIAKSGT

SEQ ID NO: 199170 - protein, 13 aa, Borrelia afzelii
TNHLGVIAKSGTK

SEQ ID NO: 199171 - protein, 13 aa, Borrelia afzelii
NHLGVIAKSGTKE

SEQ ID NO: 199172 - protein, 13 aa, Borrelia afzelii
HLGVIAKSGTKEF

SEQ ID NO: 199173 - protein, 13 aa, Borrelia afzelii
LGVIAKSGTKEFI

SEQ ID NO: 199174 - protein, 13 aa, Borrelia afzelii
GVIAKSGTKEFIN

SEQ ID NO: 199175 - protein, 13 aa, Borrelia afzelii
VIAKSGTKEFINN

SEQ ID NO: 199176 - protein, 13 aa, Borrelia afzelii
IAKSGTKEFINNL

SEQ ID NO: 199177 - protein, 13 aa, Borrelia afzelii
AKSGTKEFINNLK

SEQ ID NO: 199178 - protein, 13 aa, Borrelia afzelii
KSGTKEFINNLKQ

SEQ ID NO: 199179 - protein, 13 aa, Borrelia afzelii
SGTKEFINNLKQD

SEQ ID NO: 199180 - protein, 13 aa, Borrelia afzelii
GTKEFINNLKQDE

SEQ ID NO: 199181 - protein, 13 aa, Borrelia afzelii
TKEFINNLKQDEK

SEQ ID NO: 199182 - protein, 13 aa, Borrelia afzelii
KEFINNLKQDEKK

SEQ ID NO: 199183 - protein, 13 aa, Borrelia afzelii
EFINNLKQDEKKS

SEQ ID NO: 199184 - protein, 13 aa, Borrelia afzelii
FINNLKQDEKKSA

SEQ ID NO: 199185 - protein, 13 aa, Borrelia afzelii
INNLKQDEKKSAN

SEQ ID NO: 199186 - protein, 13 aa, Borrelia afzelii
NNLKQDEKKSANL

SEQ ID NO: 199187 - protein, 13 aa, Borrelia afzelii
NLKQDEKKSANLI

SEQ ID NO: 199188 - protein, 13 aa, Borrelia afzelii
LKQDEKKSANLIG

SEQ ID NO: 199189 - protein, 13 aa, Borrelia afzelii
KQDEKKSANLIGQ

SEQ ID NO: 199190 - protein, 13 aa, Borrelia afzelii
QDEKKSANLIGQF

SEQ ID NO: 199191 - protein, 13 aa, Borrelia afzelii
DEKKSANLIGQFG

SEQ ID NO: 199192 - protein, 13 aa, Borrelia afzelii
EKKSANLIGQFGV

SEQ ID NO: 199193 - protein, 13 aa, Borrelia afzelii
KKSANLIGQFGVG

SEQ ID NO: 199194 - protein, 13 aa, Borrelia afzelii
KSANLIGQFGVGF

SEQ ID NO: 199195 - protein, 13 aa, Borrelia afzelii
SANLIGQFGVGFY

SEQ ID NO: 199196 - protein, 13 aa, Borrelia afzelii
ANLIGQFGVGFYS

SEQ ID NO: 199197 - protein, 13 aa, Borrelia afzelii
NLIGQFGVGFYSA

SEQ ID NO: 199198 - protein, 13 aa, Borrelia afzelii
LIGQFGVGFYSAF

SEQ ID NO: 199199 - protein, 13 aa, Borrelia afzelii
IGQFGVGFYSAFI

SEQ ID NO: 199200 - protein, 13 aa, Borrelia afzelii
GQFGVGFYSAFIV

SEQ ID NO: 199201 - protein, 13 aa, Borrelia afzelii
QFGVGFYSAFIVS

SEQ ID NO: 199202 - protein, 13 aa, Borrelia afzelii
FGVGFYSAFIVSE

SEQ ID NO: 199203 - protein, 13 aa, Borrelia afzelii
GVGFYSAFIVSEK

SEQ ID NO: 199204 - protein, 13 aa, Borrelia afzelii
VGFYSAFIVSEKV

SEQ ID NO: 199205 - protein, 13 aa, Borrelia afzelii
GFYSAFIVSEKVE

SEQ ID NO: 199206 - protein, 13 aa, Borrelia afzelii
FYSAFIVSEKVEV

SEQ ID NO: 199207 - protein, 13 aa, Borrelia afzelii
YSAFIVSEKVEVT

SEQ ID NO: 199208 - protein, 13 aa, Borrelia afzelii
SAFIVSEKVEVTS

SEQ ID NO: 199209 - protein, 13 aa, Borrelia afzelii
AFIVSEKVEVTSK

SEQ ID NO: 199210 - protein, 13 aa, Borrelia afzelii
FIVSEKVEVTSKK

SEQ ID NO: 199211 - protein, 13 aa, Borrelia afzelii
IVSEKVEVTSKKA

SEQ ID NO: 199212 - protein, 13 aa, Borrelia afzelii
VSEKVEVTSKKAL

SEQ ID NO: 199213 - protein, 13 aa, Borrelia afzelii
SEKVEVTSKKALE

SEQ ID NO: 199214 - protein, 13 aa, Borrelia afzelii
EKVEVTSKKALES

SEQ ID NO: 199215 - protein, 13 aa, Borrelia afzelii
KVEVTSKKALESD

SEQ ID NO: 199216 - protein, 13 aa, Borrelia afzelii
VEVTSKKALESDA

SEQ ID NO: 199217 - protein, 13 aa, Borrelia afzelii
EVTSKKALESDAY

SEQ ID NO: 199218 - protein, 13 aa, Borrelia afzelii
VTSKKALESDAYI

SEQ ID NO: 199219 - protein, 13 aa, Borrelia afzelii
TSKKALESDAYIW

SEQ ID NO: 199220 - protein, 13 aa, Borrelia afzelii
SKKALESDAYIWS

SEQ ID NO: 199221 - protein, 13 aa, Borrelia afzelii
KKALESDAYIWSS

SEQ ID NO: 199222 - protein, 13 aa, Borrelia afzelii
KALESDAYIWSSD

SEQ ID NO: 199223 - protein, 13 aa, Borrelia afzelii
ALESDAYIWSSDG

SEQ ID NO: 199224 - protein, 13 aa, Borrelia afzelii
LESDAYIWSSDGK

SEQ ID NO: 199225 - protein, 13 aa, Borrelia afzelii
ESDAYIWSSDGKT

SEQ ID NO: 199226 - protein, 13 aa, Borrelia afzelii
SDAYIWSSDGKTG

SEQ ID NO: 199227 - protein, 13 aa, Borrelia afzelii
DAYIWSSDGKTGY

SEQ ID NO: 199228 - protein, 13 aa, Borrelia afzelii
AYIWSSDGKTGYE

SEQ ID NO: 199229 - protein, 13 aa, Borrelia afzelii
YIWSSDGKTGYEI

SEQ ID NO: 199230 - protein, 13 aa, Borrelia afzelii
IWSSDGKTGYEIE

SEQ ID NO: 199231 - protein, 13 aa, Borrelia afzelii
WSSDGKTGYEIEK

SEQ ID NO: 199232 - protein, 13 aa, Borrelia afzelii
SSDGKTGYEIEKA

SEQ ID NO: 199233 - protein, 13 aa, Borrelia afzelii
SDGKTGYEIEKAK

SEQ ID NO: 199234 - protein, 13 aa, Borrelia afzelii
DGKTGYEIEKAKK

SEQ ID NO: 199235 - protein, 13 aa, Borrelia afzelii
GKTGYEIEKAKKE

SEQ ID NO: 199236 - protein, 13 aa, Borrelia afzelii
KTGYEIEKAKKED

SEQ ID NO: 199237 - protein, 13 aa, Borrelia afzelii
TGYEIEKAKKEDP

SEQ ID NO: 199238 - protein, 13 aa, Borrelia afzelii
GYEIEKAKKEDPG

SEQ ID NO: 199239 - protein, 13 aa, Borrelia afzelii
YEIEKAKKEDPGT

SEQ ID NO: 199240 - protein, 13 aa, Borrelia afzelii
EIEKAKKEDPGTE

SEQ ID NO: 199241 - protein, 13 aa, Borrelia afzelii
IEKAKKEDPGTEI

SEQ ID NO: 199242 - protein, 13 aa, Borrelia afzelii
EKAKKEDPGTEIK

SEQ ID NO: 199243 - protein, 13 aa, Borrelia afzelii
KAKKEDPGTEIKL

SEQ ID NO: 199244 - protein, 13 aa, Borrelia afzelii
AKKEDPGTEIKLY

SEQ ID NO: 199245 - protein, 13 aa, Borrelia afzelii
KKEDPGTEIKLYL

SEQ ID NO: 199246 - protein, 13 aa, Borrelia afzelii
KEDPGTEIKLYLN

SEQ ID NO: 199247 - protein, 13 aa, Borrelia afzelii
EDPGTEIKLYLNK

SEQ ID NO: 199248 - protein, 13 aa, Borrelia afzelii
DPGTEIKLYLNKE

SEQ ID NO: 199249 - protein, 13 aa, Borrelia afzelii
PGTEIKLYLNKEG

SEQ ID NO: 199250 - protein, 13 aa, Borrelia afzelii
GTEIKLYLNKEGL

SEQ ID NO: 199251 - protein, 13 aa, Borrelia afzelii
TEIKLYLNKEGLE

SEQ ID NO: 199252 - protein, 13 aa, Borrelia afzelii
EIKLYLNKEGLEY

SEQ ID NO: 199253 - protein, 13 aa, Borrelia afzelii
IKLYLNKEGLEYA

SEQ ID NO: 199254 - protein, 13 aa, Borrelia afzelii
KLYLNKEGLEYAN

SEQ ID NO: 199255 - protein, 13 aa, Borrelia afzelii
LYLNKEGLEYANK

SEQ ID NO: 199256 - protein, 13 aa, Borrelia afzelii
YLNKEGLEYANKW

SEQ ID NO: 199257 - protein, 13 aa, Borrelia afzelii
LNKEGLEYANKWK

SEQ ID NO: 199258 - protein, 13 aa, Borrelia afzelii
NKEGLEYANKWKI

SEQ ID NO: 199259 - protein, 13 aa, Borrelia afzelii
KEGLEYANKWKIQ

SEQ ID NO: 199260 - protein, 13 aa, Borrelia afzelii
EGLEYANKWKIQE

SEQ ID NO: 199261 - protein, 13 aa, Borrelia afzelii
GLEYANKWKIQEI

SEQ ID NO: 199262 - protein, 13 aa, Borrelia afzelii
LEYANKWKIQEIV

SEQ ID NO: 199263 - protein, 13 aa, Borrelia afzelii
EYANKWKIQEIVK

SEQ ID NO: 199264 - protein, 13 aa, Borrelia afzelii
YANKWKIQEIVKK

SEQ ID NO: 199265 - protein, 13 aa, Borrelia afzelii
ANKWKIQEIVKKY

SEQ ID NO: 199266 - protein, 13 aa, Borrelia afzelii
NKWKIQEIVKKYS

SEQ ID NO: 199267 - protein, 13 aa, Borrelia afzelii
KWKIQEIVKKYSN

SEQ ID NO: 199268 - protein, 13 aa, Borrelia afzelii
WKIQEIVKKYSNH

SEQ ID NO: 199269 - protein, 13 aa, Borrelia afzelii
KIQEIVKKYSNHI

SEQ ID NO: 199270 - protein, 13 aa, Borrelia afzelii
IQEIVKKYSNHIN

SEQ ID NO: 199271 - protein, 13 aa, Borrelia afzelii
QEIVKKYSNHINY

SEQ ID NO: 199272 - protein, 13 aa, Borrelia afzelii
EIVKKYSNHINYP

SEQ ID NO: 199273 - protein, 13 aa, Borrelia afzelii
IVKKYSNHINYPI

SEQ ID NO: 199274 - protein, 13 aa, Borrelia afzelii
VKKYSNHINYPIY

SEQ ID NO: 199275 - protein, 13 aa, Borrelia afzelii
KKYSNHINYPIYI

SEQ ID NO: 199276 - protein, 13 aa, Borrelia afzelii
KYSNHINYPIYIK

SEQ ID NO: 199277 - protein, 13 aa, Borrelia afzelii
YSNHINYPIYIKY

SEQ ID NO: 199278 - protein, 13 aa, Borrelia afzelii
SNHINYPIYIKYN

SEQ ID NO: 199279 - protein, 13 aa, Borrelia afzelii
NHINYPIYIKYNE

SEQ ID NO: 199280 - protein, 13 aa, Borrelia afzelii
HINYPIYIKYNEP

SEQ ID NO: 199281 - protein, 13 aa, Borrelia afzelii
INYPIYIKYNEPI

SEQ ID NO: 199282 - protein, 13 aa, Borrelia afzelii
NYPIYIKYNEPIM

SEQ ID NO: 199283 - protein, 13 aa, Borrelia afzelii
YPIYIKYNEPIMK

SEQ ID NO: 199284 - protein, 13 aa, Borrelia afzelii
PIYIKYNEPIMKD

SEQ ID NO: 199285 - protein, 13 aa, Borrelia afzelii
IYIKYNEPIMKDG

SEQ ID NO: 199286 - protein, 13 aa, Borrelia afzelii
YIKYNEPIMKDGK

SEQ ID NO: 199287 - protein, 13 aa, Borrelia afzelii
IKYNEPIMKDGKQ

SEQ ID NO: 199288 - protein, 13 aa, Borrelia afzelii
KYNEPIMKDGKQE

SEQ ID NO: 199289 - protein, 13 aa, Borrelia afzelii
YNEPIMKDGKQEG

SEQ ID NO: 199290 - protein, 13 aa, Borrelia afzelii
NEPIMKDGKQEGI

SEQ ID NO: 199291 - protein, 13 aa, Borrelia afzelii
EPIMKDGKQEGIE

SEQ ID NO: 199292 - protein, 13 aa, Borrelia afzelii
PIMKDGKQEGIEE

SEQ ID NO: 199293 - protein, 13 aa, Borrelia afzelii
IMKDGKQEGIEEK

SEQ ID NO: 199294 - protein, 13 aa, Borrelia afzelii
MKDGKQEGIEEKE

SEQ ID NO: 199295 - protein, 13 aa, Borrelia afzelii
KDGKQEGIEEKEE

SEQ ID NO: 199296 - protein, 13 aa, Borrelia afzelii
DGKQEGIEEKEEK

SEQ ID NO: 199297 - protein, 13 aa, Borrelia afzelii
GKQEGIEEKEEKL

SEQ ID NO: 199298 - protein, 13 aa, Borrelia afzelii
KQEGIEEKEEKLN

SEQ ID NO: 199299 - protein, 13 aa, Borrelia afzelii
QEGIEEKEEKLNE

SEQ ID NO: 199300 - protein, 13 aa, Borrelia afzelii
EGIEEKEEKLNET

SEQ ID NO: 199301 - protein, 13 aa, Borrelia afzelii
GIEEKEEKLNETT

SEQ ID NO: 199302 - protein, 13 aa, Borrelia afzelii
IEEKEEKLNETTA

SEQ ID NO: 199303 - protein, 13 aa, Borrelia afzelii
EEKEEKLNETTAL

SEQ ID NO: 199304 - protein, 13 aa, Borrelia afzelii
EKEEKLNETTALW

SEQ ID NO: 199305 - protein, 13 aa, Borrelia afzelii
KEEKLNETTALWT

SEQ ID NO: 199306 - protein, 13 aa, Borrelia afzelii
EEKLNETTALWTK

SEQ ID NO: 199307 - protein, 13 aa, Borrelia afzelii
EKLNETTALWTKN

SEQ ID NO: 199308 - protein, 13 aa, Borrelia afzelii
KLNETTALWTKNK

SEQ ID NO: 199309 - protein, 13 aa, Borrelia afzelii
LNETTALWTKNKS

SEQ ID NO: 199310 - protein, 13 aa, Borrelia afzelii
NETTALWTKNKSE

SEQ ID NO: 199311 - protein, 13 aa, Borrelia afzelii
ETTALWTKNKSEI

SEQ ID NO: 199312 - protein, 13 aa, Borrelia afzelii
TTALWTKNKSEIK

SEQ ID NO: 199313 - protein, 13 aa, Borrelia afzelii
TALWTKNKSEIKT

SEQ ID NO: 199314 - protein, 13 aa, Borrelia afzelii
ALWTKNKSEIKTE

SEQ ID NO: 199315 - protein, 13 aa, Borrelia afzelii
LWTKNKSEIKTEE

SEQ ID NO: 199316 - protein, 13 aa, Borrelia afzelii
WTKNKSEIKTEEY

SEQ ID NO: 199317 - protein, 13 aa, Borrelia afzelii
TKNKSEIKTEEYN

SEQ ID NO: 199318 - protein, 13 aa, Borrelia afzelii
KNKSEIKTEEYNE

SEQ ID NO: 199319 - protein, 13 aa, Borrelia afzelii
NKSEIKTEEYNEF

SEQ ID NO: 199320 - protein, 13 aa, Borrelia afzelii
KSEIKTEEYNEFY

SEQ ID NO: 199321 - protein, 13 aa, Borrelia afzelii
SEIKTEEYNEFYK

SEQ ID NO: 199322 - protein, 13 aa, Borrelia afzelii
EIKTEEYNEFYKN

SEQ ID NO: 199323 - protein, 13 aa, Borrelia afzelii
IKTEEYNEFYKNT

SEQ ID NO: 199324 - protein, 13 aa, Borrelia afzelii
KTEEYNEFYKNTT

SEQ ID NO: 199325 - protein, 13 aa, Borrelia afzelii
TEEYNEFYKNTTF

SEQ ID NO: 199326 - protein, 13 aa, Borrelia afzelii
EEYNEFYKNTTFD

SEQ ID NO: 199327 - protein, 13 aa, Borrelia afzelii
EYNEFYKNTTFDY

SEQ ID NO: 199328 - protein, 13 aa, Borrelia afzelii
YNEFYKNTTFDYE

SEQ ID NO: 199329 - protein, 13 aa, Borrelia afzelii
NEFYKNTTFDYEN

SEQ ID NO: 199330 - protein, 13 aa, Borrelia afzelii
EFYKNTTFDYENP

SEQ ID NO: 199331 - protein, 13 aa, Borrelia afzelii
FYKNTTFDYENPL

SEQ ID NO: 199332 - protein, 13 aa, Borrelia afzelii
YKNTTFDYENPLM

SEQ ID NO: 199333 - protein, 13 aa, Borrelia afzelii
KNTTFDYENPLMY

SEQ ID NO: 199334 - protein, 13 aa, Borrelia afzelii
NTTFDYENPLMYI

SEQ ID NO: 199335 - protein, 13 aa, Borrelia afzelii
TTFDYENPLMYIH

SEQ ID NO: 199336 - protein, 13 aa, Borrelia afzelii
TFDYENPLMYIHT

SEQ ID NO: 199337 - protein, 13 aa, Borrelia afzelii
FDYENPLMYIHTK

SEQ ID NO: 199338 - protein, 13 aa, Borrelia afzelii
DYENPLMYIHTKA

SEQ ID NO: 199339 - protein, 13 aa, Borrelia afzelii
YENPLMYIHTKAE

SEQ ID NO: 199340 - protein, 13 aa, Borrelia afzelii
ENPLMYIHTKAEG

SEQ ID NO: 199341 - protein, 13 aa, Borrelia afzelii
NPLMYIHTKAEGN

SEQ ID NO: 199342 - protein, 13 aa, Borrelia afzelii
PLMYIHTKAEGNL

SEQ ID NO: 199343 - protein, 13 aa, Borrelia afzelii
LMYIHTKAEGNLE

SEQ ID NO: 199344 - protein, 13 aa, Borrelia afzelii
MYIHTKAEGNLEY

SEQ ID NO: 199345 - protein, 13 aa, Borrelia afzelii
YIHTKAEGNLEYT

SEQ ID NO: 199346 - protein, 13 aa, Borrelia afzelii
IHTKAEGNLEYTN

SEQ ID NO: 199347 - protein, 13 aa, Borrelia afzelii
HTKAEGNLEYTNL

SEQ ID NO: 199348 - protein, 13 aa, Borrelia afzelii
TKAEGNLEYTNLF

SEQ ID NO: 199349 - protein, 13 aa, Borrelia afzelii
KAEGNLEYTNLFY

SEQ ID NO: 199350 - protein, 13 aa, Borrelia afzelii
AEGNLEYTNLFYI

SEQ ID NO: 199351 - protein, 13 aa, Borrelia afzelii
EGNLEYTNLFYIP

SEQ ID NO: 199352 - protein, 13 aa, Borrelia afzelii
GNLEYTNLFYIPS

SEQ ID NO: 199353 - protein, 13 aa, Borrelia afzelii
NLEYTNLFYIPSK

SEQ ID NO: 199354 - protein, 13 aa, Borrelia afzelii
LEYTNLFYIPSKA

SEQ ID NO: 199355 - protein, 13 aa, Borrelia afzelii
EYTNLFYIPSKAP

SEQ ID NO: 199356 - protein, 13 aa, Borrelia afzelii
YTNLFYIPSKAPY

SEQ ID NO: 199357 - protein, 13 aa, Borrelia afzelii
TNLFYIPSKAPYD

SEQ ID NO: 199358 - protein, 13 aa, Borrelia afzelii
NLFYIPSKAPYDL

SEQ ID NO: 199359 - protein, 13 aa, Borrelia afzelii
LFYIPSKAPYDLY

SEQ ID NO: 199360 - protein, 13 aa, Borrelia afzelii
FYIPSKAPYDLYY

SEQ ID NO: 199361 - protein, 13 aa, Borrelia afzelii
YIPSKAPYDLYYP

SEQ ID NO: 199362 - protein, 13 aa, Borrelia afzelii
IPSKAPYDLYYPN

SEQ ID NO: 199363 - protein, 13 aa, Borrelia afzelii
PSKAPYDLYYPNT

SEQ ID NO: 199364 - protein, 13 aa, Borrelia afzelii
SKAPYDLYYPNTK

SEQ ID NO: 199365 - protein, 13 aa, Borrelia afzelii
KAPYDLYYPNTKP

SEQ ID NO: 199366 - protein, 13 aa, Borrelia afzelii
APYDLYYPNTKPG

SEQ ID NO: 199367 - protein, 13 aa, Borrelia afzelii
PYDLYYPNTKPGV

SEQ ID NO: 199368 - protein, 13 aa, Borrelia afzelii
YDLYYPNTKPGVK

SEQ ID NO: 199369 - protein, 13 aa, Borrelia afzelii
DLYYPNTKPGVKL

SEQ ID NO: 199370 - protein, 13 aa, Borrelia afzelii
LYYPNTKPGVKLF

SEQ ID NO: 199371 - protein, 13 aa, Borrelia afzelii
YYPNTKPGVKLFI

SEQ ID NO: 199372 - protein, 13 aa, Borrelia afzelii
YPNTKPGVKLFIN

SEQ ID NO: 199373 - protein, 13 aa, Borrelia afzelii
PNTKPGVKLFINR

SEQ ID NO: 199374 - protein, 13 aa, Borrelia afzelii
NTKPGVKLFINRI

SEQ ID NO: 199375 - protein, 13 aa, Borrelia afzelii
TKPGVKLFINRIF

SEQ ID NO: 199376 - protein, 13 aa, Borrelia afzelii
KPGVKLFINRIFI

SEQ ID NO: 199377 - protein, 13 aa, Borrelia afzelii
PGVKLFINRIFIT

SEQ ID NO: 199378 - protein, 13 aa, Borrelia afzelii
GVKLFINRIFITD

SEQ ID NO: 199379 - protein, 13 aa, Borrelia afzelii
VKLFINRIFITDS

SEQ ID NO: 199380 - protein, 13 aa, Borrelia afzelii
KLFINRIFITDSE

SEQ ID NO: 199381 - protein, 13 aa, Borrelia afzelii
LFINRIFITDSEG

SEQ ID NO: 199382 - protein, 13 aa, Borrelia afzelii
FINRIFITDSEGS

SEQ ID NO: 199383 - protein, 13 aa, Borrelia afzelii
INRIFITDSEGSL

SEQ ID NO: 199384 - protein, 13 aa, Borrelia afzelii
NRIFITDSEGSLL

SEQ ID NO: 199385 - protein, 13 aa, Borrelia afzelii
RIFITDSEGSLLP

SEQ ID NO: 199386 - protein, 13 aa, Borrelia afzelii
IFITDSEGSLLPN

SEQ ID NO: 199387 - protein, 13 aa, Borrelia afzelii
FITDSEGSLLPNY

SEQ ID NO: 199388 - protein, 13 aa, Borrelia afzelii
ITDSEGSLLPNYL

SEQ ID NO: 199389 - protein, 13 aa, Borrelia afzelii
TDSEGSLLPNYLR

SEQ ID NO: 199390 - protein, 13 aa, Borrelia afzelii
DSEGSLLPNYLRF

SEQ ID NO: 199391 - protein, 13 aa, Borrelia afzelii
SEGSLLPNYLRFI

SEQ ID NO: 199392 - protein, 13 aa, Borrelia afzelii
EGSLLPNYLRFIK

SEQ ID NO: 199393 - protein, 13 aa, Borrelia afzelii
GSLLPNYLRFIKG

SEQ ID NO: 199394 - protein, 13 aa, Borrelia afzelii
SLLPNYLRFIKGI

SEQ ID NO: 199395 - protein, 13 aa, Borrelia afzelii
LLPNYLRFIKGII

SEQ ID NO: 199396 - protein, 13 aa, Borrelia afzelii
LPNYLRFIKGIID

SEQ ID NO: 199397 - protein, 13 aa, Borrelia afzelii
PNYLRFIKGIIDC

SEQ ID NO: 199398 - protein, 13 aa, Borrelia afzelii
NYLRFIKGIIDCQ

SEQ ID NO: 199399 - protein, 13 aa, Borrelia afzelii
YLRFIKGIIDCQD

SEQ ID NO: 199400 - protein, 13 aa, Borrelia afzelii
LRFIKGIIDCQDL

SEQ ID NO: 199401 - protein, 13 aa, Borrelia afzelii
RFIKGIIDCQDLP

SEQ ID NO: 199402 - protein, 13 aa, Borrelia afzelii
FIKGIIDCQDLPL

SEQ ID NO: 199403 - protein, 13 aa, Borrelia afzelii
IKGIIDCQDLPLN

SEQ ID NO: 199404 - protein, 13 aa, Borrelia afzelii
KGIIDCQDLPLNV

SEQ ID NO: 199405 - protein, 13 aa, Borrelia afzelii
GIIDCQDLPLNVS

SEQ ID NO: 199406 - protein, 13 aa, Borrelia afzelii
IIDCQDLPLNVSR

SEQ ID NO: 199407 - protein, 13 aa, Borrelia afzelii
IDCQDLPLNVSRE

SEQ ID NO: 199408 - protein, 13 aa, Borrelia afzelii
DCQDLPLNVSREI

SEQ ID NO: 199409 - protein, 13 aa, Borrelia afzelii
CQDLPLNVSREIL

SEQ ID NO: 199410 - protein, 13 aa, Borrelia afzelii
QDLPLNVSREILQ

SEQ ID NO: 199411 - protein, 13 aa, Borrelia afzelii
DLPLNVSREILQQ

SEQ ID NO: 199412 - protein, 13 aa, Borrelia afzelii
LPLNVSREILQQN

SEQ ID NO: 199413 - protein, 13 aa, Borrelia afzelii
PLNVSREILQQNK

SEQ ID NO: 199414 - protein, 13 aa, Borrelia afzelii
LNVSREILQQNKI

SEQ ID NO: 199415 - protein, 13 aa, Borrelia afzelii
NVSREILQQNKIL

SEQ ID NO: 199416 - protein, 13 aa, Borrelia afzelii
VSREILQQNKILS

SEQ ID NO: 199417 - protein, 13 aa, Borrelia afzelii
SREILQQNKILSK

SEQ ID NO: 199418 - protein, 13 aa, Borrelia afzelii
REILQQNKILSKI

SEQ ID NO: 199419 - protein, 13 aa, Borrelia afzelii
EILQQNKILSKIK

SEQ ID NO: 199420 - protein, 13 aa, Borrelia afzelii
ILQQNKILSKIKS

SEQ ID NO: 199421 - protein, 13 aa, Borrelia afzelii
LQQNKILSKIKSS

SEQ ID NO: 199422 - protein, 13 aa, Borrelia afzelii
QQNKILSKIKSSS

SEQ ID NO: 199423 - protein, 13 aa, Borrelia afzelii
QNKILSKIKSSSV

SEQ ID NO: 199424 - protein, 13 aa, Borrelia afzelii
NKILSKIKSSSVK

SEQ ID NO: 199425 - protein, 13 aa, Borrelia afzelii
KILSKIKSSSVKK

SEQ ID NO: 199426 - protein, 13 aa, Borrelia afzelii
ILSKIKSSSVKKI

SEQ ID NO: 199427 - protein, 13 aa, Borrelia afzelii
LSKIKSSSVKKIL

SEQ ID NO: 199428 - protein, 13 aa, Borrelia afzelii
SKIKSSSVKKILS

SEQ ID NO: 199429 - protein, 13 aa, Borrelia afzelii
KIKSSSVKKILSE

SEQ ID NO: 199430 - protein, 13 aa, Borrelia afzelii
IKSSSVKKILSEL

SEQ ID NO: 199431 - protein, 13 aa, Borrelia afzelii
KSSSVKKILSELE

SEQ ID NO: 199432 - protein, 13 aa, Borrelia afzelii
SSSVKKILSELEK

SEQ ID NO: 199433 - protein, 13 aa, Borrelia afzelii
SSVKKILSELEKL

SEQ ID NO: 199434 - protein, 13 aa, Borrelia afzelii
SVKKILSELEKLS

SEQ ID NO: 199435 - protein, 13 aa, Borrelia afzelii
VKKILSELEKLSK

SEQ ID NO: 199436 - protein, 13 aa, Borrelia afzelii
KKILSELEKLSKK

SEQ ID NO: 199437 - protein, 13 aa, Borrelia afzelii
KILSELEKLSKKN

SEQ ID NO: 199438 - protein, 13 aa, Borrelia afzelii
ILSELEKLSKKNP

SEQ ID NO: 199439 - protein, 13 aa, Borrelia afzelii
LSELEKLSKKNPE

SEQ ID NO: 199440 - protein, 13 aa, Borrelia afzelii
SELEKLSKKNPEK

SEQ ID NO: 199441 - protein, 13 aa, Borrelia afzelii
ELEKLSKKNPEKF

SEQ ID NO: 199442 - protein, 13 aa, Borrelia afzelii
LEKLSKKNPEKFS

SEQ ID NO: 199443 - protein, 13 aa, Borrelia afzelii
EKLSKKNPEKFSE

SEQ ID NO: 199444 - protein, 13 aa, Borrelia afzelii
KLSKKNPEKFSEF

SEQ ID NO: 199445 - protein, 13 aa, Borrelia afzelii
LSKKNPEKFSEFS

SEQ ID NO: 199446 - protein, 13 aa, Borrelia afzelii
SKKNPEKFSEFSK

SEQ ID NO: 199447 - protein, 13 aa, Borrelia afzelii
KKNPEKFSEFSKE

SEQ ID NO: 199448 - protein, 13 aa, Borrelia afzelii
KNPEKFSEFSKEF

SEQ ID NO: 199449 - protein, 13 aa, Borrelia afzelii
NPEKFSEFSKEFG

SEQ ID NO: 199450 - protein, 13 aa, Borrelia afzelii
PEKFSEFSKEFGR

SEQ ID NO: 199451 - protein, 13 aa, Borrelia afzelii
EKFSEFSKEFGRC

SEQ ID NO: 199452 - protein, 13 aa, Borrelia afzelii
KFSEFSKEFGRCI

SEQ ID NO: 199453 - protein, 13 aa, Borrelia afzelii
FSEFSKEFGRCIK

SEQ ID NO: 199454 - protein, 13 aa, Borrelia afzelii
SEFSKEFGRCIKE

SEQ ID NO: 199455 - protein, 13 aa, Borrelia afzelii
EFSKEFGRCIKEG

SEQ ID NO: 199456 - protein, 13 aa, Borrelia afzelii
FSKEFGRCIKEGV

SEQ ID NO: 199457 - protein, 13 aa, Borrelia afzelii
SKEFGRCIKEGVY

SEQ ID NO: 199458 - protein, 13 aa, Borrelia afzelii
KEFGRCIKEGVYS

SEQ ID NO: 199459 - protein, 13 aa, Borrelia afzelii
EFGRCIKEGVYSD

SEQ ID NO: 199460 - protein, 13 aa, Borrelia afzelii
FGRCIKEGVYSDF

SEQ ID NO: 199461 - protein, 13 aa, Borrelia afzelii
GRCIKEGVYSDFE

SEQ ID NO: 199462 - protein, 13 aa, Borrelia afzelii
RCIKEGVYSDFEN

SEQ ID NO: 199463 - protein, 13 aa, Borrelia afzelii
CIKEGVYSDFENR

SEQ ID NO: 199464 - protein, 13 aa, Borrelia afzelii
IKEGVYSDFENRE

SEQ ID NO: 199465 - protein, 13 aa, Borrelia afzelii
KEGVYSDFENREK

SEQ ID NO: 199466 - protein, 13 aa, Borrelia afzelii
EGVYSDFENREKL

SEQ ID NO: 199467 - protein, 13 aa, Borrelia afzelii
GVYSDFENREKLI

SEQ ID NO: 199468 - protein, 13 aa, Borrelia afzelii
VYSDFENREKLIS

SEQ ID NO: 199469 - protein, 13 aa, Borrelia afzelii
YSDFENREKLISL

SEQ ID NO: 199470 - protein, 13 aa, Borrelia afzelii
SDFENREKLISLI

SEQ ID NO: 199471 - protein, 13 aa, Borrelia afzelii
DFENREKLISLIR

SEQ ID NO: 199472 - protein, 13 aa, Borrelia afzelii
FENREKLISLIRF

SEQ ID NO: 199473 - protein, 13 aa, Borrelia afzelii
ENREKLISLIRFK

SEQ ID NO: 199474 - protein, 13 aa, Borrelia afzelii
NREKLISLIRFKS

SEQ ID NO: 199475 - protein, 13 aa, Borrelia afzelii
REKLISLIRFKSS

SEQ ID NO: 199476 - protein, 13 aa, Borrelia afzelii
EKLISLIRFKSSS

SEQ ID NO: 199477 - protein, 13 aa, Borrelia afzelii
KLISLIRFKSSSV

SEQ ID NO: 199478 - protein, 13 aa, Borrelia afzelii
LISLIRFKSSSVD

SEQ ID NO: 199479 - protein, 13 aa, Borrelia afzelii
ISLIRFKSSSVDG

SEQ ID NO: 199480 - protein, 13 aa, Borrelia afzelii
SLIRFKSSSVDGF

SEQ ID NO: 199481 - protein, 13 aa, Borrelia afzelii
LIRFKSSSVDGFV

SEQ ID NO: 199482 - protein, 13 aa, Borrelia afzelii
IRFKSSSVDGFVS

SEQ ID NO: 199483 - protein, 13 aa, Borrelia afzelii
RFKSSSVDGFVSF

SEQ ID NO: 199484 - protein, 13 aa, Borrelia afzelii
FKSSSVDGFVSFK

SEQ ID NO: 199485 - protein, 13 aa, Borrelia afzelii
KSSSVDGFVSFKE

SEQ ID NO: 199486 - protein, 13 aa, Borrelia afzelii
SSSVDGFVSFKEY

SEQ ID NO: 199487 - protein, 13 aa, Borrelia afzelii
SSVDGFVSFKEYK

SEQ ID NO: 199488 - protein, 13 aa, Borrelia afzelii
SVDGFVSFKEYKE

SEQ ID NO: 199489 - protein, 13 aa, Borrelia afzelii
VDGFVSFKEYKER

SEQ ID NO: 199490 - protein, 13 aa, Borrelia afzelii
DGFVSFKEYKERM

SEQ ID NO: 199491 - protein, 13 aa, Borrelia afzelii
GFVSFKEYKERMN

SEQ ID NO: 199492 - protein, 13 aa, Borrelia afzelii
FVSFKEYKERMNE

SEQ ID NO: 199493 - protein, 13 aa, Borrelia afzelii
VSFKEYKERMNEG

SEQ ID NO: 199494 - protein, 13 aa, Borrelia afzelii
SFKEYKERMNEGQ

SEQ ID NO: 199495 - protein, 13 aa, Borrelia afzelii
FKEYKERMNEGQK

SEQ ID NO: 199496 - protein, 13 aa, Borrelia afzelii
KEYKERMNEGQKS

SEQ ID NO: 199497 - protein, 13 aa, Borrelia afzelii
EYKERMNEGQKSI

SEQ ID NO: 199498 - protein, 13 aa, Borrelia afzelii
YKERMNEGQKSIY

SEQ ID NO: 199499 - protein, 13 aa, Borrelia afzelii
KERMNEGQKSIYY

SEQ ID NO: 199500 - protein, 13 aa, Borrelia afzelii
ERMNEGQKSIYYI

SEQ ID NO: 199501 - protein, 13 aa, Borrelia afzelii
RMNEGQKSIYYIT

SEQ ID NO: 199502 - protein, 13 aa, Borrelia afzelii
MNEGQKSIYYITG

SEQ ID NO: 199503 - protein, 13 aa, Borrelia afzelii
NEGQKSIYYITGG

SEQ ID NO: 199504 - protein, 13 aa, Borrelia afzelii
EGQKSIYYITGGK

SEQ ID NO: 199505 - protein, 13 aa, Borrelia afzelii
GQKSIYYITGGKE

SEQ ID NO: 199506 - protein, 13 aa, Borrelia afzelii
QKSIYYITGGKEN

SEQ ID NO: 199507 - protein, 13 aa, Borrelia afzelii
KSIYYITGGKENI

SEQ ID NO: 199508 - protein, 13 aa, Borrelia afzelii
SIYYITGGKENIL

SEQ ID NO: 199509 - protein, 13 aa, Borrelia afzelii
IYYITGGKENILK

SEQ ID NO: 199510 - protein, 13 aa, Borrelia afzelii
YYITGGKENILKE

SEQ ID NO: 199511 - protein, 13 aa, Borrelia afzelii
YITGGKENILKEN

SEQ ID NO: 199512 - protein, 13 aa, Borrelia afzelii
ITGGKENILKENP

SEQ ID NO: 199513 - protein, 13 aa, Borrelia afzelii
TGGKENILKENPI

SEQ ID NO: 199514 - protein, 13 aa, Borrelia afzelii
GGKENILKENPIV

SEQ ID NO: 199515 - protein, 13 aa, Borrelia afzelii
GKENILKENPIVT

SEQ ID NO: 199516 - protein, 13 aa, Borrelia afzelii
KENILKENPIVTA

SEQ ID NO: 199517 - protein, 13 aa, Borrelia afzelii
ENILKENPIVTAY

SEQ ID NO: 199518 - protein, 13 aa, Borrelia afzelii
NILKENPIVTAYK

SEQ ID NO: 199519 - protein, 13 aa, Borrelia afzelii
ILKENPIVTAYKE

SEQ ID NO: 199520 - protein, 13 aa, Borrelia afzelii
LKENPIVTAYKEK

SEQ ID NO: 199521 - protein, 13 aa, Borrelia afzelii
KENPIVTAYKEKG

SEQ ID NO: 199522 - protein, 13 aa, Borrelia afzelii
ENPIVTAYKEKGF

SEQ ID NO: 199523 - protein, 13 aa, Borrelia afzelii
NPIVTAYKEKGFE

SEQ ID NO: 199524 - protein, 13 aa, Borrelia afzelii
PIVTAYKEKGFEI

SEQ ID NO: 199525 - protein, 13 aa, Borrelia afzelii
IVTAYKEKGFEIL

SEQ ID NO: 199526 - protein, 13 aa, Borrelia afzelii
VTAYKEKGFEILI

SEQ ID NO: 199527 - protein, 13 aa, Borrelia afzelii
TAYKEKGFEILIM

SEQ ID NO: 199528 - protein, 13 aa, Borrelia afzelii
AYKEKGFEILIMD

SEQ ID NO: 199529 - protein, 13 aa, Borrelia afzelii
YKEKGFEILIMDD

SEQ ID NO: 199530 - protein, 13 aa, Borrelia afzelii
KEKGFEILIMDDE

SEQ ID NO: 199531 - protein, 13 aa, Borrelia afzelii
EKGFEILIMDDEL

SEQ ID NO: 199532 - protein, 13 aa, Borrelia afzelii
KGFEILIMDDELD

SEQ ID NO: 199533 - protein, 13 aa, Borrelia afzelii
GFEILIMDDELDE

SEQ ID NO: 199534 - protein, 13 aa, Borrelia afzelii
FEILIMDDELDEA

SEQ ID NO: 199535 - protein, 13 aa, Borrelia afzelii
EILIMDDELDEAI

SEQ ID NO: 199536 - protein, 13 aa, Borrelia afzelii
ILIMDDELDEAIL

SEQ ID NO: 199537 - protein, 13 aa, Borrelia afzelii
LIMDDELDEAILN

SEQ ID NO: 199538 - protein, 13 aa, Borrelia afzelii
IMDDELDEAILNL

SEQ ID NO: 199539 - protein, 13 aa, Borrelia afzelii
MDDELDEAILNLI

SEQ ID NO: 199540 - protein, 13 aa, Borrelia afzelii
DDELDEAILNLIP

SEQ ID NO: 199541 - protein, 13 aa, Borrelia afzelii
DELDEAILNLIPE

SEQ ID NO: 199542 - protein, 13 aa, Borrelia afzelii
ELDEAILNLIPEY

SEQ ID NO: 199543 - protein, 13 aa, Borrelia afzelii
LDEAILNLIPEYE

SEQ ID NO: 199544 - protein, 13 aa, Borrelia afzelii
DEAILNLIPEYEG

SEQ ID NO: 199545 - protein, 13 aa, Borrelia afzelii
EAILNLIPEYEGL

SEQ ID NO: 199546 - protein, 13 aa, Borrelia afzelii
AILNLIPEYEGLK

SEQ ID NO: 199547 - protein, 13 aa, Borrelia afzelii
ILNLIPEYEGLKL

SEQ ID NO: 199548 - protein, 13 aa, Borrelia afzelii
LNLIPEYEGLKLK

SEQ ID NO: 199549 - protein, 13 aa, Borrelia afzelii
NLIPEYEGLKLKA

SEQ ID NO: 199550 - protein, 13 aa, Borrelia afzelii
LIPEYEGLKLKAI

SEQ ID NO: 199551 - protein, 13 aa, Borrelia afzelii
IPEYEGLKLKAIN

SEQ ID NO: 199552 - protein, 13 aa, Borrelia afzelii
PEYEGLKLKAINK

SEQ ID NO: 199553 - protein, 13 aa, Borrelia afzelii
EYEGLKLKAINKN

SEQ ID NO: 199554 - protein, 13 aa, Borrelia afzelii
YEGLKLKAINKNE

SEQ ID NO: 199555 - protein, 13 aa, Borrelia afzelii
EGLKLKAINKNET

SEQ ID NO: 199556 - protein, 13 aa, Borrelia afzelii
GLKLKAINKNETS

SEQ ID NO: 199557 - protein, 13 aa, Borrelia afzelii
LKLKAINKNETSN

SEQ ID NO: 199558 - protein, 13 aa, Borrelia afzelii
KLKAINKNETSNE

SEQ ID NO: 199559 - protein, 13 aa, Borrelia afzelii
LKAINKNETSNEL

SEQ ID NO: 199560 - protein, 13 aa, Borrelia afzelii
KAINKNETSNELK

SEQ ID NO: 199561 - protein, 13 aa, Borrelia afzelii
AINKNETSNELKD

SEQ ID NO: 199562 - protein, 13 aa, Borrelia afzelii
INKNETSNELKDE

SEQ ID NO: 199563 - protein, 13 aa, Borrelia afzelii
NKNETSNELKDEN

SEQ ID NO: 199564 - protein, 13 aa, Borrelia afzelii
KNETSNELKDENF

SEQ ID NO: 199565 - protein, 13 aa, Borrelia afzelii
NETSNELKDENFK

SEQ ID NO: 199566 - protein, 13 aa, Borrelia afzelii
ETSNELKDENFKK

SEQ ID NO: 199567 - protein, 13 aa, Borrelia afzelii
TSNELKDENFKKI

SEQ ID NO: 199568 - protein, 13 aa, Borrelia afzelii
SNELKDENFKKIE

SEQ ID NO: 199569 - protein, 13 aa, Borrelia afzelii
NELKDENFKKIEE

SEQ ID NO: 199570 - protein, 13 aa, Borrelia afzelii
ELKDENFKKIEEE

SEQ ID NO: 199571 - protein, 13 aa, Borrelia afzelii
LKDENFKKIEEEF

SEQ ID NO: 199572 - protein, 13 aa, Borrelia afzelii
KDENFKKIEEEFK

SEQ ID NO: 199573 - protein, 13 aa, Borrelia afzelii
DENFKKIEEEFKD

SEQ ID NO: 199574 - protein, 13 aa, Borrelia afzelii
ENFKKIEEEFKDT

SEQ ID NO: 199575 - protein, 13 aa, Borrelia afzelii
NFKKIEEEFKDTL

SEQ ID NO: 199576 - protein, 13 aa, Borrelia afzelii
FKKIEEEFKDTLT

SEQ ID NO: 199577 - protein, 13 aa, Borrelia afzelii
KKIEEEFKDTLTR

SEQ ID NO: 199578 - protein, 13 aa, Borrelia afzelii
KIEEEFKDTLTRV

SEQ ID NO: 199579 - protein, 13 aa, Borrelia afzelii
IEEEFKDTLTRVK

SEQ ID NO: 199580 - protein, 13 aa, Borrelia afzelii
EEEFKDTLTRVKE

SEQ ID NO: 199581 - protein, 13 aa, Borrelia afzelii
EEFKDTLTRVKEI

SEQ ID NO: 199582 - protein, 13 aa, Borrelia afzelii
EFKDTLTRVKEIL

SEQ ID NO: 199583 - protein, 13 aa, Borrelia afzelii
FKDTLTRVKEILK

SEQ ID NO: 199584 - protein, 13 aa, Borrelia afzelii
KDTLTRVKEILKD

SEQ ID NO: 199585 - protein, 13 aa, Borrelia afzelii
DTLTRVKEILKDQ

SEQ ID NO: 199586 - protein, 13 aa, Borrelia afzelii
TLTRVKEILKDQI

SEQ ID NO: 199587 - protein, 13 aa, Borrelia afzelii
LTRVKEILKDQIK

SEQ ID NO: 199588 - protein, 13 aa, Borrelia afzelii
TRVKEILKDQIKE

SEQ ID NO: 199589 - protein, 13 aa, Borrelia afzelii
RVKEILKDQIKEV

SEQ ID NO: 199590 - protein, 13 aa, Borrelia afzelii
VKEILKDQIKEVN

SEQ ID NO: 199591 - protein, 13 aa, Borrelia afzelii
KEILKDQIKEVNL

SEQ ID NO: 199592 - protein, 13 aa, Borrelia afzelii
EILKDQIKEVNLS

SEQ ID NO: 199593 - protein, 13 aa, Borrelia afzelii
ILKDQIKEVNLSA

SEQ ID NO: 199594 - protein, 13 aa, Borrelia afzelii
LKDQIKEVNLSAT

SEQ ID NO: 199595 - protein, 13 aa, Borrelia afzelii
KDQIKEVNLSATL

SEQ ID NO: 199596 - protein, 13 aa, Borrelia afzelii
DQIKEVNLSATLI

SEQ ID NO: 199597 - protein, 13 aa, Borrelia afzelii
QIKEVNLSATLIK

SEQ ID NO: 199598 - protein, 13 aa, Borrelia afzelii
IKEVNLSATLIKE

SEQ ID NO: 199599 - protein, 13 aa, Borrelia afzelii
KEVNLSATLIKEP

SEQ ID NO: 199600 - protein, 13 aa, Borrelia afzelii
EVNLSATLIKEPS

SEQ ID NO: 199601 - protein, 13 aa, Borrelia afzelii
VNLSATLIKEPSA

SEQ ID NO: 199602 - protein, 13 aa, Borrelia afzelii
NLSATLIKEPSAI

SEQ ID NO: 199603 - protein, 13 aa, Borrelia afzelii
LSATLIKEPSAII

SEQ ID NO: 199604 - protein, 13 aa, Borrelia afzelii
SATLIKEPSAIIV

SEQ ID NO: 199605 - protein, 13 aa, Borrelia afzelii
ATLIKEPSAIIVD

SEQ ID NO: 199606 - protein, 13 aa, Borrelia afzelii
TLIKEPSAIIVDS

SEQ ID NO: 199607 - protein, 13 aa, Borrelia afzelii
LIKEPSAIIVDSN

SEQ ID NO: 199608 - protein, 13 aa, Borrelia afzelii
IKEPSAIIVDSND

SEQ ID NO: 199609 - protein, 13 aa, Borrelia afzelii
KEPSAIIVDSNDP

SEQ ID NO: 199610 - protein, 13 aa, Borrelia afzelii
EPSAIIVDSNDPT

SEQ ID NO: 199611 - protein, 13 aa, Borrelia afzelii
PSAIIVDSNDPTY

SEQ ID NO: 199612 - protein, 13 aa, Borrelia afzelii
SAIIVDSNDPTYQ

SEQ ID NO: 199613 - protein, 13 aa, Borrelia afzelii
AIIVDSNDPTYQM

SEQ ID NO: 199614 - protein, 13 aa, Borrelia afzelii
IIVDSNDPTYQMQ

SEQ ID NO: 199615 - protein, 13 aa, Borrelia afzelii
IVDSNDPTYQMQK

SEQ ID NO: 199616 - protein, 13 aa, Borrelia afzelii
VDSNDPTYQMQKI

SEQ ID NO: 199617 - protein, 13 aa, Borrelia afzelii
DSNDPTYQMQKIM

SEQ ID NO: 199618 - protein, 13 aa, Borrelia afzelii
SNDPTYQMQKIML

SEQ ID NO: 199619 - protein, 13 aa, Borrelia afzelii
NDPTYQMQKIMLS

SEQ ID NO: 199620 - protein, 13 aa, Borrelia afzelii
DPTYQMQKIMLSM

SEQ ID NO: 199621 - protein, 13 aa, Borrelia afzelii
PTYQMQKIMLSMG

SEQ ID NO: 199622 - protein, 13 aa, Borrelia afzelii
TYQMQKIMLSMGQ

SEQ ID NO: 199623 - protein, 13 aa, Borrelia afzelii
YQMQKIMLSMGQE

SEQ ID NO: 199624 - protein, 13 aa, Borrelia afzelii
QMQKIMLSMGQEV

SEQ ID NO: 199625 - protein, 13 aa, Borrelia afzelii
MQKIMLSMGQEVK

SEQ ID NO: 199626 - protein, 13 aa, Borrelia afzelii
QKIMLSMGQEVKE

SEQ ID NO: 199627 - protein, 13 aa, Borrelia afzelii
KIMLSMGQEVKEI

SEQ ID NO: 199628 - protein, 13 aa, Borrelia afzelii
IMLSMGQEVKEIK

SEQ ID NO: 199629 - protein, 13 aa, Borrelia afzelii
MLSMGQEVKEIKP

SEQ ID NO: 199630 - protein, 13 aa, Borrelia afzelii
LSMGQEVKEIKPI

SEQ ID NO: 199631 - protein, 13 aa, Borrelia afzelii
SMGQEVKEIKPIL

SEQ ID NO: 199632 - protein, 13 aa, Borrelia afzelii
MGQEVKEIKPILE

SEQ ID NO: 199633 - protein, 13 aa, Borrelia afzelii
GQEVKEIKPILEL

SEQ ID NO: 199634 - protein, 13 aa, Borrelia afzelii
QEVKEIKPILELN

SEQ ID NO: 199635 - protein, 13 aa, Borrelia afzelii
EVKEIKPILELNP

SEQ ID NO: 199636 - protein, 13 aa, Borrelia afzelii
VKEIKPILELNPN

SEQ ID NO: 199637 - protein, 13 aa, Borrelia afzelii
KEIKPILELNPNN

SEQ ID NO: 199638 - protein, 13 aa, Borrelia afzelii
EIKPILELNPNNK

SEQ ID NO: 199639 - protein, 13 aa, Borrelia afzelii
IKPILELNPNNKI

SEQ ID NO: 199640 - protein, 13 aa, Borrelia afzelii
KPILELNPNNKIV

SEQ ID NO: 199641 - protein, 13 aa, Borrelia afzelii
PILELNPNNKIVQ

SEQ ID NO: 199642 - protein, 13 aa, Borrelia afzelii
ILELNPNNKIVQN

SEQ ID NO: 199643 - protein, 13 aa, Borrelia afzelii
LELNPNNKIVQNL

SEQ ID NO: 199644 - protein, 13 aa, Borrelia afzelii
ELNPNNKIVQNLK

SEQ ID NO: 199645 - protein, 13 aa, Borrelia afzelii
LNPNNKIVQNLKN

SEQ ID NO: 199646 - protein, 13 aa, Borrelia afzelii
NPNNKIVQNLKNL

SEQ ID NO: 199647 - protein, 13 aa, Borrelia afzelii
PNNKIVQNLKNLE

SEQ ID NO: 199648 - protein, 13 aa, Borrelia afzelii
NNKIVQNLKNLEP

SEQ ID NO: 199649 - protein, 13 aa, Borrelia afzelii
NKIVQNLKNLEPE

SEQ ID NO: 199650 - protein, 13 aa, Borrelia afzelii
KIVQNLKNLEPEK

SEQ ID NO: 199651 - protein, 13 aa, Borrelia afzelii
IVQNLKNLEPEKL

SEQ ID NO: 199652 - protein, 13 aa, Borrelia afzelii
VQNLKNLEPEKLE

SEQ ID NO: 199653 - protein, 13 aa, Borrelia afzelii
QNLKNLEPEKLEK

SEQ ID NO: 199654 - protein, 13 aa, Borrelia afzelii
NLKNLEPEKLEKI

SEQ ID NO: 199655 - protein, 13 aa, Borrelia afzelii
LKNLEPEKLEKIS

SEQ ID NO: 199656 - protein, 13 aa, Borrelia afzelii
KNLEPEKLEKISI

SEQ ID NO: 199657 - protein, 13 aa, Borrelia afzelii
NLEPEKLEKISIL

SEQ ID NO: 199658 - protein, 13 aa, Borrelia afzelii
LEPEKLEKISILL

SEQ ID NO: 199659 - protein, 13 aa, Borrelia afzelii
EPEKLEKISILLF

SEQ ID NO: 199660 - protein, 13 aa, Borrelia afzelii
PEKLEKISILLFE

SEQ ID NO: 199661 - protein, 13 aa, Borrelia afzelii
EKLEKISILLFEE

SEQ ID NO: 199662 - protein, 13 aa, Borrelia afzelii
KLEKISILLFEEA

SEQ ID NO: 199663 - protein, 13 aa, Borrelia afzelii
LEKISILLFEEAL

SEQ ID NO: 199664 - protein, 13 aa, Borrelia afzelii
EKISILLFEEALL

SEQ ID NO: 199665 - protein, 13 aa, Borrelia afzelii
KISILLFEEALLT

SEQ ID NO: 199666 - protein, 13 aa, Borrelia afzelii
ISILLFEEALLTS

SEQ ID NO: 199667 - protein, 13 aa, Borrelia afzelii
SILLFEEALLTSG

SEQ ID NO: 199668 - protein, 13 aa, Borrelia afzelii
ILLFEEALLTSGM

SEQ ID NO: 199669 - protein, 13 aa, Borrelia afzelii
LLFEEALLTSGMP

SEQ ID NO: 199670 - protein, 13 aa, Borrelia afzelii
LFEEALLTSGMPS

SEQ ID NO: 199671 - protein, 13 aa, Borrelia afzelii
FEEALLTSGMPSK

SEQ ID NO: 199672 - protein, 13 aa, Borrelia afzelii
EEALLTSGMPSKN

SEQ ID NO: 199673 - protein, 13 aa, Borrelia afzelii
EALLTSGMPSKNP

SEQ ID NO: 199674 - protein, 13 aa, Borrelia afzelii
ALLTSGMPSKNPR

SEQ ID NO: 199675 - protein, 13 aa, Borrelia afzelii
LLTSGMPSKNPRK

SEQ ID NO: 199676 - protein, 13 aa, Borrelia afzelii
LTSGMPSKNPRKF

SEQ ID NO: 199677 - protein, 13 aa, Borrelia afzelii
TSGMPSKNPRKFI

SEQ ID NO: 199678 - protein, 13 aa, Borrelia afzelii
SGMPSKNPRKFIN

SEQ ID NO: 199679 - protein, 13 aa, Borrelia afzelii
GMPSKNPRKFINI

SEQ ID NO: 199680 - protein, 13 aa, Borrelia afzelii
MPSKNPRKFINII

SEQ ID NO: 199681 - protein, 13 aa, Borrelia afzelii
PSKNPRKFINIIN

SEQ ID NO: 199682 - protein, 13 aa, Borrelia afzelii
SKNPRKFINIINE

SEQ ID NO: 199683 - protein, 13 aa, Borrelia afzelii
KNPRKFINIINEF

SEQ ID NO: 199684 - protein, 13 aa, Borrelia afzelii
NPRKFINIINEFL

SEQ ID NO: 199685 - protein, 13 aa, Borrelia afzelii
PRKFINIINEFLE

SEQ ID NO: 199686 - protein, 13 aa, Borrelia afzelii
RKFINIINEFLEK

SEQ ID NO: 199687 - protein, 13 aa, Borrelia afzelii
KFINIINEFLEKD

SEQ ID NO: 199688 - protein, 13 aa, Borrelia afzelii
FINIINEFLEKDL

SEQ ID NO: 199689 - protein, 13 aa, Borrelia afzelii
INIINEFLEKDLL

SEQ ID NO: 199690 - protein, 14 aa, Borrelia afzelii
MKKQFDTEVNDLLY

SEQ ID NO: 199691 - protein, 14 aa, Borrelia afzelii
KKQFDTEVNDLLYL

SEQ ID NO: 199692 - protein, 14 aa, Borrelia afzelii
KQFDTEVNDLLYLI

SEQ ID NO: 199693 - protein, 14 aa, Borrelia afzelii
QFDTEVNDLLYLII

SEQ ID NO: 199694 - protein, 14 aa, Borrelia afzelii
FDTEVNDLLYLIIH

SEQ ID NO: 199695 - protein, 14 aa, Borrelia afzelii
DTEVNDLLYLIIHS

SEQ ID NO: 199696 - protein, 14 aa, Borrelia afzelii
TEVNDLLYLIIHSL

SEQ ID NO: 199697 - protein, 14 aa, Borrelia afzelii
EVNDLLYLIIHSLY

SEQ ID NO: 199698 - protein, 14 aa, Borrelia afzelii
VNDLLYLIIHSLYS

SEQ ID NO: 199699 - protein, 14 aa, Borrelia afzelii
NDLLYLIIHSLYSH

SEQ ID NO: 199700 - protein, 14 aa, Borrelia afzelii
DLLYLIIHSLYSHK

SEQ ID NO: 199701 - protein, 14 aa, Borrelia afzelii
LLYLIIHSLYSHKE

SEQ ID NO: 199702 - protein, 14 aa, Borrelia afzelii
LYLIIHSLYSHKEI

SEQ ID NO: 199703 - protein, 14 aa, Borrelia afzelii
YLIIHSLYSHKEIF

SEQ ID NO: 199704 - protein, 14 aa, Borrelia afzelii
LIIHSLYSHKEIFL

SEQ ID NO: 199705 - protein, 14 aa, Borrelia afzelii
IIHSLYSHKEIFLR

SEQ ID NO: 199706 - protein, 14 aa, Borrelia afzelii
IHSLYSHKEIFLRE

SEQ ID NO: 199707 - protein, 14 aa, Borrelia afzelii
HSLYSHKEIFLREL

SEQ ID NO: 199708 - protein, 14 aa, Borrelia afzelii
SLYSHKEIFLRELI

SEQ ID NO: 199709 - protein, 14 aa, Borrelia afzelii
LYSHKEIFLRELIS

SEQ ID NO: 199710 - protein, 14 aa, Borrelia afzelii
YSHKEIFLRELISN

SEQ ID NO: 199711 - protein, 14 aa, Borrelia afzelii
SHKEIFLRELISNA

SEQ ID NO: 199712 - protein, 14 aa, Borrelia afzelii
HKEIFLRELISNAS

SEQ ID NO: 199713 - protein, 14 aa, Borrelia afzelii
KEIFLRELISNASD

SEQ ID NO: 199714 - protein, 14 aa, Borrelia afzelii
EIFLRELISNASDA

SEQ ID NO: 199715 - protein, 14 aa, Borrelia afzelii
IFLRELISNASDAI

SEQ ID NO: 199716 - protein, 14 aa, Borrelia afzelii
FLRELISNASDAID

SEQ ID NO: 199717 - protein, 14 aa, Borrelia afzelii
LRELISNASDAIDK

SEQ ID NO: 199718 - protein, 14 aa, Borrelia afzelii
RELISNASDAIDKL

SEQ ID NO: 199719 - protein, 14 aa, Borrelia afzelii
ELISNASDAIDKLK

SEQ ID NO: 199720 - protein, 14 aa, Borrelia afzelii
LISNASDAIDKLKF

SEQ ID NO: 199721 - protein, 14 aa, Borrelia afzelii
ISNASDAIDKLKFL

SEQ ID NO: 199722 - protein, 14 aa, Borrelia afzelii
SNASDAIDKLKFLS

SEQ ID NO: 199723 - protein, 14 aa, Borrelia afzelii
NASDAIDKLKFLSL

SEQ ID NO: 199724 - protein, 14 aa, Borrelia afzelii
ASDAIDKLKFLSLT

SEQ ID NO: 199725 - protein, 14 aa, Borrelia afzelii
SDAIDKLKFLSLTN

SEQ ID NO: 199726 - protein, 14 aa, Borrelia afzelii
DAIDKLKFLSLTNE

SEQ ID NO: 199727 - protein, 14 aa, Borrelia afzelii
AIDKLKFLSLTNEK

SEQ ID NO: 199728 - protein, 14 aa, Borrelia afzelii
IDKLKFLSLTNEKF

SEQ ID NO: 199729 - protein, 14 aa, Borrelia afzelii
DKLKFLSLTNEKFK

SEQ ID NO: 199730 - protein, 14 aa, Borrelia afzelii
KLKFLSLTNEKFKN

SEQ ID NO: 199731 - protein, 14 aa, Borrelia afzelii
LKFLSLTNEKFKNI

SEQ ID NO: 199732 - protein, 14 aa, Borrelia afzelii
KFLSLTNEKFKNIA

SEQ ID NO: 199733 - protein, 14 aa, Borrelia afzelii
FLSLTNEKFKNIAL

SEQ ID NO: 199734 - protein, 14 aa, Borrelia afzelii
LSLTNEKFKNIALE

SEQ ID NO: 199735 - protein, 14 aa, Borrelia afzelii
SLTNEKFKNIALEP

SEQ ID NO: 199736 - protein, 14 aa, Borrelia afzelii
LTNEKFKNIALEPK

SEQ ID NO: 199737 - protein, 14 aa, Borrelia afzelii
TNEKFKNIALEPKI

SEQ ID NO: 199738 - protein, 14 aa, Borrelia afzelii
NEKFKNIALEPKIE

SEQ ID NO: 199739 - protein, 14 aa, Borrelia afzelii
EKFKNIALEPKIEI

SEQ ID NO: 199740 - protein, 14 aa, Borrelia afzelii
KFKNIALEPKIEIT

SEQ ID NO: 199741 - protein, 14 aa, Borrelia afzelii
FKNIALEPKIEITF

SEQ ID NO: 199742 - protein, 14 aa, Borrelia afzelii
KNIALEPKIEITFD

SEQ ID NO: 199743 - protein, 14 aa, Borrelia afzelii
NIALEPKIEITFDD

SEQ ID NO: 199744 - protein, 14 aa, Borrelia afzelii
IALEPKIEITFDDK

SEQ ID NO: 199745 - protein, 14 aa, Borrelia afzelii
ALEPKIEITFDDKS

SEQ ID NO: 199746 - protein, 14 aa, Borrelia afzelii
LEPKIEITFDDKSI

SEQ ID NO: 199747 - protein, 14 aa, Borrelia afzelii
EPKIEITFDDKSIL

SEQ ID NO: 199748 - protein, 14 aa, Borrelia afzelii
PKIEITFDDKSILI

SEQ ID NO: 199749 - protein, 14 aa, Borrelia afzelii
KIEITFDDKSILIK

SEQ ID NO: 199750 - protein, 14 aa, Borrelia afzelii
IEITFDDKSILIKD

SEQ ID NO: 199751 - protein, 14 aa, Borrelia afzelii
EITFDDKSILIKDN

SEQ ID NO: 199752 - protein, 14 aa, Borrelia afzelii
ITFDDKSILIKDNG

SEQ ID NO: 199753 - protein, 14 aa, Borrelia afzelii
TFDDKSILIKDNGI

SEQ ID NO: 199754 - protein, 14 aa, Borrelia afzelii
FDDKSILIKDNGIG

SEQ ID NO: 199755 - protein, 14 aa, Borrelia afzelii
DDKSILIKDNGIGM

SEQ ID NO: 199756 - protein, 14 aa, Borrelia afzelii
DKSILIKDNGIGMN

SEQ ID NO: 199757 - protein, 14 aa, Borrelia afzelii
KSILIKDNGIGMNE

SEQ ID NO: 199758 - protein, 14 aa, Borrelia afzelii
SILIKDNGIGMNEQ

SEQ ID NO: 199759 - protein, 14 aa, Borrelia afzelii
ILIKDNGIGMNEQE

SEQ ID NO: 199760 - protein, 14 aa, Borrelia afzelii
LIKDNGIGMNEQEL

SEQ ID NO: 199761 - protein, 14 aa, Borrelia afzelii
IKDNGIGMNEQELT

SEQ ID NO: 199762 - protein, 14 aa, Borrelia afzelii
KDNGIGMNEQELTN

SEQ ID NO: 199763 - protein, 14 aa, Borrelia afzelii
DNGIGMNEQELTNH

SEQ ID NO: 199764 - protein, 14 aa, Borrelia afzelii
NGIGMNEQELTNHL

SEQ ID NO: 199765 - protein, 14 aa, Borrelia afzelii
GIGMNEQELTNHLG

SEQ ID NO: 199766 - protein, 14 aa, Borrelia afzelii
IGMNEQELTNHLGV

SEQ ID NO: 199767 - protein, 14 aa, Borrelia afzelii
GMNEQELTNHLGVI

SEQ ID NO: 199768 - protein, 14 aa, Borrelia afzelii
MNEQELTNHLGVIA

SEQ ID NO: 199769 - protein, 14 aa, Borrelia afzelii
NEQELTNHLGVIAK

SEQ ID NO: 199770 - protein, 14 aa, Borrelia afzelii
EQELTNHLGVIAKS

SEQ ID NO: 199771 - protein, 14 aa, Borrelia afzelii
QELTNHLGVIAKSG

SEQ ID NO: 199772 - protein, 14 aa, Borrelia afzelii
ELTNHLGVIAKSGT

SEQ ID NO: 199773 - protein, 14 aa, Borrelia afzelii
LTNHLGVIAKSGTK

SEQ ID NO: 199774 - protein, 14 aa, Borrelia afzelii
TNHLGVIAKSGTKE

SEQ ID NO: 199775 - protein, 14 aa, Borrelia afzelii
NHLGVIAKSGTKEF

SEQ ID NO: 199776 - protein, 14 aa, Borrelia afzelii
HLGVIAKSGTKEFI

SEQ ID NO: 199777 - protein, 14 aa, Borrelia afzelii
LGVIAKSGTKEFIN

SEQ ID NO: 199778 - protein, 14 aa, Borrelia afzelii
GVIAKSGTKEFINN

SEQ ID NO: 199779 - protein, 14 aa, Borrelia afzelii
VIAKSGTKEFINNL

SEQ ID NO: 199780 - protein, 14 aa, Borrelia afzelii
IAKSGTKEFINNLK

SEQ ID NO: 199781 - protein, 14 aa, Borrelia afzelii
AKSGTKEFINNLKQ

SEQ ID NO: 199782 - protein, 14 aa, Borrelia afzelii
KSGTKEFINNLKQD

SEQ ID NO: 199783 - protein, 14 aa, Borrelia afzelii
SGTKEFINNLKQDE

SEQ ID NO: 199784 - protein, 14 aa, Borrelia afzelii
GTKEFINNLKQDEK

SEQ ID NO: 199785 - protein, 14 aa, Borrelia afzelii
TKEFINNLKQDEKK

SEQ ID NO: 199786 - protein, 14 aa, Borrelia afzelii
KEFINNLKQDEKKS

SEQ ID NO: 199787 - protein, 14 aa, Borrelia afzelii
EFINNLKQDEKKSA

SEQ ID NO: 199788 - protein, 14 aa, Borrelia afzelii
FINNLKQDEKKSAN

SEQ ID NO: 199789 - protein, 14 aa, Borrelia afzelii
INNLKQDEKKSANL

SEQ ID NO: 199790 - protein, 14 aa, Borrelia afzelii
NNLKQDEKKSANLI

SEQ ID NO: 199791 - protein, 14 aa, Borrelia afzelii
NLKQDEKKSANLIG

SEQ ID NO: 199792 - protein, 14 aa, Borrelia afzelii
LKQDEKKSANLIGQ

SEQ ID NO: 199793 - protein, 14 aa, Borrelia afzelii
KQDEKKSANLIGQF

SEQ ID NO: 199794 - protein, 14 aa, Borrelia afzelii
QDEKKSANLIGQFG

SEQ ID NO: 199795 - protein, 14 aa, Borrelia afzelii
DEKKSANLIGQFGV

SEQ ID NO: 199796 - protein, 14 aa, Borrelia afzelii
EKKSANLIGQFGVG

SEQ ID NO: 199797 - protein, 14 aa, Borrelia afzelii
KKSANLIGQFGVGF

SEQ ID NO: 199798 - protein, 14 aa, Borrelia afzelii
KSANLIGQFGVGFY

SEQ ID NO: 199799 - protein, 14 aa, Borrelia afzelii
SANLIGQFGVGFYS

SEQ ID NO: 199800 - protein, 14 aa, Borrelia afzelii
ANLIGQFGVGFYSA

SEQ ID NO: 199801 - protein, 14 aa, Borrelia afzelii
NLIGQFGVGFYSAF

SEQ ID NO: 199802 - protein, 14 aa, Borrelia afzelii
LIGQFGVGFYSAFI

SEQ ID NO: 199803 - protein, 14 aa, Borrelia afzelii
IGQFGVGFYSAFIV

SEQ ID NO: 199804 - protein, 14 aa, Borrelia afzelii
GQFGVGFYSAFIVS

SEQ ID NO: 199805 - protein, 14 aa, Borrelia afzelii
QFGVGFYSAFIVSE

SEQ ID NO: 199806 - protein, 14 aa, Borrelia afzelii
FGVGFYSAFIVSEK

SEQ ID NO: 199807 - protein, 14 aa, Borrelia afzelii
GVGFYSAFIVSEKV

SEQ ID NO: 199808 - protein, 14 aa, Borrelia afzelii
VGFYSAFIVSEKVE

SEQ ID NO: 199809 - protein, 14 aa, Borrelia afzelii
GFYSAFIVSEKVEV

SEQ ID NO: 199810 - protein, 14 aa, Borrelia afzelii
FYSAFIVSEKVEVT

SEQ ID NO: 199811 - protein, 14 aa, Borrelia afzelii
YSAFIVSEKVEVTS

SEQ ID NO: 199812 - protein, 14 aa, Borrelia afzelii
SAFIVSEKVEVTSK

SEQ ID NO: 199813 - protein, 14 aa, Borrelia afzelii
AFIVSEKVEVTSKK

SEQ ID NO: 199814 - protein, 14 aa, Borrelia afzelii
FIVSEKVEVTSKKA

SEQ ID NO: 199815 - protein, 14 aa, Borrelia afzelii
IVSEKVEVTSKKAL

SEQ ID NO: 199816 - protein, 14 aa, Borrelia afzelii
VSEKVEVTSKKALE

SEQ ID NO: 199817 - protein, 14 aa, Borrelia afzelii
SEKVEVTSKKALES

SEQ ID NO: 199818 - protein, 14 aa, Borrelia afzelii
EKVEVTSKKALESD

SEQ ID NO: 199819 - protein, 14 aa, Borrelia afzelii
KVEVTSKKALESDA

SEQ ID NO: 199820 - protein, 14 aa, Borrelia afzelii
VEVTSKKALESDAY

SEQ ID NO: 199821 - protein, 14 aa, Borrelia afzelii
EVTSKKALESDAYI

SEQ ID NO: 199822 - protein, 14 aa, Borrelia afzelii
VTSKKALESDAYIW

SEQ ID NO: 199823 - protein, 14 aa, Borrelia afzelii
TSKKALESDAYIWS

SEQ ID NO: 199824 - protein, 14 aa, Borrelia afzelii
SKKALESDAYIWSS

SEQ ID NO: 199825 - protein, 14 aa, Borrelia afzelii
KKALESDAYIWSSD

SEQ ID NO: 199826 - protein, 14 aa, Borrelia afzelii
KALESDAYIWSSDG

SEQ ID NO: 199827 - protein, 14 aa, Borrelia afzelii
ALESDAYIWSSDGK

SEQ ID NO: 199828 - protein, 14 aa, Borrelia afzelii
LESDAYIWSSDGKT

SEQ ID NO: 199829 - protein, 14 aa, Borrelia afzelii
ESDAYIWSSDGKTG

SEQ ID NO: 199830 - protein, 14 aa, Borrelia afzelii
SDAYIWSSDGKTGY

SEQ ID NO: 199831 - protein, 14 aa, Borrelia afzelii
DAYIWSSDGKTGYE

SEQ ID NO: 199832 - protein, 14 aa, Borrelia afzelii
AYIWSSDGKTGYEI

SEQ ID NO: 199833 - protein, 14 aa, Borrelia afzelii
YIWSSDGKTGYEIE

SEQ ID NO: 199834 - protein, 14 aa, Borrelia afzelii
IWSSDGKTGYEIEK

SEQ ID NO: 199835 - protein, 14 aa, Borrelia afzelii
WSSDGKTGYEIEKA

SEQ ID NO: 199836 - protein, 14 aa, Borrelia afzelii
SSDGKTGYEIEKAK

SEQ ID NO: 199837 - protein, 14 aa, Borrelia afzelii
SDGKTGYEIEKAKK

SEQ ID NO: 199838 - protein, 14 aa, Borrelia afzelii
DGKTGYEIEKAKKE

SEQ ID NO: 199839 - protein, 14 aa, Borrelia afzelii
GKTGYEIEKAKKED

SEQ ID NO: 199840 - protein, 14 aa, Borrelia afzelii
KTGYEIEKAKKEDP

SEQ ID NO: 199841 - protein, 14 aa, Borrelia afzelii
TGYEIEKAKKEDPG

SEQ ID NO: 199842 - protein, 14 aa, Borrelia afzelii
GYEIEKAKKEDPGT

SEQ ID NO: 199843 - protein, 14 aa, Borrelia afzelii
YEIEKAKKEDPGTE

SEQ ID NO: 199844 - protein, 14 aa, Borrelia afzelii
EIEKAKKEDPGTEI

SEQ ID NO: 199845 - protein, 14 aa, Borrelia afzelii
IEKAKKEDPGTEIK

SEQ ID NO: 199846 - protein, 14 aa, Borrelia afzelii
EKAKKEDPGTEIKL

SEQ ID NO: 199847 - protein, 14 aa, Borrelia afzelii
KAKKEDPGTEIKLY

SEQ ID NO: 199848 - protein, 14 aa, Borrelia afzelii
AKKEDPGTEIKLYL

SEQ ID NO: 199849 - protein, 14 aa, Borrelia afzelii
KKEDPGTEIKLYLN

SEQ ID NO: 199850 - protein, 14 aa, Borrelia afzelii
KEDPGTEIKLYLNK

SEQ ID NO: 199851 - protein, 14 aa, Borrelia afzelii
EDPGTEIKLYLNKE

SEQ ID NO: 199852 - protein, 14 aa, Borrelia afzelii
DPGTEIKLYLNKEG

SEQ ID NO: 199853 - protein, 14 aa, Borrelia afzelii
PGTEIKLYLNKEGL

SEQ ID NO: 199854 - protein, 14 aa, Borrelia afzelii
GTEIKLYLNKEGLE

SEQ ID NO: 199855 - protein, 14 aa, Borrelia afzelii
TEIKLYLNKEGLEY

SEQ ID NO: 199856 - protein, 14 aa, Borrelia afzelii
EIKLYLNKEGLEYA

SEQ ID NO: 199857 - protein, 14 aa, Borrelia afzelii
IKLYLNKEGLEYAN

SEQ ID NO: 199858 - protein, 14 aa, Borrelia afzelii
KLYLNKEGLEYANK

SEQ ID NO: 199859 - protein, 14 aa, Borrelia afzelii
LYLNKEGLEYANKW

SEQ ID NO: 199860 - protein, 14 aa, Borrelia afzelii
YLNKEGLEYANKWK

SEQ ID NO: 199861 - protein, 14 aa, Borrelia afzelii
LNKEGLEYANKWKI

SEQ ID NO: 199862 - protein, 14 aa, Borrelia afzelii
NKEGLEYANKWKIQ

SEQ ID NO: 199863 - protein, 14 aa, Borrelia afzelii
KEGLEYANKWKIQE

SEQ ID NO: 199864 - protein, 14 aa, Borrelia afzelii
EGLEYANKWKIQEI

SEQ ID NO: 199865 - protein, 14 aa, Borrelia afzelii
GLEYANKWKIQEIV

SEQ ID NO: 199866 - protein, 14 aa, Borrelia afzelii
LEYANKWKIQEIVK

SEQ ID NO: 199867 - protein, 14 aa, Borrelia afzelii
EYANKWKIQEIVKK

SEQ ID NO: 199868 - protein, 14 aa, Borrelia afzelii
YANKWKIQEIVKKY

SEQ ID NO: 199869 - protein, 14 aa, Borrelia afzelii
ANKWKIQEIVKKYS

SEQ ID NO: 199870 - protein, 14 aa, Borrelia afzelii
NKWKIQEIVKKYSN

SEQ ID NO: 199871 - protein, 14 aa, Borrelia afzelii
KWKIQEIVKKYSNH

SEQ ID NO: 199872 - protein, 14 aa, Borrelia afzelii
WKIQEIVKKYSNHI

SEQ ID NO: 199873 - protein, 14 aa, Borrelia afzelii
KIQEIVKKYSNHIN

SEQ ID NO: 199874 - protein, 14 aa, Borrelia afzelii
IQEIVKKYSNHINY

SEQ ID NO: 199875 - protein, 14 aa, Borrelia afzelii
QEIVKKYSNHINYP

SEQ ID NO: 199876 - protein, 14 aa, Borrelia afzelii
EIVKKYSNHINYPI

SEQ ID NO: 199877 - protein, 14 aa, Borrelia afzelii
IVKKYSNHINYPIY

SEQ ID NO: 199878 - protein, 14 aa, Borrelia afzelii
VKKYSNHINYPIYI

SEQ ID NO: 199879 - protein, 14 aa, Borrelia afzelii
KKYSNHINYPIYIK

SEQ ID NO: 199880 - protein, 14 aa, Borrelia afzelii
KYSNHINYPIYIKY

SEQ ID NO: 199881 - protein, 14 aa, Borrelia afzelii
YSNHINYPIYIKYN

SEQ ID NO: 199882 - protein, 14 aa, Borrelia afzelii
SNHINYPIYIKYNE

SEQ ID NO: 199883 - protein, 14 aa, Borrelia afzelii
NHINYPIYIKYNEP

SEQ ID NO: 199884 - protein, 14 aa, Borrelia afzelii
HINYPIYIKYNEPI

SEQ ID NO: 199885 - protein, 14 aa, Borrelia afzelii
INYPIYIKYNEPIM

SEQ ID NO: 199886 - protein, 14 aa, Borrelia afzelii
NYPIYIKYNEPIMK

SEQ ID NO: 199887 - protein, 14 aa, Borrelia afzelii
YPIYIKYNEPIMKD

SEQ ID NO: 199888 - protein, 14 aa, Borrelia afzelii
PIYIKYNEPIMKDG

SEQ ID NO: 199889 - protein, 14 aa, Borrelia afzelii
IYIKYNEPIMKDGK

SEQ ID NO: 199890 - protein, 14 aa, Borrelia afzelii
YIKYNEPIMKDGKQ

SEQ ID NO: 199891 - protein, 14 aa, Borrelia afzelii
IKYNEPIMKDGKQE

SEQ ID NO: 199892 - protein, 14 aa, Borrelia afzelii
KYNEPIMKDGKQEG

SEQ ID NO: 199893 - protein, 14 aa, Borrelia afzelii
YNEPIMKDGKQEGI

SEQ ID NO: 199894 - protein, 14 aa, Borrelia afzelii
NEPIMKDGKQEGIE

SEQ ID NO: 199895 - protein, 14 aa, Borrelia afzelii
EPIMKDGKQEGIEE

SEQ ID NO: 199896 - protein, 14 aa, Borrelia afzelii
PIMKDGKQEGIEEK

SEQ ID NO: 199897 - protein, 14 aa, Borrelia afzelii
IMKDGKQEGIEEKE

SEQ ID NO: 199898 - protein, 14 aa, Borrelia afzelii
MKDGKQEGIEEKEE

SEQ ID NO: 199899 - protein, 14 aa, Borrelia afzelii
KDGKQEGIEEKEEK

SEQ ID NO: 199900 - protein, 14 aa, Borrelia afzelii
DGKQEGIEEKEEKL

SEQ ID NO: 199901 - protein, 14 aa, Borrelia afzelii
GKQEGIEEKEEKLN

SEQ ID NO: 199902 - protein, 14 aa, Borrelia afzelii
KQEGIEEKEEKLNE

SEQ ID NO: 199903 - protein, 14 aa, Borrelia afzelii
QEGIEEKEEKLNET

SEQ ID NO: 199904 - protein, 14 aa, Borrelia afzelii
EGIEEKEEKLNETT

SEQ ID NO: 199905 - protein, 14 aa, Borrelia afzelii
GIEEKEEKLNETTA

SEQ ID NO: 199906 - protein, 14 aa, Borrelia afzelii
IEEKEEKLNETTAL

SEQ ID NO: 199907 - protein, 14 aa, Borrelia afzelii
EEKEEKLNETTALW

SEQ ID NO: 199908 - protein, 14 aa, Borrelia afzelii
EKEEKLNETTALWT

SEQ ID NO: 199909 - protein, 14 aa, Borrelia afzelii
KEEKLNETTALWTK

SEQ ID NO: 199910 - protein, 14 aa, Borrelia afzelii
EEKLNETTALWTKN

SEQ ID NO: 199911 - protein, 14 aa, Borrelia afzelii
EKLNETTALWTKNK

SEQ ID NO: 199912 - protein, 14 aa, Borrelia afzelii
KLNETTALWTKNKS

SEQ ID NO: 199913 - protein, 14 aa, Borrelia afzelii
LNETTALWTKNKSE

SEQ ID NO: 199914 - protein, 14 aa, Borrelia afzelii
NETTALWTKNKSEI

SEQ ID NO: 199915 - protein, 14 aa, Borrelia afzelii
ETTALWTKNKSEIK

SEQ ID NO: 199916 - protein, 14 aa, Borrelia afzelii
TTALWTKNKSEIKT

SEQ ID NO: 199917 - protein, 14 aa, Borrelia afzelii
TALWTKNKSEIKTE

SEQ ID NO: 199918 - protein, 14 aa, Borrelia afzelii
ALWTKNKSEIKTEE

SEQ ID NO: 199919 - protein, 14 aa, Borrelia afzelii
LWTKNKSEIKTEEY

SEQ ID NO: 199920 - protein, 14 aa, Borrelia afzelii
WTKNKSEIKTEEYN

SEQ ID NO: 199921 - protein, 14 aa, Borrelia afzelii
TKNKSEIKTEEYNE

SEQ ID NO: 199922 - protein, 14 aa, Borrelia afzelii
KNKSEIKTEEYNEF

SEQ ID NO: 199923 - protein, 14 aa, Borrelia afzelii
NKSEIKTEEYNEFY

SEQ ID NO: 199924 - protein, 14 aa, Borrelia afzelii
KSEIKTEEYNEFYK

SEQ ID NO: 199925 - protein, 14 aa, Borrelia afzelii
SEIKTEEYNEFYKN

SEQ ID NO: 199926 - protein, 14 aa, Borrelia afzelii
EIKTEEYNEFYKNT

SEQ ID NO: 199927 - protein, 14 aa, Borrelia afzelii
IKTEEYNEFYKNTT

SEQ ID NO: 199928 - protein, 14 aa, Borrelia afzelii
KTEEYNEFYKNTTF

SEQ ID NO: 199929 - protein, 14 aa, Borrelia afzelii
TEEYNEFYKNTTFD

SEQ ID NO: 199930 - protein, 14 aa, Borrelia afzelii
EEYNEFYKNTTFDY

SEQ ID NO: 199931 - protein, 14 aa, Borrelia afzelii
EYNEFYKNTTFDYE

SEQ ID NO: 199932 - protein, 14 aa, Borrelia afzelii
YNEFYKNTTFDYEN

SEQ ID NO: 199933 - protein, 14 aa, Borrelia afzelii
NEFYKNTTFDYENP

SEQ ID NO: 199934 - protein, 14 aa, Borrelia afzelii
EFYKNTTFDYENPL

SEQ ID NO: 199935 - protein, 14 aa, Borrelia afzelii
FYKNTTFDYENPLM

SEQ ID NO: 199936 - protein, 14 aa, Borrelia afzelii
YKNTTFDYENPLMY

SEQ ID NO: 199937 - protein, 14 aa, Borrelia afzelii
KNTTFDYENPLMYI

SEQ ID NO: 199938 - protein, 14 aa, Borrelia afzelii
NTTFDYENPLMYIH

SEQ ID NO: 199939 - protein, 14 aa, Borrelia afzelii
TTFDYENPLMYIHT

SEQ ID NO: 199940 - protein, 14 aa, Borrelia afzelii
TFDYENPLMYIHTK

SEQ ID NO: 199941 - protein, 14 aa, Borrelia afzelii
FDYENPLMYIHTKA

SEQ ID NO: 199942 - protein, 14 aa, Borrelia afzelii
DYENPLMYIHTKAE

SEQ ID NO: 199943 - protein, 14 aa, Borrelia afzelii
YENPLMYIHTKAEG

SEQ ID NO: 199944 - protein, 14 aa, Borrelia afzelii
ENPLMYIHTKAEGN

SEQ ID NO: 199945 - protein, 14 aa, Borrelia afzelii
NPLMYIHTKAEGNL

SEQ ID NO: 199946 - protein, 14 aa, Borrelia afzelii
PLMYIHTKAEGNLE

SEQ ID NO: 199947 - protein, 14 aa, Borrelia afzelii
LMYIHTKAEGNLEY

SEQ ID NO: 199948 - protein, 14 aa, Borrelia afzelii
MYIHTKAEGNLEYT

SEQ ID NO: 199949 - protein, 14 aa, Borrelia afzelii
YIHTKAEGNLEYTN

SEQ ID NO: 199950 - protein, 14 aa, Borrelia afzelii
IHTKAEGNLEYTNL

SEQ ID NO: 199951 - protein, 14 aa, Borrelia afzelii
HTKAEGNLEYTNLF

SEQ ID NO: 199952 - protein, 14 aa, Borrelia afzelii
TKAEGNLEYTNLFY

SEQ ID NO: 199953 - protein, 14 aa, Borrelia afzelii
KAEGNLEYTNLFYI

SEQ ID NO: 199954 - protein, 14 aa, Borrelia afzelii
AEGNLEYTNLFYIP

SEQ ID NO: 199955 - protein, 14 aa, Borrelia afzelii
EGNLEYTNLFYIPS

SEQ ID NO: 199956 - protein, 14 aa, Borrelia afzelii
GNLEYTNLFYIPSK

SEQ ID NO: 199957 - protein, 14 aa, Borrelia afzelii
NLEYTNLFYIPSKA

SEQ ID NO: 199958 - protein, 14 aa, Borrelia afzelii
LEYTNLFYIPSKAP

SEQ ID NO: 199959 - protein, 14 aa, Borrelia afzelii
EYTNLFYIPSKAPY

SEQ ID NO: 199960 - protein, 14 aa, Borrelia afzelii
YTNLFYIPSKAPYD

SEQ ID NO: 199961 - protein, 14 aa, Borrelia afzelii
TNLFYIPSKAPYDL

SEQ ID NO: 199962 - protein, 14 aa, Borrelia afzelii
NLFYIPSKAPYDLY

SEQ ID NO: 199963 - protein, 14 aa, Borrelia afzelii
LFYIPSKAPYDLYY

SEQ ID NO: 199964 - protein, 14 aa, Borrelia afzelii
FYIPSKAPYDLYYP

SEQ ID NO: 199965 - protein, 14 aa, Borrelia afzelii
YIPSKAPYDLYYPN

SEQ ID NO: 199966 - protein, 14 aa, Borrelia afzelii
IPSKAPYDLYYPNT

SEQ ID NO: 199967 - protein, 14 aa, Borrelia afzelii
PSKAPYDLYYPNTK

SEQ ID NO: 199968 - protein, 14 aa, Borrelia afzelii
SKAPYDLYYPNTKP

SEQ ID NO: 199969 - protein, 14 aa, Borrelia afzelii
KAPYDLYYPNTKPG

SEQ ID NO: 199970 - protein, 14 aa, Borrelia afzelii
APYDLYYPNTKPGV

SEQ ID NO: 199971 - protein, 14 aa, Borrelia afzelii
PYDLYYPNTKPGVK

SEQ ID NO: 199972 - protein, 14 aa, Borrelia afzelii
YDLYYPNTKPGVKL

SEQ ID NO: 199973 - protein, 14 aa, Borrelia afzelii
DLYYPNTKPGVKLF

SEQ ID NO: 199974 - protein, 14 aa, Borrelia afzelii
LYYPNTKPGVKLFI

SEQ ID NO: 199975 - protein, 14 aa, Borrelia afzelii
YYPNTKPGVKLFIN

SEQ ID NO: 199976 - protein, 14 aa, Borrelia afzelii
YPNTKPGVKLFINR

SEQ ID NO: 199977 - protein, 14 aa, Borrelia afzelii
PNTKPGVKLFINRI

SEQ ID NO: 199978 - protein, 14 aa, Borrelia afzelii
NTKPGVKLFINRIF

SEQ ID NO: 199979 - protein, 14 aa, Borrelia afzelii
TKPGVKLFINRIFI

SEQ ID NO: 199980 - protein, 14 aa, Borrelia afzelii
KPGVKLFINRIFIT

SEQ ID NO: 199981 - protein, 14 aa, Borrelia afzelii
PGVKLFINRIFITD

SEQ ID NO: 199982 - protein, 14 aa, Borrelia afzelii
GVKLFINRIFITDS

SEQ ID NO: 199983 - protein, 14 aa, Borrelia afzelii
VKLFINRIFITDSE

SEQ ID NO: 199984 - protein, 14 aa, Borrelia afzelii
KLFINRIFITDSEG

SEQ ID NO: 199985 - protein, 14 aa, Borrelia afzelii
LFINRIFITDSEGS

SEQ ID NO: 199986 - protein, 14 aa, Borrelia afzelii
FINRIFITDSEGSL

SEQ ID NO: 199987 - protein, 14 aa, Borrelia afzelii
INRIFITDSEGSLL

SEQ ID NO: 199988 - protein, 14 aa, Borrelia afzelii
NRIFITDSEGSLLP

SEQ ID NO: 199989 - protein, 14 aa, Borrelia afzelii
RIFITDSEGSLLPN

SEQ ID NO: 199990 - protein, 14 aa, Borrelia afzelii
IFITDSEGSLLPNY

SEQ ID NO: 199991 - protein, 14 aa, Borrelia afzelii
FITDSEGSLLPNYL

SEQ ID NO: 199992 - protein, 14 aa, Borrelia afzelii
ITDSEGSLLPNYLR

SEQ ID NO: 199993 - protein, 14 aa, Borrelia afzelii
TDSEGSLLPNYLRF

SEQ ID NO: 199994 - protein, 14 aa, Borrelia afzelii
DSEGSLLPNYLRFI

SEQ ID NO: 199995 - protein, 14 aa, Borrelia afzelii
SEGSLLPNYLRFIK

SEQ ID NO: 199996 - protein, 14 aa, Borrelia afzelii
EGSLLPNYLRFIKG

SEQ ID NO: 199997 - protein, 14 aa, Borrelia afzelii
GSLLPNYLRFIKGI

SEQ ID NO: 199998 - protein, 14 aa, Borrelia afzelii
SLLPNYLRFIKGII

SEQ ID NO: 199999 - protein, 14 aa, Borrelia afzelii
LLPNYLRFIKGIID

SEQ ID NO: 200000 - protein, 14 aa, Borrelia afzelii
LPNYLRFIKGIIDC

SEQ ID NO: 200001 - protein, 14 aa, Borrelia afzelii
PNYLRFIKGIIDCQ

SEQ ID NO: 200002 - protein, 14 aa, Borrelia afzelii
NYLRFIKGIIDCQD

SEQ ID NO: 200003 - protein, 14 aa, Borrelia afzelii
YLRFIKGIIDCQDL

SEQ ID NO: 200004 - protein, 14 aa, Borrelia afzelii
LRFIKGIIDCQDLP

SEQ ID NO: 200005 - protein, 14 aa, Borrelia afzelii
RFIKGIIDCQDLPL

SEQ ID NO: 200006 - protein, 14 aa, Borrelia afzelii
FIKGIIDCQDLPLN

SEQ ID NO: 200007 - protein, 14 aa, Borrelia afzelii
IKGIIDCQDLPLNV

SEQ ID NO: 200008 - protein, 14 aa, Borrelia afzelii
KGIIDCQDLPLNVS

SEQ ID NO: 200009 - protein, 14 aa, Borrelia afzelii
GIIDCQDLPLNVSR

SEQ ID NO: 200010 - protein, 14 aa, Borrelia afzelii
IIDCQDLPLNVSRE

SEQ ID NO: 200011 - protein, 14 aa, Borrelia afzelii
IDCQDLPLNVSREI

SEQ ID NO: 200012 - protein, 14 aa, Borrelia afzelii
DCQDLPLNVSREIL

SEQ ID NO: 200013 - protein, 14 aa, Borrelia afzelii
CQDLPLNVSREILQ

SEQ ID NO: 200014 - protein, 14 aa, Borrelia afzelii
QDLPLNVSREILQQ

SEQ ID NO: 200015 - protein, 14 aa, Borrelia afzelii
DLPLNVSREILQQN

SEQ ID NO: 200016 - protein, 14 aa, Borrelia afzelii
LPLNVSREILQQNK

SEQ ID NO: 200017 - protein, 14 aa, Borrelia afzelii
PLNVSREILQQNKI

SEQ ID NO: 200018 - protein, 14 aa, Borrelia afzelii
LNVSREILQQNKIL

SEQ ID NO: 200019 - protein, 14 aa, Borrelia afzelii
NVSREILQQNKILS

SEQ ID NO: 200020 - protein, 14 aa, Borrelia afzelii
VSREILQQNKILSK

SEQ ID NO: 200021 - protein, 14 aa, Borrelia afzelii
SREILQQNKILSKI

SEQ ID NO: 200022 - protein, 14 aa, Borrelia afzelii
REILQQNKILSKIK

SEQ ID NO: 200023 - protein, 14 aa, Borrelia afzelii
EILQQNKILSKIKS

SEQ ID NO: 200024 - protein, 14 aa, Borrelia afzelii
ILQQNKILSKIKSS

SEQ ID NO: 200025 - protein, 14 aa, Borrelia afzelii
LQQNKILSKIKSSS

SEQ ID NO: 200026 - protein, 14 aa, Borrelia afzelii
QQNKILSKIKSSSV

SEQ ID NO: 200027 - protein, 14 aa, Borrelia afzelii
QNKILSKIKSSSVK

SEQ ID NO: 200028 - protein, 14 aa, Borrelia afzelii
NKILSKIKSSSVKK

SEQ ID NO: 200029 - protein, 14 aa, Borrelia afzelii
KILSKIKSSSVKKI

SEQ ID NO: 200030 - protein, 14 aa, Borrelia afzelii
ILSKIKSSSVKKIL

SEQ ID NO: 200031 - protein, 14 aa, Borrelia afzelii
LSKIKSSSVKKILS

SEQ ID NO: 200032 - protein, 14 aa, Borrelia afzelii
SKIKSSSVKKILSE

SEQ ID NO: 200033 - protein, 14 aa, Borrelia afzelii
KIKSSSVKKILSEL

SEQ ID NO: 200034 - protein, 14 aa, Borrelia afzelii
IKSSSVKKILSELE

SEQ ID NO: 200035 - protein, 14 aa, Borrelia afzelii
KSSSVKKILSELEK

SEQ ID NO: 200036 - protein, 14 aa, Borrelia afzelii
SSSVKKILSELEKL

SEQ ID NO: 200037 - protein, 14 aa, Borrelia afzelii
SSVKKILSELEKLS

SEQ ID NO: 200038 - protein, 14 aa, Borrelia afzelii
SVKKILSELEKLSK

SEQ ID NO: 200039 - protein, 14 aa, Borrelia afzelii
VKKILSELEKLSKK

SEQ ID NO: 200040 - protein, 14 aa, Borrelia afzelii
KKILSELEKLSKKN

SEQ ID NO: 200041 - protein, 14 aa, Borrelia afzelii
KILSELEKLSKKNP

SEQ ID NO: 200042 - protein, 14 aa, Borrelia afzelii
ILSELEKLSKKNPE

SEQ ID NO: 200043 - protein, 14 aa, Borrelia afzelii
LSELEKLSKKNPEK

SEQ ID NO: 200044 - protein, 14 aa, Borrelia afzelii
SELEKLSKKNPEKF

SEQ ID NO: 200045 - protein, 14 aa, Borrelia afzelii
ELEKLSKKNPEKFS

SEQ ID NO: 200046 - protein, 14 aa, Borrelia afzelii
LEKLSKKNPEKFSE

SEQ ID NO: 200047 - protein, 14 aa, Borrelia afzelii
EKLSKKNPEKFSEF

SEQ ID NO: 200048 - protein, 14 aa, Borrelia afzelii
KLSKKNPEKFSEFS

SEQ ID NO: 200049 - protein, 14 aa, Borrelia afzelii
LSKKNPEKFSEFSK

SEQ ID NO: 200050 - protein, 14 aa, Borrelia afzelii
SKKNPEKFSEFSKE

SEQ ID NO: 200051 - protein, 14 aa, Borrelia afzelii
KKNPEKFSEFSKEF

SEQ ID NO: 200052 - protein, 14 aa, Borrelia afzelii
KNPEKFSEFSKEFG

SEQ ID NO: 200053 - protein, 14 aa, Borrelia afzelii
NPEKFSEFSKEFGR

SEQ ID NO: 200054 - protein, 14 aa, Borrelia afzelii
PEKFSEFSKEFGRC

SEQ ID NO: 200055 - protein, 14 aa, Borrelia afzelii
EKFSEFSKEFGRCI

SEQ ID NO: 200056 - protein, 14 aa, Borrelia afzelii
KFSEFSKEFGRCIK

SEQ ID NO: 200057 - protein, 14 aa, Borrelia afzelii
FSEFSKEFGRCIKE

SEQ ID NO: 200058 - protein, 14 aa, Borrelia afzelii
SEFSKEFGRCIKEG

SEQ ID NO: 200059 - protein, 14 aa, Borrelia afzelii
EFSKEFGRCIKEGV

SEQ ID NO: 200060 - protein, 14 aa, Borrelia afzelii
FSKEFGRCIKEGVY

SEQ ID NO: 200061 - protein, 14 aa, Borrelia afzelii
SKEFGRCIKEGVYS

SEQ ID NO: 200062 - protein, 14 aa, Borrelia afzelii
KEFGRCIKEGVYSD

SEQ ID NO: 200063 - protein, 14 aa, Borrelia afzelii
EFGRCIKEGVYSDF

SEQ ID NO: 200064 - protein, 14 aa, Borrelia afzelii
FGRCIKEGVYSDFE

SEQ ID NO: 200065 - protein, 14 aa, Borrelia afzelii
GRCIKEGVYSDFEN

SEQ ID NO: 200066 - protein, 14 aa, Borrelia afzelii
RCIKEGVYSDFENR

SEQ ID NO: 200067 - protein, 14 aa, Borrelia afzelii
CIKEGVYSDFENRE

SEQ ID NO: 200068 - protein, 14 aa, Borrelia afzelii
IKEGVYSDFENREK

SEQ ID NO: 200069 - protein, 14 aa, Borrelia afzelii
KEGVYSDFENREKL

SEQ ID NO: 200070 - protein, 14 aa, Borrelia afzelii
EGVYSDFENREKLI

SEQ ID NO: 200071 - protein, 14 aa, Borrelia afzelii
GVYSDFENREKLIS

SEQ ID NO: 200072 - protein, 14 aa, Borrelia afzelii
VYSDFENREKLISL

SEQ ID NO: 200073 - protein, 14 aa, Borrelia afzelii
YSDFENREKLISLI

SEQ ID NO: 200074 - protein, 14 aa, Borrelia afzelii
SDFENREKLISLIR

SEQ ID NO: 200075 - protein, 14 aa, Borrelia afzelii
DFENREKLISLIRF

SEQ ID NO: 200076 - protein, 14 aa, Borrelia afzelii
FENREKLISLIRFK

SEQ ID NO: 200077 - protein, 14 aa, Borrelia afzelii
ENREKLISLIRFKS

SEQ ID NO: 200078 - protein, 14 aa, Borrelia afzelii
NREKLISLIRFKSS

SEQ ID NO: 200079 - protein, 14 aa, Borrelia afzelii
REKLISLIRFKSSS

SEQ ID NO: 200080 - protein, 14 aa, Borrelia afzelii
EKLISLIRFKSSSV

SEQ ID NO: 200081 - protein, 14 aa, Borrelia afzelii
KLISLIRFKSSSVD

SEQ ID NO: 200082 - protein, 14 aa, Borrelia afzelii
LISLIRFKSSSVDG

SEQ ID NO: 200083 - protein, 14 aa, Borrelia afzelii
ISLIRFKSSSVDGF

SEQ ID NO: 200084 - protein, 14 aa, Borrelia afzelii
SLIRFKSSSVDGFV

SEQ ID NO: 200085 - protein, 14 aa, Borrelia afzelii
LIRFKSSSVDGFVS

SEQ ID NO: 200086 - protein, 14 aa, Borrelia afzelii
IRFKSSSVDGFVSF

SEQ ID NO: 200087 - protein, 14 aa, Borrelia afzelii
RFKSSSVDGFVSFK

SEQ ID NO: 200088 - protein, 14 aa, Borrelia afzelii
FKSSSVDGFVSFKE

SEQ ID NO: 200089 - protein, 14 aa, Borrelia afzelii
KSSSVDGFVSFKEY

SEQ ID NO: 200090 - protein, 14 aa, Borrelia afzelii
SSSVDGFVSFKEYK

SEQ ID NO: 200091 - protein, 14 aa, Borrelia afzelii
SSVDGFVSFKEYKE

SEQ ID NO: 200092 - protein, 14 aa, Borrelia afzelii
SVDGFVSFKEYKER

SEQ ID NO: 200093 - protein, 14 aa, Borrelia afzelii
VDGFVSFKEYKERM

SEQ ID NO: 200094 - protein, 14 aa, Borrelia afzelii
DGFVSFKEYKERMN

SEQ ID NO: 200095 - protein, 14 aa, Borrelia afzelii
GFVSFKEYKERMNE

SEQ ID NO: 200096 - protein, 14 aa, Borrelia afzelii
FVSFKEYKERMNEG

SEQ ID NO: 200097 - protein, 14 aa, Borrelia afzelii
VSFKEYKERMNEGQ

SEQ ID NO: 200098 - protein, 14 aa, Borrelia afzelii
SFKEYKERMNEGQK

SEQ ID NO: 200099 - protein, 14 aa, Borrelia afzelii
FKEYKERMNEGQKS

SEQ ID NO: 200100 - protein, 14 aa, Borrelia afzelii
KEYKERMNEGQKSI

SEQ ID NO: 200101 - protein, 14 aa, Borrelia afzelii
EYKERMNEGQKSIY

SEQ ID NO: 200102 - protein, 14 aa, Borrelia afzelii
YKERMNEGQKSIYY

SEQ ID NO: 200103 - protein, 14 aa, Borrelia afzelii
KERMNEGQKSIYYI

SEQ ID NO: 200104 - protein, 14 aa, Borrelia afzelii
ERMNEGQKSIYYIT

SEQ ID NO: 200105 - protein, 14 aa, Borrelia afzelii
RMNEGQKSIYYITG

SEQ ID NO: 200106 - protein, 14 aa, Borrelia afzelii
MNEGQKSIYYITGG

SEQ ID NO: 200107 - protein, 14 aa, Borrelia afzelii
NEGQKSIYYITGGK

SEQ ID NO: 200108 - protein, 14 aa, Borrelia afzelii
EGQKSIYYITGGKE

SEQ ID NO: 200109 - protein, 14 aa, Borrelia afzelii
GQKSIYYITGGKEN

SEQ ID NO: 200110 - protein, 14 aa, Borrelia afzelii
QKSIYYITGGKENI

SEQ ID NO: 200111 - protein, 14 aa, Borrelia afzelii
KSIYYITGGKENIL

SEQ ID NO: 200112 - protein, 14 aa, Borrelia afzelii
SIYYITGGKENILK

SEQ ID NO: 200113 - protein, 14 aa, Borrelia afzelii
IYYITGGKENILKE

SEQ ID NO: 200114 - protein, 14 aa, Borrelia afzelii
YYITGGKENILKEN

SEQ ID NO: 200115 - protein, 14 aa, Borrelia afzelii
YITGGKENILKENP

SEQ ID NO: 200116 - protein, 14 aa, Borrelia afzelii
ITGGKENILKENPI

SEQ ID NO: 200117 - protein, 14 aa, Borrelia afzelii
TGGKENILKENPIV

SEQ ID NO: 200118 - protein, 14 aa, Borrelia afzelii
GGKENILKENPIVT

SEQ ID NO: 200119 - protein, 14 aa, Borrelia afzelii
GKENILKENPIVTA

SEQ ID NO: 200120 - protein, 14 aa, Borrelia afzelii
KENILKENPIVTAY

SEQ ID NO: 200121 - protein, 14 aa, Borrelia afzelii
ENILKENPIVTAYK

SEQ ID NO: 200122 - protein, 14 aa, Borrelia afzelii
NILKENPIVTAYKE

SEQ ID NO: 200123 - protein, 14 aa, Borrelia afzelii
ILKENPIVTAYKEK

SEQ ID NO: 200124 - protein, 14 aa, Borrelia afzelii
LKENPIVTAYKEKG

SEQ ID NO: 200125 - protein, 14 aa, Borrelia afzelii
KENPIVTAYKEKGF

SEQ ID NO: 200126 - protein, 14 aa, Borrelia afzelii
ENPIVTAYKEKGFE

SEQ ID NO: 200127 - protein, 14 aa, Borrelia afzelii
NPIVTAYKEKGFEI

SEQ ID NO: 200128 - protein, 14 aa, Borrelia afzelii
PIVTAYKEKGFEIL

SEQ ID NO: 200129 - protein, 14 aa, Borrelia afzelii
IVTAYKEKGFEILI

SEQ ID NO: 200130 - protein, 14 aa, Borrelia afzelii
VTAYKEKGFEILIM

SEQ ID NO: 200131 - protein, 14 aa, Borrelia afzelii
TAYKEKGFEILIMD

SEQ ID NO: 200132 - protein, 14 aa, Borrelia afzelii
AYKEKGFEILIMDD

SEQ ID NO: 200133 - protein, 14 aa, Borrelia afzelii
YKEKGFEILIMDDE

SEQ ID NO: 200134 - protein, 14 aa, Borrelia afzelii
KEKGFEILIMDDEL

SEQ ID NO: 200135 - protein, 14 aa, Borrelia afzelii
EKGFEILIMDDELD

SEQ ID NO: 200136 - protein, 14 aa, Borrelia afzelii
KGFEILIMDDELDE

SEQ ID NO: 200137 - protein, 14 aa, Borrelia afzelii
GFEILIMDDELDEA

SEQ ID NO: 200138 - protein, 14 aa, Borrelia afzelii
FEILIMDDELDEAI

SEQ ID NO: 200139 - protein, 14 aa, Borrelia afzelii
EILIMDDELDEAIL

SEQ ID NO: 200140 - protein, 14 aa, Borrelia afzelii
ILIMDDELDEAILN

SEQ ID NO: 200141 - protein, 14 aa, Borrelia afzelii
LIMDDELDEAILNL

SEQ ID NO: 200142 - protein, 14 aa, Borrelia afzelii
IMDDELDEAILNLI

SEQ ID NO: 200143 - protein, 14 aa, Borrelia afzelii
MDDELDEAILNLIP

SEQ ID NO: 200144 - protein, 14 aa, Borrelia afzelii
DDELDEAILNLIPE

SEQ ID NO: 200145 - protein, 14 aa, Borrelia afzelii
DELDEAILNLIPEY

SEQ ID NO: 200146 - protein, 14 aa, Borrelia afzelii
ELDEAILNLIPEYE

SEQ ID NO: 200147 - protein, 14 aa, Borrelia afzelii
LDEAILNLIPEYEG

SEQ ID NO: 200148 - protein, 14 aa, Borrelia afzelii
DEAILNLIPEYEGL

SEQ ID NO: 200149 - protein, 14 aa, Borrelia afzelii
EAILNLIPEYEGLK

SEQ ID NO: 200150 - protein, 14 aa, Borrelia afzelii
AILNLIPEYEGLKL

SEQ ID NO: 200151 - protein, 14 aa, Borrelia afzelii
ILNLIPEYEGLKLK

SEQ ID NO: 200152 - protein, 14 aa, Borrelia afzelii
LNLIPEYEGLKLKA

SEQ ID NO: 200153 - protein, 14 aa, Borrelia afzelii
NLIPEYEGLKLKAI

SEQ ID NO: 200154 - protein, 14 aa, Borrelia afzelii
LIPEYEGLKLKAIN

SEQ ID NO: 200155 - protein, 14 aa, Borrelia afzelii
IPEYEGLKLKAINK

SEQ ID NO: 200156 - protein, 14 aa, Borrelia afzelii
PEYEGLKLKAINKN

SEQ ID NO: 200157 - protein, 14 aa, Borrelia afzelii
EYEGLKLKAINKNE

SEQ ID NO: 200158 - protein, 14 aa, Borrelia afzelii
YEGLKLKAINKNET

SEQ ID NO: 200159 - protein, 14 aa, Borrelia afzelii
EGLKLKAINKNETS

SEQ ID NO: 200160 - protein, 14 aa, Borrelia afzelii
GLKLKAINKNETSN

SEQ ID NO: 200161 - protein, 14 aa, Borrelia afzelii
LKLKAINKNETSNE

SEQ ID NO: 200162 - protein, 14 aa, Borrelia afzelii
KLKAINKNETSNEL

SEQ ID NO: 200163 - protein, 14 aa, Borrelia afzelii
LKAINKNETSNELK

SEQ ID NO: 200164 - protein, 14 aa, Borrelia afzelii
KAINKNETSNELKD

SEQ ID NO: 200165 - protein, 14 aa, Borrelia afzelii
AINKNETSNELKDE

SEQ ID NO: 200166 - protein, 14 aa, Borrelia afzelii
INKNETSNELKDEN

SEQ ID NO: 200167 - protein, 14 aa, Borrelia afzelii
NKNETSNELKDENF

SEQ ID NO: 200168 - protein, 14 aa, Borrelia afzelii
KNETSNELKDENFK

SEQ ID NO: 200169 - protein, 14 aa, Borrelia afzelii
NETSNELKDENFKK

SEQ ID NO: 200170 - protein, 14 aa, Borrelia afzelii
ETSNELKDENFKKI

SEQ ID NO: 200171 - protein, 14 aa, Borrelia afzelii
TSNELKDENFKKIE

SEQ ID NO: 200172 - protein, 14 aa, Borrelia afzelii
SNELKDENFKKIEE

SEQ ID NO: 200173 - protein, 14 aa, Borrelia afzelii
NELKDENFKKIEEE

SEQ ID NO: 200174 - protein, 14 aa, Borrelia afzelii
ELKDENFKKIEEEF

SEQ ID NO: 200175 - protein, 14 aa, Borrelia afzelii
LKDENFKKIEEEFK

SEQ ID NO: 200176 - protein, 14 aa, Borrelia afzelii
KDENFKKIEEEFKD

SEQ ID NO: 200177 - protein, 14 aa, Borrelia afzelii
DENFKKIEEEFKDT

SEQ ID NO: 200178 - protein, 14 aa, Borrelia afzelii
ENFKKIEEEFKDTL

SEQ ID NO: 200179 - protein, 14 aa, Borrelia afzelii
NFKKIEEEFKDTLT

SEQ ID NO: 200180 - protein, 14 aa, Borrelia afzelii
FKKIEEEFKDTLTR

SEQ ID NO: 200181 - protein, 14 aa, Borrelia afzelii
KKIEEEFKDTLTRV

SEQ ID NO: 200182 - protein, 14 aa, Borrelia afzelii
KIEEEFKDTLTRVK

SEQ ID NO: 200183 - protein, 14 aa, Borrelia afzelii
IEEEFKDTLTRVKE

SEQ ID NO: 200184 - protein, 14 aa, Borrelia afzelii
EEEFKDTLTRVKEI

SEQ ID NO: 200185 - protein, 14 aa, Borrelia afzelii
EEFKDTLTRVKEIL

SEQ ID NO: 200186 - protein, 14 aa, Borrelia afzelii
EFKDTLTRVKEILK

SEQ ID NO: 200187 - protein, 14 aa, Borrelia afzelii
FKDTLTRVKEILKD

SEQ ID NO: 200188 - protein, 14 aa, Borrelia afzelii
KDTLTRVKEILKDQ

SEQ ID NO: 200189 - protein, 14 aa, Borrelia afzelii
DTLTRVKEILKDQI

SEQ ID NO: 200190 - protein, 14 aa, Borrelia afzelii
TLTRVKEILKDQIK

SEQ ID NO: 200191 - protein, 14 aa, Borrelia afzelii
LTRVKEILKDQIKE

SEQ ID NO: 200192 - protein, 14 aa, Borrelia afzelii
TRVKEILKDQIKEV

SEQ ID NO: 200193 - protein, 14 aa, Borrelia afzelii
RVKEILKDQIKEVN

SEQ ID NO: 200194 - protein, 14 aa, Borrelia afzelii
VKEILKDQIKEVNL

SEQ ID NO: 200195 - protein, 14 aa, Borrelia afzelii
KEILKDQIKEVNLS

SEQ ID NO: 200196 - protein, 14 aa, Borrelia afzelii
EILKDQIKEVNLSA

SEQ ID NO: 200197 - protein, 14 aa, Borrelia afzelii
ILKDQIKEVNLSAT

SEQ ID NO: 200198 - protein, 14 aa, Borrelia afzelii
LKDQIKEVNLSATL

SEQ ID NO: 200199 - protein, 14 aa, Borrelia afzelii
KDQIKEVNLSATLI

SEQ ID NO: 200200 - protein, 14 aa, Borrelia afzelii
DQIKEVNLSATLIK

SEQ ID NO: 200201 - protein, 14 aa, Borrelia afzelii
QIKEVNLSATLIKE

SEQ ID NO: 200202 - protein, 14 aa, Borrelia afzelii
IKEVNLSATLIKEP

SEQ ID NO: 200203 - protein, 14 aa, Borrelia afzelii
KEVNLSATLIKEPS

SEQ ID NO: 200204 - protein, 14 aa, Borrelia afzelii
EVNLSATLIKEPSA

SEQ ID NO: 200205 - protein, 14 aa, Borrelia afzelii
VNLSATLIKEPSAI

SEQ ID NO: 200206 - protein, 14 aa, Borrelia afzelii
NLSATLIKEPSAII

SEQ ID NO: 200207 - protein, 14 aa, Borrelia afzelii
LSATLIKEPSAIIV

SEQ ID NO: 200208 - protein, 14 aa, Borrelia afzelii
SATLIKEPSAIIVD

SEQ ID NO: 200209 - protein, 14 aa, Borrelia afzelii
ATLIKEPSAIIVDS

SEQ ID NO: 200210 - protein, 14 aa, Borrelia afzelii
TLIKEPSAIIVDSN

SEQ ID NO: 200211 - protein, 14 aa, Borrelia afzelii
LIKEPSAIIVDSND

SEQ ID NO: 200212 - protein, 14 aa, Borrelia afzelii
IKEPSAIIVDSNDP

SEQ ID NO: 200213 - protein, 14 aa, Borrelia afzelii
KEPSAIIVDSNDPT

SEQ ID NO: 200214 - protein, 14 aa, Borrelia afzelii
EPSAIIVDSNDPTY

SEQ ID NO: 200215 - protein, 14 aa, Borrelia afzelii
PSAIIVDSNDPTYQ

SEQ ID NO: 200216 - protein, 14 aa, Borrelia afzelii
SAIIVDSNDPTYQM

SEQ ID NO: 200217 - protein, 14 aa, Borrelia afzelii
AIIVDSNDPTYQMQ

SEQ ID NO: 200218 - protein, 14 aa, Borrelia afzelii
IIVDSNDPTYQMQK

SEQ ID NO: 200219 - protein, 14 aa, Borrelia afzelii
IVDSNDPTYQMQKI

SEQ ID NO: 200220 - protein, 14 aa, Borrelia afzelii
VDSNDPTYQMQKIM

SEQ ID NO: 200221 - protein, 14 aa, Borrelia afzelii
DSNDPTYQMQKIML

SEQ ID NO: 200222 - protein, 14 aa, Borrelia afzelii
SNDPTYQMQKIMLS

SEQ ID NO: 200223 - protein, 14 aa, Borrelia afzelii
NDPTYQMQKIMLSM

SEQ ID NO: 200224 - protein, 14 aa, Borrelia afzelii
DPTYQMQKIMLSMG

SEQ ID NO: 200225 - protein, 14 aa, Borrelia afzelii
PTYQMQKIMLSMGQ

SEQ ID NO: 200226 - protein, 14 aa, Borrelia afzelii
TYQMQKIMLSMGQE

SEQ ID NO: 200227 - protein, 14 aa, Borrelia afzelii
YQMQKIMLSMGQEV

SEQ ID NO: 200228 - protein, 14 aa, Borrelia afzelii
QMQKIMLSMGQEVK

SEQ ID NO: 200229 - protein, 14 aa, Borrelia afzelii
MQKIMLSMGQEVKE

SEQ ID NO: 200230 - protein, 14 aa, Borrelia afzelii
QKIMLSMGQEVKEI

SEQ ID NO: 200231 - protein, 14 aa, Borrelia afzelii
KIMLSMGQEVKEIK

SEQ ID NO: 200232 - protein, 14 aa, Borrelia afzelii
IMLSMGQEVKEIKP

SEQ ID NO: 200233 - protein, 14 aa, Borrelia afzelii
MLSMGQEVKEIKPI

SEQ ID NO: 200234 - protein, 14 aa, Borrelia afzelii
LSMGQEVKEIKPIL

SEQ ID NO: 200235 - protein, 14 aa, Borrelia afzelii
SMGQEVKEIKPILE

SEQ ID NO: 200236 - protein, 14 aa, Borrelia afzelii
MGQEVKEIKPILEL

SEQ ID NO: 200237 - protein, 14 aa, Borrelia afzelii
GQEVKEIKPILELN

SEQ ID NO: 200238 - protein, 14 aa, Borrelia afzelii
QEVKEIKPILELNP

SEQ ID NO: 200239 - protein, 14 aa, Borrelia afzelii
EVKEIKPILELNPN

SEQ ID NO: 200240 - protein, 14 aa, Borrelia afzelii
VKEIKPILELNPNN

SEQ ID NO: 200241 - protein, 14 aa, Borrelia afzelii
KEIKPILELNPNNK

SEQ ID NO: 200242 - protein, 14 aa, Borrelia afzelii
EIKPILELNPNNKI

SEQ ID NO: 200243 - protein, 14 aa, Borrelia afzelii
IKPILELNPNNKIV

SEQ ID NO: 200244 - protein, 14 aa, Borrelia afzelii
KPILELNPNNKIVQ

SEQ ID NO: 200245 - protein, 14 aa, Borrelia afzelii
PILELNPNNKIVQN

SEQ ID NO: 200246 - protein, 14 aa, Borrelia afzelii
ILELNPNNKIVQNL

SEQ ID NO: 200247 - protein, 14 aa, Borrelia afzelii
LELNPNNKIVQNLK

SEQ ID NO: 200248 - protein, 14 aa, Borrelia afzelii
ELNPNNKIVQNLKN

SEQ ID NO: 200249 - protein, 14 aa, Borrelia afzelii
LNPNNKIVQNLKNL

SEQ ID NO: 200250 - protein, 14 aa, Borrelia afzelii
NPNNKIVQNLKNLE

SEQ ID NO: 200251 - protein, 14 aa, Borrelia afzelii
PNNKIVQNLKNLEP

SEQ ID NO: 200252 - protein, 14 aa, Borrelia afzelii
NNKIVQNLKNLEPE

SEQ ID NO: 200253 - protein, 14 aa, Borrelia afzelii
NKIVQNLKNLEPEK

SEQ ID NO: 200254 - protein, 14 aa, Borrelia afzelii
KIVQNLKNLEPEKL

SEQ ID NO: 200255 - protein, 14 aa, Borrelia afzelii
IVQNLKNLEPEKLE

SEQ ID NO: 200256 - protein, 14 aa, Borrelia afzelii
VQNLKNLEPEKLEK

SEQ ID NO: 200257 - protein, 14 aa, Borrelia afzelii
QNLKNLEPEKLEKI

SEQ ID NO: 200258 - protein, 14 aa, Borrelia afzelii
NLKNLEPEKLEKIS

SEQ ID NO: 200259 - protein, 14 aa, Borrelia afzelii
LKNLEPEKLEKISI

SEQ ID NO: 200260 - protein, 14 aa, Borrelia afzelii
KNLEPEKLEKISIL

SEQ ID NO: 200261 - protein, 14 aa, Borrelia afzelii
NLEPEKLEKISILL

SEQ ID NO: 200262 - protein, 14 aa, Borrelia afzelii
LEPEKLEKISILLF

SEQ ID NO: 200263 - protein, 14 aa, Borrelia afzelii
EPEKLEKISILLFE

SEQ ID NO: 200264 - protein, 14 aa, Borrelia afzelii
PEKLEKISILLFEE

SEQ ID NO: 200265 - protein, 14 aa, Borrelia afzelii
EKLEKISILLFEEA

SEQ ID NO: 200266 - protein, 14 aa, Borrelia afzelii
KLEKISILLFEEAL

SEQ ID NO: 200267 - protein, 14 aa, Borrelia afzelii
LEKISILLFEEALL

SEQ ID NO: 200268 - protein, 14 aa, Borrelia afzelii
EKISILLFEEALLT

SEQ ID NO: 200269 - protein, 14 aa, Borrelia afzelii
KISILLFEEALLTS

SEQ ID NO: 200270 - protein, 14 aa, Borrelia afzelii
ISILLFEEALLTSG

SEQ ID NO: 200271 - protein, 14 aa, Borrelia afzelii
SILLFEEALLTSGM

SEQ ID NO: 200272 - protein, 14 aa, Borrelia afzelii
ILLFEEALLTSGMP

SEQ ID NO: 200273 - protein, 14 aa, Borrelia afzelii
LLFEEALLTSGMPS

SEQ ID NO: 200274 - protein, 14 aa, Borrelia afzelii
LFEEALLTSGMPSK

SEQ ID NO: 200275 - protein, 14 aa, Borrelia afzelii
FEEALLTSGMPSKN

SEQ ID NO: 200276 - protein, 14 aa, Borrelia afzelii
EEALLTSGMPSKNP

SEQ ID NO: 200277 - protein, 14 aa, Borrelia afzelii
EALLTSGMPSKNPR

SEQ ID NO: 200278 - protein, 14 aa, Borrelia afzelii
ALLTSGMPSKNPRK

SEQ ID NO: 200279 - protein, 14 aa, Borrelia afzelii
LLTSGMPSKNPRKF

SEQ ID NO: 200280 - protein, 14 aa, Borrelia afzelii
LTSGMPSKNPRKFI

SEQ ID NO: 200281 - protein, 14 aa, Borrelia afzelii
TSGMPSKNPRKFIN

SEQ ID NO: 200282 - protein, 14 aa, Borrelia afzelii
SGMPSKNPRKFINI

SEQ ID NO: 200283 - protein, 14 aa, Borrelia afzelii
GMPSKNPRKFINII

SEQ ID NO: 200284 - protein, 14 aa, Borrelia afzelii
MPSKNPRKFINIIN

SEQ ID NO: 200285 - protein, 14 aa, Borrelia afzelii
PSKNPRKFINIINE

SEQ ID NO: 200286 - protein, 14 aa, Borrelia afzelii
SKNPRKFINIINEF

SEQ ID NO: 200287 - protein, 14 aa, Borrelia afzelii
KNPRKFINIINEFL

SEQ ID NO: 200288 - protein, 14 aa, Borrelia afzelii
NPRKFINIINEFLE

SEQ ID NO: 200289 - protein, 14 aa, Borrelia afzelii
PRKFINIINEFLEK

SEQ ID NO: 200290 - protein, 14 aa, Borrelia afzelii
RKFINIINEFLEKD

SEQ ID NO: 200291 - protein, 14 aa, Borrelia afzelii
KFINIINEFLEKDL

SEQ ID NO: 200292 - protein, 14 aa, Borrelia afzelii
FINIINEFLEKDLL

SEQ ID NO: 200293 - protein, 15 aa, Borrelia afzelii
MKKQFDTEVNDLLYL

SEQ ID NO: 200294 - protein, 15 aa, Borrelia afzelii
KKQFDTEVNDLLYLI

SEQ ID NO: 200295 - protein, 15 aa, Borrelia afzelii
KQFDTEVNDLLYLII

SEQ ID NO: 200296 - protein, 15 aa, Borrelia afzelii
QFDTEVNDLLYLIIH

SEQ ID NO: 200297 - protein, 15 aa, Borrelia afzelii
FDTEVNDLLYLIIHS

SEQ ID NO: 200298 - protein, 15 aa, Borrelia afzelii
DTEVNDLLYLIIHSL

SEQ ID NO: 200299 - protein, 15 aa, Borrelia afzelii
TEVNDLLYLIIHSLY

SEQ ID NO: 200300 - protein, 15 aa, Borrelia afzelii
EVNDLLYLIIHSLYS

SEQ ID NO: 200301 - protein, 15 aa, Borrelia afzelii
VNDLLYLIIHSLYSH

SEQ ID NO: 200302 - protein, 15 aa, Borrelia afzelii
NDLLYLIIHSLYSHK

SEQ ID NO: 200303 - protein, 15 aa, Borrelia afzelii
DLLYLIIHSLYSHKE

SEQ ID NO: 200304 - protein, 15 aa, Borrelia afzelii
LLYLIIHSLYSHKEI

SEQ ID NO: 200305 - protein, 15 aa, Borrelia afzelii
LYLIIHSLYSHKEIF

SEQ ID NO: 200306 - protein, 15 aa, Borrelia afzelii
YLIIHSLYSHKEIFL

SEQ ID NO: 200307 - protein, 15 aa, Borrelia afzelii
LIIHSLYSHKEIFLR

SEQ ID NO: 200308 - protein, 15 aa, Borrelia afzelii
IIHSLYSHKEIFLRE

SEQ ID NO: 200309 - protein, 15 aa, Borrelia afzelii
IHSLYSHKEIFLREL

SEQ ID NO: 200310 - protein, 15 aa, Borrelia afzelii
HSLYSHKEIFLRELI

SEQ ID NO: 200311 - protein, 15 aa, Borrelia afzelii
SLYSHKEIFLRELIS

SEQ ID NO: 200312 - protein, 15 aa, Borrelia afzelii
LYSHKEIFLRELISN

SEQ ID NO: 200313 - protein, 15 aa, Borrelia afzelii
YSHKEIFLRELISNA

SEQ ID NO: 200314 - protein, 15 aa, Borrelia afzelii
SHKEIFLRELISNAS

SEQ ID NO: 200315 - protein, 15 aa, Borrelia afzelii
HKEIFLRELISNASD

SEQ ID NO: 200316 - protein, 15 aa, Borrelia afzelii
KEIFLRELISNASDA

SEQ ID NO: 200317 - protein, 15 aa, Borrelia afzelii
EIFLRELISNASDAI

SEQ ID NO: 200318 - protein, 15 aa, Borrelia afzelii
IFLRELISNASDAID

SEQ ID NO: 200319 - protein, 15 aa, Borrelia afzelii
FLRELISNASDAIDK

SEQ ID NO: 200320 - protein, 15 aa, Borrelia afzelii
LRELISNASDAIDKL

SEQ ID NO: 200321 - protein, 15 aa, Borrelia afzelii
RELISNASDAIDKLK

SEQ ID NO: 200322 - protein, 15 aa, Borrelia afzelii
ELISNASDAIDKLKF

SEQ ID NO: 200323 - protein, 15 aa, Borrelia afzelii
LISNASDAIDKLKFL

SEQ ID NO: 200324 - protein, 15 aa, Borrelia afzelii
ISNASDAIDKLKFLS

SEQ ID NO: 200325 - protein, 15 aa, Borrelia afzelii
SNASDAIDKLKFLSL

SEQ ID NO: 200326 - protein, 15 aa, Borrelia afzelii
NASDAIDKLKFLSLT

SEQ ID NO: 200327 - protein, 15 aa, Borrelia afzelii
ASDAIDKLKFLSLTN

SEQ ID NO: 200328 - protein, 15 aa, Borrelia afzelii
SDAIDKLKFLSLTNE

SEQ ID NO: 200329 - protein, 15 aa, Borrelia afzelii
DAIDKLKFLSLTNEK

SEQ ID NO: 200330 - protein, 15 aa, Borrelia afzelii
AIDKLKFLSLTNEKF

SEQ ID NO: 200331 - protein, 15 aa, Borrelia afzelii
IDKLKFLSLTNEKFK

SEQ ID NO: 200332 - protein, 15 aa, Borrelia afzelii
DKLKFLSLTNEKFKN

SEQ ID NO: 200333 - protein, 15 aa, Borrelia afzelii
KLKFLSLTNEKFKNI

SEQ ID NO: 200334 - protein, 15 aa, Borrelia afzelii
LKFLSLTNEKFKNIA

SEQ ID NO: 200335 - protein, 15 aa, Borrelia afzelii
KFLSLTNEKFKNIAL

SEQ ID NO: 200336 - protein, 15 aa, Borrelia afzelii
FLSLTNEKFKNIALE

SEQ ID NO: 200337 - protein, 15 aa, Borrelia afzelii
LSLTNEKFKNIALEP

SEQ ID NO: 200338 - protein, 15 aa, Borrelia afzelii
SLTNEKFKNIALEPK

SEQ ID NO: 200339 - protein, 15 aa, Borrelia afzelii
LTNEKFKNIALEPKI

SEQ ID NO: 200340 - protein, 15 aa, Borrelia afzelii
TNEKFKNIALEPKIE

SEQ ID NO: 200341 - protein, 15 aa, Borrelia afzelii
NEKFKNIALEPKIEI

SEQ ID NO: 200342 - protein, 15 aa, Borrelia afzelii
EKFKNIALEPKIEIT

SEQ ID NO: 200343 - protein, 15 aa, Borrelia afzelii
KFKNIALEPKIEITF

SEQ ID NO: 200344 - protein, 15 aa, Borrelia afzelii
FKNIALEPKIEITFD

SEQ ID NO: 200345 - protein, 15 aa, Borrelia afzelii
KNIALEPKIEITFDD

SEQ ID NO: 200346 - protein, 15 aa, Borrelia afzelii
NIALEPKIEITFDDK

SEQ ID NO: 200347 - protein, 15 aa, Borrelia afzelii
IALEPKIEITFDDKS

SEQ ID NO: 200348 - protein, 15 aa, Borrelia afzelii
ALEPKIEITFDDKSI

SEQ ID NO: 200349 - protein, 15 aa, Borrelia afzelii
LEPKIEITFDDKSIL

SEQ ID NO: 200350 - protein, 15 aa, Borrelia afzelii
EPKIEITFDDKSILI

SEQ ID NO: 200351 - protein, 15 aa, Borrelia afzelii
PKIEITFDDKSILIK

SEQ ID NO: 200352 - protein, 15 aa, Borrelia afzelii
KIEITFDDKSILIKD

SEQ ID NO: 200353 - protein, 15 aa, Borrelia afzelii
IEITFDDKSILIKDN

SEQ ID NO: 200354 - protein, 15 aa, Borrelia afzelii
EITFDDKSILIKDNG

SEQ ID NO: 200355 - protein, 15 aa, Borrelia afzelii
ITFDDKSILIKDNGI

SEQ ID NO: 200356 - protein, 15 aa, Borrelia afzelii
TFDDKSILIKDNGIG

SEQ ID NO: 200357 - protein, 15 aa, Borrelia afzelii
FDDKSILIKDNGIGM

SEQ ID NO: 200358 - protein, 15 aa, Borrelia afzelii
DDKSILIKDNGIGMN

SEQ ID NO: 200359 - protein, 15 aa, Borrelia afzelii
DKSILIKDNGIGMNE

SEQ ID NO: 200360 - protein, 15 aa, Borrelia afzelii
KSILIKDNGIGMNEQ

SEQ ID NO: 200361 - protein, 15 aa, Borrelia afzelii
SILIKDNGIGMNEQE

SEQ ID NO: 200362 - protein, 15 aa, Borrelia afzelii
ILIKDNGIGMNEQEL

SEQ ID NO: 200363 - protein, 15 aa, Borrelia afzelii
LIKDNGIGMNEQELT

SEQ ID NO: 200364 - protein, 15 aa, Borrelia afzelii
IKDNGIGMNEQELTN

SEQ ID NO: 200365 - protein, 15 aa, Borrelia afzelii
KDNGIGMNEQELTNH

SEQ ID NO: 200366 - protein, 15 aa, Borrelia afzelii
DNGIGMNEQELTNHL

SEQ ID NO: 200367 - protein, 15 aa, Borrelia afzelii
NGIGMNEQELTNHLG

SEQ ID NO: 200368 - protein, 15 aa, Borrelia afzelii
GIGMNEQELTNHLGV

SEQ ID NO: 200369 - protein, 15 aa, Borrelia afzelii
IGMNEQELTNHLGVI

SEQ ID NO: 200370 - protein, 15 aa, Borrelia afzelii
GMNEQELTNHLGVIA

SEQ ID NO: 200371 - protein, 15 aa, Borrelia afzelii
MNEQELTNHLGVIAK

SEQ ID NO: 200372 - protein, 15 aa, Borrelia afzelii
NEQELTNHLGVIAKS

SEQ ID NO: 200373 - protein, 15 aa, Borrelia afzelii
EQELTNHLGVIAKSG

SEQ ID NO: 200374 - protein, 15 aa, Borrelia afzelii
QELTNHLGVIAKSGT

SEQ ID NO: 200375 - protein, 15 aa, Borrelia afzelii
ELTNHLGVIAKSGTK

SEQ ID NO: 200376 - protein, 15 aa, Borrelia afzelii
LTNHLGVIAKSGTKE

SEQ ID NO: 200377 - protein, 15 aa, Borrelia afzelii
TNHLGVIAKSGTKEF

SEQ ID NO: 200378 - protein, 15 aa, Borrelia afzelii
NHLGVIAKSGTKEFI

SEQ ID NO: 200379 - protein, 15 aa, Borrelia afzelii
HLGVIAKSGTKEFIN

SEQ ID NO: 200380 - protein, 15 aa, Borrelia afzelii
LGVIAKSGTKEFINN

SEQ ID NO: 200381 - protein, 15 aa, Borrelia afzelii
GVIAKSGTKEFINNL

SEQ ID NO: 200382 - protein, 15 aa, Borrelia afzelii
VIAKSGTKEFINNLK

SEQ ID NO: 200383 - protein, 15 aa, Borrelia afzelii
IAKSGTKEFINNLKQ

SEQ ID NO: 200384 - protein, 15 aa, Borrelia afzelii
AKSGTKEFINNLKQD

SEQ ID NO: 200385 - protein, 15 aa, Borrelia afzelii
KSGTKEFINNLKQDE

SEQ ID NO: 200386 - protein, 15 aa, Borrelia afzelii
SGTKEFINNLKQDEK

SEQ ID NO: 200387 - protein, 15 aa, Borrelia afzelii
GTKEFINNLKQDEKK

SEQ ID NO: 200388 - protein, 15 aa, Borrelia afzelii
TKEFINNLKQDEKKS

SEQ ID NO: 200389 - protein, 15 aa, Borrelia afzelii
KEFINNLKQDEKKSA

SEQ ID NO: 200390 - protein, 15 aa, Borrelia afzelii
EFINNLKQDEKKSAN

SEQ ID NO: 200391 - protein, 15 aa, Borrelia afzelii
FINNLKQDEKKSANL

SEQ ID NO: 200392 - protein, 15 aa, Borrelia afzelii
INNLKQDEKKSANLI

SEQ ID NO: 200393 - protein, 15 aa, Borrelia afzelii
NNLKQDEKKSANLIG

SEQ ID NO: 200394 - protein, 15 aa, Borrelia afzelii
NLKQDEKKSANLIGQ

SEQ ID NO: 200395 - protein, 15 aa, Borrelia afzelii
LKQDEKKSANLIGQF

SEQ ID NO: 200396 - protein, 15 aa, Borrelia afzelii
KQDEKKSANLIGQFG

SEQ ID NO: 200397 - protein, 15 aa, Borrelia afzelii
QDEKKSANLIGQFGV

SEQ ID NO: 200398 - protein, 15 aa, Borrelia afzelii
DEKKSANLIGQFGVG

SEQ ID NO: 200399 - protein, 15 aa, Borrelia afzelii
EKKSANLIGQFGVGF

SEQ ID NO: 200400 - protein, 15 aa, Borrelia afzelii
KKSANLIGQFGVGFY

SEQ ID NO: 200401 - protein, 15 aa, Borrelia afzelii
KSANLIGQFGVGFYS

SEQ ID NO: 200402 - protein, 15 aa, Borrelia afzelii
SANLIGQFGVGFYSA

SEQ ID NO: 200403 - protein, 15 aa, Borrelia afzelii
ANLIGQFGVGFYSAF

SEQ ID NO: 200404 - protein, 15 aa, Borrelia afzelii
NLIGQFGVGFYSAFI

SEQ ID NO: 200405 - protein, 15 aa, Borrelia afzelii
LIGQFGVGFYSAFIV

SEQ ID NO: 200406 - protein, 15 aa, Borrelia afzelii
IGQFGVGFYSAFIVS

SEQ ID NO: 200407 - protein, 15 aa, Borrelia afzelii
GQFGVGFYSAFIVSE

SEQ ID NO: 200408 - protein, 15 aa, Borrelia afzelii
QFGVGFYSAFIVSEK

SEQ ID NO: 200409 - protein, 15 aa, Borrelia afzelii
FGVGFYSAFIVSEKV

SEQ ID NO: 200410 - protein, 15 aa, Borrelia afzelii
GVGFYSAFIVSEKVE

SEQ ID NO: 200411 - protein, 15 aa, Borrelia afzelii
VGFYSAFIVSEKVEV

SEQ ID NO: 200412 - protein, 15 aa, Borrelia afzelii
GFYSAFIVSEKVEVT

SEQ ID NO: 200413 - protein, 15 aa, Borrelia afzelii
FYSAFIVSEKVEVTS

SEQ ID NO: 200414 - protein, 15 aa, Borrelia afzelii
YSAFIVSEKVEVTSK

SEQ ID NO: 200415 - protein, 15 aa, Borrelia afzelii
SAFIVSEKVEVTSKK

SEQ ID NO: 200416 - protein, 15 aa, Borrelia afzelii
AFIVSEKVEVTSKKA

SEQ ID NO: 200417 - protein, 15 aa, Borrelia afzelii
FIVSEKVEVTSKKAL

SEQ ID NO: 200418 - protein, 15 aa, Borrelia afzelii
IVSEKVEVTSKKALE

SEQ ID NO: 200419 - protein, 15 aa, Borrelia afzelii
VSEKVEVTSKKALES

SEQ ID NO: 200420 - protein, 15 aa, Borrelia afzelii
SEKVEVTSKKALESD

SEQ ID NO: 200421 - protein, 15 aa, Borrelia afzelii
EKVEVTSKKALESDA

SEQ ID NO: 200422 - protein, 15 aa, Borrelia afzelii
KVEVTSKKALESDAY

SEQ ID NO: 200423 - protein, 15 aa, Borrelia afzelii
VEVTSKKALESDAYI

SEQ ID NO: 200424 - protein, 15 aa, Borrelia afzelii
EVTSKKALESDAYIW

SEQ ID NO: 200425 - protein, 15 aa, Borrelia afzelii
VTSKKALESDAYIWS

SEQ ID NO: 200426 - protein, 15 aa, Borrelia afzelii
TSKKALESDAYIWSS

SEQ ID NO: 200427 - protein, 15 aa, Borrelia afzelii
SKKALESDAYIWSSD

SEQ ID NO: 200428 - protein, 15 aa, Borrelia afzelii
KKALESDAYIWSSDG

SEQ ID NO: 200429 - protein, 15 aa, Borrelia afzelii
KALESDAYIWSSDGK

SEQ ID NO: 200430 - protein, 15 aa, Borrelia afzelii
ALESDAYIWSSDGKT

SEQ ID NO: 200431 - protein, 15 aa, Borrelia afzelii
LESDAYIWSSDGKTG

SEQ ID NO: 200432 - protein, 15 aa, Borrelia afzelii
ESDAYIWSSDGKTGY

SEQ ID NO: 200433 - protein, 15 aa, Borrelia afzelii
SDAYIWSSDGKTGYE

SEQ ID NO: 200434 - protein, 15 aa, Borrelia afzelii
DAYIWSSDGKTGYEI

SEQ ID NO: 200435 - protein, 15 aa, Borrelia afzelii
AYIWSSDGKTGYEIE

SEQ ID NO: 200436 - protein, 15 aa, Borrelia afzelii
YIWSSDGKTGYEIEK

SEQ ID NO: 200437 - protein, 15 aa, Borrelia afzelii
IWSSDGKTGYEIEKA

SEQ ID NO: 200438 - protein, 15 aa, Borrelia afzelii
WSSDGKTGYEIEKAK

SEQ ID NO: 200439 - protein, 15 aa, Borrelia afzelii
SSDGKTGYEIEKAKK

SEQ ID NO: 200440 - protein, 15 aa, Borrelia afzelii
SDGKTGYEIEKAKKE

SEQ ID NO: 200441 - protein, 15 aa, Borrelia afzelii
DGKTGYEIEKAKKED

SEQ ID NO: 200442 - protein, 15 aa, Borrelia afzelii
GKTGYEIEKAKKEDP

SEQ ID NO: 200443 - protein, 15 aa, Borrelia afzelii
KTGYEIEKAKKEDPG

SEQ ID NO: 200444 - protein, 15 aa, Borrelia afzelii
TGYEIEKAKKEDPGT

SEQ ID NO: 200445 - protein, 15 aa, Borrelia afzelii
GYEIEKAKKEDPGTE

SEQ ID NO: 200446 - protein, 15 aa, Borrelia afzelii
YEIEKAKKEDPGTEI

SEQ ID NO: 200447 - protein, 15 aa, Borrelia afzelii
EIEKAKKEDPGTEIK

SEQ ID NO: 200448 - protein, 15 aa, Borrelia afzelii
IEKAKKEDPGTEIKL

SEQ ID NO: 200449 - protein, 15 aa, Borrelia afzelii
EKAKKEDPGTEIKLY

SEQ ID NO: 200450 - protein, 15 aa, Borrelia afzelii
KAKKEDPGTEIKLYL

SEQ ID NO: 200451 - protein, 15 aa, Borrelia afzelii
AKKEDPGTEIKLYLN

SEQ ID NO: 200452 - protein, 15 aa, Borrelia afzelii
KKEDPGTEIKLYLNK

SEQ ID NO: 200453 - protein, 15 aa, Borrelia afzelii
KEDPGTEIKLYLNKE

SEQ ID NO: 200454 - protein, 15 aa, Borrelia afzelii
EDPGTEIKLYLNKEG

SEQ ID NO: 200455 - protein, 15 aa, Borrelia afzelii
DPGTEIKLYLNKEGL

SEQ ID NO: 200456 - protein, 15 aa, Borrelia afzelii
PGTEIKLYLNKEGLE

SEQ ID NO: 200457 - protein, 15 aa, Borrelia afzelii
GTEIKLYLNKEGLEY

SEQ ID NO: 200458 - protein, 15 aa, Borrelia afzelii
TEIKLYLNKEGLEYA

SEQ ID NO: 200459 - protein, 15 aa, Borrelia afzelii
EIKLYLNKEGLEYAN

SEQ ID NO: 200460 - protein, 15 aa, Borrelia afzelii
IKLYLNKEGLEYANK

SEQ ID NO: 200461 - protein, 15 aa, Borrelia afzelii
KLYLNKEGLEYANKW

SEQ ID NO: 200462 - protein, 15 aa, Borrelia afzelii
LYLNKEGLEYANKWK

SEQ ID NO: 200463 - protein, 15 aa, Borrelia afzelii
YLNKEGLEYANKWKI

SEQ ID NO: 200464 - protein, 15 aa, Borrelia afzelii
LNKEGLEYANKWKIQ

SEQ ID NO: 200465 - protein, 15 aa, Borrelia afzelii
NKEGLEYANKWKIQE

SEQ ID NO: 200466 - protein, 15 aa, Borrelia afzelii
KEGLEYANKWKIQEI

SEQ ID NO: 200467 - protein, 15 aa, Borrelia afzelii
EGLEYANKWKIQEIV

SEQ ID NO: 200468 - protein, 15 aa, Borrelia afzelii
GLEYANKWKIQEIVK

SEQ ID NO: 200469 - protein, 15 aa, Borrelia afzelii
LEYANKWKIQEIVKK

SEQ ID NO: 200470 - protein, 15 aa, Borrelia afzelii
EYANKWKIQEIVKKY

SEQ ID NO: 200471 - protein, 15 aa, Borrelia afzelii
YANKWKIQEIVKKYS

SEQ ID NO: 200472 - protein, 15 aa, Borrelia afzelii
ANKWKIQEIVKKYSN

SEQ ID NO: 200473 - protein, 15 aa, Borrelia afzelii
NKWKIQEIVKKYSNH

SEQ ID NO: 200474 - protein, 15 aa, Borrelia afzelii
KWKIQEIVKKYSNHI

SEQ ID NO: 200475 - protein, 15 aa, Borrelia afzelii
WKIQEIVKKYSNHIN

SEQ ID NO: 200476 - protein, 15 aa, Borrelia afzelii
KIQEIVKKYSNHINY

SEQ ID NO: 200477 - protein, 15 aa, Borrelia afzelii
IQEIVKKYSNHINYP

SEQ ID NO: 200478 - protein, 15 aa, Borrelia afzelii
QEIVKKYSNHINYPI

SEQ ID NO: 200479 - protein, 15 aa, Borrelia afzelii
EIVKKYSNHINYPIY

SEQ ID NO: 200480 - protein, 15 aa, Borrelia afzelii
IVKKYSNHINYPIYI

SEQ ID NO: 200481 - protein, 15 aa, Borrelia afzelii
VKKYSNHINYPIYIK

SEQ ID NO: 200482 - protein, 15 aa, Borrelia afzelii
KKYSNHINYPIYIKY

SEQ ID NO: 200483 - protein, 15 aa, Borrelia afzelii
KYSNHINYPIYIKYN

SEQ ID NO: 200484 - protein, 15 aa, Borrelia afzelii
YSNHINYPIYIKYNE

SEQ ID NO: 200485 - protein, 15 aa, Borrelia afzelii
SNHINYPIYIKYNEP

SEQ ID NO: 200486 - protein, 15 aa, Borrelia afzelii
NHINYPIYIKYNEPI

SEQ ID NO: 200487 - protein, 15 aa, Borrelia afzelii
HINYPIYIKYNEPIM

SEQ ID NO: 200488 - protein, 15 aa, Borrelia afzelii
INYPIYIKYNEPIMK

SEQ ID NO: 200489 - protein, 15 aa, Borrelia afzelii
NYPIYIKYNEPIMKD

SEQ ID NO: 200490 - protein, 15 aa, Borrelia afzelii
YPIYIKYNEPIMKDG

SEQ ID NO: 200491 - protein, 15 aa, Borrelia afzelii
PIYIKYNEPIMKDGK

SEQ ID NO: 200492 - protein, 15 aa, Borrelia afzelii
IYIKYNEPIMKDGKQ

SEQ ID NO: 200493 - protein, 15 aa, Borrelia afzelii
YIKYNEPIMKDGKQE

SEQ ID NO: 200494 - protein, 15 aa, Borrelia afzelii
IKYNEPIMKDGKQEG

SEQ ID NO: 200495 - protein, 15 aa, Borrelia afzelii
KYNEPIMKDGKQEGI

SEQ ID NO: 200496 - protein, 15 aa, Borrelia afzelii
YNEPIMKDGKQEGIE

SEQ ID NO: 200497 - protein, 15 aa, Borrelia afzelii
NEPIMKDGKQEGIEE

SEQ ID NO: 200498 - protein, 15 aa, Borrelia afzelii
EPIMKDGKQEGIEEK

SEQ ID NO: 200499 - protein, 15 aa, Borrelia afzelii
PIMKDGKQEGIEEKE

SEQ ID NO: 200500 - protein, 15 aa, Borrelia afzelii
IMKDGKQEGIEEKEE

SEQ ID NO: 200501 - protein, 15 aa, Borrelia afzelii
MKDGKQEGIEEKEEK

SEQ ID NO: 200502 - protein, 15 aa, Borrelia afzelii
KDGKQEGIEEKEEKL

SEQ ID NO: 200503 - protein, 15 aa, Borrelia afzelii
DGKQEGIEEKEEKLN

SEQ ID NO: 200504 - protein, 15 aa, Borrelia afzelii
GKQEGIEEKEEKLNE

SEQ ID NO: 200505 - protein, 15 aa, Borrelia afzelii
KQEGIEEKEEKLNET

SEQ ID NO: 200506 - protein, 15 aa, Borrelia afzelii
QEGIEEKEEKLNETT

SEQ ID NO: 200507 - protein, 15 aa, Borrelia afzelii
EGIEEKEEKLNETTA

SEQ ID NO: 200508 - protein, 15 aa, Borrelia afzelii
GIEEKEEKLNETTAL

SEQ ID NO: 200509 - protein, 15 aa, Borrelia afzelii
IEEKEEKLNETTALW

SEQ ID NO: 200510 - protein, 15 aa, Borrelia afzelii
EEKEEKLNETTALWT

SEQ ID NO: 200511 - protein, 15 aa, Borrelia afzelii
EKEEKLNETTALWTK

SEQ ID NO: 200512 - protein, 15 aa, Borrelia afzelii
KEEKLNETTALWTKN

SEQ ID NO: 200513 - protein, 15 aa, Borrelia afzelii
EEKLNETTALWTKNK

SEQ ID NO: 200514 - protein, 15 aa, Borrelia afzelii
EKLNETTALWTKNKS

SEQ ID NO: 200515 - protein, 15 aa, Borrelia afzelii
KLNETTALWTKNKSE

SEQ ID NO: 200516 - protein, 15 aa, Borrelia afzelii
LNETTALWTKNKSEI

SEQ ID NO: 200517 - protein, 15 aa, Borrelia afzelii
NETTALWTKNKSEIK

SEQ ID NO: 200518 - protein, 15 aa, Borrelia afzelii
ETTALWTKNKSEIKT

SEQ ID NO: 200519 - protein, 15 aa, Borrelia afzelii
TTALWTKNKSEIKTE

SEQ ID NO: 200520 - protein, 15 aa, Borrelia afzelii
TALWTKNKSEIKTEE

SEQ ID NO: 200521 - protein, 15 aa, Borrelia afzelii
ALWTKNKSEIKTEEY

SEQ ID NO: 200522 - protein, 15 aa, Borrelia afzelii
LWTKNKSEIKTEEYN

SEQ ID NO: 200523 - protein, 15 aa, Borrelia afzelii
WTKNKSEIKTEEYNE

SEQ ID NO: 200524 - protein, 15 aa, Borrelia afzelii
TKNKSEIKTEEYNEF

SEQ ID NO: 200525 - protein, 15 aa, Borrelia afzelii
KNKSEIKTEEYNEFY

SEQ ID NO: 200526 - protein, 15 aa, Borrelia afzelii
NKSEIKTEEYNEFYK

SEQ ID NO: 200527 - protein, 15 aa, Borrelia afzelii
KSEIKTEEYNEFYKN

SEQ ID NO: 200528 - protein, 15 aa, Borrelia afzelii
SEIKTEEYNEFYKNT

SEQ ID NO: 200529 - protein, 15 aa, Borrelia afzelii
EIKTEEYNEFYKNTT

SEQ ID NO: 200530 - protein, 15 aa, Borrelia afzelii
IKTEEYNEFYKNTTF

SEQ ID NO: 200531 - protein, 15 aa, Borrelia afzelii
KTEEYNEFYKNTTFD

SEQ ID NO: 200532 - protein, 15 aa, Borrelia afzelii
TEEYNEFYKNTTFDY

SEQ ID NO: 200533 - protein, 15 aa, Borrelia afzelii
EEYNEFYKNTTFDYE

SEQ ID NO: 200534 - protein, 15 aa, Borrelia afzelii
EYNEFYKNTTFDYEN

SEQ ID NO: 200535 - protein, 15 aa, Borrelia afzelii
YNEFYKNTTFDYENP

SEQ ID NO: 200536 - protein, 15 aa, Borrelia afzelii
NEFYKNTTFDYENPL

SEQ ID NO: 200537 - protein, 15 aa, Borrelia afzelii
EFYKNTTFDYENPLM

SEQ ID NO: 200538 - protein, 15 aa, Borrelia afzelii
FYKNTTFDYENPLMY

SEQ ID NO: 200539 - protein, 15 aa, Borrelia afzelii
YKNTTFDYENPLMYI

SEQ ID NO: 200540 - protein, 15 aa, Borrelia afzelii
KNTTFDYENPLMYIH

SEQ ID NO: 200541 - protein, 15 aa, Borrelia afzelii
NTTFDYENPLMYIHT

SEQ ID NO: 200542 - protein, 15 aa, Borrelia afzelii
TTFDYENPLMYIHTK

SEQ ID NO: 200543 - protein, 15 aa, Borrelia afzelii
TFDYENPLMYIHTKA

SEQ ID NO: 200544 - protein, 15 aa, Borrelia afzelii
FDYENPLMYIHTKAE

SEQ ID NO: 200545 - protein, 15 aa, Borrelia afzelii
DYENPLMYIHTKAEG

SEQ ID NO: 200546 - protein, 15 aa, Borrelia afzelii
YENPLMYIHTKAEGN

SEQ ID NO: 200547 - protein, 15 aa, Borrelia afzelii
ENPLMYIHTKAEGNL

SEQ ID NO: 200548 - protein, 15 aa, Borrelia afzelii
NPLMYIHTKAEGNLE

SEQ ID NO: 200549 - protein, 15 aa, Borrelia afzelii
PLMYIHTKAEGNLEY

SEQ ID NO: 200550 - protein, 15 aa, Borrelia afzelii
LMYIHTKAEGNLEYT

SEQ ID NO: 200551 - protein, 15 aa, Borrelia afzelii
MYIHTKAEGNLEYTN

SEQ ID NO: 200552 - protein, 15 aa, Borrelia afzelii
YIHTKAEGNLEYTNL

SEQ ID NO: 200553 - protein, 15 aa, Borrelia afzelii
IHTKAEGNLEYTNLF

SEQ ID NO: 200554 - protein, 15 aa, Borrelia afzelii
HTKAEGNLEYTNLFY

SEQ ID NO: 200555 - protein, 15 aa, Borrelia afzelii
TKAEGNLEYTNLFYI

SEQ ID NO: 200556 - protein, 15 aa, Borrelia afzelii
KAEGNLEYTNLFYIP

SEQ ID NO: 200557 - protein, 15 aa, Borrelia afzelii
AEGNLEYTNLFYIPS

SEQ ID NO: 200558 - protein, 15 aa, Borrelia afzelii
EGNLEYTNLFYIPSK

SEQ ID NO: 200559 - protein, 15 aa, Borrelia afzelii
GNLEYTNLFYIPSKA

SEQ ID NO: 200560 - protein, 15 aa, Borrelia afzelii
NLEYTNLFYIPSKAP

SEQ ID NO: 200561 - protein, 15 aa, Borrelia afzelii
LEYTNLFYIPSKAPY

SEQ ID NO: 200562 - protein, 15 aa, Borrelia afzelii
EYTNLFYIPSKAPYD

SEQ ID NO: 200563 - protein, 15 aa, Borrelia afzelii
YTNLFYIPSKAPYDL

SEQ ID NO: 200564 - protein, 15 aa, Borrelia afzelii
TNLFYIPSKAPYDLY

SEQ ID NO: 200565 - protein, 15 aa, Borrelia afzelii
NLFYIPSKAPYDLYY

SEQ ID NO: 200566 - protein, 15 aa, Borrelia afzelii
LFYIPSKAPYDLYYP

SEQ ID NO: 200567 - protein, 15 aa, Borrelia afzelii
FYIPSKAPYDLYYPN

SEQ ID NO: 200568 - protein, 15 aa, Borrelia afzelii
YIPSKAPYDLYYPNT

SEQ ID NO: 200569 - protein, 15 aa, Borrelia afzelii
IPSKAPYDLYYPNTK

SEQ ID NO: 200570 - protein, 15 aa, Borrelia afzelii
PSKAPYDLYYPNTKP

SEQ ID NO: 200571 - protein, 15 aa, Borrelia afzelii
SKAPYDLYYPNTKPG

SEQ ID NO: 200572 - protein, 15 aa, Borrelia afzelii
KAPYDLYYPNTKPGV

SEQ ID NO: 200573 - protein, 15 aa, Borrelia afzelii
APYDLYYPNTKPGVK

SEQ ID NO: 200574 - protein, 15 aa, Borrelia afzelii
PYDLYYPNTKPGVKL

SEQ ID NO: 200575 - protein, 15 aa, Borrelia afzelii
YDLYYPNTKPGVKLF

SEQ ID NO: 200576 - protein, 15 aa, Borrelia afzelii
DLYYPNTKPGVKLFI

SEQ ID NO: 200577 - protein, 15 aa, Borrelia afzelii
LYYPNTKPGVKLFIN

SEQ ID NO: 200578 - protein, 15 aa, Borrelia afzelii
YYPNTKPGVKLFINR

SEQ ID NO: 200579 - protein, 15 aa, Borrelia afzelii
YPNTKPGVKLFINRI

SEQ ID NO: 200580 - protein, 15 aa, Borrelia afzelii
PNTKPGVKLFINRIF

SEQ ID NO: 200581 - protein, 15 aa, Borrelia afzelii
NTKPGVKLFINRIFI

SEQ ID NO: 200582 - protein, 15 aa, Borrelia afzelii
TKPGVKLFINRIFIT

SEQ ID NO: 200583 - protein, 15 aa, Borrelia afzelii
KPGVKLFINRIFITD

SEQ ID NO: 200584 - protein, 15 aa, Borrelia afzelii
PGVKLFINRIFITDS

SEQ ID NO: 200585 - protein, 15 aa, Borrelia afzelii
GVKLFINRIFITDSE

SEQ ID NO: 200586 - protein, 15 aa, Borrelia afzelii
VKLFINRIFITDSEG

SEQ ID NO: 200587 - protein, 15 aa, Borrelia afzelii
KLFINRIFITDSEGS

SEQ ID NO: 200588 - protein, 15 aa, Borrelia afzelii
LFINRIFITDSEGSL

SEQ ID NO: 200589 - protein, 15 aa, Borrelia afzelii
FINRIFITDSEGSLL

SEQ ID NO: 200590 - protein, 15 aa, Borrelia afzelii
INRIFITDSEGSLLP

SEQ ID NO: 200591 - protein, 15 aa, Borrelia afzelii
NRIFITDSEGSLLPN

SEQ ID NO: 200592 - protein, 15 aa, Borrelia afzelii
RIFITDSEGSLLPNY

SEQ ID NO: 200593 - protein, 15 aa, Borrelia afzelii
IFITDSEGSLLPNYL

SEQ ID NO: 200594 - protein, 15 aa, Borrelia afzelii
FITDSEGSLLPNYLR

SEQ ID NO: 200595 - protein, 15 aa, Borrelia afzelii
ITDSEGSLLPNYLRF

SEQ ID NO: 200596 - protein, 15 aa, Borrelia afzelii
TDSEGSLLPNYLRFI

SEQ ID NO: 200597 - protein, 15 aa, Borrelia afzelii
DSEGSLLPNYLRFIK

SEQ ID NO: 200598 - protein, 15 aa, Borrelia afzelii
SEGSLLPNYLRFIKG

SEQ ID NO: 200599 - protein, 15 aa, Borrelia afzelii
EGSLLPNYLRFIKGI

SEQ ID NO: 200600 - protein, 15 aa, Borrelia afzelii
GSLLPNYLRFIKGII

SEQ ID NO: 200601 - protein, 15 aa, Borrelia afzelii
SLLPNYLRFIKGIID

SEQ ID NO: 200602 - protein, 15 aa, Borrelia afzelii
LLPNYLRFIKGIIDC

SEQ ID NO: 200603 - protein, 15 aa, Borrelia afzelii
LPNYLRFIKGIIDCQ

SEQ ID NO: 200604 - protein, 15 aa, Borrelia afzelii
PNYLRFIKGIIDCQD

SEQ ID NO: 200605 - protein, 15 aa, Borrelia afzelii
NYLRFIKGIIDCQDL

SEQ ID NO: 200606 - protein, 15 aa, Borrelia afzelii
YLRFIKGIIDCQDLP

SEQ ID NO: 200607 - protein, 15 aa, Borrelia afzelii
LRFIKGIIDCQDLPL

SEQ ID NO: 200608 - protein, 15 aa, Borrelia afzelii
RFIKGIIDCQDLPLN

SEQ ID NO: 200609 - protein, 15 aa, Borrelia afzelii
FIKGIIDCQDLPLNV

SEQ ID NO: 200610 - protein, 15 aa, Borrelia afzelii
IKGIIDCQDLPLNVS

SEQ ID NO: 200611 - protein, 15 aa, Borrelia afzelii
KGIIDCQDLPLNVSR

SEQ ID NO: 200612 - protein, 15 aa, Borrelia afzelii
GIIDCQDLPLNVSRE

SEQ ID NO: 200613 - protein, 15 aa, Borrelia afzelii
IIDCQDLPLNVSREI

SEQ ID NO: 200614 - protein, 15 aa, Borrelia afzelii
IDCQDLPLNVSREIL

SEQ ID NO: 200615 - protein, 15 aa, Borrelia afzelii
DCQDLPLNVSREILQ

SEQ ID NO: 200616 - protein, 15 aa, Borrelia afzelii
CQDLPLNVSREILQQ

SEQ ID NO: 200617 - protein, 15 aa, Borrelia afzelii
QDLPLNVSREILQQN

SEQ ID NO: 200618 - protein, 15 aa, Borrelia afzelii
DLPLNVSREILQQNK

SEQ ID NO: 200619 - protein, 15 aa, Borrelia afzelii
LPLNVSREILQQNKI

SEQ ID NO: 200620 - protein, 15 aa, Borrelia afzelii
PLNVSREILQQNKIL

SEQ ID NO: 200621 - protein, 15 aa, Borrelia afzelii
LNVSREILQQNKILS

SEQ ID NO: 200622 - protein, 15 aa, Borrelia afzelii
NVSREILQQNKILSK

SEQ ID NO: 200623 - protein, 15 aa, Borrelia afzelii
VSREILQQNKILSKI

SEQ ID NO: 200624 - protein, 15 aa, Borrelia afzelii
SREILQQNKILSKIK

SEQ ID NO: 200625 - protein, 15 aa, Borrelia afzelii
REILQQNKILSKIKS

SEQ ID NO: 200626 - protein, 15 aa, Borrelia afzelii
EILQQNKILSKIKSS

SEQ ID NO: 200627 - protein, 15 aa, Borrelia afzelii
ILQQNKILSKIKSSS

SEQ ID NO: 200628 - protein, 15 aa, Borrelia afzelii
LQQNKILSKIKSSSV

SEQ ID NO: 200629 - protein, 15 aa, Borrelia afzelii
QQNKILSKIKSSSVK

SEQ ID NO: 200630 - protein, 15 aa, Borrelia afzelii
QNKILSKIKSSSVKK

SEQ ID NO: 200631 - protein, 15 aa, Borrelia afzelii
NKILSKIKSSSVKKI

SEQ ID NO: 200632 - protein, 15 aa, Borrelia afzelii
KILSKIKSSSVKKIL

SEQ ID NO: 200633 - protein, 15 aa, Borrelia afzelii
ILSKIKSSSVKKILS

SEQ ID NO: 200634 - protein, 15 aa, Borrelia afzelii
LSKIKSSSVKKILSE

SEQ ID NO: 200635 - protein, 15 aa, Borrelia afzelii
SKIKSSSVKKILSEL

SEQ ID NO: 200636 - protein, 15 aa, Borrelia afzelii
KIKSSSVKKILSELE

SEQ ID NO: 200637 - protein, 15 aa, Borrelia afzelii
IKSSSVKKILSELEK

SEQ ID NO: 200638 - protein, 15 aa, Borrelia afzelii
KSSSVKKILSELEKL

SEQ ID NO: 200639 - protein, 15 aa, Borrelia afzelii
SSSVKKILSELEKLS

SEQ ID NO: 200640 - protein, 15 aa, Borrelia afzelii
SSVKKILSELEKLSK

SEQ ID NO: 200641 - protein, 15 aa, Borrelia afzelii
SVKKILSELEKLSKK

SEQ ID NO: 200642 - protein, 15 aa, Borrelia afzelii
VKKILSELEKLSKKN

SEQ ID NO: 200643 - protein, 15 aa, Borrelia afzelii
KKILSELEKLSKKNP

SEQ ID NO: 200644 - protein, 15 aa, Borrelia afzelii
KILSELEKLSKKNPE

SEQ ID NO: 200645 - protein, 15 aa, Borrelia afzelii
ILSELEKLSKKNPEK

SEQ ID NO: 200646 - protein, 15 aa, Borrelia afzelii
LSELEKLSKKNPEKF

SEQ ID NO: 200647 - protein, 15 aa, Borrelia afzelii
SELEKLSKKNPEKFS

SEQ ID NO: 200648 - protein, 15 aa, Borrelia afzelii
ELEKLSKKNPEKFSE

SEQ ID NO: 200649 - protein, 15 aa, Borrelia afzelii
LEKLSKKNPEKFSEF

SEQ ID NO: 200650 - protein, 15 aa, Borrelia afzelii
EKLSKKNPEKFSEFS

SEQ ID NO: 200651 - protein, 15 aa, Borrelia afzelii
KLSKKNPEKFSEFSK

SEQ ID NO: 200652 - protein, 15 aa, Borrelia afzelii
LSKKNPEKFSEFSKE

SEQ ID NO: 200653 - protein, 15 aa, Borrelia afzelii
SKKNPEKFSEFSKEF

SEQ ID NO: 200654 - protein, 15 aa, Borrelia afzelii
KKNPEKFSEFSKEFG

SEQ ID NO: 200655 - protein, 15 aa, Borrelia afzelii
KNPEKFSEFSKEFGR

SEQ ID NO: 200656 - protein, 15 aa, Borrelia afzelii
NPEKFSEFSKEFGRC

SEQ ID NO: 200657 - protein, 15 aa, Borrelia afzelii
PEKFSEFSKEFGRCI

SEQ ID NO: 200658 - protein, 15 aa, Borrelia afzelii
EKFSEFSKEFGRCIK

SEQ ID NO: 200659 - protein, 15 aa, Borrelia afzelii
KFSEFSKEFGRCIKE

SEQ ID NO: 200660 - protein, 15 aa, Borrelia afzelii
FSEFSKEFGRCIKEG

SEQ ID NO: 200661 - protein, 15 aa, Borrelia afzelii
SEFSKEFGRCIKEGV

SEQ ID NO: 200662 - protein, 15 aa, Borrelia afzelii
EFSKEFGRCIKEGVY

SEQ ID NO: 200663 - protein, 15 aa, Borrelia afzelii
FSKEFGRCIKEGVYS

SEQ ID NO: 200664 - protein, 15 aa, Borrelia afzelii
SKEFGRCIKEGVYSD

SEQ ID NO: 200665 - protein, 15 aa, Borrelia afzelii
KEFGRCIKEGVYSDF

SEQ ID NO: 200666 - protein, 15 aa, Borrelia afzelii
EFGRCIKEGVYSDFE

SEQ ID NO: 200667 - protein, 15 aa, Borrelia afzelii
FGRCIKEGVYSDFEN

SEQ ID NO: 200668 - protein, 15 aa, Borrelia afzelii
GRCIKEGVYSDFENR

SEQ ID NO: 200669 - protein, 15 aa, Borrelia afzelii
RCIKEGVYSDFENRE

SEQ ID NO: 200670 - protein, 15 aa, Borrelia afzelii
CIKEGVYSDFENREK

SEQ ID NO: 200671 - protein, 15 aa, Borrelia afzelii
IKEGVYSDFENREKL

SEQ ID NO: 200672 - protein, 15 aa, Borrelia afzelii
KEGVYSDFENREKLI

SEQ ID NO: 200673 - protein, 15 aa, Borrelia afzelii
EGVYSDFENREKLIS

SEQ ID NO: 200674 - protein, 15 aa, Borrelia afzelii
GVYSDFENREKLISL

SEQ ID NO: 200675 - protein, 15 aa, Borrelia afzelii
VYSDFENREKLISLI

SEQ ID NO: 200676 - protein, 15 aa, Borrelia afzelii
YSDFENREKLISLIR

SEQ ID NO: 200677 - protein, 15 aa, Borrelia afzelii
SDFENREKLISLIRF

SEQ ID NO: 200678 - protein, 15 aa, Borrelia afzelii
DFENREKLISLIRFK

SEQ ID NO: 200679 - protein, 15 aa, Borrelia afzelii
FENREKLISLIRFKS

SEQ ID NO: 200680 - protein, 15 aa, Borrelia afzelii
ENREKLISLIRFKSS

SEQ ID NO: 200681 - protein, 15 aa, Borrelia afzelii
NREKLISLIRFKSSS

SEQ ID NO: 200682 - protein, 15 aa, Borrelia afzelii
REKLISLIRFKSSSV

SEQ ID NO: 200683 - protein, 15 aa, Borrelia afzelii
EKLISLIRFKSSSVD

SEQ ID NO: 200684 - protein, 15 aa, Borrelia afzelii
KLISLIRFKSSSVDG

SEQ ID NO: 200685 - protein, 15 aa, Borrelia afzelii
LISLIRFKSSSVDGF

SEQ ID NO: 200686 - protein, 15 aa, Borrelia afzelii
ISLIRFKSSSVDGFV

SEQ ID NO: 200687 - protein, 15 aa, Borrelia afzelii
SLIRFKSSSVDGFVS

SEQ ID NO: 200688 - protein, 15 aa, Borrelia afzelii
LIRFKSSSVDGFVSF

SEQ ID NO: 200689 - protein, 15 aa, Borrelia afzelii
IRFKSSSVDGFVSFK

SEQ ID NO: 200690 - protein, 15 aa, Borrelia afzelii
RFKSSSVDGFVSFKE

SEQ ID NO: 200691 - protein, 15 aa, Borrelia afzelii
FKSSSVDGFVSFKEY

SEQ ID NO: 200692 - protein, 15 aa, Borrelia afzelii
KSSSVDGFVSFKEYK

SEQ ID NO: 200693 - protein, 15 aa, Borrelia afzelii
SSSVDGFVSFKEYKE

SEQ ID NO: 200694 - protein, 15 aa, Borrelia afzelii
SSVDGFVSFKEYKER

SEQ ID NO: 200695 - protein, 15 aa, Borrelia afzelii
SVDGFVSFKEYKERM

SEQ ID NO: 200696 - protein, 15 aa, Borrelia afzelii
VDGFVSFKEYKERMN

SEQ ID NO: 200697 - protein, 15 aa, Borrelia afzelii
DGFVSFKEYKERMNE

SEQ ID NO: 200698 - protein, 15 aa, Borrelia afzelii
GFVSFKEYKERMNEG

SEQ ID NO: 200699 - protein, 15 aa, Borrelia afzelii
FVSFKEYKERMNEGQ

SEQ ID NO: 200700 - protein, 15 aa, Borrelia afzelii
VSFKEYKERMNEGQK

SEQ ID NO: 200701 - protein, 15 aa, Borrelia afzelii
SFKEYKERMNEGQKS

SEQ ID NO: 200702 - protein, 15 aa, Borrelia afzelii
FKEYKERMNEGQKSI

SEQ ID NO: 200703 - protein, 15 aa, Borrelia afzelii
KEYKERMNEGQKSIY

SEQ ID NO: 200704 - protein, 15 aa, Borrelia afzelii
EYKERMNEGQKSIYY

SEQ ID NO: 200705 - protein, 15 aa, Borrelia afzelii
YKERMNEGQKSIYYI

SEQ ID NO: 200706 - protein, 15 aa, Borrelia afzelii
KERMNEGQKSIYYIT

SEQ ID NO: 200707 - protein, 15 aa, Borrelia afzelii
ERMNEGQKSIYYITG

SEQ ID NO: 200708 - protein, 15 aa, Borrelia afzelii
RMNEGQKSIYYITGG

SEQ ID NO: 200709 - protein, 15 aa, Borrelia afzelii
MNEGQKSIYYITGGK

SEQ ID NO: 200710 - protein, 15 aa, Borrelia afzelii
NEGQKSIYYITGGKE

SEQ ID NO: 200711 - protein, 15 aa, Borrelia afzelii
EGQKSIYYITGGKEN

SEQ ID NO: 200712 - protein, 15 aa, Borrelia afzelii
GQKSIYYITGGKENI

SEQ ID NO: 200713 - protein, 15 aa, Borrelia afzelii
QKSIYYITGGKENIL

SEQ ID NO: 200714 - protein, 15 aa, Borrelia afzelii
KSIYYITGGKENILK

SEQ ID NO: 200715 - protein, 15 aa, Borrelia afzelii
SIYYITGGKENILKE

SEQ ID NO: 200716 - protein, 15 aa, Borrelia afzelii
IYYITGGKENILKEN

SEQ ID NO: 200717 - protein, 15 aa, Borrelia afzelii
YYITGGKENILKENP

SEQ ID NO: 200718 - protein, 15 aa, Borrelia afzelii
YITGGKENILKENPI

SEQ ID NO: 200719 - protein, 15 aa, Borrelia afzelii
ITGGKENILKENPIV

SEQ ID NO: 200720 - protein, 15 aa, Borrelia afzelii
TGGKENILKENPIVT

SEQ ID NO: 200721 - protein, 15 aa, Borrelia afzelii
GGKENILKENPIVTA

SEQ ID NO: 200722 - protein, 15 aa, Borrelia afzelii
GKENILKENPIVTAY

SEQ ID NO: 200723 - protein, 15 aa, Borrelia afzelii
KENILKENPIVTAYK

SEQ ID NO: 200724 - protein, 15 aa, Borrelia afzelii
ENILKENPIVTAYKE

SEQ ID NO: 200725 - protein, 15 aa, Borrelia afzelii
NILKENPIVTAYKEK

SEQ ID NO: 200726 - protein, 15 aa, Borrelia afzelii
ILKENPIVTAYKEKG

SEQ ID NO: 200727 - protein, 15 aa, Borrelia afzelii
LKENPIVTAYKEKGF

SEQ ID NO: 200728 - protein, 15 aa, Borrelia afzelii
KENPIVTAYKEKGFE

SEQ ID NO: 200729 - protein, 15 aa, Borrelia afzelii
ENPIVTAYKEKGFEI

SEQ ID NO: 200730 - protein, 15 aa, Borrelia afzelii
NPIVTAYKEKGFEIL

SEQ ID NO: 200731 - protein, 15 aa, Borrelia afzelii
PIVTAYKEKGFEILI

SEQ ID NO: 200732 - protein, 15 aa, Borrelia afzelii
IVTAYKEKGFEILIM

SEQ ID NO: 200733 - protein, 15 aa, Borrelia afzelii
VTAYKEKGFEILIMD

SEQ ID NO: 200734 - protein, 15 aa, Borrelia afzelii
TAYKEKGFEILIMDD

SEQ ID NO: 200735 - protein, 15 aa, Borrelia afzelii
AYKEKGFEILIMDDE

SEQ ID NO: 200736 - protein, 15 aa, Borrelia afzelii
YKEKGFEILIMDDEL

SEQ ID NO: 200737 - protein, 15 aa, Borrelia afzelii
KEKGFEILIMDDELD

SEQ ID NO: 200738 - protein, 15 aa, Borrelia afzelii
EKGFEILIMDDELDE

SEQ ID NO: 200739 - protein, 15 aa, Borrelia afzelii
KGFEILIMDDELDEA

SEQ ID NO: 200740 - protein, 15 aa, Borrelia afzelii
GFEILIMDDELDEAI

SEQ ID NO: 200741 - protein, 15 aa, Borrelia afzelii
FEILIMDDELDEAIL

SEQ ID NO: 200742 - protein, 15 aa, Borrelia afzelii
EILIMDDELDEAILN

SEQ ID NO: 200743 - protein, 15 aa, Borrelia afzelii
ILIMDDELDEAILNL

SEQ ID NO: 200744 - protein, 15 aa, Borrelia afzelii
LIMDDELDEAILNLI

SEQ ID NO: 200745 - protein, 15 aa, Borrelia afzelii
IMDDELDEAILNLIP

SEQ ID NO: 200746 - protein, 15 aa, Borrelia afzelii
MDDELDEAILNLIPE

SEQ ID NO: 200747 - protein, 15 aa, Borrelia afzelii
DDELDEAILNLIPEY

SEQ ID NO: 200748 - protein, 15 aa, Borrelia afzelii
DELDEAILNLIPEYE

SEQ ID NO: 200749 - protein, 15 aa, Borrelia afzelii
ELDEAILNLIPEYEG

SEQ ID NO: 200750 - protein, 15 aa, Borrelia afzelii
LDEAILNLIPEYEGL

SEQ ID NO: 200751 - protein, 15 aa, Borrelia afzelii
DEAILNLIPEYEGLK

SEQ ID NO: 200752 - protein, 15 aa, Borrelia afzelii
EAILNLIPEYEGLKL

SEQ ID NO: 200753 - protein, 15 aa, Borrelia afzelii
AILNLIPEYEGLKLK

SEQ ID NO: 200754 - protein, 15 aa, Borrelia afzelii
ILNLIPEYEGLKLKA

SEQ ID NO: 200755 - protein, 15 aa, Borrelia afzelii
LNLIPEYEGLKLKAI

SEQ ID NO: 200756 - protein, 15 aa, Borrelia afzelii
NLIPEYEGLKLKAIN

SEQ ID NO: 200757 - protein, 15 aa, Borrelia afzelii
LIPEYEGLKLKAINK

SEQ ID NO: 200758 - protein, 15 aa, Borrelia afzelii
IPEYEGLKLKAINKN

SEQ ID NO: 200759 - protein, 15 aa, Borrelia afzelii
PEYEGLKLKAINKNE

SEQ ID NO: 200760 - protein, 15 aa, Borrelia afzelii
EYEGLKLKAINKNET

SEQ ID NO: 200761 - protein, 15 aa, Borrelia afzelii
YEGLKLKAINKNETS

SEQ ID NO: 200762 - protein, 15 aa, Borrelia afzelii
EGLKLKAINKNETSN

SEQ ID NO: 200763 - protein, 15 aa, Borrelia afzelii
GLKLKAINKNETSNE

SEQ ID NO: 200764 - protein, 15 aa, Borrelia afzelii
LKLKAINKNETSNEL

SEQ ID NO: 200765 - protein, 15 aa, Borrelia afzelii
KLKAINKNETSNELK

SEQ ID NO: 200766 - protein, 15 aa, Borrelia afzelii
LKAINKNETSNELKD

SEQ ID NO: 200767 - protein, 15 aa, Borrelia afzelii
KAINKNETSNELKDE

SEQ ID NO: 200768 - protein, 15 aa, Borrelia afzelii
AINKNETSNELKDEN

SEQ ID NO: 200769 - protein, 15 aa, Borrelia afzelii
INKNETSNELKDENF

SEQ ID NO: 200770 - protein, 15 aa, Borrelia afzelii
NKNETSNELKDENFK

SEQ ID NO: 200771 - protein, 15 aa, Borrelia afzelii
KNETSNELKDENFKK

SEQ ID NO: 200772 - protein, 15 aa, Borrelia afzelii
NETSNELKDENFKKI

SEQ ID NO: 200773 - protein, 15 aa, Borrelia afzelii
ETSNELKDENFKKIE

SEQ ID NO: 200774 - protein, 15 aa, Borrelia afzelii
TSNELKDENFKKIEE

SEQ ID NO: 200775 - protein, 15 aa, Borrelia afzelii
SNELKDENFKKIEEE

SEQ ID NO: 200776 - protein, 15 aa, Borrelia afzelii
NELKDENFKKIEEEF

SEQ ID NO: 200777 - protein, 15 aa, Borrelia afzelii
ELKDENFKKIEEEFK

SEQ ID NO: 200778 - protein, 15 aa, Borrelia afzelii
LKDENFKKIEEEFKD

SEQ ID NO: 200779 - protein, 15 aa, Borrelia afzelii
KDENFKKIEEEFKDT

SEQ ID NO: 200780 - protein, 15 aa, Borrelia afzelii
DENFKKIEEEFKDTL

SEQ ID NO: 200781 - protein, 15 aa, Borrelia afzelii
ENFKKIEEEFKDTLT

SEQ ID NO: 200782 - protein, 15 aa, Borrelia afzelii
NFKKIEEEFKDTLTR

SEQ ID NO: 200783 - protein, 15 aa, Borrelia afzelii
FKKIEEEFKDTLTRV

SEQ ID NO: 200784 - protein, 15 aa, Borrelia afzelii
KKIEEEFKDTLTRVK

SEQ ID NO: 200785 - protein, 15 aa, Borrelia afzelii
KIEEEFKDTLTRVKE

SEQ ID NO: 200786 - protein, 15 aa, Borrelia afzelii
IEEEFKDTLTRVKEI

SEQ ID NO: 200787 - protein, 15 aa, Borrelia afzelii
EEEFKDTLTRVKEIL

SEQ ID NO: 200788 - protein, 15 aa, Borrelia afzelii
EEFKDTLTRVKEILK

SEQ ID NO: 200789 - protein, 15 aa, Borrelia afzelii
EFKDTLTRVKEILKD

SEQ ID NO: 200790 - protein, 15 aa, Borrelia afzelii
FKDTLTRVKEILKDQ

SEQ ID NO: 200791 - protein, 15 aa, Borrelia afzelii
KDTLTRVKEILKDQI

SEQ ID NO: 200792 - protein, 15 aa, Borrelia afzelii
DTLTRVKEILKDQIK

SEQ ID NO: 200793 - protein, 15 aa, Borrelia afzelii
TLTRVKEILKDQIKE

SEQ ID NO: 200794 - protein, 15 aa, Borrelia afzelii
LTRVKEILKDQIKEV

SEQ ID NO: 200795 - protein, 15 aa, Borrelia afzelii
TRVKEILKDQIKEVN

SEQ ID NO: 200796 - protein, 15 aa, Borrelia afzelii
RVKEILKDQIKEVNL

SEQ ID NO: 200797 - protein, 15 aa, Borrelia afzelii
VKEILKDQIKEVNLS

SEQ ID NO: 200798 - protein, 15 aa, Borrelia afzelii
KEILKDQIKEVNLSA

SEQ ID NO: 200799 - protein, 15 aa, Borrelia afzelii
EILKDQIKEVNLSAT

SEQ ID NO: 200800 - protein, 15 aa, Borrelia afzelii
ILKDQIKEVNLSATL

SEQ ID NO: 200801 - protein, 15 aa, Borrelia afzelii
LKDQIKEVNLSATLI

SEQ ID NO: 200802 - protein, 15 aa, Borrelia afzelii
KDQIKEVNLSATLIK

SEQ ID NO: 200803 - protein, 15 aa, Borrelia afzelii
DQIKEVNLSATLIKE

SEQ ID NO: 200804 - protein, 15 aa, Borrelia afzelii
QIKEVNLSATLIKEP

SEQ ID NO: 200805 - protein, 15 aa, Borrelia afzelii
IKEVNLSATLIKEPS

SEQ ID NO: 200806 - protein, 15 aa, Borrelia afzelii
KEVNLSATLIKEPSA

SEQ ID NO: 200807 - protein, 15 aa, Borrelia afzelii
EVNLSATLIKEPSAI

SEQ ID NO: 200808 - protein, 15 aa, Borrelia afzelii
VNLSATLIKEPSAII

SEQ ID NO: 200809 - protein, 15 aa, Borrelia afzelii
NLSATLIKEPSAIIV

SEQ ID NO: 200810 - protein, 15 aa, Borrelia afzelii
LSATLIKEPSAIIVD

SEQ ID NO: 200811 - protein, 15 aa, Borrelia afzelii
SATLIKEPSAIIVDS

SEQ ID NO: 200812 - protein, 15 aa, Borrelia afzelii
ATLIKEPSAIIVDSN

SEQ ID NO: 200813 - protein, 15 aa, Borrelia afzelii
TLIKEPSAIIVDSND

SEQ ID NO: 200814 - protein, 15 aa, Borrelia afzelii
LIKEPSAIIVDSNDP

SEQ ID NO: 200815 - protein, 15 aa, Borrelia afzelii
IKEPSAIIVDSNDPT

SEQ ID NO: 200816 - protein, 15 aa, Borrelia afzelii
KEPSAIIVDSNDPTY

SEQ ID NO: 200817 - protein, 15 aa, Borrelia afzelii
EPSAIIVDSNDPTYQ

SEQ ID NO: 200818 - protein, 15 aa, Borrelia afzelii
PSAIIVDSNDPTYQM

SEQ ID NO: 200819 - protein, 15 aa, Borrelia afzelii
SAIIVDSNDPTYQMQ

SEQ ID NO: 200820 - protein, 15 aa, Borrelia afzelii
AIIVDSNDPTYQMQK

SEQ ID NO: 200821 - protein, 15 aa, Borrelia afzelii
IIVDSNDPTYQMQKI

SEQ ID NO: 200822 - protein, 15 aa, Borrelia afzelii
IVDSNDPTYQMQKIM

SEQ ID NO: 200823 - protein, 15 aa, Borrelia afzelii
VDSNDPTYQMQKIML

SEQ ID NO: 200824 - protein, 15 aa, Borrelia afzelii
DSNDPTYQMQKIMLS

SEQ ID NO: 200825 - protein, 15 aa, Borrelia afzelii
SNDPTYQMQKIMLSM

SEQ ID NO: 200826 - protein, 15 aa, Borrelia afzelii
NDPTYQMQKIMLSMG

SEQ ID NO: 200827 - protein, 15 aa, Borrelia afzelii
DPTYQMQKIMLSMGQ

SEQ ID NO: 200828 - protein, 15 aa, Borrelia afzelii
PTYQMQKIMLSMGQE

SEQ ID NO: 200829 - protein, 15 aa, Borrelia afzelii
TYQMQKIMLSMGQEV

SEQ ID NO: 200830 - protein, 15 aa, Borrelia afzelii
YQMQKIMLSMGQEVK

SEQ ID NO: 200831 - protein, 15 aa, Borrelia afzelii
QMQKIMLSMGQEVKE

SEQ ID NO: 200832 - protein, 15 aa, Borrelia afzelii
MQKIMLSMGQEVKEI

SEQ ID NO: 200833 - protein, 15 aa, Borrelia afzelii
QKIMLSMGQEVKEIK

SEQ ID NO: 200834 - protein, 15 aa, Borrelia afzelii
KIMLSMGQEVKEIKP

SEQ ID NO: 200835 - protein, 15 aa, Borrelia afzelii
IMLSMGQEVKEIKPI

SEQ ID NO: 200836 - protein, 15 aa, Borrelia afzelii
MLSMGQEVKEIKPIL

SEQ ID NO: 200837 - protein, 15 aa, Borrelia afzelii
LSMGQEVKEIKPILE

SEQ ID NO: 200838 - protein, 15 aa, Borrelia afzelii
SMGQEVKEIKPILEL

SEQ ID NO: 200839 - protein, 15 aa, Borrelia afzelii
MGQEVKEIKPILELN

SEQ ID NO: 200840 - protein, 15 aa, Borrelia afzelii
GQEVKEIKPILELNP

SEQ ID NO: 200841 - protein, 15 aa, Borrelia afzelii
QEVKEIKPILELNPN

SEQ ID NO: 200842 - protein, 15 aa, Borrelia afzelii
EVKEIKPILELNPNN

SEQ ID NO: 200843 - protein, 15 aa, Borrelia afzelii
VKEIKPILELNPNNK

SEQ ID NO: 200844 - protein, 15 aa, Borrelia afzelii
KEIKPILELNPNNKI

SEQ ID NO: 200845 - protein, 15 aa, Borrelia afzelii
EIKPILELNPNNKIV

SEQ ID NO: 200846 - protein, 15 aa, Borrelia afzelii
IKPILELNPNNKIVQ

SEQ ID NO: 200847 - protein, 15 aa, Borrelia afzelii
KPILELNPNNKIVQN

SEQ ID NO: 200848 - protein, 15 aa, Borrelia afzelii
PILELNPNNKIVQNL

SEQ ID NO: 200849 - protein, 15 aa, Borrelia afzelii
ILELNPNNKIVQNLK

SEQ ID NO: 200850 - protein, 15 aa, Borrelia afzelii
LELNPNNKIVQNLKN

SEQ ID NO: 200851 - protein, 15 aa, Borrelia afzelii
ELNPNNKIVQNLKNL

SEQ ID NO: 200852 - protein, 15 aa, Borrelia afzelii
LNPNNKIVQNLKNLE

SEQ ID NO: 200853 - protein, 15 aa, Borrelia afzelii
NPNNKIVQNLKNLEP

SEQ ID NO: 200854 - protein, 15 aa, Borrelia afzelii
PNNKIVQNLKNLEPE

SEQ ID NO: 200855 - protein, 15 aa, Borrelia afzelii
NNKIVQNLKNLEPEK

SEQ ID NO: 200856 - protein, 15 aa, Borrelia afzelii
NKIVQNLKNLEPEKL

SEQ ID NO: 200857 - protein, 15 aa, Borrelia afzelii
KIVQNLKNLEPEKLE

SEQ ID NO: 200858 - protein, 15 aa, Borrelia afzelii
IVQNLKNLEPEKLEK

SEQ ID NO: 200859 - protein, 15 aa, Borrelia afzelii
VQNLKNLEPEKLEKI

SEQ ID NO: 200860 - protein, 15 aa, Borrelia afzelii
QNLKNLEPEKLEKIS

SEQ ID NO: 200861 - protein, 15 aa, Borrelia afzelii
NLKNLEPEKLEKISI

SEQ ID NO: 200862 - protein, 15 aa, Borrelia afzelii
LKNLEPEKLEKISIL

SEQ ID NO: 200863 - protein, 15 aa, Borrelia afzelii
KNLEPEKLEKISILL

SEQ ID NO: 200864 - protein, 15 aa, Borrelia afzelii
NLEPEKLEKISILLF

SEQ ID NO: 200865 - protein, 15 aa, Borrelia afzelii
LEPEKLEKISILLFE

SEQ ID NO: 200866 - protein, 15 aa, Borrelia afzelii
EPEKLEKISILLFEE

SEQ ID NO: 200867 - protein, 15 aa, Borrelia afzelii
PEKLEKISILLFEEA

SEQ ID NO: 200868 - protein, 15 aa, Borrelia afzelii
EKLEKISILLFEEAL

SEQ ID NO: 200869 - protein, 15 aa, Borrelia afzelii
KLEKISILLFEEALL

SEQ ID NO: 200870 - protein, 15 aa, Borrelia afzelii
LEKISILLFEEALLT

SEQ ID NO: 200871 - protein, 15 aa, Borrelia afzelii
EKISILLFEEALLTS

SEQ ID NO: 200872 - protein, 15 aa, Borrelia afzelii
KISILLFEEALLTSG

SEQ ID NO: 200873 - protein, 15 aa, Borrelia afzelii
ISILLFEEALLTSGM

SEQ ID NO: 200874 - protein, 15 aa, Borrelia afzelii
SILLFEEALLTSGMP

SEQ ID NO: 200875 - protein, 15 aa, Borrelia afzelii
ILLFEEALLTSGMPS

SEQ ID NO: 200876 - protein, 15 aa, Borrelia afzelii
LLFEEALLTSGMPSK

SEQ ID NO: 200877 - protein, 15 aa, Borrelia afzelii
LFEEALLTSGMPSKN

SEQ ID NO: 200878 - protein, 15 aa, Borrelia afzelii
FEEALLTSGMPSKNP

SEQ ID NO: 200879 - protein, 15 aa, Borrelia afzelii
EEALLTSGMPSKNPR

SEQ ID NO: 200880 - protein, 15 aa, Borrelia afzelii
EALLTSGMPSKNPRK

SEQ ID NO: 200881 - protein, 15 aa, Borrelia afzelii
ALLTSGMPSKNPRKF

SEQ ID NO: 200882 - protein, 15 aa, Borrelia afzelii
LLTSGMPSKNPRKFI

SEQ ID NO: 200883 - protein, 15 aa, Borrelia afzelii
LTSGMPSKNPRKFIN

SEQ ID NO: 200884 - protein, 15 aa, Borrelia afzelii
TSGMPSKNPRKFINI

SEQ ID NO: 200885 - protein, 15 aa, Borrelia afzelii
SGMPSKNPRKFINII

SEQ ID NO: 200886 - protein, 15 aa, Borrelia afzelii
GMPSKNPRKFINIIN

SEQ ID NO: 200887 - protein, 15 aa, Borrelia afzelii
MPSKNPRKFINIINE

SEQ ID NO: 200888 - protein, 15 aa, Borrelia afzelii
PSKNPRKFINIINEF

SEQ ID NO: 200889 - protein, 15 aa, Borrelia afzelii
SKNPRKFINIINEFL

SEQ ID NO: 200890 - protein, 15 aa, Borrelia afzelii
KNPRKFINIINEFLE

SEQ ID NO: 200891 - protein, 15 aa, Borrelia afzelii
NPRKFINIINEFLEK

SEQ ID NO: 200892 - protein, 15 aa, Borrelia afzelii
PRKFINIINEFLEKD

SEQ ID NO: 200893 - protein, 15 aa, Borrelia afzelii
RKFINIINEFLEKDL

SEQ ID NO: 200894 - protein, 15 aa, Borrelia afzelii
KFINIINEFLEKDLL

SEQ ID NO: 200895 - protein, 16 aa, Borrelia afzelii
MKKQFDTEVNDLLYLI

SEQ ID NO: 200896 - protein, 16 aa, Borrelia afzelii
KKQFDTEVNDLLYLII

SEQ ID NO: 200897 - protein, 16 aa, Borrelia afzelii
KQFDTEVNDLLYLIIH

SEQ ID NO: 200898 - protein, 16 aa, Borrelia afzelii
QFDTEVNDLLYLIIHS

SEQ ID NO: 200899 - protein, 16 aa, Borrelia afzelii
FDTEVNDLLYLIIHSL

SEQ ID NO: 200900 - protein, 16 aa, Borrelia afzelii
DTEVNDLLYLIIHSLY

SEQ ID NO: 200901 - protein, 16 aa, Borrelia afzelii
TEVNDLLYLIIHSLYS

SEQ ID NO: 200902 - protein, 16 aa, Borrelia afzelii
EVNDLLYLIIHSLYSH

SEQ ID NO: 200903 - protein, 16 aa, Borrelia afzelii
VNDLLYLIIHSLYSHK

SEQ ID NO: 200904 - protein, 16 aa, Borrelia afzelii
NDLLYLIIHSLYSHKE

SEQ ID NO: 200905 - protein, 16 aa, Borrelia afzelii
DLLYLIIHSLYSHKEI

SEQ ID NO: 200906 - protein, 16 aa, Borrelia afzelii
LLYLIIHSLYSHKEIF

SEQ ID NO: 200907 - protein, 16 aa, Borrelia afzelii
LYLIIHSLYSHKEIFL

SEQ ID NO: 200908 - protein, 16 aa, Borrelia afzelii
YLIIHSLYSHKEIFLR

SEQ ID NO: 200909 - protein, 16 aa, Borrelia afzelii
LIIHSLYSHKEIFLRE

SEQ ID NO: 200910 - protein, 16 aa, Borrelia afzelii
IIHSLYSHKEIFLREL

SEQ ID NO: 200911 - protein, 16 aa, Borrelia afzelii
IHSLYSHKEIFLRELI

SEQ ID NO: 200912 - protein, 16 aa, Borrelia afzelii
HSLYSHKEIFLRELIS

SEQ ID NO: 200913 - protein, 16 aa, Borrelia afzelii
SLYSHKEIFLRELISN

SEQ ID NO: 200914 - protein, 16 aa, Borrelia afzelii
LYSHKEIFLRELISNA

SEQ ID NO: 200915 - protein, 16 aa, Borrelia afzelii
YSHKEIFLRELISNAS

SEQ ID NO: 200916 - protein, 16 aa, Borrelia afzelii
SHKEIFLRELISNASD

SEQ ID NO: 200917 - protein, 16 aa, Borrelia afzelii
HKEIFLRELISNASDA

SEQ ID NO: 200918 - protein, 16 aa, Borrelia afzelii
KEIFLRELISNASDAI

SEQ ID NO: 200919 - protein, 16 aa, Borrelia afzelii
EIFLRELISNASDAID

SEQ ID NO: 200920 - protein, 16 aa, Borrelia afzelii
IFLRELISNASDAIDK

SEQ ID NO: 200921 - protein, 16 aa, Borrelia afzelii
FLRELISNASDAIDKL

SEQ ID NO: 200922 - protein, 16 aa, Borrelia afzelii
LRELISNASDAIDKLK

SEQ ID NO: 200923 - protein, 16 aa, Borrelia afzelii
RELISNASDAIDKLKF

SEQ ID NO: 200924 - protein, 16 aa, Borrelia afzelii
ELISNASDAIDKLKFL

SEQ ID NO: 200925 - protein, 16 aa, Borrelia afzelii
LISNASDAIDKLKFLS

SEQ ID NO: 200926 - protein, 16 aa, Borrelia afzelii
ISNASDAIDKLKFLSL

SEQ ID NO: 200927 - protein, 16 aa, Borrelia afzelii
SNASDAIDKLKFLSLT

SEQ ID NO: 200928 - protein, 16 aa, Borrelia afzelii
NASDAIDKLKFLSLTN

SEQ ID NO: 200929 - protein, 16 aa, Borrelia afzelii
ASDAIDKLKFLSLTNE

SEQ ID NO: 200930 - protein, 16 aa, Borrelia afzelii
SDAIDKLKFLSLTNEK

SEQ ID NO: 200931 - protein, 16 aa, Borrelia afzelii
DAIDKLKFLSLTNEKF

SEQ ID NO: 200932 - protein, 16 aa, Borrelia afzelii
AIDKLKFLSLTNEKFK

SEQ ID NO: 200933 - protein, 16 aa, Borrelia afzelii
IDKLKFLSLTNEKFKN

SEQ ID NO: 200934 - protein, 16 aa, Borrelia afzelii
DKLKFLSLTNEKFKNI

SEQ ID NO: 200935 - protein, 16 aa, Borrelia afzelii
KLKFLSLTNEKFKNIA

SEQ ID NO: 200936 - protein, 16 aa, Borrelia afzelii
LKFLSLTNEKFKNIAL

SEQ ID NO: 200937 - protein, 16 aa, Borrelia afzelii
KFLSLTNEKFKNIALE

SEQ ID NO: 200938 - protein, 16 aa, Borrelia afzelii
FLSLTNEKFKNIALEP

SEQ ID NO: 200939 - protein, 16 aa, Borrelia afzelii
LSLTNEKFKNIALEPK

SEQ ID NO: 200940 - protein, 16 aa, Borrelia afzelii
SLTNEKFKNIALEPKI

SEQ ID NO: 200941 - protein, 16 aa, Borrelia afzelii
LTNEKFKNIALEPKIE

SEQ ID NO: 200942 - protein, 16 aa, Borrelia afzelii
TNEKFKNIALEPKIEI

SEQ ID NO: 200943 - protein, 16 aa, Borrelia afzelii
NEKFKNIALEPKIEIT

SEQ ID NO: 200944 - protein, 16 aa, Borrelia afzelii
EKFKNIALEPKIEITF

SEQ ID NO: 200945 - protein, 16 aa, Borrelia afzelii
KFKNIALEPKIEITFD

SEQ ID NO: 200946 - protein, 16 aa, Borrelia afzelii
FKNIALEPKIEITFDD

SEQ ID NO: 200947 - protein, 16 aa, Borrelia afzelii
KNIALEPKIEITFDDK

SEQ ID NO: 200948 - protein, 16 aa, Borrelia afzelii
NIALEPKIEITFDDKS

SEQ ID NO: 200949 - protein, 16 aa, Borrelia afzelii
IALEPKIEITFDDKSI

SEQ ID NO: 200950 - protein, 16 aa, Borrelia afzelii
ALEPKIEITFDDKSIL

SEQ ID NO: 200951 - protein, 16 aa, Borrelia afzelii
LEPKIEITFDDKSILI

SEQ ID NO: 200952 - protein, 16 aa, Borrelia afzelii
EPKIEITFDDKSILIK

SEQ ID NO: 200953 - protein, 16 aa, Borrelia afzelii
PKIEITFDDKSILIKD

SEQ ID NO: 200954 - protein, 16 aa, Borrelia afzelii
KIEITFDDKSILIKDN

SEQ ID NO: 200955 - protein, 16 aa, Borrelia afzelii
IEITFDDKSILIKDNG

SEQ ID NO: 200956 - protein, 16 aa, Borrelia afzelii
EITFDDKSILIKDNGI

SEQ ID NO: 200957 - protein, 16 aa, Borrelia afzelii
ITFDDKSILIKDNGIG

SEQ ID NO: 200958 - protein, 16 aa, Borrelia afzelii
TFDDKSILIKDNGIGM

SEQ ID NO: 200959 - protein, 16 aa, Borrelia afzelii
FDDKSILIKDNGIGMN

SEQ ID NO: 200960 - protein, 16 aa, Borrelia afzelii
DDKSILIKDNGIGMNE

SEQ ID NO: 200961 - protein, 16 aa, Borrelia afzelii
DKSILIKDNGIGMNEQ

SEQ ID NO: 200962 - protein, 16 aa, Borrelia afzelii
KSILIKDNGIGMNEQE

SEQ ID NO: 200963 - protein, 16 aa, Borrelia afzelii
SILIKDNGIGMNEQEL

SEQ ID NO: 200964 - protein, 16 aa, Borrelia afzelii
ILIKDNGIGMNEQELT

SEQ ID NO: 200965 - protein, 16 aa, Borrelia afzelii
LIKDNGIGMNEQELTN

SEQ ID NO: 200966 - protein, 16 aa, Borrelia afzelii
IKDNGIGMNEQELTNH

SEQ ID NO: 200967 - protein, 16 aa, Borrelia afzelii
KDNGIGMNEQELTNHL

SEQ ID NO: 200968 - protein, 16 aa, Borrelia afzelii
DNGIGMNEQELTNHLG

SEQ ID NO: 200969 - protein, 16 aa, Borrelia afzelii
NGIGMNEQELTNHLGV

SEQ ID NO: 200970 - protein, 16 aa, Borrelia afzelii
GIGMNEQELTNHLGVI

SEQ ID NO: 200971 - protein, 16 aa, Borrelia afzelii
IGMNEQELTNHLGVIA

SEQ ID NO: 200972 - protein, 16 aa, Borrelia afzelii
GMNEQELTNHLGVIAK

SEQ ID NO: 200973 - protein, 16 aa, Borrelia afzelii
MNEQELTNHLGVIAKS

SEQ ID NO: 200974 - protein, 16 aa, Borrelia afzelii
NEQELTNHLGVIAKSG

SEQ ID NO: 200975 - protein, 16 aa, Borrelia afzelii
EQELTNHLGVIAKSGT

SEQ ID NO: 200976 - protein, 16 aa, Borrelia afzelii
QELTNHLGVIAKSGTK

SEQ ID NO: 200977 - protein, 16 aa, Borrelia afzelii
ELTNHLGVIAKSGTKE

SEQ ID NO: 200978 - protein, 16 aa, Borrelia afzelii
LTNHLGVIAKSGTKEF

SEQ ID NO: 200979 - protein, 16 aa, Borrelia afzelii
TNHLGVIAKSGTKEFI

SEQ ID NO: 200980 - protein, 16 aa, Borrelia afzelii
NHLGVIAKSGTKEFIN

SEQ ID NO: 200981 - protein, 16 aa, Borrelia afzelii
HLGVIAKSGTKEFINN

SEQ ID NO: 200982 - protein, 16 aa, Borrelia afzelii
LGVIAKSGTKEFINNL

SEQ ID NO: 200983 - protein, 16 aa, Borrelia afzelii
GVIAKSGTKEFINNLK

SEQ ID NO: 200984 - protein, 16 aa, Borrelia afzelii
VIAKSGTKEFINNLKQ

SEQ ID NO: 200985 - protein, 16 aa, Borrelia afzelii
IAKSGTKEFINNLKQD

SEQ ID NO: 200986 - protein, 16 aa, Borrelia afzelii
AKSGTKEFINNLKQDE

SEQ ID NO: 200987 - protein, 16 aa, Borrelia afzelii
KSGTKEFINNLKQDEK

SEQ ID NO: 200988 - protein, 16 aa, Borrelia afzelii
SGTKEFINNLKQDEKK

SEQ ID NO: 200989 - protein, 16 aa, Borrelia afzelii
GTKEFINNLKQDEKKS

SEQ ID NO: 200990 - protein, 16 aa, Borrelia afzelii
TKEFINNLKQDEKKSA

SEQ ID NO: 200991 - protein, 16 aa, Borrelia afzelii
KEFINNLKQDEKKSAN

SEQ ID NO: 200992 - protein, 16 aa, Borrelia afzelii
EFINNLKQDEKKSANL

SEQ ID NO: 200993 - protein, 16 aa, Borrelia afzelii
FINNLKQDEKKSANLI

SEQ ID NO: 200994 - protein, 16 aa, Borrelia afzelii
INNLKQDEKKSANLIG

SEQ ID NO: 200995 - protein, 16 aa, Borrelia afzelii
NNLKQDEKKSANLIGQ

SEQ ID NO: 200996 - protein, 16 aa, Borrelia afzelii
NLKQDEKKSANLIGQF

SEQ ID NO: 200997 - protein, 16 aa, Borrelia afzelii
LKQDEKKSANLIGQFG

SEQ ID NO: 200998 - protein, 16 aa, Borrelia afzelii
KQDEKKSANLIGQFGV

SEQ ID NO: 200999 - protein, 16 aa, Borrelia afzelii
QDEKKSANLIGQFGVG

SEQ ID NO: 201000 - protein, 16 aa, Borrelia afzelii
DEKKSANLIGQFGVGF

SEQ ID NO: 201001 - protein, 16 aa, Borrelia afzelii
EKKSANLIGQFGVGFY

SEQ ID NO: 201002 - protein, 16 aa, Borrelia afzelii
KKSANLIGQFGVGFYS

SEQ ID NO: 201003 - protein, 16 aa, Borrelia afzelii
KSANLIGQFGVGFYSA

SEQ ID NO: 201004 - protein, 16 aa, Borrelia afzelii
SANLIGQFGVGFYSAF

SEQ ID NO: 201005 - protein, 16 aa, Borrelia afzelii
ANLIGQFGVGFYSAFI

SEQ ID NO: 201006 - protein, 16 aa, Borrelia afzelii
NLIGQFGVGFYSAFIV

SEQ ID NO: 201007 - protein, 16 aa, Borrelia afzelii
LIGQFGVGFYSAFIVS

SEQ ID NO: 201008 - protein, 16 aa, Borrelia afzelii
IGQFGVGFYSAFIVSE

SEQ ID NO: 201009 - protein, 16 aa, Borrelia afzelii
GQFGVGFYSAFIVSEK

SEQ ID NO: 201010 - protein, 16 aa, Borrelia afzelii
QFGVGFYSAFIVSEKV

SEQ ID NO: 201011 - protein, 16 aa, Borrelia afzelii
FGVGFYSAFIVSEKVE

SEQ ID NO: 201012 - protein, 16 aa, Borrelia afzelii
GVGFYSAFIVSEKVEV

SEQ ID NO: 201013 - protein, 16 aa, Borrelia afzelii
VGFYSAFIVSEKVEVT

SEQ ID NO: 201014 - protein, 16 aa, Borrelia afzelii
GFYSAFIVSEKVEVTS

SEQ ID NO: 201015 - protein, 16 aa, Borrelia afzelii
FYSAFIVSEKVEVTSK

SEQ ID NO: 201016 - protein, 16 aa, Borrelia afzelii
YSAFIVSEKVEVTSKK

SEQ ID NO: 201017 - protein, 16 aa, Borrelia afzelii
SAFIVSEKVEVTSKKA

SEQ ID NO: 201018 - protein, 16 aa, Borrelia afzelii
AFIVSEKVEVTSKKAL

SEQ ID NO: 201019 - protein, 16 aa, Borrelia afzelii
FIVSEKVEVTSKKALE

SEQ ID NO: 201020 - protein, 16 aa, Borrelia afzelii
IVSEKVEVTSKKALES

SEQ ID NO: 201021 - protein, 16 aa, Borrelia afzelii
VSEKVEVTSKKALESD

SEQ ID NO: 201022 - protein, 16 aa, Borrelia afzelii
SEKVEVTSKKALESDA

SEQ ID NO: 201023 - protein, 16 aa, Borrelia afzelii
EKVEVTSKKALESDAY

SEQ ID NO: 201024 - protein, 16 aa, Borrelia afzelii
KVEVTSKKALESDAYI

SEQ ID NO: 201025 - protein, 16 aa, Borrelia afzelii
VEVTSKKALESDAYIW

SEQ ID NO: 201026 - protein, 16 aa, Borrelia afzelii
EVTSKKALESDAYIWS

SEQ ID NO: 201027 - protein, 16 aa, Borrelia afzelii
VTSKKALESDAYIWSS

SEQ ID NO: 201028 - protein, 16 aa, Borrelia afzelii
TSKKALESDAYIWSSD

SEQ ID NO: 201029 - protein, 16 aa, Borrelia afzelii
SKKALESDAYIWSSDG

SEQ ID NO: 201030 - protein, 16 aa, Borrelia afzelii
KKALESDAYIWSSDGK

SEQ ID NO: 201031 - protein, 16 aa, Borrelia afzelii
KALESDAYIWSSDGKT

SEQ ID NO: 201032 - protein, 16 aa, Borrelia afzelii
ALESDAYIWSSDGKTG

SEQ ID NO: 201033 - protein, 16 aa, Borrelia afzelii
LESDAYIWSSDGKTGY

SEQ ID NO: 201034 - protein, 16 aa, Borrelia afzelii
ESDAYIWSSDGKTGYE

SEQ ID NO: 201035 - protein, 16 aa, Borrelia afzelii
SDAYIWSSDGKTGYEI

SEQ ID NO: 201036 - protein, 16 aa, Borrelia afzelii
DAYIWSSDGKTGYEIE

SEQ ID NO: 201037 - protein, 16 aa, Borrelia afzelii
AYIWSSDGKTGYEIEK

SEQ ID NO: 201038 - protein, 16 aa, Borrelia afzelii
YIWSSDGKTGYEIEKA

SEQ ID NO: 201039 - protein, 16 aa, Borrelia afzelii
IWSSDGKTGYEIEKAK

SEQ ID NO: 201040 - protein, 16 aa, Borrelia afzelii
WSSDGKTGYEIEKAKK

SEQ ID NO: 201041 - protein, 16 aa, Borrelia afzelii
SSDGKTGYEIEKAKKE

SEQ ID NO: 201042 - protein, 16 aa, Borrelia afzelii
SDGKTGYEIEKAKKED

SEQ ID NO: 201043 - protein, 16 aa, Borrelia afzelii
DGKTGYEIEKAKKEDP

SEQ ID NO: 201044 - protein, 16 aa, Borrelia afzelii
GKTGYEIEKAKKEDPG

SEQ ID NO: 201045 - protein, 16 aa, Borrelia afzelii
KTGYEIEKAKKEDPGT

SEQ ID NO: 201046 - protein, 16 aa, Borrelia afzelii
TGYEIEKAKKEDPGTE

SEQ ID NO: 201047 - protein, 16 aa, Borrelia afzelii
GYEIEKAKKEDPGTEI

SEQ ID NO: 201048 - protein, 16 aa, Borrelia afzelii
YEIEKAKKEDPGTEIK

SEQ ID NO: 201049 - protein, 16 aa, Borrelia afzelii
EIEKAKKEDPGTEIKL

SEQ ID NO: 201050 - protein, 16 aa, Borrelia afzelii
IEKAKKEDPGTEIKLY

SEQ ID NO: 201051 - protein, 16 aa, Borrelia afzelii
EKAKKEDPGTEIKLYL

SEQ ID NO: 201052 - protein, 16 aa, Borrelia afzelii
KAKKEDPGTEIKLYLN

SEQ ID NO: 201053 - protein, 16 aa, Borrelia afzelii
AKKEDPGTEIKLYLNK

SEQ ID NO: 201054 - protein, 16 aa, Borrelia afzelii
KKEDPGTEIKLYLNKE

SEQ ID NO: 201055 - protein, 16 aa, Borrelia afzelii
KEDPGTEIKLYLNKEG

SEQ ID NO: 201056 - protein, 16 aa, Borrelia afzelii
EDPGTEIKLYLNKEGL

SEQ ID NO: 201057 - protein, 16 aa, Borrelia afzelii
DPGTEIKLYLNKEGLE

SEQ ID NO: 201058 - protein, 16 aa, Borrelia afzelii
PGTEIKLYLNKEGLEY

SEQ ID NO: 201059 - protein, 16 aa, Borrelia afzelii
GTEIKLYLNKEGLEYA

SEQ ID NO: 201060 - protein, 16 aa, Borrelia afzelii
TEIKLYLNKEGLEYAN

SEQ ID NO: 201061 - protein, 16 aa, Borrelia afzelii
EIKLYLNKEGLEYANK

SEQ ID NO: 201062 - protein, 16 aa, Borrelia afzelii
IKLYLNKEGLEYANKW

SEQ ID NO: 201063 - protein, 16 aa, Borrelia afzelii
KLYLNKEGLEYANKWK

SEQ ID NO: 201064 - protein, 16 aa, Borrelia afzelii
LYLNKEGLEYANKWKI

SEQ ID NO: 201065 - protein, 16 aa, Borrelia afzelii
YLNKEGLEYANKWKIQ

SEQ ID NO: 201066 - protein, 16 aa, Borrelia afzelii
LNKEGLEYANKWKIQE

SEQ ID NO: 201067 - protein, 16 aa, Borrelia afzelii
NKEGLEYANKWKIQEI

SEQ ID NO: 201068 - protein, 16 aa, Borrelia afzelii
KEGLEYANKWKIQEIV

SEQ ID NO: 201069 - protein, 16 aa, Borrelia afzelii
EGLEYANKWKIQEIVK

SEQ ID NO: 201070 - protein, 16 aa, Borrelia afzelii
GLEYANKWKIQEIVKK

SEQ ID NO: 201071 - protein, 16 aa, Borrelia afzelii
LEYANKWKIQEIVKKY

SEQ ID NO: 201072 - protein, 16 aa, Borrelia afzelii
EYANKWKIQEIVKKYS

SEQ ID NO: 201073 - protein, 16 aa, Borrelia afzelii
YANKWKIQEIVKKYSN

SEQ ID NO: 201074 - protein, 16 aa, Borrelia afzelii
ANKWKIQEIVKKYSNH

SEQ ID NO: 201075 - protein, 16 aa, Borrelia afzelii
NKWKIQEIVKKYSNHI

SEQ ID NO: 201076 - protein, 16 aa, Borrelia afzelii
KWKIQEIVKKYSNHIN

SEQ ID NO: 201077 - protein, 16 aa, Borrelia afzelii
WKIQEIVKKYSNHINY

SEQ ID NO: 201078 - protein, 16 aa, Borrelia afzelii
KIQEIVKKYSNHINYP

SEQ ID NO: 201079 - protein, 16 aa, Borrelia afzelii
IQEIVKKYSNHINYPI

SEQ ID NO: 201080 - protein, 16 aa, Borrelia afzelii
QEIVKKYSNHINYPIY

SEQ ID NO: 201081 - protein, 16 aa, Borrelia afzelii
EIVKKYSNHINYPIYI

SEQ ID NO: 201082 - protein, 16 aa, Borrelia afzelii
IVKKYSNHINYPIYIK

SEQ ID NO: 201083 - protein, 16 aa, Borrelia afzelii
VKKYSNHINYPIYIKY

SEQ ID NO: 201084 - protein, 16 aa, Borrelia afzelii
KKYSNHINYPIYIKYN

SEQ ID NO: 201085 - protein, 16 aa, Borrelia afzelii
KYSNHINYPIYIKYNE

SEQ ID NO: 201086 - protein, 16 aa, Borrelia afzelii
YSNHINYPIYIKYNEP

SEQ ID NO: 201087 - protein, 16 aa, Borrelia afzelii
SNHINYPIYIKYNEPI

SEQ ID NO: 201088 - protein, 16 aa, Borrelia afzelii
NHINYPIYIKYNEPIM

SEQ ID NO: 201089 - protein, 16 aa, Borrelia afzelii
HINYPIYIKYNEPIMK

SEQ ID NO: 201090 - protein, 16 aa, Borrelia afzelii
INYPIYIKYNEPIMKD

SEQ ID NO: 201091 - protein, 16 aa, Borrelia afzelii
NYPIYIKYNEPIMKDG

SEQ ID NO: 201092 - protein, 16 aa, Borrelia afzelii
YPIYIKYNEPIMKDGK

SEQ ID NO: 201093 - protein, 16 aa, Borrelia afzelii
PIYIKYNEPIMKDGKQ

SEQ ID NO: 201094 - protein, 16 aa, Borrelia afzelii
IYIKYNEPIMKDGKQE

SEQ ID NO: 201095 - protein, 16 aa, Borrelia afzelii
YIKYNEPIMKDGKQEG

SEQ ID NO: 201096 - protein, 16 aa, Borrelia afzelii
IKYNEPIMKDGKQEGI

SEQ ID NO: 201097 - protein, 16 aa, Borrelia afzelii
KYNEPIMKDGKQEGIE

SEQ ID NO: 201098 - protein, 16 aa, Borrelia afzelii
YNEPIMKDGKQEGIEE

SEQ ID NO: 201099 - protein, 16 aa, Borrelia afzelii
NEPIMKDGKQEGIEEK

SEQ ID NO: 201100 - protein, 16 aa, Borrelia afzelii
EPIMKDGKQEGIEEKE

SEQ ID NO: 201101 - protein, 16 aa, Borrelia afzelii
PIMKDGKQEGIEEKEE

SEQ ID NO: 201102 - protein, 16 aa, Borrelia afzelii
IMKDGKQEGIEEKEEK

SEQ ID NO: 201103 - protein, 16 aa, Borrelia afzelii
MKDGKQEGIEEKEEKL

SEQ ID NO: 201104 - protein, 16 aa, Borrelia afzelii
KDGKQEGIEEKEEKLN

SEQ ID NO: 201105 - protein, 16 aa, Borrelia afzelii
DGKQEGIEEKEEKLNE

SEQ ID NO: 201106 - protein, 16 aa, Borrelia afzelii
GKQEGIEEKEEKLNET

SEQ ID NO: 201107 - protein, 16 aa, Borrelia afzelii
KQEGIEEKEEKLNETT

SEQ ID NO: 201108 - protein, 16 aa, Borrelia afzelii
QEGIEEKEEKLNETTA

SEQ ID NO: 201109 - protein, 16 aa, Borrelia afzelii
EGIEEKEEKLNETTAL

SEQ ID NO: 201110 - protein, 16 aa, Borrelia afzelii
GIEEKEEKLNETTALW

SEQ ID NO: 201111 - protein, 16 aa, Borrelia afzelii
IEEKEEKLNETTALWT

SEQ ID NO: 201112 - protein, 16 aa, Borrelia afzelii
EEKEEKLNETTALWTK

SEQ ID NO: 201113 - protein, 16 aa, Borrelia afzelii
EKEEKLNETTALWTKN

SEQ ID NO: 201114 - protein, 16 aa, Borrelia afzelii
KEEKLNETTALWTKNK

SEQ ID NO: 201115 - protein, 16 aa, Borrelia afzelii
EEKLNETTALWTKNKS

SEQ ID NO: 201116 - protein, 16 aa, Borrelia afzelii
EKLNETTALWTKNKSE

SEQ ID NO: 201117 - protein, 16 aa, Borrelia afzelii
KLNETTALWTKNKSEI

SEQ ID NO: 201118 - protein, 16 aa, Borrelia afzelii
LNETTALWTKNKSEIK

SEQ ID NO: 201119 - protein, 16 aa, Borrelia afzelii
NETTALWTKNKSEIKT

SEQ ID NO: 201120 - protein, 16 aa, Borrelia afzelii
ETTALWTKNKSEIKTE

SEQ ID NO: 201121 - protein, 16 aa, Borrelia afzelii
TTALWTKNKSEIKTEE

SEQ ID NO: 201122 - protein, 16 aa, Borrelia afzelii
TALWTKNKSEIKTEEY

SEQ ID NO: 201123 - protein, 16 aa, Borrelia afzelii
ALWTKNKSEIKTEEYN

SEQ ID NO: 201124 - protein, 16 aa, Borrelia afzelii
LWTKNKSEIKTEEYNE

SEQ ID NO: 201125 - protein, 16 aa, Borrelia afzelii
WTKNKSEIKTEEYNEF

SEQ ID NO: 201126 - protein, 16 aa, Borrelia afzelii
TKNKSEIKTEEYNEFY

SEQ ID NO: 201127 - protein, 16 aa, Borrelia afzelii
KNKSEIKTEEYNEFYK

SEQ ID NO: 201128 - protein, 16 aa, Borrelia afzelii
NKSEIKTEEYNEFYKN

SEQ ID NO: 201129 - protein, 16 aa, Borrelia afzelii
KSEIKTEEYNEFYKNT

SEQ ID NO: 201130 - protein, 16 aa, Borrelia afzelii
SEIKTEEYNEFYKNTT

SEQ ID NO: 201131 - protein, 16 aa, Borrelia afzelii
EIKTEEYNEFYKNTTF

SEQ ID NO: 201132 - protein, 16 aa, Borrelia afzelii
IKTEEYNEFYKNTTFD

SEQ ID NO: 201133 - protein, 16 aa, Borrelia afzelii
KTEEYNEFYKNTTFDY

SEQ ID NO: 201134 - protein, 16 aa, Borrelia afzelii
TEEYNEFYKNTTFDYE

SEQ ID NO: 201135 - protein, 16 aa, Borrelia afzelii
EEYNEFYKNTTFDYEN

SEQ ID NO: 201136 - protein, 16 aa, Borrelia afzelii
EYNEFYKNTTFDYENP

SEQ ID NO: 201137 - protein, 16 aa, Borrelia afzelii
YNEFYKNTTFDYENPL

SEQ ID NO: 201138 - protein, 16 aa, Borrelia afzelii
NEFYKNTTFDYENPLM

SEQ ID NO: 201139 - protein, 16 aa, Borrelia afzelii
EFYKNTTFDYENPLMY

SEQ ID NO: 201140 - protein, 16 aa, Borrelia afzelii
FYKNTTFDYENPLMYI

SEQ ID NO: 201141 - protein, 16 aa, Borrelia afzelii
YKNTTFDYENPLMYIH

SEQ ID NO: 201142 - protein, 16 aa, Borrelia afzelii
KNTTFDYENPLMYIHT

SEQ ID NO: 201143 - protein, 16 aa, Borrelia afzelii
NTTFDYENPLMYIHTK

SEQ ID NO: 201144 - protein, 16 aa, Borrelia afzelii
TTFDYENPLMYIHTKA

SEQ ID NO: 201145 - protein, 16 aa, Borrelia afzelii
TFDYENPLMYIHTKAE

SEQ ID NO: 201146 - protein, 16 aa, Borrelia afzelii
FDYENPLMYIHTKAEG

SEQ ID NO: 201147 - protein, 16 aa, Borrelia afzelii
DYENPLMYIHTKAEGN

SEQ ID NO: 201148 - protein, 16 aa, Borrelia afzelii
YENPLMYIHTKAEGNL

SEQ ID NO: 201149 - protein, 16 aa, Borrelia afzelii
ENPLMYIHTKAEGNLE

SEQ ID NO: 201150 - protein, 16 aa, Borrelia afzelii
NPLMYIHTKAEGNLEY

SEQ ID NO: 201151 - protein, 16 aa, Borrelia afzelii
PLMYIHTKAEGNLEYT

SEQ ID NO: 201152 - protein, 16 aa, Borrelia afzelii
LMYIHTKAEGNLEYTN

SEQ ID NO: 201153 - protein, 16 aa, Borrelia afzelii
MYIHTKAEGNLEYTNL

SEQ ID NO: 201154 - protein, 16 aa, Borrelia afzelii
YIHTKAEGNLEYTNLF

SEQ ID NO: 201155 - protein, 16 aa, Borrelia afzelii
IHTKAEGNLEYTNLFY

SEQ ID NO: 201156 - protein, 16 aa, Borrelia afzelii
HTKAEGNLEYTNLFYI

SEQ ID NO: 201157 - protein, 16 aa, Borrelia afzelii
TKAEGNLEYTNLFYIP

SEQ ID NO: 201158 - protein, 16 aa, Borrelia afzelii
KAEGNLEYTNLFYIPS

SEQ ID NO: 201159 - protein, 16 aa, Borrelia afzelii
AEGNLEYTNLFYIPSK

SEQ ID NO: 201160 - protein, 16 aa, Borrelia afzelii
EGNLEYTNLFYIPSKA

SEQ ID NO: 201161 - protein, 16 aa, Borrelia afzelii
GNLEYTNLFYIPSKAP

SEQ ID NO: 201162 - protein, 16 aa, Borrelia afzelii
NLEYTNLFYIPSKAPY

SEQ ID NO: 201163 - protein, 16 aa, Borrelia afzelii
LEYTNLFYIPSKAPYD

SEQ ID NO: 201164 - protein, 16 aa, Borrelia afzelii
EYTNLFYIPSKAPYDL

SEQ ID NO: 201165 - protein, 16 aa, Borrelia afzelii
YTNLFYIPSKAPYDLY

SEQ ID NO: 201166 - protein, 16 aa, Borrelia afzelii
TNLFYIPSKAPYDLYY

SEQ ID NO: 201167 - protein, 16 aa, Borrelia afzelii
NLFYIPSKAPYDLYYP

SEQ ID NO: 201168 - protein, 16 aa, Borrelia afzelii
LFYIPSKAPYDLYYPN

SEQ ID NO: 201169 - protein, 16 aa, Borrelia afzelii
FYIPSKAPYDLYYPNT

SEQ ID NO: 201170 - protein, 16 aa, Borrelia afzelii
YIPSKAPYDLYYPNTK

SEQ ID NO: 201171 - protein, 16 aa, Borrelia afzelii
IPSKAPYDLYYPNTKP

SEQ ID NO: 201172 - protein, 16 aa, Borrelia afzelii
PSKAPYDLYYPNTKPG

SEQ ID NO: 201173 - protein, 16 aa, Borrelia afzelii
SKAPYDLYYPNTKPGV

SEQ ID NO: 201174 - protein, 16 aa, Borrelia afzelii
KAPYDLYYPNTKPGVK

SEQ ID NO: 201175 - protein, 16 aa, Borrelia afzelii
APYDLYYPNTKPGVKL

SEQ ID NO: 201176 - protein, 16 aa, Borrelia afzelii
PYDLYYPNTKPGVKLF

SEQ ID NO: 201177 - protein, 16 aa, Borrelia afzelii
YDLYYPNTKPGVKLFI

SEQ ID NO: 201178 - protein, 16 aa, Borrelia afzelii
DLYYPNTKPGVKLFIN

SEQ ID NO: 201179 - protein, 16 aa, Borrelia afzelii
LYYPNTKPGVKLFINR

SEQ ID NO: 201180 - protein, 16 aa, Borrelia afzelii
YYPNTKPGVKLFINRI

SEQ ID NO: 201181 - protein, 16 aa, Borrelia afzelii
YPNTKPGVKLFINRIF

SEQ ID NO: 201182 - protein, 16 aa, Borrelia afzelii
PNTKPGVKLFINRIFI

SEQ ID NO: 201183 - protein, 16 aa, Borrelia afzelii
NTKPGVKLFINRIFIT

SEQ ID NO: 201184 - protein, 16 aa, Borrelia afzelii
TKPGVKLFINRIFITD

SEQ ID NO: 201185 - protein, 16 aa, Borrelia afzelii
KPGVKLFINRIFITDS

SEQ ID NO: 201186 - protein, 16 aa, Borrelia afzelii
PGVKLFINRIFITDSE

SEQ ID NO: 201187 - protein, 16 aa, Borrelia afzelii
GVKLFINRIFITDSEG

SEQ ID NO: 201188 - protein, 16 aa, Borrelia afzelii
VKLFINRIFITDSEGS

SEQ ID NO: 201189 - protein, 16 aa, Borrelia afzelii
KLFINRIFITDSEGSL

SEQ ID NO: 201190 - protein, 16 aa, Borrelia afzelii
LFINRIFITDSEGSLL

SEQ ID NO: 201191 - protein, 16 aa, Borrelia afzelii
FINRIFITDSEGSLLP

SEQ ID NO: 201192 - protein, 16 aa, Borrelia afzelii
INRIFITDSEGSLLPN

SEQ ID NO: 201193 - protein, 16 aa, Borrelia afzelii
NRIFITDSEGSLLPNY

SEQ ID NO: 201194 - protein, 16 aa, Borrelia afzelii
RIFITDSEGSLLPNYL

SEQ ID NO: 201195 - protein, 16 aa, Borrelia afzelii
IFITDSEGSLLPNYLR

SEQ ID NO: 201196 - protein, 16 aa, Borrelia afzelii
FITDSEGSLLPNYLRF

SEQ ID NO: 201197 - protein, 16 aa, Borrelia afzelii
ITDSEGSLLPNYLRFI

SEQ ID NO: 201198 - protein, 16 aa, Borrelia afzelii
TDSEGSLLPNYLRFIK

SEQ ID NO: 201199 - protein, 16 aa, Borrelia afzelii
DSEGSLLPNYLRFIKG

SEQ ID NO: 201200 - protein, 16 aa, Borrelia afzelii
SEGSLLPNYLRFIKGI

SEQ ID NO: 201201 - protein, 16 aa, Borrelia afzelii
EGSLLPNYLRFIKGII

SEQ ID NO: 201202 - protein, 16 aa, Borrelia afzelii
GSLLPNYLRFIKGIID

SEQ ID NO: 201203 - protein, 16 aa, Borrelia afzelii
SLLPNYLRFIKGIIDC

SEQ ID NO: 201204 - protein, 16 aa, Borrelia afzelii
LLPNYLRFIKGIIDCQ

SEQ ID NO: 201205 - protein, 16 aa, Borrelia afzelii
LPNYLRFIKGIIDCQD

SEQ ID NO: 201206 - protein, 16 aa, Borrelia afzelii
PNYLRFIKGIIDCQDL

SEQ ID NO: 201207 - protein, 16 aa, Borrelia afzelii
NYLRFIKGIIDCQDLP

SEQ ID NO: 201208 - protein, 16 aa, Borrelia afzelii
YLRFIKGIIDCQDLPL

SEQ ID NO: 201209 - protein, 16 aa, Borrelia afzelii
LRFIKGIIDCQDLPLN

SEQ ID NO: 201210 - protein, 16 aa, Borrelia afzelii
RFIKGIIDCQDLPLNV

SEQ ID NO: 201211 - protein, 16 aa, Borrelia afzelii
FIKGIIDCQDLPLNVS

SEQ ID NO: 201212 - protein, 16 aa, Borrelia afzelii
IKGIIDCQDLPLNVSR

SEQ ID NO: 201213 - protein, 16 aa, Borrelia afzelii
KGIIDCQDLPLNVSRE

SEQ ID NO: 201214 - protein, 16 aa, Borrelia afzelii
GIIDCQDLPLNVSREI

SEQ ID NO: 201215 - protein, 16 aa, Borrelia afzelii
IIDCQDLPLNVSREIL

SEQ ID NO: 201216 - protein, 16 aa, Borrelia afzelii
IDCQDLPLNVSREILQ

SEQ ID NO: 201217 - protein, 16 aa, Borrelia afzelii
DCQDLPLNVSREILQQ

SEQ ID NO: 201218 - protein, 16 aa, Borrelia afzelii
CQDLPLNVSREILQQN

SEQ ID NO: 201219 - protein, 16 aa, Borrelia afzelii
QDLPLNVSREILQQNK

SEQ ID NO: 201220 - protein, 16 aa, Borrelia afzelii
DLPLNVSREILQQNKI

SEQ ID NO: 201221 - protein, 16 aa, Borrelia afzelii
LPLNVSREILQQNKIL

SEQ ID NO: 201222 - protein, 16 aa, Borrelia afzelii
PLNVSREILQQNKILS

SEQ ID NO: 201223 - protein, 16 aa, Borrelia afzelii
LNVSREILQQNKILSK

SEQ ID NO: 201224 - protein, 16 aa, Borrelia afzelii
NVSREILQQNKILSKI

SEQ ID NO: 201225 - protein, 16 aa, Borrelia afzelii
VSREILQQNKILSKIK

SEQ ID NO: 201226 - protein, 16 aa, Borrelia afzelii
SREILQQNKILSKIKS

SEQ ID NO: 201227 - protein, 16 aa, Borrelia afzelii
REILQQNKILSKIKSS

SEQ ID NO: 201228 - protein, 16 aa, Borrelia afzelii
EILQQNKILSKIKSSS

SEQ ID NO: 201229 - protein, 16 aa, Borrelia afzelii
ILQQNKILSKIKSSSV

SEQ ID NO: 201230 - protein, 16 aa, Borrelia afzelii
LQQNKILSKIKSSSVK

SEQ ID NO: 201231 - protein, 16 aa, Borrelia afzelii
QQNKILSKIKSSSVKK

SEQ ID NO: 201232 - protein, 16 aa, Borrelia afzelii
QNKILSKIKSSSVKKI

SEQ ID NO: 201233 - protein, 16 aa, Borrelia afzelii
NKILSKIKSSSVKKIL

SEQ ID NO: 201234 - protein, 16 aa, Borrelia afzelii
KILSKIKSSSVKKILS

SEQ ID NO: 201235 - protein, 16 aa, Borrelia afzelii
ILSKIKSSSVKKILSE

SEQ ID NO: 201236 - protein, 16 aa, Borrelia afzelii
LSKIKSSSVKKILSEL

SEQ ID NO: 201237 - protein, 16 aa, Borrelia afzelii
SKIKSSSVKKILSELE

SEQ ID NO: 201238 - protein, 16 aa, Borrelia afzelii
KIKSSSVKKILSELEK

SEQ ID NO: 201239 - protein, 16 aa, Borrelia afzelii
IKSSSVKKILSELEKL

SEQ ID NO: 201240 - protein, 16 aa, Borrelia afzelii
KSSSVKKILSELEKLS

SEQ ID NO: 201241 - protein, 16 aa, Borrelia afzelii
SSSVKKILSELEKLSK

SEQ ID NO: 201242 - protein, 16 aa, Borrelia afzelii
SSVKKILSELEKLSKK

SEQ ID NO: 201243 - protein, 16 aa, Borrelia afzelii
SVKKILSELEKLSKKN

SEQ ID NO: 201244 - protein, 16 aa, Borrelia afzelii
VKKILSELEKLSKKNP

SEQ ID NO: 201245 - protein, 16 aa, Borrelia afzelii
KKILSELEKLSKKNPE

SEQ ID NO: 201246 - protein, 16 aa, Borrelia afzelii
KILSELEKLSKKNPEK

SEQ ID NO: 201247 - protein, 16 aa, Borrelia afzelii
ILSELEKLSKKNPEKF

SEQ ID NO: 201248 - protein, 16 aa, Borrelia afzelii
LSELEKLSKKNPEKFS

SEQ ID NO: 201249 - protein, 16 aa, Borrelia afzelii
SELEKLSKKNPEKFSE

SEQ ID NO: 201250 - protein, 16 aa, Borrelia afzelii
ELEKLSKKNPEKFSEF

SEQ ID NO: 201251 - protein, 16 aa, Borrelia afzelii
LEKLSKKNPEKFSEFS

SEQ ID NO: 201252 - protein, 16 aa, Borrelia afzelii
EKLSKKNPEKFSEFSK

SEQ ID NO: 201253 - protein, 16 aa, Borrelia afzelii
KLSKKNPEKFSEFSKE

SEQ ID NO: 201254 - protein, 16 aa, Borrelia afzelii
LSKKNPEKFSEFSKEF

SEQ ID NO: 201255 - protein, 16 aa, Borrelia afzelii
SKKNPEKFSEFSKEFG

SEQ ID NO: 201256 - protein, 16 aa, Borrelia afzelii
KKNPEKFSEFSKEFGR

SEQ ID NO: 201257 - protein, 16 aa, Borrelia afzelii
KNPEKFSEFSKEFGRC

SEQ ID NO: 201258 - protein, 16 aa, Borrelia afzelii
NPEKFSEFSKEFGRCI

SEQ ID NO: 201259 - protein, 16 aa, Borrelia afzelii
PEKFSEFSKEFGRCIK

SEQ ID NO: 201260 - protein, 16 aa, Borrelia afzelii
EKFSEFSKEFGRCIKE

SEQ ID NO: 201261 - protein, 16 aa, Borrelia afzelii
KFSEFSKEFGRCIKEG

SEQ ID NO: 201262 - protein, 16 aa, Borrelia afzelii
FSEFSKEFGRCIKEGV

SEQ ID NO: 201263 - protein, 16 aa, Borrelia afzelii
SEFSKEFGRCIKEGVY

SEQ ID NO: 201264 - protein, 16 aa, Borrelia afzelii
EFSKEFGRCIKEGVYS

SEQ ID NO: 201265 - protein, 16 aa, Borrelia afzelii
FSKEFGRCIKEGVYSD

SEQ ID NO: 201266 - protein, 16 aa, Borrelia afzelii
SKEFGRCIKEGVYSDF

SEQ ID NO: 201267 - protein, 16 aa, Borrelia afzelii
KEFGRCIKEGVYSDFE

SEQ ID NO: 201268 - protein, 16 aa, Borrelia afzelii
EFGRCIKEGVYSDFEN

SEQ ID NO: 201269 - protein, 16 aa, Borrelia afzelii
FGRCIKEGVYSDFENR

SEQ ID NO: 201270 - protein, 16 aa, Borrelia afzelii
GRCIKEGVYSDFENRE

SEQ ID NO: 201271 - protein, 16 aa, Borrelia afzelii
RCIKEGVYSDFENREK

SEQ ID NO: 201272 - protein, 16 aa, Borrelia afzelii
CIKEGVYSDFENREKL

SEQ ID NO: 201273 - protein, 16 aa, Borrelia afzelii
IKEGVYSDFENREKLI

SEQ ID NO: 201274 - protein, 16 aa, Borrelia afzelii
KEGVYSDFENREKLIS

SEQ ID NO: 201275 - protein, 16 aa, Borrelia afzelii
EGVYSDFENREKLISL

SEQ ID NO: 201276 - protein, 16 aa, Borrelia afzelii
GVYSDFENREKLISLI

SEQ ID NO: 201277 - protein, 16 aa, Borrelia afzelii
VYSDFENREKLISLIR

SEQ ID NO: 201278 - protein, 16 aa, Borrelia afzelii
YSDFENREKLISLIRF

SEQ ID NO: 201279 - protein, 16 aa, Borrelia afzelii
SDFENREKLISLIRFK

SEQ ID NO: 201280 - protein, 16 aa, Borrelia afzelii
DFENREKLISLIRFKS

SEQ ID NO: 201281 - protein, 16 aa, Borrelia afzelii
FENREKLISLIRFKSS

SEQ ID NO: 201282 - protein, 16 aa, Borrelia afzelii
ENREKLISLIRFKSSS

SEQ ID NO: 201283 - protein, 16 aa, Borrelia afzelii
NREKLISLIRFKSSSV

SEQ ID NO: 201284 - protein, 16 aa, Borrelia afzelii
REKLISLIRFKSSSVD

SEQ ID NO: 201285 - protein, 16 aa, Borrelia afzelii
EKLISLIRFKSSSVDG

SEQ ID NO: 201286 - protein, 16 aa, Borrelia afzelii
KLISLIRFKSSSVDGF

SEQ ID NO: 201287 - protein, 16 aa, Borrelia afzelii
LISLIRFKSSSVDGFV

SEQ ID NO: 201288 - protein, 16 aa, Borrelia afzelii
ISLIRFKSSSVDGFVS

SEQ ID NO: 201289 - protein, 16 aa, Borrelia afzelii
SLIRFKSSSVDGFVSF

SEQ ID NO: 201290 - protein, 16 aa, Borrelia afzelii
LIRFKSSSVDGFVSFK

SEQ ID NO: 201291 - protein, 16 aa, Borrelia afzelii
IRFKSSSVDGFVSFKE

SEQ ID NO: 201292 - protein, 16 aa, Borrelia afzelii
RFKSSSVDGFVSFKEY

SEQ ID NO: 201293 - protein, 16 aa, Borrelia afzelii
FKSSSVDGFVSFKEYK

SEQ ID NO: 201294 - protein, 16 aa, Borrelia afzelii
KSSSVDGFVSFKEYKE

SEQ ID NO: 201295 - protein, 16 aa, Borrelia afzelii
SSSVDGFVSFKEYKER

SEQ ID NO: 201296 - protein, 16 aa, Borrelia afzelii
SSVDGFVSFKEYKERM

SEQ ID NO: 201297 - protein, 16 aa, Borrelia afzelii
SVDGFVSFKEYKERMN

SEQ ID NO: 201298 - protein, 16 aa, Borrelia afzelii
VDGFVSFKEYKERMNE

SEQ ID NO: 201299 - protein, 16 aa, Borrelia afzelii
DGFVSFKEYKERMNEG

SEQ ID NO: 201300 - protein, 16 aa, Borrelia afzelii
GFVSFKEYKERMNEGQ

SEQ ID NO: 201301 - protein, 16 aa, Borrelia afzelii
FVSFKEYKERMNEGQK

SEQ ID NO: 201302 - protein, 16 aa, Borrelia afzelii
VSFKEYKERMNEGQKS

SEQ ID NO: 201303 - protein, 16 aa, Borrelia afzelii
SFKEYKERMNEGQKSI

SEQ ID NO: 201304 - protein, 16 aa, Borrelia afzelii
FKEYKERMNEGQKSIY

SEQ ID NO: 201305 - protein, 16 aa, Borrelia afzelii
KEYKERMNEGQKSIYY

SEQ ID NO: 201306 - protein, 16 aa, Borrelia afzelii
EYKERMNEGQKSIYYI

SEQ ID NO: 201307 - protein, 16 aa, Borrelia afzelii
YKERMNEGQKSIYYIT

SEQ ID NO: 201308 - protein, 16 aa, Borrelia afzelii
KERMNEGQKSIYYITG

SEQ ID NO: 201309 - protein, 16 aa, Borrelia afzelii
ERMNEGQKSIYYITGG

SEQ ID NO: 201310 - protein, 16 aa, Borrelia afzelii
RMNEGQKSIYYITGGK

SEQ ID NO: 201311 - protein, 16 aa, Borrelia afzelii
MNEGQKSIYYITGGKE

SEQ ID NO: 201312 - protein, 16 aa, Borrelia afzelii
NEGQKSIYYITGGKEN

SEQ ID NO: 201313 - protein, 16 aa, Borrelia afzelii
EGQKSIYYITGGKENI

SEQ ID NO: 201314 - protein, 16 aa, Borrelia afzelii
GQKSIYYITGGKENIL

SEQ ID NO: 201315 - protein, 16 aa, Borrelia afzelii
QKSIYYITGGKENILK

SEQ ID NO: 201316 - protein, 16 aa, Borrelia afzelii
KSIYYITGGKENILKE

SEQ ID NO: 201317 - protein, 16 aa, Borrelia afzelii
SIYYITGGKENILKEN

SEQ ID NO: 201318 - protein, 16 aa, Borrelia afzelii
IYYITGGKENILKENP

SEQ ID NO: 201319 - protein, 16 aa, Borrelia afzelii
YYITGGKENILKENPI

SEQ ID NO: 201320 - protein, 16 aa, Borrelia afzelii
YITGGKENILKENPIV

SEQ ID NO: 201321 - protein, 16 aa, Borrelia afzelii
ITGGKENILKENPIVT

SEQ ID NO: 201322 - protein, 16 aa, Borrelia afzelii
TGGKENILKENPIVTA

SEQ ID NO: 201323 - protein, 16 aa, Borrelia afzelii
GGKENILKENPIVTAY

SEQ ID NO: 201324 - protein, 16 aa, Borrelia afzelii
GKENILKENPIVTAYK

SEQ ID NO: 201325 - protein, 16 aa, Borrelia afzelii
KENILKENPIVTAYKE

SEQ ID NO: 201326 - protein, 16 aa, Borrelia afzelii
ENILKENPIVTAYKEK

SEQ ID NO: 201327 - protein, 16 aa, Borrelia afzelii
NILKENPIVTAYKEKG

SEQ ID NO: 201328 - protein, 16 aa, Borrelia afzelii
ILKENPIVTAYKEKGF

SEQ ID NO: 201329 - protein, 16 aa, Borrelia afzelii
LKENPIVTAYKEKGFE

SEQ ID NO: 201330 - protein, 16 aa, Borrelia afzelii
KENPIVTAYKEKGFEI

SEQ ID NO: 201331 - protein, 16 aa, Borrelia afzelii
ENPIVTAYKEKGFEIL

SEQ ID NO: 201332 - protein, 16 aa, Borrelia afzelii
NPIVTAYKEKGFEILI

SEQ ID NO: 201333 - protein, 16 aa, Borrelia afzelii
PIVTAYKEKGFEILIM

SEQ ID NO: 201334 - protein, 16 aa, Borrelia afzelii
IVTAYKEKGFEILIMD

SEQ ID NO: 201335 - protein, 16 aa, Borrelia afzelii
VTAYKEKGFEILIMDD

SEQ ID NO: 201336 - protein, 16 aa, Borrelia afzelii
TAYKEKGFEILIMDDE

SEQ ID NO: 201337 - protein, 16 aa, Borrelia afzelii
AYKEKGFEILIMDDEL

SEQ ID NO: 201338 - protein, 16 aa, Borrelia afzelii
YKEKGFEILIMDDELD

SEQ ID NO: 201339 - protein, 16 aa, Borrelia afzelii
KEKGFEILIMDDELDE

SEQ ID NO: 201340 - protein, 16 aa, Borrelia afzelii
EKGFEILIMDDELDEA

SEQ ID NO: 201341 - protein, 16 aa, Borrelia afzelii
KGFEILIMDDELDEAI

SEQ ID NO: 201342 - protein, 16 aa, Borrelia afzelii
GFEILIMDDELDEAIL

SEQ ID NO: 201343 - protein, 16 aa, Borrelia afzelii
FEILIMDDELDEAILN

SEQ ID NO: 201344 - protein, 16 aa, Borrelia afzelii
EILIMDDELDEAILNL

SEQ ID NO: 201345 - protein, 16 aa, Borrelia afzelii
ILIMDDELDEAILNLI

SEQ ID NO: 201346 - protein, 16 aa, Borrelia afzelii
LIMDDELDEAILNLIP

SEQ ID NO: 201347 - protein, 16 aa, Borrelia afzelii
IMDDELDEAILNLIPE

SEQ ID NO: 201348 - protein, 16 aa, Borrelia afzelii
MDDELDEAILNLIPEY

SEQ ID NO: 201349 - protein, 16 aa, Borrelia afzelii
DDELDEAILNLIPEYE

SEQ ID NO: 201350 - protein, 16 aa, Borrelia afzelii
DELDEAILNLIPEYEG

SEQ ID NO: 201351 - protein, 16 aa, Borrelia afzelii
ELDEAILNLIPEYEGL

SEQ ID NO: 201352 - protein, 16 aa, Borrelia afzelii
LDEAILNLIPEYEGLK

SEQ ID NO: 201353 - protein, 16 aa, Borrelia afzelii
DEAILNLIPEYEGLKL

SEQ ID NO: 201354 - protein, 16 aa, Borrelia afzelii
EAILNLIPEYEGLKLK

SEQ ID NO: 201355 - protein, 16 aa, Borrelia afzelii
AILNLIPEYEGLKLKA

SEQ ID NO: 201356 - protein, 16 aa, Borrelia afzelii
ILNLIPEYEGLKLKAI

SEQ ID NO: 201357 - protein, 16 aa, Borrelia afzelii
LNLIPEYEGLKLKAIN

SEQ ID NO: 201358 - protein, 16 aa, Borrelia afzelii
NLIPEYEGLKLKAINK

SEQ ID NO: 201359 - protein, 16 aa, Borrelia afzelii
LIPEYEGLKLKAINKN

SEQ ID NO: 201360 - protein, 16 aa, Borrelia afzelii
IPEYEGLKLKAINKNE

SEQ ID NO: 201361 - protein, 16 aa, Borrelia afzelii
PEYEGLKLKAINKNET

SEQ ID NO: 201362 - protein, 16 aa, Borrelia afzelii
EYEGLKLKAINKNETS

SEQ ID NO: 201363 - protein, 16 aa, Borrelia afzelii
YEGLKLKAINKNETSN

SEQ ID NO: 201364 - protein, 16 aa, Borrelia afzelii
EGLKLKAINKNETSNE

SEQ ID NO: 201365 - protein, 16 aa, Borrelia afzelii
GLKLKAINKNETSNEL

SEQ ID NO: 201366 - protein, 16 aa, Borrelia afzelii
LKLKAINKNETSNELK

SEQ ID NO: 201367 - protein, 16 aa, Borrelia afzelii
KLKAINKNETSNELKD

SEQ ID NO: 201368 - protein, 16 aa, Borrelia afzelii
LKAINKNETSNELKDE

SEQ ID NO: 201369 - protein, 16 aa, Borrelia afzelii
KAINKNETSNELKDEN

SEQ ID NO: 201370 - protein, 16 aa, Borrelia afzelii
AINKNETSNELKDENF

SEQ ID NO: 201371 - protein, 16 aa, Borrelia afzelii
INKNETSNELKDENFK

SEQ ID NO: 201372 - protein, 16 aa, Borrelia afzelii
NKNETSNELKDENFKK

SEQ ID NO: 201373 - protein, 16 aa, Borrelia afzelii
KNETSNELKDENFKKI

SEQ ID NO: 201374 - protein, 16 aa, Borrelia afzelii
NETSNELKDENFKKIE

SEQ ID NO: 201375 - protein, 16 aa, Borrelia afzelii
ETSNELKDENFKKIEE

SEQ ID NO: 201376 - protein, 16 aa, Borrelia afzelii
TSNELKDENFKKIEEE

SEQ ID NO: 201377 - protein, 16 aa, Borrelia afzelii
SNELKDENFKKIEEEF

SEQ ID NO: 201378 - protein, 16 aa, Borrelia afzelii
NELKDENFKKIEEEFK

SEQ ID NO: 201379 - protein, 16 aa, Borrelia afzelii
ELKDENFKKIEEEFKD

SEQ ID NO: 201380 - protein, 16 aa, Borrelia afzelii
LKDENFKKIEEEFKDT

SEQ ID NO: 201381 - protein, 16 aa, Borrelia afzelii
KDENFKKIEEEFKDTL

SEQ ID NO: 201382 - protein, 16 aa, Borrelia afzelii
DENFKKIEEEFKDTLT

SEQ ID NO: 201383 - protein, 16 aa, Borrelia afzelii
ENFKKIEEEFKDTLTR

SEQ ID NO: 201384 - protein, 16 aa, Borrelia afzelii
NFKKIEEEFKDTLTRV

SEQ ID NO: 201385 - protein, 16 aa, Borrelia afzelii
FKKIEEEFKDTLTRVK

SEQ ID NO: 201386 - protein, 16 aa, Borrelia afzelii
KKIEEEFKDTLTRVKE

SEQ ID NO: 201387 - protein, 16 aa, Borrelia afzelii
KIEEEFKDTLTRVKEI

SEQ ID NO: 201388 - protein, 16 aa, Borrelia afzelii
IEEEFKDTLTRVKEIL

SEQ ID NO: 201389 - protein, 16 aa, Borrelia afzelii
EEEFKDTLTRVKEILK

SEQ ID NO: 201390 - protein, 16 aa, Borrelia afzelii
EEFKDTLTRVKEILKD

SEQ ID NO: 201391 - protein, 16 aa, Borrelia afzelii
EFKDTLTRVKEILKDQ

SEQ ID NO: 201392 - protein, 16 aa, Borrelia afzelii
FKDTLTRVKEILKDQI

SEQ ID NO: 201393 - protein, 16 aa, Borrelia afzelii
KDTLTRVKEILKDQIK

SEQ ID NO: 201394 - protein, 16 aa, Borrelia afzelii
DTLTRVKEILKDQIKE

SEQ ID NO: 201395 - protein, 16 aa, Borrelia afzelii
TLTRVKEILKDQIKEV

SEQ ID NO: 201396 - protein, 16 aa, Borrelia afzelii
LTRVKEILKDQIKEVN

SEQ ID NO: 201397 - protein, 16 aa, Borrelia afzelii
TRVKEILKDQIKEVNL

SEQ ID NO: 201398 - protein, 16 aa, Borrelia afzelii
RVKEILKDQIKEVNLS

SEQ ID NO: 201399 - protein, 16 aa, Borrelia afzelii
VKEILKDQIKEVNLSA

SEQ ID NO: 201400 - protein, 16 aa, Borrelia afzelii
KEILKDQIKEVNLSAT

SEQ ID NO: 201401 - protein, 16 aa, Borrelia afzelii
EILKDQIKEVNLSATL

SEQ ID NO: 201402 - protein, 16 aa, Borrelia afzelii
ILKDQIKEVNLSATLI

SEQ ID NO: 201403 - protein, 16 aa, Borrelia afzelii
LKDQIKEVNLSATLIK

SEQ ID NO: 201404 - protein, 16 aa, Borrelia afzelii
KDQIKEVNLSATLIKE

SEQ ID NO: 201405 - protein, 16 aa, Borrelia afzelii
DQIKEVNLSATLIKEP

SEQ ID NO: 201406 - protein, 16 aa, Borrelia afzelii
QIKEVNLSATLIKEPS

SEQ ID NO: 201407 - protein, 16 aa, Borrelia afzelii
IKEVNLSATLIKEPSA

SEQ ID NO: 201408 - protein, 16 aa, Borrelia afzelii
KEVNLSATLIKEPSAI

SEQ ID NO: 201409 - protein, 16 aa, Borrelia afzelii
EVNLSATLIKEPSAII

SEQ ID NO: 201410 - protein, 16 aa, Borrelia afzelii
VNLSATLIKEPSAIIV

SEQ ID NO: 201411 - protein, 16 aa, Borrelia afzelii
NLSATLIKEPSAIIVD

SEQ ID NO: 201412 - protein, 16 aa, Borrelia afzelii
LSATLIKEPSAIIVDS

SEQ ID NO: 201413 - protein, 16 aa, Borrelia afzelii
SATLIKEPSAIIVDSN

SEQ ID NO: 201414 - protein, 16 aa, Borrelia afzelii
ATLIKEPSAIIVDSND

SEQ ID NO: 201415 - protein, 16 aa, Borrelia afzelii
TLIKEPSAIIVDSNDP

SEQ ID NO: 201416 - protein, 16 aa, Borrelia afzelii
LIKEPSAIIVDSNDPT

SEQ ID NO: 201417 - protein, 16 aa, Borrelia afzelii
IKEPSAIIVDSNDPTY

SEQ ID NO: 201418 - protein, 16 aa, Borrelia afzelii
KEPSAIIVDSNDPTYQ

SEQ ID NO: 201419 - protein, 16 aa, Borrelia afzelii
EPSAIIVDSNDPTYQM

SEQ ID NO: 201420 - protein, 16 aa, Borrelia afzelii
PSAIIVDSNDPTYQMQ

SEQ ID NO: 201421 - protein, 16 aa, Borrelia afzelii
SAIIVDSNDPTYQMQK

SEQ ID NO: 201422 - protein, 16 aa, Borrelia afzelii
AIIVDSNDPTYQMQKI

SEQ ID NO: 201423 - protein, 16 aa, Borrelia afzelii
IIVDSNDPTYQMQKIM

SEQ ID NO: 201424 - protein, 16 aa, Borrelia afzelii
IVDSNDPTYQMQKIML

SEQ ID NO: 201425 - protein, 16 aa, Borrelia afzelii
VDSNDPTYQMQKIMLS

SEQ ID NO: 201426 - protein, 16 aa, Borrelia afzelii
DSNDPTYQMQKIMLSM

SEQ ID NO: 201427 - protein, 16 aa, Borrelia afzelii
SNDPTYQMQKIMLSMG

SEQ ID NO: 201428 - protein, 16 aa, Borrelia afzelii
NDPTYQMQKIMLSMGQ

SEQ ID NO: 201429 - protein, 16 aa, Borrelia afzelii
DPTYQMQKIMLSMGQE

SEQ ID NO: 201430 - protein, 16 aa, Borrelia afzelii
PTYQMQKIMLSMGQEV

SEQ ID NO: 201431 - protein, 16 aa, Borrelia afzelii
TYQMQKIMLSMGQEVK

SEQ ID NO: 201432 - protein, 16 aa, Borrelia afzelii
YQMQKIMLSMGQEVKE

SEQ ID NO: 201433 - protein, 16 aa, Borrelia afzelii
QMQKIMLSMGQEVKEI

SEQ ID NO: 201434 - protein, 16 aa, Borrelia afzelii
MQKIMLSMGQEVKEIK

SEQ ID NO: 201435 - protein, 16 aa, Borrelia afzelii
QKIMLSMGQEVKEIKP

SEQ ID NO: 201436 - protein, 16 aa, Borrelia afzelii
KIMLSMGQEVKEIKPI

SEQ ID NO: 201437 - protein, 16 aa, Borrelia afzelii
IMLSMGQEVKEIKPIL

SEQ ID NO: 201438 - protein, 16 aa, Borrelia afzelii
MLSMGQEVKEIKPILE

SEQ ID NO: 201439 - protein, 16 aa, Borrelia afzelii
LSMGQEVKEIKPILEL

SEQ ID NO: 201440 - protein, 16 aa, Borrelia afzelii
SMGQEVKEIKPILELN

SEQ ID NO: 201441 - protein, 16 aa, Borrelia afzelii
MGQEVKEIKPILELNP

SEQ ID NO: 201442 - protein, 16 aa, Borrelia afzelii
GQEVKEIKPILELNPN

SEQ ID NO: 201443 - protein, 16 aa, Borrelia afzelii
QEVKEIKPILELNPNN

SEQ ID NO: 201444 - protein, 16 aa, Borrelia afzelii
EVKEIKPILELNPNNK

SEQ ID NO: 201445 - protein, 16 aa, Borrelia afzelii
VKEIKPILELNPNNKI

SEQ ID NO: 201446 - protein, 16 aa, Borrelia afzelii
KEIKPILELNPNNKIV

SEQ ID NO: 201447 - protein, 16 aa, Borrelia afzelii
EIKPILELNPNNKIVQ

SEQ ID NO: 201448 - protein, 16 aa, Borrelia afzelii
IKPILELNPNNKIVQN

SEQ ID NO: 201449 - protein, 16 aa, Borrelia afzelii
KPILELNPNNKIVQNL

SEQ ID NO: 201450 - protein, 16 aa, Borrelia afzelii
PILELNPNNKIVQNLK

SEQ ID NO: 201451 - protein, 16 aa, Borrelia afzelii
ILELNPNNKIVQNLKN

SEQ ID NO: 201452 - protein, 16 aa, Borrelia afzelii
LELNPNNKIVQNLKNL

SEQ ID NO: 201453 - protein, 16 aa, Borrelia afzelii
ELNPNNKIVQNLKNLE

SEQ ID NO: 201454 - protein, 16 aa, Borrelia afzelii
LNPNNKIVQNLKNLEP

SEQ ID NO: 201455 - protein, 16 aa, Borrelia afzelii
NPNNKIVQNLKNLEPE

SEQ ID NO: 201456 - protein, 16 aa, Borrelia afzelii
PNNKIVQNLKNLEPEK

SEQ ID NO: 201457 - protein, 16 aa, Borrelia afzelii
NNKIVQNLKNLEPEKL

SEQ ID NO: 201458 - protein, 16 aa, Borrelia afzelii
NKIVQNLKNLEPEKLE

SEQ ID NO: 201459 - protein, 16 aa, Borrelia afzelii
KIVQNLKNLEPEKLEK

SEQ ID NO: 201460 - protein, 16 aa, Borrelia afzelii
IVQNLKNLEPEKLEKI

SEQ ID NO: 201461 - protein, 16 aa, Borrelia afzelii
VQNLKNLEPEKLEKIS

SEQ ID NO: 201462 - protein, 16 aa, Borrelia afzelii
QNLKNLEPEKLEKISI

SEQ ID NO: 201463 - protein, 16 aa, Borrelia afzelii
NLKNLEPEKLEKISIL

SEQ ID NO: 201464 - protein, 16 aa, Borrelia afzelii
LKNLEPEKLEKISILL

SEQ ID NO: 201465 - protein, 16 aa, Borrelia afzelii
KNLEPEKLEKISILLF

SEQ ID NO: 201466 - protein, 16 aa, Borrelia afzelii
NLEPEKLEKISILLFE

SEQ ID NO: 201467 - protein, 16 aa, Borrelia afzelii
LEPEKLEKISILLFEE

SEQ ID NO: 201468 - protein, 16 aa, Borrelia afzelii
EPEKLEKISILLFEEA

SEQ ID NO: 201469 - protein, 16 aa, Borrelia afzelii
PEKLEKISILLFEEAL

SEQ ID NO: 201470 - protein, 16 aa, Borrelia afzelii
EKLEKISILLFEEALL

SEQ ID NO: 201471 - protein, 16 aa, Borrelia afzelii
KLEKISILLFEEALLT

SEQ ID NO: 201472 - protein, 16 aa, Borrelia afzelii
LEKISILLFEEALLTS

SEQ ID NO: 201473 - protein, 16 aa, Borrelia afzelii
EKISILLFEEALLTSG

SEQ ID NO: 201474 - protein, 16 aa, Borrelia afzelii
KISILLFEEALLTSGM

SEQ ID NO: 201475 - protein, 16 aa, Borrelia afzelii
ISILLFEEALLTSGMP

SEQ ID NO: 201476 - protein, 16 aa, Borrelia afzelii
SILLFEEALLTSGMPS

SEQ ID NO: 201477 - protein, 16 aa, Borrelia afzelii
ILLFEEALLTSGMPSK

SEQ ID NO: 201478 - protein, 16 aa, Borrelia afzelii
LLFEEALLTSGMPSKN

SEQ ID NO: 201479 - protein, 16 aa, Borrelia afzelii
LFEEALLTSGMPSKNP

SEQ ID NO: 201480 - protein, 16 aa, Borrelia afzelii
FEEALLTSGMPSKNPR

SEQ ID NO: 201481 - protein, 16 aa, Borrelia afzelii
EEALLTSGMPSKNPRK

SEQ ID NO: 201482 - protein, 16 aa, Borrelia afzelii
EALLTSGMPSKNPRKF

SEQ ID NO: 201483 - protein, 16 aa, Borrelia afzelii
ALLTSGMPSKNPRKFI

SEQ ID NO: 201484 - protein, 16 aa, Borrelia afzelii
LLTSGMPSKNPRKFIN

SEQ ID NO: 201485 - protein, 16 aa, Borrelia afzelii
LTSGMPSKNPRKFINI

SEQ ID NO: 201486 - protein, 16 aa, Borrelia afzelii
TSGMPSKNPRKFINII

SEQ ID NO: 201487 - protein, 16 aa, Borrelia afzelii
SGMPSKNPRKFINIIN

SEQ ID NO: 201488 - protein, 16 aa, Borrelia afzelii
GMPSKNPRKFINIINE

SEQ ID NO: 201489 - protein, 16 aa, Borrelia afzelii
MPSKNPRKFINIINEF

SEQ ID NO: 201490 - protein, 16 aa, Borrelia afzelii
PSKNPRKFINIINEFL

SEQ ID NO: 201491 - protein, 16 aa, Borrelia afzelii
SKNPRKFINIINEFLE

SEQ ID NO: 201492 - protein, 16 aa, Borrelia afzelii
KNPRKFINIINEFLEK

SEQ ID NO: 201493 - protein, 16 aa, Borrelia afzelii
NPRKFINIINEFLEKD

SEQ ID NO: 201494 - protein, 16 aa, Borrelia afzelii
PRKFINIINEFLEKDL

SEQ ID NO: 201495 - protein, 16 aa, Borrelia afzelii
RKFINIINEFLEKDLL

SEQ ID NO: 201496 - protein, 189 aa, Borrelia Burgdorferi
MRLYLTGFALALALIGCAQKGAEPKNTSQKYDDQEVINSNKAPKDAKQTPPAAAEDSVTLFSGNEIFVSKEKNSSGKYDLRTTINQVELKGTSDKNNGSGSLEGVKADKSKVKLIVSDDLNTVTVETFDSSGKKDSSKVTVKHGSITEDTFKANKLDSKKLTRSNGTMLEYSQMTDADNATKAVETLKN

SEQ ID NO: 201497 - protein, 8 aa, Borrelia Burgdorferi
MRLYLTGF

SEQ ID NO: 201498 - protein, 8 aa, Borrelia Burgdorferi
RLYLTGFA

SEQ ID NO: 201499 - protein, 8 aa, Borrelia Burgdorferi
LYLTGFAL

SEQ ID NO: 201500 - protein, 8 aa, Borrelia Burgdorferi
YLTGFALA

SEQ ID NO: 201501 - protein, 8 aa, Borrelia Burgdorferi
LTGFALAL

SEQ ID NO: 201502 - protein, 8 aa, Borrelia Burgdorferi
TGFALALA

SEQ ID NO: 201503 - protein, 8 aa, Borrelia Burgdorferi
GFALALAL

SEQ ID NO: 201504 - protein, 8 aa, Borrelia Burgdorferi
FALALALI

SEQ ID NO: 201505 - protein, 8 aa, Borrelia Burgdorferi
ALALALIG

SEQ ID NO: 201506 - protein, 8 aa, Borrelia Burgdorferi
LALALIGC

SEQ ID NO: 201507 - protein, 8 aa, Borrelia Burgdorferi
ALALIGCA

SEQ ID NO: 201508 - protein, 8 aa, Borrelia Burgdorferi
LALIGCAQ

SEQ ID NO: 201509 - protein, 8 aa, Borrelia Burgdorferi
ALIGCAQK

SEQ ID NO: 201510 - protein, 8 aa, Borrelia Burgdorferi
LIGCAQKG

SEQ ID NO: 201511 - protein, 8 aa, Borrelia Burgdorferi
IGCAQKGA

SEQ ID NO: 201512 - protein, 8 aa, Borrelia Burgdorferi
GCAQKGAE

SEQ ID NO: 201513 - protein, 8 aa, Borrelia Burgdorferi
CAQKGAEP

SEQ ID NO: 201514 - protein, 8 aa, Borrelia Burgdorferi
AQKGAEPK

SEQ ID NO: 201515 - protein, 8 aa, Borrelia Burgdorferi
QKGAEPKN

SEQ ID NO: 201516 - protein, 8 aa, Borrelia Burgdorferi
KGAEPKNT

SEQ ID NO: 201517 - protein, 8 aa, Borrelia Burgdorferi
GAEPKNTS

SEQ ID NO: 201518 - protein, 8 aa, Borrelia Burgdorferi
AEPKNTSQ

SEQ ID NO: 201519 - protein, 8 aa, Borrelia Burgdorferi
EPKNTSQK

SEQ ID NO: 201520 - protein, 8 aa, Borrelia Burgdorferi
PKNTSQKY

SEQ ID NO: 201521 - protein, 8 aa, Borrelia Burgdorferi
KNTSQKYD

SEQ ID NO: 201522 - protein, 8 aa, Borrelia Burgdorferi
NTSQKYDD

SEQ ID NO: 201523 - protein, 8 aa, Borrelia Burgdorferi
TSQKYDDQ

SEQ ID NO: 201524 - protein, 8 aa, Borrelia Burgdorferi
SQKYDDQE

SEQ ID NO: 201525 - protein, 8 aa, Borrelia Burgdorferi
QKYDDQEV

SEQ ID NO: 201526 - protein, 8 aa, Borrelia Burgdorferi
KYDDQEVI

SEQ ID NO: 201527 - protein, 8 aa, Borrelia Burgdorferi
YDDQEVIN

SEQ ID NO: 201528 - protein, 8 aa, Borrelia Burgdorferi
DDQEVINS

SEQ ID NO: 201529 - protein, 8 aa, Borrelia Burgdorferi
DQEVINSN

SEQ ID NO: 201530 - protein, 8 aa, Borrelia Burgdorferi
QEVINSNK

SEQ ID NO: 201531 - protein, 8 aa, Borrelia Burgdorferi
EVINSNKA

SEQ ID NO: 201532 - protein, 8 aa, Borrelia Burgdorferi
VINSNKAP

SEQ ID NO: 201533 - protein, 8 aa, Borrelia Burgdorferi
INSNKAPK

SEQ ID NO: 201534 - protein, 8 aa, Borrelia Burgdorferi
NSNKAPKD

SEQ ID NO: 201535 - protein, 8 aa, Borrelia Burgdorferi
SNKAPKDA

SEQ ID NO: 201536 - protein, 8 aa, Borrelia Burgdorferi
NKAPKDAK

SEQ ID NO: 201537 - protein, 8 aa, Borrelia Burgdorferi
KAPKDAKQ

SEQ ID NO: 201538 - protein, 8 aa, Borrelia Burgdorferi
APKDAKQT

SEQ ID NO: 201539 - protein, 8 aa, Borrelia Burgdorferi
PKDAKQTP

SEQ ID NO: 201540 - protein, 8 aa, Borrelia Burgdorferi
KDAKQTPP

SEQ ID NO: 201541 - protein, 8 aa, Borrelia Burgdorferi
DAKQTPPA

SEQ ID NO: 201542 - protein, 8 aa, Borrelia Burgdorferi
AKQTPPAA

SEQ ID NO: 201543 - protein, 8 aa, Borrelia Burgdorferi
KQTPPAAA

SEQ ID NO: 201544 - protein, 8 aa, Borrelia Burgdorferi
QTPPAAAE

SEQ ID NO: 201545 - protein, 8 aa, Borrelia Burgdorferi
TPPAAAED

SEQ ID NO: 201546 - protein, 8 aa, Borrelia Burgdorferi
PPAAAEDS

SEQ ID NO: 201547 - protein, 8 aa, Borrelia Burgdorferi
PAAAEDSV

SEQ ID NO: 201548 - protein, 8 aa, Borrelia Burgdorferi
AAAEDSVT

SEQ ID NO: 201549 - protein, 8 aa, Borrelia Burgdorferi
AAEDSVTL

SEQ ID NO: 201550 - protein, 8 aa, Borrelia Burgdorferi
AEDSVTLF

SEQ ID NO: 201551 - protein, 8 aa, Borrelia Burgdorferi
EDSVTLFS

SEQ ID NO: 201552 - protein, 8 aa, Borrelia Burgdorferi
DSVTLFSG

SEQ ID NO: 201553 - protein, 8 aa, Borrelia Burgdorferi
SVTLFSGN

SEQ ID NO: 201554 - protein, 8 aa, Borrelia Burgdorferi
VTLFSGNE

SEQ ID NO: 201555 - protein, 8 aa, Borrelia Burgdorferi
TLFSGNEI

SEQ ID NO: 201556 - protein, 8 aa, Borrelia Burgdorferi
LFSGNEIF

SEQ ID NO: 201557 - protein, 8 aa, Borrelia Burgdorferi
FSGNEIFV

SEQ ID NO: 201558 - protein, 8 aa, Borrelia Burgdorferi
SGNEIFVS

SEQ ID NO: 201559 - protein, 8 aa, Borrelia Burgdorferi
GNEIFVSK

SEQ ID NO: 201560 - protein, 8 aa, Borrelia Burgdorferi
NEIFVSKE

SEQ ID NO: 201561 - protein, 8 aa, Borrelia Burgdorferi
EIFVSKEK

SEQ ID NO: 201562 - protein, 8 aa, Borrelia Burgdorferi
IFVSKEKN

SEQ ID NO: 201563 - protein, 8 aa, Borrelia Burgdorferi
FVSKEKNS

SEQ ID NO: 201564 - protein, 8 aa, Borrelia Burgdorferi
VSKEKNSS

SEQ ID NO: 201565 - protein, 8 aa, Borrelia Burgdorferi
SKEKNSSG

SEQ ID NO: 201566 - protein, 8 aa, Borrelia Burgdorferi
KEKNSSGK

SEQ ID NO: 201567 - protein, 8 aa, Borrelia Burgdorferi
EKNSSGKY

SEQ ID NO: 201568 - protein, 8 aa, Borrelia Burgdorferi
KNSSGKYD

SEQ ID NO: 201569 - protein, 8 aa, Borrelia Burgdorferi
NSSGKYDL

SEQ ID NO: 201570 - protein, 8 aa, Borrelia Burgdorferi
SSGKYDLR

SEQ ID NO: 201571 - protein, 8 aa, Borrelia Burgdorferi
SGKYDLRT

SEQ ID NO: 201572 - protein, 8 aa, Borrelia Burgdorferi
GKYDLRTT

SEQ ID NO: 201573 - protein, 8 aa, Borrelia Burgdorferi
KYDLRTTI

SEQ ID NO: 201574 - protein, 8 aa, Borrelia Burgdorferi
YDLRTTIN

SEQ ID NO: 201575 - protein, 8 aa, Borrelia Burgdorferi
DLRTTINQ

SEQ ID NO: 201576 - protein, 8 aa, Borrelia Burgdorferi
LRTTINQV

SEQ ID NO: 201577 - protein, 8 aa, Borrelia Burgdorferi
RTTINQVE

SEQ ID NO: 201578 - protein, 8 aa, Borrelia Burgdorferi
TTINQVEL

SEQ ID NO: 201579 - protein, 8 aa, Borrelia Burgdorferi
TINQVELK

SEQ ID NO: 201580 - protein, 8 aa, Borrelia Burgdorferi
INQVELKG

SEQ ID NO: 201581 - protein, 8 aa, Borrelia Burgdorferi
NQVELKGT

SEQ ID NO: 201582 - protein, 8 aa, Borrelia Burgdorferi
QVELKGTS

SEQ ID NO: 201583 - protein, 8 aa, Borrelia Burgdorferi
VELKGTSD

SEQ ID NO: 201584 - protein, 8 aa, Borrelia Burgdorferi
ELKGTSDK

SEQ ID NO: 201585 - protein, 8 aa, Borrelia Burgdorferi
LKGTSDKN

SEQ ID NO: 201586 - protein, 8 aa, Borrelia Burgdorferi
KGTSDKNN

SEQ ID NO: 201587 - protein, 8 aa, Borrelia Burgdorferi
GTSDKNNG

SEQ ID NO: 201588 - protein, 8 aa, Borrelia Burgdorferi
TSDKNNGS

SEQ ID NO: 201589 - protein, 8 aa, Borrelia Burgdorferi
SDKNNGSG

SEQ ID NO: 201590 - protein, 8 aa, Borrelia Burgdorferi
DKNNGSGS

SEQ ID NO: 201591 - protein, 8 aa, Borrelia Burgdorferi
KNNGSGSL

SEQ ID NO: 201592 - protein, 8 aa, Borrelia Burgdorferi
NNGSGSLE

SEQ ID NO: 201593 - protein, 8 aa, Borrelia Burgdorferi
NGSGSLEG

SEQ ID NO: 201594 - protein, 8 aa, Borrelia Burgdorferi
GSGSLEGV

SEQ ID NO: 201595 - protein, 8 aa, Borrelia Burgdorferi
SGSLEGVK

SEQ ID NO: 201596 - protein, 8 aa, Borrelia Burgdorferi
GSLEGVKA

SEQ ID NO: 201597 - protein, 8 aa, Borrelia Burgdorferi
SLEGVKAD

SEQ ID NO: 201598 - protein, 8 aa, Borrelia Burgdorferi
LEGVKADK

SEQ ID NO: 201599 - protein, 8 aa, Borrelia Burgdorferi
EGVKADKS

SEQ ID NO: 201600 - protein, 8 aa, Borrelia Burgdorferi
GVKADKSK

SEQ ID NO: 201601 - protein, 8 aa, Borrelia Burgdorferi
VKADKSKV

SEQ ID NO: 201602 - protein, 8 aa, Borrelia Burgdorferi
KADKSKVK

SEQ ID NO: 201603 - protein, 8 aa, Borrelia Burgdorferi
ADKSKVKL

SEQ ID NO: 201604 - protein, 8 aa, Borrelia Burgdorferi
DKSKVKLI

SEQ ID NO: 201605 - protein, 8 aa, Borrelia Burgdorferi
KSKVKLIV

SEQ ID NO: 201606 - protein, 8 aa, Borrelia Burgdorferi
SKVKLIVS

SEQ ID NO: 201607 - protein, 8 aa, Borrelia Burgdorferi
KVKLIVSD

SEQ ID NO: 201608 - protein, 8 aa, Borrelia Burgdorferi
VKLIVSDD

SEQ ID NO: 201609 - protein, 8 aa, Borrelia Burgdorferi
KLIVSDDL

SEQ ID NO: 201610 - protein, 8 aa, Borrelia Burgdorferi
LIVSDDLN

SEQ ID NO: 201611 - protein, 8 aa, Borrelia Burgdorferi
IVSDDLNT

SEQ ID NO: 201612 - protein, 8 aa, Borrelia Burgdorferi
VSDDLNTV

SEQ ID NO: 201613 - protein, 8 aa, Borrelia Burgdorferi
SDDLNTVT

SEQ ID NO: 201614 - protein, 8 aa, Borrelia Burgdorferi
DDLNTVTV

SEQ ID NO: 201615 - protein, 8 aa, Borrelia Burgdorferi
DLNTVTVE

SEQ ID NO: 201616 - protein, 8 aa, Borrelia Burgdorferi
LNTVTVET

SEQ ID NO: 201617 - protein, 8 aa, Borrelia Burgdorferi
NTVTVETF

SEQ ID NO: 201618 - protein, 8 aa, Borrelia Burgdorferi
TVTVETFD

SEQ ID NO: 201619 - protein, 8 aa, Borrelia Burgdorferi
VTVETFDS

SEQ ID NO: 201620 - protein, 8 aa, Borrelia Burgdorferi
TVETFDSS

SEQ ID NO: 201621 - protein, 8 aa, Borrelia Burgdorferi
VETFDSSG

SEQ ID NO: 201622 - protein, 8 aa, Borrelia Burgdorferi
ETFDSSGK

SEQ ID NO: 201623 - protein, 8 aa, Borrelia Burgdorferi
TFDSSGKK

SEQ ID NO: 201624 - protein, 8 aa, Borrelia Burgdorferi
FDSSGKKD

SEQ ID NO: 201625 - protein, 8 aa, Borrelia Burgdorferi
DSSGKKDS

SEQ ID NO: 201626 - protein, 8 aa, Borrelia Burgdorferi
SSGKKDSS

SEQ ID NO: 201627 - protein, 8 aa, Borrelia Burgdorferi
SGKKDSSK

SEQ ID NO: 201628 - protein, 8 aa, Borrelia Burgdorferi
GKKDSSKV

SEQ ID NO: 201629 - protein, 8 aa, Borrelia Burgdorferi
KKDSSKVT

SEQ ID NO: 201630 - protein, 8 aa, Borrelia Burgdorferi
KDSSKVTV

SEQ ID NO: 201631 - protein, 8 aa, Borrelia Burgdorferi
DSSKVTVK

SEQ ID NO: 201632 - protein, 8 aa, Borrelia Burgdorferi
SSKVTVKH

SEQ ID NO: 201633 - protein, 8 aa, Borrelia Burgdorferi
SKVTVKHG

SEQ ID NO: 201634 - protein, 8 aa, Borrelia Burgdorferi
KVTVKHGS

SEQ ID NO: 201635 - protein, 8 aa, Borrelia Burgdorferi
VTVKHGSI

SEQ ID NO: 201636 - protein, 8 aa, Borrelia Burgdorferi
TVKHGSIT

SEQ ID NO: 201637 - protein, 8 aa, Borrelia Burgdorferi
VKHGSITE

SEQ ID NO: 201638 - protein, 8 aa, Borrelia Burgdorferi
KHGSITED

SEQ ID NO: 201639 - protein, 8 aa, Borrelia Burgdorferi
HGSITEDT

SEQ ID NO: 201640 - protein, 8 aa, Borrelia Burgdorferi
GSITEDTF

SEQ ID NO: 201641 - protein, 8 aa, Borrelia Burgdorferi
SITEDTFK

SEQ ID NO: 201642 - protein, 8 aa, Borrelia Burgdorferi
ITEDTFKA

SEQ ID NO: 201643 - protein, 8 aa, Borrelia Burgdorferi
TEDTFKAN

SEQ ID NO: 201644 - protein, 8 aa, Borrelia Burgdorferi
EDTFKANK

SEQ ID NO: 201645 - protein, 8 aa, Borrelia Burgdorferi
DTFKANKL

SEQ ID NO: 201646 - protein, 8 aa, Borrelia Burgdorferi
TFKANKLD

SEQ ID NO: 201647 - protein, 8 aa, Borrelia Burgdorferi
FKANKLDS

SEQ ID NO: 201648 - protein, 8 aa, Borrelia Burgdorferi
KANKLDSK

SEQ ID NO: 201649 - protein, 8 aa, Borrelia Burgdorferi
ANKLDSKK

SEQ ID NO: 201650 - protein, 8 aa, Borrelia Burgdorferi
NKLDSKKL

SEQ ID NO: 201651 - protein, 8 aa, Borrelia Burgdorferi
KLDSKKLT

SEQ ID NO: 201652 - protein, 8 aa, Borrelia Burgdorferi
LDSKKLTR

SEQ ID NO: 201653 - protein, 8 aa, Borrelia Burgdorferi
DSKKLTRS

SEQ ID NO: 201654 - protein, 8 aa, Borrelia Burgdorferi
SKKLTRSN

SEQ ID NO: 201655 - protein, 8 aa, Borrelia Burgdorferi
KKLTRSNG

SEQ ID NO: 201656 - protein, 8 aa, Borrelia Burgdorferi
KLTRSNGT

SEQ ID NO: 201657 - protein, 8 aa, Borrelia Burgdorferi
LTRSNGTM

SEQ ID NO: 201658 - protein, 8 aa, Borrelia Burgdorferi
TRSNGTML

SEQ ID NO: 201659 - protein, 8 aa, Borrelia Burgdorferi
RSNGTMLE

SEQ ID NO: 201660 - protein, 8 aa, Borrelia Burgdorferi
SNGTMLEY

SEQ ID NO: 201661 - protein, 8 aa, Borrelia Burgdorferi
NGTMLEYS

SEQ ID NO: 201662 - protein, 8 aa, Borrelia Burgdorferi
GTMLEYSQ

SEQ ID NO: 201663 - protein, 8 aa, Borrelia Burgdorferi
TMLEYSQM

SEQ ID NO: 201664 - protein, 8 aa, Borrelia Burgdorferi
MLEYSQMT

SEQ ID NO: 201665 - protein, 8 aa, Borrelia Burgdorferi
LEYSQMTD

SEQ ID NO: 201666 - protein, 8 aa, Borrelia Burgdorferi
EYSQMTDA

SEQ ID NO: 201667 - protein, 8 aa, Borrelia Burgdorferi
YSQMTDAD

SEQ ID NO: 201668 - protein, 8 aa, Borrelia Burgdorferi
SQMTDADN

SEQ ID NO: 201669 - protein, 8 aa, Borrelia Burgdorferi
QMTDADNA

SEQ ID NO: 201670 - protein, 8 aa, Borrelia Burgdorferi
MTDADNAT

SEQ ID NO: 201671 - protein, 8 aa, Borrelia Burgdorferi
TDADNATK

SEQ ID NO: 201672 - protein, 8 aa, Borrelia Burgdorferi
DADNATKA

SEQ ID NO: 201673 - protein, 8 aa, Borrelia Burgdorferi
ADNATKAV

SEQ ID NO: 201674 - protein, 8 aa, Borrelia Burgdorferi
DNATKAVE

SEQ ID NO: 201675 - protein, 8 aa, Borrelia Burgdorferi
NATKAVET

SEQ ID NO: 201676 - protein, 8 aa, Borrelia Burgdorferi
ATKAVETL

SEQ ID NO: 201677 - protein, 8 aa, Borrelia Burgdorferi
TKAVETLK

SEQ ID NO: 201678 - protein, 8 aa, Borrelia Burgdorferi
KAVETLKN

SEQ ID NO: 201679 - protein, 9 aa, Borrelia Burgdorferi
MRLYLTGFA

SEQ ID NO: 201680 - protein, 9 aa, Borrelia Burgdorferi
RLYLTGFAL

SEQ ID NO: 201681 - protein, 9 aa, Borrelia Burgdorferi
LYLTGFALA

SEQ ID NO: 201682 - protein, 9 aa, Borrelia Burgdorferi
YLTGFALAL

SEQ ID NO: 201683 - protein, 9 aa, Borrelia Burgdorferi
LTGFALALA

SEQ ID NO: 201684 - protein, 9 aa, Borrelia Burgdorferi
TGFALALAL

SEQ ID NO: 201685 - protein, 9 aa, Borrelia Burgdorferi
GFALALALI

SEQ ID NO: 201686 - protein, 9 aa, Borrelia Burgdorferi
FALALALIG

SEQ ID NO: 201687 - protein, 9 aa, Borrelia Burgdorferi
ALALALIGC

SEQ ID NO: 201688 - protein, 9 aa, Borrelia Burgdorferi
LALALIGCA

SEQ ID NO: 201689 - protein, 9 aa, Borrelia Burgdorferi
ALALIGCAQ

SEQ ID NO: 201690 - protein, 9 aa, Borrelia Burgdorferi
LALIGCAQK

SEQ ID NO: 201691 - protein, 9 aa, Borrelia Burgdorferi
ALIGCAQKG

SEQ ID NO: 201692 - protein, 9 aa, Borrelia Burgdorferi
LIGCAQKGA

SEQ ID NO: 201693 - protein, 9 aa, Borrelia Burgdorferi
IGCAQKGAE

SEQ ID NO: 201694 - protein, 9 aa, Borrelia Burgdorferi
GCAQKGAEP

SEQ ID NO: 201695 - protein, 9 aa, Borrelia Burgdorferi
CAQKGAEPK

SEQ ID NO: 201696 - protein, 9 aa, Borrelia Burgdorferi
AQKGAEPKN

SEQ ID NO: 201697 - protein, 9 aa, Borrelia Burgdorferi
QKGAEPKNT

SEQ ID NO: 201698 - protein, 9 aa, Borrelia Burgdorferi
KGAEPKNTS

SEQ ID NO: 201699 - protein, 9 aa, Borrelia Burgdorferi
GAEPKNTSQ

SEQ ID NO: 201700 - protein, 9 aa, Borrelia Burgdorferi
AEPKNTSQK

SEQ ID NO: 201701 - protein, 9 aa, Borrelia Burgdorferi
EPKNTSQKY

SEQ ID NO: 201702 - protein, 9 aa, Borrelia Burgdorferi
PKNTSQKYD

SEQ ID NO: 201703 - protein, 9 aa, Borrelia Burgdorferi
KNTSQKYDD

SEQ ID NO: 201704 - protein, 9 aa, Borrelia Burgdorferi
NTSQKYDDQ

SEQ ID NO: 201705 - protein, 9 aa, Borrelia Burgdorferi
TSQKYDDQE

SEQ ID NO: 201706 - protein, 9 aa, Borrelia Burgdorferi
SQKYDDQEV

SEQ ID NO: 201707 - protein, 9 aa, Borrelia Burgdorferi
QKYDDQEVI

SEQ ID NO: 201708 - protein, 9 aa, Borrelia Burgdorferi
KYDDQEVIN

SEQ ID NO: 201709 - protein, 9 aa, Borrelia Burgdorferi
YDDQEVINS

SEQ ID NO: 201710 - protein, 9 aa, Borrelia Burgdorferi
DDQEVINSN

SEQ ID NO: 201711 - protein, 9 aa, Borrelia Burgdorferi
DQEVINSNK

SEQ ID NO: 201712 - protein, 9 aa, Borrelia Burgdorferi
QEVINSNKA

SEQ ID NO: 201713 - protein, 9 aa, Borrelia Burgdorferi
EVINSNKAP

SEQ ID NO: 201714 - protein, 9 aa, Borrelia Burgdorferi
VINSNKAPK

SEQ ID NO: 201715 - protein, 9 aa, Borrelia Burgdorferi
INSNKAPKD

SEQ ID NO: 201716 - protein, 9 aa, Borrelia Burgdorferi
NSNKAPKDA

SEQ ID NO: 201717 - protein, 9 aa, Borrelia Burgdorferi
SNKAPKDAK

SEQ ID NO: 201718 - protein, 9 aa, Borrelia Burgdorferi
NKAPKDAKQ

SEQ ID NO: 201719 - protein, 9 aa, Borrelia Burgdorferi
KAPKDAKQT

SEQ ID NO: 201720 - protein, 9 aa, Borrelia Burgdorferi
APKDAKQTP

SEQ ID NO: 201721 - protein, 9 aa, Borrelia Burgdorferi
PKDAKQTPP

SEQ ID NO: 201722 - protein, 9 aa, Borrelia Burgdorferi
KDAKQTPPA

SEQ ID NO: 201723 - protein, 9 aa, Borrelia Burgdorferi
DAKQTPPAA

SEQ ID NO: 201724 - protein, 9 aa, Borrelia Burgdorferi
AKQTPPAAA

SEQ ID NO: 201725 - protein, 9 aa, Borrelia Burgdorferi
KQTPPAAAE

SEQ ID NO: 201726 - protein, 9 aa, Borrelia Burgdorferi
QTPPAAAED

SEQ ID NO: 201727 - protein, 9 aa, Borrelia Burgdorferi
TPPAAAEDS

SEQ ID NO: 201728 - protein, 9 aa, Borrelia Burgdorferi
PPAAAEDSV

SEQ ID NO: 201729 - protein, 9 aa, Borrelia Burgdorferi
PAAAEDSVT

SEQ ID NO: 201730 - protein, 9 aa, Borrelia Burgdorferi
AAAEDSVTL

SEQ ID NO: 201731 - protein, 9 aa, Borrelia Burgdorferi
AAEDSVTLF

SEQ ID NO: 201732 - protein, 9 aa, Borrelia Burgdorferi
AEDSVTLFS

SEQ ID NO: 201733 - protein, 9 aa, Borrelia Burgdorferi
EDSVTLFSG

SEQ ID NO: 201734 - protein, 9 aa, Borrelia Burgdorferi
DSVTLFSGN

SEQ ID NO: 201735 - protein, 9 aa, Borrelia Burgdorferi
SVTLFSGNE

SEQ ID NO: 201736 - protein, 9 aa, Borrelia Burgdorferi
VTLFSGNEI

SEQ ID NO: 201737 - protein, 9 aa, Borrelia Burgdorferi
TLFSGNEIF

SEQ ID NO: 201738 - protein, 9 aa, Borrelia Burgdorferi
LFSGNEIFV

SEQ ID NO: 201739 - protein, 9 aa, Borrelia Burgdorferi
FSGNEIFVS

SEQ ID NO: 201740 - protein, 9 aa, Borrelia Burgdorferi
SGNEIFVSK

SEQ ID NO: 201741 - protein, 9 aa, Borrelia Burgdorferi
GNEIFVSKE

SEQ ID NO: 201742 - protein, 9 aa, Borrelia Burgdorferi
NEIFVSKEK

SEQ ID NO: 201743 - protein, 9 aa, Borrelia Burgdorferi
EIFVSKEKN

SEQ ID NO: 201744 - protein, 9 aa, Borrelia Burgdorferi
IFVSKEKNS

SEQ ID NO: 201745 - protein, 9 aa, Borrelia Burgdorferi
FVSKEKNSS

SEQ ID NO: 201746 - protein, 9 aa, Borrelia Burgdorferi
VSKEKNSSG

SEQ ID NO: 201747 - protein, 9 aa, Borrelia Burgdorferi
SKEKNSSGK

SEQ ID NO: 201748 - protein, 9 aa, Borrelia Burgdorferi
KEKNSSGKY

SEQ ID NO: 201749 - protein, 9 aa, Borrelia Burgdorferi
EKNSSGKYD

SEQ ID NO: 201750 - protein, 9 aa, Borrelia Burgdorferi
KNSSGKYDL

SEQ ID NO: 201751 - protein, 9 aa, Borrelia Burgdorferi
NSSGKYDLR

SEQ ID NO: 201752 - protein, 9 aa, Borrelia Burgdorferi
SSGKYDLRT

SEQ ID NO: 201753 - protein, 9 aa, Borrelia Burgdorferi
SGKYDLRTT

SEQ ID NO: 201754 - protein, 9 aa, Borrelia Burgdorferi
GKYDLRTTI

SEQ ID NO: 201755 - protein, 9 aa, Borrelia Burgdorferi
KYDLRTTIN

SEQ ID NO: 201756 - protein, 9 aa, Borrelia Burgdorferi
YDLRTTINQ

SEQ ID NO: 201757 - protein, 9 aa, Borrelia Burgdorferi
DLRTTINQV

SEQ ID NO: 201758 - protein, 9 aa, Borrelia Burgdorferi
LRTTINQVE

SEQ ID NO: 201759 - protein, 9 aa, Borrelia Burgdorferi
RTTINQVEL

SEQ ID NO: 201760 - protein, 9 aa, Borrelia Burgdorferi
TTINQVELK

SEQ ID NO: 201761 - protein, 9 aa, Borrelia Burgdorferi
TINQVELKG

SEQ ID NO: 201762 - protein, 9 aa, Borrelia Burgdorferi
INQVELKGT

SEQ ID NO: 201763 - protein, 9 aa, Borrelia Burgdorferi
NQVELKGTS

SEQ ID NO: 201764 - protein, 9 aa, Borrelia Burgdorferi
QVELKGTSD

SEQ ID NO: 201765 - protein, 9 aa, Borrelia Burgdorferi
VELKGTSDK

SEQ ID NO: 201766 - protein, 9 aa, Borrelia Burgdorferi
ELKGTSDKN

SEQ ID NO: 201767 - protein, 9 aa, Borrelia Burgdorferi
LKGTSDKNN

SEQ ID NO: 201768 - protein, 9 aa, Borrelia Burgdorferi
KGTSDKNNG

SEQ ID NO: 201769 - protein, 9 aa, Borrelia Burgdorferi
GTSDKNNGS

SEQ ID NO: 201770 - protein, 9 aa, Borrelia Burgdorferi
TSDKNNGSG

SEQ ID NO: 201771 - protein, 9 aa, Borrelia Burgdorferi
SDKNNGSGS

SEQ ID NO: 201772 - protein, 9 aa, Borrelia Burgdorferi
DKNNGSGSL

SEQ ID NO: 201773 - protein, 9 aa, Borrelia Burgdorferi
KNNGSGSLE

SEQ ID NO: 201774 - protein, 9 aa, Borrelia Burgdorferi
NNGSGSLEG

SEQ ID NO: 201775 - protein, 9 aa, Borrelia Burgdorferi
NGSGSLEGV

SEQ ID NO: 201776 - protein, 9 aa, Borrelia Burgdorferi
GSGSLEGVK

SEQ ID NO: 201777 - protein, 9 aa, Borrelia Burgdorferi
SGSLEGVKA

SEQ ID NO: 201778 - protein, 9 aa, Borrelia Burgdorferi
GSLEGVKAD

SEQ ID NO: 201779 - protein, 9 aa, Borrelia Burgdorferi
SLEGVKADK

SEQ ID NO: 201780 - protein, 9 aa, Borrelia Burgdorferi
LEGVKADKS

SEQ ID NO: 201781 - protein, 9 aa, Borrelia Burgdorferi
EGVKADKSK

SEQ ID NO: 201782 - protein, 9 aa, Borrelia Burgdorferi
GVKADKSKV

SEQ ID NO: 201783 - protein, 9 aa, Borrelia Burgdorferi
VKADKSKVK

SEQ ID NO: 201784 - protein, 9 aa, Borrelia Burgdorferi
KADKSKVKL

SEQ ID NO: 201785 - protein, 9 aa, Borrelia Burgdorferi
ADKSKVKLI

SEQ ID NO: 201786 - protein, 9 aa, Borrelia Burgdorferi
DKSKVKLIV

SEQ ID NO: 201787 - protein, 9 aa, Borrelia Burgdorferi
KSKVKLIVS

SEQ ID NO: 201788 - protein, 9 aa, Borrelia Burgdorferi
SKVKLIVSD

SEQ ID NO: 201789 - protein, 9 aa, Borrelia Burgdorferi
KVKLIVSDD

SEQ ID NO: 201790 - protein, 9 aa, Borrelia Burgdorferi
VKLIVSDDL

SEQ ID NO: 201791 - protein, 9 aa, Borrelia Burgdorferi
KLIVSDDLN

SEQ ID NO: 201792 - protein, 9 aa, Borrelia Burgdorferi
LIVSDDLNT

SEQ ID NO: 201793 - protein, 9 aa, Borrelia Burgdorferi
IVSDDLNTV

SEQ ID NO: 201794 - protein, 9 aa, Borrelia Burgdorferi
VSDDLNTVT

SEQ ID NO: 201795 - protein, 9 aa, Borrelia Burgdorferi
SDDLNTVTV

SEQ ID NO: 201796 - protein, 9 aa, Borrelia Burgdorferi
DDLNTVTVE

SEQ ID NO: 201797 - protein, 9 aa, Borrelia Burgdorferi
DLNTVTVET

SEQ ID NO: 201798 - protein, 9 aa, Borrelia Burgdorferi
LNTVTVETF

SEQ ID NO: 201799 - protein, 9 aa, Borrelia Burgdorferi
NTVTVETFD

SEQ ID NO: 201800 - protein, 9 aa, Borrelia Burgdorferi
TVTVETFDS

SEQ ID NO: 201801 - protein, 9 aa, Borrelia Burgdorferi
VTVETFDSS

SEQ ID NO: 201802 - protein, 9 aa, Borrelia Burgdorferi
TVETFDSSG

SEQ ID NO: 201803 - protein, 9 aa, Borrelia Burgdorferi
VETFDSSGK

SEQ ID NO: 201804 - protein, 9 aa, Borrelia Burgdorferi
ETFDSSGKK

SEQ ID NO: 201805 - protein, 9 aa, Borrelia Burgdorferi
TFDSSGKKD

SEQ ID NO: 201806 - protein, 9 aa, Borrelia Burgdorferi
FDSSGKKDS

SEQ ID NO: 201807 - protein, 9 aa, Borrelia Burgdorferi
DSSGKKDSS

SEQ ID NO: 201808 - protein, 9 aa, Borrelia Burgdorferi
SSGKKDSSK

SEQ ID NO: 201809 - protein, 9 aa, Borrelia Burgdorferi
SGKKDSSKV

SEQ ID NO: 201810 - protein, 9 aa, Borrelia Burgdorferi
GKKDSSKVT

SEQ ID NO: 201811 - protein, 9 aa, Borrelia Burgdorferi
KKDSSKVTV

SEQ ID NO: 201812 - protein, 9 aa, Borrelia Burgdorferi
KDSSKVTVK

SEQ ID NO: 201813 - protein, 9 aa, Borrelia Burgdorferi
DSSKVTVKH

SEQ ID NO: 201814 - protein, 9 aa, Borrelia Burgdorferi
SSKVTVKHG

SEQ ID NO: 201815 - protein, 9 aa, Borrelia Burgdorferi
SKVTVKHGS

SEQ ID NO: 201816 - protein, 9 aa, Borrelia Burgdorferi
KVTVKHGSI

SEQ ID NO: 201817 - protein, 9 aa, Borrelia Burgdorferi
VTVKHGSIT

SEQ ID NO: 201818 - protein, 9 aa, Borrelia Burgdorferi
TVKHGSITE

SEQ ID NO: 201819 - protein, 9 aa, Borrelia Burgdorferi
VKHGSITED

SEQ ID NO: 201820 - protein, 9 aa, Borrelia Burgdorferi
KHGSITEDT

SEQ ID NO: 201821 - protein, 9 aa, Borrelia Burgdorferi
HGSITEDTF

SEQ ID NO: 201822 - protein, 9 aa, Borrelia Burgdorferi
GSITEDTFK

SEQ ID NO: 201823 - protein, 9 aa, Borrelia Burgdorferi
SITEDTFKA

SEQ ID NO: 201824 - protein, 9 aa, Borrelia Burgdorferi
ITEDTFKAN

SEQ ID NO: 201825 - protein, 9 aa, Borrelia Burgdorferi
TEDTFKANK

SEQ ID NO: 201826 - protein, 9 aa, Borrelia Burgdorferi
EDTFKANKL

SEQ ID NO: 201827 - protein, 9 aa, Borrelia Burgdorferi
DTFKANKLD

SEQ ID NO: 201828 - protein, 9 aa, Borrelia Burgdorferi
TFKANKLDS

SEQ ID NO: 201829 - protein, 9 aa, Borrelia Burgdorferi
FKANKLDSK

SEQ ID NO: 201830 - protein, 9 aa, Borrelia Burgdorferi
KANKLDSKK

SEQ ID NO: 201831 - protein, 9 aa, Borrelia Burgdorferi
ANKLDSKKL

SEQ ID NO: 201832 - protein, 9 aa, Borrelia Burgdorferi
NKLDSKKLT

SEQ ID NO: 201833 - protein, 9 aa, Borrelia Burgdorferi
KLDSKKLTR

SEQ ID NO: 201834 - protein, 9 aa, Borrelia Burgdorferi
LDSKKLTRS

SEQ ID NO: 201835 - protein, 9 aa, Borrelia Burgdorferi
DSKKLTRSN

SEQ ID NO: 201836 - protein, 9 aa, Borrelia Burgdorferi
SKKLTRSNG

SEQ ID NO: 201837 - protein, 9 aa, Borrelia Burgdorferi
KKLTRSNGT

SEQ ID NO: 201838 - protein, 9 aa, Borrelia Burgdorferi
KLTRSNGTM

SEQ ID NO: 201839 - protein, 9 aa, Borrelia Burgdorferi
LTRSNGTML

SEQ ID NO: 201840 - protein, 9 aa, Borrelia Burgdorferi
TRSNGTMLE

SEQ ID NO: 201841 - protein, 9 aa, Borrelia Burgdorferi
RSNGTMLEY

SEQ ID NO: 201842 - protein, 9 aa, Borrelia Burgdorferi
SNGTMLEYS

SEQ ID NO: 201843 - protein, 9 aa, Borrelia Burgdorferi
NGTMLEYSQ

SEQ ID NO: 201844 - protein, 9 aa, Borrelia Burgdorferi
GTMLEYSQM

SEQ ID NO: 201845 - protein, 9 aa, Borrelia Burgdorferi
TMLEYSQMT

SEQ ID NO: 201846 - protein, 9 aa, Borrelia Burgdorferi
MLEYSQMTD

SEQ ID NO: 201847 - protein, 9 aa, Borrelia Burgdorferi
LEYSQMTDA

SEQ ID NO: 201848 - protein, 9 aa, Borrelia Burgdorferi
EYSQMTDAD

SEQ ID NO: 201849 - protein, 9 aa, Borrelia Burgdorferi
YSQMTDADN

SEQ ID NO: 201850 - protein, 9 aa, Borrelia Burgdorferi
SQMTDADNA

SEQ ID NO: 201851 - protein, 9 aa, Borrelia Burgdorferi
QMTDADNAT

SEQ ID NO: 201852 - protein, 9 aa, Borrelia Burgdorferi
MTDADNATK

SEQ ID NO: 201853 - protein, 9 aa, Borrelia Burgdorferi
TDADNATKA

SEQ ID NO: 201854 - protein, 9 aa, Borrelia Burgdorferi
DADNATKAV

SEQ ID NO: 201855 - protein, 9 aa, Borrelia Burgdorferi
ADNATKAVE

SEQ ID NO: 201856 - protein, 9 aa, Borrelia Burgdorferi
DNATKAVET

SEQ ID NO: 201857 - protein, 9 aa, Borrelia Burgdorferi
NATKAVETL

SEQ ID NO: 201858 - protein, 9 aa, Borrelia Burgdorferi
ATKAVETLK

SEQ ID NO: 201859 - protein, 9 aa, Borrelia Burgdorferi
TKAVETLKN

SEQ ID NO: 201860 - protein, 10 aa, Borrelia Burgdorferi
MRLYLTGFAL

SEQ ID NO: 201861 - protein, 10 aa, Borrelia Burgdorferi
RLYLTGFALA

SEQ ID NO: 201862 - protein, 10 aa, Borrelia Burgdorferi
LYLTGFALAL

SEQ ID NO: 201863 - protein, 10 aa, Borrelia Burgdorferi
YLTGFALALA

SEQ ID NO: 201864 - protein, 10 aa, Borrelia Burgdorferi
LTGFALALAL

SEQ ID NO: 201865 - protein, 10 aa, Borrelia Burgdorferi
TGFALALALI

SEQ ID NO: 201866 - protein, 10 aa, Borrelia Burgdorferi
GFALALALIG

SEQ ID NO: 201867 - protein, 10 aa, Borrelia Burgdorferi
FALALALIGC

SEQ ID NO: 201868 - protein, 10 aa, Borrelia Burgdorferi
ALALALIGCA

SEQ ID NO: 201869 - protein, 10 aa, Borrelia Burgdorferi
LALALIGCAQ

SEQ ID NO: 201870 - protein, 10 aa, Borrelia Burgdorferi
ALALIGCAQK

SEQ ID NO: 201871 - protein, 10 aa, Borrelia Burgdorferi
LALIGCAQKG

SEQ ID NO: 201872 - protein, 10 aa, Borrelia Burgdorferi
ALIGCAQKGA

SEQ ID NO: 201873 - protein, 10 aa, Borrelia Burgdorferi
LIGCAQKGAE

SEQ ID NO: 201874 - protein, 10 aa, Borrelia Burgdorferi
IGCAQKGAEP

SEQ ID NO: 201875 - protein, 10 aa, Borrelia Burgdorferi
GCAQKGAEPK

SEQ ID NO: 201876 - protein, 10 aa, Borrelia Burgdorferi
CAQKGAEPKN

SEQ ID NO: 201877 - protein, 10 aa, Borrelia Burgdorferi
AQKGAEPKNT

SEQ ID NO: 201878 - protein, 10 aa, Borrelia Burgdorferi
QKGAEPKNTS

SEQ ID NO: 201879 - protein, 10 aa, Borrelia Burgdorferi
KGAEPKNTSQ

SEQ ID NO: 201880 - protein, 10 aa, Borrelia Burgdorferi
GAEPKNTSQK

SEQ ID NO: 201881 - protein, 10 aa, Borrelia Burgdorferi
AEPKNTSQKY

SEQ ID NO: 201882 - protein, 10 aa, Borrelia Burgdorferi
EPKNTSQKYD

SEQ ID NO: 201883 - protein, 10 aa, Borrelia Burgdorferi
PKNTSQKYDD

SEQ ID NO: 201884 - protein, 10 aa, Borrelia Burgdorferi
KNTSQKYDDQ

SEQ ID NO: 201885 - protein, 10 aa, Borrelia Burgdorferi
NTSQKYDDQE

SEQ ID NO: 201886 - protein, 10 aa, Borrelia Burgdorferi
TSQKYDDQEV

SEQ ID NO: 201887 - protein, 10 aa, Borrelia Burgdorferi
SQKYDDQEVI

SEQ ID NO: 201888 - protein, 10 aa, Borrelia Burgdorferi
QKYDDQEVIN

SEQ ID NO: 201889 - protein, 10 aa, Borrelia Burgdorferi
KYDDQEVINS

SEQ ID NO: 201890 - protein, 10 aa, Borrelia Burgdorferi
YDDQEVINSN

SEQ ID NO: 201891 - protein, 10 aa, Borrelia Burgdorferi
DDQEVINSNK

SEQ ID NO: 201892 - protein, 10 aa, Borrelia Burgdorferi
DQEVINSNKA

SEQ ID NO: 201893 - protein, 10 aa, Borrelia Burgdorferi
QEVINSNKAP

SEQ ID NO: 201894 - protein, 10 aa, Borrelia Burgdorferi
EVINSNKAPK

SEQ ID NO: 201895 - protein, 10 aa, Borrelia Burgdorferi
VINSNKAPKD

SEQ ID NO: 201896 - protein, 10 aa, Borrelia Burgdorferi
INSNKAPKDA

SEQ ID NO: 201897 - protein, 10 aa, Borrelia Burgdorferi
NSNKAPKDAK

SEQ ID NO: 201898 - protein, 10 aa, Borrelia Burgdorferi
SNKAPKDAKQ

SEQ ID NO: 201899 - protein, 10 aa, Borrelia Burgdorferi
NKAPKDAKQT

SEQ ID NO: 201900 - protein, 10 aa, Borrelia Burgdorferi
KAPKDAKQTP

SEQ ID NO: 201901 - protein, 10 aa, Borrelia Burgdorferi
APKDAKQTPP

SEQ ID NO: 201902 - protein, 10 aa, Borrelia Burgdorferi
PKDAKQTPPA

SEQ ID NO: 201903 - protein, 10 aa, Borrelia Burgdorferi
KDAKQTPPAA

SEQ ID NO: 201904 - protein, 10 aa, Borrelia Burgdorferi
DAKQTPPAAA

SEQ ID NO: 201905 - protein, 10 aa, Borrelia Burgdorferi
AKQTPPAAAE

SEQ ID NO: 201906 - protein, 10 aa, Borrelia Burgdorferi
KQTPPAAAED

SEQ ID NO: 201907 - protein, 10 aa, Borrelia Burgdorferi
QTPPAAAEDS

SEQ ID NO: 201908 - protein, 10 aa, Borrelia Burgdorferi
TPPAAAEDSV

SEQ ID NO: 201909 - protein, 10 aa, Borrelia Burgdorferi
PPAAAEDSVT

SEQ ID NO: 201910 - protein, 10 aa, Borrelia Burgdorferi
PAAAEDSVTL

SEQ ID NO: 201911 - protein, 10 aa, Borrelia Burgdorferi
AAAEDSVTLF

SEQ ID NO: 201912 - protein, 10 aa, Borrelia Burgdorferi
AAEDSVTLFS

SEQ ID NO: 201913 - protein, 10 aa, Borrelia Burgdorferi
AEDSVTLFSG

SEQ ID NO: 201914 - protein, 10 aa, Borrelia Burgdorferi
EDSVTLFSGN

SEQ ID NO: 201915 - protein, 10 aa, Borrelia Burgdorferi
DSVTLFSGNE

SEQ ID NO: 201916 - protein, 10 aa, Borrelia Burgdorferi
SVTLFSGNEI

SEQ ID NO: 201917 - protein, 10 aa, Borrelia Burgdorferi
VTLFSGNEIF

SEQ ID NO: 201918 - protein, 10 aa, Borrelia Burgdorferi
TLFSGNEIFV

SEQ ID NO: 201919 - protein, 10 aa, Borrelia Burgdorferi
LFSGNEIFVS

SEQ ID NO: 201920 - protein, 10 aa, Borrelia Burgdorferi
FSGNEIFVSK

SEQ ID NO: 201921 - protein, 10 aa, Borrelia Burgdorferi
SGNEIFVSKE

SEQ ID NO: 201922 - protein, 10 aa, Borrelia Burgdorferi
GNEIFVSKEK

SEQ ID NO: 201923 - protein, 10 aa, Borrelia Burgdorferi
NEIFVSKEKN

SEQ ID NO: 201924 - protein, 10 aa, Borrelia Burgdorferi
EIFVSKEKNS

SEQ ID NO: 201925 - protein, 10 aa, Borrelia Burgdorferi
IFVSKEKNSS

SEQ ID NO: 201926 - protein, 10 aa, Borrelia Burgdorferi
FVSKEKNSSG

SEQ ID NO: 201927 - protein, 10 aa, Borrelia Burgdorferi
VSKEKNSSGK

SEQ ID NO: 201928 - protein, 10 aa, Borrelia Burgdorferi
SKEKNSSGKY

SEQ ID NO: 201929 - protein, 10 aa, Borrelia Burgdorferi
KEKNSSGKYD

SEQ ID NO: 201930 - protein, 10 aa, Borrelia Burgdorferi
EKNSSGKYDL

SEQ ID NO: 201931 - protein, 10 aa, Borrelia Burgdorferi
KNSSGKYDLR

SEQ ID NO: 201932 - protein, 10 aa, Borrelia Burgdorferi
NSSGKYDLRT

SEQ ID NO: 201933 - protein, 10 aa, Borrelia Burgdorferi
SSGKYDLRTT

SEQ ID NO: 201934 - protein, 10 aa, Borrelia Burgdorferi
SGKYDLRTTI

SEQ ID NO: 201935 - protein, 10 aa, Borrelia Burgdorferi
GKYDLRTTIN

SEQ ID NO: 201936 - protein, 10 aa, Borrelia Burgdorferi
KYDLRTTINQ

SEQ ID NO: 201937 - protein, 10 aa, Borrelia Burgdorferi
YDLRTTINQV

SEQ ID NO: 201938 - protein, 10 aa, Borrelia Burgdorferi
DLRTTINQVE

SEQ ID NO: 201939 - protein, 10 aa, Borrelia Burgdorferi
LRTTINQVEL

SEQ ID NO: 201940 - protein, 10 aa, Borrelia Burgdorferi
RTTINQVELK

SEQ ID NO: 201941 - protein, 10 aa, Borrelia Burgdorferi
TTINQVELKG

SEQ ID NO: 201942 - protein, 10 aa, Borrelia Burgdorferi
TINQVELKGT

SEQ ID NO: 201943 - protein, 10 aa, Borrelia Burgdorferi
INQVELKGTS

SEQ ID NO: 201944 - protein, 10 aa, Borrelia Burgdorferi
NQVELKGTSD

SEQ ID NO: 201945 - protein, 10 aa, Borrelia Burgdorferi
QVELKGTSDK

SEQ ID NO: 201946 - protein, 10 aa, Borrelia Burgdorferi
VELKGTSDKN

SEQ ID NO: 201947 - protein, 10 aa, Borrelia Burgdorferi
ELKGTSDKNN

SEQ ID NO: 201948 - protein, 10 aa, Borrelia Burgdorferi
LKGTSDKNNG

SEQ ID NO: 201949 - protein, 10 aa, Borrelia Burgdorferi
KGTSDKNNGS

SEQ ID NO: 201950 - protein, 10 aa, Borrelia Burgdorferi
GTSDKNNGSG

SEQ ID NO: 201951 - protein, 10 aa, Borrelia Burgdorferi
TSDKNNGSGS

SEQ ID NO: 201952 - protein, 10 aa, Borrelia Burgdorferi
SDKNNGSGSL

SEQ ID NO: 201953 - protein, 10 aa, Borrelia Burgdorferi
DKNNGSGSLE

SEQ ID NO: 201954 - protein, 10 aa, Borrelia Burgdorferi
KNNGSGSLEG

SEQ ID NO: 201955 - protein, 10 aa, Borrelia Burgdorferi
NNGSGSLEGV

SEQ ID NO: 201956 - protein, 10 aa, Borrelia Burgdorferi
NGSGSLEGVK

SEQ ID NO: 201957 - protein, 10 aa, Borrelia Burgdorferi
GSGSLEGVKA

SEQ ID NO: 201958 - protein, 10 aa, Borrelia Burgdorferi
SGSLEGVKAD

SEQ ID NO: 201959 - protein, 10 aa, Borrelia Burgdorferi
GSLEGVKADK

SEQ ID NO: 201960 - protein, 10 aa, Borrelia Burgdorferi
SLEGVKADKS

SEQ ID NO: 201961 - protein, 10 aa, Borrelia Burgdorferi
LEGVKADKSK

SEQ ID NO: 201962 - protein, 10 aa, Borrelia Burgdorferi
EGVKADKSKV

SEQ ID NO: 201963 - protein, 10 aa, Borrelia Burgdorferi
GVKADKSKVK

SEQ ID NO: 201964 - protein, 10 aa, Borrelia Burgdorferi
VKADKSKVKL

SEQ ID NO: 201965 - protein, 10 aa, Borrelia Burgdorferi
KADKSKVKLI

SEQ ID NO: 201966 - protein, 10 aa, Borrelia Burgdorferi
ADKSKVKLIV

SEQ ID NO: 201967 - protein, 10 aa, Borrelia Burgdorferi
DKSKVKLIVS

SEQ ID NO: 201968 - protein, 10 aa, Borrelia Burgdorferi
KSKVKLIVSD

SEQ ID NO: 201969 - protein, 10 aa, Borrelia Burgdorferi
SKVKLIVSDD

SEQ ID NO: 201970 - protein, 10 aa, Borrelia Burgdorferi
KVKLIVSDDL

SEQ ID NO: 201971 - protein, 10 aa, Borrelia Burgdorferi
VKLIVSDDLN

SEQ ID NO: 201972 - protein, 10 aa, Borrelia Burgdorferi
KLIVSDDLNT

SEQ ID NO: 201973 - protein, 10 aa, Borrelia Burgdorferi
LIVSDDLNTV

SEQ ID NO: 201974 - protein, 10 aa, Borrelia Burgdorferi
IVSDDLNTVT

SEQ ID NO: 201975 - protein, 10 aa, Borrelia Burgdorferi
VSDDLNTVTV

SEQ ID NO: 201976 - protein, 10 aa, Borrelia Burgdorferi
SDDLNTVTVE

SEQ ID NO: 201977 - protein, 10 aa, Borrelia Burgdorferi
DDLNTVTVET

SEQ ID NO: 201978 - protein, 10 aa, Borrelia Burgdorferi
DLNTVTVETF

SEQ ID NO: 201979 - protein, 10 aa, Borrelia Burgdorferi
LNTVTVETFD

SEQ ID NO: 201980 - protein, 10 aa, Borrelia Burgdorferi
NTVTVETFDS

SEQ ID NO: 201981 - protein, 10 aa, Borrelia Burgdorferi
TVTVETFDSS

SEQ ID NO: 201982 - protein, 10 aa, Borrelia Burgdorferi
VTVETFDSSG

SEQ ID NO: 201983 - protein, 10 aa, Borrelia Burgdorferi
TVETFDSSGK

SEQ ID NO: 201984 - protein, 10 aa, Borrelia Burgdorferi
VETFDSSGKK

SEQ ID NO: 201985 - protein, 10 aa, Borrelia Burgdorferi
ETFDSSGKKD

SEQ ID NO: 201986 - protein, 10 aa, Borrelia Burgdorferi
TFDSSGKKDS

SEQ ID NO: 201987 - protein, 10 aa, Borrelia Burgdorferi
FDSSGKKDSS

SEQ ID NO: 201988 - protein, 10 aa, Borrelia Burgdorferi
DSSGKKDSSK

SEQ ID NO: 201989 - protein, 10 aa, Borrelia Burgdorferi
SSGKKDSSKV

SEQ ID NO: 201990 - protein, 10 aa, Borrelia Burgdorferi
SGKKDSSKVT

SEQ ID NO: 201991 - protein, 10 aa, Borrelia Burgdorferi
GKKDSSKVTV

SEQ ID NO: 201992 - protein, 10 aa, Borrelia Burgdorferi
KKDSSKVTVK

SEQ ID NO: 201993 - protein, 10 aa, Borrelia Burgdorferi
KDSSKVTVKH

SEQ ID NO: 201994 - protein, 10 aa, Borrelia Burgdorferi
DSSKVTVKHG

SEQ ID NO: 201995 - protein, 10 aa, Borrelia Burgdorferi
SSKVTVKHGS

SEQ ID NO: 201996 - protein, 10 aa, Borrelia Burgdorferi
SKVTVKHGSI

SEQ ID NO: 201997 - protein, 10 aa, Borrelia Burgdorferi
KVTVKHGSIT

SEQ ID NO: 201998 - protein, 10 aa, Borrelia Burgdorferi
VTVKHGSITE

SEQ ID NO: 201999 - protein, 10 aa, Borrelia Burgdorferi
TVKHGSITED

SEQ ID NO: 202000 - protein, 10 aa, Borrelia Burgdorferi
VKHGSITEDT

SEQ ID NO: 202001 - protein, 10 aa, Borrelia Burgdorferi
KHGSITEDTF

SEQ ID NO: 202002 - protein, 10 aa, Borrelia Burgdorferi
HGSITEDTFK

SEQ ID NO: 202003 - protein, 10 aa, Borrelia Burgdorferi
GSITEDTFKA

SEQ ID NO: 202004 - protein, 10 aa, Borrelia Burgdorferi
SITEDTFKAN

SEQ ID NO: 202005 - protein, 10 aa, Borrelia Burgdorferi
ITEDTFKANK

SEQ ID NO: 202006 - protein, 10 aa, Borrelia Burgdorferi
TEDTFKANKL

SEQ ID NO: 202007 - protein, 10 aa, Borrelia Burgdorferi
EDTFKANKLD

SEQ ID NO: 202008 - protein, 10 aa, Borrelia Burgdorferi
DTFKANKLDS

SEQ ID NO: 202009 - protein, 10 aa, Borrelia Burgdorferi
TFKANKLDSK

SEQ ID NO: 202010 - protein, 10 aa, Borrelia Burgdorferi
FKANKLDSKK

SEQ ID NO: 202011 - protein, 10 aa, Borrelia Burgdorferi
KANKLDSKKL

SEQ ID NO: 202012 - protein, 10 aa, Borrelia Burgdorferi
ANKLDSKKLT

SEQ ID NO: 202013 - protein, 10 aa, Borrelia Burgdorferi
NKLDSKKLTR

SEQ ID NO: 202014 - protein, 10 aa, Borrelia Burgdorferi
KLDSKKLTRS

SEQ ID NO: 202015 - protein, 10 aa, Borrelia Burgdorferi
LDSKKLTRSN

SEQ ID NO: 202016 - protein, 10 aa, Borrelia Burgdorferi
DSKKLTRSNG

SEQ ID NO: 202017 - protein, 10 aa, Borrelia Burgdorferi
SKKLTRSNGT

SEQ ID NO: 202018 - protein, 10 aa, Borrelia Burgdorferi
KKLTRSNGTM

SEQ ID NO: 202019 - protein, 10 aa, Borrelia Burgdorferi
KLTRSNGTML

SEQ ID NO: 202020 - protein, 10 aa, Borrelia Burgdorferi
LTRSNGTMLE

SEQ ID NO: 202021 - protein, 10 aa, Borrelia Burgdorferi
TRSNGTMLEY

SEQ ID NO: 202022 - protein, 10 aa, Borrelia Burgdorferi
RSNGTMLEYS

SEQ ID NO: 202023 - protein, 10 aa, Borrelia Burgdorferi
SNGTMLEYSQ

SEQ ID NO: 202024 - protein, 10 aa, Borrelia Burgdorferi
NGTMLEYSQM

SEQ ID NO: 202025 - protein, 10 aa, Borrelia Burgdorferi
GTMLEYSQMT

SEQ ID NO: 202026 - protein, 10 aa, Borrelia Burgdorferi
TMLEYSQMTD

SEQ ID NO: 202027 - protein, 10 aa, Borrelia Burgdorferi
MLEYSQMTDA

SEQ ID NO: 202028 - protein, 10 aa, Borrelia Burgdorferi
LEYSQMTDAD

SEQ ID NO: 202029 - protein, 10 aa, Borrelia Burgdorferi
EYSQMTDADN

SEQ ID NO: 202030 - protein, 10 aa, Borrelia Burgdorferi
YSQMTDADNA

SEQ ID NO: 202031 - protein, 10 aa, Borrelia Burgdorferi
SQMTDADNAT

SEQ ID NO: 202032 - protein, 10 aa, Borrelia Burgdorferi
QMTDADNATK

SEQ ID NO: 202033 - protein, 10 aa, Borrelia Burgdorferi
MTDADNATKA

SEQ ID NO: 202034 - protein, 10 aa, Borrelia Burgdorferi
TDADNATKAV

SEQ ID NO: 202035 - protein, 10 aa, Borrelia Burgdorferi
DADNATKAVE

SEQ ID NO: 202036 - protein, 10 aa, Borrelia Burgdorferi
ADNATKAVET

SEQ ID NO: 202037 - protein, 10 aa, Borrelia Burgdorferi
DNATKAVETL

SEQ ID NO: 202038 - protein, 10 aa, Borrelia Burgdorferi
NATKAVETLK

SEQ ID NO: 202039 - protein, 10 aa, Borrelia Burgdorferi
ATKAVETLKN

SEQ ID NO: 202040 - protein, 11 aa, Borrelia Burgdorferi
MRLYLTGFALA

SEQ ID NO: 202041 - protein, 11 aa, Borrelia Burgdorferi
RLYLTGFALAL

SEQ ID NO: 202042 - protein, 11 aa, Borrelia Burgdorferi
LYLTGFALALA

SEQ ID NO: 202043 - protein, 11 aa, Borrelia Burgdorferi
YLTGFALALAL

SEQ ID NO: 202044 - protein, 11 aa, Borrelia Burgdorferi
LTGFALALALI

SEQ ID NO: 202045 - protein, 11 aa, Borrelia Burgdorferi
TGFALALALIG

SEQ ID NO: 202046 - protein, 11 aa, Borrelia Burgdorferi
GFALALALIGC

SEQ ID NO: 202047 - protein, 11 aa, Borrelia Burgdorferi
FALALALIGCA

SEQ ID NO: 202048 - protein, 11 aa, Borrelia Burgdorferi
ALALALIGCAQ

SEQ ID NO: 202049 - protein, 11 aa, Borrelia Burgdorferi
LALALIGCAQK

SEQ ID NO: 202050 - protein, 11 aa, Borrelia Burgdorferi
ALALIGCAQKG

SEQ ID NO: 202051 - protein, 11 aa, Borrelia Burgdorferi
LALIGCAQKGA

SEQ ID NO: 202052 - protein, 11 aa, Borrelia Burgdorferi
ALIGCAQKGAE

SEQ ID NO: 202053 - protein, 11 aa, Borrelia Burgdorferi
LIGCAQKGAEP

SEQ ID NO: 202054 - protein, 11 aa, Borrelia Burgdorferi
IGCAQKGAEPK

SEQ ID NO: 202055 - protein, 11 aa, Borrelia Burgdorferi
GCAQKGAEPKN

SEQ ID NO: 202056 - protein, 11 aa, Borrelia Burgdorferi
CAQKGAEPKNT

SEQ ID NO: 202057 - protein, 11 aa, Borrelia Burgdorferi
AQKGAEPKNTS

SEQ ID NO: 202058 - protein, 11 aa, Borrelia Burgdorferi
QKGAEPKNTSQ

SEQ ID NO: 202059 - protein, 11 aa, Borrelia Burgdorferi
KGAEPKNTSQK

SEQ ID NO: 202060 - protein, 11 aa, Borrelia Burgdorferi
GAEPKNTSQKY

SEQ ID NO: 202061 - protein, 11 aa, Borrelia Burgdorferi
AEPKNTSQKYD

SEQ ID NO: 202062 - protein, 11 aa, Borrelia Burgdorferi
EPKNTSQKYDD

SEQ ID NO: 202063 - protein, 11 aa, Borrelia Burgdorferi
PKNTSQKYDDQ

SEQ ID NO: 202064 - protein, 11 aa, Borrelia Burgdorferi
KNTSQKYDDQE

SEQ ID NO: 202065 - protein, 11 aa, Borrelia Burgdorferi
NTSQKYDDQEV

SEQ ID NO: 202066 - protein, 11 aa, Borrelia Burgdorferi
TSQKYDDQEVI

SEQ ID NO: 202067 - protein, 11 aa, Borrelia Burgdorferi
SQKYDDQEVIN

SEQ ID NO: 202068 - protein, 11 aa, Borrelia Burgdorferi
QKYDDQEVINS

SEQ ID NO: 202069 - protein, 11 aa, Borrelia Burgdorferi
KYDDQEVINSN

SEQ ID NO: 202070 - protein, 11 aa, Borrelia Burgdorferi
YDDQEVINSNK

SEQ ID NO: 202071 - protein, 11 aa, Borrelia Burgdorferi
DDQEVINSNKA

SEQ ID NO: 202072 - protein, 11 aa, Borrelia Burgdorferi
DQEVINSNKAP

SEQ ID NO: 202073 - protein, 11 aa, Borrelia Burgdorferi
QEVINSNKAPK

SEQ ID NO: 202074 - protein, 11 aa, Borrelia Burgdorferi
EVINSNKAPKD

SEQ ID NO: 202075 - protein, 11 aa, Borrelia Burgdorferi
VINSNKAPKDA

SEQ ID NO: 202076 - protein, 11 aa, Borrelia Burgdorferi
INSNKAPKDAK

SEQ ID NO: 202077 - protein, 11 aa, Borrelia Burgdorferi
NSNKAPKDAKQ

SEQ ID NO: 202078 - protein, 11 aa, Borrelia Burgdorferi
SNKAPKDAKQT

SEQ ID NO: 202079 - protein, 11 aa, Borrelia Burgdorferi
NKAPKDAKQTP

SEQ ID NO: 202080 - protein, 11 aa, Borrelia Burgdorferi
KAPKDAKQTPP

SEQ ID NO: 202081 - protein, 11 aa, Borrelia Burgdorferi
APKDAKQTPPA

SEQ ID NO: 202082 - protein, 11 aa, Borrelia Burgdorferi
PKDAKQTPPAA

SEQ ID NO: 202083 - protein, 11 aa, Borrelia Burgdorferi
KDAKQTPPAAA

SEQ ID NO: 202084 - protein, 11 aa, Borrelia Burgdorferi
DAKQTPPAAAE

SEQ ID NO: 202085 - protein, 11 aa, Borrelia Burgdorferi
AKQTPPAAAED

SEQ ID NO: 202086 - protein, 11 aa, Borrelia Burgdorferi
KQTPPAAAEDS

SEQ ID NO: 202087 - protein, 11 aa, Borrelia Burgdorferi
QTPPAAAEDSV

SEQ ID NO: 202088 - protein, 11 aa, Borrelia Burgdorferi
TPPAAAEDSVT

SEQ ID NO: 202089 - protein, 11 aa, Borrelia Burgdorferi
PPAAAEDSVTL

SEQ ID NO: 202090 - protein, 11 aa, Borrelia Burgdorferi
PAAAEDSVTLF

SEQ ID NO: 202091 - protein, 11 aa, Borrelia Burgdorferi
AAAEDSVTLFS

SEQ ID NO: 202092 - protein, 11 aa, Borrelia Burgdorferi
AAEDSVTLFSG

SEQ ID NO: 202093 - protein, 11 aa, Borrelia Burgdorferi
AEDSVTLFSGN

SEQ ID NO: 202094 - protein, 11 aa, Borrelia Burgdorferi
EDSVTLFSGNE

SEQ ID NO: 202095 - protein, 11 aa, Borrelia Burgdorferi
DSVTLFSGNEI

SEQ ID NO: 202096 - protein, 11 aa, Borrelia Burgdorferi
SVTLFSGNEIF

SEQ ID NO: 202097 - protein, 11 aa, Borrelia Burgdorferi
VTLFSGNEIFV

SEQ ID NO: 202098 - protein, 11 aa, Borrelia Burgdorferi
TLFSGNEIFVS

SEQ ID NO: 202099 - protein, 11 aa, Borrelia Burgdorferi
LFSGNEIFVSK

SEQ ID NO: 202100 - protein, 11 aa, Borrelia Burgdorferi
FSGNEIFVSKE

SEQ ID NO: 202101 - protein, 11 aa, Borrelia Burgdorferi
SGNEIFVSKEK

SEQ ID NO: 202102 - protein, 11 aa, Borrelia Burgdorferi
GNEIFVSKEKN

SEQ ID NO: 202103 - protein, 11 aa, Borrelia Burgdorferi
NEIFVSKEKNS

SEQ ID NO: 202104 - protein, 11 aa, Borrelia Burgdorferi
EIFVSKEKNSS

SEQ ID NO: 202105 - protein, 11 aa, Borrelia Burgdorferi
IFVSKEKNSSG

SEQ ID NO: 202106 - protein, 11 aa, Borrelia Burgdorferi
FVSKEKNSSGK

SEQ ID NO: 202107 - protein, 11 aa, Borrelia Burgdorferi
VSKEKNSSGKY

SEQ ID NO: 202108 - protein, 11 aa, Borrelia Burgdorferi
SKEKNSSGKYD

SEQ ID NO: 202109 - protein, 11 aa, Borrelia Burgdorferi
KEKNSSGKYDL

SEQ ID NO: 202110 - protein, 11 aa, Borrelia Burgdorferi
EKNSSGKYDLR

SEQ ID NO: 202111 - protein, 11 aa, Borrelia Burgdorferi
KNSSGKYDLRT

SEQ ID NO: 202112 - protein, 11 aa, Borrelia Burgdorferi
NSSGKYDLRTT

SEQ ID NO: 202113 - protein, 11 aa, Borrelia Burgdorferi
SSGKYDLRTTI

SEQ ID NO: 202114 - protein, 11 aa, Borrelia Burgdorferi
SGKYDLRTTIN

SEQ ID NO: 202115 - protein, 11 aa, Borrelia Burgdorferi
GKYDLRTTINQ

SEQ ID NO: 202116 - protein, 11 aa, Borrelia Burgdorferi
KYDLRTTINQV

SEQ ID NO: 202117 - protein, 11 aa, Borrelia Burgdorferi
YDLRTTINQVE

SEQ ID NO: 202118 - protein, 11 aa, Borrelia Burgdorferi
DLRTTINQVEL

SEQ ID NO: 202119 - protein, 11 aa, Borrelia Burgdorferi
LRTTINQVELK

SEQ ID NO: 202120 - protein, 11 aa, Borrelia Burgdorferi
RTTINQVELKG

SEQ ID NO: 202121 - protein, 11 aa, Borrelia Burgdorferi
TTINQVELKGT

SEQ ID NO: 202122 - protein, 11 aa, Borrelia Burgdorferi
TINQVELKGTS

SEQ ID NO: 202123 - protein, 11 aa, Borrelia Burgdorferi
INQVELKGTSD

SEQ ID NO: 202124 - protein, 11 aa, Borrelia Burgdorferi
NQVELKGTSDK

SEQ ID NO: 202125 - protein, 11 aa, Borrelia Burgdorferi
QVELKGTSDKN

SEQ ID NO: 202126 - protein, 11 aa, Borrelia Burgdorferi
VELKGTSDKNN

SEQ ID NO: 202127 - protein, 11 aa, Borrelia Burgdorferi
ELKGTSDKNNG

SEQ ID NO: 202128 - protein, 11 aa, Borrelia Burgdorferi
LKGTSDKNNGS

SEQ ID NO: 202129 - protein, 11 aa, Borrelia Burgdorferi
KGTSDKNNGSG

SEQ ID NO: 202130 - protein, 11 aa, Borrelia Burgdorferi
GTSDKNNGSGS

SEQ ID NO: 202131 - protein, 11 aa, Borrelia Burgdorferi
TSDKNNGSGSL

SEQ ID NO: 202132 - protein, 11 aa, Borrelia Burgdorferi
SDKNNGSGSLE

SEQ ID NO: 202133 - protein, 11 aa, Borrelia Burgdorferi
DKNNGSGSLEG

SEQ ID NO: 202134 - protein, 11 aa, Borrelia Burgdorferi
KNNGSGSLEGV

SEQ ID NO: 202135 - protein, 11 aa, Borrelia Burgdorferi
NNGSGSLEGVK

SEQ ID NO: 202136 - protein, 11 aa, Borrelia Burgdorferi
NGSGSLEGVKA

SEQ ID NO: 202137 - protein, 11 aa, Borrelia Burgdorferi
GSGSLEGVKAD

SEQ ID NO: 202138 - protein, 11 aa, Borrelia Burgdorferi
SGSLEGVKADK

SEQ ID NO: 202139 - protein, 11 aa, Borrelia Burgdorferi
GSLEGVKADKS

SEQ ID NO: 202140 - protein, 11 aa, Borrelia Burgdorferi
SLEGVKADKSK

SEQ ID NO: 202141 - protein, 11 aa, Borrelia Burgdorferi
LEGVKADKSKV

SEQ ID NO: 202142 - protein, 11 aa, Borrelia Burgdorferi
EGVKADKSKVK

SEQ ID NO: 202143 - protein, 11 aa, Borrelia Burgdorferi
GVKADKSKVKL

SEQ ID NO: 202144 - protein, 11 aa, Borrelia Burgdorferi
VKADKSKVKLI

SEQ ID NO: 202145 - protein, 11 aa, Borrelia Burgdorferi
KADKSKVKLIV

SEQ ID NO: 202146 - protein, 11 aa, Borrelia Burgdorferi
ADKSKVKLIVS

SEQ ID NO: 202147 - protein, 11 aa, Borrelia Burgdorferi
DKSKVKLIVSD

SEQ ID NO: 202148 - protein, 11 aa, Borrelia Burgdorferi
KSKVKLIVSDD

SEQ ID NO: 202149 - protein, 11 aa, Borrelia Burgdorferi
SKVKLIVSDDL

SEQ ID NO: 202150 - protein, 11 aa, Borrelia Burgdorferi
KVKLIVSDDLN

SEQ ID NO: 202151 - protein, 11 aa, Borrelia Burgdorferi
VKLIVSDDLNT

SEQ ID NO: 202152 - protein, 11 aa, Borrelia Burgdorferi
KLIVSDDLNTV

SEQ ID NO: 202153 - protein, 11 aa, Borrelia Burgdorferi
LIVSDDLNTVT

SEQ ID NO: 202154 - protein, 11 aa, Borrelia Burgdorferi
IVSDDLNTVTV

SEQ ID NO: 202155 - protein, 11 aa, Borrelia Burgdorferi
VSDDLNTVTVE

SEQ ID NO: 202156 - protein, 11 aa, Borrelia Burgdorferi
SDDLNTVTVET

SEQ ID NO: 202157 - protein, 11 aa, Borrelia Burgdorferi
DDLNTVTVETF

SEQ ID NO: 202158 - protein, 11 aa, Borrelia Burgdorferi
DLNTVTVETFD

SEQ ID NO: 202159 - protein, 11 aa, Borrelia Burgdorferi
LNTVTVETFDS

SEQ ID NO: 202160 - protein, 11 aa, Borrelia Burgdorferi
NTVTVETFDSS

SEQ ID NO: 202161 - protein, 11 aa, Borrelia Burgdorferi
TVTVETFDSSG

SEQ ID NO: 202162 - protein, 11 aa, Borrelia Burgdorferi
VTVETFDSSGK

SEQ ID NO: 202163 - protein, 11 aa, Borrelia Burgdorferi
TVETFDSSGKK

SEQ ID NO: 202164 - protein, 11 aa, Borrelia Burgdorferi
VETFDSSGKKD

SEQ ID NO: 202165 - protein, 11 aa, Borrelia Burgdorferi
ETFDSSGKKDS

SEQ ID NO: 202166 - protein, 11 aa, Borrelia Burgdorferi
TFDSSGKKDSS

SEQ ID NO: 202167 - protein, 11 aa, Borrelia Burgdorferi
FDSSGKKDSSK

SEQ ID NO: 202168 - protein, 11 aa, Borrelia Burgdorferi
DSSGKKDSSKV

SEQ ID NO: 202169 - protein, 11 aa, Borrelia Burgdorferi
SSGKKDSSKVT

SEQ ID NO: 202170 - protein, 11 aa, Borrelia Burgdorferi
SGKKDSSKVTV

SEQ ID NO: 202171 - protein, 11 aa, Borrelia Burgdorferi
GKKDSSKVTVK

SEQ ID NO: 202172 - protein, 11 aa, Borrelia Burgdorferi
KKDSSKVTVKH

SEQ ID NO: 202173 - protein, 11 aa, Borrelia Burgdorferi
KDSSKVTVKHG

SEQ ID NO: 202174 - protein, 11 aa, Borrelia Burgdorferi
DSSKVTVKHGS

SEQ ID NO: 202175 - protein, 11 aa, Borrelia Burgdorferi
SSKVTVKHGSI

SEQ ID NO: 202176 - protein, 11 aa, Borrelia Burgdorferi
SKVTVKHGSIT

SEQ ID NO: 202177 - protein, 11 aa, Borrelia Burgdorferi
KVTVKHGSITE

SEQ ID NO: 202178 - protein, 11 aa, Borrelia Burgdorferi
VTVKHGSITED

SEQ ID NO: 202179 - protein, 11 aa, Borrelia Burgdorferi
TVKHGSITEDT

SEQ ID NO: 202180 - protein, 11 aa, Borrelia Burgdorferi
VKHGSITEDTF

SEQ ID NO: 202181 - protein, 11 aa, Borrelia Burgdorferi
KHGSITEDTFK

SEQ ID NO: 202182 - protein, 11 aa, Borrelia Burgdorferi
HGSITEDTFKA

SEQ ID NO: 202183 - protein, 11 aa, Borrelia Burgdorferi
GSITEDTFKAN

SEQ ID NO: 202184 - protein, 11 aa, Borrelia Burgdorferi
SITEDTFKANK

SEQ ID NO: 202185 - protein, 11 aa, Borrelia Burgdorferi
ITEDTFKANKL

SEQ ID NO: 202186 - protein, 11 aa, Borrelia Burgdorferi
TEDTFKANKLD

SEQ ID NO: 202187 - protein, 11 aa, Borrelia Burgdorferi
EDTFKANKLDS

SEQ ID NO: 202188 - protein, 11 aa, Borrelia Burgdorferi
DTFKANKLDSK

SEQ ID NO: 202189 - protein, 11 aa, Borrelia Burgdorferi
TFKANKLDSKK

SEQ ID NO: 202190 - protein, 11 aa, Borrelia Burgdorferi
FKANKLDSKKL

SEQ ID NO: 202191 - protein, 11 aa, Borrelia Burgdorferi
KANKLDSKKLT

SEQ ID NO: 202192 - protein, 11 aa, Borrelia Burgdorferi
ANKLDSKKLTR

SEQ ID NO: 202193 - protein, 11 aa, Borrelia Burgdorferi
NKLDSKKLTRS

SEQ ID NO: 202194 - protein, 11 aa, Borrelia Burgdorferi
KLDSKKLTRSN

SEQ ID NO: 202195 - protein, 11 aa, Borrelia Burgdorferi
LDSKKLTRSNG

SEQ ID NO: 202196 - protein, 11 aa, Borrelia Burgdorferi
DSKKLTRSNGT

SEQ ID NO: 202197 - protein, 11 aa, Borrelia Burgdorferi
SKKLTRSNGTM

SEQ ID NO: 202198 - protein, 11 aa, Borrelia Burgdorferi
KKLTRSNGTML

SEQ ID NO: 202199 - protein, 11 aa, Borrelia Burgdorferi
KLTRSNGTMLE

SEQ ID NO: 202200 - protein, 11 aa, Borrelia Burgdorferi
LTRSNGTMLEY

SEQ ID NO: 202201 - protein, 11 aa, Borrelia Burgdorferi
TRSNGTMLEYS

SEQ ID NO: 202202 - protein, 11 aa, Borrelia Burgdorferi
RSNGTMLEYSQ

SEQ ID NO: 202203 - protein, 11 aa, Borrelia Burgdorferi
SNGTMLEYSQM

SEQ ID NO: 202204 - protein, 11 aa, Borrelia Burgdorferi
NGTMLEYSQMT

SEQ ID NO: 202205 - protein, 11 aa, Borrelia Burgdorferi
GTMLEYSQMTD

SEQ ID NO: 202206 - protein, 11 aa, Borrelia Burgdorferi
TMLEYSQMTDA

SEQ ID NO: 202207 - protein, 11 aa, Borrelia Burgdorferi
MLEYSQMTDAD

SEQ ID NO: 202208 - protein, 11 aa, Borrelia Burgdorferi
LEYSQMTDADN

SEQ ID NO: 202209 - protein, 11 aa, Borrelia Burgdorferi
EYSQMTDADNA

SEQ ID NO: 202210 - protein, 11 aa, Borrelia Burgdorferi
YSQMTDADNAT

SEQ ID NO: 202211 - protein, 11 aa, Borrelia Burgdorferi
SQMTDADNATK

SEQ ID NO: 202212 - protein, 11 aa, Borrelia Burgdorferi
QMTDADNATKA

SEQ ID NO: 202213 - protein, 11 aa, Borrelia Burgdorferi
MTDADNATKAV

SEQ ID NO: 202214 - protein, 11 aa, Borrelia Burgdorferi
TDADNATKAVE

SEQ ID NO: 202215 - protein, 11 aa, Borrelia Burgdorferi
DADNATKAVET

SEQ ID NO: 202216 - protein, 11 aa, Borrelia Burgdorferi
ADNATKAVETL

SEQ ID NO: 202217 - protein, 11 aa, Borrelia Burgdorferi
DNATKAVETLK

SEQ ID NO: 202218 - protein, 11 aa, Borrelia Burgdorferi
NATKAVETLKN

SEQ ID NO: 202219 - protein, 13 aa, Borrelia Burgdorferi
MRLYLTGFALALA

SEQ ID NO: 202220 - protein, 13 aa, Borrelia Burgdorferi
RLYLTGFALALAL

SEQ ID NO: 202221 - protein, 13 aa, Borrelia Burgdorferi
LYLTGFALALALI

SEQ ID NO: 202222 - protein, 13 aa, Borrelia Burgdorferi
YLTGFALALALIG

SEQ ID NO: 202223 - protein, 13 aa, Borrelia Burgdorferi
LTGFALALALIGC

SEQ ID NO: 202224 - protein, 13 aa, Borrelia Burgdorferi
TGFALALALIGCA

SEQ ID NO: 202225 - protein, 13 aa, Borrelia Burgdorferi
GFALALALIGCAQ

SEQ ID NO: 202226 - protein, 13 aa, Borrelia Burgdorferi
FALALALIGCAQK

SEQ ID NO: 202227 - protein, 13 aa, Borrelia Burgdorferi
ALALALIGCAQKG

SEQ ID NO: 202228 - protein, 13 aa, Borrelia Burgdorferi
LALALIGCAQKGA

SEQ ID NO: 202229 - protein, 13 aa, Borrelia Burgdorferi
ALALIGCAQKGAE

SEQ ID NO: 202230 - protein, 13 aa, Borrelia Burgdorferi
LALIGCAQKGAEP

SEQ ID NO: 202231 - protein, 13 aa, Borrelia Burgdorferi
ALIGCAQKGAEPK

SEQ ID NO: 202232 - protein, 13 aa, Borrelia Burgdorferi
LIGCAQKGAEPKN

SEQ ID NO: 202233 - protein, 13 aa, Borrelia Burgdorferi
IGCAQKGAEPKNT

SEQ ID NO: 202234 - protein, 13 aa, Borrelia Burgdorferi
GCAQKGAEPKNTS

SEQ ID NO: 202235 - protein, 13 aa, Borrelia Burgdorferi
CAQKGAEPKNTSQ

SEQ ID NO: 202236 - protein, 13 aa, Borrelia Burgdorferi
AQKGAEPKNTSQK

SEQ ID NO: 202237 - protein, 13 aa, Borrelia Burgdorferi
QKGAEPKNTSQKY

SEQ ID NO: 202238 - protein, 13 aa, Borrelia Burgdorferi
KGAEPKNTSQKYD

SEQ ID NO: 202239 - protein, 13 aa, Borrelia Burgdorferi
GAEPKNTSQKYDD

SEQ ID NO: 202240 - protein, 13 aa, Borrelia Burgdorferi
AEPKNTSQKYDDQ

SEQ ID NO: 202241 - protein, 13 aa, Borrelia Burgdorferi
EPKNTSQKYDDQE

SEQ ID NO: 202242 - protein, 13 aa, Borrelia Burgdorferi
PKNTSQKYDDQEV

SEQ ID NO: 202243 - protein, 13 aa, Borrelia Burgdorferi
KNTSQKYDDQEVI

SEQ ID NO: 202244 - protein, 13 aa, Borrelia Burgdorferi
NTSQKYDDQEVIN

SEQ ID NO: 202245 - protein, 13 aa, Borrelia Burgdorferi
TSQKYDDQEVINS

SEQ ID NO: 202246 - protein, 13 aa, Borrelia Burgdorferi
SQKYDDQEVINSN

SEQ ID NO: 202247 - protein, 13 aa, Borrelia Burgdorferi
QKYDDQEVINSNK

SEQ ID NO: 202248 - protein, 13 aa, Borrelia Burgdorferi
KYDDQEVINSNKA

SEQ ID NO: 202249 - protein, 13 aa, Borrelia Burgdorferi
YDDQEVINSNKAP

SEQ ID NO: 202250 - protein, 13 aa, Borrelia Burgdorferi
DDQEVINSNKAPK

SEQ ID NO: 202251 - protein, 13 aa, Borrelia Burgdorferi
DQEVINSNKAPKD

SEQ ID NO: 202252 - protein, 13 aa, Borrelia Burgdorferi
QEVINSNKAPKDA

SEQ ID NO: 202253 - protein, 13 aa, Borrelia Burgdorferi
EVINSNKAPKDAK

SEQ ID NO: 202254 - protein, 13 aa, Borrelia Burgdorferi
VINSNKAPKDAKQ

SEQ ID NO: 202255 - protein, 13 aa, Borrelia Burgdorferi
INSNKAPKDAKQT

SEQ ID NO: 202256 - protein, 13 aa, Borrelia Burgdorferi
NSNKAPKDAKQTP

SEQ ID NO: 202257 - protein, 13 aa, Borrelia Burgdorferi
SNKAPKDAKQTPP

SEQ ID NO: 202258 - protein, 13 aa, Borrelia Burgdorferi
NKAPKDAKQTPPA

SEQ ID NO: 202259 - protein, 13 aa, Borrelia Burgdorferi
KAPKDAKQTPPAA

SEQ ID NO: 202260 - protein, 13 aa, Borrelia Burgdorferi
APKDAKQTPPAAA

SEQ ID NO: 202261 - protein, 13 aa, Borrelia Burgdorferi
PKDAKQTPPAAAE

SEQ ID NO: 202262 - protein, 13 aa, Borrelia Burgdorferi
KDAKQTPPAAAED

SEQ ID NO: 202263 - protein, 13 aa, Borrelia Burgdorferi
DAKQTPPAAAEDS

SEQ ID NO: 202264 - protein, 13 aa, Borrelia Burgdorferi
AKQTPPAAAEDSV

SEQ ID NO: 202265 - protein, 13 aa, Borrelia Burgdorferi
KQTPPAAAEDSVT

SEQ ID NO: 202266 - protein, 13 aa, Borrelia Burgdorferi
QTPPAAAEDSVTL

SEQ ID NO: 202267 - protein, 13 aa, Borrelia Burgdorferi
TPPAAAEDSVTLF

SEQ ID NO: 202268 - protein, 13 aa, Borrelia Burgdorferi
PPAAAEDSVTLFS

SEQ ID NO: 202269 - protein, 13 aa, Borrelia Burgdorferi
PAAAEDSVTLFSG

SEQ ID NO: 202270 - protein, 13 aa, Borrelia Burgdorferi
AAAEDSVTLFSGN

SEQ ID NO: 202271 - protein, 13 aa, Borrelia Burgdorferi
AAEDSVTLFSGNE

SEQ ID NO: 202272 - protein, 13 aa, Borrelia Burgdorferi
AEDSVTLFSGNEI

SEQ ID NO: 202273 - protein, 13 aa, Borrelia Burgdorferi
EDSVTLFSGNEIF

SEQ ID NO: 202274 - protein, 13 aa, Borrelia Burgdorferi
DSVTLFSGNEIFV

SEQ ID NO: 202275 - protein, 13 aa, Borrelia Burgdorferi
SVTLFSGNEIFVS

SEQ ID NO: 202276 - protein, 13 aa, Borrelia Burgdorferi
VTLFSGNEIFVSK

SEQ ID NO: 202277 - protein, 13 aa, Borrelia Burgdorferi
TLFSGNEIFVSKE

SEQ ID NO: 202278 - protein, 13 aa, Borrelia Burgdorferi
LFSGNEIFVSKEK

SEQ ID NO: 202279 - protein, 13 aa, Borrelia Burgdorferi
FSGNEIFVSKEKN

SEQ ID NO: 202280 - protein, 13 aa, Borrelia Burgdorferi
SGNEIFVSKEKNS

SEQ ID NO: 202281 - protein, 13 aa, Borrelia Burgdorferi
GNEIFVSKEKNSS

SEQ ID NO: 202282 - protein, 13 aa, Borrelia Burgdorferi
NEIFVSKEKNSSG

SEQ ID NO: 202283 - protein, 13 aa, Borrelia Burgdorferi
EIFVSKEKNSSGK

SEQ ID NO: 202284 - protein, 13 aa, Borrelia Burgdorferi
IFVSKEKNSSGKY

SEQ ID NO: 202285 - protein, 13 aa, Borrelia Burgdorferi
FVSKEKNSSGKYD

SEQ ID NO: 202286 - protein, 13 aa, Borrelia Burgdorferi
VSKEKNSSGKYDL

SEQ ID NO: 202287 - protein, 13 aa, Borrelia Burgdorferi
SKEKNSSGKYDLR

SEQ ID NO: 202288 - protein, 13 aa, Borrelia Burgdorferi
KEKNSSGKYDLRT

SEQ ID NO: 202289 - protein, 13 aa, Borrelia Burgdorferi
EKNSSGKYDLRTT

SEQ ID NO: 202290 - protein, 13 aa, Borrelia Burgdorferi
KNSSGKYDLRTTI

SEQ ID NO: 202291 - protein, 13 aa, Borrelia Burgdorferi
NSSGKYDLRTTIN

SEQ ID NO: 202292 - protein, 13 aa, Borrelia Burgdorferi
SSGKYDLRTTINQ

SEQ ID NO: 202293 - protein, 13 aa, Borrelia Burgdorferi
SGKYDLRTTINQV

SEQ ID NO: 202294 - protein, 13 aa, Borrelia Burgdorferi
GKYDLRTTINQVE

SEQ ID NO: 202295 - protein, 13 aa, Borrelia Burgdorferi
KYDLRTTINQVEL

SEQ ID NO: 202296 - protein, 13 aa, Borrelia Burgdorferi
YDLRTTINQVELK

SEQ ID NO: 202297 - protein, 13 aa, Borrelia Burgdorferi
DLRTTINQVELKG

SEQ ID NO: 202298 - protein, 13 aa, Borrelia Burgdorferi
LRTTINQVELKGT

SEQ ID NO: 202299 - protein, 13 aa, Borrelia Burgdorferi
RTTINQVELKGTS

SEQ ID NO: 202300 - protein, 13 aa, Borrelia Burgdorferi
TTINQVELKGTSD

SEQ ID NO: 202301 - protein, 13 aa, Borrelia Burgdorferi
TINQVELKGTSDK

SEQ ID NO: 202302 - protein, 13 aa, Borrelia Burgdorferi
INQVELKGTSDKN

SEQ ID NO: 202303 - protein, 13 aa, Borrelia Burgdorferi
NQVELKGTSDKNN

SEQ ID NO: 202304 - protein, 13 aa, Borrelia Burgdorferi
QVELKGTSDKNNG

SEQ ID NO: 202305 - protein, 13 aa, Borrelia Burgdorferi
VELKGTSDKNNGS

SEQ ID NO: 202306 - protein, 13 aa, Borrelia Burgdorferi
ELKGTSDKNNGSG

SEQ ID NO: 202307 - protein, 13 aa, Borrelia Burgdorferi
LKGTSDKNNGSGS

SEQ ID NO: 202308 - protein, 13 aa, Borrelia Burgdorferi
KGTSDKNNGSGSL

SEQ ID NO: 202309 - protein, 13 aa, Borrelia Burgdorferi
GTSDKNNGSGSLE

SEQ ID NO: 202310 - protein, 13 aa, Borrelia Burgdorferi
TSDKNNGSGSLEG

SEQ ID NO: 202311 - protein, 13 aa, Borrelia Burgdorferi
SDKNNGSGSLEGV

SEQ ID NO: 202312 - protein, 13 aa, Borrelia Burgdorferi
DKNNGSGSLEGVK

SEQ ID NO: 202313 - protein, 13 aa, Borrelia Burgdorferi
KNNGSGSLEGVKA

SEQ ID NO: 202314 - protein, 13 aa, Borrelia Burgdorferi
NNGSGSLEGVKAD

SEQ ID NO: 202315 - protein, 13 aa, Borrelia Burgdorferi
NGSGSLEGVKADK

SEQ ID NO: 202316 - protein, 13 aa, Borrelia Burgdorferi
GSGSLEGVKADKS

SEQ ID NO: 202317 - protein, 13 aa, Borrelia Burgdorferi
SGSLEGVKADKSK

SEQ ID NO: 202318 - protein, 13 aa, Borrelia Burgdorferi
GSLEGVKADKSKV

SEQ ID NO: 202319 - protein, 13 aa, Borrelia Burgdorferi
SLEGVKADKSKVK

SEQ ID NO: 202320 - protein, 13 aa, Borrelia Burgdorferi
LEGVKADKSKVKL

SEQ ID NO: 202321 - protein, 13 aa, Borrelia Burgdorferi
EGVKADKSKVKLI

SEQ ID NO: 202322 - protein, 13 aa, Borrelia Burgdorferi
GVKADKSKVKLIV

SEQ ID NO: 202323 - protein, 13 aa, Borrelia Burgdorferi
VKADKSKVKLIVS

SEQ ID NO: 202324 - protein, 13 aa, Borrelia Burgdorferi
KADKSKVKLIVSD

SEQ ID NO: 202325 - protein, 13 aa, Borrelia Burgdorferi
ADKSKVKLIVSDD

SEQ ID NO: 202326 - protein, 13 aa, Borrelia Burgdorferi
DKSKVKLIVSDDL

SEQ ID NO: 202327 - protein, 13 aa, Borrelia Burgdorferi
KSKVKLIVSDDLN

SEQ ID NO: 202328 - protein, 13 aa, Borrelia Burgdorferi
SKVKLIVSDDLNT

SEQ ID NO: 202329 - protein, 13 aa, Borrelia Burgdorferi
KVKLIVSDDLNTV

SEQ ID NO: 202330 - protein, 13 aa, Borrelia Burgdorferi
VKLIVSDDLNTVT

SEQ ID NO: 202331 - protein, 13 aa, Borrelia Burgdorferi
KLIVSDDLNTVTV

SEQ ID NO: 202332 - protein, 13 aa, Borrelia Burgdorferi
LIVSDDLNTVTVE

SEQ ID NO: 202333 - protein, 13 aa, Borrelia Burgdorferi
IVSDDLNTVTVET

SEQ ID NO: 202334 - protein, 13 aa, Borrelia Burgdorferi
VSDDLNTVTVETF

SEQ ID NO: 202335 - protein, 13 aa, Borrelia Burgdorferi
SDDLNTVTVETFD

SEQ ID NO: 202336 - protein, 13 aa, Borrelia Burgdorferi
DDLNTVTVETFDS

SEQ ID NO: 202337 - protein, 13 aa, Borrelia Burgdorferi
DLNTVTVETFDSS

SEQ ID NO: 202338 - protein, 13 aa, Borrelia Burgdorferi
LNTVTVETFDSSG

SEQ ID NO: 202339 - protein, 13 aa, Borrelia Burgdorferi
NTVTVETFDSSGK

SEQ ID NO: 202340 - protein, 13 aa, Borrelia Burgdorferi
TVTVETFDSSGKK

SEQ ID NO: 202341 - protein, 13 aa, Borrelia Burgdorferi
VTVETFDSSGKKD

SEQ ID NO: 202342 - protein, 13 aa, Borrelia Burgdorferi
TVETFDSSGKKDS

SEQ ID NO: 202343 - protein, 13 aa, Borrelia Burgdorferi
VETFDSSGKKDSS

SEQ ID NO: 202344 - protein, 13 aa, Borrelia Burgdorferi
ETFDSSGKKDSSK

SEQ ID NO: 202345 - protein, 13 aa, Borrelia Burgdorferi
TFDSSGKKDSSKV

SEQ ID NO: 202346 - protein, 13 aa, Borrelia Burgdorferi
FDSSGKKDSSKVT

SEQ ID NO: 202347 - protein, 13 aa, Borrelia Burgdorferi
DSSGKKDSSKVTV

SEQ ID NO: 202348 - protein, 13 aa, Borrelia Burgdorferi
SSGKKDSSKVTVK

SEQ ID NO: 202349 - protein, 13 aa, Borrelia Burgdorferi
SGKKDSSKVTVKH

SEQ ID NO: 202350 - protein, 13 aa, Borrelia Burgdorferi
GKKDSSKVTVKHG

SEQ ID NO: 202351 - protein, 13 aa, Borrelia Burgdorferi
KKDSSKVTVKHGS

SEQ ID NO: 202352 - protein, 13 aa, Borrelia Burgdorferi
KDSSKVTVKHGSI

SEQ ID NO: 202353 - protein, 13 aa, Borrelia Burgdorferi
DSSKVTVKHGSIT

SEQ ID NO: 202354 - protein, 13 aa, Borrelia Burgdorferi
SSKVTVKHGSITE

SEQ ID NO: 202355 - protein, 13 aa, Borrelia Burgdorferi
SKVTVKHGSITED

SEQ ID NO: 202356 - protein, 13 aa, Borrelia Burgdorferi
KVTVKHGSITEDT

SEQ ID NO: 202357 - protein, 13 aa, Borrelia Burgdorferi
VTVKHGSITEDTF

SEQ ID NO: 202358 - protein, 13 aa, Borrelia Burgdorferi
TVKHGSITEDTFK

SEQ ID NO: 202359 - protein, 13 aa, Borrelia Burgdorferi
VKHGSITEDTFKA

SEQ ID NO: 202360 - protein, 13 aa, Borrelia Burgdorferi
KHGSITEDTFKAN

SEQ ID NO: 202361 - protein, 13 aa, Borrelia Burgdorferi
HGSITEDTFKANK

SEQ ID NO: 202362 - protein, 13 aa, Borrelia Burgdorferi
GSITEDTFKANKL

SEQ ID NO: 202363 - protein, 13 aa, Borrelia Burgdorferi
SITEDTFKANKLD

SEQ ID NO: 202364 - protein, 13 aa, Borrelia Burgdorferi
ITEDTFKANKLDS

SEQ ID NO: 202365 - protein, 13 aa, Borrelia Burgdorferi
TEDTFKANKLDSK

SEQ ID NO: 202366 - protein, 13 aa, Borrelia Burgdorferi
EDTFKANKLDSKK

SEQ ID NO: 202367 - protein, 13 aa, Borrelia Burgdorferi
DTFKANKLDSKKL

SEQ ID NO: 202368 - protein, 13 aa, Borrelia Burgdorferi
TFKANKLDSKKLT

SEQ ID NO: 202369 - protein, 13 aa, Borrelia Burgdorferi
FKANKLDSKKLTR

SEQ ID NO: 202370 - protein, 13 aa, Borrelia Burgdorferi
KANKLDSKKLTRS

SEQ ID NO: 202371 - protein, 13 aa, Borrelia Burgdorferi
ANKLDSKKLTRSN

SEQ ID NO: 202372 - protein, 13 aa, Borrelia Burgdorferi
NKLDSKKLTRSNG

SEQ ID NO: 202373 - protein, 13 aa, Borrelia Burgdorferi
KLDSKKLTRSNGT

SEQ ID NO: 202374 - protein, 13 aa, Borrelia Burgdorferi
LDSKKLTRSNGTM

SEQ ID NO: 202375 - protein, 13 aa, Borrelia Burgdorferi
DSKKLTRSNGTML

SEQ ID NO: 202376 - protein, 13 aa, Borrelia Burgdorferi
SKKLTRSNGTMLE

SEQ ID NO: 202377 - protein, 13 aa, Borrelia Burgdorferi
KKLTRSNGTMLEY

SEQ ID NO: 202378 - protein, 13 aa, Borrelia Burgdorferi
KLTRSNGTMLEYS

SEQ ID NO: 202379 - protein, 13 aa, Borrelia Burgdorferi
LTRSNGTMLEYSQ

SEQ ID NO: 202380 - protein, 13 aa, Borrelia Burgdorferi
TRSNGTMLEYSQM

SEQ ID NO: 202381 - protein, 13 aa, Borrelia Burgdorferi
RSNGTMLEYSQMT

SEQ ID NO: 202382 - protein, 13 aa, Borrelia Burgdorferi
SNGTMLEYSQMTD

SEQ ID NO: 202383 - protein, 13 aa, Borrelia Burgdorferi
NGTMLEYSQMTDA

SEQ ID NO: 202384 - protein, 13 aa, Borrelia Burgdorferi
GTMLEYSQMTDAD

SEQ ID NO: 202385 - protein, 13 aa, Borrelia Burgdorferi
TMLEYSQMTDADN

SEQ ID NO: 202386 - protein, 13 aa, Borrelia Burgdorferi
MLEYSQMTDADNA

SEQ ID NO: 202387 - protein, 13 aa, Borrelia Burgdorferi
LEYSQMTDADNAT

SEQ ID NO: 202388 - protein, 13 aa, Borrelia Burgdorferi
EYSQMTDADNATK

SEQ ID NO: 202389 - protein, 13 aa, Borrelia Burgdorferi
YSQMTDADNATKA

SEQ ID NO: 202390 - protein, 13 aa, Borrelia Burgdorferi
SQMTDADNATKAV

SEQ ID NO: 202391 - protein, 13 aa, Borrelia Burgdorferi
QMTDADNATKAVE

SEQ ID NO: 202392 - protein, 13 aa, Borrelia Burgdorferi
MTDADNATKAVET

SEQ ID NO: 202393 - protein, 13 aa, Borrelia Burgdorferi
TDADNATKAVETL

SEQ ID NO: 202394 - protein, 13 aa, Borrelia Burgdorferi
DADNATKAVETLK

SEQ ID NO: 202395 - protein, 13 aa, Borrelia Burgdorferi
ADNATKAVETLKN

SEQ ID NO: 202396 - protein, 14 aa, Borrelia Burgdorferi
MRLYLTGFALALAL

SEQ ID NO: 202397 - protein, 14 aa, Borrelia Burgdorferi
RLYLTGFALALALI

SEQ ID NO: 202398 - protein, 14 aa, Borrelia Burgdorferi
LYLTGFALALALIG

SEQ ID NO: 202399 - protein, 14 aa, Borrelia Burgdorferi
YLTGFALALALIGC

SEQ ID NO: 202400 - protein, 14 aa, Borrelia Burgdorferi
LTGFALALALIGCA

SEQ ID NO: 202401 - protein, 14 aa, Borrelia Burgdorferi
TGFALALALIGCAQ

SEQ ID NO: 202402 - protein, 14 aa, Borrelia Burgdorferi
GFALALALIGCAQK

SEQ ID NO: 202403 - protein, 14 aa, Borrelia Burgdorferi
FALALALIGCAQKG

SEQ ID NO: 202404 - protein, 14 aa, Borrelia Burgdorferi
ALALALIGCAQKGA

SEQ ID NO: 202405 - protein, 14 aa, Borrelia Burgdorferi
LALALIGCAQKGAE

SEQ ID NO: 202406 - protein, 14 aa, Borrelia Burgdorferi
ALALIGCAQKGAEP

SEQ ID NO: 202407 - protein, 14 aa, Borrelia Burgdorferi
LALIGCAQKGAEPK

SEQ ID NO: 202408 - protein, 14 aa, Borrelia Burgdorferi
ALIGCAQKGAEPKN

SEQ ID NO: 202409 - protein, 14 aa, Borrelia Burgdorferi
LIGCAQKGAEPKNT

SEQ ID NO: 202410 - protein, 14 aa, Borrelia Burgdorferi
IGCAQKGAEPKNTS

SEQ ID NO: 202411 - protein, 14 aa, Borrelia Burgdorferi
GCAQKGAEPKNTSQ

SEQ ID NO: 202412 - protein, 14 aa, Borrelia Burgdorferi
CAQKGAEPKNTSQK

SEQ ID NO: 202413 - protein, 14 aa, Borrelia Burgdorferi
AQKGAEPKNTSQKY

SEQ ID NO: 202414 - protein, 14 aa, Borrelia Burgdorferi
QKGAEPKNTSQKYD

SEQ ID NO: 202415 - protein, 14 aa, Borrelia Burgdorferi
KGAEPKNTSQKYDD

SEQ ID NO: 202416 - protein, 14 aa, Borrelia Burgdorferi
GAEPKNTSQKYDDQ

SEQ ID NO: 202417 - protein, 14 aa, Borrelia Burgdorferi
AEPKNTSQKYDDQE

SEQ ID NO: 202418 - protein, 14 aa, Borrelia Burgdorferi
EPKNTSQKYDDQEV

SEQ ID NO: 202419 - protein, 14 aa, Borrelia Burgdorferi
PKNTSQKYDDQEVI

SEQ ID NO: 202420 - protein, 14 aa, Borrelia Burgdorferi
KNTSQKYDDQEVIN

SEQ ID NO: 202421 - protein, 14 aa, Borrelia Burgdorferi
NTSQKYDDQEVINS

SEQ ID NO: 202422 - protein, 14 aa, Borrelia Burgdorferi
TSQKYDDQEVINSN

SEQ ID NO: 202423 - protein, 14 aa, Borrelia Burgdorferi
SQKYDDQEVINSNK

SEQ ID NO: 202424 - protein, 14 aa, Borrelia Burgdorferi
QKYDDQEVINSNKA

SEQ ID NO: 202425 - protein, 14 aa, Borrelia Burgdorferi
KYDDQEVINSNKAP

SEQ ID NO: 202426 - protein, 14 aa, Borrelia Burgdorferi
YDDQEVINSNKAPK

SEQ ID NO: 202427 - protein, 14 aa, Borrelia Burgdorferi
DDQEVINSNKAPKD

SEQ ID NO: 202428 - protein, 14 aa, Borrelia Burgdorferi
DQEVINSNKAPKDA

SEQ ID NO: 202429 - protein, 14 aa, Borrelia Burgdorferi
QEVINSNKAPKDAK

SEQ ID NO: 202430 - protein, 14 aa, Borrelia Burgdorferi
EVINSNKAPKDAKQ

SEQ ID NO: 202431 - protein, 14 aa, Borrelia Burgdorferi
VINSNKAPKDAKQT

SEQ ID NO: 202432 - protein, 14 aa, Borrelia Burgdorferi
INSNKAPKDAKQTP

SEQ ID NO: 202433 - protein, 14 aa, Borrelia Burgdorferi
NSNKAPKDAKQTPP

SEQ ID NO: 202434 - protein, 14 aa, Borrelia Burgdorferi
SNKAPKDAKQTPPA

SEQ ID NO: 202435 - protein, 14 aa, Borrelia Burgdorferi
NKAPKDAKQTPPAA

SEQ ID NO: 202436 - protein, 14 aa, Borrelia Burgdorferi
KAPKDAKQTPPAAA

SEQ ID NO: 202437 - protein, 14 aa, Borrelia Burgdorferi
APKDAKQTPPAAAE

SEQ ID NO: 202438 - protein, 14 aa, Borrelia Burgdorferi
PKDAKQTPPAAAED

SEQ ID NO: 202439 - protein, 14 aa, Borrelia Burgdorferi
KDAKQTPPAAAEDS

SEQ ID NO: 202440 - protein, 14 aa, Borrelia Burgdorferi
DAKQTPPAAAEDSV

SEQ ID NO: 202441 - protein, 14 aa, Borrelia Burgdorferi
AKQTPPAAAEDSVT

SEQ ID NO: 202442 - protein, 14 aa, Borrelia Burgdorferi
KQTPPAAAEDSVTL

SEQ ID NO: 202443 - protein, 14 aa, Borrelia Burgdorferi
QTPPAAAEDSVTLF

SEQ ID NO: 202444 - protein, 14 aa, Borrelia Burgdorferi
TPPAAAEDSVTLFS

SEQ ID NO: 202445 - protein, 14 aa, Borrelia Burgdorferi
PPAAAEDSVTLFSG

SEQ ID NO: 202446 - protein, 14 aa, Borrelia Burgdorferi
PAAAEDSVTLFSGN

SEQ ID NO: 202447 - protein, 14 aa, Borrelia Burgdorferi
AAAEDSVTLFSGNE

SEQ ID NO: 202448 - protein, 14 aa, Borrelia Burgdorferi
AAEDSVTLFSGNEI

SEQ ID NO: 202449 - protein, 14 aa, Borrelia Burgdorferi
AEDSVTLFSGNEIF

SEQ ID NO: 202450 - protein, 14 aa, Borrelia Burgdorferi
EDSVTLFSGNEIFV

SEQ ID NO: 202451 - protein, 14 aa, Borrelia Burgdorferi
DSVTLFSGNEIFVS

SEQ ID NO: 202452 - protein, 14 aa, Borrelia Burgdorferi
SVTLFSGNEIFVSK

SEQ ID NO: 202453 - protein, 14 aa, Borrelia Burgdorferi
VTLFSGNEIFVSKE

SEQ ID NO: 202454 - protein, 14 aa, Borrelia Burgdorferi
TLFSGNEIFVSKEK

SEQ ID NO: 202455 - protein, 14 aa, Borrelia Burgdorferi
LFSGNEIFVSKEKN

SEQ ID NO: 202456 - protein, 14 aa, Borrelia Burgdorferi
FSGNEIFVSKEKNS

SEQ ID NO: 202457 - protein, 14 aa, Borrelia Burgdorferi
SGNEIFVSKEKNSS

SEQ ID NO: 202458 - protein, 14 aa, Borrelia Burgdorferi
GNEIFVSKEKNSSG

SEQ ID NO: 202459 - protein, 14 aa, Borrelia Burgdorferi
NEIFVSKEKNSSGK

SEQ ID NO: 202460 - protein, 14 aa, Borrelia Burgdorferi
EIFVSKEKNSSGKY

SEQ ID NO: 202461 - protein, 14 aa, Borrelia Burgdorferi
IFVSKEKNSSGKYD

SEQ ID NO: 202462 - protein, 14 aa, Borrelia Burgdorferi
FVSKEKNSSGKYDL

SEQ ID NO: 202463 - protein, 14 aa, Borrelia Burgdorferi
VSKEKNSSGKYDLR

SEQ ID NO: 202464 - protein, 14 aa, Borrelia Burgdorferi
SKEKNSSGKYDLRT

SEQ ID NO: 202465 - protein, 14 aa, Borrelia Burgdorferi
KEKNSSGKYDLRTT

SEQ ID NO: 202466 - protein, 14 aa, Borrelia Burgdorferi
EKNSSGKYDLRTTI

SEQ ID NO: 202467 - protein, 14 aa, Borrelia Burgdorferi
KNSSGKYDLRTTIN

SEQ ID NO: 202468 - protein, 14 aa, Borrelia Burgdorferi
NSSGKYDLRTTINQ

SEQ ID NO: 202469 - protein, 14 aa, Borrelia Burgdorferi
SSGKYDLRTTINQV

SEQ ID NO: 202470 - protein, 14 aa, Borrelia Burgdorferi
SGKYDLRTTINQVE

SEQ ID NO: 202471 - protein, 14 aa, Borrelia Burgdorferi
GKYDLRTTINQVEL

SEQ ID NO: 202472 - protein, 14 aa, Borrelia Burgdorferi
KYDLRTTINQVELK

SEQ ID NO: 202473 - protein, 14 aa, Borrelia Burgdorferi
YDLRTTINQVELKG

SEQ ID NO: 202474 - protein, 14 aa, Borrelia Burgdorferi
DLRTTINQVELKGT

SEQ ID NO: 202475 - protein, 14 aa, Borrelia Burgdorferi
LRTTINQVELKGTS

SEQ ID NO: 202476 - protein, 14 aa, Borrelia Burgdorferi
RTTINQVELKGTSD

SEQ ID NO: 202477 - protein, 14 aa, Borrelia Burgdorferi
TTINQVELKGTSDK

SEQ ID NO: 202478 - protein, 14 aa, Borrelia Burgdorferi
TINQVELKGTSDKN

SEQ ID NO: 202479 - protein, 14 aa, Borrelia Burgdorferi
INQVELKGTSDKNN

SEQ ID NO: 202480 - protein, 14 aa, Borrelia Burgdorferi
NQVELKGTSDKNNG

SEQ ID NO: 202481 - protein, 14 aa, Borrelia Burgdorferi
QVELKGTSDKNNGS

SEQ ID NO: 202482 - protein, 14 aa, Borrelia Burgdorferi
VELKGTSDKNNGSG

SEQ ID NO: 202483 - protein, 14 aa, Borrelia Burgdorferi
ELKGTSDKNNGSGS

SEQ ID NO: 202484 - protein, 14 aa, Borrelia Burgdorferi
LKGTSDKNNGSGSL

SEQ ID NO: 202485 - protein, 14 aa, Borrelia Burgdorferi
KGTSDKNNGSGSLE

SEQ ID NO: 202486 - protein, 14 aa, Borrelia Burgdorferi
GTSDKNNGSGSLEG

SEQ ID NO: 202487 - protein, 14 aa, Borrelia Burgdorferi
TSDKNNGSGSLEGV

SEQ ID NO: 202488 - protein, 14 aa, Borrelia Burgdorferi
SDKNNGSGSLEGVK

SEQ ID NO: 202489 - protein, 14 aa, Borrelia Burgdorferi
DKNNGSGSLEGVKA

SEQ ID NO: 202490 - protein, 14 aa, Borrelia Burgdorferi
KNNGSGSLEGVKAD

SEQ ID NO: 202491 - protein, 14 aa, Borrelia Burgdorferi
NNGSGSLEGVKADK

SEQ ID NO: 202492 - protein, 14 aa, Borrelia Burgdorferi
NGSGSLEGVKADKS

SEQ ID NO: 202493 - protein, 14 aa, Borrelia Burgdorferi
GSGSLEGVKADKSK

SEQ ID NO: 202494 - protein, 14 aa, Borrelia Burgdorferi
SGSLEGVKADKSKV

SEQ ID NO: 202495 - protein, 14 aa, Borrelia Burgdorferi
GSLEGVKADKSKVK

SEQ ID NO: 202496 - protein, 14 aa, Borrelia Burgdorferi
SLEGVKADKSKVKL

SEQ ID NO: 202497 - protein, 14 aa, Borrelia Burgdorferi
LEGVKADKSKVKLI

SEQ ID NO: 202498 - protein, 14 aa, Borrelia Burgdorferi
EGVKADKSKVKLIV

SEQ ID NO: 202499 - protein, 14 aa, Borrelia Burgdorferi
GVKADKSKVKLIVS

SEQ ID NO: 202500 - protein, 14 aa, Borrelia Burgdorferi
VKADKSKVKLIVSD

SEQ ID NO: 202501 - protein, 14 aa, Borrelia Burgdorferi
KADKSKVKLIVSDD

SEQ ID NO: 202502 - protein, 14 aa, Borrelia Burgdorferi
ADKSKVKLIVSDDL

SEQ ID NO: 202503 - protein, 14 aa, Borrelia Burgdorferi
DKSKVKLIVSDDLN

SEQ ID NO: 202504 - protein, 14 aa, Borrelia Burgdorferi
KSKVKLIVSDDLNT

SEQ ID NO: 202505 - protein, 14 aa, Borrelia Burgdorferi
SKVKLIVSDDLNTV

SEQ ID NO: 202506 - protein, 14 aa, Borrelia Burgdorferi
KVKLIVSDDLNTVT

SEQ ID NO: 202507 - protein, 14 aa, Borrelia Burgdorferi
VKLIVSDDLNTVTV

SEQ ID NO: 202508 - protein, 14 aa, Borrelia Burgdorferi
KLIVSDDLNTVTVE

SEQ ID NO: 202509 - protein, 14 aa, Borrelia Burgdorferi
LIVSDDLNTVTVET

SEQ ID NO: 202510 - protein, 14 aa, Borrelia Burgdorferi
IVSDDLNTVTVETF

SEQ ID NO: 202511 - protein, 14 aa, Borrelia Burgdorferi
VSDDLNTVTVETFD

SEQ ID NO: 202512 - protein, 14 aa, Borrelia Burgdorferi
SDDLNTVTVETFDS

SEQ ID NO: 202513 - protein, 14 aa, Borrelia Burgdorferi
DDLNTVTVETFDSS

SEQ ID NO: 202514 - protein, 14 aa, Borrelia Burgdorferi
DLNTVTVETFDSSG

SEQ ID NO: 202515 - protein, 14 aa, Borrelia Burgdorferi
LNTVTVETFDSSGK

SEQ ID NO: 202516 - protein, 14 aa, Borrelia Burgdorferi
NTVTVETFDSSGKK

SEQ ID NO: 202517 - protein, 14 aa, Borrelia Burgdorferi
TVTVETFDSSGKKD

SEQ ID NO: 202518 - protein, 14 aa, Borrelia Burgdorferi
VTVETFDSSGKKDS

SEQ ID NO: 202519 - protein, 14 aa, Borrelia Burgdorferi
TVETFDSSGKKDSS

SEQ ID NO: 202520 - protein, 14 aa, Borrelia Burgdorferi
VETFDSSGKKDSSK

SEQ ID NO: 202521 - protein, 14 aa, Borrelia Burgdorferi
ETFDSSGKKDSSKV

SEQ ID NO: 202522 - protein, 14 aa, Borrelia Burgdorferi
TFDSSGKKDSSKVT

SEQ ID NO: 202523 - protein, 14 aa, Borrelia Burgdorferi
FDSSGKKDSSKVTV

SEQ ID NO: 202524 - protein, 14 aa, Borrelia Burgdorferi
DSSGKKDSSKVTVK

SEQ ID NO: 202525 - protein, 14 aa, Borrelia Burgdorferi
SSGKKDSSKVTVKH

SEQ ID NO: 202526 - protein, 14 aa, Borrelia Burgdorferi
SGKKDSSKVTVKHG

SEQ ID NO: 202527 - protein, 14 aa, Borrelia Burgdorferi
GKKDSSKVTVKHGS

SEQ ID NO: 202528 - protein, 14 aa, Borrelia Burgdorferi
KKDSSKVTVKHGSI

SEQ ID NO: 202529 - protein, 14 aa, Borrelia Burgdorferi
KDSSKVTVKHGSIT

SEQ ID NO: 202530 - protein, 14 aa, Borrelia Burgdorferi
DSSKVTVKHGSITE

SEQ ID NO: 202531 - protein, 14 aa, Borrelia Burgdorferi
SSKVTVKHGSITED

SEQ ID NO: 202532 - protein, 14 aa, Borrelia Burgdorferi
SKVTVKHGSITEDT

SEQ ID NO: 202533 - protein, 14 aa, Borrelia Burgdorferi
KVTVKHGSITEDTF

SEQ ID NO: 202534 - protein, 14 aa, Borrelia Burgdorferi
VTVKHGSITEDTFK

SEQ ID NO: 202535 - protein, 14 aa, Borrelia Burgdorferi
TVKHGSITEDTFKA

SEQ ID NO: 202536 - protein, 14 aa, Borrelia Burgdorferi
VKHGSITEDTFKAN

SEQ ID NO: 202537 - protein, 14 aa, Borrelia Burgdorferi
KHGSITEDTFKANK

SEQ ID NO: 202538 - protein, 14 aa, Borrelia Burgdorferi
HGSITEDTFKANKL

SEQ ID NO: 202539 - protein, 14 aa, Borrelia Burgdorferi
GSITEDTFKANKLD

SEQ ID NO: 202540 - protein, 14 aa, Borrelia Burgdorferi
SITEDTFKANKLDS

SEQ ID NO: 202541 - protein, 14 aa, Borrelia Burgdorferi
ITEDTFKANKLDSK

SEQ ID NO: 202542 - protein, 14 aa, Borrelia Burgdorferi
TEDTFKANKLDSKK

SEQ ID NO: 202543 - protein, 14 aa, Borrelia Burgdorferi
EDTFKANKLDSKKL

SEQ ID NO: 202544 - protein, 14 aa, Borrelia Burgdorferi
DTFKANKLDSKKLT

SEQ ID NO: 202545 - protein, 14 aa, Borrelia Burgdorferi
TFKANKLDSKKLTR

SEQ ID NO: 202546 - protein, 14 aa, Borrelia Burgdorferi
FKANKLDSKKLTRS

SEQ ID NO: 202547 - protein, 14 aa, Borrelia Burgdorferi
KANKLDSKKLTRSN

SEQ ID NO: 202548 - protein, 14 aa, Borrelia Burgdorferi
ANKLDSKKLTRSNG

SEQ ID NO: 202549 - protein, 14 aa, Borrelia Burgdorferi
NKLDSKKLTRSNGT

SEQ ID NO: 202550 - protein, 14 aa, Borrelia Burgdorferi
KLDSKKLTRSNGTM

SEQ ID NO: 202551 - protein, 14 aa, Borrelia Burgdorferi
LDSKKLTRSNGTML

SEQ ID NO: 202552 - protein, 14 aa, Borrelia Burgdorferi
DSKKLTRSNGTMLE

SEQ ID NO: 202553 - protein, 14 aa, Borrelia Burgdorferi
SKKLTRSNGTMLEY

SEQ ID NO: 202554 - protein, 14 aa, Borrelia Burgdorferi
KKLTRSNGTMLEYS

SEQ ID NO: 202555 - protein, 14 aa, Borrelia Burgdorferi
KLTRSNGTMLEYSQ

SEQ ID NO: 202556 - protein, 14 aa, Borrelia Burgdorferi
LTRSNGTMLEYSQM

SEQ ID NO: 202557 - protein, 14 aa, Borrelia Burgdorferi
TRSNGTMLEYSQMT

SEQ ID NO: 202558 - protein, 14 aa, Borrelia Burgdorferi
RSNGTMLEYSQMTD

SEQ ID NO: 202559 - protein, 14 aa, Borrelia Burgdorferi
SNGTMLEYSQMTDA

SEQ ID NO: 202560 - protein, 14 aa, Borrelia Burgdorferi
NGTMLEYSQMTDAD

SEQ ID NO: 202561 - protein, 14 aa, Borrelia Burgdorferi
GTMLEYSQMTDADN

SEQ ID NO: 202562 - protein, 14 aa, Borrelia Burgdorferi
TMLEYSQMTDADNA

SEQ ID NO: 202563 - protein, 14 aa, Borrelia Burgdorferi
MLEYSQMTDADNAT

SEQ ID NO: 202564 - protein, 14 aa, Borrelia Burgdorferi
LEYSQMTDADNATK

SEQ ID NO: 202565 - protein, 14 aa, Borrelia Burgdorferi
EYSQMTDADNATKA

SEQ ID NO: 202566 - protein, 14 aa, Borrelia Burgdorferi
YSQMTDADNATKAV

SEQ ID NO: 202567 - protein, 14 aa, Borrelia Burgdorferi
SQMTDADNATKAVE

SEQ ID NO: 202568 - protein, 14 aa, Borrelia Burgdorferi
QMTDADNATKAVET

SEQ ID NO: 202569 - protein, 14 aa, Borrelia Burgdorferi
MTDADNATKAVETL

SEQ ID NO: 202570 - protein, 14 aa, Borrelia Burgdorferi
TDADNATKAVETLK

SEQ ID NO: 202571 - protein, 14 aa, Borrelia Burgdorferi
DADNATKAVETLKN

SEQ ID NO: 202572 - protein, 15 aa, Borrelia Burgdorferi
MRLYLTGFALALALI

SEQ ID NO: 202573 - protein, 15 aa, Borrelia Burgdorferi
RLYLTGFALALALIG

SEQ ID NO: 202574 - protein, 15 aa, Borrelia Burgdorferi
LYLTGFALALALIGC

SEQ ID NO: 202575 - protein, 15 aa, Borrelia Burgdorferi
YLTGFALALALIGCA

SEQ ID NO: 202576 - protein, 15 aa, Borrelia Burgdorferi
LTGFALALALIGCAQ

SEQ ID NO: 202577 - protein, 15 aa, Borrelia Burgdorferi
TGFALALALIGCAQK

SEQ ID NO: 202578 - protein, 15 aa, Borrelia Burgdorferi
GFALALALIGCAQKG

SEQ ID NO: 202579 - protein, 15 aa, Borrelia Burgdorferi
FALALALIGCAQKGA

SEQ ID NO: 202580 - protein, 15 aa, Borrelia Burgdorferi
ALALALIGCAQKGAE

SEQ ID NO: 202581 - protein, 15 aa, Borrelia Burgdorferi
LALALIGCAQKGAEP

SEQ ID NO: 202582 - protein, 15 aa, Borrelia Burgdorferi
ALALIGCAQKGAEPK

SEQ ID NO: 202583 - protein, 15 aa, Borrelia Burgdorferi
LALIGCAQKGAEPKN

SEQ ID NO: 202584 - protein, 15 aa, Borrelia Burgdorferi
ALIGCAQKGAEPKNT

SEQ ID NO: 202585 - protein, 15 aa, Borrelia Burgdorferi
LIGCAQKGAEPKNTS

SEQ ID NO: 202586 - protein, 15 aa, Borrelia Burgdorferi
IGCAQKGAEPKNTSQ

SEQ ID NO: 202587 - protein, 15 aa, Borrelia Burgdorferi
GCAQKGAEPKNTSQK

SEQ ID NO: 202588 - protein, 15 aa, Borrelia Burgdorferi
CAQKGAEPKNTSQKY

SEQ ID NO: 202589 - protein, 15 aa, Borrelia Burgdorferi
AQKGAEPKNTSQKYD

SEQ ID NO: 202590 - protein, 15 aa, Borrelia Burgdorferi
QKGAEPKNTSQKYDD

SEQ ID NO: 202591 - protein, 15 aa, Borrelia Burgdorferi
KGAEPKNTSQKYDDQ

SEQ ID NO: 202592 - protein, 15 aa, Borrelia Burgdorferi
GAEPKNTSQKYDDQE

SEQ ID NO: 202593 - protein, 15 aa, Borrelia Burgdorferi
AEPKNTSQKYDDQEV

SEQ ID NO: 202594 - protein, 15 aa, Borrelia Burgdorferi
EPKNTSQKYDDQEVI

SEQ ID NO: 202595 - protein, 15 aa, Borrelia Burgdorferi
PKNTSQKYDDQEVIN

SEQ ID NO: 202596 - protein, 15 aa, Borrelia Burgdorferi
KNTSQKYDDQEVINS

SEQ ID NO: 202597 - protein, 15 aa, Borrelia Burgdorferi
NTSQKYDDQEVINSN

SEQ ID NO: 202598 - protein, 15 aa, Borrelia Burgdorferi
TSQKYDDQEVINSNK

SEQ ID NO: 202599 - protein, 15 aa, Borrelia Burgdorferi
SQKYDDQEVINSNKA

SEQ ID NO: 202600 - protein, 15 aa, Borrelia Burgdorferi
QKYDDQEVINSNKAP

SEQ ID NO: 202601 - protein, 15 aa, Borrelia Burgdorferi
KYDDQEVINSNKAPK

SEQ ID NO: 202602 - protein, 15 aa, Borrelia Burgdorferi
YDDQEVINSNKAPKD

SEQ ID NO: 202603 - protein, 15 aa, Borrelia Burgdorferi
DDQEVINSNKAPKDA

SEQ ID NO: 202604 - protein, 15 aa, Borrelia Burgdorferi
DQEVINSNKAPKDAK

SEQ ID NO: 202605 - protein, 15 aa, Borrelia Burgdorferi
QEVINSNKAPKDAKQ

SEQ ID NO: 202606 - protein, 15 aa, Borrelia Burgdorferi
EVINSNKAPKDAKQT

SEQ ID NO: 202607 - protein, 15 aa, Borrelia Burgdorferi
VINSNKAPKDAKQTP

SEQ ID NO: 202608 - protein, 15 aa, Borrelia Burgdorferi
INSNKAPKDAKQTPP

SEQ ID NO: 202609 - protein, 15 aa, Borrelia Burgdorferi
NSNKAPKDAKQTPPA

SEQ ID NO: 202610 - protein, 15 aa, Borrelia Burgdorferi
SNKAPKDAKQTPPAA

SEQ ID NO: 202611 - protein, 15 aa, Borrelia Burgdorferi
NKAPKDAKQTPPAAA

SEQ ID NO: 202612 - protein, 15 aa, Borrelia Burgdorferi
KAPKDAKQTPPAAAE

SEQ ID NO: 202613 - protein, 15 aa, Borrelia Burgdorferi
APKDAKQTPPAAAED

SEQ ID NO: 202614 - protein, 15 aa, Borrelia Burgdorferi
PKDAKQTPPAAAEDS

SEQ ID NO: 202615 - protein, 15 aa, Borrelia Burgdorferi
KDAKQTPPAAAEDSV

SEQ ID NO: 202616 - protein, 15 aa, Borrelia Burgdorferi
DAKQTPPAAAEDSVT

SEQ ID NO: 202617 - protein, 15 aa, Borrelia Burgdorferi
AKQTPPAAAEDSVTL

SEQ ID NO: 202618 - protein, 15 aa, Borrelia Burgdorferi
KQTPPAAAEDSVTLF

SEQ ID NO: 202619 - protein, 15 aa, Borrelia Burgdorferi
QTPPAAAEDSVTLFS

SEQ ID NO: 202620 - protein, 15 aa, Borrelia Burgdorferi
TPPAAAEDSVTLFSG

SEQ ID NO: 202621 - protein, 15 aa, Borrelia Burgdorferi
PPAAAEDSVTLFSGN

SEQ ID NO: 202622 - protein, 15 aa, Borrelia Burgdorferi
PAAAEDSVTLFSGNE

SEQ ID NO: 202623 - protein, 15 aa, Borrelia Burgdorferi
AAAEDSVTLFSGNEI

SEQ ID NO: 202624 - protein, 15 aa, Borrelia Burgdorferi
AAEDSVTLFSGNEIF

SEQ ID NO: 202625 - protein, 15 aa, Borrelia Burgdorferi
AEDSVTLFSGNEIFV

SEQ ID NO: 202626 - protein, 15 aa, Borrelia Burgdorferi
EDSVTLFSGNEIFVS

SEQ ID NO: 202627 - protein, 15 aa, Borrelia Burgdorferi
DSVTLFSGNEIFVSK

SEQ ID NO: 202628 - protein, 15 aa, Borrelia Burgdorferi
SVTLFSGNEIFVSKE

SEQ ID NO: 202629 - protein, 15 aa, Borrelia Burgdorferi
VTLFSGNEIFVSKEK

SEQ ID NO: 202630 - protein, 15 aa, Borrelia Burgdorferi
TLFSGNEIFVSKEKN

SEQ ID NO: 202631 - protein, 15 aa, Borrelia Burgdorferi
LFSGNEIFVSKEKNS

SEQ ID NO: 202632 - protein, 15 aa, Borrelia Burgdorferi
FSGNEIFVSKEKNSS

SEQ ID NO: 202633 - protein, 15 aa, Borrelia Burgdorferi
SGNEIFVSKEKNSSG

SEQ ID NO: 202634 - protein, 15 aa, Borrelia Burgdorferi
GNEIFVSKEKNSSGK

SEQ ID NO: 202635 - protein, 15 aa, Borrelia Burgdorferi
NEIFVSKEKNSSGKY

SEQ ID NO: 202636 - protein, 15 aa, Borrelia Burgdorferi
EIFVSKEKNSSGKYD

SEQ ID NO: 202637 - protein, 15 aa, Borrelia Burgdorferi
IFVSKEKNSSGKYDL

SEQ ID NO: 202638 - protein, 15 aa, Borrelia Burgdorferi
FVSKEKNSSGKYDLR

SEQ ID NO: 202639 - protein, 15 aa, Borrelia Burgdorferi
VSKEKNSSGKYDLRT

SEQ ID NO: 202640 - protein, 15 aa, Borrelia Burgdorferi
SKEKNSSGKYDLRTT

SEQ ID NO: 202641 - protein, 15 aa, Borrelia Burgdorferi
KEKNSSGKYDLRTTI

SEQ ID NO: 202642 - protein, 15 aa, Borrelia Burgdorferi
EKNSSGKYDLRTTIN

SEQ ID NO: 202643 - protein, 15 aa, Borrelia Burgdorferi
KNSSGKYDLRTTINQ

SEQ ID NO: 202644 - protein, 15 aa, Borrelia Burgdorferi
NSSGKYDLRTTINQV

SEQ ID NO: 202645 - protein, 15 aa, Borrelia Burgdorferi
SSGKYDLRTTINQVE

SEQ ID NO: 202646 - protein, 15 aa, Borrelia Burgdorferi
SGKYDLRTTINQVEL

SEQ ID NO: 202647 - protein, 15 aa, Borrelia Burgdorferi
GKYDLRTTINQVELK

SEQ ID NO: 202648 - protein, 15 aa, Borrelia Burgdorferi
KYDLRTTINQVELKG

SEQ ID NO: 202649 - protein, 15 aa, Borrelia Burgdorferi
YDLRTTINQVELKGT

SEQ ID NO: 202650 - protein, 15 aa, Borrelia Burgdorferi
DLRTTINQVELKGTS

SEQ ID NO: 202651 - protein, 15 aa, Borrelia Burgdorferi
LRTTINQVELKGTSD

SEQ ID NO: 202652 - protein, 15 aa, Borrelia Burgdorferi
RTTINQVELKGTSDK

SEQ ID NO: 202653 - protein, 15 aa, Borrelia Burgdorferi
TTINQVELKGTSDKN

SEQ ID NO: 202654 - protein, 15 aa, Borrelia Burgdorferi
TINQVELKGTSDKNN

SEQ ID NO: 202655 - protein, 15 aa, Borrelia Burgdorferi
INQVELKGTSDKNNG

SEQ ID NO: 202656 - protein, 15 aa, Borrelia Burgdorferi
NQVELKGTSDKNNGS

SEQ ID NO: 202657 - protein, 15 aa, Borrelia Burgdorferi
QVELKGTSDKNNGSG

SEQ ID NO: 202658 - protein, 15 aa, Borrelia Burgdorferi
VELKGTSDKNNGSGS

SEQ ID NO: 202659 - protein, 15 aa, Borrelia Burgdorferi
ELKGTSDKNNGSGSL

SEQ ID NO: 202660 - protein, 15 aa, Borrelia Burgdorferi
LKGTSDKNNGSGSLE

SEQ ID NO: 202661 - protein, 15 aa, Borrelia Burgdorferi
KGTSDKNNGSGSLEG

SEQ ID NO: 202662 - protein, 15 aa, Borrelia Burgdorferi
GTSDKNNGSGSLEGV

SEQ ID NO: 202663 - protein, 15 aa, Borrelia Burgdorferi
TSDKNNGSGSLEGVK

SEQ ID NO: 202664 - protein, 15 aa, Borrelia Burgdorferi
SDKNNGSGSLEGVKA

SEQ ID NO: 202665 - protein, 15 aa, Borrelia Burgdorferi
DKNNGSGSLEGVKAD

SEQ ID NO: 202666 - protein, 15 aa, Borrelia Burgdorferi
KNNGSGSLEGVKADK

SEQ ID NO: 202667 - protein, 15 aa, Borrelia Burgdorferi
NNGSGSLEGVKADKS

SEQ ID NO: 202668 - protein, 15 aa, Borrelia Burgdorferi
NGSGSLEGVKADKSK

SEQ ID NO: 202669 - protein, 15 aa, Borrelia Burgdorferi
GSGSLEGVKADKSKV

SEQ ID NO: 202670 - protein, 15 aa, Borrelia Burgdorferi
SGSLEGVKADKSKVK

SEQ ID NO: 202671 - protein, 15 aa, Borrelia Burgdorferi
GSLEGVKADKSKVKL

SEQ ID NO: 202672 - protein, 15 aa, Borrelia Burgdorferi
SLEGVKADKSKVKLI

SEQ ID NO: 202673 - protein, 15 aa, Borrelia Burgdorferi
LEGVKADKSKVKLIV

SEQ ID NO: 202674 - protein, 15 aa, Borrelia Burgdorferi
EGVKADKSKVKLIVS

SEQ ID NO: 202675 - protein, 15 aa, Borrelia Burgdorferi
GVKADKSKVKLIVSD

SEQ ID NO: 202676 - protein, 15 aa, Borrelia Burgdorferi
VKADKSKVKLIVSDD

SEQ ID NO: 202677 - protein, 15 aa, Borrelia Burgdorferi
KADKSKVKLIVSDDL

SEQ ID NO: 202678 - protein, 15 aa, Borrelia Burgdorferi
ADKSKVKLIVSDDLN

SEQ ID NO: 202679 - protein, 15 aa, Borrelia Burgdorferi
DKSKVKLIVSDDLNT

SEQ ID NO: 202680 - protein, 15 aa, Borrelia Burgdorferi
KSKVKLIVSDDLNTV

SEQ ID NO: 202681 - protein, 15 aa, Borrelia Burgdorferi
SKVKLIVSDDLNTVT

SEQ ID NO: 202682 - protein, 15 aa, Borrelia Burgdorferi
KVKLIVSDDLNTVTV

SEQ ID NO: 202683 - protein, 15 aa, Borrelia Burgdorferi
VKLIVSDDLNTVTVE

SEQ ID NO: 202684 - protein, 15 aa, Borrelia Burgdorferi
KLIVSDDLNTVTVET

SEQ ID NO: 202685 - protein, 15 aa, Borrelia Burgdorferi
LIVSDDLNTVTVETF

SEQ ID NO: 202686 - protein, 15 aa, Borrelia Burgdorferi
IVSDDLNTVTVETFD

SEQ ID NO: 202687 - protein, 15 aa, Borrelia Burgdorferi
VSDDLNTVTVETFDS

SEQ ID NO: 202688 - protein, 15 aa, Borrelia Burgdorferi
SDDLNTVTVETFDSS

SEQ ID NO: 202689 - protein, 15 aa, Borrelia Burgdorferi
DDLNTVTVETFDSSG

SEQ ID NO: 202690 - protein, 15 aa, Borrelia Burgdorferi
DLNTVTVETFDSSGK

SEQ ID NO: 202691 - protein, 15 aa, Borrelia Burgdorferi
LNTVTVETFDSSGKK

SEQ ID NO: 202692 - protein, 15 aa, Borrelia Burgdorferi
NTVTVETFDSSGKKD

SEQ ID NO: 202693 - protein, 15 aa, Borrelia Burgdorferi
TVTVETFDSSGKKDS

SEQ ID NO: 202694 - protein, 15 aa, Borrelia Burgdorferi
VTVETFDSSGKKDSS

SEQ ID NO: 202695 - protein, 15 aa, Borrelia Burgdorferi
TVETFDSSGKKDSSK

SEQ ID NO: 202696 - protein, 15 aa, Borrelia Burgdorferi
VETFDSSGKKDSSKV

SEQ ID NO: 202697 - protein, 15 aa, Borrelia Burgdorferi
ETFDSSGKKDSSKVT

SEQ ID NO: 202698 - protein, 15 aa, Borrelia Burgdorferi
TFDSSGKKDSSKVTV

SEQ ID NO: 202699 - protein, 15 aa, Borrelia Burgdorferi
FDSSGKKDSSKVTVK

SEQ ID NO: 202700 - protein, 15 aa, Borrelia Burgdorferi
DSSGKKDSSKVTVKH

SEQ ID NO: 202701 - protein, 15 aa, Borrelia Burgdorferi
SSGKKDSSKVTVKHG

SEQ ID NO: 202702 - protein, 15 aa, Borrelia Burgdorferi
SGKKDSSKVTVKHGS

SEQ ID NO: 202703 - protein, 15 aa, Borrelia Burgdorferi
GKKDSSKVTVKHGSI

SEQ ID NO: 202704 - protein, 15 aa, Borrelia Burgdorferi
KKDSSKVTVKHGSIT

SEQ ID NO: 202705 - protein, 15 aa, Borrelia Burgdorferi
KDSSKVTVKHGSITE

SEQ ID NO: 202706 - protein, 15 aa, Borrelia Burgdorferi
DSSKVTVKHGSITED

SEQ ID NO: 202707 - protein, 15 aa, Borrelia Burgdorferi
SSKVTVKHGSITEDT

SEQ ID NO: 202708 - protein, 15 aa, Borrelia Burgdorferi
SKVTVKHGSITEDTF

SEQ ID NO: 202709 - protein, 15 aa, Borrelia Burgdorferi
KVTVKHGSITEDTFK

SEQ ID NO: 202710 - protein, 15 aa, Borrelia Burgdorferi
VTVKHGSITEDTFKA

SEQ ID NO: 202711 - protein, 15 aa, Borrelia Burgdorferi
TVKHGSITEDTFKAN

SEQ ID NO: 202712 - protein, 15 aa, Borrelia Burgdorferi
VKHGSITEDTFKANK

SEQ ID NO: 202713 - protein, 15 aa, Borrelia Burgdorferi
KHGSITEDTFKANKL

SEQ ID NO: 202714 - protein, 15 aa, Borrelia Burgdorferi
HGSITEDTFKANKLD

SEQ ID NO: 202715 - protein, 15 aa, Borrelia Burgdorferi
GSITEDTFKANKLDS

SEQ ID NO: 202716 - protein, 15 aa, Borrelia Burgdorferi
SITEDTFKANKLDSK

SEQ ID NO: 202717 - protein, 15 aa, Borrelia Burgdorferi
ITEDTFKANKLDSKK

SEQ ID NO: 202718 - protein, 15 aa, Borrelia Burgdorferi
TEDTFKANKLDSKKL

SEQ ID NO: 202719 - protein, 15 aa, Borrelia Burgdorferi
EDTFKANKLDSKKLT

SEQ ID NO: 202720 - protein, 15 aa, Borrelia Burgdorferi
DTFKANKLDSKKLTR

SEQ ID NO: 202721 - protein, 15 aa, Borrelia Burgdorferi
TFKANKLDSKKLTRS

SEQ ID NO: 202722 - protein, 15 aa, Borrelia Burgdorferi
FKANKLDSKKLTRSN

SEQ ID NO: 202723 - protein, 15 aa, Borrelia Burgdorferi
KANKLDSKKLTRSNG

SEQ ID NO: 202724 - protein, 15 aa, Borrelia Burgdorferi
ANKLDSKKLTRSNGT

SEQ ID NO: 202725 - protein, 15 aa, Borrelia Burgdorferi
NKLDSKKLTRSNGTM

SEQ ID NO: 202726 - protein, 15 aa, Borrelia Burgdorferi
KLDSKKLTRSNGTML

SEQ ID NO: 202727 - protein, 15 aa, Borrelia Burgdorferi
LDSKKLTRSNGTMLE

SEQ ID NO: 202728 - protein, 15 aa, Borrelia Burgdorferi
DSKKLTRSNGTMLEY

SEQ ID NO: 202729 - protein, 15 aa, Borrelia Burgdorferi
SKKLTRSNGTMLEYS

SEQ ID NO: 202730 - protein, 15 aa, Borrelia Burgdorferi
KKLTRSNGTMLEYSQ

SEQ ID NO: 202731 - protein, 15 aa, Borrelia Burgdorferi
KLTRSNGTMLEYSQM

SEQ ID NO: 202732 - protein, 15 aa, Borrelia Burgdorferi
LTRSNGTMLEYSQMT

SEQ ID NO: 202733 - protein, 15 aa, Borrelia Burgdorferi
TRSNGTMLEYSQMTD

SEQ ID NO: 202734 - protein, 15 aa, Borrelia Burgdorferi
RSNGTMLEYSQMTDA

SEQ ID NO: 202735 - protein, 15 aa, Borrelia Burgdorferi
SNGTMLEYSQMTDAD

SEQ ID NO: 202736 - protein, 15 aa, Borrelia Burgdorferi
NGTMLEYSQMTDADN

SEQ ID NO: 202737 - protein, 15 aa, Borrelia Burgdorferi
GTMLEYSQMTDADNA

SEQ ID NO: 202738 - protein, 15 aa, Borrelia Burgdorferi
TMLEYSQMTDADNAT

SEQ ID NO: 202739 - protein, 15 aa, Borrelia Burgdorferi
MLEYSQMTDADNATK

SEQ ID NO: 202740 - protein, 15 aa, Borrelia Burgdorferi
LEYSQMTDADNATKA

SEQ ID NO: 202741 - protein, 15 aa, Borrelia Burgdorferi
EYSQMTDADNATKAV

SEQ ID NO: 202742 - protein, 15 aa, Borrelia Burgdorferi
YSQMTDADNATKAVE

SEQ ID NO: 202743 - protein, 15 aa, Borrelia Burgdorferi
SQMTDADNATKAVET

SEQ ID NO: 202744 - protein, 15 aa, Borrelia Burgdorferi
QMTDADNATKAVETL

SEQ ID NO: 202745 - protein, 15 aa, Borrelia Burgdorferi
MTDADNATKAVETLK

SEQ ID NO: 202746 - protein, 15 aa, Borrelia Burgdorferi
TDADNATKAVETLKN

SEQ ID NO: 202747 - protein, 16 aa, Borrelia Burgdorferi
MRLYLTGFALALALIG

SEQ ID NO: 202748 - protein, 16 aa, Borrelia Burgdorferi
RLYLTGFALALALIGC

SEQ ID NO: 202749 - protein, 16 aa, Borrelia Burgdorferi
LYLTGFALALALIGCA

SEQ ID NO: 202750 - protein, 16 aa, Borrelia Burgdorferi
YLTGFALALALIGCAQ

SEQ ID NO: 202751 - protein, 16 aa, Borrelia Burgdorferi
LTGFALALALIGCAQK

SEQ ID NO: 202752 - protein, 16 aa, Borrelia Burgdorferi
TGFALALALIGCAQKG

SEQ ID NO: 202753 - protein, 16 aa, Borrelia Burgdorferi
GFALALALIGCAQKGA

SEQ ID NO: 202754 - protein, 16 aa, Borrelia Burgdorferi
FALALALIGCAQKGAE

SEQ ID NO: 202755 - protein, 16 aa, Borrelia Burgdorferi
ALALALIGCAQKGAEP

SEQ ID NO: 202756 - protein, 16 aa, Borrelia Burgdorferi
LALALIGCAQKGAEPK

SEQ ID NO: 202757 - protein, 16 aa, Borrelia Burgdorferi
ALALIGCAQKGAEPKN

SEQ ID NO: 202758 - protein, 16 aa, Borrelia Burgdorferi
LALIGCAQKGAEPKNT

SEQ ID NO: 202759 - protein, 16 aa, Borrelia Burgdorferi
ALIGCAQKGAEPKNTS

SEQ ID NO: 202760 - protein, 16 aa, Borrelia Burgdorferi
LIGCAQKGAEPKNTSQ

SEQ ID NO: 202761 - protein, 16 aa, Borrelia Burgdorferi
IGCAQKGAEPKNTSQK

SEQ ID NO: 202762 - protein, 16 aa, Borrelia Burgdorferi
GCAQKGAEPKNTSQKY

SEQ ID NO: 202763 - protein, 16 aa, Borrelia Burgdorferi
CAQKGAEPKNTSQKYD

SEQ ID NO: 202764 - protein, 16 aa, Borrelia Burgdorferi
AQKGAEPKNTSQKYDD

SEQ ID NO: 202765 - protein, 16 aa, Borrelia Burgdorferi
QKGAEPKNTSQKYDDQ

SEQ ID NO: 202766 - protein, 16 aa, Borrelia Burgdorferi
KGAEPKNTSQKYDDQE

SEQ ID NO: 202767 - protein, 16 aa, Borrelia Burgdorferi
GAEPKNTSQKYDDQEV

SEQ ID NO: 202768 - protein, 16 aa, Borrelia Burgdorferi
AEPKNTSQKYDDQEVI

SEQ ID NO: 202769 - protein, 16 aa, Borrelia Burgdorferi
EPKNTSQKYDDQEVIN

SEQ ID NO: 202770 - protein, 16 aa, Borrelia Burgdorferi
PKNTSQKYDDQEVINS

SEQ ID NO: 202771 - protein, 16 aa, Borrelia Burgdorferi
KNTSQKYDDQEVINSN

SEQ ID NO: 202772 - protein, 16 aa, Borrelia Burgdorferi
NTSQKYDDQEVINSNK

SEQ ID NO: 202773 - protein, 16 aa, Borrelia Burgdorferi
TSQKYDDQEVINSNKA

SEQ ID NO: 202774 - protein, 16 aa, Borrelia Burgdorferi
SQKYDDQEVINSNKAP

SEQ ID NO: 202775 - protein, 16 aa, Borrelia Burgdorferi
QKYDDQEVINSNKAPK

SEQ ID NO: 202776 - protein, 16 aa, Borrelia Burgdorferi
KYDDQEVINSNKAPKD

SEQ ID NO: 202777 - protein, 16 aa, Borrelia Burgdorferi
YDDQEVINSNKAPKDA

SEQ ID NO: 202778 - protein, 16 aa, Borrelia Burgdorferi
DDQEVINSNKAPKDAK

SEQ ID NO: 202779 - protein, 16 aa, Borrelia Burgdorferi
DQEVINSNKAPKDAKQ

SEQ ID NO: 202780 - protein, 16 aa, Borrelia Burgdorferi
QEVINSNKAPKDAKQT

SEQ ID NO: 202781 - protein, 16 aa, Borrelia Burgdorferi
EVINSNKAPKDAKQTP

SEQ ID NO: 202782 - protein, 16 aa, Borrelia Burgdorferi
VINSNKAPKDAKQTPP

SEQ ID NO: 202783 - protein, 16 aa, Borrelia Burgdorferi
INSNKAPKDAKQTPPA

SEQ ID NO: 202784 - protein, 16 aa, Borrelia Burgdorferi
NSNKAPKDAKQTPPAA

SEQ ID NO: 202785 - protein, 16 aa, Borrelia Burgdorferi
SNKAPKDAKQTPPAAA

SEQ ID NO: 202786 - protein, 16 aa, Borrelia Burgdorferi
NKAPKDAKQTPPAAAE

SEQ ID NO: 202787 - protein, 16 aa, Borrelia Burgdorferi
KAPKDAKQTPPAAAED

SEQ ID NO: 202788 - protein, 16 aa, Borrelia Burgdorferi
APKDAKQTPPAAAEDS

SEQ ID NO: 202789 - protein, 16 aa, Borrelia Burgdorferi
PKDAKQTPPAAAEDSV

SEQ ID NO: 202790 - protein, 16 aa, Borrelia Burgdorferi
KDAKQTPPAAAEDSVT

SEQ ID NO: 202791 - protein, 16 aa, Borrelia Burgdorferi
DAKQTPPAAAEDSVTL

SEQ ID NO: 202792 - protein, 16 aa, Borrelia Burgdorferi
AKQTPPAAAEDSVTLF

SEQ ID NO: 202793 - protein, 16 aa, Borrelia Burgdorferi
KQTPPAAAEDSVTLFS

SEQ ID NO: 202794 - protein, 16 aa, Borrelia Burgdorferi
QTPPAAAEDSVTLFSG

SEQ ID NO: 202795 - protein, 16 aa, Borrelia Burgdorferi
TPPAAAEDSVTLFSGN

SEQ ID NO: 202796 - protein, 16 aa, Borrelia Burgdorferi
PPAAAEDSVTLFSGNE

SEQ ID NO: 202797 - protein, 16 aa, Borrelia Burgdorferi
PAAAEDSVTLFSGNEI

SEQ ID NO: 202798 - protein, 16 aa, Borrelia Burgdorferi
AAAEDSVTLFSGNEIF

SEQ ID NO: 202799 - protein, 16 aa, Borrelia Burgdorferi
AAEDSVTLFSGNEIFV

SEQ ID NO: 202800 - protein, 16 aa, Borrelia Burgdorferi
AEDSVTLFSGNEIFVS

SEQ ID NO: 202801 - protein, 16 aa, Borrelia Burgdorferi
EDSVTLFSGNEIFVSK

SEQ ID NO: 202802 - protein, 16 aa, Borrelia Burgdorferi
DSVTLFSGNEIFVSKE

SEQ ID NO: 202803 - protein, 16 aa, Borrelia Burgdorferi
SVTLFSGNEIFVSKEK

SEQ ID NO: 202804 - protein, 16 aa, Borrelia Burgdorferi
VTLFSGNEIFVSKEKN

SEQ ID NO: 202805 - protein, 16 aa, Borrelia Burgdorferi
TLFSGNEIFVSKEKNS

SEQ ID NO: 202806 - protein, 16 aa, Borrelia Burgdorferi
LFSGNEIFVSKEKNSS

SEQ ID NO: 202807 - protein, 16 aa, Borrelia Burgdorferi
FSGNEIFVSKEKNSSG

SEQ ID NO: 202808 - protein, 16 aa, Borrelia Burgdorferi
SGNEIFVSKEKNSSGK

SEQ ID NO: 202809 - protein, 16 aa, Borrelia Burgdorferi
GNEIFVSKEKNSSGKY

SEQ ID NO: 202810 - protein, 16 aa, Borrelia Burgdorferi
NEIFVSKEKNSSGKYD

SEQ ID NO: 202811 - protein, 16 aa, Borrelia Burgdorferi
EIFVSKEKNSSGKYDL

SEQ ID NO: 202812 - protein, 16 aa, Borrelia Burgdorferi
IFVSKEKNSSGKYDLR

SEQ ID NO: 202813 - protein, 16 aa, Borrelia Burgdorferi
FVSKEKNSSGKYDLRT

SEQ ID NO: 202814 - protein, 16 aa, Borrelia Burgdorferi
VSKEKNSSGKYDLRTT

SEQ ID NO: 202815 - protein, 16 aa, Borrelia Burgdorferi
SKEKNSSGKYDLRTTI

SEQ ID NO: 202816 - protein, 16 aa, Borrelia Burgdorferi
KEKNSSGKYDLRTTIN

SEQ ID NO: 202817 - protein, 16 aa, Borrelia Burgdorferi
EKNSSGKYDLRTTINQ

SEQ ID NO: 202818 - protein, 16 aa, Borrelia Burgdorferi
KNSSGKYDLRTTINQV

SEQ ID NO: 202819 - protein, 16 aa, Borrelia Burgdorferi
NSSGKYDLRTTINQVE

SEQ ID NO: 202820 - protein, 16 aa, Borrelia Burgdorferi
SSGKYDLRTTINQVEL

SEQ ID NO: 202821 - protein, 16 aa, Borrelia Burgdorferi
SGKYDLRTTINQVELK

SEQ ID NO: 202822 - protein, 16 aa, Borrelia Burgdorferi
GKYDLRTTINQVELKG

SEQ ID NO: 202823 - protein, 16 aa, Borrelia Burgdorferi
KYDLRTTINQVELKGT

SEQ ID NO: 202824 - protein, 16 aa, Borrelia Burgdorferi
YDLRTTINQVELKGTS

SEQ ID NO: 202825 - protein, 16 aa, Borrelia Burgdorferi
DLRTTINQVELKGTSD

SEQ ID NO: 202826 - protein, 16 aa, Borrelia Burgdorferi
LRTTINQVELKGTSDK

SEQ ID NO: 202827 - protein, 16 aa, Borrelia Burgdorferi
RTTINQVELKGTSDKN

SEQ ID NO: 202828 - protein, 16 aa, Borrelia Burgdorferi
TTINQVELKGTSDKNN

SEQ ID NO: 202829 - protein, 16 aa, Borrelia Burgdorferi
TINQVELKGTSDKNNG

SEQ ID NO: 202830 - protein, 16 aa, Borrelia Burgdorferi
INQVELKGTSDKNNGS

SEQ ID NO: 202831 - protein, 16 aa, Borrelia Burgdorferi
NQVELKGTSDKNNGSG

SEQ ID NO: 202832 - protein, 16 aa, Borrelia Burgdorferi
QVELKGTSDKNNGSGS

SEQ ID NO: 202833 - protein, 16 aa, Borrelia Burgdorferi
VELKGTSDKNNGSGSL

SEQ ID NO: 202834 - protein, 16 aa, Borrelia Burgdorferi
ELKGTSDKNNGSGSLE

SEQ ID NO: 202835 - protein, 16 aa, Borrelia Burgdorferi
LKGTSDKNNGSGSLEG

SEQ ID NO: 202836 - protein, 16 aa, Borrelia Burgdorferi
KGTSDKNNGSGSLEGV

SEQ ID NO: 202837 - protein, 16 aa, Borrelia Burgdorferi
GTSDKNNGSGSLEGVK

SEQ ID NO: 202838 - protein, 16 aa, Borrelia Burgdorferi
TSDKNNGSGSLEGVKA

SEQ ID NO: 202839 - protein, 16 aa, Borrelia Burgdorferi
SDKNNGSGSLEGVKAD

SEQ ID NO: 202840 - protein, 16 aa, Borrelia Burgdorferi
DKNNGSGSLEGVKADK

SEQ ID NO: 202841 - protein, 16 aa, Borrelia Burgdorferi
KNNGSGSLEGVKADKS

SEQ ID NO: 202842 - protein, 16 aa, Borrelia Burgdorferi
NNGSGSLEGVKADKSK

SEQ ID NO: 202843 - protein, 16 aa, Borrelia Burgdorferi
NGSGSLEGVKADKSKV

SEQ ID NO: 202844 - protein, 16 aa, Borrelia Burgdorferi
GSGSLEGVKADKSKVK

SEQ ID NO: 202845 - protein, 16 aa, Borrelia Burgdorferi
SGSLEGVKADKSKVKL

SEQ ID NO: 202846 - protein, 16 aa, Borrelia Burgdorferi
GSLEGVKADKSKVKLI

SEQ ID NO: 202847 - protein, 16 aa, Borrelia Burgdorferi
SLEGVKADKSKVKLIV

SEQ ID NO: 202848 - protein, 16 aa, Borrelia Burgdorferi
LEGVKADKSKVKLIVS

SEQ ID NO: 202849 - protein, 16 aa, Borrelia Burgdorferi
EGVKADKSKVKLIVSD

SEQ ID NO: 202850 - protein, 16 aa, Borrelia Burgdorferi
GVKADKSKVKLIVSDD

SEQ ID NO: 202851 - protein, 16 aa, Borrelia Burgdorferi
VKADKSKVKLIVSDDL

SEQ ID NO: 202852 - protein, 16 aa, Borrelia Burgdorferi
KADKSKVKLIVSDDLN

SEQ ID NO: 202853 - protein, 16 aa, Borrelia Burgdorferi
ADKSKVKLIVSDDLNT

SEQ ID NO: 202854 - protein, 16 aa, Borrelia Burgdorferi
DKSKVKLIVSDDLNTV

SEQ ID NO: 202855 - protein, 16 aa, Borrelia Burgdorferi
KSKVKLIVSDDLNTVT

SEQ ID NO: 202856 - protein, 16 aa, Borrelia Burgdorferi
SKVKLIVSDDLNTVTV

SEQ ID NO: 202857 - protein, 16 aa, Borrelia Burgdorferi
KVKLIVSDDLNTVTVE

SEQ ID NO: 202858 - protein, 16 aa, Borrelia Burgdorferi
VKLIVSDDLNTVTVET

SEQ ID NO: 202859 - protein, 16 aa, Borrelia Burgdorferi
KLIVSDDLNTVTVETF

SEQ ID NO: 202860 - protein, 16 aa, Borrelia Burgdorferi
LIVSDDLNTVTVETFD

SEQ ID NO: 202861 - protein, 16 aa, Borrelia Burgdorferi
IVSDDLNTVTVETFDS

SEQ ID NO: 202862 - protein, 16 aa, Borrelia Burgdorferi
VSDDLNTVTVETFDSS

SEQ ID NO: 202863 - protein, 16 aa, Borrelia Burgdorferi
SDDLNTVTVETFDSSG

SEQ ID NO: 202864 - protein, 16 aa, Borrelia Burgdorferi
DDLNTVTVETFDSSGK

SEQ ID NO: 202865 - protein, 16 aa, Borrelia Burgdorferi
DLNTVTVETFDSSGKK

SEQ ID NO: 202866 - protein, 16 aa, Borrelia Burgdorferi
LNTVTVETFDSSGKKD

SEQ ID NO: 202867 - protein, 16 aa, Borrelia Burgdorferi
NTVTVETFDSSGKKDS

SEQ ID NO: 202868 - protein, 16 aa, Borrelia Burgdorferi
TVTVETFDSSGKKDSS

SEQ ID NO: 202869 - protein, 16 aa, Borrelia Burgdorferi
VTVETFDSSGKKDSSK

SEQ ID NO: 202870 - protein, 16 aa, Borrelia Burgdorferi
TVETFDSSGKKDSSKV

SEQ ID NO: 202871 - protein, 16 aa, Borrelia Burgdorferi
VETFDSSGKKDSSKVT

SEQ ID NO: 202872 - protein, 16 aa, Borrelia Burgdorferi
ETFDSSGKKDSSKVTV

SEQ ID NO: 202873 - protein, 16 aa, Borrelia Burgdorferi
TFDSSGKKDSSKVTVK

SEQ ID NO: 202874 - protein, 16 aa, Borrelia Burgdorferi
FDSSGKKDSSKVTVKH

SEQ ID NO: 202875 - protein, 16 aa, Borrelia Burgdorferi
DSSGKKDSSKVTVKHG

SEQ ID NO: 202876 - protein, 16 aa, Borrelia Burgdorferi
SSGKKDSSKVTVKHGS

SEQ ID NO: 202877 - protein, 16 aa, Borrelia Burgdorferi
SGKKDSSKVTVKHGSI

SEQ ID NO: 202878 - protein, 16 aa, Borrelia Burgdorferi
GKKDSSKVTVKHGSIT

SEQ ID NO: 202879 - protein, 16 aa, Borrelia Burgdorferi
KKDSSKVTVKHGSITE

SEQ ID NO: 202880 - protein, 16 aa, Borrelia Burgdorferi
KDSSKVTVKHGSITED

SEQ ID NO: 202881 - protein, 16 aa, Borrelia Burgdorferi
DSSKVTVKHGSITEDT

SEQ ID NO: 202882 - protein, 16 aa, Borrelia Burgdorferi
SSKVTVKHGSITEDTF

SEQ ID NO: 202883 - protein, 16 aa, Borrelia Burgdorferi
SKVTVKHGSITEDTFK

SEQ ID NO: 202884 - protein, 16 aa, Borrelia Burgdorferi
KVTVKHGSITEDTFKA

SEQ ID NO: 202885 - protein, 16 aa, Borrelia Burgdorferi
VTVKHGSITEDTFKAN

SEQ ID NO: 202886 - protein, 16 aa, Borrelia Burgdorferi
TVKHGSITEDTFKANK

SEQ ID NO: 202887 - protein, 16 aa, Borrelia Burgdorferi
VKHGSITEDTFKANKL

SEQ ID NO: 202888 - protein, 16 aa, Borrelia Burgdorferi
KHGSITEDTFKANKLD

SEQ ID NO: 202889 - protein, 16 aa, Borrelia Burgdorferi
HGSITEDTFKANKLDS

SEQ ID NO: 202890 - protein, 16 aa, Borrelia Burgdorferi
GSITEDTFKANKLDSK

SEQ ID NO: 202891 - protein, 16 aa, Borrelia Burgdorferi
SITEDTFKANKLDSKK

SEQ ID NO: 202892 - protein, 16 aa, Borrelia Burgdorferi
ITEDTFKANKLDSKKL

SEQ ID NO: 202893 - protein, 16 aa, Borrelia Burgdorferi
TEDTFKANKLDSKKLT

SEQ ID NO: 202894 - protein, 16 aa, Borrelia Burgdorferi
EDTFKANKLDSKKLTR

SEQ ID NO: 202895 - protein, 16 aa, Borrelia Burgdorferi
DTFKANKLDSKKLTRS

SEQ ID NO: 202896 - protein, 16 aa, Borrelia Burgdorferi
TFKANKLDSKKLTRSN

SEQ ID NO: 202897 - protein, 16 aa, Borrelia Burgdorferi
FKANKLDSKKLTRSNG

SEQ ID NO: 202898 - protein, 16 aa, Borrelia Burgdorferi
KANKLDSKKLTRSNGT

SEQ ID NO: 202899 - protein, 16 aa, Borrelia Burgdorferi
ANKLDSKKLTRSNGTM

SEQ ID NO: 202900 - protein, 16 aa, Borrelia Burgdorferi
NKLDSKKLTRSNGTML

SEQ ID NO: 202901 - protein, 16 aa, Borrelia Burgdorferi
KLDSKKLTRSNGTMLE

SEQ ID NO: 202902 - protein, 16 aa, Borrelia Burgdorferi
LDSKKLTRSNGTMLEY

SEQ ID NO: 202903 - protein, 16 aa, Borrelia Burgdorferi
DSKKLTRSNGTMLEYS

SEQ ID NO: 202904 - protein, 16 aa, Borrelia Burgdorferi
SKKLTRSNGTMLEYSQ

SEQ ID NO: 202905 - protein, 16 aa, Borrelia Burgdorferi
KKLTRSNGTMLEYSQM

SEQ ID NO: 202906 - protein, 16 aa, Borrelia Burgdorferi
KLTRSNGTMLEYSQMT

SEQ ID NO: 202907 - protein, 16 aa, Borrelia Burgdorferi
LTRSNGTMLEYSQMTD

SEQ ID NO: 202908 - protein, 16 aa, Borrelia Burgdorferi
TRSNGTMLEYSQMTDA

SEQ ID NO: 202909 - protein, 16 aa, Borrelia Burgdorferi
RSNGTMLEYSQMTDAD

SEQ ID NO: 202910 - protein, 16 aa, Borrelia Burgdorferi
SNGTMLEYSQMTDADN

SEQ ID NO: 202911 - protein, 16 aa, Borrelia Burgdorferi
NGTMLEYSQMTDADNA

SEQ ID NO: 202912 - protein, 16 aa, Borrelia Burgdorferi
GTMLEYSQMTDADNAT

SEQ ID NO: 202913 - protein, 16 aa, Borrelia Burgdorferi
TMLEYSQMTDADNATK

SEQ ID NO: 202914 - protein, 16 aa, Borrelia Burgdorferi
MLEYSQMTDADNATKA

SEQ ID NO: 202915 - protein, 16 aa, Borrelia Burgdorferi
LEYSQMTDADNATKAV

SEQ ID NO: 202916 - protein, 16 aa, Borrelia Burgdorferi
EYSQMTDADNATKAVE

SEQ ID NO: 202917 - protein, 16 aa, Borrelia Burgdorferi
YSQMTDADNATKAVET

SEQ ID NO: 202918 - protein, 16 aa, Borrelia Burgdorferi
SQMTDADNATKAVETL

SEQ ID NO: 202919 - protein, 16 aa, Borrelia Burgdorferi
QMTDADNATKAVETLK

SEQ ID NO: 202920 - protein, 16 aa, Borrelia Burgdorferi
MTDADNATKAVETLKN

SEQ ID NO: 202921 - protein, 325 aa, Borrelia afzelii
FLSCSGKSGLESGIPKVSLVIDGTFDDKSFNESALNGVKKLKEEFEIELVLKESSTNSYLSDLEGLKDAGSNLIWLIGYKFSDVAKAVSLQNSEMKYAIIDPVYSNEPIPANLVGMTFRAQEGAFLTGYIAAKVSKTGKIGFLGGIEGDIVDAFRYGYEAGAKYANKDIKIFSQYIGSFSDLEAGRSVATKMYSDGIDIIHHAAGLGGIGAIEVAKELGSGHYIIGVDEDQSYLAPNNVITSTTKDVGRSLNLLTSNYLKTNTFEGGKLINYGLKEGVVGFVRNPKMIPFEVEKEIDSLSSKIINKEVIVPYNKESYEKFLKEFI

SEQ ID NO: 202922 - protein, 8 aa, Borrelia afzelii
FLSCSGKS

SEQ ID NO: 202923 - protein, 8 aa, Borrelia afzelii
LSCSGKSG

SEQ ID NO: 202924 - protein, 8 aa, Borrelia afzelii
SCSGKSGL

SEQ ID NO: 202925 - protein, 8 aa, Borrelia afzelii
CSGKSGLE

SEQ ID NO: 202926 - protein, 8 aa, Borrelia afzelii
SGKSGLES

SEQ ID NO: 202927 - protein, 8 aa, Borrelia afzelii
GKSGLESG

SEQ ID NO: 202928 - protein, 8 aa, Borrelia afzelii
KSGLESGI

SEQ ID NO: 202929 - protein, 8 aa, Borrelia afzelii
SGLESGIP

SEQ ID NO: 202930 - protein, 8 aa, Borrelia afzelii
GLESGIPK

SEQ ID NO: 202931 - protein, 8 aa, Borrelia afzelii
LESGIPKV

SEQ ID NO: 202932 - protein, 8 aa, Borrelia afzelii
ESGIPKVS

SEQ ID NO: 202933 - protein, 8 aa, Borrelia afzelii
SGIPKVSL

SEQ ID NO: 202934 - protein, 8 aa, Borrelia afzelii
GIPKVSLV

SEQ ID NO: 202935 - protein, 8 aa, Borrelia afzelii
IPKVSLVI

SEQ ID NO: 202936 - protein, 8 aa, Borrelia afzelii
PKVSLVID

SEQ ID NO: 202937 - protein, 8 aa, Borrelia afzelii
KVSLVIDG

SEQ ID NO: 202938 - protein, 8 aa, Borrelia afzelii
VSLVIDGT

SEQ ID NO: 202939 - protein, 8 aa, Borrelia afzelii
SLVIDGTF

SEQ ID NO: 202940 - protein, 8 aa, Borrelia afzelii
LVIDGTFD

SEQ ID NO: 202941 - protein, 8 aa, Borrelia afzelii
VIDGTFDD

SEQ ID NO: 202942 - protein, 8 aa, Borrelia afzelii
IDGTFDDK

SEQ ID NO: 202943 - protein, 8 aa, Borrelia afzelii
DGTFDDKS

SEQ ID NO: 202944 - protein, 8 aa, Borrelia afzelii
GTFDDKSF

SEQ ID NO: 202945 - protein, 8 aa, Borrelia afzelii
TFDDKSFN

SEQ ID NO: 202946 - protein, 8 aa, Borrelia afzelii
FDDKSFNE

SEQ ID NO: 202947 - protein, 8 aa, Borrelia afzelii
DDKSFNES

SEQ ID NO: 202948 - protein, 8 aa, Borrelia afzelii
DKSFNESA

SEQ ID NO: 202949 - protein, 8 aa, Borrelia afzelii
KSFNESAL

SEQ ID NO: 202950 - protein, 8 aa, Borrelia afzelii
SFNESALN

SEQ ID NO: 202951 - protein, 8 aa, Borrelia afzelii
FNESALNG

SEQ ID NO: 202952 - protein, 8 aa, Borrelia afzelii
NESALNGV

SEQ ID NO: 202953 - protein, 8 aa, Borrelia afzelii
ESALNGVK

SEQ ID NO: 202954 - protein, 8 aa, Borrelia afzelii
SALNGVKK

SEQ ID NO: 202955 - protein, 8 aa, Borrelia afzelii
ALNGVKKL

SEQ ID NO: 202956 - protein, 8 aa, Borrelia afzelii
LNGVKKLK

SEQ ID NO: 202957 - protein, 8 aa, Borrelia afzelii
NGVKKLKE

SEQ ID NO: 202958 - protein, 8 aa, Borrelia afzelii
GVKKLKEE

SEQ ID NO: 202959 - protein, 8 aa, Borrelia afzelii
VKKLKEEF

SEQ ID NO: 202960 - protein, 8 aa, Borrelia afzelii
KKLKEEFE

SEQ ID NO: 202961 - protein, 8 aa, Borrelia afzelii
KLKEEFEI

SEQ ID NO: 202962 - protein, 8 aa, Borrelia afzelii
LKEEFEIE

SEQ ID NO: 202963 - protein, 8 aa, Borrelia afzelii
KEEFEIEL

SEQ ID NO: 202964 - protein, 8 aa, Borrelia afzelii
EEFEIELV

SEQ ID NO: 202965 - protein, 8 aa, Borrelia afzelii
EFEIELVL

SEQ ID NO: 202966 - protein, 8 aa, Borrelia afzelii
FEIELVLK

SEQ ID NO: 202967 - protein, 8 aa, Borrelia afzelii
EIELVLKE

SEQ ID NO: 202968 - protein, 8 aa, Borrelia afzelii
IELVLKES

SEQ ID NO: 202969 - protein, 8 aa, Borrelia afzelii
ELVLKESS

SEQ ID NO: 202970 - protein, 8 aa, Borrelia afzelii
LVLKESST

SEQ ID NO: 202971 - protein, 8 aa, Borrelia afzelii
VLKESSTN

SEQ ID NO: 202972 - protein, 8 aa, Borrelia afzelii
LKESSTNS

SEQ ID NO: 202973 - protein, 8 aa, Borrelia afzelii
KESSTNSY

SEQ ID NO: 202974 - protein, 8 aa, Borrelia afzelii
ESSTNSYL

SEQ ID NO: 202975 - protein, 8 aa, Borrelia afzelii
SSTNSYLS

SEQ ID NO: 202976 - protein, 8 aa, Borrelia afzelii
STNSYLSD

SEQ ID NO: 202977 - protein, 8 aa, Borrelia afzelii
TNSYLSDL

SEQ ID NO: 202978 - protein, 8 aa, Borrelia afzelii
NSYLSDLE

SEQ ID NO: 202979 - protein, 8 aa, Borrelia afzelii
SYLSDLEG

SEQ ID NO: 202980 - protein, 8 aa, Borrelia afzelii
YLSDLEGL

SEQ ID NO: 202981 - protein, 8 aa, Borrelia afzelii
LSDLEGLK

SEQ ID NO: 202982 - protein, 8 aa, Borrelia afzelii
SDLEGLKD

SEQ ID NO: 202983 - protein, 8 aa, Borrelia afzelii
DLEGLKDA

SEQ ID NO: 202984 - protein, 8 aa, Borrelia afzelii
LEGLKDAG

SEQ ID NO: 202985 - protein, 8 aa, Borrelia afzelii
EGLKDAGS

SEQ ID NO: 202986 - protein, 8 aa, Borrelia afzelii
GLKDAGSN

SEQ ID NO: 202987 - protein, 8 aa, Borrelia afzelii
LKDAGSNL

SEQ ID NO: 202988 - protein, 8 aa, Borrelia afzelii
KDAGSNLI

SEQ ID NO: 202989 - protein, 8 aa, Borrelia afzelii
DAGSNLIW

SEQ ID NO: 202990 - protein, 8 aa, Borrelia afzelii
AGSNLIWL

SEQ ID NO: 202991 - protein, 8 aa, Borrelia afzelii
GSNLIWLI

SEQ ID NO: 202992 - protein, 8 aa, Borrelia afzelii
SNLIWLIG

SEQ ID NO: 202993 - protein, 8 aa, Borrelia afzelii
NLIWLIGY

SEQ ID NO: 202994 - protein, 8 aa, Borrelia afzelii
LIWLIGYK

SEQ ID NO: 202995 - protein, 8 aa, Borrelia afzelii
IWLIGYKF

SEQ ID NO: 202996 - protein, 8 aa, Borrelia afzelii
WLIGYKFS

SEQ ID NO: 202997 - protein, 8 aa, Borrelia afzelii
LIGYKFSD

SEQ ID NO: 202998 - protein, 8 aa, Borrelia afzelii
IGYKFSDV

SEQ ID NO: 202999 - protein, 8 aa, Borrelia afzelii
GYKFSDVA

SEQ ID NO: 203000 - protein, 8 aa, Borrelia afzelii
YKFSDVAK

SEQ ID NO: 203001 - protein, 8 aa, Borrelia afzelii
KFSDVAKA

SEQ ID NO: 203002 - protein, 8 aa, Borrelia afzelii
FSDVAKAV

SEQ ID NO: 203003 - protein, 8 aa, Borrelia afzelii
SDVAKAVS

SEQ ID NO: 203004 - protein, 8 aa, Borrelia afzelii
DVAKAVSL

SEQ ID NO: 203005 - protein, 8 aa, Borrelia afzelii
VAKAVSLQ

SEQ ID NO: 203006 - protein, 8 aa, Borrelia afzelii
AKAVSLQN

SEQ ID NO: 203007 - protein, 8 aa, Borrelia afzelii
KAVSLQNS

SEQ ID NO: 203008 - protein, 8 aa, Borrelia afzelii
AVSLQNSE

SEQ ID NO: 203009 - protein, 8 aa, Borrelia afzelii
VSLQNSEM

SEQ ID NO: 203010 - protein, 8 aa, Borrelia afzelii
SLQNSEMK

SEQ ID NO: 203011 - protein, 8 aa, Borrelia afzelii
LQNSEMKY

SEQ ID NO: 203012 - protein, 8 aa, Borrelia afzelii
QNSEMKYA

SEQ ID NO: 203013 - protein, 8 aa, Borrelia afzelii
NSEMKYAI

SEQ ID NO: 203014 - protein, 8 aa, Borrelia afzelii
SEMKYAII

SEQ ID NO: 203015 - protein, 8 aa, Borrelia afzelii
EMKYAIID

SEQ ID NO: 203016 - protein, 8 aa, Borrelia afzelii
MKYAIIDP

SEQ ID NO: 203017 - protein, 8 aa, Borrelia afzelii
KYAIIDPV

SEQ ID NO: 203018 - protein, 8 aa, Borrelia afzelii
YAIIDPVY

SEQ ID NO: 203019 - protein, 8 aa, Borrelia afzelii
AIIDPVYS

SEQ ID NO: 203020 - protein, 8 aa, Borrelia afzelii
IIDPVYSN

SEQ ID NO: 203021 - protein, 8 aa, Borrelia afzelii
IDPVYSNE

SEQ ID NO: 203022 - protein, 8 aa, Borrelia afzelii
DPVYSNEP

SEQ ID NO: 203023 - protein, 8 aa, Borrelia afzelii
PVYSNEPI

SEQ ID NO: 203024 - protein, 8 aa, Borrelia afzelii
VYSNEPIP

SEQ ID NO: 203025 - protein, 8 aa, Borrelia afzelii
YSNEPIPA

SEQ ID NO: 203026 - protein, 8 aa, Borrelia afzelii
SNEPIPAN

SEQ ID NO: 203027 - protein, 8 aa, Borrelia afzelii
NEPIPANL

SEQ ID NO: 203028 - protein, 8 aa, Borrelia afzelii
EPIPANLV

SEQ ID NO: 203029 - protein, 8 aa, Borrelia afzelii
PIPANLVG

SEQ ID NO: 203030 - protein, 8 aa, Borrelia afzelii
IPANLVGM

SEQ ID NO: 203031 - protein, 8 aa, Borrelia afzelii
PANLVGMT

SEQ ID NO: 203032 - protein, 8 aa, Borrelia afzelii
ANLVGMTF

SEQ ID NO: 203033 - protein, 8 aa, Borrelia afzelii
NLVGMTFR

SEQ ID NO: 203034 - protein, 8 aa, Borrelia afzelii
LVGMTFRA

SEQ ID NO: 203035 - protein, 8 aa, Borrelia afzelii
VGMTFRAQ

SEQ ID NO: 203036 - protein, 8 aa, Borrelia afzelii
GMTFRAQE

SEQ ID NO: 203037 - protein, 8 aa, Borrelia afzelii
MTFRAQEG

SEQ ID NO: 203038 - protein, 8 aa, Borrelia afzelii
TFRAQEGA

SEQ ID NO: 203039 - protein, 8 aa, Borrelia afzelii
FRAQEGAF

SEQ ID NO: 203040 - protein, 8 aa, Borrelia afzelii
RAQEGAFL

SEQ ID NO: 203041 - protein, 8 aa, Borrelia afzelii
AQEGAFLT

SEQ ID NO: 203042 - protein, 8 aa, Borrelia afzelii
QEGAFLTG

SEQ ID NO: 203043 - protein, 8 aa, Borrelia afzelii
EGAFLTGY

SEQ ID NO: 203044 - protein, 8 aa, Borrelia afzelii
GAFLTGYI

SEQ ID NO: 203045 - protein, 8 aa, Borrelia afzelii
AFLTGYIA

SEQ ID NO: 203046 - protein, 8 aa, Borrelia afzelii
FLTGYIAA

SEQ ID NO: 203047 - protein, 8 aa, Borrelia afzelii
LTGYIAAK

SEQ ID NO: 203048 - protein, 8 aa, Borrelia afzelii
TGYIAAKV

SEQ ID NO: 203049 - protein, 8 aa, Borrelia afzelii
GYIAAKVS

SEQ ID NO: 203050 - protein, 8 aa, Borrelia afzelii
YIAAKVSK

SEQ ID NO: 203051 - protein, 8 aa, Borrelia afzelii
IAAKVSKT

SEQ ID NO: 203052 - protein, 8 aa, Borrelia afzelii
AAKVSKTG

SEQ ID NO: 203053 - protein, 8 aa, Borrelia afzelii
AKVSKTGK

SEQ ID NO: 203054 - protein, 8 aa, Borrelia afzelii
KVSKTGKI

SEQ ID NO: 203055 - protein, 8 aa, Borrelia afzelii
VSKTGKIG

SEQ ID NO: 203056 - protein, 8 aa, Borrelia afzelii
SKTGKIGF

SEQ ID NO: 203057 - protein, 8 aa, Borrelia afzelii
KTGKIGFL

SEQ ID NO: 203058 - protein, 8 aa, Borrelia afzelii
TGKIGFLG

SEQ ID NO: 203059 - protein, 8 aa, Borrelia afzelii
GKIGFLGG

SEQ ID NO: 203060 - protein, 8 aa, Borrelia afzelii
KIGFLGGI

SEQ ID NO: 203061 - protein, 8 aa, Borrelia afzelii
IGFLGGIE

SEQ ID NO: 203062 - protein, 8 aa, Borrelia afzelii
GFLGGIEG

SEQ ID NO: 203063 - protein, 8 aa, Borrelia afzelii
FLGGIEGD

SEQ ID NO: 203064 - protein, 8 aa, Borrelia afzelii
LGGIEGDI

SEQ ID NO: 203065 - protein, 8 aa, Borrelia afzelii
GGIEGDIV

SEQ ID NO: 203066 - protein, 8 aa, Borrelia afzelii
GIEGDIVD

SEQ ID NO: 203067 - protein, 8 aa, Borrelia afzelii
IEGDIVDA

SEQ ID NO: 203068 - protein, 8 aa, Borrelia afzelii
EGDIVDAF

SEQ ID NO: 203069 - protein, 8 aa, Borrelia afzelii
GDIVDAFR

SEQ ID NO: 203070 - protein, 8 aa, Borrelia afzelii
DIVDAFRY

SEQ ID NO: 203071 - protein, 8 aa, Borrelia afzelii
IVDAFRYG

SEQ ID NO: 203072 - protein, 8 aa, Borrelia afzelii
VDAFRYGY

SEQ ID NO: 203073 - protein, 8 aa, Borrelia afzelii
DAFRYGYE

SEQ ID NO: 203074 - protein, 8 aa, Borrelia afzelii
AFRYGYEA

SEQ ID NO: 203075 - protein, 8 aa, Borrelia afzelii
FRYGYEAG

SEQ ID NO: 203076 - protein, 8 aa, Borrelia afzelii
RYGYEAGA

SEQ ID NO: 203077 - protein, 8 aa, Borrelia afzelii
YGYEAGAK

SEQ ID NO: 203078 - protein, 8 aa, Borrelia afzelii
GYEAGAKY

SEQ ID NO: 203079 - protein, 8 aa, Borrelia afzelii
YEAGAKYA

SEQ ID NO: 203080 - protein, 8 aa, Borrelia afzelii
EAGAKYAN

SEQ ID NO: 203081 - protein, 8 aa, Borrelia afzelii
AGAKYANK

SEQ ID NO: 203082 - protein, 8 aa, Borrelia afzelii
GAKYANKD

SEQ ID NO: 203083 - protein, 8 aa, Borrelia afzelii
AKYANKDI

SEQ ID NO: 203084 - protein, 8 aa, Borrelia afzelii
KYANKDIK

SEQ ID NO: 203085 - protein, 8 aa, Borrelia afzelii
YANKDIKI

SEQ ID NO: 203086 - protein, 8 aa, Borrelia afzelii
ANKDIKIF

SEQ ID NO: 203087 - protein, 8 aa, Borrelia afzelii
NKDIKIFS

SEQ ID NO: 203088 - protein, 8 aa, Borrelia afzelii
KDIKIFSQ

SEQ ID NO: 203089 - protein, 8 aa, Borrelia afzelii
DIKIFSQY

SEQ ID NO: 203090 - protein, 8 aa, Borrelia afzelii
IKIFSQYI

SEQ ID NO: 203091 - protein, 8 aa, Borrelia afzelii
KIFSQYIG

SEQ ID NO: 203092 - protein, 8 aa, Borrelia afzelii
IFSQYIGS

SEQ ID NO: 203093 - protein, 8 aa, Borrelia afzelii
FSQYIGSF

SEQ ID NO: 203094 - protein, 8 aa, Borrelia afzelii
SQYIGSFS

SEQ ID NO: 203095 - protein, 8 aa, Borrelia afzelii
QYIGSFSD

SEQ ID NO: 203096 - protein, 8 aa, Borrelia afzelii
YIGSFSDL

SEQ ID NO: 203097 - protein, 8 aa, Borrelia afzelii
IGSFSDLE

SEQ ID NO: 203098 - protein, 8 aa, Borrelia afzelii
GSFSDLEA

SEQ ID NO: 203099 - protein, 8 aa, Borrelia afzelii
SFSDLEAG

SEQ ID NO: 203100 - protein, 8 aa, Borrelia afzelii
FSDLEAGR

SEQ ID NO: 203101 - protein, 8 aa, Borrelia afzelii
SDLEAGRS

SEQ ID NO: 203102 - protein, 8 aa, Borrelia afzelii
DLEAGRSV

SEQ ID NO: 203103 - protein, 8 aa, Borrelia afzelii
LEAGRSVA

SEQ ID NO: 203104 - protein, 8 aa, Borrelia afzelii
EAGRSVAT

SEQ ID NO: 203105 - protein, 8 aa, Borrelia afzelii
AGRSVATK

SEQ ID NO: 203106 - protein, 8 aa, Borrelia afzelii
GRSVATKM

SEQ ID NO: 203107 - protein, 8 aa, Borrelia afzelii
RSVATKMY

SEQ ID NO: 203108 - protein, 8 aa, Borrelia afzelii
SVATKMYS

SEQ ID NO: 203109 - protein, 8 aa, Borrelia afzelii
VATKMYSD

SEQ ID NO: 203110 - protein, 8 aa, Borrelia afzelii
ATKMYSDG

SEQ ID NO: 203111 - protein, 8 aa, Borrelia afzelii
TKMYSDGI

SEQ ID NO: 203112 - protein, 8 aa, Borrelia afzelii
KMYSDGID

SEQ ID NO: 203113 - protein, 8 aa, Borrelia afzelii
MYSDGIDI

SEQ ID NO: 203114 - protein, 8 aa, Borrelia afzelii
YSDGIDII

SEQ ID NO: 203115 - protein, 8 aa, Borrelia afzelii
SDGIDIIH

SEQ ID NO: 203116 - protein, 8 aa, Borrelia afzelii
DGIDIIHH

SEQ ID NO: 203117 - protein, 8 aa, Borrelia afzelii
GIDIIHHA

SEQ ID NO: 203118 - protein, 8 aa, Borrelia afzelii
IDIIHHAA

SEQ ID NO: 203119 - protein, 8 aa, Borrelia afzelii
DIIHHAAG

SEQ ID NO: 203120 - protein, 8 aa, Borrelia afzelii
IIHHAAGL

SEQ ID NO: 203121 - protein, 8 aa, Borrelia afzelii
IHHAAGLG

SEQ ID NO: 203122 - protein, 8 aa, Borrelia afzelii
HHAAGLGG

SEQ ID NO: 203123 - protein, 8 aa, Borrelia afzelii
HAAGLGGI

SEQ ID NO: 203124 - protein, 8 aa, Borrelia afzelii
AAGLGGIG

SEQ ID NO: 203125 - protein, 8 aa, Borrelia afzelii
AGLGGIGA

SEQ ID NO: 203126 - protein, 8 aa, Borrelia afzelii
GLGGIGAI

SEQ ID NO: 203127 - protein, 8 aa, Borrelia afzelii
LGGIGAIE

SEQ ID NO: 203128 - protein, 8 aa, Borrelia afzelii
GGIGAIEV

SEQ ID NO: 203129 - protein, 8 aa, Borrelia afzelii
GIGAIEVA

SEQ ID NO: 203130 - protein, 8 aa, Borrelia afzelii
IGAIEVAK

SEQ ID NO: 203131 - protein, 8 aa, Borrelia afzelii
GAIEVAKE

SEQ ID NO: 203132 - protein, 8 aa, Borrelia afzelii
AIEVAKEL

SEQ ID NO: 203133 - protein, 8 aa, Borrelia afzelii
IEVAKELG

SEQ ID NO: 203134 - protein, 8 aa, Borrelia afzelii
EVAKELGS

SEQ ID NO: 203135 - protein, 8 aa, Borrelia afzelii
VAKELGSG

SEQ ID NO: 203136 - protein, 8 aa, Borrelia afzelii
AKELGSGH

SEQ ID NO: 203137 - protein, 8 aa, Borrelia afzelii
KELGSGHY

SEQ ID NO: 203138 - protein, 8 aa, Borrelia afzelii
ELGSGHYI

SEQ ID NO: 203139 - protein, 8 aa, Borrelia afzelii
LGSGHYII

SEQ ID NO: 203140 - protein, 8 aa, Borrelia afzelii
GSGHYIIG

SEQ ID NO: 203141 - protein, 8 aa, Borrelia afzelii
SGHYIIGV

SEQ ID NO: 203142 - protein, 8 aa, Borrelia afzelii
GHYIIGVD

SEQ ID NO: 203143 - protein, 8 aa, Borrelia afzelii
HYIIGVDE

SEQ ID NO: 203144 - protein, 8 aa, Borrelia afzelii
YIIGVDED

SEQ ID NO: 203145 - protein, 8 aa, Borrelia afzelii
IIGVDEDQ

SEQ ID NO: 203146 - protein, 8 aa, Borrelia afzelii
IGVDEDQS

SEQ ID NO: 203147 - protein, 8 aa, Borrelia afzelii
GVDEDQSY

SEQ ID NO: 203148 - protein, 8 aa, Borrelia afzelii
VDEDQSYL

SEQ ID NO: 203149 - protein, 8 aa, Borrelia afzelii
DEDQSYLA

SEQ ID NO: 203150 - protein, 8 aa, Borrelia afzelii
EDQSYLAP

SEQ ID NO: 203151 - protein, 8 aa, Borrelia afzelii
DQSYLAPN

SEQ ID NO: 203152 - protein, 8 aa, Borrelia afzelii
QSYLAPNN

SEQ ID NO: 203153 - protein, 8 aa, Borrelia afzelii
SYLAPNNV

SEQ ID NO: 203154 - protein, 8 aa, Borrelia afzelii
YLAPNNVI

SEQ ID NO: 203155 - protein, 8 aa, Borrelia afzelii
LAPNNVIT

SEQ ID NO: 203156 - protein, 8 aa, Borrelia afzelii
APNNVITS

SEQ ID NO: 203157 - protein, 8 aa, Borrelia afzelii
PNNVITST

SEQ ID NO: 203158 - protein, 8 aa, Borrelia afzelii
NNVITSTT

SEQ ID NO: 203159 - protein, 8 aa, Borrelia afzelii
NVITSTTK

SEQ ID NO: 203160 - protein, 8 aa, Borrelia afzelii
VITSTTKD

SEQ ID NO: 203161 - protein, 8 aa, Borrelia afzelii
ITSTTKDV

SEQ ID NO: 203162 - protein, 8 aa, Borrelia afzelii
TSTTKDVG

SEQ ID NO: 203163 - protein, 8 aa, Borrelia afzelii
STTKDVGR

SEQ ID NO: 203164 - protein, 8 aa, Borrelia afzelii
TTKDVGRS

SEQ ID NO: 203165 - protein, 8 aa, Borrelia afzelii
TKDVGRSL

SEQ ID NO: 203166 - protein, 8 aa, Borrelia afzelii
KDVGRSLN

SEQ ID NO: 203167 - protein, 8 aa, Borrelia afzelii
DVGRSLNL

SEQ ID NO: 203168 - protein, 8 aa, Borrelia afzelii
VGRSLNLL

SEQ ID NO: 203169 - protein, 8 aa, Borrelia afzelii
GRSLNLLT

SEQ ID NO: 203170 - protein, 8 aa, Borrelia afzelii
RSLNLLTS

SEQ ID NO: 203171 - protein, 8 aa, Borrelia afzelii
SLNLLTSN

SEQ ID NO: 203172 - protein, 8 aa, Borrelia afzelii
LNLLTSNY

SEQ ID NO: 203173 - protein, 8 aa, Borrelia afzelii
NLLTSNYL

SEQ ID NO: 203174 - protein, 8 aa, Borrelia afzelii
LLTSNYLK

SEQ ID NO: 203175 - protein, 8 aa, Borrelia afzelii
LTSNYLKT

SEQ ID NO: 203176 - protein, 8 aa, Borrelia afzelii
TSNYLKTN

SEQ ID NO: 203177 - protein, 8 aa, Borrelia afzelii
SNYLKTNT

SEQ ID NO: 203178 - protein, 8 aa, Borrelia afzelii
NYLKTNTF

SEQ ID NO: 203179 - protein, 8 aa, Borrelia afzelii
YLKTNTFE

SEQ ID NO: 203180 - protein, 8 aa, Borrelia afzelii
LKTNTFEG

SEQ ID NO: 203181 - protein, 8 aa, Borrelia afzelii
KTNTFEGG

SEQ ID NO: 203182 - protein, 8 aa, Borrelia afzelii
TNTFEGGK

SEQ ID NO: 203183 - protein, 8 aa, Borrelia afzelii
NTFEGGKL

SEQ ID NO: 203184 - protein, 8 aa, Borrelia afzelii
TFEGGKLI

SEQ ID NO: 203185 - protein, 8 aa, Borrelia afzelii
FEGGKLIN

SEQ ID NO: 203186 - protein, 8 aa, Borrelia afzelii
EGGKLINY

SEQ ID NO: 203187 - protein, 8 aa, Borrelia afzelii
GGKLINYG

SEQ ID NO: 203188 - protein, 8 aa, Borrelia afzelii
GKLINYGL

SEQ ID NO: 203189 - protein, 8 aa, Borrelia afzelii
KLINYGLK

SEQ ID NO: 203190 - protein, 8 aa, Borrelia afzelii
LINYGLKE

SEQ ID NO: 203191 - protein, 8 aa, Borrelia afzelii
INYGLKEG

SEQ ID NO: 203192 - protein, 8 aa, Borrelia afzelii
NYGLKEGV

SEQ ID NO: 203193 - protein, 8 aa, Borrelia afzelii
YGLKEGVV

SEQ ID NO: 203194 - protein, 8 aa, Borrelia afzelii
GLKEGVVG

SEQ ID NO: 203195 - protein, 8 aa, Borrelia afzelii
LKEGVVGF

SEQ ID NO: 203196 - protein, 8 aa, Borrelia afzelii
KEGVVGFV

SEQ ID NO: 203197 - protein, 8 aa, Borrelia afzelii
EGVVGFVR

SEQ ID NO: 203198 - protein, 8 aa, Borrelia afzelii
GVVGFVRN

SEQ ID NO: 203199 - protein, 8 aa, Borrelia afzelii
VVGFVRNP

SEQ ID NO: 203200 - protein, 8 aa, Borrelia afzelii
VGFVRNPK

SEQ ID NO: 203201 - protein, 8 aa, Borrelia afzelii
GFVRNPKM

SEQ ID NO: 203202 - protein, 8 aa, Borrelia afzelii
FVRNPKMI

SEQ ID NO: 203203 - protein, 8 aa, Borrelia afzelii
VRNPKMIP

SEQ ID NO: 203204 - protein, 8 aa, Borrelia afzelii
RNPKMIPF

SEQ ID NO: 203205 - protein, 8 aa, Borrelia afzelii
NPKMIPFE

SEQ ID NO: 203206 - protein, 8 aa, Borrelia afzelii
PKMIPFEV

SEQ ID NO: 203207 - protein, 8 aa, Borrelia afzelii
KMIPFEVE

SEQ ID NO: 203208 - protein, 8 aa, Borrelia afzelii
MIPFEVEK

SEQ ID NO: 203209 - protein, 8 aa, Borrelia afzelii
IPFEVEKE

SEQ ID NO: 203210 - protein, 8 aa, Borrelia afzelii
PFEVEKEI

SEQ ID NO: 203211 - protein, 8 aa, Borrelia afzelii
FEVEKEID

SEQ ID NO: 203212 - protein, 8 aa, Borrelia afzelii
EVEKEIDS

SEQ ID NO: 203213 - protein, 8 aa, Borrelia afzelii
VEKEIDSL

SEQ ID NO: 203214 - protein, 8 aa, Borrelia afzelii
EKEIDSLS

SEQ ID NO: 203215 - protein, 8 aa, Borrelia afzelii
KEIDSLSS

SEQ ID NO: 203216 - protein, 8 aa, Borrelia afzelii
EIDSLSSK

SEQ ID NO: 203217 - protein, 8 aa, Borrelia afzelii
IDSLSSKI

SEQ ID NO: 203218 - protein, 8 aa, Borrelia afzelii
DSLSSKII

SEQ ID NO: 203219 - protein, 8 aa, Borrelia afzelii
SLSSKIIN

SEQ ID NO: 203220 - protein, 8 aa, Borrelia afzelii
LSSKIINK

SEQ ID NO: 203221 - protein, 8 aa, Borrelia afzelii
SSKIINKE

SEQ ID NO: 203222 - protein, 8 aa, Borrelia afzelii
SKIINKEV

SEQ ID NO: 203223 - protein, 8 aa, Borrelia afzelii
KIINKEVI

SEQ ID NO: 203224 - protein, 8 aa, Borrelia afzelii
IINKEVIV

SEQ ID NO: 203225 - protein, 8 aa, Borrelia afzelii
INKEVIVP

SEQ ID NO: 203226 - protein, 8 aa, Borrelia afzelii
NKEVIVPY

SEQ ID NO: 203227 - protein, 8 aa, Borrelia afzelii
KEVIVPYN

SEQ ID NO: 203228 - protein, 8 aa, Borrelia afzelii
EVIVPYNK

SEQ ID NO: 203229 - protein, 8 aa, Borrelia afzelii
VIVPYNKE

SEQ ID NO: 203230 - protein, 8 aa, Borrelia afzelii
IVPYNKES

SEQ ID NO: 203231 - protein, 8 aa, Borrelia afzelii
VPYNKESY

SEQ ID NO: 203232 - protein, 8 aa, Borrelia afzelii
PYNKESYE

SEQ ID NO: 203233 - protein, 8 aa, Borrelia afzelii
YNKESYEK

SEQ ID NO: 203234 - protein, 8 aa, Borrelia afzelii
NKESYEKF

SEQ ID NO: 203235 - protein, 8 aa, Borrelia afzelii
KESYEKFL

SEQ ID NO: 203236 - protein, 8 aa, Borrelia afzelii
ESYEKFLK

SEQ ID NO: 203237 - protein, 8 aa, Borrelia afzelii
SYEKFLKE

SEQ ID NO: 203238 - protein, 8 aa, Borrelia afzelii
YEKFLKEF

SEQ ID NO: 203239 - protein, 8 aa, Borrelia afzelii
EKFLKEFI

SEQ ID NO: 203240 - protein, 9 aa, Borrelia afzelii
FLSCSGKSG

SEQ ID NO: 203241 - protein, 9 aa, Borrelia afzelii
LSCSGKSGL

SEQ ID NO: 203242 - protein, 9 aa, Borrelia afzelii
SCSGKSGLE

SEQ ID NO: 203243 - protein, 9 aa, Borrelia afzelii
CSGKSGLES

SEQ ID NO: 203244 - protein, 9 aa, Borrelia afzelii
SGKSGLESG

SEQ ID NO: 203245 - protein, 9 aa, Borrelia afzelii
GKSGLESGI

SEQ ID NO: 203246 - protein, 9 aa, Borrelia afzelii
KSGLESGIP

SEQ ID NO: 203247 - protein, 9 aa, Borrelia afzelii
SGLESGIPK

SEQ ID NO: 203248 - protein, 9 aa, Borrelia afzelii
GLESGIPKV

SEQ ID NO: 203249 - protein, 9 aa, Borrelia afzelii
LESGIPKVS

SEQ ID NO: 203250 - protein, 9 aa, Borrelia afzelii
ESGIPKVSL

SEQ ID NO: 203251 - protein, 9 aa, Borrelia afzelii
SGIPKVSLV

SEQ ID NO: 203252 - protein, 9 aa, Borrelia afzelii
GIPKVSLVI

SEQ ID NO: 203253 - protein, 9 aa, Borrelia afzelii
IPKVSLVID

SEQ ID NO: 203254 - protein, 9 aa, Borrelia afzelii
PKVSLVIDG

SEQ ID NO: 203255 - protein, 9 aa, Borrelia afzelii
KVSLVIDGT

SEQ ID NO: 203256 - protein, 9 aa, Borrelia afzelii
VSLVIDGTF

SEQ ID NO: 203257 - protein, 9 aa, Borrelia afzelii
SLVIDGTFD

SEQ ID NO: 203258 - protein, 9 aa, Borrelia afzelii
LVIDGTFDD

SEQ ID NO: 203259 - protein, 9 aa, Borrelia afzelii
VIDGTFDDK

SEQ ID NO: 203260 - protein, 9 aa, Borrelia afzelii
IDGTFDDKS

SEQ ID NO: 203261 - protein, 9 aa, Borrelia afzelii
DGTFDDKSF

SEQ ID NO: 203262 - protein, 9 aa, Borrelia afzelii
GTFDDKSFN

SEQ ID NO: 203263 - protein, 9 aa, Borrelia afzelii
TFDDKSFNE

SEQ ID NO: 203264 - protein, 9 aa, Borrelia afzelii
FDDKSFNES

SEQ ID NO: 203265 - protein, 9 aa, Borrelia afzelii
DDKSFNESA

SEQ ID NO: 203266 - protein, 9 aa, Borrelia afzelii
DKSFNESAL

SEQ ID NO: 203267 - protein, 9 aa, Borrelia afzelii
KSFNESALN

SEQ ID NO: 203268 - protein, 9 aa, Borrelia afzelii
SFNESALNG

SEQ ID NO: 203269 - protein, 9 aa, Borrelia afzelii
FNESALNGV

SEQ ID NO: 203270 - protein, 9 aa, Borrelia afzelii
NESALNGVK

SEQ ID NO: 203271 - protein, 9 aa, Borrelia afzelii
ESALNGVKK

SEQ ID NO: 203272 - protein, 9 aa, Borrelia afzelii
SALNGVKKL

SEQ ID NO: 203273 - protein, 9 aa, Borrelia afzelii
ALNGVKKLK

SEQ ID NO: 203274 - protein, 9 aa, Borrelia afzelii
LNGVKKLKE

SEQ ID NO: 203275 - protein, 9 aa, Borrelia afzelii
NGVKKLKEE

SEQ ID NO: 203276 - protein, 9 aa, Borrelia afzelii
GVKKLKEEF

SEQ ID NO: 203277 - protein, 9 aa, Borrelia afzelii
VKKLKEEFE

SEQ ID NO: 203278 - protein, 9 aa, Borrelia afzelii
KKLKEEFEI

SEQ ID NO: 203279 - protein, 9 aa, Borrelia afzelii
KLKEEFEIE

SEQ ID NO: 203280 - protein, 9 aa, Borrelia afzelii
LKEEFEIEL

SEQ ID NO: 203281 - protein, 9 aa, Borrelia afzelii
KEEFEIELV

SEQ ID NO: 203282 - protein, 9 aa, Borrelia afzelii
EEFEIELVL

SEQ ID NO: 203283 - protein, 9 aa, Borrelia afzelii
EFEIELVLK

SEQ ID NO: 203284 - protein, 9 aa, Borrelia afzelii
FEIELVLKE

SEQ ID NO: 203285 - protein, 9 aa, Borrelia afzelii
EIELVLKES

SEQ ID NO: 203286 - protein, 9 aa, Borrelia afzelii
IELVLKESS

SEQ ID NO: 203287 - protein, 9 aa, Borrelia afzelii
ELVLKESST

SEQ ID NO: 203288 - protein, 9 aa, Borrelia afzelii
LVLKESSTN

SEQ ID NO: 203289 - protein, 9 aa, Borrelia afzelii
VLKESSTNS

SEQ ID NO: 203290 - protein, 9 aa, Borrelia afzelii
LKESSTNSY

SEQ ID NO: 203291 - protein, 9 aa, Borrelia afzelii
KESSTNSYL

SEQ ID NO: 203292 - protein, 9 aa, Borrelia afzelii
ESSTNSYLS

SEQ ID NO: 203293 - protein, 9 aa, Borrelia afzelii
SSTNSYLSD

SEQ ID NO: 203294 - protein, 9 aa, Borrelia afzelii
STNSYLSDL

SEQ ID NO: 203295 - protein, 9 aa, Borrelia afzelii
TNSYLSDLE

SEQ ID NO: 203296 - protein, 9 aa, Borrelia afzelii
NSYLSDLEG

SEQ ID NO: 203297 - protein, 9 aa, Borrelia afzelii
SYLSDLEGL

SEQ ID NO: 203298 - protein, 9 aa, Borrelia afzelii
YLSDLEGLK

SEQ ID NO: 203299 - protein, 9 aa, Borrelia afzelii
LSDLEGLKD

SEQ ID NO: 203300 - protein, 9 aa, Borrelia afzelii
SDLEGLKDA

SEQ ID NO: 203301 - protein, 9 aa, Borrelia afzelii
DLEGLKDAG

SEQ ID NO: 203302 - protein, 9 aa, Borrelia afzelii
LEGLKDAGS

SEQ ID NO: 203303 - protein, 9 aa, Borrelia afzelii
EGLKDAGSN

SEQ ID NO: 203304 - protein, 9 aa, Borrelia afzelii
GLKDAGSNL

SEQ ID NO: 203305 - protein, 9 aa, Borrelia afzelii
LKDAGSNLI

SEQ ID NO: 203306 - protein, 9 aa, Borrelia afzelii
KDAGSNLIW

SEQ ID NO: 203307 - protein, 9 aa, Borrelia afzelii
DAGSNLIWL

SEQ ID NO: 203308 - protein, 9 aa, Borrelia afzelii
AGSNLIWLI

SEQ ID NO: 203309 - protein, 9 aa, Borrelia afzelii
GSNLIWLIG

SEQ ID NO: 203310 - protein, 9 aa, Borrelia afzelii
SNLIWLIGY

SEQ ID NO: 203311 - protein, 9 aa, Borrelia afzelii
NLIWLIGYK

SEQ ID NO: 203312 - protein, 9 aa, Borrelia afzelii
LIWLIGYKF

SEQ ID NO: 203313 - protein, 9 aa, Borrelia afzelii
IWLIGYKFS

SEQ ID NO: 203314 - protein, 9 aa, Borrelia afzelii
WLIGYKFSD

SEQ ID NO: 203315 - protein, 9 aa, Borrelia afzelii
LIGYKFSDV

SEQ ID NO: 203316 - protein, 9 aa, Borrelia afzelii
IGYKFSDVA

SEQ ID NO: 203317 - protein, 9 aa, Borrelia afzelii
GYKFSDVAK

SEQ ID NO: 203318 - protein, 9 aa, Borrelia afzelii
YKFSDVAKA

SEQ ID NO: 203319 - protein, 9 aa, Borrelia afzelii
KFSDVAKAV

SEQ ID NO: 203320 - protein, 9 aa, Borrelia afzelii
FSDVAKAVS

SEQ ID NO: 203321 - protein, 9 aa, Borrelia afzelii
SDVAKAVSL

SEQ ID NO: 203322 - protein, 9 aa, Borrelia afzelii
DVAKAVSLQ

SEQ ID NO: 203323 - protein, 9 aa, Borrelia afzelii
VAKAVSLQN

SEQ ID NO: 203324 - protein, 9 aa, Borrelia afzelii
AKAVSLQNS

SEQ ID NO: 203325 - protein, 9 aa, Borrelia afzelii
KAVSLQNSE

SEQ ID NO: 203326 - protein, 9 aa, Borrelia afzelii
AVSLQNSEM

SEQ ID NO: 203327 - protein, 9 aa, Borrelia afzelii
VSLQNSEMK

SEQ ID NO: 203328 - protein, 9 aa, Borrelia afzelii
SLQNSEMKY

SEQ ID NO: 203329 - protein, 9 aa, Borrelia afzelii
LQNSEMKYA

SEQ ID NO: 203330 - protein, 9 aa, Borrelia afzelii
QNSEMKYAI

SEQ ID NO: 203331 - protein, 9 aa, Borrelia afzelii
NSEMKYAII

SEQ ID NO: 203332 - protein, 9 aa, Borrelia afzelii
SEMKYAIID

SEQ ID NO: 203333 - protein, 9 aa, Borrelia afzelii
EMKYAIIDP

SEQ ID NO: 203334 - protein, 9 aa, Borrelia afzelii
MKYAIIDPV

SEQ ID NO: 203335 - protein, 9 aa, Borrelia afzelii
KYAIIDPVY

SEQ ID NO: 203336 - protein, 9 aa, Borrelia afzelii
YAIIDPVYS

SEQ ID NO: 203337 - protein, 9 aa, Borrelia afzelii
AIIDPVYSN

SEQ ID NO: 203338 - protein, 9 aa, Borrelia afzelii
IIDPVYSNE

SEQ ID NO: 203339 - protein, 9 aa, Borrelia afzelii
IDPVYSNEP

SEQ ID NO: 203340 - protein, 9 aa, Borrelia afzelii
DPVYSNEPI

SEQ ID NO: 203341 - protein, 9 aa, Borrelia afzelii
PVYSNEPIP

SEQ ID NO: 203342 - protein, 9 aa, Borrelia afzelii
VYSNEPIPA

SEQ ID NO: 203343 - protein, 9 aa, Borrelia afzelii
YSNEPIPAN

SEQ ID NO: 203344 - protein, 9 aa, Borrelia afzelii
SNEPIPANL

SEQ ID NO: 203345 - protein, 9 aa, Borrelia afzelii
NEPIPANLV

SEQ ID NO: 203346 - protein, 9 aa, Borrelia afzelii
EPIPANLVG

SEQ ID NO: 203347 - protein, 9 aa, Borrelia afzelii
PIPANLVGM

SEQ ID NO: 203348 - protein, 9 aa, Borrelia afzelii
IPANLVGMT

SEQ ID NO: 203349 - protein, 9 aa, Borrelia afzelii
PANLVGMTF

SEQ ID NO: 203350 - protein, 9 aa, Borrelia afzelii
ANLVGMTFR

SEQ ID NO: 203351 - protein, 9 aa, Borrelia afzelii
NLVGMTFRA

SEQ ID NO: 203352 - protein, 9 aa, Borrelia afzelii
LVGMTFRAQ

SEQ ID NO: 203353 - protein, 9 aa, Borrelia afzelii
VGMTFRAQE

SEQ ID NO: 203354 - protein, 9 aa, Borrelia afzelii
GMTFRAQEG

SEQ ID NO: 203355 - protein, 9 aa, Borrelia afzelii
MTFRAQEGA

SEQ ID NO: 203356 - protein, 9 aa, Borrelia afzelii
TFRAQEGAF

SEQ ID NO: 203357 - protein, 9 aa, Borrelia afzelii
FRAQEGAFL

SEQ ID NO: 203358 - protein, 9 aa, Borrelia afzelii
RAQEGAFLT

SEQ ID NO: 203359 - protein, 9 aa, Borrelia afzelii
AQEGAFLTG

SEQ ID NO: 203360 - protein, 9 aa, Borrelia afzelii
QEGAFLTGY

SEQ ID NO: 203361 - protein, 9 aa, Borrelia afzelii
EGAFLTGYI

SEQ ID NO: 203362 - protein, 9 aa, Borrelia afzelii
GAFLTGYIA

SEQ ID NO: 203363 - protein, 9 aa, Borrelia afzelii
AFLTGYIAA

SEQ ID NO: 203364 - protein, 9 aa, Borrelia afzelii
FLTGYIAAK

SEQ ID NO: 203365 - protein, 9 aa, Borrelia afzelii
LTGYIAAKV

SEQ ID NO: 203366 - protein, 9 aa, Borrelia afzelii
TGYIAAKVS

SEQ ID NO: 203367 - protein, 9 aa, Borrelia afzelii
GYIAAKVSK

SEQ ID NO: 203368 - protein, 9 aa, Borrelia afzelii
YIAAKVSKT

SEQ ID NO: 203369 - protein, 9 aa, Borrelia afzelii
IAAKVSKTG

SEQ ID NO: 203370 - protein, 9 aa, Borrelia afzelii
AAKVSKTGK

SEQ ID NO: 203371 - protein, 9 aa, Borrelia afzelii
AKVSKTGKI

SEQ ID NO: 203372 - protein, 9 aa, Borrelia afzelii
KVSKTGKIG

SEQ ID NO: 203373 - protein, 9 aa, Borrelia afzelii
VSKTGKIGF

SEQ ID NO: 203374 - protein, 9 aa, Borrelia afzelii
SKTGKIGFL

SEQ ID NO: 203375 - protein, 9 aa, Borrelia afzelii
KTGKIGFLG

SEQ ID NO: 203376 - protein, 9 aa, Borrelia afzelii
TGKIGFLGG

SEQ ID NO: 203377 - protein, 9 aa, Borrelia afzelii
GKIGFLGGI

SEQ ID NO: 203378 - protein, 9 aa, Borrelia afzelii
KIGFLGGIE

SEQ ID NO: 203379 - protein, 9 aa, Borrelia afzelii
IGFLGGIEG

SEQ ID NO: 203380 - protein, 9 aa, Borrelia afzelii
GFLGGIEGD

SEQ ID NO: 203381 - protein, 9 aa, Borrelia afzelii
FLGGIEGDI

SEQ ID NO: 203382 - protein, 9 aa, Borrelia afzelii
LGGIEGDIV

SEQ ID NO: 203383 - protein, 9 aa, Borrelia afzelii
GGIEGDIVD

SEQ ID NO: 203384 - protein, 9 aa, Borrelia afzelii
GIEGDIVDA

SEQ ID NO: 203385 - protein, 9 aa, Borrelia afzelii
IEGDIVDAF

SEQ ID NO: 203386 - protein, 9 aa, Borrelia afzelii
EGDIVDAFR

SEQ ID NO: 203387 - protein, 9 aa, Borrelia afzelii
GDIVDAFRY

SEQ ID NO: 203388 - protein, 9 aa, Borrelia afzelii
DIVDAFRYG

SEQ ID NO: 203389 - protein, 9 aa, Borrelia afzelii
IVDAFRYGY

SEQ ID NO: 203390 - protein, 9 aa, Borrelia afzelii
VDAFRYGYE

SEQ ID NO: 203391 - protein, 9 aa, Borrelia afzelii
DAFRYGYEA

SEQ ID NO: 203392 - protein, 9 aa, Borrelia afzelii
AFRYGYEAG

SEQ ID NO: 203393 - protein, 9 aa, Borrelia afzelii
FRYGYEAGA

SEQ ID NO: 203394 - protein, 9 aa, Borrelia afzelii
RYGYEAGAK

SEQ ID NO: 203395 - protein, 9 aa, Borrelia afzelii
YGYEAGAKY

SEQ ID NO: 203396 - protein, 9 aa, Borrelia afzelii
GYEAGAKYA

SEQ ID NO: 203397 - protein, 9 aa, Borrelia afzelii
YEAGAKYAN

SEQ ID NO: 203398 - protein, 9 aa, Borrelia afzelii
EAGAKYANK

SEQ ID NO: 203399 - protein, 9 aa, Borrelia afzelii
AGAKYANKD

SEQ ID NO: 203400 - protein, 9 aa, Borrelia afzelii
GAKYANKDI

SEQ ID NO: 203401 - protein, 9 aa, Borrelia afzelii
AKYANKDIK

SEQ ID NO: 203402 - protein, 9 aa, Borrelia afzelii
KYANKDIKI

SEQ ID NO: 203403 - protein, 9 aa, Borrelia afzelii
YANKDIKIF

SEQ ID NO: 203404 - protein, 9 aa, Borrelia afzelii
ANKDIKIFS

SEQ ID NO: 203405 - protein, 9 aa, Borrelia afzelii
NKDIKIFSQ

SEQ ID NO: 203406 - protein, 9 aa, Borrelia afzelii
KDIKIFSQY

SEQ ID NO: 203407 - protein, 9 aa, Borrelia afzelii
DIKIFSQYI

SEQ ID NO: 203408 - protein, 9 aa, Borrelia afzelii
IKIFSQYIG

SEQ ID NO: 203409 - protein, 9 aa, Borrelia afzelii
KIFSQYIGS

SEQ ID NO: 203410 - protein, 9 aa, Borrelia afzelii
IFSQYIGSF

SEQ ID NO: 203411 - protein, 9 aa, Borrelia afzelii
FSQYIGSFS

SEQ ID NO: 203412 - protein, 9 aa, Borrelia afzelii
SQYIGSFSD

SEQ ID NO: 203413 - protein, 9 aa, Borrelia afzelii
QYIGSFSDL

SEQ ID NO: 203414 - protein, 9 aa, Borrelia afzelii
YIGSFSDLE

SEQ ID NO: 203415 - protein, 9 aa, Borrelia afzelii
IGSFSDLEA

SEQ ID NO: 203416 - protein, 9 aa, Borrelia afzelii
GSFSDLEAG

SEQ ID NO: 203417 - protein, 9 aa, Borrelia afzelii
SFSDLEAGR

SEQ ID NO: 203418 - protein, 9 aa, Borrelia afzelii
FSDLEAGRS

SEQ ID NO: 203419 - protein, 9 aa, Borrelia afzelii
SDLEAGRSV

SEQ ID NO: 203420 - protein, 9 aa, Borrelia afzelii
DLEAGRSVA

SEQ ID NO: 203421 - protein, 9 aa, Borrelia afzelii
LEAGRSVAT

SEQ ID NO: 203422 - protein, 9 aa, Borrelia afzelii
EAGRSVATK

SEQ ID NO: 203423 - protein, 9 aa, Borrelia afzelii
AGRSVATKM

SEQ ID NO: 203424 - protein, 9 aa, Borrelia afzelii
GRSVATKMY

SEQ ID NO: 203425 - protein, 9 aa, Borrelia afzelii
RSVATKMYS

SEQ ID NO: 203426 - protein, 9 aa, Borrelia afzelii
SVATKMYSD

SEQ ID NO: 203427 - protein, 9 aa, Borrelia afzelii
VATKMYSDG

SEQ ID NO: 203428 - protein, 9 aa, Borrelia afzelii
ATKMYSDGI

SEQ ID NO: 203429 - protein, 9 aa, Borrelia afzelii
TKMYSDGID

SEQ ID NO: 203430 - protein, 9 aa, Borrelia afzelii
KMYSDGIDI

SEQ ID NO: 203431 - protein, 9 aa, Borrelia afzelii
MYSDGIDII

SEQ ID NO: 203432 - protein, 9 aa, Borrelia afzelii
YSDGIDIIH

SEQ ID NO: 203433 - protein, 9 aa, Borrelia afzelii
SDGIDIIHH

SEQ ID NO: 203434 - protein, 9 aa, Borrelia afzelii
DGIDIIHHA

SEQ ID NO: 203435 - protein, 9 aa, Borrelia afzelii
GIDIIHHAA

SEQ ID NO: 203436 - protein, 9 aa, Borrelia afzelii
IDIIHHAAG

SEQ ID NO: 203437 - protein, 9 aa, Borrelia afzelii
DIIHHAAGL

SEQ ID NO: 203438 - protein, 9 aa, Borrelia afzelii
IIHHAAGLG

SEQ ID NO: 203439 - protein, 9 aa, Borrelia afzelii
IHHAAGLGG

SEQ ID NO: 203440 - protein, 9 aa, Borrelia afzelii
HHAAGLGGI

SEQ ID NO: 203441 - protein, 9 aa, Borrelia afzelii
HAAGLGGIG

SEQ ID NO: 203442 - protein, 9 aa, Borrelia afzelii
AAGLGGIGA

SEQ ID NO: 203443 - protein, 9 aa, Borrelia afzelii
AGLGGIGAI

SEQ ID NO: 203444 - protein, 9 aa, Borrelia afzelii
GLGGIGAIE

SEQ ID NO: 203445 - protein, 9 aa, Borrelia afzelii
LGGIGAIEV

SEQ ID NO: 203446 - protein, 9 aa, Borrelia afzelii
GGIGAIEVA

SEQ ID NO: 203447 - protein, 9 aa, Borrelia afzelii
GIGAIEVAK

SEQ ID NO: 203448 - protein, 9 aa, Borrelia afzelii
IGAIEVAKE

SEQ ID NO: 203449 - protein, 9 aa, Borrelia afzelii
GAIEVAKEL

SEQ ID NO: 203450 - protein, 9 aa, Borrelia afzelii
AIEVAKELG

SEQ ID NO: 203451 - protein, 9 aa, Borrelia afzelii
IEVAKELGS

SEQ ID NO: 203452 - protein, 9 aa, Borrelia afzelii
EVAKELGSG

SEQ ID NO: 203453 - protein, 9 aa, Borrelia afzelii
VAKELGSGH

SEQ ID NO: 203454 - protein, 9 aa, Borrelia afzelii
AKELGSGHY

SEQ ID NO: 203455 - protein, 9 aa, Borrelia afzelii
KELGSGHYI

SEQ ID NO: 203456 - protein, 9 aa, Borrelia afzelii
ELGSGHYII

SEQ ID NO: 203457 - protein, 9 aa, Borrelia afzelii
LGSGHYIIG

SEQ ID NO: 203458 - protein, 9 aa, Borrelia afzelii
GSGHYIIGV

SEQ ID NO: 203459 - protein, 9 aa, Borrelia afzelii
SGHYIIGVD

SEQ ID NO: 203460 - protein, 9 aa, Borrelia afzelii
GHYIIGVDE

SEQ ID NO: 203461 - protein, 9 aa, Borrelia afzelii
HYIIGVDED

SEQ ID NO: 203462 - protein, 9 aa, Borrelia afzelii
YIIGVDEDQ

SEQ ID NO: 203463 - protein, 9 aa, Borrelia afzelii
IIGVDEDQS

SEQ ID NO: 203464 - protein, 9 aa, Borrelia afzelii
IGVDEDQSY

SEQ ID NO: 203465 - protein, 9 aa, Borrelia afzelii
GVDEDQSYL

SEQ ID NO: 203466 - protein, 9 aa, Borrelia afzelii
VDEDQSYLA

SEQ ID NO: 203467 - protein, 9 aa, Borrelia afzelii
DEDQSYLAP

SEQ ID NO: 203468 - protein, 9 aa, Borrelia afzelii
EDQSYLAPN

SEQ ID NO: 203469 - protein, 9 aa, Borrelia afzelii
DQSYLAPNN

SEQ ID NO: 203470 - protein, 9 aa, Borrelia afzelii
QSYLAPNNV

SEQ ID NO: 203471 - protein, 9 aa, Borrelia afzelii
SYLAPNNVI

SEQ ID NO: 203472 - protein, 9 aa, Borrelia afzelii
YLAPNNVIT

SEQ ID NO: 203473 - protein, 9 aa, Borrelia afzelii
LAPNNVITS

SEQ ID NO: 203474 - protein, 9 aa, Borrelia afzelii
APNNVITST

SEQ ID NO: 203475 - protein, 9 aa, Borrelia afzelii
PNNVITSTT

SEQ ID NO: 203476 - protein, 9 aa, Borrelia afzelii
NNVITSTTK

SEQ ID NO: 203477 - protein, 9 aa, Borrelia afzelii
NVITSTTKD

SEQ ID NO: 203478 - protein, 9 aa, Borrelia afzelii
VITSTTKDV

SEQ ID NO: 203479 - protein, 9 aa, Borrelia afzelii
ITSTTKDVG

SEQ ID NO: 203480 - protein, 9 aa, Borrelia afzelii
TSTTKDVGR

SEQ ID NO: 203481 - protein, 9 aa, Borrelia afzelii
STTKDVGRS

SEQ ID NO: 203482 - protein, 9 aa, Borrelia afzelii
TTKDVGRSL

SEQ ID NO: 203483 - protein, 9 aa, Borrelia afzelii
TKDVGRSLN

SEQ ID NO: 203484 - protein, 9 aa, Borrelia afzelii
KDVGRSLNL

SEQ ID NO: 203485 - protein, 9 aa, Borrelia afzelii
DVGRSLNLL

SEQ ID NO: 203486 - protein, 9 aa, Borrelia afzelii
VGRSLNLLT

SEQ ID NO: 203487 - protein, 9 aa, Borrelia afzelii
GRSLNLLTS

SEQ ID NO: 203488 - protein, 9 aa, Borrelia afzelii
RSLNLLTSN

SEQ ID NO: 203489 - protein, 9 aa, Borrelia afzelii
SLNLLTSNY

SEQ ID NO: 203490 - protein, 9 aa, Borrelia afzelii
LNLLTSNYL

SEQ ID NO: 203491 - protein, 9 aa, Borrelia afzelii
NLLTSNYLK

SEQ ID NO: 203492 - protein, 9 aa, Borrelia afzelii
LLTSNYLKT

SEQ ID NO: 203493 - protein, 9 aa, Borrelia afzelii
LTSNYLKTN

SEQ ID NO: 203494 - protein, 9 aa, Borrelia afzelii
TSNYLKTNT

SEQ ID NO: 203495 - protein, 9 aa, Borrelia afzelii
SNYLKTNTF

SEQ ID NO: 203496 - protein, 9 aa, Borrelia afzelii
NYLKTNTFE

SEQ ID NO: 203497 - protein, 9 aa, Borrelia afzelii
YLKTNTFEG

SEQ ID NO: 203498 - protein, 9 aa, Borrelia afzelii
LKTNTFEGG

SEQ ID NO: 203499 - protein, 9 aa, Borrelia afzelii
KTNTFEGGK

SEQ ID NO: 203500 - protein, 9 aa, Borrelia afzelii
TNTFEGGKL

SEQ ID NO: 203501 - protein, 9 aa, Borrelia afzelii
NTFEGGKLI

SEQ ID NO: 203502 - protein, 9 aa, Borrelia afzelii
TFEGGKLIN

SEQ ID NO: 203503 - protein, 9 aa, Borrelia afzelii
FEGGKLINY

SEQ ID NO: 203504 - protein, 9 aa, Borrelia afzelii
EGGKLINYG

SEQ ID NO: 203505 - protein, 9 aa, Borrelia afzelii
GGKLINYGL

SEQ ID NO: 203506 - protein, 9 aa, Borrelia afzelii
GKLINYGLK

SEQ ID NO: 203507 - protein, 9 aa, Borrelia afzelii
KLINYGLKE

SEQ ID NO: 203508 - protein, 9 aa, Borrelia afzelii
LINYGLKEG

SEQ ID NO: 203509 - protein, 9 aa, Borrelia afzelii
INYGLKEGV

SEQ ID NO: 203510 - protein, 9 aa, Borrelia afzelii
NYGLKEGVV

SEQ ID NO: 203511 - protein, 9 aa, Borrelia afzelii
YGLKEGVVG

SEQ ID NO: 203512 - protein, 9 aa, Borrelia afzelii
GLKEGVVGF

SEQ ID NO: 203513 - protein, 9 aa, Borrelia afzelii
LKEGVVGFV

SEQ ID NO: 203514 - protein, 9 aa, Borrelia afzelii
KEGVVGFVR

SEQ ID NO: 203515 - protein, 9 aa, Borrelia afzelii
EGVVGFVRN

SEQ ID NO: 203516 - protein, 9 aa, Borrelia afzelii
GVVGFVRNP

SEQ ID NO: 203517 - protein, 9 aa, Borrelia afzelii
VVGFVRNPK

SEQ ID NO: 203518 - protein, 9 aa, Borrelia afzelii
VGFVRNPKM

SEQ ID NO: 203519 - protein, 9 aa, Borrelia afzelii
GFVRNPKMI

SEQ ID NO: 203520 - protein, 9 aa, Borrelia afzelii
FVRNPKMIP

SEQ ID NO: 203521 - protein, 9 aa, Borrelia afzelii
VRNPKMIPF

SEQ ID NO: 203522 - protein, 9 aa, Borrelia afzelii
RNPKMIPFE

SEQ ID NO: 203523 - protein, 9 aa, Borrelia afzelii
NPKMIPFEV

SEQ ID NO: 203524 - protein, 9 aa, Borrelia afzelii
PKMIPFEVE

SEQ ID NO: 203525 - protein, 9 aa, Borrelia afzelii
KMIPFEVEK

SEQ ID NO: 203526 - protein, 9 aa, Borrelia afzelii
MIPFEVEKE

SEQ ID NO: 203527 - protein, 9 aa, Borrelia afzelii
IPFEVEKEI

SEQ ID NO: 203528 - protein, 9 aa, Borrelia afzelii
PFEVEKEID

SEQ ID NO: 203529 - protein, 9 aa, Borrelia afzelii
FEVEKEIDS

SEQ ID NO: 203530 - protein, 9 aa, Borrelia afzelii
EVEKEIDSL

SEQ ID NO: 203531 - protein, 9 aa, Borrelia afzelii
VEKEIDSLS

SEQ ID NO: 203532 - protein, 9 aa, Borrelia afzelii
EKEIDSLSS

SEQ ID NO: 203533 - protein, 9 aa, Borrelia afzelii
KEIDSLSSK

SEQ ID NO: 203534 - protein, 9 aa, Borrelia afzelii
EIDSLSSKI

SEQ ID NO: 203535 - protein, 9 aa, Borrelia afzelii
IDSLSSKII

SEQ ID NO: 203536 - protein, 9 aa, Borrelia afzelii
DSLSSKIIN

SEQ ID NO: 203537 - protein, 9 aa, Borrelia afzelii
SLSSKIINK

SEQ ID NO: 203538 - protein, 9 aa, Borrelia afzelii
LSSKIINKE

SEQ ID NO: 203539 - protein, 9 aa, Borrelia afzelii
SSKIINKEV

SEQ ID NO: 203540 - protein, 9 aa, Borrelia afzelii
SKIINKEVI

SEQ ID NO: 203541 - protein, 9 aa, Borrelia afzelii
KIINKEVIV

SEQ ID NO: 203542 - protein, 9 aa, Borrelia afzelii
IINKEVIVP

SEQ ID NO: 203543 - protein, 9 aa, Borrelia afzelii
INKEVIVPY

SEQ ID NO: 203544 - protein, 9 aa, Borrelia afzelii
NKEVIVPYN

SEQ ID NO: 203545 - protein, 9 aa, Borrelia afzelii
KEVIVPYNK

SEQ ID NO: 203546 - protein, 9 aa, Borrelia afzelii
EVIVPYNKE

SEQ ID NO: 203547 - protein, 9 aa, Borrelia afzelii
VIVPYNKES

SEQ ID NO: 203548 - protein, 9 aa, Borrelia afzelii
IVPYNKESY

SEQ ID NO: 203549 - protein, 9 aa, Borrelia afzelii
VPYNKESYE

SEQ ID NO: 203550 - protein, 9 aa, Borrelia afzelii
PYNKESYEK

SEQ ID NO: 203551 - protein, 9 aa, Borrelia afzelii
YNKESYEKF

SEQ ID NO: 203552 - protein, 9 aa, Borrelia afzelii
NKESYEKFL

SEQ ID NO: 203553 - protein, 9 aa, Borrelia afzelii
KESYEKFLK

SEQ ID NO: 203554 - protein, 9 aa, Borrelia afzelii
ESYEKFLKE

SEQ ID NO: 203555 - protein, 9 aa, Borrelia afzelii
SYEKFLKEF

SEQ ID NO: 203556 - protein, 9 aa, Borrelia afzelii
YEKFLKEFI

SEQ ID NO: 203557 - protein, 10 aa, Borrelia afzelii
FLSCSGKSGL

SEQ ID NO: 203558 - protein, 10 aa, Borrelia afzelii
LSCSGKSGLE

SEQ ID NO: 203559 - protein, 10 aa, Borrelia afzelii
SCSGKSGLES

SEQ ID NO: 203560 - protein, 10 aa, Borrelia afzelii
CSGKSGLESG

SEQ ID NO: 203561 - protein, 10 aa, Borrelia afzelii
SGKSGLESGI

SEQ ID NO: 203562 - protein, 10 aa, Borrelia afzelii
GKSGLESGIP

SEQ ID NO: 203563 - protein, 10 aa, Borrelia afzelii
KSGLESGIPK

SEQ ID NO: 203564 - protein, 10 aa, Borrelia afzelii
SGLESGIPKV

SEQ ID NO: 203565 - protein, 10 aa, Borrelia afzelii
GLESGIPKVS

SEQ ID NO: 203566 - protein, 10 aa, Borrelia afzelii
LESGIPKVSL

SEQ ID NO: 203567 - protein, 10 aa, Borrelia afzelii
ESGIPKVSLV

SEQ ID NO: 203568 - protein, 10 aa, Borrelia afzelii
SGIPKVSLVI

SEQ ID NO: 203569 - protein, 10 aa, Borrelia afzelii
GIPKVSLVID

SEQ ID NO: 203570 - protein, 10 aa, Borrelia afzelii
IPKVSLVIDG

SEQ ID NO: 203571 - protein, 10 aa, Borrelia afzelii
PKVSLVIDGT

SEQ ID NO: 203572 - protein, 10 aa, Borrelia afzelii
KVSLVIDGTF

SEQ ID NO: 203573 - protein, 10 aa, Borrelia afzelii
VSLVIDGTFD

SEQ ID NO: 203574 - protein, 10 aa, Borrelia afzelii
SLVIDGTFDD

SEQ ID NO: 203575 - protein, 10 aa, Borrelia afzelii
LVIDGTFDDK

SEQ ID NO: 203576 - protein, 10 aa, Borrelia afzelii
VIDGTFDDKS

SEQ ID NO: 203577 - protein, 10 aa, Borrelia afzelii
IDGTFDDKSF

SEQ ID NO: 203578 - protein, 10 aa, Borrelia afzelii
DGTFDDKSFN

SEQ ID NO: 203579 - protein, 10 aa, Borrelia afzelii
GTFDDKSFNE

SEQ ID NO: 203580 - protein, 10 aa, Borrelia afzelii
TFDDKSFNES

SEQ ID NO: 203581 - protein, 10 aa, Borrelia afzelii
FDDKSFNESA

SEQ ID NO: 203582 - protein, 10 aa, Borrelia afzelii
DDKSFNESAL

SEQ ID NO: 203583 - protein, 10 aa, Borrelia afzelii
DKSFNESALN

SEQ ID NO: 203584 - protein, 10 aa, Borrelia afzelii
KSFNESALNG

SEQ ID NO: 203585 - protein, 10 aa, Borrelia afzelii
SFNESALNGV

SEQ ID NO: 203586 - protein, 10 aa, Borrelia afzelii
FNESALNGVK

SEQ ID NO: 203587 - protein, 10 aa, Borrelia afzelii
NESALNGVKK

SEQ ID NO: 203588 - protein, 10 aa, Borrelia afzelii
ESALNGVKKL

SEQ ID NO: 203589 - protein, 10 aa, Borrelia afzelii
SALNGVKKLK

SEQ ID NO: 203590 - protein, 10 aa, Borrelia afzelii
ALNGVKKLKE

SEQ ID NO: 203591 - protein, 10 aa, Borrelia afzelii
LNGVKKLKEE

SEQ ID NO: 203592 - protein, 10 aa, Borrelia afzelii
NGVKKLKEEF

SEQ ID NO: 203593 - protein, 10 aa, Borrelia afzelii
GVKKLKEEFE

SEQ ID NO: 203594 - protein, 10 aa, Borrelia afzelii
VKKLKEEFEI

SEQ ID NO: 203595 - protein, 10 aa, Borrelia afzelii
KKLKEEFEIE

SEQ ID NO: 203596 - protein, 10 aa, Borrelia afzelii
KLKEEFEIEL

SEQ ID NO: 203597 - protein, 10 aa, Borrelia afzelii
LKEEFEIELV

SEQ ID NO: 203598 - protein, 10 aa, Borrelia afzelii
KEEFEIELVL

SEQ ID NO: 203599 - protein, 10 aa, Borrelia afzelii
EEFEIELVLK

SEQ ID NO: 203600 - protein, 10 aa, Borrelia afzelii
EFEIELVLKE

SEQ ID NO: 203601 - protein, 10 aa, Borrelia afzelii
FEIELVLKES

SEQ ID NO: 203602 - protein, 10 aa, Borrelia afzelii
EIELVLKESS

SEQ ID NO: 203603 - protein, 10 aa, Borrelia afzelii
IELVLKESST

SEQ ID NO: 203604 - protein, 10 aa, Borrelia afzelii
ELVLKESSTN

SEQ ID NO: 203605 - protein, 10 aa, Borrelia afzelii
LVLKESSTNS

SEQ ID NO: 203606 - protein, 10 aa, Borrelia afzelii
VLKESSTNSY

SEQ ID NO: 203607 - protein, 10 aa, Borrelia afzelii
LKESSTNSYL

SEQ ID NO: 203608 - protein, 10 aa, Borrelia afzelii
KESSTNSYLS

SEQ ID NO: 203609 - protein, 10 aa, Borrelia afzelii
ESSTNSYLSD

SEQ ID NO: 203610 - protein, 10 aa, Borrelia afzelii
SSTNSYLSDL

SEQ ID NO: 203611 - protein, 10 aa, Borrelia afzelii
STNSYLSDLE

SEQ ID NO: 203612 - protein, 10 aa, Borrelia afzelii
TNSYLSDLEG

SEQ ID NO: 203613 - protein, 10 aa, Borrelia afzelii
NSYLSDLEGL

SEQ ID NO: 203614 - protein, 10 aa, Borrelia afzelii
SYLSDLEGLK

SEQ ID NO: 203615 - protein, 10 aa, Borrelia afzelii
YLSDLEGLKD

SEQ ID NO: 203616 - protein, 10 aa, Borrelia afzelii
LSDLEGLKDA

SEQ ID NO: 203617 - protein, 10 aa, Borrelia afzelii
SDLEGLKDAG

SEQ ID NO: 203618 - protein, 10 aa, Borrelia afzelii
DLEGLKDAGS

SEQ ID NO: 203619 - protein, 10 aa, Borrelia afzelii
LEGLKDAGSN

SEQ ID NO: 203620 - protein, 10 aa, Borrelia afzelii
EGLKDAGSNL

SEQ ID NO: 203621 - protein, 10 aa, Borrelia afzelii
GLKDAGSNLI

SEQ ID NO: 203622 - protein, 10 aa, Borrelia afzelii
LKDAGSNLIW

SEQ ID NO: 203623 - protein, 10 aa, Borrelia afzelii
KDAGSNLIWL

SEQ ID NO: 203624 - protein, 10 aa, Borrelia afzelii
DAGSNLIWLI

SEQ ID NO: 203625 - protein, 10 aa, Borrelia afzelii
AGSNLIWLIG

SEQ ID NO: 203626 - protein, 10 aa, Borrelia afzelii
GSNLIWLIGY

SEQ ID NO: 203627 - protein, 10 aa, Borrelia afzelii
SNLIWLIGYK

SEQ ID NO: 203628 - protein, 10 aa, Borrelia afzelii
NLIWLIGYKF

SEQ ID NO: 203629 - protein, 10 aa, Borrelia afzelii
LIWLIGYKFS

SEQ ID NO: 203630 - protein, 10 aa, Borrelia afzelii
IWLIGYKFSD

SEQ ID NO: 203631 - protein, 10 aa, Borrelia afzelii
WLIGYKFSDV

SEQ ID NO: 203632 - protein, 10 aa, Borrelia afzelii
LIGYKFSDVA

SEQ ID NO: 203633 - protein, 10 aa, Borrelia afzelii
IGYKFSDVAK

SEQ ID NO: 203634 - protein, 10 aa, Borrelia afzelii
GYKFSDVAKA

SEQ ID NO: 203635 - protein, 10 aa, Borrelia afzelii
YKFSDVAKAV

SEQ ID NO: 203636 - protein, 10 aa, Borrelia afzelii
KFSDVAKAVS

SEQ ID NO: 203637 - protein, 10 aa, Borrelia afzelii
FSDVAKAVSL

SEQ ID NO: 203638 - protein, 10 aa, Borrelia afzelii
SDVAKAVSLQ

SEQ ID NO: 203639 - protein, 10 aa, Borrelia afzelii
DVAKAVSLQN

SEQ ID NO: 203640 - protein, 10 aa, Borrelia afzelii
VAKAVSLQNS

SEQ ID NO: 203641 - protein, 10 aa, Borrelia afzelii
AKAVSLQNSE

SEQ ID NO: 203642 - protein, 10 aa, Borrelia afzelii
KAVSLQNSEM

SEQ ID NO: 203643 - protein, 10 aa, Borrelia afzelii
AVSLQNSEMK

SEQ ID NO: 203644 - protein, 10 aa, Borrelia afzelii
VSLQNSEMKY

SEQ ID NO: 203645 - protein, 10 aa, Borrelia afzelii
SLQNSEMKYA

SEQ ID NO: 203646 - protein, 10 aa, Borrelia afzelii
LQNSEMKYAI

SEQ ID NO: 203647 - protein, 10 aa, Borrelia afzelii
QNSEMKYAII

SEQ ID NO: 203648 - protein, 10 aa, Borrelia afzelii
NSEMKYAIID

SEQ ID NO: 203649 - protein, 10 aa, Borrelia afzelii
SEMKYAIIDP

SEQ ID NO: 203650 - protein, 10 aa, Borrelia afzelii
EMKYAIIDPV

SEQ ID NO: 203651 - protein, 10 aa, Borrelia afzelii
MKYAIIDPVY

SEQ ID NO: 203652 - protein, 10 aa, Borrelia afzelii
KYAIIDPVYS

SEQ ID NO: 203653 - protein, 10 aa, Borrelia afzelii
YAIIDPVYSN

SEQ ID NO: 203654 - protein, 10 aa, Borrelia afzelii
AIIDPVYSNE

SEQ ID NO: 203655 - protein, 10 aa, Borrelia afzelii
IIDPVYSNEP

SEQ ID NO: 203656 - protein, 10 aa, Borrelia afzelii
IDPVYSNEPI

SEQ ID NO: 203657 - protein, 10 aa, Borrelia afzelii
DPVYSNEPIP

SEQ ID NO: 203658 - protein, 10 aa, Borrelia afzelii
PVYSNEPIPA

SEQ ID NO: 203659 - protein, 10 aa, Borrelia afzelii
VYSNEPIPAN

SEQ ID NO: 203660 - protein, 10 aa, Borrelia afzelii
YSNEPIPANL

SEQ ID NO: 203661 - protein, 10 aa, Borrelia afzelii
SNEPIPANLV

SEQ ID NO: 203662 - protein, 10 aa, Borrelia afzelii
NEPIPANLVG

SEQ ID NO: 203663 - protein, 10 aa, Borrelia afzelii
EPIPANLVGM

SEQ ID NO: 203664 - protein, 10 aa, Borrelia afzelii
PIPANLVGMT

SEQ ID NO: 203665 - protein, 10 aa, Borrelia afzelii
IPANLVGMTF

SEQ ID NO: 203666 - protein, 10 aa, Borrelia afzelii
PANLVGMTFR

SEQ ID NO: 203667 - protein, 10 aa, Borrelia afzelii
ANLVGMTFRA

SEQ ID NO: 203668 - protein, 10 aa, Borrelia afzelii
NLVGMTFRAQ

SEQ ID NO: 203669 - protein, 10 aa, Borrelia afzelii
LVGMTFRAQE

SEQ ID NO: 203670 - protein, 10 aa, Borrelia afzelii
VGMTFRAQEG

SEQ ID NO: 203671 - protein, 10 aa, Borrelia afzelii
GMTFRAQEGA

SEQ ID NO: 203672 - protein, 10 aa, Borrelia afzelii
MTFRAQEGAF

SEQ ID NO: 203673 - protein, 10 aa, Borrelia afzelii
TFRAQEGAFL

SEQ ID NO: 203674 - protein, 10 aa, Borrelia afzelii
FRAQEGAFLT

SEQ ID NO: 203675 - protein, 10 aa, Borrelia afzelii
RAQEGAFLTG

SEQ ID NO: 203676 - protein, 10 aa, Borrelia afzelii
AQEGAFLTGY

SEQ ID NO: 203677 - protein, 10 aa, Borrelia afzelii
QEGAFLTGYI

SEQ ID NO: 203678 - protein, 10 aa, Borrelia afzelii
EGAFLTGYIA

SEQ ID NO: 203679 - protein, 10 aa, Borrelia afzelii
GAFLTGYIAA

SEQ ID NO: 203680 - protein, 10 aa, Borrelia afzelii
AFLTGYIAAK

SEQ ID NO: 203681 - protein, 10 aa, Borrelia afzelii
FLTGYIAAKV

SEQ ID NO: 203682 - protein, 10 aa, Borrelia afzelii
LTGYIAAKVS

SEQ ID NO: 203683 - protein, 10 aa, Borrelia afzelii
TGYIAAKVSK

SEQ ID NO: 203684 - protein, 10 aa, Borrelia afzelii
GYIAAKVSKT

SEQ ID NO: 203685 - protein, 10 aa, Borrelia afzelii
YIAAKVSKTG

SEQ ID NO: 203686 - protein, 10 aa, Borrelia afzelii
IAAKVSKTGK

SEQ ID NO: 203687 - protein, 10 aa, Borrelia afzelii
AAKVSKTGKI

SEQ ID NO: 203688 - protein, 10 aa, Borrelia afzelii
AKVSKTGKIG

SEQ ID NO: 203689 - protein, 10 aa, Borrelia afzelii
KVSKTGKIGF

SEQ ID NO: 203690 - protein, 10 aa, Borrelia afzelii
VSKTGKIGFL

SEQ ID NO: 203691 - protein, 10 aa, Borrelia afzelii
SKTGKIGFLG

SEQ ID NO: 203692 - protein, 10 aa, Borrelia afzelii
KTGKIGFLGG

SEQ ID NO: 203693 - protein, 10 aa, Borrelia afzelii
TGKIGFLGGI

SEQ ID NO: 203694 - protein, 10 aa, Borrelia afzelii
GKIGFLGGIE

SEQ ID NO: 203695 - protein, 10 aa, Borrelia afzelii
KIGFLGGIEG

SEQ ID NO: 203696 - protein, 10 aa, Borrelia afzelii
IGFLGGIEGD

SEQ ID NO: 203697 - protein, 10 aa, Borrelia afzelii
GFLGGIEGDI

SEQ ID NO: 203698 - protein, 10 aa, Borrelia afzelii
FLGGIEGDIV

SEQ ID NO: 203699 - protein, 10 aa, Borrelia afzelii
LGGIEGDIVD

SEQ ID NO: 203700 - protein, 10 aa, Borrelia afzelii
GGIEGDIVDA

SEQ ID NO: 203701 - protein, 10 aa, Borrelia afzelii
GIEGDIVDAF

SEQ ID NO: 203702 - protein, 10 aa, Borrelia afzelii
IEGDIVDAFR

SEQ ID NO: 203703 - protein, 10 aa, Borrelia afzelii
EGDIVDAFRY

SEQ ID NO: 203704 - protein, 10 aa, Borrelia afzelii
GDIVDAFRYG

SEQ ID NO: 203705 - protein, 10 aa, Borrelia afzelii
DIVDAFRYGY

SEQ ID NO: 203706 - protein, 10 aa, Borrelia afzelii
IVDAFRYGYE

SEQ ID NO: 203707 - protein, 10 aa, Borrelia afzelii
VDAFRYGYEA

SEQ ID NO: 203708 - protein, 10 aa, Borrelia afzelii
DAFRYGYEAG

SEQ ID NO: 203709 - protein, 10 aa, Borrelia afzelii
AFRYGYEAGA

SEQ ID NO: 203710 - protein, 10 aa, Borrelia afzelii
FRYGYEAGAK

SEQ ID NO: 203711 - protein, 10 aa, Borrelia afzelii
RYGYEAGAKY

SEQ ID NO: 203712 - protein, 10 aa, Borrelia afzelii
YGYEAGAKYA

SEQ ID NO: 203713 - protein, 10 aa, Borrelia afzelii
GYEAGAKYAN

SEQ ID NO: 203714 - protein, 10 aa, Borrelia afzelii
YEAGAKYANK

SEQ ID NO: 203715 - protein, 10 aa, Borrelia afzelii
EAGAKYANKD

SEQ ID NO: 203716 - protein, 10 aa, Borrelia afzelii
AGAKYANKDI

SEQ ID NO: 203717 - protein, 10 aa, Borrelia afzelii
GAKYANKDIK

SEQ ID NO: 203718 - protein, 10 aa, Borrelia afzelii
AKYANKDIKI

SEQ ID NO: 203719 - protein, 10 aa, Borrelia afzelii
KYANKDIKIF

SEQ ID NO: 203720 - protein, 10 aa, Borrelia afzelii
YANKDIKIFS

SEQ ID NO: 203721 - protein, 10 aa, Borrelia afzelii
ANKDIKIFSQ

SEQ ID NO: 203722 - protein, 10 aa, Borrelia afzelii
NKDIKIFSQY

SEQ ID NO: 203723 - protein, 10 aa, Borrelia afzelii
KDIKIFSQYI

SEQ ID NO: 203724 - protein, 10 aa, Borrelia afzelii
DIKIFSQYIG

SEQ ID NO: 203725 - protein, 10 aa, Borrelia afzelii
IKIFSQYIGS

SEQ ID NO: 203726 - protein, 10 aa, Borrelia afzelii
KIFSQYIGSF

SEQ ID NO: 203727 - protein, 10 aa, Borrelia afzelii
IFSQYIGSFS

SEQ ID NO: 203728 - protein, 10 aa, Borrelia afzelii
FSQYIGSFSD

SEQ ID NO: 203729 - protein, 10 aa, Borrelia afzelii
SQYIGSFSDL

SEQ ID NO: 203730 - protein, 10 aa, Borrelia afzelii
QYIGSFSDLE

SEQ ID NO: 203731 - protein, 10 aa, Borrelia afzelii
YIGSFSDLEA

SEQ ID NO: 203732 - protein, 10 aa, Borrelia afzelii
IGSFSDLEAG

SEQ ID NO: 203733 - protein, 10 aa, Borrelia afzelii
GSFSDLEAGR

SEQ ID NO: 203734 - protein, 10 aa, Borrelia afzelii
SFSDLEAGRS

SEQ ID NO: 203735 - protein, 10 aa, Borrelia afzelii
FSDLEAGRSV

SEQ ID NO: 203736 - protein, 10 aa, Borrelia afzelii
SDLEAGRSVA

SEQ ID NO: 203737 - protein, 10 aa, Borrelia afzelii
DLEAGRSVAT

SEQ ID NO: 203738 - protein, 10 aa, Borrelia afzelii
LEAGRSVATK

SEQ ID NO: 203739 - protein, 10 aa, Borrelia afzelii
EAGRSVATKM

SEQ ID NO: 203740 - protein, 10 aa, Borrelia afzelii
AGRSVATKMY

SEQ ID NO: 203741 - protein, 10 aa, Borrelia afzelii
GRSVATKMYS

SEQ ID NO: 203742 - protein, 10 aa, Borrelia afzelii
RSVATKMYSD

SEQ ID NO: 203743 - protein, 10 aa, Borrelia afzelii
SVATKMYSDG

SEQ ID NO: 203744 - protein, 10 aa, Borrelia afzelii
VATKMYSDGI

SEQ ID NO: 203745 - protein, 10 aa, Borrelia afzelii
ATKMYSDGID

SEQ ID NO: 203746 - protein, 10 aa, Borrelia afzelii
TKMYSDGIDI

SEQ ID NO: 203747 - protein, 10 aa, Borrelia afzelii
KMYSDGIDII

SEQ ID NO: 203748 - protein, 10 aa, Borrelia afzelii
MYSDGIDIIH

SEQ ID NO: 203749 - protein, 10 aa, Borrelia afzelii
YSDGIDIIHH

SEQ ID NO: 203750 - protein, 10 aa, Borrelia afzelii
SDGIDIIHHA

SEQ ID NO: 203751 - protein, 10 aa, Borrelia afzelii
DGIDIIHHAA

SEQ ID NO: 203752 - protein, 10 aa, Borrelia afzelii
GIDIIHHAAG

SEQ ID NO: 203753 - protein, 10 aa, Borrelia afzelii
IDIIHHAAGL

SEQ ID NO: 203754 - protein, 10 aa, Borrelia afzelii
DIIHHAAGLG

SEQ ID NO: 203755 - protein, 10 aa, Borrelia afzelii
IIHHAAGLGG

SEQ ID NO: 203756 - protein, 10 aa, Borrelia afzelii
IHHAAGLGGI

SEQ ID NO: 203757 - protein, 10 aa, Borrelia afzelii
HHAAGLGGIG

SEQ ID NO: 203758 - protein, 10 aa, Borrelia afzelii
HAAGLGGIGA

SEQ ID NO: 203759 - protein, 10 aa, Borrelia afzelii
AAGLGGIGAI

SEQ ID NO: 203760 - protein, 10 aa, Borrelia afzelii
AGLGGIGAIE

SEQ ID NO: 203761 - protein, 10 aa, Borrelia afzelii
GLGGIGAIEV

SEQ ID NO: 203762 - protein, 10 aa, Borrelia afzelii
LGGIGAIEVA

SEQ ID NO: 203763 - protein, 10 aa, Borrelia afzelii
GGIGAIEVAK

SEQ ID NO: 203764 - protein, 10 aa, Borrelia afzelii
GIGAIEVAKE

SEQ ID NO: 203765 - protein, 10 aa, Borrelia afzelii
IGAIEVAKEL

SEQ ID NO: 203766 - protein, 10 aa, Borrelia afzelii
GAIEVAKELG

SEQ ID NO: 203767 - protein, 10 aa, Borrelia afzelii
AIEVAKELGS

SEQ ID NO: 203768 - protein, 10 aa, Borrelia afzelii
IEVAKELGSG

SEQ ID NO: 203769 - protein, 10 aa, Borrelia afzelii
EVAKELGSGH

SEQ ID NO: 203770 - protein, 10 aa, Borrelia afzelii
VAKELGSGHY

SEQ ID NO: 203771 - protein, 10 aa, Borrelia afzelii
AKELGSGHYI

SEQ ID NO: 203772 - protein, 10 aa, Borrelia afzelii
KELGSGHYII

SEQ ID NO: 203773 - protein, 10 aa, Borrelia afzelii
ELGSGHYIIG

SEQ ID NO: 203774 - protein, 10 aa, Borrelia afzelii
LGSGHYIIGV

SEQ ID NO: 203775 - protein, 10 aa, Borrelia afzelii
GSGHYIIGVD

SEQ ID NO: 203776 - protein, 10 aa, Borrelia afzelii
SGHYIIGVDE

SEQ ID NO: 203777 - protein, 10 aa, Borrelia afzelii
GHYIIGVDED

SEQ ID NO: 203778 - protein, 10 aa, Borrelia afzelii
HYIIGVDEDQ

SEQ ID NO: 203779 - protein, 10 aa, Borrelia afzelii
YIIGVDEDQS

SEQ ID NO: 203780 - protein, 10 aa, Borrelia afzelii
IIGVDEDQSY

SEQ ID NO: 203781 - protein, 10 aa, Borrelia afzelii
IGVDEDQSYL

SEQ ID NO: 203782 - protein, 10 aa, Borrelia afzelii
GVDEDQSYLA

SEQ ID NO: 203783 - protein, 10 aa, Borrelia afzelii
VDEDQSYLAP

SEQ ID NO: 203784 - protein, 10 aa, Borrelia afzelii
DEDQSYLAPN

SEQ ID NO: 203785 - protein, 10 aa, Borrelia afzelii
EDQSYLAPNN

SEQ ID NO: 203786 - protein, 10 aa, Borrelia afzelii
DQSYLAPNNV

SEQ ID NO: 203787 - protein, 10 aa, Borrelia afzelii
QSYLAPNNVI

SEQ ID NO: 203788 - protein, 10 aa, Borrelia afzelii
SYLAPNNVIT

SEQ ID NO: 203789 - protein, 10 aa, Borrelia afzelii
YLAPNNVITS

SEQ ID NO: 203790 - protein, 10 aa, Borrelia afzelii
LAPNNVITST

SEQ ID NO: 203791 - protein, 10 aa, Borrelia afzelii
APNNVITSTT

SEQ ID NO: 203792 - protein, 10 aa, Borrelia afzelii
PNNVITSTTK

SEQ ID NO: 203793 - protein, 10 aa, Borrelia afzelii
NNVITSTTKD

SEQ ID NO: 203794 - protein, 10 aa, Borrelia afzelii
NVITSTTKDV

SEQ ID NO: 203795 - protein, 10 aa, Borrelia afzelii
VITSTTKDVG

SEQ ID NO: 203796 - protein, 10 aa, Borrelia afzelii
ITSTTKDVGR

SEQ ID NO: 203797 - protein, 10 aa, Borrelia afzelii
TSTTKDVGRS

SEQ ID NO: 203798 - protein, 10 aa, Borrelia afzelii
STTKDVGRSL

SEQ ID NO: 203799 - protein, 10 aa, Borrelia afzelii
TTKDVGRSLN

SEQ ID NO: 203800 - protein, 10 aa, Borrelia afzelii
TKDVGRSLNL

SEQ ID NO: 203801 - protein, 10 aa, Borrelia afzelii
KDVGRSLNLL

SEQ ID NO: 203802 - protein, 10 aa, Borrelia afzelii
DVGRSLNLLT

SEQ ID NO: 203803 - protein, 10 aa, Borrelia afzelii
VGRSLNLLTS

SEQ ID NO: 203804 - protein, 10 aa, Borrelia afzelii
GRSLNLLTSN

SEQ ID NO: 203805 - protein, 10 aa, Borrelia afzelii
RSLNLLTSNY

SEQ ID NO: 203806 - protein, 10 aa, Borrelia afzelii
SLNLLTSNYL

SEQ ID NO: 203807 - protein, 10 aa, Borrelia afzelii
LNLLTSNYLK

SEQ ID NO: 203808 - protein, 10 aa, Borrelia afzelii
NLLTSNYLKT

SEQ ID NO: 203809 - protein, 10 aa, Borrelia afzelii
LLTSNYLKTN

SEQ ID NO: 203810 - protein, 10 aa, Borrelia afzelii
LTSNYLKTNT

SEQ ID NO: 203811 - protein, 10 aa, Borrelia afzelii
TSNYLKTNTF

SEQ ID NO: 203812 - protein, 10 aa, Borrelia afzelii
SNYLKTNTFE

SEQ ID NO: 203813 - protein, 10 aa, Borrelia afzelii
NYLKTNTFEG

SEQ ID NO: 203814 - protein, 10 aa, Borrelia afzelii
YLKTNTFEGG

SEQ ID NO: 203815 - protein, 10 aa, Borrelia afzelii
LKTNTFEGGK

SEQ ID NO: 203816 - protein, 10 aa, Borrelia afzelii
KTNTFEGGKL

SEQ ID NO: 203817 - protein, 10 aa, Borrelia afzelii
TNTFEGGKLI

SEQ ID NO: 203818 - protein, 10 aa, Borrelia afzelii
NTFEGGKLIN

SEQ ID NO: 203819 - protein, 10 aa, Borrelia afzelii
TFEGGKLINY

SEQ ID NO: 203820 - protein, 10 aa, Borrelia afzelii
FEGGKLINYG

SEQ ID NO: 203821 - protein, 10 aa, Borrelia afzelii
EGGKLINYGL

SEQ ID NO: 203822 - protein, 10 aa, Borrelia afzelii
GGKLINYGLK

SEQ ID NO: 203823 - protein, 10 aa, Borrelia afzelii
GKLINYGLKE

SEQ ID NO: 203824 - protein, 10 aa, Borrelia afzelii
KLINYGLKEG

SEQ ID NO: 203825 - protein, 10 aa, Borrelia afzelii
LINYGLKEGV

SEQ ID NO: 203826 - protein, 10 aa, Borrelia afzelii
INYGLKEGVV

SEQ ID NO: 203827 - protein, 10 aa, Borrelia afzelii
NYGLKEGVVG

SEQ ID NO: 203828 - protein, 10 aa, Borrelia afzelii
YGLKEGVVGF

SEQ ID NO: 203829 - protein, 10 aa, Borrelia afzelii
GLKEGVVGFV

SEQ ID NO: 203830 - protein, 10 aa, Borrelia afzelii
LKEGVVGFVR

SEQ ID NO: 203831 - protein, 10 aa, Borrelia afzelii
KEGVVGFVRN

SEQ ID NO: 203832 - protein, 10 aa, Borrelia afzelii
EGVVGFVRNP

SEQ ID NO: 203833 - protein, 10 aa, Borrelia afzelii
GVVGFVRNPK

SEQ ID NO: 203834 - protein, 10 aa, Borrelia afzelii
VVGFVRNPKM

SEQ ID NO: 203835 - protein, 10 aa, Borrelia afzelii
VGFVRNPKMI

SEQ ID NO: 203836 - protein, 10 aa, Borrelia afzelii
GFVRNPKMIP

SEQ ID NO: 203837 - protein, 10 aa, Borrelia afzelii
FVRNPKMIPF

SEQ ID NO: 203838 - protein, 10 aa, Borrelia afzelii
VRNPKMIPFE

SEQ ID NO: 203839 - protein, 10 aa, Borrelia afzelii
RNPKMIPFEV

SEQ ID NO: 203840 - protein, 10 aa, Borrelia afzelii
NPKMIPFEVE

SEQ ID NO: 203841 - protein, 10 aa, Borrelia afzelii
PKMIPFEVEK

SEQ ID NO: 203842 - protein, 10 aa, Borrelia afzelii
KMIPFEVEKE

SEQ ID NO: 203843 - protein, 10 aa, Borrelia afzelii
MIPFEVEKEI

SEQ ID NO: 203844 - protein, 10 aa, Borrelia afzelii
IPFEVEKEID

SEQ ID NO: 203845 - protein, 10 aa, Borrelia afzelii
PFEVEKEIDS

SEQ ID NO: 203846 - protein, 10 aa, Borrelia afzelii
FEVEKEIDSL

SEQ ID NO: 203847 - protein, 10 aa, Borrelia afzelii
EVEKEIDSLS

SEQ ID NO: 203848 - protein, 10 aa, Borrelia afzelii
VEKEIDSLSS

SEQ ID NO: 203849 - protein, 10 aa, Borrelia afzelii
EKEIDSLSSK

SEQ ID NO: 203850 - protein, 10 aa, Borrelia afzelii
KEIDSLSSKI

SEQ ID NO: 203851 - protein, 10 aa, Borrelia afzelii
EIDSLSSKII

SEQ ID NO: 203852 - protein, 10 aa, Borrelia afzelii
IDSLSSKIIN

SEQ ID NO: 203853 - protein, 10 aa, Borrelia afzelii
DSLSSKIINK

SEQ ID NO: 203854 - protein, 10 aa, Borrelia afzelii
SLSSKIINKE

SEQ ID NO: 203855 - protein, 10 aa, Borrelia afzelii
LSSKIINKEV

SEQ ID NO: 203856 - protein, 10 aa, Borrelia afzelii
SSKIINKEVI

SEQ ID NO: 203857 - protein, 10 aa, Borrelia afzelii
SKIINKEVIV

SEQ ID NO: 203858 - protein, 10 aa, Borrelia afzelii
KIINKEVIVP

SEQ ID NO: 203859 - protein, 10 aa, Borrelia afzelii
IINKEVIVPY

SEQ ID NO: 203860 - protein, 10 aa, Borrelia afzelii
INKEVIVPYN

SEQ ID NO: 203861 - protein, 10 aa, Borrelia afzelii
NKEVIVPYNK

SEQ ID NO: 203862 - protein, 10 aa, Borrelia afzelii
KEVIVPYNKE

SEQ ID NO: 203863 - protein, 10 aa, Borrelia afzelii
EVIVPYNKES

SEQ ID NO: 203864 - protein, 10 aa, Borrelia afzelii
VIVPYNKESY

SEQ ID NO: 203865 - protein, 10 aa, Borrelia afzelii
IVPYNKESYE

SEQ ID NO: 203866 - protein, 10 aa, Borrelia afzelii
VPYNKESYEK

SEQ ID NO: 203867 - protein, 10 aa, Borrelia afzelii
PYNKESYEKF

SEQ ID NO: 203868 - protein, 10 aa, Borrelia afzelii
YNKESYEKFL

SEQ ID NO: 203869 - protein, 10 aa, Borrelia afzelii
NKESYEKFLK

SEQ ID NO: 203870 - protein, 10 aa, Borrelia afzelii
KESYEKFLKE

SEQ ID NO: 203871 - protein, 10 aa, Borrelia afzelii
ESYEKFLKEF

SEQ ID NO: 203872 - protein, 10 aa, Borrelia afzelii
SYEKFLKEFI

SEQ ID NO: 203873 - protein, 11 aa, Borrelia afzelii
FLSCSGKSGLE

SEQ ID NO: 203874 - protein, 11 aa, Borrelia afzelii
LSCSGKSGLES

SEQ ID NO: 203875 - protein, 11 aa, Borrelia afzelii
SCSGKSGLESG

SEQ ID NO: 203876 - protein, 11 aa, Borrelia afzelii
CSGKSGLESGI

SEQ ID NO: 203877 - protein, 11 aa, Borrelia afzelii
SGKSGLESGIP

SEQ ID NO: 203878 - protein, 11 aa, Borrelia afzelii
GKSGLESGIPK

SEQ ID NO: 203879 - protein, 11 aa, Borrelia afzelii
KSGLESGIPKV

SEQ ID NO: 203880 - protein, 11 aa, Borrelia afzelii
SGLESGIPKVS

SEQ ID NO: 203881 - protein, 11 aa, Borrelia afzelii
GLESGIPKVSL

SEQ ID NO: 203882 - protein, 11 aa, Borrelia afzelii
LESGIPKVSLV

SEQ ID NO: 203883 - protein, 11 aa, Borrelia afzelii
ESGIPKVSLVI

SEQ ID NO: 203884 - protein, 11 aa, Borrelia afzelii
SGIPKVSLVID

SEQ ID NO: 203885 - protein, 11 aa, Borrelia afzelii
GIPKVSLVIDG

SEQ ID NO: 203886 - protein, 11 aa, Borrelia afzelii
IPKVSLVIDGT

SEQ ID NO: 203887 - protein, 11 aa, Borrelia afzelii
PKVSLVIDGTF

SEQ ID NO: 203888 - protein, 11 aa, Borrelia afzelii
KVSLVIDGTFD

SEQ ID NO: 203889 - protein, 11 aa, Borrelia afzelii
VSLVIDGTFDD

SEQ ID NO: 203890 - protein, 11 aa, Borrelia afzelii
SLVIDGTFDDK

SEQ ID NO: 203891 - protein, 11 aa, Borrelia afzelii
LVIDGTFDDKS

SEQ ID NO: 203892 - protein, 11 aa, Borrelia afzelii
VIDGTFDDKSF

SEQ ID NO: 203893 - protein, 11 aa, Borrelia afzelii
IDGTFDDKSFN

SEQ ID NO: 203894 - protein, 11 aa, Borrelia afzelii
DGTFDDKSFNE

SEQ ID NO: 203895 - protein, 11 aa, Borrelia afzelii
GTFDDKSFNES

SEQ ID NO: 203896 - protein, 11 aa, Borrelia afzelii
TFDDKSFNESA

SEQ ID NO: 203897 - protein, 11 aa, Borrelia afzelii
FDDKSFNESAL

SEQ ID NO: 203898 - protein, 11 aa, Borrelia afzelii
DDKSFNESALN

SEQ ID NO: 203899 - protein, 11 aa, Borrelia afzelii
DKSFNESALNG

SEQ ID NO: 203900 - protein, 11 aa, Borrelia afzelii
KSFNESALNGV

SEQ ID NO: 203901 - protein, 11 aa, Borrelia afzelii
SFNESALNGVK

SEQ ID NO: 203902 - protein, 11 aa, Borrelia afzelii
FNESALNGVKK

SEQ ID NO: 203903 - protein, 11 aa, Borrelia afzelii
NESALNGVKKL

SEQ ID NO: 203904 - protein, 11 aa, Borrelia afzelii
ESALNGVKKLK

SEQ ID NO: 203905 - protein, 11 aa, Borrelia afzelii
SALNGVKKLKE

SEQ ID NO: 203906 - protein, 11 aa, Borrelia afzelii
ALNGVKKLKEE

SEQ ID NO: 203907 - protein, 11 aa, Borrelia afzelii
LNGVKKLKEEF

SEQ ID NO: 203908 - protein, 11 aa, Borrelia afzelii
NGVKKLKEEFE

SEQ ID NO: 203909 - protein, 11 aa, Borrelia afzelii
GVKKLKEEFEI

SEQ ID NO: 203910 - protein, 11 aa, Borrelia afzelii
VKKLKEEFEIE

SEQ ID NO: 203911 - protein, 11 aa, Borrelia afzelii
KKLKEEFEIEL

SEQ ID NO: 203912 - protein, 11 aa, Borrelia afzelii
KLKEEFEIELV

SEQ ID NO: 203913 - protein, 11 aa, Borrelia afzelii
LKEEFEIELVL

SEQ ID NO: 203914 - protein, 11 aa, Borrelia afzelii
KEEFEIELVLK

SEQ ID NO: 203915 - protein, 11 aa, Borrelia afzelii
EEFEIELVLKE

SEQ ID NO: 203916 - protein, 11 aa, Borrelia afzelii
EFEIELVLKES

SEQ ID NO: 203917 - protein, 11 aa, Borrelia afzelii
FEIELVLKESS

SEQ ID NO: 203918 - protein, 11 aa, Borrelia afzelii
EIELVLKESST

SEQ ID NO: 203919 - protein, 11 aa, Borrelia afzelii
IELVLKESSTN

SEQ ID NO: 203920 - protein, 11 aa, Borrelia afzelii
ELVLKESSTNS

SEQ ID NO: 203921 - protein, 11 aa, Borrelia afzelii
LVLKESSTNSY

SEQ ID NO: 203922 - protein, 11 aa, Borrelia afzelii
VLKESSTNSYL

SEQ ID NO: 203923 - protein, 11 aa, Borrelia afzelii
LKESSTNSYLS

SEQ ID NO: 203924 - protein, 11 aa, Borrelia afzelii
KESSTNSYLSD

SEQ ID NO: 203925 - protein, 11 aa, Borrelia afzelii
ESSTNSYLSDL

SEQ ID NO: 203926 - protein, 11 aa, Borrelia afzelii
SSTNSYLSDLE

SEQ ID NO: 203927 - protein, 11 aa, Borrelia afzelii
STNSYLSDLEG

SEQ ID NO: 203928 - protein, 11 aa, Borrelia afzelii
TNSYLSDLEGL

SEQ ID NO: 203929 - protein, 11 aa, Borrelia afzelii
NSYLSDLEGLK

SEQ ID NO: 203930 - protein, 11 aa, Borrelia afzelii
SYLSDLEGLKD

SEQ ID NO: 203931 - protein, 11 aa, Borrelia afzelii
YLSDLEGLKDA

SEQ ID NO: 203932 - protein, 11 aa, Borrelia afzelii
LSDLEGLKDAG

SEQ ID NO: 203933 - protein, 11 aa, Borrelia afzelii
SDLEGLKDAGS

SEQ ID NO: 203934 - protein, 11 aa, Borrelia afzelii
DLEGLKDAGSN

SEQ ID NO: 203935 - protein, 11 aa, Borrelia afzelii
LEGLKDAGSNL

SEQ ID NO: 203936 - protein, 11 aa, Borrelia afzelii
EGLKDAGSNLI

SEQ ID NO: 203937 - protein, 11 aa, Borrelia afzelii
GLKDAGSNLIW

SEQ ID NO: 203938 - protein, 11 aa, Borrelia afzelii
LKDAGSNLIWL

SEQ ID NO: 203939 - protein, 11 aa, Borrelia afzelii
KDAGSNLIWLI

SEQ ID NO: 203940 - protein, 11 aa, Borrelia afzelii
DAGSNLIWLIG

SEQ ID NO: 203941 - protein, 11 aa, Borrelia afzelii
AGSNLIWLIGY

SEQ ID NO: 203942 - protein, 11 aa, Borrelia afzelii
GSNLIWLIGYK

SEQ ID NO: 203943 - protein, 11 aa, Borrelia afzelii
SNLIWLIGYKF

SEQ ID NO: 203944 - protein, 11 aa, Borrelia afzelii
NLIWLIGYKFS

SEQ ID NO: 203945 - protein, 11 aa, Borrelia afzelii
LIWLIGYKFSD

SEQ ID NO: 203946 - protein, 11 aa, Borrelia afzelii
IWLIGYKFSDV

SEQ ID NO: 203947 - protein, 11 aa, Borrelia afzelii
WLIGYKFSDVA

SEQ ID NO: 203948 - protein, 11 aa, Borrelia afzelii
LIGYKFSDVAK

SEQ ID NO: 203949 - protein, 11 aa, Borrelia afzelii
IGYKFSDVAKA

SEQ ID NO: 203950 - protein, 11 aa, Borrelia afzelii
GYKFSDVAKAV

SEQ ID NO: 203951 - protein, 11 aa, Borrelia afzelii
YKFSDVAKAVS

SEQ ID NO: 203952 - protein, 11 aa, Borrelia afzelii
KFSDVAKAVSL

SEQ ID NO: 203953 - protein, 11 aa, Borrelia afzelii
FSDVAKAVSLQ

SEQ ID NO: 203954 - protein, 11 aa, Borrelia afzelii
SDVAKAVSLQN

SEQ ID NO: 203955 - protein, 11 aa, Borrelia afzelii
DVAKAVSLQNS

SEQ ID NO: 203956 - protein, 11 aa, Borrelia afzelii
VAKAVSLQNSE

SEQ ID NO: 203957 - protein, 11 aa, Borrelia afzelii
AKAVSLQNSEM

SEQ ID NO: 203958 - protein, 11 aa, Borrelia afzelii
KAVSLQNSEMK

SEQ ID NO: 203959 - protein, 11 aa, Borrelia afzelii
AVSLQNSEMKY

SEQ ID NO: 203960 - protein, 11 aa, Borrelia afzelii
VSLQNSEMKYA

SEQ ID NO: 203961 - protein, 11 aa, Borrelia afzelii
SLQNSEMKYAI

SEQ ID NO: 203962 - protein, 11 aa, Borrelia afzelii
LQNSEMKYAII

SEQ ID NO: 203963 - protein, 11 aa, Borrelia afzelii
QNSEMKYAIID

SEQ ID NO: 203964 - protein, 11 aa, Borrelia afzelii
NSEMKYAIIDP

SEQ ID NO: 203965 - protein, 11 aa, Borrelia afzelii
SEMKYAIIDPV

SEQ ID NO: 203966 - protein, 11 aa, Borrelia afzelii
EMKYAIIDPVY

SEQ ID NO: 203967 - protein, 11 aa, Borrelia afzelii
MKYAIIDPVYS

SEQ ID NO: 203968 - protein, 11 aa, Borrelia afzelii
KYAIIDPVYSN

SEQ ID NO: 203969 - protein, 11 aa, Borrelia afzelii
YAIIDPVYSNE

SEQ ID NO: 203970 - protein, 11 aa, Borrelia afzelii
AIIDPVYSNEP

SEQ ID NO: 203971 - protein, 11 aa, Borrelia afzelii
IIDPVYSNEPI

SEQ ID NO: 203972 - protein, 11 aa, Borrelia afzelii
IDPVYSNEPIP

SEQ ID NO: 203973 - protein, 11 aa, Borrelia afzelii
DPVYSNEPIPA

SEQ ID NO: 203974 - protein, 11 aa, Borrelia afzelii
PVYSNEPIPAN

SEQ ID NO: 203975 - protein, 11 aa, Borrelia afzelii
VYSNEPIPANL

SEQ ID NO: 203976 - protein, 11 aa, Borrelia afzelii
YSNEPIPANLV

SEQ ID NO: 203977 - protein, 11 aa, Borrelia afzelii
SNEPIPANLVG

SEQ ID NO: 203978 - protein, 11 aa, Borrelia afzelii
NEPIPANLVGM

SEQ ID NO: 203979 - protein, 11 aa, Borrelia afzelii
EPIPANLVGMT

SEQ ID NO: 203980 - protein, 11 aa, Borrelia afzelii
PIPANLVGMTF

SEQ ID NO: 203981 - protein, 11 aa, Borrelia afzelii
IPANLVGMTFR

SEQ ID NO: 203982 - protein, 11 aa, Borrelia afzelii
PANLVGMTFRA

SEQ ID NO: 203983 - protein, 11 aa, Borrelia afzelii
ANLVGMTFRAQ

SEQ ID NO: 203984 - protein, 11 aa, Borrelia afzelii
NLVGMTFRAQE

SEQ ID NO: 203985 - protein, 11 aa, Borrelia afzelii
LVGMTFRAQEG

SEQ ID NO: 203986 - protein, 11 aa, Borrelia afzelii
VGMTFRAQEGA

SEQ ID NO: 203987 - protein, 11 aa, Borrelia afzelii
GMTFRAQEGAF

SEQ ID NO: 203988 - protein, 11 aa, Borrelia afzelii
MTFRAQEGAFL

SEQ ID NO: 203989 - protein, 11 aa, Borrelia afzelii
TFRAQEGAFLT

SEQ ID NO: 203990 - protein, 11 aa, Borrelia afzelii
FRAQEGAFLTG

SEQ ID NO: 203991 - protein, 11 aa, Borrelia afzelii
RAQEGAFLTGY

SEQ ID NO: 203992 - protein, 11 aa, Borrelia afzelii
AQEGAFLTGYI

SEQ ID NO: 203993 - protein, 11 aa, Borrelia afzelii
QEGAFLTGYIA

SEQ ID NO: 203994 - protein, 11 aa, Borrelia afzelii
EGAFLTGYIAA

SEQ ID NO: 203995 - protein, 11 aa, Borrelia afzelii
GAFLTGYIAAK

SEQ ID NO: 203996 - protein, 11 aa, Borrelia afzelii
AFLTGYIAAKV

SEQ ID NO: 203997 - protein, 11 aa, Borrelia afzelii
FLTGYIAAKVS

SEQ ID NO: 203998 - protein, 11 aa, Borrelia afzelii
LTGYIAAKVSK

SEQ ID NO: 203999 - protein, 11 aa, Borrelia afzelii
TGYIAAKVSKT

SEQ ID NO: 204000 - protein, 11 aa, Borrelia afzelii
GYIAAKVSKTG

SEQ ID NO: 204001 - protein, 11 aa, Borrelia afzelii
YIAAKVSKTGK

SEQ ID NO: 204002 - protein, 11 aa, Borrelia afzelii
IAAKVSKTGKI

SEQ ID NO: 204003 - protein, 11 aa, Borrelia afzelii
AAKVSKTGKIG

SEQ ID NO: 204004 - protein, 11 aa, Borrelia afzelii
AKVSKTGKIGF

SEQ ID NO: 204005 - protein, 11 aa, Borrelia afzelii
KVSKTGKIGFL

SEQ ID NO: 204006 - protein, 11 aa, Borrelia afzelii
VSKTGKIGFLG

SEQ ID NO: 204007 - protein, 11 aa, Borrelia afzelii
SKTGKIGFLGG

SEQ ID NO: 204008 - protein, 11 aa, Borrelia afzelii
KTGKIGFLGGI

SEQ ID NO: 204009 - protein, 11 aa, Borrelia afzelii
TGKIGFLGGIE

SEQ ID NO: 204010 - protein, 11 aa, Borrelia afzelii
GKIGFLGGIEG

SEQ ID NO: 204011 - protein, 11 aa, Borrelia afzelii
KIGFLGGIEGD

SEQ ID NO: 204012 - protein, 11 aa, Borrelia afzelii
IGFLGGIEGDI

SEQ ID NO: 204013 - protein, 11 aa, Borrelia afzelii
GFLGGIEGDIV

SEQ ID NO: 204014 - protein, 11 aa, Borrelia afzelii
FLGGIEGDIVD

SEQ ID NO: 204015 - protein, 11 aa, Borrelia afzelii
LGGIEGDIVDA

SEQ ID NO: 204016 - protein, 11 aa, Borrelia afzelii
GGIEGDIVDAF

SEQ ID NO: 204017 - protein, 11 aa, Borrelia afzelii
GIEGDIVDAFR

SEQ ID NO: 204018 - protein, 11 aa, Borrelia afzelii
IEGDIVDAFRY

SEQ ID NO: 204019 - protein, 11 aa, Borrelia afzelii
EGDIVDAFRYG

SEQ ID NO: 204020 - protein, 11 aa, Borrelia afzelii
GDIVDAFRYGY

SEQ ID NO: 204021 - protein, 11 aa, Borrelia afzelii
DIVDAFRYGYE

SEQ ID NO: 204022 - protein, 11 aa, Borrelia afzelii
IVDAFRYGYEA

SEQ ID NO: 204023 - protein, 11 aa, Borrelia afzelii
VDAFRYGYEAG

SEQ ID NO: 204024 - protein, 11 aa, Borrelia afzelii
DAFRYGYEAGA

SEQ ID NO: 204025 - protein, 11 aa, Borrelia afzelii
AFRYGYEAGAK

SEQ ID NO: 204026 - protein, 11 aa, Borrelia afzelii
FRYGYEAGAKY

SEQ ID NO: 204027 - protein, 11 aa, Borrelia afzelii
RYGYEAGAKYA

SEQ ID NO: 204028 - protein, 11 aa, Borrelia afzelii
YGYEAGAKYAN

SEQ ID NO: 204029 - protein, 11 aa, Borrelia afzelii
GYEAGAKYANK

SEQ ID NO: 204030 - protein, 11 aa, Borrelia afzelii
YEAGAKYANKD

SEQ ID NO: 204031 - protein, 11 aa, Borrelia afzelii
EAGAKYANKDI

SEQ ID NO: 204032 - protein, 11 aa, Borrelia afzelii
AGAKYANKDIK

SEQ ID NO: 204033 - protein, 11 aa, Borrelia afzelii
GAKYANKDIKI

SEQ ID NO: 204034 - protein, 11 aa, Borrelia afzelii
AKYANKDIKIF

SEQ ID NO: 204035 - protein, 11 aa, Borrelia afzelii
KYANKDIKIFS

SEQ ID NO: 204036 - protein, 11 aa, Borrelia afzelii
YANKDIKIFSQ

SEQ ID NO: 204037 - protein, 11 aa, Borrelia afzelii
ANKDIKIFSQY

SEQ ID NO: 204038 - protein, 11 aa, Borrelia afzelii
NKDIKIFSQYI

SEQ ID NO: 204039 - protein, 11 aa, Borrelia afzelii
KDIKIFSQYIG

SEQ ID NO: 204040 - protein, 11 aa, Borrelia afzelii
DIKIFSQYIGS

SEQ ID NO: 204041 - protein, 11 aa, Borrelia afzelii
IKIFSQYIGSF

SEQ ID NO: 204042 - protein, 11 aa, Borrelia afzelii
KIFSQYIGSFS

SEQ ID NO: 204043 - protein, 11 aa, Borrelia afzelii
IFSQYIGSFSD

SEQ ID NO: 204044 - protein, 11 aa, Borrelia afzelii
FSQYIGSFSDL

SEQ ID NO: 204045 - protein, 11 aa, Borrelia afzelii
SQYIGSFSDLE

SEQ ID NO: 204046 - protein, 11 aa, Borrelia afzelii
QYIGSFSDLEA

SEQ ID NO: 204047 - protein, 11 aa, Borrelia afzelii
YIGSFSDLEAG

SEQ ID NO: 204048 - protein, 11 aa, Borrelia afzelii
IGSFSDLEAGR

SEQ ID NO: 204049 - protein, 11 aa, Borrelia afzelii
GSFSDLEAGRS

SEQ ID NO: 204050 - protein, 11 aa, Borrelia afzelii
SFSDLEAGRSV

SEQ ID NO: 204051 - protein, 11 aa, Borrelia afzelii
FSDLEAGRSVA

SEQ ID NO: 204052 - protein, 11 aa, Borrelia afzelii
SDLEAGRSVAT

SEQ ID NO: 204053 - protein, 11 aa, Borrelia afzelii
DLEAGRSVATK

SEQ ID NO: 204054 - protein, 11 aa, Borrelia afzelii
LEAGRSVATKM

SEQ ID NO: 204055 - protein, 11 aa, Borrelia afzelii
EAGRSVATKMY

SEQ ID NO: 204056 - protein, 11 aa, Borrelia afzelii
AGRSVATKMYS

SEQ ID NO: 204057 - protein, 11 aa, Borrelia afzelii
GRSVATKMYSD

SEQ ID NO: 204058 - protein, 11 aa, Borrelia afzelii
RSVATKMYSDG

SEQ ID NO: 204059 - protein, 11 aa, Borrelia afzelii
SVATKMYSDGI

SEQ ID NO: 204060 - protein, 11 aa, Borrelia afzelii
VATKMYSDGID

SEQ ID NO: 204061 - protein, 11 aa, Borrelia afzelii
ATKMYSDGIDI

SEQ ID NO: 204062 - protein, 11 aa, Borrelia afzelii
TKMYSDGIDII

SEQ ID NO: 204063 - protein, 11 aa, Borrelia afzelii
KMYSDGIDIIH

SEQ ID NO: 204064 - protein, 11 aa, Borrelia afzelii
MYSDGIDIIHH

SEQ ID NO: 204065 - protein, 11 aa, Borrelia afzelii
YSDGIDIIHHA

SEQ ID NO: 204066 - protein, 11 aa, Borrelia afzelii
SDGIDIIHHAA

SEQ ID NO: 204067 - protein, 11 aa, Borrelia afzelii
DGIDIIHHAAG

SEQ ID NO: 204068 - protein, 11 aa, Borrelia afzelii
GIDIIHHAAGL

SEQ ID NO: 204069 - protein, 11 aa, Borrelia afzelii
IDIIHHAAGLG

SEQ ID NO: 204070 - protein, 11 aa, Borrelia afzelii
DIIHHAAGLGG

SEQ ID NO: 204071 - protein, 11 aa, Borrelia afzelii
IIHHAAGLGGI

SEQ ID NO: 204072 - protein, 11 aa, Borrelia afzelii
IHHAAGLGGIG

SEQ ID NO: 204073 - protein, 11 aa, Borrelia afzelii
HHAAGLGGIGA

SEQ ID NO: 204074 - protein, 11 aa, Borrelia afzelii
HAAGLGGIGAI

SEQ ID NO: 204075 - protein, 11 aa, Borrelia afzelii
AAGLGGIGAIE

SEQ ID NO: 204076 - protein, 11 aa, Borrelia afzelii
AGLGGIGAIEV

SEQ ID NO: 204077 - protein, 11 aa, Borrelia afzelii
GLGGIGAIEVA

SEQ ID NO: 204078 - protein, 11 aa, Borrelia afzelii
LGGIGAIEVAK

SEQ ID NO: 204079 - protein, 11 aa, Borrelia afzelii
GGIGAIEVAKE

SEQ ID NO: 204080 - protein, 11 aa, Borrelia afzelii
GIGAIEVAKEL

SEQ ID NO: 204081 - protein, 11 aa, Borrelia afzelii
IGAIEVAKELG

SEQ ID NO: 204082 - protein, 11 aa, Borrelia afzelii
GAIEVAKELGS

SEQ ID NO: 204083 - protein, 11 aa, Borrelia afzelii
AIEVAKELGSG

SEQ ID NO: 204084 - protein, 11 aa, Borrelia afzelii
IEVAKELGSGH

SEQ ID NO: 204085 - protein, 11 aa, Borrelia afzelii
EVAKELGSGHY

SEQ ID NO: 204086 - protein, 11 aa, Borrelia afzelii
VAKELGSGHYI

SEQ ID NO: 204087 - protein, 11 aa, Borrelia afzelii
AKELGSGHYII

SEQ ID NO: 204088 - protein, 11 aa, Borrelia afzelii
KELGSGHYIIG

SEQ ID NO: 204089 - protein, 11 aa, Borrelia afzelii
ELGSGHYIIGV

SEQ ID NO: 204090 - protein, 11 aa, Borrelia afzelii
LGSGHYIIGVD

SEQ ID NO: 204091 - protein, 11 aa, Borrelia afzelii
GSGHYIIGVDE

SEQ ID NO: 204092 - protein, 11 aa, Borrelia afzelii
SGHYIIGVDED

SEQ ID NO: 204093 - protein, 11 aa, Borrelia afzelii
GHYIIGVDEDQ

SEQ ID NO: 204094 - protein, 11 aa, Borrelia afzelii
HYIIGVDEDQS

SEQ ID NO: 204095 - protein, 11 aa, Borrelia afzelii
YIIGVDEDQSY

SEQ ID NO: 204096 - protein, 11 aa, Borrelia afzelii
IIGVDEDQSYL

SEQ ID NO: 204097 - protein, 11 aa, Borrelia afzelii
IGVDEDQSYLA

SEQ ID NO: 204098 - protein, 11 aa, Borrelia afzelii
GVDEDQSYLAP

SEQ ID NO: 204099 - protein, 11 aa, Borrelia afzelii
VDEDQSYLAPN

SEQ ID NO: 204100 - protein, 11 aa, Borrelia afzelii
DEDQSYLAPNN

SEQ ID NO: 204101 - protein, 11 aa, Borrelia afzelii
EDQSYLAPNNV

SEQ ID NO: 204102 - protein, 11 aa, Borrelia afzelii
DQSYLAPNNVI

SEQ ID NO: 204103 - protein, 11 aa, Borrelia afzelii
QSYLAPNNVIT

SEQ ID NO: 204104 - protein, 11 aa, Borrelia afzelii
SYLAPNNVITS

SEQ ID NO: 204105 - protein, 11 aa, Borrelia afzelii
YLAPNNVITST

SEQ ID NO: 204106 - protein, 11 aa, Borrelia afzelii
LAPNNVITSTT

SEQ ID NO: 204107 - protein, 11 aa, Borrelia afzelii
APNNVITSTTK

SEQ ID NO: 204108 - protein, 11 aa, Borrelia afzelii
PNNVITSTTKD

SEQ ID NO: 204109 - protein, 11 aa, Borrelia afzelii
NNVITSTTKDV

SEQ ID NO: 204110 - protein, 11 aa, Borrelia afzelii
NVITSTTKDVG

SEQ ID NO: 204111 - protein, 11 aa, Borrelia afzelii
VITSTTKDVGR

SEQ ID NO: 204112 - protein, 11 aa, Borrelia afzelii
ITSTTKDVGRS

SEQ ID NO: 204113 - protein, 11 aa, Borrelia afzelii
TSTTKDVGRSL

SEQ ID NO: 204114 - protein, 11 aa, Borrelia afzelii
STTKDVGRSLN

SEQ ID NO: 204115 - protein, 11 aa, Borrelia afzelii
TTKDVGRSLNL

SEQ ID NO: 204116 - protein, 11 aa, Borrelia afzelii
TKDVGRSLNLL

SEQ ID NO: 204117 - protein, 11 aa, Borrelia afzelii
KDVGRSLNLLT

SEQ ID NO: 204118 - protein, 11 aa, Borrelia afzelii
DVGRSLNLLTS

SEQ ID NO: 204119 - protein, 11 aa, Borrelia afzelii
VGRSLNLLTSN

SEQ ID NO: 204120 - protein, 11 aa, Borrelia afzelii
GRSLNLLTSNY

SEQ ID NO: 204121 - protein, 11 aa, Borrelia afzelii
RSLNLLTSNYL

SEQ ID NO: 204122 - protein, 11 aa, Borrelia afzelii
SLNLLTSNYLK

SEQ ID NO: 204123 - protein, 11 aa, Borrelia afzelii
LNLLTSNYLKT

SEQ ID NO: 204124 - protein, 11 aa, Borrelia afzelii
NLLTSNYLKTN

SEQ ID NO: 204125 - protein, 11 aa, Borrelia afzelii
LLTSNYLKTNT

SEQ ID NO: 204126 - protein, 11 aa, Borrelia afzelii
LTSNYLKTNTF

SEQ ID NO: 204127 - protein, 11 aa, Borrelia afzelii
TSNYLKTNTFE

SEQ ID NO: 204128 - protein, 11 aa, Borrelia afzelii
SNYLKTNTFEG

SEQ ID NO: 204129 - protein, 11 aa, Borrelia afzelii
NYLKTNTFEGG

SEQ ID NO: 204130 - protein, 11 aa, Borrelia afzelii
YLKTNTFEGGK

SEQ ID NO: 204131 - protein, 11 aa, Borrelia afzelii
LKTNTFEGGKL

SEQ ID NO: 204132 - protein, 11 aa, Borrelia afzelii
KTNTFEGGKLI

SEQ ID NO: 204133 - protein, 11 aa, Borrelia afzelii
TNTFEGGKLIN

SEQ ID NO: 204134 - protein, 11 aa, Borrelia afzelii
NTFEGGKLINY

SEQ ID NO: 204135 - protein, 11 aa, Borrelia afzelii
TFEGGKLINYG

SEQ ID NO: 204136 - protein, 11 aa, Borrelia afzelii
FEGGKLINYGL

SEQ ID NO: 204137 - protein, 11 aa, Borrelia afzelii
EGGKLINYGLK

SEQ ID NO: 204138 - protein, 11 aa, Borrelia afzelii
GGKLINYGLKE

SEQ ID NO: 204139 - protein, 11 aa, Borrelia afzelii
GKLINYGLKEG

SEQ ID NO: 204140 - protein, 11 aa, Borrelia afzelii
KLINYGLKEGV

SEQ ID NO: 204141 - protein, 11 aa, Borrelia afzelii
LINYGLKEGVV

SEQ ID NO: 204142 - protein, 11 aa, Borrelia afzelii
INYGLKEGVVG

SEQ ID NO: 204143 - protein, 11 aa, Borrelia afzelii
NYGLKEGVVGF

SEQ ID NO: 204144 - protein, 11 aa, Borrelia afzelii
YGLKEGVVGFV

SEQ ID NO: 204145 - protein, 11 aa, Borrelia afzelii
GLKEGVVGFVR

SEQ ID NO: 204146 - protein, 11 aa, Borrelia afzelii
LKEGVVGFVRN

SEQ ID NO: 204147 - protein, 11 aa, Borrelia afzelii
KEGVVGFVRNP

SEQ ID NO: 204148 - protein, 11 aa, Borrelia afzelii
EGVVGFVRNPK

SEQ ID NO: 204149 - protein, 11 aa, Borrelia afzelii
GVVGFVRNPKM

SEQ ID NO: 204150 - protein, 11 aa, Borrelia afzelii
VVGFVRNPKMI

SEQ ID NO: 204151 - protein, 11 aa, Borrelia afzelii
VGFVRNPKMIP

SEQ ID NO: 204152 - protein, 11 aa, Borrelia afzelii
GFVRNPKMIPF

SEQ ID NO: 204153 - protein, 11 aa, Borrelia afzelii
FVRNPKMIPFE

SEQ ID NO: 204154 - protein, 11 aa, Borrelia afzelii
VRNPKMIPFEV

SEQ ID NO: 204155 - protein, 11 aa, Borrelia afzelii
RNPKMIPFEVE

SEQ ID NO: 204156 - protein, 11 aa, Borrelia afzelii
NPKMIPFEVEK

SEQ ID NO: 204157 - protein, 11 aa, Borrelia afzelii
PKMIPFEVEKE

SEQ ID NO: 204158 - protein, 11 aa, Borrelia afzelii
KMIPFEVEKEI

SEQ ID NO: 204159 - protein, 11 aa, Borrelia afzelii
MIPFEVEKEID

SEQ ID NO: 204160 - protein, 11 aa, Borrelia afzelii
IPFEVEKEIDS

SEQ ID NO: 204161 - protein, 11 aa, Borrelia afzelii
PFEVEKEIDSL

SEQ ID NO: 204162 - protein, 11 aa, Borrelia afzelii
FEVEKEIDSLS

SEQ ID NO: 204163 - protein, 11 aa, Borrelia afzelii
EVEKEIDSLSS

SEQ ID NO: 204164 - protein, 11 aa, Borrelia afzelii
VEKEIDSLSSK

SEQ ID NO: 204165 - protein, 11 aa, Borrelia afzelii
EKEIDSLSSKI

SEQ ID NO: 204166 - protein, 11 aa, Borrelia afzelii
KEIDSLSSKII

SEQ ID NO: 204167 - protein, 11 aa, Borrelia afzelii
EIDSLSSKIIN

SEQ ID NO: 204168 - protein, 11 aa, Borrelia afzelii
IDSLSSKIINK

SEQ ID NO: 204169 - protein, 11 aa, Borrelia afzelii
DSLSSKIINKE

SEQ ID NO: 204170 - protein, 11 aa, Borrelia afzelii
SLSSKIINKEV

SEQ ID NO: 204171 - protein, 11 aa, Borrelia afzelii
LSSKIINKEVI

SEQ ID NO: 204172 - protein, 11 aa, Borrelia afzelii
SSKIINKEVIV

SEQ ID NO: 204173 - protein, 11 aa, Borrelia afzelii
SKIINKEVIVP

SEQ ID NO: 204174 - protein, 11 aa, Borrelia afzelii
KIINKEVIVPY

SEQ ID NO: 204175 - protein, 11 aa, Borrelia afzelii
IINKEVIVPYN

SEQ ID NO: 204176 - protein, 11 aa, Borrelia afzelii
INKEVIVPYNK

SEQ ID NO: 204177 - protein, 11 aa, Borrelia afzelii
NKEVIVPYNKE

SEQ ID NO: 204178 - protein, 11 aa, Borrelia afzelii
KEVIVPYNKES

SEQ ID NO: 204179 - protein, 11 aa, Borrelia afzelii
EVIVPYNKESY

SEQ ID NO: 204180 - protein, 11 aa, Borrelia afzelii
VIVPYNKESYE

SEQ ID NO: 204181 - protein, 11 aa, Borrelia afzelii
IVPYNKESYEK

SEQ ID NO: 204182 - protein, 11 aa, Borrelia afzelii
VPYNKESYEKF

SEQ ID NO: 204183 - protein, 11 aa, Borrelia afzelii
PYNKESYEKFL

SEQ ID NO: 204184 - protein, 11 aa, Borrelia afzelii
YNKESYEKFLK

SEQ ID NO: 204185 - protein, 11 aa, Borrelia afzelii
NKESYEKFLKE

SEQ ID NO: 204186 - protein, 11 aa, Borrelia afzelii
KESYEKFLKEF

SEQ ID NO: 204187 - protein, 11 aa, Borrelia afzelii
ESYEKFLKEFI

SEQ ID NO: 204188 - protein, 13 aa, Borrelia afzelii
FLSCSGKSGLESG

SEQ ID NO: 204189 - protein, 13 aa, Borrelia afzelii
LSCSGKSGLESGI

SEQ ID NO: 204190 - protein, 13 aa, Borrelia afzelii
SCSGKSGLESGIP

SEQ ID NO: 204191 - protein, 13 aa, Borrelia afzelii
CSGKSGLESGIPK

SEQ ID NO: 204192 - protein, 13 aa, Borrelia afzelii
SGKSGLESGIPKV

SEQ ID NO: 204193 - protein, 13 aa, Borrelia afzelii
GKSGLESGIPKVS

SEQ ID NO: 204194 - protein, 13 aa, Borrelia afzelii
KSGLESGIPKVSL

SEQ ID NO: 204195 - protein, 13 aa, Borrelia afzelii
SGLESGIPKVSLV

SEQ ID NO: 204196 - protein, 13 aa, Borrelia afzelii
GLESGIPKVSLVI

SEQ ID NO: 204197 - protein, 13 aa, Borrelia afzelii
LESGIPKVSLVID

SEQ ID NO: 204198 - protein, 13 aa, Borrelia afzelii
ESGIPKVSLVIDG

SEQ ID NO: 204199 - protein, 13 aa, Borrelia afzelii
SGIPKVSLVIDGT

SEQ ID NO: 204200 - protein, 13 aa, Borrelia afzelii
GIPKVSLVIDGTF

SEQ ID NO: 204201 - protein, 13 aa, Borrelia afzelii
IPKVSLVIDGTFD

SEQ ID NO: 204202 - protein, 13 aa, Borrelia afzelii
PKVSLVIDGTFDD

SEQ ID NO: 204203 - protein, 13 aa, Borrelia afzelii
KVSLVIDGTFDDK

SEQ ID NO: 204204 - protein, 13 aa, Borrelia afzelii
VSLVIDGTFDDKS

SEQ ID NO: 204205 - protein, 13 aa, Borrelia afzelii
SLVIDGTFDDKSF

SEQ ID NO: 204206 - protein, 13 aa, Borrelia afzelii
LVIDGTFDDKSFN

SEQ ID NO: 204207 - protein, 13 aa, Borrelia afzelii
VIDGTFDDKSFNE

SEQ ID NO: 204208 - protein, 13 aa, Borrelia afzelii
IDGTFDDKSFNES

SEQ ID NO: 204209 - protein, 13 aa, Borrelia afzelii
DGTFDDKSFNESA

SEQ ID NO: 204210 - protein, 13 aa, Borrelia afzelii
GTFDDKSFNESAL

SEQ ID NO: 204211 - protein, 13 aa, Borrelia afzelii
TFDDKSFNESALN

SEQ ID NO: 204212 - protein, 13 aa, Borrelia afzelii
FDDKSFNESALNG

SEQ ID NO: 204213 - protein, 13 aa, Borrelia afzelii
DDKSFNESALNGV

SEQ ID NO: 204214 - protein, 13 aa, Borrelia afzelii
DKSFNESALNGVK

SEQ ID NO: 204215 - protein, 13 aa, Borrelia afzelii
KSFNESALNGVKK

SEQ ID NO: 204216 - protein, 13 aa, Borrelia afzelii
SFNESALNGVKKL

SEQ ID NO: 204217 - protein, 13 aa, Borrelia afzelii
FNESALNGVKKLK

SEQ ID NO: 204218 - protein, 13 aa, Borrelia afzelii
NESALNGVKKLKE

SEQ ID NO: 204219 - protein, 13 aa, Borrelia afzelii
ESALNGVKKLKEE

SEQ ID NO: 204220 - protein, 13 aa, Borrelia afzelii
SALNGVKKLKEEF

SEQ ID NO: 204221 - protein, 13 aa, Borrelia afzelii
ALNGVKKLKEEFE

SEQ ID NO: 204222 - protein, 13 aa, Borrelia afzelii
LNGVKKLKEEFEI

SEQ ID NO: 204223 - protein, 13 aa, Borrelia afzelii
NGVKKLKEEFEIE

SEQ ID NO: 204224 - protein, 13 aa, Borrelia afzelii
GVKKLKEEFEIEL

SEQ ID NO: 204225 - protein, 13 aa, Borrelia afzelii
VKKLKEEFEIELV

SEQ ID NO: 204226 - protein, 13 aa, Borrelia afzelii
KKLKEEFEIELVL

SEQ ID NO: 204227 - protein, 13 aa, Borrelia afzelii
KLKEEFEIELVLK

SEQ ID NO: 204228 - protein, 13 aa, Borrelia afzelii
LKEEFEIELVLKE

SEQ ID NO: 204229 - protein, 13 aa, Borrelia afzelii
KEEFEIELVLKES

SEQ ID NO: 204230 - protein, 13 aa, Borrelia afzelii
EEFEIELVLKESS

SEQ ID NO: 204231 - protein, 13 aa, Borrelia afzelii
EFEIELVLKESST

SEQ ID NO: 204232 - protein, 13 aa, Borrelia afzelii
FEIELVLKESSTN

SEQ ID NO: 204233 - protein, 13 aa, Borrelia afzelii
EIELVLKESSTNS

SEQ ID NO: 204234 - protein, 13 aa, Borrelia afzelii
IELVLKESSTNSY

SEQ ID NO: 204235 - protein, 13 aa, Borrelia afzelii
ELVLKESSTNSYL

SEQ ID NO: 204236 - protein, 13 aa, Borrelia afzelii
LVLKESSTNSYLS

SEQ ID NO: 204237 - protein, 13 aa, Borrelia afzelii
VLKESSTNSYLSD

SEQ ID NO: 204238 - protein, 13 aa, Borrelia afzelii
LKESSTNSYLSDL

SEQ ID NO: 204239 - protein, 13 aa, Borrelia afzelii
KESSTNSYLSDLE

SEQ ID NO: 204240 - protein, 13 aa, Borrelia afzelii
ESSTNSYLSDLEG

SEQ ID NO: 204241 - protein, 13 aa, Borrelia afzelii
SSTNSYLSDLEGL

SEQ ID NO: 204242 - protein, 13 aa, Borrelia afzelii
STNSYLSDLEGLK

SEQ ID NO: 204243 - protein, 13 aa, Borrelia afzelii
TNSYLSDLEGLKD

SEQ ID NO: 204244 - protein, 13 aa, Borrelia afzelii
NSYLSDLEGLKDA

SEQ ID NO: 204245 - protein, 13 aa, Borrelia afzelii
SYLSDLEGLKDAG

SEQ ID NO: 204246 - protein, 13 aa, Borrelia afzelii
YLSDLEGLKDAGS

SEQ ID NO: 204247 - protein, 13 aa, Borrelia afzelii
LSDLEGLKDAGSN

SEQ ID NO: 204248 - protein, 13 aa, Borrelia afzelii
SDLEGLKDAGSNL

SEQ ID NO: 204249 - protein, 13 aa, Borrelia afzelii
DLEGLKDAGSNLI

SEQ ID NO: 204250 - protein, 13 aa, Borrelia afzelii
LEGLKDAGSNLIW

SEQ ID NO: 204251 - protein, 13 aa, Borrelia afzelii
EGLKDAGSNLIWL

SEQ ID NO: 204252 - protein, 13 aa, Borrelia afzelii
GLKDAGSNLIWLI

SEQ ID NO: 204253 - protein, 13 aa, Borrelia afzelii
LKDAGSNLIWLIG

SEQ ID NO: 204254 - protein, 13 aa, Borrelia afzelii
KDAGSNLIWLIGY

SEQ ID NO: 204255 - protein, 13 aa, Borrelia afzelii
DAGSNLIWLIGYK

SEQ ID NO: 204256 - protein, 13 aa, Borrelia afzelii
AGSNLIWLIGYKF

SEQ ID NO: 204257 - protein, 13 aa, Borrelia afzelii
GSNLIWLIGYKFS

SEQ ID NO: 204258 - protein, 13 aa, Borrelia afzelii
SNLIWLIGYKFSD

SEQ ID NO: 204259 - protein, 13 aa, Borrelia afzelii
NLIWLIGYKFSDV

SEQ ID NO: 204260 - protein, 13 aa, Borrelia afzelii
LIWLIGYKFSDVA

SEQ ID NO: 204261 - protein, 13 aa, Borrelia afzelii
IWLIGYKFSDVAK

SEQ ID NO: 204262 - protein, 13 aa, Borrelia afzelii
WLIGYKFSDVAKA

SEQ ID NO: 204263 - protein, 13 aa, Borrelia afzelii
LIGYKFSDVAKAV

SEQ ID NO: 204264 - protein, 13 aa, Borrelia afzelii
IGYKFSDVAKAVS

SEQ ID NO: 204265 - protein, 13 aa, Borrelia afzelii
GYKFSDVAKAVSL

SEQ ID NO: 204266 - protein, 13 aa, Borrelia afzelii
YKFSDVAKAVSLQ

SEQ ID NO: 204267 - protein, 13 aa, Borrelia afzelii
KFSDVAKAVSLQN

SEQ ID NO: 204268 - protein, 13 aa, Borrelia afzelii
FSDVAKAVSLQNS

SEQ ID NO: 204269 - protein, 13 aa, Borrelia afzelii
SDVAKAVSLQNSE

SEQ ID NO: 204270 - protein, 13 aa, Borrelia afzelii
DVAKAVSLQNSEM

SEQ ID NO: 204271 - protein, 13 aa, Borrelia afzelii
VAKAVSLQNSEMK

SEQ ID NO: 204272 - protein, 13 aa, Borrelia afzelii
AKAVSLQNSEMKY

SEQ ID NO: 204273 - protein, 13 aa, Borrelia afzelii
KAVSLQNSEMKYA

SEQ ID NO: 204274 - protein, 13 aa, Borrelia afzelii
AVSLQNSEMKYAI

SEQ ID NO: 204275 - protein, 13 aa, Borrelia afzelii
VSLQNSEMKYAII

SEQ ID NO: 204276 - protein, 13 aa, Borrelia afzelii
SLQNSEMKYAIID

SEQ ID NO: 204277 - protein, 13 aa, Borrelia afzelii
LQNSEMKYAIIDP

SEQ ID NO: 204278 - protein, 13 aa, Borrelia afzelii
QNSEMKYAIIDPV

SEQ ID NO: 204279 - protein, 13 aa, Borrelia afzelii
NSEMKYAIIDPVY

SEQ ID NO: 204280 - protein, 13 aa, Borrelia afzelii
SEMKYAIIDPVYS

SEQ ID NO: 204281 - protein, 13 aa, Borrelia afzelii
EMKYAIIDPVYSN

SEQ ID NO: 204282 - protein, 13 aa, Borrelia afzelii
MKYAIIDPVYSNE

SEQ ID NO: 204283 - protein, 13 aa, Borrelia afzelii
KYAIIDPVYSNEP

SEQ ID NO: 204284 - protein, 13 aa, Borrelia afzelii
YAIIDPVYSNEPI

SEQ ID NO: 204285 - protein, 13 aa, Borrelia afzelii
AIIDPVYSNEPIP

SEQ ID NO: 204286 - protein, 13 aa, Borrelia afzelii
IIDPVYSNEPIPA

SEQ ID NO: 204287 - protein, 13 aa, Borrelia afzelii
IDPVYSNEPIPAN

SEQ ID NO: 204288 - protein, 13 aa, Borrelia afzelii
DPVYSNEPIPANL

SEQ ID NO: 204289 - protein, 13 aa, Borrelia afzelii
PVYSNEPIPANLV

SEQ ID NO: 204290 - protein, 13 aa, Borrelia afzelii
VYSNEPIPANLVG

SEQ ID NO: 204291 - protein, 13 aa, Borrelia afzelii
YSNEPIPANLVGM

SEQ ID NO: 204292 - protein, 13 aa, Borrelia afzelii
SNEPIPANLVGMT

SEQ ID NO: 204293 - protein, 13 aa, Borrelia afzelii
NEPIPANLVGMTF

SEQ ID NO: 204294 - protein, 13 aa, Borrelia afzelii
EPIPANLVGMTFR

SEQ ID NO: 204295 - protein, 13 aa, Borrelia afzelii
PIPANLVGMTFRA

SEQ ID NO: 204296 - protein, 13 aa, Borrelia afzelii
IPANLVGMTFRAQ

SEQ ID NO: 204297 - protein, 13 aa, Borrelia afzelii
PANLVGMTFRAQE

SEQ ID NO: 204298 - protein, 13 aa, Borrelia afzelii
ANLVGMTFRAQEG

SEQ ID NO: 204299 - protein, 13 aa, Borrelia afzelii
NLVGMTFRAQEGA

SEQ ID NO: 204300 - protein, 13 aa, Borrelia afzelii
LVGMTFRAQEGAF

SEQ ID NO: 204301 - protein, 13 aa, Borrelia afzelii
VGMTFRAQEGAFL

SEQ ID NO: 204302 - protein, 13 aa, Borrelia afzelii
GMTFRAQEGAFLT

SEQ ID NO: 204303 - protein, 13 aa, Borrelia afzelii
MTFRAQEGAFLTG

SEQ ID NO: 204304 - protein, 13 aa, Borrelia afzelii
TFRAQEGAFLTGY

SEQ ID NO: 204305 - protein, 13 aa, Borrelia afzelii
FRAQEGAFLTGYI

SEQ ID NO: 204306 - protein, 13 aa, Borrelia afzelii
RAQEGAFLTGYIA

SEQ ID NO: 204307 - protein, 13 aa, Borrelia afzelii
AQEGAFLTGYIAA

SEQ ID NO: 204308 - protein, 13 aa, Borrelia afzelii
QEGAFLTGYIAAK

SEQ ID NO: 204309 - protein, 13 aa, Borrelia afzelii
EGAFLTGYIAAKV

SEQ ID NO: 204310 - protein, 13 aa, Borrelia afzelii
GAFLTGYIAAKVS

SEQ ID NO: 204311 - protein, 13 aa, Borrelia afzelii
AFLTGYIAAKVSK

SEQ ID NO: 204312 - protein, 13 aa, Borrelia afzelii
FLTGYIAAKVSKT

SEQ ID NO: 204313 - protein, 13 aa, Borrelia afzelii
LTGYIAAKVSKTG

SEQ ID NO: 204314 - protein, 13 aa, Borrelia afzelii
TGYIAAKVSKTGK

SEQ ID NO: 204315 - protein, 13 aa, Borrelia afzelii
GYIAAKVSKTGKI

SEQ ID NO: 204316 - protein, 13 aa, Borrelia afzelii
YIAAKVSKTGKIG

SEQ ID NO: 204317 - protein, 13 aa, Borrelia afzelii
IAAKVSKTGKIGF

SEQ ID NO: 204318 - protein, 13 aa, Borrelia afzelii
AAKVSKTGKIGFL

SEQ ID NO: 204319 - protein, 13 aa, Borrelia afzelii
AKVSKTGKIGFLG

SEQ ID NO: 204320 - protein, 13 aa, Borrelia afzelii
KVSKTGKIGFLGG

SEQ ID NO: 204321 - protein, 13 aa, Borrelia afzelii
VSKTGKIGFLGGI

SEQ ID NO: 204322 - protein, 13 aa, Borrelia afzelii
SKTGKIGFLGGIE

SEQ ID NO: 204323 - protein, 13 aa, Borrelia afzelii
KTGKIGFLGGIEG

SEQ ID NO: 204324 - protein, 13 aa, Borrelia afzelii
TGKIGFLGGIEGD

SEQ ID NO: 204325 - protein, 13 aa, Borrelia afzelii
GKIGFLGGIEGDI

SEQ ID NO: 204326 - protein, 13 aa, Borrelia afzelii
KIGFLGGIEGDIV

SEQ ID NO: 204327 - protein, 13 aa, Borrelia afzelii
IGFLGGIEGDIVD

SEQ ID NO: 204328 - protein, 13 aa, Borrelia afzelii
GFLGGIEGDIVDA

SEQ ID NO: 204329 - protein, 13 aa, Borrelia afzelii
FLGGIEGDIVDAF

SEQ ID NO: 204330 - protein, 13 aa, Borrelia afzelii
LGGIEGDIVDAFR

SEQ ID NO: 204331 - protein, 13 aa, Borrelia afzelii
GGIEGDIVDAFRY

SEQ ID NO: 204332 - protein, 13 aa, Borrelia afzelii
GIEGDIVDAFRYG

SEQ ID NO: 204333 - protein, 13 aa, Borrelia afzelii
IEGDIVDAFRYGY

SEQ ID NO: 204334 - protein, 13 aa, Borrelia afzelii
EGDIVDAFRYGYE

SEQ ID NO: 204335 - protein, 13 aa, Borrelia afzelii
GDIVDAFRYGYEA

SEQ ID NO: 204336 - protein, 13 aa, Borrelia afzelii
DIVDAFRYGYEAG

SEQ ID NO: 204337 - protein, 13 aa, Borrelia afzelii
IVDAFRYGYEAGA

SEQ ID NO: 204338 - protein, 13 aa, Borrelia afzelii
VDAFRYGYEAGAK

SEQ ID NO: 204339 - protein, 13 aa, Borrelia afzelii
DAFRYGYEAGAKY

SEQ ID NO: 204340 - protein, 13 aa, Borrelia afzelii
AFRYGYEAGAKYA

SEQ ID NO: 204341 - protein, 13 aa, Borrelia afzelii
FRYGYEAGAKYAN

SEQ ID NO: 204342 - protein, 13 aa, Borrelia afzelii
RYGYEAGAKYANK

SEQ ID NO: 204343 - protein, 13 aa, Borrelia afzelii
YGYEAGAKYANKD

SEQ ID NO: 204344 - protein, 13 aa, Borrelia afzelii
GYEAGAKYANKDI

SEQ ID NO: 204345 - protein, 13 aa, Borrelia afzelii
YEAGAKYANKDIK

SEQ ID NO: 204346 - protein, 13 aa, Borrelia afzelii
EAGAKYANKDIKI

SEQ ID NO: 204347 - protein, 13 aa, Borrelia afzelii
AGAKYANKDIKIF

SEQ ID NO: 204348 - protein, 13 aa, Borrelia afzelii
GAKYANKDIKIFS

SEQ ID NO: 204349 - protein, 13 aa, Borrelia afzelii
AKYANKDIKIFSQ

SEQ ID NO: 204350 - protein, 13 aa, Borrelia afzelii
KYANKDIKIFSQY

SEQ ID NO: 204351 - protein, 13 aa, Borrelia afzelii
YANKDIKIFSQYI

SEQ ID NO: 204352 - protein, 13 aa, Borrelia afzelii
ANKDIKIFSQYIG

SEQ ID NO: 204353 - protein, 13 aa, Borrelia afzelii
NKDIKIFSQYIGS

SEQ ID NO: 204354 - protein, 13 aa, Borrelia afzelii
KDIKIFSQYIGSF

SEQ ID NO: 204355 - protein, 13 aa, Borrelia afzelii
DIKIFSQYIGSFS

SEQ ID NO: 204356 - protein, 13 aa, Borrelia afzelii
IKIFSQYIGSFSD

SEQ ID NO: 204357 - protein, 13 aa, Borrelia afzelii
KIFSQYIGSFSDL

SEQ ID NO: 204358 - protein, 13 aa, Borrelia afzelii
IFSQYIGSFSDLE

SEQ ID NO: 204359 - protein, 13 aa, Borrelia afzelii
FSQYIGSFSDLEA

SEQ ID NO: 204360 - protein, 13 aa, Borrelia afzelii
SQYIGSFSDLEAG

SEQ ID NO: 204361 - protein, 13 aa, Borrelia afzelii
QYIGSFSDLEAGR

SEQ ID NO: 204362 - protein, 13 aa, Borrelia afzelii
YIGSFSDLEAGRS

SEQ ID NO: 204363 - protein, 13 aa, Borrelia afzelii
IGSFSDLEAGRSV

SEQ ID NO: 204364 - protein, 13 aa, Borrelia afzelii
GSFSDLEAGRSVA

SEQ ID NO: 204365 - protein, 13 aa, Borrelia afzelii
SFSDLEAGRSVAT

SEQ ID NO: 204366 - protein, 13 aa, Borrelia afzelii
FSDLEAGRSVATK

SEQ ID NO: 204367 - protein, 13 aa, Borrelia afzelii
SDLEAGRSVATKM

SEQ ID NO: 204368 - protein, 13 aa, Borrelia afzelii
DLEAGRSVATKMY

SEQ ID NO: 204369 - protein, 13 aa, Borrelia afzelii
LEAGRSVATKMYS

SEQ ID NO: 204370 - protein, 13 aa, Borrelia afzelii
EAGRSVATKMYSD

SEQ ID NO: 204371 - protein, 13 aa, Borrelia afzelii
AGRSVATKMYSDG

SEQ ID NO: 204372 - protein, 13 aa, Borrelia afzelii
GRSVATKMYSDGI

SEQ ID NO: 204373 - protein, 13 aa, Borrelia afzelii
RSVATKMYSDGID

SEQ ID NO: 204374 - protein, 13 aa, Borrelia afzelii
SVATKMYSDGIDI

SEQ ID NO: 204375 - protein, 13 aa, Borrelia afzelii
VATKMYSDGIDII

SEQ ID NO: 204376 - protein, 13 aa, Borrelia afzelii
ATKMYSDGIDIIH

SEQ ID NO: 204377 - protein, 13 aa, Borrelia afzelii
TKMYSDGIDIIHH

SEQ ID NO: 204378 - protein, 13 aa, Borrelia afzelii
KMYSDGIDIIHHA

SEQ ID NO: 204379 - protein, 13 aa, Borrelia afzelii
MYSDGIDIIHHAA

SEQ ID NO: 204380 - protein, 13 aa, Borrelia afzelii
YSDGIDIIHHAAG

SEQ ID NO: 204381 - protein, 13 aa, Borrelia afzelii
SDGIDIIHHAAGL

SEQ ID NO: 204382 - protein, 13 aa, Borrelia afzelii
DGIDIIHHAAGLG

SEQ ID NO: 204383 - protein, 13 aa, Borrelia afzelii
GIDIIHHAAGLGG

SEQ ID NO: 204384 - protein, 13 aa, Borrelia afzelii
IDIIHHAAGLGGI

SEQ ID NO: 204385 - protein, 13 aa, Borrelia afzelii
DIIHHAAGLGGIG

SEQ ID NO: 204386 - protein, 13 aa, Borrelia afzelii
IIHHAAGLGGIGA

SEQ ID NO: 204387 - protein, 13 aa, Borrelia afzelii
IHHAAGLGGIGAI

SEQ ID NO: 204388 - protein, 13 aa, Borrelia afzelii
HHAAGLGGIGAIE

SEQ ID NO: 204389 - protein, 13 aa, Borrelia afzelii
HAAGLGGIGAIEV

SEQ ID NO: 204390 - protein, 13 aa, Borrelia afzelii
AAGLGGIGAIEVA

SEQ ID NO: 204391 - protein, 13 aa, Borrelia afzelii
AGLGGIGAIEVAK

SEQ ID NO: 204392 - protein, 13 aa, Borrelia afzelii
GLGGIGAIEVAKE

SEQ ID NO: 204393 - protein, 13 aa, Borrelia afzelii
LGGIGAIEVAKEL

SEQ ID NO: 204394 - protein, 13 aa, Borrelia afzelii
GGIGAIEVAKELG

SEQ ID NO: 204395 - protein, 13 aa, Borrelia afzelii
GIGAIEVAKELGS

SEQ ID NO: 204396 - protein, 13 aa, Borrelia afzelii
IGAIEVAKELGSG

SEQ ID NO: 204397 - protein, 13 aa, Borrelia afzelii
GAIEVAKELGSGH

SEQ ID NO: 204398 - protein, 13 aa, Borrelia afzelii
AIEVAKELGSGHY

SEQ ID NO: 204399 - protein, 13 aa, Borrelia afzelii
IEVAKELGSGHYI

SEQ ID NO: 204400 - protein, 13 aa, Borrelia afzelii
EVAKELGSGHYII

SEQ ID NO: 204401 - protein, 13 aa, Borrelia afzelii
VAKELGSGHYIIG

SEQ ID NO: 204402 - protein, 13 aa, Borrelia afzelii
AKELGSGHYIIGV

SEQ ID NO: 204403 - protein, 13 aa, Borrelia afzelii
KELGSGHYIIGVD

SEQ ID NO: 204404 - protein, 13 aa, Borrelia afzelii
ELGSGHYIIGVDE

SEQ ID NO: 204405 - protein, 13 aa, Borrelia afzelii
LGSGHYIIGVDED

SEQ ID NO: 204406 - protein, 13 aa, Borrelia afzelii
GSGHYIIGVDEDQ

SEQ ID NO: 204407 - protein, 13 aa, Borrelia afzelii
SGHYIIGVDEDQS

SEQ ID NO: 204408 - protein, 13 aa, Borrelia afzelii
GHYIIGVDEDQSY

SEQ ID NO: 204409 - protein, 13 aa, Borrelia afzelii
HYIIGVDEDQSYL

SEQ ID NO: 204410 - protein, 13 aa, Borrelia afzelii
YIIGVDEDQSYLA

SEQ ID NO: 204411 - protein, 13 aa, Borrelia afzelii
IIGVDEDQSYLAP

SEQ ID NO: 204412 - protein, 13 aa, Borrelia afzelii
IGVDEDQSYLAPN

SEQ ID NO: 204413 - protein, 13 aa, Borrelia afzelii
GVDEDQSYLAPNN

SEQ ID NO: 204414 - protein, 13 aa, Borrelia afzelii
VDEDQSYLAPNNV

SEQ ID NO: 204415 - protein, 13 aa, Borrelia afzelii
DEDQSYLAPNNVI

SEQ ID NO: 204416 - protein, 13 aa, Borrelia afzelii
EDQSYLAPNNVIT

SEQ ID NO: 204417 - protein, 13 aa, Borrelia afzelii
DQSYLAPNNVITS

SEQ ID NO: 204418 - protein, 13 aa, Borrelia afzelii
QSYLAPNNVITST

SEQ ID NO: 204419 - protein, 13 aa, Borrelia afzelii
SYLAPNNVITSTT

SEQ ID NO: 204420 - protein, 13 aa, Borrelia afzelii
YLAPNNVITSTTK

SEQ ID NO: 204421 - protein, 13 aa, Borrelia afzelii
LAPNNVITSTTKD

SEQ ID NO: 204422 - protein, 13 aa, Borrelia afzelii
APNNVITSTTKDV

SEQ ID NO: 204423 - protein, 13 aa, Borrelia afzelii
PNNVITSTTKDVG

SEQ ID NO: 204424 - protein, 13 aa, Borrelia afzelii
NNVITSTTKDVGR

SEQ ID NO: 204425 - protein, 13 aa, Borrelia afzelii
NVITSTTKDVGRS

SEQ ID NO: 204426 - protein, 13 aa, Borrelia afzelii
VITSTTKDVGRSL

SEQ ID NO: 204427 - protein, 13 aa, Borrelia afzelii
ITSTTKDVGRSLN

SEQ ID NO: 204428 - protein, 13 aa, Borrelia afzelii
TSTTKDVGRSLNL

SEQ ID NO: 204429 - protein, 13 aa, Borrelia afzelii
STTKDVGRSLNLL

SEQ ID NO: 204430 - protein, 13 aa, Borrelia afzelii
TTKDVGRSLNLLT

SEQ ID NO: 204431 - protein, 13 aa, Borrelia afzelii
TKDVGRSLNLLTS

SEQ ID NO: 204432 - protein, 13 aa, Borrelia afzelii
KDVGRSLNLLTSN

SEQ ID NO: 204433 - protein, 13 aa, Borrelia afzelii
DVGRSLNLLTSNY

SEQ ID NO: 204434 - protein, 13 aa, Borrelia afzelii
VGRSLNLLTSNYL

SEQ ID NO: 204435 - protein, 13 aa, Borrelia afzelii
GRSLNLLTSNYLK

SEQ ID NO: 204436 - protein, 13 aa, Borrelia afzelii
RSLNLLTSNYLKT

SEQ ID NO: 204437 - protein, 13 aa, Borrelia afzelii
SLNLLTSNYLKTN

SEQ ID NO: 204438 - protein, 13 aa, Borrelia afzelii
LNLLTSNYLKTNT

SEQ ID NO: 204439 - protein, 13 aa, Borrelia afzelii
NLLTSNYLKTNTF

SEQ ID NO: 204440 - protein, 13 aa, Borrelia afzelii
LLTSNYLKTNTFE

SEQ ID NO: 204441 - protein, 13 aa, Borrelia afzelii
LTSNYLKTNTFEG

SEQ ID NO: 204442 - protein, 13 aa, Borrelia afzelii
TSNYLKTNTFEGG

SEQ ID NO: 204443 - protein, 13 aa, Borrelia afzelii
SNYLKTNTFEGGK

SEQ ID NO: 204444 - protein, 13 aa, Borrelia afzelii
NYLKTNTFEGGKL

SEQ ID NO: 204445 - protein, 13 aa, Borrelia afzelii
YLKTNTFEGGKLI

SEQ ID NO: 204446 - protein, 13 aa, Borrelia afzelii
LKTNTFEGGKLIN

SEQ ID NO: 204447 - protein, 13 aa, Borrelia afzelii
KTNTFEGGKLINY

SEQ ID NO: 204448 - protein, 13 aa, Borrelia afzelii
TNTFEGGKLINYG

SEQ ID NO: 204449 - protein, 13 aa, Borrelia afzelii
NTFEGGKLINYGL

SEQ ID NO: 204450 - protein, 13 aa, Borrelia afzelii
TFEGGKLINYGLK

SEQ ID NO: 204451 - protein, 13 aa, Borrelia afzelii
FEGGKLINYGLKE

SEQ ID NO: 204452 - protein, 13 aa, Borrelia afzelii
EGGKLINYGLKEG

SEQ ID NO: 204453 - protein, 13 aa, Borrelia afzelii
GGKLINYGLKEGV

SEQ ID NO: 204454 - protein, 13 aa, Borrelia afzelii
GKLINYGLKEGVV

SEQ ID NO: 204455 - protein, 13 aa, Borrelia afzelii
KLINYGLKEGVVG

SEQ ID NO: 204456 - protein, 13 aa, Borrelia afzelii
LINYGLKEGVVGF

SEQ ID NO: 204457 - protein, 13 aa, Borrelia afzelii
INYGLKEGVVGFV

SEQ ID NO: 204458 - protein, 13 aa, Borrelia afzelii
NYGLKEGVVGFVR

SEQ ID NO: 204459 - protein, 13 aa, Borrelia afzelii
YGLKEGVVGFVRN

SEQ ID NO: 204460 - protein, 13 aa, Borrelia afzelii
GLKEGVVGFVRNP

SEQ ID NO: 204461 - protein, 13 aa, Borrelia afzelii
LKEGVVGFVRNPK

SEQ ID NO: 204462 - protein, 13 aa, Borrelia afzelii
KEGVVGFVRNPKM

SEQ ID NO: 204463 - protein, 13 aa, Borrelia afzelii
EGVVGFVRNPKMI

SEQ ID NO: 204464 - protein, 13 aa, Borrelia afzelii
GVVGFVRNPKMIP

SEQ ID NO: 204465 - protein, 13 aa, Borrelia afzelii
VVGFVRNPKMIPF

SEQ ID NO: 204466 - protein, 13 aa, Borrelia afzelii
VGFVRNPKMIPFE

SEQ ID NO: 204467 - protein, 13 aa, Borrelia afzelii
GFVRNPKMIPFEV

SEQ ID NO: 204468 - protein, 13 aa, Borrelia afzelii
FVRNPKMIPFEVE

SEQ ID NO: 204469 - protein, 13 aa, Borrelia afzelii
VRNPKMIPFEVEK

SEQ ID NO: 204470 - protein, 13 aa, Borrelia afzelii
RNPKMIPFEVEKE

SEQ ID NO: 204471 - protein, 13 aa, Borrelia afzelii
NPKMIPFEVEKEI

SEQ ID NO: 204472 - protein, 13 aa, Borrelia afzelii
PKMIPFEVEKEID

SEQ ID NO: 204473 - protein, 13 aa, Borrelia afzelii
KMIPFEVEKEIDS

SEQ ID NO: 204474 - protein, 13 aa, Borrelia afzelii
MIPFEVEKEIDSL

SEQ ID NO: 204475 - protein, 13 aa, Borrelia afzelii
IPFEVEKEIDSLS

SEQ ID NO: 204476 - protein, 13 aa, Borrelia afzelii
PFEVEKEIDSLSS

SEQ ID NO: 204477 - protein, 13 aa, Borrelia afzelii
FEVEKEIDSLSSK

SEQ ID NO: 204478 - protein, 13 aa, Borrelia afzelii
EVEKEIDSLSSKI

SEQ ID NO: 204479 - protein, 13 aa, Borrelia afzelii
VEKEIDSLSSKII

SEQ ID NO: 204480 - protein, 13 aa, Borrelia afzelii
EKEIDSLSSKIIN

SEQ ID NO: 204481 - protein, 13 aa, Borrelia afzelii
KEIDSLSSKIINK

SEQ ID NO: 204482 - protein, 13 aa, Borrelia afzelii
EIDSLSSKIINKE

SEQ ID NO: 204483 - protein, 13 aa, Borrelia afzelii
IDSLSSKIINKEV

SEQ ID NO: 204484 - protein, 13 aa, Borrelia afzelii
DSLSSKIINKEVI

SEQ ID NO: 204485 - protein, 13 aa, Borrelia afzelii
SLSSKIINKEVIV

SEQ ID NO: 204486 - protein, 13 aa, Borrelia afzelii
LSSKIINKEVIVP

SEQ ID NO: 204487 - protein, 13 aa, Borrelia afzelii
SSKIINKEVIVPY

SEQ ID NO: 204488 - protein, 13 aa, Borrelia afzelii
SKIINKEVIVPYN

SEQ ID NO: 204489 - protein, 13 aa, Borrelia afzelii
KIINKEVIVPYNK

SEQ ID NO: 204490 - protein, 13 aa, Borrelia afzelii
IINKEVIVPYNKE

SEQ ID NO: 204491 - protein, 13 aa, Borrelia afzelii
INKEVIVPYNKES

SEQ ID NO: 204492 - protein, 13 aa, Borrelia afzelii
NKEVIVPYNKESY

SEQ ID NO: 204493 - protein, 13 aa, Borrelia afzelii
KEVIVPYNKESYE

SEQ ID NO: 204494 - protein, 13 aa, Borrelia afzelii
EVIVPYNKESYEK

SEQ ID NO: 204495 - protein, 13 aa, Borrelia afzelii
VIVPYNKESYEKF

SEQ ID NO: 204496 - protein, 13 aa, Borrelia afzelii
IVPYNKESYEKFL

SEQ ID NO: 204497 - protein, 13 aa, Borrelia afzelii
VPYNKESYEKFLK

SEQ ID NO: 204498 - protein, 13 aa, Borrelia afzelii
PYNKESYEKFLKE

SEQ ID NO: 204499 - protein, 13 aa, Borrelia afzelii
YNKESYEKFLKEF

SEQ ID NO: 204500 - protein, 13 aa, Borrelia afzelii
NKESYEKFLKEFI

SEQ ID NO: 204501 - protein, 14 aa, Borrelia afzelii
FLSCSGKSGLESGI

SEQ ID NO: 204502 - protein, 14 aa, Borrelia afzelii
LSCSGKSGLESGIP

SEQ ID NO: 204503 - protein, 14 aa, Borrelia afzelii
SCSGKSGLESGIPK

SEQ ID NO: 204504 - protein, 14 aa, Borrelia afzelii
CSGKSGLESGIPKV

SEQ ID NO: 204505 - protein, 14 aa, Borrelia afzelii
SGKSGLESGIPKVS

SEQ ID NO: 204506 - protein, 14 aa, Borrelia afzelii
GKSGLESGIPKVSL

SEQ ID NO: 204507 - protein, 14 aa, Borrelia afzelii
KSGLESGIPKVSLV

SEQ ID NO: 204508 - protein, 14 aa, Borrelia afzelii
SGLESGIPKVSLVI

SEQ ID NO: 204509 - protein, 14 aa, Borrelia afzelii
GLESGIPKVSLVID

SEQ ID NO: 204510 - protein, 14 aa, Borrelia afzelii
LESGIPKVSLVIDG

SEQ ID NO: 204511 - protein, 14 aa, Borrelia afzelii
ESGIPKVSLVIDGT

SEQ ID NO: 204512 - protein, 14 aa, Borrelia afzelii
SGIPKVSLVIDGTF

SEQ ID NO: 204513 - protein, 14 aa, Borrelia afzelii
GIPKVSLVIDGTFD

SEQ ID NO: 204514 - protein, 14 aa, Borrelia afzelii
IPKVSLVIDGTFDD

SEQ ID NO: 204515 - protein, 14 aa, Borrelia afzelii
PKVSLVIDGTFDDK

SEQ ID NO: 204516 - protein, 14 aa, Borrelia afzelii
KVSLVIDGTFDDKS

SEQ ID NO: 204517 - protein, 14 aa, Borrelia afzelii
VSLVIDGTFDDKSF

SEQ ID NO: 204518 - protein, 14 aa, Borrelia afzelii
SLVIDGTFDDKSFN

SEQ ID NO: 204519 - protein, 14 aa, Borrelia afzelii
LVIDGTFDDKSFNE

SEQ ID NO: 204520 - protein, 14 aa, Borrelia afzelii
VIDGTFDDKSFNES

SEQ ID NO: 204521 - protein, 14 aa, Borrelia afzelii
IDGTFDDKSFNESA

SEQ ID NO: 204522 - protein, 14 aa, Borrelia afzelii
DGTFDDKSFNESAL

SEQ ID NO: 204523 - protein, 14 aa, Borrelia afzelii
GTFDDKSFNESALN

SEQ ID NO: 204524 - protein, 14 aa, Borrelia afzelii
TFDDKSFNESALNG

SEQ ID NO: 204525 - protein, 14 aa, Borrelia afzelii
FDDKSFNESALNGV

SEQ ID NO: 204526 - protein, 14 aa, Borrelia afzelii
DDKSFNESALNGVK

SEQ ID NO: 204527 - protein, 14 aa, Borrelia afzelii
DKSFNESALNGVKK

SEQ ID NO: 204528 - protein, 14 aa, Borrelia afzelii
KSFNESALNGVKKL

SEQ ID NO: 204529 - protein, 14 aa, Borrelia afzelii
SFNESALNGVKKLK

SEQ ID NO: 204530 - protein, 14 aa, Borrelia afzelii
FNESALNGVKKLKE

SEQ ID NO: 204531 - protein, 14 aa, Borrelia afzelii
NESALNGVKKLKEE

SEQ ID NO: 204532 - protein, 14 aa, Borrelia afzelii
ESALNGVKKLKEEF

SEQ ID NO: 204533 - protein, 14 aa, Borrelia afzelii
SALNGVKKLKEEFE

SEQ ID NO: 204534 - protein, 14 aa, Borrelia afzelii
ALNGVKKLKEEFEI

SEQ ID NO: 204535 - protein, 14 aa, Borrelia afzelii
LNGVKKLKEEFEIE

SEQ ID NO: 204536 - protein, 14 aa, Borrelia afzelii
NGVKKLKEEFEIEL

SEQ ID NO: 204537 - protein, 14 aa, Borrelia afzelii
GVKKLKEEFEIELV

SEQ ID NO: 204538 - protein, 14 aa, Borrelia afzelii
VKKLKEEFEIELVL

SEQ ID NO: 204539 - protein, 14 aa, Borrelia afzelii
KKLKEEFEIELVLK

SEQ ID NO: 204540 - protein, 14 aa, Borrelia afzelii
KLKEEFEIELVLKE

SEQ ID NO: 204541 - protein, 14 aa, Borrelia afzelii
LKEEFEIELVLKES

SEQ ID NO: 204542 - protein, 14 aa, Borrelia afzelii
KEEFEIELVLKESS

SEQ ID NO: 204543 - protein, 14 aa, Borrelia afzelii
EEFEIELVLKESST

SEQ ID NO: 204544 - protein, 14 aa, Borrelia afzelii
EFEIELVLKESSTN

SEQ ID NO: 204545 - protein, 14 aa, Borrelia afzelii
FEIELVLKESSTNS

SEQ ID NO: 204546 - protein, 14 aa, Borrelia afzelii
EIELVLKESSTNSY

SEQ ID NO: 204547 - protein, 14 aa, Borrelia afzelii
IELVLKESSTNSYL

SEQ ID NO: 204548 - protein, 14 aa, Borrelia afzelii
ELVLKESSTNSYLS

SEQ ID NO: 204549 - protein, 14 aa, Borrelia afzelii
LVLKESSTNSYLSD

SEQ ID NO: 204550 - protein, 14 aa, Borrelia afzelii
VLKESSTNSYLSDL

SEQ ID NO: 204551 - protein, 14 aa, Borrelia afzelii
LKESSTNSYLSDLE

SEQ ID NO: 204552 - protein, 14 aa, Borrelia afzelii
KESSTNSYLSDLEG

SEQ ID NO: 204553 - protein, 14 aa, Borrelia afzelii
ESSTNSYLSDLEGL

SEQ ID NO: 204554 - protein, 14 aa, Borrelia afzelii
SSTNSYLSDLEGLK

SEQ ID NO: 204555 - protein, 14 aa, Borrelia afzelii
STNSYLSDLEGLKD

SEQ ID NO: 204556 - protein, 14 aa, Borrelia afzelii
TNSYLSDLEGLKDA

SEQ ID NO: 204557 - protein, 14 aa, Borrelia afzelii
NSYLSDLEGLKDAG

SEQ ID NO: 204558 - protein, 14 aa, Borrelia afzelii
SYLSDLEGLKDAGS

SEQ ID NO: 204559 - protein, 14 aa, Borrelia afzelii
YLSDLEGLKDAGSN

SEQ ID NO: 204560 - protein, 14 aa, Borrelia afzelii
LSDLEGLKDAGSNL

SEQ ID NO: 204561 - protein, 14 aa, Borrelia afzelii
SDLEGLKDAGSNLI

SEQ ID NO: 204562 - protein, 14 aa, Borrelia afzelii
DLEGLKDAGSNLIW

SEQ ID NO: 204563 - protein, 14 aa, Borrelia afzelii
LEGLKDAGSNLIWL

SEQ ID NO: 204564 - protein, 14 aa, Borrelia afzelii
EGLKDAGSNLIWLI

SEQ ID NO: 204565 - protein, 14 aa, Borrelia afzelii
GLKDAGSNLIWLIG

SEQ ID NO: 204566 - protein, 14 aa, Borrelia afzelii
LKDAGSNLIWLIGY

SEQ ID NO: 204567 - protein, 14 aa, Borrelia afzelii
KDAGSNLIWLIGYK

SEQ ID NO: 204568 - protein, 14 aa, Borrelia afzelii
DAGSNLIWLIGYKF

SEQ ID NO: 204569 - protein, 14 aa, Borrelia afzelii
AGSNLIWLIGYKFS

SEQ ID NO: 204570 - protein, 14 aa, Borrelia afzelii
GSNLIWLIGYKFSD

SEQ ID NO: 204571 - protein, 14 aa, Borrelia afzelii
SNLIWLIGYKFSDV

SEQ ID NO: 204572 - protein, 14 aa, Borrelia afzelii
NLIWLIGYKFSDVA

SEQ ID NO: 204573 - protein, 14 aa, Borrelia afzelii
LIWLIGYKFSDVAK

SEQ ID NO: 204574 - protein, 14 aa, Borrelia afzelii
IWLIGYKFSDVAKA

SEQ ID NO: 204575 - protein, 14 aa, Borrelia afzelii
WLIGYKFSDVAKAV

SEQ ID NO: 204576 - protein, 14 aa, Borrelia afzelii
LIGYKFSDVAKAVS

SEQ ID NO: 204577 - protein, 14 aa, Borrelia afzelii
IGYKFSDVAKAVSL

SEQ ID NO: 204578 - protein, 14 aa, Borrelia afzelii
GYKFSDVAKAVSLQ

SEQ ID NO: 204579 - protein, 14 aa, Borrelia afzelii
YKFSDVAKAVSLQN

SEQ ID NO: 204580 - protein, 14 aa, Borrelia afzelii
KFSDVAKAVSLQNS

SEQ ID NO: 204581 - protein, 14 aa, Borrelia afzelii
FSDVAKAVSLQNSE

SEQ ID NO: 204582 - protein, 14 aa, Borrelia afzelii
SDVAKAVSLQNSEM

SEQ ID NO: 204583 - protein, 14 aa, Borrelia afzelii
DVAKAVSLQNSEMK

SEQ ID NO: 204584 - protein, 14 aa, Borrelia afzelii
VAKAVSLQNSEMKY

SEQ ID NO: 204585 - protein, 14 aa, Borrelia afzelii
AKAVSLQNSEMKYA

SEQ ID NO: 204586 - protein, 14 aa, Borrelia afzelii
KAVSLQNSEMKYAI

SEQ ID NO: 204587 - protein, 14 aa, Borrelia afzelii
AVSLQNSEMKYAII

SEQ ID NO: 204588 - protein, 14 aa, Borrelia afzelii
VSLQNSEMKYAIID

SEQ ID NO: 204589 - protein, 14 aa, Borrelia afzelii
SLQNSEMKYAIIDP

SEQ ID NO: 204590 - protein, 14 aa, Borrelia afzelii
LQNSEMKYAIIDPV

SEQ ID NO: 204591 - protein, 14 aa, Borrelia afzelii
QNSEMKYAIIDPVY

SEQ ID NO: 204592 - protein, 14 aa, Borrelia afzelii
NSEMKYAIIDPVYS

SEQ ID NO: 204593 - protein, 14 aa, Borrelia afzelii
SEMKYAIIDPVYSN

SEQ ID NO: 204594 - protein, 14 aa, Borrelia afzelii
EMKYAIIDPVYSNE

SEQ ID NO: 204595 - protein, 14 aa, Borrelia afzelii
MKYAIIDPVYSNEP

SEQ ID NO: 204596 - protein, 14 aa, Borrelia afzelii
KYAIIDPVYSNEPI

SEQ ID NO: 204597 - protein, 14 aa, Borrelia afzelii
YAIIDPVYSNEPIP

SEQ ID NO: 204598 - protein, 14 aa, Borrelia afzelii
AIIDPVYSNEPIPA

SEQ ID NO: 204599 - protein, 14 aa, Borrelia afzelii
IIDPVYSNEPIPAN

SEQ ID NO: 204600 - protein, 14 aa, Borrelia afzelii
IDPVYSNEPIPANL

SEQ ID NO: 204601 - protein, 14 aa, Borrelia afzelii
DPVYSNEPIPANLV

SEQ ID NO: 204602 - protein, 14 aa, Borrelia afzelii
PVYSNEPIPANLVG

SEQ ID NO: 204603 - protein, 14 aa, Borrelia afzelii
VYSNEPIPANLVGM

SEQ ID NO: 204604 - protein, 14 aa, Borrelia afzelii
YSNEPIPANLVGMT

SEQ ID NO: 204605 - protein, 14 aa, Borrelia afzelii
SNEPIPANLVGMTF

SEQ ID NO: 204606 - protein, 14 aa, Borrelia afzelii
NEPIPANLVGMTFR

SEQ ID NO: 204607 - protein, 14 aa, Borrelia afzelii
EPIPANLVGMTFRA

SEQ ID NO: 204608 - protein, 14 aa, Borrelia afzelii
PIPANLVGMTFRAQ

SEQ ID NO: 204609 - protein, 14 aa, Borrelia afzelii
IPANLVGMTFRAQE

SEQ ID NO: 204610 - protein, 14 aa, Borrelia afzelii
PANLVGMTFRAQEG

SEQ ID NO: 204611 - protein, 14 aa, Borrelia afzelii
ANLVGMTFRAQEGA

SEQ ID NO: 204612 - protein, 14 aa, Borrelia afzelii
NLVGMTFRAQEGAF

SEQ ID NO: 204613 - protein, 14 aa, Borrelia afzelii
LVGMTFRAQEGAFL

SEQ ID NO: 204614 - protein, 14 aa, Borrelia afzelii
VGMTFRAQEGAFLT

SEQ ID NO: 204615 - protein, 14 aa, Borrelia afzelii
GMTFRAQEGAFLTG

SEQ ID NO: 204616 - protein, 14 aa, Borrelia afzelii
MTFRAQEGAFLTGY

SEQ ID NO: 204617 - protein, 14 aa, Borrelia afzelii
TFRAQEGAFLTGYI

SEQ ID NO: 204618 - protein, 14 aa, Borrelia afzelii
FRAQEGAFLTGYIA

SEQ ID NO: 204619 - protein, 14 aa, Borrelia afzelii
RAQEGAFLTGYIAA

SEQ ID NO: 204620 - protein, 14 aa, Borrelia afzelii
AQEGAFLTGYIAAK

SEQ ID NO: 204621 - protein, 14 aa, Borrelia afzelii
QEGAFLTGYIAAKV

SEQ ID NO: 204622 - protein, 14 aa, Borrelia afzelii
EGAFLTGYIAAKVS

SEQ ID NO: 204623 - protein, 14 aa, Borrelia afzelii
GAFLTGYIAAKVSK

SEQ ID NO: 204624 - protein, 14 aa, Borrelia afzelii
AFLTGYIAAKVSKT

SEQ ID NO: 204625 - protein, 14 aa, Borrelia afzelii
FLTGYIAAKVSKTG

SEQ ID NO: 204626 - protein, 14 aa, Borrelia afzelii
LTGYIAAKVSKTGK

SEQ ID NO: 204627 - protein, 14 aa, Borrelia afzelii
TGYIAAKVSKTGKI

SEQ ID NO: 204628 - protein, 14 aa, Borrelia afzelii
GYIAAKVSKTGKIG

SEQ ID NO: 204629 - protein, 14 aa, Borrelia afzelii
YIAAKVSKTGKIGF

SEQ ID NO: 204630 - protein, 14 aa, Borrelia afzelii
IAAKVSKTGKIGFL

SEQ ID NO: 204631 - protein, 14 aa, Borrelia afzelii
AAKVSKTGKIGFLG

SEQ ID NO: 204632 - protein, 14 aa, Borrelia afzelii
AKVSKTGKIGFLGG

SEQ ID NO: 204633 - protein, 14 aa, Borrelia afzelii
KVSKTGKIGFLGGI

SEQ ID NO: 204634 - protein, 14 aa, Borrelia afzelii
VSKTGKIGFLGGIE

SEQ ID NO: 204635 - protein, 14 aa, Borrelia afzelii
SKTGKIGFLGGIEG

SEQ ID NO: 204636 - protein, 14 aa, Borrelia afzelii
KTGKIGFLGGIEGD

SEQ ID NO: 204637 - protein, 14 aa, Borrelia afzelii
TGKIGFLGGIEGDI

SEQ ID NO: 204638 - protein, 14 aa, Borrelia afzelii
GKIGFLGGIEGDIV

SEQ ID NO: 204639 - protein, 14 aa, Borrelia afzelii
KIGFLGGIEGDIVD

SEQ ID NO: 204640 - protein, 14 aa, Borrelia afzelii
IGFLGGIEGDIVDA

SEQ ID NO: 204641 - protein, 14 aa, Borrelia afzelii
GFLGGIEGDIVDAF

SEQ ID NO: 204642 - protein, 14 aa, Borrelia afzelii
FLGGIEGDIVDAFR

SEQ ID NO: 204643 - protein, 14 aa, Borrelia afzelii
LGGIEGDIVDAFRY

SEQ ID NO: 204644 - protein, 14 aa, Borrelia afzelii
GGIEGDIVDAFRYG

SEQ ID NO: 204645 - protein, 14 aa, Borrelia afzelii
GIEGDIVDAFRYGY

SEQ ID NO: 204646 - protein, 14 aa, Borrelia afzelii
IEGDIVDAFRYGYE

SEQ ID NO: 204647 - protein, 14 aa, Borrelia afzelii
EGDIVDAFRYGYEA

SEQ ID NO: 204648 - protein, 14 aa, Borrelia afzelii
GDIVDAFRYGYEAG

SEQ ID NO: 204649 - protein, 14 aa, Borrelia afzelii
DIVDAFRYGYEAGA

SEQ ID NO: 204650 - protein, 14 aa, Borrelia afzelii
IVDAFRYGYEAGAK

SEQ ID NO: 204651 - protein, 14 aa, Borrelia afzelii
VDAFRYGYEAGAKY

SEQ ID NO: 204652 - protein, 14 aa, Borrelia afzelii
DAFRYGYEAGAKYA

SEQ ID NO: 204653 - protein, 14 aa, Borrelia afzelii
AFRYGYEAGAKYAN

SEQ ID NO: 204654 - protein, 14 aa, Borrelia afzelii
FRYGYEAGAKYANK

SEQ ID NO: 204655 - protein, 14 aa, Borrelia afzelii
RYGYEAGAKYANKD

SEQ ID NO: 204656 - protein, 14 aa, Borrelia afzelii
YGYEAGAKYANKDI

SEQ ID NO: 204657 - protein, 14 aa, Borrelia afzelii
GYEAGAKYANKDIK

SEQ ID NO: 204658 - protein, 14 aa, Borrelia afzelii
YEAGAKYANKDIKI

SEQ ID NO: 204659 - protein, 14 aa, Borrelia afzelii
EAGAKYANKDIKIF

SEQ ID NO: 204660 - protein, 14 aa, Borrelia afzelii
AGAKYANKDIKIFS

SEQ ID NO: 204661 - protein, 14 aa, Borrelia afzelii
GAKYANKDIKIFSQ

SEQ ID NO: 204662 - protein, 14 aa, Borrelia afzelii
AKYANKDIKIFSQY

SEQ ID NO: 204663 - protein, 14 aa, Borrelia afzelii
KYANKDIKIFSQYI

SEQ ID NO: 204664 - protein, 14 aa, Borrelia afzelii
YANKDIKIFSQYIG

SEQ ID NO: 204665 - protein, 14 aa, Borrelia afzelii
ANKDIKIFSQYIGS

SEQ ID NO: 204666 - protein, 14 aa, Borrelia afzelii
NKDIKIFSQYIGSF

SEQ ID NO: 204667 - protein, 14 aa, Borrelia afzelii
KDIKIFSQYIGSFS

SEQ ID NO: 204668 - protein, 14 aa, Borrelia afzelii
DIKIFSQYIGSFSD

SEQ ID NO: 204669 - protein, 14 aa, Borrelia afzelii
IKIFSQYIGSFSDL

SEQ ID NO: 204670 - protein, 14 aa, Borrelia afzelii
KIFSQYIGSFSDLE

SEQ ID NO: 204671 - protein, 14 aa, Borrelia afzelii
IFSQYIGSFSDLEA

SEQ ID NO: 204672 - protein, 14 aa, Borrelia afzelii
FSQYIGSFSDLEAG

SEQ ID NO: 204673 - protein, 14 aa, Borrelia afzelii
SQYIGSFSDLEAGR

SEQ ID NO: 204674 - protein, 14 aa, Borrelia afzelii
QYIGSFSDLEAGRS

SEQ ID NO: 204675 - protein, 14 aa, Borrelia afzelii
YIGSFSDLEAGRSV

SEQ ID NO: 204676 - protein, 14 aa, Borrelia afzelii
IGSFSDLEAGRSVA

SEQ ID NO: 204677 - protein, 14 aa, Borrelia afzelii
GSFSDLEAGRSVAT

SEQ ID NO: 204678 - protein, 14 aa, Borrelia afzelii
SFSDLEAGRSVATK

SEQ ID NO: 204679 - protein, 14 aa, Borrelia afzelii
FSDLEAGRSVATKM

SEQ ID NO: 204680 - protein, 14 aa, Borrelia afzelii
SDLEAGRSVATKMY

SEQ ID NO: 204681 - protein, 14 aa, Borrelia afzelii
DLEAGRSVATKMYS

SEQ ID NO: 204682 - protein, 14 aa, Borrelia afzelii
LEAGRSVATKMYSD

SEQ ID NO: 204683 - protein, 14 aa, Borrelia afzelii
EAGRSVATKMYSDG

SEQ ID NO: 204684 - protein, 14 aa, Borrelia afzelii
AGRSVATKMYSDGI

SEQ ID NO: 204685 - protein, 14 aa, Borrelia afzelii
GRSVATKMYSDGID

SEQ ID NO: 204686 - protein, 14 aa, Borrelia afzelii
RSVATKMYSDGIDI

SEQ ID NO: 204687 - protein, 14 aa, Borrelia afzelii
SVATKMYSDGIDII

SEQ ID NO: 204688 - protein, 14 aa, Borrelia afzelii
VATKMYSDGIDIIH

SEQ ID NO: 204689 - protein, 14 aa, Borrelia afzelii
ATKMYSDGIDIIHH

SEQ ID NO: 204690 - protein, 14 aa, Borrelia afzelii
TKMYSDGIDIIHHA

SEQ ID NO: 204691 - protein, 14 aa, Borrelia afzelii
KMYSDGIDIIHHAA

SEQ ID NO: 204692 - protein, 14 aa, Borrelia afzelii
MYSDGIDIIHHAAG

SEQ ID NO: 204693 - protein, 14 aa, Borrelia afzelii
YSDGIDIIHHAAGL

SEQ ID NO: 204694 - protein, 14 aa, Borrelia afzelii
SDGIDIIHHAAGLG

SEQ ID NO: 204695 - protein, 14 aa, Borrelia afzelii
DGIDIIHHAAGLGG

SEQ ID NO: 204696 - protein, 14 aa, Borrelia afzelii
GIDIIHHAAGLGGI

SEQ ID NO: 204697 - protein, 14 aa, Borrelia afzelii
IDIIHHAAGLGGIG

SEQ ID NO: 204698 - protein, 14 aa, Borrelia afzelii
DIIHHAAGLGGIGA

SEQ ID NO: 204699 - protein, 14 aa, Borrelia afzelii
IIHHAAGLGGIGAI

SEQ ID NO: 204700 - protein, 14 aa, Borrelia afzelii
IHHAAGLGGIGAIE

SEQ ID NO: 204701 - protein, 14 aa, Borrelia afzelii
HHAAGLGGIGAIEV

SEQ ID NO: 204702 - protein, 14 aa, Borrelia afzelii
HAAGLGGIGAIEVA

SEQ ID NO: 204703 - protein, 14 aa, Borrelia afzelii
AAGLGGIGAIEVAK

SEQ ID NO: 204704 - protein, 14 aa, Borrelia afzelii
AGLGGIGAIEVAKE

SEQ ID NO: 204705 - protein, 14 aa, Borrelia afzelii
GLGGIGAIEVAKEL

SEQ ID NO: 204706 - protein, 14 aa, Borrelia afzelii
LGGIGAIEVAKELG

SEQ ID NO: 204707 - protein, 14 aa, Borrelia afzelii
GGIGAIEVAKELGS

SEQ ID NO: 204708 - protein, 14 aa, Borrelia afzelii
GIGAIEVAKELGSG

SEQ ID NO: 204709 - protein, 14 aa, Borrelia afzelii
IGAIEVAKELGSGH

SEQ ID NO: 204710 - protein, 14 aa, Borrelia afzelii
GAIEVAKELGSGHY

SEQ ID NO: 204711 - protein, 14 aa, Borrelia afzelii
AIEVAKELGSGHYI

SEQ ID NO: 204712 - protein, 14 aa, Borrelia afzelii
IEVAKELGSGHYII

SEQ ID NO: 204713 - protein, 14 aa, Borrelia afzelii
EVAKELGSGHYIIG

SEQ ID NO: 204714 - protein, 14 aa, Borrelia afzelii
VAKELGSGHYIIGV

SEQ ID NO: 204715 - protein, 14 aa, Borrelia afzelii
AKELGSGHYIIGVD

SEQ ID NO: 204716 - protein, 14 aa, Borrelia afzelii
KELGSGHYIIGVDE

SEQ ID NO: 204717 - protein, 14 aa, Borrelia afzelii
ELGSGHYIIGVDED

SEQ ID NO: 204718 - protein, 14 aa, Borrelia afzelii
LGSGHYIIGVDEDQ

SEQ ID NO: 204719 - protein, 14 aa, Borrelia afzelii
GSGHYIIGVDEDQS

SEQ ID NO: 204720 - protein, 14 aa, Borrelia afzelii
SGHYIIGVDEDQSY

SEQ ID NO: 204721 - protein, 14 aa, Borrelia afzelii
GHYIIGVDEDQSYL

SEQ ID NO: 204722 - protein, 14 aa, Borrelia afzelii
HYIIGVDEDQSYLA

SEQ ID NO: 204723 - protein, 14 aa, Borrelia afzelii
YIIGVDEDQSYLAP

SEQ ID NO: 204724 - protein, 14 aa, Borrelia afzelii
IIGVDEDQSYLAPN

SEQ ID NO: 204725 - protein, 14 aa, Borrelia afzelii
IGVDEDQSYLAPNN

SEQ ID NO: 204726 - protein, 14 aa, Borrelia afzelii
GVDEDQSYLAPNNV

SEQ ID NO: 204727 - protein, 14 aa, Borrelia afzelii
VDEDQSYLAPNNVI

SEQ ID NO: 204728 - protein, 14 aa, Borrelia afzelii
DEDQSYLAPNNVIT

SEQ ID NO: 204729 - protein, 14 aa, Borrelia afzelii
EDQSYLAPNNVITS

SEQ ID NO: 204730 - protein, 14 aa, Borrelia afzelii
DQSYLAPNNVITST

SEQ ID NO: 204731 - protein, 14 aa, Borrelia afzelii
QSYLAPNNVITSTT

SEQ ID NO: 204732 - protein, 14 aa, Borrelia afzelii
SYLAPNNVITSTTK

SEQ ID NO: 204733 - protein, 14 aa, Borrelia afzelii
YLAPNNVITSTTKD

SEQ ID NO: 204734 - protein, 14 aa, Borrelia afzelii
LAPNNVITSTTKDV

SEQ ID NO: 204735 - protein, 14 aa, Borrelia afzelii
APNNVITSTTKDVG

SEQ ID NO: 204736 - protein, 14 aa, Borrelia afzelii
PNNVITSTTKDVGR

SEQ ID NO: 204737 - protein, 14 aa, Borrelia afzelii
NNVITSTTKDVGRS

SEQ ID NO: 204738 - protein, 14 aa, Borrelia afzelii
NVITSTTKDVGRSL

SEQ ID NO: 204739 - protein, 14 aa, Borrelia afzelii
VITSTTKDVGRSLN

SEQ ID NO: 204740 - protein, 14 aa, Borrelia afzelii
ITSTTKDVGRSLNL

SEQ ID NO: 204741 - protein, 14 aa, Borrelia afzelii
TSTTKDVGRSLNLL

SEQ ID NO: 204742 - protein, 14 aa, Borrelia afzelii
STTKDVGRSLNLLT

SEQ ID NO: 204743 - protein, 14 aa, Borrelia afzelii
TTKDVGRSLNLLTS

SEQ ID NO: 204744 - protein, 14 aa, Borrelia afzelii
TKDVGRSLNLLTSN

SEQ ID NO: 204745 - protein, 14 aa, Borrelia afzelii
KDVGRSLNLLTSNY

SEQ ID NO: 204746 - protein, 14 aa, Borrelia afzelii
DVGRSLNLLTSNYL

SEQ ID NO: 204747 - protein, 14 aa, Borrelia afzelii
VGRSLNLLTSNYLK

SEQ ID NO: 204748 - protein, 14 aa, Borrelia afzelii
GRSLNLLTSNYLKT

SEQ ID NO: 204749 - protein, 14 aa, Borrelia afzelii
RSLNLLTSNYLKTN

SEQ ID NO: 204750 - protein, 14 aa, Borrelia afzelii
SLNLLTSNYLKTNT

SEQ ID NO: 204751 - protein, 14 aa, Borrelia afzelii
LNLLTSNYLKTNTF

SEQ ID NO: 204752 - protein, 14 aa, Borrelia afzelii
NLLTSNYLKTNTFE

SEQ ID NO: 204753 - protein, 14 aa, Borrelia afzelii
LLTSNYLKTNTFEG

SEQ ID NO: 204754 - protein, 14 aa, Borrelia afzelii
LTSNYLKTNTFEGG

SEQ ID NO: 204755 - protein, 14 aa, Borrelia afzelii
TSNYLKTNTFEGGK

SEQ ID NO: 204756 - protein, 14 aa, Borrelia afzelii
SNYLKTNTFEGGKL

SEQ ID NO: 204757 - protein, 14 aa, Borrelia afzelii
NYLKTNTFEGGKLI

SEQ ID NO: 204758 - protein, 14 aa, Borrelia afzelii
YLKTNTFEGGKLIN

SEQ ID NO: 204759 - protein, 14 aa, Borrelia afzelii
LKTNTFEGGKLINY

SEQ ID NO: 204760 - protein, 14 aa, Borrelia afzelii
KTNTFEGGKLINYG

SEQ ID NO: 204761 - protein, 14 aa, Borrelia afzelii
TNTFEGGKLINYGL

SEQ ID NO: 204762 - protein, 14 aa, Borrelia afzelii
NTFEGGKLINYGLK

SEQ ID NO: 204763 - protein, 14 aa, Borrelia afzelii
TFEGGKLINYGLKE

SEQ ID NO: 204764 - protein, 14 aa, Borrelia afzelii
FEGGKLINYGLKEG

SEQ ID NO: 204765 - protein, 14 aa, Borrelia afzelii
EGGKLINYGLKEGV

SEQ ID NO: 204766 - protein, 14 aa, Borrelia afzelii
GGKLINYGLKEGVV

SEQ ID NO: 204767 - protein, 14 aa, Borrelia afzelii
GKLINYGLKEGVVG

SEQ ID NO: 204768 - protein, 14 aa, Borrelia afzelii
KLINYGLKEGVVGF

SEQ ID NO: 204769 - protein, 14 aa, Borrelia afzelii
LINYGLKEGVVGFV

SEQ ID NO: 204770 - protein, 14 aa, Borrelia afzelii
INYGLKEGVVGFVR

SEQ ID NO: 204771 - protein, 14 aa, Borrelia afzelii
NYGLKEGVVGFVRN

SEQ ID NO: 204772 - protein, 14 aa, Borrelia afzelii
YGLKEGVVGFVRNP

SEQ ID NO: 204773 - protein, 14 aa, Borrelia afzelii
GLKEGVVGFVRNPK

SEQ ID NO: 204774 - protein, 14 aa, Borrelia afzelii
LKEGVVGFVRNPKM

SEQ ID NO: 204775 - protein, 14 aa, Borrelia afzelii
KEGVVGFVRNPKMI

SEQ ID NO: 204776 - protein, 14 aa, Borrelia afzelii
EGVVGFVRNPKMIP

SEQ ID NO: 204777 - protein, 14 aa, Borrelia afzelii
GVVGFVRNPKMIPF

SEQ ID NO: 204778 - protein, 14 aa, Borrelia afzelii
VVGFVRNPKMIPFE

SEQ ID NO: 204779 - protein, 14 aa, Borrelia afzelii
VGFVRNPKMIPFEV

SEQ ID NO: 204780 - protein, 14 aa, Borrelia afzelii
GFVRNPKMIPFEVE

SEQ ID NO: 204781 - protein, 14 aa, Borrelia afzelii
FVRNPKMIPFEVEK

SEQ ID NO: 204782 - protein, 14 aa, Borrelia afzelii
VRNPKMIPFEVEKE

SEQ ID NO: 204783 - protein, 14 aa, Borrelia afzelii
RNPKMIPFEVEKEI

SEQ ID NO: 204784 - protein, 14 aa, Borrelia afzelii
NPKMIPFEVEKEID

SEQ ID NO: 204785 - protein, 14 aa, Borrelia afzelii
PKMIPFEVEKEIDS

SEQ ID NO: 204786 - protein, 14 aa, Borrelia afzelii
KMIPFEVEKEIDSL

SEQ ID NO: 204787 - protein, 14 aa, Borrelia afzelii
MIPFEVEKEIDSLS

SEQ ID NO: 204788 - protein, 14 aa, Borrelia afzelii
IPFEVEKEIDSLSS

SEQ ID NO: 204789 - protein, 14 aa, Borrelia afzelii
PFEVEKEIDSLSSK

SEQ ID NO: 204790 - protein, 14 aa, Borrelia afzelii
FEVEKEIDSLSSKI

SEQ ID NO: 204791 - protein, 14 aa, Borrelia afzelii
EVEKEIDSLSSKII

SEQ ID NO: 204792 - protein, 14 aa, Borrelia afzelii
VEKEIDSLSSKIIN

SEQ ID NO: 204793 - protein, 14 aa, Borrelia afzelii
EKEIDSLSSKIINK

SEQ ID NO: 204794 - protein, 14 aa, Borrelia afzelii
KEIDSLSSKIINKE

SEQ ID NO: 204795 - protein, 14 aa, Borrelia afzelii
EIDSLSSKIINKEV

SEQ ID NO: 204796 - protein, 14 aa, Borrelia afzelii
IDSLSSKIINKEVI

SEQ ID NO: 204797 - protein, 14 aa, Borrelia afzelii
DSLSSKIINKEVIV

SEQ ID NO: 204798 - protein, 14 aa, Borrelia afzelii
SLSSKIINKEVIVP

SEQ ID NO: 204799 - protein, 14 aa, Borrelia afzelii
LSSKIINKEVIVPY

SEQ ID NO: 204800 - protein, 14 aa, Borrelia afzelii
SSKIINKEVIVPYN

SEQ ID NO: 204801 - protein, 14 aa, Borrelia afzelii
SKIINKEVIVPYNK

SEQ ID NO: 204802 - protein, 14 aa, Borrelia afzelii
KIINKEVIVPYNKE

SEQ ID NO: 204803 - protein, 14 aa, Borrelia afzelii
IINKEVIVPYNKES

SEQ ID NO: 204804 - protein, 14 aa, Borrelia afzelii
INKEVIVPYNKESY

SEQ ID NO: 204805 - protein, 14 aa, Borrelia afzelii
NKEVIVPYNKESYE

SEQ ID NO: 204806 - protein, 14 aa, Borrelia afzelii
KEVIVPYNKESYEK

SEQ ID NO: 204807 - protein, 14 aa, Borrelia afzelii
EVIVPYNKESYEKF

SEQ ID NO: 204808 - protein, 14 aa, Borrelia afzelii
VIVPYNKESYEKFL

SEQ ID NO: 204809 - protein, 14 aa, Borrelia afzelii
IVPYNKESYEKFLK

SEQ ID NO: 204810 - protein, 14 aa, Borrelia afzelii
VPYNKESYEKFLKE

SEQ ID NO: 204811 - protein, 14 aa, Borrelia afzelii
PYNKESYEKFLKEF

SEQ ID NO: 204812 - protein, 14 aa, Borrelia afzelii
YNKESYEKFLKEFI

SEQ ID NO: 204813 - protein, 15 aa, Borrelia afzelii
FLSCSGKSGLESGIP

SEQ ID NO: 204814 - protein, 15 aa, Borrelia afzelii
LSCSGKSGLESGIPK

SEQ ID NO: 204815 - protein, 15 aa, Borrelia afzelii
SCSGKSGLESGIPKV

SEQ ID NO: 204816 - protein, 15 aa, Borrelia afzelii
CSGKSGLESGIPKVS

SEQ ID NO: 204817 - protein, 15 aa, Borrelia afzelii
SGKSGLESGIPKVSL

SEQ ID NO: 204818 - protein, 15 aa, Borrelia afzelii
GKSGLESGIPKVSLV

SEQ ID NO: 204819 - protein, 15 aa, Borrelia afzelii
KSGLESGIPKVSLVI

SEQ ID NO: 204820 - protein, 15 aa, Borrelia afzelii
SGLESGIPKVSLVID

SEQ ID NO: 204821 - protein, 15 aa, Borrelia afzelii
GLESGIPKVSLVIDG

SEQ ID NO: 204822 - protein, 15 aa, Borrelia afzelii
LESGIPKVSLVIDGT

SEQ ID NO: 204823 - protein, 15 aa, Borrelia afzelii
ESGIPKVSLVIDGTF

SEQ ID NO: 204824 - protein, 15 aa, Borrelia afzelii
SGIPKVSLVIDGTFD

SEQ ID NO: 204825 - protein, 15 aa, Borrelia afzelii
GIPKVSLVIDGTFDD

SEQ ID NO: 204826 - protein, 15 aa, Borrelia afzelii
IPKVSLVIDGTFDDK

SEQ ID NO: 204827 - protein, 15 aa, Borrelia afzelii
PKVSLVIDGTFDDKS

SEQ ID NO: 204828 - protein, 15 aa, Borrelia afzelii
KVSLVIDGTFDDKSF

SEQ ID NO: 204829 - protein, 15 aa, Borrelia afzelii
VSLVIDGTFDDKSFN

SEQ ID NO: 204830 - protein, 15 aa, Borrelia afzelii
SLVIDGTFDDKSFNE

SEQ ID NO: 204831 - protein, 15 aa, Borrelia afzelii
LVIDGTFDDKSFNES

SEQ ID NO: 204832 - protein, 15 aa, Borrelia afzelii
VIDGTFDDKSFNESA

SEQ ID NO: 204833 - protein, 15 aa, Borrelia afzelii
IDGTFDDKSFNESAL

SEQ ID NO: 204834 - protein, 15 aa, Borrelia afzelii
DGTFDDKSFNESALN

SEQ ID NO: 204835 - protein, 15 aa, Borrelia afzelii
GTFDDKSFNESALNG

SEQ ID NO: 204836 - protein, 15 aa, Borrelia afzelii
TFDDKSFNESALNGV

SEQ ID NO: 204837 - protein, 15 aa, Borrelia afzelii
FDDKSFNESALNGVK

SEQ ID NO: 204838 - protein, 15 aa, Borrelia afzelii
DDKSFNESALNGVKK

SEQ ID NO: 204839 - protein, 15 aa, Borrelia afzelii
DKSFNESALNGVKKL

SEQ ID NO: 204840 - protein, 15 aa, Borrelia afzelii
KSFNESALNGVKKLK

SEQ ID NO: 204841 - protein, 15 aa, Borrelia afzelii
SFNESALNGVKKLKE

SEQ ID NO: 204842 - protein, 15 aa, Borrelia afzelii
FNESALNGVKKLKEE

SEQ ID NO: 204843 - protein, 15 aa, Borrelia afzelii
NESALNGVKKLKEEF

SEQ ID NO: 204844 - protein, 15 aa, Borrelia afzelii
ESALNGVKKLKEEFE

SEQ ID NO: 204845 - protein, 15 aa, Borrelia afzelii
SALNGVKKLKEEFEI

SEQ ID NO: 204846 - protein, 15 aa, Borrelia afzelii
ALNGVKKLKEEFEIE

SEQ ID NO: 204847 - protein, 15 aa, Borrelia afzelii
LNGVKKLKEEFEIEL

SEQ ID NO: 204848 - protein, 15 aa, Borrelia afzelii
NGVKKLKEEFEIELV

SEQ ID NO: 204849 - protein, 15 aa, Borrelia afzelii
GVKKLKEEFEIELVL

SEQ ID NO: 204850 - protein, 15 aa, Borrelia afzelii
VKKLKEEFEIELVLK

SEQ ID NO: 204851 - protein, 15 aa, Borrelia afzelii
KKLKEEFEIELVLKE

SEQ ID NO: 204852 - protein, 15 aa, Borrelia afzelii
KLKEEFEIELVLKES

SEQ ID NO: 204853 - protein, 15 aa, Borrelia afzelii
LKEEFEIELVLKESS

SEQ ID NO: 204854 - protein, 15 aa, Borrelia afzelii
KEEFEIELVLKESST

SEQ ID NO: 204855 - protein, 15 aa, Borrelia afzelii
EEFEIELVLKESSTN

SEQ ID NO: 204856 - protein, 15 aa, Borrelia afzelii
EFEIELVLKESSTNS

SEQ ID NO: 204857 - protein, 15 aa, Borrelia afzelii
FEIELVLKESSTNSY

SEQ ID NO: 204858 - protein, 15 aa, Borrelia afzelii
EIELVLKESSTNSYL

SEQ ID NO: 204859 - protein, 15 aa, Borrelia afzelii
IELVLKESSTNSYLS

SEQ ID NO: 204860 - protein, 15 aa, Borrelia afzelii
ELVLKESSTNSYLSD

SEQ ID NO: 204861 - protein, 15 aa, Borrelia afzelii
LVLKESSTNSYLSDL

SEQ ID NO: 204862 - protein, 15 aa, Borrelia afzelii
VLKESSTNSYLSDLE

SEQ ID NO: 204863 - protein, 15 aa, Borrelia afzelii
LKESSTNSYLSDLEG

SEQ ID NO: 204864 - protein, 15 aa, Borrelia afzelii
KESSTNSYLSDLEGL

SEQ ID NO: 204865 - protein, 15 aa, Borrelia afzelii
ESSTNSYLSDLEGLK

SEQ ID NO: 204866 - protein, 15 aa, Borrelia afzelii
SSTNSYLSDLEGLKD

SEQ ID NO: 204867 - protein, 15 aa, Borrelia afzelii
STNSYLSDLEGLKDA

SEQ ID NO: 204868 - protein, 15 aa, Borrelia afzelii
TNSYLSDLEGLKDAG

SEQ ID NO: 204869 - protein, 15 aa, Borrelia afzelii
NSYLSDLEGLKDAGS

SEQ ID NO: 204870 - protein, 15 aa, Borrelia afzelii
SYLSDLEGLKDAGSN

SEQ ID NO: 204871 - protein, 15 aa, Borrelia afzelii
YLSDLEGLKDAGSNL

SEQ ID NO: 204872 - protein, 15 aa, Borrelia afzelii
LSDLEGLKDAGSNLI

SEQ ID NO: 204873 - protein, 15 aa, Borrelia afzelii
SDLEGLKDAGSNLIW

SEQ ID NO: 204874 - protein, 15 aa, Borrelia afzelii
DLEGLKDAGSNLIWL

SEQ ID NO: 204875 - protein, 15 aa, Borrelia afzelii
LEGLKDAGSNLIWLI

SEQ ID NO: 204876 - protein, 15 aa, Borrelia afzelii
EGLKDAGSNLIWLIG

SEQ ID NO: 204877 - protein, 15 aa, Borrelia afzelii
GLKDAGSNLIWLIGY

SEQ ID NO: 204878 - protein, 15 aa, Borrelia afzelii
LKDAGSNLIWLIGYK

SEQ ID NO: 204879 - protein, 15 aa, Borrelia afzelii
KDAGSNLIWLIGYKF

SEQ ID NO: 204880 - protein, 15 aa, Borrelia afzelii
DAGSNLIWLIGYKFS

SEQ ID NO: 204881 - protein, 15 aa, Borrelia afzelii
AGSNLIWLIGYKFSD

SEQ ID NO: 204882 - protein, 15 aa, Borrelia afzelii
GSNLIWLIGYKFSDV

SEQ ID NO: 204883 - protein, 15 aa, Borrelia afzelii
SNLIWLIGYKFSDVA

SEQ ID NO: 204884 - protein, 15 aa, Borrelia afzelii
NLIWLIGYKFSDVAK

SEQ ID NO: 204885 - protein, 15 aa, Borrelia afzelii
LIWLIGYKFSDVAKA

SEQ ID NO: 204886 - protein, 15 aa, Borrelia afzelii
IWLIGYKFSDVAKAV

SEQ ID NO: 204887 - protein, 15 aa, Borrelia afzelii
WLIGYKFSDVAKAVS

SEQ ID NO: 204888 - protein, 15 aa, Borrelia afzelii
LIGYKFSDVAKAVSL

SEQ ID NO: 204889 - protein, 15 aa, Borrelia afzelii
IGYKFSDVAKAVSLQ

SEQ ID NO: 204890 - protein, 15 aa, Borrelia afzelii
GYKFSDVAKAVSLQN

SEQ ID NO: 204891 - protein, 15 aa, Borrelia afzelii
YKFSDVAKAVSLQNS

SEQ ID NO: 204892 - protein, 15 aa, Borrelia afzelii
KFSDVAKAVSLQNSE

SEQ ID NO: 204893 - protein, 15 aa, Borrelia afzelii
FSDVAKAVSLQNSEM

SEQ ID NO: 204894 - protein, 15 aa, Borrelia afzelii
SDVAKAVSLQNSEMK

SEQ ID NO: 204895 - protein, 15 aa, Borrelia afzelii
DVAKAVSLQNSEMKY

SEQ ID NO: 204896 - protein, 15 aa, Borrelia afzelii
VAKAVSLQNSEMKYA

SEQ ID NO: 204897 - protein, 15 aa, Borrelia afzelii
AKAVSLQNSEMKYAI

SEQ ID NO: 204898 - protein, 15 aa, Borrelia afzelii
KAVSLQNSEMKYAII

SEQ ID NO: 204899 - protein, 15 aa, Borrelia afzelii
AVSLQNSEMKYAIID

SEQ ID NO: 204900 - protein, 15 aa, Borrelia afzelii
VSLQNSEMKYAIIDP

SEQ ID NO: 204901 - protein, 15 aa, Borrelia afzelii
SLQNSEMKYAIIDPV

SEQ ID NO: 204902 - protein, 15 aa, Borrelia afzelii
LQNSEMKYAIIDPVY

SEQ ID NO: 204903 - protein, 15 aa, Borrelia afzelii
QNSEMKYAIIDPVYS

SEQ ID NO: 204904 - protein, 15 aa, Borrelia afzelii
NSEMKYAIIDPVYSN

SEQ ID NO: 204905 - protein, 15 aa, Borrelia afzelii
SEMKYAIIDPVYSNE

SEQ ID NO: 204906 - protein, 15 aa, Borrelia afzelii
EMKYAIIDPVYSNEP

SEQ ID NO: 204907 - protein, 15 aa, Borrelia afzelii
MKYAIIDPVYSNEPI

SEQ ID NO: 204908 - protein, 15 aa, Borrelia afzelii
KYAIIDPVYSNEPIP

SEQ ID NO: 204909 - protein, 15 aa, Borrelia afzelii
YAIIDPVYSNEPIPA

SEQ ID NO: 204910 - protein, 15 aa, Borrelia afzelii
AIIDPVYSNEPIPAN

SEQ ID NO: 204911 - protein, 15 aa, Borrelia afzelii
IIDPVYSNEPIPANL

SEQ ID NO: 204912 - protein, 15 aa, Borrelia afzelii
IDPVYSNEPIPANLV

SEQ ID NO: 204913 - protein, 15 aa, Borrelia afzelii
DPVYSNEPIPANLVG

SEQ ID NO: 204914 - protein, 15 aa, Borrelia afzelii
PVYSNEPIPANLVGM

SEQ ID NO: 204915 - protein, 15 aa, Borrelia afzelii
VYSNEPIPANLVGMT

SEQ ID NO: 204916 - protein, 15 aa, Borrelia afzelii
YSNEPIPANLVGMTF

SEQ ID NO: 204917 - protein, 15 aa, Borrelia afzelii
SNEPIPANLVGMTFR

SEQ ID NO: 204918 - protein, 15 aa, Borrelia afzelii
NEPIPANLVGMTFRA

SEQ ID NO: 204919 - protein, 15 aa, Borrelia afzelii
EPIPANLVGMTFRAQ

SEQ ID NO: 204920 - protein, 15 aa, Borrelia afzelii
PIPANLVGMTFRAQE

SEQ ID NO: 204921 - protein, 15 aa, Borrelia afzelii
IPANLVGMTFRAQEG

SEQ ID NO: 204922 - protein, 15 aa, Borrelia afzelii
PANLVGMTFRAQEGA

SEQ ID NO: 204923 - protein, 15 aa, Borrelia afzelii
ANLVGMTFRAQEGAF

SEQ ID NO: 204924 - protein, 15 aa, Borrelia afzelii
NLVGMTFRAQEGAFL

SEQ ID NO: 204925 - protein, 15 aa, Borrelia afzelii
LVGMTFRAQEGAFLT

SEQ ID NO: 204926 - protein, 15 aa, Borrelia afzelii
VGMTFRAQEGAFLTG

SEQ ID NO: 204927 - protein, 15 aa, Borrelia afzelii
GMTFRAQEGAFLTGY

SEQ ID NO: 204928 - protein, 15 aa, Borrelia afzelii
MTFRAQEGAFLTGYI

SEQ ID NO: 204929 - protein, 15 aa, Borrelia afzelii
TFRAQEGAFLTGYIA

SEQ ID NO: 204930 - protein, 15 aa, Borrelia afzelii
FRAQEGAFLTGYIAA

SEQ ID NO: 204931 - protein, 15 aa, Borrelia afzelii
RAQEGAFLTGYIAAK

SEQ ID NO: 204932 - protein, 15 aa, Borrelia afzelii
AQEGAFLTGYIAAKV

SEQ ID NO: 204933 - protein, 15 aa, Borrelia afzelii
QEGAFLTGYIAAKVS

SEQ ID NO: 204934 - protein, 15 aa, Borrelia afzelii
EGAFLTGYIAAKVSK

SEQ ID NO: 204935 - protein, 15 aa, Borrelia afzelii
GAFLTGYIAAKVSKT

SEQ ID NO: 204936 - protein, 15 aa, Borrelia afzelii
AFLTGYIAAKVSKTG

SEQ ID NO: 204937 - protein, 15 aa, Borrelia afzelii
FLTGYIAAKVSKTGK

SEQ ID NO: 204938 - protein, 15 aa, Borrelia afzelii
LTGYIAAKVSKTGKI

SEQ ID NO: 204939 - protein, 15 aa, Borrelia afzelii
TGYIAAKVSKTGKIG

SEQ ID NO: 204940 - protein, 15 aa, Borrelia afzelii
GYIAAKVSKTGKIGF

SEQ ID NO: 204941 - protein, 15 aa, Borrelia afzelii
YIAAKVSKTGKIGFL

SEQ ID NO: 204942 - protein, 15 aa, Borrelia afzelii
IAAKVSKTGKIGFLG

SEQ ID NO: 204943 - protein, 15 aa, Borrelia afzelii
AAKVSKTGKIGFLGG

SEQ ID NO: 204944 - protein, 15 aa, Borrelia afzelii
AKVSKTGKIGFLGGI

SEQ ID NO: 204945 - protein, 15 aa, Borrelia afzelii
KVSKTGKIGFLGGIE

SEQ ID NO: 204946 - protein, 15 aa, Borrelia afzelii
VSKTGKIGFLGGIEG

SEQ ID NO: 204947 - protein, 15 aa, Borrelia afzelii
SKTGKIGFLGGIEGD

SEQ ID NO: 204948 - protein, 15 aa, Borrelia afzelii
KTGKIGFLGGIEGDI

SEQ ID NO: 204949 - protein, 15 aa, Borrelia afzelii
TGKIGFLGGIEGDIV

SEQ ID NO: 204950 - protein, 15 aa, Borrelia afzelii
GKIGFLGGIEGDIVD

SEQ ID NO: 204951 - protein, 15 aa, Borrelia afzelii
KIGFLGGIEGDIVDA

SEQ ID NO: 204952 - protein, 15 aa, Borrelia afzelii
IGFLGGIEGDIVDAF

SEQ ID NO: 204953 - protein, 15 aa, Borrelia afzelii
GFLGGIEGDIVDAFR

SEQ ID NO: 204954 - protein, 15 aa, Borrelia afzelii
FLGGIEGDIVDAFRY

SEQ ID NO: 204955 - protein, 15 aa, Borrelia afzelii
LGGIEGDIVDAFRYG

SEQ ID NO: 204956 - protein, 15 aa, Borrelia afzelii
GGIEGDIVDAFRYGY

SEQ ID NO: 204957 - protein, 15 aa, Borrelia afzelii
GIEGDIVDAFRYGYE

SEQ ID NO: 204958 - protein, 15 aa, Borrelia afzelii
IEGDIVDAFRYGYEA

SEQ ID NO: 204959 - protein, 15 aa, Borrelia afzelii
EGDIVDAFRYGYEAG

SEQ ID NO: 204960 - protein, 15 aa, Borrelia afzelii
GDIVDAFRYGYEAGA

SEQ ID NO: 204961 - protein, 15 aa, Borrelia afzelii
DIVDAFRYGYEAGAK

SEQ ID NO: 204962 - protein, 15 aa, Borrelia afzelii
IVDAFRYGYEAGAKY

SEQ ID NO: 204963 - protein, 15 aa, Borrelia afzelii
VDAFRYGYEAGAKYA

SEQ ID NO: 204964 - protein, 15 aa, Borrelia afzelii
DAFRYGYEAGAKYAN

SEQ ID NO: 204965 - protein, 15 aa, Borrelia afzelii
AFRYGYEAGAKYANK

SEQ ID NO: 204966 - protein, 15 aa, Borrelia afzelii
FRYGYEAGAKYANKD

SEQ ID NO: 204967 - protein, 15 aa, Borrelia afzelii
RYGYEAGAKYANKDI

SEQ ID NO: 204968 - protein, 15 aa, Borrelia afzelii
YGYEAGAKYANKDIK

SEQ ID NO: 204969 - protein, 15 aa, Borrelia afzelii
GYEAGAKYANKDIKI

SEQ ID NO: 204970 - protein, 15 aa, Borrelia afzelii
YEAGAKYANKDIKIF

SEQ ID NO: 204971 - protein, 15 aa, Borrelia afzelii
EAGAKYANKDIKIFS

SEQ ID NO: 204972 - protein, 15 aa, Borrelia afzelii
AGAKYANKDIKIFSQ

SEQ ID NO: 204973 - protein, 15 aa, Borrelia afzelii
GAKYANKDIKIFSQY

SEQ ID NO: 204974 - protein, 15 aa, Borrelia afzelii
AKYANKDIKIFSQYI

SEQ ID NO: 204975 - protein, 15 aa, Borrelia afzelii
KYANKDIKIFSQYIG

SEQ ID NO: 204976 - protein, 15 aa, Borrelia afzelii
YANKDIKIFSQYIGS

SEQ ID NO: 204977 - protein, 15 aa, Borrelia afzelii
ANKDIKIFSQYIGSF

SEQ ID NO: 204978 - protein, 15 aa, Borrelia afzelii
NKDIKIFSQYIGSFS

SEQ ID NO: 204979 - protein, 15 aa, Borrelia afzelii
KDIKIFSQYIGSFSD

SEQ ID NO: 204980 - protein, 15 aa, Borrelia afzelii
DIKIFSQYIGSFSDL

SEQ ID NO: 204981 - protein, 15 aa, Borrelia afzelii
IKIFSQYIGSFSDLE

SEQ ID NO: 204982 - protein, 15 aa, Borrelia afzelii
KIFSQYIGSFSDLEA

SEQ ID NO: 204983 - protein, 15 aa, Borrelia afzelii
IFSQYIGSFSDLEAG

SEQ ID NO: 204984 - protein, 15 aa, Borrelia afzelii
FSQYIGSFSDLEAGR

SEQ ID NO: 204985 - protein, 15 aa, Borrelia afzelii
SQYIGSFSDLEAGRS

SEQ ID NO: 204986 - protein, 15 aa, Borrelia afzelii
QYIGSFSDLEAGRSV

SEQ ID NO: 204987 - protein, 15 aa, Borrelia afzelii
YIGSFSDLEAGRSVA

SEQ ID NO: 204988 - protein, 15 aa, Borrelia afzelii
IGSFSDLEAGRSVAT

SEQ ID NO: 204989 - protein, 15 aa, Borrelia afzelii
GSFSDLEAGRSVATK

SEQ ID NO: 204990 - protein, 15 aa, Borrelia afzelii
SFSDLEAGRSVATKM

SEQ ID NO: 204991 - protein, 15 aa, Borrelia afzelii
FSDLEAGRSVATKMY

SEQ ID NO: 204992 - protein, 15 aa, Borrelia afzelii
SDLEAGRSVATKMYS

SEQ ID NO: 204993 - protein, 15 aa, Borrelia afzelii
DLEAGRSVATKMYSD

SEQ ID NO: 204994 - protein, 15 aa, Borrelia afzelii
LEAGRSVATKMYSDG

SEQ ID NO: 204995 - protein, 15 aa, Borrelia afzelii
EAGRSVATKMYSDGI

SEQ ID NO: 204996 - protein, 15 aa, Borrelia afzelii
AGRSVATKMYSDGID

SEQ ID NO: 204997 - protein, 15 aa, Borrelia afzelii
GRSVATKMYSDGIDI

SEQ ID NO: 204998 - protein, 15 aa, Borrelia afzelii
RSVATKMYSDGIDII

SEQ ID NO: 204999 - protein, 15 aa, Borrelia afzelii
SVATKMYSDGIDIIH

SEQ ID NO: 205000 - protein, 15 aa, Borrelia afzelii
VATKMYSDGIDIIHH

SEQ ID NO: 205001 - protein, 15 aa, Borrelia afzelii
ATKMYSDGIDIIHHA

SEQ ID NO: 205002 - protein, 15 aa, Borrelia afzelii
TKMYSDGIDIIHHAA

SEQ ID NO: 205003 - protein, 15 aa, Borrelia afzelii
KMYSDGIDIIHHAAG

SEQ ID NO: 205004 - protein, 15 aa, Borrelia afzelii
MYSDGIDIIHHAAGL

SEQ ID NO: 205005 - protein, 15 aa, Borrelia afzelii
YSDGIDIIHHAAGLG

SEQ ID NO: 205006 - protein, 15 aa, Borrelia afzelii
SDGIDIIHHAAGLGG

SEQ ID NO: 205007 - protein, 15 aa, Borrelia afzelii
DGIDIIHHAAGLGGI

SEQ ID NO: 205008 - protein, 15 aa, Borrelia afzelii
GIDIIHHAAGLGGIG

SEQ ID NO: 205009 - protein, 15 aa, Borrelia afzelii
IDIIHHAAGLGGIGA

SEQ ID NO: 205010 - protein, 15 aa, Borrelia afzelii
DIIHHAAGLGGIGAI

SEQ ID NO: 205011 - protein, 15 aa, Borrelia afzelii
IIHHAAGLGGIGAIE

SEQ ID NO: 205012 - protein, 15 aa, Borrelia afzelii
IHHAAGLGGIGAIEV

SEQ ID NO: 205013 - protein, 15 aa, Borrelia afzelii
HHAAGLGGIGAIEVA

SEQ ID NO: 205014 - protein, 15 aa, Borrelia afzelii
HAAGLGGIGAIEVAK

SEQ ID NO: 205015 - protein, 15 aa, Borrelia afzelii
AAGLGGIGAIEVAKE

SEQ ID NO: 205016 - protein, 15 aa, Borrelia afzelii
AGLGGIGAIEVAKEL

SEQ ID NO: 205017 - protein, 15 aa, Borrelia afzelii
GLGGIGAIEVAKELG

SEQ ID NO: 205018 - protein, 15 aa, Borrelia afzelii
LGGIGAIEVAKELGS

SEQ ID NO: 205019 - protein, 15 aa, Borrelia afzelii
GGIGAIEVAKELGSG

SEQ ID NO: 205020 - protein, 15 aa, Borrelia afzelii
GIGAIEVAKELGSGH

SEQ ID NO: 205021 - protein, 15 aa, Borrelia afzelii
IGAIEVAKELGSGHY

SEQ ID NO: 205022 - protein, 15 aa, Borrelia afzelii
GAIEVAKELGSGHYI

SEQ ID NO: 205023 - protein, 15 aa, Borrelia afzelii
AIEVAKELGSGHYII

SEQ ID NO: 205024 - protein, 15 aa, Borrelia afzelii
IEVAKELGSGHYIIG

SEQ ID NO: 205025 - protein, 15 aa, Borrelia afzelii
EVAKELGSGHYIIGV

SEQ ID NO: 205026 - protein, 15 aa, Borrelia afzelii
VAKELGSGHYIIGVD

SEQ ID NO: 205027 - protein, 15 aa, Borrelia afzelii
AKELGSGHYIIGVDE

SEQ ID NO: 205028 - protein, 15 aa, Borrelia afzelii
KELGSGHYIIGVDED

SEQ ID NO: 205029 - protein, 15 aa, Borrelia afzelii
ELGSGHYIIGVDEDQ

SEQ ID NO: 205030 - protein, 15 aa, Borrelia afzelii
LGSGHYIIGVDEDQS

SEQ ID NO: 205031 - protein, 15 aa, Borrelia afzelii
GSGHYIIGVDEDQSY

SEQ ID NO: 205032 - protein, 15 aa, Borrelia afzelii
SGHYIIGVDEDQSYL

SEQ ID NO: 205033 - protein, 15 aa, Borrelia afzelii
GHYIIGVDEDQSYLA

SEQ ID NO: 205034 - protein, 15 aa, Borrelia afzelii
HYIIGVDEDQSYLAP

SEQ ID NO: 205035 - protein, 15 aa, Borrelia afzelii
YIIGVDEDQSYLAPN

SEQ ID NO: 205036 - protein, 15 aa, Borrelia afzelii
IIGVDEDQSYLAPNN

SEQ ID NO: 205037 - protein, 15 aa, Borrelia afzelii
IGVDEDQSYLAPNNV

SEQ ID NO: 205038 - protein, 15 aa, Borrelia afzelii
GVDEDQSYLAPNNVI

SEQ ID NO: 205039 - protein, 15 aa, Borrelia afzelii
VDEDQSYLAPNNVIT

SEQ ID NO: 205040 - protein, 15 aa, Borrelia afzelii
DEDQSYLAPNNVITS

SEQ ID NO: 205041 - protein, 15 aa, Borrelia afzelii
EDQSYLAPNNVITST

SEQ ID NO: 205042 - protein, 15 aa, Borrelia afzelii
DQSYLAPNNVITSTT

SEQ ID NO: 205043 - protein, 15 aa, Borrelia afzelii
QSYLAPNNVITSTTK

SEQ ID NO: 205044 - protein, 15 aa, Borrelia afzelii
SYLAPNNVITSTTKD

SEQ ID NO: 205045 - protein, 15 aa, Borrelia afzelii
YLAPNNVITSTTKDV

SEQ ID NO: 205046 - protein, 15 aa, Borrelia afzelii
LAPNNVITSTTKDVG

SEQ ID NO: 205047 - protein, 15 aa, Borrelia afzelii
APNNVITSTTKDVGR

SEQ ID NO: 205048 - protein, 15 aa, Borrelia afzelii
PNNVITSTTKDVGRS

SEQ ID NO: 205049 - protein, 15 aa, Borrelia afzelii
NNVITSTTKDVGRSL

SEQ ID NO: 205050 - protein, 15 aa, Borrelia afzelii
NVITSTTKDVGRSLN

SEQ ID NO: 205051 - protein, 15 aa, Borrelia afzelii
VITSTTKDVGRSLNL

SEQ ID NO: 205052 - protein, 15 aa, Borrelia afzelii
ITSTTKDVGRSLNLL

SEQ ID NO: 205053 - protein, 15 aa, Borrelia afzelii
TSTTKDVGRSLNLLT

SEQ ID NO: 205054 - protein, 15 aa, Borrelia afzelii
STTKDVGRSLNLLTS

SEQ ID NO: 205055 - protein, 15 aa, Borrelia afzelii
TTKDVGRSLNLLTSN

SEQ ID NO: 205056 - protein, 15 aa, Borrelia afzelii
TKDVGRSLNLLTSNY

SEQ ID NO: 205057 - protein, 15 aa, Borrelia afzelii
KDVGRSLNLLTSNYL

SEQ ID NO: 205058 - protein, 15 aa, Borrelia afzelii
DVGRSLNLLTSNYLK

SEQ ID NO: 205059 - protein, 15 aa, Borrelia afzelii
VGRSLNLLTSNYLKT

SEQ ID NO: 205060 - protein, 15 aa, Borrelia afzelii
GRSLNLLTSNYLKTN

SEQ ID NO: 205061 - protein, 15 aa, Borrelia afzelii
RSLNLLTSNYLKTNT

SEQ ID NO: 205062 - protein, 15 aa, Borrelia afzelii
SLNLLTSNYLKTNTF

SEQ ID NO: 205063 - protein, 15 aa, Borrelia afzelii
LNLLTSNYLKTNTFE

SEQ ID NO: 205064 - protein, 15 aa, Borrelia afzelii
NLLTSNYLKTNTFEG

SEQ ID NO: 205065 - protein, 15 aa, Borrelia afzelii
LLTSNYLKTNTFEGG

SEQ ID NO: 205066 - protein, 15 aa, Borrelia afzelii
LTSNYLKTNTFEGGK

SEQ ID NO: 205067 - protein, 15 aa, Borrelia afzelii
TSNYLKTNTFEGGKL

SEQ ID NO: 205068 - protein, 15 aa, Borrelia afzelii
SNYLKTNTFEGGKLI

SEQ ID NO: 205069 - protein, 15 aa, Borrelia afzelii
NYLKTNTFEGGKLIN

SEQ ID NO: 205070 - protein, 15 aa, Borrelia afzelii
YLKTNTFEGGKLINY

SEQ ID NO: 205071 - protein, 15 aa, Borrelia afzelii
LKTNTFEGGKLINYG

SEQ ID NO: 205072 - protein, 15 aa, Borrelia afzelii
KTNTFEGGKLINYGL

SEQ ID NO: 205073 - protein, 15 aa, Borrelia afzelii
TNTFEGGKLINYGLK

SEQ ID NO: 205074 - protein, 15 aa, Borrelia afzelii
NTFEGGKLINYGLKE

SEQ ID NO: 205075 - protein, 15 aa, Borrelia afzelii
TFEGGKLINYGLKEG

SEQ ID NO: 205076 - protein, 15 aa, Borrelia afzelii
FEGGKLINYGLKEGV

SEQ ID NO: 205077 - protein, 15 aa, Borrelia afzelii
EGGKLINYGLKEGVV

SEQ ID NO: 205078 - protein, 15 aa, Borrelia afzelii
GGKLINYGLKEGVVG

SEQ ID NO: 205079 - protein, 15 aa, Borrelia afzelii
GKLINYGLKEGVVGF

SEQ ID NO: 205080 - protein, 15 aa, Borrelia afzelii
KLINYGLKEGVVGFV

SEQ ID NO: 205081 - protein, 15 aa, Borrelia afzelii
LINYGLKEGVVGFVR

SEQ ID NO: 205082 - protein, 15 aa, Borrelia afzelii
INYGLKEGVVGFVRN

SEQ ID NO: 205083 - protein, 15 aa, Borrelia afzelii
NYGLKEGVVGFVRNP

SEQ ID NO: 205084 - protein, 15 aa, Borrelia afzelii
YGLKEGVVGFVRNPK

SEQ ID NO: 205085 - protein, 15 aa, Borrelia afzelii
GLKEGVVGFVRNPKM

SEQ ID NO: 205086 - protein, 15 aa, Borrelia afzelii
LKEGVVGFVRNPKMI

SEQ ID NO: 205087 - protein, 15 aa, Borrelia afzelii
KEGVVGFVRNPKMIP

SEQ ID NO: 205088 - protein, 15 aa, Borrelia afzelii
EGVVGFVRNPKMIPF

SEQ ID NO: 205089 - protein, 15 aa, Borrelia afzelii
GVVGFVRNPKMIPFE

SEQ ID NO: 205090 - protein, 15 aa, Borrelia afzelii
VVGFVRNPKMIPFEV

SEQ ID NO: 205091 - protein, 15 aa, Borrelia afzelii
VGFVRNPKMIPFEVE

SEQ ID NO: 205092 - protein, 15 aa, Borrelia afzelii
GFVRNPKMIPFEVEK

SEQ ID NO: 205093 - protein, 15 aa, Borrelia afzelii
FVRNPKMIPFEVEKE

SEQ ID NO: 205094 - protein, 15 aa, Borrelia afzelii
VRNPKMIPFEVEKEI

SEQ ID NO: 205095 - protein, 15 aa, Borrelia afzelii
RNPKMIPFEVEKEID

SEQ ID NO: 205096 - protein, 15 aa, Borrelia afzelii
NPKMIPFEVEKEIDS

SEQ ID NO: 205097 - protein, 15 aa, Borrelia afzelii
PKMIPFEVEKEIDSL

SEQ ID NO: 205098 - protein, 15 aa, Borrelia afzelii
KMIPFEVEKEIDSLS

SEQ ID NO: 205099 - protein, 15 aa, Borrelia afzelii
MIPFEVEKEIDSLSS

SEQ ID NO: 205100 - protein, 15 aa, Borrelia afzelii
IPFEVEKEIDSLSSK

SEQ ID NO: 205101 - protein, 15 aa, Borrelia afzelii
PFEVEKEIDSLSSKI

SEQ ID NO: 205102 - protein, 15 aa, Borrelia afzelii
FEVEKEIDSLSSKII

SEQ ID NO: 205103 - protein, 15 aa, Borrelia afzelii
EVEKEIDSLSSKIIN

SEQ ID NO: 205104 - protein, 15 aa, Borrelia afzelii
VEKEIDSLSSKIINK

SEQ ID NO: 205105 - protein, 15 aa, Borrelia afzelii
EKEIDSLSSKIINKE

SEQ ID NO: 205106 - protein, 15 aa, Borrelia afzelii
KEIDSLSSKIINKEV

SEQ ID NO: 205107 - protein, 15 aa, Borrelia afzelii
EIDSLSSKIINKEVI

SEQ ID NO: 205108 - protein, 15 aa, Borrelia afzelii
IDSLSSKIINKEVIV

SEQ ID NO: 205109 - protein, 15 aa, Borrelia afzelii
DSLSSKIINKEVIVP

SEQ ID NO: 205110 - protein, 15 aa, Borrelia afzelii
SLSSKIINKEVIVPY

SEQ ID NO: 205111 - protein, 15 aa, Borrelia afzelii
LSSKIINKEVIVPYN

SEQ ID NO: 205112 - protein, 15 aa, Borrelia afzelii
SSKIINKEVIVPYNK

SEQ ID NO: 205113 - protein, 15 aa, Borrelia afzelii
SKIINKEVIVPYNKE

SEQ ID NO: 205114 - protein, 15 aa, Borrelia afzelii
KIINKEVIVPYNKES

SEQ ID NO: 205115 - protein, 15 aa, Borrelia afzelii
IINKEVIVPYNKESY

SEQ ID NO: 205116 - protein, 15 aa, Borrelia afzelii
INKEVIVPYNKESYE

SEQ ID NO: 205117 - protein, 15 aa, Borrelia afzelii
NKEVIVPYNKESYEK

SEQ ID NO: 205118 - protein, 15 aa, Borrelia afzelii
KEVIVPYNKESYEKF

SEQ ID NO: 205119 - protein, 15 aa, Borrelia afzelii
EVIVPYNKESYEKFL

SEQ ID NO: 205120 - protein, 15 aa, Borrelia afzelii
VIVPYNKESYEKFLK

SEQ ID NO: 205121 - protein, 15 aa, Borrelia afzelii
IVPYNKESYEKFLKE

SEQ ID NO: 205122 - protein, 15 aa, Borrelia afzelii
VPYNKESYEKFLKEF

SEQ ID NO: 205123 - protein, 15 aa, Borrelia afzelii
PYNKESYEKFLKEFI

SEQ ID NO: 205124 - protein, 16 aa, Borrelia afzelii
FLSCSGKSGLESGIPK

SEQ ID NO: 205125 - protein, 16 aa, Borrelia afzelii
LSCSGKSGLESGIPKV

SEQ ID NO: 205126 - protein, 16 aa, Borrelia afzelii
SCSGKSGLESGIPKVS

SEQ ID NO: 205127 - protein, 16 aa, Borrelia afzelii
CSGKSGLESGIPKVSL

SEQ ID NO: 205128 - protein, 16 aa, Borrelia afzelii
SGKSGLESGIPKVSLV

SEQ ID NO: 205129 - protein, 16 aa, Borrelia afzelii
GKSGLESGIPKVSLVI

SEQ ID NO: 205130 - protein, 16 aa, Borrelia afzelii
KSGLESGIPKVSLVID

SEQ ID NO: 205131 - protein, 16 aa, Borrelia afzelii
SGLESGIPKVSLVIDG

SEQ ID NO: 205132 - protein, 16 aa, Borrelia afzelii
GLESGIPKVSLVIDGT

SEQ ID NO: 205133 - protein, 16 aa, Borrelia afzelii
LESGIPKVSLVIDGTF

SEQ ID NO: 205134 - protein, 16 aa, Borrelia afzelii
ESGIPKVSLVIDGTFD

SEQ ID NO: 205135 - protein, 16 aa, Borrelia afzelii
SGIPKVSLVIDGTFDD

SEQ ID NO: 205136 - protein, 16 aa, Borrelia afzelii
GIPKVSLVIDGTFDDK

SEQ ID NO: 205137 - protein, 16 aa, Borrelia afzelii
IPKVSLVIDGTFDDKS

SEQ ID NO: 205138 - protein, 16 aa, Borrelia afzelii
PKVSLVIDGTFDDKSF

SEQ ID NO: 205139 - protein, 16 aa, Borrelia afzelii
KVSLVIDGTFDDKSFN

SEQ ID NO: 205140 - protein, 16 aa, Borrelia afzelii
VSLVIDGTFDDKSFNE

SEQ ID NO: 205141 - protein, 16 aa, Borrelia afzelii
SLVIDGTFDDKSFNES

SEQ ID NO: 205142 - protein, 16 aa, Borrelia afzelii
LVIDGTFDDKSFNESA

SEQ ID NO: 205143 - protein, 16 aa, Borrelia afzelii
VIDGTFDDKSFNESAL

SEQ ID NO: 205144 - protein, 16 aa, Borrelia afzelii
IDGTFDDKSFNESALN

SEQ ID NO: 205145 - protein, 16 aa, Borrelia afzelii
DGTFDDKSFNESALNG

SEQ ID NO: 205146 - protein, 16 aa, Borrelia afzelii
GTFDDKSFNESALNGV

SEQ ID NO: 205147 - protein, 16 aa, Borrelia afzelii
TFDDKSFNESALNGVK

SEQ ID NO: 205148 - protein, 16 aa, Borrelia afzelii
FDDKSFNESALNGVKK

SEQ ID NO: 205149 - protein, 16 aa, Borrelia afzelii
DDKSFNESALNGVKKL

SEQ ID NO: 205150 - protein, 16 aa, Borrelia afzelii
DKSFNESALNGVKKLK

SEQ ID NO: 205151 - protein, 16 aa, Borrelia afzelii
KSFNESALNGVKKLKE

SEQ ID NO: 205152 - protein, 16 aa, Borrelia afzelii
SFNESALNGVKKLKEE

SEQ ID NO: 205153 - protein, 16 aa, Borrelia afzelii
FNESALNGVKKLKEEF

SEQ ID NO: 205154 - protein, 16 aa, Borrelia afzelii
NESALNGVKKLKEEFE

SEQ ID NO: 205155 - protein, 16 aa, Borrelia afzelii
ESALNGVKKLKEEFEI

SEQ ID NO: 205156 - protein, 16 aa, Borrelia afzelii
SALNGVKKLKEEFEIE

SEQ ID NO: 205157 - protein, 16 aa, Borrelia afzelii
ALNGVKKLKEEFEIEL

SEQ ID NO: 205158 - protein, 16 aa, Borrelia afzelii
LNGVKKLKEEFEIELV

SEQ ID NO: 205159 - protein, 16 aa, Borrelia afzelii
NGVKKLKEEFEIELVL

SEQ ID NO: 205160 - protein, 16 aa, Borrelia afzelii
GVKKLKEEFEIELVLK

SEQ ID NO: 205161 - protein, 16 aa, Borrelia afzelii
VKKLKEEFEIELVLKE

SEQ ID NO: 205162 - protein, 16 aa, Borrelia afzelii
KKLKEEFEIELVLKES

SEQ ID NO: 205163 - protein, 16 aa, Borrelia afzelii
KLKEEFEIELVLKESS

SEQ ID NO: 205164 - protein, 16 aa, Borrelia afzelii
LKEEFEIELVLKESST

SEQ ID NO: 205165 - protein, 16 aa, Borrelia afzelii
KEEFEIELVLKESSTN

SEQ ID NO: 205166 - protein, 16 aa, Borrelia afzelii
EEFEIELVLKESSTNS

SEQ ID NO: 205167 - protein, 16 aa, Borrelia afzelii
EFEIELVLKESSTNSY

SEQ ID NO: 205168 - protein, 16 aa, Borrelia afzelii
FEIELVLKESSTNSYL

SEQ ID NO: 205169 - protein, 16 aa, Borrelia afzelii
EIELVLKESSTNSYLS

SEQ ID NO: 205170 - protein, 16 aa, Borrelia afzelii
IELVLKESSTNSYLSD

SEQ ID NO: 205171 - protein, 16 aa, Borrelia afzelii
ELVLKESSTNSYLSDL

SEQ ID NO: 205172 - protein, 16 aa, Borrelia afzelii
LVLKESSTNSYLSDLE

SEQ ID NO: 205173 - protein, 16 aa, Borrelia afzelii
VLKESSTNSYLSDLEG

SEQ ID NO: 205174 - protein, 16 aa, Borrelia afzelii
LKESSTNSYLSDLEGL

SEQ ID NO: 205175 - protein, 16 aa, Borrelia afzelii
KESSTNSYLSDLEGLK

SEQ ID NO: 205176 - protein, 16 aa, Borrelia afzelii
ESSTNSYLSDLEGLKD

SEQ ID NO: 205177 - protein, 16 aa, Borrelia afzelii
SSTNSYLSDLEGLKDA

SEQ ID NO: 205178 - protein, 16 aa, Borrelia afzelii
STNSYLSDLEGLKDAG

SEQ ID NO: 205179 - protein, 16 aa, Borrelia afzelii
TNSYLSDLEGLKDAGS

SEQ ID NO: 205180 - protein, 16 aa, Borrelia afzelii
NSYLSDLEGLKDAGSN

SEQ ID NO: 205181 - protein, 16 aa, Borrelia afzelii
SYLSDLEGLKDAGSNL

SEQ ID NO: 205182 - protein, 16 aa, Borrelia afzelii
YLSDLEGLKDAGSNLI

SEQ ID NO: 205183 - protein, 16 aa, Borrelia afzelii
LSDLEGLKDAGSNLIW

SEQ ID NO: 205184 - protein, 16 aa, Borrelia afzelii
SDLEGLKDAGSNLIWL

SEQ ID NO: 205185 - protein, 16 aa, Borrelia afzelii
DLEGLKDAGSNLIWLI

SEQ ID NO: 205186 - protein, 16 aa, Borrelia afzelii
LEGLKDAGSNLIWLIG

SEQ ID NO: 205187 - protein, 16 aa, Borrelia afzelii
EGLKDAGSNLIWLIGY

SEQ ID NO: 205188 - protein, 16 aa, Borrelia afzelii
GLKDAGSNLIWLIGYK

SEQ ID NO: 205189 - protein, 16 aa, Borrelia afzelii
LKDAGSNLIWLIGYKF

SEQ ID NO: 205190 - protein, 16 aa, Borrelia afzelii
KDAGSNLIWLIGYKFS

SEQ ID NO: 205191 - protein, 16 aa, Borrelia afzelii
DAGSNLIWLIGYKFSD

SEQ ID NO: 205192 - protein, 16 aa, Borrelia afzelii
AGSNLIWLIGYKFSDV

SEQ ID NO: 205193 - protein, 16 aa, Borrelia afzelii
GSNLIWLIGYKFSDVA

SEQ ID NO: 205194 - protein, 16 aa, Borrelia afzelii
SNLIWLIGYKFSDVAK

SEQ ID NO: 205195 - protein, 16 aa, Borrelia afzelii
NLIWLIGYKFSDVAKA

SEQ ID NO: 205196 - protein, 16 aa, Borrelia afzelii
LIWLIGYKFSDVAKAV

SEQ ID NO: 205197 - protein, 16 aa, Borrelia afzelii
IWLIGYKFSDVAKAVS

SEQ ID NO: 205198 - protein, 16 aa, Borrelia afzelii
WLIGYKFSDVAKAVSL

SEQ ID NO: 205199 - protein, 16 aa, Borrelia afzelii
LIGYKFSDVAKAVSLQ

SEQ ID NO: 205200 - protein, 16 aa, Borrelia afzelii
IGYKFSDVAKAVSLQN

SEQ ID NO: 205201 - protein, 16 aa, Borrelia afzelii
GYKFSDVAKAVSLQNS

SEQ ID NO: 205202 - protein, 16 aa, Borrelia afzelii
YKFSDVAKAVSLQNSE

SEQ ID NO: 205203 - protein, 16 aa, Borrelia afzelii
KFSDVAKAVSLQNSEM

SEQ ID NO: 205204 - protein, 16 aa, Borrelia afzelii
FSDVAKAVSLQNSEMK

SEQ ID NO: 205205 - protein, 16 aa, Borrelia afzelii
SDVAKAVSLQNSEMKY

SEQ ID NO: 205206 - protein, 16 aa, Borrelia afzelii
DVAKAVSLQNSEMKYA

SEQ ID NO: 205207 - protein, 16 aa, Borrelia afzelii
VAKAVSLQNSEMKYAI

SEQ ID NO: 205208 - protein, 16 aa, Borrelia afzelii
AKAVSLQNSEMKYAII

SEQ ID NO: 205209 - protein, 16 aa, Borrelia afzelii
KAVSLQNSEMKYAIID

SEQ ID NO: 205210 - protein, 16 aa, Borrelia afzelii
AVSLQNSEMKYAIIDP

SEQ ID NO: 205211 - protein, 16 aa, Borrelia afzelii
VSLQNSEMKYAIIDPV

SEQ ID NO: 205212 - protein, 16 aa, Borrelia afzelii
SLQNSEMKYAIIDPVY

SEQ ID NO: 205213 - protein, 16 aa, Borrelia afzelii
LQNSEMKYAIIDPVYS

SEQ ID NO: 205214 - protein, 16 aa, Borrelia afzelii
QNSEMKYAIIDPVYSN

SEQ ID NO: 205215 - protein, 16 aa, Borrelia afzelii
NSEMKYAIIDPVYSNE

SEQ ID NO: 205216 - protein, 16 aa, Borrelia afzelii
SEMKYAIIDPVYSNEP

SEQ ID NO: 205217 - protein, 16 aa, Borrelia afzelii
EMKYAIIDPVYSNEPI

SEQ ID NO: 205218 - protein, 16 aa, Borrelia afzelii
MKYAIIDPVYSNEPIP

SEQ ID NO: 205219 - protein, 16 aa, Borrelia afzelii
KYAIIDPVYSNEPIPA

SEQ ID NO: 205220 - protein, 16 aa, Borrelia afzelii
YAIIDPVYSNEPIPAN

SEQ ID NO: 205221 - protein, 16 aa, Borrelia afzelii
AIIDPVYSNEPIPANL

SEQ ID NO: 205222 - protein, 16 aa, Borrelia afzelii
IIDPVYSNEPIPANLV

SEQ ID NO: 205223 - protein, 16 aa, Borrelia afzelii
IDPVYSNEPIPANLVG

SEQ ID NO: 205224 - protein, 16 aa, Borrelia afzelii
DPVYSNEPIPANLVGM

SEQ ID NO: 205225 - protein, 16 aa, Borrelia afzelii
PVYSNEPIPANLVGMT

SEQ ID NO: 205226 - protein, 16 aa, Borrelia afzelii
VYSNEPIPANLVGMTF

SEQ ID NO: 205227 - protein, 16 aa, Borrelia afzelii
YSNEPIPANLVGMTFR

SEQ ID NO: 205228 - protein, 16 aa, Borrelia afzelii
SNEPIPANLVGMTFRA

SEQ ID NO: 205229 - protein, 16 aa, Borrelia afzelii
NEPIPANLVGMTFRAQ

SEQ ID NO: 205230 - protein, 16 aa, Borrelia afzelii
EPIPANLVGMTFRAQE

SEQ ID NO: 205231 - protein, 16 aa, Borrelia afzelii
PIPANLVGMTFRAQEG

SEQ ID NO: 205232 - protein, 16 aa, Borrelia afzelii
IPANLVGMTFRAQEGA

SEQ ID NO: 205233 - protein, 16 aa, Borrelia afzelii
PANLVGMTFRAQEGAF

SEQ ID NO: 205234 - protein, 16 aa, Borrelia afzelii
ANLVGMTFRAQEGAFL

SEQ ID NO: 205235 - protein, 16 aa, Borrelia afzelii
NLVGMTFRAQEGAFLT

SEQ ID NO: 205236 - protein, 16 aa, Borrelia afzelii
LVGMTFRAQEGAFLTG

SEQ ID NO: 205237 - protein, 16 aa, Borrelia afzelii
VGMTFRAQEGAFLTGY

SEQ ID NO: 205238 - protein, 16 aa, Borrelia afzelii
GMTFRAQEGAFLTGYI

SEQ ID NO: 205239 - protein, 16 aa, Borrelia afzelii
MTFRAQEGAFLTGYIA

SEQ ID NO: 205240 - protein, 16 aa, Borrelia afzelii
TFRAQEGAFLTGYIAA

SEQ ID NO: 205241 - protein, 16 aa, Borrelia afzelii
FRAQEGAFLTGYIAAK

SEQ ID NO: 205242 - protein, 16 aa, Borrelia afzelii
RAQEGAFLTGYIAAKV

SEQ ID NO: 205243 - protein, 16 aa, Borrelia afzelii
AQEGAFLTGYIAAKVS

SEQ ID NO: 205244 - protein, 16 aa, Borrelia afzelii
QEGAFLTGYIAAKVSK

SEQ ID NO: 205245 - protein, 16 aa, Borrelia afzelii
EGAFLTGYIAAKVSKT

SEQ ID NO: 205246 - protein, 16 aa, Borrelia afzelii
GAFLTGYIAAKVSKTG

SEQ ID NO: 205247 - protein, 16 aa, Borrelia afzelii
AFLTGYIAAKVSKTGK

SEQ ID NO: 205248 - protein, 16 aa, Borrelia afzelii
FLTGYIAAKVSKTGKI

SEQ ID NO: 205249 - protein, 16 aa, Borrelia afzelii
LTGYIAAKVSKTGKIG

SEQ ID NO: 205250 - protein, 16 aa, Borrelia afzelii
TGYIAAKVSKTGKIGF

SEQ ID NO: 205251 - protein, 16 aa, Borrelia afzelii
GYIAAKVSKTGKIGFL

SEQ ID NO: 205252 - protein, 16 aa, Borrelia afzelii
YIAAKVSKTGKIGFLG

SEQ ID NO: 205253 - protein, 16 aa, Borrelia afzelii
IAAKVSKTGKIGFLGG

SEQ ID NO: 205254 - protein, 16 aa, Borrelia afzelii
AAKVSKTGKIGFLGGI

SEQ ID NO: 205255 - protein, 16 aa, Borrelia afzelii
AKVSKTGKIGFLGGIE

SEQ ID NO: 205256 - protein, 16 aa, Borrelia afzelii
KVSKTGKIGFLGGIEG

SEQ ID NO: 205257 - protein, 16 aa, Borrelia afzelii
VSKTGKIGFLGGIEGD

SEQ ID NO: 205258 - protein, 16 aa, Borrelia afzelii
SKTGKIGFLGGIEGDI

SEQ ID NO: 205259 - protein, 16 aa, Borrelia afzelii
KTGKIGFLGGIEGDIV

SEQ ID NO: 205260 - protein, 16 aa, Borrelia afzelii
TGKIGFLGGIEGDIVD

SEQ ID NO: 205261 - protein, 16 aa, Borrelia afzelii
GKIGFLGGIEGDIVDA

SEQ ID NO: 205262 - protein, 16 aa, Borrelia afzelii
KIGFLGGIEGDIVDAF

SEQ ID NO: 205263 - protein, 16 aa, Borrelia afzelii
IGFLGGIEGDIVDAFR

SEQ ID NO: 205264 - protein, 16 aa, Borrelia afzelii
GFLGGIEGDIVDAFRY

SEQ ID NO: 205265 - protein, 16 aa, Borrelia afzelii
FLGGIEGDIVDAFRYG

SEQ ID NO: 205266 - protein, 16 aa, Borrelia afzelii
LGGIEGDIVDAFRYGY

SEQ ID NO: 205267 - protein, 16 aa, Borrelia afzelii
GGIEGDIVDAFRYGYE

SEQ ID NO: 205268 - protein, 16 aa, Borrelia afzelii
GIEGDIVDAFRYGYEA

SEQ ID NO: 205269 - protein, 16 aa, Borrelia afzelii
IEGDIVDAFRYGYEAG

SEQ ID NO: 205270 - protein, 16 aa, Borrelia afzelii
EGDIVDAFRYGYEAGA

SEQ ID NO: 205271 - protein, 16 aa, Borrelia afzelii
GDIVDAFRYGYEAGAK

SEQ ID NO: 205272 - protein, 16 aa, Borrelia afzelii
DIVDAFRYGYEAGAKY

SEQ ID NO: 205273 - protein, 16 aa, Borrelia afzelii
IVDAFRYGYEAGAKYA

SEQ ID NO: 205274 - protein, 16 aa, Borrelia afzelii
VDAFRYGYEAGAKYAN

SEQ ID NO: 205275 - protein, 16 aa, Borrelia afzelii
DAFRYGYEAGAKYANK

SEQ ID NO: 205276 - protein, 16 aa, Borrelia afzelii
AFRYGYEAGAKYANKD

SEQ ID NO: 205277 - protein, 16 aa, Borrelia afzelii
FRYGYEAGAKYANKDI

SEQ ID NO: 205278 - protein, 16 aa, Borrelia afzelii
RYGYEAGAKYANKDIK

SEQ ID NO: 205279 - protein, 16 aa, Borrelia afzelii
YGYEAGAKYANKDIKI

SEQ ID NO: 205280 - protein, 16 aa, Borrelia afzelii
GYEAGAKYANKDIKIF

SEQ ID NO: 205281 - protein, 16 aa, Borrelia afzelii
YEAGAKYANKDIKIFS

SEQ ID NO: 205282 - protein, 16 aa, Borrelia afzelii
EAGAKYANKDIKIFSQ

SEQ ID NO: 205283 - protein, 16 aa, Borrelia afzelii
AGAKYANKDIKIFSQY

SEQ ID NO: 205284 - protein, 16 aa, Borrelia afzelii
GAKYANKDIKIFSQYI

SEQ ID NO: 205285 - protein, 16 aa, Borrelia afzelii
AKYANKDIKIFSQYIG

SEQ ID NO: 205286 - protein, 16 aa, Borrelia afzelii
KYANKDIKIFSQYIGS

SEQ ID NO: 205287 - protein, 16 aa, Borrelia afzelii
YANKDIKIFSQYIGSF

SEQ ID NO: 205288 - protein, 16 aa, Borrelia afzelii
ANKDIKIFSQYIGSFS

SEQ ID NO: 205289 - protein, 16 aa, Borrelia afzelii
NKDIKIFSQYIGSFSD

SEQ ID NO: 205290 - protein, 16 aa, Borrelia afzelii
KDIKIFSQYIGSFSDL

SEQ ID NO: 205291 - protein, 16 aa, Borrelia afzelii
DIKIFSQYIGSFSDLE

SEQ ID NO: 205292 - protein, 16 aa, Borrelia afzelii
IKIFSQYIGSFSDLEA

SEQ ID NO: 205293 - protein, 16 aa, Borrelia afzelii
KIFSQYIGSFSDLEAG

SEQ ID NO: 205294 - protein, 16 aa, Borrelia afzelii
IFSQYIGSFSDLEAGR

SEQ ID NO: 205295 - protein, 16 aa, Borrelia afzelii
FSQYIGSFSDLEAGRS

SEQ ID NO: 205296 - protein, 16 aa, Borrelia afzelii
SQYIGSFSDLEAGRSV

SEQ ID NO: 205297 - protein, 16 aa, Borrelia afzelii
QYIGSFSDLEAGRSVA

SEQ ID NO: 205298 - protein, 16 aa, Borrelia afzelii
YIGSFSDLEAGRSVAT

SEQ ID NO: 205299 - protein, 16 aa, Borrelia afzelii
IGSFSDLEAGRSVATK

SEQ ID NO: 205300 - protein, 16 aa, Borrelia afzelii
GSFSDLEAGRSVATKM

SEQ ID NO: 205301 - protein, 16 aa, Borrelia afzelii
SFSDLEAGRSVATKMY

SEQ ID NO: 205302 - protein, 16 aa, Borrelia afzelii
FSDLEAGRSVATKMYS

SEQ ID NO: 205303 - protein, 16 aa, Borrelia afzelii
SDLEAGRSVATKMYSD

SEQ ID NO: 205304 - protein, 16 aa, Borrelia afzelii
DLEAGRSVATKMYSDG

SEQ ID NO: 205305 - protein, 16 aa, Borrelia afzelii
LEAGRSVATKMYSDGI

SEQ ID NO: 205306 - protein, 16 aa, Borrelia afzelii
EAGRSVATKMYSDGID

SEQ ID NO: 205307 - protein, 16 aa, Borrelia afzelii
AGRSVATKMYSDGIDI

SEQ ID NO: 205308 - protein, 16 aa, Borrelia afzelii
GRSVATKMYSDGIDII

SEQ ID NO: 205309 - protein, 16 aa, Borrelia afzelii
RSVATKMYSDGIDIIH

SEQ ID NO: 205310 - protein, 16 aa, Borrelia afzelii
SVATKMYSDGIDIIHH

SEQ ID NO: 205311 - protein, 16 aa, Borrelia afzelii
VATKMYSDGIDIIHHA

SEQ ID NO: 205312 - protein, 16 aa, Borrelia afzelii
ATKMYSDGIDIIHHAA

SEQ ID NO: 205313 - protein, 16 aa, Borrelia afzelii
TKMYSDGIDIIHHAAG

SEQ ID NO: 205314 - protein, 16 aa, Borrelia afzelii
KMYSDGIDIIHHAAGL

SEQ ID NO: 205315 - protein, 16 aa, Borrelia afzelii
MYSDGIDIIHHAAGLG

SEQ ID NO: 205316 - protein, 16 aa, Borrelia afzelii
YSDGIDIIHHAAGLGG

SEQ ID NO: 205317 - protein, 16 aa, Borrelia afzelii
SDGIDIIHHAAGLGGI

SEQ ID NO: 205318 - protein, 16 aa, Borrelia afzelii
DGIDIIHHAAGLGGIG

SEQ ID NO: 205319 - protein, 16 aa, Borrelia afzelii
GIDIIHHAAGLGGIGA

SEQ ID NO: 205320 - protein, 16 aa, Borrelia afzelii
IDIIHHAAGLGGIGAI

SEQ ID NO: 205321 - protein, 16 aa, Borrelia afzelii
DIIHHAAGLGGIGAIE

SEQ ID NO: 205322 - protein, 16 aa, Borrelia afzelii
IIHHAAGLGGIGAIEV

SEQ ID NO: 205323 - protein, 16 aa, Borrelia afzelii
IHHAAGLGGIGAIEVA

SEQ ID NO: 205324 - protein, 16 aa, Borrelia afzelii
HHAAGLGGIGAIEVAK

SEQ ID NO: 205325 - protein, 16 aa, Borrelia afzelii
HAAGLGGIGAIEVAKE

SEQ ID NO: 205326 - protein, 16 aa, Borrelia afzelii
AAGLGGIGAIEVAKEL

SEQ ID NO: 205327 - protein, 16 aa, Borrelia afzelii
AGLGGIGAIEVAKELG

SEQ ID NO: 205328 - protein, 16 aa, Borrelia afzelii
GLGGIGAIEVAKELGS

SEQ ID NO: 205329 - protein, 16 aa, Borrelia afzelii
LGGIGAIEVAKELGSG

SEQ ID NO: 205330 - protein, 16 aa, Borrelia afzelii
GGIGAIEVAKELGSGH

SEQ ID NO: 205331 - protein, 16 aa, Borrelia afzelii
GIGAIEVAKELGSGHY

SEQ ID NO: 205332 - protein, 16 aa, Borrelia afzelii
IGAIEVAKELGSGHYI

SEQ ID NO: 205333 - protein, 16 aa, Borrelia afzelii
GAIEVAKELGSGHYII

SEQ ID NO: 205334 - protein, 16 aa, Borrelia afzelii
AIEVAKELGSGHYIIG

SEQ ID NO: 205335 - protein, 16 aa, Borrelia afzelii
IEVAKELGSGHYIIGV

SEQ ID NO: 205336 - protein, 16 aa, Borrelia afzelii
EVAKELGSGHYIIGVD

SEQ ID NO: 205337 - protein, 16 aa, Borrelia afzelii
VAKELGSGHYIIGVDE

SEQ ID NO: 205338 - protein, 16 aa, Borrelia afzelii
AKELGSGHYIIGVDED

SEQ ID NO: 205339 - protein, 16 aa, Borrelia afzelii
KELGSGHYIIGVDEDQ

SEQ ID NO: 205340 - protein, 16 aa, Borrelia afzelii
ELGSGHYIIGVDEDQS

SEQ ID NO: 205341 - protein, 16 aa, Borrelia afzelii
LGSGHYIIGVDEDQSY

SEQ ID NO: 205342 - protein, 16 aa, Borrelia afzelii
GSGHYIIGVDEDQSYL

SEQ ID NO: 205343 - protein, 16 aa, Borrelia afzelii
SGHYIIGVDEDQSYLA

SEQ ID NO: 205344 - protein, 16 aa, Borrelia afzelii
GHYIIGVDEDQSYLAP

SEQ ID NO: 205345 - protein, 16 aa, Borrelia afzelii
HYIIGVDEDQSYLAPN

SEQ ID NO: 205346 - protein, 16 aa, Borrelia afzelii
YIIGVDEDQSYLAPNN

SEQ ID NO: 205347 - protein, 16 aa, Borrelia afzelii
IIGVDEDQSYLAPNNV

SEQ ID NO: 205348 - protein, 16 aa, Borrelia afzelii
IGVDEDQSYLAPNNVI

SEQ ID NO: 205349 - protein, 16 aa, Borrelia afzelii
GVDEDQSYLAPNNVIT

SEQ ID NO: 205350 - protein, 16 aa, Borrelia afzelii
VDEDQSYLAPNNVITS

SEQ ID NO: 205351 - protein, 16 aa, Borrelia afzelii
DEDQSYLAPNNVITST

SEQ ID NO: 205352 - protein, 16 aa, Borrelia afzelii
EDQSYLAPNNVITSTT

SEQ ID NO: 205353 - protein, 16 aa, Borrelia afzelii
DQSYLAPNNVITSTTK

SEQ ID NO: 205354 - protein, 16 aa, Borrelia afzelii
QSYLAPNNVITSTTKD

SEQ ID NO: 205355 - protein, 16 aa, Borrelia afzelii
SYLAPNNVITSTTKDV

SEQ ID NO: 205356 - protein, 16 aa, Borrelia afzelii
YLAPNNVITSTTKDVG

SEQ ID NO: 205357 - protein, 16 aa, Borrelia afzelii
LAPNNVITSTTKDVGR

SEQ ID NO: 205358 - protein, 16 aa, Borrelia afzelii
APNNVITSTTKDVGRS

SEQ ID NO: 205359 - protein, 16 aa, Borrelia afzelii
PNNVITSTTKDVGRSL

SEQ ID NO: 205360 - protein, 16 aa, Borrelia afzelii
NNVITSTTKDVGRSLN

SEQ ID NO: 205361 - protein, 16 aa, Borrelia afzelii
NVITSTTKDVGRSLNL

SEQ ID NO: 205362 - protein, 16 aa, Borrelia afzelii
VITSTTKDVGRSLNLL

SEQ ID NO: 205363 - protein, 16 aa, Borrelia afzelii
ITSTTKDVGRSLNLLT

SEQ ID NO: 205364 - protein, 16 aa, Borrelia afzelii
TSTTKDVGRSLNLLTS

SEQ ID NO: 205365 - protein, 16 aa, Borrelia afzelii
STTKDVGRSLNLLTSN

SEQ ID NO: 205366 - protein, 16 aa, Borrelia afzelii
TTKDVGRSLNLLTSNY

SEQ ID NO: 205367 - protein, 16 aa, Borrelia afzelii
TKDVGRSLNLLTSNYL

SEQ ID NO: 205368 - protein, 16 aa, Borrelia afzelii
KDVGRSLNLLTSNYLK

SEQ ID NO: 205369 - protein, 16 aa, Borrelia afzelii
DVGRSLNLLTSNYLKT

SEQ ID NO: 205370 - protein, 16 aa, Borrelia afzelii
VGRSLNLLTSNYLKTN

SEQ ID NO: 205371 - protein, 16 aa, Borrelia afzelii
GRSLNLLTSNYLKTNT

SEQ ID NO: 205372 - protein, 16 aa, Borrelia afzelii
RSLNLLTSNYLKTNTF

SEQ ID NO: 205373 - protein, 16 aa, Borrelia afzelii
SLNLLTSNYLKTNTFE

SEQ ID NO: 205374 - protein, 16 aa, Borrelia afzelii
LNLLTSNYLKTNTFEG

SEQ ID NO: 205375 - protein, 16 aa, Borrelia afzelii
NLLTSNYLKTNTFEGG

SEQ ID NO: 205376 - protein, 16 aa, Borrelia afzelii
LLTSNYLKTNTFEGGK

SEQ ID NO: 205377 - protein, 16 aa, Borrelia afzelii
LTSNYLKTNTFEGGKL

SEQ ID NO: 205378 - protein, 16 aa, Borrelia afzelii
TSNYLKTNTFEGGKLI

SEQ ID NO: 205379 - protein, 16 aa, Borrelia afzelii
SNYLKTNTFEGGKLIN

SEQ ID NO: 205380 - protein, 16 aa, Borrelia afzelii
NYLKTNTFEGGKLINY

SEQ ID NO: 205381 - protein, 16 aa, Borrelia afzelii
YLKTNTFEGGKLINYG

SEQ ID NO: 205382 - protein, 16 aa, Borrelia afzelii
LKTNTFEGGKLINYGL

SEQ ID NO: 205383 - protein, 16 aa, Borrelia afzelii
KTNTFEGGKLINYGLK

SEQ ID NO: 205384 - protein, 16 aa, Borrelia afzelii
TNTFEGGKLINYGLKE

SEQ ID NO: 205385 - protein, 16 aa, Borrelia afzelii
NTFEGGKLINYGLKEG

SEQ ID NO: 205386 - protein, 16 aa, Borrelia afzelii
TFEGGKLINYGLKEGV

SEQ ID NO: 205387 - protein, 16 aa, Borrelia afzelii
FEGGKLINYGLKEGVV

SEQ ID NO: 205388 - protein, 16 aa, Borrelia afzelii
EGGKLINYGLKEGVVG

SEQ ID NO: 205389 - protein, 16 aa, Borrelia afzelii
GGKLINYGLKEGVVGF

SEQ ID NO: 205390 - protein, 16 aa, Borrelia afzelii
GKLINYGLKEGVVGFV

SEQ ID NO: 205391 - protein, 16 aa, Borrelia afzelii
KLINYGLKEGVVGFVR

SEQ ID NO: 205392 - protein, 16 aa, Borrelia afzelii
LINYGLKEGVVGFVRN

SEQ ID NO: 205393 - protein, 16 aa, Borrelia afzelii
INYGLKEGVVGFVRNP

SEQ ID NO: 205394 - protein, 16 aa, Borrelia afzelii
NYGLKEGVVGFVRNPK

SEQ ID NO: 205395 - protein, 16 aa, Borrelia afzelii
YGLKEGVVGFVRNPKM

SEQ ID NO: 205396 - protein, 16 aa, Borrelia afzelii
GLKEGVVGFVRNPKMI

SEQ ID NO: 205397 - protein, 16 aa, Borrelia afzelii
LKEGVVGFVRNPKMIP

SEQ ID NO: 205398 - protein, 16 aa, Borrelia afzelii
KEGVVGFVRNPKMIPF

SEQ ID NO: 205399 - protein, 16 aa, Borrelia afzelii
EGVVGFVRNPKMIPFE

SEQ ID NO: 205400 - protein, 16 aa, Borrelia afzelii
GVVGFVRNPKMIPFEV

SEQ ID NO: 205401 - protein, 16 aa, Borrelia afzelii
VVGFVRNPKMIPFEVE

SEQ ID NO: 205402 - protein, 16 aa, Borrelia afzelii
VGFVRNPKMIPFEVEK

SEQ ID NO: 205403 - protein, 16 aa, Borrelia afzelii
GFVRNPKMIPFEVEKE

SEQ ID NO: 205404 - protein, 16 aa, Borrelia afzelii
FVRNPKMIPFEVEKEI

SEQ ID NO: 205405 - protein, 16 aa, Borrelia afzelii
VRNPKMIPFEVEKEID

SEQ ID NO: 205406 - protein, 16 aa, Borrelia afzelii
RNPKMIPFEVEKEIDS

SEQ ID NO: 205407 - protein, 16 aa, Borrelia afzelii
NPKMIPFEVEKEIDSL

SEQ ID NO: 205408 - protein, 16 aa, Borrelia afzelii
PKMIPFEVEKEIDSLS

SEQ ID NO: 205409 - protein, 16 aa, Borrelia afzelii
KMIPFEVEKEIDSLSS

SEQ ID NO: 205410 - protein, 16 aa, Borrelia afzelii
MIPFEVEKEIDSLSSK

SEQ ID NO: 205411 - protein, 16 aa, Borrelia afzelii
IPFEVEKEIDSLSSKI

SEQ ID NO: 205412 - protein, 16 aa, Borrelia afzelii
PFEVEKEIDSLSSKII

SEQ ID NO: 205413 - protein, 16 aa, Borrelia afzelii
FEVEKEIDSLSSKIIN

SEQ ID NO: 205414 - protein, 16 aa, Borrelia afzelii
EVEKEIDSLSSKIINK

SEQ ID NO: 205415 - protein, 16 aa, Borrelia afzelii
VEKEIDSLSSKIINKE

SEQ ID NO: 205416 - protein, 16 aa, Borrelia afzelii
EKEIDSLSSKIINKEV

SEQ ID NO: 205417 - protein, 16 aa, Borrelia afzelii
KEIDSLSSKIINKEVI

SEQ ID NO: 205418 - protein, 16 aa, Borrelia afzelii
EIDSLSSKIINKEVIV

SEQ ID NO: 205419 - protein, 16 aa, Borrelia afzelii
IDSLSSKIINKEVIVP

SEQ ID NO: 205420 - protein, 16 aa, Borrelia afzelii
DSLSSKIINKEVIVPY

SEQ ID NO: 205421 - protein, 16 aa, Borrelia afzelii
SLSSKIINKEVIVPYN

SEQ ID NO: 205422 - protein, 16 aa, Borrelia afzelii
LSSKIINKEVIVPYNK

SEQ ID NO: 205423 - protein, 16 aa, Borrelia afzelii
SSKIINKEVIVPYNKE

SEQ ID NO: 205424 - protein, 16 aa, Borrelia afzelii
SKIINKEVIVPYNKES

SEQ ID NO: 205425 - protein, 16 aa, Borrelia afzelii
KIINKEVIVPYNKESY

SEQ ID NO: 205426 - protein, 16 aa, Borrelia afzelii
IINKEVIVPYNKESYE

SEQ ID NO: 205427 - protein, 16 aa, Borrelia afzelii
INKEVIVPYNKESYEK

SEQ ID NO: 205428 - protein, 16 aa, Borrelia afzelii
NKEVIVPYNKESYEKF

SEQ ID NO: 205429 - protein, 16 aa, Borrelia afzelii
KEVIVPYNKESYEKFL

SEQ ID NO: 205430 - protein, 16 aa, Borrelia afzelii
EVIVPYNKESYEKFLK

SEQ ID NO: 205431 - protein, 16 aa, Borrelia afzelii
VIVPYNKESYEKFLKE

SEQ ID NO: 205432 - protein, 16 aa, Borrelia afzelii
IVPYNKESYEKFLKEF

SEQ ID NO: 205433 - protein, 16 aa, Borrelia afzelii
VPYNKESYEKFLKEFI

SEQ ID NO: 205434 - protein, 336 aa, Borrelia Burgdorferi; identical to SEQ ID NO: 23

SEQ ID NO: 205435 - protein, 8 aa, Borrelia Burgdorferi
MIINHNTS

SEQ ID NO: 205436 - protein, 8 aa, Borrelia Burgdorferi
IINHNTSA

SEQ ID NO: 205437 - protein, 8 aa, Borrelia Burgdorferi
INHNTSAI

SEQ ID NO: 205438 - protein, 8 aa, Borrelia Burgdorferi
NHNTSAIN

SEQ ID NO: 205439 - protein, 8 aa, Borrelia Burgdorferi
HNTSAINA

SEQ ID NO: 205440 - protein, 8 aa, Borrelia Burgdorferi
NTSAINAS

SEQ ID NO: 205441 - protein, 8 aa, Borrelia Burgdorferi
TSAINASR

SEQ ID NO: 205442 - protein, 8 aa, Borrelia Burgdorferi
SAINASRN

SEQ ID NO: 205443 - protein, 8 aa, Borrelia Burgdorferi
AINASRNN

SEQ ID NO: 205444 - protein, 8 aa, Borrelia Burgdorferi
INASRNNG

SEQ ID NO: 205445 - protein, 8 aa, Borrelia Burgdorferi
NASRNNGI

SEQ ID NO: 205446 - protein, 8 aa, Borrelia Burgdorferi
ASRNNGIN

SEQ ID NO: 205447 - protein, 8 aa, Borrelia Burgdorferi
SRNNGINA

SEQ ID NO: 205448 - protein, 8 aa, Borrelia Burgdorferi
RNNGINAA

SEQ ID NO: 205449 - protein, 8 aa, Borrelia Burgdorferi
NNGINAAN

SEQ ID NO: 205450 - protein, 8 aa, Borrelia Burgdorferi
NGINAANL

SEQ ID NO: 205451 - protein, 8 aa, Borrelia Burgdorferi
GINAANLS

SEQ ID NO: 205452 - protein, 8 aa, Borrelia Burgdorferi
INAANLSK

SEQ ID NO: 205453 - protein, 8 aa, Borrelia Burgdorferi
NAANLSKT

SEQ ID NO: 205454 - protein, 8 aa, Borrelia Burgdorferi
AANLSKTQ

SEQ ID NO: 205455 - protein, 8 aa, Borrelia Burgdorferi
ANLSKTQE

SEQ ID NO: 205456 - protein, 8 aa, Borrelia Burgdorferi
NLSKTQEK

SEQ ID NO: 205457 - protein, 8 aa, Borrelia Burgdorferi
LSKTQEKL

SEQ ID NO: 205458 - protein, 8 aa, Borrelia Burgdorferi
SKTQEKLS

SEQ ID NO: 205459 - protein, 8 aa, Borrelia Burgdorferi
KTQEKLSS

SEQ ID NO: 205460 - protein, 8 aa, Borrelia Burgdorferi
TQEKLSSG

SEQ ID NO: 205461 - protein, 8 aa, Borrelia Burgdorferi
QEKLSSGY

SEQ ID NO: 205462 - protein, 8 aa, Borrelia Burgdorferi
EKLSSGYR

SEQ ID NO: 205463 - protein, 8 aa, Borrelia Burgdorferi
KLSSGYRI

SEQ ID NO: 205464 - protein, 8 aa, Borrelia Burgdorferi
LSSGYRIN

SEQ ID NO: 205465 - protein, 8 aa, Borrelia Burgdorferi
SSGYRINR

SEQ ID NO: 205466 - protein, 8 aa, Borrelia Burgdorferi
SGYRINRA

SEQ ID NO: 205467 - protein, 8 aa, Borrelia Burgdorferi
GYRINRAS

SEQ ID NO: 205468 - protein, 8 aa, Borrelia Burgdorferi
YRINRASD

SEQ ID NO: 205469 - protein, 8 aa, Borrelia Burgdorferi
RINRASDD

SEQ ID NO: 205470 - protein, 8 aa, Borrelia Burgdorferi
INRASDDA

SEQ ID NO: 205471 - protein, 8 aa, Borrelia Burgdorferi
NRASDDAA

SEQ ID NO: 205472 - protein, 8 aa, Borrelia Burgdorferi
RASDDAAG

SEQ ID NO: 205473 - protein, 8 aa, Borrelia Burgdorferi
ASDDAAGM

SEQ ID NO: 205474 - protein, 8 aa, Borrelia Burgdorferi
SDDAAGMG

SEQ ID NO: 205475 - protein, 8 aa, Borrelia Burgdorferi
DDAAGMGV

SEQ ID NO: 205476 - protein, 8 aa, Borrelia Burgdorferi
DAAGMGVS

SEQ ID NO: 205477 - protein, 8 aa, Borrelia Burgdorferi
AAGMGVSG

SEQ ID NO: 205478 - protein, 8 aa, Borrelia Burgdorferi
AGMGVSGK

SEQ ID NO: 205479 - protein, 8 aa, Borrelia Burgdorferi
GMGVSGKI

SEQ ID NO: 205480 - protein, 8 aa, Borrelia Burgdorferi
MGVSGKIN

SEQ ID NO: 205481 - protein, 8 aa, Borrelia Burgdorferi
GVSGKINA

SEQ ID NO: 205482 - protein, 8 aa, Borrelia Burgdorferi
VSGKINAQ

SEQ ID NO: 205483 - protein, 8 aa, Borrelia Burgdorferi
SGKINAQI

SEQ ID NO: 205484 - protein, 8 aa, Borrelia Burgdorferi
GKINAQIR

SEQ ID NO: 205485 - protein, 8 aa, Borrelia Burgdorferi
KINAQIRG

SEQ ID NO: 205486 - protein, 8 aa, Borrelia Burgdorferi
INAQIRGL

SEQ ID NO: 205487 - protein, 8 aa, Borrelia Burgdorferi
NAQIRGLS

SEQ ID NO: 205488 - protein, 8 aa, Borrelia Burgdorferi
AQIRGLSQ

SEQ ID NO: 205489 - protein, 8 aa, Borrelia Burgdorferi
QIRGLSQA

SEQ ID NO: 205490 - protein, 8 aa, Borrelia Burgdorferi
IRGLSQAS

SEQ ID NO: 205491 - protein, 8 aa, Borrelia Burgdorferi
RGLSQASR

SEQ ID NO: 205492 - protein, 8 aa, Borrelia Burgdorferi
GLSQASRN

SEQ ID NO: 205493 - protein, 8 aa, Borrelia Burgdorferi
LSQASRNT

SEQ ID NO: 205494 - protein, 8 aa, Borrelia Burgdorferi
SQASRNTS

SEQ ID NO: 205495 - protein, 8 aa, Borrelia Burgdorferi
QASRNTSK

SEQ ID NO: 205496 - protein, 8 aa, Borrelia Burgdorferi
ASRNTSKA

SEQ ID NO: 205497 - protein, 8 aa, Borrelia Burgdorferi
SRNTSKAI

SEQ ID NO: 205498 - protein, 8 aa, Borrelia Burgdorferi
RNTSKAIN

SEQ ID NO: 205499 - protein, 8 aa, Borrelia Burgdorferi
NTSKAINF

SEQ ID NO: 205500 - protein, 8 aa, Borrelia Burgdorferi
TSKAINFI

SEQ ID NO: 205501 - protein, 8 aa, Borrelia Burgdorferi
SKAINFIQ

SEQ ID NO: 205502 - protein, 8 aa, Borrelia Burgdorferi
KAINFIQT

SEQ ID NO: 205503 - protein, 8 aa, Borrelia Burgdorferi
AINFIQTT

SEQ ID NO: 205504 - protein, 8 aa, Borrelia Burgdorferi
INFIQTTE

SEQ ID NO: 205505 - protein, 8 aa, Borrelia Burgdorferi
NFIQTTEG

SEQ ID NO: 205506 - protein, 8 aa, Borrelia Burgdorferi
FIQTTEGN

SEQ ID NO: 205507 - protein, 8 aa, Borrelia Burgdorferi
IQTTEGNL

SEQ ID NO: 205508 - protein, 8 aa, Borrelia Burgdorferi
QTTEGNLN

SEQ ID NO: 205509 - protein, 8 aa, Borrelia Burgdorferi
TTEGNLNE

SEQ ID NO: 205510 - protein, 8 aa, Borrelia Burgdorferi
TEGNLNEV

SEQ ID NO: 205511 - protein, 8 aa, Borrelia Burgdorferi
EGNLNEVE

SEQ ID NO: 205512 - protein, 8 aa, Borrelia Burgdorferi
GNLNEVEK

SEQ ID NO: 205513 - protein, 8 aa, Borrelia Burgdorferi
NLNEVEKV

SEQ ID NO: 205514 - protein, 8 aa, Borrelia Burgdorferi
LNEVEKVL

SEQ ID NO: 205515 - protein, 8 aa, Borrelia Burgdorferi
NEVEKVLV

SEQ ID NO: 205516 - protein, 8 aa, Borrelia Burgdorferi
EVEKVLVR

SEQ ID NO: 205517 - protein, 8 aa, Borrelia Burgdorferi
VEKVLVRM

SEQ ID NO: 205518 - protein, 8 aa, Borrelia Burgdorferi
EKVLVRMK

SEQ ID NO: 205519 - protein, 8 aa, Borrelia Burgdorferi
KVLVRMKE

SEQ ID NO: 205520 - protein, 8 aa, Borrelia Burgdorferi
VLVRMKEL

SEQ ID NO: 205521 - protein, 8 aa, Borrelia Burgdorferi
LVRMKELA

SEQ ID NO: 205522 - protein, 8 aa, Borrelia Burgdorferi
VRMKELAV

SEQ ID NO: 205523 - protein, 8 aa, Borrelia Burgdorferi
RMKELAVQ

SEQ ID NO: 205524 - protein, 8 aa, Borrelia Burgdorferi
MKELAVQS

SEQ ID NO: 205525 - protein, 8 aa, Borrelia Burgdorferi
KELAVQSG

SEQ ID NO: 205526 - protein, 8 aa, Borrelia Burgdorferi
ELAVQSGN

SEQ ID NO: 205527 - protein, 8 aa, Borrelia Burgdorferi
LAVQSGNG

SEQ ID NO: 205528 - protein, 8 aa, Borrelia Burgdorferi
AVQSGNGT

SEQ ID NO: 205529 - protein, 8 aa, Borrelia Burgdorferi
VQSGNGTY

SEQ ID NO: 205530 - protein, 8 aa, Borrelia Burgdorferi
QSGNGTYS

SEQ ID NO: 205531 - protein, 8 aa, Borrelia Burgdorferi
SGNGTYSD

SEQ ID NO: 205532 - protein, 8 aa, Borrelia Burgdorferi
GNGTYSDA

SEQ ID NO: 205533 - protein, 8 aa, Borrelia Burgdorferi
NGTYSDAD

SEQ ID NO: 205534 - protein, 8 aa, Borrelia Burgdorferi
GTYSDADR

SEQ ID NO: 205535 - protein, 8 aa, Borrelia Burgdorferi
TYSDADRG

SEQ ID NO: 205536 - protein, 8 aa, Borrelia Burgdorferi
YSDADRGS

SEQ ID NO: 205537 - protein, 8 aa, Borrelia Burgdorferi
SDADRGSI

SEQ ID NO: 205538 - protein, 8 aa, Borrelia Burgdorferi
DADRGSIQ

SEQ ID NO: 205539 - protein, 8 aa, Borrelia Burgdorferi
ADRGSIQI

SEQ ID NO: 205540 - protein, 8 aa, Borrelia Burgdorferi
DRGSIQIE

SEQ ID NO: 205541 - protein, 8 aa, Borrelia Burgdorferi
RGSIQIEI

SEQ ID NO: 205542 - protein, 8 aa, Borrelia Burgdorferi
GSIQIEIE

SEQ ID NO: 205543 - protein, 8 aa, Borrelia Burgdorferi
SIQIEIEQ

SEQ ID NO: 205544 - protein, 8 aa, Borrelia Burgdorferi
IQIEIEQL

SEQ ID NO: 205545 - protein, 8 aa, Borrelia Burgdorferi
QIEIEQLT

SEQ ID NO: 205546 - protein, 8 aa, Borrelia Burgdorferi
IEIEQLTD

SEQ ID NO: 205547 - protein, 8 aa, Borrelia Burgdorferi
EIEQLTDE

SEQ ID NO: 205548 - protein, 8 aa, Borrelia Burgdorferi
IEQLTDEI

SEQ ID NO: 205549 - protein, 8 aa, Borrelia Burgdorferi
EQLTDEIN

SEQ ID NO: 205550 - protein, 8 aa, Borrelia Burgdorferi
QLTDEINR

SEQ ID NO: 205551 - protein, 8 aa, Borrelia Burgdorferi
LTDEINRI

SEQ ID NO: 205552 - protein, 8 aa, Borrelia Burgdorferi
TDEINRIA

SEQ ID NO: 205553 - protein, 8 aa, Borrelia Burgdorferi
DEINRIAD

SEQ ID NO: 205554 - protein, 8 aa, Borrelia Burgdorferi
EINRIADQ

SEQ ID NO: 205555 - protein, 8 aa, Borrelia Burgdorferi
INRIADQA

SEQ ID NO: 205556 - protein, 8 aa, Borrelia Burgdorferi
NRIADQAQ

SEQ ID NO: 205557 - protein, 8 aa, Borrelia Burgdorferi
RIADQAQY

SEQ ID NO: 205558 - protein, 8 aa, Borrelia Burgdorferi
IADQAQYN

SEQ ID NO: 205559 - protein, 8 aa, Borrelia Burgdorferi
ADQAQYNQ

SEQ ID NO: 205560 - protein, 8 aa, Borrelia Burgdorferi
DQAQYNQM

SEQ ID NO: 205561 - protein, 8 aa, Borrelia Burgdorferi
QAQYNQMH

SEQ ID NO: 205562 - protein, 8 aa, Borrelia Burgdorferi
AQYNQMHM

SEQ ID NO: 205563 - protein, 8 aa, Borrelia Burgdorferi
QYNQMHML

SEQ ID NO: 205564 - protein, 8 aa, Borrelia Burgdorferi
YNQMHMLS

SEQ ID NO: 205565 - protein, 8 aa, Borrelia Burgdorferi
NQMHMLSN

SEQ ID NO: 205566 - protein, 8 aa, Borrelia Burgdorferi
QMHMLSNK

SEQ ID NO: 205567 - protein, 8 aa, Borrelia Burgdorferi
MHMLSNKS

SEQ ID NO: 205568 - protein, 8 aa, Borrelia Burgdorferi
HMLSNKSA

SEQ ID NO: 205569 - protein, 8 aa, Borrelia Burgdorferi
MLSNKSAS

SEQ ID NO: 205570 - protein, 8 aa, Borrelia Burgdorferi
LSNKSASQ

SEQ ID NO: 205571 - protein, 8 aa, Borrelia Burgdorferi
SNKSASQN

SEQ ID NO: 205572 - protein, 8 aa, Borrelia Burgdorferi
NKSASQNV

SEQ ID NO: 205573 - protein, 8 aa, Borrelia Burgdorferi
KSASQNVR

SEQ ID NO: 205574 - protein, 8 aa, Borrelia Burgdorferi
SASQNVRT

SEQ ID NO: 205575 - protein, 8 aa, Borrelia Burgdorferi
ASQNVRTA

SEQ ID NO: 205576 - protein, 8 aa, Borrelia Burgdorferi
SQNVRTAE

SEQ ID NO: 205577 - protein, 8 aa, Borrelia Burgdorferi
QNVRTAEE

SEQ ID NO: 205578 - protein, 8 aa, Borrelia Burgdorferi
NVRTAEEL

SEQ ID NO: 205579 - protein, 8 aa, Borrelia Burgdorferi
VRTAEELG

SEQ ID NO: 205580 - protein, 8 aa, Borrelia Burgdorferi
RTAEELGM

SEQ ID NO: 205581 - protein, 8 aa, Borrelia Burgdorferi
TAEELGMQ

SEQ ID NO: 205582 - protein, 8 aa, Borrelia Burgdorferi
AEELGMQP

SEQ ID NO: 205583 - protein, 8 aa, Borrelia Burgdorferi
EELGMQPA

SEQ ID NO: 205584 - protein, 8 aa, Borrelia Burgdorferi
ELGMQPAK

SEQ ID NO: 205585 - protein, 8 aa, Borrelia Burgdorferi
LGMQPAKI

SEQ ID NO: 205586 - protein, 8 aa, Borrelia Burgdorferi
GMQPAKIN

SEQ ID NO: 205587 - protein, 8 aa, Borrelia Burgdorferi
MQPAKINT

SEQ ID NO: 205588 - protein, 8 aa, Borrelia Burgdorferi
QPAKINTP

SEQ ID NO: 205589 - protein, 8 aa, Borrelia Burgdorferi
PAKINTPA

SEQ ID NO: 205590 - protein, 8 aa, Borrelia Burgdorferi
AKINTPAS

SEQ ID NO: 205591 - protein, 8 aa, Borrelia Burgdorferi
KINTPASL

SEQ ID NO: 205592 - protein, 8 aa, Borrelia Burgdorferi
INTPASLS

SEQ ID NO: 205593 - protein, 8 aa, Borrelia Burgdorferi
NTPASLSG

SEQ ID NO: 205594 - protein, 8 aa, Borrelia Burgdorferi
TPASLSGS

SEQ ID NO: 205595 - protein, 8 aa, Borrelia Burgdorferi
PASLSGSQ

SEQ ID NO: 205596 - protein, 8 aa, Borrelia Burgdorferi
ASLSGSQA

SEQ ID NO: 205597 - protein, 8 aa, Borrelia Burgdorferi
SLSGSQAS

SEQ ID NO: 205598 - protein, 8 aa, Borrelia Burgdorferi
LSGSQASW

SEQ ID NO: 205599 - protein, 8 aa, Borrelia Burgdorferi
SGSQASWT

SEQ ID NO: 205600 - protein, 8 aa, Borrelia Burgdorferi
GSQASWTL

SEQ ID NO: 205601 - protein, 8 aa, Borrelia Burgdorferi
SQASWTLR

SEQ ID NO: 205602 - protein, 8 aa, Borrelia Burgdorferi
QASWTLRV

SEQ ID NO: 205603 - protein, 8 aa, Borrelia Burgdorferi
ASWTLRVH

SEQ ID NO: 205604 - protein, 8 aa, Borrelia Burgdorferi
SWTLRVHV

SEQ ID NO: 205605 - protein, 8 aa, Borrelia Burgdorferi
WTLRVHVG

SEQ ID NO: 205606 - protein, 8 aa, Borrelia Burgdorferi
TLRVHVGA

SEQ ID NO: 205607 - protein, 8 aa, Borrelia Burgdorferi
LRVHVGAN

SEQ ID NO: 205608 - protein, 8 aa, Borrelia Burgdorferi
RVHVGANQ

SEQ ID NO: 205609 - protein, 8 aa, Borrelia Burgdorferi
VHVGANQD

SEQ ID NO: 205610 - protein, 8 aa, Borrelia Burgdorferi
HVGANQDE

SEQ ID NO: 205611 - protein, 8 aa, Borrelia Burgdorferi
VGANQDEA

SEQ ID NO: 205612 - protein, 8 aa, Borrelia Burgdorferi
GANQDEAI

SEQ ID NO: 205613 - protein, 8 aa, Borrelia Burgdorferi
ANQDEAIA

SEQ ID NO: 205614 - protein, 8 aa, Borrelia Burgdorferi
NQDEAIAV

SEQ ID NO: 205615 - protein, 8 aa, Borrelia Burgdorferi
QDEAIAVN

SEQ ID NO: 205616 - protein, 8 aa, Borrelia Burgdorferi
DEAIAVNI

SEQ ID NO: 205617 - protein, 8 aa, Borrelia Burgdorferi
EAIAVNIY

SEQ ID NO: 205618 - protein, 8 aa, Borrelia Burgdorferi
AIAVNIYA

SEQ ID NO: 205619 - protein, 8 aa, Borrelia Burgdorferi
IAVNIYAA

SEQ ID NO: 205620 - protein, 8 aa, Borrelia Burgdorferi
AVNIYAAN

SEQ ID NO: 205621 - protein, 8 aa, Borrelia Burgdorferi
VNIYAANV

SEQ ID NO: 205622 - protein, 8 aa, Borrelia Burgdorferi
NIYAANVA

SEQ ID NO: 205623 - protein, 8 aa, Borrelia Burgdorferi
IYAANVAN

SEQ ID NO: 205624 - protein, 8 aa, Borrelia Burgdorferi
YAANVANL

SEQ ID NO: 205625 - protein, 8 aa, Borrelia Burgdorferi
AANVANLF

SEQ ID NO: 205626 - protein, 8 aa, Borrelia Burgdorferi
ANVANLFS

SEQ ID NO: 205627 - protein, 8 aa, Borrelia Burgdorferi
NVANLFSG

SEQ ID NO: 205628 - protein, 8 aa, Borrelia Burgdorferi
VANLFSGE

SEQ ID NO: 205629 - protein, 8 aa, Borrelia Burgdorferi
ANLFSGEG

SEQ ID NO: 205630 - protein, 8 aa, Borrelia Burgdorferi
NLFSGEGA

SEQ ID NO: 205631 - protein, 8 aa, Borrelia Burgdorferi
LFSGEGAQ

SEQ ID NO: 205632 - protein, 8 aa, Borrelia Burgdorferi
FSGEGAQT

SEQ ID NO: 205633 - protein, 8 aa, Borrelia Burgdorferi
SGEGAQTA

SEQ ID NO: 205634 - protein, 8 aa, Borrelia Burgdorferi
GEGAQTAQ

SEQ ID NO: 205635 - protein, 8 aa, Borrelia Burgdorferi
EGAQTAQA

SEQ ID NO: 205636 - protein, 8 aa, Borrelia Burgdorferi
GAQTAQAA

SEQ ID NO: 205637 - protein, 8 aa, Borrelia Burgdorferi
AQTAQAAP

SEQ ID NO: 205638 - protein, 8 aa, Borrelia Burgdorferi
QTAQAAPV

SEQ ID NO: 205639 - protein, 8 aa, Borrelia Burgdorferi
TAQAAPVQ

SEQ ID NO: 205640 - protein, 8 aa, Borrelia Burgdorferi
AQAAPVQE

SEQ ID NO: 205641 - protein, 8 aa, Borrelia Burgdorferi
QAAPVQEG

SEQ ID NO: 205642 - protein, 8 aa, Borrelia Burgdorferi
AAPVQEGV

SEQ ID NO: 205643 - protein, 8 aa, Borrelia Burgdorferi
APVQEGVQ

SEQ ID NO: 205644 - protein, 8 aa, Borrelia Burgdorferi
PVQEGVQQ

SEQ ID NO: 205645 - protein, 8 aa, Borrelia Burgdorferi
VQEGVQQE

SEQ ID NO: 205646 - protein, 8 aa, Borrelia Burgdorferi
QEGVQQEG

SEQ ID NO: 205647 - protein, 8 aa, Borrelia Burgdorferi
EGVQQEGA

SEQ ID NO: 205648 - protein, 8 aa, Borrelia Burgdorferi
GVQQEGAQ

SEQ ID NO: 205649 - protein, 8 aa, Borrelia Burgdorferi
VQQEGAQQ

SEQ ID NO: 205650 - protein, 8 aa, Borrelia Burgdorferi
QQEGAQQP

SEQ ID NO: 205651 - protein, 8 aa, Borrelia Burgdorferi
QEGAQQPA

SEQ ID NO: 205652 - protein, 8 aa, Borrelia Burgdorferi
EGAQQPAP

SEQ ID NO: 205653 - protein, 8 aa, Borrelia Burgdorferi
GAQQPAPA

SEQ ID NO: 205654 - protein, 8 aa, Borrelia Burgdorferi
AQQPAPAT

SEQ ID NO: 205655 - protein, 8 aa, Borrelia Burgdorferi
QQPAPATA

SEQ ID NO: 205656 - protein, 8 aa, Borrelia Burgdorferi
QPAPATAP

SEQ ID NO: 205657 - protein, 8 aa, Borrelia Burgdorferi
PAPATAPS

SEQ ID NO: 205658 - protein, 8 aa, Borrelia Burgdorferi
APATAPSQ

SEQ ID NO: 205659 - protein, 8 aa, Borrelia Burgdorferi
PATAPSQG

SEQ ID NO: 205660 - protein, 8 aa, Borrelia Burgdorferi
ATAPSQGG

SEQ ID NO: 205661 - protein, 8 aa, Borrelia Burgdorferi
TAPSQGGV

SEQ ID NO: 205662 - protein, 8 aa, Borrelia Burgdorferi
APSQGGVN

SEQ ID NO: 205663 - protein, 8 aa, Borrelia Burgdorferi
PSQGGVNS

SEQ ID NO: 205664 - protein, 8 aa, Borrelia Burgdorferi
SQGGVNSP

SEQ ID NO: 205665 - protein, 8 aa, Borrelia Burgdorferi
QGGVNSPV

SEQ ID NO: 205666 - protein, 8 aa, Borrelia Burgdorferi
GGVNSPVN

SEQ ID NO: 205667 - protein, 8 aa, Borrelia Burgdorferi
GVNSPVNV

SEQ ID NO: 205668 - protein, 8 aa, Borrelia Burgdorferi
VNSPVNVT

SEQ ID NO: 205669 - protein, 8 aa, Borrelia Burgdorferi
NSPVNVTT

SEQ ID NO: 205670 - protein, 8 aa, Borrelia Burgdorferi
SPVNVTTT

SEQ ID NO: 205671 - protein, 8 aa, Borrelia Burgdorferi
PVNVTTTV

SEQ ID NO: 205672 - protein, 8 aa, Borrelia Burgdorferi
VNVTTTVD

SEQ ID NO: 205673 - protein, 8 aa, Borrelia Burgdorferi
NVTTTVDA

SEQ ID NO: 205674 - protein, 8 aa, Borrelia Burgdorferi
VTTTVDAN

SEQ ID NO: 205675 - protein, 8 aa, Borrelia Burgdorferi
TTTVDANT

SEQ ID NO: 205676 - protein, 8 aa, Borrelia Burgdorferi
TTVDANTS

SEQ ID NO: 205677 - protein, 8 aa, Borrelia Burgdorferi
TVDANTSL

SEQ ID NO: 205678 - protein, 8 aa, Borrelia Burgdorferi
VDANTSLA

SEQ ID NO: 205679 - protein, 8 aa, Borrelia Burgdorferi
DANTSLAK

SEQ ID NO: 205680 - protein, 8 aa, Borrelia Burgdorferi
ANTSLAKI

SEQ ID NO: 205681 - protein, 8 aa, Borrelia Burgdorferi
NTSLAKIE

SEQ ID NO: 205682 - protein, 8 aa, Borrelia Burgdorferi
TSLAKIEN

SEQ ID NO: 205683 - protein, 8 aa, Borrelia Burgdorferi
SLAKIENA

SEQ ID NO: 205684 - protein, 8 aa, Borrelia Burgdorferi
LAKIENAI

SEQ ID NO: 205685 - protein, 8 aa, Borrelia Burgdorferi
AKIENAIR

SEQ ID NO: 205686 - protein, 8 aa, Borrelia Burgdorferi
KIENAIRM

SEQ ID NO: 205687 - protein, 8 aa, Borrelia Burgdorferi
IENAIRMI

SEQ ID NO: 205688 - protein, 8 aa, Borrelia Burgdorferi
ENAIRMIS

SEQ ID NO: 205689 - protein, 8 aa, Borrelia Burgdorferi
NAIRMISD

SEQ ID NO: 205690 - protein, 8 aa, Borrelia Burgdorferi
AIRMISDQ

SEQ ID NO: 205691 - protein, 8 aa, Borrelia Burgdorferi
IRMISDQR

SEQ ID NO: 205692 - protein, 8 aa, Borrelia Burgdorferi
RMISDQRA

SEQ ID NO: 205693 - protein, 8 aa, Borrelia Burgdorferi
MISDQRAN

SEQ ID NO: 205694 - protein, 8 aa, Borrelia Burgdorferi
ISDQRANL

SEQ ID NO: 205695 - protein, 8 aa, Borrelia Burgdorferi
SDQRANLG

SEQ ID NO: 205696 - protein, 8 aa, Borrelia Burgdorferi
DQRANLGA

SEQ ID NO: 205697 - protein, 8 aa, Borrelia Burgdorferi
QRANLGAF

SEQ ID NO: 205698 - protein, 8 aa, Borrelia Burgdorferi
RANLGAFQ

SEQ ID NO: 205699 - protein, 8 aa, Borrelia Burgdorferi
ANLGAFQN

SEQ ID NO: 205700 - protein, 8 aa, Borrelia Burgdorferi
NLGAFQNR

SEQ ID NO: 205701 - protein, 8 aa, Borrelia Burgdorferi
LGAFQNRL

SEQ ID NO: 205702 - protein, 8 aa, Borrelia Burgdorferi
GAFQNRLE

SEQ ID NO: 205703 - protein, 8 aa, Borrelia Burgdorferi
AFQNRLES

SEQ ID NO: 205704 - protein, 8 aa, Borrelia Burgdorferi
FQNRLESI

SEQ ID NO: 205705 - protein, 8 aa, Borrelia Burgdorferi
QNRLESIK

SEQ ID NO: 205706 - protein, 8 aa, Borrelia Burgdorferi
NRLESIKN

SEQ ID NO: 205707 - protein, 8 aa, Borrelia Burgdorferi
RLESIKNS

SEQ ID NO: 205708 - protein, 8 aa, Borrelia Burgdorferi
LESIKNST

SEQ ID NO: 205709 - protein, 8 aa, Borrelia Burgdorferi
ESIKNSTE

SEQ ID NO: 205710 - protein, 8 aa, Borrelia Burgdorferi
SIKNSTEY

SEQ ID NO: 205711 - protein, 8 aa, Borrelia Burgdorferi
IKNSTEYA

SEQ ID NO: 205712 - protein, 8 aa, Borrelia Burgdorferi
KNSTEYAI

SEQ ID NO: 205713 - protein, 8 aa, Borrelia Burgdorferi
NSTEYAIE

SEQ ID NO: 205714 - protein, 8 aa, Borrelia Burgdorferi
STEYAIEN

SEQ ID NO: 205715 - protein, 8 aa, Borrelia Burgdorferi
TEYAIENL

SEQ ID NO: 205716 - protein, 8 aa, Borrelia Burgdorferi
EYAIENLK

SEQ ID NO: 205717 - protein, 8 aa, Borrelia Burgdorferi
YAIENLKA

SEQ ID NO: 205718 - protein, 8 aa, Borrelia Burgdorferi
AIENLKAS

SEQ ID NO: 205719 - protein, 8 aa, Borrelia Burgdorferi
IENLKASY

SEQ ID NO: 205720 - protein, 8 aa, Borrelia Burgdorferi
ENLKASYA

SEQ ID NO: 205721 - protein, 8 aa, Borrelia Burgdorferi
NLKASYAQ

SEQ ID NO: 205722 - protein, 8 aa, Borrelia Burgdorferi
LKASYAQI

SEQ ID NO: 205723 - protein, 8 aa, Borrelia Burgdorferi
KASYAQIK

SEQ ID NO: 205724 - protein, 8 aa, Borrelia Burgdorferi
ASYAQIKD

SEQ ID NO: 205725 - protein, 8 aa, Borrelia Burgdorferi
SYAQIKDA

SEQ ID NO: 205726 - protein, 8 aa, Borrelia Burgdorferi
YAQIKDAT

SEQ ID NO: 205727 - protein, 8 aa, Borrelia Burgdorferi
AQIKDATM

SEQ ID NO: 205728 - protein, 8 aa, Borrelia Burgdorferi
QIKDATMT

SEQ ID NO: 205729 - protein, 8 aa, Borrelia Burgdorferi
IKDATMTD

SEQ ID NO: 205730 - protein, 8 aa, Borrelia Burgdorferi
KDATMTDE

SEQ ID NO: 205731 - protein, 8 aa, Borrelia Burgdorferi
DATMTDEV

SEQ ID NO: 205732 - protein, 8 aa, Borrelia Burgdorferi
ATMTDEVV

SEQ ID NO: 205733 - protein, 8 aa, Borrelia Burgdorferi
TMTDEVVA

SEQ ID NO: 205734 - protein, 8 aa, Borrelia Burgdorferi
MTDEVVAA

SEQ ID NO: 205735 - protein, 8 aa, Borrelia Burgdorferi
TDEVVAAT

SEQ ID NO: 205736 - protein, 8 aa, Borrelia Burgdorferi
DEVVAATT

SEQ ID NO: 205737 - protein, 8 aa, Borrelia Burgdorferi
EVVAATTN

SEQ ID NO: 205738 - protein, 8 aa, Borrelia Burgdorferi
VVAATTNS

SEQ ID NO: 205739 - protein, 8 aa, Borrelia Burgdorferi
VAATTNSI

SEQ ID NO: 205740 - protein, 8 aa, Borrelia Burgdorferi
AATTNSIL

SEQ ID NO: 205741 - protein, 8 aa, Borrelia Burgdorferi
ATTNSILT

SEQ ID NO: 205742 - protein, 8 aa, Borrelia Burgdorferi
TTNSILTQ

SEQ ID NO: 205743 - protein, 8 aa, Borrelia Burgdorferi
TNSILTQS

SEQ ID NO: 205744 - protein, 8 aa, Borrelia Burgdorferi
NSILTQSA

SEQ ID NO: 205745 - protein, 8 aa, Borrelia Burgdorferi
SILTQSAM

SEQ ID NO: 205746 - protein, 8 aa, Borrelia Burgdorferi
ILTQSAMA

SEQ ID NO: 205747 - protein, 8 aa, Borrelia Burgdorferi
LTQSAMAM

SEQ ID NO: 205748 - protein, 8 aa, Borrelia Burgdorferi
TQSAMAMI

SEQ ID NO: 205749 - protein, 8 aa, Borrelia Burgdorferi
QSAMAMIA

SEQ ID NO: 205750 - protein, 8 aa, Borrelia Burgdorferi
SAMAMIAQ

SEQ ID NO: 205751 - protein, 8 aa, Borrelia Burgdorferi
AMAMIAQA

SEQ ID NO: 205752 - protein, 8 aa, Borrelia Burgdorferi
MAMIAQAN

SEQ ID NO: 205753 - protein, 8 aa, Borrelia Burgdorferi
AMIAQANQ

SEQ ID NO: 205754 - protein, 8 aa, Borrelia Burgdorferi
MIAQANQV

SEQ ID NO: 205755 - protein, 8 aa, Borrelia Burgdorferi
IAQANQVP

SEQ ID NO: 205756 - protein, 8 aa, Borrelia Burgdorferi
AQANQVPQ

SEQ ID NO: 205757 - protein, 8 aa, Borrelia Burgdorferi
QANQVPQY

SEQ ID NO: 205758 - protein, 8 aa, Borrelia Burgdorferi
ANQVPQYV

SEQ ID NO: 205759 - protein, 8 aa, Borrelia Burgdorferi
NQVPQYVL

SEQ ID NO: 205760 - protein, 8 aa, Borrelia Burgdorferi
QVPQYVLS

SEQ ID NO: 205761 - protein, 8 aa, Borrelia Burgdorferi
VPQYVLSL

SEQ ID NO: 205762 - protein, 8 aa, Borrelia Burgdorferi
PQYVLSLL

SEQ ID NO: 205763 - protein, 8 aa, Borrelia Burgdorferi
QYVLSLLR

SEQ ID NO: 205764 - protein, 9 aa, Borrelia Burgdorferi
MIINHNTSA

SEQ ID NO: 205765 - protein, 9 aa, Borrelia Burgdorferi
IINHNTSAI

SEQ ID NO: 205766 - protein, 9 aa, Borrelia Burgdorferi
INHNTSAIN

SEQ ID NO: 205767 - protein, 9 aa, Borrelia Burgdorferi
NHNTSAINA

SEQ ID NO: 205768 - protein, 9 aa, Borrelia Burgdorferi
HNTSAINAS

SEQ ID NO: 205769 - protein, 9 aa, Borrelia Burgdorferi
NTSAINASR

SEQ ID NO: 205770 - protein, 9 aa, Borrelia Burgdorferi
TSAINASRN

SEQ ID NO: 205771 - protein, 9 aa, Borrelia Burgdorferi
SAINASRNN

SEQ ID NO: 205772 - protein, 9 aa, Borrelia Burgdorferi
AINASRNNG

SEQ ID NO: 205773 - protein, 9 aa, Borrelia Burgdorferi
INASRNNGI

SEQ ID NO: 205774 - protein, 9 aa, Borrelia Burgdorferi
NASRNNGIN

SEQ ID NO: 205775 - protein, 9 aa, Borrelia Burgdorferi
ASRNNGINA

SEQ ID NO: 205776 - protein, 9 aa, Borrelia Burgdorferi
SRNNGINAA

SEQ ID NO: 205777 - protein, 9 aa, Borrelia Burgdorferi
RNNGINAAN

SEQ ID NO: 205778 - protein, 9 aa, Borrelia Burgdorferi
NNGINAANL

SEQ ID NO: 205779 - protein, 9 aa, Borrelia Burgdorferi
NGINAANLS

SEQ ID NO: 205780 - protein, 9 aa, Borrelia Burgdorferi
GINAANLSK

SEQ ID NO: 205781 - protein, 9 aa, Borrelia Burgdorferi
INAANLSKT

SEQ ID NO: 205782 - protein, 9 aa, Borrelia Burgdorferi
NAANLSKTQ

SEQ ID NO: 205783 - protein, 9 aa, Borrelia Burgdorferi
AANLSKTQE

SEQ ID NO: 205784 - protein, 9 aa, Borrelia Burgdorferi
ANLSKTQEK

SEQ ID NO: 205785 - protein, 9 aa, Borrelia Burgdorferi
NLSKTQEKL

SEQ ID NO: 205786 - protein, 9 aa, Borrelia Burgdorferi
LSKTQEKLS

SEQ ID NO: 205787 - protein, 9 aa, Borrelia Burgdorferi
SKTQEKLSS

SEQ ID NO: 205788 - protein, 9 aa, Borrelia Burgdorferi
KTQEKLSSG

SEQ ID NO: 205789 - protein, 9 aa, Borrelia Burgdorferi
TQEKLSSGY

SEQ ID NO: 205790 - protein, 9 aa, Borrelia Burgdorferi
QEKLSSGYR

SEQ ID NO: 205791 - protein, 9 aa, Borrelia Burgdorferi
EKLSSGYRI

SEQ ID NO: 205792 - protein, 9 aa, Borrelia Burgdorferi
KLSSGYRIN

SEQ ID NO: 205793 - protein, 9 aa, Borrelia Burgdorferi
LSSGYRINR

SEQ ID NO: 205794 - protein, 9 aa, Borrelia Burgdorferi
SSGYRINRA

SEQ ID NO: 205795 - protein, 9 aa, Borrelia Burgdorferi
SGYRINRAS

SEQ ID NO: 205796 - protein, 9 aa, Borrelia Burgdorferi
GYRINRASD

SEQ ID NO: 205797 - protein, 9 aa, Borrelia Burgdorferi
YRINRASDD

SEQ ID NO: 205798 - protein, 9 aa, Borrelia Burgdorferi
RINRASDDA

SEQ ID NO: 205799 - protein, 9 aa, Borrelia Burgdorferi
INRASDDAA

SEQ ID NO: 205800 - protein, 9 aa, Borrelia Burgdorferi
NRASDDAAG

SEQ ID NO: 205801 - protein, 9 aa, Borrelia Burgdorferi
RASDDAAGM

SEQ ID NO: 205802 - protein, 9 aa, Borrelia Burgdorferi
ASDDAAGMG

SEQ ID NO: 205803 - protein, 9 aa, Borrelia Burgdorferi
SDDAAGMGV

SEQ ID NO: 205804 - protein, 9 aa, Borrelia Burgdorferi
DDAAGMGVS

SEQ ID NO: 205805 - protein, 9 aa, Borrelia Burgdorferi
DAAGMGVSG

SEQ ID NO: 205806 - protein, 9 aa, Borrelia Burgdorferi
AAGMGVSGK

SEQ ID NO: 205807 - protein, 9 aa, Borrelia Burgdorferi
AGMGVSGKI

SEQ ID NO: 205808 - protein, 9 aa, Borrelia Burgdorferi
GMGVSGKIN

SEQ ID NO: 205809 - protein, 9 aa, Borrelia Burgdorferi
MGVSGKINA

SEQ ID NO: 205810 - protein, 9 aa, Borrelia Burgdorferi
GVSGKINAQ

SEQ ID NO: 205811 - protein, 9 aa, Borrelia Burgdorferi
VSGKINAQI

SEQ ID NO: 205812 - protein, 9 aa, Borrelia Burgdorferi
SGKINAQIR

SEQ ID NO: 205813 - protein, 9 aa, Borrelia Burgdorferi
GKINAQIRG

SEQ ID NO: 205814 - protein, 9 aa, Borrelia Burgdorferi
KINAQIRGL

SEQ ID NO: 205815 - protein, 9 aa, Borrelia Burgdorferi
INAQIRGLS

SEQ ID NO: 205816 - protein, 9 aa, Borrelia Burgdorferi
NAQIRGLSQ

SEQ ID NO: 205817 - protein, 9 aa, Borrelia Burgdorferi
AQIRGLSQA

SEQ ID NO: 205818 - protein, 9 aa, Borrelia Burgdorferi
QIRGLSQAS

SEQ ID NO: 205819 - protein, 9 aa, Borrelia Burgdorferi
IRGLSQASR

SEQ ID NO: 205820 - protein, 9 aa, Borrelia Burgdorferi
RGLSQASRN

SEQ ID NO: 205821 - protein, 9 aa, Borrelia Burgdorferi
GLSQASRNT

SEQ ID NO: 205822 - protein, 9 aa, Borrelia Burgdorferi
LSQASRNTS

SEQ ID NO: 205823 - protein, 9 aa, Borrelia Burgdorferi
SQASRNTSK

SEQ ID NO: 205824 - protein, 9 aa, Borrelia Burgdorferi
QASRNTSKA

SEQ ID NO: 205825 - protein, 9 aa, Borrelia Burgdorferi
ASRNTSKAI

SEQ ID NO: 205826 - protein, 9 aa, Borrelia Burgdorferi
SRNTSKAIN

SEQ ID NO: 205827 - protein, 9 aa, Borrelia Burgdorferi
RNTSKAINF

SEQ ID NO: 205828 - protein, 9 aa, Borrelia Burgdorferi
NTSKAINFI

SEQ ID NO: 205829 - protein, 9 aa, Borrelia Burgdorferi
TSKAINFIQ

SEQ ID NO: 205830 - protein, 9 aa, Borrelia Burgdorferi
SKAINFIQT

SEQ ID NO: 205831 - protein, 9 aa, Borrelia Burgdorferi
KAINFIQTT

SEQ ID NO: 205832 - protein, 9 aa, Borrelia Burgdorferi
AINFIQTTE

SEQ ID NO: 205833 - protein, 9 aa, Borrelia Burgdorferi
INFIQTTEG

SEQ ID NO: 205834 - protein, 9 aa, Borrelia Burgdorferi
NFIQTTEGN

SEQ ID NO: 205835 - protein, 9 aa, Borrelia Burgdorferi
FIQTTEGNL

SEQ ID NO: 205836 - protein, 9 aa, Borrelia Burgdorferi
IQTTEGNLN

SEQ ID NO: 205837 - protein, 9 aa, Borrelia Burgdorferi
QTTEGNLNE

SEQ ID NO: 205838 - protein, 9 aa, Borrelia Burgdorferi
TTEGNLNEV

SEQ ID NO: 205839 - protein, 9 aa, Borrelia Burgdorferi
TEGNLNEVE

SEQ ID NO: 205840 - protein, 9 aa, Borrelia Burgdorferi
EGNLNEVEK

SEQ ID NO: 205841 - protein, 9 aa, Borrelia Burgdorferi
GNLNEVEKV

SEQ ID NO: 205842 - protein, 9 aa, Borrelia Burgdorferi
NLNEVEKVL

SEQ ID NO: 205843 - protein, 9 aa, Borrelia Burgdorferi
LNEVEKVLV

SEQ ID NO: 205844 - protein, 9 aa, Borrelia Burgdorferi
NEVEKVLVR

SEQ ID NO: 205845 - protein, 9 aa, Borrelia Burgdorferi
EVEKVLVRM

SEQ ID NO: 205846 - protein, 9 aa, Borrelia Burgdorferi
VEKVLVRMK

SEQ ID NO: 205847 - protein, 9 aa, Borrelia Burgdorferi
EKVLVRMKE

SEQ ID NO: 205848 - protein, 9 aa, Borrelia Burgdorferi
KVLVRMKEL

SEQ ID NO: 205849 - protein, 9 aa, Borrelia Burgdorferi
VLVRMKELA

SEQ ID NO: 205850 - protein, 9 aa, Borrelia Burgdorferi
LVRMKELAV

SEQ ID NO: 205851 - protein, 9 aa, Borrelia Burgdorferi
VRMKELAVQ

SEQ ID NO: 205852 - protein, 9 aa, Borrelia Burgdorferi
RMKELAVQS

SEQ ID NO: 205853 - protein, 9 aa, Borrelia Burgdorferi
MKELAVQSG

SEQ ID NO: 205854 - protein, 9 aa, Borrelia Burgdorferi
KELAVQSGN

SEQ ID NO: 205855 - protein, 9 aa, Borrelia Burgdorferi
ELAVQSGNG

SEQ ID NO: 205856 - protein, 9 aa, Borrelia Burgdorferi
LAVQSGNGT

SEQ ID NO: 205857 - protein, 9 aa, Borrelia Burgdorferi
AVQSGNGTY

SEQ ID NO: 205858 - protein, 9 aa, Borrelia Burgdorferi
VQSGNGTYS

SEQ ID NO: 205859 - protein, 9 aa, Borrelia Burgdorferi
QSGNGTYSD

SEQ ID NO: 205860 - protein, 9 aa, Borrelia Burgdorferi
SGNGTYSDA

SEQ ID NO: 205861 - protein, 9 aa, Borrelia Burgdorferi
GNGTYSDAD

SEQ ID NO: 205862 - protein, 9 aa, Borrelia Burgdorferi
NGTYSDADR

SEQ ID NO: 205863 - protein, 9 aa, Borrelia Burgdorferi
GTYSDADRG

SEQ ID NO: 205864 - protein, 9 aa, Borrelia Burgdorferi
TYSDADRGS

SEQ ID NO: 205865 - protein, 9 aa, Borrelia Burgdorferi
YSDADRGSI

SEQ ID NO: 205866 - protein, 9 aa, Borrelia Burgdorferi
SDADRGSIQ

SEQ ID NO: 205867 - protein, 9 aa, Borrelia Burgdorferi
DADRGSIQI

SEQ ID NO: 205868 - protein, 9 aa, Borrelia Burgdorferi
ADRGSIQIE

SEQ ID NO: 205869 - protein, 9 aa, Borrelia Burgdorferi
DRGSIQIEI

SEQ ID NO: 205870 - protein, 9 aa, Borrelia Burgdorferi
RGSIQIEIE

SEQ ID NO: 205871 - protein, 9 aa, Borrelia Burgdorferi
GSIQIEIEQ

SEQ ID NO: 205872 - protein, 9 aa, Borrelia Burgdorferi
SIQIEIEQL

SEQ ID NO: 205873 - protein, 9 aa, Borrelia Burgdorferi
IQIEIEQLT

SEQ ID NO: 205874 - protein, 9 aa, Borrelia Burgdorferi
QIEIEQLTD

SEQ ID NO: 205875 - protein, 9 aa, Borrelia Burgdorferi
IEIEQLTDE

SEQ ID NO: 205876 - protein, 9 aa, Borrelia Burgdorferi
EIEQLTDEI

SEQ ID NO: 205877 - protein, 9 aa, Borrelia Burgdorferi
IEQLTDEIN

SEQ ID NO: 205878 - protein, 9 aa, Borrelia Burgdorferi
EQLTDEINR

SEQ ID NO: 205879 - protein, 9 aa, Borrelia Burgdorferi
QLTDEINRI

SEQ ID NO: 205880 - protein, 9 aa, Borrelia Burgdorferi
LTDEINRIA

SEQ ID NO: 205881 - protein, 9 aa, Borrelia Burgdorferi
TDEINRIAD

SEQ ID NO: 205882 - protein, 9 aa, Borrelia Burgdorferi
DEINRIADQ

SEQ ID NO: 205883 - protein, 9 aa, Borrelia Burgdorferi
EINRIADQA

SEQ ID NO: 205884 - protein, 9 aa, Borrelia Burgdorferi
INRIADQAQ

SEQ ID NO: 205885 - protein, 9 aa, Borrelia Burgdorferi
NRIADQAQY

SEQ ID NO: 205886 - protein, 9 aa, Borrelia Burgdorferi
RIADQAQYN

SEQ ID NO: 205887 - protein, 9 aa, Borrelia Burgdorferi
IADQAQYNQ

SEQ ID NO: 205888 - protein, 9 aa, Borrelia Burgdorferi
ADQAQYNQM

SEQ ID NO: 205889 - protein, 9 aa, Borrelia Burgdorferi
DQAQYNQMH

SEQ ID NO: 205890 - protein, 9 aa, Borrelia Burgdorferi
QAQYNQMHM

SEQ ID NO: 205891 - protein, 9 aa, Borrelia Burgdorferi
AQYNQMHML

SEQ ID NO: 205892 - protein, 9 aa, Borrelia Burgdorferi
QYNQMHMLS

SEQ ID NO: 205893 - protein, 9 aa, Borrelia Burgdorferi
YNQMHMLSN

SEQ ID NO: 205894 - protein, 9 aa, Borrelia Burgdorferi
NQMHMLSNK

SEQ ID NO: 205895 - protein, 9 aa, Borrelia Burgdorferi
QMHMLSNKS

SEQ ID NO: 205896 - protein, 9 aa, Borrelia Burgdorferi
MHMLSNKSA

SEQ ID NO: 205897 - protein, 9 aa, Borrelia Burgdorferi
HMLSNKSAS

SEQ ID NO: 205898 - protein, 9 aa, Borrelia Burgdorferi
MLSNKSASQ

SEQ ID NO: 205899 - protein, 9 aa, Borrelia Burgdorferi
LSNKSASQN

SEQ ID NO: 205900 - protein, 9 aa, Borrelia Burgdorferi
SNKSASQNV

SEQ ID NO: 205901 - protein, 9 aa, Borrelia Burgdorferi
NKSASQNVR

SEQ ID NO: 205902 - protein, 9 aa, Borrelia Burgdorferi
KSASQNVRT

SEQ ID NO: 205903 - protein, 9 aa, Borrelia Burgdorferi
SASQNVRTA

SEQ ID NO: 205904 - protein, 9 aa, Borrelia Burgdorferi
ASQNVRTAE

SEQ ID NO: 205905 - protein, 9 aa, Borrelia Burgdorferi
SQNVRTAEE

SEQ ID NO: 205906 - protein, 9 aa, Borrelia Burgdorferi
QNVRTAEEL

SEQ ID NO: 205907 - protein, 9 aa, Borrelia Burgdorferi
NVRTAEELG

SEQ ID NO: 205908 - protein, 9 aa, Borrelia Burgdorferi
VRTAEELGM

SEQ ID NO: 205909 - protein, 9 aa, Borrelia Burgdorferi
RTAEELGMQ

SEQ ID NO: 205910 - protein, 9 aa, Borrelia Burgdorferi
TAEELGMQP

SEQ ID NO: 205911 - protein, 9 aa, Borrelia Burgdorferi
AEELGMQPA

SEQ ID NO: 205912 - protein, 9 aa, Borrelia Burgdorferi
EELGMQPAK

SEQ ID NO: 205913 - protein, 9 aa, Borrelia Burgdorferi
ELGMQPAKI

SEQ ID NO: 205914 - protein, 9 aa, Borrelia Burgdorferi
LGMQPAKIN

SEQ ID NO: 205915 - protein, 9 aa, Borrelia Burgdorferi
GMQPAKINT

SEQ ID NO: 205916 - protein, 9 aa, Borrelia Burgdorferi
MQPAKINTP

SEQ ID NO: 205917 - protein, 9 aa, Borrelia Burgdorferi
QPAKINTPA

SEQ ID NO: 205918 - protein, 9 aa, Borrelia Burgdorferi
PAKINTPAS

SEQ ID NO: 205919 - protein, 9 aa, Borrelia Burgdorferi
AKINTPASL

SEQ ID NO: 205920 - protein, 9 aa, Borrelia Burgdorferi
KINTPASLS

SEQ ID NO: 205921 - protein, 9 aa, Borrelia Burgdorferi
INTPASLSG

SEQ ID NO: 205922 - protein, 9 aa, Borrelia Burgdorferi
NTPASLSGS

SEQ ID NO: 205923 - protein, 9 aa, Borrelia Burgdorferi
TPASLSGSQ

SEQ ID NO: 205924 - protein, 9 aa, Borrelia Burgdorferi
PASLSGSQA

SEQ ID NO: 205925 - protein, 9 aa, Borrelia Burgdorferi
ASLSGSQAS

SEQ ID NO: 205926 - protein, 9 aa, Borrelia Burgdorferi
SLSGSQASW

SEQ ID NO: 205927 - protein, 9 aa, Borrelia Burgdorferi
LSGSQASWT

SEQ ID NO: 205928 - protein, 9 aa, Borrelia Burgdorferi
SGSQASWTL

SEQ ID NO: 205929 - protein, 9 aa, Borrelia Burgdorferi
GSQASWTLR

SEQ ID NO: 205930 - protein, 9 aa, Borrelia Burgdorferi
SQASWTLRV

SEQ ID NO: 205931 - protein, 9 aa, Borrelia Burgdorferi
QASWTLRVH

SEQ ID NO: 205932 - protein, 9 aa, Borrelia Burgdorferi
ASWTLRVHV

SEQ ID NO: 205933 - protein, 9 aa, Borrelia Burgdorferi
SWTLRVHVG

SEQ ID NO: 205934 - protein, 9 aa, Borrelia Burgdorferi
WTLRVHVGA

SEQ ID NO: 205935 - protein, 9 aa, Borrelia Burgdorferi
TLRVHVGAN

SEQ ID NO: 205936 - protein, 9 aa, Borrelia Burgdorferi
LRVHVGANQ

SEQ ID NO: 205937 - protein, 9 aa, Borrelia Burgdorferi
RVHVGANQD

SEQ ID NO: 205938 - protein, 9 aa, Borrelia Burgdorferi
VHVGANQDE

SEQ ID NO: 205939 - protein, 9 aa, Borrelia Burgdorferi
HVGANQDEA

SEQ ID NO: 205940 - protein, 9 aa, Borrelia Burgdorferi
VGANQDEAI

SEQ ID NO: 205941 - protein, 9 aa, Borrelia Burgdorferi
GANQDEAIA

SEQ ID NO: 205942 - protein, 9 aa, Borrelia Burgdorferi
ANQDEAIAV

SEQ ID NO: 205943 - protein, 9 aa, Borrelia Burgdorferi
NQDEAIAVN

SEQ ID NO: 205944 - protein, 9 aa, Borrelia Burgdorferi
QDEAIAVNI

SEQ ID NO: 205945 - protein, 9 aa, Borrelia Burgdorferi
DEAIAVNIY

SEQ ID NO: 205946 - protein, 9 aa, Borrelia Burgdorferi
EAIAVNIYA

SEQ ID NO: 205947 - protein, 9 aa, Borrelia Burgdorferi
AIAVNIYAA

SEQ ID NO: 205948 - protein, 9 aa, Borrelia Burgdorferi
IAVNIYAAN

SEQ ID NO: 205949 - protein, 9 aa, Borrelia Burgdorferi
AVNIYAANV

SEQ ID NO: 205950 - protein, 9 aa, Borrelia Burgdorferi
VNIYAANVA

SEQ ID NO: 205951 - protein, 9 aa, Borrelia Burgdorferi
NIYAANVAN

SEQ ID NO: 205952 - protein, 9 aa, Borrelia Burgdorferi
IYAANVANL

SEQ ID NO: 205953 - protein, 9 aa, Borrelia Burgdorferi
YAANVANLF

SEQ ID NO: 205954 - protein, 9 aa, Borrelia Burgdorferi
AANVANLFS

SEQ ID NO: 205955 - protein, 9 aa, Borrelia Burgdorferi
ANVANLFSG

SEQ ID NO: 205956 - protein, 9 aa, Borrelia Burgdorferi
NVANLFSGE

SEQ ID NO: 205957 - protein, 9 aa, Borrelia Burgdorferi
VANLFSGEG

SEQ ID NO: 205958 - protein, 9 aa, Borrelia Burgdorferi
ANLFSGEGA

SEQ ID NO: 205959 - protein, 9 aa, Borrelia Burgdorferi
NLFSGEGAQ

SEQ ID NO: 205960 - protein, 9 aa, Borrelia Burgdorferi
LFSGEGAQT

SEQ ID NO: 205961 - protein, 9 aa, Borrelia Burgdorferi
FSGEGAQTA

SEQ ID NO: 205962 - protein, 9 aa, Borrelia Burgdorferi
SGEGAQTAQ

SEQ ID NO: 205963 - protein, 9 aa, Borrelia Burgdorferi
GEGAQTAQA

SEQ ID NO: 205964 - protein, 9 aa, Borrelia Burgdorferi
EGAQTAQAA

SEQ ID NO: 205965 - protein, 9 aa, Borrelia Burgdorferi
GAQTAQAAP

SEQ ID NO: 205966 - protein, 9 aa, Borrelia Burgdorferi
AQTAQAAPV

SEQ ID NO: 205967 - protein, 9 aa, Borrelia Burgdorferi
QTAQAAPVQ

SEQ ID NO: 205968 - protein, 9 aa, Borrelia Burgdorferi
TAQAAPVQE

SEQ ID NO: 205969 - protein, 9 aa, Borrelia Burgdorferi
AQAAPVQEG

SEQ ID NO: 205970 - protein, 9 aa, Borrelia Burgdorferi
QAAPVQEGV

SEQ ID NO: 205971 - protein, 9 aa, Borrelia Burgdorferi
AAPVQEGVQ

SEQ ID NO: 205972 - protein, 9 aa, Borrelia Burgdorferi
APVQEGVQQ

SEQ ID NO: 205973 - protein, 9 aa, Borrelia Burgdorferi
PVQEGVQQE

SEQ ID NO: 205974 - protein, 9 aa, Borrelia Burgdorferi
VQEGVQQEG

SEQ ID NO: 205975 - protein, 9 aa, Borrelia Burgdorferi
QEGVQQEGA

SEQ ID NO: 205976 - protein, 9 aa, Borrelia Burgdorferi
EGVQQEGAQ

SEQ ID NO: 205977 - protein, 9 aa, Borrelia Burgdorferi
GVQQEGAQQ

SEQ ID NO: 205978 - protein, 9 aa, Borrelia Burgdorferi
VQQEGAQQP

SEQ ID NO: 205979 - protein, 9 aa, Borrelia Burgdorferi
QQEGAQQPA

SEQ ID NO: 205980 - protein, 9 aa, Borrelia Burgdorferi
QEGAQQPAP

SEQ ID NO: 205981 - protein, 9 aa, Borrelia Burgdorferi
EGAQQPAPA

SEQ ID NO: 205982 - protein, 9 aa, Borrelia Burgdorferi
GAQQPAPAT

SEQ ID NO: 205983 - protein, 9 aa, Borrelia Burgdorferi
AQQPAPATA

SEQ ID NO: 205984 - protein, 9 aa, Borrelia Burgdorferi
QQPAPATAP

SEQ ID NO: 205985 - protein, 9 aa, Borrelia Burgdorferi
QPAPATAPS

SEQ ID NO: 205986 - protein, 9 aa, Borrelia Burgdorferi
PAPATAPSQ

SEQ ID NO: 205987 - protein, 9 aa, Borrelia Burgdorferi
APATAPSQG

SEQ ID NO: 205988 - protein, 9 aa, Borrelia Burgdorferi
PATAPSQGG

SEQ ID NO: 205989 - protein, 9 aa, Borrelia Burgdorferi
ATAPSQGGV

SEQ ID NO: 205990 - protein, 9 aa, Borrelia Burgdorferi
TAPSQGGVN

SEQ ID NO: 205991 - protein, 9 aa, Borrelia Burgdorferi
APSQGGVNS

SEQ ID NO: 205992 - protein, 9 aa, Borrelia Burgdorferi
PSQGGVNSP

SEQ ID NO: 205993 - protein, 9 aa, Borrelia Burgdorferi
SQGGVNSPV

SEQ ID NO: 205994 - protein, 9 aa, Borrelia Burgdorferi
QGGVNSPVN

SEQ ID NO: 205995 - protein, 9 aa, Borrelia Burgdorferi
GGVNSPVNV

SEQ ID NO: 205996 - protein, 9 aa, Borrelia Burgdorferi
GVNSPVNVT

SEQ ID NO: 205997 - protein, 9 aa, Borrelia Burgdorferi
VNSPVNVTT

SEQ ID NO: 205998 - protein, 9 aa, Borrelia Burgdorferi
NSPVNVTTT

SEQ ID NO: 205999 - protein, 9 aa, Borrelia Burgdorferi
SPVNVTTTV

SEQ ID NO: 206000 - protein, 9 aa, Borrelia Burgdorferi
PVNVTTTVD

SEQ ID NO: 206001 - protein, 9 aa, Borrelia Burgdorferi
VNVTTTVDA

SEQ ID NO: 206002 - protein, 9 aa, Borrelia Burgdorferi
NVTTTVDAN

SEQ ID NO: 206003 - protein, 9 aa, Borrelia Burgdorferi
VTTTVDANT

SEQ ID NO: 206004 - protein, 9 aa, Borrelia Burgdorferi
TTTVDANTS

SEQ ID NO: 206005 - protein, 9 aa, Borrelia Burgdorferi
TTVDANTSL

SEQ ID NO: 206006 - protein, 9 aa, Borrelia Burgdorferi
TVDANTSLA

SEQ ID NO: 206007 - protein, 9 aa, Borrelia Burgdorferi
VDANTSLAK

SEQ ID NO: 206008 - protein, 9 aa, Borrelia Burgdorferi
DANTSLAKI

SEQ ID NO: 206009 - protein, 9 aa, Borrelia Burgdorferi
ANTSLAKIE

SEQ ID NO: 206010 - protein, 9 aa, Borrelia Burgdorferi
NTSLAKIEN

SEQ ID NO: 206011 - protein, 9 aa, Borrelia Burgdorferi
TSLAKIENA

SEQ ID NO: 206012 - protein, 9 aa, Borrelia Burgdorferi
SLAKIENAI

SEQ ID NO: 206013 - protein, 9 aa, Borrelia Burgdorferi
LAKIENAIR

SEQ ID NO: 206014 - protein, 9 aa, Borrelia Burgdorferi
AKIENAIRM

SEQ ID NO: 206015 - protein, 9 aa, Borrelia Burgdorferi
KIENAIRMI

SEQ ID NO: 206016 - protein, 9 aa, Borrelia Burgdorferi
IENAIRMIS

SEQ ID NO: 206017 - protein, 9 aa, Borrelia Burgdorferi
ENAIRMISD

SEQ ID NO: 206018 - protein, 9 aa, Borrelia Burgdorferi
NAIRMISDQ

SEQ ID NO: 206019 - protein, 9 aa, Borrelia Burgdorferi
AIRMISDQR

SEQ ID NO: 206020 - protein, 9 aa, Borrelia Burgdorferi
IRMISDQRA

SEQ ID NO: 206021 - protein, 9 aa, Borrelia Burgdorferi
RMISDQRAN

SEQ ID NO: 206022 - protein, 9 aa, Borrelia Burgdorferi
MISDQRANL

SEQ ID NO: 206023 - protein, 9 aa, Borrelia Burgdorferi
ISDQRANLG

SEQ ID NO: 206024 - protein, 9 aa, Borrelia Burgdorferi
SDQRANLGA

SEQ ID NO: 206025 - protein, 9 aa, Borrelia Burgdorferi
DQRANLGAF

SEQ ID NO: 206026 - protein, 9 aa, Borrelia Burgdorferi
QRANLGAFQ

SEQ ID NO: 206027 - protein, 9 aa, Borrelia Burgdorferi
RANLGAFQN

SEQ ID NO: 206028 - protein, 9 aa, Borrelia Burgdorferi
ANLGAFQNR

SEQ ID NO: 206029 - protein, 9 aa, Borrelia Burgdorferi
NLGAFQNRL

SEQ ID NO: 206030 - protein, 9 aa, Borrelia Burgdorferi
LGAFQNRLE

SEQ ID NO: 206031 - protein, 9 aa, Borrelia Burgdorferi
GAFQNRLES

SEQ ID NO: 206032 - protein, 9 aa, Borrelia Burgdorferi
AFQNRLESI

SEQ ID NO: 206033 - protein, 9 aa, Borrelia Burgdorferi
FQNRLESIK

SEQ ID NO: 206034 - protein, 9 aa, Borrelia Burgdorferi
QNRLESIKN

SEQ ID NO: 206035 - protein, 9 aa, Borrelia Burgdorferi
NRLESIKNS

SEQ ID NO: 206036 - protein, 9 aa, Borrelia Burgdorferi
RLESIKNST

SEQ ID NO: 206037 - protein, 9 aa, Borrelia Burgdorferi
LESIKNSTE

SEQ ID NO: 206038 - protein, 9 aa, Borrelia Burgdorferi
ESIKNSTEY

SEQ ID NO: 206039 - protein, 9 aa, Borrelia Burgdorferi
SIKNSTEYA

SEQ ID NO: 206040 - protein, 9 aa, Borrelia Burgdorferi
IKNSTEYAI

SEQ ID NO: 206041 - protein, 9 aa, Borrelia Burgdorferi
KNSTEYAIE

SEQ ID NO: 206042 - protein, 9 aa, Borrelia Burgdorferi
NSTEYAIEN

SEQ ID NO: 206043 - protein, 9 aa, Borrelia Burgdorferi
STEYAIENL

SEQ ID NO: 206044 - protein, 9 aa, Borrelia Burgdorferi
TEYAIENLK

SEQ ID NO: 206045 - protein, 9 aa, Borrelia Burgdorferi
EYAIENLKA

SEQ ID NO: 206046 - protein, 9 aa, Borrelia Burgdorferi
YAIENLKAS

SEQ ID NO: 206047 - protein, 9 aa, Borrelia Burgdorferi
AIENLKASY

SEQ ID NO: 206048 - protein, 9 aa, Borrelia Burgdorferi
IENLKASYA

SEQ ID NO: 206049 - protein, 9 aa, Borrelia Burgdorferi
ENLKASYAQ

SEQ ID NO: 206050 - protein, 9 aa, Borrelia Burgdorferi
NLKASYAQI

SEQ ID NO: 206051 - protein, 9 aa, Borrelia Burgdorferi
LKASYAQIK

SEQ ID NO: 206052 - protein, 9 aa, Borrelia Burgdorferi
KASYAQIKD

SEQ ID NO: 206053 - protein, 9 aa, Borrelia Burgdorferi
ASYAQIKDA

SEQ ID NO: 206054 - protein, 9 aa, Borrelia Burgdorferi
SYAQIKDAT

SEQ ID NO: 206055 - protein, 9 aa, Borrelia Burgdorferi
YAQIKDATM

SEQ ID NO: 206056 - protein, 9 aa, Borrelia Burgdorferi
AQIKDATMT

SEQ ID NO: 206057 - protein, 9 aa, Borrelia Burgdorferi
QIKDATMTD

SEQ ID NO: 206058 - protein, 9 aa, Borrelia Burgdorferi
IKDATMTDE

SEQ ID NO: 206059 - protein, 9 aa, Borrelia Burgdorferi
KDATMTDEV

SEQ ID NO: 206060 - protein, 9 aa, Borrelia Burgdorferi
DATMTDEVV

SEQ ID NO: 206061 - protein, 9 aa, Borrelia Burgdorferi
ATMTDEVVA

SEQ ID NO: 206062 - protein, 9 aa, Borrelia Burgdorferi
TMTDEVVAA

SEQ ID NO: 206063 - protein, 9 aa, Borrelia Burgdorferi
MTDEVVAAT

SEQ ID NO: 206064 - protein, 9 aa, Borrelia Burgdorferi
TDEVVAATT

SEQ ID NO: 206065 - protein, 9 aa, Borrelia Burgdorferi
DEVVAATTN

SEQ ID NO: 206066 - protein, 9 aa, Borrelia Burgdorferi
EVVAATTNS

SEQ ID NO: 206067 - protein, 9 aa, Borrelia Burgdorferi
VVAATTNSI

SEQ ID NO: 206068 - protein, 9 aa, Borrelia Burgdorferi
VAATTNSIL

SEQ ID NO: 206069 - protein, 9 aa, Borrelia Burgdorferi
AATTNSILT

SEQ ID NO: 206070 - protein, 9 aa, Borrelia Burgdorferi
ATTNSILTQ

SEQ ID NO: 206071 - protein, 9 aa, Borrelia Burgdorferi
TTNSILTQS

SEQ ID NO: 206072 - protein, 9 aa, Borrelia Burgdorferi
TNSILTQSA

SEQ ID NO: 206073 - protein, 9 aa, Borrelia Burgdorferi
NSILTQSAM

SEQ ID NO: 206074 - protein, 9 aa, Borrelia Burgdorferi
SILTQSAMA

SEQ ID NO: 206075 - protein, 9 aa, Borrelia Burgdorferi
ILTQSAMAM

SEQ ID NO: 206076 - protein, 9 aa, Borrelia Burgdorferi
LTQSAMAMI

SEQ ID NO: 206077 - protein, 9 aa, Borrelia Burgdorferi
TQSAMAMIA

SEQ ID NO: 206078 - protein, 9 aa, Borrelia Burgdorferi
QSAMAMIAQ

SEQ ID NO: 206079 - protein, 9 aa, Borrelia Burgdorferi
SAMAMIAQA

SEQ ID NO: 206080 - protein, 9 aa, Borrelia Burgdorferi
AMAMIAQAN

SEQ ID NO: 206081 - protein, 9 aa, Borrelia Burgdorferi
MAMIAQANQ

SEQ ID NO: 206082 - protein, 9 aa, Borrelia Burgdorferi
AMIAQANQV

SEQ ID NO: 206083 - protein, 9 aa, Borrelia Burgdorferi
MIAQANQVP

SEQ ID NO: 206084 - protein, 9 aa, Borrelia Burgdorferi
IAQANQVPQ

SEQ ID NO: 206085 - protein, 9 aa, Borrelia Burgdorferi
AQANQVPQY

SEQ ID NO: 206086 - protein, 9 aa, Borrelia Burgdorferi
QANQVPQYV

SEQ ID NO: 206087 - protein, 9 aa, Borrelia Burgdorferi
ANQVPQYVL

SEQ ID NO: 206088 - protein, 9 aa, Borrelia Burgdorferi
NQVPQYVLS

SEQ ID NO: 206089 - protein, 9 aa, Borrelia Burgdorferi
QVPQYVLSL

SEQ ID NO: 206090 - protein, 9 aa, Borrelia Burgdorferi
VPQYVLSLL

SEQ ID NO: 206091 - protein, 9 aa, Borrelia Burgdorferi
PQYVLSLLR

SEQ ID NO: 206092 - protein, 10 aa, Borrelia Burgdorferi
MIINHNTSAI

SEQ ID NO: 206093 - protein, 10 aa, Borrelia Burgdorferi
IINHNTSAIN

SEQ ID NO: 206094 - protein, 10 aa, Borrelia Burgdorferi
INHNTSAINA

SEQ ID NO: 206095 - protein, 10 aa, Borrelia Burgdorferi
NHNTSAINAS

SEQ ID NO: 206096 - protein, 10 aa, Borrelia Burgdorferi
HNTSAINASR

SEQ ID NO: 206097 - protein, 10 aa, Borrelia Burgdorferi
NTSAINASRN

SEQ ID NO: 206098 - protein, 10 aa, Borrelia Burgdorferi
TSAINASRNN

SEQ ID NO: 206099 - protein, 10 aa, Borrelia Burgdorferi
SAINASRNNG

SEQ ID NO: 206100 - protein, 10 aa, Borrelia Burgdorferi
AINASRNNGI

SEQ ID NO: 206101 - protein, 10 aa, Borrelia Burgdorferi
INASRNNGIN

SEQ ID NO: 206102 - protein, 10 aa, Borrelia Burgdorferi
NASRNNGINA

SEQ ID NO: 206103 - protein, 10 aa, Borrelia Burgdorferi
ASRNNGINAA

SEQ ID NO: 206104 - protein, 10 aa, Borrelia Burgdorferi
SRNNGINAAN

SEQ ID NO: 206105 - protein, 10 aa, Borrelia Burgdorferi
RNNGINAANL

SEQ ID NO: 206106 - protein, 10 aa, Borrelia Burgdorferi
NNGINAANLS

SEQ ID NO: 206107 - protein, 10 aa, Borrelia Burgdorferi
NGINAANLSK

SEQ ID NO: 206108 - protein, 10 aa, Borrelia Burgdorferi
GINAANLSKT

SEQ ID NO: 206109 - protein, 10 aa, Borrelia Burgdorferi
INAANLSKTQ

SEQ ID NO: 206110 - protein, 10 aa, Borrelia Burgdorferi
NAANLSKTQE

SEQ ID NO: 206111 - protein, 10 aa, Borrelia Burgdorferi
AANLSKTQEK

SEQ ID NO: 206112 - protein, 10 aa, Borrelia Burgdorferi
ANLSKTQEKL

SEQ ID NO: 206113 - protein, 10 aa, Borrelia Burgdorferi
NLSKTQEKLS

SEQ ID NO: 206114 - protein, 10 aa, Borrelia Burgdorferi
LSKTQEKLSS

SEQ ID NO: 206115 - protein, 10 aa, Borrelia Burgdorferi
SKTQEKLSSG

SEQ ID NO: 206116 - protein, 10 aa, Borrelia Burgdorferi
KTQEKLSSGY

SEQ ID NO: 206117 - protein, 10 aa, Borrelia Burgdorferi
TQEKLSSGYR

SEQ ID NO: 206118 - protein, 10 aa, Borrelia Burgdorferi
QEKLSSGYRI

SEQ ID NO: 206119 - protein, 10 aa, Borrelia Burgdorferi
EKLSSGYRIN

SEQ ID NO: 206120 - protein, 10 aa, Borrelia Burgdorferi
KLSSGYRINR

SEQ ID NO: 206121 - protein, 10 aa, Borrelia Burgdorferi
LSSGYRINRA

SEQ ID NO: 206122 - protein, 10 aa, Borrelia Burgdorferi
SSGYRINRAS

SEQ ID NO: 206123 - protein, 10 aa, Borrelia Burgdorferi
SGYRINRASD

SEQ ID NO: 206124 - protein, 10 aa, Borrelia Burgdorferi
GYRINRASDD

SEQ ID NO: 206125 - protein, 10 aa, Borrelia Burgdorferi
YRINRASDDA

SEQ ID NO: 206126 - protein, 10 aa, Borrelia Burgdorferi
RINRASDDAA

SEQ ID NO: 206127 - protein, 10 aa, Borrelia Burgdorferi
INRASDDAAG

SEQ ID NO: 206128 - protein, 10 aa, Borrelia Burgdorferi
NRASDDAAGM

SEQ ID NO: 206129 - protein, 10 aa, Borrelia Burgdorferi
RASDDAAGMG

SEQ ID NO: 206130 - protein, 10 aa, Borrelia Burgdorferi
ASDDAAGMGV

SEQ ID NO: 206131 - protein, 10 aa, Borrelia Burgdorferi
SDDAAGMGVS

SEQ ID NO: 206132 - protein, 10 aa, Borrelia Burgdorferi
DDAAGMGVSG

SEQ ID NO: 206133 - protein, 10 aa, Borrelia Burgdorferi
DAAGMGVSGK

SEQ ID NO: 206134 - protein, 10 aa, Borrelia Burgdorferi
AAGMGVSGKI

SEQ ID NO: 206135 - protein, 10 aa, Borrelia Burgdorferi
AGMGVSGKIN

SEQ ID NO: 206136 - protein, 10 aa, Borrelia Burgdorferi
GMGVSGKINA

SEQ ID NO: 206137 - protein, 10 aa, Borrelia Burgdorferi
MGVSGKINAQ

SEQ ID NO: 206138 - protein, 10 aa, Borrelia Burgdorferi
GVSGKINAQI

SEQ ID NO: 206139 - protein, 10 aa, Borrelia Burgdorferi
VSGKINAQIR

SEQ ID NO: 206140 - protein, 10 aa, Borrelia Burgdorferi
SGKINAQIRG

SEQ ID NO: 206141 - protein, 10 aa, Borrelia Burgdorferi
GKINAQIRGL

SEQ ID NO: 206142 - protein, 10 aa, Borrelia Burgdorferi
KINAQIRGLS

SEQ ID NO: 206143 - protein, 10 aa, Borrelia Burgdorferi
INAQIRGLSQ

SEQ ID NO: 206144 - protein, 10 aa, Borrelia Burgdorferi
NAQIRGLSQA

SEQ ID NO: 206145 - protein, 10 aa, Borrelia Burgdorferi
AQIRGLSQAS

SEQ ID NO: 206146 - protein, 10 aa, Borrelia Burgdorferi
QIRGLSQASR

SEQ ID NO: 206147 - protein, 10 aa, Borrelia Burgdorferi
IRGLSQASRN

SEQ ID NO: 206148 - protein, 10 aa, Borrelia Burgdorferi
RGLSQASRNT

SEQ ID NO: 206149 - protein, 10 aa, Borrelia Burgdorferi
GLSQASRNTS

SEQ ID NO: 206150 - protein, 10 aa, Borrelia Burgdorferi
LSQASRNTSK

SEQ ID NO: 206151 - protein, 10 aa, Borrelia Burgdorferi
SQASRNTSKA

SEQ ID NO: 206152 - protein, 10 aa, Borrelia Burgdorferi
QASRNTSKAI

SEQ ID NO: 206153 - protein, 10 aa, Borrelia Burgdorferi
ASRNTSKAIN

SEQ ID NO: 206154 - protein, 10 aa, Borrelia Burgdorferi
SRNTSKAINF

SEQ ID NO: 206155 - protein, 10 aa, Borrelia Burgdorferi
RNTSKAINFI

SEQ ID NO: 206156 - protein, 10 aa, Borrelia Burgdorferi
NTSKAINFIQ

SEQ ID NO: 206157 - protein, 10 aa, Borrelia Burgdorferi
TSKAINFIQT

SEQ ID NO: 206158 - protein, 10 aa, Borrelia Burgdorferi
SKAINFIQTT

SEQ ID NO: 206159 - protein, 10 aa, Borrelia Burgdorferi
KAINFIQTTE

SEQ ID NO: 206160 - protein, 10 aa, Borrelia Burgdorferi
AINFIQTTEG

SEQ ID NO: 206161 - protein, 10 aa, Borrelia Burgdorferi
INFIQTTEGN

SEQ ID NO: 206162 - protein, 10 aa, Borrelia Burgdorferi
NFIQTTEGNL

SEQ ID NO: 206163 - protein, 10 aa, Borrelia Burgdorferi
FIQTTEGNLN

SEQ ID NO: 206164 - protein, 10 aa, Borrelia Burgdorferi
IQTTEGNLNE

SEQ ID NO: 206165 - protein, 10 aa, Borrelia Burgdorferi
QTTEGNLNEV

SEQ ID NO: 206166 - protein, 10 aa, Borrelia Burgdorferi
TTEGNLNEVE

SEQ ID NO: 206167 - protein, 10 aa, Borrelia Burgdorferi
TEGNLNEVEK

SEQ ID NO: 206168 - protein, 10 aa, Borrelia Burgdorferi
EGNLNEVEKV

SEQ ID NO: 206169 - protein, 10 aa, Borrelia Burgdorferi
GNLNEVEKVL

SEQ ID NO: 206170 - protein, 10 aa, Borrelia Burgdorferi
NLNEVEKVLV

SEQ ID NO: 206171 - protein, 10 aa, Borrelia Burgdorferi
LNEVEKVLVR

SEQ ID NO: 206172 - protein, 10 aa, Borrelia Burgdorferi
NEVEKVLVRM

SEQ ID NO: 206173 - protein, 10 aa, Borrelia Burgdorferi
EVEKVLVRMK

SEQ ID NO: 206174 - protein, 10 aa, Borrelia Burgdorferi
VEKVLVRMKE

SEQ ID NO: 206175 - protein, 10 aa, Borrelia Burgdorferi
EKVLVRMKEL

SEQ ID NO: 206176 - protein, 10 aa, Borrelia Burgdorferi
KVLVRMKELA

SEQ ID NO: 206177 - protein, 10 aa, Borrelia Burgdorferi
VLVRMKELAV

SEQ ID NO: 206178 - protein, 10 aa, Borrelia Burgdorferi
LVRMKELAVQ

SEQ ID NO: 206179 - protein, 10 aa, Borrelia Burgdorferi
VRMKELAVQS

SEQ ID NO: 206180 - protein, 10 aa, Borrelia Burgdorferi
RMKELAVQSG

SEQ ID NO: 206181 - protein, 10 aa, Borrelia Burgdorferi
MKELAVQSGN

SEQ ID NO: 206182 - protein, 10 aa, Borrelia Burgdorferi
KELAVQSGNG

SEQ ID NO: 206183 - protein, 10 aa, Borrelia Burgdorferi
ELAVQSGNGT

SEQ ID NO: 206184 - protein, 10 aa, Borrelia Burgdorferi
LAVQSGNGTY

SEQ ID NO: 206185 - protein, 10 aa, Borrelia Burgdorferi
AVQSGNGTYS

SEQ ID NO: 206186 - protein, 10 aa, Borrelia Burgdorferi
VQSGNGTYSD

SEQ ID NO: 206187 - protein, 10 aa, Borrelia Burgdorferi
QSGNGTYSDA

SEQ ID NO: 206188 - protein, 10 aa, Borrelia Burgdorferi
SGNGTYSDAD

SEQ ID NO: 206189 - protein, 10 aa, Borrelia Burgdorferi
GNGTYSDADR

SEQ ID NO: 206190 - protein, 10 aa, Borrelia Burgdorferi
NGTYSDADRG

SEQ ID NO: 206191 - protein, 10 aa, Borrelia Burgdorferi
GTYSDADRGS

SEQ ID NO: 206192 - protein, 10 aa, Borrelia Burgdorferi
TYSDADRGSI

SEQ ID NO: 206193 - protein, 10 aa, Borrelia Burgdorferi
YSDADRGSIQ

SEQ ID NO: 206194 - protein, 10 aa, Borrelia Burgdorferi
SDADRGSIQI

SEQ ID NO: 206195 - protein, 10 aa, Borrelia Burgdorferi
DADRGSIQIE

SEQ ID NO: 206196 - protein, 10 aa, Borrelia Burgdorferi
ADRGSIQIEI

SEQ ID NO: 206197 - protein, 10 aa, Borrelia Burgdorferi
DRGSIQIEIE

SEQ ID NO: 206198 - protein, 10 aa, Borrelia Burgdorferi
RGSIQIEIEQ

SEQ ID NO: 206199 - protein, 10 aa, Borrelia Burgdorferi
GSIQIEIEQL

SEQ ID NO: 206200 - protein, 10 aa, Borrelia Burgdorferi
SIQIEIEQLT

SEQ ID NO: 206201 - protein, 10 aa, Borrelia Burgdorferi
IQIEIEQLTD

SEQ ID NO: 206202 - protein, 10 aa, Borrelia Burgdorferi
QIEIEQLTDE

SEQ ID NO: 206203 - protein, 10 aa, Borrelia Burgdorferi
IEIEQLTDEI

SEQ ID NO: 206204 - protein, 10 aa, Borrelia Burgdorferi
EIEQLTDEIN

SEQ ID NO: 206205 - protein, 10 aa, Borrelia Burgdorferi
IEQLTDEINR

SEQ ID NO: 206206 - protein, 10 aa, Borrelia Burgdorferi
EQLTDEINRI

SEQ ID NO: 206207 - protein, 10 aa, Borrelia Burgdorferi
QLTDEINRIA

SEQ ID NO: 206208 - protein, 10 aa, Borrelia Burgdorferi
LTDEINRIAD

SEQ ID NO: 206209 - protein, 10 aa, Borrelia Burgdorferi
TDEINRIADQ

SEQ ID NO: 206210 - protein, 10 aa, Borrelia Burgdorferi
DEINRIADQA

SEQ ID NO: 206211 - protein, 10 aa, Borrelia Burgdorferi
EINRIADQAQ

SEQ ID NO: 206212 - protein, 10 aa, Borrelia Burgdorferi
INRIADQAQY

SEQ ID NO: 206213 - protein, 10 aa, Borrelia Burgdorferi
NRIADQAQYN

SEQ ID NO: 206214 - protein, 10 aa, Borrelia Burgdorferi
RIADQAQYNQ

SEQ ID NO: 206215 - protein, 10 aa, Borrelia Burgdorferi
IADQAQYNQM

SEQ ID NO: 206216 - protein, 10 aa, Borrelia Burgdorferi
ADQAQYNQMH

SEQ ID NO: 206217 - protein, 10 aa, Borrelia Burgdorferi
DQAQYNQMHM

SEQ ID NO: 206218 - protein, 10 aa, Borrelia Burgdorferi
QAQYNQMHML

SEQ ID NO: 206219 - protein, 10 aa, Borrelia Burgdorferi
AQYNQMHMLS

SEQ ID NO: 206220 - protein, 10 aa, Borrelia Burgdorferi
QYNQMHMLSN

SEQ ID NO: 206221 - protein, 10 aa, Borrelia Burgdorferi
YNQMHMLSNK

SEQ ID NO: 206222 - protein, 10 aa, Borrelia Burgdorferi
NQMHMLSNKS

SEQ ID NO: 206223 - protein, 10 aa, Borrelia Burgdorferi
QMHMLSNKSA

SEQ ID NO: 206224 - protein, 10 aa, Borrelia Burgdorferi
MHMLSNKSAS

SEQ ID NO: 206225 - protein, 10 aa, Borrelia Burgdorferi
HMLSNKSASQ

SEQ ID NO: 206226 - protein, 10 aa, Borrelia Burgdorferi
MLSNKSASQN

SEQ ID NO: 206227 - protein, 10 aa, Borrelia Burgdorferi
LSNKSASQNV

SEQ ID NO: 206228 - protein, 10 aa, Borrelia Burgdorferi
SNKSASQNVR

SEQ ID NO: 206229 - protein, 10 aa, Borrelia Burgdorferi
NKSASQNVRT

SEQ ID NO: 206230 - protein, 10 aa, Borrelia Burgdorferi
KSASQNVRTA

SEQ ID NO: 206231 - protein, 10 aa, Borrelia Burgdorferi
SASQNVRTAE

SEQ ID NO: 206232 - protein, 10 aa, Borrelia Burgdorferi
ASQNVRTAEE

SEQ ID NO: 206233 - protein, 10 aa, Borrelia Burgdorferi
SQNVRTAEEL

SEQ ID NO: 206234 - protein, 10 aa, Borrelia Burgdorferi
QNVRTAEELG

SEQ ID NO: 206235 - protein, 10 aa, Borrelia Burgdorferi
NVRTAEELGM

SEQ ID NO: 206236 - protein, 10 aa, Borrelia Burgdorferi
VRTAEELGMQ

SEQ ID NO: 206237 - protein, 10 aa, Borrelia Burgdorferi
RTAEELGMQP

SEQ ID NO: 206238 - protein, 10 aa, Borrelia Burgdorferi
TAEELGMQPA

SEQ ID NO: 206239 - protein, 10 aa, Borrelia Burgdorferi
AEELGMQPAK

SEQ ID NO: 206240 - protein, 10 aa, Borrelia Burgdorferi
EELGMQPAKI

SEQ ID NO: 206241 - protein, 10 aa, Borrelia Burgdorferi
ELGMQPAKIN

SEQ ID NO: 206242 - protein, 10 aa, Borrelia Burgdorferi
LGMQPAKINT

SEQ ID NO: 206243 - protein, 10 aa, Borrelia Burgdorferi
GMQPAKINTP

SEQ ID NO: 206244 - protein, 10 aa, Borrelia Burgdorferi
MQPAKINTPA

SEQ ID NO: 206245 - protein, 10 aa, Borrelia Burgdorferi
QPAKINTPAS

SEQ ID NO: 206246 - protein, 10 aa, Borrelia Burgdorferi
PAKINTPASL

SEQ ID NO: 206247 - protein, 10 aa, Borrelia Burgdorferi
AKINTPASLS

SEQ ID NO: 206248 - protein, 10 aa, Borrelia Burgdorferi
KINTPASLSG

SEQ ID NO: 206249 - protein, 10 aa, Borrelia Burgdorferi
INTPASLSGS

SEQ ID NO: 206250 - protein, 10 aa, Borrelia Burgdorferi
NTPASLSGSQ

SEQ ID NO: 206251 - protein, 10 aa, Borrelia Burgdorferi
TPASLSGSQA

SEQ ID NO: 206252 - protein, 10 aa, Borrelia Burgdorferi
PASLSGSQAS

SEQ ID NO: 206253 - protein, 10 aa, Borrelia Burgdorferi
ASLSGSQASW

SEQ ID NO: 206254 - protein, 10 aa, Borrelia Burgdorferi
SLSGSQASWT

SEQ ID NO: 206255 - protein, 10 aa, Borrelia Burgdorferi
LSGSQASWTL

SEQ ID NO: 206256 - protein, 10 aa, Borrelia Burgdorferi
SGSQASWTLR

SEQ ID NO: 206257 - protein, 10 aa, Borrelia Burgdorferi
GSQASWTLRV

SEQ ID NO: 206258 - protein, 10 aa, Borrelia Burgdorferi
SQASWTLRVH

SEQ ID NO: 206259 - protein, 10 aa, Borrelia Burgdorferi
QASWTLRVHV

SEQ ID NO: 206260 - protein, 10 aa, Borrelia Burgdorferi
ASWTLRVHVG

SEQ ID NO: 206261 - protein, 10 aa, Borrelia Burgdorferi
SWTLRVHVGA

SEQ ID NO: 206262 - protein, 10 aa, Borrelia Burgdorferi
WTLRVHVGAN

SEQ ID NO: 206263 - protein, 10 aa, Borrelia Burgdorferi
TLRVHVGANQ

SEQ ID NO: 206264 - protein, 10 aa, Borrelia Burgdorferi
LRVHVGANQD

SEQ ID NO: 206265 - protein, 10 aa, Borrelia Burgdorferi
RVHVGANQDE

SEQ ID NO: 206266 - protein, 10 aa, Borrelia Burgdorferi
VHVGANQDEA

SEQ ID NO: 206267 - protein, 10 aa, Borrelia Burgdorferi
HVGANQDEAI

SEQ ID NO: 206268 - protein, 10 aa, Borrelia Burgdorferi
VGANQDEAIA

SEQ ID NO: 206269 - protein, 10 aa, Borrelia Burgdorferi
GANQDEAIAV

SEQ ID NO: 206270 - protein, 10 aa, Borrelia Burgdorferi
ANQDEAIAVN

SEQ ID NO: 206271 - protein, 10 aa, Borrelia Burgdorferi
NQDEAIAVNI

SEQ ID NO: 206272 - protein, 10 aa, Borrelia Burgdorferi
QDEAIAVNIY

SEQ ID NO: 206273 - protein, 10 aa, Borrelia Burgdorferi
DEAIAVNIYA

SEQ ID NO: 206274 - protein, 10 aa, Borrelia Burgdorferi
EAIAVNIYAA

SEQ ID NO: 206275 - protein, 10 aa, Borrelia Burgdorferi
AIAVNIYAAN

SEQ ID NO: 206276 - protein, 10 aa, Borrelia Burgdorferi
IAVNIYAANV

SEQ ID NO: 206277 - protein, 10 aa, Borrelia Burgdorferi
AVNIYAANVA

SEQ ID NO: 206278 - protein, 10 aa, Borrelia Burgdorferi
VNIYAANVAN

SEQ ID NO: 206279 - protein, 10 aa, Borrelia Burgdorferi
NIYAANVANL

SEQ ID NO: 206280 - protein, 10 aa, Borrelia Burgdorferi
IYAANVANLF

SEQ ID NO: 206281 - protein, 10 aa, Borrelia Burgdorferi
YAANVANLFS

SEQ ID NO: 206282 - protein, 10 aa, Borrelia Burgdorferi
AANVANLFSG

SEQ ID NO: 206283 - protein, 10 aa, Borrelia Burgdorferi
ANVANLFSGE

SEQ ID NO: 206284 - protein, 10 aa, Borrelia Burgdorferi
NVANLFSGEG

SEQ ID NO: 206285 - protein, 10 aa, Borrelia Burgdorferi
VANLFSGEGA

SEQ ID NO: 206286 - protein, 10 aa, Borrelia Burgdorferi
ANLFSGEGAQ

SEQ ID NO: 206287 - protein, 10 aa, Borrelia Burgdorferi
NLFSGEGAQT

SEQ ID NO: 206288 - protein, 10 aa, Borrelia Burgdorferi
LFSGEGAQTA

SEQ ID NO: 206289 - protein, 10 aa, Borrelia Burgdorferi
FSGEGAQTAQ

SEQ ID NO: 206290 - protein, 10 aa, Borrelia Burgdorferi
SGEGAQTAQA

SEQ ID NO: 206291 - protein, 10 aa, Borrelia Burgdorferi
GEGAQTAQAA

SEQ ID NO: 206292 - protein, 10 aa, Borrelia Burgdorferi
EGAQTAQAAP

SEQ ID NO: 206293 - protein, 10 aa, Borrelia Burgdorferi
GAQTAQAAPV

SEQ ID NO: 206294 - protein, 10 aa, Borrelia Burgdorferi
AQTAQAAPVQ

SEQ ID NO: 206295 - protein, 10 aa, Borrelia Burgdorferi
QTAQAAPVQE

SEQ ID NO: 206296 - protein, 10 aa, Borrelia Burgdorferi
TAQAAPVQEG

SEQ ID NO: 206297 - protein, 10 aa, Borrelia Burgdorferi
AQAAPVQEGV

SEQ ID NO: 206298 - protein, 10 aa, Borrelia Burgdorferi
QAAPVQEGVQ

SEQ ID NO: 206299 - protein, 10 aa, Borrelia Burgdorferi
AAPVQEGVQQ

SEQ ID NO: 206300 - protein, 10 aa, Borrelia Burgdorferi
APVQEGVQQE

SEQ ID NO: 206301 - protein, 10 aa, Borrelia Burgdorferi
PVQEGVQQEG

SEQ ID NO: 206302 - protein, 10 aa, Borrelia Burgdorferi
VQEGVQQEGA

SEQ ID NO: 206303 - protein, 10 aa, Borrelia Burgdorferi
QEGVQQEGAQ

SEQ ID NO: 206304 - protein, 10 aa, Borrelia Burgdorferi
EGVQQEGAQQ

SEQ ID NO: 206305 - protein, 10 aa, Borrelia Burgdorferi
GVQQEGAQQP

SEQ ID NO: 206306 - protein, 10 aa, Borrelia Burgdorferi
VQQEGAQQPA

SEQ ID NO: 206307 - protein, 10 aa, Borrelia Burgdorferi
QQEGAQQPAP

SEQ ID NO: 206308 - protein, 10 aa, Borrelia Burgdorferi
QEGAQQPAPA

SEQ ID NO: 206309 - protein, 10 aa, Borrelia Burgdorferi
EGAQQPAPAT

SEQ ID NO: 206310 - protein, 10 aa, Borrelia Burgdorferi
GAQQPAPATA

SEQ ID NO: 206311 - protein, 10 aa, Borrelia Burgdorferi
AQQPAPATAP

SEQ ID NO: 206312 - protein, 10 aa, Borrelia Burgdorferi
QQPAPATAPS

SEQ ID NO: 206313 - protein, 10 aa, Borrelia Burgdorferi
QPAPATAPSQ

SEQ ID NO: 206314 - protein, 10 aa, Borrelia Burgdorferi
PAPATAPSQG

SEQ ID NO: 206315 - protein, 10 aa, Borrelia Burgdorferi
APATAPSQGG

SEQ ID NO: 206316 - protein, 10 aa, Borrelia Burgdorferi
PATAPSQGGV

SEQ ID NO: 206317 - protein, 10 aa, Borrelia Burgdorferi
ATAPSQGGVN

SEQ ID NO: 206318 - protein, 10 aa, Borrelia Burgdorferi
TAPSQGGVNS

SEQ ID NO: 206319 - protein, 10 aa, Borrelia Burgdorferi
APSQGGVNSP

SEQ ID NO: 206320 - protein, 10 aa, Borrelia Burgdorferi
PSQGGVNSPV

SEQ ID NO: 206321 - protein, 10 aa, Borrelia Burgdorferi
SQGGVNSPVN

SEQ ID NO: 206322 - protein, 10 aa, Borrelia Burgdorferi
QGGVNSPVNV

SEQ ID NO: 206323 - protein, 10 aa, Borrelia Burgdorferi
GGVNSPVNVT

SEQ ID NO: 206324 - protein, 10 aa, Borrelia Burgdorferi
GVNSPVNVTT

SEQ ID NO: 206325 - protein, 10 aa, Borrelia Burgdorferi
VNSPVNVTTT

SEQ ID NO: 206326 - protein, 10 aa, Borrelia Burgdorferi
NSPVNVTTTV

SEQ ID NO: 206327 - protein, 10 aa, Borrelia Burgdorferi
SPVNVTTTVD

SEQ ID NO: 206328 - protein, 10 aa, Borrelia Burgdorferi
PVNVTTTVDA

SEQ ID NO: 206329 - protein, 10 aa, Borrelia Burgdorferi
VNVTTTVDAN

SEQ ID NO: 206330 - protein, 10 aa, Borrelia Burgdorferi
NVTTTVDANT

SEQ ID NO: 206331 - protein, 10 aa, Borrelia Burgdorferi
VTTTVDANTS

SEQ ID NO: 206332 - protein, 10 aa, Borrelia Burgdorferi
TTTVDANTSL

SEQ ID NO: 206333 - protein, 10 aa, Borrelia Burgdorferi
TTVDANTSLA

SEQ ID NO: 206334 - protein, 10 aa, Borrelia Burgdorferi
TVDANTSLAK

SEQ ID NO: 206335 - protein, 10 aa, Borrelia Burgdorferi
VDANTSLAKI

SEQ ID NO: 206336 - protein, 10 aa, Borrelia Burgdorferi
DANTSLAKIE

SEQ ID NO: 206337 - protein, 10 aa, Borrelia Burgdorferi
ANTSLAKIEN

SEQ ID NO: 206338 - protein, 10 aa, Borrelia Burgdorferi
NTSLAKIENA

SEQ ID NO: 206339 - protein, 10 aa, Borrelia Burgdorferi
TSLAKIENAI

SEQ ID NO: 206340 - protein, 10 aa, Borrelia Burgdorferi
SLAKIENAIR

SEQ ID NO: 206341 - protein, 10 aa, Borrelia Burgdorferi
LAKIENAIRM

SEQ ID NO: 206342 - protein, 10 aa, Borrelia Burgdorferi
AKIENAIRMI

SEQ ID NO: 206343 - protein, 10 aa, Borrelia Burgdorferi
KIENAIRMIS

SEQ ID NO: 206344 - protein, 10 aa, Borrelia Burgdorferi
IENAIRMISD

SEQ ID NO: 206345 - protein, 10 aa, Borrelia Burgdorferi
ENAIRMISDQ

SEQ ID NO: 206346 - protein, 10 aa, Borrelia Burgdorferi
NAIRMISDQR

SEQ ID NO: 206347 - protein, 10 aa, Borrelia Burgdorferi
AIRMISDQRA

SEQ ID NO: 206348 - protein, 10 aa, Borrelia Burgdorferi
IRMISDQRAN

SEQ ID NO: 206349 - protein, 10 aa, Borrelia Burgdorferi
RMISDQRANL

SEQ ID NO: 206350 - protein, 10 aa, Borrelia Burgdorferi
MISDQRANLG

SEQ ID NO: 206351 - protein, 10 aa, Borrelia Burgdorferi
ISDQRANLGA

SEQ ID NO: 206352 - protein, 10 aa, Borrelia Burgdorferi
SDQRANLGAF

SEQ ID NO: 206353 - protein, 10 aa, Borrelia Burgdorferi
DQRANLGAFQ

SEQ ID NO: 206354 - protein, 10 aa, Borrelia Burgdorferi
QRANLGAFQN

SEQ ID NO: 206355 - protein, 10 aa, Borrelia Burgdorferi
RANLGAFQNR

SEQ ID NO: 206356 - protein, 10 aa, Borrelia Burgdorferi
ANLGAFQNRL

SEQ ID NO: 206357 - protein, 10 aa, Borrelia Burgdorferi
NLGAFQNRLE

SEQ ID NO: 206358 - protein, 10 aa, Borrelia Burgdorferi
LGAFQNRLES

SEQ ID NO: 206359 - protein, 10 aa, Borrelia Burgdorferi
GAFQNRLESI

SEQ ID NO: 206360 - protein, 10 aa, Borrelia Burgdorferi
AFQNRLESIK

SEQ ID NO: 206361 - protein, 10 aa, Borrelia Burgdorferi
FQNRLESIKN

SEQ ID NO: 206362 - protein, 10 aa, Borrelia Burgdorferi
QNRLESIKNS

SEQ ID NO: 206363 - protein, 10 aa, Borrelia Burgdorferi
NRLESIKNST

SEQ ID NO: 206364 - protein, 10 aa, Borrelia Burgdorferi
RLESIKNSTE

SEQ ID NO: 206365 - protein, 10 aa, Borrelia Burgdorferi
LESIKNSTEY

SEQ ID NO: 206366 - protein, 10 aa, Borrelia Burgdorferi
ESIKNSTEYA

SEQ ID NO: 206367 - protein, 10 aa, Borrelia Burgdorferi
SIKNSTEYAI

SEQ ID NO: 206368 - protein, 10 aa, Borrelia Burgdorferi
IKNSTEYAIE

SEQ ID NO: 206369 - protein, 10 aa, Borrelia Burgdorferi
KNSTEYAIEN

SEQ ID NO: 206370 - protein, 10 aa, Borrelia Burgdorferi
NSTEYAIENL

SEQ ID NO: 206371 - protein, 10 aa, Borrelia Burgdorferi
STEYAIENLK

SEQ ID NO: 206372 - protein, 10 aa, Borrelia Burgdorferi
TEYAIENLKA

SEQ ID NO: 206373 - protein, 10 aa, Borrelia Burgdorferi
EYAIENLKAS

SEQ ID NO: 206374 - protein, 10 aa, Borrelia Burgdorferi
YAIENLKASY

SEQ ID NO: 206375 - protein, 10 aa, Borrelia Burgdorferi
AIENLKASYA

SEQ ID NO: 206376 - protein, 10 aa, Borrelia Burgdorferi
IENLKASYAQ

SEQ ID NO: 206377 - protein, 10 aa, Borrelia Burgdorferi
ENLKASYAQI

SEQ ID NO: 206378 - protein, 10 aa, Borrelia Burgdorferi
NLKASYAQIK

SEQ ID NO: 206379 - protein, 10 aa, Borrelia Burgdorferi
LKASYAQIKD

SEQ ID NO: 206380 - protein, 10 aa, Borrelia Burgdorferi
KASYAQIKDA

SEQ ID NO: 206381 - protein, 10 aa, Borrelia Burgdorferi
ASYAQIKDAT

SEQ ID NO: 206382 - protein, 10 aa, Borrelia Burgdorferi
SYAQIKDATM

SEQ ID NO: 206383 - protein, 10 aa, Borrelia Burgdorferi
YAQIKDATMT

SEQ ID NO: 206384 - protein, 10 aa, Borrelia Burgdorferi
AQIKDATMTD

SEQ ID NO: 206385 - protein, 10 aa, Borrelia Burgdorferi
QIKDATMTDE

SEQ ID NO: 206386 - protein, 10 aa, Borrelia Burgdorferi
IKDATMTDEV

SEQ ID NO: 206387 - protein, 10 aa, Borrelia Burgdorferi
KDATMTDEVV

SEQ ID NO: 206388 - protein, 10 aa, Borrelia Burgdorferi
DATMTDEVVA

SEQ ID NO: 206389 - protein, 10 aa, Borrelia Burgdorferi
ATMTDEVVAA

SEQ ID NO: 206390 - protein, 10 aa, Borrelia Burgdorferi
TMTDEVVAAT

SEQ ID NO: 206391 - protein, 10 aa, Borrelia Burgdorferi
MTDEVVAATT

SEQ ID NO: 206392 - protein, 10 aa, Borrelia Burgdorferi
TDEVVAATTN

SEQ ID NO: 206393 - protein, 10 aa, Borrelia Burgdorferi
DEVVAATTNS

SEQ ID NO: 206394 - protein, 10 aa, Borrelia Burgdorferi
EVVAATTNSI

SEQ ID NO: 206395 - protein, 10 aa, Borrelia Burgdorferi
VVAATTNSIL

SEQ ID NO: 206396 - protein, 10 aa, Borrelia Burgdorferi
VAATTNSILT

SEQ ID NO: 206397 - protein, 10 aa, Borrelia Burgdorferi
AATTNSILTQ

SEQ ID NO: 206398 - protein, 10 aa, Borrelia Burgdorferi
ATTNSILTQS

SEQ ID NO: 206399 - protein, 10 aa, Borrelia Burgdorferi
TTNSILTQSA

SEQ ID NO: 206400 - protein, 10 aa, Borrelia Burgdorferi
TNSILTQSAM

SEQ ID NO: 206401 - protein, 10 aa, Borrelia Burgdorferi
NSILTQSAMA

SEQ ID NO: 206402 - protein, 10 aa, Borrelia Burgdorferi
SILTQSAMAM

SEQ ID NO: 206403 - protein, 10 aa, Borrelia Burgdorferi
ILTQSAMAMI

SEQ ID NO: 206404 - protein, 10 aa, Borrelia Burgdorferi
LTQSAMAMIA

SEQ ID NO: 206405 - protein, 10 aa, Borrelia Burgdorferi
TQSAMAMIAQ

SEQ ID NO: 206406 - protein, 10 aa, Borrelia Burgdorferi
QSAMAMIAQA

SEQ ID NO: 206407 - protein, 10 aa, Borrelia Burgdorferi
SAMAMIAQAN

SEQ ID NO: 206408 - protein, 10 aa, Borrelia Burgdorferi
AMAMIAQANQ

SEQ ID NO: 206409 - protein, 10 aa, Borrelia Burgdorferi
MAMIAQANQV

SEQ ID NO: 206410 - protein, 10 aa, Borrelia Burgdorferi
AMIAQANQVP

SEQ ID NO: 206411 - protein, 10 aa, Borrelia Burgdorferi
MIAQANQVPQ

SEQ ID NO: 206412 - protein, 10 aa, Borrelia Burgdorferi
IAQANQVPQY

SEQ ID NO: 206413 - protein, 10 aa, Borrelia Burgdorferi
AQANQVPQYV

SEQ ID NO: 206414 - protein, 10 aa, Borrelia Burgdorferi
QANQVPQYVL

SEQ ID NO: 206415 - protein, 10 aa, Borrelia Burgdorferi
ANQVPQYVLS

SEQ ID NO: 206416 - protein, 10 aa, Borrelia Burgdorferi
NQVPQYVLSL

SEQ ID NO: 206417 - protein, 10 aa, Borrelia Burgdorferi
QVPQYVLSLL

SEQ ID NO: 206418 - protein, 10 aa, Borrelia Burgdorferi
VPQYVLSLLR

SEQ ID NO: 206419 - protein, 11 aa, Borrelia Burgdorferi
MIINHNTSAIN

SEQ ID NO: 206420 - protein, 11 aa, Borrelia Burgdorferi
IINHNTSAINA

SEQ ID NO: 206421 - protein, 11 aa, Borrelia Burgdorferi
INHNTSAINAS

SEQ ID NO: 206422 - protein, 11 aa, Borrelia Burgdorferi
NHNTSAINASR

SEQ ID NO: 206423 - protein, 11 aa, Borrelia Burgdorferi
HNTSAINASRN

SEQ ID NO: 206424 - protein, 11 aa, Borrelia Burgdorferi
NTSAINASRNN

SEQ ID NO: 206425 - protein, 11 aa, Borrelia Burgdorferi
TSAINASRNNG

SEQ ID NO: 206426 - protein, 11 aa, Borrelia Burgdorferi
SAINASRNNGI

SEQ ID NO: 206427 - protein, 11 aa, Borrelia Burgdorferi
AINASRNNGIN

SEQ ID NO: 206428 - protein, 11 aa, Borrelia Burgdorferi
INASRNNGINA

SEQ ID NO: 206429 - protein, 11 aa, Borrelia Burgdorferi
NASRNNGINAA

SEQ ID NO: 206430 - protein, 11 aa, Borrelia Burgdorferi
ASRNNGINAAN

SEQ ID NO: 206431 - protein, 11 aa, Borrelia Burgdorferi
SRNNGINAANL

SEQ ID NO: 206432 - protein, 11 aa, Borrelia Burgdorferi
RNNGINAANLS

SEQ ID NO: 206433 - protein, 11 aa, Borrelia Burgdorferi
NNGINAANLSK

SEQ ID NO: 206434 - protein, 11 aa, Borrelia Burgdorferi
NGINAANLSKT

SEQ ID NO: 206435 - protein, 11 aa, Borrelia Burgdorferi
GINAANLSKTQ

SEQ ID NO: 206436 - protein, 11 aa, Borrelia Burgdorferi
INAANLSKTQE

SEQ ID NO: 206437 - protein, 11 aa, Borrelia Burgdorferi
NAANLSKTQEK

SEQ ID NO: 206438 - protein, 11 aa, Borrelia Burgdorferi
AANLSKTQEKL

SEQ ID NO: 206439 - protein, 11 aa, Borrelia Burgdorferi
ANLSKTQEKLS

SEQ ID NO: 206440 - protein, 11 aa, Borrelia Burgdorferi
NLSKTQEKLSS

SEQ ID NO: 206441 - protein, 11 aa, Borrelia Burgdorferi
LSKTQEKLSSG

SEQ ID NO: 206442 - protein, 11 aa, Borrelia Burgdorferi
SKTQEKLSSGY

SEQ ID NO: 206443 - protein, 11 aa, Borrelia Burgdorferi
KTQEKLSSGYR

SEQ ID NO: 206444 - protein, 11 aa, Borrelia Burgdorferi
TQEKLSSGYRI

SEQ ID NO: 206445 - protein, 11 aa, Borrelia Burgdorferi
QEKLSSGYRIN

SEQ ID NO: 206446 - protein, 11 aa, Borrelia Burgdorferi
EKLSSGYRINR

SEQ ID NO: 206447 - protein, 11 aa, Borrelia Burgdorferi
KLSSGYRINRA

SEQ ID NO: 206448 - protein, 11 aa, Borrelia Burgdorferi
LSSGYRINRAS

SEQ ID NO: 206449 - protein, 11 aa, Borrelia Burgdorferi
SSGYRINRASD

SEQ ID NO: 206450 - protein, 11 aa, Borrelia Burgdorferi
SGYRINRASDD

SEQ ID NO: 206451 - protein, 11 aa, Borrelia Burgdorferi
GYRINRASDDA

SEQ ID NO: 206452 - protein, 11 aa, Borrelia Burgdorferi
YRINRASDDAA

SEQ ID NO: 206453 - protein, 11 aa, Borrelia Burgdorferi
RINRASDDAAG

SEQ ID NO: 206454 - protein, 11 aa, Borrelia Burgdorferi
INRASDDAAGM

SEQ ID NO: 206455 - protein, 11 aa, Borrelia Burgdorferi
NRASDDAAGMG

SEQ ID NO: 206456 - protein, 11 aa, Borrelia Burgdorferi
RASDDAAGMGV

SEQ ID NO: 206457 - protein, 11 aa, Borrelia Burgdorferi
ASDDAAGMGVS

SEQ ID NO: 206458 - protein, 11 aa, Borrelia Burgdorferi
SDDAAGMGVSG

SEQ ID NO: 206459 - protein, 11 aa, Borrelia Burgdorferi
DDAAGMGVSGK

SEQ ID NO: 206460 - protein, 11 aa, Borrelia Burgdorferi
DAAGMGVSGKI

SEQ ID NO: 206461 - protein, 11 aa, Borrelia Burgdorferi
AAGMGVSGKIN

SEQ ID NO: 206462 - protein, 11 aa, Borrelia Burgdorferi
AGMGVSGKINA

SEQ ID NO: 206463 - protein, 11 aa, Borrelia Burgdorferi
GMGVSGKINAQ

SEQ ID NO: 206464 - protein, 11 aa, Borrelia Burgdorferi
MGVSGKINAQI

SEQ ID NO: 206465 - protein, 11 aa, Borrelia Burgdorferi
GVSGKINAQIR

SEQ ID NO: 206466 - protein, 11 aa, Borrelia Burgdorferi
VSGKINAQIRG

SEQ ID NO: 206467 - protein, 11 aa, Borrelia Burgdorferi
SGKINAQIRGL

SEQ ID NO: 206468 - protein, 11 aa, Borrelia Burgdorferi
GKINAQIRGLS

SEQ ID NO: 206469 - protein, 11 aa, Borrelia Burgdorferi
KINAQIRGLSQ

SEQ ID NO: 206470 - protein, 11 aa, Borrelia Burgdorferi
INAQIRGLSQA

SEQ ID NO: 206471 - protein, 11 aa, Borrelia Burgdorferi
NAQIRGLSQAS

SEQ ID NO: 206472 - protein, 11 aa, Borrelia Burgdorferi
AQIRGLSQASR

SEQ ID NO: 206473 - protein, 11 aa, Borrelia Burgdorferi
QIRGLSQASRN

SEQ ID NO: 206474 - protein, 11 aa, Borrelia Burgdorferi
IRGLSQASRNT

SEQ ID NO: 206475 - protein, 11 aa, Borrelia Burgdorferi
RGLSQASRNTS

SEQ ID NO: 206476 - protein, 11 aa, Borrelia Burgdorferi
GLSQASRNTSK

SEQ ID NO: 206477 - protein, 11 aa, Borrelia Burgdorferi
LSQASRNTSKA

SEQ ID NO: 206478 - protein, 11 aa, Borrelia Burgdorferi
SQASRNTSKAI

SEQ ID NO: 206479 - protein, 11 aa, Borrelia Burgdorferi
QASRNTSKAIN

SEQ ID NO: 206480 - protein, 11 aa, Borrelia Burgdorferi
ASRNTSKAINF

SEQ ID NO: 206481 - protein, 11 aa, Borrelia Burgdorferi
SRNTSKAINFI

SEQ ID NO: 206482 - protein, 11 aa, Borrelia Burgdorferi
RNTSKAINFIQ

SEQ ID NO: 206483 - protein, 11 aa, Borrelia Burgdorferi
NTSKAINFIQT

SEQ ID NO: 206484 - protein, 11 aa, Borrelia Burgdorferi
TSKAINFIQTT

SEQ ID NO: 206485 - protein, 11 aa, Borrelia Burgdorferi
SKAINFIQTTE

SEQ ID NO: 206486 - protein, 11 aa, Borrelia Burgdorferi
KAINFIQTTEG

SEQ ID NO: 206487 - protein, 11 aa, Borrelia Burgdorferi
AINFIQTTEGN

SEQ ID NO: 206488 - protein, 11 aa, Borrelia Burgdorferi
INFIQTTEGNL

SEQ ID NO: 206489 - protein, 11 aa, Borrelia Burgdorferi
NFIQTTEGNLN

SEQ ID NO: 206490 - protein, 11 aa, Borrelia Burgdorferi
FIQTTEGNLNE

SEQ ID NO: 206491 - protein, 11 aa, Borrelia Burgdorferi
IQTTEGNLNEV

SEQ ID NO: 206492 - protein, 11 aa, Borrelia Burgdorferi
QTTEGNLNEVE

SEQ ID NO: 206493 - protein, 11 aa, Borrelia Burgdorferi
TTEGNLNEVEK

SEQ ID NO: 206494 - protein, 11 aa, Borrelia Burgdorferi
TEGNLNEVEKV

SEQ ID NO: 206495 - protein, 11 aa, Borrelia Burgdorferi
EGNLNEVEKVL

SEQ ID NO: 206496 - protein, 11 aa, Borrelia Burgdorferi
GNLNEVEKVLV

SEQ ID NO: 206497 - protein, 11 aa, Borrelia Burgdorferi
NLNEVEKVLVR

SEQ ID NO: 206498 - protein, 11 aa, Borrelia Burgdorferi
LNEVEKVLVRM

SEQ ID NO: 206499 - protein, 11 aa, Borrelia Burgdorferi
NEVEKVLVRMK

SEQ ID NO: 206500 - protein, 11 aa, Borrelia Burgdorferi
EVEKVLVRMKE

SEQ ID NO: 206501 - protein, 11 aa, Borrelia Burgdorferi
VEKVLVRMKEL

SEQ ID NO: 206502 - protein, 11 aa, Borrelia Burgdorferi
EKVLVRMKELA

SEQ ID NO: 206503 - protein, 11 aa, Borrelia Burgdorferi
KVLVRMKELAV

SEQ ID NO: 206504 - protein, 11 aa, Borrelia Burgdorferi
VLVRMKELAVQ

SEQ ID NO: 206505 - protein, 11 aa, Borrelia Burgdorferi
LVRMKELAVQS

SEQ ID NO: 206506 - protein, 11 aa, Borrelia Burgdorferi
VRMKELAVQSG

SEQ ID NO: 206507 - protein, 11 aa, Borrelia Burgdorferi
RMKELAVQSGN

SEQ ID NO: 206508 - protein, 11 aa, Borrelia Burgdorferi
MKELAVQSGNG

SEQ ID NO: 206509 - protein, 11 aa, Borrelia Burgdorferi
KELAVQSGNGT

SEQ ID NO: 206510 - protein, 11 aa, Borrelia Burgdorferi
ELAVQSGNGTY

SEQ ID NO: 206511 - protein, 11 aa, Borrelia Burgdorferi
LAVQSGNGTYS

SEQ ID NO: 206512 - protein, 11 aa, Borrelia Burgdorferi
AVQSGNGTYSD

SEQ ID NO: 206513 - protein, 11 aa, Borrelia Burgdorferi
VQSGNGTYSDA

SEQ ID NO: 206514 - protein, 11 aa, Borrelia Burgdorferi
QSGNGTYSDAD

SEQ ID NO: 206515 - protein, 11 aa, Borrelia Burgdorferi
SGNGTYSDADR

SEQ ID NO: 206516 - protein, 11 aa, Borrelia Burgdorferi
GNGTYSDADRG

SEQ ID NO: 206517 - protein, 11 aa, Borrelia Burgdorferi
NGTYSDADRGS

SEQ ID NO: 206518 - protein, 11 aa, Borrelia Burgdorferi
GTYSDADRGSI

SEQ ID NO: 206519 - protein, 11 aa, Borrelia Burgdorferi
TYSDADRGSIQ

SEQ ID NO: 206520 - protein, 11 aa, Borrelia Burgdorferi
YSDADRGSIQI

SEQ ID NO: 206521 - protein, 11 aa, Borrelia Burgdorferi
SDADRGSIQIE

SEQ ID NO: 206522 - protein, 11 aa, Borrelia Burgdorferi
DADRGSIQIEI

SEQ ID NO: 206523 - protein, 11 aa, Borrelia Burgdorferi
ADRGSIQIEIE

SEQ ID NO: 206524 - protein, 11 aa, Borrelia Burgdorferi
DRGSIQIEIEQ

SEQ ID NO: 206525 - protein, 11 aa, Borrelia Burgdorferi
RGSIQIEIEQL

SEQ ID NO: 206526 - protein, 11 aa, Borrelia Burgdorferi
GSIQIEIEQLT

SEQ ID NO: 206527 - protein, 11 aa, Borrelia Burgdorferi
SIQIEIEQLTD

SEQ ID NO: 206528 - protein, 11 aa, Borrelia Burgdorferi
IQIEIEQLTDE

SEQ ID NO: 206529 - protein, 11 aa, Borrelia Burgdorferi
QIEIEQLTDEI

SEQ ID NO: 206530 - protein, 11 aa, Borrelia Burgdorferi
IEIEQLTDEIN

SEQ ID NO: 206531 - protein, 11 aa, Borrelia Burgdorferi
EIEQLTDEINR

SEQ ID NO: 206532 - protein, 11 aa, Borrelia Burgdorferi
IEQLTDEINRI

SEQ ID NO: 206533 - protein, 11 aa, Borrelia Burgdorferi
EQLTDEINRIA

SEQ ID NO: 206534 - protein, 11 aa, Borrelia Burgdorferi
QLTDEINRIAD

SEQ ID NO: 206535 - protein, 11 aa, Borrelia Burgdorferi
LTDEINRIADQ

SEQ ID NO: 206536 - protein, 11 aa, Borrelia Burgdorferi
TDEINRIADQA

SEQ ID NO: 206537 - protein, 11 aa, Borrelia Burgdorferi
DEINRIADQAQ

SEQ ID NO: 206538 - protein, 11 aa, Borrelia Burgdorferi
EINRIADQAQY

SEQ ID NO: 206539 - protein, 11 aa, Borrelia Burgdorferi
INRIADQAQYN

SEQ ID NO: 206540 - protein, 11 aa, Borrelia Burgdorferi
NRIADQAQYNQ

SEQ ID NO: 206541 - protein, 11 aa, Borrelia Burgdorferi
RIADQAQYNQM

SEQ ID NO: 206542 - protein, 11 aa, Borrelia Burgdorferi
IADQAQYNQMH

SEQ ID NO: 206543 - protein, 11 aa, Borrelia Burgdorferi
ADQAQYNQMHM

SEQ ID NO: 206544 - protein, 11 aa, Borrelia Burgdorferi
DQAQYNQMHML

SEQ ID NO: 206545 - protein, 11 aa, Borrelia Burgdorferi
QAQYNQMHMLS

SEQ ID NO: 206546 - protein, 11 aa, Borrelia Burgdorferi
AQYNQMHMLSN

SEQ ID NO: 206547 - protein, 11 aa, Borrelia Burgdorferi
QYNQMHMLSNK

SEQ ID NO: 206548 - protein, 11 aa, Borrelia Burgdorferi
YNQMHMLSNKS

SEQ ID NO: 206549 - protein, 11 aa, Borrelia Burgdorferi
NQMHMLSNKSA

SEQ ID NO: 206550 - protein, 11 aa, Borrelia Burgdorferi
QMHMLSNKSAS

SEQ ID NO: 206551 - protein, 11 aa, Borrelia Burgdorferi
MHMLSNKSASQ

SEQ ID NO: 206552 - protein, 11 aa, Borrelia Burgdorferi
HMLSNKSASQN

SEQ ID NO: 206553 - protein, 11 aa, Borrelia Burgdorferi
MLSNKSASQNV

SEQ ID NO: 206554 - protein, 11 aa, Borrelia Burgdorferi
LSNKSASQNVR

SEQ ID NO: 206555 - protein, 11 aa, Borrelia Burgdorferi
SNKSASQNVRT

SEQ ID NO: 206556 - protein, 11 aa, Borrelia Burgdorferi
NKSASQNVRTA

SEQ ID NO: 206557 - protein, 11 aa, Borrelia Burgdorferi
KSASQNVRTAE

SEQ ID NO: 206558 - protein, 11 aa, Borrelia Burgdorferi
SASQNVRTAEE

SEQ ID NO: 206559 - protein, 11 aa, Borrelia Burgdorferi
ASQNVRTAEEL

SEQ ID NO: 206560 - protein, 11 aa, Borrelia Burgdorferi
SQNVRTAEELG

SEQ ID NO: 206561 - protein, 11 aa, Borrelia Burgdorferi
QNVRTAEELGM

SEQ ID NO: 206562 - protein, 11 aa, Borrelia Burgdorferi
NVRTAEELGMQ

SEQ ID NO: 206563 - protein, 11 aa, Borrelia Burgdorferi
VRTAEELGMQP

SEQ ID NO: 206564 - protein, 11 aa, Borrelia Burgdorferi
RTAEELGMQPA

SEQ ID NO: 206565 - protein, 11 aa, Borrelia Burgdorferi
TAEELGMQPAK

SEQ ID NO: 206566 - protein, 11 aa, Borrelia Burgdorferi
AEELGMQPAKI

SEQ ID NO: 206567 - protein, 11 aa, Borrelia Burgdorferi
EELGMQPAKIN

SEQ ID NO: 206568 - protein, 11 aa, Borrelia Burgdorferi
ELGMQPAKINT

SEQ ID NO: 206569 - protein, 11 aa, Borrelia Burgdorferi
LGMQPAKINTP

SEQ ID NO: 206570 - protein, 11 aa, Borrelia Burgdorferi
GMQPAKINTPA

SEQ ID NO: 206571 - protein, 11 aa, Borrelia Burgdorferi
MQPAKINTPAS

SEQ ID NO: 206572 - protein, 11 aa, Borrelia Burgdorferi
QPAKINTPASL

SEQ ID NO: 206573 - protein, 11 aa, Borrelia Burgdorferi
PAKINTPASLS

SEQ ID NO: 206574 - protein, 11 aa, Borrelia Burgdorferi
AKINTPASLSG

SEQ ID NO: 206575 - protein, 11 aa, Borrelia Burgdorferi
KINTPASLSGS

SEQ ID NO: 206576 - protein, 11 aa, Borrelia Burgdorferi
INTPASLSGSQ

SEQ ID NO: 206577 - protein, 11 aa, Borrelia Burgdorferi
NTPASLSGSQA

SEQ ID NO: 206578 - protein, 11 aa, Borrelia Burgdorferi
TPASLSGSQAS

SEQ ID NO: 206579 - protein, 11 aa, Borrelia Burgdorferi
PASLSGSQASW

SEQ ID NO: 206580 - protein, 11 aa, Borrelia Burgdorferi
ASLSGSQASWT

SEQ ID NO: 206581 - protein, 11 aa, Borrelia Burgdorferi
SLSGSQASWTL

SEQ ID NO: 206582 - protein, 11 aa, Borrelia Burgdorferi
LSGSQASWTLR

SEQ ID NO: 206583 - protein, 11 aa, Borrelia Burgdorferi
SGSQASWTLRV

SEQ ID NO: 206584 - protein, 11 aa, Borrelia Burgdorferi
GSQASWTLRVH

SEQ ID NO: 206585 - protein, 11 aa, Borrelia Burgdorferi
SQASWTLRVHV

SEQ ID NO: 206586 - protein, 11 aa, Borrelia Burgdorferi
QASWTLRVHVG

SEQ ID NO: 206587 - protein, 11 aa, Borrelia Burgdorferi
ASWTLRVHVGA

SEQ ID NO: 206588 - protein, 11 aa, Borrelia Burgdorferi
SWTLRVHVGAN

SEQ ID NO: 206589 - protein, 11 aa, Borrelia Burgdorferi
WTLRVHVGANQ

SEQ ID NO: 206590 - protein, 11 aa, Borrelia Burgdorferi
TLRVHVGANQD

SEQ ID NO: 206591 - protein, 11 aa, Borrelia Burgdorferi
LRVHVGANQDE

SEQ ID NO: 206592 - protein, 11 aa, Borrelia Burgdorferi
RVHVGANQDEA

SEQ ID NO: 206593 - protein, 11 aa, Borrelia Burgdorferi
VHVGANQDEAI

SEQ ID NO: 206594 - protein, 11 aa, Borrelia Burgdorferi
HVGANQDEAIA

SEQ ID NO: 206595 - protein, 11 aa, Borrelia Burgdorferi
VGANQDEAIAV

SEQ ID NO: 206596 - protein, 11 aa, Borrelia Burgdorferi
GANQDEAIAVN

SEQ ID NO: 206597 - protein, 11 aa, Borrelia Burgdorferi
ANQDEAIAVNI

SEQ ID NO: 206598 - protein, 11 aa, Borrelia Burgdorferi
NQDEAIAVNIY

SEQ ID NO: 206599 - protein, 11 aa, Borrelia Burgdorferi
QDEAIAVNIYA

SEQ ID NO: 206600 - protein, 11 aa, Borrelia Burgdorferi
DEAIAVNIYAA

SEQ ID NO: 206601 - protein, 11 aa, Borrelia Burgdorferi
EAIAVNIYAAN

SEQ ID NO: 206602 - protein, 11 aa, Borrelia Burgdorferi
AIAVNIYAANV

SEQ ID NO: 206603 - protein, 11 aa, Borrelia Burgdorferi
IAVNIYAANVA

SEQ ID NO: 206604 - protein, 11 aa, Borrelia Burgdorferi
AVNIYAANVAN

SEQ ID NO: 206605 - protein, 11 aa, Borrelia Burgdorferi
VNIYAANVANL

SEQ ID NO: 206606 - protein, 11 aa, Borrelia Burgdorferi
NIYAANVANLF

SEQ ID NO: 206607 - protein, 11 aa, Borrelia Burgdorferi
IYAANVANLFS

SEQ ID NO: 206608 - protein, 11 aa, Borrelia Burgdorferi
YAANVANLFSG

SEQ ID NO: 206609 - protein, 11 aa, Borrelia Burgdorferi
AANVANLFSGE

SEQ ID NO: 206610 - protein, 11 aa, Borrelia Burgdorferi
ANVANLFSGEG

SEQ ID NO: 206611 - protein, 11 aa, Borrelia Burgdorferi
NVANLFSGEGA

SEQ ID NO: 206612 - protein, 11 aa, Borrelia Burgdorferi
VANLFSGEGAQ

SEQ ID NO: 206613 - protein, 11 aa, Borrelia Burgdorferi
ANLFSGEGAQT

SEQ ID NO: 206614 - protein, 11 aa, Borrelia Burgdorferi
NLFSGEGAQTA

SEQ ID NO: 206615 - protein, 11 aa, Borrelia Burgdorferi
LFSGEGAQTAQ

SEQ ID NO: 206616 - protein, 11 aa, Borrelia Burgdorferi
FSGEGAQTAQA

SEQ ID NO: 206617 - protein, 11 aa, Borrelia Burgdorferi
SGEGAQTAQAA

SEQ ID NO: 206618 - protein, 11 aa, Borrelia Burgdorferi
GEGAQTAQAAP

SEQ ID NO: 206619 - protein, 11 aa, Borrelia Burgdorferi
EGAQTAQAAPV

SEQ ID NO: 206620 - protein, 11 aa, Borrelia Burgdorferi
GAQTAQAAPVQ

SEQ ID NO: 206621 - protein, 11 aa, Borrelia Burgdorferi
AQTAQAAPVQE

SEQ ID NO: 206622 - protein, 11 aa, Borrelia Burgdorferi
QTAQAAPVQEG

SEQ ID NO: 206623 - protein, 11 aa, Borrelia Burgdorferi
TAQAAPVQEGV

SEQ ID NO: 206624 - protein, 11 aa, Borrelia Burgdorferi
AQAAPVQEGVQ

SEQ ID NO: 206625 - protein, 11 aa, Borrelia Burgdorferi
QAAPVQEGVQQ

SEQ ID NO: 206626 - protein, 11 aa, Borrelia Burgdorferi
AAPVQEGVQQE

SEQ ID NO: 206627 - protein, 11 aa, Borrelia Burgdorferi
APVQEGVQQEG

SEQ ID NO: 206628 - protein, 11 aa, Borrelia Burgdorferi
PVQEGVQQEGA

SEQ ID NO: 206629 - protein, 11 aa, Borrelia Burgdorferi
VQEGVQQEGAQ

SEQ ID NO: 206630 - protein, 11 aa, Borrelia Burgdorferi
QEGVQQEGAQQ

SEQ ID NO: 206631 - protein, 11 aa, Borrelia Burgdorferi
EGVQQEGAQQP

SEQ ID NO: 206632 - protein, 11 aa, Borrelia Burgdorferi
GVQQEGAQQPA

SEQ ID NO: 206633 - protein, 11 aa, Borrelia Burgdorferi
VQQEGAQQPAP

SEQ ID NO: 206634 - protein, 11 aa, Borrelia Burgdorferi
QQEGAQQPAPA

SEQ ID NO: 206635 - protein, 11 aa, Borrelia Burgdorferi
QEGAQQPAPAT

SEQ ID NO: 206636 - protein, 11 aa, Borrelia Burgdorferi
EGAQQPAPATA

SEQ ID NO: 206637 - protein, 11 aa, Borrelia Burgdorferi
GAQQPAPATAP

SEQ ID NO: 206638 - protein, 11 aa, Borrelia Burgdorferi
AQQPAPATAPS

SEQ ID NO: 206639 - protein, 11 aa, Borrelia Burgdorferi
QQPAPATAPSQ

SEQ ID NO: 206640 - protein, 11 aa, Borrelia Burgdorferi
QPAPATAPSQG

SEQ ID NO: 206641 - protein, 11 aa, Borrelia Burgdorferi
PAPATAPSQGG

SEQ ID NO: 206642 - protein, 11 aa, Borrelia Burgdorferi
APATAPSQGGV

SEQ ID NO: 206643 - protein, 11 aa, Borrelia Burgdorferi
PATAPSQGGVN

SEQ ID NO: 206644 - protein, 11 aa, Borrelia Burgdorferi
ATAPSQGGVNS

SEQ ID NO: 206645 - protein, 11 aa, Borrelia Burgdorferi
TAPSQGGVNSP

SEQ ID NO: 206646 - protein, 11 aa, Borrelia Burgdorferi
APSQGGVNSPV

SEQ ID NO: 206647 - protein, 11 aa, Borrelia Burgdorferi
PSQGGVNSPVN

SEQ ID NO: 206648 - protein, 11 aa, Borrelia Burgdorferi
SQGGVNSPVNV

SEQ ID NO: 206649 - protein, 11 aa, Borrelia Burgdorferi
QGGVNSPVNVT

SEQ ID NO: 206650 - protein, 11 aa, Borrelia Burgdorferi
GGVNSPVNVTT

SEQ ID NO: 206651 - protein, 11 aa, Borrelia Burgdorferi
GVNSPVNVTTT

SEQ ID NO: 206652 - protein, 11 aa, Borrelia Burgdorferi
VNSPVNVTTTV

SEQ ID NO: 206653 - protein, 11 aa, Borrelia Burgdorferi
NSPVNVTTTVD

SEQ ID NO: 206654 - protein, 11 aa, Borrelia Burgdorferi
SPVNVTTTVDA

SEQ ID NO: 206655 - protein, 11 aa, Borrelia Burgdorferi
PVNVTTTVDAN

SEQ ID NO: 206656 - protein, 11 aa, Borrelia Burgdorferi
VNVTTTVDANT

SEQ ID NO: 206657 - protein, 11 aa, Borrelia Burgdorferi
NVTTTVDANTS

SEQ ID NO: 206658 - protein, 11 aa, Borrelia Burgdorferi
VTTTVDANTSL

SEQ ID NO: 206659 - protein, 11 aa, Borrelia Burgdorferi
TTTVDANTSLA

SEQ ID NO: 206660 - protein, 11 aa, Borrelia Burgdorferi
TTVDANTSLAK

SEQ ID NO: 206661 - protein, 11 aa, Borrelia Burgdorferi
TVDANTSLAKI

SEQ ID NO: 206662 - protein, 11 aa, Borrelia Burgdorferi
VDANTSLAKIE

SEQ ID NO: 206663 - protein, 11 aa, Borrelia Burgdorferi
DANTSLAKIEN

SEQ ID NO: 206664 - protein, 11 aa, Borrelia Burgdorferi
ANTSLAKIENA

SEQ ID NO: 206665 - protein, 11 aa, Borrelia Burgdorferi
NTSLAKIENAI

SEQ ID NO: 206666 - protein, 11 aa, Borrelia Burgdorferi
TSLAKIENAIR

SEQ ID NO: 206667 - protein, 11 aa, Borrelia Burgdorferi
SLAKIENAIRM

SEQ ID NO: 206668 - protein, 11 aa, Borrelia Burgdorferi
LAKIENAIRMI

SEQ ID NO: 206669 - protein, 11 aa, Borrelia Burgdorferi
AKIENAIRMIS

SEQ ID NO: 206670 - protein, 11 aa, Borrelia Burgdorferi
KIENAIRMISD

SEQ ID NO: 206671 - protein, 11 aa, Borrelia Burgdorferi
IENAIRMISDQ

SEQ ID NO: 206672 - protein, 11 aa, Borrelia Burgdorferi
ENAIRMISDQR

SEQ ID NO: 206673 - protein, 11 aa, Borrelia Burgdorferi
NAIRMISDQRA

SEQ ID NO: 206674 - protein, 11 aa, Borrelia Burgdorferi
AIRMISDQRAN

SEQ ID NO: 206675 - protein, 11 aa, Borrelia Burgdorferi
IRMISDQRANL

SEQ ID NO: 206676 - protein, 11 aa, Borrelia Burgdorferi
RMISDQRANLG

SEQ ID NO: 206677 - protein, 11 aa, Borrelia Burgdorferi
MISDQRANLGA

SEQ ID NO: 206678 - protein, 11 aa, Borrelia Burgdorferi
ISDQRANLGAF

SEQ ID NO: 206679 - protein, 11 aa, Borrelia Burgdorferi
SDQRANLGAFQ

SEQ ID NO: 206680 - protein, 11 aa, Borrelia Burgdorferi
DQRANLGAFQN

SEQ ID NO: 206681 - protein, 11 aa, Borrelia Burgdorferi
QRANLGAFQNR

SEQ ID NO: 206682 - protein, 11 aa, Borrelia Burgdorferi
RANLGAFQNRL

SEQ ID NO: 206683 - protein, 11 aa, Borrelia Burgdorferi
ANLGAFQNRLE

SEQ ID NO: 206684 - protein, 11 aa, Borrelia Burgdorferi
NLGAFQNRLES

SEQ ID NO: 206685 - protein, 11 aa, Borrelia Burgdorferi
LGAFQNRLESI

SEQ ID NO: 206686 - protein, 11 aa, Borrelia Burgdorferi
GAFQNRLESIK

SEQ ID NO: 206687 - protein, 11 aa, Borrelia Burgdorferi
AFQNRLESIKN

SEQ ID NO: 206688 - protein, 11 aa, Borrelia Burgdorferi
FQNRLESIKNS

SEQ ID NO: 206689 - protein, 11 aa, Borrelia Burgdorferi
QNRLESIKNST

SEQ ID NO: 206690 - protein, 11 aa, Borrelia Burgdorferi
NRLESIKNSTE

SEQ ID NO: 206691 - protein, 11 aa, Borrelia Burgdorferi
RLESIKNSTEY

SEQ ID NO: 206692 - protein, 11 aa, Borrelia Burgdorferi
LESIKNSTEYA

SEQ ID NO: 206693 - protein, 11 aa, Borrelia Burgdorferi
ESIKNSTEYAI

SEQ ID NO: 206694 - protein, 11 aa, Borrelia Burgdorferi
SIKNSTEYAIE

SEQ ID NO: 206695 - protein, 11 aa, Borrelia Burgdorferi
IKNSTEYAIEN

SEQ ID NO: 206696 - protein, 11 aa, Borrelia Burgdorferi
KNSTEYAIENL

SEQ ID NO: 206697 - protein, 11 aa, Borrelia Burgdorferi
NSTEYAIENLK

SEQ ID NO: 206698 - protein, 11 aa, Borrelia Burgdorferi
STEYAIENLKA

SEQ ID NO: 206699 - protein, 11 aa, Borrelia Burgdorferi
TEYAIENLKAS

SEQ ID NO: 206700 - protein, 11 aa, Borrelia Burgdorferi
EYAIENLKASY

SEQ ID NO: 206701 - protein, 11 aa, Borrelia Burgdorferi
YAIENLKASYA

SEQ ID NO: 206702 - protein, 11 aa, Borrelia Burgdorferi
AIENLKASYAQ

SEQ ID NO: 206703 - protein, 11 aa, Borrelia Burgdorferi
IENLKASYAQI

SEQ ID NO: 206704 - protein, 11 aa, Borrelia Burgdorferi
ENLKASYAQIK

SEQ ID NO: 206705 - protein, 11 aa, Borrelia Burgdorferi
NLKASYAQIKD

SEQ ID NO: 206706 - protein, 11 aa, Borrelia Burgdorferi
LKASYAQIKDA

SEQ ID NO: 206707 - protein, 11 aa, Borrelia Burgdorferi
KASYAQIKDAT

SEQ ID NO: 206708 - protein, 11 aa, Borrelia Burgdorferi
ASYAQIKDATM

SEQ ID NO: 206709 - protein, 11 aa, Borrelia Burgdorferi
SYAQIKDATMT

SEQ ID NO: 206710 - protein, 11 aa, Borrelia Burgdorferi
YAQIKDATMTD

SEQ ID NO: 206711 - protein, 11 aa, Borrelia Burgdorferi
AQIKDATMTDE

SEQ ID NO: 206712 - protein, 11 aa, Borrelia Burgdorferi
QIKDATMTDEV

SEQ ID NO: 206713 - protein, 11 aa, Borrelia Burgdorferi
IKDATMTDEVV

SEQ ID NO: 206714 - protein, 11 aa, Borrelia Burgdorferi
KDATMTDEVVA

SEQ ID NO: 206715 - protein, 11 aa, Borrelia Burgdorferi
DATMTDEVVAA

SEQ ID NO: 206716 - protein, 11 aa, Borrelia Burgdorferi
ATMTDEVVAAT

SEQ ID NO: 206717 - protein, 11 aa, Borrelia Burgdorferi
TMTDEVVAATT

SEQ ID NO: 206718 - protein, 11 aa, Borrelia Burgdorferi
MTDEVVAATTN

SEQ ID NO: 206719 - protein, 11 aa, Borrelia Burgdorferi
TDEVVAATTNS

SEQ ID NO: 206720 - protein, 11 aa, Borrelia Burgdorferi
DEVVAATTNSI

SEQ ID NO: 206721 - protein, 11 aa, Borrelia Burgdorferi
EVVAATTNSIL

SEQ ID NO: 206722 - protein, 11 aa, Borrelia Burgdorferi
VVAATTNSILT

SEQ ID NO: 206723 - protein, 11 aa, Borrelia Burgdorferi
VAATTNSILTQ

SEQ ID NO: 206724 - protein, 11 aa, Borrelia Burgdorferi
AATTNSILTQS

SEQ ID NO: 206725 - protein, 11 aa, Borrelia Burgdorferi
ATTNSILTQSA

SEQ ID NO: 206726 - protein, 11 aa, Borrelia Burgdorferi
TTNSILTQSAM

SEQ ID NO: 206727 - protein, 11 aa, Borrelia Burgdorferi
TNSILTQSAMA

SEQ ID NO: 206728 - protein, 11 aa, Borrelia Burgdorferi
NSILTQSAMAM

SEQ ID NO: 206729 - protein, 11 aa, Borrelia Burgdorferi
SILTQSAMAMI

SEQ ID NO: 206730 - protein, 11 aa, Borrelia Burgdorferi
ILTQSAMAMIA

SEQ ID NO: 206731 - protein, 11 aa, Borrelia Burgdorferi
LTQSAMAMIAQ

SEQ ID NO: 206732 - protein, 11 aa, Borrelia Burgdorferi
TQSAMAMIAQA

SEQ ID NO: 206733 - protein, 11 aa, Borrelia Burgdorferi
QSAMAMIAQAN

SEQ ID NO: 206734 - protein, 11 aa, Borrelia Burgdorferi
SAMAMIAQANQ

SEQ ID NO: 206735 - protein, 11 aa, Borrelia Burgdorferi
AMAMIAQANQV

SEQ ID NO: 206736 - protein, 11 aa, Borrelia Burgdorferi
MAMIAQANQVP

SEQ ID NO: 206737 - protein, 11 aa, Borrelia Burgdorferi
AMIAQANQVPQ

SEQ ID NO: 206738 - protein, 11 aa, Borrelia Burgdorferi
MIAQANQVPQY

SEQ ID NO: 206739 - protein, 11 aa, Borrelia Burgdorferi
IAQANQVPQYV

SEQ ID NO: 206740 - protein, 11 aa, Borrelia Burgdorferi
AQANQVPQYVL

SEQ ID NO: 206741 - protein, 11 aa, Borrelia Burgdorferi
QANQVPQYVLS

SEQ ID NO: 206742 - protein, 11 aa, Borrelia Burgdorferi
ANQVPQYVLSL

SEQ ID NO: 206743 - protein, 11 aa, Borrelia Burgdorferi
NQVPQYVLSLL

SEQ ID NO: 206744 - protein, 11 aa, Borrelia Burgdorferi
QVPQYVLSLLR

SEQ ID NO: 206745 - protein, 13 aa, Borrelia Burgdorferi
MIINHNTSAINAS

SEQ ID NO: 206746 - protein, 13 aa, Borrelia Burgdorferi
IINHNTSAINASR

SEQ ID NO: 206747 - protein, 13 aa, Borrelia Burgdorferi
INHNTSAINASRN

SEQ ID NO: 206748 - protein, 13 aa, Borrelia Burgdorferi
NHNTSAINASRNN

SEQ ID NO: 206749 - protein, 13 aa, Borrelia Burgdorferi
HNTSAINASRNNG

SEQ ID NO: 206750 - protein, 13 aa, Borrelia Burgdorferi
NTSAINASRNNGI

SEQ ID NO: 206751 - protein, 13 aa, Borrelia Burgdorferi
TSAINASRNNGIN

SEQ ID NO: 206752 - protein, 13 aa, Borrelia Burgdorferi
SAINASRNNGINA

SEQ ID NO: 206753 - protein, 13 aa, Borrelia Burgdorferi
AINASRNNGINAA

SEQ ID NO: 206754 - protein, 13 aa, Borrelia Burgdorferi
INASRNNGINAAN

SEQ ID NO: 206755 - protein, 13 aa, Borrelia Burgdorferi
NASRNNGINAANL

SEQ ID NO: 206756 - protein, 13 aa, Borrelia Burgdorferi
ASRNNGINAANLS

SEQ ID NO: 206757 - protein, 13 aa, Borrelia Burgdorferi
SRNNGINAANLSK

SEQ ID NO: 206758 - protein, 13 aa, Borrelia Burgdorferi
RNNGINAANLSKT

SEQ ID NO: 206759 - protein, 13 aa, Borrelia Burgdorferi
NNGINAANLSKTQ

SEQ ID NO: 206760 - protein, 13 aa, Borrelia Burgdorferi
NGINAANLSKTQE

SEQ ID NO: 206761 - protein, 13 aa, Borrelia Burgdorferi
GINAANLSKTQEK

SEQ ID NO: 206762 - protein, 13 aa, Borrelia Burgdorferi
INAANLSKTQEKL

SEQ ID NO: 206763 - protein, 13 aa, Borrelia Burgdorferi
NAANLSKTQEKLS

SEQ ID NO: 206764 - protein, 13 aa, Borrelia Burgdorferi
AANLSKTQEKLSS

SEQ ID NO: 206765 - protein, 13 aa, Borrelia Burgdorferi
ANLSKTQEKLSSG

SEQ ID NO: 206766 - protein, 13 aa, Borrelia Burgdorferi
NLSKTQEKLSSGY

SEQ ID NO: 206767 - protein, 13 aa, Borrelia Burgdorferi
LSKTQEKLSSGYR

SEQ ID NO: 206768 - protein, 13 aa, Borrelia Burgdorferi
SKTQEKLSSGYRI

SEQ ID NO: 206769 - protein, 13 aa, Borrelia Burgdorferi
KTQEKLSSGYRIN

SEQ ID NO: 206770 - protein, 13 aa, Borrelia Burgdorferi
TQEKLSSGYRINR

SEQ ID NO: 206771 - protein, 13 aa, Borrelia Burgdorferi
QEKLSSGYRINRA

SEQ ID NO: 206772 - protein, 13 aa, Borrelia Burgdorferi
EKLSSGYRINRAS

SEQ ID NO: 206773 - protein, 13 aa, Borrelia Burgdorferi
KLSSGYRINRASD

SEQ ID NO: 206774 - protein, 13 aa, Borrelia Burgdorferi
LSSGYRINRASDD

SEQ ID NO: 206775 - protein, 13 aa, Borrelia Burgdorferi
SSGYRINRASDDA

SEQ ID NO: 206776 - protein, 13 aa, Borrelia Burgdorferi
SGYRINRASDDAA

SEQ ID NO: 206777 - protein, 13 aa, Borrelia Burgdorferi
GYRINRASDDAAG

SEQ ID NO: 206778 - protein, 13 aa, Borrelia Burgdorferi
YRINRASDDAAGM

SEQ ID NO: 206779 - protein, 13 aa, Borrelia Burgdorferi
RINRASDDAAGMG

SEQ ID NO: 206780 - protein, 13 aa, Borrelia Burgdorferi
INRASDDAAGMGV

SEQ ID NO: 206781 - protein, 13 aa, Borrelia Burgdorferi
NRASDDAAGMGVS

SEQ ID NO: 206782 - protein, 13 aa, Borrelia Burgdorferi
RASDDAAGMGVSG

SEQ ID NO: 206783 - protein, 13 aa, Borrelia Burgdorferi
ASDDAAGMGVSGK

SEQ ID NO: 206784 - protein, 13 aa, Borrelia Burgdorferi
SDDAAGMGVSGKI

SEQ ID NO: 206785 - protein, 13 aa, Borrelia Burgdorferi
DDAAGMGVSGKIN

SEQ ID NO: 206786 - protein, 13 aa, Borrelia Burgdorferi
DAAGMGVSGKINA

SEQ ID NO: 206787 - protein, 13 aa, Borrelia Burgdorferi
AAGMGVSGKINAQ

SEQ ID NO: 206788 - protein, 13 aa, Borrelia Burgdorferi
AGMGVSGKINAQI

SEQ ID NO: 206789 - protein, 13 aa, Borrelia Burgdorferi
GMGVSGKINAQIR

SEQ ID NO: 206790 - protein, 13 aa, Borrelia Burgdorferi
MGVSGKINAQIRG

SEQ ID NO: 206791 - protein, 13 aa, Borrelia Burgdorferi
GVSGKINAQIRGL

SEQ ID NO: 206792 - protein, 13 aa, Borrelia Burgdorferi
VSGKINAQIRGLS

SEQ ID NO: 206793 - protein, 13 aa, Borrelia Burgdorferi
SGKINAQIRGLSQ

SEQ ID NO: 206794 - protein, 13 aa, Borrelia Burgdorferi
GKINAQIRGLSQA

SEQ ID NO: 206795 - protein, 13 aa, Borrelia Burgdorferi
KINAQIRGLSQAS

SEQ ID NO: 206796 - protein, 13 aa, Borrelia Burgdorferi
INAQIRGLSQASR

SEQ ID NO: 206797 - protein, 13 aa, Borrelia Burgdorferi
NAQIRGLSQASRN

SEQ ID NO: 206798 - protein, 13 aa, Borrelia Burgdorferi
AQIRGLSQASRNT

SEQ ID NO: 206799 - protein, 13 aa, Borrelia Burgdorferi
QIRGLSQASRNTS

SEQ ID NO: 206800 - protein, 13 aa, Borrelia Burgdorferi
IRGLSQASRNTSK

SEQ ID NO: 206801 - protein, 13 aa, Borrelia Burgdorferi
RGLSQASRNTSKA

SEQ ID NO: 206802 - protein, 13 aa, Borrelia Burgdorferi
GLSQASRNTSKAI

SEQ ID NO: 206803 - protein, 13 aa, Borrelia Burgdorferi
LSQASRNTSKAIN

SEQ ID NO: 206804 - protein, 13 aa, Borrelia Burgdorferi
SQASRNTSKAINF

SEQ ID NO: 206805 - protein, 13 aa, Borrelia Burgdorferi
QASRNTSKAINFI

SEQ ID NO: 206806 - protein, 13 aa, Borrelia Burgdorferi
ASRNTSKAINFIQ

SEQ ID NO: 206807 - protein, 13 aa, Borrelia Burgdorferi
SRNTSKAINFIQT

SEQ ID NO: 206808 - protein, 13 aa, Borrelia Burgdorferi
RNTSKAINFIQTT

SEQ ID NO: 206809 - protein, 13 aa, Borrelia Burgdorferi
NTSKAINFIQTTE

SEQ ID NO: 206810 - protein, 13 aa, Borrelia Burgdorferi
TSKAINFIQTTEG

SEQ ID NO: 206811 - protein, 13 aa, Borrelia Burgdorferi
SKAINFIQTTEGN

SEQ ID NO: 206812 - protein, 13 aa, Borrelia Burgdorferi
KAINFIQTTEGNL

SEQ ID NO: 206813 - protein, 13 aa, Borrelia Burgdorferi
AINFIQTTEGNLN

SEQ ID NO: 206814 - protein, 13 aa, Borrelia Burgdorferi
INFIQTTEGNLNE

SEQ ID NO: 206815 - protein, 13 aa, Borrelia Burgdorferi
NFIQTTEGNLNEV

SEQ ID NO: 206816 - protein, 13 aa, Borrelia Burgdorferi
FIQTTEGNLNEVE

SEQ ID NO: 206817 - protein, 13 aa, Borrelia Burgdorferi
IQTTEGNLNEVEK

SEQ ID NO: 206818 - protein, 13 aa, Borrelia Burgdorferi
QTTEGNLNEVEKV

SEQ ID NO: 206819 - protein, 13 aa, Borrelia Burgdorferi
TTEGNLNEVEKVL

SEQ ID NO: 206820 - protein, 13 aa, Borrelia Burgdorferi
TEGNLNEVEKVLV

SEQ ID NO: 206821 - protein, 13 aa, Borrelia Burgdorferi
EGNLNEVEKVLVR

SEQ ID NO: 206822 - protein, 13 aa, Borrelia Burgdorferi
GNLNEVEKVLVRM

SEQ ID NO: 206823 - protein, 13 aa, Borrelia Burgdorferi
NLNEVEKVLVRMK

SEQ ID NO: 206824 - protein, 13 aa, Borrelia Burgdorferi
LNEVEKVLVRMKE

SEQ ID NO: 206825 - protein, 13 aa, Borrelia Burgdorferi
NEVEKVLVRMKEL

SEQ ID NO: 206826 - protein, 13 aa, Borrelia Burgdorferi
EVEKVLVRMKELA

SEQ ID NO: 206827 - protein, 13 aa, Borrelia Burgdorferi
VEKVLVRMKELAV

SEQ ID NO: 206828 - protein, 13 aa, Borrelia Burgdorferi
EKVLVRMKELAVQ

SEQ ID NO: 206829 - protein, 13 aa, Borrelia Burgdorferi
KVLVRMKELAVQS

SEQ ID NO: 206830 - protein, 13 aa, Borrelia Burgdorferi
VLVRMKELAVQSG

SEQ ID NO: 206831 - protein, 13 aa, Borrelia Burgdorferi
LVRMKELAVQSGN

SEQ ID NO: 206832 - protein, 13 aa, Borrelia Burgdorferi
VRMKELAVQSGNG

SEQ ID NO: 206833 - protein, 13 aa, Borrelia Burgdorferi
RMKELAVQSGNGT

SEQ ID NO: 206834 - protein, 13 aa, Borrelia Burgdorferi
MKELAVQSGNGTY

SEQ ID NO: 206835 - protein, 13 aa, Borrelia Burgdorferi
KELAVQSGNGTYS

SEQ ID NO: 206836 - protein, 13 aa, Borrelia Burgdorferi
ELAVQSGNGTYSD

SEQ ID NO: 206837 - protein, 13 aa, Borrelia Burgdorferi
LAVQSGNGTYSDA

SEQ ID NO: 206838 - protein, 13 aa, Borrelia Burgdorferi
AVQSGNGTYSDAD

SEQ ID NO: 206839 - protein, 13 aa, Borrelia Burgdorferi
VQSGNGTYSDADR

SEQ ID NO: 206840 - protein, 13 aa, Borrelia Burgdorferi
QSGNGTYSDADRG

SEQ ID NO: 206841 - protein, 13 aa, Borrelia Burgdorferi
SGNGTYSDADRGS

SEQ ID NO: 206842 - protein, 13 aa, Borrelia Burgdorferi
GNGTYSDADRGSI

SEQ ID NO: 206843 - protein, 13 aa, Borrelia Burgdorferi
NGTYSDADRGSIQ

SEQ ID NO: 206844 - protein, 13 aa, Borrelia Burgdorferi
GTYSDADRGSIQI

SEQ ID NO: 206845 - protein, 13 aa, Borrelia Burgdorferi
TYSDADRGSIQIE

SEQ ID NO: 206846 - protein, 13 aa, Borrelia Burgdorferi
YSDADRGSIQIEI

SEQ ID NO: 206847 - protein, 13 aa, Borrelia Burgdorferi
SDADRGSIQIEIE

SEQ ID NO: 206848 - protein, 13 aa, Borrelia Burgdorferi
DADRGSIQIEIEQ

SEQ ID NO: 206849 - protein, 13 aa, Borrelia Burgdorferi
ADRGSIQIEIEQL

SEQ ID NO: 206850 - protein, 13 aa, Borrelia Burgdorferi
DRGSIQIEIEQLT

SEQ ID NO: 206851 - protein, 13 aa, Borrelia Burgdorferi
RGSIQIEIEQLTD

SEQ ID NO: 206852 - protein, 13 aa, Borrelia Burgdorferi
GSIQIEIEQLTDE

SEQ ID NO: 206853 - protein, 13 aa, Borrelia Burgdorferi
SIQIEIEQLTDEI

SEQ ID NO: 206854 - protein, 13 aa, Borrelia Burgdorferi
IQIEIEQLTDEIN

SEQ ID NO: 206855 - protein, 13 aa, Borrelia Burgdorferi
QIEIEQLTDEINR

SEQ ID NO: 206856 - protein, 13 aa, Borrelia Burgdorferi
IEIEQLTDEINRI

SEQ ID NO: 206857 - protein, 13 aa, Borrelia Burgdorferi
EIEQLTDEINRIA

SEQ ID NO: 206858 - protein, 13 aa, Borrelia Burgdorferi
IEQLTDEINRIAD

SEQ ID NO: 206859 - protein, 13 aa, Borrelia Burgdorferi
EQLTDEINRIADQ

SEQ ID NO: 206860 - protein, 13 aa, Borrelia Burgdorferi
QLTDEINRIADQA

SEQ ID NO: 206861 - protein, 13 aa, Borrelia Burgdorferi
LTDEINRIADQAQ

SEQ ID NO: 206862 - protein, 13 aa, Borrelia Burgdorferi
TDEINRIADQAQY

SEQ ID NO: 206863 - protein, 13 aa, Borrelia Burgdorferi
DEINRIADQAQYN

SEQ ID NO: 206864 - protein, 13 aa, Borrelia Burgdorferi
EINRIADQAQYNQ

SEQ ID NO: 206865 - protein, 13 aa, Borrelia Burgdorferi
INRIADQAQYNQM

SEQ ID NO: 206866 - protein, 13 aa, Borrelia Burgdorferi
NRIADQAQYNQMH

SEQ ID NO: 206867 - protein, 13 aa, Borrelia Burgdorferi
RIADQAQYNQMHM

SEQ ID NO: 206868 - protein, 13 aa, Borrelia Burgdorferi
IADQAQYNQMHML

SEQ ID NO: 206869 - protein, 13 aa, Borrelia Burgdorferi
ADQAQYNQMHMLS

SEQ ID NO: 206870 - protein, 13 aa, Borrelia Burgdorferi
DQAQYNQMHMLSN

SEQ ID NO: 206871 - protein, 13 aa, Borrelia Burgdorferi
QAQYNQMHMLSNK

SEQ ID NO: 206872 - protein, 13 aa, Borrelia Burgdorferi
AQYNQMHMLSNKS

SEQ ID NO: 206873 - protein, 13 aa, Borrelia Burgdorferi
QYNQMHMLSNKSA

SEQ ID NO: 206874 - protein, 13 aa, Borrelia Burgdorferi
YNQMHMLSNKSAS

SEQ ID NO: 206875 - protein, 13 aa, Borrelia Burgdorferi
NQMHMLSNKSASQ

SEQ ID NO: 206876 - protein, 13 aa, Borrelia Burgdorferi
QMHMLSNKSASQN

SEQ ID NO: 206877 - protein, 13 aa, Borrelia Burgdorferi
MHMLSNKSASQNV

SEQ ID NO: 206878 - protein, 13 aa, Borrelia Burgdorferi
HMLSNKSASQNVR

SEQ ID NO: 206879 - protein, 13 aa, Borrelia Burgdorferi
MLSNKSASQNVRT

SEQ ID NO: 206880 - protein, 13 aa, Borrelia Burgdorferi
LSNKSASQNVRTA

SEQ ID NO: 206881 - protein, 13 aa, Borrelia Burgdorferi
SNKSASQNVRTAE

SEQ ID NO: 206882 - protein, 13 aa, Borrelia Burgdorferi
NKSASQNVRTAEE

SEQ ID NO: 206883 - protein, 13 aa, Borrelia Burgdorferi
KSASQNVRTAEEL

SEQ ID NO: 206884 - protein, 13 aa, Borrelia Burgdorferi
SASQNVRTAEELG

SEQ ID NO: 206885 - protein, 13 aa, Borrelia Burgdorferi
ASQNVRTAEELGM

SEQ ID NO: 206886 - protein, 13 aa, Borrelia Burgdorferi
SQNVRTAEELGMQ

SEQ ID NO: 206887 - protein, 13 aa, Borrelia Burgdorferi
QNVRTAEELGMQP

SEQ ID NO: 206888 - protein, 13 aa, Borrelia Burgdorferi
NVRTAEELGMQPA

SEQ ID NO: 206889 - protein, 13 aa, Borrelia Burgdorferi
VRTAEELGMQPAK

SEQ ID NO: 206890 - protein, 13 aa, Borrelia Burgdorferi
RTAEELGMQPAKI

SEQ ID NO: 206891 - protein, 13 aa, Borrelia Burgdorferi
TAEELGMQPAKIN

SEQ ID NO: 206892 - protein, 13 aa, Borrelia Burgdorferi
AEELGMQPAKINT

SEQ ID NO: 206893 - protein, 13 aa, Borrelia Burgdorferi
EELGMQPAKINTP

SEQ ID NO: 206894 - protein, 13 aa, Borrelia Burgdorferi
ELGMQPAKINTPA

SEQ ID NO: 206895 - protein, 13 aa, Borrelia Burgdorferi
LGMQPAKINTPAS

SEQ ID NO: 206896 - protein, 13 aa, Borrelia Burgdorferi
GMQPAKINTPASL

SEQ ID NO: 206897 - protein, 13 aa, Borrelia Burgdorferi
MQPAKINTPASLS

SEQ ID NO: 206898 - protein, 13 aa, Borrelia Burgdorferi
QPAKINTPASLSG

SEQ ID NO: 206899 - protein, 13 aa, Borrelia Burgdorferi
PAKINTPASLSGS

SEQ ID NO: 206900 - protein, 13 aa, Borrelia Burgdorferi
AKINTPASLSGSQ

SEQ ID NO: 206901 - protein, 13 aa, Borrelia Burgdorferi
KINTPASLSGSQA

SEQ ID NO: 206902 - protein, 13 aa, Borrelia Burgdorferi
INTPASLSGSQAS

SEQ ID NO: 206903 - protein, 13 aa, Borrelia Burgdorferi
NTPASLSGSQASW

SEQ ID NO: 206904 - protein, 13 aa, Borrelia Burgdorferi
TPASLSGSQASWT

SEQ ID NO: 206905 - protein, 13 aa, Borrelia Burgdorferi
PASLSGSQASWTL

SEQ ID NO: 206906 - protein, 13 aa, Borrelia Burgdorferi
ASLSGSQASWTLR

SEQ ID NO: 206907 - protein, 13 aa, Borrelia Burgdorferi
SLSGSQASWTLRV

SEQ ID NO: 206908 - protein, 13 aa, Borrelia Burgdorferi
LSGSQASWTLRVH

SEQ ID NO: 206909 - protein, 13 aa, Borrelia Burgdorferi
SGSQASWTLRVHV

SEQ ID NO: 206910 - protein, 13 aa, Borrelia Burgdorferi
GSQASWTLRVHVG

SEQ ID NO: 206911 - protein, 13 aa, Borrelia Burgdorferi
SQASWTLRVHVGA

SEQ ID NO: 206912 - protein, 13 aa, Borrelia Burgdorferi
QASWTLRVHVGAN

SEQ ID NO: 206913 - protein, 13 aa, Borrelia Burgdorferi
ASWTLRVHVGANQ

SEQ ID NO: 206914 - protein, 13 aa, Borrelia Burgdorferi
SWTLRVHVGANQD

SEQ ID NO: 206915 - protein, 13 aa, Borrelia Burgdorferi
WTLRVHVGANQDE

SEQ ID NO: 206916 - protein, 13 aa, Borrelia Burgdorferi
TLRVHVGANQDEA

SEQ ID NO: 206917 - protein, 13 aa, Borrelia Burgdorferi
LRVHVGANQDEAI

SEQ ID NO: 206918 - protein, 13 aa, Borrelia Burgdorferi
RVHVGANQDEAIA

SEQ ID NO: 206919 - protein, 13 aa, Borrelia Burgdorferi
VHVGANQDEAIAV

SEQ ID NO: 206920 - protein, 13 aa, Borrelia Burgdorferi
HVGANQDEAIAVN

SEQ ID NO: 206921 - protein, 13 aa, Borrelia Burgdorferi
VGANQDEAIAVNI

SEQ ID NO: 206922 - protein, 13 aa, Borrelia Burgdorferi
GANQDEAIAVNIY

SEQ ID NO: 206923 - protein, 13 aa, Borrelia Burgdorferi
ANQDEAIAVNIYA

SEQ ID NO: 206924 - protein, 13 aa, Borrelia Burgdorferi
NQDEAIAVNIYAA

SEQ ID NO: 206925 - protein, 13 aa, Borrelia Burgdorferi
QDEAIAVNIYAAN

SEQ ID NO: 206926 - protein, 13 aa, Borrelia Burgdorferi
DEAIAVNIYAANV

SEQ ID NO: 206927 - protein, 13 aa, Borrelia Burgdorferi
EAIAVNIYAANVA

SEQ ID NO: 206928 - protein, 13 aa, Borrelia Burgdorferi
AIAVNIYAANVAN

SEQ ID NO: 206929 - protein, 13 aa, Borrelia Burgdorferi
IAVNIYAANVANL

SEQ ID NO: 206930 - protein, 13 aa, Borrelia Burgdorferi
AVNIYAANVANLF

SEQ ID NO: 206931 - protein, 13 aa, Borrelia Burgdorferi
VNIYAANVANLFS

SEQ ID NO: 206932 - protein, 13 aa, Borrelia Burgdorferi
NIYAANVANLFSG

SEQ ID NO: 206933 - protein, 13 aa, Borrelia Burgdorferi
IYAANVANLFSGE

SEQ ID NO: 206934 - protein, 13 aa, Borrelia Burgdorferi
YAANVANLFSGEG

SEQ ID NO: 206935 - protein, 13 aa, Borrelia Burgdorferi
AANVANLFSGEGA

SEQ ID NO: 206936 - protein, 13 aa, Borrelia Burgdorferi
ANVANLFSGEGAQ

SEQ ID NO: 206937 - protein, 13 aa, Borrelia Burgdorferi
NVANLFSGEGAQT

SEQ ID NO: 206938 - protein, 13 aa, Borrelia Burgdorferi
VANLFSGEGAQTA

SEQ ID NO: 206939 - protein, 13 aa, Borrelia Burgdorferi
ANLFSGEGAQTAQ

SEQ ID NO: 206940 - protein, 13 aa, Borrelia Burgdorferi
NLFSGEGAQTAQA

SEQ ID NO: 206941 - protein, 13 aa, Borrelia Burgdorferi
LFSGEGAQTAQAA

SEQ ID NO: 206942 - protein, 13 aa, Borrelia Burgdorferi
FSGEGAQTAQAAP

SEQ ID NO: 206943 - protein, 13 aa, Borrelia Burgdorferi
SGEGAQTAQAAPV

SEQ ID NO: 206944 - protein, 13 aa, Borrelia Burgdorferi
GEGAQTAQAAPVQ

SEQ ID NO: 206945 - protein, 13 aa, Borrelia Burgdorferi
EGAQTAQAAPVQE

SEQ ID NO: 206946 - protein, 13 aa, Borrelia Burgdorferi
GAQTAQAAPVQEG

SEQ ID NO: 206947 - protein, 13 aa, Borrelia Burgdorferi
AQTAQAAPVQEGV

SEQ ID NO: 206948 - protein, 13 aa, Borrelia Burgdorferi
QTAQAAPVQEGVQ

SEQ ID NO: 206949 - protein, 13 aa, Borrelia Burgdorferi
TAQAAPVQEGVQQ

SEQ ID NO: 206950 - protein, 13 aa, Borrelia Burgdorferi
AQAAPVQEGVQQE

SEQ ID NO: 206951 - protein, 13 aa, Borrelia Burgdorferi
QAAPVQEGVQQEG

SEQ ID NO: 206952 - protein, 13 aa, Borrelia Burgdorferi
AAPVQEGVQQEGA

SEQ ID NO: 206953 - protein, 13 aa, Borrelia Burgdorferi
APVQEGVQQEGAQ

SEQ ID NO: 206954 - protein, 13 aa, Borrelia Burgdorferi
PVQEGVQQEGAQQ

SEQ ID NO: 206955 - protein, 13 aa, Borrelia Burgdorferi
VQEGVQQEGAQQP

SEQ ID NO: 206956 - protein, 13 aa, Borrelia Burgdorferi
QEGVQQEGAQQPA

SEQ ID NO: 206957 - protein, 13 aa, Borrelia Burgdorferi
EGVQQEGAQQPAP

SEQ ID NO: 206958 - protein, 13 aa, Borrelia Burgdorferi
GVQQEGAQQPAPA

SEQ ID NO: 206959 - protein, 13 aa, Borrelia Burgdorferi
VQQEGAQQPAPAT

SEQ ID NO: 206960 - protein, 13 aa, Borrelia Burgdorferi
QQEGAQQPAPATA

SEQ ID NO: 206961 - protein, 13 aa, Borrelia Burgdorferi
QEGAQQPAPATAP

SEQ ID NO: 206962 - protein, 13 aa, Borrelia Burgdorferi
EGAQQPAPATAPS

SEQ ID NO: 206963 - protein, 13 aa, Borrelia Burgdorferi
GAQQPAPATAPSQ

SEQ ID NO: 206964 - protein, 13 aa, Borrelia Burgdorferi
AQQPAPATAPSQG

SEQ ID NO: 206965 - protein, 13 aa, Borrelia Burgdorferi
QQPAPATAPSQGG

SEQ ID NO: 206966 - protein, 13 aa, Borrelia Burgdorferi
QPAPATAPSQGGV

SEQ ID NO: 206967 - protein, 13 aa, Borrelia Burgdorferi
PAPATAPSQGGVN

SEQ ID NO: 206968 - protein, 13 aa, Borrelia Burgdorferi
APATAPSQGGVNS

SEQ ID NO: 206969 - protein, 13 aa, Borrelia Burgdorferi
PATAPSQGGVNSP

SEQ ID NO: 206970 - protein, 13 aa, Borrelia Burgdorferi
ATAPSQGGVNSPV

SEQ ID NO: 206971 - protein, 13 aa, Borrelia Burgdorferi
TAPSQGGVNSPVN

SEQ ID NO: 206972 - protein, 13 aa, Borrelia Burgdorferi
APSQGGVNSPVNV

SEQ ID NO: 206973 - protein, 13 aa, Borrelia Burgdorferi
PSQGGVNSPVNVT

SEQ ID NO: 206974 - protein, 13 aa, Borrelia Burgdorferi
SQGGVNSPVNVTT

SEQ ID NO: 206975 - protein, 13 aa, Borrelia Burgdorferi
QGGVNSPVNVTTT

SEQ ID NO: 206976 - protein, 13 aa, Borrelia Burgdorferi
GGVNSPVNVTTTV

SEQ ID NO: 206977 - protein, 13 aa, Borrelia Burgdorferi
GVNSPVNVTTTVD

SEQ ID NO: 206978 - protein, 13 aa, Borrelia Burgdorferi
VNSPVNVTTTVDA

SEQ ID NO: 206979 - protein, 13 aa, Borrelia Burgdorferi
NSPVNVTTTVDAN

SEQ ID NO: 206980 - protein, 13 aa, Borrelia Burgdorferi
SPVNVTTTVDANT

SEQ ID NO: 206981 - protein, 13 aa, Borrelia Burgdorferi
PVNVTTTVDANTS

SEQ ID NO: 206982 - protein, 13 aa, Borrelia Burgdorferi
VNVTTTVDANTSL

SEQ ID NO: 206983 - protein, 13 aa, Borrelia Burgdorferi
NVTTTVDANTSLA

SEQ ID NO: 206984 - protein, 13 aa, Borrelia Burgdorferi
VTTTVDANTSLAK

SEQ ID NO: 206985 - protein, 13 aa, Borrelia Burgdorferi
TTTVDANTSLAKI

SEQ ID NO: 206986 - protein, 13 aa, Borrelia Burgdorferi
TTVDANTSLAKIE

SEQ ID NO: 206987 - protein, 13 aa, Borrelia Burgdorferi
TVDANTSLAKIEN

SEQ ID NO: 206988 - protein, 13 aa, Borrelia Burgdorferi
VDANTSLAKIENA

SEQ ID NO: 206989 - protein, 13 aa, Borrelia Burgdorferi
DANTSLAKIENAI

SEQ ID NO: 206990 - protein, 13 aa, Borrelia Burgdorferi
ANTSLAKIENAIR

SEQ ID NO: 206991 - protein, 13 aa, Borrelia Burgdorferi
NTSLAKIENAIRM

SEQ ID NO: 206992 - protein, 13 aa, Borrelia Burgdorferi
TSLAKIENAIRMI

SEQ ID NO: 206993 - protein, 13 aa, Borrelia Burgdorferi
SLAKIENAIRMIS

SEQ ID NO: 206994 - protein, 13 aa, Borrelia Burgdorferi
LAKIENAIRMISD

SEQ ID NO: 206995 - protein, 13 aa, Borrelia Burgdorferi
AKIENAIRMISDQ

SEQ ID NO: 206996 - protein, 13 aa, Borrelia Burgdorferi
KIENAIRMISDQR

SEQ ID NO: 206997 - protein, 13 aa, Borrelia Burgdorferi
IENAIRMISDQRA

SEQ ID NO: 206998 - protein, 13 aa, Borrelia Burgdorferi
ENAIRMISDQRAN

SEQ ID NO: 206999 - protein, 13 aa, Borrelia Burgdorferi
NAIRMISDQRANL

SEQ ID NO: 207000 - protein, 13 aa, Borrelia Burgdorferi
AIRMISDQRANLG

SEQ ID NO: 207001 - protein, 13 aa, Borrelia Burgdorferi
IRMISDQRANLGA

SEQ ID NO: 207002 - protein, 13 aa, Borrelia Burgdorferi
RMISDQRANLGAF

SEQ ID NO: 207003 - protein, 13 aa, Borrelia Burgdorferi
MISDQRANLGAFQ

SEQ ID NO: 207004 - protein, 13 aa, Borrelia Burgdorferi
ISDQRANLGAFQN

SEQ ID NO: 207005 - protein, 13 aa, Borrelia Burgdorferi
SDQRANLGAFQNR

SEQ ID NO: 207006 - protein, 13 aa, Borrelia Burgdorferi
DQRANLGAFQNRL

SEQ ID NO: 207007 - protein, 13 aa, Borrelia Burgdorferi
QRANLGAFQNRLE

SEQ ID NO: 207008 - protein, 13 aa, Borrelia Burgdorferi
RANLGAFQNRLES

SEQ ID NO: 207009 - protein, 13 aa, Borrelia Burgdorferi
ANLGAFQNRLESI

SEQ ID NO: 207010 - protein, 13 aa, Borrelia Burgdorferi
NLGAFQNRLESIK

SEQ ID NO: 207011 - protein, 13 aa, Borrelia Burgdorferi
LGAFQNRLESIKN

SEQ ID NO: 207012 - protein, 13 aa, Borrelia Burgdorferi
GAFQNRLESIKNS

SEQ ID NO: 207013 - protein, 13 aa, Borrelia Burgdorferi
AFQNRLESIKNST

SEQ ID NO: 207014 - protein, 13 aa, Borrelia Burgdorferi
FQNRLESIKNSTE

SEQ ID NO: 207015 - protein, 13 aa, Borrelia Burgdorferi
QNRLESIKNSTEY

SEQ ID NO: 207016 - protein, 13 aa, Borrelia Burgdorferi
NRLESIKNSTEYA

SEQ ID NO: 207017 - protein, 13 aa, Borrelia Burgdorferi
RLESIKNSTEYAI

SEQ ID NO: 207018 - protein, 13 aa, Borrelia Burgdorferi
LESIKNSTEYAIE

SEQ ID NO: 207019 - protein, 13 aa, Borrelia Burgdorferi
ESIKNSTEYAIEN

SEQ ID NO: 207020 - protein, 13 aa, Borrelia Burgdorferi
SIKNSTEYAIENL

SEQ ID NO: 207021 - protein, 13 aa, Borrelia Burgdorferi
IKNSTEYAIENLK

SEQ ID NO: 207022 - protein, 13 aa, Borrelia Burgdorferi
KNSTEYAIENLKA

SEQ ID NO: 207023 - protein, 13 aa, Borrelia Burgdorferi
NSTEYAIENLKAS

SEQ ID NO: 207024 - protein, 13 aa, Borrelia Burgdorferi
STEYAIENLKASY

SEQ ID NO: 207025 - protein, 13 aa, Borrelia Burgdorferi
TEYAIENLKASYA

SEQ ID NO: 207026 - protein, 13 aa, Borrelia Burgdorferi
EYAIENLKASYAQ

SEQ ID NO: 207027 - protein, 13 aa, Borrelia Burgdorferi
YAIENLKASYAQI

SEQ ID NO: 207028 - protein, 13 aa, Borrelia Burgdorferi
AIENLKASYAQIK

SEQ ID NO: 207029 - protein, 13 aa, Borrelia Burgdorferi
IENLKASYAQIKD

SEQ ID NO: 207030 - protein, 13 aa, Borrelia Burgdorferi
ENLKASYAQIKDA

SEQ ID NO: 207031 - protein, 13 aa, Borrelia Burgdorferi
NLKASYAQIKDAT

SEQ ID NO: 207032 - protein, 13 aa, Borrelia Burgdorferi
LKASYAQIKDATM

SEQ ID NO: 207033 - protein, 13 aa, Borrelia Burgdorferi
KASYAQIKDATMT

SEQ ID NO: 207034 - protein, 13 aa, Borrelia Burgdorferi
ASYAQIKDATMTD

SEQ ID NO: 207035 - protein, 13 aa, Borrelia Burgdorferi
SYAQIKDATMTDE

SEQ ID NO: 207036 - protein, 13 aa, Borrelia Burgdorferi
YAQIKDATMTDEV

SEQ ID NO: 207037 - protein, 13 aa, Borrelia Burgdorferi
AQIKDATMTDEVV

SEQ ID NO: 207038 - protein, 13 aa, Borrelia Burgdorferi
QIKDATMTDEVVA

SEQ ID NO: 207039 - protein, 13 aa, Borrelia Burgdorferi
IKDATMTDEVVAA

SEQ ID NO: 207040 - protein, 13 aa, Borrelia Burgdorferi
KDATMTDEVVAAT

SEQ ID NO: 207041 - protein, 13 aa, Borrelia Burgdorferi
DATMTDEVVAATT

SEQ ID NO: 207042 - protein, 13 aa, Borrelia Burgdorferi
ATMTDEVVAATTN

SEQ ID NO: 207043 - protein, 13 aa, Borrelia Burgdorferi
TMTDEVVAATTNS

SEQ ID NO: 207044 - protein, 13 aa, Borrelia Burgdorferi
MTDEVVAATTNSI

SEQ ID NO: 207045 - protein, 13 aa, Borrelia Burgdorferi
TDEVVAATTNSIL

SEQ ID NO: 207046 - protein, 13 aa, Borrelia Burgdorferi
DEVVAATTNSILT

SEQ ID NO: 207047 - protein, 13 aa, Borrelia Burgdorferi
EVVAATTNSILTQ

SEQ ID NO: 207048 - protein, 13 aa, Borrelia Burgdorferi
VVAATTNSILTQS

SEQ ID NO: 207049 - protein, 13 aa, Borrelia Burgdorferi
VAATTNSILTQSA

SEQ ID NO: 207050 - protein, 13 aa, Borrelia Burgdorferi
AATTNSILTQSAM

SEQ ID NO: 207051 - protein, 13 aa, Borrelia Burgdorferi
ATTNSILTQSAMA

SEQ ID NO: 207052 - protein, 13 aa, Borrelia Burgdorferi
TTNSILTQSAMAM

SEQ ID NO: 207053 - protein, 13 aa, Borrelia Burgdorferi
TNSILTQSAMAMI

SEQ ID NO: 207054 - protein, 13 aa, Borrelia Burgdorferi
NSILTQSAMAMIA

SEQ ID NO: 207055 - protein, 13 aa, Borrelia Burgdorferi
SILTQSAMAMIAQ

SEQ ID NO: 207056 - protein, 13 aa, Borrelia Burgdorferi
ILTQSAMAMIAQA

SEQ ID NO: 207057 - protein, 13 aa, Borrelia Burgdorferi
LTQSAMAMIAQAN

SEQ ID NO: 207058 - protein, 13 aa, Borrelia Burgdorferi
TQSAMAMIAQANQ

SEQ ID NO: 207059 - protein, 13 aa, Borrelia Burgdorferi
QSAMAMIAQANQV

SEQ ID NO: 207060 - protein, 13 aa, Borrelia Burgdorferi
SAMAMIAQANQVP

SEQ ID NO: 207061 - protein, 13 aa, Borrelia Burgdorferi
AMAMIAQANQVPQ

SEQ ID NO: 207062 - protein, 13 aa, Borrelia Burgdorferi
MAMIAQANQVPQY

SEQ ID NO: 207063 - protein, 13 aa, Borrelia Burgdorferi
AMIAQANQVPQYV

SEQ ID NO: 207064 - protein, 13 aa, Borrelia Burgdorferi
MIAQANQVPQYVL

SEQ ID NO: 207065 - protein, 13 aa, Borrelia Burgdorferi
IAQANQVPQYVLS

SEQ ID NO: 207066 - protein, 13 aa, Borrelia Burgdorferi
AQANQVPQYVLSL

SEQ ID NO: 207067 - protein, 13 aa, Borrelia Burgdorferi
QANQVPQYVLSLL

SEQ ID NO: 207068 - protein, 13 aa, Borrelia Burgdorferi
ANQVPQYVLSLLR

SEQ ID NO: 207069 - protein, 14 aa, Borrelia Burgdorferi
MIINHNTSAINASR

SEQ ID NO: 207070 - protein, 14 aa, Borrelia Burgdorferi
IINHNTSAINASRN

SEQ ID NO: 207071 - protein, 14 aa, Borrelia Burgdorferi
INHNTSAINASRNN

SEQ ID NO: 207072 - protein, 14 aa, Borrelia Burgdorferi
NHNTSAINASRNNG

SEQ ID NO: 207073 - protein, 14 aa, Borrelia Burgdorferi
HNTSAINASRNNGI

SEQ ID NO: 207074 - protein, 14 aa, Borrelia Burgdorferi
NTSAINASRNNGIN

SEQ ID NO: 207075 - protein, 14 aa, Borrelia Burgdorferi
TSAINASRNNGINA

SEQ ID NO: 207076 - protein, 14 aa, Borrelia Burgdorferi
SAINASRNNGINAA

SEQ ID NO: 207077 - protein, 14 aa, Borrelia Burgdorferi
AINASRNNGINAAN

SEQ ID NO: 207078 - protein, 14 aa, Borrelia Burgdorferi
INASRNNGINAANL

SEQ ID NO: 207079 - protein, 14 aa, Borrelia Burgdorferi
NASRNNGINAANLS

SEQ ID NO: 207080 - protein, 14 aa, Borrelia Burgdorferi
ASRNNGINAANLSK

SEQ ID NO: 207081 - protein, 14 aa, Borrelia Burgdorferi
SRNNGINAANLSKT

SEQ ID NO: 207082 - protein, 14 aa, Borrelia Burgdorferi
RNNGINAANLSKTQ

SEQ ID NO: 207083 - protein, 14 aa, Borrelia Burgdorferi
NNGINAANLSKTQE

SEQ ID NO: 207084 - protein, 14 aa, Borrelia Burgdorferi
NGINAANLSKTQEK

SEQ ID NO: 207085 - protein, 14 aa, Borrelia Burgdorferi
GINAANLSKTQEKL

SEQ ID NO: 207086 - protein, 14 aa, Borrelia Burgdorferi
INAANLSKTQEKLS

SEQ ID NO: 207087 - protein, 14 aa, Borrelia Burgdorferi
NAANLSKTQEKLSS

SEQ ID NO: 207088 - protein, 14 aa, Borrelia Burgdorferi
AANLSKTQEKLSSG

SEQ ID NO: 207089 - protein, 14 aa, Borrelia Burgdorferi
ANLSKTQEKLSSGY

SEQ ID NO: 207090 - protein, 14 aa, Borrelia Burgdorferi
NLSKTQEKLSSGYR

SEQ ID NO: 207091 - protein, 14 aa, Borrelia Burgdorferi
LSKTQEKLSSGYRI

SEQ ID NO: 207092 - protein, 14 aa, Borrelia Burgdorferi
SKTQEKLSSGYRIN

SEQ ID NO: 207093 - protein, 14 aa, Borrelia Burgdorferi
KTQEKLSSGYRINR

SEQ ID NO: 207094 - protein, 14 aa, Borrelia Burgdorferi
TQEKLSSGYRINRA

SEQ ID NO: 207095 - protein, 14 aa, Borrelia Burgdorferi
QEKLSSGYRINRAS

SEQ ID NO: 207096 - protein, 14 aa, Borrelia Burgdorferi
EKLSSGYRINRASD

SEQ ID NO: 207097 - protein, 14 aa, Borrelia Burgdorferi
KLSSGYRINRASDD

SEQ ID NO: 207098 - protein, 14 aa, Borrelia Burgdorferi
LSSGYRINRASDDA

SEQ ID NO: 207099 - protein, 14 aa, Borrelia Burgdorferi
SSGYRINRASDDAA

SEQ ID NO: 207100 - protein, 14 aa, Borrelia Burgdorferi
SGYRINRASDDAAG

SEQ ID NO: 207101 - protein, 14 aa, Borrelia Burgdorferi
GYRINRASDDAAGM

SEQ ID NO: 207102 - protein, 14 aa, Borrelia Burgdorferi
YRINRASDDAAGMG

SEQ ID NO: 207103 - protein, 14 aa, Borrelia Burgdorferi
RINRASDDAAGMGV

SEQ ID NO: 207104 - protein, 14 aa, Borrelia Burgdorferi
INRASDDAAGMGVS

SEQ ID NO: 207105 - protein, 14 aa, Borrelia Burgdorferi
NRASDDAAGMGVSG

SEQ ID NO: 207106 - protein, 14 aa, Borrelia Burgdorferi
RASDDAAGMGVSGK

SEQ ID NO: 207107 - protein, 14 aa, Borrelia Burgdorferi
ASDDAAGMGVSGKI

SEQ ID NO: 207108 - protein, 14 aa, Borrelia Burgdorferi
SDDAAGMGVSGKIN

SEQ ID NO: 207109 - protein, 14 aa, Borrelia Burgdorferi
DDAAGMGVSGKINA

SEQ ID NO: 207110 - protein, 14 aa, Borrelia Burgdorferi
DAAGMGVSGKINAQ

SEQ ID NO: 207111 - protein, 14 aa, Borrelia Burgdorferi
AAGMGVSGKINAQI

SEQ ID NO: 207112 - protein, 14 aa, Borrelia Burgdorferi
AGMGVSGKINAQIR

SEQ ID NO: 207113 - protein, 14 aa, Borrelia Burgdorferi
GMGVSGKINAQIRG

SEQ ID NO: 207114 - protein, 14 aa, Borrelia Burgdorferi
MGVSGKINAQIRGL

SEQ ID NO: 207115 - protein, 14 aa, Borrelia Burgdorferi
GVSGKINAQIRGLS

SEQ ID NO: 207116 - protein, 14 aa, Borrelia Burgdorferi
VSGKINAQIRGLSQ

SEQ ID NO: 207117 - protein, 14 aa, Borrelia Burgdorferi
SGKINAQIRGLSQA

SEQ ID NO: 207118 - protein, 14 aa, Borrelia Burgdorferi
GKINAQIRGLSQAS

SEQ ID NO: 207119 - protein, 14 aa, Borrelia Burgdorferi
KINAQIRGLSQASR

SEQ ID NO: 207120 - protein, 14 aa, Borrelia Burgdorferi
INAQIRGLSQASRN

SEQ ID NO: 207121 - protein, 14 aa, Borrelia Burgdorferi
NAQIRGLSQASRNT

SEQ ID NO: 207122 - protein, 14 aa, Borrelia Burgdorferi
AQIRGLSQASRNTS

SEQ ID NO: 207123 - protein, 14 aa, Borrelia Burgdorferi
QIRGLSQASRNTSK

SEQ ID NO: 207124 - protein, 14 aa, Borrelia Burgdorferi
IRGLSQASRNTSKA

SEQ ID NO: 207125 - protein, 14 aa, Borrelia Burgdorferi
RGLSQASRNTSKAI

SEQ ID NO: 207126 - protein, 14 aa, Borrelia Burgdorferi
GLSQASRNTSKAIN

SEQ ID NO: 207127 - protein, 14 aa, Borrelia Burgdorferi
LSQASRNTSKAINF

SEQ ID NO: 207128 - protein, 14 aa, Borrelia Burgdorferi
SQASRNTSKAINFI

SEQ ID NO: 207129 - protein, 14 aa, Borrelia Burgdorferi
QASRNTSKAINFIQ

SEQ ID NO: 207130 - protein, 14 aa, Borrelia Burgdorferi
ASRNTSKAINFIQT

SEQ ID NO: 207131 - protein, 14 aa, Borrelia Burgdorferi
SRNTSKAINFIQTT

SEQ ID NO: 207132 - protein, 14 aa, Borrelia Burgdorferi
RNTSKAINFIQTTE

SEQ ID NO: 207133 - protein, 14 aa, Borrelia Burgdorferi
NTSKAINFIQTTEG

SEQ ID NO: 207134 - protein, 14 aa, Borrelia Burgdorferi
TSKAINFIQTTEGN

SEQ ID NO: 207135 - protein, 14 aa, Borrelia Burgdorferi
SKAINFIQTTEGNL

SEQ ID NO: 207136 - protein, 14 aa, Borrelia Burgdorferi
KAINFIQTTEGNLN

SEQ ID NO: 207137 - protein, 14 aa, Borrelia Burgdorferi
AINFIQTTEGNLNE

SEQ ID NO: 207138 - protein, 14 aa, Borrelia Burgdorferi
INFIQTTEGNLNEV

SEQ ID NO: 207139 - protein, 14 aa, Borrelia Burgdorferi
NFIQTTEGNLNEVE

SEQ ID NO: 207140 - protein, 14 aa, Borrelia Burgdorferi
FIQTTEGNLNEVEK

SEQ ID NO: 207141 - protein, 14 aa, Borrelia Burgdorferi
IQTTEGNLNEVEKV

SEQ ID NO: 207142 - protein, 14 aa, Borrelia Burgdorferi
QTTEGNLNEVEKVL

SEQ ID NO: 207143 - protein, 14 aa, Borrelia Burgdorferi
TTEGNLNEVEKVLV

SEQ ID NO: 207144 - protein, 14 aa, Borrelia Burgdorferi
TEGNLNEVEKVLVR

SEQ ID NO: 207145 - protein, 14 aa, Borrelia Burgdorferi
EGNLNEVEKVLVRM

SEQ ID NO: 207146 - protein, 14 aa, Borrelia Burgdorferi
GNLNEVEKVLVRMK

SEQ ID NO: 207147 - protein, 14 aa, Borrelia Burgdorferi
NLNEVEKVLVRMKE

SEQ ID NO: 207148 - protein, 14 aa, Borrelia Burgdorferi
LNEVEKVLVRMKEL

SEQ ID NO: 207149 - protein, 14 aa, Borrelia Burgdorferi
NEVEKVLVRMKELA

SEQ ID NO: 207150 - protein, 14 aa, Borrelia Burgdorferi
EVEKVLVRMKELAV

SEQ ID NO: 207151 - protein, 14 aa, Borrelia Burgdorferi
VEKVLVRMKELAVQ

SEQ ID NO: 207152 - protein, 14 aa, Borrelia Burgdorferi
EKVLVRMKELAVQS

SEQ ID NO: 207153 - protein, 14 aa, Borrelia Burgdorferi
KVLVRMKELAVQSG

SEQ ID NO: 207154 - protein, 14 aa, Borrelia Burgdorferi
VLVRMKELAVQSGN

SEQ ID NO: 207155 - protein, 14 aa, Borrelia Burgdorferi
LVRMKELAVQSGNG

SEQ ID NO: 207156 - protein, 14 aa, Borrelia Burgdorferi
VRMKELAVQSGNGT

SEQ ID NO: 207157 - protein, 14 aa, Borrelia Burgdorferi
RMKELAVQSGNGTY

SEQ ID NO: 207158 - protein, 14 aa, Borrelia Burgdorferi
MKELAVQSGNGTYS

SEQ ID NO: 207159 - protein, 14 aa, Borrelia Burgdorferi
KELAVQSGNGTYSD

SEQ ID NO: 207160 - protein, 14 aa, Borrelia Burgdorferi
ELAVQSGNGTYSDA

SEQ ID NO: 207161 - protein, 14 aa, Borrelia Burgdorferi
LAVQSGNGTYSDAD

SEQ ID NO: 207162 - protein, 14 aa, Borrelia Burgdorferi
AVQSGNGTYSDADR

SEQ ID NO: 207163 - protein, 14 aa, Borrelia Burgdorferi
VQSGNGTYSDADRG

SEQ ID NO: 207164 - protein, 14 aa, Borrelia Burgdorferi
QSGNGTYSDADRGS

SEQ ID NO: 207165 - protein, 14 aa, Borrelia Burgdorferi
SGNGTYSDADRGSI

SEQ ID NO: 207166 - protein, 14 aa, Borrelia Burgdorferi
GNGTYSDADRGSIQ

SEQ ID NO: 207167 - protein, 14 aa, Borrelia Burgdorferi
NGTYSDADRGSIQI

SEQ ID NO: 207168 - protein, 14 aa, Borrelia Burgdorferi
GTYSDADRGSIQIE

SEQ ID NO: 207169 - protein, 14 aa, Borrelia Burgdorferi
TYSDADRGSIQIEI

SEQ ID NO: 207170 - protein, 14 aa, Borrelia Burgdorferi
YSDADRGSIQIEIE

SEQ ID NO: 207171 - protein, 14 aa, Borrelia Burgdorferi
SDADRGSIQIEIEQ

SEQ ID NO: 207172 - protein, 14 aa, Borrelia Burgdorferi
DADRGSIQIEIEQL

SEQ ID NO: 207173 - protein, 14 aa, Borrelia Burgdorferi
ADRGSIQIEIEQLT

SEQ ID NO: 207174 - protein, 14 aa, Borrelia Burgdorferi
DRGSIQIEIEQLTD

SEQ ID NO: 207175 - protein, 14 aa, Borrelia Burgdorferi
RGSIQIEIEQLTDE

SEQ ID NO: 207176 - protein, 14 aa, Borrelia Burgdorferi
GSIQIEIEQLTDEI

SEQ ID NO: 207177 - protein, 14 aa, Borrelia Burgdorferi
SIQIEIEQLTDEIN

SEQ ID NO: 207178 - protein, 14 aa, Borrelia Burgdorferi
IQIEIEQLTDEINR

SEQ ID NO: 207179 - protein, 14 aa, Borrelia Burgdorferi
QIEIEQLTDEINRI

SEQ ID NO: 207180 - protein, 14 aa, Borrelia Burgdorferi
IEIEQLTDEINRIA

SEQ ID NO: 207181 - protein, 14 aa, Borrelia Burgdorferi
EIEQLTDEINRIAD

SEQ ID NO: 207182 - protein, 14 aa, Borrelia Burgdorferi
IEQLTDEINRIADQ

SEQ ID NO: 207183 - protein, 14 aa, Borrelia Burgdorferi
EQLTDEINRIADQA

SEQ ID NO: 207184 - protein, 14 aa, Borrelia Burgdorferi
QLTDEINRIADQAQ

SEQ ID NO: 207185 - protein, 14 aa, Borrelia Burgdorferi
LTDEINRIADQAQY

SEQ ID NO: 207186 - protein, 14 aa, Borrelia Burgdorferi
TDEINRIADQAQYN

SEQ ID NO: 207187 - protein, 14 aa, Borrelia Burgdorferi
DEINRIADQAQYNQ

SEQ ID NO: 207188 - protein, 14 aa, Borrelia Burgdorferi
EINRIADQAQYNQM

SEQ ID NO: 207189 - protein, 14 aa, Borrelia Burgdorferi
INRIADQAQYNQMH

SEQ ID NO: 207190 - protein, 14 aa, Borrelia Burgdorferi
NRIADQAQYNQMHM

SEQ ID NO: 207191 - protein, 14 aa, Borrelia Burgdorferi
RIADQAQYNQMHML

SEQ ID NO: 207192 - protein, 14 aa, Borrelia Burgdorferi
IADQAQYNQMHMLS

SEQ ID NO: 207193 - protein, 14 aa, Borrelia Burgdorferi
ADQAQYNQMHMLSN

SEQ ID NO: 207194 - protein, 14 aa, Borrelia Burgdorferi
DQAQYNQMHMLSNK

SEQ ID NO: 207195 - protein, 14 aa, Borrelia Burgdorferi
QAQYNQMHMLSNKS

SEQ ID NO: 207196 - protein, 14 aa, Borrelia Burgdorferi
AQYNQMHMLSNKSA

SEQ ID NO: 207197 - protein, 14 aa, Borrelia Burgdorferi
QYNQMHMLSNKSAS

SEQ ID NO: 207198 - protein, 14 aa, Borrelia Burgdorferi
YNQMHMLSNKSASQ

SEQ ID NO: 207199 - protein, 14 aa, Borrelia Burgdorferi
NQMHMLSNKSASQN

SEQ ID NO: 207200 - protein, 14 aa, Borrelia Burgdorferi
QMHMLSNKSASQNV

SEQ ID NO: 207201 - protein, 14 aa, Borrelia Burgdorferi
MHMLSNKSASQNVR

SEQ ID NO: 207202 - protein, 14 aa, Borrelia Burgdorferi
HMLSNKSASQNVRT

SEQ ID NO: 207203 - protein, 14 aa, Borrelia Burgdorferi
MLSNKSASQNVRTA

SEQ ID NO: 207204 - protein, 14 aa, Borrelia Burgdorferi
LSNKSASQNVRTAE

SEQ ID NO: 207205 - protein, 14 aa, Borrelia Burgdorferi
SNKSASQNVRTAEE

SEQ ID NO: 207206 - protein, 14 aa, Borrelia Burgdorferi
NKSASQNVRTAEEL

SEQ ID NO: 207207 - protein, 14 aa, Borrelia Burgdorferi
KSASQNVRTAEELG

SEQ ID NO: 207208 - protein, 14 aa, Borrelia Burgdorferi
SASQNVRTAEELGM

SEQ ID NO: 207209 - protein, 14 aa, Borrelia Burgdorferi
ASQNVRTAEELGMQ

SEQ ID NO: 207210 - protein, 14 aa, Borrelia Burgdorferi
SQNVRTAEELGMQP

SEQ ID NO: 207211 - protein, 14 aa, Borrelia Burgdorferi
QNVRTAEELGMQPA

SEQ ID NO: 207212 - protein, 14 aa, Borrelia Burgdorferi
NVRTAEELGMQPAK

SEQ ID NO: 207213 - protein, 14 aa, Borrelia Burgdorferi
VRTAEELGMQPAKI

SEQ ID NO: 207214 - protein, 14 aa, Borrelia Burgdorferi
RTAEELGMQPAKIN

SEQ ID NO: 207215 - protein, 14 aa, Borrelia Burgdorferi
TAEELGMQPAKINT

SEQ ID NO: 207216 - protein, 14 aa, Borrelia Burgdorferi
AEELGMQPAKINTP

SEQ ID NO: 207217 - protein, 14 aa, Borrelia Burgdorferi
EELGMQPAKINTPA

SEQ ID NO: 207218 - protein, 14 aa, Borrelia Burgdorferi
ELGMQPAKINTPAS

SEQ ID NO: 207219 - protein, 14 aa, Borrelia Burgdorferi
LGMQPAKINTPASL

SEQ ID NO: 207220 - protein, 14 aa, Borrelia Burgdorferi
GMQPAKINTPASLS

SEQ ID NO: 207221 - protein, 14 aa, Borrelia Burgdorferi
MQPAKINTPASLSG

SEQ ID NO: 207222 - protein, 14 aa, Borrelia Burgdorferi
QPAKINTPASLSGS

SEQ ID NO: 207223 - protein, 14 aa, Borrelia Burgdorferi
PAKINTPASLSGSQ

SEQ ID NO: 207224 - protein, 14 aa, Borrelia Burgdorferi
AKINTPASLSGSQA

SEQ ID NO: 207225 - protein, 14 aa, Borrelia Burgdorferi
KINTPASLSGSQAS

SEQ ID NO: 207226 - protein, 14 aa, Borrelia Burgdorferi
INTPASLSGSQASW

SEQ ID NO: 207227 - protein, 14 aa, Borrelia Burgdorferi
NTPASLSGSQASWT

SEQ ID NO: 207228 - protein, 14 aa, Borrelia Burgdorferi
TPASLSGSQASWTL

SEQ ID NO: 207229 - protein, 14 aa, Borrelia Burgdorferi
PASLSGSQASWTLR

SEQ ID NO: 207230 - protein, 14 aa, Borrelia Burgdorferi
ASLSGSQASWTLRV

SEQ ID NO: 207231 - protein, 14 aa, Borrelia Burgdorferi
SLSGSQASWTLRVH

SEQ ID NO: 207232 - protein, 14 aa, Borrelia Burgdorferi
LSGSQASWTLRVHV

SEQ ID NO: 207233 - protein, 14 aa, Borrelia Burgdorferi
SGSQASWTLRVHVG

SEQ ID NO: 207234 - protein, 14 aa, Borrelia Burgdorferi
GSQASWTLRVHVGA

SEQ ID NO: 207235 - protein, 14 aa, Borrelia Burgdorferi
SQASWTLRVHVGAN

SEQ ID NO: 207236 - protein, 14 aa, Borrelia Burgdorferi
QASWTLRVHVGANQ

SEQ ID NO: 207237 - protein, 14 aa, Borrelia Burgdorferi
ASWTLRVHVGANQD

SEQ ID NO: 207238 - protein, 14 aa, Borrelia Burgdorferi
SWTLRVHVGANQDE

SEQ ID NO: 207239 - protein, 14 aa, Borrelia Burgdorferi
WTLRVHVGANQDEA

SEQ ID NO: 207240 - protein, 14 aa, Borrelia Burgdorferi
TLRVHVGANQDEAI

SEQ ID NO: 207241 - protein, 14 aa, Borrelia Burgdorferi
LRVHVGANQDEAIA

SEQ ID NO: 207242 - protein, 14 aa, Borrelia Burgdorferi
RVHVGANQDEAIAV

SEQ ID NO: 207243 - protein, 14 aa, Borrelia Burgdorferi
VHVGANQDEAIAVN

SEQ ID NO: 207244 - protein, 14 aa, Borrelia Burgdorferi
HVGANQDEAIAVNI

SEQ ID NO: 207245 - protein, 14 aa, Borrelia Burgdorferi
VGANQDEAIAVNIY

SEQ ID NO: 207246 - protein, 14 aa, Borrelia Burgdorferi
GANQDEAIAVNIYA

SEQ ID NO: 207247 - protein, 14 aa, Borrelia Burgdorferi
ANQDEAIAVNIYAA

SEQ ID NO: 207248 - protein, 14 aa, Borrelia Burgdorferi
NQDEAIAVNIYAAN

SEQ ID NO: 207249 - protein, 14 aa, Borrelia Burgdorferi
QDEAIAVNIYAANV

SEQ ID NO: 207250 - protein, 14 aa, Borrelia Burgdorferi
DEAIAVNIYAANVA

SEQ ID NO: 207251 - protein, 14 aa, Borrelia Burgdorferi
EAIAVNIYAANVAN

SEQ ID NO: 207252 - protein, 14 aa, Borrelia Burgdorferi
AIAVNIYAANVANL

SEQ ID NO: 207253 - protein, 14 aa, Borrelia Burgdorferi
IAVNIYAANVANLF

SEQ ID NO: 207254 - protein, 14 aa, Borrelia Burgdorferi
AVNIYAANVANLFS

SEQ ID NO: 207255 - protein, 14 aa, Borrelia Burgdorferi
VNIYAANVANLFSG

SEQ ID NO: 207256 - protein, 14 aa, Borrelia Burgdorferi
NIYAANVANLFSGE

SEQ ID NO: 207257 - protein, 14 aa, Borrelia Burgdorferi
IYAANVANLFSGEG

SEQ ID NO: 207258 - protein, 14 aa, Borrelia Burgdorferi
YAANVANLFSGEGA

SEQ ID NO: 207259 - protein, 14 aa, Borrelia Burgdorferi
AANVANLFSGEGAQ

SEQ ID NO: 207260 - protein, 14 aa, Borrelia Burgdorferi
ANVANLFSGEGAQT

SEQ ID NO: 207261 - protein, 14 aa, Borrelia Burgdorferi
NVANLFSGEGAQTA

SEQ ID NO: 207262 - protein, 14 aa, Borrelia Burgdorferi
VANLFSGEGAQTAQ

SEQ ID NO: 207263 - protein, 14 aa, Borrelia Burgdorferi
ANLFSGEGAQTAQA

SEQ ID NO: 207264 - protein, 14 aa, Borrelia Burgdorferi
NLFSGEGAQTAQAA

SEQ ID NO: 207265 - protein, 14 aa, Borrelia Burgdorferi
LFSGEGAQTAQAAP

SEQ ID NO: 207266 - protein, 14 aa, Borrelia Burgdorferi
FSGEGAQTAQAAPV

SEQ ID NO: 207267 - protein, 14 aa, Borrelia Burgdorferi
SGEGAQTAQAAPVQ

SEQ ID NO: 207268 - protein, 14 aa, Borrelia Burgdorferi
GEGAQTAQAAPVQE

SEQ ID NO: 207269 - protein, 14 aa, Borrelia Burgdorferi
EGAQTAQAAPVQEG

SEQ ID NO: 207270 - protein, 14 aa, Borrelia Burgdorferi
GAQTAQAAPVQEGV

SEQ ID NO: 207271 - protein, 14 aa, Borrelia Burgdorferi
AQTAQAAPVQEGVQ

SEQ ID NO: 207272 - protein, 14 aa, Borrelia Burgdorferi
QTAQAAPVQEGVQQ

SEQ ID NO: 207273 - protein, 14 aa, Borrelia Burgdorferi
TAQAAPVQEGVQQE

SEQ ID NO: 207274 - protein, 14 aa, Borrelia Burgdorferi
AQAAPVQEGVQQEG

SEQ ID NO: 207275 - protein, 14 aa, Borrelia Burgdorferi
QAAPVQEGVQQEGA

SEQ ID NO: 207276 - protein, 14 aa, Borrelia Burgdorferi
AAPVQEGVQQEGAQ

SEQ ID NO: 207277 - protein, 14 aa, Borrelia Burgdorferi
APVQEGVQQEGAQQ

SEQ ID NO: 207278 - protein, 14 aa, Borrelia Burgdorferi
PVQEGVQQEGAQQP

SEQ ID NO: 207279 - protein, 14 aa, Borrelia Burgdorferi
VQEGVQQEGAQQPA

SEQ ID NO: 207280 - protein, 14 aa, Borrelia Burgdorferi
QEGVQQEGAQQPAP

SEQ ID NO: 207281 - protein, 14 aa, Borrelia Burgdorferi
EGVQQEGAQQPAPA

SEQ ID NO: 207282 - protein, 14 aa, Borrelia Burgdorferi
GVQQEGAQQPAPAT

SEQ ID NO: 207283 - protein, 14 aa, Borrelia Burgdorferi
VQQEGAQQPAPATA

SEQ ID NO: 207284 - protein, 14 aa, Borrelia Burgdorferi
QQEGAQQPAPATAP

SEQ ID NO: 207285 - protein, 14 aa, Borrelia Burgdorferi
QEGAQQPAPATAPS

SEQ ID NO: 207286 - protein, 14 aa, Borrelia Burgdorferi
EGAQQPAPATAPSQ

SEQ ID NO: 207287 - protein, 14 aa, Borrelia Burgdorferi
GAQQPAPATAPSQG

SEQ ID NO: 207288 - protein, 14 aa, Borrelia Burgdorferi
AQQPAPATAPSQGG

SEQ ID NO: 207289 - protein, 14 aa, Borrelia Burgdorferi
QQPAPATAPSQGGV

SEQ ID NO: 207290 - protein, 14 aa, Borrelia Burgdorferi
QPAPATAPSQGGVN

SEQ ID NO: 207291 - protein, 14 aa, Borrelia Burgdorferi
PAPATAPSQGGVNS

SEQ ID NO: 207292 - protein, 14 aa, Borrelia Burgdorferi
APATAPSQGGVNSP

SEQ ID NO: 207293 - protein, 14 aa, Borrelia Burgdorferi
PATAPSQGGVNSPV

SEQ ID NO: 207294 - protein, 14 aa, Borrelia Burgdorferi
ATAPSQGGVNSPVN

SEQ ID NO: 207295 - protein, 14 aa, Borrelia Burgdorferi
TAPSQGGVNSPVNV

SEQ ID NO: 207296 - protein, 14 aa, Borrelia Burgdorferi
APSQGGVNSPVNVT

SEQ ID NO: 207297 - protein, 14 aa, Borrelia Burgdorferi
PSQGGVNSPVNVTT

SEQ ID NO: 207298 - protein, 14 aa, Borrelia Burgdorferi
SQGGVNSPVNVTTT

SEQ ID NO: 207299 - protein, 14 aa, Borrelia Burgdorferi
QGGVNSPVNVTTTV

SEQ ID NO: 207300 - protein, 14 aa, Borrelia Burgdorferi
GGVNSPVNVTTTVD

SEQ ID NO: 207301 - protein, 14 aa, Borrelia Burgdorferi
GVNSPVNVTTTVDA

SEQ ID NO: 207302 - protein, 14 aa, Borrelia Burgdorferi
VNSPVNVTTTVDAN

SEQ ID NO: 207303 - protein, 14 aa, Borrelia Burgdorferi
NSPVNVTTTVDANT

SEQ ID NO: 207304 - protein, 14 aa, Borrelia Burgdorferi
SPVNVTTTVDANTS

SEQ ID NO: 207305 - protein, 14 aa, Borrelia Burgdorferi
PVNVTTTVDANTSL

SEQ ID NO: 207306 - protein, 14 aa, Borrelia Burgdorferi
VNVTTTVDANTSLA

SEQ ID NO: 207307 - protein, 14 aa, Borrelia Burgdorferi
NVTTTVDANTSLAK

SEQ ID NO: 207308 - protein, 14 aa, Borrelia Burgdorferi
VTTTVDANTSLAKI

SEQ ID NO: 207309 - protein, 14 aa, Borrelia Burgdorferi
TTTVDANTSLAKIE

SEQ ID NO: 207310 - protein, 14 aa, Borrelia Burgdorferi
TTVDANTSLAKIEN

SEQ ID NO: 207311 - protein, 14 aa, Borrelia Burgdorferi
TVDANTSLAKIENA

SEQ ID NO: 207312 - protein, 14 aa, Borrelia Burgdorferi
VDANTSLAKIENAI

SEQ ID NO: 207313 - protein, 14 aa, Borrelia Burgdorferi
DANTSLAKIENAIR

SEQ ID NO: 207314 - protein, 14 aa, Borrelia Burgdorferi
ANTSLAKIENAIRM

SEQ ID NO: 207315 - protein, 14 aa, Borrelia Burgdorferi
NTSLAKIENAIRMI

SEQ ID NO: 207316 - protein, 14 aa, Borrelia Burgdorferi
TSLAKIENAIRMIS

SEQ ID NO: 207317 - protein, 14 aa, Borrelia Burgdorferi
SLAKIENAIRMISD

SEQ ID NO: 207318 - protein, 14 aa, Borrelia Burgdorferi
LAKIENAIRMISDQ

SEQ ID NO: 207319 - protein, 14 aa, Borrelia Burgdorferi
AKIENAIRMISDQR

SEQ ID NO: 207320 - protein, 14 aa, Borrelia Burgdorferi
KIENAIRMISDQRA

SEQ ID NO: 207321 - protein, 14 aa, Borrelia Burgdorferi
IENAIRMISDQRAN

SEQ ID NO: 207322 - protein, 14 aa, Borrelia Burgdorferi
ENAIRMISDQRANL

SEQ ID NO: 207323 - protein, 14 aa, Borrelia Burgdorferi
NAIRMISDQRANLG

SEQ ID NO: 207324 - protein, 14 aa, Borrelia Burgdorferi
AIRMISDQRANLGA

SEQ ID NO: 207325 - protein, 14 aa, Borrelia Burgdorferi
IRMISDQRANLGAF

SEQ ID NO: 207326 - protein, 14 aa, Borrelia Burgdorferi
RMISDQRANLGAFQ

SEQ ID NO: 207327 - protein, 14 aa, Borrelia Burgdorferi
MISDQRANLGAFQN

SEQ ID NO: 207328 - protein, 14 aa, Borrelia Burgdorferi
ISDQRANLGAFQNR

SEQ ID NO: 207329 - protein, 14 aa, Borrelia Burgdorferi
SDQRANLGAFQNRL

SEQ ID NO: 207330 - protein, 14 aa, Borrelia Burgdorferi
DQRANLGAFQNRLE

SEQ ID NO: 207331 - protein, 14 aa, Borrelia Burgdorferi
QRANLGAFQNRLES

SEQ ID NO: 207332 - protein, 14 aa, Borrelia Burgdorferi
RANLGAFQNRLESI

SEQ ID NO: 207333 - protein, 14 aa, Borrelia Burgdorferi
ANLGAFQNRLESIK

SEQ ID NO: 207334 - protein, 14 aa, Borrelia Burgdorferi
NLGAFQNRLESIKN

SEQ ID NO: 207335 - protein, 14 aa, Borrelia Burgdorferi
LGAFQNRLESIKNS

SEQ ID NO: 207336 - protein, 14 aa, Borrelia Burgdorferi
GAFQNRLESIKNST

SEQ ID NO: 207337 - protein, 14 aa, Borrelia Burgdorferi
AFQNRLESIKNSTE

SEQ ID NO: 207338 - protein, 14 aa, Borrelia Burgdorferi
FQNRLESIKNSTEY

SEQ ID NO: 207339 - protein, 14 aa, Borrelia Burgdorferi
QNRLESIKNSTEYA

SEQ ID NO: 207340 - protein, 14 aa, Borrelia Burgdorferi
NRLESIKNSTEYAI

SEQ ID NO: 207341 - protein, 14 aa, Borrelia Burgdorferi
RLESIKNSTEYAIE

SEQ ID NO: 207342 - protein, 14 aa, Borrelia Burgdorferi
LESIKNSTEYAIEN

SEQ ID NO: 207343 - protein, 14 aa, Borrelia Burgdorferi
ESIKNSTEYAIENL

SEQ ID NO: 207344 - protein, 14 aa, Borrelia Burgdorferi
SIKNSTEYAIENLK

SEQ ID NO: 207345 - protein, 14 aa, Borrelia Burgdorferi
IKNSTEYAIENLKA

SEQ ID NO: 207346 - protein, 14 aa, Borrelia Burgdorferi
KNSTEYAIENLKAS

SEQ ID NO: 207347 - protein, 14 aa, Borrelia Burgdorferi
NSTEYAIENLKASY

SEQ ID NO: 207348 - protein, 14 aa, Borrelia Burgdorferi
STEYAIENLKASYA

SEQ ID NO: 207349 - protein, 14 aa, Borrelia Burgdorferi
TEYAIENLKASYAQ

SEQ ID NO: 207350 - protein, 14 aa, Borrelia Burgdorferi
EYAIENLKASYAQI

SEQ ID NO: 207351 - protein, 14 aa, Borrelia Burgdorferi
YAIENLKASYAQIK

SEQ ID NO: 207352 - protein, 14 aa, Borrelia Burgdorferi
AIENLKASYAQIKD

SEQ ID NO: 207353 - protein, 14 aa, Borrelia Burgdorferi
IENLKASYAQIKDA

SEQ ID NO: 207354 - protein, 14 aa, Borrelia Burgdorferi
ENLKASYAQIKDAT

SEQ ID NO: 207355 - protein, 14 aa, Borrelia Burgdorferi
NLKASYAQIKDATM

SEQ ID NO: 207356 - protein, 14 aa, Borrelia Burgdorferi
LKASYAQIKDATMT

SEQ ID NO: 207357 - protein, 14 aa, Borrelia Burgdorferi
KASYAQIKDATMTD

SEQ ID NO: 207358 - protein, 14 aa, Borrelia Burgdorferi
ASYAQIKDATMTDE

SEQ ID NO: 207359 - protein, 14 aa, Borrelia Burgdorferi
SYAQIKDATMTDEV

SEQ ID NO: 207360 - protein, 14 aa, Borrelia Burgdorferi
YAQIKDATMTDEVV

SEQ ID NO: 207361 - protein, 14 aa, Borrelia Burgdorferi
AQIKDATMTDEVVA

SEQ ID NO: 207362 - protein, 14 aa, Borrelia Burgdorferi
QIKDATMTDEVVAA

SEQ ID NO: 207363 - protein, 14 aa, Borrelia Burgdorferi
IKDATMTDEVVAAT

SEQ ID NO: 207364 - protein, 14 aa, Borrelia Burgdorferi
KDATMTDEVVAATT

SEQ ID NO: 207365 - protein, 14 aa, Borrelia Burgdorferi
DATMTDEVVAATTN

SEQ ID NO: 207366 - protein, 14 aa, Borrelia Burgdorferi
ATMTDEVVAATTNS

SEQ ID NO: 207367 - protein, 14 aa, Borrelia Burgdorferi
TMTDEVVAATTNSI

SEQ ID NO: 207368 - protein, 14 aa, Borrelia Burgdorferi
MTDEVVAATTNSIL

SEQ ID NO: 207369 - protein, 14 aa, Borrelia Burgdorferi
TDEVVAATTNSILT

SEQ ID NO: 207370 - protein, 14 aa, Borrelia Burgdorferi
DEVVAATTNSILTQ

SEQ ID NO: 207371 - protein, 14 aa, Borrelia Burgdorferi
EVVAATTNSILTQS

SEQ ID NO: 207372 - protein, 14 aa, Borrelia Burgdorferi
VVAATTNSILTQSA

SEQ ID NO: 207373 - protein, 14 aa, Borrelia Burgdorferi
VAATTNSILTQSAM

SEQ ID NO: 207374 - protein, 14 aa, Borrelia Burgdorferi
AATTNSILTQSAMA

SEQ ID NO: 207375 - protein, 14 aa, Borrelia Burgdorferi
ATTNSILTQSAMAM

SEQ ID NO: 207376 - protein, 14 aa, Borrelia Burgdorferi
TTNSILTQSAMAMI

SEQ ID NO: 207377 - protein, 14 aa, Borrelia Burgdorferi
TNSILTQSAMAMIA

SEQ ID NO: 207378 - protein, 14 aa, Borrelia Burgdorferi
NSILTQSAMAMIAQ

SEQ ID NO: 207379 - protein, 14 aa, Borrelia Burgdorferi
SILTQSAMAMIAQA

SEQ ID NO: 207380 - protein, 14 aa, Borrelia Burgdorferi
ILTQSAMAMIAQAN

SEQ ID NO: 207381 - protein, 14 aa, Borrelia Burgdorferi
LTQSAMAMIAQANQ

SEQ ID NO: 207382 - protein, 14 aa, Borrelia Burgdorferi
TQSAMAMIAQANQV

SEQ ID NO: 207383 - protein, 14 aa, Borrelia Burgdorferi
QSAMAMIAQANQVP

SEQ ID NO: 207384 - protein, 14 aa, Borrelia Burgdorferi
SAMAMIAQANQVPQ

SEQ ID NO: 207385 - protein, 14 aa, Borrelia Burgdorferi
AMAMIAQANQVPQY

SEQ ID NO: 207386 - protein, 14 aa, Borrelia Burgdorferi
MAMIAQANQVPQYV

SEQ ID NO: 207387 - protein, 14 aa, Borrelia Burgdorferi
AMIAQANQVPQYVL

SEQ ID NO: 207388 - protein, 14 aa, Borrelia Burgdorferi
MIAQANQVPQYVLS

SEQ ID NO: 207389 - protein, 14 aa, Borrelia Burgdorferi
IAQANQVPQYVLSL

SEQ ID NO: 207390 - protein, 14 aa, Borrelia Burgdorferi
AQANQVPQYVLSLL

SEQ ID NO: 207391 - protein, 14 aa, Borrelia Burgdorferi
QANQVPQYVLSLLR

SEQ ID NO: 207392 - protein, 15 aa, Borrelia Burgdorferi
MIINHNTSAINASRN

SEQ ID NO: 207393 - protein, 15 aa, Borrelia Burgdorferi
IINHNTSAINASRNN

SEQ ID NO: 207394 - protein, 15 aa, Borrelia Burgdorferi
INHNTSAINASRNNG

SEQ ID NO: 207395 - protein, 15 aa, Borrelia Burgdorferi
NHNTSAINASRNNGI

SEQ ID NO: 207396 - protein, 15 aa, Borrelia Burgdorferi
HNTSAINASRNNGIN

SEQ ID NO: 207397 - protein, 15 aa, Borrelia Burgdorferi
NTSAINASRNNGINA

SEQ ID NO: 207398 - protein, 15 aa, Borrelia Burgdorferi
TSAINASRNNGINAA

SEQ ID NO: 207399 - protein, 15 aa, Borrelia Burgdorferi
SAINASRNNGINAAN

SEQ ID NO: 207400 - protein, 15 aa, Borrelia Burgdorferi
AINASRNNGINAANL

SEQ ID NO: 207401 - protein, 15 aa, Borrelia Burgdorferi
INASRNNGINAANLS

SEQ ID NO: 207402 - protein, 15 aa, Borrelia Burgdorferi
NASRNNGINAANLSK

SEQ ID NO: 207403 - protein, 15 aa, Borrelia Burgdorferi
ASRNNGINAANLSKT

SEQ ID NO: 207404 - protein, 15 aa, Borrelia Burgdorferi
SRNNGINAANLSKTQ

SEQ ID NO: 207405 - protein, 15 aa, Borrelia Burgdorferi
RNNGINAANLSKTQE

SEQ ID NO: 207406 - protein, 15 aa, Borrelia Burgdorferi
NNGINAANLSKTQEK

SEQ ID NO: 207407 - protein, 15 aa, Borrelia Burgdorferi
NGINAANLSKTQEKL

SEQ ID NO: 207408 - protein, 15 aa, Borrelia Burgdorferi
GINAANLSKTQEKLS

SEQ ID NO: 207409 - protein, 15 aa, Borrelia Burgdorferi
INAANLSKTQEKLSS

SEQ ID NO: 207410 - protein, 15 aa, Borrelia Burgdorferi
NAANLSKTQEKLSSG

SEQ ID NO: 207411 - protein, 15 aa, Borrelia Burgdorferi
AANLSKTQEKLSSGY

SEQ ID NO: 207412 - protein, 15 aa, Borrelia Burgdorferi
ANLSKTQEKLSSGYR

SEQ ID NO: 207413 - protein, 15 aa, Borrelia Burgdorferi
NLSKTQEKLSSGYRI

SEQ ID NO: 207414 - protein, 15 aa, Borrelia Burgdorferi
LSKTQEKLSSGYRIN

SEQ ID NO: 207415 - protein, 15 aa, Borrelia Burgdorferi
SKTQEKLSSGYRINR

SEQ ID NO: 207416 - protein, 15 aa, Borrelia Burgdorferi
KTQEKLSSGYRINRA

SEQ ID NO: 207417 - protein, 15 aa, Borrelia Burgdorferi
TQEKLSSGYRINRAS

SEQ ID NO: 207418 - protein, 15 aa, Borrelia Burgdorferi
QEKLSSGYRINRASD

SEQ ID NO: 207419 - protein, 15 aa, Borrelia Burgdorferi
EKLSSGYRINRASDD

SEQ ID NO: 207420 - protein, 15 aa, Borrelia Burgdorferi
KLSSGYRINRASDDA

SEQ ID NO: 207421 - protein, 15 aa, Borrelia Burgdorferi
LSSGYRINRASDDAA

SEQ ID NO: 207422 - protein, 15 aa, Borrelia Burgdorferi
SSGYRINRASDDAAG

SEQ ID NO: 207423 - protein, 15 aa, Borrelia Burgdorferi
SGYRINRASDDAAGM

SEQ ID NO: 207424 - protein, 15 aa, Borrelia Burgdorferi
GYRINRASDDAAGMG

SEQ ID NO: 207425 - protein, 15 aa, Borrelia Burgdorferi
YRINRASDDAAGMGV

SEQ ID NO: 207426 - protein, 15 aa, Borrelia Burgdorferi
RINRASDDAAGMGVS

SEQ ID NO: 207427 - protein, 15 aa, Borrelia Burgdorferi
INRASDDAAGMGVSG

SEQ ID NO: 207428 - protein, 15 aa, Borrelia Burgdorferi
NRASDDAAGMGVSGK

SEQ ID NO: 207429 - protein, 15 aa, Borrelia Burgdorferi
RASDDAAGMGVSGKI

SEQ ID NO: 207430 - protein, 15 aa, Borrelia Burgdorferi
ASDDAAGMGVSGKIN

SEQ ID NO: 207431 - protein, 15 aa, Borrelia Burgdorferi
SDDAAGMGVSGKINA

SEQ ID NO: 207432 - protein, 15 aa, Borrelia Burgdorferi
DDAAGMGVSGKINAQ

SEQ ID NO: 207433 - protein, 15 aa, Borrelia Burgdorferi
DAAGMGVSGKINAQI

SEQ ID NO: 207434 - protein, 15 aa, Borrelia Burgdorferi
AAGMGVSGKINAQIR

SEQ ID NO: 207435 - protein, 15 aa, Borrelia Burgdorferi
AGMGVSGKINAQIRG

SEQ ID NO: 207436 - protein, 15 aa, Borrelia Burgdorferi
GMGVSGKINAQIRGL

SEQ ID NO: 207437 - protein, 15 aa, Borrelia Burgdorferi
MGVSGKINAQIRGLS

SEQ ID NO: 207438 - protein, 15 aa, Borrelia Burgdorferi
GVSGKINAQIRGLSQ

SEQ ID NO: 207439 - protein, 15 aa, Borrelia Burgdorferi
VSGKINAQIRGLSQA

SEQ ID NO: 207440 - protein, 15 aa, Borrelia Burgdorferi
SGKINAQIRGLSQAS

SEQ ID NO: 207441 - protein, 15 aa, Borrelia Burgdorferi
GKINAQIRGLSQASR

SEQ ID NO: 207442 - protein, 15 aa, Borrelia Burgdorferi
KINAQIRGLSQASRN

SEQ ID NO: 207443 - protein, 15 aa, Borrelia Burgdorferi
INAQIRGLSQASRNT

SEQ ID NO: 207444 - protein, 15 aa, Borrelia Burgdorferi
NAQIRGLSQASRNTS

SEQ ID NO: 207445 - protein, 15 aa, Borrelia Burgdorferi
AQIRGLSQASRNTSK

SEQ ID NO: 207446 - protein, 15 aa, Borrelia Burgdorferi
QIRGLSQASRNTSKA

SEQ ID NO: 207447 - protein, 15 aa, Borrelia Burgdorferi
IRGLSQASRNTSKAI

SEQ ID NO: 207448 - protein, 15 aa, Borrelia Burgdorferi
RGLSQASRNTSKAIN

SEQ ID NO: 207449 - protein, 15 aa, Borrelia Burgdorferi
GLSQASRNTSKAINF

SEQ ID NO: 207450 - protein, 15 aa, Borrelia Burgdorferi
LSQASRNTSKAINFI

SEQ ID NO: 207451 - protein, 15 aa, Borrelia Burgdorferi
SQASRNTSKAINFIQ

SEQ ID NO: 207452 - protein, 15 aa, Borrelia Burgdorferi
QASRNTSKAINFIQT

SEQ ID NO: 207453 - protein, 15 aa, Borrelia Burgdorferi
ASRNTSKAINFIQTT

SEQ ID NO: 207454 - protein, 15 aa, Borrelia Burgdorferi
SRNTSKAINFIQTTE

SEQ ID NO: 207455 - protein, 15 aa, Borrelia Burgdorferi
RNTSKAINFIQTTEG

SEQ ID NO: 207456 - protein, 15 aa, Borrelia Burgdorferi
NTSKAINFIQTTEGN

SEQ ID NO: 207457 - protein, 15 aa, Borrelia Burgdorferi
TSKAINFIQTTEGNL

SEQ ID NO: 207458 - protein, 15 aa, Borrelia Burgdorferi
SKAINFIQTTEGNLN

SEQ ID NO: 207459 - protein, 15 aa, Borrelia Burgdorferi
KAINFIQTTEGNLNE

SEQ ID NO: 207460 - protein, 15 aa, Borrelia Burgdorferi
AINFIQTTEGNLNEV

SEQ ID NO: 207461 - protein, 15 aa, Borrelia Burgdorferi
INFIQTTEGNLNEVE

SEQ ID NO: 207462 - protein, 15 aa, Borrelia Burgdorferi
NFIQTTEGNLNEVEK

SEQ ID NO: 207463 - protein, 15 aa, Borrelia Burgdorferi
FIQTTEGNLNEVEKV

SEQ ID NO: 207464 - protein, 15 aa, Borrelia Burgdorferi
IQTTEGNLNEVEKVL

SEQ ID NO: 207465 - protein, 15 aa, Borrelia Burgdorferi
QTTEGNLNEVEKVLV

SEQ ID NO: 207466 - protein, 15 aa, Borrelia Burgdorferi
TTEGNLNEVEKVLVR

SEQ ID NO: 207467 - protein, 15 aa, Borrelia Burgdorferi
TEGNLNEVEKVLVRM

SEQ ID NO: 207468 - protein, 15 aa, Borrelia Burgdorferi
EGNLNEVEKVLVRMK

SEQ ID NO: 207469 - protein, 15 aa, Borrelia Burgdorferi
GNLNEVEKVLVRMKE

SEQ ID NO: 207470 - protein, 15 aa, Borrelia Burgdorferi
NLNEVEKVLVRMKEL

SEQ ID NO: 207471 - protein, 15 aa, Borrelia Burgdorferi
LNEVEKVLVRMKELA

SEQ ID NO: 207472 - protein, 15 aa, Borrelia Burgdorferi
NEVEKVLVRMKELAV

SEQ ID NO: 207473 - protein, 15 aa, Borrelia Burgdorferi
EVEKVLVRMKELAVQ

SEQ ID NO: 207474 - protein, 15 aa, Borrelia Burgdorferi
VEKVLVRMKELAVQS

SEQ ID NO: 207475 - protein, 15 aa, Borrelia Burgdorferi
EKVLVRMKELAVQSG

SEQ ID NO: 207476 - protein, 15 aa, Borrelia Burgdorferi
KVLVRMKELAVQSGN

SEQ ID NO: 207477 - protein, 15 aa, Borrelia Burgdorferi
VLVRMKELAVQSGNG

SEQ ID NO: 207478 - protein, 15 aa, Borrelia Burgdorferi
LVRMKELAVQSGNGT

SEQ ID NO: 207479 - protein, 15 aa, Borrelia Burgdorferi
VRMKELAVQSGNGTY

SEQ ID NO: 207480 - protein, 15 aa, Borrelia Burgdorferi
RMKELAVQSGNGTYS

SEQ ID NO: 207481 - protein, 15 aa, Borrelia Burgdorferi
MKELAVQSGNGTYSD

SEQ ID NO: 207482 - protein, 15 aa, Borrelia Burgdorferi
KELAVQSGNGTYSDA

SEQ ID NO: 207483 - protein, 15 aa, Borrelia Burgdorferi
ELAVQSGNGTYSDAD

SEQ ID NO: 207484 - protein, 15 aa, Borrelia Burgdorferi
LAVQSGNGTYSDADR

SEQ ID NO: 207485 - protein, 15 aa, Borrelia Burgdorferi
AVQSGNGTYSDADRG

SEQ ID NO: 207486 - protein, 15 aa, Borrelia Burgdorferi
VQSGNGTYSDADRGS

SEQ ID NO: 207487 - protein, 15 aa, Borrelia Burgdorferi
QSGNGTYSDADRGSI

SEQ ID NO: 207488 - protein, 15 aa, Borrelia Burgdorferi
SGNGTYSDADRGSIQ

SEQ ID NO: 207489 - protein, 15 aa, Borrelia Burgdorferi
GNGTYSDADRGSIQI

SEQ ID NO: 207490 - protein, 15 aa, Borrelia Burgdorferi
NGTYSDADRGSIQIE

SEQ ID NO: 207491 - protein, 15 aa, Borrelia Burgdorferi
GTYSDADRGSIQIEI

SEQ ID NO: 207492 - protein, 15 aa, Borrelia Burgdorferi
TYSDADRGSIQIEIE

SEQ ID NO: 207493 - protein, 15 aa, Borrelia Burgdorferi
YSDADRGSIQIEIEQ

SEQ ID NO: 207494 - protein, 15 aa, Borrelia Burgdorferi
SDADRGSIQIEIEQL

SEQ ID NO: 207495 - protein, 15 aa, Borrelia Burgdorferi
DADRGSIQIEIEQLT

SEQ ID NO: 207496 - protein, 15 aa, Borrelia Burgdorferi
ADRGSIQIEIEQLTD

SEQ ID NO: 207497 - protein, 15 aa, Borrelia Burgdorferi
DRGSIQIEIEQLTDE

SEQ ID NO: 207498 - protein, 15 aa, Borrelia Burgdorferi
RGSIQIEIEQLTDEI

SEQ ID NO: 207499 - protein, 15 aa, Borrelia Burgdorferi
GSIQIEIEQLTDEIN

SEQ ID NO: 207500 - protein, 15 aa, Borrelia Burgdorferi
SIQIEIEQLTDEINR

SEQ ID NO: 207501 - protein, 15 aa, Borrelia Burgdorferi
IQIEIEQLTDEINRI

SEQ ID NO: 207502 - protein, 15 aa, Borrelia Burgdorferi
QIEIEQLTDEINRIA

SEQ ID NO: 207503 - protein, 15 aa, Borrelia Burgdorferi
IEIEQLTDEINRIAD

SEQ ID NO: 207504 - protein, 15 aa, Borrelia Burgdorferi
EIEQLTDEINRIADQ

SEQ ID NO: 207505 - protein, 15 aa, Borrelia Burgdorferi
IEQLTDEINRIADQA

SEQ ID NO: 207506 - protein, 15 aa, Borrelia Burgdorferi
EQLTDEINRIADQAQ

SEQ ID NO: 207507 - protein, 15 aa, Borrelia Burgdorferi
QLTDEINRIADQAQY

SEQ ID NO: 207508 - protein, 15 aa, Borrelia Burgdorferi
LTDEINRIADQAQYN

SEQ ID NO: 207509 - protein, 15 aa, Borrelia Burgdorferi
TDEINRIADQAQYNQ

SEQ ID NO: 207510 - protein, 15 aa, Borrelia Burgdorferi
DEINRIADQAQYNQM

SEQ ID NO: 207511 - protein, 15 aa, Borrelia Burgdorferi
EINRIADQAQYNQMH

SEQ ID NO: 207512 - protein, 15 aa, Borrelia Burgdorferi
INRIADQAQYNQMHM

SEQ ID NO: 207513 - protein, 15 aa, Borrelia Burgdorferi
NRIADQAQYNQMHML

SEQ ID NO: 207514 - protein, 15 aa, Borrelia Burgdorferi
RIADQAQYNQMHMLS

SEQ ID NO: 207515 - protein, 15 aa, Borrelia Burgdorferi
IADQAQYNQMHMLSN

SEQ ID NO: 207516 - protein, 15 aa, Borrelia Burgdorferi
ADQAQYNQMHMLSNK

SEQ ID NO: 207517 - protein, 15 aa, Borrelia Burgdorferi
DQAQYNQMHMLSNKS

SEQ ID NO: 207518 - protein, 15 aa, Borrelia Burgdorferi
QAQYNQMHMLSNKSA

SEQ ID NO: 207519 - protein, 15 aa, Borrelia Burgdorferi
AQYNQMHMLSNKSAS

SEQ ID NO: 207520 - protein, 15 aa, Borrelia Burgdorferi
QYNQMHMLSNKSASQ

SEQ ID NO: 207521 - protein, 15 aa, Borrelia Burgdorferi
YNQMHMLSNKSASQN

SEQ ID NO: 207522 - protein, 15 aa, Borrelia Burgdorferi
NQMHMLSNKSASQNV

SEQ ID NO: 207523 - protein, 15 aa, Borrelia Burgdorferi
QMHMLSNKSASQNVR

SEQ ID NO: 207524 - protein, 15 aa, Borrelia Burgdorferi
MHMLSNKSASQNVRT

SEQ ID NO: 207525 - protein, 15 aa, Borrelia Burgdorferi
HMLSNKSASQNVRTA

SEQ ID NO: 207526 - protein, 15 aa, Borrelia Burgdorferi
MLSNKSASQNVRTAE

SEQ ID NO: 207527 - protein, 15 aa, Borrelia Burgdorferi
LSNKSASQNVRTAEE

SEQ ID NO: 207528 - protein, 15 aa, Borrelia Burgdorferi
SNKSASQNVRTAEEL

SEQ ID NO: 207529 - protein, 15 aa, Borrelia Burgdorferi
NKSASQNVRTAEELG

SEQ ID NO: 207530 - protein, 15 aa, Borrelia Burgdorferi
KSASQNVRTAEELGM

SEQ ID NO: 207531 - protein, 15 aa, Borrelia Burgdorferi
SASQNVRTAEELGMQ

SEQ ID NO: 207532 - protein, 15 aa, Borrelia Burgdorferi
ASQNVRTAEELGMQP

SEQ ID NO: 207533 - protein, 15 aa, Borrelia Burgdorferi
SQNVRTAEELGMQPA

SEQ ID NO: 207534 - protein, 15 aa, Borrelia Burgdorferi
QNVRTAEELGMQPAK

SEQ ID NO: 207535 - protein, 15 aa, Borrelia Burgdorferi
NVRTAEELGMQPAKI

SEQ ID NO: 207536 - protein, 15 aa, Borrelia Burgdorferi
VRTAEELGMQPAKIN

SEQ ID NO: 207537 - protein, 15 aa, Borrelia Burgdorferi
RTAEELGMQPAKINT

SEQ ID NO: 207538 - protein, 15 aa, Borrelia Burgdorferi
TAEELGMQPAKINTP

SEQ ID NO: 207539 - protein, 15 aa, Borrelia Burgdorferi
AEELGMQPAKINTPA

SEQ ID NO: 207540 - protein, 15 aa, Borrelia Burgdorferi
EELGMQPAKINTPAS

SEQ ID NO: 207541 - protein, 15 aa, Borrelia Burgdorferi
ELGMQPAKINTPASL

SEQ ID NO: 207542 - protein, 15 aa, Borrelia Burgdorferi
LGMQPAKINTPASLS

SEQ ID NO: 207543 - protein, 15 aa, Borrelia Burgdorferi
GMQPAKINTPASLSG

SEQ ID NO: 207544 - protein, 15 aa, Borrelia Burgdorferi
MQPAKINTPASLSGS

SEQ ID NO: 207545 - protein, 15 aa, Borrelia Burgdorferi
QPAKINTPASLSGSQ

SEQ ID NO: 207546 - protein, 15 aa, Borrelia Burgdorferi
PAKINTPASLSGSQA

SEQ ID NO: 207547 - protein, 15 aa, Borrelia Burgdorferi
AKINTPASLSGSQAS

SEQ ID NO: 207548 - protein, 15 aa, Borrelia Burgdorferi
KINTPASLSGSQASW

SEQ ID NO: 207549 - protein, 15 aa, Borrelia Burgdorferi
INTPASLSGSQASWT

SEQ ID NO: 207550 - protein, 15 aa, Borrelia Burgdorferi
NTPASLSGSQASWTL

SEQ ID NO: 207551 - protein, 15 aa, Borrelia Burgdorferi
TPASLSGSQASWTLR

SEQ ID NO: 207552 - protein, 15 aa, Borrelia Burgdorferi
PASLSGSQASWTLRV

SEQ ID NO: 207553 - protein, 15 aa, Borrelia Burgdorferi
ASLSGSQASWTLRVH

SEQ ID NO: 207554 - protein, 15 aa, Borrelia Burgdorferi
SLSGSQASWTLRVHV

SEQ ID NO: 207555 - protein, 15 aa, Borrelia Burgdorferi
LSGSQASWTLRVHVG

SEQ ID NO: 207556 - protein, 15 aa, Borrelia Burgdorferi
SGSQASWTLRVHVGA

SEQ ID NO: 207557 - protein, 15 aa, Borrelia Burgdorferi
GSQASWTLRVHVGAN

SEQ ID NO: 207558 - protein, 15 aa, Borrelia Burgdorferi
SQASWTLRVHVGANQ

SEQ ID NO: 207559 - protein, 15 aa, Borrelia Burgdorferi
QASWTLRVHVGANQD

SEQ ID NO: 207560 - protein, 15 aa, Borrelia Burgdorferi
ASWTLRVHVGANQDE

SEQ ID NO: 207561 - protein, 15 aa, Borrelia Burgdorferi
SWTLRVHVGANQDEA

SEQ ID NO: 207562 - protein, 15 aa, Borrelia Burgdorferi
WTLRVHVGANQDEAI

SEQ ID NO: 207563 - protein, 15 aa, Borrelia Burgdorferi
TLRVHVGANQDEAIA

SEQ ID NO: 207564 - protein, 15 aa, Borrelia Burgdorferi
LRVHVGANQDEAIAV

SEQ ID NO: 207565 - protein, 15 aa, Borrelia Burgdorferi
RVHVGANQDEAIAVN

SEQ ID NO: 207566 - protein, 15 aa, Borrelia Burgdorferi
VHVGANQDEAIAVNI

SEQ ID NO: 207567 - protein, 15 aa, Borrelia Burgdorferi
HVGANQDEAIAVNIY

SEQ ID NO: 207568 - protein, 15 aa, Borrelia Burgdorferi
VGANQDEAIAVNIYA

SEQ ID NO: 207569 - protein, 15 aa, Borrelia Burgdorferi
GANQDEAIAVNIYAA

SEQ ID NO: 207570 - protein, 15 aa, Borrelia Burgdorferi
ANQDEAIAVNIYAAN

SEQ ID NO: 207571 - protein, 15 aa, Borrelia Burgdorferi
NQDEAIAVNIYAANV

SEQ ID NO: 207572 - protein, 15 aa, Borrelia Burgdorferi
QDEAIAVNIYAANVA

SEQ ID NO: 207573 - protein, 15 aa, Borrelia Burgdorferi
DEAIAVNIYAANVAN

SEQ ID NO: 207574 - protein, 15 aa, Borrelia Burgdorferi
EAIAVNIYAANVANL

SEQ ID NO: 207575 - protein, 15 aa, Borrelia Burgdorferi
AIAVNIYAANVANLF

SEQ ID NO: 207576 - protein, 15 aa, Borrelia Burgdorferi
IAVNIYAANVANLFS

SEQ ID NO: 207577 - protein, 15 aa, Borrelia Burgdorferi
AVNIYAANVANLFSG

SEQ ID NO: 207578 - protein, 15 aa, Borrelia Burgdorferi
VNIYAANVANLFSGE

SEQ ID NO: 207579 - protein, 15 aa, Borrelia Burgdorferi
NIYAANVANLFSGEG

SEQ ID NO: 207580 - protein, 15 aa, Borrelia Burgdorferi
IYAANVANLFSGEGA

SEQ ID NO: 207581 - protein, 15 aa, Borrelia Burgdorferi
YAANVANLFSGEGAQ

SEQ ID NO: 207582 - protein, 15 aa, Borrelia Burgdorferi
AANVANLFSGEGAQT

SEQ ID NO: 207583 - protein, 15 aa, Borrelia Burgdorferi
ANVANLFSGEGAQTA

SEQ ID NO: 207584 - protein, 15 aa, Borrelia Burgdorferi
NVANLFSGEGAQTAQ

SEQ ID NO: 207585 - protein, 15 aa, Borrelia Burgdorferi
VANLFSGEGAQTAQA

SEQ ID NO: 207586 - protein, 15 aa, Borrelia Burgdorferi
ANLFSGEGAQTAQAA

SEQ ID NO: 207587 - protein, 15 aa, Borrelia Burgdorferi
NLFSGEGAQTAQAAP

SEQ ID NO: 207588 - protein, 15 aa, Borrelia Burgdorferi
LFSGEGAQTAQAAPV

SEQ ID NO: 207589 - protein, 15 aa, Borrelia Burgdorferi
FSGEGAQTAQAAPVQ

SEQ ID NO: 207590 - protein, 15 aa, Borrelia Burgdorferi
SGEGAQTAQAAPVQE

SEQ ID NO: 207591 - protein, 15 aa, Borrelia Burgdorferi
GEGAQTAQAAPVQEG

SEQ ID NO: 207592 - protein, 15 aa, Borrelia Burgdorferi
EGAQTAQAAPVQEGV

SEQ ID NO: 207593 - protein, 15 aa, Borrelia Burgdorferi
GAQTAQAAPVQEGVQ

SEQ ID NO: 207594 - protein, 15 aa, Borrelia Burgdorferi
AQTAQAAPVQEGVQQ

SEQ ID NO: 207595 - protein, 15 aa, Borrelia Burgdorferi
QTAQAAPVQEGVQQE

SEQ ID NO: 207596 - protein, 15 aa, Borrelia Burgdorferi
TAQAAPVQEGVQQEG

SEQ ID NO: 207597 - protein, 15 aa, Borrelia Burgdorferi
AQAAPVQEGVQQEGA

SEQ ID NO: 207598 - protein, 15 aa, Borrelia Burgdorferi
QAAPVQEGVQQEGAQ

SEQ ID NO: 207599 - protein, 15 aa, Borrelia Burgdorferi
AAPVQEGVQQEGAQQ

SEQ ID NO: 207600 - protein, 15 aa, Borrelia Burgdorferi
APVQEGVQQEGAQQP

SEQ ID NO: 207601 - protein, 15 aa, Borrelia Burgdorferi
PVQEGVQQEGAQQPA

SEQ ID NO: 207602 - protein, 15 aa, Borrelia Burgdorferi
VQEGVQQEGAQQPAP

SEQ ID NO: 207603 - protein, 15 aa, Borrelia Burgdorferi
QEGVQQEGAQQPAPA

SEQ ID NO: 207604 - protein, 15 aa, Borrelia Burgdorferi
EGVQQEGAQQPAPAT

SEQ ID NO: 207605 - protein, 15 aa, Borrelia Burgdorferi
GVQQEGAQQPAPATA

SEQ ID NO: 207606 - protein, 15 aa, Borrelia Burgdorferi
VQQEGAQQPAPATAP

SEQ ID NO: 207607 - protein, 15 aa, Borrelia Burgdorferi
QQEGAQQPAPATAPS

SEQ ID NO: 207608 - protein, 15 aa, Borrelia Burgdorferi
QEGAQQPAPATAPSQ

SEQ ID NO: 207609 - protein, 15 aa, Borrelia Burgdorferi
EGAQQPAPATAPSQG

SEQ ID NO: 207610 - protein, 15 aa, Borrelia Burgdorferi
GAQQPAPATAPSQGG

SEQ ID NO: 207611 - protein, 15 aa, Borrelia Burgdorferi
AQQPAPATAPSQGGV

SEQ ID NO: 207612 - protein, 15 aa, Borrelia Burgdorferi
QQPAPATAPSQGGVN

SEQ ID NO: 207613 - protein, 15 aa, Borrelia Burgdorferi
QPAPATAPSQGGVNS

SEQ ID NO: 207614 - protein, 15 aa, Borrelia Burgdorferi
PAPATAPSQGGVNSP

SEQ ID NO: 207615 - protein, 15 aa, Borrelia Burgdorferi
APATAPSQGGVNSPV

SEQ ID NO: 207616 - protein, 15 aa, Borrelia Burgdorferi
PATAPSQGGVNSPVN

SEQ ID NO: 207617 - protein, 15 aa, Borrelia Burgdorferi
ATAPSQGGVNSPVNV

SEQ ID NO: 207618 - protein, 15 aa, Borrelia Burgdorferi
TAPSQGGVNSPVNVT

SEQ ID NO: 207619 - protein, 15 aa, Borrelia Burgdorferi
APSQGGVNSPVNVTT

SEQ ID NO: 207620 - protein, 15 aa, Borrelia Burgdorferi
PSQGGVNSPVNVTTT

SEQ ID NO: 207621 - protein, 15 aa, Borrelia Burgdorferi
SQGGVNSPVNVTTTV

SEQ ID NO: 207622 - protein, 15 aa, Borrelia Burgdorferi
QGGVNSPVNVTTTVD

SEQ ID NO: 207623 - protein, 15 aa, Borrelia Burgdorferi
GGVNSPVNVTTTVDA

SEQ ID NO: 207624 - protein, 15 aa, Borrelia Burgdorferi
GVNSPVNVTTTVDAN

SEQ ID NO: 207625 - protein, 15 aa, Borrelia Burgdorferi
VNSPVNVTTTVDANT

SEQ ID NO: 207626 - protein, 15 aa, Borrelia Burgdorferi
NSPVNVTTTVDANTS

SEQ ID NO: 207627 - protein, 15 aa, Borrelia Burgdorferi
SPVNVTTTVDANTSL

SEQ ID NO: 207628 - protein, 15 aa, Borrelia Burgdorferi
PVNVTTTVDANTSLA

SEQ ID NO: 207629 - protein, 15 aa, Borrelia Burgdorferi
VNVTTTVDANTSLAK

SEQ ID NO: 207630 - protein, 15 aa, Borrelia Burgdorferi
NVTTTVDANTSLAKI

SEQ ID NO: 207631 - protein, 15 aa, Borrelia Burgdorferi
VTTTVDANTSLAKIE

SEQ ID NO: 207632 - protein, 15 aa, Borrelia Burgdorferi
TTTVDANTSLAKIEN

SEQ ID NO: 207633 - protein, 15 aa, Borrelia Burgdorferi
TTVDANTSLAKIENA

SEQ ID NO: 207634 - protein, 15 aa, Borrelia Burgdorferi
TVDANTSLAKIENAI

SEQ ID NO: 207635 - protein, 15 aa, Borrelia Burgdorferi
VDANTSLAKIENAIR

SEQ ID NO: 207636 - protein, 15 aa, Borrelia Burgdorferi
DANTSLAKIENAIRM

SEQ ID NO: 207637 - protein, 15 aa, Borrelia Burgdorferi
ANTSLAKIENAIRMI

SEQ ID NO: 207638 - protein, 15 aa, Borrelia Burgdorferi
NTSLAKIENAIRMIS

SEQ ID NO: 207639 - protein, 15 aa, Borrelia Burgdorferi
TSLAKIENAIRMISD

SEQ ID NO: 207640 - protein, 15 aa, Borrelia Burgdorferi
SLAKIENAIRMISDQ

SEQ ID NO: 207641 - protein, 15 aa, Borrelia Burgdorferi
LAKIENAIRMISDQR

SEQ ID NO: 207642 - protein, 15 aa, Borrelia Burgdorferi
AKIENAIRMISDQRA

SEQ ID NO: 207643 - protein, 15 aa, Borrelia Burgdorferi
KIENAIRMISDQRAN

SEQ ID NO: 207644 - protein, 15 aa, Borrelia Burgdorferi
IENAIRMISDQRANL

SEQ ID NO: 207645 - protein, 15 aa, Borrelia Burgdorferi
ENAIRMISDQRANLG

SEQ ID NO: 207646 - protein, 15 aa, Borrelia Burgdorferi
NAIRMISDQRANLGA

SEQ ID NO: 207647 - protein, 15 aa, Borrelia Burgdorferi
AIRMISDQRANLGAF

SEQ ID NO: 207648 - protein, 15 aa, Borrelia Burgdorferi
IRMISDQRANLGAFQ

SEQ ID NO: 207649 - protein, 15 aa, Borrelia Burgdorferi
RMISDQRANLGAFQN

SEQ ID NO: 207650 - protein, 15 aa, Borrelia Burgdorferi
MISDQRANLGAFQNR

SEQ ID NO: 207651 - protein, 15 aa, Borrelia Burgdorferi
ISDQRANLGAFQNRL

SEQ ID NO: 207652 - protein, 15 aa, Borrelia Burgdorferi
SDQRANLGAFQNRLE

SEQ ID NO: 207653 - protein, 15 aa, Borrelia Burgdorferi
DQRANLGAFQNRLES

SEQ ID NO: 207654 - protein, 15 aa, Borrelia Burgdorferi
QRANLGAFQNRLESI

SEQ ID NO: 207655 - protein, 15 aa, Borrelia Burgdorferi
RANLGAFQNRLESIK

SEQ ID NO: 207656 - protein, 15 aa, Borrelia Burgdorferi
ANLGAFQNRLESIKN

SEQ ID NO: 207657 - protein, 15 aa, Borrelia Burgdorferi
NLGAFQNRLESIKNS

SEQ ID NO: 207658 - protein, 15 aa, Borrelia Burgdorferi
LGAFQNRLESIKNST

SEQ ID NO: 207659 - protein, 15 aa, Borrelia Burgdorferi
GAFQNRLESIKNSTE

SEQ ID NO: 207660 - protein, 15 aa, Borrelia Burgdorferi
AFQNRLESIKNSTEY

SEQ ID NO: 207661 - protein, 15 aa, Borrelia Burgdorferi
FQNRLESIKNSTEYA

SEQ ID NO: 207662 - protein, 15 aa, Borrelia Burgdorferi
QNRLESIKNSTEYAI

SEQ ID NO: 207663 - protein, 15 aa, Borrelia Burgdorferi
NRLESIKNSTEYAIE

SEQ ID NO: 207664 - protein, 15 aa, Borrelia Burgdorferi
RLESIKNSTEYAIEN

SEQ ID NO: 207665 - protein, 15 aa, Borrelia Burgdorferi
LESIKNSTEYAIENL

SEQ ID NO: 207666 - protein, 15 aa, Borrelia Burgdorferi
ESIKNSTEYAIENLK

SEQ ID NO: 207667 - protein, 15 aa, Borrelia Burgdorferi
SIKNSTEYAIENLKA

SEQ ID NO: 207668 - protein, 15 aa, Borrelia Burgdorferi
IKNSTEYAIENLKAS

SEQ ID NO: 207669 - protein, 15 aa, Borrelia Burgdorferi
KNSTEYAIENLKASY

SEQ ID NO: 207670 - protein, 15 aa, Borrelia Burgdorferi
NSTEYAIENLKASYA

SEQ ID NO: 207671 - protein, 15 aa, Borrelia Burgdorferi
STEYAIENLKASYAQ

SEQ ID NO: 207672 - protein, 15 aa, Borrelia Burgdorferi
TEYAIENLKASYAQI

SEQ ID NO: 207673 - protein, 15 aa, Borrelia Burgdorferi
EYAIENLKASYAQIK

SEQ ID NO: 207674 - protein, 15 aa, Borrelia Burgdorferi
YAIENLKASYAQIKD

SEQ ID NO: 207675 - protein, 15 aa, Borrelia Burgdorferi
AIENLKASYAQIKDA

SEQ ID NO: 207676 - protein, 15 aa, Borrelia Burgdorferi
IENLKASYAQIKDAT

SEQ ID NO: 207677 - protein, 15 aa, Borrelia Burgdorferi
ENLKASYAQIKDATM

SEQ ID NO: 207678 - protein, 15 aa, Borrelia Burgdorferi
NLKASYAQIKDATMT

SEQ ID NO: 207679 - protein, 15 aa, Borrelia Burgdorferi
LKASYAQIKDATMTD

SEQ ID NO: 207680 - protein, 15 aa, Borrelia Burgdorferi
KASYAQIKDATMTDE

SEQ ID NO: 207681 - protein, 15 aa, Borrelia Burgdorferi
ASYAQIKDATMTDEV

SEQ ID NO: 207682 - protein, 15 aa, Borrelia Burgdorferi
SYAQIKDATMTDEVV

SEQ ID NO: 207683 - protein, 15 aa, Borrelia Burgdorferi
YAQIKDATMTDEVVA

SEQ ID NO: 207684 - protein, 15 aa, Borrelia Burgdorferi
AQIKDATMTDEVVAA

SEQ ID NO: 207685 - protein, 15 aa, Borrelia Burgdorferi
QIKDATMTDEVVAAT

SEQ ID NO: 207686 - protein, 15 aa, Borrelia Burgdorferi
IKDATMTDEVVAATT

SEQ ID NO: 207687 - protein, 15 aa, Borrelia Burgdorferi
KDATMTDEVVAATTN

SEQ ID NO: 207688 - protein, 15 aa, Borrelia Burgdorferi
DATMTDEVVAATTNS

SEQ ID NO: 207689 - protein, 15 aa, Borrelia Burgdorferi
ATMTDEVVAATTNSI

SEQ ID NO: 207690 - protein, 15 aa, Borrelia Burgdorferi
TMTDEVVAATTNSIL

SEQ ID NO: 207691 - protein, 15 aa, Borrelia Burgdorferi
MTDEVVAATTNSILT

SEQ ID NO: 207692 - protein, 15 aa, Borrelia Burgdorferi
TDEVVAATTNSILTQ

SEQ ID NO: 207693 - protein, 15 aa, Borrelia Burgdorferi
DEVVAATTNSILTQS

SEQ ID NO: 207694 - protein, 15 aa, Borrelia Burgdorferi
EVVAATTNSILTQSA

SEQ ID NO: 207695 - protein, 15 aa, Borrelia Burgdorferi
VVAATTNSILTQSAM

SEQ ID NO: 207696 - protein, 15 aa, Borrelia Burgdorferi
VAATTNSILTQSAMA

SEQ ID NO: 207697 - protein, 15 aa, Borrelia Burgdorferi
AATTNSILTQSAMAM

SEQ ID NO: 207698 - protein, 15 aa, Borrelia Burgdorferi
ATTNSILTQSAMAMI

SEQ ID NO: 207699 - protein, 15 aa, Borrelia Burgdorferi
TTNSILTQSAMAMIA

SEQ ID NO: 207700 - protein, 15 aa, Borrelia Burgdorferi
TNSILTQSAMAMIAQ

SEQ ID NO: 207701 - protein, 15 aa, Borrelia Burgdorferi
NSILTQSAMAMIAQA

SEQ ID NO: 207702 - protein, 15 aa, Borrelia Burgdorferi
SILTQSAMAMIAQAN

SEQ ID NO: 207703 - protein, 15 aa, Borrelia Burgdorferi
ILTQSAMAMIAQANQ

SEQ ID NO: 207704 - protein, 15 aa, Borrelia Burgdorferi
LTQSAMAMIAQANQV

SEQ ID NO: 207705 - protein, 15 aa, Borrelia Burgdorferi
TQSAMAMIAQANQVP

SEQ ID NO: 207706 - protein, 15 aa, Borrelia Burgdorferi
QSAMAMIAQANQVPQ

SEQ ID NO: 207707 - protein, 15 aa, Borrelia Burgdorferi
SAMAMIAQANQVPQY

SEQ ID NO: 207708 - protein, 15 aa, Borrelia Burgdorferi
AMAMIAQANQVPQYV

SEQ ID NO: 207709 - protein, 15 aa, Borrelia Burgdorferi
MAMIAQANQVPQYVL

SEQ ID NO: 207710 - protein, 15 aa, Borrelia Burgdorferi
AMIAQANQVPQYVLS

SEQ ID NO: 207711 - protein, 15 aa, Borrelia Burgdorferi
MIAQANQVPQYVLSL

SEQ ID NO: 207712 - protein, 15 aa, Borrelia Burgdorferi
IAQANQVPQYVLSLL

SEQ ID NO: 207713 - protein, 15 aa, Borrelia Burgdorferi
AQANQVPQYVLSLLR

SEQ ID NO: 207714 - protein, 16 aa, Borrelia Burgdorferi
MIINHNTSAINASRNN

SEQ ID NO: 207715 - protein, 16 aa, Borrelia Burgdorferi
IINHNTSAINASRNNG

SEQ ID NO: 207716 - protein, 16 aa, Borrelia Burgdorferi
INHNTSAINASRNNGI

SEQ ID NO: 207717 - protein, 16 aa, Borrelia Burgdorferi
NHNTSAINASRNNGIN

SEQ ID NO: 207718 - protein, 16 aa, Borrelia Burgdorferi
HNTSAINASRNNGINA

SEQ ID NO: 207719 - protein, 16 aa, Borrelia Burgdorferi
NTSAINASRNNGINAA

SEQ ID NO: 207720 - protein, 16 aa, Borrelia Burgdorferi
TSAINASRNNGINAAN

SEQ ID NO: 207721 - protein, 16 aa, Borrelia Burgdorferi
SAINASRNNGINAANL

SEQ ID NO: 207722 - protein, 16 aa, Borrelia Burgdorferi
AINASRNNGINAANLS

SEQ ID NO: 207723 - protein, 16 aa, Borrelia Burgdorferi
INASRNNGINAANLSK

SEQ ID NO: 207724 - protein, 16 aa, Borrelia Burgdorferi
NASRNNGINAANLSKT

SEQ ID NO: 207725 - protein, 16 aa, Borrelia Burgdorferi
ASRNNGINAANLSKTQ

SEQ ID NO: 207726 - protein, 16 aa, Borrelia Burgdorferi
SRNNGINAANLSKTQE

SEQ ID NO: 207727 - protein, 16 aa, Borrelia Burgdorferi
RNNGINAANLSKTQEK

SEQ ID NO: 207728 - protein, 16 aa, Borrelia Burgdorferi
NNGINAANLSKTQEKL

SEQ ID NO: 207729 - protein, 16 aa, Borrelia Burgdorferi
NGINAANLSKTQEKLS

SEQ ID NO: 207730 - protein, 16 aa, Borrelia Burgdorferi
GINAANLSKTQEKLSS

SEQ ID NO: 207731 - protein, 16 aa, Borrelia Burgdorferi
INAANLSKTQEKLSSG

SEQ ID NO: 207732 - protein, 16 aa, Borrelia Burgdorferi
NAANLSKTQEKLSSGY

SEQ ID NO: 207733 - protein, 16 aa, Borrelia Burgdorferi
AANLSKTQEKLSSGYR

SEQ ID NO: 207734 - protein, 16 aa, Borrelia Burgdorferi
ANLSKTQEKLSSGYRI

SEQ ID NO: 207735 - protein, 16 aa, Borrelia Burgdorferi
NLSKTQEKLSSGYRIN

SEQ ID NO: 207736 - protein, 16 aa, Borrelia Burgdorferi
LSKTQEKLSSGYRINR

SEQ ID NO: 207737 - protein, 16 aa, Borrelia Burgdorferi
SKTQEKLSSGYRINRA

SEQ ID NO: 207738 - protein, 16 aa, Borrelia Burgdorferi
KTQEKLSSGYRINRAS

SEQ ID NO: 207739 - protein, 16 aa, Borrelia Burgdorferi
TQEKLSSGYRINRASD

SEQ ID NO: 207740 - protein, 16 aa, Borrelia Burgdorferi
QEKLSSGYRINRASDD

SEQ ID NO: 207741 - protein, 16 aa, Borrelia Burgdorferi
EKLSSGYRINRASDDA

SEQ ID NO: 207742 - protein, 16 aa, Borrelia Burgdorferi
KLSSGYRINRASDDAA

SEQ ID NO: 207743 - protein, 16 aa, Borrelia Burgdorferi
LSSGYRINRASDDAAG

SEQ ID NO: 207744 - protein, 16 aa, Borrelia Burgdorferi
SSGYRINRASDDAAGM

SEQ ID NO: 207745 - protein, 16 aa, Borrelia Burgdorferi
SGYRINRASDDAAGMG

SEQ ID NO: 207746 - protein, 16 aa, Borrelia Burgdorferi
GYRINRASDDAAGMGV

SEQ ID NO: 207747 - protein, 16 aa, Borrelia Burgdorferi
YRINRASDDAAGMGVS

SEQ ID NO: 207748 - protein, 16 aa, Borrelia Burgdorferi
RINRASDDAAGMGVSG

SEQ ID NO: 207749 - protein, 16 aa, Borrelia Burgdorferi
INRASDDAAGMGVSGK

SEQ ID NO: 207750 - protein, 16 aa, Borrelia Burgdorferi
NRASDDAAGMGVSGKI

SEQ ID NO: 207751 - protein, 16 aa, Borrelia Burgdorferi
RASDDAAGMGVSGKIN

SEQ ID NO: 207752 - protein, 16 aa, Borrelia Burgdorferi
ASDDAAGMGVSGKINA

SEQ ID NO: 207753 - protein, 16 aa, Borrelia Burgdorferi
SDDAAGMGVSGKINAQ

SEQ ID NO: 207754 - protein, 16 aa, Borrelia Burgdorferi
DDAAGMGVSGKINAQI

SEQ ID NO: 207755 - protein, 16 aa, Borrelia Burgdorferi
DAAGMGVSGKINAQIR

SEQ ID NO: 207756 - protein, 16 aa, Borrelia Burgdorferi
AAGMGVSGKINAQIRG

SEQ ID NO: 207757 - protein, 16 aa, Borrelia Burgdorferi
AGMGVSGKINAQIRGL

SEQ ID NO: 207758 - protein, 16 aa, Borrelia Burgdorferi
GMGVSGKINAQIRGLS

SEQ ID NO: 207759 - protein, 16 aa, Borrelia Burgdorferi
MGVSGKINAQIRGLSQ

SEQ ID NO: 207760 - protein, 16 aa, Borrelia Burgdorferi
GVSGKINAQIRGLSQA

SEQ ID NO: 207761 - protein, 16 aa, Borrelia Burgdorferi
VSGKINAQIRGLSQAS

SEQ ID NO: 207762 - protein, 16 aa, Borrelia Burgdorferi
SGKINAQIRGLSQASR

SEQ ID NO: 207763 - protein, 16 aa, Borrelia Burgdorferi
GKINAQIRGLSQASRN

SEQ ID NO: 207764 - protein, 16 aa, Borrelia Burgdorferi
KINAQIRGLSQASRNT

SEQ ID NO: 207765 - protein, 16 aa, Borrelia Burgdorferi
INAQIRGLSQASRNTS

SEQ ID NO: 207766 - protein, 16 aa, Borrelia Burgdorferi
NAQIRGLSQASRNTSK

SEQ ID NO: 207767 - protein, 16 aa, Borrelia Burgdorferi
AQIRGLSQASRNTSKA

SEQ ID NO: 207768 - protein, 16 aa, Borrelia Burgdorferi
QIRGLSQASRNTSKAI

SEQ ID NO: 207769 - protein, 16 aa, Borrelia Burgdorferi
IRGLSQASRNTSKAIN

SEQ ID NO: 207770 - protein, 16 aa, Borrelia Burgdorferi
RGLSQASRNTSKAINF

SEQ ID NO: 207771 - protein, 16 aa, Borrelia Burgdorferi
GLSQASRNTSKAINFI

SEQ ID NO: 207772 - protein, 16 aa, Borrelia Burgdorferi
LSQASRNTSKAINFIQ

SEQ ID NO: 207773 - protein, 16 aa, Borrelia Burgdorferi
SQASRNTSKAINFIQT

SEQ ID NO: 207774 - protein, 16 aa, Borrelia Burgdorferi
QASRNTSKAINFIQTT

SEQ ID NO: 207775 - protein, 16 aa, Borrelia Burgdorferi
ASRNTSKAINFIQTTE

SEQ ID NO: 207776 - protein, 16 aa, Borrelia Burgdorferi
SRNTSKAINFIQTTEG

SEQ ID NO: 207777 - protein, 16 aa, Borrelia Burgdorferi
RNTSKAINFIQTTEGN

SEQ ID NO: 207778 - protein, 16 aa, Borrelia Burgdorferi
NTSKAINFIQTTEGNL

SEQ ID NO: 207779 - protein, 16 aa, Borrelia Burgdorferi
TSKAINFIQTTEGNLN

SEQ ID NO: 207780 - protein, 16 aa, Borrelia Burgdorferi
SKAINFIQTTEGNLNE

SEQ ID NO: 207781 - protein, 16 aa, Borrelia Burgdorferi
KAINFIQTTEGNLNEV

SEQ ID NO: 207782 - protein, 16 aa, Borrelia Burgdorferi
AINFIQTTEGNLNEVE

SEQ ID NO: 207783 - protein, 16 aa, Borrelia Burgdorferi
INFIQTTEGNLNEVEK

SEQ ID NO: 207784 - protein, 16 aa, Borrelia Burgdorferi
NFIQTTEGNLNEVEKV

SEQ ID NO: 207785 - protein, 16 aa, Borrelia Burgdorferi
FIQTTEGNLNEVEKVL

SEQ ID NO: 207786 - protein, 16 aa, Borrelia Burgdorferi
IQTTEGNLNEVEKVLV

SEQ ID NO: 207787 - protein, 16 aa, Borrelia Burgdorferi
QTTEGNLNEVEKVLVR

SEQ ID NO: 207788 - protein, 16 aa, Borrelia Burgdorferi
TTEGNLNEVEKVLVRM

SEQ ID NO: 207789 - protein, 16 aa, Borrelia Burgdorferi
TEGNLNEVEKVLVRMK

SEQ ID NO: 207790 - protein, 16 aa, Borrelia Burgdorferi
EGNLNEVEKVLVRMKE

SEQ ID NO: 207791 - protein, 16 aa, Borrelia Burgdorferi
GNLNEVEKVLVRMKEL

SEQ ID NO: 207792 - protein, 16 aa, Borrelia Burgdorferi
NLNEVEKVLVRMKELA

SEQ ID NO: 207793 - protein, 16 aa, Borrelia Burgdorferi
LNEVEKVLVRMKELAV

SEQ ID NO: 207794 - protein, 16 aa, Borrelia Burgdorferi
NEVEKVLVRMKELAVQ

SEQ ID NO: 207795 - protein, 16 aa, Borrelia Burgdorferi
EVEKVLVRMKELAVQS

SEQ ID NO: 207796 - protein, 16 aa, Borrelia Burgdorferi
VEKVLVRMKELAVQSG

SEQ ID NO: 207797 - protein, 16 aa, Borrelia Burgdorferi
EKVLVRMKELAVQSGN

SEQ ID NO: 207798 - protein, 16 aa, Borrelia Burgdorferi
KVLVRMKELAVQSGNG

SEQ ID NO: 207799 - protein, 16 aa, Borrelia Burgdorferi
VLVRMKELAVQSGNGT

SEQ ID NO: 207800 - protein, 16 aa, Borrelia Burgdorferi
LVRMKELAVQSGNGTY

SEQ ID NO: 207801 - protein, 16 aa, Borrelia Burgdorferi
VRMKELAVQSGNGTYS

SEQ ID NO: 207802 - protein, 16 aa, Borrelia Burgdorferi
RMKELAVQSGNGTYSD

SEQ ID NO: 207803 - protein, 16 aa, Borrelia Burgdorferi
MKELAVQSGNGTYSDA

SEQ ID NO: 207804 - protein, 16 aa, Borrelia Burgdorferi
KELAVQSGNGTYSDAD

SEQ ID NO: 207805 - protein, 16 aa, Borrelia Burgdorferi
ELAVQSGNGTYSDADR

SEQ ID NO: 207806 - protein, 16 aa, Borrelia Burgdorferi
LAVQSGNGTYSDADRG

SEQ ID NO: 207807 - protein, 16 aa, Borrelia Burgdorferi
AVQSGNGTYSDADRGS

SEQ ID NO: 207808 - protein, 16 aa, Borrelia Burgdorferi
VQSGNGTYSDADRGSI

SEQ ID NO: 207809 - protein, 16 aa, Borrelia Burgdorferi
QSGNGTYSDADRGSIQ

SEQ ID NO: 207810 - protein, 16 aa, Borrelia Burgdorferi
SGNGTYSDADRGSIQI

SEQ ID NO: 207811 - protein, 16 aa, Borrelia Burgdorferi
GNGTYSDADRGSIQIE

SEQ ID NO: 207812 - protein, 16 aa, Borrelia Burgdorferi
NGTYSDADRGSIQIEI

SEQ ID NO: 207813 - protein, 16 aa, Borrelia Burgdorferi
GTYSDADRGSIQIEIE

SEQ ID NO: 207814 - protein, 16 aa, Borrelia Burgdorferi
TYSDADRGSIQIEIEQ

SEQ ID NO: 207815 - protein, 16 aa, Borrelia Burgdorferi
YSDADRGSIQIEIEQL

SEQ ID NO: 207816 - protein, 16 aa, Borrelia Burgdorferi
SDADRGSIQIEIEQLT

SEQ ID NO: 207817 - protein, 16 aa, Borrelia Burgdorferi
DADRGSIQIEIEQLTD

SEQ ID NO: 207818 - protein, 16 aa, Borrelia Burgdorferi
ADRGSIQIEIEQLTDE

SEQ ID NO: 207819 - protein, 16 aa, Borrelia Burgdorferi
DRGSIQIEIEQLTDEI

SEQ ID NO: 207820 - protein, 16 aa, Borrelia Burgdorferi
RGSIQIEIEQLTDEIN

SEQ ID NO: 207821 - protein, 16 aa, Borrelia Burgdorferi
GSIQIEIEQLTDEINR

SEQ ID NO: 207822 - protein, 16 aa, Borrelia Burgdorferi
SIQIEIEQLTDEINRI

SEQ ID NO: 207823 - protein, 16 aa, Borrelia Burgdorferi
IQIEIEQLTDEINRIA

SEQ ID NO: 207824 - protein, 16 aa, Borrelia Burgdorferi
QIEIEQLTDEINRIAD

SEQ ID NO: 207825 - protein, 16 aa, Borrelia Burgdorferi
IEIEQLTDEINRIADQ

SEQ ID NO: 207826 - protein, 16 aa, Borrelia Burgdorferi
EIEQLTDEINRIADQA

SEQ ID NO: 207827 - protein, 16 aa, Borrelia Burgdorferi
IEQLTDEINRIADQAQ

SEQ ID NO: 207828 - protein, 16 aa, Borrelia Burgdorferi
EQLTDEINRIADQAQY

SEQ ID NO: 207829 - protein, 16 aa, Borrelia Burgdorferi
QLTDEINRIADQAQYN

SEQ ID NO: 207830 - protein, 16 aa, Borrelia Burgdorferi
LTDEINRIADQAQYNQ

SEQ ID NO: 207831 - protein, 16 aa, Borrelia Burgdorferi
TDEINRIADQAQYNQM

SEQ ID NO: 207832 - protein, 16 aa, Borrelia Burgdorferi
DEINRIADQAQYNQMH

SEQ ID NO: 207833 - protein, 16 aa, Borrelia Burgdorferi
EINRIADQAQYNQMHM

SEQ ID NO: 207834 - protein, 16 aa, Borrelia Burgdorferi
INRIADQAQYNQMHML

SEQ ID NO: 207835 - protein, 16 aa, Borrelia Burgdorferi
NRIADQAQYNQMHMLS

SEQ ID NO: 207836 - protein, 16 aa, Borrelia Burgdorferi
RIADQAQYNQMHMLSN

SEQ ID NO: 207837 - protein, 16 aa, Borrelia Burgdorferi
IADQAQYNQMHMLSNK

SEQ ID NO: 207838 - protein, 16 aa, Borrelia Burgdorferi
ADQAQYNQMHMLSNKS

SEQ ID NO: 207839 - protein, 16 aa, Borrelia Burgdorferi
DQAQYNQMHMLSNKSA

SEQ ID NO: 207840 - protein, 16 aa, Borrelia Burgdorferi
QAQYNQMHMLSNKSAS

SEQ ID NO: 207841 - protein, 16 aa, Borrelia Burgdorferi
AQYNQMHMLSNKSASQ

SEQ ID NO: 207842 - protein, 16 aa, Borrelia Burgdorferi
QYNQMHMLSNKSASQN

SEQ ID NO: 207843 - protein, 16 aa, Borrelia Burgdorferi
YNQMHMLSNKSASQNV

SEQ ID NO: 207844 - protein, 16 aa, Borrelia Burgdorferi
NQMHMLSNKSASQNVR

SEQ ID NO: 207845 - protein, 16 aa, Borrelia Burgdorferi
QMHMLSNKSASQNVRT

SEQ ID NO: 207846 - protein, 16 aa, Borrelia Burgdorferi
MHMLSNKSASQNVRTA

SEQ ID NO: 207847 - protein, 16 aa, Borrelia Burgdorferi
HMLSNKSASQNVRTAE

SEQ ID NO: 207848 - protein, 16 aa, Borrelia Burgdorferi
MLSNKSASQNVRTAEE

SEQ ID NO: 207849 - protein, 16 aa, Borrelia Burgdorferi
LSNKSASQNVRTAEEL

SEQ ID NO: 207850 - protein, 16 aa, Borrelia Burgdorferi
SNKSASQNVRTAEELG

SEQ ID NO: 207851 - protein, 16 aa, Borrelia Burgdorferi
NKSASQNVRTAEELGM

SEQ ID NO: 207852 - protein, 16 aa, Borrelia Burgdorferi
KSASQNVRTAEELGMQ

SEQ ID NO: 207853 - protein, 16 aa, Borrelia Burgdorferi
SASQNVRTAEELGMQP

SEQ ID NO: 207854 - protein, 16 aa, Borrelia Burgdorferi
ASQNVRTAEELGMQPA

SEQ ID NO: 207855 - protein, 16 aa, Borrelia Burgdorferi
SQNVRTAEELGMQPAK

SEQ ID NO: 207856 - protein, 16 aa, Borrelia Burgdorferi
QNVRTAEELGMQPAKI

SEQ ID NO: 207857 - protein, 16 aa, Borrelia Burgdorferi
NVRTAEELGMQPAKIN

SEQ ID NO: 207858 - protein, 16 aa, Borrelia Burgdorferi
VRTAEELGMQPAKINT

SEQ ID NO: 207859 - protein, 16 aa, Borrelia Burgdorferi
RTAEELGMQPAKINTP

SEQ ID NO: 207860 - protein, 16 aa, Borrelia Burgdorferi
TAEELGMQPAKINTPA

SEQ ID NO: 207861 - protein, 16 aa, Borrelia Burgdorferi
AEELGMQPAKINTPAS

SEQ ID NO: 207862 - protein, 16 aa, Borrelia Burgdorferi
EELGMQPAKINTPASL

SEQ ID NO: 207863 - protein, 16 aa, Borrelia Burgdorferi
ELGMQPAKINTPASLS

SEQ ID NO: 207864 - protein, 16 aa, Borrelia Burgdorferi
LGMQPAKINTPASLSG

SEQ ID NO: 207865 - protein, 16 aa, Borrelia Burgdorferi
GMQPAKINTPASLSGS

SEQ ID NO: 207866 - protein, 16 aa, Borrelia Burgdorferi
MQPAKINTPASLSGSQ

SEQ ID NO: 207867 - protein, 16 aa, Borrelia Burgdorferi
QPAKINTPASLSGSQA

SEQ ID NO: 207868 - protein, 16 aa, Borrelia Burgdorferi
PAKINTPASLSGSQAS

SEQ ID NO: 207869 - protein, 16 aa, Borrelia Burgdorferi
AKINTPASLSGSQASW

SEQ ID NO: 207870 - protein, 16 aa, Borrelia Burgdorferi
KINTPASLSGSQASWT

SEQ ID NO: 207871 - protein, 16 aa, Borrelia Burgdorferi
INTPASLSGSQASWTL

SEQ ID NO: 207872 - protein, 16 aa, Borrelia Burgdorferi
NTPASLSGSQASWTLR

SEQ ID NO: 207873 - protein, 16 aa, Borrelia Burgdorferi
TPASLSGSQASWTLRV

SEQ ID NO: 207874 - protein, 16 aa, Borrelia Burgdorferi
PASLSGSQASWTLRVH

SEQ ID NO: 207875 - protein, 16 aa, Borrelia Burgdorferi
ASLSGSQASWTLRVHV

SEQ ID NO: 207876 - protein, 16 aa, Borrelia Burgdorferi
SLSGSQASWTLRVHVG

SEQ ID NO: 207877 - protein, 16 aa, Borrelia Burgdorferi
LSGSQASWTLRVHVGA

SEQ ID NO: 207878 - protein, 16 aa, Borrelia Burgdorferi
SGSQASWTLRVHVGAN

SEQ ID NO: 207879 - protein, 16 aa, Borrelia Burgdorferi
GSQASWTLRVHVGANQ

SEQ ID NO: 207880 - protein, 16 aa, Borrelia Burgdorferi
SQASWTLRVHVGANQD

SEQ ID NO: 207881 - protein, 16 aa, Borrelia Burgdorferi
QASWTLRVHVGANQDE

SEQ ID NO: 207882 - protein, 16 aa, Borrelia Burgdorferi
ASWTLRVHVGANQDEA

SEQ ID NO: 207883 - protein, 16 aa, Borrelia Burgdorferi
SWTLRVHVGANQDEAI

SEQ ID NO: 207884 - protein, 16 aa, Borrelia Burgdorferi
WTLRVHVGANQDEAIA

SEQ ID NO: 207885 - protein, 16 aa, Borrelia Burgdorferi
TLRVHVGANQDEAIAV

SEQ ID NO: 207886 - protein, 16 aa, Borrelia Burgdorferi
LRVHVGANQDEAIAVN

SEQ ID NO: 207887 - protein, 16 aa, Borrelia Burgdorferi
RVHVGANQDEAIAVNI

SEQ ID NO: 207888 - protein, 16 aa, Borrelia Burgdorferi
VHVGANQDEAIAVNIY

SEQ ID NO: 207889 - protein, 16 aa, Borrelia Burgdorferi
HVGANQDEAIAVNIYA

SEQ ID NO: 207890 - protein, 16 aa, Borrelia Burgdorferi
VGANQDEAIAVNIYAA

SEQ ID NO: 207891 - protein, 16 aa, Borrelia Burgdorferi
GANQDEAIAVNIYAAN

SEQ ID NO: 207892 - protein, 16 aa, Borrelia Burgdorferi
ANQDEAIAVNIYAANV

SEQ ID NO: 207893 - protein, 16 aa, Borrelia Burgdorferi
NQDEAIAVNIYAANVA

SEQ ID NO: 207894 - protein, 16 aa, Borrelia Burgdorferi
QDEAIAVNIYAANVAN

SEQ ID NO: 207895 - protein, 16 aa, Borrelia Burgdorferi
DEAIAVNIYAANVANL

SEQ ID NO: 207896 - protein, 16 aa, Borrelia Burgdorferi
EAIAVNIYAANVANLF

SEQ ID NO: 207897 - protein, 16 aa, Borrelia Burgdorferi
AIAVNIYAANVANLFS

SEQ ID NO: 207898 - protein, 16 aa, Borrelia Burgdorferi
IAVNIYAANVANLFSG

SEQ ID NO: 207899 - protein, 16 aa, Borrelia Burgdorferi
AVNIYAANVANLFSGE

SEQ ID NO: 207900 - protein, 16 aa, Borrelia Burgdorferi
VNIYAANVANLFSGEG

SEQ ID NO: 207901 - protein, 16 aa, Borrelia Burgdorferi
NIYAANVANLFSGEGA

SEQ ID NO: 207902 - protein, 16 aa, Borrelia Burgdorferi
IYAANVANLFSGEGAQ

SEQ ID NO: 207903 - protein, 16 aa, Borrelia Burgdorferi
YAANVANLFSGEGAQT

SEQ ID NO: 207904 - protein, 16 aa, Borrelia Burgdorferi
AANVANLFSGEGAQTA

SEQ ID NO: 207905 - protein, 16 aa, Borrelia Burgdorferi
ANVANLFSGEGAQTAQ

SEQ ID NO: 207906 - protein, 16 aa, Borrelia Burgdorferi
NVANLFSGEGAQTAQA

SEQ ID NO: 207907 - protein, 16 aa, Borrelia Burgdorferi
VANLFSGEGAQTAQAA

SEQ ID NO: 207908 - protein, 16 aa, Borrelia Burgdorferi
ANLFSGEGAQTAQAAP

SEQ ID NO: 207909 - protein, 16 aa, Borrelia Burgdorferi
NLFSGEGAQTAQAAPV

SEQ ID NO: 207910 - protein, 16 aa, Borrelia Burgdorferi
LFSGEGAQTAQAAPVQ

SEQ ID NO: 207911 - protein, 16 aa, Borrelia Burgdorferi
FSGEGAQTAQAAPVQE

SEQ ID NO: 207912 - protein, 16 aa, Borrelia Burgdorferi
SGEGAQTAQAAPVQEG

SEQ ID NO: 207913 - protein, 16 aa, Borrelia Burgdorferi
GEGAQTAQAAPVQEGV

SEQ ID NO: 207914 - protein, 16 aa, Borrelia Burgdorferi
EGAQTAQAAPVQEGVQ

SEQ ID NO: 207915 - protein, 16 aa, Borrelia Burgdorferi
GAQTAQAAPVQEGVQQ

SEQ ID NO: 207916 - protein, 16 aa, Borrelia Burgdorferi
AQTAQAAPVQEGVQQE

SEQ ID NO: 207917 - protein, 16 aa, Borrelia Burgdorferi
QTAQAAPVQEGVQQEG

SEQ ID NO: 207918 - protein, 16 aa, Borrelia Burgdorferi
TAQAAPVQEGVQQEGA

SEQ ID NO: 207919 - protein, 16 aa, Borrelia Burgdorferi
AQAAPVQEGVQQEGAQ

SEQ ID NO: 207920 - protein, 16 aa, Borrelia Burgdorferi
QAAPVQEGVQQEGAQQ

SEQ ID NO: 207921 - protein, 16 aa, Borrelia Burgdorferi
AAPVQEGVQQEGAQQP

SEQ ID NO: 207922 - protein, 16 aa, Borrelia Burgdorferi
APVQEGVQQEGAQQPA

SEQ ID NO: 207923 - protein, 16 aa, Borrelia Burgdorferi
PVQEGVQQEGAQQPAP

SEQ ID NO: 207924 - protein, 16 aa, Borrelia Burgdorferi
VQEGVQQEGAQQPAPA

SEQ ID NO: 207925 - protein, 16 aa, Borrelia Burgdorferi
QEGVQQEGAQQPAPAT

SEQ ID NO: 207926 - protein, 16 aa, Borrelia Burgdorferi
EGVQQEGAQQPAPATA

SEQ ID NO: 207927 - protein, 16 aa, Borrelia Burgdorferi
GVQQEGAQQPAPATAP

SEQ ID NO: 207928 - protein, 16 aa, Borrelia Burgdorferi
VQQEGAQQPAPATAPS

SEQ ID NO: 207929 - protein, 16 aa, Borrelia Burgdorferi
QQEGAQQPAPATAPSQ

SEQ ID NO: 207930 - protein, 16 aa, Borrelia Burgdorferi
QEGAQQPAPATAPSQG

SEQ ID NO: 207931 - protein, 16 aa, Borrelia Burgdorferi
EGAQQPAPATAPSQGG

SEQ ID NO: 207932 - protein, 16 aa, Borrelia Burgdorferi
GAQQPAPATAPSQGGV

SEQ ID NO: 207933 - protein, 16 aa, Borrelia Burgdorferi
AQQPAPATAPSQGGVN

SEQ ID NO: 207934 - protein, 16 aa, Borrelia Burgdorferi
QQPAPATAPSQGGVNS

SEQ ID NO: 207935 - protein, 16 aa, Borrelia Burgdorferi
QPAPATAPSQGGVNSP

SEQ ID NO: 207936 - protein, 16 aa, Borrelia Burgdorferi
PAPATAPSQGGVNSPV

SEQ ID NO: 207937 - protein, 16 aa, Borrelia Burgdorferi
APATAPSQGGVNSPVN

SEQ ID NO: 207938 - protein, 16 aa, Borrelia Burgdorferi
PATAPSQGGVNSPVNV

SEQ ID NO: 207939 - protein, 16 aa, Borrelia Burgdorferi
ATAPSQGGVNSPVNVT

SEQ ID NO: 207940 - protein, 16 aa, Borrelia Burgdorferi
TAPSQGGVNSPVNVTT

SEQ ID NO: 207941 - protein, 16 aa, Borrelia Burgdorferi
APSQGGVNSPVNVTTT

SEQ ID NO: 207942 - protein, 16 aa, Borrelia Burgdorferi
PSQGGVNSPVNVTTTV

SEQ ID NO: 207943 - protein, 16 aa, Borrelia Burgdorferi
SQGGVNSPVNVTTTVD

SEQ ID NO: 207944 - protein, 16 aa, Borrelia Burgdorferi
QGGVNSPVNVTTTVDA

SEQ ID NO: 207945 - protein, 16 aa, Borrelia Burgdorferi
GGVNSPVNVTTTVDAN

SEQ ID NO: 207946 - protein, 16 aa, Borrelia Burgdorferi
GVNSPVNVTTTVDANT

SEQ ID NO: 207947 - protein, 16 aa, Borrelia Burgdorferi
VNSPVNVTTTVDANTS

SEQ ID NO: 207948 - protein, 16 aa, Borrelia Burgdorferi
NSPVNVTTTVDANTSL

SEQ ID NO: 207949 - protein, 16 aa, Borrelia Burgdorferi
SPVNVTTTVDANTSLA

SEQ ID NO: 207950 - protein, 16 aa, Borrelia Burgdorferi
PVNVTTTVDANTSLAK

SEQ ID NO: 207951 - protein, 16 aa, Borrelia Burgdorferi
VNVTTTVDANTSLAKI

SEQ ID NO: 207952 - protein, 16 aa, Borrelia Burgdorferi
NVTTTVDANTSLAKIE

SEQ ID NO: 207953 - protein, 16 aa, Borrelia Burgdorferi
VTTTVDANTSLAKIEN

SEQ ID NO: 207954 - protein, 16 aa, Borrelia Burgdorferi
TTTVDANTSLAKIENA

SEQ ID NO: 207955 - protein, 16 aa, Borrelia Burgdorferi
TTVDANTSLAKIENAI

SEQ ID NO: 207956 - protein, 16 aa, Borrelia Burgdorferi
TVDANTSLAKIENAIR

SEQ ID NO: 207957 - protein, 16 aa, Borrelia Burgdorferi
VDANTSLAKIENAIRM

SEQ ID NO: 207958 - protein, 16 aa, Borrelia Burgdorferi
DANTSLAKIENAIRMI

SEQ ID NO: 207959 - protein, 16 aa, Borrelia Burgdorferi
ANTSLAKIENAIRMIS

SEQ ID NO: 207960 - protein, 16 aa, Borrelia Burgdorferi
NTSLAKIENAIRMISD

SEQ ID NO: 207961 - protein, 16 aa, Borrelia Burgdorferi
TSLAKIENAIRMISDQ

SEQ ID NO: 207962 - protein, 16 aa, Borrelia Burgdorferi
SLAKIENAIRMISDQR

SEQ ID NO: 207963 - protein, 16 aa, Borrelia Burgdorferi
LAKIENAIRMISDQRA

SEQ ID NO: 207964 - protein, 16 aa, Borrelia Burgdorferi
AKIENAIRMISDQRAN

SEQ ID NO: 207965 - protein, 16 aa, Borrelia Burgdorferi
KIENAIRMISDQRANL

SEQ ID NO: 207966 - protein, 16 aa, Borrelia Burgdorferi
IENAIRMISDQRANLG

SEQ ID NO: 207967 - protein, 16 aa, Borrelia Burgdorferi
ENAIRMISDQRANLGA

SEQ ID NO: 207968 - protein, 16 aa, Borrelia Burgdorferi
NAIRMISDQRANLGAF

SEQ ID NO: 207969 - protein, 16 aa, Borrelia Burgdorferi
AIRMISDQRANLGAFQ

SEQ ID NO: 207970 - protein, 16 aa, Borrelia Burgdorferi
IRMISDQRANLGAFQN

SEQ ID NO: 207971 - protein, 16 aa, Borrelia Burgdorferi
RMISDQRANLGAFQNR

SEQ ID NO: 207972 - protein, 16 aa, Borrelia Burgdorferi
MISDQRANLGAFQNRL

SEQ ID NO: 207973 - protein, 16 aa, Borrelia Burgdorferi
ISDQRANLGAFQNRLE

SEQ ID NO: 207974 - protein, 16 aa, Borrelia Burgdorferi
SDQRANLGAFQNRLES

SEQ ID NO: 207975 - protein, 16 aa, Borrelia Burgdorferi
DQRANLGAFQNRLESI

SEQ ID NO: 207976 - protein, 16 aa, Borrelia Burgdorferi
QRANLGAFQNRLESIK

SEQ ID NO: 207977 - protein, 16 aa, Borrelia Burgdorferi
RANLGAFQNRLESIKN

SEQ ID NO: 207978 - protein, 16 aa, Borrelia Burgdorferi
ANLGAFQNRLESIKNS

SEQ ID NO: 207979 - protein, 16 aa, Borrelia Burgdorferi
NLGAFQNRLESIKNST

SEQ ID NO: 207980 - protein, 16 aa, Borrelia Burgdorferi
LGAFQNRLESIKNSTE

SEQ ID NO: 207981 - protein, 16 aa, Borrelia Burgdorferi
GAFQNRLESIKNSTEY

SEQ ID NO: 207982 - protein, 16 aa, Borrelia Burgdorferi
AFQNRLESIKNSTEYA

SEQ ID NO: 207983 - protein, 16 aa, Borrelia Burgdorferi
FQNRLESIKNSTEYAI

SEQ ID NO: 207984 - protein, 16 aa, Borrelia Burgdorferi
QNRLESIKNSTEYAIE

SEQ ID NO: 207985 - protein, 16 aa, Borrelia Burgdorferi
NRLESIKNSTEYAIEN

SEQ ID NO: 207986 - protein, 16 aa, Borrelia Burgdorferi
RLESIKNSTEYAIENL

SEQ ID NO: 207987 - protein, 16 aa, Borrelia Burgdorferi
LESIKNSTEYAIENLK

SEQ ID NO: 207988 - protein, 16 aa, Borrelia Burgdorferi
ESIKNSTEYAIENLKA

SEQ ID NO: 207989 - protein, 16 aa, Borrelia Burgdorferi
SIKNSTEYAIENLKAS

SEQ ID NO: 207990 - protein, 16 aa, Borrelia Burgdorferi
IKNSTEYAIENLKASY

SEQ ID NO: 207991 - protein, 16 aa, Borrelia Burgdorferi
KNSTEYAIENLKASYA

SEQ ID NO: 207992 - protein, 16 aa, Borrelia Burgdorferi
NSTEYAIENLKASYAQ

SEQ ID NO: 207993 - protein, 16 aa, Borrelia Burgdorferi
STEYAIENLKASYAQI

SEQ ID NO: 207994 - protein, 16 aa, Borrelia Burgdorferi
TEYAIENLKASYAQIK

SEQ ID NO: 207995 - protein, 16 aa, Borrelia Burgdorferi
EYAIENLKASYAQIKD

SEQ ID NO: 207996 - protein, 16 aa, Borrelia Burgdorferi
YAIENLKASYAQIKDA

SEQ ID NO: 207997 - protein, 16 aa, Borrelia Burgdorferi
AIENLKASYAQIKDAT

SEQ ID NO: 207998 - protein, 16 aa, Borrelia Burgdorferi
IENLKASYAQIKDATM

SEQ ID NO: 207999 - protein, 16 aa, Borrelia Burgdorferi
ENLKASYAQIKDATMT

SEQ ID NO: 208000 - protein, 16 aa, Borrelia Burgdorferi
NLKASYAQIKDATMTD

SEQ ID NO: 208001 - protein, 16 aa, Borrelia Burgdorferi
LKASYAQIKDATMTDE

SEQ ID NO: 208002 - protein, 16 aa, Borrelia Burgdorferi
KASYAQIKDATMTDEV

SEQ ID NO: 208003 - protein, 16 aa, Borrelia Burgdorferi
ASYAQIKDATMTDEVV

SEQ ID NO: 208004 - protein, 16 aa, Borrelia Burgdorferi
SYAQIKDATMTDEVVA

SEQ ID NO: 208005 - protein, 16 aa, Borrelia Burgdorferi
YAQIKDATMTDEVVAA

SEQ ID NO: 208006 - protein, 16 aa, Borrelia Burgdorferi
AQIKDATMTDEVVAAT

SEQ ID NO: 208007 - protein, 16 aa, Borrelia Burgdorferi
QIKDATMTDEVVAATT

SEQ ID NO: 208008 - protein, 16 aa, Borrelia Burgdorferi
IKDATMTDEVVAATTN

SEQ ID NO: 208009 - protein, 16 aa, Borrelia Burgdorferi
KDATMTDEVVAATTNS

SEQ ID NO: 208010 - protein, 16 aa, Borrelia Burgdorferi
DATMTDEVVAATTNSI

SEQ ID NO: 208011 - protein, 16 aa, Borrelia Burgdorferi
ATMTDEVVAATTNSIL

SEQ ID NO: 208012 - protein, 16 aa, Borrelia Burgdorferi
TMTDEVVAATTNSILT

SEQ ID NO: 208013 - protein, 16 aa, Borrelia Burgdorferi
MTDEVVAATTNSILTQ

SEQ ID NO: 208014 - protein, 16 aa, Borrelia Burgdorferi
TDEVVAATTNSILTQS

SEQ ID NO: 208015 - protein, 16 aa, Borrelia Burgdorferi
DEVVAATTNSILTQSA

SEQ ID NO: 208016 - protein, 16 aa, Borrelia Burgdorferi
EVVAATTNSILTQSAM

SEQ ID NO: 208017 - protein, 16 aa, Borrelia Burgdorferi
VVAATTNSILTQSAMA

SEQ ID NO: 208018 - protein, 16 aa, Borrelia Burgdorferi
VAATTNSILTQSAMAM

SEQ ID NO: 208019 - protein, 16 aa, Borrelia Burgdorferi
AATTNSILTQSAMAMI

SEQ ID NO: 208020 - protein, 16 aa, Borrelia Burgdorferi
ATTNSILTQSAMAMIA

SEQ ID NO: 208021 - protein, 16 aa, Borrelia Burgdorferi
TTNSILTQSAMAMIAQ

SEQ ID NO: 208022 - protein, 16 aa, Borrelia Burgdorferi
TNSILTQSAMAMIAQA

SEQ ID NO: 208023 - protein, 16 aa, Borrelia Burgdorferi
NSILTQSAMAMIAQAN

SEQ ID NO: 208024 - protein, 16 aa, Borrelia Burgdorferi
SILTQSAMAMIAQANQ

SEQ ID NO: 208025 - protein, 16 aa, Borrelia Burgdorferi
ILTQSAMAMIAQANQV

SEQ ID NO: 208026 - protein, 16 aa, Borrelia Burgdorferi
LTQSAMAMIAQANQVP

SEQ ID NO: 208027 - protein, 16 aa, Borrelia Burgdorferi
TQSAMAMIAQANQVPQ

SEQ ID NO: 208028 - protein, 16 aa, Borrelia Burgdorferi
QSAMAMIAQANQVPQY

SEQ ID NO: 208029 - protein, 16 aa, Borrelia Burgdorferi
SAMAMIAQANQVPQYV

SEQ ID NO: 208030 - protein, 16 aa, Borrelia Burgdorferi
AMAMIAQANQVPQYVL

SEQ ID NO: 208031 - protein, 16 aa, Borrelia Burgdorferi
MAMIAQANQVPQYVLS

SEQ ID NO: 208032 - protein, 16 aa, Borrelia Burgdorferi
AMIAQANQVPQYVLSL

SEQ ID NO: 208033 - protein, 16 aa, Borrelia Burgdorferi
MIAQANQVPQYVLSLL

SEQ ID NO: 208034 - protein, 16 aa, Borrelia Burgdorferi
IAQANQVPQYVLSLLR

SEQ ID NO: 208035 - protein, 341 aa, Borrelia afzelii
MKRKAKSILFFLLSTALFAQETDGLTEGSKRAEPGELVLDFAELARDPSSTKLDLTNYVDYVYSGASGIVKPEDMVVDLGISNWSVLLTPSARLQAYVKNSVVAPALVKSESKRYAGDTILGVRVLFPSYSQSSAMIMPPFKIPFYSGESGNQFLGKGLIDNIKTMKEIKVSVYSLGYEVDLEVLFEDMNGMEYAYSLGTLKFKGWADLIWSNPNYIPNISARIIKDDVPNYPLASSKMRFKAFRVSKSHSSKEQNFIFYVKDLRVLYDKLSVSIDSDIDSESVFKVYETSGAESLRKLKAHETFKRVLKLREKISMPEGSFQNFIEKVESDKPEESSSEN

SEQ ID NO: 208036 - protein, 13 aa, Borrelia afzelii
MKRKAKSILFFLL

SEQ ID NO: 208037 - protein, 13 aa, Borrelia afzelii
KRKAKSILFFLLS

SEQ ID NO: 208038 - protein, 13 aa, Borrelia afzelii
RKAKSILFFLLST

SEQ ID NO: 208039 - protein, 13 aa, Borrelia afzelii
KAKSILFFLLSTA

SEQ ID NO: 208040 - protein, 13 aa, Borrelia afzelii
AKSILFFLLSTAL

SEQ ID NO: 208041 - protein, 13 aa, Borrelia afzelii
KSILFFLLSTALF

SEQ ID NO: 208042 - protein, 13 aa, Borrelia afzelii
SILFFLLSTALFA

SEQ ID NO: 208043 - protein, 13 aa, Borrelia afzelii
ILFFLLSTALFAQ

SEQ ID NO: 208044 - protein, 13 aa, Borrelia afzelii
LFFLLSTALFAQE

SEQ ID NO: 208045 - protein, 13 aa, Borrelia afzelii
FFLLSTALFAQET

SEQ ID NO: 208046 - protein, 13 aa, Borrelia afzelii
FLLSTALFAQETD

SEQ ID NO: 208047 - protein, 13 aa, Borrelia afzelii
LLSTALFAQETDG

SEQ ID NO: 208048 - protein, 13 aa, Borrelia afzelii
LSTALFAQETDGL

SEQ ID NO: 208049 - protein, 13 aa, Borrelia afzelii
STALFAQETDGLT

SEQ ID NO: 208050 - protein, 13 aa, Borrelia afzelii
TALFAQETDGLTE

SEQ ID NO: 208051 - protein, 13 aa, Borrelia afzelii
ALFAQETDGLTEG

SEQ ID NO: 208052 - protein, 13 aa, Borrelia afzelii
LFAQETDGLTEGS

SEQ ID NO: 208053 - protein, 13 aa, Borrelia afzelii
FAQETDGLTEGSK

SEQ ID NO: 208054 - protein, 13 aa, Borrelia afzelii
AQETDGLTEGSKR

SEQ ID NO: 208055 - protein, 13 aa, Borrelia afzelii
QETDGLTEGSKRA

SEQ ID NO: 208056 - protein, 13 aa, Borrelia afzelii
ETDGLTEGSKRAE

SEQ ID NO: 208057 - protein, 13 aa, Borrelia afzelii
TDGLTEGSKRAEP

SEQ ID NO: 208058 - protein, 13 aa, Borrelia afzelii
DGLTEGSKRAEPG

SEQ ID NO: 208059 - protein, 13 aa, Borrelia afzelii
GLTEGSKRAEPGE

SEQ ID NO: 208060 - protein, 13 aa, Borrelia afzelii
LTEGSKRAEPGEL

SEQ ID NO: 208061 - protein, 13 aa, Borrelia afzelii
TEGSKRAEPGELV

SEQ ID NO: 208062 - protein, 13 aa, Borrelia afzelii
EGSKRAEPGELVL

SEQ ID NO: 208063 - protein, 13 aa, Borrelia afzelii
GSKRAEPGELVLD

SEQ ID NO: 208064 - protein, 13 aa, Borrelia afzelii
SKRAEPGELVLDF

SEQ ID NO: 208065 - protein, 13 aa, Borrelia afzelii
KRAEPGELVLDFA

SEQ ID NO: 208066 - protein, 13 aa, Borrelia afzelii
RAEPGELVLDFAE

SEQ ID NO: 208067 - protein, 13 aa, Borrelia afzelii
AEPGELVLDFAEL

SEQ ID NO: 208068 - protein, 13 aa, Borrelia afzelii
EPGELVLDFAELA

SEQ ID NO: 208069 - protein, 13 aa, Borrelia afzelii
PGELVLDFAELAR

SEQ ID NO: 208070 - protein, 13 aa, Borrelia afzelii
GELVLDFAELARD

SEQ ID NO: 208071 - protein, 13 aa, Borrelia afzelii
ELVLDFAELARDP

SEQ ID NO: 208072 - protein, 13 aa, Borrelia afzelii
LVLDFAELARDPS

SEQ ID NO: 208073 - protein, 13 aa, Borrelia afzelii
VLDFAELARDPSS

SEQ ID NO: 208074 - protein, 13 aa, Borrelia afzelii
LDFAELARDPSST

SEQ ID NO: 208075 - protein, 13 aa, Borrelia afzelii
DFAELARDPSSTK

SEQ ID NO: 208076 - protein, 13 aa, Borrelia afzelii
FAELARDPSSTKL

SEQ ID NO: 208077 - protein, 13 aa, Borrelia afzelii
AELARDPSSTKLD

SEQ ID NO: 208078 - protein, 13 aa, Borrelia afzelii
ELARDPSSTKLDL

SEQ ID NO: 208079 - protein, 13 aa, Borrelia afzelii
LARDPSSTKLDLT

SEQ ID NO: 208080 - protein, 13 aa, Borrelia afzelii
ARDPSSTKLDLTN

SEQ ID NO: 208081 - protein, 13 aa, Borrelia afzelii
RDPSSTKLDLTNY

SEQ ID NO: 208082 - protein, 13 aa, Borrelia afzelii
DPSSTKLDLTNYV

SEQ ID NO: 208083 - protein, 13 aa, Borrelia afzelii
PSSTKLDLTNYVD

SEQ ID NO: 208084 - protein, 13 aa, Borrelia afzelii
SSTKLDLTNYVDY

SEQ ID NO: 208085 - protein, 13 aa, Borrelia afzelii
STKLDLTNYVDYV

SEQ ID NO: 208086 - protein, 13 aa, Borrelia afzelii
TKLDLTNYVDYVY

SEQ ID NO: 208087 - protein, 13 aa, Borrelia afzelii
KLDLTNYVDYVYS

SEQ ID NO: 208088 - protein, 13 aa, Borrelia afzelii
LDLTNYVDYVYSG

SEQ ID NO: 208089 - protein, 13 aa, Borrelia afzelii
DLTNYVDYVYSGA

SEQ ID NO: 208090 - protein, 13 aa, Borrelia afzelii
LTNYVDYVYSGAS

SEQ ID NO: 208091 - protein, 13 aa, Borrelia afzelii
TNYVDYVYSGASG

SEQ ID NO: 208092 - protein, 13 aa, Borrelia afzelii
NYVDYVYSGASGI

SEQ ID NO: 208093 - protein, 13 aa, Borrelia afzelii
YVDYVYSGASGIV

SEQ ID NO: 208094 - protein, 13 aa, Borrelia afzelii
VDYVYSGASGIVK

SEQ ID NO: 208095 - protein, 13 aa, Borrelia afzelii
DYVYSGASGIVKP

SEQ ID NO: 208096 - protein, 13 aa, Borrelia afzelii
YVYSGASGIVKPE

SEQ ID NO: 208097 - protein, 13 aa, Borrelia afzelii
VYSGASGIVKPED

SEQ ID NO: 208098 - protein, 13 aa, Borrelia afzelii
YSGASGIVKPEDM

SEQ ID NO: 208099 - protein, 13 aa, Borrelia afzelii
SGASGIVKPEDMV

SEQ ID NO: 208100 - protein, 13 aa, Borrelia afzelii
GASGIVKPEDMVV

SEQ ID NO: 208101 - protein, 13 aa, Borrelia afzelii
ASGIVKPEDMVVD

SEQ ID NO: 208102 - protein, 13 aa, Borrelia afzelii
SGIVKPEDMVVDL

SEQ ID NO: 208103 - protein, 13 aa, Borrelia afzelii
GIVKPEDMVVDLG

SEQ ID NO: 208104 - protein, 13 aa, Borrelia afzelii
IVKPEDMVVDLGI

SEQ ID NO: 208105 - protein, 13 aa, Borrelia afzelii
VKPEDMVVDLGIS

SEQ ID NO: 208106 - protein, 13 aa, Borrelia afzelii
KPEDMVVDLGISN

SEQ ID NO: 208107 - protein, 13 aa, Borrelia afzelii
PEDMVVDLGISNW

SEQ ID NO: 208108 - protein, 13 aa, Borrelia afzelii
EDMVVDLGISNWS

SEQ ID NO: 208109 - protein, 13 aa, Borrelia afzelii
DMVVDLGISNWSV

SEQ ID NO: 208110 - protein, 13 aa, Borrelia afzelii
MVVDLGISNWSVL

SEQ ID NO: 208111 - protein, 13 aa, Borrelia afzelii
VVDLGISNWSVLL

SEQ ID NO: 208112 - protein, 13 aa, Borrelia afzelii
VDLGISNWSVLLT

SEQ ID NO: 208113 - protein, 13 aa, Borrelia afzelii
DLGISNWSVLLTP

SEQ ID NO: 208114 - protein, 13 aa, Borrelia afzelii
LGISNWSVLLTPS

SEQ ID NO: 208115 - protein, 13 aa, Borrelia afzelii
GISNWSVLLTPSA

SEQ ID NO: 208116 - protein, 13 aa, Borrelia afzelii
ISNWSVLLTPSAR

SEQ ID NO: 208117 - protein, 13 aa, Borrelia afzelii
SNWSVLLTPSARL

SEQ ID NO: 208118 - protein, 13 aa, Borrelia afzelii
NWSVLLTPSARLQ

SEQ ID NO: 208119 - protein, 13 aa, Borrelia afzelii
WSVLLTPSARLQA

SEQ ID NO: 208120 - protein, 13 aa, Borrelia afzelii
SVLLTPSARLQAY

SEQ ID NO: 208121 - protein, 13 aa, Borrelia afzelii
VLLTPSARLQAYV

SEQ ID NO: 208122 - protein, 13 aa, Borrelia afzelii
LLTPSARLQAYVK

SEQ ID NO: 208123 - protein, 13 aa, Borrelia afzelii
LTPSARLQAYVKN

SEQ ID NO: 208124 - protein, 13 aa, Borrelia afzelii
TPSARLQAYVKNS

SEQ ID NO: 208125 - protein, 13 aa, Borrelia afzelii
PSARLQAYVKNSV

SEQ ID NO: 208126 - protein, 13 aa, Borrelia afzelii
SARLQAYVKNSVV

SEQ ID NO: 208127 - protein, 13 aa, Borrelia afzelii
ARLQAYVKNSVVA

SEQ ID NO: 208128 - protein, 13 aa, Borrelia afzelii
RLQAYVKNSVVAP

SEQ ID NO: 208129 - protein, 13 aa, Borrelia afzelii
LQAYVKNSVVAPA

SEQ ID NO: 208130 - protein, 13 aa, Borrelia afzelii
QAYVKNSVVAPAL

SEQ ID NO: 208131 - protein, 13 aa, Borrelia afzelii
AYVKNSVVAPALV

SEQ ID NO: 208132 - protein, 13 aa, Borrelia afzelii
YVKNSVVAPALVK

SEQ ID NO: 208133 - protein, 13 aa, Borrelia afzelii
VKNSVVAPALVKS

SEQ ID NO: 208134 - protein, 13 aa, Borrelia afzelii
KNSVVAPALVKSE

SEQ ID NO: 208135 - protein, 13 aa, Borrelia afzelii
NSVVAPALVKSES

SEQ ID NO: 208136 - protein, 13 aa, Borrelia afzelii
SVVAPALVKSESK

SEQ ID NO: 208137 - protein, 13 aa, Borrelia afzelii
VVAPALVKSESKR

SEQ ID NO: 208138 - protein, 13 aa, Borrelia afzelii
VAPALVKSESKRY

SEQ ID NO: 208139 - protein, 13 aa, Borrelia afzelii
APALVKSESKRYA

SEQ ID NO: 208140 - protein, 13 aa, Borrelia afzelii
PALVKSESKRYAG

SEQ ID NO: 208141 - protein, 13 aa, Borrelia afzelii
ALVKSESKRYAGD

SEQ ID NO: 208142 - protein, 13 aa, Borrelia afzelii
LVKSESKRYAGDT

SEQ ID NO: 208143 - protein, 13 aa, Borrelia afzelii
VKSESKRYAGDTI

SEQ ID NO: 208144 - protein, 13 aa, Borrelia afzelii
KSESKRYAGDTIL

SEQ ID NO: 208145 - protein, 13 aa, Borrelia afzelii
SESKRYAGDTILG

SEQ ID NO: 208146 - protein, 13 aa, Borrelia afzelii
ESKRYAGDTILGV

SEQ ID NO: 208147 - protein, 13 aa, Borrelia afzelii
SKRYAGDTILGVR

SEQ ID NO: 208148 - protein, 13 aa, Borrelia afzelii
KRYAGDTILGVRV

SEQ ID NO: 208149 - protein, 13 aa, Borrelia afzelii
RYAGDTILGVRVL

SEQ ID NO: 208150 - protein, 13 aa, Borrelia afzelii
YAGDTILGVRVLF

SEQ ID NO: 208151 - protein, 13 aa, Borrelia afzelii
AGDTILGVRVLFP

SEQ ID NO: 208152 - protein, 13 aa, Borrelia afzelii
GDTILGVRVLFPS

SEQ ID NO: 208153 - protein, 13 aa, Borrelia afzelii
DTILGVRVLFPSY

SEQ ID NO: 208154 - protein, 13 aa, Borrelia afzelii
TILGVRVLFPSYS

SEQ ID NO: 208155 - protein, 13 aa, Borrelia afzelii
ILGVRVLFPSYSQ

SEQ ID NO: 208156 - protein, 13 aa, Borrelia afzelii
LGVRVLFPSYSQS

SEQ ID NO: 208157 - protein, 13 aa, Borrelia afzelii
GVRVLFPSYSQSS

SEQ ID NO: 208158 - protein, 13 aa, Borrelia afzelii
VRVLFPSYSQSSA

SEQ ID NO: 208159 - protein, 13 aa, Borrelia afzelii
RVLFPSYSQSSAM

SEQ ID NO: 208160 - protein, 13 aa, Borrelia afzelii
VLFPSYSQSSAMI

SEQ ID NO: 208161 - protein, 13 aa, Borrelia afzelii
LFPSYSQSSAMIM

SEQ ID NO: 208162 - protein, 13 aa, Borrelia afzelii
FPSYSQSSAMIMP

SEQ ID NO: 208163 - protein, 13 aa, Borrelia afzelii
PSYSQSSAMIMPP

SEQ ID NO: 208164 - protein, 13 aa, Borrelia afzelii
SYSQSSAMIMPPF

SEQ ID NO: 208165 - protein, 13 aa, Borrelia afzelii
YSQSSAMIMPPFK

SEQ ID NO: 208166 - protein, 13 aa, Borrelia afzelii
SQSSAMIMPPFKI

SEQ ID NO: 208167 - protein, 13 aa, Borrelia afzelii
QSSAMIMPPFKIP

SEQ ID NO: 208168 - protein, 13 aa, Borrelia afzelii
SSAMIMPPFKIPF

SEQ ID NO: 208169 - protein, 13 aa, Borrelia afzelii
SAMIMPPFKIPFY

SEQ ID NO: 208170 - protein, 13 aa, Borrelia afzelii
AMIMPPFKIPFYS

SEQ ID NO: 208171 - protein, 13 aa, Borrelia afzelii
MIMPPFKIPFYSG

SEQ ID NO: 208172 - protein, 13 aa, Borrelia afzelii
IMPPFKIPFYSGE

SEQ ID NO: 208173 - protein, 13 aa, Borrelia afzelii
MPPFKIPFYSGES

SEQ ID NO: 208174 - protein, 13 aa, Borrelia afzelii
PPFKIPFYSGESG

SEQ ID NO: 208175 - protein, 13 aa, Borrelia afzelii
PFKIPFYSGESGN

SEQ ID NO: 208176 - protein, 13 aa, Borrelia afzelii
FKIPFYSGESGNQ

SEQ ID NO: 208177 - protein, 13 aa, Borrelia afzelii
KIPFYSGESGNQF

SEQ ID NO: 208178 - protein, 13 aa, Borrelia afzelii
IPFYSGESGNQFL

SEQ ID NO: 208179 - protein, 13 aa, Borrelia afzelii
PFYSGESGNQFLG

SEQ ID NO: 208180 - protein, 13 aa, Borrelia afzelii
FYSGESGNQFLGK

SEQ ID NO: 208181 - protein, 13 aa, Borrelia afzelii
YSGESGNQFLGKG

SEQ ID NO: 208182 - protein, 13 aa, Borrelia afzelii
SGESGNQFLGKGL

SEQ ID NO: 208183 - protein, 13 aa, Borrelia afzelii
GESGNQFLGKGLI

SEQ ID NO: 208184 - protein, 13 aa, Borrelia afzelii
ESGNQFLGKGLID

SEQ ID NO: 208185 - protein, 13 aa, Borrelia afzelii
SGNQFLGKGLIDN

SEQ ID NO: 208186 - protein, 13 aa, Borrelia afzelii
GNQFLGKGLIDNI

SEQ ID NO: 208187 - protein, 13 aa, Borrelia afzelii
NQFLGKGLIDNIK

SEQ ID NO: 208188 - protein, 13 aa, Borrelia afzelii
QFLGKGLIDNIKT

SEQ ID NO: 208189 - protein, 13 aa, Borrelia afzelii
FLGKGLIDNIKTM

SEQ ID NO: 208190 - protein, 13 aa, Borrelia afzelii
LGKGLIDNIKTMK

SEQ ID NO: 208191 - protein, 13 aa, Borrelia afzelii
GKGLIDNIKTMKE

SEQ ID NO: 208192 - protein, 13 aa, Borrelia afzelii
KGLIDNIKTMKEI

SEQ ID NO: 208193 - protein, 13 aa, Borrelia afzelii
GLIDNIKTMKEIK

SEQ ID NO: 208194 - protein, 13 aa, Borrelia afzelii
LIDNIKTMKEIKV

SEQ ID NO: 208195 - protein, 13 aa, Borrelia afzelii
IDNIKTMKEIKVS

SEQ ID NO: 208196 - protein, 13 aa, Borrelia afzelii
DNIKTMKEIKVSV

SEQ ID NO: 208197 - protein, 13 aa, Borrelia afzelii
NIKTMKEIKVSVY

SEQ ID NO: 208198 - protein, 13 aa, Borrelia afzelii
IKTMKEIKVSVYS

SEQ ID NO: 208199 - protein, 13 aa, Borrelia afzelii
KTMKEIKVSVYSL

SEQ ID NO: 208200 - protein, 13 aa, Borrelia afzelii
TMKEIKVSVYSLG

SEQ ID NO: 208201 - protein, 13 aa, Borrelia afzelii
MKEIKVSVYSLGY

SEQ ID NO: 208202 - protein, 13 aa, Borrelia afzelii
KEIKVSVYSLGYE

SEQ ID NO: 208203 - protein, 13 aa, Borrelia afzelii
EIKVSVYSLGYEV

SEQ ID NO: 208204 - protein, 13 aa, Borrelia afzelii
IKVSVYSLGYEVD

SEQ ID NO: 208205 - protein, 13 aa, Borrelia afzelii
KVSVYSLGYEVDL

SEQ ID NO: 208206 - protein, 13 aa, Borrelia afzelii
VSVYSLGYEVDLE

SEQ ID NO: 208207 - protein, 13 aa, Borrelia afzelii
SVYSLGYEVDLEV

SEQ ID NO: 208208 - protein, 13 aa, Borrelia afzelii
VYSLGYEVDLEVL

SEQ ID NO: 208209 - protein, 13 aa, Borrelia afzelii
YSLGYEVDLEVLF

SEQ ID NO: 208210 - protein, 13 aa, Borrelia afzelii
SLGYEVDLEVLFE

SEQ ID NO: 208211 - protein, 13 aa, Borrelia afzelii
LGYEVDLEVLFED

SEQ ID NO: 208212 - protein, 13 aa, Borrelia afzelii
GYEVDLEVLFEDM

SEQ ID NO: 208213 - protein, 13 aa, Borrelia afzelii
YEVDLEVLFEDMN

SEQ ID NO: 208214 - protein, 13 aa, Borrelia afzelii
EVDLEVLFEDMNG

SEQ ID NO: 208215 - protein, 13 aa, Borrelia afzelii
VDLEVLFEDMNGM

SEQ ID NO: 208216 - protein, 13 aa, Borrelia afzelii
DLEVLFEDMNGME

SEQ ID NO: 208217 - protein, 13 aa, Borrelia afzelii
LEVLFEDMNGMEY

SEQ ID NO: 208218 - protein, 13 aa, Borrelia afzelii
EVLFEDMNGMEYA

SEQ ID NO: 208219 - protein, 13 aa, Borrelia afzelii
VLFEDMNGMEYAY

SEQ ID NO: 208220 - protein, 13 aa, Borrelia afzelii
LFEDMNGMEYAYS

SEQ ID NO: 208221 - protein, 13 aa, Borrelia afzelii
FEDMNGMEYAYSL

SEQ ID NO: 208222 - protein, 13 aa, Borrelia afzelii
EDMNGMEYAYSLG

SEQ ID NO: 208223 - protein, 13 aa, Borrelia afzelii
DMNGMEYAYSLGT

SEQ ID NO: 208224 - protein, 13 aa, Borrelia afzelii
MNGMEYAYSLGTL

SEQ ID NO: 208225 - protein, 13 aa, Borrelia afzelii
NGMEYAYSLGTLK

SEQ ID NO: 208226 - protein, 13 aa, Borrelia afzelii
GMEYAYSLGTLKF

SEQ ID NO: 208227 - protein, 13 aa, Borrelia afzelii
MEYAYSLGTLKFK

SEQ ID NO: 208228 - protein, 13 aa, Borrelia afzelii
EYAYSLGTLKFKG

SEQ ID NO: 208229 - protein, 13 aa, Borrelia afzelii
YAYSLGTLKFKGW

SEQ ID NO: 208230 - protein, 13 aa, Borrelia afzelii
AYSLGTLKFKGWA

SEQ ID NO: 208231 - protein, 13 aa, Borrelia afzelii
YSLGTLKFKGWAD

SEQ ID NO: 208232 - protein, 13 aa, Borrelia afzelii
SLGTLKFKGWADL

SEQ ID NO: 208233 - protein, 13 aa, Borrelia afzelii
LGTLKFKGWADLI

SEQ ID NO: 208234 - protein, 13 aa, Borrelia afzelii
GTLKFKGWADLIW

SEQ ID NO: 208235 - protein, 13 aa, Borrelia afzelii
TLKFKGWADLIWS

SEQ ID NO: 208236 - protein, 13 aa, Borrelia afzelii
LKFKGWADLIWSN

SEQ ID NO: 208237 - protein, 13 aa, Borrelia afzelii
KFKGWADLIWSNP

SEQ ID NO: 208238 - protein, 13 aa, Borrelia afzelii
FKGWADLIWSNPN

SEQ ID NO: 208239 - protein, 13 aa, Borrelia afzelii
KGWADLIWSNPNY

SEQ ID NO: 208240 - protein, 13 aa, Borrelia afzelii
GWADLIWSNPNYI

SEQ ID NO: 208241 - protein, 13 aa, Borrelia afzelii
WADLIWSNPNYIP

SEQ ID NO: 208242 - protein, 13 aa, Borrelia afzelii
ADLIWSNPNYIPN

SEQ ID NO: 208243 - protein, 13 aa, Borrelia afzelii
DLIWSNPNYIPNI

SEQ ID NO: 208244 - protein, 13 aa, Borrelia afzelii
LIWSNPNYIPNIS

SEQ ID NO: 208245 - protein, 13 aa, Borrelia afzelii
IWSNPNYIPNISA

SEQ ID NO: 208246 - protein, 13 aa, Borrelia afzelii
WSNPNYIPNISAR

SEQ ID NO: 208247 - protein, 13 aa, Borrelia afzelii
SNPNYIPNISARI

SEQ ID NO: 208248 - protein, 13 aa, Borrelia afzelii
NPNYIPNISARII

SEQ ID NO: 208249 - protein, 13 aa, Borrelia afzelii
PNYIPNISARIIK

SEQ ID NO: 208250 - protein, 13 aa, Borrelia afzelii
NYIPNISARIIKD

SEQ ID NO: 208251 - protein, 13 aa, Borrelia afzelii
YIPNISARIIKDD

SEQ ID NO: 208252 - protein, 13 aa, Borrelia afzelii
IPNISARIIKDDV

SEQ ID NO: 208253 - protein, 13 aa, Borrelia afzelii
PNISARIIKDDVP

SEQ ID NO: 208254 - protein, 13 aa, Borrelia afzelii
NISARIIKDDVPN

SEQ ID NO: 208255 - protein, 13 aa, Borrelia afzelii
ISARIIKDDVPNY

SEQ ID NO: 208256 - protein, 13 aa, Borrelia afzelii
SARIIKDDVPNYP

SEQ ID NO: 208257 - protein, 13 aa, Borrelia afzelii
ARIIKDDVPNYPL

SEQ ID NO: 208258 - protein, 13 aa, Borrelia afzelii
RIIKDDVPNYPLA

SEQ ID NO: 208259 - protein, 13 aa, Borrelia afzelii
IIKDDVPNYPLAS

SEQ ID NO: 208260 - protein, 13 aa, Borrelia afzelii
IKDDVPNYPLASS

SEQ ID NO: 208261 - protein, 13 aa, Borrelia afzelii
KDDVPNYPLASSK

SEQ ID NO: 208262 - protein, 13 aa, Borrelia afzelii
DDVPNYPLASSKM

SEQ ID NO: 208263 - protein, 13 aa, Borrelia afzelii
DVPNYPLASSKMR

SEQ ID NO: 208264 - protein, 13 aa, Borrelia afzelii
VPNYPLASSKMRF

SEQ ID NO: 208265 - protein, 13 aa, Borrelia afzelii
PNYPLASSKMRFK

SEQ ID NO: 208266 - protein, 13 aa, Borrelia afzelii
NYPLASSKMRFKA

SEQ ID NO: 208267 - protein, 13 aa, Borrelia afzelii
YPLASSKMRFKAF

SEQ ID NO: 208268 - protein, 13 aa, Borrelia afzelii
PLASSKMRFKAFR

SEQ ID NO: 208269 - protein, 13 aa, Borrelia afzelii
LASSKMRFKAFRV

SEQ ID NO: 208270 - protein, 13 aa, Borrelia afzelii
ASSKMRFKAFRVS

SEQ ID NO: 208271 - protein, 13 aa, Borrelia afzelii
SSKMRFKAFRVSK

SEQ ID NO: 208272 - protein, 13 aa, Borrelia afzelii
SKMRFKAFRVSKS

SEQ ID NO: 208273 - protein, 13 aa, Borrelia afzelii
KMRFKAFRVSKSH

SEQ ID NO: 208274 - protein, 13 aa, Borrelia afzelii
MRFKAFRVSKSHS

SEQ ID NO: 208275 - protein, 13 aa, Borrelia afzelii
RFKAFRVSKSHSS

SEQ ID NO: 208276 - protein, 13 aa, Borrelia afzelii
FKAFRVSKSHSSK

SEQ ID NO: 208277 - protein, 13 aa, Borrelia afzelii
KAFRVSKSHSSKE

SEQ ID NO: 208278 - protein, 13 aa, Borrelia afzelii
AFRVSKSHSSKEQ

SEQ ID NO: 208279 - protein, 13 aa, Borrelia afzelii
FRVSKSHSSKEQN

SEQ ID NO: 208280 - protein, 13 aa, Borrelia afzelii
RVSKSHSSKEQNF

SEQ ID NO: 208281 - protein, 13 aa, Borrelia afzelii
VSKSHSSKEQNFI

SEQ ID NO: 208282 - protein, 13 aa, Borrelia afzelii
SKSHSSKEQNFIF

SEQ ID NO: 208283 - protein, 13 aa, Borrelia afzelii
KSHSSKEQNFIFY

SEQ ID NO: 208284 - protein, 13 aa, Borrelia afzelii
SHSSKEQNFIFYV

SEQ ID NO: 208285 - protein, 13 aa, Borrelia afzelii
HSSKEQNFIFYVK

SEQ ID NO: 208286 - protein, 13 aa, Borrelia afzelii
SSKEQNFIFYVKD

SEQ ID NO: 208287 - protein, 13 aa, Borrelia afzelii
SKEQNFIFYVKDL

SEQ ID NO: 208288 - protein, 13 aa, Borrelia afzelii
KEQNFIFYVKDLR

SEQ ID NO: 208289 - protein, 13 aa, Borrelia afzelii
EQNFIFYVKDLRV

SEQ ID NO: 208290 - protein, 13 aa, Borrelia afzelii
QNFIFYVKDLRVL

SEQ ID NO: 208291 - protein, 13 aa, Borrelia afzelii
NFIFYVKDLRVLY

SEQ ID NO: 208292 - protein, 13 aa, Borrelia afzelii
FIFYVKDLRVLYD

SEQ ID NO: 208293 - protein, 13 aa, Borrelia afzelii
IFYVKDLRVLYDK

SEQ ID NO: 208294 - protein, 13 aa, Borrelia afzelii
FYVKDLRVLYDKL

SEQ ID NO: 208295 - protein, 13 aa, Borrelia afzelii
YVKDLRVLYDKLS

SEQ ID NO: 208296 - protein, 13 aa, Borrelia afzelii
VKDLRVLYDKLSV

SEQ ID NO: 208297 - protein, 13 aa, Borrelia afzelii
KDLRVLYDKLSVS

SEQ ID NO: 208298 - protein, 13 aa, Borrelia afzelii
DLRVLYDKLSVSI

SEQ ID NO: 208299 - protein, 13 aa, Borrelia afzelii
LRVLYDKLSVSID

SEQ ID NO: 208300 - protein, 13 aa, Borrelia afzelii
RVLYDKLSVSIDS

SEQ ID NO: 208301 - protein, 13 aa, Borrelia afzelii
VLYDKLSVSIDSD

SEQ ID NO: 208302 - protein, 13 aa, Borrelia afzelii
LYDKLSVSIDSDI

SEQ ID NO: 208303 - protein, 13 aa, Borrelia afzelii
YDKLSVSIDSDID

SEQ ID NO: 208304 - protein, 13 aa, Borrelia afzelii
DKLSVSIDSDIDS

SEQ ID NO: 208305 - protein, 13 aa, Borrelia afzelii
KLSVSIDSDIDSE

SEQ ID NO: 208306 - protein, 13 aa, Borrelia afzelii
LSVSIDSDIDSES

SEQ ID NO: 208307 - protein, 13 aa, Borrelia afzelii
SVSIDSDIDSESV

SEQ ID NO: 208308 - protein, 13 aa, Borrelia afzelii
VSIDSDIDSESVF

SEQ ID NO: 208309 - protein, 13 aa, Borrelia afzelii
SIDSDIDSESVFK

SEQ ID NO: 208310 - protein, 13 aa, Borrelia afzelii
IDSDIDSESVFKV

SEQ ID NO: 208311 - protein, 13 aa, Borrelia afzelii
DSDIDSESVFKVY

SEQ ID NO: 208312 - protein, 13 aa, Borrelia afzelii
SDIDSESVFKVYE

SEQ ID NO: 208313 - protein, 13 aa, Borrelia afzelii
DIDSESVFKVYET

SEQ ID NO: 208314 - protein, 13 aa, Borrelia afzelii
IDSESVFKVYETS

SEQ ID NO: 208315 - protein, 13 aa, Borrelia afzelii
DSESVFKVYETSG

SEQ ID NO: 208316 - protein, 13 aa, Borrelia afzelii
SESVFKVYETSGA

SEQ ID NO: 208317 - protein, 13 aa, Borrelia afzelii
ESVFKVYETSGAE

SEQ ID NO: 208318 - protein, 13 aa, Borrelia afzelii
SVFKVYETSGAES

SEQ ID NO: 208319 - protein, 13 aa, Borrelia afzelii
VFKVYETSGAESL

SEQ ID NO: 208320 - protein, 13 aa, Borrelia afzelii
FKVYETSGAESLR

SEQ ID NO: 208321 - protein, 13 aa, Borrelia afzelii
KVYETSGAESLRK

SEQ ID NO: 208322 - protein, 13 aa, Borrelia afzelii
VYETSGAESLRKL

SEQ ID NO: 208323 - protein, 13 aa, Borrelia afzelii
YETSGAESLRKLK

SEQ ID NO: 208324 - protein, 13 aa, Borrelia afzelii
ETSGAESLRKLKA

SEQ ID NO: 208325 - protein, 13 aa, Borrelia afzelii
TSGAESLRKLKAH

SEQ ID NO: 208326 - protein, 13 aa, Borrelia afzelii
SGAESLRKLKAHE

SEQ ID NO: 208327 - protein, 13 aa, Borrelia afzelii
GAESLRKLKAHET

SEQ ID NO: 208328 - protein, 13 aa, Borrelia afzelii
AESLRKLKAHETF

SEQ ID NO: 208329 - protein, 13 aa, Borrelia afzelii
ESLRKLKAHETFK

SEQ ID NO: 208330 - protein, 13 aa, Borrelia afzelii
SLRKLKAHETFKR

SEQ ID NO: 208331 - protein, 13 aa, Borrelia afzelii
LRKLKAHETFKRV

SEQ ID NO: 208332 - protein, 13 aa, Borrelia afzelii
RKLKAHETFKRVL

SEQ ID NO: 208333 - protein, 13 aa, Borrelia afzelii
KLKAHETFKRVLK

SEQ ID NO: 208334 - protein, 13 aa, Borrelia afzelii
LKAHETFKRVLKL

SEQ ID NO: 208335 - protein, 13 aa, Borrelia afzelii
KAHETFKRVLKLR

SEQ ID NO: 208336 - protein, 13 aa, Borrelia afzelii
AHETFKRVLKLRE

SEQ ID NO: 208337 - protein, 13 aa, Borrelia afzelii
HETFKRVLKLREK

SEQ ID NO: 208338 - protein, 13 aa, Borrelia afzelii
ETFKRVLKLREKI

SEQ ID NO: 208339 - protein, 13 aa, Borrelia afzelii
TFKRVLKLREKIS

SEQ ID NO: 208340 - protein, 13 aa, Borrelia afzelii
FKRVLKLREKISM

SEQ ID NO: 208341 - protein, 13 aa, Borrelia afzelii
KRVLKLREKISMP

SEQ ID NO: 208342 - protein, 13 aa, Borrelia afzelii
RVLKLREKISMPE

SEQ ID NO: 208343 - protein, 13 aa, Borrelia afzelii
VLKLREKISMPEG

SEQ ID NO: 208344 - protein, 13 aa, Borrelia afzelii
LKLREKISMPEGS

SEQ ID NO: 208345 - protein, 13 aa, Borrelia afzelii
KLREKISMPEGSF

SEQ ID NO: 208346 - protein, 13 aa, Borrelia afzelii
LREKISMPEGSFQ

SEQ ID NO: 208347 - protein, 13 aa, Borrelia afzelii
REKISMPEGSFQN

SEQ ID NO: 208348 - protein, 13 aa, Borrelia afzelii
EKISMPEGSFQNF

SEQ ID NO: 208349 - protein, 13 aa, Borrelia afzelii
KISMPEGSFQNFI

SEQ ID NO: 208350 - protein, 13 aa, Borrelia afzelii
ISMPEGSFQNFIE

SEQ ID NO: 208351 - protein, 13 aa, Borrelia afzelii
SMPEGSFQNFIEK

SEQ ID NO: 208352 - protein, 13 aa, Borrelia afzelii
MPEGSFQNFIEKV

SEQ ID NO: 208353 - protein, 13 aa, Borrelia afzelii
PEGSFQNFIEKVE

SEQ ID NO: 208354 - protein, 13 aa, Borrelia afzelii
EGSFQNFIEKVES

SEQ ID NO: 208355 - protein, 13 aa, Borrelia afzelii
GSFQNFIEKVESD

SEQ ID NO: 208356 - protein, 13 aa, Borrelia afzelii
SFQNFIEKVESDK

SEQ ID NO: 208357 - protein, 13 aa, Borrelia afzelii
FQNFIEKVESDKP

SEQ ID NO: 208358 - protein, 13 aa, Borrelia afzelii
QNFIEKVESDKPE

SEQ ID NO: 208359 - protein, 13 aa, Borrelia afzelii
NFIEKVESDKPEE

SEQ ID NO: 208360 - protein, 13 aa, Borrelia afzelii
FIEKVESDKPEES

SEQ ID NO: 208361 - protein, 13 aa, Borrelia afzelii
IEKVESDKPEESS

SEQ ID NO: 208362 - protein, 13 aa, Borrelia afzelii
EKVESDKPEESSS

SEQ ID NO: 208363 - protein, 13 aa, Borrelia afzelii
KVESDKPEESSSE

SEQ ID NO: 208364 - protein, 13 aa, Borrelia afzelii
VESDKPEESSSEN

SEQ ID NO: 208365 - protein, 14 aa, Borrelia afzelii
MKRKAKSILFFLLS

SEQ ID NO: 208366 - protein, 14 aa, Borrelia afzelii
KRKAKSILFFLLST

SEQ ID NO: 208367 - protein, 14 aa, Borrelia afzelii
RKAKSILFFLLSTA

SEQ ID NO: 208368 - protein, 14 aa, Borrelia afzelii
KAKSILFFLLSTAL

SEQ ID NO: 208369 - protein, 14 aa, Borrelia afzelii
AKSILFFLLSTALF

SEQ ID NO: 208370 - protein, 14 aa, Borrelia afzelii
KSILFFLLSTALFA

SEQ ID NO: 208371 - protein, 14 aa, Borrelia afzelii
SILFFLLSTALFAQ

SEQ ID NO: 208372 - protein, 14 aa, Borrelia afzelii
ILFFLLSTALFAQE

SEQ ID NO: 208373 - protein, 14 aa, Borrelia afzelii
LFFLLSTALFAQET

SEQ ID NO: 208374 - protein, 14 aa, Borrelia afzelii
FFLLSTALFAQETD

SEQ ID NO: 208375 - protein, 14 aa, Borrelia afzelii
FLLSTALFAQETDG

SEQ ID NO: 208376 - protein, 14 aa, Borrelia afzelii
LLSTALFAQETDGL

SEQ ID NO: 208377 - protein, 14 aa, Borrelia afzelii
LSTALFAQETDGLT

SEQ ID NO: 208378 - protein, 14 aa, Borrelia afzelii
STALFAQETDGLTE

SEQ ID NO: 208379 - protein, 14 aa, Borrelia afzelii
TALFAQETDGLTEG

SEQ ID NO: 208380 - protein, 14 aa, Borrelia afzelii
ALFAQETDGLTEGS

SEQ ID NO: 208381 - protein, 14 aa, Borrelia afzelii
LFAQETDGLTEGSK

SEQ ID NO: 208382 - protein, 14 aa, Borrelia afzelii
FAQETDGLTEGSKR

SEQ ID NO: 208383 - protein, 14 aa, Borrelia afzelii
AQETDGLTEGSKRA

SEQ ID NO: 208384 - protein, 14 aa, Borrelia afzelii
QETDGLTEGSKRAE

SEQ ID NO: 208385 - protein, 14 aa, Borrelia afzelii
ETDGLTEGSKRAEP

SEQ ID NO: 208386 - protein, 14 aa, Borrelia afzelii
TDGLTEGSKRAEPG

SEQ ID NO: 208387 - protein, 14 aa, Borrelia afzelii
DGLTEGSKRAEPGE

SEQ ID NO: 208388 - protein, 14 aa, Borrelia afzelii
GLTEGSKRAEPGEL

SEQ ID NO: 208389 - protein, 14 aa, Borrelia afzelii
LTEGSKRAEPGELV

SEQ ID NO: 208390 - protein, 14 aa, Borrelia afzelii
TEGSKRAEPGELVL

SEQ ID NO: 208391 - protein, 14 aa, Borrelia afzelii
EGSKRAEPGELVLD

SEQ ID NO: 208392 - protein, 14 aa, Borrelia afzelii
GSKRAEPGELVLDF

SEQ ID NO: 208393 - protein, 14 aa, Borrelia afzelii
SKRAEPGELVLDFA

SEQ ID NO: 208394 - protein, 14 aa, Borrelia afzelii
KRAEPGELVLDFAE

SEQ ID NO: 208395 - protein, 14 aa, Borrelia afzelii
RAEPGELVLDFAEL

SEQ ID NO: 208396 - protein, 14 aa, Borrelia afzelii
AEPGELVLDFAELA

SEQ ID NO: 208397 - protein, 14 aa, Borrelia afzelii
EPGELVLDFAELAR

SEQ ID NO: 208398 - protein, 14 aa, Borrelia afzelii
PGELVLDFAELARD

SEQ ID NO: 208399 - protein, 14 aa, Borrelia afzelii
GELVLDFAELARDP

SEQ ID NO: 208400 - protein, 14 aa, Borrelia afzelii
ELVLDFAELARDPS

SEQ ID NO: 208401 - protein, 14 aa, Borrelia afzelii
LVLDFAELARDPSS

SEQ ID NO: 208402 - protein, 14 aa, Borrelia afzelii
VLDFAELARDPSST

SEQ ID NO: 208403 - protein, 14 aa, Borrelia afzelii
LDFAELARDPSSTK

SEQ ID NO: 208404 - protein, 14 aa, Borrelia afzelii
DFAELARDPSSTKL

SEQ ID NO: 208405 - protein, 14 aa, Borrelia afzelii
FAELARDPSSTKLD

SEQ ID NO: 208406 - protein, 14 aa, Borrelia afzelii
AELARDPSSTKLDL

SEQ ID NO: 208407 - protein, 14 aa, Borrelia afzelii
ELARDPSSTKLDLT

SEQ ID NO: 208408 - protein, 14 aa, Borrelia afzelii
LARDPSSTKLDLTN

SEQ ID NO: 208409 - protein, 14 aa, Borrelia afzelii
ARDPSSTKLDLTNY

SEQ ID NO: 208410 - protein, 14 aa, Borrelia afzelii
RDPSSTKLDLTNYV

SEQ ID NO: 208411 - protein, 14 aa, Borrelia afzelii
DPSSTKLDLTNYVD

SEQ ID NO: 208412 - protein, 14 aa, Borrelia afzelii
PSSTKLDLTNYVDY

SEQ ID NO: 208413 - protein, 14 aa, Borrelia afzelii
SSTKLDLTNYVDYV

SEQ ID NO: 208414 - protein, 14 aa, Borrelia afzelii
STKLDLTNYVDYVY

SEQ ID NO: 208415 - protein, 14 aa, Borrelia afzelii
TKLDLTNYVDYVYS

SEQ ID NO: 208416 - protein, 14 aa, Borrelia afzelii
KLDLTNYVDYVYSG

SEQ ID NO: 208417 - protein, 14 aa, Borrelia afzelii
LDLTNYVDYVYSGA

SEQ ID NO: 208418 - protein, 14 aa, Borrelia afzelii
DLTNYVDYVYSGAS

SEQ ID NO: 208419 - protein, 14 aa, Borrelia afzelii
LTNYVDYVYSGASG

SEQ ID NO: 208420 - protein, 14 aa, Borrelia afzelii
TNYVDYVYSGASGI

SEQ ID NO: 208421 - protein, 14 aa, Borrelia afzelii
NYVDYVYSGASGIV

SEQ ID NO: 208422 - protein, 14 aa, Borrelia afzelii
YVDYVYSGASGIVK

SEQ ID NO: 208423 - protein, 14 aa, Borrelia afzelii
VDYVYSGASGIVKP

SEQ ID NO: 208424 - protein, 14 aa, Borrelia afzelii
DYVYSGASGIVKPE

SEQ ID NO: 208425 - protein, 14 aa, Borrelia afzelii
YVYSGASGIVKPED

SEQ ID NO: 208426 - protein, 14 aa, Borrelia afzelii
VYSGASGIVKPEDM

SEQ ID NO: 208427 - protein, 14 aa, Borrelia afzelii
YSGASGIVKPEDMV

SEQ ID NO: 208428 - protein, 14 aa, Borrelia afzelii
SGASGIVKPEDMVV

SEQ ID NO: 208429 - protein, 14 aa, Borrelia afzelii
GASGIVKPEDMVVD

SEQ ID NO: 208430 - protein, 14 aa, Borrelia afzelii
ASGIVKPEDMVVDL

SEQ ID NO: 208431 - protein, 14 aa, Borrelia afzelii
SGIVKPEDMVVDLG

SEQ ID NO: 208432 - protein, 14 aa, Borrelia afzelii
GIVKPEDMVVDLGI

SEQ ID NO: 208433 - protein, 14 aa, Borrelia afzelii
IVKPEDMVVDLGIS

SEQ ID NO: 208434 - protein, 14 aa, Borrelia afzelii
VKPEDMVVDLGISN

SEQ ID NO: 208435 - protein, 14 aa, Borrelia afzelii
KPEDMVVDLGISNW

SEQ ID NO: 208436 - protein, 14 aa, Borrelia afzelii
PEDMVVDLGISNWS

SEQ ID NO: 208437 - protein, 14 aa, Borrelia afzelii
EDMVVDLGISNWSV

SEQ ID NO: 208438 - protein, 14 aa, Borrelia afzelii
DMVVDLGISNWSVL

SEQ ID NO: 208439 - protein, 14 aa, Borrelia afzelii
MVVDLGISNWSVLL

SEQ ID NO: 208440 - protein, 14 aa, Borrelia afzelii
VVDLGISNWSVLLT

SEQ ID NO: 208441 - protein, 14 aa, Borrelia afzelii
VDLGISNWSVLLTP

SEQ ID NO: 208442 - protein, 14 aa, Borrelia afzelii
DLGISNWSVLLTPS

SEQ ID NO: 208443 - protein, 14 aa, Borrelia afzelii
LGISNWSVLLTPSA

SEQ ID NO: 208444 - protein, 14 aa, Borrelia afzelii
GISNWSVLLTPSAR

SEQ ID NO: 208445 - protein, 14 aa, Borrelia afzelii
ISNWSVLLTPSARL

SEQ ID NO: 208446 - protein, 14 aa, Borrelia afzelii
SNWSVLLTPSARLQ

SEQ ID NO: 208447 - protein, 14 aa, Borrelia afzelii
NWSVLLTPSARLQA

SEQ ID NO: 208448 - protein, 14 aa, Borrelia afzelii
WSVLLTPSARLQAY

SEQ ID NO: 208449 - protein, 14 aa, Borrelia afzelii
SVLLTPSARLQAYV

SEQ ID NO: 208450 - protein, 14 aa, Borrelia afzelii
VLLTPSARLQAYVK

SEQ ID NO: 208451 - protein, 14 aa, Borrelia afzelii
LLTPSARLQAYVKN

SEQ ID NO: 208452 - protein, 14 aa, Borrelia afzelii
LTPSARLQAYVKNS

SEQ ID NO: 208453 - protein, 14 aa, Borrelia afzelii
TPSARLQAYVKNSV

SEQ ID NO: 208454 - protein, 14 aa, Borrelia afzelii
PSARLQAYVKNSVV

SEQ ID NO: 208455 - protein, 14 aa, Borrelia afzelii
SARLQAYVKNSVVA

SEQ ID NO: 208456 - protein, 14 aa, Borrelia afzelii
ARLQAYVKNSVVAP

SEQ ID NO: 208457 - protein, 14 aa, Borrelia afzelii
RLQAYVKNSVVAPA

SEQ ID NO: 208458 - protein, 14 aa, Borrelia afzelii
LQAYVKNSVVAPAL

SEQ ID NO: 208459 - protein, 14 aa, Borrelia afzelii
QAYVKNSVVAPALV

SEQ ID NO: 208460 - protein, 14 aa, Borrelia afzelii
AYVKNSVVAPALVK

SEQ ID NO: 208461 - protein, 14 aa, Borrelia afzelii
YVKNSVVAPALVKS

SEQ ID NO: 208462 - protein, 14 aa, Borrelia afzelii
VKNSVVAPALVKSE

SEQ ID NO: 208463 - protein, 14 aa, Borrelia afzelii
KNSVVAPALVKSES

SEQ ID NO: 208464 - protein, 14 aa, Borrelia afzelii
NSVVAPALVKSESK

SEQ ID NO: 208465 - protein, 14 aa, Borrelia afzelii
SVVAPALVKSESKR

SEQ ID NO: 208466 - protein, 14 aa, Borrelia afzelii
VVAPALVKSESKRY

SEQ ID NO: 208467 - protein, 14 aa, Borrelia afzelii
VAPALVKSESKRYA

SEQ ID NO: 208468 - protein, 14 aa, Borrelia afzelii
APALVKSESKRYAG

SEQ ID NO: 208469 - protein, 14 aa, Borrelia afzelii
PALVKSESKRYAGD

SEQ ID NO: 208470 - protein, 14 aa, Borrelia afzelii
ALVKSESKRYAGDT

SEQ ID NO: 208471 - protein, 14 aa, Borrelia afzelii
LVKSESKRYAGDTI

SEQ ID NO: 208472 - protein, 14 aa, Borrelia afzelii
VKSESKRYAGDTIL

SEQ ID NO: 208473 - protein, 14 aa, Borrelia afzelii
KSESKRYAGDTILG

SEQ ID NO: 208474 - protein, 14 aa, Borrelia afzelii
SESKRYAGDTILGV

SEQ ID NO: 208475 - protein, 14 aa, Borrelia afzelii
ESKRYAGDTILGVR

SEQ ID NO: 208476 - protein, 14 aa, Borrelia afzelii
SKRYAGDTILGVRV

SEQ ID NO: 208477 - protein, 14 aa, Borrelia afzelii
KRYAGDTILGVRVL

SEQ ID NO: 208478 - protein, 14 aa, Borrelia afzelii
RYAGDTILGVRVLF

SEQ ID NO: 208479 - protein, 14 aa, Borrelia afzelii
YAGDTILGVRVLFP

SEQ ID NO: 208480 - protein, 14 aa, Borrelia afzelii
AGDTILGVRVLFPS

SEQ ID NO: 208481 - protein, 14 aa, Borrelia afzelii
GDTILGVRVLFPSY

SEQ ID NO: 208482 - protein, 14 aa, Borrelia afzelii
DTILGVRVLFPSYS

SEQ ID NO: 208483 - protein, 14 aa, Borrelia afzelii
TILGVRVLFPSYSQ

SEQ ID NO: 208484 - protein, 14 aa, Borrelia afzelii
ILGVRVLFPSYSQS

SEQ ID NO: 208485 - protein, 14 aa, Borrelia afzelii
LGVRVLFPSYSQSS

SEQ ID NO: 208486 - protein, 14 aa, Borrelia afzelii
GVRVLFPSYSQSSA

SEQ ID NO: 208487 - protein, 14 aa, Borrelia afzelii
VRVLFPSYSQSSAM

SEQ ID NO: 208488 - protein, 14 aa, Borrelia afzelii
RVLFPSYSQSSAMI

SEQ ID NO: 208489 - protein, 14 aa, Borrelia afzelii
VLFPSYSQSSAMIM

SEQ ID NO: 208490 - protein, 14 aa, Borrelia afzelii
LFPSYSQSSAMIMP

SEQ ID NO: 208491 - protein, 14 aa, Borrelia afzelii
FPSYSQSSAMIMPP

SEQ ID NO: 208492 - protein, 14 aa, Borrelia afzelii
PSYSQSSAMIMPPF

SEQ ID NO: 208493 - protein, 14 aa, Borrelia afzelii
SYSQSSAMIMPPFK

SEQ ID NO: 208494 - protein, 14 aa, Borrelia afzelii
YSQSSAMIMPPFKI

SEQ ID NO: 208495 - protein, 14 aa, Borrelia afzelii
SQSSAMIMPPFKIP

SEQ ID NO: 208496 - protein, 14 aa, Borrelia afzelii
QSSAMIMPPFKIPF

SEQ ID NO: 208497 - protein, 14 aa, Borrelia afzelii
SSAMIMPPFKIPFY

SEQ ID NO: 208498 - protein, 14 aa, Borrelia afzelii
SAMIMPPFKIPFYS

SEQ ID NO: 208499 - protein, 14 aa, Borrelia afzelii
AMIMPPFKIPFYSG

SEQ ID NO: 208500 - protein, 14 aa, Borrelia afzelii
MIMPPFKIPFYSGE

SEQ ID NO: 208501 - protein, 14 aa, Borrelia afzelii
IMPPFKIPFYSGES

SEQ ID NO: 208502 - protein, 14 aa, Borrelia afzelii
MPPFKIPFYSGESG

SEQ ID NO: 208503 - protein, 14 aa, Borrelia afzelii
PPFKIPFYSGESGN

SEQ ID NO: 208504 - protein, 14 aa, Borrelia afzelii
PFKIPFYSGESGNQ

SEQ ID NO: 208505 - protein, 14 aa, Borrelia afzelii
FKIPFYSGESGNQF

SEQ ID NO: 208506 - protein, 14 aa, Borrelia afzelii
KIPFYSGESGNQFL

SEQ ID NO: 208507 - protein, 14 aa, Borrelia afzelii
IPFYSGESGNQFLG

SEQ ID NO: 208508 - protein, 14 aa, Borrelia afzelii
PFYSGESGNQFLGK

SEQ ID NO: 208509 - protein, 14 aa, Borrelia afzelii
FYSGESGNQFLGKG

SEQ ID NO: 208510 - protein, 14 aa, Borrelia afzelii
YSGESGNQFLGKGL

SEQ ID NO: 208511 - protein, 14 aa, Borrelia afzelii
SGESGNQFLGKGLI

SEQ ID NO: 208512 - protein, 14 aa, Borrelia afzelii
GESGNQFLGKGLID

SEQ ID NO: 208513 - protein, 14 aa, Borrelia afzelii
ESGNQFLGKGLIDN

SEQ ID NO: 208514 - protein, 14 aa, Borrelia afzelii
SGNQFLGKGLIDNI

SEQ ID NO: 208515 - protein, 14 aa, Borrelia afzelii
GNQFLGKGLIDNIK

SEQ ID NO: 208516 - protein, 14 aa, Borrelia afzelii
NQFLGKGLIDNIKT

SEQ ID NO: 208517 - protein, 14 aa, Borrelia afzelii
QFLGKGLIDNIKTM

SEQ ID NO: 208518 - protein, 14 aa, Borrelia afzelii
FLGKGLIDNIKTMK

SEQ ID NO: 208519 - protein, 14 aa, Borrelia afzelii
LGKGLIDNIKTMKE

SEQ ID NO: 208520 - protein, 14 aa, Borrelia afzelii
GKGLIDNIKTMKEI

SEQ ID NO: 208521 - protein, 14 aa, Borrelia afzelii
KGLIDNIKTMKEIK

SEQ ID NO: 208522 - protein, 14 aa, Borrelia afzelii
GLIDNIKTMKEIKV

SEQ ID NO: 208523 - protein, 14 aa, Borrelia afzelii
LIDNIKTMKEIKVS

SEQ ID NO: 208524 - protein, 14 aa, Borrelia afzelii
IDNIKTMKEIKVSV

SEQ ID NO: 208525 - protein, 14 aa, Borrelia afzelii
DNIKTMKEIKVSVY

SEQ ID NO: 208526 - protein, 14 aa, Borrelia afzelii
NIKTMKEIKVSVYS

SEQ ID NO: 208527 - protein, 14 aa, Borrelia afzelii
IKTMKEIKVSVYSL

SEQ ID NO: 208528 - protein, 14 aa, Borrelia afzelii
KTMKEIKVSVYSLG

SEQ ID NO: 208529 - protein, 14 aa, Borrelia afzelii
TMKEIKVSVYSLGY

SEQ ID NO: 208530 - protein, 14 aa, Borrelia afzelii
MKEIKVSVYSLGYE

SEQ ID NO: 208531 - protein, 14 aa, Borrelia afzelii
KEIKVSVYSLGYEV

SEQ ID NO: 208532 - protein, 14 aa, Borrelia afzelii
EIKVSVYSLGYEVD

SEQ ID NO: 208533 - protein, 14 aa, Borrelia afzelii
IKVSVYSLGYEVDL

SEQ ID NO: 208534 - protein, 14 aa, Borrelia afzelii
KVSVYSLGYEVDLE

SEQ ID NO: 208535 - protein, 14 aa, Borrelia afzelii
VSVYSLGYEVDLEV

SEQ ID NO: 208536 - protein, 14 aa, Borrelia afzelii
SVYSLGYEVDLEVL

SEQ ID NO: 208537 - protein, 14 aa, Borrelia afzelii
VYSLGYEVDLEVLF

SEQ ID NO: 208538 - protein, 14 aa, Borrelia afzelii
YSLGYEVDLEVLFE

SEQ ID NO: 208539 - protein, 14 aa, Borrelia afzelii
SLGYEVDLEVLFED

SEQ ID NO: 208540 - protein, 14 aa, Borrelia afzelii
LGYEVDLEVLFEDM

SEQ ID NO: 208541 - protein, 14 aa, Borrelia afzelii
GYEVDLEVLFEDMN

SEQ ID NO: 208542 - protein, 14 aa, Borrelia afzelii
YEVDLEVLFEDMNG

SEQ ID NO: 208543 - protein, 14 aa, Borrelia afzelii
EVDLEVLFEDMNGM

SEQ ID NO: 208544 - protein, 14 aa, Borrelia afzelii
VDLEVLFEDMNGME

SEQ ID NO: 208545 - protein, 14 aa, Borrelia afzelii
DLEVLFEDMNGMEY

SEQ ID NO: 208546 - protein, 14 aa, Borrelia afzelii
LEVLFEDMNGMEYA

SEQ ID NO: 208547 - protein, 14 aa, Borrelia afzelii
EVLFEDMNGMEYAY

SEQ ID NO: 208548 - protein, 14 aa, Borrelia afzelii
VLFEDMNGMEYAYS

SEQ ID NO: 208549 - protein, 14 aa, Borrelia afzelii
LFEDMNGMEYAYSL

SEQ ID NO: 208550 - protein, 14 aa, Borrelia afzelii
FEDMNGMEYAYSLG

SEQ ID NO: 208551 - protein, 14 aa, Borrelia afzelii
EDMNGMEYAYSLGT

SEQ ID NO: 208552 - protein, 14 aa, Borrelia afzelii
DMNGMEYAYSLGTL

SEQ ID NO: 208553 - protein, 14 aa, Borrelia afzelii
MNGMEYAYSLGTLK

SEQ ID NO: 208554 - protein, 14 aa, Borrelia afzelii
NGMEYAYSLGTLKF

SEQ ID NO: 208555 - protein, 14 aa, Borrelia afzelii
GMEYAYSLGTLKFK

SEQ ID NO: 208556 - protein, 14 aa, Borrelia afzelii
MEYAYSLGTLKFKG

SEQ ID NO: 208557 - protein, 14 aa, Borrelia afzelii
EYAYSLGTLKFKGW

SEQ ID NO: 208558 - protein, 14 aa, Borrelia afzelii
YAYSLGTLKFKGWA

SEQ ID NO: 208559 - protein, 14 aa, Borrelia afzelii
AYSLGTLKFKGWAD

SEQ ID NO: 208560 - protein, 14 aa, Borrelia afzelii
YSLGTLKFKGWADL

SEQ ID NO: 208561 - protein, 14 aa, Borrelia afzelii
SLGTLKFKGWADLI

SEQ ID NO: 208562 - protein, 14 aa, Borrelia afzelii
LGTLKFKGWADLIW

SEQ ID NO: 208563 - protein, 14 aa, Borrelia afzelii
GTLKFKGWADLIWS

SEQ ID NO: 208564 - protein, 14 aa, Borrelia afzelii
TLKFKGWADLIWSN

SEQ ID NO: 208565 - protein, 14 aa, Borrelia afzelii
LKFKGWADLIWSNP

SEQ ID NO: 208566 - protein, 14 aa, Borrelia afzelii
KFKGWADLIWSNPN

SEQ ID NO: 208567 - protein, 14 aa, Borrelia afzelii
FKGWADLIWSNPNY

SEQ ID NO: 208568 - protein, 14 aa, Borrelia afzelii
KGWADLIWSNPNYI

SEQ ID NO: 208569 - protein, 14 aa, Borrelia afzelii
GWADLIWSNPNYIP

SEQ ID NO: 208570 - protein, 14 aa, Borrelia afzelii
WADLIWSNPNYIPN

SEQ ID NO: 208571 - protein, 14 aa, Borrelia afzelii
ADLIWSNPNYIPNI

SEQ ID NO: 208572 - protein, 14 aa, Borrelia afzelii
DLIWSNPNYIPNIS

SEQ ID NO: 208573 - protein, 14 aa, Borrelia afzelii
LIWSNPNYIPNISA

SEQ ID NO: 208574 - protein, 14 aa, Borrelia afzelii
IWSNPNYIPNISAR

SEQ ID NO: 208575 - protein, 14 aa, Borrelia afzelii
WSNPNYIPNISARI

SEQ ID NO: 208576 - protein, 14 aa, Borrelia afzelii
SNPNYIPNISARII

SEQ ID NO: 208577 - protein, 14 aa, Borrelia afzelii
NPNYIPNISARIIK

SEQ ID NO: 208578 - protein, 14 aa, Borrelia afzelii
PNYIPNISARIIKD

SEQ ID NO: 208579 - protein, 14 aa, Borrelia afzelii
NYIPNISARIIKDD

SEQ ID NO: 208580 - protein, 14 aa, Borrelia afzelii
YIPNISARIIKDDV

SEQ ID NO: 208581 - protein, 14 aa, Borrelia afzelii
IPNISARIIKDDVP

SEQ ID NO: 208582 - protein, 14 aa, Borrelia afzelii
PNISARIIKDDVPN

SEQ ID NO: 208583 - protein, 14 aa, Borrelia afzelii
NISARIIKDDVPNY

SEQ ID NO: 208584 - protein, 14 aa, Borrelia afzelii
ISARIIKDDVPNYP

SEQ ID NO: 208585 - protein, 14 aa, Borrelia afzelii
SARIIKDDVPNYPL

SEQ ID NO: 208586 - protein, 14 aa, Borrelia afzelii
ARIIKDDVPNYPLA

SEQ ID NO: 208587 - protein, 14 aa, Borrelia afzelii
RIIKDDVPNYPLAS

SEQ ID NO: 208588 - protein, 14 aa, Borrelia afzelii
IIKDDVPNYPLASS

SEQ ID NO: 208589 - protein, 14 aa, Borrelia afzelii
IKDDVPNYPLASSK

SEQ ID NO: 208590 - protein, 14 aa, Borrelia afzelii
KDDVPNYPLASSKM

SEQ ID NO: 208591 - protein, 14 aa, Borrelia afzelii
DDVPNYPLASSKMR

SEQ ID NO: 208592 - protein, 14 aa, Borrelia afzelii
DVPNYPLASSKMRF

SEQ ID NO: 208593 - protein, 14 aa, Borrelia afzelii
VPNYPLASSKMRFK

SEQ ID NO: 208594 - protein, 14 aa, Borrelia afzelii
PNYPLASSKMRFKA

SEQ ID NO: 208595 - protein, 14 aa, Borrelia afzelii
NYPLASSKMRFKAF

SEQ ID NO: 208596 - protein, 14 aa, Borrelia afzelii
YPLASSKMRFKAFR

SEQ ID NO: 208597 - protein, 14 aa, Borrelia afzelii
PLASSKMRFKAFRV

SEQ ID NO: 208598 - protein, 14 aa, Borrelia afzelii
LASSKMRFKAFRVS

SEQ ID NO: 208599 - protein, 14 aa, Borrelia afzelii
ASSKMRFKAFRVSK

SEQ ID NO: 208600 - protein, 14 aa, Borrelia afzelii
SSKMRFKAFRVSKS

SEQ ID NO: 208601 - protein, 14 aa, Borrelia afzelii
SKMRFKAFRVSKSH

SEQ ID NO: 208602 - protein, 14 aa, Borrelia afzelii
KMRFKAFRVSKSHS

SEQ ID NO: 208603 - protein, 14 aa, Borrelia afzelii
MRFKAFRVSKSHSS

SEQ ID NO: 208604 - protein, 14 aa, Borrelia afzelii
RFKAFRVSKSHSSK

SEQ ID NO: 208605 - protein, 14 aa, Borrelia afzelii
FKAFRVSKSHSSKE

SEQ ID NO: 208606 - protein, 14 aa, Borrelia afzelii
KAFRVSKSHSSKEQ

SEQ ID NO: 208607 - protein, 14 aa, Borrelia afzelii
AFRVSKSHSSKEQN

SEQ ID NO: 208608 - protein, 14 aa, Borrelia afzelii
FRVSKSHSSKEQNF

SEQ ID NO: 208609 - protein, 14 aa, Borrelia afzelii
RVSKSHSSKEQNFI

SEQ ID NO: 208610 - protein, 14 aa, Borrelia afzelii
VSKSHSSKEQNFIF

SEQ ID NO: 208611 - protein, 14 aa, Borrelia afzelii
SKSHSSKEQNFIFY

SEQ ID NO: 208612 - protein, 14 aa, Borrelia afzelii
KSHSSKEQNFIFYV

SEQ ID NO: 208613 - protein, 14 aa, Borrelia afzelii
SHSSKEQNFIFYVK

SEQ ID NO: 208614 - protein, 14 aa, Borrelia afzelii
HSSKEQNFIFYVKD

SEQ ID NO: 208615 - protein, 14 aa, Borrelia afzelii
SSKEQNFIFYVKDL

SEQ ID NO: 208616 - protein, 14 aa, Borrelia afzelii
SKEQNFIFYVKDLR

SEQ ID NO: 208617 - protein, 14 aa, Borrelia afzelii
KEQNFIFYVKDLRV

SEQ ID NO: 208618 - protein, 14 aa, Borrelia afzelii
EQNFIFYVKDLRVL

SEQ ID NO: 208619 - protein, 14 aa, Borrelia afzelii
QNFIFYVKDLRVLY

SEQ ID NO: 208620 - protein, 14 aa, Borrelia afzelii
NFIFYVKDLRVLYD

SEQ ID NO: 208621 - protein, 14 aa, Borrelia afzelii
FIFYVKDLRVLYDK

SEQ ID NO: 208622 - protein, 14 aa, Borrelia afzelii
IFYVKDLRVLYDKL

SEQ ID NO: 208623 - protein, 14 aa, Borrelia afzelii
FYVKDLRVLYDKLS

SEQ ID NO: 208624 - protein, 14 aa, Borrelia afzelii
YVKDLRVLYDKLSV

SEQ ID NO: 208625 - protein, 14 aa, Borrelia afzelii
VKDLRVLYDKLSVS

SEQ ID NO: 208626 - protein, 14 aa, Borrelia afzelii
KDLRVLYDKLSVSI

SEQ ID NO: 208627 - protein, 14 aa, Borrelia afzelii
DLRVLYDKLSVSID

SEQ ID NO: 208628 - protein, 14 aa, Borrelia afzelii
LRVLYDKLSVSIDS

SEQ ID NO: 208629 - protein, 14 aa, Borrelia afzelii
RVLYDKLSVSIDSD

SEQ ID NO: 208630 - protein, 14 aa, Borrelia afzelii
VLYDKLSVSIDSDI

SEQ ID NO: 208631 - protein, 14 aa, Borrelia afzelii
LYDKLSVSIDSDID

SEQ ID NO: 208632 - protein, 14 aa, Borrelia afzelii
YDKLSVSIDSDIDS

SEQ ID NO: 208633 - protein, 14 aa, Borrelia afzelii
DKLSVSIDSDIDSE

SEQ ID NO: 208634 - protein, 14 aa, Borrelia afzelii
KLSVSIDSDIDSES

SEQ ID NO: 208635 - protein, 14 aa, Borrelia afzelii
LSVSIDSDIDSESV

SEQ ID NO: 208636 - protein, 14 aa, Borrelia afzelii
SVSIDSDIDSESVF

SEQ ID NO: 208637 - protein, 14 aa, Borrelia afzelii
VSIDSDIDSESVFK

SEQ ID NO: 208638 - protein, 14 aa, Borrelia afzelii
SIDSDIDSESVFKV

SEQ ID NO: 208639 - protein, 14 aa, Borrelia afzelii
IDSDIDSESVFKVY

SEQ ID NO: 208640 - protein, 14 aa, Borrelia afzelii
DSDIDSESVFKVYE

SEQ ID NO: 208641 - protein, 14 aa, Borrelia afzelii
SDIDSESVFKVYET

SEQ ID NO: 208642 - protein, 14 aa, Borrelia afzelii
DIDSESVFKVYETS

SEQ ID NO: 208643 - protein, 14 aa, Borrelia afzelii
IDSESVFKVYETSG

SEQ ID NO: 208644 - protein, 14 aa, Borrelia afzelii
DSESVFKVYETSGA

SEQ ID NO: 208645 - protein, 14 aa, Borrelia afzelii
SESVFKVYETSGAE

SEQ ID NO: 208646 - protein, 14 aa, Borrelia afzelii
ESVFKVYETSGAES

SEQ ID NO: 208647 - protein, 14 aa, Borrelia afzelii
SVFKVYETSGAESL

SEQ ID NO: 208648 - protein, 14 aa, Borrelia afzelii
VFKVYETSGAESLR

SEQ ID NO: 208649 - protein, 14 aa, Borrelia afzelii
FKVYETSGAESLRK

SEQ ID NO: 208650 - protein, 14 aa, Borrelia afzelii
KVYETSGAESLRKL

SEQ ID NO: 208651 - protein, 14 aa, Borrelia afzelii
VYETSGAESLRKLK

SEQ ID NO: 208652 - protein, 14 aa, Borrelia afzelii
YETSGAESLRKLKA

SEQ ID NO: 208653 - protein, 14 aa, Borrelia afzelii
ETSGAESLRKLKAH

SEQ ID NO: 208654 - protein, 14 aa, Borrelia afzelii
TSGAESLRKLKAHE

SEQ ID NO: 208655 - protein, 14 aa, Borrelia afzelii
SGAESLRKLKAHET

SEQ ID NO: 208656 - protein, 14 aa, Borrelia afzelii
GAESLRKLKAHETF

SEQ ID NO: 208657 - protein, 14 aa, Borrelia afzelii
AESLRKLKAHETFK

SEQ ID NO: 208658 - protein, 14 aa, Borrelia afzelii
ESLRKLKAHETFKR

SEQ ID NO: 208659 - protein, 14 aa, Borrelia afzelii
SLRKLKAHETFKRV

SEQ ID NO: 208660 - protein, 14 aa, Borrelia afzelii
LRKLKAHETFKRVL

SEQ ID NO: 208661 - protein, 14 aa, Borrelia afzelii
RKLKAHETFKRVLK

SEQ ID NO: 208662 - protein, 14 aa, Borrelia afzelii
KLKAHETFKRVLKL

SEQ ID NO: 208663 - protein, 14 aa, Borrelia afzelii
LKAHETFKRVLKLR

SEQ ID NO: 208664 - protein, 14 aa, Borrelia afzelii
KAHETFKRVLKLRE

SEQ ID NO: 208665 - protein, 14 aa, Borrelia afzelii
AHETFKRVLKLREK

SEQ ID NO: 208666 - protein, 14 aa, Borrelia afzelii
HETFKRVLKLREKI

SEQ ID NO: 208667 - protein, 14 aa, Borrelia afzelii
ETFKRVLKLREKIS

SEQ ID NO: 208668 - protein, 14 aa, Borrelia afzelii
TFKRVLKLREKISM

SEQ ID NO: 208669 - protein, 14 aa, Borrelia afzelii
FKRVLKLREKISMP

SEQ ID NO: 208670 - protein, 14 aa, Borrelia afzelii
KRVLKLREKISMPE

SEQ ID NO: 208671 - protein, 14 aa, Borrelia afzelii
RVLKLREKISMPEG

SEQ ID NO: 208672 - protein, 14 aa, Borrelia afzelii
VLKLREKISMPEGS

SEQ ID NO: 208673 - protein, 14 aa, Borrelia afzelii
LKLREKISMPEGSF

SEQ ID NO: 208674 - protein, 14 aa, Borrelia afzelii
KLREKISMPEGSFQ

SEQ ID NO: 208675 - protein, 14 aa, Borrelia afzelii
LREKISMPEGSFQN

SEQ ID NO: 208676 - protein, 14 aa, Borrelia afzelii
REKISMPEGSFQNF

SEQ ID NO: 208677 - protein, 14 aa, Borrelia afzelii
EKISMPEGSFQNFI

SEQ ID NO: 208678 - protein, 14 aa, Borrelia afzelii
KISMPEGSFQNFIE

SEQ ID NO: 208679 - protein, 14 aa, Borrelia afzelii
ISMPEGSFQNFIEK

SEQ ID NO: 208680 - protein, 14 aa, Borrelia afzelii
SMPEGSFQNFIEKV

SEQ ID NO: 208681 - protein, 14 aa, Borrelia afzelii
MPEGSFQNFIEKVE

SEQ ID NO: 208682 - protein, 14 aa, Borrelia afzelii
PEGSFQNFIEKVES

SEQ ID NO: 208683 - protein, 14 aa, Borrelia afzelii
EGSFQNFIEKVESD

SEQ ID NO: 208684 - protein, 14 aa, Borrelia afzelii
GSFQNFIEKVESDK

SEQ ID NO: 208685 - protein, 14 aa, Borrelia afzelii
SFQNFIEKVESDKP

SEQ ID NO: 208686 - protein, 14 aa, Borrelia afzelii
FQNFIEKVESDKPE

SEQ ID NO: 208687 - protein, 14 aa, Borrelia afzelii
QNFIEKVESDKPEE

SEQ ID NO: 208688 - protein, 14 aa, Borrelia afzelii
NFIEKVESDKPEES

SEQ ID NO: 208689 - protein, 14 aa, Borrelia afzelii
FIEKVESDKPEESS

SEQ ID NO: 208690 - protein, 14 aa, Borrelia afzelii
IEKVESDKPEESSS

SEQ ID NO: 208691 - protein, 14 aa, Borrelia afzelii
EKVESDKPEESSSE

SEQ ID NO: 208692 - protein, 14 aa, Borrelia afzelii
KVESDKPEESSSEN

SEQ ID NO: 208693 - protein, 15 aa, Borrelia afzelii
MKRKAKSILFFLLST

SEQ ID NO: 208694 - protein, 15 aa, Borrelia afzelii
KRKAKSILFFLLSTA

SEQ ID NO: 208695 - protein, 15 aa, Borrelia afzelii
RKAKSILFFLLSTAL

SEQ ID NO: 208696 - protein, 15 aa, Borrelia afzelii
KAKSILFFLLSTALF

SEQ ID NO: 208697 - protein, 15 aa, Borrelia afzelii
AKSILFFLLSTALFA

SEQ ID NO: 208698 - protein, 15 aa, Borrelia afzelii
KSILFFLLSTALFAQ

SEQ ID NO: 208699 - protein, 15 aa, Borrelia afzelii
SILFFLLSTALFAQE

SEQ ID NO: 208700 - protein, 15 aa, Borrelia afzelii
ILFFLLSTALFAQET

SEQ ID NO: 208701 - protein, 15 aa, Borrelia afzelii
LFFLLSTALFAQETD

SEQ ID NO: 208702 - protein, 15 aa, Borrelia afzelii
FFLLSTALFAQETDG

SEQ ID NO: 208703 - protein, 15 aa, Borrelia afzelii
FLLSTALFAQETDGL

SEQ ID NO: 208704 - protein, 15 aa, Borrelia afzelii
LLSTALFAQETDGLT

SEQ ID NO: 208705 - protein, 15 aa, Borrelia afzelii
LSTALFAQETDGLTE

SEQ ID NO: 208706 - protein, 15 aa, Borrelia afzelii
STALFAQETDGLTEG

SEQ ID NO: 208707 - protein, 15 aa, Borrelia afzelii
TALFAQETDGLTEGS

SEQ ID NO: 208708 - protein, 15 aa, Borrelia afzelii
ALFAQETDGLTEGSK

SEQ ID NO: 208709 - protein, 15 aa, Borrelia afzelii
LFAQETDGLTEGSKR

SEQ ID NO: 208710 - protein, 15 aa, Borrelia afzelii
FAQETDGLTEGSKRA

SEQ ID NO: 208711 - protein, 15 aa, Borrelia afzelii
AQETDGLTEGSKRAE

SEQ ID NO: 208712 - protein, 15 aa, Borrelia afzelii
QETDGLTEGSKRAEP

SEQ ID NO: 208713 - protein, 15 aa, Borrelia afzelii
ETDGLTEGSKRAEPG

SEQ ID NO: 208714 - protein, 15 aa, Borrelia afzelii
TDGLTEGSKRAEPGE

SEQ ID NO: 208715 - protein, 15 aa, Borrelia afzelii
DGLTEGSKRAEPGEL

SEQ ID NO: 208716 - protein, 15 aa, Borrelia afzelii
GLTEGSKRAEPGELV

SEQ ID NO: 208717 - protein, 15 aa, Borrelia afzelii
LTEGSKRAEPGELVL

SEQ ID NO: 208718 - protein, 15 aa, Borrelia afzelii
TEGSKRAEPGELVLD

SEQ ID NO: 208719 - protein, 15 aa, Borrelia afzelii
EGSKRAEPGELVLDF

SEQ ID NO: 208720 - protein, 15 aa, Borrelia afzelii
GSKRAEPGELVLDFA

SEQ ID NO: 208721 - protein, 15 aa, Borrelia afzelii
SKRAEPGELVLDFAE

SEQ ID NO: 208722 - protein, 15 aa, Borrelia afzelii
KRAEPGELVLDFAEL

SEQ ID NO: 208723 - protein, 15 aa, Borrelia afzelii
RAEPGELVLDFAELA

SEQ ID NO: 208724 - protein, 15 aa, Borrelia afzelii
AEPGELVLDFAELAR

SEQ ID NO: 208725 - protein, 15 aa, Borrelia afzelii
EPGELVLDFAELARD

SEQ ID NO: 208726 - protein, 15 aa, Borrelia afzelii
PGELVLDFAELARDP
